United States Patent 7,691,997 (FUNCTIONAL AND HYPERFUNCTIONAL SIRNA) - sequence listing, part 26

SEQ ID NO: 1048255 - RNA, 19 nt, Homo sapiens
gguaaaggcucaggcuguu

SEQ ID NO: 1048256 - RNA, 19 nt, Homo sapiens
gaggagaugcugcccaauu

SEQ ID NO: 1048257 - RNA, 19 nt, Homo sapiens
gcagucaaguuucgagaca

SEQ ID NO: 1048258 - RNA, 19 nt, Homo sapiens
aaagggagauguacaaggu

SEQ ID NO: 1048259 - RNA, 19 nt, Homo sapiens
gaccaacuauuucuacgau

SEQ ID NO: 1048260 - RNA, 19 nt, Homo sapiens
ccucagaaguugcguagga

SEQ ID NO: 1048261 - RNA, 19 nt, Homo sapiens
ggauaagcuuugucaguag

SEQ ID NO: 1048262 - RNA, 19 nt, Homo sapiens
gggaggcgcagucaaguuu

SEQ ID NO: 1048263 - RNA, 19 nt, Homo sapiens
ggaucaggccagauaagua

SEQ ID NO: 1048264 - RNA, 19 nt, Homo sapiens
guacaaggugcaugagaaa

SEQ ID NO: 1048265 - RNA, 19 nt, Homo sapiens
gaguggugcuggccaauca

SEQ ID NO: 1048266 - RNA, 19 nt, Homo sapiens
gaguggaucaggccagaua

SEQ ID NO: 1048267 - RNA, 19 nt, Homo sapiens
ccaacuauuucuacgaugu

SEQ ID NO: 1048268 - RNA, 19 nt, Homo sapiens
cccauaguauugcugguua

SEQ ID NO: 1048269 - RNA, 19 nt, Homo sapiens
uggaggcucugagggauua

SEQ ID NO: 1048270 - RNA, 19 nt, Homo sapiens
ccaaacaggcauuauagga

SEQ ID NO: 1048271 - RNA, 19 nt, Homo sapiens
ucucaggaguucuggaauu

SEQ ID NO: 1048272 - RNA, 19 nt, Homo sapiens
cagugaagcccucauuauu

SEQ ID NO: 1048273 - RNA, 19 nt, Homo sapiens
gggcuacuacugacacuuu

SEQ ID NO: 1048274 - RNA, 19 nt, Homo sapiens
aaacuguccuuaugugagu

SEQ ID NO: 1048275 - RNA, 19 nt, Homo sapiens
ccagauaaguauggccauu

SEQ ID NO: 1048276 - RNA, 19 nt, Homo sapiens
ggacaauacuccaguuccu

SEQ ID NO: 1048277 - RNA, 19 nt, Homo sapiens
ccacuccacucacuaaagg

SEQ ID NO: 1048278 - RNA, 19 nt, Homo sapiens
uguacaaggugcaugagaa

SEQ ID NO: 1048279 - RNA, 19 nt, Homo sapiens
gggauuacuugcuccaaag

SEQ ID NO: 1048280 - RNA, 19 nt, Homo sapiens
uaaagccaguaauucucua

SEQ ID NO: 1048281 - RNA, 19 nt, Homo sapiens
aggagaugcugcccaauug

SEQ ID NO: 1048282 - RNA, 19 nt, Homo sapiens
gguuauggauuuauugacu

SEQ ID NO: 1048283 - RNA, 19 nt, Homo sapiens
ggcuacuacugacacuuua

SEQ ID NO: 1048284 - RNA, 19 nt, Homo sapiens
gagccacacucaccuuguc

SEQ ID NO: 1048285 - RNA, 19 nt, Homo sapiens
guucuggaauuucugugaa

SEQ ID NO: 1048286 - RNA, 19 nt, Homo sapiens
ccagugaagcccucauuau

SEQ ID NO: 1048287 - RNA, 19 nt, Homo sapiens
gauuuccagucaauucaga

SEQ ID NO: 1048288 - RNA, 19 nt, Homo sapiens
guaaaggcucaggcuguua

SEQ ID NO: 1048289 - RNA, 19 nt, Homo sapiens
uauuaaacuuucccuguuc

SEQ ID NO: 1048290 - RNA, 19 nt, Homo sapiens
ugagugcacugccauuucu

SEQ ID NO: 1048291 - RNA, 19 nt, Homo sapiens
aaaggacaauacuccaguu

SEQ ID NO: 1048292 - RNA, 19 nt, Homo sapiens
acaccuggcuggagaagca

SEQ ID NO: 1048293 - RNA, 19 nt, Homo sapiens
ugaguucccaguauuuauu

SEQ ID NO: 1048294 - RNA, 19 nt, Homo sapiens
ugaagugccugucgaagcu

SEQ ID NO: 1048295 - RNA, 19 nt, Homo sapiens
agauaaguauggccauuuc

SEQ ID NO: 1048296 - RNA, 19 nt, Homo sapiens
gcaccucucugggaauaac

SEQ ID NO: 1048297 - RNA, 19 nt, Homo sapiens
uaguauugcugguuaugga

SEQ ID NO: 1048298 - RNA, 19 nt, Homo sapiens
guggacgacuggugucuca

SEQ ID NO: 1048299 - RNA, 19 nt, Homo sapiens
gugaagcccucauuauucc

SEQ ID NO: 1048300 - RNA, 19 nt, Homo sapiens
ccauuugucuucacucaac

SEQ ID NO: 1048301 - RNA, 19 nt, Homo sapiens
caggaguucuggaauuucu

SEQ ID NO: 1048302 - RNA, 19 nt, Homo sapiens
cucaggaguucuggaauuu

SEQ ID NO: 1048303 - RNA, 19 nt, Homo sapiens
ccauuucucucaggaguuc

SEQ ID NO: 1048304 - RNA, 19 nt, Homo sapiens
aggcaccucucugggaaua

SEQ ID NO: 1048305 - RNA, 19 nt, Homo sapiens
caccaaacaggcauuauag

SEQ ID NO: 1048306 - RNA, 19 nt, Homo sapiens
cagauaaguauggccauuu

SEQ ID NO: 1048307 - RNA, 19 nt, Homo sapiens
caggagagagcgugaguuc

SEQ ID NO: 1048308 - RNA, 19 nt, Homo sapiens
uggccucacucagauauug

SEQ ID NO: 1048309 - RNA, 19 nt, Homo sapiens
gggcaccaaacaggcauua

SEQ ID NO: 1048310 - RNA, 19 nt, Homo sapiens
uauugcugguuauggauuu

SEQ ID NO: 1048311 - RNA, 19 nt, Homo sapiens
ucaaacuguccuuauguga

SEQ ID NO: 1048312 - RNA, 19 nt, Homo sapiens
uaaaggcucaggcuguuag

SEQ ID NO: 1048313 - RNA, 19 nt, Homo sapiens
cgugaguucccaguauuua

SEQ ID NO: 1048314 - RNA, 19 nt, Homo sapiens
caacuacgagggccuggau

SEQ ID NO: 1048315 - RNA, 19 nt, Homo sapiens
agccaguaauucucuauau

SEQ ID NO: 1048316 - RNA, 19 nt, Homo sapiens
agggauuacuugcuccaaa

SEQ ID NO: 1048317 - RNA, 19 nt, Homo sapiens
ccgcagagagccacacuca

SEQ ID NO: 1048318 - RNA, 19 nt, Homo sapiens
ccauaguauugcugguuau

SEQ ID NO: 1048319 - RNA, 19 nt, Homo sapiens
cugcauggaaugucuggua

SEQ ID NO: 1048320 - RNA, 19 nt, Homo sapiens
agugaagcccucauuauuc

SEQ ID NO: 1048321 - RNA, 19 nt, Homo sapiens
agucaauucagaagcauuu

SEQ ID NO: 1048322 - RNA, 19 nt, Homo sapiens
gcgugaguucccaguauuu

SEQ ID NO: 1048323 - RNA, 19 nt, Homo sapiens
ggaguucuggaauuucugu

SEQ ID NO: 1048324 - RNA, 19 nt, Homo sapiens
auacggcgcaggugccuuu

SEQ ID NO: 1048325 - RNA, 19 nt, Homo sapiens
gccggugacugugacauca

SEQ ID NO: 1048326 - RNA, 19 nt, Homo sapiens
acugugacaucaacuacga

SEQ ID NO: 1048327 - RNA, 19 nt, Homo sapiens
gaagaagaaaaggacaaua

SEQ ID NO: 1048328 - RNA, 19 nt, Homo sapiens
cuccagcccucagaaguug

SEQ ID NO: 1048329 - RNA, 19 nt, Homo sapiens
caguagagggcaccaaaca

SEQ ID NO: 1048330 - RNA, 19 nt, Homo sapiens
caacuauuucuacgaugug

SEQ ID NO: 1048331 - RNA, 19 nt, Homo sapiens
agauauugguggaggagau

SEQ ID NO: 1048332 - RNA, 19 nt, Homo sapiens
guccaacccuggccucacu

SEQ ID NO: 1048333 - RNA, 19 nt, Homo sapiens
gucaguagagggcaccaaa

SEQ ID NO: 1048334 - RNA, 19 nt, Homo sapiens
ucucaaacuguccuuaugu

SEQ ID NO: 1048335 - RNA, 19 nt, Homo sapiens
gacacagcgccuccacuga

SEQ ID NO: 1048336 - RNA, 19 nt, Homo sapiens
uaaguauggccauuucucu

SEQ ID NO: 1048337 - RNA, 19 nt, Homo sapiens
guauugcugguuauggauu

SEQ ID NO: 1048338 - RNA, 19 nt, Homo sapiens
cucaaacuguccuuaugug

SEQ ID NO: 1048339 - RNA, 19 nt, Homo sapiens
ccuccagcccucagaaguu

SEQ ID NO: 1048340 - RNA, 19 nt, Homo sapiens
gugaguucccaguauuuau

SEQ ID NO: 1048341 - RNA, 19 nt, Homo sapiens
gauauugguggaggagaug

SEQ ID NO: 1048342 - RNA, 19 nt, Homo sapiens
gcaguaaacuugucugaaa

SEQ ID NO: 1048343 - RNA, 19 nt, Homo sapiens
guaaagaaaugccucgaaa

SEQ ID NO: 1048344 - RNA, 19 nt, Homo sapiens
caaguugugugcuauauuu

SEQ ID NO: 1048345 - RNA, 19 nt, Homo sapiens
ggaagaagaaccaguuaua

SEQ ID NO: 1048346 - RNA, 19 nt, Homo sapiens
agaggaagcucguuuaauu

SEQ ID NO: 1048347 - RNA, 19 nt, Homo sapiens
gagaggcgcugcuuccuuu

SEQ ID NO: 1048348 - RNA, 19 nt, Homo sapiens
caaggcaccucgucaguaa

SEQ ID NO: 1048349 - RNA, 19 nt, Homo sapiens
gaagaagaaccaguuauaa

SEQ ID NO: 1048350 - RNA, 19 nt, Homo sapiens
gauauggugucuccuggua

SEQ ID NO: 1048351 - RNA, 19 nt, Homo sapiens
ugaagcagaucaacaaaug

SEQ ID NO: 1048352 - RNA, 19 nt, Homo sapiens
gacagcagcuucagaggaa

SEQ ID NO: 1048353 - RNA, 19 nt, Homo sapiens
gcaaacauguaucaaugga

SEQ ID NO: 1048354 - RNA, 19 nt, Homo sapiens
uaacugcagugaagucuga

SEQ ID NO: 1048355 - RNA, 19 nt, Homo sapiens
guaauagcuuccuuuaaga

SEQ ID NO: 1048356 - RNA, 19 nt, Homo sapiens
uguaauagcuuccuuuaag

SEQ ID NO: 1048357 - RNA, 19 nt, Homo sapiens
gcucagaccauuuaugaaa

SEQ ID NO: 1048358 - RNA, 19 nt, Homo sapiens
gaaggaagaagaaccaguu

SEQ ID NO: 1048359 - RNA, 19 nt, Homo sapiens
ucaaauaugcccuaguuaa

SEQ ID NO: 1048360 - RNA, 19 nt, Homo sapiens
aaacugcucugaacuaaag

SEQ ID NO: 1048361 - RNA, 19 nt, Homo sapiens
guucagaccucuuccuguu

SEQ ID NO: 1048362 - RNA, 19 nt, Homo sapiens
ggugaaaccucugauuguu

SEQ ID NO: 1048363 - RNA, 19 nt, Homo sapiens
acuaggcguugacaaauua

SEQ ID NO: 1048364 - RNA, 19 nt, Homo sapiens
gaacagucccucccacuuc

SEQ ID NO: 1048365 - RNA, 19 nt, Homo sapiens
uacgagaucugaugaguga

SEQ ID NO: 1048366 - RNA, 19 nt, Homo sapiens
gacauguucuguuguguug

SEQ ID NO: 1048367 - RNA, 19 nt, Homo sapiens
gcaagacgagucacagaaa

SEQ ID NO: 1048368 - RNA, 19 nt, Homo sapiens
ggcaugagaaaccaaauua

SEQ ID NO: 1048369 - RNA, 19 nt, Homo sapiens
ccacaggagugcugcuuga

SEQ ID NO: 1048370 - RNA, 19 nt, Homo sapiens
ugacaggugugcccacuga

SEQ ID NO: 1048371 - RNA, 19 nt, Homo sapiens
auaaagagcaguaaacuug

SEQ ID NO: 1048372 - RNA, 19 nt, Homo sapiens
gaggaagcucguuuaauuu

SEQ ID NO: 1048373 - RNA, 19 nt, Homo sapiens
ucucuugucuggcaucuuu

SEQ ID NO: 1048374 - RNA, 19 nt, Homo sapiens
ugaaggaggucucucuugu

SEQ ID NO: 1048375 - RNA, 19 nt, Homo sapiens
cuucaaauaugcccuaguu

SEQ ID NO: 1048376 - RNA, 19 nt, Homo sapiens
guauagugcaggcuuguua

SEQ ID NO: 1048377 - RNA, 19 nt, Homo sapiens
ucaagaggcuuuccuaucg

SEQ ID NO: 1048378 - RNA, 19 nt, Homo sapiens
ucaaagaaggucuaaggua

SEQ ID NO: 1048379 - RNA, 19 nt, Homo sapiens
uaugaagccuggagccuuu

SEQ ID NO: 1048380 - RNA, 19 nt, Homo sapiens
uaagaugacuguaauucuc

SEQ ID NO: 1048381 - RNA, 19 nt, Homo sapiens
gaagauaaggagaguggaa

SEQ ID NO: 1048382 - RNA, 19 nt, Homo sapiens
gcauucacuaguacaauua

SEQ ID NO: 1048383 - RNA, 19 nt, Homo sapiens
uggcaaacauguaucaaug

SEQ ID NO: 1048384 - RNA, 19 nt, Homo sapiens
gaagucugauucugaugga

SEQ ID NO: 1048385 - RNA, 19 nt, Homo sapiens
gcucugaacuaaagcucaa

SEQ ID NO: 1048386 - RNA, 19 nt, Homo sapiens
gggcccauguaauuguuua

SEQ ID NO: 1048387 - RNA, 19 nt, Homo sapiens
cuucugacauuuauaguug

SEQ ID NO: 1048388 - RNA, 19 nt, Homo sapiens
caagacgagucacagaaau

SEQ ID NO: 1048389 - RNA, 19 nt, Homo sapiens
gccaaggccuacaguguug

SEQ ID NO: 1048390 - RNA, 19 nt, Homo sapiens
uuaaacugcucugaacuaa

SEQ ID NO: 1048391 - RNA, 19 nt, Homo sapiens
caaaacagccuucccaaaa

SEQ ID NO: 1048392 - RNA, 19 nt, Homo sapiens
uaacaaggcagauaugaag

SEQ ID NO: 1048393 - RNA, 19 nt, Homo sapiens
uaauucaaguugugugcua

SEQ ID NO: 1048394 - RNA, 19 nt, Homo sapiens
ccacagaagcaacgucaaa

SEQ ID NO: 1048395 - RNA, 19 nt, Homo sapiens
ggaaggcucacuuuuguua

SEQ ID NO: 1048396 - RNA, 19 nt, Homo sapiens
ggaagcucguuuaauuuua

SEQ ID NO: 1048397 - RNA, 19 nt, Homo sapiens
ccagcgauguuguccauau

SEQ ID NO: 1048398 - RNA, 19 nt, Homo sapiens
ggccuacaguguugugaaa

SEQ ID NO: 1048399 - RNA, 19 nt, Homo sapiens
aaucacagcuucggaacuu

SEQ ID NO: 1048400 - RNA, 19 nt, Homo sapiens
guugauacuugccuauaga

SEQ ID NO: 1048401 - RNA, 19 nt, Homo sapiens
gaugacugauggcuuggaa

SEQ ID NO: 1048402 - RNA, 19 nt, Homo sapiens
acacggcucagaccauuua

SEQ ID NO: 1048403 - RNA, 19 nt, Homo sapiens
ucaaaugacuccagaucca

SEQ ID NO: 1048404 - RNA, 19 nt, Homo sapiens
gcauuugagaacaacauua

SEQ ID NO: 1048405 - RNA, 19 nt, Homo sapiens
ggaagcaaagcaaauagga

SEQ ID NO: 1048406 - RNA, 19 nt, Homo sapiens
auacuugccuauagaaaug

SEQ ID NO: 1048407 - RNA, 19 nt, Homo sapiens
ugaccaggaugcuuuguuc

SEQ ID NO: 1048408 - RNA, 19 nt, Homo sapiens
guuaaacugcucugaacua

SEQ ID NO: 1048409 - RNA, 19 nt, Homo sapiens
ggagccaaaucugguuauu

SEQ ID NO: 1048410 - RNA, 19 nt, Homo sapiens
guauugcaguaaagaaaug

SEQ ID NO: 1048411 - RNA, 19 nt, Homo sapiens
caugguugaugaugcaauu

SEQ ID NO: 1048412 - RNA, 19 nt, Homo sapiens
ucuguuguguugcacuuua

SEQ ID NO: 1048413 - RNA, 19 nt, Homo sapiens
agagacugcuuaugauaug

SEQ ID NO: 1048414 - RNA, 19 nt, Homo sapiens
gcaacaucacaaaugaaua

SEQ ID NO: 1048415 - RNA, 19 nt, Homo sapiens
gagauuauguucgugugau

SEQ ID NO: 1048416 - RNA, 19 nt, Homo sapiens
uaaccuaucaggaaugaau

SEQ ID NO: 1048417 - RNA, 19 nt, Homo sapiens
aaccauaacugcagugaag

SEQ ID NO: 1048418 - RNA, 19 nt, Homo sapiens
gauacuugccuauagaaau

SEQ ID NO: 1048419 - RNA, 19 nt, Homo sapiens
gcagugaagucugauucug

SEQ ID NO: 1048420 - RNA, 19 nt, Homo sapiens
gaacgugcucagacucuug

SEQ ID NO: 1048421 - RNA, 19 nt, Homo sapiens
uuaauggcauggaagagaa

SEQ ID NO: 1048422 - RNA, 19 nt, Homo sapiens
ugacgagagugggaaugua

SEQ ID NO: 1048423 - RNA, 19 nt, Homo sapiens
gggaagauuggaagugauu

SEQ ID NO: 1048424 - RNA, 19 nt, Homo sapiens
agacacggcucagaccauu

SEQ ID NO: 1048425 - RNA, 19 nt, Homo sapiens
gaugucaccugcaguuugc

SEQ ID NO: 1048426 - RNA, 19 nt, Homo sapiens
aaagcucacuccaacaugu

SEQ ID NO: 1048427 - RNA, 19 nt, Homo sapiens
ugaaagagggaaucacaga

SEQ ID NO: 1048428 - RNA, 19 nt, Homo sapiens
caaacagaaugguucaaac

SEQ ID NO: 1048429 - RNA, 19 nt, Homo sapiens
cuaucgacaugguuuacua

SEQ ID NO: 1048430 - RNA, 19 nt, Homo sapiens
cggcagguguucauuguuc

SEQ ID NO: 1048431 - RNA, 19 nt, Homo sapiens
ucagucugcccguuaauaa

SEQ ID NO: 1048432 - RNA, 19 nt, Homo sapiens
gcaggagaaggaagaagaa

SEQ ID NO: 1048433 - RNA, 19 nt, Homo sapiens
ccacugagaaugaugacuu

SEQ ID NO: 1048434 - RNA, 19 nt, Homo sapiens
ucagaccucuuccuguuuc

SEQ ID NO: 1048435 - RNA, 19 nt, Homo sapiens
uauccuguguuuaugugua

SEQ ID NO: 1048436 - RNA, 19 nt, Homo sapiens
gauguuguccauaucagaa

SEQ ID NO: 1048437 - RNA, 19 nt, Homo sapiens
aagcaaagcaaauaggauu

SEQ ID NO: 1048438 - RNA, 19 nt, Homo sapiens
cggcucagaccauuuauga

SEQ ID NO: 1048439 - RNA, 19 nt, Homo sapiens
caagaggcuuuccuaucga

SEQ ID NO: 1048440 - RNA, 19 nt, Homo sapiens
ugauuggucuggcucaguu

SEQ ID NO: 1048441 - RNA, 19 nt, Homo sapiens
ccaggaugcuuuguucuuc

SEQ ID NO: 1048442 - RNA, 19 nt, Homo sapiens
guagagagcuaacguuuga

SEQ ID NO: 1048443 - RNA, 19 nt, Homo sapiens
cagaugagcuuucaaguug

SEQ ID NO: 1048444 - RNA, 19 nt, Homo sapiens
ggacuaauccagugguuua

SEQ ID NO: 1048445 - RNA, 19 nt, Homo sapiens
gcaguugccuucacaagaa

SEQ ID NO: 1048446 - RNA, 19 nt, Homo sapiens
uagcagcucugaauccuua

SEQ ID NO: 1048447 - RNA, 19 nt, Homo sapiens
acaaauaccucaucuguuc

SEQ ID NO: 1048448 - RNA, 19 nt, Homo sapiens
gaaacacugucuguacuaa

SEQ ID NO: 1048449 - RNA, 19 nt, Homo sapiens
gacaaaggcucugaauuga

SEQ ID NO: 1048450 - RNA, 19 nt, Homo sapiens
ugacaaaggcucugaauug

SEQ ID NO: 1048451 - RNA, 19 nt, Homo sapiens
gagcuaacguuugauaguu

SEQ ID NO: 1048452 - RNA, 19 nt, Homo sapiens
guaaagguacuaacaugua

SEQ ID NO: 1048453 - RNA, 19 nt, Homo sapiens
caaaggcucugaauugaag

SEQ ID NO: 1048454 - RNA, 19 nt, Homo sapiens
ggaagacgauaauuacaag

SEQ ID NO: 1048455 - RNA, 19 nt, Homo sapiens
gcaagcagugucaauauug

SEQ ID NO: 1048456 - RNA, 19 nt, Homo sapiens
aauccuacaugguaucaua

SEQ ID NO: 1048457 - RNA, 19 nt, Homo sapiens
ucucaacucuguucaguau

SEQ ID NO: 1048458 - RNA, 19 nt, Homo sapiens
gaauaaccuucaugcacuu

SEQ ID NO: 1048459 - RNA, 19 nt, Homo sapiens
gaauaugcgggucagauaa

SEQ ID NO: 1048460 - RNA, 19 nt, Homo sapiens
ggcaagcagugucaauauu

SEQ ID NO: 1048461 - RNA, 19 nt, Homo sapiens
gaaagcauggaccuaauga

SEQ ID NO: 1048462 - RNA, 19 nt, Homo sapiens
caccuugcauucccuauuu

SEQ ID NO: 1048463 - RNA, 19 nt, Homo sapiens
ucaacucuguucaguauau

SEQ ID NO: 1048464 - RNA, 19 nt, Homo sapiens
gaaacuguaugagcugaau

SEQ ID NO: 1048465 - RNA, 19 nt, Homo sapiens
gguauucgauguucuuaag

SEQ ID NO: 1048466 - RNA, 19 nt, Homo sapiens
gaggaaagcauggaccuaa

SEQ ID NO: 1048467 - RNA, 19 nt, Homo sapiens
ccucuucccuguauuauag

SEQ ID NO: 1048468 - RNA, 19 nt, Homo sapiens
agaccagccugaccaauau

SEQ ID NO: 1048469 - RNA, 19 nt, Homo sapiens
caacucuguucaguauaua

SEQ ID NO: 1048470 - RNA, 19 nt, Homo sapiens
gaagauaacuacaaaagac

SEQ ID NO: 1048471 - RNA, 19 nt, Homo sapiens
caaguagguuggaucuuca

SEQ ID NO: 1048472 - RNA, 19 nt, Homo sapiens
acaaguagguuggaucuuc

SEQ ID NO: 1048473 - RNA, 19 nt, Homo sapiens
acagcagucuugugaauau

SEQ ID NO: 1048474 - RNA, 19 nt, Homo sapiens
ggaaagcauggaccuaaug

SEQ ID NO: 1048475 - RNA, 19 nt, Homo sapiens
gacacaucguuguuuguuu

SEQ ID NO: 1048476 - RNA, 19 nt, Homo sapiens
uuacagcagucuugugaau

SEQ ID NO: 1048477 - RNA, 19 nt, Homo sapiens
gaugagcuuucaaguugug

SEQ ID NO: 1048478 - RNA, 19 nt, Homo sapiens
gcaggagaaucacuugaac

SEQ ID NO: 1048479 - RNA, 19 nt, Homo sapiens
ugaccaauauagugaaaca

SEQ ID NO: 1048480 - RNA, 19 nt, Homo sapiens
ccagaugagcuuucaaguu

SEQ ID NO: 1048481 - RNA, 19 nt, Homo sapiens
ggucagauaacauuaaugg

SEQ ID NO: 1048482 - RNA, 19 nt, Homo sapiens
gcucugaauccuuaaguga

SEQ ID NO: 1048483 - RNA, 19 nt, Homo sapiens
auacaucgauucagcauac

SEQ ID NO: 1048484 - RNA, 19 nt, Homo sapiens
guuccaguauuuaaagcua

SEQ ID NO: 1048485 - RNA, 19 nt, Homo sapiens
uagcagaauuauccucuuc

SEQ ID NO: 1048486 - RNA, 19 nt, Homo sapiens
cucagagacuauauaagua

SEQ ID NO: 1048487 - RNA, 19 nt, Homo sapiens
agacucagagacuauauaa

SEQ ID NO: 1048488 - RNA, 19 nt, Homo sapiens
aaacaugggcguuauuaag

SEQ ID NO: 1048489 - RNA, 19 nt, Homo sapiens
ggcagucaguccucuguug

SEQ ID NO: 1048490 - RNA, 19 nt, Homo sapiens
ucuucaugcucaaacauua

SEQ ID NO: 1048491 - RNA, 19 nt, Homo sapiens
agaauaugcgggucagaua

SEQ ID NO: 1048492 - RNA, 19 nt, Homo sapiens
aagcuuugaugcuguggua

SEQ ID NO: 1048493 - RNA, 19 nt, Homo sapiens
aaaccuuucuccaauguag

SEQ ID NO: 1048494 - RNA, 19 nt, Homo sapiens
aagaccagccugaccaaua

SEQ ID NO: 1048495 - RNA, 19 nt, Homo sapiens
gaguaaagaagauaacuac

SEQ ID NO: 1048496 - RNA, 19 nt, Homo sapiens
uguaugagcugaauaaccu

SEQ ID NO: 1048497 - RNA, 19 nt, Homo sapiens
gguuacaccagaagaauau

SEQ ID NO: 1048498 - RNA, 19 nt, Homo sapiens
ccagugguuuacagcagua

SEQ ID NO: 1048499 - RNA, 19 nt, Homo sapiens
aaagaugacaccuugcauu

SEQ ID NO: 1048500 - RNA, 19 nt, Homo sapiens
uaaccuucaugcacuuaug

SEQ ID NO: 1048501 - RNA, 19 nt, Homo sapiens
aaauauaguucugcaccaa

SEQ ID NO: 1048502 - RNA, 19 nt, Homo sapiens
gagacuauauaaguagcuu

SEQ ID NO: 1048503 - RNA, 19 nt, Homo sapiens
ggauguuccaguauuuaaa

SEQ ID NO: 1048504 - RNA, 19 nt, Homo sapiens
gugaaacacugucuguacu

SEQ ID NO: 1048505 - RNA, 19 nt, Homo sapiens
gagacuugguccaucuugu

SEQ ID NO: 1048506 - RNA, 19 nt, Homo sapiens
ugagagacuugguccaucu

SEQ ID NO: 1048507 - RNA, 19 nt, Homo sapiens
agagagcuaacguuugaua

SEQ ID NO: 1048508 - RNA, 19 nt, Homo sapiens
acucagagacuauauaagu

SEQ ID NO: 1048509 - RNA, 19 nt, Homo sapiens
gagccgagagugcaccauu

SEQ ID NO: 1048510 - RNA, 19 nt, Homo sapiens
ugaaacacugucuguacua

SEQ ID NO: 1048511 - RNA, 19 nt, Homo sapiens
uauccucuucccuguauua

SEQ ID NO: 1048512 - RNA, 19 nt, Homo sapiens
auacaaauaccucaucugu

SEQ ID NO: 1048513 - RNA, 19 nt, Homo sapiens
agacgauaauuacaaguag

SEQ ID NO: 1048514 - RNA, 19 nt, Homo sapiens
ggacugaugaggaaagcau

SEQ ID NO: 1048515 - RNA, 19 nt, Homo sapiens
acacaucguuguuuguuuu

SEQ ID NO: 1048516 - RNA, 19 nt, Homo sapiens
gcagucuugugaauaugau

SEQ ID NO: 1048517 - RNA, 19 nt, Homo sapiens
cccaucaacuggcagcauu

SEQ ID NO: 1048518 - RNA, 19 nt, Homo sapiens
aaacugcuaagaaacugua

SEQ ID NO: 1048519 - RNA, 19 nt, Homo sapiens
caauguagcagaauuaucc

SEQ ID NO: 1048520 - RNA, 19 nt, Homo sapiens
ucaguccucuguugcuguu

SEQ ID NO: 1048521 - RNA, 19 nt, Homo sapiens
ucaaccagaugagcuuuca

SEQ ID NO: 1048522 - RNA, 19 nt, Homo sapiens
ggcaggagaaucacuugaa

SEQ ID NO: 1048523 - RNA, 19 nt, Homo sapiens
guagcagaauuauccucuu

SEQ ID NO: 1048524 - RNA, 19 nt, Homo sapiens
ucuaaauccuacaugguau

SEQ ID NO: 1048525 - RNA, 19 nt, Homo sapiens
guuuugagccacuauauua

SEQ ID NO: 1048526 - RNA, 19 nt, Homo sapiens
ucuccaauguagcagaauu

SEQ ID NO: 1048527 - RNA, 19 nt, Homo sapiens
caggcaagcagugucaaua

SEQ ID NO: 1048528 - RNA, 19 nt, Homo sapiens
uaaaacaugggcguuauua

SEQ ID NO: 1048529 - RNA, 19 nt, Homo sapiens
caaaugcaguugccuucac

SEQ ID NO: 1048530 - RNA, 19 nt, Homo sapiens
ucaaguuguggauggaaua

SEQ ID NO: 1048531 - RNA, 19 nt, Homo sapiens
gcgggucagauaacauuaa

SEQ ID NO: 1048532 - RNA, 19 nt, Homo sapiens
uaagguuacaccagaagaa

SEQ ID NO: 1048533 - RNA, 19 nt, Homo sapiens
ugacacaucguuguuuguu

SEQ ID NO: 1048534 - RNA, 19 nt, Homo sapiens
caagcagugucaauauugc

SEQ ID NO: 1048535 - RNA, 19 nt, Homo sapiens
uaucucaacucuguucagu

SEQ ID NO: 1048536 - RNA, 19 nt, Homo sapiens
ccugaccaauauagugaaa

SEQ ID NO: 1048537 - RNA, 19 nt, Homo sapiens
cgaggcggguggaucacuu

SEQ ID NO: 1048538 - RNA, 19 nt, Homo sapiens
caacuggcagcauucuaga

SEQ ID NO: 1048539 - RNA, 19 nt, Homo sapiens
gaaaagacaaaacuaccuu

SEQ ID NO: 1048540 - RNA, 19 nt, Homo sapiens
caaguuguggauggaauaa

SEQ ID NO: 1048541 - RNA, 19 nt, Homo sapiens
gauguuccaguauuuaaag

SEQ ID NO: 1048542 - RNA, 19 nt, Homo sapiens
gcacuuaguuucucuguaa

SEQ ID NO: 1048543 - RNA, 19 nt, Homo sapiens
gcaaaugacguguauauaa

SEQ ID NO: 1048544 - RNA, 19 nt, Homo sapiens
gcugagauuuguuaaguua

SEQ ID NO: 1048545 - RNA, 19 nt, Homo sapiens
gggaagcgauuacaaauau

SEQ ID NO: 1048546 - RNA, 19 nt, Homo sapiens
caacagacauucauuccuu

SEQ ID NO: 1048547 - RNA, 19 nt, Homo sapiens
ucagaguccuuguauauuu

SEQ ID NO: 1048548 - RNA, 19 nt, Homo sapiens
gcacugcccuagcaugauu

SEQ ID NO: 1048549 - RNA, 19 nt, Homo sapiens
aaacuagucuugauagaug

SEQ ID NO: 1048550 - RNA, 19 nt, Homo sapiens
agacuuagauucaguuguu

SEQ ID NO: 1048551 - RNA, 19 nt, Homo sapiens
ggaagcgauuacaaauaua

SEQ ID NO: 1048552 - RNA, 19 nt, Homo sapiens
ccaggaaacucacuacugu

SEQ ID NO: 1048553 - RNA, 19 nt, Homo sapiens
gaaggaguuucucuuggaa

SEQ ID NO: 1048554 - RNA, 19 nt, Homo sapiens
agucuaagcugacauaugu

SEQ ID NO: 1048555 - RNA, 19 nt, Homo sapiens
uaacgugaaccuccaauuu

SEQ ID NO: 1048556 - RNA, 19 nt, Homo sapiens
gagcucacccuccauguuu

SEQ ID NO: 1048557 - RNA, 19 nt, Homo sapiens
gggcuguccucaagucuaa

SEQ ID NO: 1048558 - RNA, 19 nt, Homo sapiens
guaagggauugcugagauu

SEQ ID NO: 1048559 - RNA, 19 nt, Homo sapiens
gauauacuauguagguugu

SEQ ID NO: 1048560 - RNA, 19 nt, Homo sapiens
aaauauaaaugcccagguu

SEQ ID NO: 1048561 - RNA, 19 nt, Homo sapiens
gacuuagcauggcacauua

SEQ ID NO: 1048562 - RNA, 19 nt, Homo sapiens
gugguaaacuugagauugu

SEQ ID NO: 1048563 - RNA, 19 nt, Homo sapiens
gagaagacuuagauucagu

SEQ ID NO: 1048564 - RNA, 19 nt, Homo sapiens
ucucuagguucuugauaua

SEQ ID NO: 1048565 - RNA, 19 nt, Homo sapiens
ggauugcugagauuuguua

SEQ ID NO: 1048566 - RNA, 19 nt, Homo sapiens
ggaaacuuguuagaaaugu

SEQ ID NO: 1048567 - RNA, 19 nt, Homo sapiens
gggagaagacuuagauuca

SEQ ID NO: 1048568 - RNA, 19 nt, Homo sapiens
gggaucauuuggaaacuug

SEQ ID NO: 1048569 - RNA, 19 nt, Homo sapiens
ucagauuuguugcuauuga

SEQ ID NO: 1048570 - RNA, 19 nt, Homo sapiens
ccagucugcuugcuucaaa

SEQ ID NO: 1048571 - RNA, 19 nt, Homo sapiens
ugaauucccucuuccauac

SEQ ID NO: 1048572 - RNA, 19 nt, Homo sapiens
uuccuuagauacucucuua

SEQ ID NO: 1048573 - RNA, 19 nt, Homo sapiens
uuccagaccugcugaauug

SEQ ID NO: 1048574 - RNA, 19 nt, Homo sapiens
gcauguuggugguaaacuu

SEQ ID NO: 1048575 - RNA, 19 nt, Homo sapiens
gcacaguuaaugagauuug

SEQ ID NO: 1048576 - RNA, 19 nt, Homo sapiens
ucauuuagcugggcaacaa

SEQ ID NO: 1048577 - RNA, 19 nt, Homo sapiens
gcacauuaggugggcauua

SEQ ID NO: 1048578 - RNA, 19 nt, Homo sapiens
gauuugggcuguccucaag

SEQ ID NO: 1048579 - RNA, 19 nt, Homo sapiens
gaggaccacugucuuagag

SEQ ID NO: 1048580 - RNA, 19 nt, Homo sapiens
cagaguccuuguauauuug

SEQ ID NO: 1048581 - RNA, 19 nt, Homo sapiens
cacaagcucccaagaguuu

SEQ ID NO: 1048582 - RNA, 19 nt, Homo sapiens
ccaaacuagucuugauaga

SEQ ID NO: 1048583 - RNA, 19 nt, Homo sapiens
gacauucauuccuuuguuc

SEQ ID NO: 1048584 - RNA, 19 nt, Homo sapiens
guugaggaccacugucuua

SEQ ID NO: 1048585 - RNA, 19 nt, Homo sapiens
agauucaguuguucacuuu

SEQ ID NO: 1048586 - RNA, 19 nt, Homo sapiens
ggagaagacuuagauucag

SEQ ID NO: 1048587 - RNA, 19 nt, Homo sapiens
agacauucauuccuuuguu

SEQ ID NO: 1048588 - RNA, 19 nt, Homo sapiens
ggaacaagauccccagaug

SEQ ID NO: 1048589 - RNA, 19 nt, Homo sapiens
aggcagagcugagagagaa

SEQ ID NO: 1048590 - RNA, 19 nt, Homo sapiens
ccagggaagcgauuacaaa

SEQ ID NO: 1048591 - RNA, 19 nt, Homo sapiens
ugacuuagcauggcacauu

SEQ ID NO: 1048592 - RNA, 19 nt, Homo sapiens
uguauucuuuccaggauuu

SEQ ID NO: 1048593 - RNA, 19 nt, Homo sapiens
ucaagucuaagcugacaua

SEQ ID NO: 1048594 - RNA, 19 nt, Homo sapiens
uaaaaugaauucccucuuc

SEQ ID NO: 1048595 - RNA, 19 nt, Homo sapiens
gggcucauuuccugaacaa

SEQ ID NO: 1048596 - RNA, 19 nt, Homo sapiens
cagauuuguugcuauugaa

SEQ ID NO: 1048597 - RNA, 19 nt, Homo sapiens
aaaguucucuagguucuug

SEQ ID NO: 1048598 - RNA, 19 nt, Homo sapiens
cuuagauacucucuuagaa

SEQ ID NO: 1048599 - RNA, 19 nt, Homo sapiens
uauccaccaucacuucauu

SEQ ID NO: 1048600 - RNA, 19 nt, Homo sapiens
uagauucaguuguucacuu

SEQ ID NO: 1048601 - RNA, 19 nt, Homo sapiens
aagcaaaugacguguauau

SEQ ID NO: 1048602 - RNA, 19 nt, Homo sapiens
ucacuacuguuuugaguuu

SEQ ID NO: 1048603 - RNA, 19 nt, Homo sapiens
gcugacauaugugggagaa

SEQ ID NO: 1048604 - RNA, 19 nt, Homo sapiens
cuaccaugguguccagaaa

SEQ ID NO: 1048605 - RNA, 19 nt, Homo sapiens
uguuagaaauguagacuca

SEQ ID NO: 1048606 - RNA, 19 nt, Homo sapiens
uacacaagcucccaagagu

SEQ ID NO: 1048607 - RNA, 19 nt, Homo sapiens
guuaaaauccucuggaaaa

SEQ ID NO: 1048608 - RNA, 19 nt, Homo sapiens
ggcuguggauccaguuuga

SEQ ID NO: 1048609 - RNA, 19 nt, Homo sapiens
uauaaaugcccagguugua

SEQ ID NO: 1048610 - RNA, 19 nt, Homo sapiens
guccuuguauauuugcuuu

SEQ ID NO: 1048611 - RNA, 19 nt, Homo sapiens
uauuacauauccaccauca

SEQ ID NO: 1048612 - RNA, 19 nt, Homo sapiens
uuaccaaacuagucuugau

SEQ ID NO: 1048613 - RNA, 19 nt, Homo sapiens
cacauuaggugggcauuag

SEQ ID NO: 1048614 - RNA, 19 nt, Homo sapiens
uuucagaguccuuguauau

SEQ ID NO: 1048615 - RNA, 19 nt, Homo sapiens
cugcacaguuaaugagauu

SEQ ID NO: 1048616 - RNA, 19 nt, Homo sapiens
caaacuagucuugauagau

SEQ ID NO: 1048617 - RNA, 19 nt, Homo sapiens
uaccaaacuagucuugaua

SEQ ID NO: 1048618 - RNA, 19 nt, Homo sapiens
cuagaguaaugccacaaug

SEQ ID NO: 1048619 - RNA, 19 nt, Homo sapiens
ugacauaugugggagaaaa

SEQ ID NO: 1048620 - RNA, 19 nt, Homo sapiens
cauugucccucucccauuc

SEQ ID NO: 1048621 - RNA, 19 nt, Homo sapiens
guacacaagcucccaagag

SEQ ID NO: 1048622 - RNA, 19 nt, Homo sapiens
aguaagggauugcugagau

SEQ ID NO: 1048623 - RNA, 19 nt, Homo sapiens
aaaacuggaugcuguuaaa

SEQ ID NO: 1048624 - RNA, 19 nt, Homo sapiens
gauccauggcacuuaguuu

SEQ ID NO: 1048625 - RNA, 19 nt, Homo sapiens
cagcacugcccuagcauga

SEQ ID NO: 1048626 - RNA, 19 nt, Homo sapiens
cagaccugcugaauuggaa

SEQ ID NO: 1048627 - RNA, 19 nt, Homo sapiens
cuagguucuugauauacua

SEQ ID NO: 1048628 - RNA, 19 nt, Homo sapiens
cuccgugacuucccuugua

SEQ ID NO: 1048629 - RNA, 19 nt, Homo sapiens
caccaucacuucauuuagc

SEQ ID NO: 1048630 - RNA, 19 nt, Homo sapiens
auucugcgcacuucuguua

SEQ ID NO: 1048631 - RNA, 19 nt, Homo sapiens
gaagacuuagauucaguug

SEQ ID NO: 1048632 - RNA, 19 nt, Homo sapiens
acagauccauggcacuuag

SEQ ID NO: 1048633 - RNA, 19 nt, Homo sapiens
aaaagcaaaugacguguau

SEQ ID NO: 1048634 - RNA, 19 nt, Homo sapiens
gucauggacauuugaauau

SEQ ID NO: 1048635 - RNA, 19 nt, Homo sapiens
ugaagggaguaagggauug

SEQ ID NO: 1048636 - RNA, 19 nt, Homo sapiens
ccacagauccauggcacuu

SEQ ID NO: 1048637 - RNA, 19 nt, Homo sapiens
ccacugucuuagaggauug

SEQ ID NO: 1048638 - RNA, 19 nt, Homo sapiens
cugcugaauuggaacaaga

SEQ ID NO: 1048639 - RNA, 19 nt, Homo sapiens
ggugguaaacuugagauug

SEQ ID NO: 1048640 - RNA, 19 nt, Homo sapiens
gaacuuuucucugucuuca

SEQ ID NO: 1048641 - RNA, 19 nt, Homo sapiens
ucagggagaagacuuagau

SEQ ID NO: 1048642 - RNA, 19 nt, Homo sapiens
gaaaguaucuuaacugguu

SEQ ID NO: 1048643 - RNA, 19 nt, Homo sapiens
gaaacgaaccagaccaaua

SEQ ID NO: 1048644 - RNA, 19 nt, Homo sapiens
aaacggaggucguauaaug

SEQ ID NO: 1048645 - RNA, 19 nt, Homo sapiens
gaaaaccucugcacuuuaa

SEQ ID NO: 1048646 - RNA, 19 nt, Homo sapiens
gggaacagcuggcauuuca

SEQ ID NO: 1048647 - RNA, 19 nt, Homo sapiens
ggaaucagguggagcaugu

SEQ ID NO: 1048648 - RNA, 19 nt, Homo sapiens
ggagacuggucacugcuua

SEQ ID NO: 1048649 - RNA, 19 nt, Homo sapiens
ggacuuggauuuccucuac

SEQ ID NO: 1048650 - RNA, 19 nt, Homo sapiens
aaacgaaccagaccaauaa

SEQ ID NO: 1048651 - RNA, 19 nt, Homo sapiens
gaacugcucuuuggaaguc

SEQ ID NO: 1048652 - RNA, 19 nt, Homo sapiens
gaaguucacaguugacaaa

SEQ ID NO: 1048653 - RNA, 19 nt, Homo sapiens
ccaaagggauuaggacuug

SEQ ID NO: 1048654 - RNA, 19 nt, Homo sapiens
uggaggagcugguucauga

SEQ ID NO: 1048655 - RNA, 19 nt, Homo sapiens
gcaaacaagcaugcauuua

SEQ ID NO: 1048656 - RNA, 19 nt, Homo sapiens
ggaagauccuacugagcua

SEQ ID NO: 1048657 - RNA, 19 nt, Homo sapiens
gcucguuucucuuauuuau

SEQ ID NO: 1048658 - RNA, 19 nt, Homo sapiens
gaaaccgaaugcuucagaa

SEQ ID NO: 1048659 - RNA, 19 nt, Homo sapiens
gaagacaaggugaugauga

SEQ ID NO: 1048660 - RNA, 19 nt, Homo sapiens
cuaccaguaucaagaauuu

SEQ ID NO: 1048661 - RNA, 19 nt, Homo sapiens
aaauaaaccucaucguugu

SEQ ID NO: 1048662 - RNA, 19 nt, Homo sapiens
ucucaugugucaauacuuu

SEQ ID NO: 1048663 - RNA, 19 nt, Homo sapiens
gcagcucguuucucuuauu

SEQ ID NO: 1048664 - RNA, 19 nt, Homo sapiens
ugaaagaggacacaagaaa

SEQ ID NO: 1048665 - RNA, 19 nt, Homo sapiens
gggauuaggacuuggauuu

SEQ ID NO: 1048666 - RNA, 19 nt, Homo sapiens
gaaccaagcaaggacuaua

SEQ ID NO: 1048667 - RNA, 19 nt, Homo sapiens
aauccaagaugaaggagua

SEQ ID NO: 1048668 - RNA, 19 nt, Homo sapiens
ggacauggacagugauaga

SEQ ID NO: 1048669 - RNA, 19 nt, Homo sapiens
gaaguccgaacacaucuuu

SEQ ID NO: 1048670 - RNA, 19 nt, Homo sapiens
ggagauaucaaacggagaa

SEQ ID NO: 1048671 - RNA, 19 nt, Homo sapiens
caaacaagcaugcauuuag

SEQ ID NO: 1048672 - RNA, 19 nt, Homo sapiens
guucacaguugacaaacaa

SEQ ID NO: 1048673 - RNA, 19 nt, Homo sapiens
ggaagucgccggugcuguu

SEQ ID NO: 1048674 - RNA, 19 nt, Homo sapiens
ugauagagccuaccaguau

SEQ ID NO: 1048675 - RNA, 19 nt, Homo sapiens
ggacaauguugggaauaga

SEQ ID NO: 1048676 - RNA, 19 nt, Homo sapiens
ccagcuauuucuagguaua

SEQ ID NO: 1048677 - RNA, 19 nt, Homo sapiens
gauaucaaacggagaagaa

SEQ ID NO: 1048678 - RNA, 19 nt, Homo sapiens
gaccaaauguuaguagcaa

SEQ ID NO: 1048679 - RNA, 19 nt, Homo sapiens
cagaagagguuuccaagcu

SEQ ID NO: 1048680 - RNA, 19 nt, Homo sapiens
uaucaucccuaucuauugu

SEQ ID NO: 1048681 - RNA, 19 nt, Homo sapiens
cagcucguuucucuuauuu

SEQ ID NO: 1048682 - RNA, 19 nt, Homo sapiens
gaaaacggaggucguauaa

SEQ ID NO: 1048683 - RNA, 19 nt, Homo sapiens
gaaaauccgccuaagaaaa

SEQ ID NO: 1048684 - RNA, 19 nt, Homo sapiens
gcagaggccaaagggauua

SEQ ID NO: 1048685 - RNA, 19 nt, Homo sapiens
ggaaaccgaaugcuucaga

SEQ ID NO: 1048686 - RNA, 19 nt, Homo sapiens
gcuugucaauuucauauuc

SEQ ID NO: 1048687 - RNA, 19 nt, Homo sapiens
ucaguaauuuccagcuauu

SEQ ID NO: 1048688 - RNA, 19 nt, Homo sapiens
agaagagguuuccaagcua

SEQ ID NO: 1048689 - RNA, 19 nt, Homo sapiens
gaacagcuggcauuucagu

SEQ ID NO: 1048690 - RNA, 19 nt, Homo sapiens
cgagguggauuugcugaaa

SEQ ID NO: 1048691 - RNA, 19 nt, Homo sapiens
aaaucuacauugccucaaa

SEQ ID NO: 1048692 - RNA, 19 nt, Homo sapiens
uaccagauccugucuuuga

SEQ ID NO: 1048693 - RNA, 19 nt, Homo sapiens
cacaggacaucucuaacaa

SEQ ID NO: 1048694 - RNA, 19 nt, Homo sapiens
aaacaagcaugcauuuagg

SEQ ID NO: 1048695 - RNA, 19 nt, Homo sapiens
gacuccaacuucaauggua

SEQ ID NO: 1048696 - RNA, 19 nt, Homo sapiens
aagacaaggugaugaugaa

SEQ ID NO: 1048697 - RNA, 19 nt, Homo sapiens
caaggacuauagagagaau

SEQ ID NO: 1048698 - RNA, 19 nt, Homo sapiens
agaccauucucgaaguaua

SEQ ID NO: 1048699 - RNA, 19 nt, Homo sapiens
gcacugaugcuggauuguu

SEQ ID NO: 1048700 - RNA, 19 nt, Homo sapiens
gcucaugagugaaagugau

SEQ ID NO: 1048701 - RNA, 19 nt, Homo sapiens
guagagaucaggacaugga

SEQ ID NO: 1048702 - RNA, 19 nt, Homo sapiens
gcugaaagaggacacaaga

SEQ ID NO: 1048703 - RNA, 19 nt, Homo sapiens
gagagauaaucgagcugaa

SEQ ID NO: 1048704 - RNA, 19 nt, Homo sapiens
uguaccagauccugucuuu

SEQ ID NO: 1048705 - RNA, 19 nt, Homo sapiens
ugaaggcucugauucuagu

SEQ ID NO: 1048706 - RNA, 19 nt, Homo sapiens
gggauuucaucacaauuca

SEQ ID NO: 1048707 - RNA, 19 nt, Homo sapiens
gagccuaccaguaucaaga

SEQ ID NO: 1048708 - RNA, 19 nt, Homo sapiens
ccacaggacaucucuaaca

SEQ ID NO: 1048709 - RNA, 19 nt, Homo sapiens
uaauaauguucgagggaaa

SEQ ID NO: 1048710 - RNA, 19 nt, Homo sapiens
ugacucugaugaccaaaug

SEQ ID NO: 1048711 - RNA, 19 nt, Homo sapiens
gacaauguagugugaaguu

SEQ ID NO: 1048712 - RNA, 19 nt, Homo sapiens
gaaaagcaaagaagaaaug

SEQ ID NO: 1048713 - RNA, 19 nt, Homo sapiens
gaauuuaccaagaacaaag

SEQ ID NO: 1048714 - RNA, 19 nt, Homo sapiens
caggacaucucuaacaaac

SEQ ID NO: 1048715 - RNA, 19 nt, Homo sapiens
ggagcugguucaugaccuu

SEQ ID NO: 1048716 - RNA, 19 nt, Homo sapiens
gaaagaggacacaagaaaa

SEQ ID NO: 1048717 - RNA, 19 nt, Homo sapiens
cacugaugcuggauuguuu

SEQ ID NO: 1048718 - RNA, 19 nt, Homo sapiens
caagaugaaggaguaguuu

SEQ ID NO: 1048719 - RNA, 19 nt, Homo sapiens
cuuagacaauguaguguga

SEQ ID NO: 1048720 - RNA, 19 nt, Homo sapiens
aaacacaucacucuagcuu

SEQ ID NO: 1048721 - RNA, 19 nt, Homo sapiens
caagcaaggacuauagaga

SEQ ID NO: 1048722 - RNA, 19 nt, Homo sapiens
cuagcuuccuuacugcaua

SEQ ID NO: 1048723 - RNA, 19 nt, Homo sapiens
ggcaaacaagcaugcauuu

SEQ ID NO: 1048724 - RNA, 19 nt, Homo sapiens
guugugcccuggugggaaa

SEQ ID NO: 1048725 - RNA, 19 nt, Homo sapiens
gaugcuggauuguuuacca

SEQ ID NO: 1048726 - RNA, 19 nt, Homo sapiens
ucuaacaaacggacaauga

SEQ ID NO: 1048727 - RNA, 19 nt, Homo sapiens
cagcuggcauuucaguaga

SEQ ID NO: 1048728 - RNA, 19 nt, Homo sapiens
gaaacgccaggcaaggaaa

SEQ ID NO: 1048729 - RNA, 19 nt, Homo sapiens
auacaguccugccauagug

SEQ ID NO: 1048730 - RNA, 19 nt, Homo sapiens
gaaaauaaucagacaagga

SEQ ID NO: 1048731 - RNA, 19 nt, Homo sapiens
aaagaccucuauggcauga

SEQ ID NO: 1048732 - RNA, 19 nt, Homo sapiens
gaccuaccaucgcaucagu

SEQ ID NO: 1048733 - RNA, 19 nt, Homo sapiens
gagcacacccaccaguuuc

SEQ ID NO: 1048734 - RNA, 19 nt, Homo sapiens
ccgaugcuuugcuuaauuc

SEQ ID NO: 1048735 - RNA, 19 nt, Homo sapiens
cacaauucauggugcuaaa

SEQ ID NO: 1048736 - RNA, 19 nt, Homo sapiens
accgaaugcuucagaauau

SEQ ID NO: 1048737 - RNA, 19 nt, Homo sapiens
gagauaaucgagcugaaag

SEQ ID NO: 1048738 - RNA, 19 nt, Homo sapiens
gcaaagcgcaggccgucau

SEQ ID NO: 1048739 - RNA, 19 nt, Homo sapiens
gaauagacaggaaaagauu

SEQ ID NO: 1048740 - RNA, 19 nt, Homo sapiens
cuacauugccucaaacaca

SEQ ID NO: 1048741 - RNA, 19 nt, Homo sapiens
aaccgaaugcuucagaaua

SEQ ID NO: 1048742 - RNA, 19 nt, Homo sapiens
gaggugaucucucaaauaa

SEQ ID NO: 1048743 - RNA, 19 nt, Homo sapiens
ggacugggcuacugagaua

SEQ ID NO: 1048744 - RNA, 19 nt, Homo sapiens
gaaagggucucacgagcua

SEQ ID NO: 1048745 - RNA, 19 nt, Homo sapiens
ccacacauguugaaauuaa

SEQ ID NO: 1048746 - RNA, 19 nt, Homo sapiens
ugacaaagaucuucuacuu

SEQ ID NO: 1048747 - RNA, 19 nt, Homo sapiens
gauuuaaggucgcaaguaa

SEQ ID NO: 1048748 - RNA, 19 nt, Homo sapiens
acaaagaucuucuacuuga

SEQ ID NO: 1048749 - RNA, 19 nt, Homo sapiens
gcaaauuccuuggaguaua

SEQ ID NO: 1048750 - RNA, 19 nt, Homo sapiens
gaucugggcuugcaagaga

SEQ ID NO: 1048751 - RNA, 19 nt, Homo sapiens
gcagaaugguaacuacuuu

SEQ ID NO: 1048752 - RNA, 19 nt, Homo sapiens
agagggagauuguauuuaa

SEQ ID NO: 1048753 - RNA, 19 nt, Homo sapiens
ggugaucucucaaauaaau

SEQ ID NO: 1048754 - RNA, 19 nt, Homo sapiens
ucacugaucuucucuagga

SEQ ID NO: 1048755 - RNA, 19 nt, Homo sapiens
caaauuccuuggaguauau

SEQ ID NO: 1048756 - RNA, 19 nt, Homo sapiens
gguaacuacuuucugauuu

SEQ ID NO: 1048757 - RNA, 19 nt, Homo sapiens
gaauaggacuagauuugga

SEQ ID NO: 1048758 - RNA, 19 nt, Homo sapiens
ggaaauacuugcugaaagc

SEQ ID NO: 1048759 - RNA, 19 nt, Homo sapiens
ugaaggacuuaagcaauua

SEQ ID NO: 1048760 - RNA, 19 nt, Homo sapiens
aaacugcccuaaccuuaaa

SEQ ID NO: 1048761 - RNA, 19 nt, Homo sapiens
gaacuugaucggaaagaaa

SEQ ID NO: 1048762 - RNA, 19 nt, Homo sapiens
uaaggucgcaaguaauuua

SEQ ID NO: 1048763 - RNA, 19 nt, Homo sapiens
cugcauagcugcugggaaa

SEQ ID NO: 1048764 - RNA, 19 nt, Homo sapiens
ccaagaaccuggacacucu

SEQ ID NO: 1048765 - RNA, 19 nt, Homo sapiens
uaaaggcuauucuacacaa

SEQ ID NO: 1048766 - RNA, 19 nt, Homo sapiens
gugaagaaauggacucugu

SEQ ID NO: 1048767 - RNA, 19 nt, Homo sapiens
agaaagggcucacugaucu

SEQ ID NO: 1048768 - RNA, 19 nt, Homo sapiens
acucuucacugguaacaua

SEQ ID NO: 1048769 - RNA, 19 nt, Homo sapiens
gaaccaaaauuuuccaguu

SEQ ID NO: 1048770 - RNA, 19 nt, Homo sapiens
gugcaucacuucuguaugg

SEQ ID NO: 1048771 - RNA, 19 nt, Homo sapiens
ugaccucgaugacuuagaa

SEQ ID NO: 1048772 - RNA, 19 nt, Homo sapiens
ggauauuuguucauugguu

SEQ ID NO: 1048773 - RNA, 19 nt, Homo sapiens
gaggauauuuguucauugg

SEQ ID NO: 1048774 - RNA, 19 nt, Homo sapiens
gcacuggaguuccucaaag

SEQ ID NO: 1048775 - RNA, 19 nt, Homo sapiens
gcacuuucguuuucaauaa

SEQ ID NO: 1048776 - RNA, 19 nt, Homo sapiens
ggauaugucugugcacuca

SEQ ID NO: 1048777 - RNA, 19 nt, Homo sapiens
caaacugcccuaaccuuaa

SEQ ID NO: 1048778 - RNA, 19 nt, Homo sapiens
gauaacguauacuccagaa

SEQ ID NO: 1048779 - RNA, 19 nt, Homo sapiens
gaaggauuguaaacugaga

SEQ ID NO: 1048780 - RNA, 19 nt, Homo sapiens
ggacacucuucacugguaa

SEQ ID NO: 1048781 - RNA, 19 nt, Homo sapiens
gugaugcucuucugauuuc

SEQ ID NO: 1048782 - RNA, 19 nt, Homo sapiens
ugagugaccucgaugacuu

SEQ ID NO: 1048783 - RNA, 19 nt, Homo sapiens
ggaggauauuuguucauug

SEQ ID NO: 1048784 - RNA, 19 nt, Homo sapiens
aggcugaaauugagaauga

SEQ ID NO: 1048785 - RNA, 19 nt, Homo sapiens
uaauuuacccugaauccua

SEQ ID NO: 1048786 - RNA, 19 nt, Homo sapiens
gaagaaauggacucuguca

SEQ ID NO: 1048787 - RNA, 19 nt, Homo sapiens
gcugugcaguguuugcuaa

SEQ ID NO: 1048788 - RNA, 19 nt, Homo sapiens
aaugguaacuacuuucuga

SEQ ID NO: 1048789 - RNA, 19 nt, Homo sapiens
gguauagauugcuuucaga

SEQ ID NO: 1048790 - RNA, 19 nt, Homo sapiens
acaaacugcccuaaccuua

SEQ ID NO: 1048791 - RNA, 19 nt, Homo sapiens
gguacaggaugaggaguuu

SEQ ID NO: 1048792 - RNA, 19 nt, Homo sapiens
gaaagauaaccgugugaug

SEQ ID NO: 1048793 - RNA, 19 nt, Homo sapiens
uggaguauaugauaaagga

SEQ ID NO: 1048794 - RNA, 19 nt, Homo sapiens
gucuguaguuccugaauaa

SEQ ID NO: 1048795 - RNA, 19 nt, Homo sapiens
cuucacagauauuguuuga

SEQ ID NO: 1048796 - RNA, 19 nt, Homo sapiens
auagauugcuuucagaaga

SEQ ID NO: 1048797 - RNA, 19 nt, Homo sapiens
ggaagucuuuguggauaug

SEQ ID NO: 1048798 - RNA, 19 nt, Homo sapiens
gauggaggauauuuguuca

SEQ ID NO: 1048799 - RNA, 19 nt, Homo sapiens
uuucacuucucccuaaaua

SEQ ID NO: 1048800 - RNA, 19 nt, Homo sapiens
gauucucccucaauauguu

SEQ ID NO: 1048801 - RNA, 19 nt, Homo sapiens
augaaggacuuaagcaauu

SEQ ID NO: 1048802 - RNA, 19 nt, Homo sapiens
ucaggaaggauaacguaua

SEQ ID NO: 1048803 - RNA, 19 nt, Homo sapiens
gugcaguguuugcuaaaga

SEQ ID NO: 1048804 - RNA, 19 nt, Homo sapiens
gauggaauaggacuagauu

SEQ ID NO: 1048805 - RNA, 19 nt, Homo sapiens
ccuggcaugugaaagauaa

SEQ ID NO: 1048806 - RNA, 19 nt, Homo sapiens
aaggaagucuuuguggaua

SEQ ID NO: 1048807 - RNA, 19 nt, Homo sapiens
gagaaugaagacuauaguu

SEQ ID NO: 1048808 - RNA, 19 nt, Homo sapiens
gucgaaggcucaccugaug

SEQ ID NO: 1048809 - RNA, 19 nt, Homo sapiens
uagauugcuuucagaagaa

SEQ ID NO: 1048810 - RNA, 19 nt, Homo sapiens
caauaaaucucugcuuuug

SEQ ID NO: 1048811 - RNA, 19 nt, Homo sapiens
caauauguuucugcauuug

SEQ ID NO: 1048812 - RNA, 19 nt, Homo sapiens
guauuuaagaccagaauug

SEQ ID NO: 1048813 - RNA, 19 nt, Homo sapiens
ucacuucucccuaaauaau

SEQ ID NO: 1048814 - RNA, 19 nt, Homo sapiens
caagcugccaguaugauuu

SEQ ID NO: 1048815 - RNA, 19 nt, Homo sapiens
gcaagagaaccacaaaguc

SEQ ID NO: 1048816 - RNA, 19 nt, Homo sapiens
gcucacugaucuucucuag

SEQ ID NO: 1048817 - RNA, 19 nt, Homo sapiens
ggaaggaauggauccaguu

SEQ ID NO: 1048818 - RNA, 19 nt, Homo sapiens
ccuaaauaaucuucacaga

SEQ ID NO: 1048819 - RNA, 19 nt, Homo sapiens
gaaggaaauacuugcugaa

SEQ ID NO: 1048820 - RNA, 19 nt, Homo sapiens
gacaaagaucuucuacuug

SEQ ID NO: 1048821 - RNA, 19 nt, Homo sapiens
cagaaaaccuuugcagaaa

SEQ ID NO: 1048822 - RNA, 19 nt, Homo sapiens
caggaaggauaacguauac

SEQ ID NO: 1048823 - RNA, 19 nt, Homo sapiens
gaaggaauggauccaguuc

SEQ ID NO: 1048824 - RNA, 19 nt, Homo sapiens
cucaauauguuucugcauu

SEQ ID NO: 1048825 - RNA, 19 nt, Homo sapiens
aaugaaggauuguaaacug

SEQ ID NO: 1048826 - RNA, 19 nt, Homo sapiens
ggagagaacaguaggaaaa

SEQ ID NO: 1048827 - RNA, 19 nt, Homo sapiens
ccaaguaacaagugggaaa

SEQ ID NO: 1048828 - RNA, 19 nt, Homo sapiens
ggagugcacuuucguuuuc

SEQ ID NO: 1048829 - RNA, 19 nt, Homo sapiens
uggacacucuucacuggua

SEQ ID NO: 1048830 - RNA, 19 nt, Homo sapiens
ugucuguaguuccugaaua

SEQ ID NO: 1048831 - RNA, 19 nt, Homo sapiens
uaaagcagaagcuggcaaa

SEQ ID NO: 1048832 - RNA, 19 nt, Homo sapiens
ggaaggauaacguauacuc

SEQ ID NO: 1048833 - RNA, 19 nt, Homo sapiens
ccugauuccuggcauguga

SEQ ID NO: 1048834 - RNA, 19 nt, Homo sapiens
gcuccuauuucauuuacau

SEQ ID NO: 1048835 - RNA, 19 nt, Homo sapiens
uggaggauauuuguucauu

SEQ ID NO: 1048836 - RNA, 19 nt, Homo sapiens
cuagagggagauuguauuu

SEQ ID NO: 1048837 - RNA, 19 nt, Homo sapiens
gcacaccaaguaacaagug

SEQ ID NO: 1048838 - RNA, 19 nt, Homo sapiens
uggaauaggacuagauuug

SEQ ID NO: 1048839 - RNA, 19 nt, Homo sapiens
agauauuguuugagggaua

SEQ ID NO: 1048840 - RNA, 19 nt, Homo sapiens
cgaguugguucuagaugug

SEQ ID NO: 1048841 - RNA, 19 nt, Homo sapiens
ccagauaaucgguauagau

SEQ ID NO: 1048842 - RNA, 19 nt, Homo sapiens
ggagggaguuuauuaguua

SEQ ID NO: 1048843 - RNA, 19 nt, Homo sapiens
ggaaacagcugauccagaa

SEQ ID NO: 1048844 - RNA, 19 nt, Homo sapiens
gaaaugaucauccaguuug

SEQ ID NO: 1048845 - RNA, 19 nt, Homo sapiens
caaagagacugacaaagug

SEQ ID NO: 1048846 - RNA, 19 nt, Homo sapiens
ccuggaagcuuuagaauau

SEQ ID NO: 1048847 - RNA, 19 nt, Homo sapiens
gaaagaguccagaaacaaa

SEQ ID NO: 1048848 - RNA, 19 nt, Homo sapiens
uaugguagauugaggauuu

SEQ ID NO: 1048849 - RNA, 19 nt, Homo sapiens
cuaaacaacucucugaaau

SEQ ID NO: 1048850 - RNA, 19 nt, Homo sapiens
ggagaugugugaccagaga

SEQ ID NO: 1048851 - RNA, 19 nt, Homo sapiens
acagaggugucccugauua

SEQ ID NO: 1048852 - RNA, 19 nt, Homo sapiens
agaagucucugaagaaaga

SEQ ID NO: 1048853 - RNA, 19 nt, Homo sapiens
gguaacacuucucuauauu

SEQ ID NO: 1048854 - RNA, 19 nt, Homo sapiens
gcagaaagaaugcuuggaa

SEQ ID NO: 1048855 - RNA, 19 nt, Homo sapiens
ucaccuaccuguuucagaa

SEQ ID NO: 1048856 - RNA, 19 nt, Homo sapiens
gaagcuugcugucaucauc

SEQ ID NO: 1048857 - RNA, 19 nt, Homo sapiens
gguacgagguggauuacaa

SEQ ID NO: 1048858 - RNA, 19 nt, Homo sapiens
cagaaagaaugcuuggaaa

SEQ ID NO: 1048859 - RNA, 19 nt, Homo sapiens
ggaggaccacuuucugaua

SEQ ID NO: 1048860 - RNA, 19 nt, Homo sapiens
ggaaacagaugcgacucaa

SEQ ID NO: 1048861 - RNA, 19 nt, Homo sapiens
ggaaaugaucauccaguuu

SEQ ID NO: 1048862 - RNA, 19 nt, Homo sapiens
caaauaucguugagaggaa

SEQ ID NO: 1048863 - RNA, 19 nt, Homo sapiens
gaggaccacuuucugauag

SEQ ID NO: 1048864 - RNA, 19 nt, Homo sapiens
uagaaacccuccucugaau

SEQ ID NO: 1048865 - RNA, 19 nt, Homo sapiens
guaauacggcaauaaggua

SEQ ID NO: 1048866 - RNA, 19 nt, Homo sapiens
aaacauggaggaccacuuu

SEQ ID NO: 1048867 - RNA, 19 nt, Homo sapiens
gccaggagauccacaagga

SEQ ID NO: 1048868 - RNA, 19 nt, Homo sapiens
aaacaaagagacugacaaa

SEQ ID NO: 1048869 - RNA, 19 nt, Homo sapiens
gaagaaagaguccagaaac

SEQ ID NO: 1048870 - RNA, 19 nt, Homo sapiens
gaccagagacacaauauca

SEQ ID NO: 1048871 - RNA, 19 nt, Homo sapiens
cagccuaccucacuaacuu

SEQ ID NO: 1048872 - RNA, 19 nt, Homo sapiens
gggagaagaucggccugua

SEQ ID NO: 1048873 - RNA, 19 nt, Homo sapiens
ccuaauuccuuaagauaga

SEQ ID NO: 1048874 - RNA, 19 nt, Homo sapiens
aaagaaugcuuggaaacuu

SEQ ID NO: 1048875 - RNA, 19 nt, Homo sapiens
acaaagagacugacaaagu

SEQ ID NO: 1048876 - RNA, 19 nt, Homo sapiens
gcaaugauacuaaacaacu

SEQ ID NO: 1048877 - RNA, 19 nt, Homo sapiens
uaagauagaugcaaaaugg

SEQ ID NO: 1048878 - RNA, 19 nt, Homo sapiens
gcuauggaguuuucuauaa

SEQ ID NO: 1048879 - RNA, 19 nt, Homo sapiens
ccucagaguuguucaucuu

SEQ ID NO: 1048880 - RNA, 19 nt, Homo sapiens
aaaccuggauggagaagga

SEQ ID NO: 1048881 - RNA, 19 nt, Homo sapiens
cagaguacauggaaaugau

SEQ ID NO: 1048882 - RNA, 19 nt, Homo sapiens
gaaacaaagagacugacaa

SEQ ID NO: 1048883 - RNA, 19 nt, Homo sapiens
gacaagaccugcagcuacu

SEQ ID NO: 1048884 - RNA, 19 nt, Homo sapiens
cagcaaugauacuaaacaa

SEQ ID NO: 1048885 - RNA, 19 nt, Homo sapiens
ugguaacacuucucuauau

SEQ ID NO: 1048886 - RNA, 19 nt, Homo sapiens
gagggaguuuauuaguuaa

SEQ ID NO: 1048887 - RNA, 19 nt, Homo sapiens
ugaaguuugugaauuccua

SEQ ID NO: 1048888 - RNA, 19 nt, Homo sapiens
gaggagaggcugaucuuca

SEQ ID NO: 1048889 - RNA, 19 nt, Homo sapiens
gaaaacuccuguacgaaga

SEQ ID NO: 1048890 - RNA, 19 nt, Homo sapiens
gaaagaaugcuuggaaacu

SEQ ID NO: 1048891 - RNA, 19 nt, Homo sapiens
gaaucauugucuuccugua

SEQ ID NO: 1048892 - RNA, 19 nt, Homo sapiens
gaugaccucggaagcauuu

SEQ ID NO: 1048893 - RNA, 19 nt, Homo sapiens
gagaugaccucggaagcau

SEQ ID NO: 1048894 - RNA, 19 nt, Homo sapiens
gaaaacccacgcaagaaua

SEQ ID NO: 1048895 - RNA, 19 nt, Homo sapiens
gugcgaugcuucagggaaa

SEQ ID NO: 1048896 - RNA, 19 nt, Homo sapiens
aaacuugagucucccuaga

SEQ ID NO: 1048897 - RNA, 19 nt, Homo sapiens
aaaccaagucucauaaaug

SEQ ID NO: 1048898 - RNA, 19 nt, Homo sapiens
ugagugaucuaaauuugca

SEQ ID NO: 1048899 - RNA, 19 nt, Homo sapiens
ccaaagacaucggaaucug

SEQ ID NO: 1048900 - RNA, 19 nt, Homo sapiens
ccuagaaacccuccucuga

SEQ ID NO: 1048901 - RNA, 19 nt, Homo sapiens
aagaaugcuuggaaacuug

SEQ ID NO: 1048902 - RNA, 19 nt, Homo sapiens
gaacaacaucaucgagauc

SEQ ID NO: 1048903 - RNA, 19 nt, Homo sapiens
ugaacaacaucaucgagau

SEQ ID NO: 1048904 - RNA, 19 nt, Homo sapiens
aagaaagaguccagaaaca

SEQ ID NO: 1048905 - RNA, 19 nt, Homo sapiens
uccuagagcugaauacgaa

SEQ ID NO: 1048906 - RNA, 19 nt, Homo sapiens
ugaagaaagaguccagaaa

SEQ ID NO: 1048907 - RNA, 19 nt, Homo sapiens
uggagggaguuuauuaguu

SEQ ID NO: 1048908 - RNA, 19 nt, Homo sapiens
ccaagucgaccucagaguu

SEQ ID NO: 1048909 - RNA, 19 nt, Homo sapiens
caaaaccgguugaccagaa

SEQ ID NO: 1048910 - RNA, 19 nt, Homo sapiens
caagucgaccucagaguug

SEQ ID NO: 1048911 - RNA, 19 nt, Homo sapiens
gcuacgaggugcagaucug

SEQ ID NO: 1048912 - RNA, 19 nt, Homo sapiens
agaggaggcugucaaggau

SEQ ID NO: 1048913 - RNA, 19 nt, Homo sapiens
cuagaaacccuccucugaa

SEQ ID NO: 1048914 - RNA, 19 nt, Homo sapiens
ggcaggugcuuugcagaaa

SEQ ID NO: 1048915 - RNA, 19 nt, Homo sapiens
agaaggagcggcagaagga

SEQ ID NO: 1048916 - RNA, 19 nt, Homo sapiens
uuacguggcguucuucaaa

SEQ ID NO: 1048917 - RNA, 19 nt, Homo sapiens
cuucuucucugucuucaug

SEQ ID NO: 1048918 - RNA, 19 nt, Homo sapiens
acaacucucugaaauuucu

SEQ ID NO: 1048919 - RNA, 19 nt, Homo sapiens
gagcagaggccccuagaaa

SEQ ID NO: 1048920 - RNA, 19 nt, Homo sapiens
ucuguaguauucaagauga

SEQ ID NO: 1048921 - RNA, 19 nt, Homo sapiens
aucggaaucugguacaaua

SEQ ID NO: 1048922 - RNA, 19 nt, Homo sapiens
auacgaagccagagucuug

SEQ ID NO: 1048923 - RNA, 19 nt, Homo sapiens
gcagcaaugauacuaaaca

SEQ ID NO: 1048924 - RNA, 19 nt, Homo sapiens
acgcaagaauaaugauuga

SEQ ID NO: 1048925 - RNA, 19 nt, Homo sapiens
ggaccacuuucugauagga

SEQ ID NO: 1048926 - RNA, 19 nt, Homo sapiens
ccagaaacaaagagacuga

SEQ ID NO: 1048927 - RNA, 19 nt, Homo sapiens
ggaccucacgggcuuugaa

SEQ ID NO: 1048928 - RNA, 19 nt, Homo sapiens
gaaaaugggcagagagaga

SEQ ID NO: 1048929 - RNA, 19 nt, Homo sapiens
gaguuguucaucuuccuua

SEQ ID NO: 1048930 - RNA, 19 nt, Homo sapiens
ucaaaaugauggcugguaa

SEQ ID NO: 1048931 - RNA, 19 nt, Homo sapiens
gcgacuacguguacauuuu

SEQ ID NO: 1048932 - RNA, 19 nt, Homo sapiens
aggagaggcugaucuucaa

SEQ ID NO: 1048933 - RNA, 19 nt, Homo sapiens
cccgauggcucaccaagau

SEQ ID NO: 1048934 - RNA, 19 nt, Homo sapiens
gguaauacggcaauaaggu

SEQ ID NO: 1048935 - RNA, 19 nt, Homo sapiens
cauuaugcagggaauauuu

SEQ ID NO: 1048936 - RNA, 19 nt, Homo sapiens
ggaagaggaggcugucaag

SEQ ID NO: 1048937 - RNA, 19 nt, Homo sapiens
ccagccaccucuucgacaa

SEQ ID NO: 1048938 - RNA, 19 nt, Homo sapiens
gcaaaggccaggaggaaaa

SEQ ID NO: 1048939 - RNA, 19 nt, Homo sapiens
caaagguggagggaguuua

SEQ ID NO: 1048940 - RNA, 19 nt, Homo sapiens
gaagagugggcacgcuaug

SEQ ID NO: 1048941 - RNA, 19 nt, Homo sapiens
ccaccgcagucaucaucaa

SEQ ID NO: 1048942 - RNA, 19 nt, Homo sapiens
gaucaaagccgaguacuua

SEQ ID NO: 1048943 - RNA, 19 nt, Homo sapiens
ggaguucgcucuugcguuu

SEQ ID NO: 1048944 - RNA, 19 nt, Homo sapiens
gcacuuaucucugggaaau

SEQ ID NO: 1048945 - RNA, 19 nt, Homo sapiens
caacagagaagaugaagaa

SEQ ID NO: 1048946 - RNA, 19 nt, Homo sapiens
gaagacagacccagccuuu

SEQ ID NO: 1048947 - RNA, 19 nt, Homo sapiens
gagagaaugcugaaucuuu

SEQ ID NO: 1048948 - RNA, 19 nt, Homo sapiens
ggaggaagcugagacaaca

SEQ ID NO: 1048949 - RNA, 19 nt, Homo sapiens
gaagaugaagaaaggguua

SEQ ID NO: 1048950 - RNA, 19 nt, Homo sapiens
gagcugaacucggauagug

SEQ ID NO: 1048951 - RNA, 19 nt, Homo sapiens
guacagagcggugaucaaa

SEQ ID NO: 1048952 - RNA, 19 nt, Homo sapiens
gcagauggcacuuuccaaa

SEQ ID NO: 1048953 - RNA, 19 nt, Homo sapiens
gguuguuugugcaauauua

SEQ ID NO: 1048954 - RNA, 19 nt, Homo sapiens
cauacucuguccauacaua

SEQ ID NO: 1048955 - RNA, 19 nt, Homo sapiens
cuauaaaguccaucaguua

SEQ ID NO: 1048956 - RNA, 19 nt, Homo sapiens
gcacagcugagcccuauga

SEQ ID NO: 1048957 - RNA, 19 nt, Homo sapiens
gcaucgguauuucuauaaa

SEQ ID NO: 1048958 - RNA, 19 nt, Homo sapiens
cagagaagaugaagaaagg

SEQ ID NO: 1048959 - RNA, 19 nt, Homo sapiens
ggaaggggcucucuaaauc

SEQ ID NO: 1048960 - RNA, 19 nt, Homo sapiens
aagagaaucuggugacuuc

SEQ ID NO: 1048961 - RNA, 19 nt, Homo sapiens
gaacuugaaacucucauca

SEQ ID NO: 1048962 - RNA, 19 nt, Homo sapiens
ccagcaaccuacuguaaug

SEQ ID NO: 1048963 - RNA, 19 nt, Homo sapiens
ugacccaccuccuuccuuu

SEQ ID NO: 1048964 - RNA, 19 nt, Homo sapiens
ggaaagaaaggcucaagca

SEQ ID NO: 1048965 - RNA, 19 nt, Homo sapiens
uggcaucgguauuucuaua

SEQ ID NO: 1048966 - RNA, 19 nt, Homo sapiens
gaucucagagcuccuugua

SEQ ID NO: 1048967 - RNA, 19 nt, Homo sapiens
ucuauaaaguccaucaguu

SEQ ID NO: 1048968 - RNA, 19 nt, Homo sapiens
ucugaagccuuggaguuua

SEQ ID NO: 1048969 - RNA, 19 nt, Homo sapiens
caacauacucuguccauac

SEQ ID NO: 1048970 - RNA, 19 nt, Homo sapiens
gagcaucucccucgugaca

SEQ ID NO: 1048971 - RNA, 19 nt, Homo sapiens
ugaagaaaggguuaucuga

SEQ ID NO: 1048972 - RNA, 19 nt, Homo sapiens
caagggagaggaaaccuau

SEQ ID NO: 1048973 - RNA, 19 nt, Homo sapiens
aggguuaucugacuuccua

SEQ ID NO: 1048974 - RNA, 19 nt, Homo sapiens
gaaaggguuaucugacuuc

SEQ ID NO: 1048975 - RNA, 19 nt, Homo sapiens
ugaggucacuuccacuuca

SEQ ID NO: 1048976 - RNA, 19 nt, Homo sapiens
cagggacagugaacacauu

SEQ ID NO: 1048977 - RNA, 19 nt, Homo sapiens
uacauucccugaaggagaa

SEQ ID NO: 1048978 - RNA, 19 nt, Homo sapiens
gagcaacagagaagaugaa

SEQ ID NO: 1048979 - RNA, 19 nt, Homo sapiens
ucccagggcuucuucaugu

SEQ ID NO: 1048980 - RNA, 19 nt, Homo sapiens
gaagagaaucuggugacuu

SEQ ID NO: 1048981 - RNA, 19 nt, Homo sapiens
gacuuugacuuggacauga

SEQ ID NO: 1048982 - RNA, 19 nt, Homo sapiens
acuuaucucugggaaauuu

SEQ ID NO: 1048983 - RNA, 19 nt, Homo sapiens
gagcuaccaagcagucaaa

SEQ ID NO: 1048984 - RNA, 19 nt, Homo sapiens
gaagcuaaaccaccagucu

SEQ ID NO: 1048985 - RNA, 19 nt, Homo sapiens
gcaucucccucgugacaca

SEQ ID NO: 1048986 - RNA, 19 nt, Homo sapiens
gaggagcucaugggcauuu

SEQ ID NO: 1048987 - RNA, 19 nt, Homo sapiens
agaaaggguuaucugacuu

SEQ ID NO: 1048988 - RNA, 19 nt, Homo sapiens
caaagccgaguacuuacaa

SEQ ID NO: 1048989 - RNA, 19 nt, Homo sapiens
uaaaguccaucaguuagag

SEQ ID NO: 1048990 - RNA, 19 nt, Homo sapiens
gaggucacuuccacuucaa

SEQ ID NO: 1048991 - RNA, 19 nt, Homo sapiens
aagaaaggguuaucugacu

SEQ ID NO: 1048992 - RNA, 19 nt, Homo sapiens
agagaaugcugaaucuuuu

SEQ ID NO: 1048993 - RNA, 19 nt, Homo sapiens
agacagacccagccuuugu

SEQ ID NO: 1048994 - RNA, 19 nt, Homo sapiens
gcaaccuacuguaaugaac

SEQ ID NO: 1048995 - RNA, 19 nt, Homo sapiens
uggcacagcugagcccuau

SEQ ID NO: 1048996 - RNA, 19 nt, Homo sapiens
acaacauacucuguccaua

SEQ ID NO: 1048997 - RNA, 19 nt, Homo sapiens
ggaggaagaggagcucaug

SEQ ID NO: 1048998 - RNA, 19 nt, Homo sapiens
uuuacagacuugccguuaa

SEQ ID NO: 1048999 - RNA, 19 nt, Homo sapiens
ggacccagcaaccuacugu

SEQ ID NO: 1049000 - RNA, 19 nt, Homo sapiens
ggagcaacagagaagauga

SEQ ID NO: 1049001 - RNA, 19 nt, Homo sapiens
ggucagggacaccgagaga

SEQ ID NO: 1049002 - RNA, 19 nt, Homo sapiens
ccuggaagacugagaaugu

SEQ ID NO: 1049003 - RNA, 19 nt, Homo sapiens
ggaagucuacacccuccaa

SEQ ID NO: 1049004 - RNA, 19 nt, Homo sapiens
gaggugacuccaucagaga

SEQ ID NO: 1049005 - RNA, 19 nt, Homo sapiens
uuacagacuugccguuaac

SEQ ID NO: 1049006 - RNA, 19 nt, Homo sapiens
ccucagcccuucugcuucu

SEQ ID NO: 1049007 - RNA, 19 nt, Homo sapiens
acagagcggugaucaaagc

SEQ ID NO: 1049008 - RNA, 19 nt, Homo sapiens
caagcacggacaucaguga

SEQ ID NO: 1049009 - RNA, 19 nt, Homo sapiens
ucuacacccuccaacaaug

SEQ ID NO: 1049010 - RNA, 19 nt, Homo sapiens
cugaagccuuggaguuuau

SEQ ID NO: 1049011 - RNA, 19 nt, Homo sapiens
ccaccuacccuuggcuaaa

SEQ ID NO: 1049012 - RNA, 19 nt, Homo sapiens
aacauacucuguccauaca

SEQ ID NO: 1049013 - RNA, 19 nt, Homo sapiens
ggauaguucuagcccuucu

SEQ ID NO: 1049014 - RNA, 19 nt, Homo sapiens
ccacagacuuacggguguu

SEQ ID NO: 1049015 - RNA, 19 nt, Homo sapiens
ggcaucgguauuucuauaa

SEQ ID NO: 1049016 - RNA, 19 nt, Homo sapiens
gaacuuuguccugaaccuu

SEQ ID NO: 1049017 - RNA, 19 nt, Homo sapiens
ccagcguggucaaggagaa

SEQ ID NO: 1049018 - RNA, 19 nt, Homo sapiens
caucgguauuucuauaaag

SEQ ID NO: 1049019 - RNA, 19 nt, Homo sapiens
ggauggagagaaugcugaa

SEQ ID NO: 1049020 - RNA, 19 nt, Homo sapiens
guagacagaagcuaaacca

SEQ ID NO: 1049021 - RNA, 19 nt, Homo sapiens
ccaagggagaggaaaccua

SEQ ID NO: 1049022 - RNA, 19 nt, Homo sapiens
cacgagugcuacccaagga

SEQ ID NO: 1049023 - RNA, 19 nt, Homo sapiens
aaagguuccuguggccaaa

SEQ ID NO: 1049024 - RNA, 19 nt, Homo sapiens
cuacuguaaugaaccagau

SEQ ID NO: 1049025 - RNA, 19 nt, Homo sapiens
uggagagaaugcugaaucu

SEQ ID NO: 1049026 - RNA, 19 nt, Homo sapiens
uggagagccuggugcuuca

SEQ ID NO: 1049027 - RNA, 19 nt, Homo sapiens
cagaugcacccaaguccuu

SEQ ID NO: 1049028 - RNA, 19 nt, Homo sapiens
gcuaaacagggacagugaa

SEQ ID NO: 1049029 - RNA, 19 nt, Homo sapiens
ggccaaaauuucuacauuc

SEQ ID NO: 1049030 - RNA, 19 nt, Homo sapiens
gcugggaggaggaggaaga

SEQ ID NO: 1049031 - RNA, 19 nt, Homo sapiens
uauaaaguccaucaguuag

SEQ ID NO: 1049032 - RNA, 19 nt, Homo sapiens
accaagcagucaaagagaa

SEQ ID NO: 1049033 - RNA, 19 nt, Homo sapiens
gcaacagagaagaugaaga

SEQ ID NO: 1049034 - RNA, 19 nt, Homo sapiens
ggugauucuuguaccuaau

SEQ ID NO: 1049035 - RNA, 19 nt, Homo sapiens
cuaccaagcagucaaagag

SEQ ID NO: 1049036 - RNA, 19 nt, Homo sapiens
ggacagugaacacauuuug

SEQ ID NO: 1049037 - RNA, 19 nt, Homo sapiens
uuugguuguuugugcaaua

SEQ ID NO: 1049038 - RNA, 19 nt, Homo sapiens
ggagagaaugcugaaucuu

SEQ ID NO: 1049039 - RNA, 19 nt, Homo sapiens
uggugauucuuguaccuaa

SEQ ID NO: 1049040 - RNA, 19 nt, Homo sapiens
cuggaagacugagaauguu

SEQ ID NO: 1049041 - RNA, 19 nt, Homo sapiens
gggcauuucacccauaucu

SEQ ID NO: 1049042 - RNA, 19 nt, Homo sapiens
gaaauagugugcuggcuuu

SEQ ID NO: 1049043 - RNA, 19 nt, Homo sapiens
ggaucacucuuuaucauua

SEQ ID NO: 1049044 - RNA, 19 nt, Homo sapiens
ggaugaagaugaagacaaa

SEQ ID NO: 1049045 - RNA, 19 nt, Homo sapiens
gaagauggguuggaagaaa

SEQ ID NO: 1049046 - RNA, 19 nt, Homo sapiens
ugaaauagccuaaguaaug

SEQ ID NO: 1049047 - RNA, 19 nt, Homo sapiens
gcauggagaugaagucaaa

SEQ ID NO: 1049048 - RNA, 19 nt, Homo sapiens
gaacagguaacauauugua

SEQ ID NO: 1049049 - RNA, 19 nt, Homo sapiens
gaaauagccuaaguaaugu

SEQ ID NO: 1049050 - RNA, 19 nt, Homo sapiens
cagauaggaucacucuuua

SEQ ID NO: 1049051 - RNA, 19 nt, Homo sapiens
gcagauaggaucacucuuu

SEQ ID NO: 1049052 - RNA, 19 nt, Homo sapiens
caacaaaggucggaagaug

SEQ ID NO: 1049053 - RNA, 19 nt, Homo sapiens
gcacaauuguuaauggaaa

SEQ ID NO: 1049054 - RNA, 19 nt, Homo sapiens
ucagaaauguguaugguuu

SEQ ID NO: 1049055 - RNA, 19 nt, Homo sapiens
cgagagcgguuuacugaaa

SEQ ID NO: 1049056 - RNA, 19 nt, Homo sapiens
ugaagaaucuguugcuaug

SEQ ID NO: 1049057 - RNA, 19 nt, Homo sapiens
gaaccaauuuaugcaguaa

SEQ ID NO: 1049058 - RNA, 19 nt, Homo sapiens
gaaaagacauugaagaauc

SEQ ID NO: 1049059 - RNA, 19 nt, Homo sapiens
caauguaacugcagaagau

SEQ ID NO: 1049060 - RNA, 19 nt, Homo sapiens
gagaaacugucuuauccuu

SEQ ID NO: 1049061 - RNA, 19 nt, Homo sapiens
guucuugucuccauauauu

SEQ ID NO: 1049062 - RNA, 19 nt, Homo sapiens
caaaauggcacaauuguua

SEQ ID NO: 1049063 - RNA, 19 nt, Homo sapiens
gaaggaugguggaggaaug

SEQ ID NO: 1049064 - RNA, 19 nt, Homo sapiens
cuaaugaacagguaacaua

SEQ ID NO: 1049065 - RNA, 19 nt, Homo sapiens
cauguaagaugcacaacaa

SEQ ID NO: 1049066 - RNA, 19 nt, Homo sapiens
aagaaucuguugcuaugua

SEQ ID NO: 1049067 - RNA, 19 nt, Homo sapiens
gcuauguacuguauauuca

SEQ ID NO: 1049068 - RNA, 19 nt, Homo sapiens
gguaguggcgcauacauuu

SEQ ID NO: 1049069 - RNA, 19 nt, Homo sapiens
aauagugacugaaccaauu

SEQ ID NO: 1049070 - RNA, 19 nt, Homo sapiens
gaaauuacagacucucaga

SEQ ID NO: 1049071 - RNA, 19 nt, Homo sapiens
auaagcaacuagccauaua

SEQ ID NO: 1049072 - RNA, 19 nt, Homo sapiens
ggaagauguuggagaagau

SEQ ID NO: 1049073 - RNA, 19 nt, Homo sapiens
gcaacuagccauauaagca

SEQ ID NO: 1049074 - RNA, 19 nt, Homo sapiens
gaauacagaauacgaagau

SEQ ID NO: 1049075 - RNA, 19 nt, Homo sapiens
cagguaacauauuguagaa

SEQ ID NO: 1049076 - RNA, 19 nt, Homo sapiens
cuauacgcauccucauuua

SEQ ID NO: 1049077 - RNA, 19 nt, Homo sapiens
gagaagauggguuggaaga

SEQ ID NO: 1049078 - RNA, 19 nt, Homo sapiens
ggaacauacucuccgaauc

SEQ ID NO: 1049079 - RNA, 19 nt, Homo sapiens
uaaaugugacccuuacgua

SEQ ID NO: 1049080 - RNA, 19 nt, Homo sapiens
aaacuaaaugugacccuua

SEQ ID NO: 1049081 - RNA, 19 nt, Homo sapiens
cauccucaauugcaauaaa

SEQ ID NO: 1049082 - RNA, 19 nt, Homo sapiens
ugacuuaaguguacaucug

SEQ ID NO: 1049083 - RNA, 19 nt, Homo sapiens
gucauuagaucaccugugu

SEQ ID NO: 1049084 - RNA, 19 nt, Homo sapiens
ugaaccaauuuaugcagua

SEQ ID NO: 1049085 - RNA, 19 nt, Homo sapiens
gggagcagguuggaaguga

SEQ ID NO: 1049086 - RNA, 19 nt, Homo sapiens
gaacauacucuccgaaucc

SEQ ID NO: 1049087 - RNA, 19 nt, Homo sapiens
gauaugaacaacugaauac

SEQ ID NO: 1049088 - RNA, 19 nt, Homo sapiens
gaacuacuaaugacuuaag

SEQ ID NO: 1049089 - RNA, 19 nt, Homo sapiens
gcacggaugaguuuaucaa

SEQ ID NO: 1049090 - RNA, 19 nt, Homo sapiens
gauguucaccuucuccaaa

SEQ ID NO: 1049091 - RNA, 19 nt, Homo sapiens
gaucaccuguguugcagau

SEQ ID NO: 1049092 - RNA, 19 nt, Homo sapiens
cagaagauagugaggauga

SEQ ID NO: 1049093 - RNA, 19 nt, Homo sapiens
ugucuuauccuuucacauu

SEQ ID NO: 1049094 - RNA, 19 nt, Homo sapiens
caacuagccauauaagcaa

SEQ ID NO: 1049095 - RNA, 19 nt, Homo sapiens
cugcaucuguucauucuga

SEQ ID NO: 1049096 - RNA, 19 nt, Homo sapiens
gaaggcuaaucauagaaag

SEQ ID NO: 1049097 - RNA, 19 nt, Homo sapiens
gcaauguaacugcagaaga

SEQ ID NO: 1049098 - RNA, 19 nt, Homo sapiens
cacgagagcgguuuacuga

SEQ ID NO: 1049099 - RNA, 19 nt, Homo sapiens
gucggaagauguuggagaa

SEQ ID NO: 1049100 - RNA, 19 nt, Homo sapiens
gaaauuacugauagcaaca

SEQ ID NO: 1049101 - RNA, 19 nt, Homo sapiens
ggagcagguuggaagugaa

SEQ ID NO: 1049102 - RNA, 19 nt, Homo sapiens
augaacagguaacauauug

SEQ ID NO: 1049103 - RNA, 19 nt, Homo sapiens
acuaaugacuuaaguguac

SEQ ID NO: 1049104 - RNA, 19 nt, Homo sapiens
gagugaaggcuaaucauag

SEQ ID NO: 1049105 - RNA, 19 nt, Homo sapiens
cggaagauguuggagaaga

SEQ ID NO: 1049106 - RNA, 19 nt, Homo sapiens
guuauguccuuguggauca

SEQ ID NO: 1049107 - RNA, 19 nt, Homo sapiens
gaaguuggugucaguaagu

SEQ ID NO: 1049108 - RNA, 19 nt, Homo sapiens
gaauugugccagagaaauc

SEQ ID NO: 1049109 - RNA, 19 nt, Homo sapiens
guugcuauguacuguauau

SEQ ID NO: 1049110 - RNA, 19 nt, Homo sapiens
guguaugguuugcagcuuu

SEQ ID NO: 1049111 - RNA, 19 nt, Homo sapiens
ugucacaguuuaccucuuc

SEQ ID NO: 1049112 - RNA, 19 nt, Homo sapiens
aggcaaaccauccucauuu

SEQ ID NO: 1049113 - RNA, 19 nt, Homo sapiens
uaggaucacucuuuaucau

SEQ ID NO: 1049114 - RNA, 19 nt, Homo sapiens
uaagcaacuagccauauaa

SEQ ID NO: 1049115 - RNA, 19 nt, Homo sapiens
gcaguaaauagacuaaagu

SEQ ID NO: 1049116 - RNA, 19 nt, Homo sapiens
acgaagccauuaccaguga

SEQ ID NO: 1049117 - RNA, 19 nt, Homo sapiens
agugaaggcuaaucauaga

SEQ ID NO: 1049118 - RNA, 19 nt, Homo sapiens
agagugaaggcuaaucaua

SEQ ID NO: 1049119 - RNA, 19 nt, Homo sapiens
gaaaacauccucaauugca

SEQ ID NO: 1049120 - RNA, 19 nt, Homo sapiens
agacugaggauaguuauga

SEQ ID NO: 1049121 - RNA, 19 nt, Homo sapiens
gagcccaccuucgccuuga

SEQ ID NO: 1049122 - RNA, 19 nt, Homo sapiens
gaucaaggcagucaaaaug

SEQ ID NO: 1049123 - RNA, 19 nt, Homo sapiens
cauuagaucaccuguguug

SEQ ID NO: 1049124 - RNA, 19 nt, Homo sapiens
aagaacuaaugaacaggua

SEQ ID NO: 1049125 - RNA, 19 nt, Homo sapiens
gcgcauacauuuuguuauc

SEQ ID NO: 1049126 - RNA, 19 nt, Homo sapiens
gaccaugccuuggguaaaa

SEQ ID NO: 1049127 - RNA, 19 nt, Homo sapiens
gcacgagagcgguuuacug

SEQ ID NO: 1049128 - RNA, 19 nt, Homo sapiens
aaacgccgauccagcuuca

SEQ ID NO: 1049129 - RNA, 19 nt, Homo sapiens
cauagcuaaugagguauuu

SEQ ID NO: 1049130 - RNA, 19 nt, Homo sapiens
auacgcauccucauuuauu

SEQ ID NO: 1049131 - RNA, 19 nt, Homo sapiens
guaaacccugcuacaauug

SEQ ID NO: 1049132 - RNA, 19 nt, Homo sapiens
ggaauugugccagagaaau

SEQ ID NO: 1049133 - RNA, 19 nt, Homo sapiens
ugacugaaccaauuuaugc

SEQ ID NO: 1049134 - RNA, 19 nt, Homo sapiens
ugaaggcuaaucauagaaa

SEQ ID NO: 1049135 - RNA, 19 nt, Homo sapiens
uggagaagauggguuggaa

SEQ ID NO: 1049136 - RNA, 19 nt, Homo sapiens
acaaaggucggaagauguu

SEQ ID NO: 1049137 - RNA, 19 nt, Homo sapiens
gagaugaagucaaaauugg

SEQ ID NO: 1049138 - RNA, 19 nt, Homo sapiens
ccgaaucccugaaguuggu

SEQ ID NO: 1049139 - RNA, 19 nt, Homo sapiens
ugaggauaguuaugacgaa

SEQ ID NO: 1049140 - RNA, 19 nt, Homo sapiens
ccucauuuauucccuuuag

SEQ ID NO: 1049141 - RNA, 19 nt, Homo sapiens
acuauacgcauccucauuu

SEQ ID NO: 1049142 - RNA, 19 nt, Homo sapiens
ggauuacacuucaagauua

SEQ ID NO: 1049143 - RNA, 19 nt, Homo sapiens
ucacuuaacugguguaauu

SEQ ID NO: 1049144 - RNA, 19 nt, Homo sapiens
ggacagugaucauuagaaa

SEQ ID NO: 1049145 - RNA, 19 nt, Homo sapiens
gaacaagguugaggagaaa

SEQ ID NO: 1049146 - RNA, 19 nt, Homo sapiens
gaacugaagagaauuauug

SEQ ID NO: 1049147 - RNA, 19 nt, Homo sapiens
gcacaagaguguaauggaa

SEQ ID NO: 1049148 - RNA, 19 nt, Homo sapiens
gacaggagcuugaaauugu

SEQ ID NO: 1049149 - RNA, 19 nt, Homo sapiens
gaagaacugaagagaauua

SEQ ID NO: 1049150 - RNA, 19 nt, Homo sapiens
gcagugagguccuaaagug

SEQ ID NO: 1049151 - RNA, 19 nt, Homo sapiens
uuagcaagcuuaaugguua

SEQ ID NO: 1049152 - RNA, 19 nt, Homo sapiens
gagacuaggucauuaggaa

SEQ ID NO: 1049153 - RNA, 19 nt, Homo sapiens
caaaugaggccuacugauu

SEQ ID NO: 1049154 - RNA, 19 nt, Homo sapiens
gaagauacuuuagguggaa

SEQ ID NO: 1049155 - RNA, 19 nt, Homo sapiens
ucugauagauuuccucuuu

SEQ ID NO: 1049156 - RNA, 19 nt, Homo sapiens
ggaacuauguagccagauu

SEQ ID NO: 1049157 - RNA, 19 nt, Homo sapiens
caaguacgcuaucaucuuc

SEQ ID NO: 1049158 - RNA, 19 nt, Homo sapiens
guaaccauguuccuuguuu

SEQ ID NO: 1049159 - RNA, 19 nt, Homo sapiens
gaaauagugcuuacguuga

SEQ ID NO: 1049160 - RNA, 19 nt, Homo sapiens
gguagcaacuggccaaaug

SEQ ID NO: 1049161 - RNA, 19 nt, Homo sapiens
guagauacauccugugaca

SEQ ID NO: 1049162 - RNA, 19 nt, Homo sapiens
aaaugaggccuacugauua

SEQ ID NO: 1049163 - RNA, 19 nt, Homo sapiens
gagaaauagugcuuacguu

SEQ ID NO: 1049164 - RNA, 19 nt, Homo sapiens
cauggaaagucaaaugauu

SEQ ID NO: 1049165 - RNA, 19 nt, Homo sapiens
gaaauuguucugguagaua

SEQ ID NO: 1049166 - RNA, 19 nt, Homo sapiens
ugaacaagguugaggagaa

SEQ ID NO: 1049167 - RNA, 19 nt, Homo sapiens
gaaaggcaaguguagauug

SEQ ID NO: 1049168 - RNA, 19 nt, Homo sapiens
gaggcuaugucucuaauuc

SEQ ID NO: 1049169 - RNA, 19 nt, Homo sapiens
uggaagaacugaagagaau

SEQ ID NO: 1049170 - RNA, 19 nt, Homo sapiens
ggacggaaagcuuagauau

SEQ ID NO: 1049171 - RNA, 19 nt, Homo sapiens
caacaacagcaauuacaaa

SEQ ID NO: 1049172 - RNA, 19 nt, Homo sapiens
aaauagugcuuacguugaa

SEQ ID NO: 1049173 - RNA, 19 nt, Homo sapiens
ggaacaaguuagcacugaa

SEQ ID NO: 1049174 - RNA, 19 nt, Homo sapiens
gugagguccuaaaguguua

SEQ ID NO: 1049175 - RNA, 19 nt, Homo sapiens
cagggauuauucacauuua

SEQ ID NO: 1049176 - RNA, 19 nt, Homo sapiens
aaguguagauugucccuua

SEQ ID NO: 1049177 - RNA, 19 nt, Homo sapiens
gcaaguacgcuaucaucuu

SEQ ID NO: 1049178 - RNA, 19 nt, Homo sapiens
auaaagagaccacuugaaa

SEQ ID NO: 1049179 - RNA, 19 nt, Homo sapiens
gacagaagauacuuuaggu

SEQ ID NO: 1049180 - RNA, 19 nt, Homo sapiens
ccacacacauuaaauucug

SEQ ID NO: 1049181 - RNA, 19 nt, Homo sapiens
cuugagaacuauaaaguga

SEQ ID NO: 1049182 - RNA, 19 nt, Homo sapiens
gaagagaauuauugaugac

SEQ ID NO: 1049183 - RNA, 19 nt, Homo sapiens
ccacgagucucacuucagu

SEQ ID NO: 1049184 - RNA, 19 nt, Homo sapiens
aaaccaagaugggagacua

SEQ ID NO: 1049185 - RNA, 19 nt, Homo sapiens
gcuaucaucuucaggucuu

SEQ ID NO: 1049186 - RNA, 19 nt, Homo sapiens
gauugucccuuauuuccuu

SEQ ID NO: 1049187 - RNA, 19 nt, Homo sapiens
gauggacagugaucauuag

SEQ ID NO: 1049188 - RNA, 19 nt, Homo sapiens
gguuguggcuccuguugaa

SEQ ID NO: 1049189 - RNA, 19 nt, Homo sapiens
gaacaaguuagcacugaau

SEQ ID NO: 1049190 - RNA, 19 nt, Homo sapiens
ucacuucaguuucccaguu

SEQ ID NO: 1049191 - RNA, 19 nt, Homo sapiens
cuaaaguguuacaagagua

SEQ ID NO: 1049192 - RNA, 19 nt, Homo sapiens
caggcuguuuguauauuua

SEQ ID NO: 1049193 - RNA, 19 nt, Homo sapiens
caauguauuugguguguag

SEQ ID NO: 1049194 - RNA, 19 nt, Homo sapiens
guccuaaaguguuacaaga

SEQ ID NO: 1049195 - RNA, 19 nt, Homo sapiens
uuaccuccuuccuuaauaa

SEQ ID NO: 1049196 - RNA, 19 nt, Homo sapiens
acuauaaagugaacaccua

SEQ ID NO: 1049197 - RNA, 19 nt, Homo sapiens
uagguucucuuauugaugu

SEQ ID NO: 1049198 - RNA, 19 nt, Homo sapiens
gaggagaaauagugcuuac

SEQ ID NO: 1049199 - RNA, 19 nt, Homo sapiens
ugauagauuuccucuuuca

SEQ ID NO: 1049200 - RNA, 19 nt, Homo sapiens
uguagauugucccuuauuu

SEQ ID NO: 1049201 - RNA, 19 nt, Homo sapiens
ucaggcuguuuguauauuu

SEQ ID NO: 1049202 - RNA, 19 nt, Homo sapiens
gagaauuauugaugacagu

SEQ ID NO: 1049203 - RNA, 19 nt, Homo sapiens
gaugucaaccucagaaaca

SEQ ID NO: 1049204 - RNA, 19 nt, Homo sapiens
gagcauggcuugguaaccu

SEQ ID NO: 1049205 - RNA, 19 nt, Homo sapiens
gaugagcacauaucuuuua

SEQ ID NO: 1049206 - RNA, 19 nt, Homo sapiens
gaugggagacuaggucauu

SEQ ID NO: 1049207 - RNA, 19 nt, Homo sapiens
gcacgaguuucuggaguuc

SEQ ID NO: 1049208 - RNA, 19 nt, Homo sapiens
ugaggugugccuuguauaa

SEQ ID NO: 1049209 - RNA, 19 nt, Homo sapiens
aaaggcaaguguagauugu

SEQ ID NO: 1049210 - RNA, 19 nt, Homo sapiens
uaaagagaccacuugaaau

SEQ ID NO: 1049211 - RNA, 19 nt, Homo sapiens
uuguagaccuugaugauug

SEQ ID NO: 1049212 - RNA, 19 nt, Homo sapiens
gcccauugccuucagguuu

SEQ ID NO: 1049213 - RNA, 19 nt, Homo sapiens
cgacaggagcuugaaauug

SEQ ID NO: 1049214 - RNA, 19 nt, Homo sapiens
uaaugguuauccuuacuug

SEQ ID NO: 1049215 - RNA, 19 nt, Homo sapiens
gaaaauacauuagcaagcu

SEQ ID NO: 1049216 - RNA, 19 nt, Homo sapiens
aauuggagaugagcacaua

SEQ ID NO: 1049217 - RNA, 19 nt, Homo sapiens
ucuagagcauggcuuggua

SEQ ID NO: 1049218 - RNA, 19 nt, Homo sapiens
gagucgggcaguccaauaa

SEQ ID NO: 1049219 - RNA, 19 nt, Homo sapiens
cauguuccuuguuuccuuu

SEQ ID NO: 1049220 - RNA, 19 nt, Homo sapiens
ccuaaaguguuacaagagu

SEQ ID NO: 1049221 - RNA, 19 nt, Homo sapiens
gaacuauguagccagauuc

SEQ ID NO: 1049222 - RNA, 19 nt, Homo sapiens
acaggagcuugaaauugua

SEQ ID NO: 1049223 - RNA, 19 nt, Homo sapiens
gcaguaugaaaucguauug

SEQ ID NO: 1049224 - RNA, 19 nt, Homo sapiens
aaauguuucuguuccaguu

SEQ ID NO: 1049225 - RNA, 19 nt, Homo sapiens
ccucagggauuauucacau

SEQ ID NO: 1049226 - RNA, 19 nt, Homo sapiens
ccuccuuccuuaauaaaga

SEQ ID NO: 1049227 - RNA, 19 nt, Homo sapiens
ggagaaauagugcuuacgu

SEQ ID NO: 1049228 - RNA, 19 nt, Homo sapiens
ggcacgaguuucuggaguu

SEQ ID NO: 1049229 - RNA, 19 nt, Homo sapiens
gauuuccacuucauuaugc

SEQ ID NO: 1049230 - RNA, 19 nt, Homo sapiens
acaagaguguaauggaaga

SEQ ID NO: 1049231 - RNA, 19 nt, Homo sapiens
uaauaaagagaccacuuga

SEQ ID NO: 1049232 - RNA, 19 nt, Homo sapiens
ugaugauugugcaguauga

SEQ ID NO: 1049233 - RNA, 19 nt, Homo sapiens
gaggccuacugauuacuug

SEQ ID NO: 1049234 - RNA, 19 nt, Homo sapiens
uaauggaaacguccuaugu

SEQ ID NO: 1049235 - RNA, 19 nt, Homo sapiens
gcuuagauaugccaacaac

SEQ ID NO: 1049236 - RNA, 19 nt, Homo sapiens
cagauucccauccaugaaa

SEQ ID NO: 1049237 - RNA, 19 nt, Homo sapiens
caaguuugggcacgaguuu

SEQ ID NO: 1049238 - RNA, 19 nt, Homo sapiens
ucucuaacuuccuuacguu

SEQ ID NO: 1049239 - RNA, 19 nt, Homo sapiens
ccacaguuguugguuguuc

SEQ ID NO: 1049240 - RNA, 19 nt, Homo sapiens
gcccacaguuguugguugu

SEQ ID NO: 1049241 - RNA, 19 nt, Homo sapiens
gaauuauugaugacaguga

SEQ ID NO: 1049242 - RNA, 19 nt, Homo sapiens
ggucagggcuucacugugu

SEQ ID NO: 1049243 - RNA, 19 nt, Homo sapiens
ugaagcugguggugaauuu

SEQ ID NO: 1049244 - RNA, 19 nt, Homo sapiens
ugaauuuccucuucuacuu

SEQ ID NO: 1049245 - RNA, 19 nt, Homo sapiens
ugccucagcuucccaagua

SEQ ID NO: 1049246 - RNA, 19 nt, Homo sapiens
gaauuuccucuucuacuuu

SEQ ID NO: 1049247 - RNA, 19 nt, Homo sapiens
guacagagccagacaaagc

SEQ ID NO: 1049248 - RNA, 19 nt, Homo sapiens
ggccaugccuggaucuguu

SEQ ID NO: 1049249 - RNA, 19 nt, Homo sapiens
gguggugaauuuccucuuc

SEQ ID NO: 1049250 - RNA, 19 nt, Homo sapiens
ggccaucacaccuggauuu

SEQ ID NO: 1049251 - RNA, 19 nt, Homo sapiens
ggaacgaaauccggaaggu

SEQ ID NO: 1049252 - RNA, 19 nt, Homo sapiens
uuaugaaacugcccagcaa

SEQ ID NO: 1049253 - RNA, 19 nt, Homo sapiens
gcagagucguccgggaaga

SEQ ID NO: 1049254 - RNA, 19 nt, Homo sapiens
caucacaccuggauuuuca

SEQ ID NO: 1049255 - RNA, 19 nt, Homo sapiens
ucaaauaaagguaccucuu

SEQ ID NO: 1049256 - RNA, 19 nt, Homo sapiens
ugcuuguucuguucaaaua

SEQ ID NO: 1049257 - RNA, 19 nt, Homo sapiens
uggugaagcugguggugaa

SEQ ID NO: 1049258 - RNA, 19 nt, Homo sapiens
gcagcgaggagcaguguca

SEQ ID NO: 1049259 - RNA, 19 nt, Homo sapiens
gccuggaucuguuuuguuu

SEQ ID NO: 1049260 - RNA, 19 nt, Homo sapiens
cuucuggacucaagugauc

SEQ ID NO: 1049261 - RNA, 19 nt, Homo sapiens
gcggagccaugcgguacaa

SEQ ID NO: 1049262 - RNA, 19 nt, Homo sapiens
ggaaggugacgggcaagga

SEQ ID NO: 1049263 - RNA, 19 nt, Homo sapiens
gaauguacagagccagaca

SEQ ID NO: 1049264 - RNA, 19 nt, Homo sapiens
cagacaaagcugugaaugg

SEQ ID NO: 1049265 - RNA, 19 nt, Homo sapiens
uggugaauuuccucuucua

SEQ ID NO: 1049266 - RNA, 19 nt, Homo sapiens
cccggcaccuucuccauca

SEQ ID NO: 1049267 - RNA, 19 nt, Homo sapiens
gagccaugcgguacaacga

SEQ ID NO: 1049268 - RNA, 19 nt, Homo sapiens
uugaggacccugagaggaa

SEQ ID NO: 1049269 - RNA, 19 nt, Homo sapiens
gaacccagcuggaaucuua

SEQ ID NO: 1049270 - RNA, 19 nt, Homo sapiens
gaacacacgucuaaauuaa

SEQ ID NO: 1049271 - RNA, 19 nt, Homo sapiens
ggaagaaacugauuuagaa

SEQ ID NO: 1049272 - RNA, 19 nt, Homo sapiens
gaaagaagauaccgagaaa

SEQ ID NO: 1049273 - RNA, 19 nt, Homo sapiens
gaagaugacuuugagguuu

SEQ ID NO: 1049274 - RNA, 19 nt, Homo sapiens
gaaagcagaugaccucaga

SEQ ID NO: 1049275 - RNA, 19 nt, Homo sapiens
gagaguggcucccaaacua

SEQ ID NO: 1049276 - RNA, 19 nt, Homo sapiens
gcaaauacguccucugugu

SEQ ID NO: 1049277 - RNA, 19 nt, Homo sapiens
gacauaagguggauaauuc

SEQ ID NO: 1049278 - RNA, 19 nt, Homo sapiens
gaaccugagucaagagaaa

SEQ ID NO: 1049279 - RNA, 19 nt, Homo sapiens
ucacauuacugcuagauuu

SEQ ID NO: 1049280 - RNA, 19 nt, Homo sapiens
gaagaaaugucagguuugu

SEQ ID NO: 1049281 - RNA, 19 nt, Homo sapiens
gaacaccagucuaccauuc

SEQ ID NO: 1049282 - RNA, 19 nt, Homo sapiens
ggacaacccucucaaguac

SEQ ID NO: 1049283 - RNA, 19 nt, Homo sapiens
gagaguauuucgaguuauu

SEQ ID NO: 1049284 - RNA, 19 nt, Homo sapiens
gaagauaccgagaaagaaa

SEQ ID NO: 1049285 - RNA, 19 nt, Homo sapiens
ugaaaggauuggcgaguua

SEQ ID NO: 1049286 - RNA, 19 nt, Homo sapiens
ccacaucgcuuccuuggau

SEQ ID NO: 1049287 - RNA, 19 nt, Homo sapiens
gaagcgagguagaacagaa

SEQ ID NO: 1049288 - RNA, 19 nt, Homo sapiens
ucaaagagcuauuaaugca

SEQ ID NO: 1049289 - RNA, 19 nt, Homo sapiens
ggaagaaagacauaaagaa

SEQ ID NO: 1049290 - RNA, 19 nt, Homo sapiens
gaacagaauuugaaaagga

SEQ ID NO: 1049291 - RNA, 19 nt, Homo sapiens
guaaugacccagauuuaaa

SEQ ID NO: 1049292 - RNA, 19 nt, Homo sapiens
aagaagaaaugucagguuu

SEQ ID NO: 1049293 - RNA, 19 nt, Homo sapiens
gaagugaagagaaagauga

SEQ ID NO: 1049294 - RNA, 19 nt, Homo sapiens
gauugauacuccaagguua

SEQ ID NO: 1049295 - RNA, 19 nt, Homo sapiens
gggagaaaguacuguugua

SEQ ID NO: 1049296 - RNA, 19 nt, Homo sapiens
gaagauagagaaagaagau

SEQ ID NO: 1049297 - RNA, 19 nt, Homo sapiens
gaggaaaggccgcucagua

SEQ ID NO: 1049298 - RNA, 19 nt, Homo sapiens
ggaccgcguuucuguaaug

SEQ ID NO: 1049299 - RNA, 19 nt, Homo sapiens
ggucuccguucacgacuua

SEQ ID NO: 1049300 - RNA, 19 nt, Homo sapiens
gaaagaaagcacagagaga

SEQ ID NO: 1049301 - RNA, 19 nt, Homo sapiens
uaagaccagugaaaguuaa

SEQ ID NO: 1049302 - RNA, 19 nt, Homo sapiens
agacaucgcagguucaaua

SEQ ID NO: 1049303 - RNA, 19 nt, Homo sapiens
aggcauauguucaguguaa

SEQ ID NO: 1049304 - RNA, 19 nt, Homo sapiens
ggacagauacaaacaguuc

SEQ ID NO: 1049305 - RNA, 19 nt, Homo sapiens
ugaacacacgucuaaauua

SEQ ID NO: 1049306 - RNA, 19 nt, Homo sapiens
uaaacagccuaccaugaaa

SEQ ID NO: 1049307 - RNA, 19 nt, Homo sapiens
gugacagucuuucccauaa

SEQ ID NO: 1049308 - RNA, 19 nt, Homo sapiens
cgaagauaauguugaaaga

SEQ ID NO: 1049309 - RNA, 19 nt, Homo sapiens
gcaggcauauguucagugu

SEQ ID NO: 1049310 - RNA, 19 nt, Homo sapiens
gaaagaggagaugaagaua

SEQ ID NO: 1049311 - RNA, 19 nt, Homo sapiens
agaagaagcugcguaagga

SEQ ID NO: 1049312 - RNA, 19 nt, Homo sapiens
gagagaagaagcugcguaa

SEQ ID NO: 1049313 - RNA, 19 nt, Homo sapiens
aguaagaagugaagagaaa

SEQ ID NO: 1049314 - RNA, 19 nt, Homo sapiens
guggauaauucuacauuug

SEQ ID NO: 1049315 - RNA, 19 nt, Homo sapiens
caaagaugauaccuggaaa

SEQ ID NO: 1049316 - RNA, 19 nt, Homo sapiens
gagaaauauuccaaagaga

SEQ ID NO: 1049317 - RNA, 19 nt, Homo sapiens
aagaggagaugaagauaga

SEQ ID NO: 1049318 - RNA, 19 nt, Homo sapiens
cugagaguauuucgaguua

SEQ ID NO: 1049319 - RNA, 19 nt, Homo sapiens
guaguuaugccaaagauug

SEQ ID NO: 1049320 - RNA, 19 nt, Homo sapiens
aaagcaacguggauagaaa

SEQ ID NO: 1049321 - RNA, 19 nt, Homo sapiens
gagaagaaccaaagaugau

SEQ ID NO: 1049322 - RNA, 19 nt, Homo sapiens
aaaggccgcucaguaagua

SEQ ID NO: 1049323 - RNA, 19 nt, Homo sapiens
gguggauaauucuacauuu

SEQ ID NO: 1049324 - RNA, 19 nt, Homo sapiens
gaggaccgcguuucuguaa

SEQ ID NO: 1049325 - RNA, 19 nt, Homo sapiens
cauaagccauggcacaaga

SEQ ID NO: 1049326 - RNA, 19 nt, Homo sapiens
guaaugaaccugagucaag

SEQ ID NO: 1049327 - RNA, 19 nt, Homo sapiens
gagaaagaaagcugcagua

SEQ ID NO: 1049328 - RNA, 19 nt, Homo sapiens
ggaauuacuccaccgcaaa

SEQ ID NO: 1049329 - RNA, 19 nt, Homo sapiens
ucagcaacaugguauaaga

SEQ ID NO: 1049330 - RNA, 19 nt, Homo sapiens
caucgcagguucaauaagu

SEQ ID NO: 1049331 - RNA, 19 nt, Homo sapiens
gaggaaaccguggaaauug

SEQ ID NO: 1049332 - RNA, 19 nt, Homo sapiens
ccagaauggugaacacaga

SEQ ID NO: 1049333 - RNA, 19 nt, Homo sapiens
guaauucauucucugacaa

SEQ ID NO: 1049334 - RNA, 19 nt, Homo sapiens
uuaaacagccuaccaugaa

SEQ ID NO: 1049335 - RNA, 19 nt, Homo sapiens
gaagagaagaaccaaagau

SEQ ID NO: 1049336 - RNA, 19 nt, Homo sapiens
agaaaguacuguuguaucu

SEQ ID NO: 1049337 - RNA, 19 nt, Homo sapiens
uaaugaaccugagucaaga

SEQ ID NO: 1049338 - RNA, 19 nt, Homo sapiens
gaaaggccgcucaguaagu

SEQ ID NO: 1049339 - RNA, 19 nt, Homo sapiens
ggauaauucuacauuugug

SEQ ID NO: 1049340 - RNA, 19 nt, Homo sapiens
gaaagcacagagagaagaa

SEQ ID NO: 1049341 - RNA, 19 nt, Homo sapiens
gaugaaagcaguaaugaac

SEQ ID NO: 1049342 - RNA, 19 nt, Homo sapiens
agagaaauauuccaaagag

SEQ ID NO: 1049343 - RNA, 19 nt, Homo sapiens
ucaaguacuggcuuuauaa

SEQ ID NO: 1049344 - RNA, 19 nt, Homo sapiens
guaaguaaaguaagaagug

SEQ ID NO: 1049345 - RNA, 19 nt, Homo sapiens
cuacauuugugugcaagua

SEQ ID NO: 1049346 - RNA, 19 nt, Homo sapiens
ccaaagaugauaccuggaa

SEQ ID NO: 1049347 - RNA, 19 nt, Homo sapiens
gagagaaauauuccaaaga

SEQ ID NO: 1049348 - RNA, 19 nt, Homo sapiens
gacaagaaacaccgagaaa

SEQ ID NO: 1049349 - RNA, 19 nt, Homo sapiens
agaugaagauagagaaaga

SEQ ID NO: 1049350 - RNA, 19 nt, Homo sapiens
ugaaagaggagaugaagau

SEQ ID NO: 1049351 - RNA, 19 nt, Homo sapiens
gugaacacacgucuaaauu

SEQ ID NO: 1049352 - RNA, 19 nt, Homo sapiens
ggaccuuccugaacauaag

SEQ ID NO: 1049353 - RNA, 19 nt, Homo sapiens
gggucaagcugguacauag

SEQ ID NO: 1049354 - RNA, 19 nt, Homo sapiens
caagaaauucaaagagcua

SEQ ID NO: 1049355 - RNA, 19 nt, Homo sapiens
ugacagucuuucccauaaa

SEQ ID NO: 1049356 - RNA, 19 nt, Homo sapiens
ggagaaaguacuguuguau

SEQ ID NO: 1049357 - RNA, 19 nt, Homo sapiens
uaucagaaacuuugggaaa

SEQ ID NO: 1049358 - RNA, 19 nt, Homo sapiens
cgaggaaaccguggaaauu

SEQ ID NO: 1049359 - RNA, 19 nt, Homo sapiens
gaaagaugaagacucugaa

SEQ ID NO: 1049360 - RNA, 19 nt, Homo sapiens
gagaagaagcugcguaagg

SEQ ID NO: 1049361 - RNA, 19 nt, Homo sapiens
ggacucaggcccuuaagca

SEQ ID NO: 1049362 - RNA, 19 nt, Homo sapiens
gaacuuccucuagcucaaa

SEQ ID NO: 1049363 - RNA, 19 nt, Homo sapiens
ugcuagagcugaugcauau

SEQ ID NO: 1049364 - RNA, 19 nt, Homo sapiens
gcugagaauuuaguaagga

SEQ ID NO: 1049365 - RNA, 19 nt, Homo sapiens
gggaagaaagacauaaaga

SEQ ID NO: 1049366 - RNA, 19 nt, Homo sapiens
ggagaugaagauagagaaa

SEQ ID NO: 1049367 - RNA, 19 nt, Homo sapiens
aaagacauaagguggauaa

SEQ ID NO: 1049368 - RNA, 19 nt, Homo sapiens
gagaggaccgcguuucugu

SEQ ID NO: 1049369 - RNA, 19 nt, Homo sapiens
ggaugaagcuggaaauaaa

SEQ ID NO: 1049370 - RNA, 19 nt, Homo sapiens
gaaguuggcuuucuuuaca

SEQ ID NO: 1049371 - RNA, 19 nt, Homo sapiens
ggaaggaaaucaugccaaa

SEQ ID NO: 1049372 - RNA, 19 nt, Homo sapiens
gcagacauguacaacuuua

SEQ ID NO: 1049373 - RNA, 19 nt, Homo sapiens
aaacagaaguccuuaguga

SEQ ID NO: 1049374 - RNA, 19 nt, Homo sapiens
ggaauugccugaaccuuug

SEQ ID NO: 1049375 - RNA, 19 nt, Homo sapiens
gaaccaagcucacaaaucc

SEQ ID NO: 1049376 - RNA, 19 nt, Homo sapiens
gggagcagcuugcaagauu

SEQ ID NO: 1049377 - RNA, 19 nt, Homo sapiens
ggacguucauucuuaugua

SEQ ID NO: 1049378 - RNA, 19 nt, Homo sapiens
cugaagagguggaauuuaa

SEQ ID NO: 1049379 - RNA, 19 nt, Homo sapiens
gcacugcccugugaagaaa

SEQ ID NO: 1049380 - RNA, 19 nt, Homo sapiens
gaauguagacagaaaugua

SEQ ID NO: 1049381 - RNA, 19 nt, Homo sapiens
gaaggagacuuggugaaga

SEQ ID NO: 1049382 - RNA, 19 nt, Homo sapiens
ccaagcagauuaccauaga

SEQ ID NO: 1049383 - RNA, 19 nt, Homo sapiens
cgagagcacugcccuguga

SEQ ID NO: 1049384 - RNA, 19 nt, Homo sapiens
cagcagacauguacaacuu

SEQ ID NO: 1049385 - RNA, 19 nt, Homo sapiens
gagguggaauuuaauguau

SEQ ID NO: 1049386 - RNA, 19 nt, Homo sapiens
gagaacaugucagaaguug

SEQ ID NO: 1049387 - RNA, 19 nt, Homo sapiens
accaacagcuuccaagaua

SEQ ID NO: 1049388 - RNA, 19 nt, Homo sapiens
gagaaacaacagucagaua

SEQ ID NO: 1049389 - RNA, 19 nt, Homo sapiens
gaccagcgaugugaauaaa

SEQ ID NO: 1049390 - RNA, 19 nt, Homo sapiens
caagauaagugggcggaaa

SEQ ID NO: 1049391 - RNA, 19 nt, Homo sapiens
ugaaugaccugugucuuga

SEQ ID NO: 1049392 - RNA, 19 nt, Homo sapiens
gcaugaagcagcuggcuaa

SEQ ID NO: 1049393 - RNA, 19 nt, Homo sapiens
ugauaaggaccgaacauua

SEQ ID NO: 1049394 - RNA, 19 nt, Homo sapiens
gcagugcguuaacuaucua

SEQ ID NO: 1049395 - RNA, 19 nt, Homo sapiens
ggccagaguucuucaggaa

SEQ ID NO: 1049396 - RNA, 19 nt, Homo sapiens
guaagaagcagugcguuaa

SEQ ID NO: 1049397 - RNA, 19 nt, Homo sapiens
caacuuggaaugaguaaga

SEQ ID NO: 1049398 - RNA, 19 nt, Homo sapiens
gaaggaacacuugcugaaa

SEQ ID NO: 1049399 - RNA, 19 nt, Homo sapiens
gaagaauggacacaaguug

SEQ ID NO: 1049400 - RNA, 19 nt, Homo sapiens
gggaauugccugaaccuuu

SEQ ID NO: 1049401 - RNA, 19 nt, Homo sapiens
gaaaagacccuccccgaaa

SEQ ID NO: 1049402 - RNA, 19 nt, Homo sapiens
gccacaugcuggaaccuua

SEQ ID NO: 1049403 - RNA, 19 nt, Homo sapiens
ggaccgaacauuauucuag

SEQ ID NO: 1049404 - RNA, 19 nt, Homo sapiens
gaagagguggaauuuaaug

SEQ ID NO: 1049405 - RNA, 19 nt, Homo sapiens
uaaaggaagagauggauga

SEQ ID NO: 1049406 - RNA, 19 nt, Homo sapiens
cagcuugucuccaauccaa

SEQ ID NO: 1049407 - RNA, 19 nt, Homo sapiens
ugaagcagcuggcuaacca

SEQ ID NO: 1049408 - RNA, 19 nt, Homo sapiens
gaccgaacauuauucuagu

SEQ ID NO: 1049409 - RNA, 19 nt, Homo sapiens
uaucauguauggucugugu

SEQ ID NO: 1049410 - RNA, 19 nt, Homo sapiens
gauaguaacagacuccaau

SEQ ID NO: 1049411 - RNA, 19 nt, Homo sapiens
gguggaauuuaauguauca

SEQ ID NO: 1049412 - RNA, 19 nt, Homo sapiens
ggaguauggcaaauucuuu

SEQ ID NO: 1049413 - RNA, 19 nt, Homo sapiens
cagacuugcugcagaauca

SEQ ID NO: 1049414 - RNA, 19 nt, Homo sapiens
gagacuuggugaagaagga

SEQ ID NO: 1049415 - RNA, 19 nt, Homo sapiens
agauugcgcugcccauuga

SEQ ID NO: 1049416 - RNA, 19 nt, Homo sapiens
gaagcagugcguuaacuau

SEQ ID NO: 1049417 - RNA, 19 nt, Homo sapiens
acacugcgccgagcuguua

SEQ ID NO: 1049418 - RNA, 19 nt, Homo sapiens
uggaugaguucuauucaga

SEQ ID NO: 1049419 - RNA, 19 nt, Homo sapiens
gcuuuggacuguucuacuu

SEQ ID NO: 1049420 - RNA, 19 nt, Homo sapiens
gaaaugcgagcccaucaag

SEQ ID NO: 1049421 - RNA, 19 nt, Homo sapiens
ggagcagcuugcaagauug

SEQ ID NO: 1049422 - RNA, 19 nt, Homo sapiens
ugacagcucuugcucaaaa

SEQ ID NO: 1049423 - RNA, 19 nt, Homo sapiens
gcgaaccucuuucuuugca

SEQ ID NO: 1049424 - RNA, 19 nt, Homo sapiens
gauagcaucuggccaaaau

SEQ ID NO: 1049425 - RNA, 19 nt, Homo sapiens
gagaggaagcggccugcua

SEQ ID NO: 1049426 - RNA, 19 nt, Homo sapiens
uagaagcccaagcagauua

SEQ ID NO: 1049427 - RNA, 19 nt, Homo sapiens
ggaaauaaaguagaacagu

SEQ ID NO: 1049428 - RNA, 19 nt, Homo sapiens
gacguucauucuuauguau

SEQ ID NO: 1049429 - RNA, 19 nt, Homo sapiens
aggcgaaccucuuucuuug

SEQ ID NO: 1049430 - RNA, 19 nt, Homo sapiens
aaggaacacuugcugaaau

SEQ ID NO: 1049431 - RNA, 19 nt, Homo sapiens
cagcaucuuuccugaagug

SEQ ID NO: 1049432 - RNA, 19 nt, Homo sapiens
gcacgaagucuuuguugag

SEQ ID NO: 1049433 - RNA, 19 nt, Homo sapiens
aaggagacuuggugaagaa

SEQ ID NO: 1049434 - RNA, 19 nt, Homo sapiens
ggaaggagacuuggugaag

SEQ ID NO: 1049435 - RNA, 19 nt, Homo sapiens
ccaugugguugcagugauu

SEQ ID NO: 1049436 - RNA, 19 nt, Homo sapiens
ggagaacaugucagaaguu

SEQ ID NO: 1049437 - RNA, 19 nt, Homo sapiens
gcagaaucauuuuguauca

SEQ ID NO: 1049438 - RNA, 19 nt, Homo sapiens
cagaaguccuuagugaaga

SEQ ID NO: 1049439 - RNA, 19 nt, Homo sapiens
caggcgaaccucuuucuuu

SEQ ID NO: 1049440 - RNA, 19 nt, Homo sapiens
aaacaacagucagauagca

SEQ ID NO: 1049441 - RNA, 19 nt, Homo sapiens
cgaaggaacacuugcugaa

SEQ ID NO: 1049442 - RNA, 19 nt, Homo sapiens
gagauugcgcugcccauug

SEQ ID NO: 1049443 - RNA, 19 nt, Homo sapiens
gcugaaacgcgcauaggaa

SEQ ID NO: 1049444 - RNA, 19 nt, Homo sapiens
guaacagacuccaauucca

SEQ ID NO: 1049445 - RNA, 19 nt, Homo sapiens
gcaccaacagcuuccaaga

SEQ ID NO: 1049446 - RNA, 19 nt, Homo sapiens
gggcagagcugagaaaaca

SEQ ID NO: 1049447 - RNA, 19 nt, Homo sapiens
gcucagaccagcgauguga

SEQ ID NO: 1049448 - RNA, 19 nt, Homo sapiens
guacaacuuuauggccaaa

SEQ ID NO: 1049449 - RNA, 19 nt, Homo sapiens
ggaaccaagcucacaaauc

SEQ ID NO: 1049450 - RNA, 19 nt, Homo sapiens
ucaccuggaugaguucuau

SEQ ID NO: 1049451 - RNA, 19 nt, Homo sapiens
caagcagauuaccauagaa

SEQ ID NO: 1049452 - RNA, 19 nt, Homo sapiens
cgaagucuuuguugagaag

SEQ ID NO: 1049453 - RNA, 19 nt, Homo sapiens
gugcguuaacuaucuauuu

SEQ ID NO: 1049454 - RNA, 19 nt, Homo sapiens
gagaguauuccugcugaaa

SEQ ID NO: 1049455 - RNA, 19 nt, Homo sapiens
ggacacggugcggucaaua

SEQ ID NO: 1049456 - RNA, 19 nt, Homo sapiens
cauugaagccugugucaug

SEQ ID NO: 1049457 - RNA, 19 nt, Homo sapiens
gcauuagcagucuuagaaa

SEQ ID NO: 1049458 - RNA, 19 nt, Homo sapiens
guguggagaugcugagaau

SEQ ID NO: 1049459 - RNA, 19 nt, Homo sapiens
gacagcagccucaccaaca

SEQ ID NO: 1049460 - RNA, 19 nt, Homo sapiens
ggugauggaaggagacuug

SEQ ID NO: 1049461 - RNA, 19 nt, Homo sapiens
ucugacagcucuugcucaa

SEQ ID NO: 1049462 - RNA, 19 nt, Homo sapiens
guggagaugcugagaauca

SEQ ID NO: 1049463 - RNA, 19 nt, Homo sapiens
cuucagacuugcugcagaa

SEQ ID NO: 1049464 - RNA, 19 nt, Homo sapiens
cuacagcaacuuggaauga

SEQ ID NO: 1049465 - RNA, 19 nt, Homo sapiens
gaaacugcacagccacaug

SEQ ID NO: 1049466 - RNA, 19 nt, Homo sapiens
agaaacaacagucagauag

SEQ ID NO: 1049467 - RNA, 19 nt, Homo sapiens
gggagaaacaacagucaga

SEQ ID NO: 1049468 - RNA, 19 nt, Homo sapiens
caagugugcaggaucaaga

SEQ ID NO: 1049469 - RNA, 19 nt, Homo sapiens
gggcagaacuggacguuug

SEQ ID NO: 1049470 - RNA, 19 nt, Homo sapiens
gcagagugcuccuagauca

SEQ ID NO: 1049471 - RNA, 19 nt, Homo sapiens
gcuccuagaucaccauaaa

SEQ ID NO: 1049472 - RNA, 19 nt, Homo sapiens
cgacaucacuugccagaca

SEQ ID NO: 1049473 - RNA, 19 nt, Homo sapiens
agagucugcugaaacguua

SEQ ID NO: 1049474 - RNA, 19 nt, Homo sapiens
gaccaaccaugcauacauc

SEQ ID NO: 1049475 - RNA, 19 nt, Homo sapiens
ccaccaaugugcuccuuau

SEQ ID NO: 1049476 - RNA, 19 nt, Homo sapiens
ccuauucacugucacuuug

SEQ ID NO: 1049477 - RNA, 19 nt, Homo sapiens
acacagagcaggcuucaga

SEQ ID NO: 1049478 - RNA, 19 nt, Homo sapiens
gguuucagauggaccuauu

SEQ ID NO: 1049479 - RNA, 19 nt, Homo sapiens
gaacuggacguuugcuuuu

SEQ ID NO: 1049480 - RNA, 19 nt, Homo sapiens
ccaggccucucuccaagug

SEQ ID NO: 1049481 - RNA, 19 nt, Homo sapiens
ccaaugugcuccuuaugcu

SEQ ID NO: 1049482 - RNA, 19 nt, Homo sapiens
ucacuugccauugagauuu

SEQ ID NO: 1049483 - RNA, 19 nt, Homo sapiens
gagggcgaguguccuaauc

SEQ ID NO: 1049484 - RNA, 19 nt, Homo sapiens
agauggaccuauucacugu

SEQ ID NO: 1049485 - RNA, 19 nt, Homo sapiens
gcuuagagcgguuucagau

SEQ ID NO: 1049486 - RNA, 19 nt, Homo sapiens
ccgagucccuuccacuugu

SEQ ID NO: 1049487 - RNA, 19 nt, Homo sapiens
ggauggggcuccuggauca

SEQ ID NO: 1049488 - RNA, 19 nt, Homo sapiens
agaacuggacguuugcuuu

SEQ ID NO: 1049489 - RNA, 19 nt, Homo sapiens
gacaugaucguggaagaau

SEQ ID NO: 1049490 - RNA, 19 nt, Homo sapiens
cgaguguccuaauccuguu

SEQ ID NO: 1049491 - RNA, 19 nt, Homo sapiens
agccaaagcccgacacaga

SEQ ID NO: 1049492 - RNA, 19 nt, Homo sapiens
cgaccaaccaugcauacau

SEQ ID NO: 1049493 - RNA, 19 nt, Homo sapiens
ugaccaggccucucuccaa

SEQ ID NO: 1049494 - RNA, 19 nt, Homo sapiens
ccgcugagcaugcuguaug

SEQ ID NO: 1049495 - RNA, 19 nt, Homo sapiens
caugaucguggaagaaugu

SEQ ID NO: 1049496 - RNA, 19 nt, Homo sapiens
cuagaucaccauaaagaca

SEQ ID NO: 1049497 - RNA, 19 nt, Homo sapiens
cgagucccuuccacuuguu

SEQ ID NO: 1049498 - RNA, 19 nt, Homo sapiens
aagacaugaucguggaaga

SEQ ID NO: 1049499 - RNA, 19 nt, Homo sapiens
gacguuugcuuuugacuuc

SEQ ID NO: 1049500 - RNA, 19 nt, Homo sapiens
gagcaugcuguauguggau

SEQ ID NO: 1049501 - RNA, 19 nt, Homo sapiens
augcauacauccagagucu

SEQ ID NO: 1049502 - RNA, 19 nt, Homo sapiens
ucagauggaccuauucacu

SEQ ID NO: 1049503 - RNA, 19 nt, Homo sapiens
uagagcgguuucagaugga

SEQ ID NO: 1049504 - RNA, 19 nt, Homo sapiens
gcaccgucgacaucacuug

SEQ ID NO: 1049505 - RNA, 19 nt, Homo sapiens
caagaggcaccgucgacau

SEQ ID NO: 1049506 - RNA, 19 nt, Homo sapiens
agggcucacuugccauuga

SEQ ID NO: 1049507 - RNA, 19 nt, Homo sapiens
agaccaagccgcugagcau

SEQ ID NO: 1049508 - RNA, 19 nt, Homo sapiens
gcaugcuguauguggauaa

SEQ ID NO: 1049509 - RNA, 19 nt, Homo sapiens
ggcuucagacagcugcuua

SEQ ID NO: 1049510 - RNA, 19 nt, Homo sapiens
gaagaacacacauuacuau

SEQ ID NO: 1049511 - RNA, 19 nt, Homo sapiens
gaacacacauuacuaugac

SEQ ID NO: 1049512 - RNA, 19 nt, Homo sapiens
caacuacuaugccuucuuc

SEQ ID NO: 1049513 - RNA, 19 nt, Homo sapiens
gcaagaacgucuacaaagc

SEQ ID NO: 1049514 - RNA, 19 nt, Homo sapiens
ggagggcgcugucauuguc

SEQ ID NO: 1049515 - RNA, 19 nt, Homo sapiens
ggaagcagcacacaagaca

SEQ ID NO: 1049516 - RNA, 19 nt, Homo sapiens
gauaauugaugugauaagg

SEQ ID NO: 1049517 - RNA, 19 nt, Homo sapiens
ucccugaacuuccaucuga

SEQ ID NO: 1049518 - RNA, 19 nt, Homo sapiens
ccaccagagcuuuguauuu

SEQ ID NO: 1049519 - RNA, 19 nt, Homo sapiens
ugaagaacacacauuacua

SEQ ID NO: 1049520 - RNA, 19 nt, Homo sapiens
gacuucaacuggcgcauga

SEQ ID NO: 1049521 - RNA, 19 nt, Homo sapiens
caccagagcuuuguauuuu

SEQ ID NO: 1049522 - RNA, 19 nt, Homo sapiens
cagcuguacucccuaaugu

SEQ ID NO: 1049523 - RNA, 19 nt, Homo sapiens
uaucagcuguacucccuaa

SEQ ID NO: 1049524 - RNA, 19 nt, Homo sapiens
ggagaugggaggacgaaga

SEQ ID NO: 1049525 - RNA, 19 nt, Homo sapiens
gggcaaggccuacucauac

SEQ ID NO: 1049526 - RNA, 19 nt, Homo sapiens
gcgcugucauugucuauca

SEQ ID NO: 1049527 - RNA, 19 nt, Homo sapiens
cagcaagaacgucuacaaa

SEQ ID NO: 1049528 - RNA, 19 nt, Homo sapiens
gcagugagguggaguuccu

SEQ ID NO: 1049529 - RNA, 19 nt, Homo sapiens
cguacuguuucuuugauaa

SEQ ID NO: 1049530 - RNA, 19 nt, Homo sapiens
ucccuaauguccucugaaa

SEQ ID NO: 1049531 - RNA, 19 nt, Homo sapiens
gcugagcgccuacuaugug

SEQ ID NO: 1049532 - RNA, 19 nt, Homo sapiens
gcacacaagacagcuguau

SEQ ID NO: 1049533 - RNA, 19 nt, Homo sapiens
acaagacagugugguggua

SEQ ID NO: 1049534 - RNA, 19 nt, Homo sapiens
ccagcauucuguuugaguu

SEQ ID NO: 1049535 - RNA, 19 nt, Homo sapiens
agaacacacauuacuauga

SEQ ID NO: 1049536 - RNA, 19 nt, Homo sapiens
gucgaaauccgcucuguga

SEQ ID NO: 1049537 - RNA, 19 nt, Homo sapiens
gggacuaccuccugacacu

SEQ ID NO: 1049538 - RNA, 19 nt, Homo sapiens
guuacguacuguuucuuug

SEQ ID NO: 1049539 - RNA, 19 nt, Homo sapiens
gugcaccggugaccagugu

SEQ ID NO: 1049540 - RNA, 19 nt, Homo sapiens
ucaguggccuggcaaagag

SEQ ID NO: 1049541 - RNA, 19 nt, Homo sapiens
ccucugacgucucccacuu

SEQ ID NO: 1049542 - RNA, 19 nt, Homo sapiens
ucgugaagaacacacauua

SEQ ID NO: 1049543 - RNA, 19 nt, Homo sapiens
ccuacuauguggccuuugu

SEQ ID NO: 1049544 - RNA, 19 nt, Homo sapiens
ggaccuacuccuuccugaa

SEQ ID NO: 1049545 - RNA, 19 nt, Homo sapiens
ccacuuccgcuuccauuuc

SEQ ID NO: 1049546 - RNA, 19 nt, Homo sapiens
gcuggagggcgcugucauu

SEQ ID NO: 1049547 - RNA, 19 nt, Homo sapiens
gcaccuccgugauccucau

SEQ ID NO: 1049548 - RNA, 19 nt, Homo sapiens
acacaagacagcuguaugg

SEQ ID NO: 1049549 - RNA, 19 nt, Homo sapiens
ucugaucgacuucaacuug

SEQ ID NO: 1049550 - RNA, 19 nt, Homo sapiens
ucaacuggcgcaugaagga

SEQ ID NO: 1049551 - RNA, 19 nt, Homo sapiens
ggauguacauuccguuccu

SEQ ID NO: 1049552 - RNA, 19 nt, Homo sapiens
uccacuacaucaacaucua

SEQ ID NO: 1049553 - RNA, 19 nt, Homo sapiens
ggcaaggccuacucauacu

SEQ ID NO: 1049554 - RNA, 19 nt, Homo sapiens
gcaacuacuaugccuucuu

SEQ ID NO: 1049555 - RNA, 19 nt, Homo sapiens
gcacagcaagaacgucuac

SEQ ID NO: 1049556 - RNA, 19 nt, Homo sapiens
gugaagaacacacauuacu

SEQ ID NO: 1049557 - RNA, 19 nt, Homo sapiens
uuacguacuguuucuuuga

SEQ ID NO: 1049558 - RNA, 19 nt, Homo sapiens
acaaagccguaggccacua

SEQ ID NO: 1049559 - RNA, 19 nt, Homo sapiens
ugggcaaggccuacucaua

SEQ ID NO: 1049560 - RNA, 19 nt, Homo sapiens
cuacuaugccuucuucaag

SEQ ID NO: 1049561 - RNA, 19 nt, Homo sapiens
gagaugggaggacgaagag

SEQ ID NO: 1049562 - RNA, 19 nt, Homo sapiens
aaacuguugugccucuaca

SEQ ID NO: 1049563 - RNA, 19 nt, Homo sapiens
ccacaccucccugaacuuc

SEQ ID NO: 1049564 - RNA, 19 nt, Homo sapiens
ccaaacuguugugccucua

SEQ ID NO: 1049565 - RNA, 19 nt, Homo sapiens
cagcacccguggacugaag

SEQ ID NO: 1049566 - RNA, 19 nt, Homo sapiens
gaggagaugggaggacgaa

SEQ ID NO: 1049567 - RNA, 19 nt, Homo sapiens
gcaccggugaccaguguuc

SEQ ID NO: 1049568 - RNA, 19 nt, Homo sapiens
uggaguuccucaagaugga

SEQ ID NO: 1049569 - RNA, 19 nt, Homo sapiens
caucaacaucuacaagaca

SEQ ID NO: 1049570 - RNA, 19 nt, Homo sapiens
gaccuacuccuuccugaac

SEQ ID NO: 1049571 - RNA, 19 nt, Homo sapiens
cgacuucaacuugcugaug

SEQ ID NO: 1049572 - RNA, 19 nt, Homo sapiens
aggccagcauucuguuuga

SEQ ID NO: 1049573 - RNA, 19 nt, Homo sapiens
ggacugaagaaugcaugug

SEQ ID NO: 1049574 - RNA, 19 nt, Homo sapiens
gcgcugguccugugaacuc

SEQ ID NO: 1049575 - RNA, 19 nt, Homo sapiens
uacaucaacaucuacaaga

SEQ ID NO: 1049576 - RNA, 19 nt, Homo sapiens
uagcacucuucguccacua

SEQ ID NO: 1049577 - RNA, 19 nt, Homo sapiens
gucaguggccuggcaaaga

SEQ ID NO: 1049578 - RNA, 19 nt, Homo sapiens
guuccucugcuauccguuu

SEQ ID NO: 1049579 - RNA, 19 nt, Homo sapiens
caagacaguguggugguau

SEQ ID NO: 1049580 - RNA, 19 nt, Homo sapiens
cuacaucaacaucuacaag

SEQ ID NO: 1049581 - RNA, 19 nt, Homo sapiens
cuagguagcuuguuuguua

SEQ ID NO: 1049582 - RNA, 19 nt, Homo sapiens
gcaagucugucuaaaucua

SEQ ID NO: 1049583 - RNA, 19 nt, Homo sapiens
caagugaacuaauuguuga

SEQ ID NO: 1049584 - RNA, 19 nt, Homo sapiens
aaaccacucuugagaagua

SEQ ID NO: 1049585 - RNA, 19 nt, Homo sapiens
ggaaaguaauugcuauuca

SEQ ID NO: 1049586 - RNA, 19 nt, Homo sapiens
ugaggcaaauugaagauua

SEQ ID NO: 1049587 - RNA, 19 nt, Homo sapiens
gggaagcacugaauauuuc

SEQ ID NO: 1049588 - RNA, 19 nt, Homo sapiens
ggaauuacauaagcccuaa

SEQ ID NO: 1049589 - RNA, 19 nt, Homo sapiens
caacaaggaauucagagua

SEQ ID NO: 1049590 - RNA, 19 nt, Homo sapiens
guacugugauaacuacuuu

SEQ ID NO: 1049591 - RNA, 19 nt, Homo sapiens
gaaccagaaugugaacaaa

SEQ ID NO: 1049592 - RNA, 19 nt, Homo sapiens
agaaggaucugaagucgaa

SEQ ID NO: 1049593 - RNA, 19 nt, Homo sapiens
gacauuaagugaauucuag

SEQ ID NO: 1049594 - RNA, 19 nt, Homo sapiens
aggaaacucuguaucauuu

SEQ ID NO: 1049595 - RNA, 19 nt, Homo sapiens
gaaggaaacucuguaucau

SEQ ID NO: 1049596 - RNA, 19 nt, Homo sapiens
ggaauucagaguaauguaa

SEQ ID NO: 1049597 - RNA, 19 nt, Homo sapiens
gcauugguguauggaauua

SEQ ID NO: 1049598 - RNA, 19 nt, Homo sapiens
gguaagaacaguaauugaa

SEQ ID NO: 1049599 - RNA, 19 nt, Homo sapiens
uagcaagaauuuacuguug

SEQ ID NO: 1049600 - RNA, 19 nt, Homo sapiens
ucacagccauuguucuaaa

SEQ ID NO: 1049601 - RNA, 19 nt, Homo sapiens
uuagaaugguugugguuua

SEQ ID NO: 1049602 - RNA, 19 nt, Homo sapiens
gugcauaucuuuuaccaua

SEQ ID NO: 1049603 - RNA, 19 nt, Homo sapiens
ucaaaggcauucagucuuc

SEQ ID NO: 1049604 - RNA, 19 nt, Homo sapiens
agagaaagauacagauguu

SEQ ID NO: 1049605 - RNA, 19 nt, Homo sapiens
gaucauagcaagaauuuac

SEQ ID NO: 1049606 - RNA, 19 nt, Homo sapiens
gaaagauacagauguugaa

SEQ ID NO: 1049607 - RNA, 19 nt, Homo sapiens
guuaacacauuugccauaa

SEQ ID NO: 1049608 - RNA, 19 nt, Homo sapiens
caaaguuucguggcuauua

SEQ ID NO: 1049609 - RNA, 19 nt, Homo sapiens
gaaaguaauugcuauucac

SEQ ID NO: 1049610 - RNA, 19 nt, Homo sapiens
agauacagauguugaagaa

SEQ ID NO: 1049611 - RNA, 19 nt, Homo sapiens
gaagagaaagauacagaug

SEQ ID NO: 1049612 - RNA, 19 nt, Homo sapiens
caaaugcaagucugucuaa

SEQ ID NO: 1049613 - RNA, 19 nt, Homo sapiens
ggcuuaaacuggaagauga

SEQ ID NO: 1049614 - RNA, 19 nt, Homo sapiens
gggauuggauuugcaaguu

SEQ ID NO: 1049615 - RNA, 19 nt, Homo sapiens
gcaacacuauaaugucuca

SEQ ID NO: 1049616 - RNA, 19 nt, Homo sapiens
ggcaauaguaguaguagua

SEQ ID NO: 1049617 - RNA, 19 nt, Homo sapiens
gguagcuuguuuguuauua

SEQ ID NO: 1049618 - RNA, 19 nt, Homo sapiens
uagaaugguugugguuuaa

SEQ ID NO: 1049619 - RNA, 19 nt, Homo sapiens
gggcaaaucacacauaaca

SEQ ID NO: 1049620 - RNA, 19 nt, Homo sapiens
gauaucauccucggucuuu

SEQ ID NO: 1049621 - RNA, 19 nt, Homo sapiens
guccuagucccaccaauua

SEQ ID NO: 1049622 - RNA, 19 nt, Homo sapiens
gcucuucucucugccguuu

SEQ ID NO: 1049623 - RNA, 19 nt, Homo sapiens
aacaaggaauucagaguaa

SEQ ID NO: 1049624 - RNA, 19 nt, Homo sapiens
ggauuggauuugcaaguug

SEQ ID NO: 1049625 - RNA, 19 nt, Homo sapiens
aaaguuucguggcuauuaa

SEQ ID NO: 1049626 - RNA, 19 nt, Homo sapiens
aaaggacgcucuaggaaag

SEQ ID NO: 1049627 - RNA, 19 nt, Homo sapiens
guucugccaccaccuauua

SEQ ID NO: 1049628 - RNA, 19 nt, Homo sapiens
caaguuguguagugugcua

SEQ ID NO: 1049629 - RNA, 19 nt, Homo sapiens
cagaauccauaaggcuuua

SEQ ID NO: 1049630 - RNA, 19 nt, Homo sapiens
uaaaggacgcucuaggaaa

SEQ ID NO: 1049631 - RNA, 19 nt, Homo sapiens
gaacaguaaacuacaauac

SEQ ID NO: 1049632 - RNA, 19 nt, Homo sapiens
uaacacauuugccauaagg

SEQ ID NO: 1049633 - RNA, 19 nt, Homo sapiens
ugaaggaaacucuguauca

SEQ ID NO: 1049634 - RNA, 19 nt, Homo sapiens
gugggcaaaucacacauaa

SEQ ID NO: 1049635 - RNA, 19 nt, Homo sapiens
ggucuuuacuuccuaucaa

SEQ ID NO: 1049636 - RNA, 19 nt, Homo sapiens
acauaacacuucauucuag

SEQ ID NO: 1049637 - RNA, 19 nt, Homo sapiens
gaucaaaggcauucagucu

SEQ ID NO: 1049638 - RNA, 19 nt, Homo sapiens
gacgguaccuacagaauac

SEQ ID NO: 1049639 - RNA, 19 nt, Homo sapiens
gacaagaauuaggguaaga

SEQ ID NO: 1049640 - RNA, 19 nt, Homo sapiens
ugacgguaccuacagaaua

SEQ ID NO: 1049641 - RNA, 19 nt, Homo sapiens
aggaauagcugcauaagac

SEQ ID NO: 1049642 - RNA, 19 nt, Homo sapiens
gcaaaucacacauaacacu

SEQ ID NO: 1049643 - RNA, 19 nt, Homo sapiens
uuagagcccuuccucauuc

SEQ ID NO: 1049644 - RNA, 19 nt, Homo sapiens
ggaacaguaaacuacaaua

SEQ ID NO: 1049645 - RNA, 19 nt, Homo sapiens
uagagcccauguucuuuaa

SEQ ID NO: 1049646 - RNA, 19 nt, Homo sapiens
cuagagcccauguucuuua

SEQ ID NO: 1049647 - RNA, 19 nt, Homo sapiens
ucucuuggcuggaucauag

SEQ ID NO: 1049648 - RNA, 19 nt, Homo sapiens
ccacaucucuuggcuggau

SEQ ID NO: 1049649 - RNA, 19 nt, Homo sapiens
gcucugaacaucauuaagu

SEQ ID NO: 1049650 - RNA, 19 nt, Homo sapiens
uuaaagcucugaacaucau

SEQ ID NO: 1049651 - RNA, 19 nt, Homo sapiens
cuacuuaugguaauaggua

SEQ ID NO: 1049652 - RNA, 19 nt, Homo sapiens
aguaguagcagcagcaaua

SEQ ID NO: 1049653 - RNA, 19 nt, Homo sapiens
gauuucaggcuaacuuauu

SEQ ID NO: 1049654 - RNA, 19 nt, Homo sapiens
ggacguggaagcagcaaga

SEQ ID NO: 1049655 - RNA, 19 nt, Homo sapiens
uaucacagccauuguucua

SEQ ID NO: 1049656 - RNA, 19 nt, Homo sapiens
guagguguucuaaggaaua

SEQ ID NO: 1049657 - RNA, 19 nt, Homo sapiens
gaagaugaaagaccagcuu

SEQ ID NO: 1049658 - RNA, 19 nt, Homo sapiens
gaggcaaauugaagauuag

SEQ ID NO: 1049659 - RNA, 19 nt, Homo sapiens
ucuaaggaauagcugcaua

SEQ ID NO: 1049660 - RNA, 19 nt, Homo sapiens
uaacacuucauucuaggua

SEQ ID NO: 1049661 - RNA, 19 nt, Homo sapiens
ucaguucucuaauuaccaa

SEQ ID NO: 1049662 - RNA, 19 nt, Homo sapiens
cauccucggucuuuacuuc

SEQ ID NO: 1049663 - RNA, 19 nt, Homo sapiens
guacagggaagcacugaau

SEQ ID NO: 1049664 - RNA, 19 nt, Homo sapiens
gaaacucuguaucauuuug

SEQ ID NO: 1049665 - RNA, 19 nt, Homo sapiens
uaaagauguuucugacaag

SEQ ID NO: 1049666 - RNA, 19 nt, Homo sapiens
gcuaacuuauuaccacuca

SEQ ID NO: 1049667 - RNA, 19 nt, Homo sapiens
ucacacauaacacuucauu

SEQ ID NO: 1049668 - RNA, 19 nt, Homo sapiens
ggcauucagucuucuggaa

SEQ ID NO: 1049669 - RNA, 19 nt, Homo sapiens
cagcauugguguauggaau

SEQ ID NO: 1049670 - RNA, 19 nt, Homo sapiens
gaaagaccagcuuggaaca

SEQ ID NO: 1049671 - RNA, 19 nt, Homo sapiens
uaacugcaacacuauaaug

SEQ ID NO: 1049672 - RNA, 19 nt, Homo sapiens
gcaggaauggcaauaguag

SEQ ID NO: 1049673 - RNA, 19 nt, Homo sapiens
cuaaagcucuccacaucuc

SEQ ID NO: 1049674 - RNA, 19 nt, Homo sapiens
cuaggaaaguaauugcuau

SEQ ID NO: 1049675 - RNA, 19 nt, Homo sapiens
ugaagucgaagaugaaaga

SEQ ID NO: 1049676 - RNA, 19 nt, Homo sapiens
gguuugaggaauuaguuua

SEQ ID NO: 1049677 - RNA, 19 nt, Homo sapiens
guaagaacaguaauugaag

SEQ ID NO: 1049678 - RNA, 19 nt, Homo sapiens
gaauuaggguaagaacagu

SEQ ID NO: 1049679 - RNA, 19 nt, Homo sapiens
uuaaauacuucgcauacuc

SEQ ID NO: 1049680 - RNA, 19 nt, Homo sapiens
uuacugagucugucaaaga

SEQ ID NO: 1049681 - RNA, 19 nt, Homo sapiens
gcacauuacuuagcuaaca

SEQ ID NO: 1049682 - RNA, 19 nt, Homo sapiens
guaagacacuuggcacaaa

SEQ ID NO: 1049683 - RNA, 19 nt, Homo sapiens
acaaagcuaugugaccuua

SEQ ID NO: 1049684 - RNA, 19 nt, Homo sapiens
gaccauaucuuaggacaca

SEQ ID NO: 1049685 - RNA, 19 nt, Homo sapiens
ggucaucaccgccgacuuu

SEQ ID NO: 1049686 - RNA, 19 nt, Homo sapiens
cauaguaaaggcucaauaa

SEQ ID NO: 1049687 - RNA, 19 nt, Homo sapiens
gagacaagcccguaugugu

SEQ ID NO: 1049688 - RNA, 19 nt, Homo sapiens
aaucagggcuucaacaaca

SEQ ID NO: 1049689 - RNA, 19 nt, Homo sapiens
gaaugggccuaacuuccuu

SEQ ID NO: 1049690 - RNA, 19 nt, Homo sapiens
gcacaaaaccuggcacaua

SEQ ID NO: 1049691 - RNA, 19 nt, Homo sapiens
gaggugacguggccagaug

SEQ ID NO: 1049692 - RNA, 19 nt, Homo sapiens
gcaaucagggcuucaacaa

SEQ ID NO: 1049693 - RNA, 19 nt, Homo sapiens
caaaguggacaucgucuau

SEQ ID NO: 1049694 - RNA, 19 nt, Homo sapiens
ccacguacaccgacaaguu

SEQ ID NO: 1049695 - RNA, 19 nt, Homo sapiens
gcaauaaccggugggaaga

SEQ ID NO: 1049696 - RNA, 19 nt, Homo sapiens
gagaucuucuucaacaaca

SEQ ID NO: 1049697 - RNA, 19 nt, Homo sapiens
caaccgugauggcaaagug

SEQ ID NO: 1049698 - RNA, 19 nt, Homo sapiens
ucacugggcuuugucaaca

SEQ ID NO: 1049699 - RNA, 19 nt, Homo sapiens
ggucacagccugcgacauc

SEQ ID NO: 1049700 - RNA, 19 nt, Homo sapiens
cauccaugcacauuacuua

SEQ ID NO: 1049701 - RNA, 19 nt, Homo sapiens
gagaucuacuuccucaaca

SEQ ID NO: 1049702 - RNA, 19 nt, Homo sapiens
gcaaaguggacaucgucua

SEQ ID NO: 1049703 - RNA, 19 nt, Homo sapiens
ggacgcuacucuaucuaca

SEQ ID NO: 1049704 - RNA, 19 nt, Homo sapiens
guguggagauuagauuaaa

SEQ ID NO: 1049705 - RNA, 19 nt, Homo sapiens
cuggagaucuucuucaaca

SEQ ID NO: 1049706 - RNA, 19 nt, Homo sapiens
aaagcuaugugaccuuaca

SEQ ID NO: 1049707 - RNA, 19 nt, Homo sapiens
ccgccgacuuugacaauga

SEQ ID NO: 1049708 - RNA, 19 nt, Homo sapiens
aaaccuggcacauaguaaa

SEQ ID NO: 1049709 - RNA, 19 nt, Homo sapiens
ccagggagguggugucacu

SEQ ID NO: 1049710 - RNA, 19 nt, Homo sapiens
uaaugaccauaucuuagga

SEQ ID NO: 1049711 - RNA, 19 nt, Homo sapiens
acaauuagggagacucgua

SEQ ID NO: 1049712 - RNA, 19 nt, Homo sapiens
ccacuggagacaccaauga

SEQ ID NO: 1049713 - RNA, 19 nt, Homo sapiens
gauaucuucugcgacaaug

SEQ ID NO: 1049714 - RNA, 19 nt, Homo sapiens
caauuagggagacucguaa

SEQ ID NO: 1049715 - RNA, 19 nt, Homo sapiens
gaucuucuucaacaacauu

SEQ ID NO: 1049716 - RNA, 19 nt, Homo sapiens
acgcuacucuaucuacauu

SEQ ID NO: 1049717 - RNA, 19 nt, Homo sapiens
gcccauccaugcacauuac

SEQ ID NO: 1049718 - RNA, 19 nt, Homo sapiens
cugaugcccucauugaaau

SEQ ID NO: 1049719 - RNA, 19 nt, Homo sapiens
ccugaugcccucauugaaa

SEQ ID NO: 1049720 - RNA, 19 nt, Homo sapiens
gcucuggacgcuacucuau

SEQ ID NO: 1049721 - RNA, 19 nt, Homo sapiens
cacauuacuuagcuaacaa

SEQ ID NO: 1049722 - RNA, 19 nt, Homo sapiens
gacaucgccucacccaagu

SEQ ID NO: 1049723 - RNA, 19 nt, Homo sapiens
cuucaaccgugauggcaaa

SEQ ID NO: 1049724 - RNA, 19 nt, Homo sapiens
ggagaucuacuuccucaac

SEQ ID NO: 1049725 - RNA, 19 nt, Homo sapiens
gcccugaugcccucauuga

SEQ ID NO: 1049726 - RNA, 19 nt, Homo sapiens
gucuaaugaccauaucuua

SEQ ID NO: 1049727 - RNA, 19 nt, Homo sapiens
gagcaggggugggacauga

SEQ ID NO: 1049728 - RNA, 19 nt, Homo sapiens
ccaaugaaugcauccaguu

SEQ ID NO: 1049729 - RNA, 19 nt, Homo sapiens
gggaugaggacacacuuca

SEQ ID NO: 1049730 - RNA, 19 nt, Homo sapiens
cacaaaaccuggcacauag

SEQ ID NO: 1049731 - RNA, 19 nt, Homo sapiens
gcaaaauggggauuaagaa

SEQ ID NO: 1049732 - RNA, 19 nt, Homo sapiens
ggauaucuucugcgacaau

SEQ ID NO: 1049733 - RNA, 19 nt, Homo sapiens
uaagacacuuggcacaaaa

SEQ ID NO: 1049734 - RNA, 19 nt, Homo sapiens
ggguuaguguggagauuag

SEQ ID NO: 1049735 - RNA, 19 nt, Homo sapiens
gaauagaaucuugggguua

SEQ ID NO: 1049736 - RNA, 19 nt, Homo sapiens
accagucacuuaacuuguu

SEQ ID NO: 1049737 - RNA, 19 nt, Homo sapiens
acaaugagaaugggccuaa

SEQ ID NO: 1049738 - RNA, 19 nt, Homo sapiens
gcagcagugccucggauau

SEQ ID NO: 1049739 - RNA, 19 nt, Homo sapiens
guggagauuagauuaaaug

SEQ ID NO: 1049740 - RNA, 19 nt, Homo sapiens
gcaccgguccucguagaug

SEQ ID NO: 1049741 - RNA, 19 nt, Homo sapiens
caaugaaugcauccaguuc

SEQ ID NO: 1049742 - RNA, 19 nt, Homo sapiens
uuacaccagucacuuaacu

SEQ ID NO: 1049743 - RNA, 19 nt, Homo sapiens
caggaacucacaaagcuau

SEQ ID NO: 1049744 - RNA, 19 nt, Homo sapiens
ugauggcgcuuacauucca

SEQ ID NO: 1049745 - RNA, 19 nt, Homo sapiens
ugaacucagugcuggagau

SEQ ID NO: 1049746 - RNA, 19 nt, Homo sapiens
ggagaucuucuucaacaac

SEQ ID NO: 1049747 - RNA, 19 nt, Homo sapiens
gcuacucuaucuacauugc

SEQ ID NO: 1049748 - RNA, 19 nt, Homo sapiens
gguaaugugggcccugaug

SEQ ID NO: 1049749 - RNA, 19 nt, Homo sapiens
cuuguuagccauccauuau

SEQ ID NO: 1049750 - RNA, 19 nt, Homo sapiens
uuaguguccugaguucaaa

SEQ ID NO: 1049751 - RNA, 19 nt, Homo sapiens
ccugauggcgcuuacauuc

SEQ ID NO: 1049752 - RNA, 19 nt, Homo sapiens
gaacucagugcuggagauc

SEQ ID NO: 1049753 - RNA, 19 nt, Homo sapiens
gcacauaguaaaggcucaa

SEQ ID NO: 1049754 - RNA, 19 nt, Homo sapiens
ucuggacgcuacucuaucu

SEQ ID NO: 1049755 - RNA, 19 nt, Homo sapiens
uguaaaggccugggagcua

SEQ ID NO: 1049756 - RNA, 19 nt, Homo sapiens
gcugcugccuagacaguag

SEQ ID NO: 1049757 - RNA, 19 nt, Homo sapiens
gcuaaggucgugcucuaca

SEQ ID NO: 1049758 - RNA, 19 nt, Homo sapiens
uaguguggagauuagauua

SEQ ID NO: 1049759 - RNA, 19 nt, Homo sapiens
acaccagucacuuaacuug

SEQ ID NO: 1049760 - RNA, 19 nt, Homo sapiens
ggaacucacaaagcuaugu

SEQ ID NO: 1049761 - RNA, 19 nt, Homo sapiens
caaaaccuggcacauagua

SEQ ID NO: 1049762 - RNA, 19 nt, Homo sapiens
uguucaaguuccgcaauaa

SEQ ID NO: 1049763 - RNA, 19 nt, Homo sapiens
ucacugcacaggaaguaug

SEQ ID NO: 1049764 - RNA, 19 nt, Homo sapiens
uuguucaaguuccgcaaua

SEQ ID NO: 1049765 - RNA, 19 nt, Homo sapiens
gagcuggagaucuucuuca

SEQ ID NO: 1049766 - RNA, 19 nt, Homo sapiens
caccgccucuaucugcaaa

SEQ ID NO: 1049767 - RNA, 19 nt, Homo sapiens
gcagugccucggauaucuu

SEQ ID NO: 1049768 - RNA, 19 nt, Homo sapiens
cacguacaccgacaaguug

SEQ ID NO: 1049769 - RNA, 19 nt, Homo sapiens
aaauggggauuaagaauag

SEQ ID NO: 1049770 - RNA, 19 nt, Homo sapiens
gucgugcucuacaccaaga

SEQ ID NO: 1049771 - RNA, 19 nt, Homo sapiens
uggugucacugcacaggaa

SEQ ID NO: 1049772 - RNA, 19 nt, Homo sapiens
ccaugcacauuacuuagcu

SEQ ID NO: 1049773 - RNA, 19 nt, Homo sapiens
cgugugcccucgagacaag

SEQ ID NO: 1049774 - RNA, 19 nt, Homo sapiens
ggagcuggagaucuucuuc

SEQ ID NO: 1049775 - RNA, 19 nt, Homo sapiens
aaguggacaucgucuaugg

SEQ ID NO: 1049776 - RNA, 19 nt, Homo sapiens
ccuuacaccagucacuuaa

SEQ ID NO: 1049777 - RNA, 19 nt, Homo sapiens
gaccuuacaccagucacuu

SEQ ID NO: 1049778 - RNA, 19 nt, Homo sapiens
gacgcucuguggccugugu

SEQ ID NO: 1049779 - RNA, 19 nt, Homo sapiens
uaucgcaucugcaaaaugg

SEQ ID NO: 1049780 - RNA, 19 nt, Homo sapiens
ucaggaacucacaaagcua

SEQ ID NO: 1049781 - RNA, 19 nt, Homo sapiens
ggaaggcucuuguuaauau

SEQ ID NO: 1049782 - RNA, 19 nt, Homo sapiens
ccaagaaggucaagaagua

SEQ ID NO: 1049783 - RNA, 19 nt, Homo sapiens
ggacagggaucgagaaaga

SEQ ID NO: 1049784 - RNA, 19 nt, Homo sapiens
gaaguuaacucgaaagcaa

SEQ ID NO: 1049785 - RNA, 19 nt, Homo sapiens
ggaaggugcugaggaaaua

SEQ ID NO: 1049786 - RNA, 19 nt, Homo sapiens
gaaggaaggugcugaggaa

SEQ ID NO: 1049787 - RNA, 19 nt, Homo sapiens
gcaauaaacugccacuaau

SEQ ID NO: 1049788 - RNA, 19 nt, Homo sapiens
caaagaacguucccacaaa

SEQ ID NO: 1049789 - RNA, 19 nt, Homo sapiens
gcaaagagaaaucaaguaa

SEQ ID NO: 1049790 - RNA, 19 nt, Homo sapiens
gaaaggaaacacagaagua

SEQ ID NO: 1049791 - RNA, 19 nt, Homo sapiens
ggagauugcuguuugaguu

SEQ ID NO: 1049792 - RNA, 19 nt, Homo sapiens
gaucuuggaugucuauuau

SEQ ID NO: 1049793 - RNA, 19 nt, Homo sapiens
gagaauggaucuuggaugu

SEQ ID NO: 1049794 - RNA, 19 nt, Homo sapiens
gcacagagaugacaaaaga

SEQ ID NO: 1049795 - RNA, 19 nt, Homo sapiens
gcgcuuggauuuauguaua

SEQ ID NO: 1049796 - RNA, 19 nt, Homo sapiens
guacagggaugucuuagug

SEQ ID NO: 1049797 - RNA, 19 nt, Homo sapiens
ggaagugccuuuguaauuc

SEQ ID NO: 1049798 - RNA, 19 nt, Homo sapiens
caaaagagauuccaagaaa

SEQ ID NO: 1049799 - RNA, 19 nt, Homo sapiens
ugaaacagcuugauauagu

SEQ ID NO: 1049800 - RNA, 19 nt, Homo sapiens
gaaauagacagacauguug

SEQ ID NO: 1049801 - RNA, 19 nt, Homo sapiens
ggaaauagacagacauguu

SEQ ID NO: 1049802 - RNA, 19 nt, Homo sapiens
gcagaacccuauacuaaca

SEQ ID NO: 1049803 - RNA, 19 nt, Homo sapiens
caagaaagaugggaaggaa

SEQ ID NO: 1049804 - RNA, 19 nt, Homo sapiens
gaaguuaguuucugaugca

SEQ ID NO: 1049805 - RNA, 19 nt, Homo sapiens
guagggaagugccuuugua

SEQ ID NO: 1049806 - RNA, 19 nt, Homo sapiens
gagaaaugcuacgaucuuu

SEQ ID NO: 1049807 - RNA, 19 nt, Homo sapiens
gauaauggcaguucccuuu

SEQ ID NO: 1049808 - RNA, 19 nt, Homo sapiens
gaagaaacauaaagaagac

SEQ ID NO: 1049809 - RNA, 19 nt, Homo sapiens
gaacagaggaguauuaaaa

SEQ ID NO: 1049810 - RNA, 19 nt, Homo sapiens
ggauuaacauucuugucua

SEQ ID NO: 1049811 - RNA, 19 nt, Homo sapiens
gaacaagagagccaagaaa

SEQ ID NO: 1049812 - RNA, 19 nt, Homo sapiens
gaaacgaaguagaaguaga

SEQ ID NO: 1049813 - RNA, 19 nt, Homo sapiens
gaacauagucccagcaaag

SEQ ID NO: 1049814 - RNA, 19 nt, Homo sapiens
cggcgaagaucccgaagua

SEQ ID NO: 1049815 - RNA, 19 nt, Homo sapiens
gcaaagaacguucccacaa

SEQ ID NO: 1049816 - RNA, 19 nt, Homo sapiens
caucaugaguguggaauaa

SEQ ID NO: 1049817 - RNA, 19 nt, Homo sapiens
gaaacagcuugauauagug

SEQ ID NO: 1049818 - RNA, 19 nt, Homo sapiens
gggaagugccuuuguaauu

SEQ ID NO: 1049819 - RNA, 19 nt, Homo sapiens
gaagaggaccuagauguga

SEQ ID NO: 1049820 - RNA, 19 nt, Homo sapiens
caagugaugggucuuauaa

SEQ ID NO: 1049821 - RNA, 19 nt, Homo sapiens
uaauggagauugcuguuug

SEQ ID NO: 1049822 - RNA, 19 nt, Homo sapiens
ugacagagaauuagaaaga

SEQ ID NO: 1049823 - RNA, 19 nt, Homo sapiens
acaguuaccuuuagagaga

SEQ ID NO: 1049824 - RNA, 19 nt, Homo sapiens
ggccaugggucuucuaguu

SEQ ID NO: 1049825 - RNA, 19 nt, Homo sapiens
caacuuguauucugauuac

SEQ ID NO: 1049826 - RNA, 19 nt, Homo sapiens
gcagaugaguagagaaaca

SEQ ID NO: 1049827 - RNA, 19 nt, Homo sapiens
gggaaacgaaguagaagua

SEQ ID NO: 1049828 - RNA, 19 nt, Homo sapiens
agagagcgaucaagagaaa

SEQ ID NO: 1049829 - RNA, 19 nt, Homo sapiens
gcgaagaucccgaaguauu

SEQ ID NO: 1049830 - RNA, 19 nt, Homo sapiens
gguggaggcuguguaauga

SEQ ID NO: 1049831 - RNA, 19 nt, Homo sapiens
gcagggaaacgaaguagaa

SEQ ID NO: 1049832 - RNA, 19 nt, Homo sapiens
gauacaugaugcacagauu

SEQ ID NO: 1049833 - RNA, 19 nt, Homo sapiens
cgaaggagccaaaguauag

SEQ ID NO: 1049834 - RNA, 19 nt, Homo sapiens
gaauggaucuuggaugucu

SEQ ID NO: 1049835 - RNA, 19 nt, Homo sapiens
guacauauguccugaaaau

SEQ ID NO: 1049836 - RNA, 19 nt, Homo sapiens
uggacgagaucuacuuuaa

SEQ ID NO: 1049837 - RNA, 19 nt, Homo sapiens
ucaaauaaacgaagucgaa

SEQ ID NO: 1049838 - RNA, 19 nt, Homo sapiens
cacagacucuccauauauu

SEQ ID NO: 1049839 - RNA, 19 nt, Homo sapiens
gagccaaaguauagaacaa

SEQ ID NO: 1049840 - RNA, 19 nt, Homo sapiens
ggaaagaggaaaugaacga

SEQ ID NO: 1049841 - RNA, 19 nt, Homo sapiens
ccaaagaaagggagaaaga

SEQ ID NO: 1049842 - RNA, 19 nt, Homo sapiens
gaaagaacgccagcgacua

SEQ ID NO: 1049843 - RNA, 19 nt, Homo sapiens
ggagaaaugcuacgaucuu

SEQ ID NO: 1049844 - RNA, 19 nt, Homo sapiens
ggcaugugguaaucaauaa

SEQ ID NO: 1049845 - RNA, 19 nt, Homo sapiens
gaagagaagaaacauaaag

SEQ ID NO: 1049846 - RNA, 19 nt, Homo sapiens
cacacagacucuccauaua

SEQ ID NO: 1049847 - RNA, 19 nt, Homo sapiens
ucuacgagcucaagaccua

SEQ ID NO: 1049848 - RNA, 19 nt, Homo sapiens
gacgagaucuacuuuaagg

SEQ ID NO: 1049849 - RNA, 19 nt, Homo sapiens
gggcaugugguaaucaaua

SEQ ID NO: 1049850 - RNA, 19 nt, Homo sapiens
ccagaugacaagugaauuu

SEQ ID NO: 1049851 - RNA, 19 nt, Homo sapiens
ggugugggauuaugguuug

SEQ ID NO: 1049852 - RNA, 19 nt, Homo sapiens
agaaguaggagucgaagua

SEQ ID NO: 1049853 - RNA, 19 nt, Homo sapiens
gcaagugaugggucuuaua

SEQ ID NO: 1049854 - RNA, 19 nt, Homo sapiens
ggacaauauguuagcauuu

SEQ ID NO: 1049855 - RNA, 19 nt, Homo sapiens
cuagaacagaggaguauua

SEQ ID NO: 1049856 - RNA, 19 nt, Homo sapiens
ggagaaaggaagcaggaaa

SEQ ID NO: 1049857 - RNA, 19 nt, Homo sapiens
caagaaggcagcauuguag

SEQ ID NO: 1049858 - RNA, 19 nt, Homo sapiens
cguaauagaaugcuaaaga

SEQ ID NO: 1049859 - RNA, 19 nt, Homo sapiens
acagauuguucuugcauuu

SEQ ID NO: 1049860 - RNA, 19 nt, Homo sapiens
guuguuacaugugucauuu

SEQ ID NO: 1049861 - RNA, 19 nt, Homo sapiens
guaauagaaugcuaaagac

SEQ ID NO: 1049862 - RNA, 19 nt, Homo sapiens
ucacccaauuguuaaguuu

SEQ ID NO: 1049863 - RNA, 19 nt, Homo sapiens
uuagagcgcuuggauuuau

SEQ ID NO: 1049864 - RNA, 19 nt, Homo sapiens
aggcagcauuguaggauua

SEQ ID NO: 1049865 - RNA, 19 nt, Homo sapiens
gaaguagaagcaaagagaa

SEQ ID NO: 1049866 - RNA, 19 nt, Homo sapiens
cgagaaagagagaaagaaa

SEQ ID NO: 1049867 - RNA, 19 nt, Homo sapiens
ucacaaaacuggagugguu

SEQ ID NO: 1049868 - RNA, 19 nt, Homo sapiens
uauuagagcgcuuggauuu

SEQ ID NO: 1049869 - RNA, 19 nt, Homo sapiens
ggaauuguuucuacagcau

SEQ ID NO: 1049870 - RNA, 19 nt, Homo sapiens
gaugaaacgucaguagagu

SEQ ID NO: 1049871 - RNA, 19 nt, Homo sapiens
gggcagaugaguagagaaa

SEQ ID NO: 1049872 - RNA, 19 nt, Homo sapiens
uugcagaacccuauacuaa

SEQ ID NO: 1049873 - RNA, 19 nt, Homo sapiens
uaacauucuugucuacugu

SEQ ID NO: 1049874 - RNA, 19 nt, Homo sapiens
gauuaugguuuguguacug

SEQ ID NO: 1049875 - RNA, 19 nt, Homo sapiens
ggaacauagucccagcaaa

SEQ ID NO: 1049876 - RNA, 19 nt, Homo sapiens
aagaggaaaugaacgagaa

SEQ ID NO: 1049877 - RNA, 19 nt, Homo sapiens
aaacgaaguagaaguagaa

SEQ ID NO: 1049878 - RNA, 19 nt, Homo sapiens
aaagagauuccaagaaaga

SEQ ID NO: 1049879 - RNA, 19 nt, Homo sapiens
gagaagaaacauaaagaag

SEQ ID NO: 1049880 - RNA, 19 nt, Homo sapiens
gaagaucccgaaguauuga

SEQ ID NO: 1049881 - RNA, 19 nt, Homo sapiens
gaaguugccuuaaagaaua

SEQ ID NO: 1049882 - RNA, 19 nt, Homo sapiens
gaauauaucuggacuggua

SEQ ID NO: 1049883 - RNA, 19 nt, Homo sapiens
gugaagagcuggaaacuua

SEQ ID NO: 1049884 - RNA, 19 nt, Homo sapiens
ccucagagcuccuuaauaa

SEQ ID NO: 1049885 - RNA, 19 nt, Homo sapiens
gaucuugacuucuugaaua

SEQ ID NO: 1049886 - RNA, 19 nt, Homo sapiens
gaacaauacuuaguggaua

SEQ ID NO: 1049887 - RNA, 19 nt, Homo sapiens
gcggauaccugcuucagua

SEQ ID NO: 1049888 - RNA, 19 nt, Homo sapiens
ggaaggaaacacugaaaua

SEQ ID NO: 1049889 - RNA, 19 nt, Homo sapiens
gaauuaagcugagcaggaa

SEQ ID NO: 1049890 - RNA, 19 nt, Homo sapiens
ggacaaccuuuccaucaaa

SEQ ID NO: 1049891 - RNA, 19 nt, Homo sapiens
gagaagaccuggguacuug

SEQ ID NO: 1049892 - RNA, 19 nt, Homo sapiens
gaaggaaacacugaaauaa

SEQ ID NO: 1049893 - RNA, 19 nt, Homo sapiens
gguaucaucuucagagaaa

SEQ ID NO: 1049894 - RNA, 19 nt, Homo sapiens
gaauguccauauuguagua

SEQ ID NO: 1049895 - RNA, 19 nt, Homo sapiens
caucauauuuggugaaugu

SEQ ID NO: 1049896 - RNA, 19 nt, Homo sapiens
gcaauagaaucacuaaagg

SEQ ID NO: 1049897 - RNA, 19 nt, Homo sapiens
gggauaaacuuguguaugc

SEQ ID NO: 1049898 - RNA, 19 nt, Homo sapiens
cagcugagaacaauacuua

SEQ ID NO: 1049899 - RNA, 19 nt, Homo sapiens
gaucuaaugagcuuuauga

SEQ ID NO: 1049900 - RNA, 19 nt, Homo sapiens
gacgugaguuauccaagua

SEQ ID NO: 1049901 - RNA, 19 nt, Homo sapiens
gcguuugucucuucacuaa

SEQ ID NO: 1049902 - RNA, 19 nt, Homo sapiens
caaaguauccugcagaauc

SEQ ID NO: 1049903 - RNA, 19 nt, Homo sapiens
ggaaguugccuuaaagaau

SEQ ID NO: 1049904 - RNA, 19 nt, Homo sapiens
agaguaaacugggaaauug

SEQ ID NO: 1049905 - RNA, 19 nt, Homo sapiens
gcagcacccuccugaucua

SEQ ID NO: 1049906 - RNA, 19 nt, Homo sapiens
aggaaacacugaaauaaga

SEQ ID NO: 1049907 - RNA, 19 nt, Homo sapiens
gcaggaacauacauuugug

SEQ ID NO: 1049908 - RNA, 19 nt, Homo sapiens
acugaagaaugcaagauua

SEQ ID NO: 1049909 - RNA, 19 nt, Homo sapiens
guaugaugaugcgauaaua

SEQ ID NO: 1049910 - RNA, 19 nt, Homo sapiens
uagaaucacuaaaggcauu

SEQ ID NO: 1049911 - RNA, 19 nt, Homo sapiens
aguguugccugaagauuua

SEQ ID NO: 1049912 - RNA, 19 nt, Homo sapiens
ucaguaccaucaaguuaaa

SEQ ID NO: 1049913 - RNA, 19 nt, Homo sapiens
uuuaaucacucucaaguug

SEQ ID NO: 1049914 - RNA, 19 nt, Homo sapiens
caaagguucuugagacucu

SEQ ID NO: 1049915 - RNA, 19 nt, Homo sapiens
gaagagcuggaaacuuaaa

SEQ ID NO: 1049916 - RNA, 19 nt, Homo sapiens
uggauaccaucgaauagua

SEQ ID NO: 1049917 - RNA, 19 nt, Homo sapiens
ccugagugcuucuuucuug

SEQ ID NO: 1049918 - RNA, 19 nt, Homo sapiens
aaaguauccugcagaauca

SEQ ID NO: 1049919 - RNA, 19 nt, Homo sapiens
gcacccuccugaucuaaug

SEQ ID NO: 1049920 - RNA, 19 nt, Homo sapiens
gcaagaaauacuaacauca

SEQ ID NO: 1049921 - RNA, 19 nt, Homo sapiens
gcaacagcacgcagaauug

SEQ ID NO: 1049922 - RNA, 19 nt, Homo sapiens
ggcaaaguauccugcagaa

SEQ ID NO: 1049923 - RNA, 19 nt, Homo sapiens
ggaauuguguauagcugau

SEQ ID NO: 1049924 - RNA, 19 nt, Homo sapiens
ugagaggacuacuaacuag

SEQ ID NO: 1049925 - RNA, 19 nt, Homo sapiens
ggauaguguugccugaaga

SEQ ID NO: 1049926 - RNA, 19 nt, Homo sapiens
cagguaugaugaugcgaua

SEQ ID NO: 1049927 - RNA, 19 nt, Homo sapiens
ggaaacacugaaauaagaa

SEQ ID NO: 1049928 - RNA, 19 nt, Homo sapiens
gagcaggaacauacauuug

SEQ ID NO: 1049929 - RNA, 19 nt, Homo sapiens
guaaaaccccugggaauua

SEQ ID NO: 1049930 - RNA, 19 nt, Homo sapiens
ccauaaauauagagguaga

SEQ ID NO: 1049931 - RNA, 19 nt, Homo sapiens
gaaauuguaggccaaaguc

SEQ ID NO: 1049932 - RNA, 19 nt, Homo sapiens
gaagauuuacaacugaaga

SEQ ID NO: 1049933 - RNA, 19 nt, Homo sapiens
caacuugacgguaccauuc

SEQ ID NO: 1049934 - RNA, 19 nt, Homo sapiens
uggaugaaaucgaugagaa

SEQ ID NO: 1049935 - RNA, 19 nt, Homo sapiens
caucugcguuugucucuuc

SEQ ID NO: 1049936 - RNA, 19 nt, Homo sapiens
gcagcaauagaaucacuaa

SEQ ID NO: 1049937 - RNA, 19 nt, Homo sapiens
gaauagacaagagcuguau

SEQ ID NO: 1049938 - RNA, 19 nt, Homo sapiens
ucaagugugugauaauucu

SEQ ID NO: 1049939 - RNA, 19 nt, Homo sapiens
gagauaggaacucuugguu

SEQ ID NO: 1049940 - RNA, 19 nt, Homo sapiens
cuguggaaguguauuuaua

SEQ ID NO: 1049941 - RNA, 19 nt, Homo sapiens
gcagaauugcauuagguaa

SEQ ID NO: 1049942 - RNA, 19 nt, Homo sapiens
ucugggauguuauggauga

SEQ ID NO: 1049943 - RNA, 19 nt, Homo sapiens
aaacuuguguaugcggaua

SEQ ID NO: 1049944 - RNA, 19 nt, Homo sapiens
ccugaagauuuacaacuga

SEQ ID NO: 1049945 - RNA, 19 nt, Homo sapiens
uacuauggauuguggaauu

SEQ ID NO: 1049946 - RNA, 19 nt, Homo sapiens
gggauguuauggaugaaau

SEQ ID NO: 1049947 - RNA, 19 nt, Homo sapiens
caaccuuuccaucaaauau

SEQ ID NO: 1049948 - RNA, 19 nt, Homo sapiens
gacaaccuuuccaucaaau

SEQ ID NO: 1049949 - RNA, 19 nt, Homo sapiens
uaaaaccccugggaauuaa

SEQ ID NO: 1049950 - RNA, 19 nt, Homo sapiens
ggauuuuccuguuccauuu

SEQ ID NO: 1049951 - RNA, 19 nt, Homo sapiens
gccugaagauuuacaacug

SEQ ID NO: 1049952 - RNA, 19 nt, Homo sapiens
uugagacucuugauauuuc

SEQ ID NO: 1049953 - RNA, 19 nt, Homo sapiens
aaaaugaguuugggaauug

SEQ ID NO: 1049954 - RNA, 19 nt, Homo sapiens
agacagaguuuuaacauca

SEQ ID NO: 1049955 - RNA, 19 nt, Homo sapiens
uaccauuccugaucaagug

SEQ ID NO: 1049956 - RNA, 19 nt, Homo sapiens
ucuugagacucuugauauu

SEQ ID NO: 1049957 - RNA, 19 nt, Homo sapiens
ggaaauuguaggccaaagu

SEQ ID NO: 1049958 - RNA, 19 nt, Homo sapiens
ggugaauguccauauugua

SEQ ID NO: 1049959 - RNA, 19 nt, Homo sapiens
gaugaaaucgaugagaaga

SEQ ID NO: 1049960 - RNA, 19 nt, Homo sapiens
caaguugaaggcaaaguau

SEQ ID NO: 1049961 - RNA, 19 nt, Homo sapiens
caguucuacucaagccuua

SEQ ID NO: 1049962 - RNA, 19 nt, Homo sapiens
agacuuccaccuuaggaua

SEQ ID NO: 1049963 - RNA, 19 nt, Homo sapiens
gaagaugcuuuuggaaguu

SEQ ID NO: 1049964 - RNA, 19 nt, Homo sapiens
gcuuuaugauggaguugaa

SEQ ID NO: 1049965 - RNA, 19 nt, Homo sapiens
guucuugagacucuugaua

SEQ ID NO: 1049966 - RNA, 19 nt, Homo sapiens
uggcugagaggacuacuaa

SEQ ID NO: 1049967 - RNA, 19 nt, Homo sapiens
caucucggcucagggaaga

SEQ ID NO: 1049968 - RNA, 19 nt, Homo sapiens
guagagagcauuuaaucac

SEQ ID NO: 1049969 - RNA, 19 nt, Homo sapiens
agacgugaguuauccaagu

SEQ ID NO: 1049970 - RNA, 19 nt, Homo sapiens
caucgaauaguacaacaga

SEQ ID NO: 1049971 - RNA, 19 nt, Homo sapiens
gguaugaugaugcgauaau

SEQ ID NO: 1049972 - RNA, 19 nt, Homo sapiens
aauacaacauuucggugaa

SEQ ID NO: 1049973 - RNA, 19 nt, Homo sapiens
ggaauuuguuaugcuuauc

SEQ ID NO: 1049974 - RNA, 19 nt, Homo sapiens
guuggcagcugagaacaau

SEQ ID NO: 1049975 - RNA, 19 nt, Homo sapiens
ggaacucuugguugggaua

SEQ ID NO: 1049976 - RNA, 19 nt, Homo sapiens
gaauaguacaacagagaau

SEQ ID NO: 1049977 - RNA, 19 nt, Homo sapiens
gugaauguccauauuguag

SEQ ID NO: 1049978 - RNA, 19 nt, Homo sapiens
uaguggauaccaucgaaua

SEQ ID NO: 1049979 - RNA, 19 nt, Homo sapiens
gguagagagcauuuaauca

SEQ ID NO: 1049980 - RNA, 19 nt, Homo sapiens
cuucaguaccaucaaguua

SEQ ID NO: 1049981 - RNA, 19 nt, Homo sapiens
gaaagaacgugaagagaaa

SEQ ID NO: 1049982 - RNA, 19 nt, Homo sapiens
gauuaaagcugguauucua

SEQ ID NO: 1049983 - RNA, 19 nt, Homo sapiens
gaacagcccuuauuuacuc

SEQ ID NO: 1049984 - RNA, 19 nt, Homo sapiens
gaagagaagacauuuagaa

SEQ ID NO: 1049985 - RNA, 19 nt, Homo sapiens
caagaggucccaauuauga

SEQ ID NO: 1049986 - RNA, 19 nt, Homo sapiens
gagaacagccugcuagcua

SEQ ID NO: 1049987 - RNA, 19 nt, Homo sapiens
gcagaaguaucuccgaaug

SEQ ID NO: 1049988 - RNA, 19 nt, Homo sapiens
gaacaaauucuguacaaca

SEQ ID NO: 1049989 - RNA, 19 nt, Homo sapiens
agagaaaguucgagaagaa

SEQ ID NO: 1049990 - RNA, 19 nt, Homo sapiens
gagaagacauuuagaaacg

SEQ ID NO: 1049991 - RNA, 19 nt, Homo sapiens
gaucgccgcucgcaagcua

SEQ ID NO: 1049992 - RNA, 19 nt, Homo sapiens
gcagcauccucaccauuaa

SEQ ID NO: 1049993 - RNA, 19 nt, Homo sapiens
gaugaucugugaacguuug

SEQ ID NO: 1049994 - RNA, 19 nt, Homo sapiens
aaagaacagcccuuauuua

SEQ ID NO: 1049995 - RNA, 19 nt, Homo sapiens
gcagaagagaagacauuua

SEQ ID NO: 1049996 - RNA, 19 nt, Homo sapiens
caaauaaugcgacgauaug

SEQ ID NO: 1049997 - RNA, 19 nt, Homo sapiens
gggaugaucugugaacguu

SEQ ID NO: 1049998 - RNA, 19 nt, Homo sapiens
agaacaauaugaugcguuu

SEQ ID NO: 1049999 - RNA, 19 nt, Homo sapiens
ugaaagaacgugaagagaa

SEQ ID NO: 1050000 - RNA, 19 nt, Homo sapiens
gguaggcucuccucgaguu

SEQ ID NO: 1050001 - RNA, 19 nt, Homo sapiens
gaaaguucgagaagaauau

SEQ ID NO: 1050002 - RNA, 19 nt, Homo sapiens
gaacguuuguugaaagaac

SEQ ID NO: 1050003 - RNA, 19 nt, Homo sapiens
gaucuagccucagcacaga

SEQ ID NO: 1050004 - RNA, 19 nt, Homo sapiens
gcccuucacugguugugua

SEQ ID NO: 1050005 - RNA, 19 nt, Homo sapiens
gaagagaaaguucgagaag

SEQ ID NO: 1050006 - RNA, 19 nt, Homo sapiens
guuuacgcaugaucaaaua

SEQ ID NO: 1050007 - RNA, 19 nt, Homo sapiens
ugcaagaggucccaauuau

SEQ ID NO: 1050008 - RNA, 19 nt, Homo sapiens
gaccuuugcuaccuguauu

SEQ ID NO: 1050009 - RNA, 19 nt, Homo sapiens
gcaagaggucccaauuaug

SEQ ID NO: 1050010 - RNA, 19 nt, Homo sapiens
uaaagcugguauucuagaa

SEQ ID NO: 1050011 - RNA, 19 nt, Homo sapiens
ucacguauccugcauuugu

SEQ ID NO: 1050012 - RNA, 19 nt, Homo sapiens
aaucacguauccugcauuu

SEQ ID NO: 1050013 - RNA, 19 nt, Homo sapiens
cgagaagaauaugaagaaa

SEQ ID NO: 1050014 - RNA, 19 nt, Homo sapiens
gaucaaauaaugcgacgau

SEQ ID NO: 1050015 - RNA, 19 nt, Homo sapiens
cagaagagaagacauuuag

SEQ ID NO: 1050016 - RNA, 19 nt, Homo sapiens
agaaguaucuccgaaugga

SEQ ID NO: 1050017 - RNA, 19 nt, Homo sapiens
uaauaccaguggccucauu

SEQ ID NO: 1050018 - RNA, 19 nt, Homo sapiens
acagauccguguuguacuu

SEQ ID NO: 1050019 - RNA, 19 nt, Homo sapiens
gugaacguuuguugaaaga

SEQ ID NO: 1050020 - RNA, 19 nt, Homo sapiens
aaaggacucuggauuucga

SEQ ID NO: 1050021 - RNA, 19 nt, Homo sapiens
gugcggagccacucugaaa

SEQ ID NO: 1050022 - RNA, 19 nt, Homo sapiens
ucaaauaaugcgacgauau

SEQ ID NO: 1050023 - RNA, 19 nt, Homo sapiens
ucacugguuguguaaauaa

SEQ ID NO: 1050024 - RNA, 19 nt, Homo sapiens
cuagcuauguuucaugaau

SEQ ID NO: 1050025 - RNA, 19 nt, Homo sapiens
gaaguuuacgcaugaucaa

SEQ ID NO: 1050026 - RNA, 19 nt, Homo sapiens
acaagaguauaaacgaaug

SEQ ID NO: 1050027 - RNA, 19 nt, Homo sapiens
gaacagccugcuagcuaug

SEQ ID NO: 1050028 - RNA, 19 nt, Homo sapiens
agaacagccugcuagcuau

SEQ ID NO: 1050029 - RNA, 19 nt, Homo sapiens
acacaaaacuugcagaaca

SEQ ID NO: 1050030 - RNA, 19 nt, Homo sapiens
gaucugugaacguuuguug

SEQ ID NO: 1050031 - RNA, 19 nt, Homo sapiens
caacugguuuuggaaauuu

SEQ ID NO: 1050032 - RNA, 19 nt, Homo sapiens
agaaaguucgagaagaaua

SEQ ID NO: 1050033 - RNA, 19 nt, Homo sapiens
aaacgaaugcagaagagaa

SEQ ID NO: 1050034 - RNA, 19 nt, Homo sapiens
cagguuauuucaagcuuuc

SEQ ID NO: 1050035 - RNA, 19 nt, Homo sapiens
ucgagaagaauaugaagaa

SEQ ID NO: 1050036 - RNA, 19 nt, Homo sapiens
uauaaacgaaugcagaaga

SEQ ID NO: 1050037 - RNA, 19 nt, Homo sapiens
guacucgggcguauuagga

SEQ ID NO: 1050038 - RNA, 19 nt, Homo sapiens
aagaacagcccuuauuuac

SEQ ID NO: 1050039 - RNA, 19 nt, Homo sapiens
ugcagcauccucaccauua

SEQ ID NO: 1050040 - RNA, 19 nt, Homo sapiens
gaacacaaaacuugcagaa

SEQ ID NO: 1050041 - RNA, 19 nt, Homo sapiens
aagagaaaguucgagaaga

SEQ ID NO: 1050042 - RNA, 19 nt, Homo sapiens
ugaaaaggacucuggauuu

SEQ ID NO: 1050043 - RNA, 19 nt, Homo sapiens
gcaacugguuuuggaaauu

SEQ ID NO: 1050044 - RNA, 19 nt, Homo sapiens
aacaugcccuucacugguu

SEQ ID NO: 1050045 - RNA, 19 nt, Homo sapiens
uugcaagaggucccaauua

SEQ ID NO: 1050046 - RNA, 19 nt, Homo sapiens
gcagccaccucgcaaucuc

SEQ ID NO: 1050047 - RNA, 19 nt, Homo sapiens
ccucaccacagaacaaauu

SEQ ID NO: 1050048 - RNA, 19 nt, Homo sapiens
ggaccuuugcuaccuguau

SEQ ID NO: 1050049 - RNA, 19 nt, Homo sapiens
gcgacgauauggagaacag

SEQ ID NO: 1050050 - RNA, 19 nt, Homo sapiens
caauaugaugcguuuguga

SEQ ID NO: 1050051 - RNA, 19 nt, Homo sapiens
aaaagaacagcccuuauuu

SEQ ID NO: 1050052 - RNA, 19 nt, Homo sapiens
aagcugguauucuagaaca

SEQ ID NO: 1050053 - RNA, 19 nt, Homo sapiens
gcaagcuacugaccguacu

SEQ ID NO: 1050054 - RNA, 19 nt, Homo sapiens
cuucacugguuguguaaau

SEQ ID NO: 1050055 - RNA, 19 nt, Homo sapiens
ggauuucgacccgcuguug

SEQ ID NO: 1050056 - RNA, 19 nt, Homo sapiens
acagguuauuucaagcuuu

SEQ ID NO: 1050057 - RNA, 19 nt, Homo sapiens
auuaugacaugcagcaaug

SEQ ID NO: 1050058 - RNA, 19 nt, Homo sapiens
uuugugggcugccuuguuc

SEQ ID NO: 1050059 - RNA, 19 nt, Homo sapiens
uagcuauguuucaugaauc

SEQ ID NO: 1050060 - RNA, 19 nt, Homo sapiens
gagaaaguucgagaagaau

SEQ ID NO: 1050061 - RNA, 19 nt, Homo sapiens
agacagauccguguuguac

SEQ ID NO: 1050062 - RNA, 19 nt, Homo sapiens
gccaauaccccuucuguga

SEQ ID NO: 1050063 - RNA, 19 nt, Homo sapiens
gggcugccuuguuccuugu

SEQ ID NO: 1050064 - RNA, 19 nt, Homo sapiens
ugaagagaaaguucgagaa

SEQ ID NO: 1050065 - RNA, 19 nt, Homo sapiens
acagacagauccguguugu

SEQ ID NO: 1050066 - RNA, 19 nt, Homo sapiens
aauaugaugcguuugugaa

SEQ ID NO: 1050067 - RNA, 19 nt, Homo sapiens
ugugaacguuuguugaaag

SEQ ID NO: 1050068 - RNA, 19 nt, Homo sapiens
gaaucacguauccugcauu

SEQ ID NO: 1050069 - RNA, 19 nt, Homo sapiens
uugugaaguuuacgcauga

SEQ ID NO: 1050070 - RNA, 19 nt, Homo sapiens
augaugcguuugugaaguu

SEQ ID NO: 1050071 - RNA, 19 nt, Homo sapiens
guugaaagaacgugaagag

SEQ ID NO: 1050072 - RNA, 19 nt, Homo sapiens
auaaacgaaugcagaagag

SEQ ID NO: 1050073 - RNA, 19 nt, Homo sapiens
ugaaucacguauccugcau

SEQ ID NO: 1050074 - RNA, 19 nt, Homo sapiens
ugcuagcuauguuucauga

SEQ ID NO: 1050075 - RNA, 19 nt, Homo sapiens
cagcauccucaccauuaaa

SEQ ID NO: 1050076 - RNA, 19 nt, Homo sapiens
gauccguguuguacuucug

SEQ ID NO: 1050077 - RNA, 19 nt, Homo sapiens
caauaccccuucugugaau

SEQ ID NO: 1050078 - RNA, 19 nt, Homo sapiens
agguugggaugaucuguga

SEQ ID NO: 1050079 - RNA, 19 nt, Homo sapiens
ggauuaaagcugguauucu

SEQ ID NO: 1050080 - RNA, 19 nt, Homo sapiens
gauuucgacccgcuguuga

SEQ ID NO: 1050081 - RNA, 19 nt, Homo sapiens
ugaaacaccugccgauaaa

SEQ ID NO: 1050082 - RNA, 19 nt, Homo sapiens
gacaaauccuuccacguaa

SEQ ID NO: 1050083 - RNA, 19 nt, Homo sapiens
agacaaauccuuccacgua

SEQ ID NO: 1050084 - RNA, 19 nt, Homo sapiens
caccacgccuggcuaauuu

SEQ ID NO: 1050085 - RNA, 19 nt, Homo sapiens
acaaagaaaugcccacauc

SEQ ID NO: 1050086 - RNA, 19 nt, Homo sapiens
gcaccaccaugcccagcua

SEQ ID NO: 1050087 - RNA, 19 nt, Homo sapiens
ccaaagugcugggauuaca

SEQ ID NO: 1050088 - RNA, 19 nt, Homo sapiens
cuacuaacauggcaucuac

SEQ ID NO: 1050089 - RNA, 19 nt, Homo sapiens
ucaggacccuccagucguu

SEQ ID NO: 1050090 - RNA, 19 nt, Homo sapiens
cagcauacccaaacagaug

SEQ ID NO: 1050091 - RNA, 19 nt, Homo sapiens
cuacuaacguggcaucuac

SEQ ID NO: 1050092 - RNA, 19 nt, Homo sapiens
caccaugcccagcuaauuu

SEQ ID NO: 1050093 - RNA, 19 nt, Homo sapiens
gaacagccacaacaacaac

SEQ ID NO: 1050094 - RNA, 19 nt, Homo sapiens
gcuguucccuuaggcagaa

SEQ ID NO: 1050095 - RNA, 19 nt, Homo sapiens
uaacauggcaucuacuaac

SEQ ID NO: 1050096 - RNA, 19 nt, Homo sapiens
ccaagaacagccacaacaa

SEQ ID NO: 1050097 - RNA, 19 nt, Homo sapiens
ccaccacgccuggcuaauu

SEQ ID NO: 1050098 - RNA, 19 nt, Homo sapiens
ggaacggaaucguggaaaa

SEQ ID NO: 1050099 - RNA, 19 nt, Homo sapiens
aaauccagcugucacaaca

SEQ ID NO: 1050100 - RNA, 19 nt, Homo sapiens
gaugcacccugcccaugau

SEQ ID NO: 1050101 - RNA, 19 nt, Homo sapiens
ggcaucggcuucagagucu

SEQ ID NO: 1050102 - RNA, 19 nt, Homo sapiens
ucagggcggugucucaaag

SEQ ID NO: 1050103 - RNA, 19 nt, Homo sapiens
cuacuaggaugccacaaaa

SEQ ID NO: 1050104 - RNA, 19 nt, Homo sapiens
uuaggugugugcuccugua

SEQ ID NO: 1050105 - RNA, 19 nt, Homo sapiens
gccaagaacagccacaaca

SEQ ID NO: 1050106 - RNA, 19 nt, Homo sapiens
gaaauccagcugucacaac

SEQ ID NO: 1050107 - RNA, 19 nt, Homo sapiens
ggugugugcuccuguacca

SEQ ID NO: 1050108 - RNA, 19 nt, Homo sapiens
augaaacaccugccgauaa

SEQ ID NO: 1050109 - RNA, 19 nt, Homo sapiens
uaugaaacaccugccgaua

SEQ ID NO: 1050110 - RNA, 19 nt, Homo sapiens
ccaccaugcccagcuaauu

SEQ ID NO: 1050111 - RNA, 19 nt, Homo sapiens
ggcaggguuucaccauguu

SEQ ID NO: 1050112 - RNA, 19 nt, Homo sapiens
gcuccuguaccaacacuga

SEQ ID NO: 1050113 - RNA, 19 nt, Homo sapiens
acaaauccuuccacguaag

SEQ ID NO: 1050114 - RNA, 19 nt, Homo sapiens
caagaacagccacaacaac

SEQ ID NO: 1050115 - RNA, 19 nt, Homo sapiens
caacaggcacccacugacu

SEQ ID NO: 1050116 - RNA, 19 nt, Homo sapiens
uaacccacucucucucauu

SEQ ID NO: 1050117 - RNA, 19 nt, Homo sapiens
ccugcucacucacucauuc

SEQ ID NO: 1050118 - RNA, 19 nt, Homo sapiens
aagaacagccacaacaaca

SEQ ID NO: 1050119 - RNA, 19 nt, Homo sapiens
aggcaggguuucaccaugu

SEQ ID NO: 1050120 - RNA, 19 nt, Homo sapiens
cacaacaggcacccacuga

SEQ ID NO: 1050121 - RNA, 19 nt, Homo sapiens
cugaguagcugggaguaca

SEQ ID NO: 1050122 - RNA, 19 nt, Homo sapiens
aacccacucucucucauuc

SEQ ID NO: 1050123 - RNA, 19 nt, Homo sapiens
cuaacauggcaucuacuaa

SEQ ID NO: 1050124 - RNA, 19 nt, Homo sapiens
gcagcauacccaaacagau

SEQ ID NO: 1050125 - RNA, 19 nt, Homo sapiens
ucuacuaggaugccacaaa

SEQ ID NO: 1050126 - RNA, 19 nt, Homo sapiens
acuaacauggcaucuacua

SEQ ID NO: 1050127 - RNA, 19 nt, Homo sapiens
gggaacuuacaaagaaaug

SEQ ID NO: 1050128 - RNA, 19 nt, Homo sapiens
uuuaguagaggcaggguuu

SEQ ID NO: 1050129 - RNA, 19 nt, Homo sapiens
ggcagcauacccaaacaga

SEQ ID NO: 1050130 - RNA, 19 nt, Homo sapiens
guaccaacacugaaaucca

SEQ ID NO: 1050131 - RNA, 19 nt, Homo sapiens
ucacucccucgcucucuaa

SEQ ID NO: 1050132 - RNA, 19 nt, Homo sapiens
gaagcaaguuucugaguaa

SEQ ID NO: 1050133 - RNA, 19 nt, Homo sapiens
ggacacaucuugcaucaug

SEQ ID NO: 1050134 - RNA, 19 nt, Homo sapiens
gaagugggcuuuuguguua

SEQ ID NO: 1050135 - RNA, 19 nt, Homo sapiens
gaacuaaacuggguuaagg

SEQ ID NO: 1050136 - RNA, 19 nt, Homo sapiens
gaauaagacuccaaaggau

SEQ ID NO: 1050137 - RNA, 19 nt, Homo sapiens
ggaauaagacuccaaagga

SEQ ID NO: 1050138 - RNA, 19 nt, Homo sapiens
cagagaagauuguggugua

SEQ ID NO: 1050139 - RNA, 19 nt, Homo sapiens
gcagagaccuccguugguu

SEQ ID NO: 1050140 - RNA, 19 nt, Homo sapiens
gaacucagcugugacucuu

SEQ ID NO: 1050141 - RNA, 19 nt, Homo sapiens
ggucgaggcuugucugcua

SEQ ID NO: 1050142 - RNA, 19 nt, Homo sapiens
cagagaagaugaagaagga

SEQ ID NO: 1050143 - RNA, 19 nt, Homo sapiens
ugugguagaucauacaaua

SEQ ID NO: 1050144 - RNA, 19 nt, Homo sapiens
cagauuaacuguaaauugg

SEQ ID NO: 1050145 - RNA, 19 nt, Homo sapiens
uagcugaugucucccauaa

SEQ ID NO: 1050146 - RNA, 19 nt, Homo sapiens
gagaugggcuggugagaag

SEQ ID NO: 1050147 - RNA, 19 nt, Homo sapiens
acuaaaggaugaccgaaua

SEQ ID NO: 1050148 - RNA, 19 nt, Homo sapiens
ggaccaggcucgagaacug

SEQ ID NO: 1050149 - RNA, 19 nt, Homo sapiens
ucagagccaugaaggauuu

SEQ ID NO: 1050150 - RNA, 19 nt, Homo sapiens
gaaaugcuuccaucaggua

SEQ ID NO: 1050151 - RNA, 19 nt, Homo sapiens
aaggauagcuucacgaugu

SEQ ID NO: 1050152 - RNA, 19 nt, Homo sapiens
aaucguaccuaucguauug

SEQ ID NO: 1050153 - RNA, 19 nt, Homo sapiens
ucaagaagcugugcugugu

SEQ ID NO: 1050154 - RNA, 19 nt, Homo sapiens
gaggaacucucucccacuu

SEQ ID NO: 1050155 - RNA, 19 nt, Homo sapiens
cagagacccuuccaucuug

SEQ ID NO: 1050156 - RNA, 19 nt, Homo sapiens
uaucacaucucaggaacua

SEQ ID NO: 1050157 - RNA, 19 nt, Homo sapiens
cuccaacccuguagaauaa

SEQ ID NO: 1050158 - RNA, 19 nt, Homo sapiens
gaacugugguagaucauac

SEQ ID NO: 1050159 - RNA, 19 nt, Homo sapiens
guucacaccuguaauccaa

SEQ ID NO: 1050160 - RNA, 19 nt, Homo sapiens
ccucagaacucagcuguga

SEQ ID NO: 1050161 - RNA, 19 nt, Homo sapiens
gagaacuggucaacauguu

SEQ ID NO: 1050162 - RNA, 19 nt, Homo sapiens
guaccuaucguauugauga

SEQ ID NO: 1050163 - RNA, 19 nt, Homo sapiens
gaguucagaugcgucuuua

SEQ ID NO: 1050164 - RNA, 19 nt, Homo sapiens
ggguugaacuaaaggauga

SEQ ID NO: 1050165 - RNA, 19 nt, Homo sapiens
gauguggauuggaauaaga

SEQ ID NO: 1050166 - RNA, 19 nt, Homo sapiens
gaacgaggcagccaccaau

SEQ ID NO: 1050167 - RNA, 19 nt, Homo sapiens
gugaguggguggauuucua

SEQ ID NO: 1050168 - RNA, 19 nt, Homo sapiens
aauagagacuuaugucaga

SEQ ID NO: 1050169 - RNA, 19 nt, Homo sapiens
gcauuaagauucagaugac

SEQ ID NO: 1050170 - RNA, 19 nt, Homo sapiens
ugauggaucuauucucuau

SEQ ID NO: 1050171 - RNA, 19 nt, Homo sapiens
gcaaaaggauguacauaag

SEQ ID NO: 1050172 - RNA, 19 nt, Homo sapiens
uaaacuggguuaaggaagu

SEQ ID NO: 1050173 - RNA, 19 nt, Homo sapiens
guucagaugcgucuuuauu

SEQ ID NO: 1050174 - RNA, 19 nt, Homo sapiens
aggcagaggccauguauuu

SEQ ID NO: 1050175 - RNA, 19 nt, Homo sapiens
gcaacaccauagugcuuug

SEQ ID NO: 1050176 - RNA, 19 nt, Homo sapiens
gcugaugucucccauaagg

SEQ ID NO: 1050177 - RNA, 19 nt, Homo sapiens
ccacaagcuucuaaaccuu

SEQ ID NO: 1050178 - RNA, 19 nt, Homo sapiens
ugaucgggauggauguuua

SEQ ID NO: 1050179 - RNA, 19 nt, Homo sapiens
gaguggauauuccucugaa

SEQ ID NO: 1050180 - RNA, 19 nt, Homo sapiens
aaacuggguuaaggaagua

SEQ ID NO: 1050181 - RNA, 19 nt, Homo sapiens
gcagcuagcauccgaagga

SEQ ID NO: 1050182 - RNA, 19 nt, Homo sapiens
ugacaaagcaagacucugu

SEQ ID NO: 1050183 - RNA, 19 nt, Homo sapiens
aaccuaauaucaccaagaa

SEQ ID NO: 1050184 - RNA, 19 nt, Homo sapiens
caaguaugcccacaagcua

SEQ ID NO: 1050185 - RNA, 19 nt, Homo sapiens
ccaagauggugguguuugu

SEQ ID NO: 1050186 - RNA, 19 nt, Homo sapiens
ggaagagggaguucagaug

SEQ ID NO: 1050187 - RNA, 19 nt, Homo sapiens
agauacagaugguuguuug

SEQ ID NO: 1050188 - RNA, 19 nt, Homo sapiens
ggauguacauaagauugaa

SEQ ID NO: 1050189 - RNA, 19 nt, Homo sapiens
ggaagaggaccagccauug

SEQ ID NO: 1050190 - RNA, 19 nt, Homo sapiens
cacgaugucugaugggaaa

SEQ ID NO: 1050191 - RNA, 19 nt, Homo sapiens
ggaguucagaugcgucuuu

SEQ ID NO: 1050192 - RNA, 19 nt, Homo sapiens
ggaacucucucccacuuuu

SEQ ID NO: 1050193 - RNA, 19 nt, Homo sapiens
gaggcugacuuucaaacug

SEQ ID NO: 1050194 - RNA, 19 nt, Homo sapiens
ccagagacccuuccaucuu

SEQ ID NO: 1050195 - RNA, 19 nt, Homo sapiens
ggaucacaguuaaggaaga

SEQ ID NO: 1050196 - RNA, 19 nt, Homo sapiens
gaugauguggauuggaaua

SEQ ID NO: 1050197 - RNA, 19 nt, Homo sapiens
ugucaugcaugccauuuau

SEQ ID NO: 1050198 - RNA, 19 nt, Homo sapiens
cgaggcggguggaucauga

SEQ ID NO: 1050199 - RNA, 19 nt, Homo sapiens
ucacaucucaggaacuaaa

SEQ ID NO: 1050200 - RNA, 19 nt, Homo sapiens
gcgcacagguaauuaacca

SEQ ID NO: 1050201 - RNA, 19 nt, Homo sapiens
caggacacaucuugcauca

SEQ ID NO: 1050202 - RNA, 19 nt, Homo sapiens
ccugagcccugaucauaug

SEQ ID NO: 1050203 - RNA, 19 nt, Homo sapiens
uuaaggaaguaaccagaga

SEQ ID NO: 1050204 - RNA, 19 nt, Homo sapiens
gcccguccauggauccuuu

SEQ ID NO: 1050205 - RNA, 19 nt, Homo sapiens
guggauuucuaucuucuug

SEQ ID NO: 1050206 - RNA, 19 nt, Homo sapiens
ccagugagagacaggauaa

SEQ ID NO: 1050207 - RNA, 19 nt, Homo sapiens
uaaagaacacuuccaggau

SEQ ID NO: 1050208 - RNA, 19 nt, Homo sapiens
caagugcuaugguacuaca

SEQ ID NO: 1050209 - RNA, 19 nt, Homo sapiens
aaacagacagugcugaaau

SEQ ID NO: 1050210 - RNA, 19 nt, Homo sapiens
ucagaugcgucuuuauuac

SEQ ID NO: 1050211 - RNA, 19 nt, Homo sapiens
gcaggagaaucgcuugaac

SEQ ID NO: 1050212 - RNA, 19 nt, Homo sapiens
gaaaccccgucucuacuaa

SEQ ID NO: 1050213 - RNA, 19 nt, Homo sapiens
ucuccaacccuguagaaua

SEQ ID NO: 1050214 - RNA, 19 nt, Homo sapiens
gaagauacagaugguuguu

SEQ ID NO: 1050215 - RNA, 19 nt, Homo sapiens
aauaagacuccaaaggaua

SEQ ID NO: 1050216 - RNA, 19 nt, Homo sapiens
aagaacacuuccaggauga

SEQ ID NO: 1050217 - RNA, 19 nt, Homo sapiens
gaagcaguuuaucaauauc

SEQ ID NO: 1050218 - RNA, 19 nt, Homo sapiens
ggacagggaggaacucucu

SEQ ID NO: 1050219 - RNA, 19 nt, Homo sapiens
gcaaguuucugaguaacag

SEQ ID NO: 1050220 - RNA, 19 nt, Homo sapiens
ggagaugggcuggugagaa

SEQ ID NO: 1050221 - RNA, 19 nt, Homo sapiens
gcaggcagaggccauguau

SEQ ID NO: 1050222 - RNA, 19 nt, Homo sapiens
ccucagaacuuuguaacuc

SEQ ID NO: 1050223 - RNA, 19 nt, Homo sapiens
gaucgacacguguucucua

SEQ ID NO: 1050224 - RNA, 19 nt, Homo sapiens
gauauaacaaucguaccua

SEQ ID NO: 1050225 - RNA, 19 nt, Homo sapiens
aaagggagucuguggguuu

SEQ ID NO: 1050226 - RNA, 19 nt, Homo sapiens
gaucauacaauaacaagcu

SEQ ID NO: 1050227 - RNA, 19 nt, Homo sapiens
gcagaggccauguauuugg

SEQ ID NO: 1050228 - RNA, 19 nt, Homo sapiens
aaggaacaccucagucuuu

SEQ ID NO: 1050229 - RNA, 19 nt, Homo sapiens
cagaggccauguauuugga

SEQ ID NO: 1050230 - RNA, 19 nt, Homo sapiens
gcaaguaugcccacaagcu

SEQ ID NO: 1050231 - RNA, 19 nt, Homo sapiens
ggaacugugguagaucaua

SEQ ID NO: 1050232 - RNA, 19 nt, Homo sapiens
gaacagcgauugaccagua

SEQ ID NO: 1050233 - RNA, 19 nt, Homo sapiens
gaacacagcuucagaaacu

SEQ ID NO: 1050234 - RNA, 19 nt, Homo sapiens
gaucagcucuucagauauu

SEQ ID NO: 1050235 - RNA, 19 nt, Homo sapiens
gaauaacucugauacaaga

SEQ ID NO: 1050236 - RNA, 19 nt, Homo sapiens
ggaaagcccucccacuaaa

SEQ ID NO: 1050237 - RNA, 19 nt, Homo sapiens
ccagagagcuccuauccua

SEQ ID NO: 1050238 - RNA, 19 nt, Homo sapiens
cagaucagcucuucagaua

SEQ ID NO: 1050239 - RNA, 19 nt, Homo sapiens
gaauaaagccaucauaaga

SEQ ID NO: 1050240 - RNA, 19 nt, Homo sapiens
caaaguggcuuccucaaga

SEQ ID NO: 1050241 - RNA, 19 nt, Homo sapiens
agacucgacugaaauauua

SEQ ID NO: 1050242 - RNA, 19 nt, Homo sapiens
gaacauagugugcuucaaa

SEQ ID NO: 1050243 - RNA, 19 nt, Homo sapiens
ggaacaagcaaucuuauuu

SEQ ID NO: 1050244 - RNA, 19 nt, Homo sapiens
gaauaacagugcaguaguu

SEQ ID NO: 1050245 - RNA, 19 nt, Homo sapiens
ggaagcauguguaaaauua

SEQ ID NO: 1050246 - RNA, 19 nt, Homo sapiens
gaagagaguucuguguuug

SEQ ID NO: 1050247 - RNA, 19 nt, Homo sapiens
gaaauaagcaacagugaga

SEQ ID NO: 1050248 - RNA, 19 nt, Homo sapiens
uagcaagccugaauaugua

SEQ ID NO: 1050249 - RNA, 19 nt, Homo sapiens
gaucaaagaauaaguccua

SEQ ID NO: 1050250 - RNA, 19 nt, Homo sapiens
gaaguccgcaggcaaauuu

SEQ ID NO: 1050251 - RNA, 19 nt, Homo sapiens
ggaggaacaagcaaucuua

SEQ ID NO: 1050252 - RNA, 19 nt, Homo sapiens
uaaggagccucacaugaaa

SEQ ID NO: 1050253 - RNA, 19 nt, Homo sapiens
gugaagacauguuccauug

SEQ ID NO: 1050254 - RNA, 19 nt, Homo sapiens
gcauucagauguucuccua

SEQ ID NO: 1050255 - RNA, 19 nt, Homo sapiens
ggagugguuugaucuauau

SEQ ID NO: 1050256 - RNA, 19 nt, Homo sapiens
ggacucagcagaagaauuc

SEQ ID NO: 1050257 - RNA, 19 nt, Homo sapiens
caagaugagcuauuaguaa

SEQ ID NO: 1050258 - RNA, 19 nt, Homo sapiens
ccuaaaguauugaggauuu

SEQ ID NO: 1050259 - RNA, 19 nt, Homo sapiens
gacaacaaauuacaagaug

SEQ ID NO: 1050260 - RNA, 19 nt, Homo sapiens
gagaguaaacuacaaauuc

SEQ ID NO: 1050261 - RNA, 19 nt, Homo sapiens
guaaagauccuuccuccaa

SEQ ID NO: 1050262 - RNA, 19 nt, Homo sapiens
ggacuuaagugcuacuagu

SEQ ID NO: 1050263 - RNA, 19 nt, Homo sapiens
gguacaaacuguggaauug

SEQ ID NO: 1050264 - RNA, 19 nt, Homo sapiens
caggagagcuucagaccuu

SEQ ID NO: 1050265 - RNA, 19 nt, Homo sapiens
caagggaguugaugaaagu

SEQ ID NO: 1050266 - RNA, 19 nt, Homo sapiens
ucgauuaucuugcauguug

SEQ ID NO: 1050267 - RNA, 19 nt, Homo sapiens
caacauuuacgacugcuua

SEQ ID NO: 1050268 - RNA, 19 nt, Homo sapiens
caucaaacccugaggaauu

SEQ ID NO: 1050269 - RNA, 19 nt, Homo sapiens
gacagaggaaucaauaaua

SEQ ID NO: 1050270 - RNA, 19 nt, Homo sapiens
ggaccuugcuuagauauuc

SEQ ID NO: 1050271 - RNA, 19 nt, Homo sapiens
gagaagaacaugagguuau

SEQ ID NO: 1050272 - RNA, 19 nt, Homo sapiens
ccaaugcacuugauaugga

SEQ ID NO: 1050273 - RNA, 19 nt, Homo sapiens
gagaaucaagagucauuua

SEQ ID NO: 1050274 - RNA, 19 nt, Homo sapiens
caacgucucuuuggauguu

SEQ ID NO: 1050275 - RNA, 19 nt, Homo sapiens
uaaagauccuuccuccaaa

SEQ ID NO: 1050276 - RNA, 19 nt, Homo sapiens
gaagaaauacgagauaaca

SEQ ID NO: 1050277 - RNA, 19 nt, Homo sapiens
cagcagcuauuguuuaugu

SEQ ID NO: 1050278 - RNA, 19 nt, Homo sapiens
ucagagagcugucuagaac

SEQ ID NO: 1050279 - RNA, 19 nt, Homo sapiens
aagcagcacuuaccuuuga

SEQ ID NO: 1050280 - RNA, 19 nt, Homo sapiens
ucaugugcgucauuucuua

SEQ ID NO: 1050281 - RNA, 19 nt, Homo sapiens
gaguugaguaccacaauua

SEQ ID NO: 1050282 - RNA, 19 nt, Homo sapiens
ccagagagccauucuaugu

SEQ ID NO: 1050283 - RNA, 19 nt, Homo sapiens
cacuugauauggagaaaua

SEQ ID NO: 1050284 - RNA, 19 nt, Homo sapiens
ccagauaaauuuguacuca

SEQ ID NO: 1050285 - RNA, 19 nt, Homo sapiens
gaaaucaaacaacuuggaa

SEQ ID NO: 1050286 - RNA, 19 nt, Homo sapiens
gugagaagcaugugacuuu

SEQ ID NO: 1050287 - RNA, 19 nt, Homo sapiens
gaguauugcuauucgacua

SEQ ID NO: 1050288 - RNA, 19 nt, Homo sapiens
gaugaaggcaagaguauug

SEQ ID NO: 1050289 - RNA, 19 nt, Homo sapiens
gagaagauuuaacucaagu

SEQ ID NO: 1050290 - RNA, 19 nt, Homo sapiens
ccaacgaccuaaugauguu

SEQ ID NO: 1050291 - RNA, 19 nt, Homo sapiens
ccuuaaaccuggagaagaa

SEQ ID NO: 1050292 - RNA, 19 nt, Homo sapiens
gccaggagccuauagauga

SEQ ID NO: 1050293 - RNA, 19 nt, Homo sapiens
guagcaagccugaauaugu

SEQ ID NO: 1050294 - RNA, 19 nt, Homo sapiens
gugaagaaauacgagauaa

SEQ ID NO: 1050295 - RNA, 19 nt, Homo sapiens
cuuaguaccuggcaaagaa

SEQ ID NO: 1050296 - RNA, 19 nt, Homo sapiens
gaagacauguuccauugac

SEQ ID NO: 1050297 - RNA, 19 nt, Homo sapiens
gaacaaacuacucaagaca

SEQ ID NO: 1050298 - RNA, 19 nt, Homo sapiens
cauuuacgacugcuuauua

SEQ ID NO: 1050299 - RNA, 19 nt, Homo sapiens
ggaaugacaucaggauugg

SEQ ID NO: 1050300 - RNA, 19 nt, Homo sapiens
gauaguuauucaucaguga

SEQ ID NO: 1050301 - RNA, 19 nt, Homo sapiens
accauaaacuccucaaauu

SEQ ID NO: 1050302 - RNA, 19 nt, Homo sapiens
cagaggauguguacagguu

SEQ ID NO: 1050303 - RNA, 19 nt, Homo sapiens
ggaaagccaugggauccaa

SEQ ID NO: 1050304 - RNA, 19 nt, Homo sapiens
gaaauggcaucugucaucu

SEQ ID NO: 1050305 - RNA, 19 nt, Homo sapiens
agauuuaacucaaguggaa

SEQ ID NO: 1050306 - RNA, 19 nt, Homo sapiens
caugaugccugcuaguuau

SEQ ID NO: 1050307 - RNA, 19 nt, Homo sapiens
aauggcaucugucaucuuu

SEQ ID NO: 1050308 - RNA, 19 nt, Homo sapiens
gaauucagagauugcauuu

SEQ ID NO: 1050309 - RNA, 19 nt, Homo sapiens
ggcauuaaguucacaauac

SEQ ID NO: 1050310 - RNA, 19 nt, Homo sapiens
acaaacuacucaagacauu

SEQ ID NO: 1050311 - RNA, 19 nt, Homo sapiens
ggaauugaaccaugggauu

SEQ ID NO: 1050312 - RNA, 19 nt, Homo sapiens
acacagcagcuauuguuua

SEQ ID NO: 1050313 - RNA, 19 nt, Homo sapiens
ucagacagaggaaucaaua

SEQ ID NO: 1050314 - RNA, 19 nt, Homo sapiens
gaaaaccaguguacuccua

SEQ ID NO: 1050315 - RNA, 19 nt, Homo sapiens
cacagcagcuauuguuuau

SEQ ID NO: 1050316 - RNA, 19 nt, Homo sapiens
ggaaagaacacaagaaaau

SEQ ID NO: 1050317 - RNA, 19 nt, Homo sapiens
gaucacaaccaggcauuaa

SEQ ID NO: 1050318 - RNA, 19 nt, Homo sapiens
agaagaacaugagguuauu

SEQ ID NO: 1050319 - RNA, 19 nt, Homo sapiens
gaagaucaaagaauaaguc

SEQ ID NO: 1050320 - RNA, 19 nt, Homo sapiens
ggaaaucuguuggaaacca

SEQ ID NO: 1050321 - RNA, 19 nt, Homo sapiens
cauaaacuccucaaauuca

SEQ ID NO: 1050322 - RNA, 19 nt, Homo sapiens
ugaagacucgacugaaaua

SEQ ID NO: 1050323 - RNA, 19 nt, Homo sapiens
gggaaucacggacacuuaa

SEQ ID NO: 1050324 - RNA, 19 nt, Homo sapiens
uuaaggagccucacaugaa

SEQ ID NO: 1050325 - RNA, 19 nt, Homo sapiens
guuuccagauugugaauaa

SEQ ID NO: 1050326 - RNA, 19 nt, Homo sapiens
caauaccuuugucuggaua

SEQ ID NO: 1050327 - RNA, 19 nt, Homo sapiens
cugggaacauugaaguuua

SEQ ID NO: 1050328 - RNA, 19 nt, Homo sapiens
ccaaagaacaaacuacuca

SEQ ID NO: 1050329 - RNA, 19 nt, Homo sapiens
aaaccugacuuuagaugga

SEQ ID NO: 1050330 - RNA, 19 nt, Homo sapiens
gaaucaagagucauuuaga

SEQ ID NO: 1050331 - RNA, 19 nt, Homo sapiens
ccacggauucccucauuaa

SEQ ID NO: 1050332 - RNA, 19 nt, Homo sapiens
ggaauacaccaaacaauua

SEQ ID NO: 1050333 - RNA, 19 nt, Homo sapiens
guauagagcugcagaaaga

SEQ ID NO: 1050334 - RNA, 19 nt, Homo sapiens
gcagaaagaguaaaugaua

SEQ ID NO: 1050335 - RNA, 19 nt, Homo sapiens
gcucagaaguccucagaua

SEQ ID NO: 1050336 - RNA, 19 nt, Homo sapiens
gagaagaacuggaagaauc

SEQ ID NO: 1050337 - RNA, 19 nt, Homo sapiens
gaagaaaugcuacagguuu

SEQ ID NO: 1050338 - RNA, 19 nt, Homo sapiens
ccaaagcagugucauuuaa

SEQ ID NO: 1050339 - RNA, 19 nt, Homo sapiens
gcaagcaacugcggcauuu

SEQ ID NO: 1050340 - RNA, 19 nt, Homo sapiens
gaaaggaggagaagaaugu

SEQ ID NO: 1050341 - RNA, 19 nt, Homo sapiens
gguguugggugccauguua

SEQ ID NO: 1050342 - RNA, 19 nt, Homo sapiens
caaaacagaugaagcauuu

SEQ ID NO: 1050343 - RNA, 19 nt, Homo sapiens
gauggaagaugaaugugaa

SEQ ID NO: 1050344 - RNA, 19 nt, Homo sapiens
caagaaacguugaagagau

SEQ ID NO: 1050345 - RNA, 19 nt, Homo sapiens
ggaugacucucuuuggaaa

SEQ ID NO: 1050346 - RNA, 19 nt, Homo sapiens
gaacaucagugccaaaaga

SEQ ID NO: 1050347 - RNA, 19 nt, Homo sapiens
ccacugaacuaccagauuc

SEQ ID NO: 1050348 - RNA, 19 nt, Homo sapiens
ggaaaggaacgcagacaaa

SEQ ID NO: 1050349 - RNA, 19 nt, Homo sapiens
gcagugucauuuaauaaga

SEQ ID NO: 1050350 - RNA, 19 nt, Homo sapiens
ggagaauuauauugucuug

SEQ ID NO: 1050351 - RNA, 19 nt, Homo sapiens
ggaaaccacugaacuacca

SEQ ID NO: 1050352 - RNA, 19 nt, Homo sapiens
acaagcagauugagaagaa

SEQ ID NO: 1050353 - RNA, 19 nt, Homo sapiens
gaagaaaccauucccaaag

SEQ ID NO: 1050354 - RNA, 19 nt, Homo sapiens
cuacuuggauuacuuacaa

SEQ ID NO: 1050355 - RNA, 19 nt, Homo sapiens
caaaauauauccuggaaga

SEQ ID NO: 1050356 - RNA, 19 nt, Homo sapiens
agaugaaugugaagaagua

SEQ ID NO: 1050357 - RNA, 19 nt, Homo sapiens
gaagaugaaugugaagaag

SEQ ID NO: 1050358 - RNA, 19 nt, Homo sapiens
uagcagaguugauggaaga

SEQ ID NO: 1050359 - RNA, 19 nt, Homo sapiens
gagagccacuccagagcua

SEQ ID NO: 1050360 - RNA, 19 nt, Homo sapiens
caacuuggcagauugcauu

SEQ ID NO: 1050361 - RNA, 19 nt, Homo sapiens
ggaagaagaacaagcaauc

SEQ ID NO: 1050362 - RNA, 19 nt, Homo sapiens
cuuacgaccuguuagauaa

SEQ ID NO: 1050363 - RNA, 19 nt, Homo sapiens
ugaugaauauccuccagua

SEQ ID NO: 1050364 - RNA, 19 nt, Homo sapiens
uaauacaccuacuuggauu

SEQ ID NO: 1050365 - RNA, 19 nt, Homo sapiens
gaauauccuccaguacuua

SEQ ID NO: 1050366 - RNA, 19 nt, Homo sapiens
gagcucaccucccaucagu

SEQ ID NO: 1050367 - RNA, 19 nt, Homo sapiens
uugaagagauugugguaaa

SEQ ID NO: 1050368 - RNA, 19 nt, Homo sapiens
aagaaacguugaagagauu

SEQ ID NO: 1050369 - RNA, 19 nt, Homo sapiens
gugaagaaguagaacauca

SEQ ID NO: 1050370 - RNA, 19 nt, Homo sapiens
cagaaguccucagauauug

SEQ ID NO: 1050371 - RNA, 19 nt, Homo sapiens
gcggaugacucucuuugga

SEQ ID NO: 1050372 - RNA, 19 nt, Homo sapiens
gaagcgcgcugcugugcau

SEQ ID NO: 1050373 - RNA, 19 nt, Homo sapiens
gacaauaguuacccguuuc

SEQ ID NO: 1050374 - RNA, 19 nt, Homo sapiens
cagaguugauggaagauga

SEQ ID NO: 1050375 - RNA, 19 nt, Homo sapiens
gcacugcugugaaacugau

SEQ ID NO: 1050376 - RNA, 19 nt, Homo sapiens
uggaagaagacaauaguua

SEQ ID NO: 1050377 - RNA, 19 nt, Homo sapiens
gaauauuuccggauaaagu

SEQ ID NO: 1050378 - RNA, 19 nt, Homo sapiens
ggaagaugaaugugaagaa

SEQ ID NO: 1050379 - RNA, 19 nt, Homo sapiens
ugaauauccuccaguacuu

SEQ ID NO: 1050380 - RNA, 19 nt, Homo sapiens
gggcacuguugcuggaaua

SEQ ID NO: 1050381 - RNA, 19 nt, Homo sapiens
ucagaaguccucagauauu

SEQ ID NO: 1050382 - RNA, 19 nt, Homo sapiens
agacaauaguuacccguuu

SEQ ID NO: 1050383 - RNA, 19 nt, Homo sapiens
gagaaauuccucuggauuc

SEQ ID NO: 1050384 - RNA, 19 nt, Homo sapiens
ucgauuugcugcuuugauu

SEQ ID NO: 1050385 - RNA, 19 nt, Homo sapiens
uaucauugacugucuagua

SEQ ID NO: 1050386 - RNA, 19 nt, Homo sapiens
ucacauggguccguuuaug

SEQ ID NO: 1050387 - RNA, 19 nt, Homo sapiens
cacuguugcuggaauauuu

SEQ ID NO: 1050388 - RNA, 19 nt, Homo sapiens
gaagaacaagcaaucaaca

SEQ ID NO: 1050389 - RNA, 19 nt, Homo sapiens
ggaagaagacaauaguuac

SEQ ID NO: 1050390 - RNA, 19 nt, Homo sapiens
aaacuuacaagcagauuga

SEQ ID NO: 1050391 - RNA, 19 nt, Homo sapiens
gcuaauauccgucucacau

SEQ ID NO: 1050392 - RNA, 19 nt, Homo sapiens
ccaaaggacagguuguuga

SEQ ID NO: 1050393 - RNA, 19 nt, Homo sapiens
gcagggaaauauggaauac

SEQ ID NO: 1050394 - RNA, 19 nt, Homo sapiens
ugucucagcuccugucuuc

SEQ ID NO: 1050395 - RNA, 19 nt, Homo sapiens
agaagcagacacugaauuu

SEQ ID NO: 1050396 - RNA, 19 nt, Homo sapiens
uaacucucauccuggaauu

SEQ ID NO: 1050397 - RNA, 19 nt, Homo sapiens
gcagauugcauugcugaaa

SEQ ID NO: 1050398 - RNA, 19 nt, Homo sapiens
agacagcguuguauaccuu

SEQ ID NO: 1050399 - RNA, 19 nt, Homo sapiens
agacagacagcguuguaua

SEQ ID NO: 1050400 - RNA, 19 nt, Homo sapiens
gaagaagaacaagcaauca

SEQ ID NO: 1050401 - RNA, 19 nt, Homo sapiens
uaaagcuuacgaccuguua

SEQ ID NO: 1050402 - RNA, 19 nt, Homo sapiens
uggaauacaccaaacaauu

SEQ ID NO: 1050403 - RNA, 19 nt, Homo sapiens
gaugaugccucugguggau

SEQ ID NO: 1050404 - RNA, 19 nt, Homo sapiens
ggacagguuguugacauuu

SEQ ID NO: 1050405 - RNA, 19 nt, Homo sapiens
ugagaacgaucuggaggaa

SEQ ID NO: 1050406 - RNA, 19 nt, Homo sapiens
gaacuggaagaaucacaug

SEQ ID NO: 1050407 - RNA, 19 nt, Homo sapiens
gcuuacgaccuguuagaua

SEQ ID NO: 1050408 - RNA, 19 nt, Homo sapiens
gcgccuagaugauacuuac

SEQ ID NO: 1050409 - RNA, 19 nt, Homo sapiens
cacaagagcagggaaauau

SEQ ID NO: 1050410 - RNA, 19 nt, Homo sapiens
agaacgaucuggaggaagu

SEQ ID NO: 1050411 - RNA, 19 nt, Homo sapiens
agagaaaggaggagaagaa

SEQ ID NO: 1050412 - RNA, 19 nt, Homo sapiens
ccacaagagcagggaaaua

SEQ ID NO: 1050413 - RNA, 19 nt, Homo sapiens
cagaaagaguaaaugauac

SEQ ID NO: 1050414 - RNA, 19 nt, Homo sapiens
gagcuauuucuaagacuuu

SEQ ID NO: 1050415 - RNA, 19 nt, Homo sapiens
gaguggugguccugagauu

SEQ ID NO: 1050416 - RNA, 19 nt, Homo sapiens
gcuccugucuuccaaugau

SEQ ID NO: 1050417 - RNA, 19 nt, Homo sapiens
ccagagcuauuucuaagac

SEQ ID NO: 1050418 - RNA, 19 nt, Homo sapiens
aauauauccuggaagaaga

SEQ ID NO: 1050419 - RNA, 19 nt, Homo sapiens
gaaaggaacgcagacaaac

SEQ ID NO: 1050420 - RNA, 19 nt, Homo sapiens
agaagaaaccauucccaaa

SEQ ID NO: 1050421 - RNA, 19 nt, Homo sapiens
caucagauacaaagcuuga

SEQ ID NO: 1050422 - RNA, 19 nt, Homo sapiens
ggaauuacugcagcacaaa

SEQ ID NO: 1050423 - RNA, 19 nt, Homo sapiens
gacacuggcuaccacacuu

SEQ ID NO: 1050424 - RNA, 19 nt, Homo sapiens
uaauauccgucucacaucu

SEQ ID NO: 1050425 - RNA, 19 nt, Homo sapiens
gcaaaauacccaaagauau

SEQ ID NO: 1050426 - RNA, 19 nt, Homo sapiens
caaagcagugucauuuaau

SEQ ID NO: 1050427 - RNA, 19 nt, Homo sapiens
gaaauauggaauacaccaa

SEQ ID NO: 1050428 - RNA, 19 nt, Homo sapiens
gcuaucaagauguuuagaa

SEQ ID NO: 1050429 - RNA, 19 nt, Homo sapiens
gcccauccuuguucaacuu

SEQ ID NO: 1050430 - RNA, 19 nt, Homo sapiens
auaguuacccguuuccuaa

SEQ ID NO: 1050431 - RNA, 19 nt, Homo sapiens
acaccuacuuggauuacuu

SEQ ID NO: 1050432 - RNA, 19 nt, Homo sapiens
gagagauccugaagacuua

SEQ ID NO: 1050433 - RNA, 19 nt, Homo sapiens
ggaaggagguggucuacuu

SEQ ID NO: 1050434 - RNA, 19 nt, Homo sapiens
gccuauacaucacuuauua

SEQ ID NO: 1050435 - RNA, 19 nt, Homo sapiens
gaaccaggcuucuucacuu

SEQ ID NO: 1050436 - RNA, 19 nt, Homo sapiens
gaaacaagguugacaaacu

SEQ ID NO: 1050437 - RNA, 19 nt, Homo sapiens
gaggaugucuugauaaugu

SEQ ID NO: 1050438 - RNA, 19 nt, Homo sapiens
gcugaagucugucaugaaa

SEQ ID NO: 1050439 - RNA, 19 nt, Homo sapiens
gggagcaaguuauuucuuu

SEQ ID NO: 1050440 - RNA, 19 nt, Homo sapiens
uuacaaagcugcugaaggu

SEQ ID NO: 1050441 - RNA, 19 nt, Homo sapiens
gaaggagguggucuacuua

SEQ ID NO: 1050442 - RNA, 19 nt, Homo sapiens
uguauuggcuguucaugua

SEQ ID NO: 1050443 - RNA, 19 nt, Homo sapiens
ucauggagcuguuguauag

SEQ ID NO: 1050444 - RNA, 19 nt, Homo sapiens
gcugugauaaggaauauua

SEQ ID NO: 1050445 - RNA, 19 nt, Homo sapiens
caaggaaccugcggccuaa

SEQ ID NO: 1050446 - RNA, 19 nt, Homo sapiens
gauacagucugcaucuuau

SEQ ID NO: 1050447 - RNA, 19 nt, Homo sapiens
uggagcaaguuauuucuua

SEQ ID NO: 1050448 - RNA, 19 nt, Homo sapiens
gaagaaagagcaagaagag

SEQ ID NO: 1050449 - RNA, 19 nt, Homo sapiens
gaaguggccugucccaucu

SEQ ID NO: 1050450 - RNA, 19 nt, Homo sapiens
ucgaacaucugaagaaaga

SEQ ID NO: 1050451 - RNA, 19 nt, Homo sapiens
gggaaaagcugaagauguu

SEQ ID NO: 1050452 - RNA, 19 nt, Homo sapiens
gagggagccuuuacuacuu

SEQ ID NO: 1050453 - RNA, 19 nt, Homo sapiens
aggccaaacuggagaaaua

SEQ ID NO: 1050454 - RNA, 19 nt, Homo sapiens
ccagauccaucccaugauu

SEQ ID NO: 1050455 - RNA, 19 nt, Homo sapiens
uaagagagauccugaagac

SEQ ID NO: 1050456 - RNA, 19 nt, Homo sapiens
gcagaaaggagcuucaaau

SEQ ID NO: 1050457 - RNA, 19 nt, Homo sapiens
gaucagagcaguucuaagg

SEQ ID NO: 1050458 - RNA, 19 nt, Homo sapiens
ggaggaugauugcagaguu

SEQ ID NO: 1050459 - RNA, 19 nt, Homo sapiens
gaggaugauugcagaguug

SEQ ID NO: 1050460 - RNA, 19 nt, Homo sapiens
cagugaggaugaugaagua

SEQ ID NO: 1050461 - RNA, 19 nt, Homo sapiens
guucauguauguaggaguu

SEQ ID NO: 1050462 - RNA, 19 nt, Homo sapiens
ucaaauggcugugauaagg

SEQ ID NO: 1050463 - RNA, 19 nt, Homo sapiens
cugcgaagcuuuaguuugu

SEQ ID NO: 1050464 - RNA, 19 nt, Homo sapiens
gcucccacaucuucacuuu

SEQ ID NO: 1050465 - RNA, 19 nt, Homo sapiens
ccacagugcugggauuaga

SEQ ID NO: 1050466 - RNA, 19 nt, Homo sapiens
gagcaggcaccgaugagua

SEQ ID NO: 1050467 - RNA, 19 nt, Homo sapiens
cuaaucaaccuuuauguga

SEQ ID NO: 1050468 - RNA, 19 nt, Homo sapiens
gcagaggcccagucaaaug

SEQ ID NO: 1050469 - RNA, 19 nt, Homo sapiens
ugaaguuggugaaaggaaa

SEQ ID NO: 1050470 - RNA, 19 nt, Homo sapiens
gcugaagggugaccugugu

SEQ ID NO: 1050471 - RNA, 19 nt, Homo sapiens
guaaggaucaggacuuugu

SEQ ID NO: 1050472 - RNA, 19 nt, Homo sapiens
ggauauucaggaaguguua

SEQ ID NO: 1050473 - RNA, 19 nt, Homo sapiens
gcaggcaagccguggauuu

SEQ ID NO: 1050474 - RNA, 19 nt, Homo sapiens
aaacaagguugacaaacuc

SEQ ID NO: 1050475 - RNA, 19 nt, Homo sapiens
gcgaagcuuuaguuuguau

SEQ ID NO: 1050476 - RNA, 19 nt, Homo sapiens
ggguaaggaucaggacuuu

SEQ ID NO: 1050477 - RNA, 19 nt, Homo sapiens
gucaugaaaccacuuauuu

SEQ ID NO: 1050478 - RNA, 19 nt, Homo sapiens
gcagcuggccaauguugua

SEQ ID NO: 1050479 - RNA, 19 nt, Homo sapiens
ugauacagucugcaucuua

SEQ ID NO: 1050480 - RNA, 19 nt, Homo sapiens
gaggagggagccuuuacua

SEQ ID NO: 1050481 - RNA, 19 nt, Homo sapiens
uaccagcgauuacuagaga

SEQ ID NO: 1050482 - RNA, 19 nt, Homo sapiens
gagguuugcuauaucuaau

SEQ ID NO: 1050483 - RNA, 19 nt, Homo sapiens
cuaccaggcugaagucugu

SEQ ID NO: 1050484 - RNA, 19 nt, Homo sapiens
gaaaauggguguaauucag

SEQ ID NO: 1050485 - RNA, 19 nt, Homo sapiens
gaaaaccugcgaagcuuua

SEQ ID NO: 1050486 - RNA, 19 nt, Homo sapiens
cccaugacauuucuuucua

SEQ ID NO: 1050487 - RNA, 19 nt, Homo sapiens
ugccucagcuucccgagua

SEQ ID NO: 1050488 - RNA, 19 nt, Homo sapiens
uaagggagcaaguuauuuc

SEQ ID NO: 1050489 - RNA, 19 nt, Homo sapiens
guagaccaguguccuaagu

SEQ ID NO: 1050490 - RNA, 19 nt, Homo sapiens
guauguaggaguuaaauag

SEQ ID NO: 1050491 - RNA, 19 nt, Homo sapiens
ggagggagccuuuacuacu

SEQ ID NO: 1050492 - RNA, 19 nt, Homo sapiens
cagaaaggagcuucaaaug

SEQ ID NO: 1050493 - RNA, 19 nt, Homo sapiens
caaagcugcugaagguaag

SEQ ID NO: 1050494 - RNA, 19 nt, Homo sapiens
gcacaagcugggcaaauca

SEQ ID NO: 1050495 - RNA, 19 nt, Homo sapiens
aagcagaggcccagucaaa

SEQ ID NO: 1050496 - RNA, 19 nt, Homo sapiens
ggaagccauuguggaagaa

SEQ ID NO: 1050497 - RNA, 19 nt, Homo sapiens
ucacauguuugggagguuu

SEQ ID NO: 1050498 - RNA, 19 nt, Homo sapiens
cacgacgccuggcucauuu

SEQ ID NO: 1050499 - RNA, 19 nt, Homo sapiens
gguggaagccauuguggaa

SEQ ID NO: 1050500 - RNA, 19 nt, Homo sapiens
gaaaacgugugcacuaugg

SEQ ID NO: 1050501 - RNA, 19 nt, Homo sapiens
ccaggcuucuucacuuuga

SEQ ID NO: 1050502 - RNA, 19 nt, Homo sapiens
ccucgaacaucugaagaaa

SEQ ID NO: 1050503 - RNA, 19 nt, Homo sapiens
gaagauguucugcaaagag

SEQ ID NO: 1050504 - RNA, 19 nt, Homo sapiens
acaaagcugcugaagguaa

SEQ ID NO: 1050505 - RNA, 19 nt, Homo sapiens
gaagacuuaugcagcugau

SEQ ID NO: 1050506 - RNA, 19 nt, Homo sapiens
ggagcaaguuauuucuuac

SEQ ID NO: 1050507 - RNA, 19 nt, Homo sapiens
uaaacaggagcaaaucuug

SEQ ID NO: 1050508 - RNA, 19 nt, Homo sapiens
gcuggccaauguuguagaa

SEQ ID NO: 1050509 - RNA, 19 nt, Homo sapiens
uguccuaagucuugccuuu

SEQ ID NO: 1050510 - RNA, 19 nt, Homo sapiens
gccagacaauccugagaga

SEQ ID NO: 1050511 - RNA, 19 nt, Homo sapiens
agagagauccugaagacuu

SEQ ID NO: 1050512 - RNA, 19 nt, Homo sapiens
cagcggagaccaugcagaa

SEQ ID NO: 1050513 - RNA, 19 nt, Homo sapiens
gaaaacagaguauuguaug

SEQ ID NO: 1050514 - RNA, 19 nt, Homo sapiens
gcaugaggcccacaguguu

SEQ ID NO: 1050515 - RNA, 19 nt, Homo sapiens
aaauggcugugauaaggaa

SEQ ID NO: 1050516 - RNA, 19 nt, Homo sapiens
uggaagccauuguggaaga

SEQ ID NO: 1050517 - RNA, 19 nt, Homo sapiens
ccacgacgccuggcucauu

SEQ ID NO: 1050518 - RNA, 19 nt, Homo sapiens
ugaggaugaugaaguagau

SEQ ID NO: 1050519 - RNA, 19 nt, Homo sapiens
cagaggcccagucaaauga

SEQ ID NO: 1050520 - RNA, 19 nt, Homo sapiens
gaugauugcagaguugaaa

SEQ ID NO: 1050521 - RNA, 19 nt, Homo sapiens
gcaggucacaugccuauac

SEQ ID NO: 1050522 - RNA, 19 nt, Homo sapiens
gguuugcuauaucuaauca

SEQ ID NO: 1050523 - RNA, 19 nt, Homo sapiens
gcgcuuggauccagauacu

SEQ ID NO: 1050524 - RNA, 19 nt, Homo sapiens
gaacugccaccuggaagau

SEQ ID NO: 1050525 - RNA, 19 nt, Homo sapiens
ggaaccugcggccuaauug

SEQ ID NO: 1050526 - RNA, 19 nt, Homo sapiens
gucugaaacuucucacaug

SEQ ID NO: 1050527 - RNA, 19 nt, Homo sapiens
ucacuucgcaggucacaug

SEQ ID NO: 1050528 - RNA, 19 nt, Homo sapiens
uagcuaggauggucucgau

SEQ ID NO: 1050529 - RNA, 19 nt, Homo sapiens
ggagcaaguuauuucuuuu

SEQ ID NO: 1050530 - RNA, 19 nt, Homo sapiens
cuaaguggcaggaucagaa

SEQ ID NO: 1050531 - RNA, 19 nt, Homo sapiens
gacuuuguccauuguagua

SEQ ID NO: 1050532 - RNA, 19 nt, Homo sapiens
agacauugaugcuacauua

SEQ ID NO: 1050533 - RNA, 19 nt, Homo sapiens
gaacuuauaucuuguuggu

SEQ ID NO: 1050534 - RNA, 19 nt, Homo sapiens
agacagaacuucaaagguu

SEQ ID NO: 1050535 - RNA, 19 nt, Homo sapiens
gaacaagaaacacuagaaa

SEQ ID NO: 1050536 - RNA, 19 nt, Homo sapiens
gaacaagucauccuggaaa

SEQ ID NO: 1050537 - RNA, 19 nt, Homo sapiens
caagcacccuucucaguuu

SEQ ID NO: 1050538 - RNA, 19 nt, Homo sapiens
gacagaacuucaaagguuu

SEQ ID NO: 1050539 - RNA, 19 nt, Homo sapiens
guaaaagagugcaaugaua

SEQ ID NO: 1050540 - RNA, 19 nt, Homo sapiens
gaaugcagccuuuccagaa

SEQ ID NO: 1050541 - RNA, 19 nt, Homo sapiens
aaagugaccuuaucagcuu

SEQ ID NO: 1050542 - RNA, 19 nt, Homo sapiens
gcaguuggcuuuugaaaug

SEQ ID NO: 1050543 - RNA, 19 nt, Homo sapiens
gaacuuauuugggcaccuu

SEQ ID NO: 1050544 - RNA, 19 nt, Homo sapiens
gcaaaguuguauccaggaa

SEQ ID NO: 1050545 - RNA, 19 nt, Homo sapiens
caaagaagaaaccaaagaa

SEQ ID NO: 1050546 - RNA, 19 nt, Homo sapiens
gcaagcacccuucucaguu

SEQ ID NO: 1050547 - RNA, 19 nt, Homo sapiens
agaggaaggugcaggcuuu

SEQ ID NO: 1050548 - RNA, 19 nt, Homo sapiens
ggaaggugcaggcuuuaaa

SEQ ID NO: 1050549 - RNA, 19 nt, Homo sapiens
uaacagacccuuuaucaac

SEQ ID NO: 1050550 - RNA, 19 nt, Homo sapiens
gcauuugccauaccugaua

SEQ ID NO: 1050551 - RNA, 19 nt, Homo sapiens
acuccuggcuuuaaaguuu

SEQ ID NO: 1050552 - RNA, 19 nt, Homo sapiens
uaucagaaccaucuaauuc

SEQ ID NO: 1050553 - RNA, 19 nt, Homo sapiens
gaaggaggaaccaauggaa

SEQ ID NO: 1050554 - RNA, 19 nt, Homo sapiens
acaagugaaugcagccuuu

SEQ ID NO: 1050555 - RNA, 19 nt, Homo sapiens
uuauaucuguggucacuaa

SEQ ID NO: 1050556 - RNA, 19 nt, Homo sapiens
gaugauuacuuggaguuau

SEQ ID NO: 1050557 - RNA, 19 nt, Homo sapiens
gagcuuggccacucuccua

SEQ ID NO: 1050558 - RNA, 19 nt, Homo sapiens
gaacccagacccaaugcuu

SEQ ID NO: 1050559 - RNA, 19 nt, Homo sapiens
ccuuugcuguguuaaauaa

SEQ ID NO: 1050560 - RNA, 19 nt, Homo sapiens
uacauuaacagacccuuua

SEQ ID NO: 1050561 - RNA, 19 nt, Homo sapiens
gaaccagacagaacuucaa

SEQ ID NO: 1050562 - RNA, 19 nt, Homo sapiens
cuucaaacguccauucuca

SEQ ID NO: 1050563 - RNA, 19 nt, Homo sapiens
ggaguuauuccugcaguuu

SEQ ID NO: 1050564 - RNA, 19 nt, Homo sapiens
guguucaacuuccucaauu

SEQ ID NO: 1050565 - RNA, 19 nt, Homo sapiens
gaaaaucauuguugagaag

SEQ ID NO: 1050566 - RNA, 19 nt, Homo sapiens
ggaaaaucauuguugagaa

SEQ ID NO: 1050567 - RNA, 19 nt, Homo sapiens
caugagagccuucacauac

SEQ ID NO: 1050568 - RNA, 19 nt, Homo sapiens
gaaccuucagccaauauug

SEQ ID NO: 1050569 - RNA, 19 nt, Homo sapiens
ucagaaccuucagccaaua

SEQ ID NO: 1050570 - RNA, 19 nt, Homo sapiens
caccuuugaugauuacuug

SEQ ID NO: 1050571 - RNA, 19 nt, Homo sapiens
uauauugccuuugucuuga

SEQ ID NO: 1050572 - RNA, 19 nt, Homo sapiens
gaugaaagugaccuuauca

SEQ ID NO: 1050573 - RNA, 19 nt, Homo sapiens
gaugcuacauuauaugaac

SEQ ID NO: 1050574 - RNA, 19 nt, Homo sapiens
cagauccucaaccaaauua

SEQ ID NO: 1050575 - RNA, 19 nt, Homo sapiens
ugaaguaucagcccauaga

SEQ ID NO: 1050576 - RNA, 19 nt, Homo sapiens
agauggaggugcccaguug

SEQ ID NO: 1050577 - RNA, 19 nt, Homo sapiens
ucaaagaagaaaccaaaga

SEQ ID NO: 1050578 - RNA, 19 nt, Homo sapiens
gccaccagcucuccacguu

SEQ ID NO: 1050579 - RNA, 19 nt, Homo sapiens
ucaagcagcagcaaaugaa

SEQ ID NO: 1050580 - RNA, 19 nt, Homo sapiens
gccucacucuucuauauug

SEQ ID NO: 1050581 - RNA, 19 nt, Homo sapiens
gaagcagugggauugguaa

SEQ ID NO: 1050582 - RNA, 19 nt, Homo sapiens
ggugcccaguuguuguuua

SEQ ID NO: 1050583 - RNA, 19 nt, Homo sapiens
ucaaccaaauuauggaauc

SEQ ID NO: 1050584 - RNA, 19 nt, Homo sapiens
gaugauuuccugacaaugg

SEQ ID NO: 1050585 - RNA, 19 nt, Homo sapiens
caaugaugauuuccugaca

SEQ ID NO: 1050586 - RNA, 19 nt, Homo sapiens
aagaagaaaccaaagaaug

SEQ ID NO: 1050587 - RNA, 19 nt, Homo sapiens
gcacucaagcagcagcaaa

SEQ ID NO: 1050588 - RNA, 19 nt, Homo sapiens
ugucaaagaagaaaccaaa

SEQ ID NO: 1050589 - RNA, 19 nt, Homo sapiens
gcacgcacuccuggcuuua

SEQ ID NO: 1050590 - RNA, 19 nt, Homo sapiens
cauagaacuugcucaggau

SEQ ID NO: 1050591 - RNA, 19 nt, Homo sapiens
gaaggugcaggcuuuaaag

SEQ ID NO: 1050592 - RNA, 19 nt, Homo sapiens
agaguucuuucacaccuuu

SEQ ID NO: 1050593 - RNA, 19 nt, Homo sapiens
caacuuccucaauugcuuu

SEQ ID NO: 1050594 - RNA, 19 nt, Homo sapiens
gugaagcccugaagaagcu

SEQ ID NO: 1050595 - RNA, 19 nt, Homo sapiens
caucgugauucagguguuu

SEQ ID NO: 1050596 - RNA, 19 nt, Homo sapiens
gcaaugauaacaccaugag

SEQ ID NO: 1050597 - RNA, 19 nt, Homo sapiens
cuccaagauuagaauguua

SEQ ID NO: 1050598 - RNA, 19 nt, Homo sapiens
agaagaaaccaaagaaugg

SEQ ID NO: 1050599 - RNA, 19 nt, Homo sapiens
cauuugccauaccugauaa

SEQ ID NO: 1050600 - RNA, 19 nt, Homo sapiens
ccuccaagauuagaauguu

SEQ ID NO: 1050601 - RNA, 19 nt, Homo sapiens
cagaacuuauaucuuguug

SEQ ID NO: 1050602 - RNA, 19 nt, Homo sapiens
ccugauaagccacggcaua

SEQ ID NO: 1050603 - RNA, 19 nt, Homo sapiens
ugaugaguguuauaucugu

SEQ ID NO: 1050604 - RNA, 19 nt, Homo sapiens
gauccucaaccaaauuaug

SEQ ID NO: 1050605 - RNA, 19 nt, Homo sapiens
cuauauugccuuugucuug

SEQ ID NO: 1050606 - RNA, 19 nt, Homo sapiens
ucaacuuccucaauugcuu

SEQ ID NO: 1050607 - RNA, 19 nt, Homo sapiens
gguuugcuuugaaguauca

SEQ ID NO: 1050608 - RNA, 19 nt, Homo sapiens
gaccuuaucagcuuuggau

SEQ ID NO: 1050609 - RNA, 19 nt, Homo sapiens
ucacaggagccucaguuga

SEQ ID NO: 1050610 - RNA, 19 nt, Homo sapiens
gagaguucuuucacaccuu

SEQ ID NO: 1050611 - RNA, 19 nt, Homo sapiens
uugccucacucuucuauau

SEQ ID NO: 1050612 - RNA, 19 nt, Homo sapiens
acacucgguuugcuuugaa

SEQ ID NO: 1050613 - RNA, 19 nt, Homo sapiens
aaagaugaaagugaccuua

SEQ ID NO: 1050614 - RNA, 19 nt, Homo sapiens
ccaugagagccuucacaua

SEQ ID NO: 1050615 - RNA, 19 nt, Homo sapiens
gggcagaagcagugggauu

SEQ ID NO: 1050616 - RNA, 19 nt, Homo sapiens
ugaacaagaaacacuagaa

SEQ ID NO: 1050617 - RNA, 19 nt, Homo sapiens
ccaggaaaaucauuguuga

SEQ ID NO: 1050618 - RNA, 19 nt, Homo sapiens
cccauuagcagcugccuuu

SEQ ID NO: 1050619 - RNA, 19 nt, Homo sapiens
gaggaaggugcaggcuuua

SEQ ID NO: 1050620 - RNA, 19 nt, Homo sapiens
caaccaaauuauggaaucu

SEQ ID NO: 1050621 - RNA, 19 nt, Homo sapiens
gcccauagagaaucacaga

SEQ ID NO: 1050622 - RNA, 19 nt, Homo sapiens
gguacacucgguuugcuuu

SEQ ID NO: 1050623 - RNA, 19 nt, Homo sapiens
gacccaaugcuuagccaaa

SEQ ID NO: 1050624 - RNA, 19 nt, Homo sapiens
ucaaacguccauucucaga

SEQ ID NO: 1050625 - RNA, 19 nt, Homo sapiens
agaugaaagugaccuuauc

SEQ ID NO: 1050626 - RNA, 19 nt, Homo sapiens
ccagauccucaaccaaauu

SEQ ID NO: 1050627 - RNA, 19 nt, Homo sapiens
acagugaagcccugaagaa

SEQ ID NO: 1050628 - RNA, 19 nt, Homo sapiens
gcaucgugauucagguguu

SEQ ID NO: 1050629 - RNA, 19 nt, Homo sapiens
cgucuggcaucgugauuca

SEQ ID NO: 1050630 - RNA, 19 nt, Homo sapiens
aacagacccuuuaucaaca

SEQ ID NO: 1050631 - RNA, 19 nt, Homo sapiens
caucacaggagccucaguu

SEQ ID NO: 1050632 - RNA, 19 nt, Homo sapiens
gaugauaauugaucgcuua

SEQ ID NO: 1050633 - RNA, 19 nt, Homo sapiens
ggaagaccacuguuaauua

SEQ ID NO: 1050634 - RNA, 19 nt, Homo sapiens
gaagucaaauguaagauug

SEQ ID NO: 1050635 - RNA, 19 nt, Homo sapiens
gaagcgauauugaaagaaa

SEQ ID NO: 1050636 - RNA, 19 nt, Homo sapiens
gaauauaccucagauuaug

SEQ ID NO: 1050637 - RNA, 19 nt, Homo sapiens
gaaccuccuuguuggaaua

SEQ ID NO: 1050638 - RNA, 19 nt, Homo sapiens
ucaaacagcuacagugauu

SEQ ID NO: 1050639 - RNA, 19 nt, Homo sapiens
gaacuggaauccucgaaau

SEQ ID NO: 1050640 - RNA, 19 nt, Homo sapiens
ucaagaaccuaaauaguga

SEQ ID NO: 1050641 - RNA, 19 nt, Homo sapiens
ggaagcaagugcagauuug

SEQ ID NO: 1050642 - RNA, 19 nt, Homo sapiens
gaagaaggauauagaacug

SEQ ID NO: 1050643 - RNA, 19 nt, Homo sapiens
gaaggaagcccaagcaugu

SEQ ID NO: 1050644 - RNA, 19 nt, Homo sapiens
gcagaaaggaucauugaaa

SEQ ID NO: 1050645 - RNA, 19 nt, Homo sapiens
uggaagugcugauaaauuu

SEQ ID NO: 1050646 - RNA, 19 nt, Homo sapiens
gaagaccacuguuaauuac

SEQ ID NO: 1050647 - RNA, 19 nt, Homo sapiens
gaaccuaaauagugagaau

SEQ ID NO: 1050648 - RNA, 19 nt, Homo sapiens
gauaugacaugugauaaga

SEQ ID NO: 1050649 - RNA, 19 nt, Homo sapiens
guaagagucauacgaauaa

SEQ ID NO: 1050650 - RNA, 19 nt, Homo sapiens
gauaauugaucgcuuagau

SEQ ID NO: 1050651 - RNA, 19 nt, Homo sapiens
gcuaucaaauucuacauga

SEQ ID NO: 1050652 - RNA, 19 nt, Homo sapiens
gcaaagagaauguuaccaa

SEQ ID NO: 1050653 - RNA, 19 nt, Homo sapiens
ugaaaccgaugaagucaaa

SEQ ID NO: 1050654 - RNA, 19 nt, Homo sapiens
gaagagugcugaaaagauu

SEQ ID NO: 1050655 - RNA, 19 nt, Homo sapiens
ggacagccuuugcuauuuc

SEQ ID NO: 1050656 - RNA, 19 nt, Homo sapiens
aaacaacagucaaaucaga

SEQ ID NO: 1050657 - RNA, 19 nt, Homo sapiens
ugaaggaaaucagucauaa

SEQ ID NO: 1050658 - RNA, 19 nt, Homo sapiens
ccgaugaagucaaauguaa

SEQ ID NO: 1050659 - RNA, 19 nt, Homo sapiens
caaacugguugcucuacua

SEQ ID NO: 1050660 - RNA, 19 nt, Homo sapiens
caauaaaccugugauaagu

SEQ ID NO: 1050661 - RNA, 19 nt, Homo sapiens
caaaucagacagaauauug

SEQ ID NO: 1050662 - RNA, 19 nt, Homo sapiens
aaugagggauuucagcuua

SEQ ID NO: 1050663 - RNA, 19 nt, Homo sapiens
ggacguuaauuaugagaga

SEQ ID NO: 1050664 - RNA, 19 nt, Homo sapiens
cuacagagaaggcaagaua

SEQ ID NO: 1050665 - RNA, 19 nt, Homo sapiens
gcaugagaauggugcagua

SEQ ID NO: 1050666 - RNA, 19 nt, Homo sapiens
ucauggaguuguuccuuua

SEQ ID NO: 1050667 - RNA, 19 nt, Homo sapiens
ggaaucaaaugaccaagag

SEQ ID NO: 1050668 - RNA, 19 nt, Homo sapiens
aaaggucacuggagaagaa

SEQ ID NO: 1050669 - RNA, 19 nt, Homo sapiens
uaucacagaucauggaguu

SEQ ID NO: 1050670 - RNA, 19 nt, Homo sapiens
uaaagaagccauccgcaaa

SEQ ID NO: 1050671 - RNA, 19 nt, Homo sapiens
ccucaaaucagacagaaua

SEQ ID NO: 1050672 - RNA, 19 nt, Homo sapiens
cgagauaugacaugugaua

SEQ ID NO: 1050673 - RNA, 19 nt, Homo sapiens
gcgguuagcugcugucaca

SEQ ID NO: 1050674 - RNA, 19 nt, Homo sapiens
gagaugggaaccaagcuua

SEQ ID NO: 1050675 - RNA, 19 nt, Homo sapiens
caaacagucuuggaaucua

SEQ ID NO: 1050676 - RNA, 19 nt, Homo sapiens
ggagaaugcugccaagaac

SEQ ID NO: 1050677 - RNA, 19 nt, Homo sapiens
cuaccgggcugcaaucaaa

SEQ ID NO: 1050678 - RNA, 19 nt, Homo sapiens
gcaguaagagucauacgaa

SEQ ID NO: 1050679 - RNA, 19 nt, Homo sapiens
ggugagacucugugcauua

SEQ ID NO: 1050680 - RNA, 19 nt, Homo sapiens
gaagauugcuaugcugcuu

SEQ ID NO: 1050681 - RNA, 19 nt, Homo sapiens
cagguuauguugucaguga

SEQ ID NO: 1050682 - RNA, 19 nt, Homo sapiens
gaauacaaagccauugaaa

SEQ ID NO: 1050683 - RNA, 19 nt, Homo sapiens
aagagaauguuaccaaguu

SEQ ID NO: 1050684 - RNA, 19 nt, Homo sapiens
gcugauaaauuugcuugaa

SEQ ID NO: 1050685 - RNA, 19 nt, Homo sapiens
ucaagaaaccugccaguug

SEQ ID NO: 1050686 - RNA, 19 nt, Homo sapiens
agaagcuggugaaauauuu

SEQ ID NO: 1050687 - RNA, 19 nt, Homo sapiens
acacggaagagcacaauua

SEQ ID NO: 1050688 - RNA, 19 nt, Homo sapiens
uagaacugcucaaacguuu

SEQ ID NO: 1050689 - RNA, 19 nt, Homo sapiens
uaagauggaaagccaauaa

SEQ ID NO: 1050690 - RNA, 19 nt, Homo sapiens
guaaagcuucuacuggaua

SEQ ID NO: 1050691 - RNA, 19 nt, Homo sapiens
gcagcugucacgcuuguua

SEQ ID NO: 1050692 - RNA, 19 nt, Homo sapiens
gaaauguuccaucagcaaa

SEQ ID NO: 1050693 - RNA, 19 nt, Homo sapiens
gaagcuggugaaauauuua

SEQ ID NO: 1050694 - RNA, 19 nt, Homo sapiens
ggagaagaaccaaauuaau

SEQ ID NO: 1050695 - RNA, 19 nt, Homo sapiens
gaaccugaaaguaugauga

SEQ ID NO: 1050696 - RNA, 19 nt, Homo sapiens
uaacagagaccccauagua

SEQ ID NO: 1050697 - RNA, 19 nt, Homo sapiens
aagcauguguugaagcuaa

SEQ ID NO: 1050698 - RNA, 19 nt, Homo sapiens
gaaaugguucguuccuuug

SEQ ID NO: 1050699 - RNA, 19 nt, Homo sapiens
ugaaacaacagucaaauca

SEQ ID NO: 1050700 - RNA, 19 nt, Homo sapiens
ccaauaaaccugugauaag

SEQ ID NO: 1050701 - RNA, 19 nt, Homo sapiens
ccacuugaauggaacacaa

SEQ ID NO: 1050702 - RNA, 19 nt, Homo sapiens
caaagacauuucugguuca

SEQ ID NO: 1050703 - RNA, 19 nt, Homo sapiens
gagacucugugcauuacuu

SEQ ID NO: 1050704 - RNA, 19 nt, Homo sapiens
ggaauaaaccaagcucuuc

SEQ ID NO: 1050705 - RNA, 19 nt, Homo sapiens
aagaaguacuugugaaugu

SEQ ID NO: 1050706 - RNA, 19 nt, Homo sapiens
gaagaaguacuugugaaug

SEQ ID NO: 1050707 - RNA, 19 nt, Homo sapiens
gagacuaucgcgaauguug

SEQ ID NO: 1050708 - RNA, 19 nt, Homo sapiens
ggaaaucagucauaauccu

SEQ ID NO: 1050709 - RNA, 19 nt, Homo sapiens
gugcagauuugccaucaga

SEQ ID NO: 1050710 - RNA, 19 nt, Homo sapiens
agcgauagcuccucagaaa

SEQ ID NO: 1050711 - RNA, 19 nt, Homo sapiens
cgacagcucaggccuugua

SEQ ID NO: 1050712 - RNA, 19 nt, Homo sapiens
ggauauagaacugcucaaa

SEQ ID NO: 1050713 - RNA, 19 nt, Homo sapiens
gaaaaugcacagaauguuu

SEQ ID NO: 1050714 - RNA, 19 nt, Homo sapiens
ugaaucagguuauguuguc

SEQ ID NO: 1050715 - RNA, 19 nt, Homo sapiens
ugcguuaucugaaaucaaa

SEQ ID NO: 1050716 - RNA, 19 nt, Homo sapiens
gaaguucuggcaaguguau

SEQ ID NO: 1050717 - RNA, 19 nt, Homo sapiens
gcaguagaaccugaaagua

SEQ ID NO: 1050718 - RNA, 19 nt, Homo sapiens
acaaagccauugaaaccuu

SEQ ID NO: 1050719 - RNA, 19 nt, Homo sapiens
gaugaagucaaauguaaga

SEQ ID NO: 1050720 - RNA, 19 nt, Homo sapiens
cggaagagcacaauuacuu

SEQ ID NO: 1050721 - RNA, 19 nt, Homo sapiens
gaaaucaccccucuaaaug

SEQ ID NO: 1050722 - RNA, 19 nt, Homo sapiens
aaacagucuuggaaucuau

SEQ ID NO: 1050723 - RNA, 19 nt, Homo sapiens
gacauuacaagcuaucaaa

SEQ ID NO: 1050724 - RNA, 19 nt, Homo sapiens
ggaauacaaagccauugaa

SEQ ID NO: 1050725 - RNA, 19 nt, Homo sapiens
cagaaaggaucauugaaaa

SEQ ID NO: 1050726 - RNA, 19 nt, Homo sapiens
gaggaaacuguuagcgaua

SEQ ID NO: 1050727 - RNA, 19 nt, Homo sapiens
gccaauaaaccugugauaa

SEQ ID NO: 1050728 - RNA, 19 nt, Homo sapiens
uaugacaugugauaagaug

SEQ ID NO: 1050729 - RNA, 19 nt, Homo sapiens
uaaagcuucuacuggauau

SEQ ID NO: 1050730 - RNA, 19 nt, Homo sapiens
gggagaaugcugccaagaa

SEQ ID NO: 1050731 - RNA, 19 nt, Homo sapiens
gucaagaaccuaaauagug

SEQ ID NO: 1050732 - RNA, 19 nt, Homo sapiens
gaacuuugguccauccuuu

SEQ ID NO: 1050733 - RNA, 19 nt, Homo sapiens
guaacaacgucauuucuaa

SEQ ID NO: 1050734 - RNA, 19 nt, Homo sapiens
gaagagagcagucaagaga

SEQ ID NO: 1050735 - RNA, 19 nt, Homo sapiens
gacaguauuugcucaauuu

SEQ ID NO: 1050736 - RNA, 19 nt, Homo sapiens
caacaacaauccagaaauc

SEQ ID NO: 1050737 - RNA, 19 nt, Homo sapiens
gaaauuacccucugaugug

SEQ ID NO: 1050738 - RNA, 19 nt, Homo sapiens
ggaagagaauauagaauca

SEQ ID NO: 1050739 - RNA, 19 nt, Homo sapiens
gauaagaaagccagauuaa

SEQ ID NO: 1050740 - RNA, 19 nt, Homo sapiens
guaagaagcuggguugugu

SEQ ID NO: 1050741 - RNA, 19 nt, Homo sapiens
ggaaagcgauaguauugau

SEQ ID NO: 1050742 - RNA, 19 nt, Homo sapiens
gcacgagcaugcccugaaa

SEQ ID NO: 1050743 - RNA, 19 nt, Homo sapiens
ggauaaagcugugcaaguc

SEQ ID NO: 1050744 - RNA, 19 nt, Homo sapiens
gaggaaagcgauaguauug

SEQ ID NO: 1050745 - RNA, 19 nt, Homo sapiens
gaagcuggguuguguacuu

SEQ ID NO: 1050746 - RNA, 19 nt, Homo sapiens
caaaguggcagauaagaaa

SEQ ID NO: 1050747 - RNA, 19 nt, Homo sapiens
gaccaagccugugcaaauu

SEQ ID NO: 1050748 - RNA, 19 nt, Homo sapiens
caacaauccagaaaucuuu

SEQ ID NO: 1050749 - RNA, 19 nt, Homo sapiens
gaaaccagaugggaagaug

SEQ ID NO: 1050750 - RNA, 19 nt, Homo sapiens
gaagaucgaagaaaacuua

SEQ ID NO: 1050751 - RNA, 19 nt, Homo sapiens
ucaagaagcagcucagaaa

SEQ ID NO: 1050752 - RNA, 19 nt, Homo sapiens
aaagagccaugaaucuaaa

SEQ ID NO: 1050753 - RNA, 19 nt, Homo sapiens
gagcuguccuggaaguaaa

SEQ ID NO: 1050754 - RNA, 19 nt, Homo sapiens
ggacaaaggcaaagugaag

SEQ ID NO: 1050755 - RNA, 19 nt, Homo sapiens
ggaaauuacccucugaugu

SEQ ID NO: 1050756 - RNA, 19 nt, Homo sapiens
guaaauaucccuaggaaac

SEQ ID NO: 1050757 - RNA, 19 nt, Homo sapiens
gaacuggcucagagugaua

SEQ ID NO: 1050758 - RNA, 19 nt, Homo sapiens
guaugaaguugugucuaua

SEQ ID NO: 1050759 - RNA, 19 nt, Homo sapiens
ugaugaagaugaagaggaa

SEQ ID NO: 1050760 - RNA, 19 nt, Homo sapiens
guucaugacucaagaagca

SEQ ID NO: 1050761 - RNA, 19 nt, Homo sapiens
uaaggcaugucgaggcuuu

SEQ ID NO: 1050762 - RNA, 19 nt, Homo sapiens
ucaaauauguccgcauugu

SEQ ID NO: 1050763 - RNA, 19 nt, Homo sapiens
ggacagugaccuagaggaa

SEQ ID NO: 1050764 - RNA, 19 nt, Homo sapiens
gcagagaggaagaggauau

SEQ ID NO: 1050765 - RNA, 19 nt, Homo sapiens
aaacaucaggaaucaguua

SEQ ID NO: 1050766 - RNA, 19 nt, Homo sapiens
ggaaagaagagaagaaagg

SEQ ID NO: 1050767 - RNA, 19 nt, Homo sapiens
uguaugaaguugugucuau

SEQ ID NO: 1050768 - RNA, 19 nt, Homo sapiens
gcaaagaggagcaaauggu

SEQ ID NO: 1050769 - RNA, 19 nt, Homo sapiens
uuggagaacucaaauaugu

SEQ ID NO: 1050770 - RNA, 19 nt, Homo sapiens
gaaaagagccaugaaucua

SEQ ID NO: 1050771 - RNA, 19 nt, Homo sapiens
gaggugcccuggacugugu

SEQ ID NO: 1050772 - RNA, 19 nt, Homo sapiens
gcaggagaagcagcaauua

SEQ ID NO: 1050773 - RNA, 19 nt, Homo sapiens
ugacgaugaugaugaugaa

SEQ ID NO: 1050774 - RNA, 19 nt, Homo sapiens
aaccugagcuuuaaguguu

SEQ ID NO: 1050775 - RNA, 19 nt, Homo sapiens
caaaggcuguagaugacaa

SEQ ID NO: 1050776 - RNA, 19 nt, Homo sapiens
gaagaggaagagaauauag

SEQ ID NO: 1050777 - RNA, 19 nt, Homo sapiens
gaaguaaauaucccuagga

SEQ ID NO: 1050778 - RNA, 19 nt, Homo sapiens
gaaccugagcuuuaagugu

SEQ ID NO: 1050779 - RNA, 19 nt, Homo sapiens
caaauggaaacaccugaaa

SEQ ID NO: 1050780 - RNA, 19 nt, Homo sapiens
caaagaggagcaaaugguu

SEQ ID NO: 1050781 - RNA, 19 nt, Homo sapiens
gagcagguaucuaggaaaa

SEQ ID NO: 1050782 - RNA, 19 nt, Homo sapiens
acucaaauauguccgcauu

SEQ ID NO: 1050783 - RNA, 19 nt, Homo sapiens
ggagcugccugauggaaag

SEQ ID NO: 1050784 - RNA, 19 nt, Homo sapiens
cgaugaugaugaugaagaa

SEQ ID NO: 1050785 - RNA, 19 nt, Homo sapiens
ggaacuggcucagagugau

SEQ ID NO: 1050786 - RNA, 19 nt, Homo sapiens
ggaggacagugaccuagag

SEQ ID NO: 1050787 - RNA, 19 nt, Homo sapiens
gagauuaccaccuuugaag

SEQ ID NO: 1050788 - RNA, 19 nt, Homo sapiens
ggaccggguuccagaccaa

SEQ ID NO: 1050789 - RNA, 19 nt, Homo sapiens
caaggaguguagagugaug

SEQ ID NO: 1050790 - RNA, 19 nt, Homo sapiens
acacagagcauucuaaagg

SEQ ID NO: 1050791 - RNA, 19 nt, Homo sapiens
ugaccaagccugugcaaau

SEQ ID NO: 1050792 - RNA, 19 nt, Homo sapiens
ggaagaggauauggaagag

SEQ ID NO: 1050793 - RNA, 19 nt, Homo sapiens
agacaguauuugcucaauu

SEQ ID NO: 1050794 - RNA, 19 nt, Homo sapiens
uuugaugugugguucguua

SEQ ID NO: 1050795 - RNA, 19 nt, Homo sapiens
uaaaggagcaccucuugca

SEQ ID NO: 1050796 - RNA, 19 nt, Homo sapiens
ugaugaggcugcaaagcuu

SEQ ID NO: 1050797 - RNA, 19 nt, Homo sapiens
aaauuacccucugauguga

SEQ ID NO: 1050798 - RNA, 19 nt, Homo sapiens
gugcaagucucaaacaaaa

SEQ ID NO: 1050799 - RNA, 19 nt, Homo sapiens
ggagauuaccaccuuugaa

SEQ ID NO: 1050800 - RNA, 19 nt, Homo sapiens
ccaagccugugcaaauuca

SEQ ID NO: 1050801 - RNA, 19 nt, Homo sapiens
aaacgaugaugaugacgau

SEQ ID NO: 1050802 - RNA, 19 nt, Homo sapiens
gaagacaguauuugcucaa

SEQ ID NO: 1050803 - RNA, 19 nt, Homo sapiens
gaaagaagagaagaaaggu

SEQ ID NO: 1050804 - RNA, 19 nt, Homo sapiens
gcauuugcccaguucauga

SEQ ID NO: 1050805 - RNA, 19 nt, Homo sapiens
gagcuucuccaacaguuug

SEQ ID NO: 1050806 - RNA, 19 nt, Homo sapiens
ugacucagaagaagaagaa

SEQ ID NO: 1050807 - RNA, 19 nt, Homo sapiens
aaguaaauaucccuaggaa

SEQ ID NO: 1050808 - RNA, 19 nt, Homo sapiens
caauaguggaguucucuuu

SEQ ID NO: 1050809 - RNA, 19 nt, Homo sapiens
ggagcuguccuggaaguaa

SEQ ID NO: 1050810 - RNA, 19 nt, Homo sapiens
ccaaaguggcagauaagaa

SEQ ID NO: 1050811 - RNA, 19 nt, Homo sapiens
agagaaauaucugaaaguc

SEQ ID NO: 1050812 - RNA, 19 nt, Homo sapiens
aauaguggaguucucuuua

SEQ ID NO: 1050813 - RNA, 19 nt, Homo sapiens
gaugcgagaccucaaagga

SEQ ID NO: 1050814 - RNA, 19 nt, Homo sapiens
gaaacucaaggaccagaau

SEQ ID NO: 1050815 - RNA, 19 nt, Homo sapiens
uucuaaagguugugcauuu

SEQ ID NO: 1050816 - RNA, 19 nt, Homo sapiens
gagaauauagaaucaaagg

SEQ ID NO: 1050817 - RNA, 19 nt, Homo sapiens
ugaagaggaagagaauaua

SEQ ID NO: 1050818 - RNA, 19 nt, Homo sapiens
gaaauuauugggaccuucu

SEQ ID NO: 1050819 - RNA, 19 nt, Homo sapiens
ggaccagaauaucuuuguc

SEQ ID NO: 1050820 - RNA, 19 nt, Homo sapiens
ucaaggaccagaauaucuu

SEQ ID NO: 1050821 - RNA, 19 nt, Homo sapiens
acagagcauucuaaagguu

SEQ ID NO: 1050822 - RNA, 19 nt, Homo sapiens
ugacuugaagacaguauuu

SEQ ID NO: 1050823 - RNA, 19 nt, Homo sapiens
uaucugaaagucaacauga

SEQ ID NO: 1050824 - RNA, 19 nt, Homo sapiens
caucugaacuuugguccau

SEQ ID NO: 1050825 - RNA, 19 nt, Homo sapiens
cgaacaauauaagcggaaa

SEQ ID NO: 1050826 - RNA, 19 nt, Homo sapiens
cagcuggucgaacaauaua

SEQ ID NO: 1050827 - RNA, 19 nt, Homo sapiens
caaaagaccagcaacagaa

SEQ ID NO: 1050828 - RNA, 19 nt, Homo sapiens
uuucaaugcuggaagaugu

SEQ ID NO: 1050829 - RNA, 19 nt, Homo sapiens
agaagcagcucagaaaugc

SEQ ID NO: 1050830 - RNA, 19 nt, Homo sapiens
agacacagagcauucuaaa

SEQ ID NO: 1050831 - RNA, 19 nt, Homo sapiens
cagauaagaaagccagauu

SEQ ID NO: 1050832 - RNA, 19 nt, Homo sapiens
gcuauaagcugauuacaua

SEQ ID NO: 1050833 - RNA, 19 nt, Homo sapiens
ugaauuagcucagaaguua

SEQ ID NO: 1050834 - RNA, 19 nt, Homo sapiens
gcaaauaaaccaacacaua

SEQ ID NO: 1050835 - RNA, 19 nt, Homo sapiens
gaacgagacuucuuucuuc

SEQ ID NO: 1050836 - RNA, 19 nt, Homo sapiens
gcaaggagguguucaagga

SEQ ID NO: 1050837 - RNA, 19 nt, Homo sapiens
caggaaagcucaagacaaa

SEQ ID NO: 1050838 - RNA, 19 nt, Homo sapiens
caacaaggcuagugauuuc

SEQ ID NO: 1050839 - RNA, 19 nt, Homo sapiens
gaaugcaucugcuauuuau

SEQ ID NO: 1050840 - RNA, 19 nt, Homo sapiens
ccaauaaacucucccagaa

SEQ ID NO: 1050841 - RNA, 19 nt, Homo sapiens
gcacagaaguagaaauugu

SEQ ID NO: 1050842 - RNA, 19 nt, Homo sapiens
gcucagaaguuauuugaug

SEQ ID NO: 1050843 - RNA, 19 nt, Homo sapiens
gaccaagacuuaaacaaga

SEQ ID NO: 1050844 - RNA, 19 nt, Homo sapiens
ggaagaagaugaaaacaaa

SEQ ID NO: 1050845 - RNA, 19 nt, Homo sapiens
gaauauuacuucaguguag

SEQ ID NO: 1050846 - RNA, 19 nt, Homo sapiens
ugaauacccucuuucguuu

SEQ ID NO: 1050847 - RNA, 19 nt, Homo sapiens
gaauaccucuguaguuuua

SEQ ID NO: 1050848 - RNA, 19 nt, Homo sapiens
guaaagaguccaagaaaga

SEQ ID NO: 1050849 - RNA, 19 nt, Homo sapiens
caaaggaggauuacguaua

SEQ ID NO: 1050850 - RNA, 19 nt, Homo sapiens
ucagagaucacuucaauaa

SEQ ID NO: 1050851 - RNA, 19 nt, Homo sapiens
aaaggaggauuacguauau

SEQ ID NO: 1050852 - RNA, 19 nt, Homo sapiens
ucagugauauggagaauug

SEQ ID NO: 1050853 - RNA, 19 nt, Homo sapiens
agaaagauuugacugauga

SEQ ID NO: 1050854 - RNA, 19 nt, Homo sapiens
ccugagaaauagacucuua

SEQ ID NO: 1050855 - RNA, 19 nt, Homo sapiens
gugaaaugccugagaaaua

SEQ ID NO: 1050856 - RNA, 19 nt, Homo sapiens
gcuagugauuucagugaua

SEQ ID NO: 1050857 - RNA, 19 nt, Homo sapiens
gcauugggauugauuggaa

SEQ ID NO: 1050858 - RNA, 19 nt, Homo sapiens
gaaauaacuucagcagcaa

SEQ ID NO: 1050859 - RNA, 19 nt, Homo sapiens
agacuucucucaacugauu

SEQ ID NO: 1050860 - RNA, 19 nt, Homo sapiens
ccacaaguaucgucgaaga

SEQ ID NO: 1050861 - RNA, 19 nt, Homo sapiens
caagaguuauagcaaauug

SEQ ID NO: 1050862 - RNA, 19 nt, Homo sapiens
uagaaugucuguucagguu

SEQ ID NO: 1050863 - RNA, 19 nt, Homo sapiens
ccucagagaucacuucaau

SEQ ID NO: 1050864 - RNA, 19 nt, Homo sapiens
gggauugauuggaauauug

SEQ ID NO: 1050865 - RNA, 19 nt, Homo sapiens
ugaaaugccugagaaauag

SEQ ID NO: 1050866 - RNA, 19 nt, Homo sapiens
agaaaugaauacccucuuu

SEQ ID NO: 1050867 - RNA, 19 nt, Homo sapiens
ggacucagaaccuuggaua

SEQ ID NO: 1050868 - RNA, 19 nt, Homo sapiens
gaagucaacauuuacauca

SEQ ID NO: 1050869 - RNA, 19 nt, Homo sapiens
ggagaguaaucgucauaga

SEQ ID NO: 1050870 - RNA, 19 nt, Homo sapiens
ggaaagcucaagacaaaga

SEQ ID NO: 1050871 - RNA, 19 nt, Homo sapiens
gcaggaaguuauggaugua

SEQ ID NO: 1050872 - RNA, 19 nt, Homo sapiens
agaauucgguucccucaaa

SEQ ID NO: 1050873 - RNA, 19 nt, Homo sapiens
gacaccaccuuaugugaaa

SEQ ID NO: 1050874 - RNA, 19 nt, Homo sapiens
uaaaucagcuauguucuuc

SEQ ID NO: 1050875 - RNA, 19 nt, Homo sapiens
caagaaagauuugacugau

SEQ ID NO: 1050876 - RNA, 19 nt, Homo sapiens
gaagugagggugguaauau

SEQ ID NO: 1050877 - RNA, 19 nt, Homo sapiens
caacguaagagagcuaaua

SEQ ID NO: 1050878 - RNA, 19 nt, Homo sapiens
gagaucuucuaguaaugua

SEQ ID NO: 1050879 - RNA, 19 nt, Homo sapiens
aggaauaccucuguaguuu

SEQ ID NO: 1050880 - RNA, 19 nt, Homo sapiens
caagcaaugucuagagguu

SEQ ID NO: 1050881 - RNA, 19 nt, Homo sapiens
cuacaaaccuuaaucucau

SEQ ID NO: 1050882 - RNA, 19 nt, Homo sapiens
gaaaugauacacgaaguug

SEQ ID NO: 1050883 - RNA, 19 nt, Homo sapiens
ccaagaaguuccuguagca

SEQ ID NO: 1050884 - RNA, 19 nt, Homo sapiens
uaacucagacaccaccuua

SEQ ID NO: 1050885 - RNA, 19 nt, Homo sapiens
gaucaaccauuucaaacag

SEQ ID NO: 1050886 - RNA, 19 nt, Homo sapiens
gagcuucagguaccaauaa

SEQ ID NO: 1050887 - RNA, 19 nt, Homo sapiens
gauguacuccucauucauu

SEQ ID NO: 1050888 - RNA, 19 nt, Homo sapiens
aaacaaacacacagccaua

SEQ ID NO: 1050889 - RNA, 19 nt, Homo sapiens
gccaacaccaagugaauua

SEQ ID NO: 1050890 - RNA, 19 nt, Homo sapiens
caacagacuucucucaacu

SEQ ID NO: 1050891 - RNA, 19 nt, Homo sapiens
guaaagagcaguuugaaaa

SEQ ID NO: 1050892 - RNA, 19 nt, Homo sapiens
aaagauggaugaacaaggu

SEQ ID NO: 1050893 - RNA, 19 nt, Homo sapiens
ggaacgagacuucuuucuu

SEQ ID NO: 1050894 - RNA, 19 nt, Homo sapiens
ugaaaggacugaucaacca

SEQ ID NO: 1050895 - RNA, 19 nt, Homo sapiens
gaggauuacguauauguuu

SEQ ID NO: 1050896 - RNA, 19 nt, Homo sapiens
caacaaguguaccacaagu

SEQ ID NO: 1050897 - RNA, 19 nt, Homo sapiens
gaagagauugaacaaauag

SEQ ID NO: 1050898 - RNA, 19 nt, Homo sapiens
ggacugaucaaccauuuca

SEQ ID NO: 1050899 - RNA, 19 nt, Homo sapiens
gucauagacuuccaccuaa

SEQ ID NO: 1050900 - RNA, 19 nt, Homo sapiens
cgucgaagaugccuaagug

SEQ ID NO: 1050901 - RNA, 19 nt, Homo sapiens
gaacaccuagguuacaaga

SEQ ID NO: 1050902 - RNA, 19 nt, Homo sapiens
uccagaaucuccuagaauu

SEQ ID NO: 1050903 - RNA, 19 nt, Homo sapiens
gaaccuuggauagaaguua

SEQ ID NO: 1050904 - RNA, 19 nt, Homo sapiens
caaguauucuucaagcaau

SEQ ID NO: 1050905 - RNA, 19 nt, Homo sapiens
ggauagcacagaaguagaa

SEQ ID NO: 1050906 - RNA, 19 nt, Homo sapiens
gaucagagagucaagaaag

SEQ ID NO: 1050907 - RNA, 19 nt, Homo sapiens
gucauaaggagucagauua

SEQ ID NO: 1050908 - RNA, 19 nt, Homo sapiens
ugaaugcaucugcuauuua

SEQ ID NO: 1050909 - RNA, 19 nt, Homo sapiens
gaggagaguaaucgucaua

SEQ ID NO: 1050910 - RNA, 19 nt, Homo sapiens
gaauuuagacaacuugcuu

SEQ ID NO: 1050911 - RNA, 19 nt, Homo sapiens
uaaagaauccacaauccaa

SEQ ID NO: 1050912 - RNA, 19 nt, Homo sapiens
gagaaauagacucuuauga

SEQ ID NO: 1050913 - RNA, 19 nt, Homo sapiens
ccaagaaagauuugacuga

SEQ ID NO: 1050914 - RNA, 19 nt, Homo sapiens
ucaagaacauggugaaagg

SEQ ID NO: 1050915 - RNA, 19 nt, Homo sapiens
gagaaaugauacacgaagu

SEQ ID NO: 1050916 - RNA, 19 nt, Homo sapiens
ggaguccagugacaauuca

SEQ ID NO: 1050917 - RNA, 19 nt, Homo sapiens
gaaguaacagugacagcaa

SEQ ID NO: 1050918 - RNA, 19 nt, Homo sapiens
caaaagccauugauguaaa

SEQ ID NO: 1050919 - RNA, 19 nt, Homo sapiens
ccagugaaauugagggaau

SEQ ID NO: 1050920 - RNA, 19 nt, Homo sapiens
uauccgagguuccuuuaga

SEQ ID NO: 1050921 - RNA, 19 nt, Homo sapiens
ccaccuaauuccucuacaa

SEQ ID NO: 1050922 - RNA, 19 nt, Homo sapiens
cgucauagacuuccaccua

SEQ ID NO: 1050923 - RNA, 19 nt, Homo sapiens
aaacaaggcauagcacaaa

SEQ ID NO: 1050924 - RNA, 19 nt, Homo sapiens
cagaagaaccagaacaaga

SEQ ID NO: 1050925 - RNA, 19 nt, Homo sapiens
gaaacaaguauucuucaag

SEQ ID NO: 1050926 - RNA, 19 nt, Homo sapiens
gauugauuguccagaguuu

SEQ ID NO: 1050927 - RNA, 19 nt, Homo sapiens
aaguagaaauuguggauga

SEQ ID NO: 1050928 - RNA, 19 nt, Homo sapiens
gaaggauagcacagaagua

SEQ ID NO: 1050929 - RNA, 19 nt, Homo sapiens
gaugacguuuccaguguga

SEQ ID NO: 1050930 - RNA, 19 nt, Homo sapiens
gaacagcucaagaugucaa

SEQ ID NO: 1050931 - RNA, 19 nt, Homo sapiens
ccacuccacuuagauguug

SEQ ID NO: 1050932 - RNA, 19 nt, Homo sapiens
gcagaaagauugcaaacaa

SEQ ID NO: 1050933 - RNA, 19 nt, Homo sapiens
gagaacagcugaagaaagu

SEQ ID NO: 1050934 - RNA, 19 nt, Homo sapiens
gggauugucuucuugauuu

SEQ ID NO: 1050935 - RNA, 19 nt, Homo sapiens
gaagagacauguuuguauc

SEQ ID NO: 1050936 - RNA, 19 nt, Homo sapiens
ggaaacagaagcuuacuuu

SEQ ID NO: 1050937 - RNA, 19 nt, Homo sapiens
ggacaguguuguagaagaa

SEQ ID NO: 1050938 - RNA, 19 nt, Homo sapiens
gagaaggaaucaguaauga

SEQ ID NO: 1050939 - RNA, 19 nt, Homo sapiens
uaagaaacauucaccauca

SEQ ID NO: 1050940 - RNA, 19 nt, Homo sapiens
gaaauaggagugcagcaua

SEQ ID NO: 1050941 - RNA, 19 nt, Homo sapiens
gguagcagaugagaaauaa

SEQ ID NO: 1050942 - RNA, 19 nt, Homo sapiens
gcuauaauuucuccuacua

SEQ ID NO: 1050943 - RNA, 19 nt, Homo sapiens
ggaaacaacuaauacacau

SEQ ID NO: 1050944 - RNA, 19 nt, Homo sapiens
gcacaguagugauuggaaa

SEQ ID NO: 1050945 - RNA, 19 nt, Homo sapiens
ggaccaaacuuguauucau

SEQ ID NO: 1050946 - RNA, 19 nt, Homo sapiens
ccaaacacuuuccuuuauu

SEQ ID NO: 1050947 - RNA, 19 nt, Homo sapiens
gagcaucaaucuacagugu

SEQ ID NO: 1050948 - RNA, 19 nt, Homo sapiens
uuacuuugcugaccugaua

SEQ ID NO: 1050949 - RNA, 19 nt, Homo sapiens
gcaauuaaccguggagaaa

SEQ ID NO: 1050950 - RNA, 19 nt, Homo sapiens
agaagaaugugucagcuuu

SEQ ID NO: 1050951 - RNA, 19 nt, Homo sapiens
gagccaaacuaacaucaga

SEQ ID NO: 1050952 - RNA, 19 nt, Homo sapiens
ugagaaagauguugauaag

SEQ ID NO: 1050953 - RNA, 19 nt, Homo sapiens
ucaaaugaauggcucgaaa

SEQ ID NO: 1050954 - RNA, 19 nt, Homo sapiens
aaacaugguugcaaauuag

SEQ ID NO: 1050955 - RNA, 19 nt, Homo sapiens
acagauugcuuaacuucua

SEQ ID NO: 1050956 - RNA, 19 nt, Homo sapiens
gagaagugcaguuuccaua

SEQ ID NO: 1050957 - RNA, 19 nt, Homo sapiens
gaauucagagccaaacuaa

SEQ ID NO: 1050958 - RNA, 19 nt, Homo sapiens
gcagggaaacagaagcuua

SEQ ID NO: 1050959 - RNA, 19 nt, Homo sapiens
gcagagaaggaaucaguaa

SEQ ID NO: 1050960 - RNA, 19 nt, Homo sapiens
gaacagcugaagaaaguga

SEQ ID NO: 1050961 - RNA, 19 nt, Homo sapiens
ggaccucauucggguguua

SEQ ID NO: 1050962 - RNA, 19 nt, Homo sapiens
ugauaaaccugauuucaag

SEQ ID NO: 1050963 - RNA, 19 nt, Homo sapiens
gaccaaacuuguauucauc

SEQ ID NO: 1050964 - RNA, 19 nt, Homo sapiens
gagcaaaacugcagugaau

SEQ ID NO: 1050965 - RNA, 19 nt, Homo sapiens
cagauaugauugcuaaaga

SEQ ID NO: 1050966 - RNA, 19 nt, Homo sapiens
ugaagguacugacgguuaa

SEQ ID NO: 1050967 - RNA, 19 nt, Homo sapiens
ugacguaucccagacuuua

SEQ ID NO: 1050968 - RNA, 19 nt, Homo sapiens
uuucaacgcuucaggauau

SEQ ID NO: 1050969 - RNA, 19 nt, Homo sapiens
gcucgaaacacuucucaaa

SEQ ID NO: 1050970 - RNA, 19 nt, Homo sapiens
cauacgaaauguaacagaa

SEQ ID NO: 1050971 - RNA, 19 nt, Homo sapiens
gaaugccacucucuuugga

SEQ ID NO: 1050972 - RNA, 19 nt, Homo sapiens
cauuaggccugacguuaaa

SEQ ID NO: 1050973 - RNA, 19 nt, Homo sapiens
gcaucaaucuacaguguca

SEQ ID NO: 1050974 - RNA, 19 nt, Homo sapiens
ggagaaaauugcagaaaga

SEQ ID NO: 1050975 - RNA, 19 nt, Homo sapiens
gggaguggauccugguuau

SEQ ID NO: 1050976 - RNA, 19 nt, Homo sapiens
agucugcuaucguacauua

SEQ ID NO: 1050977 - RNA, 19 nt, Homo sapiens
gaguggauccugguuauaa

SEQ ID NO: 1050978 - RNA, 19 nt, Homo sapiens
ccagggcacugcuugagaa

SEQ ID NO: 1050979 - RNA, 19 nt, Homo sapiens
gaaaauugcagaaagauug

SEQ ID NO: 1050980 - RNA, 19 nt, Homo sapiens
gccacucucuuuggaauuu

SEQ ID NO: 1050981 - RNA, 19 nt, Homo sapiens
ccagagagcaagacaguug

SEQ ID NO: 1050982 - RNA, 19 nt, Homo sapiens
uccaaacacuuuccuuuau

SEQ ID NO: 1050983 - RNA, 19 nt, Homo sapiens
aaggauaagucaguuguuu

SEQ ID NO: 1050984 - RNA, 19 nt, Homo sapiens
cagccagccugaaagcuuu

SEQ ID NO: 1050985 - RNA, 19 nt, Homo sapiens
ucaaggaguugcugugaca

SEQ ID NO: 1050986 - RNA, 19 nt, Homo sapiens
aaauaggagugcagcauau

SEQ ID NO: 1050987 - RNA, 19 nt, Homo sapiens
auacugaugugguuuacuu

SEQ ID NO: 1050988 - RNA, 19 nt, Homo sapiens
caagacaguugggcuuaga

SEQ ID NO: 1050989 - RNA, 19 nt, Homo sapiens
gguugcaaauuagcuauaa

SEQ ID NO: 1050990 - RNA, 19 nt, Homo sapiens
ggccagaguuaaugaagau

SEQ ID NO: 1050991 - RNA, 19 nt, Homo sapiens
cuagguagcagaugagaaa

SEQ ID NO: 1050992 - RNA, 19 nt, Homo sapiens
gaaguuuuguuaaggcaua

SEQ ID NO: 1050993 - RNA, 19 nt, Homo sapiens
gggcuggacccuaauuuga

SEQ ID NO: 1050994 - RNA, 19 nt, Homo sapiens
uaacagauugcuuaacuuc

SEQ ID NO: 1050995 - RNA, 19 nt, Homo sapiens
gaaauguaacagaagcaaa

SEQ ID NO: 1050996 - RNA, 19 nt, Homo sapiens
aaacaacaguacacaccuu

SEQ ID NO: 1050997 - RNA, 19 nt, Homo sapiens
ugacauagcaaugagguuu

SEQ ID NO: 1050998 - RNA, 19 nt, Homo sapiens
gggaguggauauuaacauc

SEQ ID NO: 1050999 - RNA, 19 nt, Homo sapiens
gcaggagcaucaaucuaca

SEQ ID NO: 1051000 - RNA, 19 nt, Homo sapiens
gaccugauaaugaagaauu

SEQ ID NO: 1051001 - RNA, 19 nt, Homo sapiens
gaaacagaagcuuacuuug

SEQ ID NO: 1051002 - RNA, 19 nt, Homo sapiens
gcaaggccagaguuaauga

SEQ ID NO: 1051003 - RNA, 19 nt, Homo sapiens
caaagacacgcuugacuuc

SEQ ID NO: 1051004 - RNA, 19 nt, Homo sapiens
uggaaagccugaaaugcaa

SEQ ID NO: 1051005 - RNA, 19 nt, Homo sapiens
gaagugcaguuuccauagc

SEQ ID NO: 1051006 - RNA, 19 nt, Homo sapiens
gcuggacccuaauuugaga

SEQ ID NO: 1051007 - RNA, 19 nt, Homo sapiens
uugcugaccugauaaugaa

SEQ ID NO: 1051008 - RNA, 19 nt, Homo sapiens
gauccugguuauaaacaug

SEQ ID NO: 1051009 - RNA, 19 nt, Homo sapiens
gaacuugugccagaagaga

SEQ ID NO: 1051010 - RNA, 19 nt, Homo sapiens
gaauuguaccgucuuuguu

SEQ ID NO: 1051011 - RNA, 19 nt, Homo sapiens
ggauaagucaguuguuugu

SEQ ID NO: 1051012 - RNA, 19 nt, Homo sapiens
cagaagagacauguuugua

SEQ ID NO: 1051013 - RNA, 19 nt, Homo sapiens
gaagagaagaagccuugga

SEQ ID NO: 1051014 - RNA, 19 nt, Homo sapiens
gaguggauauuaacaucug

SEQ ID NO: 1051015 - RNA, 19 nt, Homo sapiens
gacccuaauuugagaagug

SEQ ID NO: 1051016 - RNA, 19 nt, Homo sapiens
gaaacauucaccaucauca

SEQ ID NO: 1051017 - RNA, 19 nt, Homo sapiens
ggauugucuucuugauuug

SEQ ID NO: 1051018 - RNA, 19 nt, Homo sapiens
gcaagacaguugggcuuag

SEQ ID NO: 1051019 - RNA, 19 nt, Homo sapiens
uaaaccugauuucaagaga

SEQ ID NO: 1051020 - RNA, 19 nt, Homo sapiens
gcguguacaagauccauua

SEQ ID NO: 1051021 - RNA, 19 nt, Homo sapiens
cgguuaaggucaauauuuc

SEQ ID NO: 1051022 - RNA, 19 nt, Homo sapiens
guaugggauugucuucuug

SEQ ID NO: 1051023 - RNA, 19 nt, Homo sapiens
ggacuuguaugggauuguc

SEQ ID NO: 1051024 - RNA, 19 nt, Homo sapiens
gaaggccagacgcugauuu

SEQ ID NO: 1051025 - RNA, 19 nt, Homo sapiens
acguugaggucacaaauga

SEQ ID NO: 1051026 - RNA, 19 nt, Homo sapiens
gaguugcugugacaucuuc

SEQ ID NO: 1051027 - RNA, 19 nt, Homo sapiens
gaagaaugugucagcuuug

SEQ ID NO: 1051028 - RNA, 19 nt, Homo sapiens
ccacagauugacaaggaua

SEQ ID NO: 1051029 - RNA, 19 nt, Homo sapiens
aaaccugauuucaagagaa

SEQ ID NO: 1051030 - RNA, 19 nt, Homo sapiens
guaguuaucaaaugaaugg

SEQ ID NO: 1051031 - RNA, 19 nt, Homo sapiens
gcagauaugauugcuaaag

SEQ ID NO: 1051032 - RNA, 19 nt, Homo sapiens
gagaaucaguggugaaaua

SEQ ID NO: 1051033 - RNA, 19 nt, Homo sapiens
gcaccugccuugauaauga

SEQ ID NO: 1051034 - RNA, 19 nt, Homo sapiens
ggaaggaauuguaagacua

SEQ ID NO: 1051035 - RNA, 19 nt, Homo sapiens
gcaaacaagucaucauuag

SEQ ID NO: 1051036 - RNA, 19 nt, Homo sapiens
ggaacuauauugcuucuuc

SEQ ID NO: 1051037 - RNA, 19 nt, Homo sapiens
caaauuaucgcauguaaga

SEQ ID NO: 1051038 - RNA, 19 nt, Homo sapiens
gugaaugagugcuauauga

SEQ ID NO: 1051039 - RNA, 19 nt, Homo sapiens
aaacuuacauggacauaug

SEQ ID NO: 1051040 - RNA, 19 nt, Homo sapiens
gaaggaauuguaagacuaa

SEQ ID NO: 1051041 - RNA, 19 nt, Homo sapiens
gaaagggcccaaagaauuc

SEQ ID NO: 1051042 - RNA, 19 nt, Homo sapiens
ugaaagggcccaaagaauu

SEQ ID NO: 1051043 - RNA, 19 nt, Homo sapiens
gcucaaugccaacuaauaa

SEQ ID NO: 1051044 - RNA, 19 nt, Homo sapiens
gaaguguccugccaacaau

SEQ ID NO: 1051045 - RNA, 19 nt, Homo sapiens
aaauagaccugcuuuaucu

SEQ ID NO: 1051046 - RNA, 19 nt, Homo sapiens
caugggacauccucacaua

SEQ ID NO: 1051047 - RNA, 19 nt, Homo sapiens
ccacagaagugacgacagu

SEQ ID NO: 1051048 - RNA, 19 nt, Homo sapiens
ccgcauacgugauacacua

SEQ ID NO: 1051049 - RNA, 19 nt, Homo sapiens
gaacagcagaaacucauga

SEQ ID NO: 1051050 - RNA, 19 nt, Homo sapiens
ccaaagaauucauauacca

SEQ ID NO: 1051051 - RNA, 19 nt, Homo sapiens
ugaguuaccugacagugaa

SEQ ID NO: 1051052 - RNA, 19 nt, Homo sapiens
gaacuauauugcuucuuca

SEQ ID NO: 1051053 - RNA, 19 nt, Homo sapiens
uuagguagcugaguugauu

SEQ ID NO: 1051054 - RNA, 19 nt, Homo sapiens
ggaauuguaagacuaaguu

SEQ ID NO: 1051055 - RNA, 19 nt, Homo sapiens
caagucaucauuagaacua

SEQ ID NO: 1051056 - RNA, 19 nt, Homo sapiens
ugaaacauccagcugauuu

SEQ ID NO: 1051057 - RNA, 19 nt, Homo sapiens
ggaauuaguccuggugaaa

SEQ ID NO: 1051058 - RNA, 19 nt, Homo sapiens
gaacauucaacugucauaa

SEQ ID NO: 1051059 - RNA, 19 nt, Homo sapiens
gcaaauacuguaguucaaa

SEQ ID NO: 1051060 - RNA, 19 nt, Homo sapiens
gauggcaaauacuguaguu

SEQ ID NO: 1051061 - RNA, 19 nt, Homo sapiens
ccagaauucuuuccugugu

SEQ ID NO: 1051062 - RNA, 19 nt, Homo sapiens
gugauacacuaccagaauu

SEQ ID NO: 1051063 - RNA, 19 nt, Homo sapiens
gacuuuagauggcaaauac

SEQ ID NO: 1051064 - RNA, 19 nt, Homo sapiens
gagcuuagaagaucugaau

SEQ ID NO: 1051065 - RNA, 19 nt, Homo sapiens
aauuaguccuggugaaaua

SEQ ID NO: 1051066 - RNA, 19 nt, Homo sapiens
guagcugaguugauuaaau

SEQ ID NO: 1051067 - RNA, 19 nt, Homo sapiens
aaucaguggugaaauaaug

SEQ ID NO: 1051068 - RNA, 19 nt, Homo sapiens
caugaucuguuaaagguau

SEQ ID NO: 1051069 - RNA, 19 nt, Homo sapiens
gcacagcuauguauuuugu

SEQ ID NO: 1051070 - RNA, 19 nt, Homo sapiens
ggacauccucacauacaaa

SEQ ID NO: 1051071 - RNA, 19 nt, Homo sapiens
cuucuuaccucucauagug

SEQ ID NO: 1051072 - RNA, 19 nt, Homo sapiens
ggcaaauacuguaguucaa

SEQ ID NO: 1051073 - RNA, 19 nt, Homo sapiens
guggugaaauaauggaauu

SEQ ID NO: 1051074 - RNA, 19 nt, Homo sapiens
gaagucugauaguaugcaa

SEQ ID NO: 1051075 - RNA, 19 nt, Homo sapiens
uaagcacagcuauguauuu

SEQ ID NO: 1051076 - RNA, 19 nt, Homo sapiens
ccuaagauauuuacuugag

SEQ ID NO: 1051077 - RNA, 19 nt, Homo sapiens
uccaguuucuguaugaaua

SEQ ID NO: 1051078 - RNA, 19 nt, Homo sapiens
aaugaagucugauaguaug

SEQ ID NO: 1051079 - RNA, 19 nt, Homo sapiens
caaauacuguaguucaaac

SEQ ID NO: 1051080 - RNA, 19 nt, Homo sapiens
ggacuuuagauggcaaaua

SEQ ID NO: 1051081 - RNA, 19 nt, Homo sapiens
gaaggaaguagagaagcua

SEQ ID NO: 1051082 - RNA, 19 nt, Homo sapiens
acaggauaauggcacuuua

SEQ ID NO: 1051083 - RNA, 19 nt, Homo sapiens
ucccuaagauauuuacuug

SEQ ID NO: 1051084 - RNA, 19 nt, Homo sapiens
gaauugcuccugcauuagu

SEQ ID NO: 1051085 - RNA, 19 nt, Homo sapiens
uuucaaccuuucacgaaua

SEQ ID NO: 1051086 - RNA, 19 nt, Homo sapiens
ugcggaaucuucucccaua

SEQ ID NO: 1051087 - RNA, 19 nt, Homo sapiens
gcccaaagaauucauauac

SEQ ID NO: 1051088 - RNA, 19 nt, Homo sapiens
caguugcucugccugauga

SEQ ID NO: 1051089 - RNA, 19 nt, Homo sapiens
acuagaaguuggcgagauu

SEQ ID NO: 1051090 - RNA, 19 nt, Homo sapiens
caaacaagucaucauuaga

SEQ ID NO: 1051091 - RNA, 19 nt, Homo sapiens
uggauacagugggaaguua

SEQ ID NO: 1051092 - RNA, 19 nt, Homo sapiens
aguaguuucucauuggaua

SEQ ID NO: 1051093 - RNA, 19 nt, Homo sapiens
ggauggugcugucugucuu

SEQ ID NO: 1051094 - RNA, 19 nt, Homo sapiens
guaguucaaaccaguauau

SEQ ID NO: 1051095 - RNA, 19 nt, Homo sapiens
gggacauccucacauacaa

SEQ ID NO: 1051096 - RNA, 19 nt, Homo sapiens
uguaaacacugccgaacau

SEQ ID NO: 1051097 - RNA, 19 nt, Homo sapiens
gcacuuuauugagcuuaga

SEQ ID NO: 1051098 - RNA, 19 nt, Homo sapiens
ugaauugagcuacauaugu

SEQ ID NO: 1051099 - RNA, 19 nt, Homo sapiens
guucaaaccaguauauuac

SEQ ID NO: 1051100 - RNA, 19 nt, Homo sapiens
gcaguguccaucaguagaa

SEQ ID NO: 1051101 - RNA, 19 nt, Homo sapiens
ugaaguguccugccaacaa

SEQ ID NO: 1051102 - RNA, 19 nt, Homo sapiens
gaauuaguccuggugaaau

SEQ ID NO: 1051103 - RNA, 19 nt, Homo sapiens
ccucccaucugauauagga

SEQ ID NO: 1051104 - RNA, 19 nt, Homo sapiens
ugcaaauuaucgcauguaa

SEQ ID NO: 1051105 - RNA, 19 nt, Homo sapiens
aaaggaaggaauuguaaga

SEQ ID NO: 1051106 - RNA, 19 nt, Homo sapiens
aaugagugcuauaugaguu

SEQ ID NO: 1051107 - RNA, 19 nt, Homo sapiens
ccaagacaggcucgacuuu

SEQ ID NO: 1051108 - RNA, 19 nt, Homo sapiens
cagagugggucaccagaag

SEQ ID NO: 1051109 - RNA, 19 nt, Homo sapiens
gaucugcaccugccuugau

SEQ ID NO: 1051110 - RNA, 19 nt, Homo sapiens
aaacacugccgaacauuca

SEQ ID NO: 1051111 - RNA, 19 nt, Homo sapiens
caauauggaguaccugguu

SEQ ID NO: 1051112 - RNA, 19 nt, Homo sapiens
cuacccggguucuccagua

SEQ ID NO: 1051113 - RNA, 19 nt, Homo sapiens
cauccucccaucugauaua

SEQ ID NO: 1051114 - RNA, 19 nt, Homo sapiens
gaaugagugcuauaugagu

SEQ ID NO: 1051115 - RNA, 19 nt, Homo sapiens
uuauugagcuuagaagauc

SEQ ID NO: 1051116 - RNA, 19 nt, Homo sapiens
guccaguaguuucucauug

SEQ ID NO: 1051117 - RNA, 19 nt, Homo sapiens
guucagaagauauucaugu

SEQ ID NO: 1051118 - RNA, 19 nt, Homo sapiens
gaaguuggcgagauugcau

SEQ ID NO: 1051119 - RNA, 19 nt, Homo sapiens
caaccuuucacgaauaguu

SEQ ID NO: 1051120 - RNA, 19 nt, Homo sapiens
gguguuagcaucaaaauga

SEQ ID NO: 1051121 - RNA, 19 nt, Homo sapiens
gaaguuaugggugugugaa

SEQ ID NO: 1051122 - RNA, 19 nt, Homo sapiens
ccuauugguuaaucaacaa

SEQ ID NO: 1051123 - RNA, 19 nt, Homo sapiens
uuuagucccuauugguuaa

SEQ ID NO: 1051124 - RNA, 19 nt, Homo sapiens
agaauucuuuccugugugu

SEQ ID NO: 1051125 - RNA, 19 nt, Homo sapiens
cugcugauguucugcauuc

SEQ ID NO: 1051126 - RNA, 19 nt, Homo sapiens
ggaaguagagaagcuaucu

SEQ ID NO: 1051127 - RNA, 19 nt, Homo sapiens
ccaguaguuucucauugga

SEQ ID NO: 1051128 - RNA, 19 nt, Homo sapiens
agacugggauguagcuuac

SEQ ID NO: 1051129 - RNA, 19 nt, Homo sapiens
ccuaagcacagcuauguau

SEQ ID NO: 1051130 - RNA, 19 nt, Homo sapiens
gaacuaaaagugaauugga

SEQ ID NO: 1051131 - RNA, 19 nt, Homo sapiens
ucacugacuccuuguccua

SEQ ID NO: 1051132 - RNA, 19 nt, Homo sapiens
gauaacaucuugcgaauuu

SEQ ID NO: 1051133 - RNA, 19 nt, Homo sapiens
gugauaccaucuaugauua

SEQ ID NO: 1051134 - RNA, 19 nt, Homo sapiens
gcacagguggguuucuuua

SEQ ID NO: 1051135 - RNA, 19 nt, Homo sapiens
ggaaggugauaccaucuau

SEQ ID NO: 1051136 - RNA, 19 nt, Homo sapiens
gguggaauaugcagaaaug

SEQ ID NO: 1051137 - RNA, 19 nt, Homo sapiens
cagaaggacugcaccaaug

SEQ ID NO: 1051138 - RNA, 19 nt, Homo sapiens
caauagugcugauaacauc

SEQ ID NO: 1051139 - RNA, 19 nt, Homo sapiens
gaagcaaacgggagccuuu

SEQ ID NO: 1051140 - RNA, 19 nt, Homo sapiens
gggagaacccgauucauau

SEQ ID NO: 1051141 - RNA, 19 nt, Homo sapiens
ggugauaccaucuaugauu

SEQ ID NO: 1051142 - RNA, 19 nt, Homo sapiens
gaaaagccauggaagauac

SEQ ID NO: 1051143 - RNA, 19 nt, Homo sapiens
gcacccaaccugagaacuu

SEQ ID NO: 1051144 - RNA, 19 nt, Homo sapiens
ccaaucagcgcaucuacuu

SEQ ID NO: 1051145 - RNA, 19 nt, Homo sapiens
ggcaucaucuccugcauag

SEQ ID NO: 1051146 - RNA, 19 nt, Homo sapiens
uaugauuacugcugguauu

SEQ ID NO: 1051147 - RNA, 19 nt, Homo sapiens
gggagcagguggaauaugc

SEQ ID NO: 1051148 - RNA, 19 nt, Homo sapiens
gggaagcacagguggguuu

SEQ ID NO: 1051149 - RNA, 19 nt, Homo sapiens
gcagguggaauaugcagaa

SEQ ID NO: 1051150 - RNA, 19 nt, Homo sapiens
uuuggagacucaaccguua

SEQ ID NO: 1051151 - RNA, 19 nt, Homo sapiens
gcuaaucuccgcugugcuu

SEQ ID NO: 1051152 - RNA, 19 nt, Homo sapiens
ugggugagcugauauaaaa

SEQ ID NO: 1051153 - RNA, 19 nt, Homo sapiens
ugaccaauagugcugauaa

SEQ ID NO: 1051154 - RNA, 19 nt, Homo sapiens
ugaagacuuuggagacuca

SEQ ID NO: 1051155 - RNA, 19 nt, Homo sapiens
gaauuggcguccgcuguuc

SEQ ID NO: 1051156 - RNA, 19 nt, Homo sapiens
caaacgggagccuuucuga

SEQ ID NO: 1051157 - RNA, 19 nt, Homo sapiens
gacgguuccugcaucuuga

SEQ ID NO: 1051158 - RNA, 19 nt, Homo sapiens
caaccggacugugcguguu

SEQ ID NO: 1051159 - RNA, 19 nt, Homo sapiens
ccccagagcuguaccauga

SEQ ID NO: 1051160 - RNA, 19 nt, Homo sapiens
ggaaaagccauggaagaua

SEQ ID NO: 1051161 - RNA, 19 nt, Homo sapiens
ccacguccaccuugaaugu

SEQ ID NO: 1051162 - RNA, 19 nt, Homo sapiens
ggagaacccgauucauauc

SEQ ID NO: 1051163 - RNA, 19 nt, Homo sapiens
aaggugauaccaucuauga

SEQ ID NO: 1051164 - RNA, 19 nt, Homo sapiens
gaagcgaacgggccagagu

SEQ ID NO: 1051165 - RNA, 19 nt, Homo sapiens
cggagcccguguugaguuu

SEQ ID NO: 1051166 - RNA, 19 nt, Homo sapiens
ucucccagcugccucgauu

SEQ ID NO: 1051167 - RNA, 19 nt, Homo sapiens
uccugcaucuugaccaaua

SEQ ID NO: 1051168 - RNA, 19 nt, Homo sapiens
agacaccgcuuggaacuac

SEQ ID NO: 1051169 - RNA, 19 nt, Homo sapiens
ugaguugaguccucgaauc

SEQ ID NO: 1051170 - RNA, 19 nt, Homo sapiens
ccagaaggacugcaccaau

SEQ ID NO: 1051171 - RNA, 19 nt, Homo sapiens
ggccagagcggcaucaucu

SEQ ID NO: 1051172 - RNA, 19 nt, Homo sapiens
gcucuucuguggcuucaac

SEQ ID NO: 1051173 - RNA, 19 nt, Homo sapiens
cugauaacaucuugcgaau

SEQ ID NO: 1051174 - RNA, 19 nt, Homo sapiens
ugacgguuccugcaucuug

SEQ ID NO: 1051175 - RNA, 19 nt, Homo sapiens
ucugcaguaugaagacuuu

SEQ ID NO: 1051176 - RNA, 19 nt, Homo sapiens
ccaauagugcugauaacau

SEQ ID NO: 1051177 - RNA, 19 nt, Homo sapiens
gaccaauagugcugauaac

SEQ ID NO: 1051178 - RNA, 19 nt, Homo sapiens
ucacccaccucugcuuuca

SEQ ID NO: 1051179 - RNA, 19 nt, Homo sapiens
gauuacugcugguauucuc

SEQ ID NO: 1051180 - RNA, 19 nt, Homo sapiens
gagaaagggcagggaggaa

SEQ ID NO: 1051181 - RNA, 19 nt, Homo sapiens
gaaggugauaccaucuaug

SEQ ID NO: 1051182 - RNA, 19 nt, Homo sapiens
cacccaaccugagaacuuc

SEQ ID NO: 1051183 - RNA, 19 nt, Homo sapiens
ggagacaccgcuuggaacu

SEQ ID NO: 1051184 - RNA, 19 nt, Homo sapiens
gcaaacgggagccuuucug

SEQ ID NO: 1051185 - RNA, 19 nt, Homo sapiens
caucacccaccucugcuuu

SEQ ID NO: 1051186 - RNA, 19 nt, Homo sapiens
gcaguaugaagacuuugga

SEQ ID NO: 1051187 - RNA, 19 nt, Homo sapiens
uacaagccuuccugcagaa

SEQ ID NO: 1051188 - RNA, 19 nt, Homo sapiens
gagaacccgauucauaucu

SEQ ID NO: 1051189 - RNA, 19 nt, Homo sapiens
aagcacagguggguuucuu

SEQ ID NO: 1051190 - RNA, 19 nt, Homo sapiens
cauccuggcugaggcuaau

SEQ ID NO: 1051191 - RNA, 19 nt, Homo sapiens
cgagguccgagccacauuu

SEQ ID NO: 1051192 - RNA, 19 nt, Homo sapiens
cugcugguauucucugaug

SEQ ID NO: 1051193 - RNA, 19 nt, Homo sapiens
gauaccaucuaugauuacu

SEQ ID NO: 1051194 - RNA, 19 nt, Homo sapiens
gcuuggaacuacagcuucu

SEQ ID NO: 1051195 - RNA, 19 nt, Homo sapiens
cggcaucaucuccugcaua

SEQ ID NO: 1051196 - RNA, 19 nt, Homo sapiens
ccuacaaccaccuggauga

SEQ ID NO: 1051197 - RNA, 19 nt, Homo sapiens
agaauuggcguccgcuguu

SEQ ID NO: 1051198 - RNA, 19 nt, Homo sapiens
guuccugcaucuugaccaa

SEQ ID NO: 1051199 - RNA, 19 nt, Homo sapiens
acgggagccuuucugaaga

SEQ ID NO: 1051200 - RNA, 19 nt, Homo sapiens
aaacgggagccuuucugaa

SEQ ID NO: 1051201 - RNA, 19 nt, Homo sapiens
gcgcaucuacuucgaucug

SEQ ID NO: 1051202 - RNA, 19 nt, Homo sapiens
ccaccaaucagcgcaucua

SEQ ID NO: 1051203 - RNA, 19 nt, Homo sapiens
gaucuccggcagucugguu

SEQ ID NO: 1051204 - RNA, 19 nt, Homo sapiens
gagguccgagccacauuug

SEQ ID NO: 1051205 - RNA, 19 nt, Homo sapiens
agaaauggucccuguccuu

SEQ ID NO: 1051206 - RNA, 19 nt, Homo sapiens
gagacaccgcuuggaacua

SEQ ID NO: 1051207 - RNA, 19 nt, Homo sapiens
ucggaucccugagaacuuc

SEQ ID NO: 1051208 - RNA, 19 nt, Homo sapiens
gugggugagcugauauaaa

SEQ ID NO: 1051209 - RNA, 19 nt, Homo sapiens
cagguggaauaugcagaaa

SEQ ID NO: 1051210 - RNA, 19 nt, Homo sapiens
gauggcaaccgcuucuucu

SEQ ID NO: 1051211 - RNA, 19 nt, Homo sapiens
uaugaagacuuuggagacu

SEQ ID NO: 1051212 - RNA, 19 nt, Homo sapiens
gguccgagccacauuugca

SEQ ID NO: 1051213 - RNA, 19 nt, Homo sapiens
gaaucgaggagcaagaacu

SEQ ID NO: 1051214 - RNA, 19 nt, Homo sapiens
ccacuccccuggaaacaga

SEQ ID NO: 1051215 - RNA, 19 nt, Homo sapiens
ggauggcucccagcucuuc

SEQ ID NO: 1051216 - RNA, 19 nt, Homo sapiens
cgaaugguggaaggugaua

SEQ ID NO: 1051217 - RNA, 19 nt, Homo sapiens
ccagcugccucgauuucuc

SEQ ID NO: 1051218 - RNA, 19 nt, Homo sapiens
agaacccgauucauaucug

SEQ ID NO: 1051219 - RNA, 19 nt, Homo sapiens
ugcggacucugaacugaug

SEQ ID NO: 1051220 - RNA, 19 nt, Homo sapiens
acagguggguuucuuuagc

SEQ ID NO: 1051221 - RNA, 19 nt, Homo sapiens
aauggucccuguccuucga

SEQ ID NO: 1051222 - RNA, 19 nt, Homo sapiens
aaugcggacucugaacuga

SEQ ID NO: 1051223 - RNA, 19 nt, Homo sapiens
caacagagaucuacacaga

SEQ ID NO: 1051224 - RNA, 19 nt, Homo sapiens
gaaccuaguuauucaagua

SEQ ID NO: 1051225 - RNA, 19 nt, Homo sapiens
ggugaaggcugucauuaaa

SEQ ID NO: 1051226 - RNA, 19 nt, Homo sapiens
aaaaggagcuugauaugua

SEQ ID NO: 1051227 - RNA, 19 nt, Homo sapiens
gaucauauuugcauucuac

SEQ ID NO: 1051228 - RNA, 19 nt, Homo sapiens
ugacagaagugcugaaaca

SEQ ID NO: 1051229 - RNA, 19 nt, Homo sapiens
gggaauggcuuugacagaa

SEQ ID NO: 1051230 - RNA, 19 nt, Homo sapiens
gacuagauguggcucauuu

SEQ ID NO: 1051231 - RNA, 19 nt, Homo sapiens
gcagaugcaucgcuaguca

SEQ ID NO: 1051232 - RNA, 19 nt, Homo sapiens
gacagaaccuaguuauuca

SEQ ID NO: 1051233 - RNA, 19 nt, Homo sapiens
cagaagugcugaaacauca

SEQ ID NO: 1051234 - RNA, 19 nt, Homo sapiens
gaacagcaaaggaaauuca

SEQ ID NO: 1051235 - RNA, 19 nt, Homo sapiens
ugaaggcugucauuaaaga

SEQ ID NO: 1051236 - RNA, 19 nt, Homo sapiens
caguaaaccagaagaaaua

SEQ ID NO: 1051237 - RNA, 19 nt, Homo sapiens
ggaccaaaucguaguaauu

SEQ ID NO: 1051238 - RNA, 19 nt, Homo sapiens
caacagcauuucaaacaca

SEQ ID NO: 1051239 - RNA, 19 nt, Homo sapiens
guacacaucgccaguaaug

SEQ ID NO: 1051240 - RNA, 19 nt, Homo sapiens
caucauccuuagcauuuaa

SEQ ID NO: 1051241 - RNA, 19 nt, Homo sapiens
ugacagaaccuaguuauuc

SEQ ID NO: 1051242 - RNA, 19 nt, Homo sapiens
cagaagaaauagaugaauc

SEQ ID NO: 1051243 - RNA, 19 nt, Homo sapiens
gcugaaacaucauccuuag

SEQ ID NO: 1051244 - RNA, 19 nt, Homo sapiens
ggauacaacggaucauauu

SEQ ID NO: 1051245 - RNA, 19 nt, Homo sapiens
gacaacagcauuucaaaca

SEQ ID NO: 1051246 - RNA, 19 nt, Homo sapiens
gaagcuguuuaucccauga

SEQ ID NO: 1051247 - RNA, 19 nt, Homo sapiens
gaauucagaagcuguuuau

SEQ ID NO: 1051248 - RNA, 19 nt, Homo sapiens
gacgagcaacugaagaaua

SEQ ID NO: 1051249 - RNA, 19 nt, Homo sapiens
caacgaagcagcuaauguc

SEQ ID NO: 1051250 - RNA, 19 nt, Homo sapiens
ggaauggcuuugacagaag

SEQ ID NO: 1051251 - RNA, 19 nt, Homo sapiens
gacaaacaguucagcaagu

SEQ ID NO: 1051252 - RNA, 19 nt, Homo sapiens
ggccaugguuugacaccua

SEQ ID NO: 1051253 - RNA, 19 nt, Homo sapiens
gcacuuccuucaccucauc

SEQ ID NO: 1051254 - RNA, 19 nt, Homo sapiens
gauacaacggaucauauuu

SEQ ID NO: 1051255 - RNA, 19 nt, Homo sapiens
gcaacuggacacuguacua

SEQ ID NO: 1051256 - RNA, 19 nt, Homo sapiens
gaaguacacaucgccagua

SEQ ID NO: 1051257 - RNA, 19 nt, Homo sapiens
gagaaguauuccggcauuu

SEQ ID NO: 1051258 - RNA, 19 nt, Homo sapiens
cguuacauaucaagacuuu

SEQ ID NO: 1051259 - RNA, 19 nt, Homo sapiens
gcacaauuacugucucaau

SEQ ID NO: 1051260 - RNA, 19 nt, Homo sapiens
caacuggacacuguacuaa

SEQ ID NO: 1051261 - RNA, 19 nt, Homo sapiens
cacaauuacugucucaaug

SEQ ID NO: 1051262 - RNA, 19 nt, Homo sapiens
acaaacaguucagcaaguu

SEQ ID NO: 1051263 - RNA, 19 nt, Homo sapiens
gcucccaucucaggaauau

SEQ ID NO: 1051264 - RNA, 19 nt, Homo sapiens
cagccuagcauaucucaaa

SEQ ID NO: 1051265 - RNA, 19 nt, Homo sapiens
gcuccucucucacccaaug

SEQ ID NO: 1051266 - RNA, 19 nt, Homo sapiens
acaggcagcuccucucuca

SEQ ID NO: 1051267 - RNA, 19 nt, Homo sapiens
gugaauccuuugggaagua

SEQ ID NO: 1051268 - RNA, 19 nt, Homo sapiens
acagagaucuacacagagu

SEQ ID NO: 1051269 - RNA, 19 nt, Homo sapiens
aaaggagcuugauauguau

SEQ ID NO: 1051270 - RNA, 19 nt, Homo sapiens
agagaaguauuccggcauu

SEQ ID NO: 1051271 - RNA, 19 nt, Homo sapiens
gaaacaucauccuuagcau

SEQ ID NO: 1051272 - RNA, 19 nt, Homo sapiens
caacggaucauauuugcau

SEQ ID NO: 1051273 - RNA, 19 nt, Homo sapiens
ugauauguauguugaaugg

SEQ ID NO: 1051274 - RNA, 19 nt, Homo sapiens
agauguggcucauuugugu

SEQ ID NO: 1051275 - RNA, 19 nt, Homo sapiens
ggagguacuucaugaaacg

SEQ ID NO: 1051276 - RNA, 19 nt, Homo sapiens
gaauggcuuugacagaagu

SEQ ID NO: 1051277 - RNA, 19 nt, Homo sapiens
cuucggagguacuucauga

SEQ ID NO: 1051278 - RNA, 19 nt, Homo sapiens
caaguucucucaaaaggaa

SEQ ID NO: 1051279 - RNA, 19 nt, Homo sapiens
gcuacaaugggacuucuaa

SEQ ID NO: 1051280 - RNA, 19 nt, Homo sapiens
ccuaguuauucaaguagua

SEQ ID NO: 1051281 - RNA, 19 nt, Homo sapiens
agucagugauaacuucuuu

SEQ ID NO: 1051282 - RNA, 19 nt, Homo sapiens
gcacagcgaggcaccagau

SEQ ID NO: 1051283 - RNA, 19 nt, Homo sapiens
ccaguaaaccagaagaaau

SEQ ID NO: 1051284 - RNA, 19 nt, Homo sapiens
acaauuacugucucaauga

SEQ ID NO: 1051285 - RNA, 19 nt, Homo sapiens
uaauuugugccaccaguaa

SEQ ID NO: 1051286 - RNA, 19 nt, Homo sapiens
aaguacacaucgccaguaa

SEQ ID NO: 1051287 - RNA, 19 nt, Homo sapiens
aaacaucauccuuagcauu

SEQ ID NO: 1051288 - RNA, 19 nt, Homo sapiens
caagauucagccuagcaua

SEQ ID NO: 1051289 - RNA, 19 nt, Homo sapiens
gcaaagcuggagucaguuc

SEQ ID NO: 1051290 - RNA, 19 nt, Homo sapiens
ugaugcaacuggacacugu

SEQ ID NO: 1051291 - RNA, 19 nt, Homo sapiens
ggaacauaguccagucagu

SEQ ID NO: 1051292 - RNA, 19 nt, Homo sapiens
cagcuaauguccucugaac

SEQ ID NO: 1051293 - RNA, 19 nt, Homo sapiens
gcaccucaucgaccuggua

SEQ ID NO: 1051294 - RNA, 19 nt, Homo sapiens
ugaaacaucauccuuagca

SEQ ID NO: 1051295 - RNA, 19 nt, Homo sapiens
gagcuugauauguauguug

SEQ ID NO: 1051296 - RNA, 19 nt, Homo sapiens
guugaggcccguuacauau

SEQ ID NO: 1051297 - RNA, 19 nt, Homo sapiens
acagaccuuucagccauua

SEQ ID NO: 1051298 - RNA, 19 nt, Homo sapiens
ugaauucagaagcuguuua

SEQ ID NO: 1051299 - RNA, 19 nt, Homo sapiens
cagcacaauuacugucuca

SEQ ID NO: 1051300 - RNA, 19 nt, Homo sapiens
cgccagcccucggugauuu

SEQ ID NO: 1051301 - RNA, 19 nt, Homo sapiens
aacaucauccuuagcauuu

SEQ ID NO: 1051302 - RNA, 19 nt, Homo sapiens
ugaggcccguuacauauca

SEQ ID NO: 1051303 - RNA, 19 nt, Homo sapiens
aagauccagugaauccuuu

SEQ ID NO: 1051304 - RNA, 19 nt, Homo sapiens
gcuaauguccucugaacag

SEQ ID NO: 1051305 - RNA, 19 nt, Homo sapiens
uggcagccuuccuugaauu

SEQ ID NO: 1051306 - RNA, 19 nt, Homo sapiens
uguuaucacugccagcaaa

SEQ ID NO: 1051307 - RNA, 19 nt, Homo sapiens
auacaacggaucauauuug

SEQ ID NO: 1051308 - RNA, 19 nt, Homo sapiens
uaguacaacugcucucaca

SEQ ID NO: 1051309 - RNA, 19 nt, Homo sapiens
gcgaggcaccagauaauag

SEQ ID NO: 1051310 - RNA, 19 nt, Homo sapiens
guaauuugugccaccagua

SEQ ID NO: 1051311 - RNA, 19 nt, Homo sapiens
agaugucucugcgaguaua

SEQ ID NO: 1051312 - RNA, 19 nt, Homo sapiens
gguaaccaaugagauuauc

SEQ ID NO: 1051313 - RNA, 19 nt, Homo sapiens
acgagcaacugaagaauac

SEQ ID NO: 1051314 - RNA, 19 nt, Homo sapiens
augcagggcucccaucuca

SEQ ID NO: 1051315 - RNA, 19 nt, Homo sapiens
ucaaguaguaccuguggaa

SEQ ID NO: 1051316 - RNA, 19 nt, Homo sapiens
caacugaagaauacugaca

SEQ ID NO: 1051317 - RNA, 19 nt, Homo sapiens
caucgccaguaaugaguga

SEQ ID NO: 1051318 - RNA, 19 nt, Homo sapiens
ccagggccaugguuugaca

SEQ ID NO: 1051319 - RNA, 19 nt, Homo sapiens
ggaucauauuugcauucua

SEQ ID NO: 1051320 - RNA, 19 nt, Homo sapiens
caggauacaacggaucaua

SEQ ID NO: 1051321 - RNA, 19 nt, Homo sapiens
gacccguacucagcaacua

SEQ ID NO: 1051322 - RNA, 19 nt, Homo sapiens
caagauccagugaauccuu

SEQ ID NO: 1051323 - RNA, 19 nt, Homo sapiens
guaaauagguguguugaau

SEQ ID NO: 1051324 - RNA, 19 nt, Homo sapiens
gaguaaauaugguccaauu

SEQ ID NO: 1051325 - RNA, 19 nt, Homo sapiens
uggaaucccuuuguaaaua

SEQ ID NO: 1051326 - RNA, 19 nt, Homo sapiens
gcucuggaaucccuuugua

SEQ ID NO: 1051327 - RNA, 19 nt, Homo sapiens
ggaaucccuuuguaaauag

SEQ ID NO: 1051328 - RNA, 19 nt, Homo sapiens
ggaaggcucuccuccacau

SEQ ID NO: 1051329 - RNA, 19 nt, Homo sapiens
gggaauuacuguguauuug

SEQ ID NO: 1051330 - RNA, 19 nt, Homo sapiens
ggccuaggcuccaaucuca

SEQ ID NO: 1051331 - RNA, 19 nt, Homo sapiens
cgucuuagcuucacugucu

SEQ ID NO: 1051332 - RNA, 19 nt, Homo sapiens
caccaagcguccucuauga

SEQ ID NO: 1051333 - RNA, 19 nt, Homo sapiens
agaagccgcugccaaauca

SEQ ID NO: 1051334 - RNA, 19 nt, Homo sapiens
gcugggacgucaauaggaa

SEQ ID NO: 1051335 - RNA, 19 nt, Homo sapiens
cagagaagccgcugccaaa

SEQ ID NO: 1051336 - RNA, 19 nt, Homo sapiens
cgagauagaguaaauaugg

SEQ ID NO: 1051337 - RNA, 19 nt, Homo sapiens
gaagaucccaggcucaagu

SEQ ID NO: 1051338 - RNA, 19 nt, Homo sapiens
ggaggccuacgucgagaua

SEQ ID NO: 1051339 - RNA, 19 nt, Homo sapiens
gaauuacuguguauuugcu

SEQ ID NO: 1051340 - RNA, 19 nt, Homo sapiens
ucgcucagcuaccgaaaug

SEQ ID NO: 1051341 - RNA, 19 nt, Homo sapiens
gugauucguugccucagaa

SEQ ID NO: 1051342 - RNA, 19 nt, Homo sapiens
gagaagccgcugccaaauc

SEQ ID NO: 1051343 - RNA, 19 nt, Homo sapiens
cgggaaaccuccagagaag

SEQ ID NO: 1051344 - RNA, 19 nt, Homo sapiens
gagauagaguaaauauggu

SEQ ID NO: 1051345 - RNA, 19 nt, Homo sapiens
gaagcgcgcugugcaaagc

SEQ ID NO: 1051346 - RNA, 19 nt, Homo sapiens
cauuguaguucgcaugguu

SEQ ID NO: 1051347 - RNA, 19 nt, Homo sapiens
cacaagacccgcagaggaa

SEQ ID NO: 1051348 - RNA, 19 nt, Homo sapiens
ucgcaugguucucuggaaa

SEQ ID NO: 1051349 - RNA, 19 nt, Homo sapiens
aaaggugacccgacaauca

SEQ ID NO: 1051350 - RNA, 19 nt, Homo sapiens
ggugagggacauuguaguu

SEQ ID NO: 1051351 - RNA, 19 nt, Homo sapiens
auucugaccuggagugaga

SEQ ID NO: 1051352 - RNA, 19 nt, Homo sapiens
ccaccaagcguccucuaug

SEQ ID NO: 1051353 - RNA, 19 nt, Homo sapiens
ggguggcugucgagaaguu

SEQ ID NO: 1051354 - RNA, 19 nt, Homo sapiens
ggaccaaaggaaagacaga

SEQ ID NO: 1051355 - RNA, 19 nt, Homo sapiens
ugacaggggcuccgucuua

SEQ ID NO: 1051356 - RNA, 19 nt, Homo sapiens
gaaggcucuccuccacaua

SEQ ID NO: 1051357 - RNA, 19 nt, Homo sapiens
ggaauuacuguguauuugc

SEQ ID NO: 1051358 - RNA, 19 nt, Homo sapiens
gaaaaggaagggaaggaaa

SEQ ID NO: 1051359 - RNA, 19 nt, Homo sapiens
cuacgucgagauagaguaa

SEQ ID NO: 1051360 - RNA, 19 nt, Homo sapiens
gacugcaugucaaggagaa

SEQ ID NO: 1051361 - RNA, 19 nt, Homo sapiens
gagcccagacccuccagaa

SEQ ID NO: 1051362 - RNA, 19 nt, Homo sapiens
gggaagcgcgcugugcaaa

SEQ ID NO: 1051363 - RNA, 19 nt, Homo sapiens
ucuggaaucccuuuguaaa

SEQ ID NO: 1051364 - RNA, 19 nt, Homo sapiens
ucucuagacgacugaauaa

SEQ ID NO: 1051365 - RNA, 19 nt, Homo sapiens
gauccacggaaucuucuga

SEQ ID NO: 1051366 - RNA, 19 nt, Homo sapiens
auagguguguugaauuugu

SEQ ID NO: 1051367 - RNA, 19 nt, Homo sapiens
ggauaagggagagaaggaa

SEQ ID NO: 1051368 - RNA, 19 nt, Homo sapiens
uagaguaaauaugguccaa

SEQ ID NO: 1051369 - RNA, 19 nt, Homo sapiens
uagguguguugaauuuguu

SEQ ID NO: 1051370 - RNA, 19 nt, Homo sapiens
aaagugggcucuggaaucc

SEQ ID NO: 1051371 - RNA, 19 nt, Homo sapiens
ccgggaaaccuccagagaa

SEQ ID NO: 1051372 - RNA, 19 nt, Homo sapiens
gaaggcagcccugguucca

SEQ ID NO: 1051373 - RNA, 19 nt, Homo sapiens
gagcuccuccucaagucuu

SEQ ID NO: 1051374 - RNA, 19 nt, Homo sapiens
gagaaggaagagagaccaa

SEQ ID NO: 1051375 - RNA, 19 nt, Homo sapiens
gaggagcacagagcagaga

SEQ ID NO: 1051376 - RNA, 19 nt, Homo sapiens
gcucagcuaccgaaauguc

SEQ ID NO: 1051377 - RNA, 19 nt, Homo sapiens
gggagagaaggaagagaga

SEQ ID NO: 1051378 - RNA, 19 nt, Homo sapiens
ggaagcgcgcugugcaaag

SEQ ID NO: 1051379 - RNA, 19 nt, Homo sapiens
gucgagauagaguaaauau

SEQ ID NO: 1051380 - RNA, 19 nt, Homo sapiens
caaugccgguccacacaac

SEQ ID NO: 1051381 - RNA, 19 nt, Homo sapiens
cccagacccuccagaagca

SEQ ID NO: 1051382 - RNA, 19 nt, Homo sapiens
aggccuacgucgagauaga

SEQ ID NO: 1051383 - RNA, 19 nt, Homo sapiens
gaaucccuuuguaaauagg

SEQ ID NO: 1051384 - RNA, 19 nt, Homo sapiens
cugaauaagggaaaaguua

SEQ ID NO: 1051385 - RNA, 19 nt, Homo sapiens
ccaccgaacuuuggggaaa

SEQ ID NO: 1051386 - RNA, 19 nt, Homo sapiens
gacccuguccucucugauc

SEQ ID NO: 1051387 - RNA, 19 nt, Homo sapiens
gacaaucaaccccugaaaa

SEQ ID NO: 1051388 - RNA, 19 nt, Homo sapiens
aaggugacccgacaaucaa

SEQ ID NO: 1051389 - RNA, 19 nt, Homo sapiens
ggaggaggcugguacaaua

SEQ ID NO: 1051390 - RNA, 19 nt, Homo sapiens
gaacagagggaacauuaua

SEQ ID NO: 1051391 - RNA, 19 nt, Homo sapiens
gaagagaaguggugacaca

SEQ ID NO: 1051392 - RNA, 19 nt, Homo sapiens
gaaggacacucgggaacua

SEQ ID NO: 1051393 - RNA, 19 nt, Homo sapiens
cuacagaaccugcaaagua

SEQ ID NO: 1051394 - RNA, 19 nt, Homo sapiens
gaagguucauggagaagaa

SEQ ID NO: 1051395 - RNA, 19 nt, Homo sapiens
gcugacaaaucaacacgua

SEQ ID NO: 1051396 - RNA, 19 nt, Homo sapiens
uccauaagcugaccacuuu

SEQ ID NO: 1051397 - RNA, 19 nt, Homo sapiens
gguacugucucuggaauuu

SEQ ID NO: 1051398 - RNA, 19 nt, Homo sapiens
caaugaagccacacuauau

SEQ ID NO: 1051399 - RNA, 19 nt, Homo sapiens
gagggaacauuauaagcuu

SEQ ID NO: 1051400 - RNA, 19 nt, Homo sapiens
ggagagggcuacauuugag

SEQ ID NO: 1051401 - RNA, 19 nt, Homo sapiens
gagaaagcccagaaagaaa

SEQ ID NO: 1051402 - RNA, 19 nt, Homo sapiens
gaagagcagcggcgauuug

SEQ ID NO: 1051403 - RNA, 19 nt, Homo sapiens
gagaaguggugacacacaa

SEQ ID NO: 1051404 - RNA, 19 nt, Homo sapiens
gagcugcugcuaaauaauu

SEQ ID NO: 1051405 - RNA, 19 nt, Homo sapiens
guaaugaguuccgaagguu

SEQ ID NO: 1051406 - RNA, 19 nt, Homo sapiens
gagagaaagcccagaaaga

SEQ ID NO: 1051407 - RNA, 19 nt, Homo sapiens
ggaggagcgugaacgagaa

SEQ ID NO: 1051408 - RNA, 19 nt, Homo sapiens
ggagggagaagauggcuuu

SEQ ID NO: 1051409 - RNA, 19 nt, Homo sapiens
aaccagagaugauuuggaa

SEQ ID NO: 1051410 - RNA, 19 nt, Homo sapiens
gcagaaauccggcaaucga

SEQ ID NO: 1051411 - RNA, 19 nt, Homo sapiens
aaagaagccuacugaggaa

SEQ ID NO: 1051412 - RNA, 19 nt, Homo sapiens
guuuggagcugcugcuaaa

SEQ ID NO: 1051413 - RNA, 19 nt, Homo sapiens
ccacuuugcaugucuauga

SEQ ID NO: 1051414 - RNA, 19 nt, Homo sapiens
cagaacugcugcuacagaa

SEQ ID NO: 1051415 - RNA, 19 nt, Homo sapiens
gggcuacauuugagaaguu

SEQ ID NO: 1051416 - RNA, 19 nt, Homo sapiens
aagaacagagggaacauua

SEQ ID NO: 1051417 - RNA, 19 nt, Homo sapiens
uggagcugcugcuaaauaa

SEQ ID NO: 1051418 - RNA, 19 nt, Homo sapiens
agacugcacucaccucaga

SEQ ID NO: 1051419 - RNA, 19 nt, Homo sapiens
ggugcuauauuucaaggaa

SEQ ID NO: 1051420 - RNA, 19 nt, Homo sapiens
agacagggcuagagguaug

SEQ ID NO: 1051421 - RNA, 19 nt, Homo sapiens
gagaagagcagcggcgauu

SEQ ID NO: 1051422 - RNA, 19 nt, Homo sapiens
ggauauuucagagaaguua

SEQ ID NO: 1051423 - RNA, 19 nt, Homo sapiens
gaauccagaugccuacgau

SEQ ID NO: 1051424 - RNA, 19 nt, Homo sapiens
acaaugaagccacacuaua

SEQ ID NO: 1051425 - RNA, 19 nt, Homo sapiens
uacagaaccugcaaaguag

SEQ ID NO: 1051426 - RNA, 19 nt, Homo sapiens
caggagaucuuuccagcau

SEQ ID NO: 1051427 - RNA, 19 nt, Homo sapiens
agagaaagcccagaaagaa

SEQ ID NO: 1051428 - RNA, 19 nt, Homo sapiens
ggagagagaaagcccagaa

SEQ ID NO: 1051429 - RNA, 19 nt, Homo sapiens
ccagcaaacucaagaagag

SEQ ID NO: 1051430 - RNA, 19 nt, Homo sapiens
gaggaagaaauaagaaaga

SEQ ID NO: 1051431 - RNA, 19 nt, Homo sapiens
caaucgaccugaggacuug

SEQ ID NO: 1051432 - RNA, 19 nt, Homo sapiens
uaagagaggagagaaagaa

SEQ ID NO: 1051433 - RNA, 19 nt, Homo sapiens
gggagagggcuacauuuga

SEQ ID NO: 1051434 - RNA, 19 nt, Homo sapiens
cuauggauauuucagagaa

SEQ ID NO: 1051435 - RNA, 19 nt, Homo sapiens
gaaugaggaaucucccaaa

SEQ ID NO: 1051436 - RNA, 19 nt, Homo sapiens
ugucugcccuggacuuuga

SEQ ID NO: 1051437 - RNA, 19 nt, Homo sapiens
ggauuguuguguugcagaa

SEQ ID NO: 1051438 - RNA, 19 nt, Homo sapiens
gggagaagauggcuuucag

SEQ ID NO: 1051439 - RNA, 19 nt, Homo sapiens
ugaggaaucucccaaacag

SEQ ID NO: 1051440 - RNA, 19 nt, Homo sapiens
agagaaagaagccuacuga

SEQ ID NO: 1051441 - RNA, 19 nt, Homo sapiens
uaaagcaacgucucaagga

SEQ ID NO: 1051442 - RNA, 19 nt, Homo sapiens
aaagacagggcuagaggua

SEQ ID NO: 1051443 - RNA, 19 nt, Homo sapiens
gcucuggaaugcacugcuu

SEQ ID NO: 1051444 - RNA, 19 nt, Homo sapiens
gcaaucgaccugaggacuu

SEQ ID NO: 1051445 - RNA, 19 nt, Homo sapiens
gaagccuacugaggaagaa

SEQ ID NO: 1051446 - RNA, 19 nt, Homo sapiens
ucacagcagcccuagguuu

SEQ ID NO: 1051447 - RNA, 19 nt, Homo sapiens
aaugaagccacacuauaua

SEQ ID NO: 1051448 - RNA, 19 nt, Homo sapiens
ggacucuucuccagcaaac

SEQ ID NO: 1051449 - RNA, 19 nt, Homo sapiens
gcgucgaucucccuguuug

SEQ ID NO: 1051450 - RNA, 19 nt, Homo sapiens
gagagagaaagcccagaaa

SEQ ID NO: 1051451 - RNA, 19 nt, Homo sapiens
cgacgcugcuggaguugug

SEQ ID NO: 1051452 - RNA, 19 nt, Homo sapiens
ugacaaaucaacacguaau

SEQ ID NO: 1051453 - RNA, 19 nt, Homo sapiens
ggacucuggaucuuuguga

SEQ ID NO: 1051454 - RNA, 19 nt, Homo sapiens
gaccugagagggcacauuc

SEQ ID NO: 1051455 - RNA, 19 nt, Homo sapiens
gcagacccaccuuccaaga

SEQ ID NO: 1051456 - RNA, 19 nt, Homo sapiens
cguaaugaguuccgaaggu

SEQ ID NO: 1051457 - RNA, 19 nt, Homo sapiens
caaaucaacacguaaugag

SEQ ID NO: 1051458 - RNA, 19 nt, Homo sapiens
uggaagaggcucagugguu

SEQ ID NO: 1051459 - RNA, 19 nt, Homo sapiens
uugccgagcuggagauguu

SEQ ID NO: 1051460 - RNA, 19 nt, Homo sapiens
gaggagccuuccacacagu

SEQ ID NO: 1051461 - RNA, 19 nt, Homo sapiens
ggaagaaauaagaaagauc

SEQ ID NO: 1051462 - RNA, 19 nt, Homo sapiens
cagcaucucgggaucagaa

SEQ ID NO: 1051463 - RNA, 19 nt, Homo sapiens
aaaggaauaagaaggagaa

SEQ ID NO: 1051464 - RNA, 19 nt, Homo sapiens
agaagauggcuuucaggua

SEQ ID NO: 1051465 - RNA, 19 nt, Homo sapiens
gaagccacacuauauaagg

SEQ ID NO: 1051466 - RNA, 19 nt, Homo sapiens
ggcugcagcugggcacuuu

SEQ ID NO: 1051467 - RNA, 19 nt, Homo sapiens
ccagaugccuacgauuaca

SEQ ID NO: 1051468 - RNA, 19 nt, Homo sapiens
aaucaacacguaaugaguu

SEQ ID NO: 1051469 - RNA, 19 nt, Homo sapiens
ggaauaagaaggagaaaag

SEQ ID NO: 1051470 - RNA, 19 nt, Homo sapiens
cuacagcgugugcuccaua

SEQ ID NO: 1051471 - RNA, 19 nt, Homo sapiens
aagaggagccuuccacaca

SEQ ID NO: 1051472 - RNA, 19 nt, Homo sapiens
guaagagaggagagaaaga

SEQ ID NO: 1051473 - RNA, 19 nt, Homo sapiens
uacagcgugugcuccauaa

SEQ ID NO: 1051474 - RNA, 19 nt, Homo sapiens
ccuaggcccucaucaggau

SEQ ID NO: 1051475 - RNA, 19 nt, Homo sapiens
gugaaaccagagaugauuu

SEQ ID NO: 1051476 - RNA, 19 nt, Homo sapiens
cacguugccuccaggauca

SEQ ID NO: 1051477 - RNA, 19 nt, Homo sapiens
uugugagucugaaguauug

SEQ ID NO: 1051478 - RNA, 19 nt, Homo sapiens
ugaaaccagagaugauuug

SEQ ID NO: 1051479 - RNA, 19 nt, Homo sapiens
caagaacagagggaacauu

SEQ ID NO: 1051480 - RNA, 19 nt, Homo sapiens
acaaaucaacacguaauga

SEQ ID NO: 1051481 - RNA, 19 nt, Homo sapiens
gacaaaucaacacguaaug

SEQ ID NO: 1051482 - RNA, 19 nt, Homo sapiens
uggccggucuuuguucuuu

SEQ ID NO: 1051483 - RNA, 19 nt, Homo sapiens
aagccacacuauauaagga

SEQ ID NO: 1051484 - RNA, 19 nt, Homo sapiens
gggaacauuauaagcuuga

SEQ ID NO: 1051485 - RNA, 19 nt, Homo sapiens
gcaggaggagcgugaacga

SEQ ID NO: 1051486 - RNA, 19 nt, Homo sapiens
auccagaugccuacgauua

SEQ ID NO: 1051487 - RNA, 19 nt, Homo sapiens
ugaccacuuugcaugucua

SEQ ID NO: 1051488 - RNA, 19 nt, Homo sapiens
gcucuggccggucuuuguu

SEQ ID NO: 1051489 - RNA, 19 nt, Homo sapiens
ggacauacuuccaacaaua

SEQ ID NO: 1051490 - RNA, 19 nt, Homo sapiens
caagacagcugccaaauau

SEQ ID NO: 1051491 - RNA, 19 nt, Homo sapiens
ggaaagacaucgaucuaaa

SEQ ID NO: 1051492 - RNA, 19 nt, Homo sapiens
caccauaacucaugcaaua

SEQ ID NO: 1051493 - RNA, 19 nt, Homo sapiens
ggaggaagcagaaagaaua

SEQ ID NO: 1051494 - RNA, 19 nt, Homo sapiens
gugcugauguuuagaaaua

SEQ ID NO: 1051495 - RNA, 19 nt, Homo sapiens
gcacaaggcuggagauugg

SEQ ID NO: 1051496 - RNA, 19 nt, Homo sapiens
aagaauagcuagagaagaa

SEQ ID NO: 1051497 - RNA, 19 nt, Homo sapiens
gggaaacauucuugucaua

SEQ ID NO: 1051498 - RNA, 19 nt, Homo sapiens
ggagcaaacuuaagaguag

SEQ ID NO: 1051499 - RNA, 19 nt, Homo sapiens
gaaaaucgcugugauauca

SEQ ID NO: 1051500 - RNA, 19 nt, Homo sapiens
gagauuauguugcaaaugg

SEQ ID NO: 1051501 - RNA, 19 nt, Homo sapiens
ccaagaaauucaucacaaa

SEQ ID NO: 1051502 - RNA, 19 nt, Homo sapiens
gaaagggccugaaaauaaa

SEQ ID NO: 1051503 - RNA, 19 nt, Homo sapiens
ugaagaugcugaaauaaug

SEQ ID NO: 1051504 - RNA, 19 nt, Homo sapiens
aaagaucggcuacagauua

SEQ ID NO: 1051505 - RNA, 19 nt, Homo sapiens
ggaauacagugucgagaug

SEQ ID NO: 1051506 - RNA, 19 nt, Homo sapiens
gguaagaguucaaguucaa

SEQ ID NO: 1051507 - RNA, 19 nt, Homo sapiens
aaagagacauugaacaguu

SEQ ID NO: 1051508 - RNA, 19 nt, Homo sapiens
gaacugccucuuugaaauu

SEQ ID NO: 1051509 - RNA, 19 nt, Homo sapiens
gaaauaaauagcaguguga

SEQ ID NO: 1051510 - RNA, 19 nt, Homo sapiens
uaagugacauguugaccua

SEQ ID NO: 1051511 - RNA, 19 nt, Homo sapiens
gagagaagccucacaaagu

SEQ ID NO: 1051512 - RNA, 19 nt, Homo sapiens
cuagugaccugguugaauu

SEQ ID NO: 1051513 - RNA, 19 nt, Homo sapiens
ccagagagcguuuggcuuu

SEQ ID NO: 1051514 - RNA, 19 nt, Homo sapiens
ggaaagaggaauugcaguu

SEQ ID NO: 1051515 - RNA, 19 nt, Homo sapiens
ggacagaaagucagguuga

SEQ ID NO: 1051516 - RNA, 19 nt, Homo sapiens
uacgagagcugcaugugua

SEQ ID NO: 1051517 - RNA, 19 nt, Homo sapiens
ccacagaagccauuacuug

SEQ ID NO: 1051518 - RNA, 19 nt, Homo sapiens
gaaagacaucgaucuaaau

SEQ ID NO: 1051519 - RNA, 19 nt, Homo sapiens
ggagaaagguaagaguuca

SEQ ID NO: 1051520 - RNA, 19 nt, Homo sapiens
uggugaagaugcugaaaua

SEQ ID NO: 1051521 - RNA, 19 nt, Homo sapiens
gcagaguguuuaugaagau

SEQ ID NO: 1051522 - RNA, 19 nt, Homo sapiens
aaaguggaguuuauuguga

SEQ ID NO: 1051523 - RNA, 19 nt, Homo sapiens
gacaagacaccgaauagaa

SEQ ID NO: 1051524 - RNA, 19 nt, Homo sapiens
ccaagacagcugccaaaua

SEQ ID NO: 1051525 - RNA, 19 nt, Homo sapiens
gagggucaguuccuaaguu

SEQ ID NO: 1051526 - RNA, 19 nt, Homo sapiens
gaacaugggucugggaaaa

SEQ ID NO: 1051527 - RNA, 19 nt, Homo sapiens
ucaggaagauauaagaguu

SEQ ID NO: 1051528 - RNA, 19 nt, Homo sapiens
gaaagaauagcuagagaag

SEQ ID NO: 1051529 - RNA, 19 nt, Homo sapiens
ugaaagaccucggaauaca

SEQ ID NO: 1051530 - RNA, 19 nt, Homo sapiens
agacaucgaucuaaauaag

SEQ ID NO: 1051531 - RNA, 19 nt, Homo sapiens
ccagaagaauacagagauu

SEQ ID NO: 1051532 - RNA, 19 nt, Homo sapiens
ggaaaucaggaagauauaa

SEQ ID NO: 1051533 - RNA, 19 nt, Homo sapiens
gcagucaaguauucugaga

SEQ ID NO: 1051534 - RNA, 19 nt, Homo sapiens
gaaagaggaauugcaguug

SEQ ID NO: 1051535 - RNA, 19 nt, Homo sapiens
uuacagugcugauguuuag

SEQ ID NO: 1051536 - RNA, 19 nt, Homo sapiens
ccaccagacucuaaucuca

SEQ ID NO: 1051537 - RNA, 19 nt, Homo sapiens
aaugaaagaccucggaaua

SEQ ID NO: 1051538 - RNA, 19 nt, Homo sapiens
guaaggagagauuauguug

SEQ ID NO: 1051539 - RNA, 19 nt, Homo sapiens
ugaaagggccugaaaauaa

SEQ ID NO: 1051540 - RNA, 19 nt, Homo sapiens
cuacuaaauuucagcauca

SEQ ID NO: 1051541 - RNA, 19 nt, Homo sapiens
gagagauuauguugcaaau

SEQ ID NO: 1051542 - RNA, 19 nt, Homo sapiens
agagaagccucacaaagug

SEQ ID NO: 1051543 - RNA, 19 nt, Homo sapiens
ggucaguuccuaaguuaaa

SEQ ID NO: 1051544 - RNA, 19 nt, Homo sapiens
aaacaggauuggcuucuuc

SEQ ID NO: 1051545 - RNA, 19 nt, Homo sapiens
caccaggaauuauuauaga

SEQ ID NO: 1051546 - RNA, 19 nt, Homo sapiens
ccgaugggcugaaacucua

SEQ ID NO: 1051547 - RNA, 19 nt, Homo sapiens
gaaauuucgagguaaucua

SEQ ID NO: 1051548 - RNA, 19 nt, Homo sapiens
uucaaaggcuccucuugua

SEQ ID NO: 1051549 - RNA, 19 nt, Homo sapiens
cagaagccauuacuugcaa

SEQ ID NO: 1051550 - RNA, 19 nt, Homo sapiens
cauuccacauucuuuguua

SEQ ID NO: 1051551 - RNA, 19 nt, Homo sapiens
gcaccaggaauuauuauag

SEQ ID NO: 1051552 - RNA, 19 nt, Homo sapiens
cagaaagaauagcuagaga

SEQ ID NO: 1051553 - RNA, 19 nt, Homo sapiens
agacccagaucaagacauu

SEQ ID NO: 1051554 - RNA, 19 nt, Homo sapiens
ggagagauuauguugcaaa

SEQ ID NO: 1051555 - RNA, 19 nt, Homo sapiens
gauaugacccuuuccuaca

SEQ ID NO: 1051556 - RNA, 19 nt, Homo sapiens
caaaggcuccucuuguaga

SEQ ID NO: 1051557 - RNA, 19 nt, Homo sapiens
gacagaaagucagguugaa

SEQ ID NO: 1051558 - RNA, 19 nt, Homo sapiens
gcaaaugguggcugggaaa

SEQ ID NO: 1051559 - RNA, 19 nt, Homo sapiens
ggccauaccagguugaauu

SEQ ID NO: 1051560 - RNA, 19 nt, Homo sapiens
gaaagaucggcuacagauu

SEQ ID NO: 1051561 - RNA, 19 nt, Homo sapiens
gccgggauccuacuaaauu

SEQ ID NO: 1051562 - RNA, 19 nt, Homo sapiens
uuaaagugguggcccauau

SEQ ID NO: 1051563 - RNA, 19 nt, Homo sapiens
cacaaaguguauuggaauu

SEQ ID NO: 1051564 - RNA, 19 nt, Homo sapiens
aagauuugcuuccacagaa

SEQ ID NO: 1051565 - RNA, 19 nt, Homo sapiens
ccacaccaguccacucuuc

SEQ ID NO: 1051566 - RNA, 19 nt, Homo sapiens
gaaacauucuugucauacg

SEQ ID NO: 1051567 - RNA, 19 nt, Homo sapiens
gaaaucaggaagauauaag

SEQ ID NO: 1051568 - RNA, 19 nt, Homo sapiens
gggcugaaacucuauccua

SEQ ID NO: 1051569 - RNA, 19 nt, Homo sapiens
caaaguguauuggaauuac

SEQ ID NO: 1051570 - RNA, 19 nt, Homo sapiens
ggagagggucaguuccuaa

SEQ ID NO: 1051571 - RNA, 19 nt, Homo sapiens
ggagugcaguggcgcaauc

SEQ ID NO: 1051572 - RNA, 19 nt, Homo sapiens
aaagaggaauugcaguugu

SEQ ID NO: 1051573 - RNA, 19 nt, Homo sapiens
gccugcagguggccuauuu

SEQ ID NO: 1051574 - RNA, 19 nt, Homo sapiens
gagcugaugaugcugacua

SEQ ID NO: 1051575 - RNA, 19 nt, Homo sapiens
gggaaagacaucgaucuaa

SEQ ID NO: 1051576 - RNA, 19 nt, Homo sapiens
guacagagggauauuccaa

SEQ ID NO: 1051577 - RNA, 19 nt, Homo sapiens
ugugauggguggaacguuu

SEQ ID NO: 1051578 - RNA, 19 nt, Homo sapiens
agaacugccucuuugaaau

SEQ ID NO: 1051579 - RNA, 19 nt, Homo sapiens
gaaaaccaccagacucuaa

SEQ ID NO: 1051580 - RNA, 19 nt, Homo sapiens
gacuauaggagauguuauu

SEQ ID NO: 1051581 - RNA, 19 nt, Homo sapiens
gcccguacauggugaagau

SEQ ID NO: 1051582 - RNA, 19 nt, Homo sapiens
uuaguuagcucaggaguag

SEQ ID NO: 1051583 - RNA, 19 nt, Homo sapiens
ggccaaagauuccgguuuu

SEQ ID NO: 1051584 - RNA, 19 nt, Homo sapiens
cauuucaccuggccaaaga

SEQ ID NO: 1051585 - RNA, 19 nt, Homo sapiens
cagaagaauacagagauua

SEQ ID NO: 1051586 - RNA, 19 nt, Homo sapiens
gugaagaugcugaaauaau

SEQ ID NO: 1051587 - RNA, 19 nt, Homo sapiens
gaauugguaaggagagauu

SEQ ID NO: 1051588 - RNA, 19 nt, Homo sapiens
acagagggauauuccaaug

SEQ ID NO: 1051589 - RNA, 19 nt, Homo sapiens
aaagagccaugacaauuua

SEQ ID NO: 1051590 - RNA, 19 nt, Homo sapiens
gaucucagguucauuaaga

SEQ ID NO: 1051591 - RNA, 19 nt, Homo sapiens
caagaucucagguucauua

SEQ ID NO: 1051592 - RNA, 19 nt, Homo sapiens
gcucacaccuguaauccua

SEQ ID NO: 1051593 - RNA, 19 nt, Homo sapiens
cagaagaacuggcagagaa

SEQ ID NO: 1051594 - RNA, 19 nt, Homo sapiens
gaaaucccauaucuacaaa

SEQ ID NO: 1051595 - RNA, 19 nt, Homo sapiens
guucauguccaaacuauua

SEQ ID NO: 1051596 - RNA, 19 nt, Homo sapiens
aaacaccugucucuacuaa

SEQ ID NO: 1051597 - RNA, 19 nt, Homo sapiens
ugaagucuauuucuaguug

SEQ ID NO: 1051598 - RNA, 19 nt, Homo sapiens
guagucauaugaagucuau

SEQ ID NO: 1051599 - RNA, 19 nt, Homo sapiens
ggaaauugaacuccugaaa

SEQ ID NO: 1051600 - RNA, 19 nt, Homo sapiens
gaaccugcuuuauauugga

SEQ ID NO: 1051601 - RNA, 19 nt, Homo sapiens
ggaguuggcugugacuuuc

SEQ ID NO: 1051602 - RNA, 19 nt, Homo sapiens
cagcagaucacaaauauuc

SEQ ID NO: 1051603 - RNA, 19 nt, Homo sapiens
gagccaugacaauuuauua

SEQ ID NO: 1051604 - RNA, 19 nt, Homo sapiens
gaagaacuggcagagaaua

SEQ ID NO: 1051605 - RNA, 19 nt, Homo sapiens
aaagagaagagaucccuua

SEQ ID NO: 1051606 - RNA, 19 nt, Homo sapiens
gcucagaagugucauacuc

SEQ ID NO: 1051607 - RNA, 19 nt, Homo sapiens
caggaaaacuuaccuauug

SEQ ID NO: 1051608 - RNA, 19 nt, Homo sapiens
uacagcagaucacaaauau

SEQ ID NO: 1051609 - RNA, 19 nt, Homo sapiens
uaacggcgcugggcuagug

SEQ ID NO: 1051610 - RNA, 19 nt, Homo sapiens
aaacccaccuugaaacaau

SEQ ID NO: 1051611 - RNA, 19 nt, Homo sapiens
cuacagcagaucacaaaua

SEQ ID NO: 1051612 - RNA, 19 nt, Homo sapiens
guaagaggaucaccuaagc

SEQ ID NO: 1051613 - RNA, 19 nt, Homo sapiens
cagagaauauacucaagug

SEQ ID NO: 1051614 - RNA, 19 nt, Homo sapiens
ugacuuucauugagagauu

SEQ ID NO: 1051615 - RNA, 19 nt, Homo sapiens
aaacuuaccuauugaagcu

SEQ ID NO: 1051616 - RNA, 19 nt, Homo sapiens
ggaggcagagguugcagua

SEQ ID NO: 1051617 - RNA, 19 nt, Homo sapiens
gaagucuauuucuaguuga

SEQ ID NO: 1051618 - RNA, 19 nt, Homo sapiens
gcugugacuuucauugaga

SEQ ID NO: 1051619 - RNA, 19 nt, Homo sapiens
aaauugaacuccugaaacu

SEQ ID NO: 1051620 - RNA, 19 nt, Homo sapiens
aagcugaaaucuaccagaa

SEQ ID NO: 1051621 - RNA, 19 nt, Homo sapiens
cgaaacaccugucucuacu

SEQ ID NO: 1051622 - RNA, 19 nt, Homo sapiens
ugaaaucccauaucuacaa

SEQ ID NO: 1051623 - RNA, 19 nt, Homo sapiens
caaguggcguaaacaacaa

SEQ ID NO: 1051624 - RNA, 19 nt, Homo sapiens
gaaauugaacuccugaaac

SEQ ID NO: 1051625 - RNA, 19 nt, Homo sapiens
gaucacaaauauucaagcu

SEQ ID NO: 1051626 - RNA, 19 nt, Homo sapiens
caucucugguagaaauaua

SEQ ID NO: 1051627 - RNA, 19 nt, Homo sapiens
ccuguaaucccaacacuuu

SEQ ID NO: 1051628 - RNA, 19 nt, Homo sapiens
ggugaaaucccauaucuac

SEQ ID NO: 1051629 - RNA, 19 nt, Homo sapiens
gacuguaacauggguauua

SEQ ID NO: 1051630 - RNA, 19 nt, Homo sapiens
gcaaagauggauauauugg

SEQ ID NO: 1051631 - RNA, 19 nt, Homo sapiens
gaccagccuugacaacaug

SEQ ID NO: 1051632 - RNA, 19 nt, Homo sapiens
gaaaaugaaccaggcuuua

SEQ ID NO: 1051633 - RNA, 19 nt, Homo sapiens
gcugaaaucuaccagaaaa

SEQ ID NO: 1051634 - RNA, 19 nt, Homo sapiens
gaaacaccugucucuacua

SEQ ID NO: 1051635 - RNA, 19 nt, Homo sapiens
gcagaucacaaauauucaa

SEQ ID NO: 1051636 - RNA, 19 nt, Homo sapiens
gauuagaaacccaccuuga

SEQ ID NO: 1051637 - RNA, 19 nt, Homo sapiens
gaagugucauacucugcaa

SEQ ID NO: 1051638 - RNA, 19 nt, Homo sapiens
gcagaauaaucgcuugaac

SEQ ID NO: 1051639 - RNA, 19 nt, Homo sapiens
gauauuauaaugccuccuu

SEQ ID NO: 1051640 - RNA, 19 nt, Homo sapiens
ucaaucaggagauguuaaa

SEQ ID NO: 1051641 - RNA, 19 nt, Homo sapiens
gaacuucaccagacuacag

SEQ ID NO: 1051642 - RNA, 19 nt, Homo sapiens
gaauaaucauuuggaagca

SEQ ID NO: 1051643 - RNA, 19 nt, Homo sapiens
gaacuccugaaacuagaaa

SEQ ID NO: 1051644 - RNA, 19 nt, Homo sapiens
gacuacagcagaucacaaa

SEQ ID NO: 1051645 - RNA, 19 nt, Homo sapiens
ucacuuaaacccaggaguu

SEQ ID NO: 1051646 - RNA, 19 nt, Homo sapiens
gaaguuucgucuuguaucc

SEQ ID NO: 1051647 - RNA, 19 nt, Homo sapiens
uuagaaacccaccuugaaa

SEQ ID NO: 1051648 - RNA, 19 nt, Homo sapiens
gacuuucauugagagauua

SEQ ID NO: 1051649 - RNA, 19 nt, Homo sapiens
ugcaaagcaugaauaauca

SEQ ID NO: 1051650 - RNA, 19 nt, Homo sapiens
gaucaugaggucaggaguu

SEQ ID NO: 1051651 - RNA, 19 nt, Homo sapiens
ccuguaauccuaacacuug

SEQ ID NO: 1051652 - RNA, 19 nt, Homo sapiens
aaacccaugugccaggaaa

SEQ ID NO: 1051653 - RNA, 19 nt, Homo sapiens
cugcaaagcaugaauaauc

SEQ ID NO: 1051654 - RNA, 19 nt, Homo sapiens
gaacuggcagagaauauac

SEQ ID NO: 1051655 - RNA, 19 nt, Homo sapiens
ucacagauauaugguacau

SEQ ID NO: 1051656 - RNA, 19 nt, Homo sapiens
ggaggcugaggcagaauaa

SEQ ID NO: 1051657 - RNA, 19 nt, Homo sapiens
gcgaaacaccugucucuac

SEQ ID NO: 1051658 - RNA, 19 nt, Homo sapiens
gcgggcagaucacuuaaac

SEQ ID NO: 1051659 - RNA, 19 nt, Homo sapiens
gcagagaauauacucaagu

SEQ ID NO: 1051660 - RNA, 19 nt, Homo sapiens
gaaacccaccuugaaacaa

SEQ ID NO: 1051661 - RNA, 19 nt, Homo sapiens
gauggucaaucaggagaug

SEQ ID NO: 1051662 - RNA, 19 nt, Homo sapiens
uauaaugccuccuuuaccu

SEQ ID NO: 1051663 - RNA, 19 nt, Homo sapiens
gagauuagaaacccaccuu

SEQ ID NO: 1051664 - RNA, 19 nt, Homo sapiens
ucaaguggcguaaacaaca

SEQ ID NO: 1051665 - RNA, 19 nt, Homo sapiens
gggaggcugaggcagaaua

SEQ ID NO: 1051666 - RNA, 19 nt, Homo sapiens
ggcaaagacuguugaaacc

SEQ ID NO: 1051667 - RNA, 19 nt, Homo sapiens
gguaagaggaucaccuaag

SEQ ID NO: 1051668 - RNA, 19 nt, Homo sapiens
uggguaacauggugaaauc

SEQ ID NO: 1051669 - RNA, 19 nt, Homo sapiens
ggucaaucaggagauguua

SEQ ID NO: 1051670 - RNA, 19 nt, Homo sapiens
acuguaacauggguauuaa

SEQ ID NO: 1051671 - RNA, 19 nt, Homo sapiens
aagaaccugcuuuauauug

SEQ ID NO: 1051672 - RNA, 19 nt, Homo sapiens
uaaugccuccuuuaccuuu

SEQ ID NO: 1051673 - RNA, 19 nt, Homo sapiens
agaccagccuugacaacau

SEQ ID NO: 1051674 - RNA, 19 nt, Homo sapiens
acaccugucucuacuaaaa

SEQ ID NO: 1051675 - RNA, 19 nt, Homo sapiens
agaacuggcagagaauaua

SEQ ID NO: 1051676 - RNA, 19 nt, Homo sapiens
ugaaccaggcuuuagcaaa

SEQ ID NO: 1051677 - RNA, 19 nt, Homo sapiens
aaagauacagcagauguug

SEQ ID NO: 1051678 - RNA, 19 nt, Homo sapiens
aggcagagguugcaguaag

SEQ ID NO: 1051679 - RNA, 19 nt, Homo sapiens
aaaagagccaugacaauuu

SEQ ID NO: 1051680 - RNA, 19 nt, Homo sapiens
guaacauggguauuaauag

SEQ ID NO: 1051681 - RNA, 19 nt, Homo sapiens
cuauugaagcuguuuauca

SEQ ID NO: 1051682 - RNA, 19 nt, Homo sapiens
ccuguaaucccagcacuuu

SEQ ID NO: 1051683 - RNA, 19 nt, Homo sapiens
cuaggccacuucauagcuu

SEQ ID NO: 1051684 - RNA, 19 nt, Homo sapiens
gauauaugguacauuugcu

SEQ ID NO: 1051685 - RNA, 19 nt, Homo sapiens
ucaccagacuacagcagau

SEQ ID NO: 1051686 - RNA, 19 nt, Homo sapiens
agauacagcagauguuguu

SEQ ID NO: 1051687 - RNA, 19 nt, Homo sapiens
ucgggaggcugagguaaga

SEQ ID NO: 1051688 - RNA, 19 nt, Homo sapiens
agagaucccuuaggcaaag

SEQ ID NO: 1051689 - RNA, 19 nt, Homo sapiens
gaagagaacucaguccaua

SEQ ID NO: 1051690 - RNA, 19 nt, Homo sapiens
ggagagagccugcgauuau

SEQ ID NO: 1051691 - RNA, 19 nt, Homo sapiens
acagguagaugaaaugaua

SEQ ID NO: 1051692 - RNA, 19 nt, Homo sapiens
gaacuggcuugacuacuuc

SEQ ID NO: 1051693 - RNA, 19 nt, Homo sapiens
gaaauacgaaucaagcaaa

SEQ ID NO: 1051694 - RNA, 19 nt, Homo sapiens
caaaugagacaccaaaguu

SEQ ID NO: 1051695 - RNA, 19 nt, Homo sapiens
ucucugagcugcugccuuu

SEQ ID NO: 1051696 - RNA, 19 nt, Homo sapiens
cagaauaacugucucuaag

SEQ ID NO: 1051697 - RNA, 19 nt, Homo sapiens
gagagagccugcgauuauu

SEQ ID NO: 1051698 - RNA, 19 nt, Homo sapiens
gagaugaacuggcuugacu

SEQ ID NO: 1051699 - RNA, 19 nt, Homo sapiens
ggaagaggaagaagaagaa

SEQ ID NO: 1051700 - RNA, 19 nt, Homo sapiens
ugaacuggcuugacuacuu

SEQ ID NO: 1051701 - RNA, 19 nt, Homo sapiens
guuuaucccuguuuacuga

SEQ ID NO: 1051702 - RNA, 19 nt, Homo sapiens
cagcagagcaggacaguug

SEQ ID NO: 1051703 - RNA, 19 nt, Homo sapiens
gaaagguaauacagguaga

SEQ ID NO: 1051704 - RNA, 19 nt, Homo sapiens
gaauaacugucucuaagcu

SEQ ID NO: 1051705 - RNA, 19 nt, Homo sapiens
gaggguagguccagaaggu

SEQ ID NO: 1051706 - RNA, 19 nt, Homo sapiens
cuucuucccuucaggcuua

SEQ ID NO: 1051707 - RNA, 19 nt, Homo sapiens
ugaauuggguggcgguuga

SEQ ID NO: 1051708 - RNA, 19 nt, Homo sapiens
gcugguaccuacuuucaau

SEQ ID NO: 1051709 - RNA, 19 nt, Homo sapiens
gagcacuucucucuuaugg

SEQ ID NO: 1051710 - RNA, 19 nt, Homo sapiens
ggcaacagcugaccuggau

SEQ ID NO: 1051711 - RNA, 19 nt, Homo sapiens
gaaguggaaauacgaauca

SEQ ID NO: 1051712 - RNA, 19 nt, Homo sapiens
gagcaguguuuuauguuua

SEQ ID NO: 1051713 - RNA, 19 nt, Homo sapiens
gagagcggauuuacaacau

SEQ ID NO: 1051714 - RNA, 19 nt, Homo sapiens
caugugcuauguucuaaga

SEQ ID NO: 1051715 - RNA, 19 nt, Homo sapiens
ggagaaucaugugcuaugu

SEQ ID NO: 1051716 - RNA, 19 nt, Homo sapiens
ucuucuaccucccuaguua

SEQ ID NO: 1051717 - RNA, 19 nt, Homo sapiens
gggaauggcagcccucuug

SEQ ID NO: 1051718 - RNA, 19 nt, Homo sapiens
ggaaauacgaaucaagcaa

SEQ ID NO: 1051719 - RNA, 19 nt, Homo sapiens
caacaagaccauuuuagua

SEQ ID NO: 1051720 - RNA, 19 nt, Homo sapiens
ccacaaaugagacaccaaa

SEQ ID NO: 1051721 - RNA, 19 nt, Homo sapiens
gguaauacagguagaugaa

SEQ ID NO: 1051722 - RNA, 19 nt, Homo sapiens
agaaucaugugcuauguuc

SEQ ID NO: 1051723 - RNA, 19 nt, Homo sapiens
gcauggacuuuguuaagca

SEQ ID NO: 1051724 - RNA, 19 nt, Homo sapiens
caggagagcggauuuacaa

SEQ ID NO: 1051725 - RNA, 19 nt, Homo sapiens
ggccaagaccaacuccuua

SEQ ID NO: 1051726 - RNA, 19 nt, Homo sapiens
ggauaucaccgaaauaaac

SEQ ID NO: 1051727 - RNA, 19 nt, Homo sapiens
gguaccuacuuucaauaaa

SEQ ID NO: 1051728 - RNA, 19 nt, Homo sapiens
gaaggcacauggcuuucuc

SEQ ID NO: 1051729 - RNA, 19 nt, Homo sapiens
caacagcugaccuggauau

SEQ ID NO: 1051730 - RNA, 19 nt, Homo sapiens
uggauaaccucuacaacau

SEQ ID NO: 1051731 - RNA, 19 nt, Homo sapiens
gucauuggccacagaauaa

SEQ ID NO: 1051732 - RNA, 19 nt, Homo sapiens
gcuuauuguuugaguguga

SEQ ID NO: 1051733 - RNA, 19 nt, Homo sapiens
ccagaggccuugggaaaca

SEQ ID NO: 1051734 - RNA, 19 nt, Homo sapiens
gaaagacuucgaccgugaa

SEQ ID NO: 1051735 - RNA, 19 nt, Homo sapiens
uggcauuucugcucucuau

SEQ ID NO: 1051736 - RNA, 19 nt, Homo sapiens
gcauacggacccacaaaug

SEQ ID NO: 1051737 - RNA, 19 nt, Homo sapiens
ggagagcggauuuacaaca

SEQ ID NO: 1051738 - RNA, 19 nt, Homo sapiens
guagggcucucugugguau

SEQ ID NO: 1051739 - RNA, 19 nt, Homo sapiens
gaacuguagggcccagauu

SEQ ID NO: 1051740 - RNA, 19 nt, Homo sapiens
gagcggauuuacaacaucu

SEQ ID NO: 1051741 - RNA, 19 nt, Homo sapiens
ggaagaagaagaagaaaau

SEQ ID NO: 1051742 - RNA, 19 nt, Homo sapiens
gaagcucgccuccuuucug

SEQ ID NO: 1051743 - RNA, 19 nt, Homo sapiens
ggagcaguguuuuauguuu

SEQ ID NO: 1051744 - RNA, 19 nt, Homo sapiens
caacucaacauccucuuca

SEQ ID NO: 1051745 - RNA, 19 nt, Homo sapiens
cauacggacccacaaauga

SEQ ID NO: 1051746 - RNA, 19 nt, Homo sapiens
gauaucaccgaaauaaaca

SEQ ID NO: 1051747 - RNA, 19 nt, Homo sapiens
ucugaguaaugguaucuuu

SEQ ID NO: 1051748 - RNA, 19 nt, Homo sapiens
ggagguuuaggcucagaua

SEQ ID NO: 1051749 - RNA, 19 nt, Homo sapiens
gagcugguaccuacuuuca

SEQ ID NO: 1051750 - RNA, 19 nt, Homo sapiens
ugaguaaugguaucuuuga

SEQ ID NO: 1051751 - RNA, 19 nt, Homo sapiens
gggcauggacuuuguuaag

SEQ ID NO: 1051752 - RNA, 19 nt, Homo sapiens
gguuuaggcucagauaagu

SEQ ID NO: 1051753 - RNA, 19 nt, Homo sapiens
cgaagaagaacccuguguu

SEQ ID NO: 1051754 - RNA, 19 nt, Homo sapiens
gaaaaugaacguaagaauc

SEQ ID NO: 1051755 - RNA, 19 nt, Homo sapiens
aagcucgccuccuuucuga

SEQ ID NO: 1051756 - RNA, 19 nt, Homo sapiens
guggauaaccucuacaaca

SEQ ID NO: 1051757 - RNA, 19 nt, Homo sapiens
auaacugucucuaagcuau

SEQ ID NO: 1051758 - RNA, 19 nt, Homo sapiens
aauccucccugcucucuga

SEQ ID NO: 1051759 - RNA, 19 nt, Homo sapiens
agaggaagaagaagaagaa

SEQ ID NO: 1051760 - RNA, 19 nt, Homo sapiens
cuaagaauuugagaacuag

SEQ ID NO: 1051761 - RNA, 19 nt, Homo sapiens
gagaaucaugugcuauguu

SEQ ID NO: 1051762 - RNA, 19 nt, Homo sapiens
ccuaguuaguggaaauuug

SEQ ID NO: 1051763 - RNA, 19 nt, Homo sapiens
uagggaacauguccgucua

SEQ ID NO: 1051764 - RNA, 19 nt, Homo sapiens
gauaguggaagaggaagaa

SEQ ID NO: 1051765 - RNA, 19 nt, Homo sapiens
ucucuaagcuauccauggu

SEQ ID NO: 1051766 - RNA, 19 nt, Homo sapiens
ugucauuggccacagaaua

SEQ ID NO: 1051767 - RNA, 19 nt, Homo sapiens
agguagagcugucuguuca

SEQ ID NO: 1051768 - RNA, 19 nt, Homo sapiens
ccaaccgucucgcccaaau

SEQ ID NO: 1051769 - RNA, 19 nt, Homo sapiens
uacaacaucucagggaaug

SEQ ID NO: 1051770 - RNA, 19 nt, Homo sapiens
auacgaaucaagcaaauug

SEQ ID NO: 1051771 - RNA, 19 nt, Homo sapiens
cagagcugguaccuacuuu

SEQ ID NO: 1051772 - RNA, 19 nt, Homo sapiens
caccaccgcuacccagaga

SEQ ID NO: 1051773 - RNA, 19 nt, Homo sapiens
acaccaaaguugacaggau

SEQ ID NO: 1051774 - RNA, 19 nt, Homo sapiens
gcggagagagccugcgauu

SEQ ID NO: 1051775 - RNA, 19 nt, Homo sapiens
cuugagaccgggagguuua

SEQ ID NO: 1051776 - RNA, 19 nt, Homo sapiens
ggagguguccauggucaaa

SEQ ID NO: 1051777 - RNA, 19 nt, Homo sapiens
guaauacagguagaugaaa

SEQ ID NO: 1051778 - RNA, 19 nt, Homo sapiens
ucaccgaaauaaacaaacu

SEQ ID NO: 1051779 - RNA, 19 nt, Homo sapiens
aaucaugugcuauguucua

SEQ ID NO: 1051780 - RNA, 19 nt, Homo sapiens
ccuggagaaucaugugcua

SEQ ID NO: 1051781 - RNA, 19 nt, Homo sapiens
ccaaggcucugcgcgagau

SEQ ID NO: 1051782 - RNA, 19 nt, Homo sapiens
uaagcagagucagcaguga

SEQ ID NO: 1051783 - RNA, 19 nt, Homo sapiens
guuaguggaaauuuggaua

SEQ ID NO: 1051784 - RNA, 19 nt, Homo sapiens
ggagccauguuccucuaag

SEQ ID NO: 1051785 - RNA, 19 nt, Homo sapiens
ccuucaggcuuauuguuug

SEQ ID NO: 1051786 - RNA, 19 nt, Homo sapiens
cagcugaccuggauaucac

SEQ ID NO: 1051787 - RNA, 19 nt, Homo sapiens
ggguggcgguugacuguag

SEQ ID NO: 1051788 - RNA, 19 nt, Homo sapiens
gcaacucaacauccucuuc

SEQ ID NO: 1051789 - RNA, 19 nt, Homo sapiens
gauaauauaugcacaguga

SEQ ID NO: 1051790 - RNA, 19 nt, Homo sapiens
gaaauaggauugcuucaga

SEQ ID NO: 1051791 - RNA, 19 nt, Homo sapiens
gaaggaauauucuuucgaa

SEQ ID NO: 1051792 - RNA, 19 nt, Homo sapiens
caauauggcuuacauguug

SEQ ID NO: 1051793 - RNA, 19 nt, Homo sapiens
guacaccaaugaucaauaa

SEQ ID NO: 1051794 - RNA, 19 nt, Homo sapiens
aaaguucccuccaacauua

SEQ ID NO: 1051795 - RNA, 19 nt, Homo sapiens
gcaggaaccaugcaacuua

SEQ ID NO: 1051796 - RNA, 19 nt, Homo sapiens
gcuaaagcuugaacuaauu

SEQ ID NO: 1051797 - RNA, 19 nt, Homo sapiens
gggauguguuuauggauua

SEQ ID NO: 1051798 - RNA, 19 nt, Homo sapiens
gcacuaaacucuugguacu

SEQ ID NO: 1051799 - RNA, 19 nt, Homo sapiens
gcauaucacugggaacaaa

SEQ ID NO: 1051800 - RNA, 19 nt, Homo sapiens
gaugugagcuacaacaaca

SEQ ID NO: 1051801 - RNA, 19 nt, Homo sapiens
gcacauacaccaccaggaa

SEQ ID NO: 1051802 - RNA, 19 nt, Homo sapiens
gagagaaucccacaugcua

SEQ ID NO: 1051803 - RNA, 19 nt, Homo sapiens
caaauugcuugccugcuaa

SEQ ID NO: 1051804 - RNA, 19 nt, Homo sapiens
acaaauugcuugccugcua

SEQ ID NO: 1051805 - RNA, 19 nt, Homo sapiens
aaacucagaugcuuagaug

SEQ ID NO: 1051806 - RNA, 19 nt, Homo sapiens
caacaagcucgaauccuua

SEQ ID NO: 1051807 - RNA, 19 nt, Homo sapiens
uacaggaacuggauuuaaa

SEQ ID NO: 1051808 - RNA, 19 nt, Homo sapiens
gaaugucgcugagcuggaa

SEQ ID NO: 1051809 - RNA, 19 nt, Homo sapiens
guacugaacagccuuaaga

SEQ ID NO: 1051810 - RNA, 19 nt, Homo sapiens
uuaccuagcuguuguuaug

SEQ ID NO: 1051811 - RNA, 19 nt, Homo sapiens
caaagaaagagaagaaaga

SEQ ID NO: 1051812 - RNA, 19 nt, Homo sapiens
ggaacaaaguggacauucu

SEQ ID NO: 1051813 - RNA, 19 nt, Homo sapiens
caauaacauucgcacaauu

SEQ ID NO: 1051814 - RNA, 19 nt, Homo sapiens
ggaccagcaccuccaguua

SEQ ID NO: 1051815 - RNA, 19 nt, Homo sapiens
gcuacugaauguuuacaaa

SEQ ID NO: 1051816 - RNA, 19 nt, Homo sapiens
auagaaggcugauagaaga

SEQ ID NO: 1051817 - RNA, 19 nt, Homo sapiens
gaacaaaguggacauucug

SEQ ID NO: 1051818 - RNA, 19 nt, Homo sapiens
acaacaagcucgaauccuu

SEQ ID NO: 1051819 - RNA, 19 nt, Homo sapiens
guauugccaucuccuguaa

SEQ ID NO: 1051820 - RNA, 19 nt, Homo sapiens
ccaugcaacuuaccaaaga

SEQ ID NO: 1051821 - RNA, 19 nt, Homo sapiens
ucacugauguggcugaaau

SEQ ID NO: 1051822 - RNA, 19 nt, Homo sapiens
ucaaaugacuaaccuccaa

SEQ ID NO: 1051823 - RNA, 19 nt, Homo sapiens
gaaguuccgugcccaugug

SEQ ID NO: 1051824 - RNA, 19 nt, Homo sapiens
aagaucagguggucuguuu

SEQ ID NO: 1051825 - RNA, 19 nt, Homo sapiens
ugacggcacuaaacucuug

SEQ ID NO: 1051826 - RNA, 19 nt, Homo sapiens
gaacuaauuccagaagcua

SEQ ID NO: 1051827 - RNA, 19 nt, Homo sapiens
gaaaacaagcagagaauaa

SEQ ID NO: 1051828 - RNA, 19 nt, Homo sapiens
uagaagacauaacugaaug

SEQ ID NO: 1051829 - RNA, 19 nt, Homo sapiens
uugagcaucugauugguua

SEQ ID NO: 1051830 - RNA, 19 nt, Homo sapiens
ggaagauagugacuugauc

SEQ ID NO: 1051831 - RNA, 19 nt, Homo sapiens
caaaucaggaggcaaagaa

SEQ ID NO: 1051832 - RNA, 19 nt, Homo sapiens
gaagugcacggcugucuau

SEQ ID NO: 1051833 - RNA, 19 nt, Homo sapiens
gauagaagacauaacugaa

SEQ ID NO: 1051834 - RNA, 19 nt, Homo sapiens
gauugcaagugcucacgua

SEQ ID NO: 1051835 - RNA, 19 nt, Homo sapiens
ccaauaacauucgcacaau

SEQ ID NO: 1051836 - RNA, 19 nt, Homo sapiens
gagaaucccacaugcuauu

SEQ ID NO: 1051837 - RNA, 19 nt, Homo sapiens
gaagagagcaguuuuagug

SEQ ID NO: 1051838 - RNA, 19 nt, Homo sapiens
caaaguucccuccaacauu

SEQ ID NO: 1051839 - RNA, 19 nt, Homo sapiens
cagcugcagugaagaagaa

SEQ ID NO: 1051840 - RNA, 19 nt, Homo sapiens
gcucaaaaguagaacauuu

SEQ ID NO: 1051841 - RNA, 19 nt, Homo sapiens
uaaguacuuuccauaccua

SEQ ID NO: 1051842 - RNA, 19 nt, Homo sapiens
caacaaacgacauuuccuu

SEQ ID NO: 1051843 - RNA, 19 nt, Homo sapiens
ggacaacaaacgacauuuc

SEQ ID NO: 1051844 - RNA, 19 nt, Homo sapiens
uugaggaaaucaucaguuu

SEQ ID NO: 1051845 - RNA, 19 nt, Homo sapiens
gaugauaggacuugaaucu

SEQ ID NO: 1051846 - RNA, 19 nt, Homo sapiens
ccaccaacaucccaaagau

SEQ ID NO: 1051847 - RNA, 19 nt, Homo sapiens
uugcuugccugcuaaagua

SEQ ID NO: 1051848 - RNA, 19 nt, Homo sapiens
aaacagagaggaugcauag

SEQ ID NO: 1051849 - RNA, 19 nt, Homo sapiens
gcacccacaauauggcuua

SEQ ID NO: 1051850 - RNA, 19 nt, Homo sapiens
caagaugggcggacaacaa

SEQ ID NO: 1051851 - RNA, 19 nt, Homo sapiens
gcacggcugucuauaacgu

SEQ ID NO: 1051852 - RNA, 19 nt, Homo sapiens
gaacugugagcuagagaga

SEQ ID NO: 1051853 - RNA, 19 nt, Homo sapiens
auaccuagcucuuauacau

SEQ ID NO: 1051854 - RNA, 19 nt, Homo sapiens
ccacauauccucgcacaga

SEQ ID NO: 1051855 - RNA, 19 nt, Homo sapiens
ggaagcagccaccaaccaa

SEQ ID NO: 1051856 - RNA, 19 nt, Homo sapiens
ggaguugcaucuguucaug

SEQ ID NO: 1051857 - RNA, 19 nt, Homo sapiens
gguccaaacaguuaucaaa

SEQ ID NO: 1051858 - RNA, 19 nt, Homo sapiens
ugagaagccugugauugaa

SEQ ID NO: 1051859 - RNA, 19 nt, Homo sapiens
caaaacaugcucaaaagua

SEQ ID NO: 1051860 - RNA, 19 nt, Homo sapiens
ucaaauguguuaccaucug

SEQ ID NO: 1051861 - RNA, 19 nt, Homo sapiens
ggugggauguguuuaugga

SEQ ID NO: 1051862 - RNA, 19 nt, Homo sapiens
ucaccucacucccagagaa

SEQ ID NO: 1051863 - RNA, 19 nt, Homo sapiens
ggagucacuuuauuucucu

SEQ ID NO: 1051864 - RNA, 19 nt, Homo sapiens
cuccacaucuuacaaaguu

SEQ ID NO: 1051865 - RNA, 19 nt, Homo sapiens
guacuuaauaggcaauuug

SEQ ID NO: 1051866 - RNA, 19 nt, Homo sapiens
gaaguucccagcaugacaa

SEQ ID NO: 1051867 - RNA, 19 nt, Homo sapiens
gcaaagaaagagaagaaag

SEQ ID NO: 1051868 - RNA, 19 nt, Homo sapiens
uucagaaccugcagcauuu

SEQ ID NO: 1051869 - RNA, 19 nt, Homo sapiens
aaacucaggcagcacauuu

SEQ ID NO: 1051870 - RNA, 19 nt, Homo sapiens
gagaguugcggcaccuuaa

SEQ ID NO: 1051871 - RNA, 19 nt, Homo sapiens
caaaguugagcaucugauu

SEQ ID NO: 1051872 - RNA, 19 nt, Homo sapiens
ccuagcuguuguuauguua

SEQ ID NO: 1051873 - RNA, 19 nt, Homo sapiens
cagagaggaugcauagaag

SEQ ID NO: 1051874 - RNA, 19 nt, Homo sapiens
gaacaacuuccuagauugc

SEQ ID NO: 1051875 - RNA, 19 nt, Homo sapiens
aauauucccuuugcaaaug

SEQ ID NO: 1051876 - RNA, 19 nt, Homo sapiens
ggaaauuaguuugaaccau

SEQ ID NO: 1051877 - RNA, 19 nt, Homo sapiens
gauugguuaugagguauuu

SEQ ID NO: 1051878 - RNA, 19 nt, Homo sapiens
ucugauugguuaugaggua

SEQ ID NO: 1051879 - RNA, 19 nt, Homo sapiens
cugagaagccugugauuga

SEQ ID NO: 1051880 - RNA, 19 nt, Homo sapiens
caacuuaccgaauccugaa

SEQ ID NO: 1051881 - RNA, 19 nt, Homo sapiens
acagagaggaugcauagaa

SEQ ID NO: 1051882 - RNA, 19 nt, Homo sapiens
gcucacguacaaguuauua

SEQ ID NO: 1051883 - RNA, 19 nt, Homo sapiens
aaacuuggagucacuuuau

SEQ ID NO: 1051884 - RNA, 19 nt, Homo sapiens
acuaaacucuugguacuga

SEQ ID NO: 1051885 - RNA, 19 nt, Homo sapiens
ugauaggacuugaaucucu

SEQ ID NO: 1051886 - RNA, 19 nt, Homo sapiens
cauggucaguagcaacuuu

SEQ ID NO: 1051887 - RNA, 19 nt, Homo sapiens
gaaacucagaugcuuagau

SEQ ID NO: 1051888 - RNA, 19 nt, Homo sapiens
ugaccaaaguucccuccaa

SEQ ID NO: 1051889 - RNA, 19 nt, Homo sapiens
ggacaaggcuucacauaaa

SEQ ID NO: 1051890 - RNA, 19 nt, Homo sapiens
ugacaaaugugcuguguua

SEQ ID NO: 1051891 - RNA, 19 nt, Homo sapiens
aaagggagauuucaguuua

SEQ ID NO: 1051892 - RNA, 19 nt, Homo sapiens
agaaagagguuaugugauu

SEQ ID NO: 1051893 - RNA, 19 nt, Homo sapiens
ccucagaccucuaauguaa

SEQ ID NO: 1051894 - RNA, 19 nt, Homo sapiens
gaagagcaauagaaccuuu

SEQ ID NO: 1051895 - RNA, 19 nt, Homo sapiens
caaaugugcuguguuagua

SEQ ID NO: 1051896 - RNA, 19 nt, Homo sapiens
ggaggcagcugucagaaga

SEQ ID NO: 1051897 - RNA, 19 nt, Homo sapiens
uagaauaacuguuccaaug

SEQ ID NO: 1051898 - RNA, 19 nt, Homo sapiens
uaaaggagguuguucacuu

SEQ ID NO: 1051899 - RNA, 19 nt, Homo sapiens
gaaagacgacguaucagaa

SEQ ID NO: 1051900 - RNA, 19 nt, Homo sapiens
guaaguugguuucaagauu

SEQ ID NO: 1051901 - RNA, 19 nt, Homo sapiens
acacuaagaucguugaaga

SEQ ID NO: 1051902 - RNA, 19 nt, Homo sapiens
ucaagucucugacaaaugu

SEQ ID NO: 1051903 - RNA, 19 nt, Homo sapiens
caugggacauaacuucuua

SEQ ID NO: 1051904 - RNA, 19 nt, Homo sapiens
gaauaacuguuccaaugau

SEQ ID NO: 1051905 - RNA, 19 nt, Homo sapiens
uaaguugguuucaagauug

SEQ ID NO: 1051906 - RNA, 19 nt, Homo sapiens
gaaagagaaagacgacgua

SEQ ID NO: 1051907 - RNA, 19 nt, Homo sapiens
cagaacaaccuacuaugua

SEQ ID NO: 1051908 - RNA, 19 nt, Homo sapiens
ccuacugucuugcauuaua

SEQ ID NO: 1051909 - RNA, 19 nt, Homo sapiens
ugaaauaguugaaguacca

SEQ ID NO: 1051910 - RNA, 19 nt, Homo sapiens
gaaagagguuaugugauuc

SEQ ID NO: 1051911 - RNA, 19 nt, Homo sapiens
ggacaagcccguuucuuuc

SEQ ID NO: 1051912 - RNA, 19 nt, Homo sapiens
ucacaagguucauuuaucu

SEQ ID NO: 1051913 - RNA, 19 nt, Homo sapiens
gaaaaggauucaucagcua

SEQ ID NO: 1051914 - RNA, 19 nt, Homo sapiens
caauagaaccuuuaagaca

SEQ ID NO: 1051915 - RNA, 19 nt, Homo sapiens
uaagaucguugaagagcaa

SEQ ID NO: 1051916 - RNA, 19 nt, Homo sapiens
acacugagguuucuguuca

SEQ ID NO: 1051917 - RNA, 19 nt, Homo sapiens
gggacaaggcuucacauaa

SEQ ID NO: 1051918 - RNA, 19 nt, Homo sapiens
ggucagaucaugggacaua

SEQ ID NO: 1051919 - RNA, 19 nt, Homo sapiens
gcaagaaccgcuacgacaa

SEQ ID NO: 1051920 - RNA, 19 nt, Homo sapiens
ugaguucuguucuuuguga

SEQ ID NO: 1051921 - RNA, 19 nt, Homo sapiens
ucagaaagagguuauguga

SEQ ID NO: 1051922 - RNA, 19 nt, Homo sapiens
gcacagcagcgaugcagaa

SEQ ID NO: 1051923 - RNA, 19 nt, Homo sapiens
guacugagccacaugacaa

SEQ ID NO: 1051924 - RNA, 19 nt, Homo sapiens
uacugaauguggagauuua

SEQ ID NO: 1051925 - RNA, 19 nt, Homo sapiens
cuacugucuugcauuauaa

SEQ ID NO: 1051926 - RNA, 19 nt, Homo sapiens
gaucaugggacauaacuuc

SEQ ID NO: 1051927 - RNA, 19 nt, Homo sapiens
uuaaaggugugaagcaaug

SEQ ID NO: 1051928 - RNA, 19 nt, Homo sapiens
acugggaccugaucuauga

SEQ ID NO: 1051929 - RNA, 19 nt, Homo sapiens
caccaucacuguaacuguu

SEQ ID NO: 1051930 - RNA, 19 nt, Homo sapiens
agagaaagacgacguauca

SEQ ID NO: 1051931 - RNA, 19 nt, Homo sapiens
ggccaaagcuacaaaagaa

SEQ ID NO: 1051932 - RNA, 19 nt, Homo sapiens
uauguaaagucacaagguu

SEQ ID NO: 1051933 - RNA, 19 nt, Homo sapiens
guuaguagaguuugauuug

SEQ ID NO: 1051934 - RNA, 19 nt, Homo sapiens
aaagauaaauuggcaaguc

SEQ ID NO: 1051935 - RNA, 19 nt, Homo sapiens
guuaugugauucuaccaaa

SEQ ID NO: 1051936 - RNA, 19 nt, Homo sapiens
ugaugcugcuauuggauua

SEQ ID NO: 1051937 - RNA, 19 nt, Homo sapiens
guaaagagaaugagaacag

SEQ ID NO: 1051938 - RNA, 19 nt, Homo sapiens
uuccacaaguuuccucuua

SEQ ID NO: 1051939 - RNA, 19 nt, Homo sapiens
guggagauuuaaacacuga

SEQ ID NO: 1051940 - RNA, 19 nt, Homo sapiens
gaucaauaacuucagauuc

SEQ ID NO: 1051941 - RNA, 19 nt, Homo sapiens
caagguucauuuaucuuuc

SEQ ID NO: 1051942 - RNA, 19 nt, Homo sapiens
gaaugagaacaguguggua

SEQ ID NO: 1051943 - RNA, 19 nt, Homo sapiens
aaaggagguuguucacuuc

SEQ ID NO: 1051944 - RNA, 19 nt, Homo sapiens
augauaaucuugcacuuga

SEQ ID NO: 1051945 - RNA, 19 nt, Homo sapiens
ccagguugaugcugcuauu

SEQ ID NO: 1051946 - RNA, 19 nt, Homo sapiens
ucuaccaaaugacuacuuu

SEQ ID NO: 1051947 - RNA, 19 nt, Homo sapiens
gcugugguccuucugcuaa

SEQ ID NO: 1051948 - RNA, 19 nt, Homo sapiens
aagauaaauuggcaaguca

SEQ ID NO: 1051949 - RNA, 19 nt, Homo sapiens
uaaagagaaugagaacagu

SEQ ID NO: 1051950 - RNA, 19 nt, Homo sapiens
ucagaccucuaauguaagu

SEQ ID NO: 1051951 - RNA, 19 nt, Homo sapiens
caacuauacuguggaggau

SEQ ID NO: 1051952 - RNA, 19 nt, Homo sapiens
gcaauagaaccuuuaagac

SEQ ID NO: 1051953 - RNA, 19 nt, Homo sapiens
ugagccacaugacaagaaa

SEQ ID NO: 1051954 - RNA, 19 nt, Homo sapiens
guauagcaguauuuguuca

SEQ ID NO: 1051955 - RNA, 19 nt, Homo sapiens
agaauaacuguuccaauga

SEQ ID NO: 1051956 - RNA, 19 nt, Homo sapiens
gaauguggagauuuaaaca

SEQ ID NO: 1051957 - RNA, 19 nt, Homo sapiens
ucucauauguaaagucaca

SEQ ID NO: 1051958 - RNA, 19 nt, Homo sapiens
caacaaaacgggcacacua

SEQ ID NO: 1051959 - RNA, 19 nt, Homo sapiens
aaaguacacuaagaucguu

SEQ ID NO: 1051960 - RNA, 19 nt, Homo sapiens
ucagaacaaccuacuaugu

SEQ ID NO: 1051961 - RNA, 19 nt, Homo sapiens
gacaaggcuucacauaaaa

SEQ ID NO: 1051962 - RNA, 19 nt, Homo sapiens
gucacaagguucauuuauc

SEQ ID NO: 1051963 - RNA, 19 nt, Homo sapiens
gcuagaacagcaaguugaa

SEQ ID NO: 1051964 - RNA, 19 nt, Homo sapiens
caccaaguauagcaguauu

SEQ ID NO: 1051965 - RNA, 19 nt, Homo sapiens
aggacaagcccguuucuuu

SEQ ID NO: 1051966 - RNA, 19 nt, Homo sapiens
aagggagauuucaguuuaa

SEQ ID NO: 1051967 - RNA, 19 nt, Homo sapiens
uaguugaaguaccagcaua

SEQ ID NO: 1051968 - RNA, 19 nt, Homo sapiens
aaagacgacguaucagaaa

SEQ ID NO: 1051969 - RNA, 19 nt, Homo sapiens
guuguucacuuccagaaag

SEQ ID NO: 1051970 - RNA, 19 nt, Homo sapiens
ccacaaguuuccucuuacu

SEQ ID NO: 1051971 - RNA, 19 nt, Homo sapiens
uauuaaaggugugaagcaa

SEQ ID NO: 1051972 - RNA, 19 nt, Homo sapiens
gaaccuuuaagacaguauu

SEQ ID NO: 1051973 - RNA, 19 nt, Homo sapiens
caaaguacacuaagaucgu

SEQ ID NO: 1051974 - RNA, 19 nt, Homo sapiens
uuauguaucugccuucaag

SEQ ID NO: 1051975 - RNA, 19 nt, Homo sapiens
aaagucacaagguucauuu

SEQ ID NO: 1051976 - RNA, 19 nt, Homo sapiens
uaccacauauccuccucua

SEQ ID NO: 1051977 - RNA, 19 nt, Homo sapiens
gaggccaccaucacuguaa

SEQ ID NO: 1051978 - RNA, 19 nt, Homo sapiens
agaaagacgacguaucaga

SEQ ID NO: 1051979 - RNA, 19 nt, Homo sapiens
gguugaugcugcuauugga

SEQ ID NO: 1051980 - RNA, 19 nt, Homo sapiens
ccaaguauagcaguauuug

SEQ ID NO: 1051981 - RNA, 19 nt, Homo sapiens
gagcgcagcgacacugaga

SEQ ID NO: 1051982 - RNA, 19 nt, Homo sapiens
cacccuagcugaaggacau

SEQ ID NO: 1051983 - RNA, 19 nt, Homo sapiens
gacaaggacaagcccguuu

SEQ ID NO: 1051984 - RNA, 19 nt, Homo sapiens
acuccagacugcuuuaaga

SEQ ID NO: 1051985 - RNA, 19 nt, Homo sapiens
uaaauuggcaagucaguac

SEQ ID NO: 1051986 - RNA, 19 nt, Homo sapiens
guguauugauuucuaaugg

SEQ ID NO: 1051987 - RNA, 19 nt, Homo sapiens
uaagagagagugcaacaac

SEQ ID NO: 1051988 - RNA, 19 nt, Homo sapiens
aaauauugcuaugggaguu

SEQ ID NO: 1051989 - RNA, 19 nt, Homo sapiens
gaagugauguuuccaaaga

SEQ ID NO: 1051990 - RNA, 19 nt, Homo sapiens
gaaaauggguguugacuga

SEQ ID NO: 1051991 - RNA, 19 nt, Homo sapiens
aagaggagcugcuguuuga

SEQ ID NO: 1051992 - RNA, 19 nt, Homo sapiens
gugcauggauugcuucauu

SEQ ID NO: 1051993 - RNA, 19 nt, Homo sapiens
gagcuguaguucccguuua

SEQ ID NO: 1051994 - RNA, 19 nt, Homo sapiens
gaaacaagaaugacaagug

SEQ ID NO: 1051995 - RNA, 19 nt, Homo sapiens
aaacaagaaugacaagugu

SEQ ID NO: 1051996 - RNA, 19 nt, Homo sapiens
gaagaaacaagaaugacaa

SEQ ID NO: 1051997 - RNA, 19 nt, Homo sapiens
ggagcaaccuucaagagau

SEQ ID NO: 1051998 - RNA, 19 nt, Homo sapiens
gaaccaauccuggcauuau

SEQ ID NO: 1051999 - RNA, 19 nt, Homo sapiens
gacacggucuuucuuauuc

SEQ ID NO: 1052000 - RNA, 19 nt, Homo sapiens
gugcucuacuugugauuua

SEQ ID NO: 1052001 - RNA, 19 nt, Homo sapiens
gggaggagcacagauauuu

SEQ ID NO: 1052002 - RNA, 19 nt, Homo sapiens
ggacacggucuuucuuauu

SEQ ID NO: 1052003 - RNA, 19 nt, Homo sapiens
ugaauuugaugaagugaug

SEQ ID NO: 1052004 - RNA, 19 nt, Homo sapiens
gagcugcuguuugaauuau

SEQ ID NO: 1052005 - RNA, 19 nt, Homo sapiens
gcugaugggucuuguucuu

SEQ ID NO: 1052006 - RNA, 19 nt, Homo sapiens
gaggaagaaacaagaauga

SEQ ID NO: 1052007 - RNA, 19 nt, Homo sapiens
gagcaaccuucaagagauc

SEQ ID NO: 1052008 - RNA, 19 nt, Homo sapiens
ccaccaaccagacuacuaa

SEQ ID NO: 1052009 - RNA, 19 nt, Homo sapiens
guacaccugggaaguauuu

SEQ ID NO: 1052010 - RNA, 19 nt, Homo sapiens
caagagaaaucugcaggau

SEQ ID NO: 1052011 - RNA, 19 nt, Homo sapiens
ggaagaaacaagaaugaca

SEQ ID NO: 1052012 - RNA, 19 nt, Homo sapiens
uuacaucgaugaccuugga

SEQ ID NO: 1052013 - RNA, 19 nt, Homo sapiens
aaccaauccuggcauuaua

SEQ ID NO: 1052014 - RNA, 19 nt, Homo sapiens
gaguacaccugggaaguau

SEQ ID NO: 1052015 - RNA, 19 nt, Homo sapiens
gaaaacccauagcuugaaa

SEQ ID NO: 1052016 - RNA, 19 nt, Homo sapiens
ggagcugcuguuugaauua

SEQ ID NO: 1052017 - RNA, 19 nt, Homo sapiens
gauuucugcugugcuuaua

SEQ ID NO: 1052018 - RNA, 19 nt, Homo sapiens
ccaggagacuuacaucgau

SEQ ID NO: 1052019 - RNA, 19 nt, Homo sapiens
gaaaccacaccuucauugu

SEQ ID NO: 1052020 - RNA, 19 nt, Homo sapiens
gagaaaccacaccuucauu

SEQ ID NO: 1052021 - RNA, 19 nt, Homo sapiens
ucagguacuuccucaucua

SEQ ID NO: 1052022 - RNA, 19 nt, Homo sapiens
uuauguggguguugaauug

SEQ ID NO: 1052023 - RNA, 19 nt, Homo sapiens
cugcugugcuuauaaauca

SEQ ID NO: 1052024 - RNA, 19 nt, Homo sapiens
ugacugccuuugagcugua

SEQ ID NO: 1052025 - RNA, 19 nt, Homo sapiens
caacucuugucgucuuaug

SEQ ID NO: 1052026 - RNA, 19 nt, Homo sapiens
ugaugggucuuguucuuau

SEQ ID NO: 1052027 - RNA, 19 nt, Homo sapiens
gaaaauuacccaaccaaga

SEQ ID NO: 1052028 - RNA, 19 nt, Homo sapiens
uguaguucccguuuauuua

SEQ ID NO: 1052029 - RNA, 19 nt, Homo sapiens
ggaaccaauccuggcauua

SEQ ID NO: 1052030 - RNA, 19 nt, Homo sapiens
gcaggagggucucauugac

SEQ ID NO: 1052031 - RNA, 19 nt, Homo sapiens
caagaggagcugcuguuug

SEQ ID NO: 1052032 - RNA, 19 nt, Homo sapiens
gucaggagcuggaguuguc

SEQ ID NO: 1052033 - RNA, 19 nt, Homo sapiens
ugcauggauugcuucauua

SEQ ID NO: 1052034 - RNA, 19 nt, Homo sapiens
guggcuaccuguuguuugu

SEQ ID NO: 1052035 - RNA, 19 nt, Homo sapiens
gugaggugcucuacuugug

SEQ ID NO: 1052036 - RNA, 19 nt, Homo sapiens
agagagccgugcauggauu

SEQ ID NO: 1052037 - RNA, 19 nt, Homo sapiens
ggugaugucagauuuauac

SEQ ID NO: 1052038 - RNA, 19 nt, Homo sapiens
guggugaugucagauuuau

SEQ ID NO: 1052039 - RNA, 19 nt, Homo sapiens
gaggagcugcuguuugaau

SEQ ID NO: 1052040 - RNA, 19 nt, Homo sapiens
aagaaugacaaguguauga

SEQ ID NO: 1052041 - RNA, 19 nt, Homo sapiens
acaagaaugacaaguguau

SEQ ID NO: 1052042 - RNA, 19 nt, Homo sapiens
gaggugcucuacuugugau

SEQ ID NO: 1052043 - RNA, 19 nt, Homo sapiens
ugcaagggaugguuuauac

SEQ ID NO: 1052044 - RNA, 19 nt, Homo sapiens
ugaguacaccugggaagua

SEQ ID NO: 1052045 - RNA, 19 nt, Homo sapiens
aagggaugguuuauacuga

SEQ ID NO: 1052046 - RNA, 19 nt, Homo sapiens
ucucugaccugugugaugu

SEQ ID NO: 1052047 - RNA, 19 nt, Homo sapiens
uuucugcugugcuuauaaa

SEQ ID NO: 1052048 - RNA, 19 nt, Homo sapiens
gagaggaagaaacaagaau

SEQ ID NO: 1052049 - RNA, 19 nt, Homo sapiens
caaguccaccggaacauuc

SEQ ID NO: 1052050 - RNA, 19 nt, Homo sapiens
cgucuuauguggguguuga

SEQ ID NO: 1052051 - RNA, 19 nt, Homo sapiens
gguggugaugucagauuua

SEQ ID NO: 1052052 - RNA, 19 nt, Homo sapiens
caagggaugguuuauacug

SEQ ID NO: 1052053 - RNA, 19 nt, Homo sapiens
uccagaaugucuucagaga

SEQ ID NO: 1052054 - RNA, 19 nt, Homo sapiens
ugaaaccgggcaucucuga

SEQ ID NO: 1052055 - RNA, 19 nt, Homo sapiens
ccaagaggagcugcuguuu

SEQ ID NO: 1052056 - RNA, 19 nt, Homo sapiens
agaaaccacaccuucauug

SEQ ID NO: 1052057 - RNA, 19 nt, Homo sapiens
ucagagagccgugcaugga

SEQ ID NO: 1052058 - RNA, 19 nt, Homo sapiens
acacacugcugcccaagag

SEQ ID NO: 1052059 - RNA, 19 nt, Homo sapiens
aacgugaggugcucuacuu

SEQ ID NO: 1052060 - RNA, 19 nt, Homo sapiens
gaugaagugauguuuccaa

SEQ ID NO: 1052061 - RNA, 19 nt, Homo sapiens
gccuggcugugcucucuuu

SEQ ID NO: 1052062 - RNA, 19 nt, Homo sapiens
aggagcugcuguuugaauu

SEQ ID NO: 1052063 - RNA, 19 nt, Homo sapiens
cugcaacucuugucgucuu

SEQ ID NO: 1052064 - RNA, 19 nt, Homo sapiens
guaguucccguuuauuuac

SEQ ID NO: 1052065 - RNA, 19 nt, Homo sapiens
cgagaaaccacaccuucau

SEQ ID NO: 1052066 - RNA, 19 nt, Homo sapiens
gaaaccgggcaucucugaa

SEQ ID NO: 1052067 - RNA, 19 nt, Homo sapiens
ccaaccagacuacuaacga

SEQ ID NO: 1052068 - RNA, 19 nt, Homo sapiens
gcugggcuuugucgugguu

SEQ ID NO: 1052069 - RNA, 19 nt, Homo sapiens
auuuauaccaggagacuua

SEQ ID NO: 1052070 - RNA, 19 nt, Homo sapiens
ggaguuguccuugcauuac

SEQ ID NO: 1052071 - RNA, 19 nt, Homo sapiens
ucuaaacucugggcaugug

SEQ ID NO: 1052072 - RNA, 19 nt, Homo sapiens
cuaccugccuuuccauguc

SEQ ID NO: 1052073 - RNA, 19 nt, Homo sapiens
agacuacuaacgaguggua

SEQ ID NO: 1052074 - RNA, 19 nt, Homo sapiens
uggacacggucuuucuuau

SEQ ID NO: 1052075 - RNA, 19 nt, Homo sapiens
augaagugauguuuccaaa

SEQ ID NO: 1052076 - RNA, 19 nt, Homo sapiens
uggaaccaauccuggcauu

SEQ ID NO: 1052077 - RNA, 19 nt, Homo sapiens
gaauuaucugugaauguug

SEQ ID NO: 1052078 - RNA, 19 nt, Homo sapiens
ucaaggggaucaagagaug

SEQ ID NO: 1052079 - RNA, 19 nt, Homo sapiens
cggagcaaccuucaagaga

SEQ ID NO: 1052080 - RNA, 19 nt, Homo sapiens
caucagguacuuccucauc

SEQ ID NO: 1052081 - RNA, 19 nt, Homo sapiens
ggauugcuucauuaccuuu

SEQ ID NO: 1052082 - RNA, 19 nt, Homo sapiens
ccuguuguuuguccuguau

SEQ ID NO: 1052083 - RNA, 19 nt, Homo sapiens
ucaucuacgucuugaccuu

SEQ ID NO: 1052084 - RNA, 19 nt, Homo sapiens
ggaaaccagcucgauccaa

SEQ ID NO: 1052085 - RNA, 19 nt, Homo sapiens
cuacuugugauuuaaggaa

SEQ ID NO: 1052086 - RNA, 19 nt, Homo sapiens
guccuugcauuaccuucuu

SEQ ID NO: 1052087 - RNA, 19 nt, Homo sapiens
uggaguuguccuugcauua

SEQ ID NO: 1052088 - RNA, 19 nt, Homo sapiens
gggaugguuuauacugagu

SEQ ID NO: 1052089 - RNA, 19 nt, Homo sapiens
gaacugaccucucuccuuu

SEQ ID NO: 1052090 - RNA, 19 nt, Homo sapiens
guaaaucaguggcacagua

SEQ ID NO: 1052091 - RNA, 19 nt, Homo sapiens
gcuggaagcucccuauaaa

SEQ ID NO: 1052092 - RNA, 19 nt, Homo sapiens
gaucggaacucacgucguu

SEQ ID NO: 1052093 - RNA, 19 nt, Homo sapiens
caacaaaggaaagaaguua

SEQ ID NO: 1052094 - RNA, 19 nt, Homo sapiens
caauaucacugaagacaug

SEQ ID NO: 1052095 - RNA, 19 nt, Homo sapiens
gaguaugccuuuccaguau

SEQ ID NO: 1052096 - RNA, 19 nt, Homo sapiens
ggaaggccauagggcauua

SEQ ID NO: 1052097 - RNA, 19 nt, Homo sapiens
gagcaaagccaccaguuga

SEQ ID NO: 1052098 - RNA, 19 nt, Homo sapiens
gagggaggcugcuacucua

SEQ ID NO: 1052099 - RNA, 19 nt, Homo sapiens
agagugaucuguccuguga

SEQ ID NO: 1052100 - RNA, 19 nt, Homo sapiens
gggagugccuaucauugua

SEQ ID NO: 1052101 - RNA, 19 nt, Homo sapiens
ggaguaugccuuuccagua

SEQ ID NO: 1052102 - RNA, 19 nt, Homo sapiens
uaagaguccucauuucaga

SEQ ID NO: 1052103 - RNA, 19 nt, Homo sapiens
gcauggacgugcauugaga

SEQ ID NO: 1052104 - RNA, 19 nt, Homo sapiens
gauaauauuguccugauga

SEQ ID NO: 1052105 - RNA, 19 nt, Homo sapiens
gugaggaucgugugcauua

SEQ ID NO: 1052106 - RNA, 19 nt, Homo sapiens
ccucaacccuggcaauuau

SEQ ID NO: 1052107 - RNA, 19 nt, Homo sapiens
ugaaggaacugaccucucu

SEQ ID NO: 1052108 - RNA, 19 nt, Homo sapiens
ucagggagccaguugauaa

SEQ ID NO: 1052109 - RNA, 19 nt, Homo sapiens
caagaggacugaguuugug

SEQ ID NO: 1052110 - RNA, 19 nt, Homo sapiens
cgguauagacggagaaaua

SEQ ID NO: 1052111 - RNA, 19 nt, Homo sapiens
ccucagaccuuagcuugaa

SEQ ID NO: 1052112 - RNA, 19 nt, Homo sapiens
gaagccagccucagaccuu

SEQ ID NO: 1052113 - RNA, 19 nt, Homo sapiens
gaaccuugccucccagugu

SEQ ID NO: 1052114 - RNA, 19 nt, Homo sapiens
gcucuaaagguuaugguuu

SEQ ID NO: 1052115 - RNA, 19 nt, Homo sapiens
ccaggaggccucagaguga

SEQ ID NO: 1052116 - RNA, 19 nt, Homo sapiens
ggcauuaacugaaggaacu

SEQ ID NO: 1052117 - RNA, 19 nt, Homo sapiens
gcugcugccuugcaacuga

SEQ ID NO: 1052118 - RNA, 19 nt, Homo sapiens
gaaggugcucuuucugcua

SEQ ID NO: 1052119 - RNA, 19 nt, Homo sapiens
uaaagguuaugguuucauc

SEQ ID NO: 1052120 - RNA, 19 nt, Homo sapiens
gggaagaggaggcgcugua

SEQ ID NO: 1052121 - RNA, 19 nt, Homo sapiens
gaaucaagaggacugaguu

SEQ ID NO: 1052122 - RNA, 19 nt, Homo sapiens
cuuagugauuccucaauuu

SEQ ID NO: 1052123 - RNA, 19 nt, Homo sapiens
ccauguguaucgucucuga

SEQ ID NO: 1052124 - RNA, 19 nt, Homo sapiens
gaaauuggggccacccuua

SEQ ID NO: 1052125 - RNA, 19 nt, Homo sapiens
acaguaagaguccucauuu

SEQ ID NO: 1052126 - RNA, 19 nt, Homo sapiens
gcaacaaaggaaagaaguu

SEQ ID NO: 1052127 - RNA, 19 nt, Homo sapiens
caucuuccuuuguauacuu

SEQ ID NO: 1052128 - RNA, 19 nt, Homo sapiens
uaucuuccaucuuccuuug

SEQ ID NO: 1052129 - RNA, 19 nt, Homo sapiens
uccaguaucuuccaucuuc

SEQ ID NO: 1052130 - RNA, 19 nt, Homo sapiens
gauacaggccgcucuaaag

SEQ ID NO: 1052131 - RNA, 19 nt, Homo sapiens
gaugaaggacucagauaca

SEQ ID NO: 1052132 - RNA, 19 nt, Homo sapiens
gcauggaagugaucuaucc

SEQ ID NO: 1052133 - RNA, 19 nt, Homo sapiens
uaggaccucugaaucaaga

SEQ ID NO: 1052134 - RNA, 19 nt, Homo sapiens
ccuuuaaccuuuagucugu

SEQ ID NO: 1052135 - RNA, 19 nt, Homo sapiens
ccuguaccuuuaaccuuua

SEQ ID NO: 1052136 - RNA, 19 nt, Homo sapiens
ggaacugaccucucuccuu

SEQ ID NO: 1052137 - RNA, 19 nt, Homo sapiens
cauugucucugaggaaauu

SEQ ID NO: 1052138 - RNA, 19 nt, Homo sapiens
gaagaggaugagcaacaaa

SEQ ID NO: 1052139 - RNA, 19 nt, Homo sapiens
ggagggaggcugcuacucu

SEQ ID NO: 1052140 - RNA, 19 nt, Homo sapiens
acaggccgcucuaaagguu

SEQ ID NO: 1052141 - RNA, 19 nt, Homo sapiens
caagggcccugggagauag

SEQ ID NO: 1052142 - RNA, 19 nt, Homo sapiens
ccacuugccacugguuaua

SEQ ID NO: 1052143 - RNA, 19 nt, Homo sapiens
agaagaggaugagcaacaa

SEQ ID NO: 1052144 - RNA, 19 nt, Homo sapiens
ucccugcacuucaauauca

SEQ ID NO: 1052145 - RNA, 19 nt, Homo sapiens
gaccaaugcgccucuaugu

SEQ ID NO: 1052146 - RNA, 19 nt, Homo sapiens
aggcaagguucgcgaugua

SEQ ID NO: 1052147 - RNA, 19 nt, Homo sapiens
gguagugagucgcgaaguc

SEQ ID NO: 1052148 - RNA, 19 nt, Homo sapiens
cauagggcauuaacugaag

SEQ ID NO: 1052149 - RNA, 19 nt, Homo sapiens
uaaaucaguggcacaguau

SEQ ID NO: 1052150 - RNA, 19 nt, Homo sapiens
guuaugguuucaucacguu

SEQ ID NO: 1052151 - RNA, 19 nt, Homo sapiens
ggaccaaugcgccucuaug

SEQ ID NO: 1052152 - RNA, 19 nt, Homo sapiens
ggagccaguugauaaucug

SEQ ID NO: 1052153 - RNA, 19 nt, Homo sapiens
ucaagaggacugaguuugu

SEQ ID NO: 1052154 - RNA, 19 nt, Homo sapiens
caguaagaguccucauuuc

SEQ ID NO: 1052155 - RNA, 19 nt, Homo sapiens
ccuugugucuguguacaua

SEQ ID NO: 1052156 - RNA, 19 nt, Homo sapiens
gagcccuucucacuggauu

SEQ ID NO: 1052157 - RNA, 19 nt, Homo sapiens
uccuguaccuuuaaccuuu

SEQ ID NO: 1052158 - RNA, 19 nt, Homo sapiens
ccuuagugauuccucaauu

SEQ ID NO: 1052159 - RNA, 19 nt, Homo sapiens
caaagccaccaguugaaga

SEQ ID NO: 1052160 - RNA, 19 nt, Homo sapiens
cgugaugcccgcacaguuu

SEQ ID NO: 1052161 - RNA, 19 nt, Homo sapiens
gggagccaguugauaaucu

SEQ ID NO: 1052162 - RNA, 19 nt, Homo sapiens
uuauagauauggacacagu

SEQ ID NO: 1052163 - RNA, 19 nt, Homo sapiens
gugucuguguacauaaaua

SEQ ID NO: 1052164 - RNA, 19 nt, Homo sapiens
gguuauagauauggacaca

SEQ ID NO: 1052165 - RNA, 19 nt, Homo sapiens
gagacaagcaaucguaguc

SEQ ID NO: 1052166 - RNA, 19 nt, Homo sapiens
aagccagccucagaccuua

SEQ ID NO: 1052167 - RNA, 19 nt, Homo sapiens
ccauagggcauuaacugaa

SEQ ID NO: 1052168 - RNA, 19 nt, Homo sapiens
ucuuugagcccuuugguaa

SEQ ID NO: 1052169 - RNA, 19 nt, Homo sapiens
uuuauacccuugugucugu

SEQ ID NO: 1052170 - RNA, 19 nt, Homo sapiens
cagcaacaguggcaaugag

SEQ ID NO: 1052171 - RNA, 19 nt, Homo sapiens
guuugugggugaaccuuga

SEQ ID NO: 1052172 - RNA, 19 nt, Homo sapiens
uacguggaauucugugaaa

SEQ ID NO: 1052173 - RNA, 19 nt, Homo sapiens
gagcaacaaaggaaagaag

SEQ ID NO: 1052174 - RNA, 19 nt, Homo sapiens
gaggaugagcaacaaagga

SEQ ID NO: 1052175 - RNA, 19 nt, Homo sapiens
ggccauagggcauuaacug

SEQ ID NO: 1052176 - RNA, 19 nt, Homo sapiens
gcaaagccaccaguugaag

SEQ ID NO: 1052177 - RNA, 19 nt, Homo sapiens
gcacagacaucacuuuucc

SEQ ID NO: 1052178 - RNA, 19 nt, Homo sapiens
ucugugaaauccagucugu

SEQ ID NO: 1052179 - RNA, 19 nt, Homo sapiens
cgaauucggccucgagauc

SEQ ID NO: 1052180 - RNA, 19 nt, Homo sapiens
ggaccaucgucgugaggau

SEQ ID NO: 1052181 - RNA, 19 nt, Homo sapiens
cacaacauacucaaaggaa

SEQ ID NO: 1052182 - RNA, 19 nt, Homo sapiens
acaagggcccugggagaua

SEQ ID NO: 1052183 - RNA, 19 nt, Homo sapiens
cccuuaagauaccaagaaa

SEQ ID NO: 1052184 - RNA, 19 nt, Homo sapiens
gaucagcagguggacguuu

SEQ ID NO: 1052185 - RNA, 19 nt, Homo sapiens
ugacuuugacauagugauu

SEQ ID NO: 1052186 - RNA, 19 nt, Homo sapiens
gccauagggcauuaacuga

SEQ ID NO: 1052187 - RNA, 19 nt, Homo sapiens
ggaauccaacugccaagca

SEQ ID NO: 1052188 - RNA, 19 nt, Homo sapiens
ccacaacauacucaaagga

SEQ ID NO: 1052189 - RNA, 19 nt, Homo sapiens
gaaaacagauccugacuua

SEQ ID NO: 1052190 - RNA, 19 nt, Homo sapiens
ugacuuagcuuacuugaaa

SEQ ID NO: 1052191 - RNA, 19 nt, Homo sapiens
gcaaauuggugucuuguuu

SEQ ID NO: 1052192 - RNA, 19 nt, Homo sapiens
gaaagacacugccaccuau

SEQ ID NO: 1052193 - RNA, 19 nt, Homo sapiens
ggaaaugccuugugauaca

SEQ ID NO: 1052194 - RNA, 19 nt, Homo sapiens
ggucauagcuuagaaagga

SEQ ID NO: 1052195 - RNA, 19 nt, Homo sapiens
caaauuacuuccugacaaa

SEQ ID NO: 1052196 - RNA, 19 nt, Homo sapiens
gaacauugauggaauaggu

SEQ ID NO: 1052197 - RNA, 19 nt, Homo sapiens
gcagagggcuccguucaaa

SEQ ID NO: 1052198 - RNA, 19 nt, Homo sapiens
gcaaauuacuuccugacaa

SEQ ID NO: 1052199 - RNA, 19 nt, Homo sapiens
agacugaacuuaaagacua

SEQ ID NO: 1052200 - RNA, 19 nt, Homo sapiens
caaagaggauguuccagaa

SEQ ID NO: 1052201 - RNA, 19 nt, Homo sapiens
gaagcaagccuuuguuaug

SEQ ID NO: 1052202 - RNA, 19 nt, Homo sapiens
gagaacauuugcccguaua

SEQ ID NO: 1052203 - RNA, 19 nt, Homo sapiens
uggaugggaugcaguauua

SEQ ID NO: 1052204 - RNA, 19 nt, Homo sapiens
gcggagagauuaacagaug

SEQ ID NO: 1052205 - RNA, 19 nt, Homo sapiens
gcacucaggcuccuaauug

SEQ ID NO: 1052206 - RNA, 19 nt, Homo sapiens
gauaugagaucucuuuaac

SEQ ID NO: 1052207 - RNA, 19 nt, Homo sapiens
gagguuuggucauagcuua

SEQ ID NO: 1052208 - RNA, 19 nt, Homo sapiens
gagaggacauucagcaguu

SEQ ID NO: 1052209 - RNA, 19 nt, Homo sapiens
caagagauuugcugaugaa

SEQ ID NO: 1052210 - RNA, 19 nt, Homo sapiens
caagagaccuuauccugau

SEQ ID NO: 1052211 - RNA, 19 nt, Homo sapiens
gaaguuaucaaaccugaaa

SEQ ID NO: 1052212 - RNA, 19 nt, Homo sapiens
gaaaauguauggagaucua

SEQ ID NO: 1052213 - RNA, 19 nt, Homo sapiens
gcagaacagugaaccaugu

SEQ ID NO: 1052214 - RNA, 19 nt, Homo sapiens
uggaagagauuacaaacaa

SEQ ID NO: 1052215 - RNA, 19 nt, Homo sapiens
gaaguccucuggauuucuu

SEQ ID NO: 1052216 - RNA, 19 nt, Homo sapiens
acacaguucuggcuuauga

SEQ ID NO: 1052217 - RNA, 19 nt, Homo sapiens
cagcaucuguguauucauu

SEQ ID NO: 1052218 - RNA, 19 nt, Homo sapiens
acgaggagcuggagaauga

SEQ ID NO: 1052219 - RNA, 19 nt, Homo sapiens
uaacgacuaugagaucuuu

SEQ ID NO: 1052220 - RNA, 19 nt, Homo sapiens
caauaguaccgaucaguua

SEQ ID NO: 1052221 - RNA, 19 nt, Homo sapiens
gcggaacauugauggaaua

SEQ ID NO: 1052222 - RNA, 19 nt, Homo sapiens
caaauuggugucuuguuua

SEQ ID NO: 1052223 - RNA, 19 nt, Homo sapiens
gaugaaggcacgguuguua

SEQ ID NO: 1052224 - RNA, 19 nt, Homo sapiens
gcaggaauuuguuuagcuu

SEQ ID NO: 1052225 - RNA, 19 nt, Homo sapiens
ggagacacaccuugaugua

SEQ ID NO: 1052226 - RNA, 19 nt, Homo sapiens
agacaguguuuaagaauga

SEQ ID NO: 1052227 - RNA, 19 nt, Homo sapiens
uggaauaggugaucaggaa

SEQ ID NO: 1052228 - RNA, 19 nt, Homo sapiens
gaaauuguuacuggacuua

SEQ ID NO: 1052229 - RNA, 19 nt, Homo sapiens
gaaguccuuucaguugaua

SEQ ID NO: 1052230 - RNA, 19 nt, Homo sapiens
gggaaguccuuucaguuga

SEQ ID NO: 1052231 - RNA, 19 nt, Homo sapiens
acaaugauuugaagacuga

SEQ ID NO: 1052232 - RNA, 19 nt, Homo sapiens
gaugaacuaggccuuauaa

SEQ ID NO: 1052233 - RNA, 19 nt, Homo sapiens
ccacuucccuaacgacuau

SEQ ID NO: 1052234 - RNA, 19 nt, Homo sapiens
cagcuagaguggaguauga

SEQ ID NO: 1052235 - RNA, 19 nt, Homo sapiens
gcacgguuguuaagagaga

SEQ ID NO: 1052236 - RNA, 19 nt, Homo sapiens
gaacuuaaagacuaucuca

SEQ ID NO: 1052237 - RNA, 19 nt, Homo sapiens
gaagaaccagcaggaauuu

SEQ ID NO: 1052238 - RNA, 19 nt, Homo sapiens
ucuuggaggugauguguua

SEQ ID NO: 1052239 - RNA, 19 nt, Homo sapiens
gggccaccauguauauuaa

SEQ ID NO: 1052240 - RNA, 19 nt, Homo sapiens
ggagaacauuugcccguau

SEQ ID NO: 1052241 - RNA, 19 nt, Homo sapiens
agacacaccuugauguaug

SEQ ID NO: 1052242 - RNA, 19 nt, Homo sapiens
aagcaagccuuuguuauga

SEQ ID NO: 1052243 - RNA, 19 nt, Homo sapiens
agucaaagccucaaagaaa

SEQ ID NO: 1052244 - RNA, 19 nt, Homo sapiens
gagaugaacuaggccuuau

SEQ ID NO: 1052245 - RNA, 19 nt, Homo sapiens
gaauuucaguacuguagug

SEQ ID NO: 1052246 - RNA, 19 nt, Homo sapiens
gaaagcaaauuggugucuu

SEQ ID NO: 1052247 - RNA, 19 nt, Homo sapiens
ucauggaagucacaaacua

SEQ ID NO: 1052248 - RNA, 19 nt, Homo sapiens
ccacagacuucgccagugu

SEQ ID NO: 1052249 - RNA, 19 nt, Homo sapiens
gaacucauuugugaauaca

SEQ ID NO: 1052250 - RNA, 19 nt, Homo sapiens
gcaauaaguacaaugacaa

SEQ ID NO: 1052251 - RNA, 19 nt, Homo sapiens
gccaccauguauauuaaua

SEQ ID NO: 1052252 - RNA, 19 nt, Homo sapiens
gguaaauucuggcaauaag

SEQ ID NO: 1052253 - RNA, 19 nt, Homo sapiens
ggaaguccuuucaguugau

SEQ ID NO: 1052254 - RNA, 19 nt, Homo sapiens
ccuugaaucugcuaaagaa

SEQ ID NO: 1052255 - RNA, 19 nt, Homo sapiens
gcaagccuuuguuaugaau

SEQ ID NO: 1052256 - RNA, 19 nt, Homo sapiens
ucaagagauuugcugauga

SEQ ID NO: 1052257 - RNA, 19 nt, Homo sapiens
ggaacucauuugugaauac

SEQ ID NO: 1052258 - RNA, 19 nt, Homo sapiens
gaugauguccgggagguua

SEQ ID NO: 1052259 - RNA, 19 nt, Homo sapiens
gucaaagccucaaagaaau

SEQ ID NO: 1052260 - RNA, 19 nt, Homo sapiens
uaggaaaugccuugugaua

SEQ ID NO: 1052261 - RNA, 19 nt, Homo sapiens
guaaagagacaagcacuau

SEQ ID NO: 1052262 - RNA, 19 nt, Homo sapiens
aagacgagauuccagauga

SEQ ID NO: 1052263 - RNA, 19 nt, Homo sapiens
uguaggaaaugccuuguga

SEQ ID NO: 1052264 - RNA, 19 nt, Homo sapiens
guacagagccccacauuug

SEQ ID NO: 1052265 - RNA, 19 nt, Homo sapiens
ucucagggcucaguaaaga

SEQ ID NO: 1052266 - RNA, 19 nt, Homo sapiens
gugaaaucuuggugguuua

SEQ ID NO: 1052267 - RNA, 19 nt, Homo sapiens
gcaugaaacguuguucuuu

SEQ ID NO: 1052268 - RNA, 19 nt, Homo sapiens
aaagguaaauucuggcaau

SEQ ID NO: 1052269 - RNA, 19 nt, Homo sapiens
gagaagaaccagcaggaau

SEQ ID NO: 1052270 - RNA, 19 nt, Homo sapiens
gaaaugccuugugauacau

SEQ ID NO: 1052271 - RNA, 19 nt, Homo sapiens
ugugaaaucuuggugguuu

SEQ ID NO: 1052272 - RNA, 19 nt, Homo sapiens
ggaagcaagccuuuguuau

SEQ ID NO: 1052273 - RNA, 19 nt, Homo sapiens
aaagagacaagcacuauau

SEQ ID NO: 1052274 - RNA, 19 nt, Homo sapiens
gcaaguggaacucauuugu

SEQ ID NO: 1052275 - RNA, 19 nt, Homo sapiens
aaguggaacucauuuguga

SEQ ID NO: 1052276 - RNA, 19 nt, Homo sapiens
guauggagaucuagauguc

SEQ ID NO: 1052277 - RNA, 19 nt, Homo sapiens
gcaaacuucaggagcuuaa

SEQ ID NO: 1052278 - RNA, 19 nt, Homo sapiens
gggcuuaugcugcacaauu

SEQ ID NO: 1052279 - RNA, 19 nt, Homo sapiens
ucagggauauucauaagca

SEQ ID NO: 1052280 - RNA, 19 nt, Homo sapiens
uaaagagacaagcacuaua

SEQ ID NO: 1052281 - RNA, 19 nt, Homo sapiens
agaucuagaugucuuauuc

SEQ ID NO: 1052282 - RNA, 19 nt, Homo sapiens
ggcaauaaguacaaugaca

SEQ ID NO: 1052283 - RNA, 19 nt, Homo sapiens
ggaagagauuacaaacaag

SEQ ID NO: 1052284 - RNA, 19 nt, Homo sapiens
uuucugagguuuggucaua

SEQ ID NO: 1052285 - RNA, 19 nt, Homo sapiens
aaagcaaauuggugucuug

SEQ ID NO: 1052286 - RNA, 19 nt, Homo sapiens
ccacugaggaugauggauu

SEQ ID NO: 1052287 - RNA, 19 nt, Homo sapiens
ucuuugagguuguuuauca

SEQ ID NO: 1052288 - RNA, 19 nt, Homo sapiens
acaccuugauguauguuaa

SEQ ID NO: 1052289 - RNA, 19 nt, Homo sapiens
gaaagacacugccaccuau

SEQ ID NO: 1052290 - RNA, 19 nt, Homo sapiens
caaauuacuuccugacaaa

SEQ ID NO: 1052291 - RNA, 19 nt, Homo sapiens
gaacauugauggaauaggu

SEQ ID NO: 1052292 - RNA, 19 nt, Homo sapiens
gcaaauuacuuccugacaa

SEQ ID NO: 1052293 - RNA, 19 nt, Homo sapiens
agacugaacuuaaagacua

SEQ ID NO: 1052294 - RNA, 19 nt, Homo sapiens
caaagaggauguuccagaa

SEQ ID NO: 1052295 - RNA, 19 nt, Homo sapiens
uggaugggaugcaguauua

SEQ ID NO: 1052296 - RNA, 19 nt, Homo sapiens
gagaggacauucagcaguu

SEQ ID NO: 1052297 - RNA, 19 nt, Homo sapiens
caagagauuugcugaugaa

SEQ ID NO: 1052298 - RNA, 19 nt, Homo sapiens
caagagaccuuauccugau

SEQ ID NO: 1052299 - RNA, 19 nt, Homo sapiens
gaaguuaucaaaccugaaa

SEQ ID NO: 1052300 - RNA, 19 nt, Homo sapiens
gaaaauguauggagaucua

SEQ ID NO: 1052301 - RNA, 19 nt, Homo sapiens
gcagaacagugaaccaugu

SEQ ID NO: 1052302 - RNA, 19 nt, Homo sapiens
acacaguucuggcuuauga

SEQ ID NO: 1052303 - RNA, 19 nt, Homo sapiens
acgaggagcuggagaauga

SEQ ID NO: 1052304 - RNA, 19 nt, Homo sapiens
gcggaacauugauggaaua

SEQ ID NO: 1052305 - RNA, 19 nt, Homo sapiens
gaugaaggcacgguuguua

SEQ ID NO: 1052306 - RNA, 19 nt, Homo sapiens
gcaggaauuuguuuagcuu

SEQ ID NO: 1052307 - RNA, 19 nt, Homo sapiens
agacaguguuuaagaauga

SEQ ID NO: 1052308 - RNA, 19 nt, Homo sapiens
uggaauaggugaucaggaa

SEQ ID NO: 1052309 - RNA, 19 nt, Homo sapiens
acaaugauuugaagacuga

SEQ ID NO: 1052310 - RNA, 19 nt, Homo sapiens
cagcuagaguggaguauga

SEQ ID NO: 1052311 - RNA, 19 nt, Homo sapiens
gcacgguuguuaagagaga

SEQ ID NO: 1052312 - RNA, 19 nt, Homo sapiens
gaacuuaaagacuaucuca

SEQ ID NO: 1052313 - RNA, 19 nt, Homo sapiens
gaagaaccagcaggaauuu

SEQ ID NO: 1052314 - RNA, 19 nt, Homo sapiens
ucauggaagucacaaacua

SEQ ID NO: 1052315 - RNA, 19 nt, Homo sapiens
gaacucauuugugaauaca

SEQ ID NO: 1052316 - RNA, 19 nt, Homo sapiens
gcaauaaguacaaugacaa

SEQ ID NO: 1052317 - RNA, 19 nt, Homo sapiens
gguaaauucuggcaauaag

SEQ ID NO: 1052318 - RNA, 19 nt, Homo sapiens
ucaagagauuugcugauga

SEQ ID NO: 1052319 - RNA, 19 nt, Homo sapiens
ggaacucauuugugaauac

SEQ ID NO: 1052320 - RNA, 19 nt, Homo sapiens
gaugauguccgggagguua

SEQ ID NO: 1052321 - RNA, 19 nt, Homo sapiens
aagacgagauuccagauga

SEQ ID NO: 1052322 - RNA, 19 nt, Homo sapiens
guaaagagacaagcacuau

SEQ ID NO: 1052323 - RNA, 19 nt, Homo sapiens
gcaugaaacguuguucuuu

SEQ ID NO: 1052324 - RNA, 19 nt, Homo sapiens
aaagguaaauucuggcaau

SEQ ID NO: 1052325 - RNA, 19 nt, Homo sapiens
ucucagggcucaguaaaga

SEQ ID NO: 1052326 - RNA, 19 nt, Homo sapiens
gcaaguggaacucauuugu

SEQ ID NO: 1052327 - RNA, 19 nt, Homo sapiens
gagaagaaccagcaggaau

SEQ ID NO: 1052328 - RNA, 19 nt, Homo sapiens
aaagagacaagcacuauau

SEQ ID NO: 1052329 - RNA, 19 nt, Homo sapiens
aaguggaacucauuuguga

SEQ ID NO: 1052330 - RNA, 19 nt, Homo sapiens
guauggagaucuagauguc

SEQ ID NO: 1052331 - RNA, 19 nt, Homo sapiens
gcaaacuucaggagcuuaa

SEQ ID NO: 1052332 - RNA, 19 nt, Homo sapiens
gggcuuaugcugcacaauu

SEQ ID NO: 1052333 - RNA, 19 nt, Homo sapiens
gaaaacagagggaagauug

SEQ ID NO: 1052334 - RNA, 19 nt, Homo sapiens
agaucuagaugucuuauuc

SEQ ID NO: 1052335 - RNA, 19 nt, Homo sapiens
uaaagagacaagcacuaua

SEQ ID NO: 1052336 - RNA, 19 nt, Homo sapiens
ggcaauaaguacaaugaca

SEQ ID NO: 1052337 - RNA, 19 nt, Homo sapiens
ccacugaggaugauggauu

SEQ ID NO: 1052338 - RNA, 19 nt, Homo sapiens
cuuaaagacuaucucaaga

SEQ ID NO: 1052339 - RNA, 19 nt, Homo sapiens
gaauagaguccagcaagug

SEQ ID NO: 1052340 - RNA, 19 nt, Homo sapiens
cgacacaguucuggcuuau

SEQ ID NO: 1052341 - RNA, 19 nt, Homo sapiens
agaaagacacugccaccua

SEQ ID NO: 1052342 - RNA, 19 nt, Homo sapiens
aaaucuggcugcaaacuuc

SEQ ID NO: 1052343 - RNA, 19 nt, Homo sapiens
ggcuuaugcugcacaauug

SEQ ID NO: 1052344 - RNA, 19 nt, Homo sapiens
ugacaaagcaaagguaaau

SEQ ID NO: 1052345 - RNA, 19 nt, Homo sapiens
agaagaaccagcaggaauu

SEQ ID NO: 1052346 - RNA, 19 nt, Homo sapiens
gauuugaagacugaacuua

SEQ ID NO: 1052347 - RNA, 19 nt, Homo sapiens
gaacagggaaaggaugaug

SEQ ID NO: 1052348 - RNA, 19 nt, Homo sapiens
gaaccagcaggaauuuguu

SEQ ID NO: 1052349 - RNA, 19 nt, Homo sapiens
ggacauucagcaguucuuu

SEQ ID NO: 1052350 - RNA, 19 nt, Homo sapiens
ugaauagaguccagcaagu

SEQ ID NO: 1052351 - RNA, 19 nt, Homo sapiens
cagacaguguuuaagaaug

SEQ ID NO: 1052352 - RNA, 19 nt, Homo sapiens
uaucaaaccugaaaaugga

SEQ ID NO: 1052353 - RNA, 19 nt, Homo sapiens
caugaaacguuguucuuuu

SEQ ID NO: 1052354 - RNA, 19 nt, Homo sapiens
gaagacgagauuccagaug

SEQ ID NO: 1052355 - RNA, 19 nt, Homo sapiens
ucaagauaguacccucaaa

SEQ ID NO: 1052356 - RNA, 19 nt, Homo sapiens
ggagaagggagaggaguga

SEQ ID NO: 1052357 - RNA, 19 nt, Homo sapiens
caagauaguacccucaaag

SEQ ID NO: 1052358 - RNA, 19 nt, Homo sapiens
ggagagcaucaagauagua

SEQ ID NO: 1052359 - RNA, 19 nt, Homo sapiens
ggauuggugcggaacauug

SEQ ID NO: 1052360 - RNA, 19 nt, Homo sapiens
aagguaaauucuggcaaua

SEQ ID NO: 1052361 - RNA, 19 nt, Homo sapiens
acaaagcaaagguaaauuc

SEQ ID NO: 1052362 - RNA, 19 nt, Homo sapiens
gaaggcacgguuguuaaga

SEQ ID NO: 1052363 - RNA, 19 nt, Homo sapiens
acccuuagcagcaugaaua

SEQ ID NO: 1052364 - RNA, 19 nt, Homo sapiens
uuguuuagcuugcaguuau

SEQ ID NO: 1052365 - RNA, 19 nt, Homo sapiens
gacugaacuuaaagacuau

SEQ ID NO: 1052366 - RNA, 19 nt, Homo sapiens
gcucuaguucugaaucuga

SEQ ID NO: 1052367 - RNA, 19 nt, Homo sapiens
aaguagagcagaacaguga

SEQ ID NO: 1052368 - RNA, 19 nt, Homo sapiens
ggaauuuguuuagcuugca

SEQ ID NO: 1052369 - RNA, 19 nt, Homo sapiens
ggagaagaaccagcaggaa

SEQ ID NO: 1052370 - RNA, 19 nt, Homo sapiens
gaguggaguaugaagcuuu

SEQ ID NO: 1052371 - RNA, 19 nt, Homo sapiens
ggaguaugaagcuuucuca

SEQ ID NO: 1052372 - RNA, 19 nt, Homo sapiens
gaguggaugggaugcagua

SEQ ID NO: 1052373 - RNA, 19 nt, Homo sapiens
ucuuauuccugacagauga

SEQ ID NO: 1052374 - RNA, 19 nt, Homo sapiens
uccagacaguguuuaagaa

SEQ ID NO: 1052375 - RNA, 19 nt, Homo sapiens
cagaacagggaaaggauga

SEQ ID NO: 1052376 - RNA, 19 nt, Homo sapiens
gaauaggugaucaggaagu

SEQ ID NO: 1052377 - RNA, 19 nt, Homo sapiens
cacugaggaugauggauug

SEQ ID NO: 1052378 - RNA, 19 nt, Homo sapiens
uaaccaaaauauccacuga

SEQ ID NO: 1052379 - RNA, 19 nt, Homo sapiens
cucaagagauuugcugaug

SEQ ID NO: 1052380 - RNA, 19 nt, Homo sapiens
caaguggaacucauuugug

SEQ ID NO: 1052381 - RNA, 19 nt, Homo sapiens
cagcaaguggaacucauuu

SEQ ID NO: 1052382 - RNA, 19 nt, Homo sapiens
acgacacaguucuggcuua

SEQ ID NO: 1052383 - RNA, 19 nt, Homo sapiens
caaagcaaagguaaauucu

SEQ ID NO: 1052384 - RNA, 19 nt, Homo sapiens
gcauuugcaagagaccuua

SEQ ID NO: 1052385 - RNA, 19 nt, Homo sapiens
ccagacaguguuuaagaau

SEQ ID NO: 1052386 - RNA, 19 nt, Homo sapiens
gagcagaacagugaaccau

SEQ ID NO: 1052387 - RNA, 19 nt, Homo sapiens
uaaaguagagcagaacagu

SEQ ID NO: 1052388 - RNA, 19 nt, Homo sapiens
gaucaggaaguuaucaaac

SEQ ID NO: 1052389 - RNA, 19 nt, Homo sapiens
caaauggucuguggacuua

SEQ ID NO: 1052390 - RNA, 19 nt, Homo sapiens
gugcauggauuacaaauuu

SEQ ID NO: 1052391 - RNA, 19 nt, Homo sapiens
ccacaucagucccuguuua

SEQ ID NO: 1052392 - RNA, 19 nt, Homo sapiens
uaucucaccuguucucuua

SEQ ID NO: 1052393 - RNA, 19 nt, Homo sapiens
uaacagaggagaacacuaa

SEQ ID NO: 1052394 - RNA, 19 nt, Homo sapiens
gggaagagaacaauuagua

SEQ ID NO: 1052395 - RNA, 19 nt, Homo sapiens
gaaguucucuuauucacau

SEQ ID NO: 1052396 - RNA, 19 nt, Homo sapiens
gaacacagaaacauuagaa

SEQ ID NO: 1052397 - RNA, 19 nt, Homo sapiens
gaaguuaggaugugauuug

SEQ ID NO: 1052398 - RNA, 19 nt, Homo sapiens
caugauggcugcuacauug

SEQ ID NO: 1052399 - RNA, 19 nt, Homo sapiens
gaauuaaaccuucacagaa

SEQ ID NO: 1052400 - RNA, 19 nt, Homo sapiens
aggaaugggugaaagauua

SEQ ID NO: 1052401 - RNA, 19 nt, Homo sapiens
ugaaacuucucucaacaua

SEQ ID NO: 1052402 - RNA, 19 nt, Homo sapiens
ccaaagaccuuaggagaga

SEQ ID NO: 1052403 - RNA, 19 nt, Homo sapiens
gcacauucacuaacaagua

SEQ ID NO: 1052404 - RNA, 19 nt, Homo sapiens
aaacaaaccugauucuucu

SEQ ID NO: 1052405 - RNA, 19 nt, Homo sapiens
gaagauccugucuguguua

SEQ ID NO: 1052406 - RNA, 19 nt, Homo sapiens
guagugcucucgaauaugu

SEQ ID NO: 1052407 - RNA, 19 nt, Homo sapiens
cacaagaucucaggaaauu

SEQ ID NO: 1052408 - RNA, 19 nt, Homo sapiens
ggcaacaacugcacauuug

SEQ ID NO: 1052409 - RNA, 19 nt, Homo sapiens
caagcgaaguucucuuauu

SEQ ID NO: 1052410 - RNA, 19 nt, Homo sapiens
gaugaaaccauuguugaua

SEQ ID NO: 1052411 - RNA, 19 nt, Homo sapiens
ucacagaucucagcuuuca

SEQ ID NO: 1052412 - RNA, 19 nt, Homo sapiens
uaaaguggguugguacuga

SEQ ID NO: 1052413 - RNA, 19 nt, Homo sapiens
guucgugacuugaguagaa

SEQ ID NO: 1052414 - RNA, 19 nt, Homo sapiens
ucacguuucuucaaucuga

SEQ ID NO: 1052415 - RNA, 19 nt, Homo sapiens
gaccuuccauaucaaguaa

SEQ ID NO: 1052416 - RNA, 19 nt, Homo sapiens
aaacuucucucaacauaag

SEQ ID NO: 1052417 - RNA, 19 nt, Homo sapiens
ccgaacuccuuuauauaua

SEQ ID NO: 1052418 - RNA, 19 nt, Homo sapiens
gaaagaauugcaacucaga

SEQ ID NO: 1052419 - RNA, 19 nt, Homo sapiens
acagaacacagaaacauua

SEQ ID NO: 1052420 - RNA, 19 nt, Homo sapiens
acaaauuucucccuuacaa

SEQ ID NO: 1052421 - RNA, 19 nt, Homo sapiens
cagaaagaauugcaacuca

SEQ ID NO: 1052422 - RNA, 19 nt, Homo sapiens
aaacauaagccacaaggaa

SEQ ID NO: 1052423 - RNA, 19 nt, Homo sapiens
ugaaagcuuuggucucuau

SEQ ID NO: 1052424 - RNA, 19 nt, Homo sapiens
gcuccucagucaacacuuu

SEQ ID NO: 1052425 - RNA, 19 nt, Homo sapiens
acacuaagcuccgauaucu

SEQ ID NO: 1052426 - RNA, 19 nt, Homo sapiens
gaaaaucagugaaaacaag

SEQ ID NO: 1052427 - RNA, 19 nt, Homo sapiens
aagcgaaguucucuuauuc

SEQ ID NO: 1052428 - RNA, 19 nt, Homo sapiens
gaaagugccuugauuuuac

SEQ ID NO: 1052429 - RNA, 19 nt, Homo sapiens
cgagaaagugccuugauuu

SEQ ID NO: 1052430 - RNA, 19 nt, Homo sapiens
ccgagaaagugccuugauu

SEQ ID NO: 1052431 - RNA, 19 nt, Homo sapiens
ugaacacucucuugaagga

SEQ ID NO: 1052432 - RNA, 19 nt, Homo sapiens
gcugaacacucucuugaag

SEQ ID NO: 1052433 - RNA, 19 nt, Homo sapiens
caacauagcaagauuccau

SEQ ID NO: 1052434 - RNA, 19 nt, Homo sapiens
ccucagcgcucacaagauc

SEQ ID NO: 1052435 - RNA, 19 nt, Homo sapiens
aaagguaacagaacagaaa

SEQ ID NO: 1052436 - RNA, 19 nt, Homo sapiens
gaaacuucucucaacauaa

SEQ ID NO: 1052437 - RNA, 19 nt, Homo sapiens
ggauuucagugugauuuga

SEQ ID NO: 1052438 - RNA, 19 nt, Homo sapiens
guaaagaacugggcuuagc

SEQ ID NO: 1052439 - RNA, 19 nt, Homo sapiens
gcugguaucccuauugcua

SEQ ID NO: 1052440 - RNA, 19 nt, Homo sapiens
uuucacagaucucagcuuu

SEQ ID NO: 1052441 - RNA, 19 nt, Homo sapiens
caggaacuguggccaaaga

SEQ ID NO: 1052442 - RNA, 19 nt, Homo sapiens
gaucacguuucuucaaucu

SEQ ID NO: 1052443 - RNA, 19 nt, Homo sapiens
aaauuaaaguggguuggua

SEQ ID NO: 1052444 - RNA, 19 nt, Homo sapiens
gcacauuuguucgugacuu

SEQ ID NO: 1052445 - RNA, 19 nt, Homo sapiens
gagacaggcuuugaagaca

SEQ ID NO: 1052446 - RNA, 19 nt, Homo sapiens
cagaaaguauagacgauca

SEQ ID NO: 1052447 - RNA, 19 nt, Homo sapiens
uaugaaagcuuuggucucu

SEQ ID NO: 1052448 - RNA, 19 nt, Homo sapiens
gaucgaccuuccauaucaa

SEQ ID NO: 1052449 - RNA, 19 nt, Homo sapiens
gaagauacagaucgaccuu

SEQ ID NO: 1052450 - RNA, 19 nt, Homo sapiens
cagaauccauuugaaacuu

SEQ ID NO: 1052451 - RNA, 19 nt, Homo sapiens
uagcagaugcagaagauaa

SEQ ID NO: 1052452 - RNA, 19 nt, Homo sapiens
aaauguuccuucagaaaga

SEQ ID NO: 1052453 - RNA, 19 nt, Homo sapiens
cagaucacguuucuucaau

SEQ ID NO: 1052454 - RNA, 19 nt, Homo sapiens
gguugguacugauaucaaa

SEQ ID NO: 1052455 - RNA, 19 nt, Homo sapiens
gcagaagauaaauguguaa

SEQ ID NO: 1052456 - RNA, 19 nt, Homo sapiens
uagaauuacuacugaagga

SEQ ID NO: 1052457 - RNA, 19 nt, Homo sapiens
gguguccgcucgugagguu

SEQ ID NO: 1052458 - RNA, 19 nt, Homo sapiens
ggacaacauagcaagauuc

SEQ ID NO: 1052459 - RNA, 19 nt, Homo sapiens
gaagagaacaauuaguacu

SEQ ID NO: 1052460 - RNA, 19 nt, Homo sapiens
caucagucccuguuuagaa

SEQ ID NO: 1052461 - RNA, 19 nt, Homo sapiens
agaucgaccuuccauauca

SEQ ID NO: 1052462 - RNA, 19 nt, Homo sapiens
agaauuaaaccuucacaga

SEQ ID NO: 1052463 - RNA, 19 nt, Homo sapiens
gaauugcaacucagaagau

SEQ ID NO: 1052464 - RNA, 19 nt, Homo sapiens
gaacacuaagcuccgauau

SEQ ID NO: 1052465 - RNA, 19 nt, Homo sapiens
ucacugcauucuuagguau

SEQ ID NO: 1052466 - RNA, 19 nt, Homo sapiens
gaguagaauuaaaccuuca

SEQ ID NO: 1052467 - RNA, 19 nt, Homo sapiens
ugcagaagauaaaugugua

SEQ ID NO: 1052468 - RNA, 19 nt, Homo sapiens
ccuagcagaugcagaagau

SEQ ID NO: 1052469 - RNA, 19 nt, Homo sapiens
gcaauuccauucagaucac

SEQ ID NO: 1052470 - RNA, 19 nt, Homo sapiens
uacaguacguuggcaauga

SEQ ID NO: 1052471 - RNA, 19 nt, Homo sapiens
ggaaugggugaaagauuau

SEQ ID NO: 1052472 - RNA, 19 nt, Homo sapiens
gagccuugguguucagugu

SEQ ID NO: 1052473 - RNA, 19 nt, Homo sapiens
gauuugacuacgaacaaua

SEQ ID NO: 1052474 - RNA, 19 nt, Homo sapiens
uccgauaucucaccuguuc

SEQ ID NO: 1052475 - RNA, 19 nt, Homo sapiens
ugguagugcucucgaauau

SEQ ID NO: 1052476 - RNA, 19 nt, Homo sapiens
ggagacaggcuuugaagac

SEQ ID NO: 1052477 - RNA, 19 nt, Homo sapiens
gaauuacuacugaaggaau

SEQ ID NO: 1052478 - RNA, 19 nt, Homo sapiens
acaccaggccuccggauuu

SEQ ID NO: 1052479 - RNA, 19 nt, Homo sapiens
cugauggaauuucaaguga

SEQ ID NO: 1052480 - RNA, 19 nt, Homo sapiens
caccuguucucuuauugaa

SEQ ID NO: 1052481 - RNA, 19 nt, Homo sapiens
ggaugaaaccauuguugau

SEQ ID NO: 1052482 - RNA, 19 nt, Homo sapiens
gggugaaagauuauuguaa

SEQ ID NO: 1052483 - RNA, 19 nt, Homo sapiens
cacauucacuaacaaguag

SEQ ID NO: 1052484 - RNA, 19 nt, Homo sapiens
ucucaccuguucucuuauu

SEQ ID NO: 1052485 - RNA, 19 nt, Homo sapiens
cagcugaacacucucuuga

SEQ ID NO: 1052486 - RNA, 19 nt, Homo sapiens
ugaaaccauuguugauauc

SEQ ID NO: 1052487 - RNA, 19 nt, Homo sapiens
agacaggcuuugaagacaa

SEQ ID NO: 1052488 - RNA, 19 nt, Homo sapiens
acagaucgaccuuccauau

SEQ ID NO: 1052489 - RNA, 19 nt, Homo sapiens
ggaaagacgcgcuguguuu

SEQ ID NO: 1052490 - RNA, 19 nt, Homo sapiens
gaccucagcuccucgcauu

SEQ ID NO: 1052491 - RNA, 19 nt, Homo sapiens
uaaagugccaggaacaaua

SEQ ID NO: 1052492 - RNA, 19 nt, Homo sapiens
gcuaaagguuggauuucaa

SEQ ID NO: 1052493 - RNA, 19 nt, Homo sapiens
uaaauacuguacaggaaga

SEQ ID NO: 1052494 - RNA, 19 nt, Homo sapiens
gaaagacgcgcuguguuug

SEQ ID NO: 1052495 - RNA, 19 nt, Homo sapiens
gagggucaaauaucuuuaa

SEQ ID NO: 1052496 - RNA, 19 nt, Homo sapiens
caggaacaauaaauacugu

SEQ ID NO: 1052497 - RNA, 19 nt, Homo sapiens
gugccaggaacaauaaaua

SEQ ID NO: 1052498 - RNA, 19 nt, Homo sapiens
aaagugccaggaacaauaa

SEQ ID NO: 1052499 - RNA, 19 nt, Homo sapiens
gcagcgggaugaggcuaaa

SEQ ID NO: 1052500 - RNA, 19 nt, Homo sapiens
gaggcuaaagguuggauuu

SEQ ID NO: 1052501 - RNA, 19 nt, Homo sapiens
uuaaauaaagugccaggaa

SEQ ID NO: 1052502 - RNA, 19 nt, Homo sapiens
ggcuaaagguuggauuuca

SEQ ID NO: 1052503 - RNA, 19 nt, Homo sapiens
ggacagacacacagacacu

SEQ ID NO: 1052504 - RNA, 19 nt, Homo sapiens
gugagggucaaauaucuuu

SEQ ID NO: 1052505 - RNA, 19 nt, Homo sapiens
cagugagggucaaauaucu

SEQ ID NO: 1052506 - RNA, 19 nt, Homo sapiens
ggucuuaaccucuguucuc

SEQ ID NO: 1052507 - RNA, 19 nt, Homo sapiens
ggaacaauaaauacuguac

SEQ ID NO: 1052508 - RNA, 19 nt, Homo sapiens
ccacaucucaagacaccaa

SEQ ID NO: 1052509 - RNA, 19 nt, Homo sapiens
ccaggaacaauaaauacug

SEQ ID NO: 1052510 - RNA, 19 nt, Homo sapiens
ucagugagggucaaauauc

SEQ ID NO: 1052511 - RNA, 19 nt, Homo sapiens
uuucaggacucuggaggaa

SEQ ID NO: 1052512 - RNA, 19 nt, Homo sapiens
gucuuaaccucuguucuca

SEQ ID NO: 1052513 - RNA, 19 nt, Homo sapiens
aaauaaagugccaggaaca

SEQ ID NO: 1052514 - RNA, 19 nt, Homo sapiens
aagacgcgcuguguuugga

SEQ ID NO: 1052515 - RNA, 19 nt, Homo sapiens
gaacagaguaugagucuua

SEQ ID NO: 1052516 - RNA, 19 nt, Homo sapiens
gaauaucucugacaagcuu

SEQ ID NO: 1052517 - RNA, 19 nt, Homo sapiens
gcagaucugucauugcaaa

SEQ ID NO: 1052518 - RNA, 19 nt, Homo sapiens
gaugugaaaugaagacuau

SEQ ID NO: 1052519 - RNA, 19 nt, Homo sapiens
gaucugucauugcaaagua

SEQ ID NO: 1052520 - RNA, 19 nt, Homo sapiens
gagauucuguugugauuau

SEQ ID NO: 1052521 - RNA, 19 nt, Homo sapiens
acacagacuucuacuauga

SEQ ID NO: 1052522 - RNA, 19 nt, Homo sapiens
gaauggaggugacagaaag

SEQ ID NO: 1052523 - RNA, 19 nt, Homo sapiens
ggaagaauccuauuucaag

SEQ ID NO: 1052524 - RNA, 19 nt, Homo sapiens
uauaagagauucuguugug

SEQ ID NO: 1052525 - RNA, 19 nt, Homo sapiens
gaggauacauugaguugga

SEQ ID NO: 1052526 - RNA, 19 nt, Homo sapiens
ccacaaagauaaccaugau

SEQ ID NO: 1052527 - RNA, 19 nt, Homo sapiens
gaccagaacuuggaaaaua

SEQ ID NO: 1052528 - RNA, 19 nt, Homo sapiens
uuuaggagcuugacuuauu

SEQ ID NO: 1052529 - RNA, 19 nt, Homo sapiens
ggagaacaauuccuauuuu

SEQ ID NO: 1052530 - RNA, 19 nt, Homo sapiens
ggucaguuaucuucacauu

SEQ ID NO: 1052531 - RNA, 19 nt, Homo sapiens
gcaaaccacacuaacauau

SEQ ID NO: 1052532 - RNA, 19 nt, Homo sapiens
gauguugccucagauaaug

SEQ ID NO: 1052533 - RNA, 19 nt, Homo sapiens
gcaggugguaccauuauaa

SEQ ID NO: 1052534 - RNA, 19 nt, Homo sapiens
gucuuaaucugaagucuuu

SEQ ID NO: 1052535 - RNA, 19 nt, Homo sapiens
guaugagucuuaaucugaa

SEQ ID NO: 1052536 - RNA, 19 nt, Homo sapiens
gaagaaaagugaagcaaag

SEQ ID NO: 1052537 - RNA, 19 nt, Homo sapiens
ggugaugaauggcugaaga

SEQ ID NO: 1052538 - RNA, 19 nt, Homo sapiens
ccagggcuauucauaucua

SEQ ID NO: 1052539 - RNA, 19 nt, Homo sapiens
gacaagcuuucguaugguu

SEQ ID NO: 1052540 - RNA, 19 nt, Homo sapiens
gagcuuuaguucagcagaa

SEQ ID NO: 1052541 - RNA, 19 nt, Homo sapiens
cuauguaugugaugugaaa

SEQ ID NO: 1052542 - RNA, 19 nt, Homo sapiens
ugacaucgcgcacuaucua

SEQ ID NO: 1052543 - RNA, 19 nt, Homo sapiens
caaagucaccuuccaaugg

SEQ ID NO: 1052544 - RNA, 19 nt, Homo sapiens
gaaaccagaaggugaugaa

SEQ ID NO: 1052545 - RNA, 19 nt, Homo sapiens
cuacacagacuucuacuau

SEQ ID NO: 1052546 - RNA, 19 nt, Homo sapiens
ggaauggaggugacagaaa

SEQ ID NO: 1052547 - RNA, 19 nt, Homo sapiens
ccucaaagccgguagaugu

SEQ ID NO: 1052548 - RNA, 19 nt, Homo sapiens
aagcagaucugucauugca

SEQ ID NO: 1052549 - RNA, 19 nt, Homo sapiens
gauuguauuuguagagugu

SEQ ID NO: 1052550 - RNA, 19 nt, Homo sapiens
acaaagauaaccaugauga

SEQ ID NO: 1052551 - RNA, 19 nt, Homo sapiens
caucuucaaucugguauau

SEQ ID NO: 1052552 - RNA, 19 nt, Homo sapiens
gcauggaagaauccuauuu

SEQ ID NO: 1052553 - RNA, 19 nt, Homo sapiens
uuaggagcuugacuuauuu

SEQ ID NO: 1052554 - RNA, 19 nt, Homo sapiens
caaaccacacuaacauauu

SEQ ID NO: 1052555 - RNA, 19 nt, Homo sapiens
gguauaagagauucuguug

SEQ ID NO: 1052556 - RNA, 19 nt, Homo sapiens
gcaaagucaccuuccaaug

SEQ ID NO: 1052557 - RNA, 19 nt, Homo sapiens
cauugaaguuucuugcaaa

SEQ ID NO: 1052558 - RNA, 19 nt, Homo sapiens
ccauugaaguuucuugcaa

SEQ ID NO: 1052559 - RNA, 19 nt, Homo sapiens
cugcuaugcuccacuguuu

SEQ ID NO: 1052560 - RNA, 19 nt, Homo sapiens
aagagauucuguugugauu

SEQ ID NO: 1052561 - RNA, 19 nt, Homo sapiens
aauaguagguggagucaca

SEQ ID NO: 1052562 - RNA, 19 nt, Homo sapiens
gcauuggcauggaagaauc

SEQ ID NO: 1052563 - RNA, 19 nt, Homo sapiens
ggagucacacaugcuaaua

SEQ ID NO: 1052564 - RNA, 19 nt, Homo sapiens
caagcugguuuacugcuau

SEQ ID NO: 1052565 - RNA, 19 nt, Homo sapiens
gauuaugcuuuaccgguau

SEQ ID NO: 1052566 - RNA, 19 nt, Homo sapiens
cugacaagcuuucguaugg

SEQ ID NO: 1052567 - RNA, 19 nt, Homo sapiens
guagauguugccucagaua

SEQ ID NO: 1052568 - RNA, 19 nt, Homo sapiens
auaucuaccuguucaacua

SEQ ID NO: 1052569 - RNA, 19 nt, Homo sapiens
gagccuccauugaaguuuc

SEQ ID NO: 1052570 - RNA, 19 nt, Homo sapiens
gaguaugagucuuaaucug

SEQ ID NO: 1052571 - RNA, 19 nt, Homo sapiens
guauggagaacaauuccua

SEQ ID NO: 1052572 - RNA, 19 nt, Homo sapiens
gaaucuauuugagcuuuag

SEQ ID NO: 1052573 - RNA, 19 nt, Homo sapiens
ugaguuggaugcuauuugg

SEQ ID NO: 1052574 - RNA, 19 nt, Homo sapiens
ucaagcugguuuacugcua

SEQ ID NO: 1052575 - RNA, 19 nt, Homo sapiens
auaccuacaucaaauggaa

SEQ ID NO: 1052576 - RNA, 19 nt, Homo sapiens
uuacgaguguaucauguga

SEQ ID NO: 1052577 - RNA, 19 nt, Homo sapiens
uaaccaugaugacuacaca

SEQ ID NO: 1052578 - RNA, 19 nt, Homo sapiens
ucaguuaucuucacauucc

SEQ ID NO: 1052579 - RNA, 19 nt, Homo sapiens
ugaaggaagugaccagaac

SEQ ID NO: 1052580 - RNA, 19 nt, Homo sapiens
uggagaacaauuccuauuu

SEQ ID NO: 1052581 - RNA, 19 nt, Homo sapiens
gugguaccauuauaacgaa

SEQ ID NO: 1052582 - RNA, 19 nt, Homo sapiens
ucuaguggcuacuguuuua

SEQ ID NO: 1052583 - RNA, 19 nt, Homo sapiens
uaugugaugugaaaugaag

SEQ ID NO: 1052584 - RNA, 19 nt, Homo sapiens
agacuucuacuaugacauu

SEQ ID NO: 1052585 - RNA, 19 nt, Homo sapiens
aagauaaccaugaugacua

SEQ ID NO: 1052586 - RNA, 19 nt, Homo sapiens
gaugaauggcugaagaugu

SEQ ID NO: 1052587 - RNA, 19 nt, Homo sapiens
uugcagagccuccauugaa

SEQ ID NO: 1052588 - RNA, 19 nt, Homo sapiens
ggucgguggucguuaugga

SEQ ID NO: 1052589 - RNA, 19 nt, Homo sapiens
ccuguuauauugugcuaau

SEQ ID NO: 1052590 - RNA, 19 nt, Homo sapiens
acauugaguuggaugcuau

SEQ ID NO: 1052591 - RNA, 19 nt, Homo sapiens
uuacuggcaucuucaaucu

SEQ ID NO: 1052592 - RNA, 19 nt, Homo sapiens
acauauuacuggcaucuuc

SEQ ID NO: 1052593 - RNA, 19 nt, Homo sapiens
ggugacagaaagaaagaaa

SEQ ID NO: 1052594 - RNA, 19 nt, Homo sapiens
uguaugugaugugaaauga

SEQ ID NO: 1052595 - RNA, 19 nt, Homo sapiens
uaacgaauuuugagagguu

SEQ ID NO: 1052596 - RNA, 19 nt, Homo sapiens
uagcagguauuuucuacua

SEQ ID NO: 1052597 - RNA, 19 nt, Homo sapiens
uauuugagcuuuaguucag

SEQ ID NO: 1052598 - RNA, 19 nt, Homo sapiens
gaggugacagaaagaaaga

SEQ ID NO: 1052599 - RNA, 19 nt, Homo sapiens
ggaggugacagaaagaaag

SEQ ID NO: 1052600 - RNA, 19 nt, Homo sapiens
cgguagauguugccucaga

SEQ ID NO: 1052601 - RNA, 19 nt, Homo sapiens
cuggcaauaucaaagcaua

SEQ ID NO: 1052602 - RNA, 19 nt, Homo sapiens
ugccucagauaauguuaaa

SEQ ID NO: 1052603 - RNA, 19 nt, Homo sapiens
ggugguaccauuauaacga

SEQ ID NO: 1052604 - RNA, 19 nt, Homo sapiens
cagcugcauuggcauggaa

SEQ ID NO: 1052605 - RNA, 19 nt, Homo sapiens
cauggaagaauccuauuuc

SEQ ID NO: 1052606 - RNA, 19 nt, Homo sapiens
auucauaucuaccuguuca

SEQ ID NO: 1052607 - RNA, 19 nt, Homo sapiens
gcugugcccucuccuacuc

SEQ ID NO: 1052608 - RNA, 19 nt, Homo sapiens
gcauguucuuucuaaucuu

SEQ ID NO: 1052609 - RNA, 19 nt, Homo sapiens
aguaugagucuuaaucuga

SEQ ID NO: 1052610 - RNA, 19 nt, Homo sapiens
cagaguaugagucuuaauc

SEQ ID NO: 1052611 - RNA, 19 nt, Homo sapiens
gacuauauauauggaaugg

SEQ ID NO: 1052612 - RNA, 19 nt, Homo sapiens
cuacuggcuucgggaauga

SEQ ID NO: 1052613 - RNA, 19 nt, Homo sapiens
guuccuuuauaccaucuuu

SEQ ID NO: 1052614 - RNA, 19 nt, Homo sapiens
ugaacacugagaagaguaa

SEQ ID NO: 1052615 - RNA, 19 nt, Homo sapiens
gaacuuaccucugcuaaug

SEQ ID NO: 1052616 - RNA, 19 nt, Homo sapiens
gcagagagguauaggguaa

SEQ ID NO: 1052617 - RNA, 19 nt, Homo sapiens
aaacacagguuccggcaua

SEQ ID NO: 1052618 - RNA, 19 nt, Homo sapiens
acagguagguuaauaauga

SEQ ID NO: 1052619 - RNA, 19 nt, Homo sapiens
ugaaggagcugguggaaga

SEQ ID NO: 1052620 - RNA, 19 nt, Homo sapiens
gcaccuuugucauguauaa

SEQ ID NO: 1052621 - RNA, 19 nt, Homo sapiens
ugacaaggcuccacucaga

SEQ ID NO: 1052622 - RNA, 19 nt, Homo sapiens
gggaaacccuggcuauguu

SEQ ID NO: 1052623 - RNA, 19 nt, Homo sapiens
ucagacagguagguuaaua

SEQ ID NO: 1052624 - RNA, 19 nt, Homo sapiens
acucuacacucuauucuuu

SEQ ID NO: 1052625 - RNA, 19 nt, Homo sapiens
ugacagaaaccaacacuug

SEQ ID NO: 1052626 - RNA, 19 nt, Homo sapiens
cagcaggcccuuucucuuu

SEQ ID NO: 1052627 - RNA, 19 nt, Homo sapiens
gguauaggguaaaggcaaa

SEQ ID NO: 1052628 - RNA, 19 nt, Homo sapiens
gcaccuggcacucugauga

SEQ ID NO: 1052629 - RNA, 19 nt, Homo sapiens
gaguagaggcaccagauuu

SEQ ID NO: 1052630 - RNA, 19 nt, Homo sapiens
caaaggaagcagaggauga

SEQ ID NO: 1052631 - RNA, 19 nt, Homo sapiens
acagagaucuuugguguuc

SEQ ID NO: 1052632 - RNA, 19 nt, Homo sapiens
gcccuugccugcagacuga

SEQ ID NO: 1052633 - RNA, 19 nt, Homo sapiens
gagccacgcccuugaagaa

SEQ ID NO: 1052634 - RNA, 19 nt, Homo sapiens
caaccuggcaguuccaauu

SEQ ID NO: 1052635 - RNA, 19 nt, Homo sapiens
acaacugucuggugacuga

SEQ ID NO: 1052636 - RNA, 19 nt, Homo sapiens
gauuucagcuccuacuaca

SEQ ID NO: 1052637 - RNA, 19 nt, Homo sapiens
guacagcucagcauggauu

SEQ ID NO: 1052638 - RNA, 19 nt, Homo sapiens
gggaggaacaccaaccuaa

SEQ ID NO: 1052639 - RNA, 19 nt, Homo sapiens
gcacaagagcaaagagaug

SEQ ID NO: 1052640 - RNA, 19 nt, Homo sapiens
ccacuagccuuccucucuu

SEQ ID NO: 1052641 - RNA, 19 nt, Homo sapiens
ccacaccucuuuggucaga

SEQ ID NO: 1052642 - RNA, 19 nt, Homo sapiens
gaucuuugguguucucucu

SEQ ID NO: 1052643 - RNA, 19 nt, Homo sapiens
gaagaacuuaccucugcua

SEQ ID NO: 1052644 - RNA, 19 nt, Homo sapiens
gauaugcaaguuccuggua

SEQ ID NO: 1052645 - RNA, 19 nt, Homo sapiens
gaaaccaacacuugaccuu

SEQ ID NO: 1052646 - RNA, 19 nt, Homo sapiens
gcacaaagaguggcaccuu

SEQ ID NO: 1052647 - RNA, 19 nt, Homo sapiens
gacagaaaccaacacuuga

SEQ ID NO: 1052648 - RNA, 19 nt, Homo sapiens
ccacugagccacauuuaag

SEQ ID NO: 1052649 - RNA, 19 nt, Homo sapiens
gaacacugaagaccagguu

SEQ ID NO: 1052650 - RNA, 19 nt, Homo sapiens
gagaugggccagugacuca

SEQ ID NO: 1052651 - RNA, 19 nt, Homo sapiens
ggccacagaggcuccaaua

SEQ ID NO: 1052652 - RNA, 19 nt, Homo sapiens
gcauggauuucagcuccua

SEQ ID NO: 1052653 - RNA, 19 nt, Homo sapiens
ccaggacacucuacacucu

SEQ ID NO: 1052654 - RNA, 19 nt, Homo sapiens
gcacucaaccuggcaguuc

SEQ ID NO: 1052655 - RNA, 19 nt, Homo sapiens
guagacacaucccaagaac

SEQ ID NO: 1052656 - RNA, 19 nt, Homo sapiens
ggacgugcagagagguaua

SEQ ID NO: 1052657 - RNA, 19 nt, Homo sapiens
caaaccaaguauacuguac

SEQ ID NO: 1052658 - RNA, 19 nt, Homo sapiens
gcaggcccuuucucuuuca

SEQ ID NO: 1052659 - RNA, 19 nt, Homo sapiens
gugagugucccuccuggua

SEQ ID NO: 1052660 - RNA, 19 nt, Homo sapiens
uccaauaccugggaauguu

SEQ ID NO: 1052661 - RNA, 19 nt, Homo sapiens
cagucucugucucuagaua

SEQ ID NO: 1052662 - RNA, 19 nt, Homo sapiens
ucucacugcuacaugauga

SEQ ID NO: 1052663 - RNA, 19 nt, Homo sapiens
gggaguugcuggacuugag

SEQ ID NO: 1052664 - RNA, 19 nt, Homo sapiens
acagagauggugaggcaua

SEQ ID NO: 1052665 - RNA, 19 nt, Homo sapiens
cuggcuauguucuggguua

SEQ ID NO: 1052666 - RNA, 19 nt, Homo sapiens
ccuggcaguuccaauuuga

SEQ ID NO: 1052667 - RNA, 19 nt, Homo sapiens
ccaaaccaaguauacugua

SEQ ID NO: 1052668 - RNA, 19 nt, Homo sapiens
ggacuugagagggcaugua

SEQ ID NO: 1052669 - RNA, 19 nt, Homo sapiens
cuuguuagcugacagaaac

SEQ ID NO: 1052670 - RNA, 19 nt, Homo sapiens
cugcagcugugcuucuauu

SEQ ID NO: 1052671 - RNA, 19 nt, Homo sapiens
ggaggaacaccaaccuaag

SEQ ID NO: 1052672 - RNA, 19 nt, Homo sapiens
cagacagguagguuaauaa

SEQ ID NO: 1052673 - RNA, 19 nt, Homo sapiens
gaaguuggaccugcuuugg

SEQ ID NO: 1052674 - RNA, 19 nt, Homo sapiens
caaagagaugggccaguga

SEQ ID NO: 1052675 - RNA, 19 nt, Homo sapiens
gaggagccacgcccuugaa

SEQ ID NO: 1052676 - RNA, 19 nt, Homo sapiens
ccacgcccuugaagaacuu

SEQ ID NO: 1052677 - RNA, 19 nt, Homo sapiens
gggacuuccuggagaguag

SEQ ID NO: 1052678 - RNA, 19 nt, Homo sapiens
aagaccagguugagaagga

SEQ ID NO: 1052679 - RNA, 19 nt, Homo sapiens
ccgcacagcuggcuaugac

SEQ ID NO: 1052680 - RNA, 19 nt, Homo sapiens
gaguggcaccuuugucaug

SEQ ID NO: 1052681 - RNA, 19 nt, Homo sapiens
ccacgaagggcacaaagag

SEQ ID NO: 1052682 - RNA, 19 nt, Homo sapiens
uuaugauuguccucccuua

SEQ ID NO: 1052683 - RNA, 19 nt, Homo sapiens
gggcacaagagcaaagaga

SEQ ID NO: 1052684 - RNA, 19 nt, Homo sapiens
ggagaguagcgccaacuag

SEQ ID NO: 1052685 - RNA, 19 nt, Homo sapiens
gagggagucugggcugagu

SEQ ID NO: 1052686 - RNA, 19 nt, Homo sapiens
ccuuugucauguauaauug

SEQ ID NO: 1052687 - RNA, 19 nt, Homo sapiens
ggaaacccuggcuauguuc

SEQ ID NO: 1052688 - RNA, 19 nt, Homo sapiens
ggacuucucacugcuacau

SEQ ID NO: 1052689 - RNA, 19 nt, Homo sapiens
ggacugccggguaccuaga

SEQ ID NO: 1052690 - RNA, 19 nt, Homo sapiens
cugaagaccagguugagaa

SEQ ID NO: 1052691 - RNA, 19 nt, Homo sapiens
gaggaguuccagcaacaga

SEQ ID NO: 1052692 - RNA, 19 nt, Homo sapiens
cugggaauguucacaaagu

SEQ ID NO: 1052693 - RNA, 19 nt, Homo sapiens
gugagugguuguugcucuu

SEQ ID NO: 1052694 - RNA, 19 nt, Homo sapiens
ugacugaccaacccuauac

SEQ ID NO: 1052695 - RNA, 19 nt, Homo sapiens
caucuguggcccugugaaa

SEQ ID NO: 1052696 - RNA, 19 nt, Homo sapiens
agacagguagguuaauaau

SEQ ID NO: 1052697 - RNA, 19 nt, Homo sapiens
cacagaggcuccaauaccu

SEQ ID NO: 1052698 - RNA, 19 nt, Homo sapiens
gagaccagcaggcccuuuc

SEQ ID NO: 1052699 - RNA, 19 nt, Homo sapiens
guauaauugugcccgucuu

SEQ ID NO: 1052700 - RNA, 19 nt, Homo sapiens
cccuguagguucucccaaa

SEQ ID NO: 1052701 - RNA, 19 nt, Homo sapiens
ggagccacgcccuugaaga

SEQ ID NO: 1052702 - RNA, 19 nt, Homo sapiens
caaguguaguauggaacaa

SEQ ID NO: 1052703 - RNA, 19 nt, Homo sapiens
uggcaccuuugucauguau

SEQ ID NO: 1052704 - RNA, 19 nt, Homo sapiens
acagcaguaucuccacgaa

SEQ ID NO: 1052705 - RNA, 19 nt, Homo sapiens
ugacagaagcaccucaucu

SEQ ID NO: 1052706 - RNA, 19 nt, Homo sapiens
acacugaagaccagguuga

SEQ ID NO: 1052707 - RNA, 19 nt, Homo sapiens
cagguagguuaauaaugau

SEQ ID NO: 1052708 - RNA, 19 nt, Homo sapiens
acucagacagguagguuaa

SEQ ID NO: 1052709 - RNA, 19 nt, Homo sapiens
guacuuccacaguuaugau

SEQ ID NO: 1052710 - RNA, 19 nt, Homo sapiens
gggaauguucacaaaguca

SEQ ID NO: 1052711 - RNA, 19 nt, Homo sapiens
ccacagaggcuccaauacc

SEQ ID NO: 1052712 - RNA, 19 nt, Homo sapiens
ccacauuuaaggccacaga

SEQ ID NO: 1052713 - RNA, 19 nt, Homo sapiens
gggccagcgcgucuuacua

SEQ ID NO: 1052714 - RNA, 19 nt, Homo sapiens
ggugaggcauagacaacca

SEQ ID NO: 1052715 - RNA, 19 nt, Homo sapiens
gaagauggaugggaaagua

SEQ ID NO: 1052716 - RNA, 19 nt, Homo sapiens
cagaagaacuuuaugauga

SEQ ID NO: 1052717 - RNA, 19 nt, Homo sapiens
gaaggaacaucuggaauga

SEQ ID NO: 1052718 - RNA, 19 nt, Homo sapiens
gagguuaacuccauauuuc

SEQ ID NO: 1052719 - RNA, 19 nt, Homo sapiens
cauuugagcugccuucaua

SEQ ID NO: 1052720 - RNA, 19 nt, Homo sapiens
ggauaggaguuauauauuc

SEQ ID NO: 1052721 - RNA, 19 nt, Homo sapiens
gaacucuucuuugaacuuu

SEQ ID NO: 1052722 - RNA, 19 nt, Homo sapiens
uagcagagcuggugauguu

SEQ ID NO: 1052723 - RNA, 19 nt, Homo sapiens
ggacaauguuacaagagua

SEQ ID NO: 1052724 - RNA, 19 nt, Homo sapiens
gcaacacucuuccgaugaa

SEQ ID NO: 1052725 - RNA, 19 nt, Homo sapiens
cagaguaccuaaguaauuu

SEQ ID NO: 1052726 - RNA, 19 nt, Homo sapiens
gaggauaggaguuauauau

SEQ ID NO: 1052727 - RNA, 19 nt, Homo sapiens
guaaauaguucuguaguag

SEQ ID NO: 1052728 - RNA, 19 nt, Homo sapiens
ggauaagaauguaaugaug

SEQ ID NO: 1052729 - RNA, 19 nt, Homo sapiens
caagagaccugcuaguaca

SEQ ID NO: 1052730 - RNA, 19 nt, Homo sapiens
guaaugaugucugcuagaa

SEQ ID NO: 1052731 - RNA, 19 nt, Homo sapiens
ugaaagugcucaagaaaca

SEQ ID NO: 1052732 - RNA, 19 nt, Homo sapiens
caaugaaagugcucaagaa

SEQ ID NO: 1052733 - RNA, 19 nt, Homo sapiens
gaacauguggcagcaauuu

SEQ ID NO: 1052734 - RNA, 19 nt, Homo sapiens
gaaaagaauuugugaggaa

SEQ ID NO: 1052735 - RNA, 19 nt, Homo sapiens
gaacuuugauucaccucuu

SEQ ID NO: 1052736 - RNA, 19 nt, Homo sapiens
caagaacucuggagaaguc

SEQ ID NO: 1052737 - RNA, 19 nt, Homo sapiens
cuagaagaaugcuaaguuu

SEQ ID NO: 1052738 - RNA, 19 nt, Homo sapiens
caacugcaauggcuggaaa

SEQ ID NO: 1052739 - RNA, 19 nt, Homo sapiens
uaaccaagauccuucuguu

SEQ ID NO: 1052740 - RNA, 19 nt, Homo sapiens
gaucuucucuccugcaauc

SEQ ID NO: 1052741 - RNA, 19 nt, Homo sapiens
gcuaaugguaggaauguua

SEQ ID NO: 1052742 - RNA, 19 nt, Homo sapiens
ggaaaugccagaagaggaa

SEQ ID NO: 1052743 - RNA, 19 nt, Homo sapiens
gaagaaugcuaaguuugug

SEQ ID NO: 1052744 - RNA, 19 nt, Homo sapiens
ggaggaugcugauggugaa

SEQ ID NO: 1052745 - RNA, 19 nt, Homo sapiens
gaaagaagagaaugcugaa

SEQ ID NO: 1052746 - RNA, 19 nt, Homo sapiens
ggccaugacugaagaacuu

SEQ ID NO: 1052747 - RNA, 19 nt, Homo sapiens
ggagauaacagcucgaugu

SEQ ID NO: 1052748 - RNA, 19 nt, Homo sapiens
acaagcaucucaucaccua

SEQ ID NO: 1052749 - RNA, 19 nt, Homo sapiens
gcagagcuggugauguuua

SEQ ID NO: 1052750 - RNA, 19 nt, Homo sapiens
gaagaggaaauacauugaa

SEQ ID NO: 1052751 - RNA, 19 nt, Homo sapiens
gcuuugaucuugcugagaa

SEQ ID NO: 1052752 - RNA, 19 nt, Homo sapiens
gagaccugcuaguacaaua

SEQ ID NO: 1052753 - RNA, 19 nt, Homo sapiens
uccaagaccuggcucagua

SEQ ID NO: 1052754 - RNA, 19 nt, Homo sapiens
gcaaugaaagugcucaaga

SEQ ID NO: 1052755 - RNA, 19 nt, Homo sapiens
gcuuugacauucuuucuug

SEQ ID NO: 1052756 - RNA, 19 nt, Homo sapiens
aaauaguggugguaaugua

SEQ ID NO: 1052757 - RNA, 19 nt, Homo sapiens
aagcaagaguacaagaaua

SEQ ID NO: 1052758 - RNA, 19 nt, Homo sapiens
gccauucucuugauucaug

SEQ ID NO: 1052759 - RNA, 19 nt, Homo sapiens
uaucacaacugcauguuuc

SEQ ID NO: 1052760 - RNA, 19 nt, Homo sapiens
gauggugaauggauugaug

SEQ ID NO: 1052761 - RNA, 19 nt, Homo sapiens
gacaagaacucuggagaag

SEQ ID NO: 1052762 - RNA, 19 nt, Homo sapiens
aaagagaaguaaccaagau

SEQ ID NO: 1052763 - RNA, 19 nt, Homo sapiens
gaagaacuuuaugaugaug

SEQ ID NO: 1052764 - RNA, 19 nt, Homo sapiens
gaagcaagaguacaagaau

SEQ ID NO: 1052765 - RNA, 19 nt, Homo sapiens
acacaaggauaagaaugua

SEQ ID NO: 1052766 - RNA, 19 nt, Homo sapiens
aaccagagguguuuaacuu

SEQ ID NO: 1052767 - RNA, 19 nt, Homo sapiens
ccagaguaccuaaguaauu

SEQ ID NO: 1052768 - RNA, 19 nt, Homo sapiens
gauaaacuucugcgaaaga

SEQ ID NO: 1052769 - RNA, 19 nt, Homo sapiens
ugaggucacugaggccuua

SEQ ID NO: 1052770 - RNA, 19 nt, Homo sapiens
gacuaacucugugaggaua

SEQ ID NO: 1052771 - RNA, 19 nt, Homo sapiens
caucagcacuagccgaguu

SEQ ID NO: 1052772 - RNA, 19 nt, Homo sapiens
gaaucaaugcuauaaagga

SEQ ID NO: 1052773 - RNA, 19 nt, Homo sapiens
ggagagguuugaagugaag

SEQ ID NO: 1052774 - RNA, 19 nt, Homo sapiens
gaaaacugcugaacaugug

SEQ ID NO: 1052775 - RNA, 19 nt, Homo sapiens
ggagaagucaugacaguag

SEQ ID NO: 1052776 - RNA, 19 nt, Homo sapiens
gguaggaauguuaauguaa

SEQ ID NO: 1052777 - RNA, 19 nt, Homo sapiens
gaauauggagaauuagaug

SEQ ID NO: 1052778 - RNA, 19 nt, Homo sapiens
cuacagaggccuccauaga

SEQ ID NO: 1052779 - RNA, 19 nt, Homo sapiens
guaggaaucaaugcuauaa

SEQ ID NO: 1052780 - RNA, 19 nt, Homo sapiens
gcaagagaccugcuaguac

SEQ ID NO: 1052781 - RNA, 19 nt, Homo sapiens
guaaauaguggugguaaug

SEQ ID NO: 1052782 - RNA, 19 nt, Homo sapiens
ugacaaagagacaagacua

SEQ ID NO: 1052783 - RNA, 19 nt, Homo sapiens
ggaggaggaugcugauggu

SEQ ID NO: 1052784 - RNA, 19 nt, Homo sapiens
guacaagaauauggagaau

SEQ ID NO: 1052785 - RNA, 19 nt, Homo sapiens
aaggagagguuugaaguga

SEQ ID NO: 1052786 - RNA, 19 nt, Homo sapiens
cagaagaggaaauacauug

SEQ ID NO: 1052787 - RNA, 19 nt, Homo sapiens
agaccuggcucaguauaaa

SEQ ID NO: 1052788 - RNA, 19 nt, Homo sapiens
ugauugaacucuacagaag

SEQ ID NO: 1052789 - RNA, 19 nt, Homo sapiens
gcaaaacacaagaacaaua

SEQ ID NO: 1052790 - RNA, 19 nt, Homo sapiens
aaacacacaaggauaagaa

SEQ ID NO: 1052791 - RNA, 19 nt, Homo sapiens
ccuucagccuguaauauuu

SEQ ID NO: 1052792 - RNA, 19 nt, Homo sapiens
guaaaucaagcauguuugu

SEQ ID NO: 1052793 - RNA, 19 nt, Homo sapiens
gcaagaaaucuccaagaag

SEQ ID NO: 1052794 - RNA, 19 nt, Homo sapiens
agcaagaaaucuccaagaa

SEQ ID NO: 1052795 - RNA, 19 nt, Homo sapiens
cgacaagaacucuggagaa

SEQ ID NO: 1052796 - RNA, 19 nt, Homo sapiens
caucaagccugcuagaacu

SEQ ID NO: 1052797 - RNA, 19 nt, Homo sapiens
gaugaagaacagcaagaaa

SEQ ID NO: 1052798 - RNA, 19 nt, Homo sapiens
guaaggagagguuugaagu

SEQ ID NO: 1052799 - RNA, 19 nt, Homo sapiens
augauaaacuucugcgaaa

SEQ ID NO: 1052800 - RNA, 19 nt, Homo sapiens
cauagaagcaagaguacaa

SEQ ID NO: 1052801 - RNA, 19 nt, Homo sapiens
gaugucugcuagaacuuug

SEQ ID NO: 1052802 - RNA, 19 nt, Homo sapiens
caaagagaaguaaccaaga

SEQ ID NO: 1052803 - RNA, 19 nt, Homo sapiens
ugaucuugcugagaaauaa

SEQ ID NO: 1052804 - RNA, 19 nt, Homo sapiens
ggacuaacucugugaggau

SEQ ID NO: 1052805 - RNA, 19 nt, Homo sapiens
auaagaaucucaucaaucc

SEQ ID NO: 1052806 - RNA, 19 nt, Homo sapiens
aaagguuucuaaugccaaa

SEQ ID NO: 1052807 - RNA, 19 nt, Homo sapiens
acaggacaauguuacaaga

SEQ ID NO: 1052808 - RNA, 19 nt, Homo sapiens
gcacuacgagaugcacuuu

SEQ ID NO: 1052809 - RNA, 19 nt, Homo sapiens
ccgcauggcccaaaugaga

SEQ ID NO: 1052810 - RNA, 19 nt, Homo sapiens
ugacuguggcaaacaauuu

SEQ ID NO: 1052811 - RNA, 19 nt, Homo sapiens
caguguaaauaguucugua

SEQ ID NO: 1052812 - RNA, 19 nt, Homo sapiens
ccuagaagaaugcuaaguu

SEQ ID NO: 1052813 - RNA, 19 nt, Homo sapiens
ugcaauggcuggaaagaca

SEQ ID NO: 1052814 - RNA, 19 nt, Homo sapiens
acagaggccuccauagaag

SEQ ID NO: 1052815 - RNA, 19 nt, Homo sapiens
gaaaggagcuaguuugcaa

SEQ ID NO: 1052816 - RNA, 19 nt, Homo sapiens
ggaggaaugugacuacuug

SEQ ID NO: 1052817 - RNA, 19 nt, Homo sapiens
ggacuaaaguucccagugu

SEQ ID NO: 1052818 - RNA, 19 nt, Homo sapiens
ggagcuaguuugcaauaaa

SEQ ID NO: 1052819 - RNA, 19 nt, Homo sapiens
gaccacagaacaauaaaua

SEQ ID NO: 1052820 - RNA, 19 nt, Homo sapiens
caagaacccuuaucuccaa

SEQ ID NO: 1052821 - RNA, 19 nt, Homo sapiens
aaucuuggcucaguauuua

SEQ ID NO: 1052822 - RNA, 19 nt, Homo sapiens
gcucacagcucucuugucu

SEQ ID NO: 1052823 - RNA, 19 nt, Homo sapiens
agaaacaucuaucgucuau

SEQ ID NO: 1052824 - RNA, 19 nt, Homo sapiens
acaguuggaugcugcaaua

SEQ ID NO: 1052825 - RNA, 19 nt, Homo sapiens
gaggaacucuaucccaaga

SEQ ID NO: 1052826 - RNA, 19 nt, Homo sapiens
ggagaaaggagcuaguuug

SEQ ID NO: 1052827 - RNA, 19 nt, Homo sapiens
ccagagaccucaccaaacu

SEQ ID NO: 1052828 - RNA, 19 nt, Homo sapiens
auaaauaugugccaucaga

SEQ ID NO: 1052829 - RNA, 19 nt, Homo sapiens
ucccuuaccugcauuauga

SEQ ID NO: 1052830 - RNA, 19 nt, Homo sapiens
caauaaauaugugccauca

SEQ ID NO: 1052831 - RNA, 19 nt, Homo sapiens
gcagagggagugcugagua

SEQ ID NO: 1052832 - RNA, 19 nt, Homo sapiens
ccacagaacaauaaauaug

SEQ ID NO: 1052833 - RNA, 19 nt, Homo sapiens
gcagcagccuggagucaug

SEQ ID NO: 1052834 - RNA, 19 nt, Homo sapiens
gaucugaaggguaguuuga

SEQ ID NO: 1052835 - RNA, 19 nt, Homo sapiens
ggagagcaucccaguguuu

SEQ ID NO: 1052836 - RNA, 19 nt, Homo sapiens
caggagcaaucaucccuuu

SEQ ID NO: 1052837 - RNA, 19 nt, Homo sapiens
gggacuagcuacaccaaca

SEQ ID NO: 1052838 - RNA, 19 nt, Homo sapiens
gcaggguggcuccuccuua

SEQ ID NO: 1052839 - RNA, 19 nt, Homo sapiens
gaagcucaccacacacaaa

SEQ ID NO: 1052840 - RNA, 19 nt, Homo sapiens
cggagcaucuguaugauuc

SEQ ID NO: 1052841 - RNA, 19 nt, Homo sapiens
ggucagacuuccucagagu

SEQ ID NO: 1052842 - RNA, 19 nt, Homo sapiens
ggagcacgaugacguagca

SEQ ID NO: 1052843 - RNA, 19 nt, Homo sapiens
gccagucccuuccugauuc

SEQ ID NO: 1052844 - RNA, 19 nt, Homo sapiens
cuacagcccuggacacagu

SEQ ID NO: 1052845 - RNA, 19 nt, Homo sapiens
uaaaggaacccaaguacca

SEQ ID NO: 1052846 - RNA, 19 nt, Homo sapiens
ggccagagaccucaccaaa

SEQ ID NO: 1052847 - RNA, 19 nt, Homo sapiens
gagcagcaguggagagcau

SEQ ID NO: 1052848 - RNA, 19 nt, Homo sapiens
caggucggcuggaggcuuu

SEQ ID NO: 1052849 - RNA, 19 nt, Homo sapiens
ggucaaauccauucccaau

SEQ ID NO: 1052850 - RNA, 19 nt, Homo sapiens
gagcuaguuugcaauaaaa

SEQ ID NO: 1052851 - RNA, 19 nt, Homo sapiens
gagaaacaucuaucgucua

SEQ ID NO: 1052852 - RNA, 19 nt, Homo sapiens
ggaacucuaucccaagaac

SEQ ID NO: 1052853 - RNA, 19 nt, Homo sapiens
gacagagcaugccacacaa

SEQ ID NO: 1052854 - RNA, 19 nt, Homo sapiens
agacagagcaugccacaca

SEQ ID NO: 1052855 - RNA, 19 nt, Homo sapiens
cagagcugcuacaagauga

SEQ ID NO: 1052856 - RNA, 19 nt, Homo sapiens
gugacagccucguggacua

SEQ ID NO: 1052857 - RNA, 19 nt, Homo sapiens
uuagaccacagaacaauaa

SEQ ID NO: 1052858 - RNA, 19 nt, Homo sapiens
cuacagggacaaacaguug

SEQ ID NO: 1052859 - RNA, 19 nt, Homo sapiens
gggagaaaggagcuaguuu

SEQ ID NO: 1052860 - RNA, 19 nt, Homo sapiens
gcuuccagauccuguguga

SEQ ID NO: 1052861 - RNA, 19 nt, Homo sapiens
acaccaacauaugcacuuu

SEQ ID NO: 1052862 - RNA, 19 nt, Homo sapiens
aggacaggcugcauuucua

SEQ ID NO: 1052863 - RNA, 19 nt, Homo sapiens
gugauuagaccacagaaca

SEQ ID NO: 1052864 - RNA, 19 nt, Homo sapiens
ggagcccagugucuucaug

SEQ ID NO: 1052865 - RNA, 19 nt, Homo sapiens
cagcuucccuuaccugcau

SEQ ID NO: 1052866 - RNA, 19 nt, Homo sapiens
cagagggagugcugaguag

SEQ ID NO: 1052867 - RNA, 19 nt, Homo sapiens
gcaggagcccagugucuuc

SEQ ID NO: 1052868 - RNA, 19 nt, Homo sapiens
gagagcaucccaguguuug

SEQ ID NO: 1052869 - RNA, 19 nt, Homo sapiens
acacugcaguugggacauu

SEQ ID NO: 1052870 - RNA, 19 nt, Homo sapiens
guggagagcaucccagugu

SEQ ID NO: 1052871 - RNA, 19 nt, Homo sapiens
gaaaucuuggcucaguauu

SEQ ID NO: 1052872 - RNA, 19 nt, Homo sapiens
cugauucccuggugcaguu

SEQ ID NO: 1052873 - RNA, 19 nt, Homo sapiens
gaggacaggcugcauuucu

SEQ ID NO: 1052874 - RNA, 19 nt, Homo sapiens
gagaaaggagcuaguuugc

SEQ ID NO: 1052875 - RNA, 19 nt, Homo sapiens
gauuagaccacagaacaau

SEQ ID NO: 1052876 - RNA, 19 nt, Homo sapiens
gacuagcuacaccaacaua

SEQ ID NO: 1052877 - RNA, 19 nt, Homo sapiens
gcacuguguuccucuucgu

SEQ ID NO: 1052878 - RNA, 19 nt, Homo sapiens
caggguggcuccuccuuac

SEQ ID NO: 1052879 - RNA, 19 nt, Homo sapiens
ggugacagcaggagcaauc

SEQ ID NO: 1052880 - RNA, 19 nt, Homo sapiens
caucuaucgucuauuaaac

SEQ ID NO: 1052881 - RNA, 19 nt, Homo sapiens
gcugcuacaagaugaauau

SEQ ID NO: 1052882 - RNA, 19 nt, Homo sapiens
ggagugcugaguagugaug

SEQ ID NO: 1052883 - RNA, 19 nt, Homo sapiens
acccuuaucuccaagacuu

SEQ ID NO: 1052884 - RNA, 19 nt, Homo sapiens
caugaguucuucccaucug

SEQ ID NO: 1052885 - RNA, 19 nt, Homo sapiens
ggccagucccuuccugauu

SEQ ID NO: 1052886 - RNA, 19 nt, Homo sapiens
uggcugacaugcugagcuu

SEQ ID NO: 1052887 - RNA, 19 nt, Homo sapiens
ggacaggcugcauuucuac

SEQ ID NO: 1052888 - RNA, 19 nt, Homo sapiens
gggaagcucaccacacaca

SEQ ID NO: 1052889 - RNA, 19 nt, Homo sapiens
gaacccuuaucuccaagac

SEQ ID NO: 1052890 - RNA, 19 nt, Homo sapiens
aaggagcuaguuugcaaua

SEQ ID NO: 1052891 - RNA, 19 nt, Homo sapiens
gagcgaccgauuccaagga

SEQ ID NO: 1052892 - RNA, 19 nt, Homo sapiens
gagggagugcugaguagug

SEQ ID NO: 1052893 - RNA, 19 nt, Homo sapiens
ugacagccucguggacuaa

SEQ ID NO: 1052894 - RNA, 19 nt, Homo sapiens
guaguuugagcucccuaaa

SEQ ID NO: 1052895 - RNA, 19 nt, Homo sapiens
uggaagccuuggccagaga

SEQ ID NO: 1052896 - RNA, 19 nt, Homo sapiens
agaaaucuuggcucaguau

SEQ ID NO: 1052897 - RNA, 19 nt, Homo sapiens
uggaggacaggcugcauuu

SEQ ID NO: 1052898 - RNA, 19 nt, Homo sapiens
gagcaucuguaugauucag

SEQ ID NO: 1052899 - RNA, 19 nt, Homo sapiens
agggagugcugaguaguga

SEQ ID NO: 1052900 - RNA, 19 nt, Homo sapiens
ggacuagcuacaccaacau

SEQ ID NO: 1052901 - RNA, 19 nt, Homo sapiens
gcugagcuucugugggaaa

SEQ ID NO: 1052902 - RNA, 19 nt, Homo sapiens
ggaugcaggagcccagugu

SEQ ID NO: 1052903 - RNA, 19 nt, Homo sapiens
gacagcaggagcaaucauc

SEQ ID NO: 1052904 - RNA, 19 nt, Homo sapiens
ggacaaacaguuggaugcu

SEQ ID NO: 1052905 - RNA, 19 nt, Homo sapiens
ggaacccaaguaccaggaa

SEQ ID NO: 1052906 - RNA, 19 nt, Homo sapiens
guaugauucagaaguacaa

SEQ ID NO: 1052907 - RNA, 19 nt, Homo sapiens
ggaagcucaccacacacaa

SEQ ID NO: 1052908 - RNA, 19 nt, Homo sapiens
uggagagcaucccaguguu

SEQ ID NO: 1052909 - RNA, 19 nt, Homo sapiens
gcucaccacacacaaagag

SEQ ID NO: 1052910 - RNA, 19 nt, Homo sapiens
gcauuucuacguggaggaa

SEQ ID NO: 1052911 - RNA, 19 nt, Homo sapiens
gguaguuugagcucccuaa

SEQ ID NO: 1052912 - RNA, 19 nt, Homo sapiens
cuagcuacaccaacauaug

SEQ ID NO: 1052913 - RNA, 19 nt, Homo sapiens
gcugagggguauagacaga

SEQ ID NO: 1052914 - RNA, 19 nt, Homo sapiens
uagcacagcugcaaacuuu

SEQ ID NO: 1052915 - RNA, 19 nt, Homo sapiens
uaaagaaacugacaaacug

SEQ ID NO: 1052916 - RNA, 19 nt, Homo sapiens
ggaaacauguauauuagug

SEQ ID NO: 1052917 - RNA, 19 nt, Homo sapiens
gguauagaguccaacuuua

SEQ ID NO: 1052918 - RNA, 19 nt, Homo sapiens
gugcaugaauuacugaaua

SEQ ID NO: 1052919 - RNA, 19 nt, Homo sapiens
acacagagcuaccugacua

SEQ ID NO: 1052920 - RNA, 19 nt, Homo sapiens
ggagaaaucuaugugaaga

SEQ ID NO: 1052921 - RNA, 19 nt, Homo sapiens
gcagauccguuaaacagaa

SEQ ID NO: 1052922 - RNA, 19 nt, Homo sapiens
ggaguugcuuuguuuauga

SEQ ID NO: 1052923 - RNA, 19 nt, Homo sapiens
ccaaauuacugcuuaugaa

SEQ ID NO: 1052924 - RNA, 19 nt, Homo sapiens
gcaaacaacuauaaauggu

SEQ ID NO: 1052925 - RNA, 19 nt, Homo sapiens
gcauauagauggccuugau

SEQ ID NO: 1052926 - RNA, 19 nt, Homo sapiens
ucaaauggcuguucaaagg

SEQ ID NO: 1052927 - RNA, 19 nt, Homo sapiens
gaaauaaagccagcauuga

SEQ ID NO: 1052928 - RNA, 19 nt, Homo sapiens
ggaccuaccugaagagaag

SEQ ID NO: 1052929 - RNA, 19 nt, Homo sapiens
guagauaagugcuaauuac

SEQ ID NO: 1052930 - RNA, 19 nt, Homo sapiens
caaaugugguucuaguuga

SEQ ID NO: 1052931 - RNA, 19 nt, Homo sapiens
cgacagaguucuauucagu

SEQ ID NO: 1052932 - RNA, 19 nt, Homo sapiens
uaugaaagcucagcaaguu

SEQ ID NO: 1052933 - RNA, 19 nt, Homo sapiens
gagaugaauucacgucgaa

SEQ ID NO: 1052934 - RNA, 19 nt, Homo sapiens
gaauucacgucgaaggaaa

SEQ ID NO: 1052935 - RNA, 19 nt, Homo sapiens
aaccauggguccacuguua

SEQ ID NO: 1052936 - RNA, 19 nt, Homo sapiens
guauagaguccaacuuuaa

SEQ ID NO: 1052937 - RNA, 19 nt, Homo sapiens
gugaagaggcuuuguuaaa

SEQ ID NO: 1052938 - RNA, 19 nt, Homo sapiens
ggagacuguuugaauguga

SEQ ID NO: 1052939 - RNA, 19 nt, Homo sapiens
ucacuaacauugucaccuu

SEQ ID NO: 1052940 - RNA, 19 nt, Homo sapiens
uggagaauaugaugugaaa

SEQ ID NO: 1052941 - RNA, 19 nt, Homo sapiens
agacccaaauuacugcuua

SEQ ID NO: 1052942 - RNA, 19 nt, Homo sapiens
cagcauugaucacuuaauc

SEQ ID NO: 1052943 - RNA, 19 nt, Homo sapiens
ugaagcaugugauuaggaa

SEQ ID NO: 1052944 - RNA, 19 nt, Homo sapiens
ccaagauacuccuguggaa

SEQ ID NO: 1052945 - RNA, 19 nt, Homo sapiens
guaaagaaacugacaaacu

SEQ ID NO: 1052946 - RNA, 19 nt, Homo sapiens
gaacuggguaugauguuga

SEQ ID NO: 1052947 - RNA, 19 nt, Homo sapiens
gguucuaguugacuucuuu

SEQ ID NO: 1052948 - RNA, 19 nt, Homo sapiens
caagaaggaaacauguaua

SEQ ID NO: 1052949 - RNA, 19 nt, Homo sapiens
agauggaguugcuuuguuu

SEQ ID NO: 1052950 - RNA, 19 nt, Homo sapiens
gguagauaagugcuaauua

SEQ ID NO: 1052951 - RNA, 19 nt, Homo sapiens
caguagguguuucuuugua

SEQ ID NO: 1052952 - RNA, 19 nt, Homo sapiens
ucaaaugccuauaauacca

SEQ ID NO: 1052953 - RNA, 19 nt, Homo sapiens
ggccuuacuuugugauuau

SEQ ID NO: 1052954 - RNA, 19 nt, Homo sapiens
gacagaggcuacagaugga

SEQ ID NO: 1052955 - RNA, 19 nt, Homo sapiens
guagguguuucuuuguauu

SEQ ID NO: 1052956 - RNA, 19 nt, Homo sapiens
gaguuaaugugaucaugau

SEQ ID NO: 1052957 - RNA, 19 nt, Homo sapiens
uagcucaaguugugcauga

SEQ ID NO: 1052958 - RNA, 19 nt, Homo sapiens
gaacugucaagugcaauuu

SEQ ID NO: 1052959 - RNA, 19 nt, Homo sapiens
ggcaggcucuggacuccua

SEQ ID NO: 1052960 - RNA, 19 nt, Homo sapiens
caaaaucagucaagaagga

SEQ ID NO: 1052961 - RNA, 19 nt, Homo sapiens
ccaaccguguuuauagaaa

SEQ ID NO: 1052962 - RNA, 19 nt, Homo sapiens
ucaaguugugcaugaauua

SEQ ID NO: 1052963 - RNA, 19 nt, Homo sapiens
gguaugauguugagcuuac

SEQ ID NO: 1052964 - RNA, 19 nt, Homo sapiens
gaaaggagaacuggguaug

SEQ ID NO: 1052965 - RNA, 19 nt, Homo sapiens
gaguuaauccgguuguuug

SEQ ID NO: 1052966 - RNA, 19 nt, Homo sapiens
cagauggaguugcuuuguu

SEQ ID NO: 1052967 - RNA, 19 nt, Homo sapiens
agaaauaaagccagcauug

SEQ ID NO: 1052968 - RNA, 19 nt, Homo sapiens
ccaaaugugguucuaguug

SEQ ID NO: 1052969 - RNA, 19 nt, Homo sapiens
uagauuacacgaucgcaua

SEQ ID NO: 1052970 - RNA, 19 nt, Homo sapiens
ggugaacugucaagugcaa

SEQ ID NO: 1052971 - RNA, 19 nt, Homo sapiens
ugaagaggcuuuguuaaaa

SEQ ID NO: 1052972 - RNA, 19 nt, Homo sapiens
ucugggaacuacaaacaaa

SEQ ID NO: 1052973 - RNA, 19 nt, Homo sapiens
uuugcagccuuauucauua

SEQ ID NO: 1052974 - RNA, 19 nt, Homo sapiens
ggagcgaauuuaagauuuu

SEQ ID NO: 1052975 - RNA, 19 nt, Homo sapiens
gcuuuguacucuucacuga

SEQ ID NO: 1052976 - RNA, 19 nt, Homo sapiens
agaaugccgugcaaacaga

SEQ ID NO: 1052977 - RNA, 19 nt, Homo sapiens
uggagcgaauuuaagauuu

SEQ ID NO: 1052978 - RNA, 19 nt, Homo sapiens
gaguugcuuuguuuaugaa

SEQ ID NO: 1052979 - RNA, 19 nt, Homo sapiens
gacgcucuaucgguaguua

SEQ ID NO: 1052980 - RNA, 19 nt, Homo sapiens
uagauggccuugaugauac

SEQ ID NO: 1052981 - RNA, 19 nt, Homo sapiens
aaacaaacgugccaaaaca

SEQ ID NO: 1052982 - RNA, 19 nt, Homo sapiens
ggugauaguuuuaaugaga

SEQ ID NO: 1052983 - RNA, 19 nt, Homo sapiens
uggcauagaagaugaauuc

SEQ ID NO: 1052984 - RNA, 19 nt, Homo sapiens
ucaagaaggaaacauguau

SEQ ID NO: 1052985 - RNA, 19 nt, Homo sapiens
gcucuggacuccuaaagcu

SEQ ID NO: 1052986 - RNA, 19 nt, Homo sapiens
auagauggccuugaugaua

SEQ ID NO: 1052987 - RNA, 19 nt, Homo sapiens
agccagcauugaucacuua

SEQ ID NO: 1052988 - RNA, 19 nt, Homo sapiens
gagaguuaaugugaucaug

SEQ ID NO: 1052989 - RNA, 19 nt, Homo sapiens
ucuagcagcagauccguua

SEQ ID NO: 1052990 - RNA, 19 nt, Homo sapiens
ucggagaaaucuaugugaa

SEQ ID NO: 1052991 - RNA, 19 nt, Homo sapiens
ggagaacuggguaugaugu

SEQ ID NO: 1052992 - RNA, 19 nt, Homo sapiens
gcagaaugccgugcaaaca

SEQ ID NO: 1052993 - RNA, 19 nt, Homo sapiens
aaauaaagccagcauugau

SEQ ID NO: 1052994 - RNA, 19 nt, Homo sapiens
gaagaaauaaagccagcau

SEQ ID NO: 1052995 - RNA, 19 nt, Homo sapiens
gacagaguucuauucagua

SEQ ID NO: 1052996 - RNA, 19 nt, Homo sapiens
cauaaugccaguuugguau

SEQ ID NO: 1052997 - RNA, 19 nt, Homo sapiens
acugaaagcugaaaacauu

SEQ ID NO: 1052998 - RNA, 19 nt, Homo sapiens
gauggaguugcuuuguuua

SEQ ID NO: 1052999 - RNA, 19 nt, Homo sapiens
caaaggaacaggacaaagc

SEQ ID NO: 1053000 - RNA, 19 nt, Homo sapiens
ggaugagagucccacaaag

SEQ ID NO: 1053001 - RNA, 19 nt, Homo sapiens
gggcauugaggaugauauu

SEQ ID NO: 1053002 - RNA, 19 nt, Homo sapiens
gagcugcuauuuuacuauu

SEQ ID NO: 1053003 - RNA, 19 nt, Homo sapiens
ucagugaagguaagauaaa

SEQ ID NO: 1053004 - RNA, 19 nt, Homo sapiens
ccauaaugccaguuuggua

SEQ ID NO: 1053005 - RNA, 19 nt, Homo sapiens
cagcagauccguuaaacag

SEQ ID NO: 1053006 - RNA, 19 nt, Homo sapiens
ccacaaaggaacaggacaa

SEQ ID NO: 1053007 - RNA, 19 nt, Homo sapiens
gaugagagucccacaaagg

SEQ ID NO: 1053008 - RNA, 19 nt, Homo sapiens
caaaacuucuggccucuga

SEQ ID NO: 1053009 - RNA, 19 nt, Homo sapiens
aaaauaccaucaucaguga

SEQ ID NO: 1053010 - RNA, 19 nt, Homo sapiens
caaccguguuuauagaaag

SEQ ID NO: 1053011 - RNA, 19 nt, Homo sapiens
uggcagauggugauaguuu

SEQ ID NO: 1053012 - RNA, 19 nt, Homo sapiens
caaauuacugcuuaugaag

SEQ ID NO: 1053013 - RNA, 19 nt, Homo sapiens
gcugcguuguguugaauga

SEQ ID NO: 1053014 - RNA, 19 nt, Homo sapiens
ggacagagguaaucaaauu

SEQ ID NO: 1053015 - RNA, 19 nt, Homo sapiens
gcaagaagcugcccuuuga

SEQ ID NO: 1053016 - RNA, 19 nt, Homo sapiens
gaaaugagagucacaaauu

SEQ ID NO: 1053017 - RNA, 19 nt, Homo sapiens
gaacugaagcccuaucaua

SEQ ID NO: 1053018 - RNA, 19 nt, Homo sapiens
ggaaugugcugaccuucua

SEQ ID NO: 1053019 - RNA, 19 nt, Homo sapiens
aaacaucacugaaaugaga

SEQ ID NO: 1053020 - RNA, 19 nt, Homo sapiens
agaaagagcucauugaauc

SEQ ID NO: 1053021 - RNA, 19 nt, Homo sapiens
gaaagacauugaauccauu

SEQ ID NO: 1053022 - RNA, 19 nt, Homo sapiens
ugacaaagauccugugguu

SEQ ID NO: 1053023 - RNA, 19 nt, Homo sapiens
ggaaagacauugaauccau

SEQ ID NO: 1053024 - RNA, 19 nt, Homo sapiens
ggagauaacauauauggaa

SEQ ID NO: 1053025 - RNA, 19 nt, Homo sapiens
cagaggagauaacauauau

SEQ ID NO: 1053026 - RNA, 19 nt, Homo sapiens
gaagaugugguccuacuaa

SEQ ID NO: 1053027 - RNA, 19 nt, Homo sapiens
gaagcugcccuuugaaauu

SEQ ID NO: 1053028 - RNA, 19 nt, Homo sapiens
gcuccaggcuuuagauuau

SEQ ID NO: 1053029 - RNA, 19 nt, Homo sapiens
gggaauaucucuguaaucu

SEQ ID NO: 1053030 - RNA, 19 nt, Homo sapiens
gacauugaauccauuagaa

SEQ ID NO: 1053031 - RNA, 19 nt, Homo sapiens
ucagugauguguuuagaaa

SEQ ID NO: 1053032 - RNA, 19 nt, Homo sapiens
aagcugcccuuugaaauua

SEQ ID NO: 1053033 - RNA, 19 nt, Homo sapiens
gcagaaagagcucauugaa

SEQ ID NO: 1053034 - RNA, 19 nt, Homo sapiens
gagauuggauuucuucaag

SEQ ID NO: 1053035 - RNA, 19 nt, Homo sapiens
ucacaaagacuggaauuaa

SEQ ID NO: 1053036 - RNA, 19 nt, Homo sapiens
ggaggugguucaauucgaa

SEQ ID NO: 1053037 - RNA, 19 nt, Homo sapiens
aauaggaggugguucaauu

SEQ ID NO: 1053038 - RNA, 19 nt, Homo sapiens
ggaauucuccaguugcuaa

SEQ ID NO: 1053039 - RNA, 19 nt, Homo sapiens
ucagaguccucaacaguuu

SEQ ID NO: 1053040 - RNA, 19 nt, Homo sapiens
caaaucauguuucucauac

SEQ ID NO: 1053041 - RNA, 19 nt, Homo sapiens
ccacaggucuaacaaucaa

SEQ ID NO: 1053042 - RNA, 19 nt, Homo sapiens
gacacucgcuuuggaauga

SEQ ID NO: 1053043 - RNA, 19 nt, Homo sapiens
caacgaagaaacagauaaa

SEQ ID NO: 1053044 - RNA, 19 nt, Homo sapiens
cacaaagacuggaauuaau

SEQ ID NO: 1053045 - RNA, 19 nt, Homo sapiens
aaucagaggagauaacaua

SEQ ID NO: 1053046 - RNA, 19 nt, Homo sapiens
aaagucagaucuagaguuc

SEQ ID NO: 1053047 - RNA, 19 nt, Homo sapiens
ggaauugccuuaggguuag

SEQ ID NO: 1053048 - RNA, 19 nt, Homo sapiens
cauaauauagugaggagua

SEQ ID NO: 1053049 - RNA, 19 nt, Homo sapiens
gcaacauucuucaccacaa

SEQ ID NO: 1053050 - RNA, 19 nt, Homo sapiens
aaucuuaccuguauuccuu

SEQ ID NO: 1053051 - RNA, 19 nt, Homo sapiens
uuacucagauugacauaga

SEQ ID NO: 1053052 - RNA, 19 nt, Homo sapiens
gugaguugauggagcauuu

SEQ ID NO: 1053053 - RNA, 19 nt, Homo sapiens
aaucaagucuuuagaugga

SEQ ID NO: 1053054 - RNA, 19 nt, Homo sapiens
agacugauaugccuuguca

SEQ ID NO: 1053055 - RNA, 19 nt, Homo sapiens
auacccagauaguagauua

SEQ ID NO: 1053056 - RNA, 19 nt, Homo sapiens
ggaaaucuuaccuguauuc

SEQ ID NO: 1053057 - RNA, 19 nt, Homo sapiens
aaacacagagauuggauuu

SEQ ID NO: 1053058 - RNA, 19 nt, Homo sapiens
gaaaaugcuugccccugua

SEQ ID NO: 1053059 - RNA, 19 nt, Homo sapiens
acaaucaagucuuuagaug

SEQ ID NO: 1053060 - RNA, 19 nt, Homo sapiens
gaaagagcucauugaauca

SEQ ID NO: 1053061 - RNA, 19 nt, Homo sapiens
caaagauccugugguuguu

SEQ ID NO: 1053062 - RNA, 19 nt, Homo sapiens
gaaaacaucacugaaauga

SEQ ID NO: 1053063 - RNA, 19 nt, Homo sapiens
guagauuauucacuuagga

SEQ ID NO: 1053064 - RNA, 19 nt, Homo sapiens
cauaauggagucacaaaga

SEQ ID NO: 1053065 - RNA, 19 nt, Homo sapiens
acacagagauuggauuucu

SEQ ID NO: 1053066 - RNA, 19 nt, Homo sapiens
ggucccagauggucaugaa

SEQ ID NO: 1053067 - RNA, 19 nt, Homo sapiens
gcauggguuuguggauaua

SEQ ID NO: 1053068 - RNA, 19 nt, Homo sapiens
gaggaguagcauaauauuu

SEQ ID NO: 1053069 - RNA, 19 nt, Homo sapiens
uuacuuaggugugaaagau

SEQ ID NO: 1053070 - RNA, 19 nt, Homo sapiens
auagagaugucauuuguag

SEQ ID NO: 1053071 - RNA, 19 nt, Homo sapiens
ucugaugguuggcgguuua

SEQ ID NO: 1053072 - RNA, 19 nt, Homo sapiens
gcagaaaacaucacugaaa

SEQ ID NO: 1053073 - RNA, 19 nt, Homo sapiens
gcucauugaaucaugcaua

SEQ ID NO: 1053074 - RNA, 19 nt, Homo sapiens
gaaacacagagauuggauu

SEQ ID NO: 1053075 - RNA, 19 nt, Homo sapiens
agacagacagccugaguuu

SEQ ID NO: 1053076 - RNA, 19 nt, Homo sapiens
gcgggaauaucucuguaau

SEQ ID NO: 1053077 - RNA, 19 nt, Homo sapiens
gaggagauaacauauaugg

SEQ ID NO: 1053078 - RNA, 19 nt, Homo sapiens
ucagaggagauaacauaua

SEQ ID NO: 1053079 - RNA, 19 nt, Homo sapiens
gugcugaccuucuagaaac

SEQ ID NO: 1053080 - RNA, 19 nt, Homo sapiens
gcuuuggaaugaagauuau

SEQ ID NO: 1053081 - RNA, 19 nt, Homo sapiens
ccagauaguagauuauuca

SEQ ID NO: 1053082 - RNA, 19 nt, Homo sapiens
uccaguugcuaauuucaua

SEQ ID NO: 1053083 - RNA, 19 nt, Homo sapiens
gcucuucgguugcaguauc

SEQ ID NO: 1053084 - RNA, 19 nt, Homo sapiens
agugaggaguagcauaaua

SEQ ID NO: 1053085 - RNA, 19 nt, Homo sapiens
gucuaacaaucaagucuuu

SEQ ID NO: 1053086 - RNA, 19 nt, Homo sapiens
gccaauagaaacuggaauu

SEQ ID NO: 1053087 - RNA, 19 nt, Homo sapiens
ugaaggagcaaaauacuua

SEQ ID NO: 1053088 - RNA, 19 nt, Homo sapiens
aggaauugccuuaggguua

SEQ ID NO: 1053089 - RNA, 19 nt, Homo sapiens
gaaauaggaggugguucaa

SEQ ID NO: 1053090 - RNA, 19 nt, Homo sapiens
aaauggcaaugaaauagga

SEQ ID NO: 1053091 - RNA, 19 nt, Homo sapiens
guuuccaaaugcaguauaa

SEQ ID NO: 1053092 - RNA, 19 nt, Homo sapiens
ggaagaugugguccuacua

SEQ ID NO: 1053093 - RNA, 19 nt, Homo sapiens
gguuggcgguuuagacaga

SEQ ID NO: 1053094 - RNA, 19 nt, Homo sapiens
gcuggaaucagaggagaua

SEQ ID NO: 1053095 - RNA, 19 nt, Homo sapiens
caaagacuggaauuaauca

SEQ ID NO: 1053096 - RNA, 19 nt, Homo sapiens
cugcauggguuuguggaua

SEQ ID NO: 1053097 - RNA, 19 nt, Homo sapiens
ggaaucagaggagauaaca

SEQ ID NO: 1053098 - RNA, 19 nt, Homo sapiens
ugucauagccuucccaaag

SEQ ID NO: 1053099 - RNA, 19 nt, Homo sapiens
gaacugugaaagccauaug

SEQ ID NO: 1053100 - RNA, 19 nt, Homo sapiens
gauccagaguuuaauugag

SEQ ID NO: 1053101 - RNA, 19 nt, Homo sapiens
agacagauauuuucagguu

SEQ ID NO: 1053102 - RNA, 19 nt, Homo sapiens
cagaaaacaucacugaaau

SEQ ID NO: 1053103 - RNA, 19 nt, Homo sapiens
gugaggaguagcauaauau

SEQ ID NO: 1053104 - RNA, 19 nt, Homo sapiens
gucauagccuucccaaagu

SEQ ID NO: 1053105 - RNA, 19 nt, Homo sapiens
agaguuuaauugaggguuu

SEQ ID NO: 1053106 - RNA, 19 nt, Homo sapiens
ccacaacgaagaaacagau

SEQ ID NO: 1053107 - RNA, 19 nt, Homo sapiens
gaaggaauccaggcaacau

SEQ ID NO: 1053108 - RNA, 19 nt, Homo sapiens
uaaagucagaucuagaguu

SEQ ID NO: 1053109 - RNA, 19 nt, Homo sapiens
gaugugguccuacuaacug

SEQ ID NO: 1053110 - RNA, 19 nt, Homo sapiens
ggauccagaguuuaauuga

SEQ ID NO: 1053111 - RNA, 19 nt, Homo sapiens
uuaagcaacuucugauggu

SEQ ID NO: 1053112 - RNA, 19 nt, Homo sapiens
ccaucaacauaauauagug

SEQ ID NO: 1053113 - RNA, 19 nt, Homo sapiens
ucacuuaggacagagguaa

SEQ ID NO: 1053114 - RNA, 19 nt, Homo sapiens
gcaagagacuuaacuauga

SEQ ID NO: 1053115 - RNA, 19 nt, Homo sapiens
caagcaagaucccuguuua

SEQ ID NO: 1053116 - RNA, 19 nt, Homo sapiens
gagaguuccuaucuaaaua

SEQ ID NO: 1053117 - RNA, 19 nt, Homo sapiens
gcauuaaguucauugcuuu

SEQ ID NO: 1053118 - RNA, 19 nt, Homo sapiens
ggaaagaggccaguuguuu

SEQ ID NO: 1053119 - RNA, 19 nt, Homo sapiens
gaagugugcugauggaaau

SEQ ID NO: 1053120 - RNA, 19 nt, Homo sapiens
caagaucccuguuuauugu

SEQ ID NO: 1053121 - RNA, 19 nt, Homo sapiens
aaacuuacgucacaucaaa

SEQ ID NO: 1053122 - RNA, 19 nt, Homo sapiens
gaagagcagucaguacauu

SEQ ID NO: 1053123 - RNA, 19 nt, Homo sapiens
ggauuugacuuucuuugaa

SEQ ID NO: 1053124 - RNA, 19 nt, Homo sapiens
ggaagcagcuagugaacga

SEQ ID NO: 1053125 - RNA, 19 nt, Homo sapiens
guucaauucugguauauga

SEQ ID NO: 1053126 - RNA, 19 nt, Homo sapiens
caaaagaccuucacaguau

SEQ ID NO: 1053127 - RNA, 19 nt, Homo sapiens
guaggaagcaagagacuua

SEQ ID NO: 1053128 - RNA, 19 nt, Homo sapiens
gaaaauggcuuaacagucu

SEQ ID NO: 1053129 - RNA, 19 nt, Homo sapiens
cagaauaggauuggaauua

SEQ ID NO: 1053130 - RNA, 19 nt, Homo sapiens
gaaagaggccaguuguuug

SEQ ID NO: 1053131 - RNA, 19 nt, Homo sapiens
gaacgauucccuuugcuaa

SEQ ID NO: 1053132 - RNA, 19 nt, Homo sapiens
gacguuaugugaaucuuaa

SEQ ID NO: 1053133 - RNA, 19 nt, Homo sapiens
gaacuugucucccauuuug

SEQ ID NO: 1053134 - RNA, 19 nt, Homo sapiens
ggaccuacuugcaaacuau

SEQ ID NO: 1053135 - RNA, 19 nt, Homo sapiens
gggcaucucuuuggguaua

SEQ ID NO: 1053136 - RNA, 19 nt, Homo sapiens
gagcaagacuccaucucaa

SEQ ID NO: 1053137 - RNA, 19 nt, Homo sapiens
ggaagcaaauucauacgau

SEQ ID NO: 1053138 - RNA, 19 nt, Homo sapiens
gcaagaucccuguuuauug

SEQ ID NO: 1053139 - RNA, 19 nt, Homo sapiens
gaaggcaugcugcugguua

SEQ ID NO: 1053140 - RNA, 19 nt, Homo sapiens
gcauagacuuucagacaga

SEQ ID NO: 1053141 - RNA, 19 nt, Homo sapiens
ggaaacaggccgaguuaga

SEQ ID NO: 1053142 - RNA, 19 nt, Homo sapiens
gaacagaugcuaaggaaac

SEQ ID NO: 1053143 - RNA, 19 nt, Homo sapiens
gguuagauguuguuugcua

SEQ ID NO: 1053144 - RNA, 19 nt, Homo sapiens
gaaacaggccgaguuagaa

SEQ ID NO: 1053145 - RNA, 19 nt, Homo sapiens
gcaagaaguuacauguauc

SEQ ID NO: 1053146 - RNA, 19 nt, Homo sapiens
ugaguuguccugucacuua

SEQ ID NO: 1053147 - RNA, 19 nt, Homo sapiens
gcagucaugugcaggaguu

SEQ ID NO: 1053148 - RNA, 19 nt, Homo sapiens
gaagcaagagacuuaacua

SEQ ID NO: 1053149 - RNA, 19 nt, Homo sapiens
gaauaugcuucaagaugug

SEQ ID NO: 1053150 - RNA, 19 nt, Homo sapiens
guuaagauguugaguacug

SEQ ID NO: 1053151 - RNA, 19 nt, Homo sapiens
gcaacuagcaggugucuca

SEQ ID NO: 1053152 - RNA, 19 nt, Homo sapiens
ucacuuaaguauccuugaa

SEQ ID NO: 1053153 - RNA, 19 nt, Homo sapiens
cauuugaggugaaccguaa

SEQ ID NO: 1053154 - RNA, 19 nt, Homo sapiens
gagcaagaaguuacaugua

SEQ ID NO: 1053155 - RNA, 19 nt, Homo sapiens
caagagcuguuucuaggau

SEQ ID NO: 1053156 - RNA, 19 nt, Homo sapiens
agaauaugcuucaagaugu

SEQ ID NO: 1053157 - RNA, 19 nt, Homo sapiens
agugauaggucaaagcuuu

SEQ ID NO: 1053158 - RNA, 19 nt, Homo sapiens
gggcaccauuggaugcuua

SEQ ID NO: 1053159 - RNA, 19 nt, Homo sapiens
aauaugacaucccaucuga

SEQ ID NO: 1053160 - RNA, 19 nt, Homo sapiens
ugaaguaccugaugcugau

SEQ ID NO: 1053161 - RNA, 19 nt, Homo sapiens
gagugggcaucaagcauuu

SEQ ID NO: 1053162 - RNA, 19 nt, Homo sapiens
cuacuuggcuaccuuaaca

SEQ ID NO: 1053163 - RNA, 19 nt, Homo sapiens
ggacacuuguacaauaugu

SEQ ID NO: 1053164 - RNA, 19 nt, Homo sapiens
ugagugauuucuccaaaga

SEQ ID NO: 1053165 - RNA, 19 nt, Homo sapiens
caucugaguuguccuguca

SEQ ID NO: 1053166 - RNA, 19 nt, Homo sapiens
ggaguuaguagcucagaaa

SEQ ID NO: 1053167 - RNA, 19 nt, Homo sapiens
ggaauccuguaucugaaga

SEQ ID NO: 1053168 - RNA, 19 nt, Homo sapiens
ugucagagaucaggagaaa

SEQ ID NO: 1053169 - RNA, 19 nt, Homo sapiens
agacaacacuauuaaacug

SEQ ID NO: 1053170 - RNA, 19 nt, Homo sapiens
ggacguuaugugaaucuua

SEQ ID NO: 1053171 - RNA, 19 nt, Homo sapiens
uuugagaguuccuaucuaa

SEQ ID NO: 1053172 - RNA, 19 nt, Homo sapiens
gaagaguuguuaucguuuu

SEQ ID NO: 1053173 - RNA, 19 nt, Homo sapiens
gggcuguucuuaaguguuc

SEQ ID NO: 1053174 - RNA, 19 nt, Homo sapiens
gaguuguccugucacuuaa

SEQ ID NO: 1053175 - RNA, 19 nt, Homo sapiens
cagaauaugcuucaagaug

SEQ ID NO: 1053176 - RNA, 19 nt, Homo sapiens
ugagggacguuaugugaau

SEQ ID NO: 1053177 - RNA, 19 nt, Homo sapiens
cugauugauuccacuaaua

SEQ ID NO: 1053178 - RNA, 19 nt, Homo sapiens
guaauugauggguacuuua

SEQ ID NO: 1053179 - RNA, 19 nt, Homo sapiens
uaucuguuauguccacuaa

SEQ ID NO: 1053180 - RNA, 19 nt, Homo sapiens
gaggcuaacuacaucuaug

SEQ ID NO: 1053181 - RNA, 19 nt, Homo sapiens
gauguuugauuccaguuuc

SEQ ID NO: 1053182 - RNA, 19 nt, Homo sapiens
gauggaagcagcuagugaa

SEQ ID NO: 1053183 - RNA, 19 nt, Homo sapiens
caacguagauguaaaagag

SEQ ID NO: 1053184 - RNA, 19 nt, Homo sapiens
gaugcaacguagauguaaa

SEQ ID NO: 1053185 - RNA, 19 nt, Homo sapiens
gugaagugcugggacauug

SEQ ID NO: 1053186 - RNA, 19 nt, Homo sapiens
ggguuuaaagccuucauua

SEQ ID NO: 1053187 - RNA, 19 nt, Homo sapiens
gcaugcugcugguuagaug

SEQ ID NO: 1053188 - RNA, 19 nt, Homo sapiens
cagagaagaugguccacau

SEQ ID NO: 1053189 - RNA, 19 nt, Homo sapiens
aaaguucccuacugaagga

SEQ ID NO: 1053190 - RNA, 19 nt, Homo sapiens
uugaagaguuguuaucguu

SEQ ID NO: 1053191 - RNA, 19 nt, Homo sapiens
ccacuuccacaacagaaua

SEQ ID NO: 1053192 - RNA, 19 nt, Homo sapiens
ugacaucccaucugaguug

SEQ ID NO: 1053193 - RNA, 19 nt, Homo sapiens
gcaacauccugguguguac

SEQ ID NO: 1053194 - RNA, 19 nt, Homo sapiens
cuuccaggcuuugguguua

SEQ ID NO: 1053195 - RNA, 19 nt, Homo sapiens
gcaggagaauugcuugaac

SEQ ID NO: 1053196 - RNA, 19 nt, Homo sapiens
gaaaccccaucucuacuaa

SEQ ID NO: 1053197 - RNA, 19 nt, Homo sapiens
gaagaacuugucucccauu

SEQ ID NO: 1053198 - RNA, 19 nt, Homo sapiens
aggaacagaugcuaaggaa

SEQ ID NO: 1053199 - RNA, 19 nt, Homo sapiens
gcugauugauuccacuaau

SEQ ID NO: 1053200 - RNA, 19 nt, Homo sapiens
gcaggugucuaguaguucu

SEQ ID NO: 1053201 - RNA, 19 nt, Homo sapiens
ggaugaagcagcaaauucu

SEQ ID NO: 1053202 - RNA, 19 nt, Homo sapiens
ggcacugucuugugaccua

SEQ ID NO: 1053203 - RNA, 19 nt, Homo sapiens
cagccugacuugccagcua

SEQ ID NO: 1053204 - RNA, 19 nt, Homo sapiens
gaacaggagcgcaugaaaa

SEQ ID NO: 1053205 - RNA, 19 nt, Homo sapiens
agcaagaaguuacauguau

SEQ ID NO: 1053206 - RNA, 19 nt, Homo sapiens
caagagacuuaacuaugag

SEQ ID NO: 1053207 - RNA, 19 nt, Homo sapiens
uaguuucaguggcagaaua

SEQ ID NO: 1053208 - RNA, 19 nt, Homo sapiens
aaagaggccaguuguuuga

SEQ ID NO: 1053209 - RNA, 19 nt, Homo sapiens
aagccuucauuaaccauua

SEQ ID NO: 1053210 - RNA, 19 nt, Homo sapiens
gguguuaagauguugagua

SEQ ID NO: 1053211 - RNA, 19 nt, Homo sapiens
ucacaucaaagucagaauu

SEQ ID NO: 1053212 - RNA, 19 nt, Homo sapiens
gcaagacccuccccaaaca

SEQ ID NO: 1053213 - RNA, 19 nt, Homo sapiens
gauuugacuuucuuugaag

SEQ ID NO: 1053214 - RNA, 19 nt, Homo sapiens
ccagacaggucauuaauaa

SEQ ID NO: 1053215 - RNA, 19 nt, Homo sapiens
ggacacaucuggaggaaau

SEQ ID NO: 1053216 - RNA, 19 nt, Homo sapiens
gaacaugacuguggcucaa

SEQ ID NO: 1053217 - RNA, 19 nt, Homo sapiens
ccaaguauguggugaagug

SEQ ID NO: 1053218 - RNA, 19 nt, Homo sapiens
cagaagcacuuguguguca

SEQ ID NO: 1053219 - RNA, 19 nt, Homo sapiens
gacgagagcccgacaguug

SEQ ID NO: 1053220 - RNA, 19 nt, Homo sapiens
ucugggagaugcuggaaua

SEQ ID NO: 1053221 - RNA, 19 nt, Homo sapiens
gagcagaucacgcuucuca

SEQ ID NO: 1053222 - RNA, 19 nt, Homo sapiens
ggaaaggcauggucucacu

SEQ ID NO: 1053223 - RNA, 19 nt, Homo sapiens
ggacagcacccuccucauc

SEQ ID NO: 1053224 - RNA, 19 nt, Homo sapiens
gcagugagcgugacacaca

SEQ ID NO: 1053225 - RNA, 19 nt, Homo sapiens
gcuggugugugaauaucua

SEQ ID NO: 1053226 - RNA, 19 nt, Homo sapiens
gcagggcuaccgcaacuuu

SEQ ID NO: 1053227 - RNA, 19 nt, Homo sapiens
ggcauggucucacucaaug

SEQ ID NO: 1053228 - RNA, 19 nt, Homo sapiens
ggaggaaauggccuucuuu

SEQ ID NO: 1053229 - RNA, 19 nt, Homo sapiens
uaccagaaccugaacauga

SEQ ID NO: 1053230 - RNA, 19 nt, Homo sapiens
gggagaugcuggaauaaaa

SEQ ID NO: 1053231 - RNA, 19 nt, Homo sapiens
uggagacgcuggcugagaa

SEQ ID NO: 1053232 - RNA, 19 nt, Homo sapiens
uaaagucuguacauauugg

SEQ ID NO: 1053233 - RNA, 19 nt, Homo sapiens
ugugugggcugguguguga

SEQ ID NO: 1053234 - RNA, 19 nt, Homo sapiens
gaggacacaucuggaggaa

SEQ ID NO: 1053235 - RNA, 19 nt, Homo sapiens
gcaccuaccagaaccugaa

SEQ ID NO: 1053236 - RNA, 19 nt, Homo sapiens
gcagaucacgcuucucauc

SEQ ID NO: 1053237 - RNA, 19 nt, Homo sapiens
cagggcaggcucagaauaa

SEQ ID NO: 1053238 - RNA, 19 nt, Homo sapiens
gcgggcagcuaauuaaguc

SEQ ID NO: 1053239 - RNA, 19 nt, Homo sapiens
gccaacaagugccgucuca

SEQ ID NO: 1053240 - RNA, 19 nt, Homo sapiens
ggugugugaauaucuauaa

SEQ ID NO: 1053241 - RNA, 19 nt, Homo sapiens
caggugcccuugaugcuau

SEQ ID NO: 1053242 - RNA, 19 nt, Homo sapiens
ggucaacagguuacauuug

SEQ ID NO: 1053243 - RNA, 19 nt, Homo sapiens
gccagacaggucauuaaua

SEQ ID NO: 1053244 - RNA, 19 nt, Homo sapiens
gucaacagguuacauuugg

SEQ ID NO: 1053245 - RNA, 19 nt, Homo sapiens
gcacucaggcgccaagaag

SEQ ID NO: 1053246 - RNA, 19 nt, Homo sapiens
ggcagcugcuccuguguga

SEQ ID NO: 1053247 - RNA, 19 nt, Homo sapiens
gcaggugcccuugaugcua

SEQ ID NO: 1053248 - RNA, 19 nt, Homo sapiens
gcagcagccucaacaagcu

SEQ ID NO: 1053249 - RNA, 19 nt, Homo sapiens
gaggacggcuccauuuacg

SEQ ID NO: 1053250 - RNA, 19 nt, Homo sapiens
gccagaagcacuugugugu

SEQ ID NO: 1053251 - RNA, 19 nt, Homo sapiens
gagguucccacaguucaua

SEQ ID NO: 1053252 - RNA, 19 nt, Homo sapiens
gugccaacaucaacuucaa

SEQ ID NO: 1053253 - RNA, 19 nt, Homo sapiens
gcacggcaccuaccagaac

SEQ ID NO: 1053254 - RNA, 19 nt, Homo sapiens
gcaccuaugacaaggacaa

SEQ ID NO: 1053255 - RNA, 19 nt, Homo sapiens
ggagagggaggacacaucu

SEQ ID NO: 1053256 - RNA, 19 nt, Homo sapiens
caaggacaaugugcucauc

SEQ ID NO: 1053257 - RNA, 19 nt, Homo sapiens
gaagggugugugcguguga

SEQ ID NO: 1053258 - RNA, 19 nt, Homo sapiens
gagauccacucggccaaca

SEQ ID NO: 1053259 - RNA, 19 nt, Homo sapiens
caaggagcgucgggucuuc

SEQ ID NO: 1053260 - RNA, 19 nt, Homo sapiens
uggaggaaauggccuucuu

SEQ ID NO: 1053261 - RNA, 19 nt, Homo sapiens
cagcugcuccugugugaga

SEQ ID NO: 1053262 - RNA, 19 nt, Homo sapiens
ccgggucacuguccuggaa

SEQ ID NO: 1053263 - RNA, 19 nt, Homo sapiens
augggacccuugcugcuua

SEQ ID NO: 1053264 - RNA, 19 nt, Homo sapiens
ucaccagccuccugaucug

SEQ ID NO: 1053265 - RNA, 19 nt, Homo sapiens
ccucagggcaggcucagaa

SEQ ID NO: 1053266 - RNA, 19 nt, Homo sapiens
gaaggcauccccaagauca

SEQ ID NO: 1053267 - RNA, 19 nt, Homo sapiens
gcagcauccuccucuacag

SEQ ID NO: 1053268 - RNA, 19 nt, Homo sapiens
gggcuggugugugaauauc

SEQ ID NO: 1053269 - RNA, 19 nt, Homo sapiens
gaugggacccuugcugcuu

SEQ ID NO: 1053270 - RNA, 19 nt, Homo sapiens
ucagggcaggcucagaaua

SEQ ID NO: 1053271 - RNA, 19 nt, Homo sapiens
uauuggagcucugggagau

SEQ ID NO: 1053272 - RNA, 19 nt, Homo sapiens
gggccagguggaaaucuuu

SEQ ID NO: 1053273 - RNA, 19 nt, Homo sapiens
gcccggaugaggacaagaa

SEQ ID NO: 1053274 - RNA, 19 nt, Homo sapiens
gaccgcagcagccucaaca

SEQ ID NO: 1053275 - RNA, 19 nt, Homo sapiens
acaugacuguggcucaaga

SEQ ID NO: 1053276 - RNA, 19 nt, Homo sapiens
cagaucacgcuucucauca

SEQ ID NO: 1053277 - RNA, 19 nt, Homo sapiens
ccuaugacaaggacaaugu

SEQ ID NO: 1053278 - RNA, 19 nt, Homo sapiens
aguauguggugaaguggaa

SEQ ID NO: 1053279 - RNA, 19 nt, Homo sapiens
gcuugucugugccaacauc

SEQ ID NO: 1053280 - RNA, 19 nt, Homo sapiens
gacagcacccuccucaucu

SEQ ID NO: 1053281 - RNA, 19 nt, Homo sapiens
agaagggcauccucuugca

SEQ ID NO: 1053282 - RNA, 19 nt, Homo sapiens
ggugaaggaggaagagauc

SEQ ID NO: 1053283 - RNA, 19 nt, Homo sapiens
ggcaagcccaguaucacuu

SEQ ID NO: 1053284 - RNA, 19 nt, Homo sapiens
gcccaaguauguggugaag

SEQ ID NO: 1053285 - RNA, 19 nt, Homo sapiens
gcaccuccauccgccucuu

SEQ ID NO: 1053286 - RNA, 19 nt, Homo sapiens
gagacgagagcccgacagu

SEQ ID NO: 1053287 - RNA, 19 nt, Homo sapiens
gggucaacagguuacauuu

SEQ ID NO: 1053288 - RNA, 19 nt, Homo sapiens
ggaauaaaagacaagaguu

SEQ ID NO: 1053289 - RNA, 19 nt, Homo sapiens
gaggaaauggccuucuuuu

SEQ ID NO: 1053290 - RNA, 19 nt, Homo sapiens
cagacaggucauuaauaaa

SEQ ID NO: 1053291 - RNA, 19 nt, Homo sapiens
ccagagguucccacaguuc

SEQ ID NO: 1053292 - RNA, 19 nt, Homo sapiens
ccaaggagcgucgggucuu

SEQ ID NO: 1053293 - RNA, 19 nt, Homo sapiens
gugggcuggugugugaaua

SEQ ID NO: 1053294 - RNA, 19 nt, Homo sapiens
agcccaguaucacuuguuu

SEQ ID NO: 1053295 - RNA, 19 nt, Homo sapiens
caaaggaaaaccucuuguu

SEQ ID NO: 1053296 - RNA, 19 nt, Homo sapiens
aaagacaagaguuacaucu

SEQ ID NO: 1053297 - RNA, 19 nt, Homo sapiens
cgagagcugacccgcaaga

SEQ ID NO: 1053298 - RNA, 19 nt, Homo sapiens
cugagacccuggagcaucu

SEQ ID NO: 1053299 - RNA, 19 nt, Homo sapiens
gaacucccaucaacucuua

SEQ ID NO: 1053300 - RNA, 19 nt, Homo sapiens
guaaauuccuauccaguua

SEQ ID NO: 1053301 - RNA, 19 nt, Homo sapiens
gaaguuugcuccaaccuuu

SEQ ID NO: 1053302 - RNA, 19 nt, Homo sapiens
gagaguauacuguagauua

SEQ ID NO: 1053303 - RNA, 19 nt, Homo sapiens
ccacuaagcuggagaagca

SEQ ID NO: 1053304 - RNA, 19 nt, Homo sapiens
gaagcagccucauacaguu

SEQ ID NO: 1053305 - RNA, 19 nt, Homo sapiens
gaggcugcaucaaagauua

SEQ ID NO: 1053306 - RNA, 19 nt, Homo sapiens
ugacacagcuuucccuuca

SEQ ID NO: 1053307 - RNA, 19 nt, Homo sapiens
gcaaggggcucaaauaguu

SEQ ID NO: 1053308 - RNA, 19 nt, Homo sapiens
ccagagcauugccuuuaua

SEQ ID NO: 1053309 - RNA, 19 nt, Homo sapiens
gaacugaggauuguuguug

SEQ ID NO: 1053310 - RNA, 19 nt, Homo sapiens
guuaaauccuguucauuga

SEQ ID NO: 1053311 - RNA, 19 nt, Homo sapiens
gcagaaagcaguagugaca

SEQ ID NO: 1053312 - RNA, 19 nt, Homo sapiens
gugccuauaucaugaagua

SEQ ID NO: 1053313 - RNA, 19 nt, Homo sapiens
uuacugcucugcucuguuu

SEQ ID NO: 1053314 - RNA, 19 nt, Homo sapiens
caacaguuccauaguuuaa

SEQ ID NO: 1053315 - RNA, 19 nt, Homo sapiens
ugucggaccuuauuuaaug

SEQ ID NO: 1053316 - RNA, 19 nt, Homo sapiens
guauguggcuagucuuauu

SEQ ID NO: 1053317 - RNA, 19 nt, Homo sapiens
gaaaggaauguaaugaaga

SEQ ID NO: 1053318 - RNA, 19 nt, Homo sapiens
caccuucgcucccgucuuu

SEQ ID NO: 1053319 - RNA, 19 nt, Homo sapiens
gcaaugaaauauuccugau

SEQ ID NO: 1053320 - RNA, 19 nt, Homo sapiens
ccaguuggauaaauauuug

SEQ ID NO: 1053321 - RNA, 19 nt, Homo sapiens
guucaucuccuuaucuaua

SEQ ID NO: 1053322 - RNA, 19 nt, Homo sapiens
ggacagauguguuuugaau

SEQ ID NO: 1053323 - RNA, 19 nt, Homo sapiens
gccacuaccuguuguauuc

SEQ ID NO: 1053324 - RNA, 19 nt, Homo sapiens
caucaaagauuaccacacu

SEQ ID NO: 1053325 - RNA, 19 nt, Homo sapiens
ggaaauccuucuuuuacua

SEQ ID NO: 1053326 - RNA, 19 nt, Homo sapiens
uuaaaaggcucaacuguaa

SEQ ID NO: 1053327 - RNA, 19 nt, Homo sapiens
guuuauaucuggcaugaau

SEQ ID NO: 1053328 - RNA, 19 nt, Homo sapiens
gagacaguauucuaccauu

SEQ ID NO: 1053329 - RNA, 19 nt, Homo sapiens
acacugaccucaauccaau

SEQ ID NO: 1053330 - RNA, 19 nt, Homo sapiens
gcucugaggcugcaucaaa

SEQ ID NO: 1053331 - RNA, 19 nt, Homo sapiens
uagguaagguaauugauug

SEQ ID NO: 1053332 - RNA, 19 nt, Homo sapiens
ugaaaggaauguaaugaag

SEQ ID NO: 1053333 - RNA, 19 nt, Homo sapiens
ucuguggccuugaguauuu

SEQ ID NO: 1053334 - RNA, 19 nt, Homo sapiens
aaagagccauugagaaaca

SEQ ID NO: 1053335 - RNA, 19 nt, Homo sapiens
aaagaagucuguaucuagu

SEQ ID NO: 1053336 - RNA, 19 nt, Homo sapiens
uaaagaagucuguaucuag

SEQ ID NO: 1053337 - RNA, 19 nt, Homo sapiens
gggauauucuuaggauaaa

SEQ ID NO: 1053338 - RNA, 19 nt, Homo sapiens
gugugucuauccugaaaua

SEQ ID NO: 1053339 - RNA, 19 nt, Homo sapiens
gaguuuauaucuggcauga

SEQ ID NO: 1053340 - RNA, 19 nt, Homo sapiens
caccaacaguuccauaguu

SEQ ID NO: 1053341 - RNA, 19 nt, Homo sapiens
cccaucaacucuuaugaaa

SEQ ID NO: 1053342 - RNA, 19 nt, Homo sapiens
acacagcuuucccuucaaa

SEQ ID NO: 1053343 - RNA, 19 nt, Homo sapiens
uuagccaguuggauaaaua

SEQ ID NO: 1053344 - RNA, 19 nt, Homo sapiens
uaucuucccagucuuguua

SEQ ID NO: 1053345 - RNA, 19 nt, Homo sapiens
uuaccacacuuccaguuaa

SEQ ID NO: 1053346 - RNA, 19 nt, Homo sapiens
aagguuaaauggaagguuu

SEQ ID NO: 1053347 - RNA, 19 nt, Homo sapiens
ggaaacaccgcuuugaucu

SEQ ID NO: 1053348 - RNA, 19 nt, Homo sapiens
ccucuuagccaguuggaua

SEQ ID NO: 1053349 - RNA, 19 nt, Homo sapiens
gcuaaugguuaaagaaguc

SEQ ID NO: 1053350 - RNA, 19 nt, Homo sapiens
uuaaugaacugaggauugu

SEQ ID NO: 1053351 - RNA, 19 nt, Homo sapiens
cggcguagguuggcucuuu

SEQ ID NO: 1053352 - RNA, 19 nt, Homo sapiens
ggcguagguuggcucuuua

SEQ ID NO: 1053353 - RNA, 19 nt, Homo sapiens
guggacauauagauuauuc

SEQ ID NO: 1053354 - RNA, 19 nt, Homo sapiens
agaagucuguaucuaguga

SEQ ID NO: 1053355 - RNA, 19 nt, Homo sapiens
cgaagaaacccauauuguc

SEQ ID NO: 1053356 - RNA, 19 nt, Homo sapiens
uguauucacucaucuuugu

SEQ ID NO: 1053357 - RNA, 19 nt, Homo sapiens
gcuuaacuauaaucagcua

SEQ ID NO: 1053358 - RNA, 19 nt, Homo sapiens
gcucugcucuguuuguucu

SEQ ID NO: 1053359 - RNA, 19 nt, Homo sapiens
gguaauugauugggaaugg

SEQ ID NO: 1053360 - RNA, 19 nt, Homo sapiens
uaauggagaguauacugua

SEQ ID NO: 1053361 - RNA, 19 nt, Homo sapiens
uugguaaccugaguuuaua

SEQ ID NO: 1053362 - RNA, 19 nt, Homo sapiens
gagcauugccuuuauaagc

SEQ ID NO: 1053363 - RNA, 19 nt, Homo sapiens
gaccuuauuuaaugaacug

SEQ ID NO: 1053364 - RNA, 19 nt, Homo sapiens
cauagacaauugcaacagu

SEQ ID NO: 1053365 - RNA, 19 nt, Homo sapiens
gcaguagugacacagcuuu

SEQ ID NO: 1053366 - RNA, 19 nt, Homo sapiens
uaaccugaguuuauaucug

SEQ ID NO: 1053367 - RNA, 19 nt, Homo sapiens
guuucaaccuaauugguaa

SEQ ID NO: 1053368 - RNA, 19 nt, Homo sapiens
accaacaguuccauaguuu

SEQ ID NO: 1053369 - RNA, 19 nt, Homo sapiens
ucaaggaaguuugcuccaa

SEQ ID NO: 1053370 - RNA, 19 nt, Homo sapiens
gggaauuggaugcauuauu

SEQ ID NO: 1053371 - RNA, 19 nt, Homo sapiens
ccaacaguuccauaguuua

SEQ ID NO: 1053372 - RNA, 19 nt, Homo sapiens
cauauugucggaccuuauu

SEQ ID NO: 1053373 - RNA, 19 nt, Homo sapiens
gaugcauuauucaacuuug

SEQ ID NO: 1053374 - RNA, 19 nt, Homo sapiens
gccaguuggauaaauauuu

SEQ ID NO: 1053375 - RNA, 19 nt, Homo sapiens
guacuucuguggccuugag

SEQ ID NO: 1053376 - RNA, 19 nt, Homo sapiens
gcauguuaaaucaagcuua

SEQ ID NO: 1053377 - RNA, 19 nt, Homo sapiens
uguuaaauccuguucauug

SEQ ID NO: 1053378 - RNA, 19 nt, Homo sapiens
uuacugugcuguguugcua

SEQ ID NO: 1053379 - RNA, 19 nt, Homo sapiens
ggaugcauuauucaacuuu

SEQ ID NO: 1053380 - RNA, 19 nt, Homo sapiens
ggacauauagauuauucgu

SEQ ID NO: 1053381 - RNA, 19 nt, Homo sapiens
gacaguauucuaccauuca

SEQ ID NO: 1053382 - RNA, 19 nt, Homo sapiens
gcucuuaccagugcucuga

SEQ ID NO: 1053383 - RNA, 19 nt, Homo sapiens
cuauguaaguaauccaaug

SEQ ID NO: 1053384 - RNA, 19 nt, Homo sapiens
gcauguaauuuggauuucu

SEQ ID NO: 1053385 - RNA, 19 nt, Homo sapiens
cauuaccguugcaugauug

SEQ ID NO: 1053386 - RNA, 19 nt, Homo sapiens
guuuacccaucaaaucuga

SEQ ID NO: 1053387 - RNA, 19 nt, Homo sapiens
caacaguuuagaugccuuu

SEQ ID NO: 1053388 - RNA, 19 nt, Homo sapiens
agacaauugcaacaguuua

SEQ ID NO: 1053389 - RNA, 19 nt, Homo sapiens
agaaagcaguagugacaca

SEQ ID NO: 1053390 - RNA, 19 nt, Homo sapiens
gaaagcagaaagcaguagu

SEQ ID NO: 1053391 - RNA, 19 nt, Homo sapiens
agacaguauucuaccauuc

SEQ ID NO: 1053392 - RNA, 19 nt, Homo sapiens
cagagcauugccuuuauaa

SEQ ID NO: 1053393 - RNA, 19 nt, Homo sapiens
uuucuuacccuucgauauu

SEQ ID NO: 1053394 - RNA, 19 nt, Homo sapiens
gcuccaaccuuuuauauac

SEQ ID NO: 1053395 - RNA, 19 nt, Homo sapiens
gcuucaugcugccacauau

SEQ ID NO: 1053396 - RNA, 19 nt, Homo sapiens
ucaaagauuaccacacuuc

SEQ ID NO: 1053397 - RNA, 19 nt, Homo sapiens
gaaauucaugcugaucuuc

SEQ ID NO: 1053398 - RNA, 19 nt, Homo sapiens
guuuuaugcugcuuuguua

SEQ ID NO: 1053399 - RNA, 19 nt, Homo sapiens
gaaacuguguguauguaua

SEQ ID NO: 1053400 - RNA, 19 nt, Homo sapiens
ggaagcagguuucaucuca

SEQ ID NO: 1053401 - RNA, 19 nt, Homo sapiens
caagggacccacagaauua

SEQ ID NO: 1053402 - RNA, 19 nt, Homo sapiens
ucaguuagcugguuaagug

SEQ ID NO: 1053403 - RNA, 19 nt, Homo sapiens
ggaaggcccugugaagaaa

SEQ ID NO: 1053404 - RNA, 19 nt, Homo sapiens
gggaguaucugagaaagaa

SEQ ID NO: 1053405 - RNA, 19 nt, Homo sapiens
gagcuaauccucuaaguuc

SEQ ID NO: 1053406 - RNA, 19 nt, Homo sapiens
gaggaagacuggcucuaug

SEQ ID NO: 1053407 - RNA, 19 nt, Homo sapiens
uaaagucucucucucucuu

SEQ ID NO: 1053408 - RNA, 19 nt, Homo sapiens
ugagagacuugcaccuuaa

SEQ ID NO: 1053409 - RNA, 19 nt, Homo sapiens
caauaggacaggaagauuu

SEQ ID NO: 1053410 - RNA, 19 nt, Homo sapiens
uaaguucucuguacucagu

SEQ ID NO: 1053411 - RNA, 19 nt, Homo sapiens
ggaagccaaugccaugugu

SEQ ID NO: 1053412 - RNA, 19 nt, Homo sapiens
ugaggaggcuguucagugu

SEQ ID NO: 1053413 - RNA, 19 nt, Homo sapiens
aaucacaccugccugagaa

SEQ ID NO: 1053414 - RNA, 19 nt, Homo sapiens
guucucaguuagcugguua

SEQ ID NO: 1053415 - RNA, 19 nt, Homo sapiens
caagagagggugugggauu

SEQ ID NO: 1053416 - RNA, 19 nt, Homo sapiens
gcuggacucuaaucccuuu

SEQ ID NO: 1053417 - RNA, 19 nt, Homo sapiens
gaucgggaguaucugagaa

SEQ ID NO: 1053418 - RNA, 19 nt, Homo sapiens
aaagauggcuuccgcuucu

SEQ ID NO: 1053419 - RNA, 19 nt, Homo sapiens
gaagcagguuucaucucaa

SEQ ID NO: 1053420 - RNA, 19 nt, Homo sapiens
ccaccacacccaacuaauu

SEQ ID NO: 1053421 - RNA, 19 nt, Homo sapiens
ggagugcaguggugugauc

SEQ ID NO: 1053422 - RNA, 19 nt, Homo sapiens
ggucugggcugugcaguuc

SEQ ID NO: 1053423 - RNA, 19 nt, Homo sapiens
uuucuaaacucaacccauu

SEQ ID NO: 1053424 - RNA, 19 nt, Homo sapiens
cccaggcccuucuuucuaa

SEQ ID NO: 1053425 - RNA, 19 nt, Homo sapiens
acaguuugcugccugguuu

SEQ ID NO: 1053426 - RNA, 19 nt, Homo sapiens
gcagguuucaucucaauau

SEQ ID NO: 1053427 - RNA, 19 nt, Homo sapiens
ccaaagugcugggauuaca

SEQ ID NO: 1053428 - RNA, 19 nt, Homo sapiens
ccaaagugcugggauuaca

SEQ ID NO: 1053429 - RNA, 19 nt, Homo sapiens
ggaaacaauaggaaccaaa

SEQ ID NO: 1053430 - RNA, 19 nt, Homo sapiens
ggaggaagacuggcucuau

SEQ ID NO: 1053431 - RNA, 19 nt, Homo sapiens
gagaaggagugggcuguca

SEQ ID NO: 1053432 - RNA, 19 nt, Homo sapiens
caccacacccaacuaauuu

SEQ ID NO: 1053433 - RNA, 19 nt, Homo sapiens
ccagcagcccugucuguua

SEQ ID NO: 1053434 - RNA, 19 nt, Homo sapiens
gaagacuggcucuaugaga

SEQ ID NO: 1053435 - RNA, 19 nt, Homo sapiens
uaaagccaagucauucaua

SEQ ID NO: 1053436 - RNA, 19 nt, Homo sapiens
cugguuaaguggaguguaa

SEQ ID NO: 1053437 - RNA, 19 nt, Homo sapiens
augagagacuugcaccuua

SEQ ID NO: 1053438 - RNA, 19 nt, Homo sapiens
gaaccuugggagucauuaa

SEQ ID NO: 1053439 - RNA, 19 nt, Homo sapiens
cagcuuuacuaucuauguu

SEQ ID NO: 1053440 - RNA, 19 nt, Homo sapiens
gacccaugcgcaagaguua

SEQ ID NO: 1053441 - RNA, 19 nt, Homo sapiens
gggagggauuucaaacaau

SEQ ID NO: 1053442 - RNA, 19 nt, Homo sapiens
ugggagggauuucaaacaa

SEQ ID NO: 1053443 - RNA, 19 nt, Homo sapiens
gcguagagaaucacaaaug

SEQ ID NO: 1053444 - RNA, 19 nt, Homo sapiens
gguuucaucucaauauugg

SEQ ID NO: 1053445 - RNA, 19 nt, Homo sapiens
cagcagcccugucuguuac

SEQ ID NO: 1053446 - RNA, 19 nt, Homo sapiens
uagagaaucacaaauggaa

SEQ ID NO: 1053447 - RNA, 19 nt, Homo sapiens
uggaaacuguguguaugua

SEQ ID NO: 1053448 - RNA, 19 nt, Homo sapiens
cagaauuacagggaaguua

SEQ ID NO: 1053449 - RNA, 19 nt, Homo sapiens
acaagggacccacagaauu

SEQ ID NO: 1053450 - RNA, 19 nt, Homo sapiens
gaaauuugaacuggagaga

SEQ ID NO: 1053451 - RNA, 19 nt, Homo sapiens
cucaguugguucucaguua

SEQ ID NO: 1053452 - RNA, 19 nt, Homo sapiens
cagguuucaucucaauauu

SEQ ID NO: 1053453 - RNA, 19 nt, Homo sapiens
uagcagccaggaaacaaua

SEQ ID NO: 1053454 - RNA, 19 nt, Homo sapiens
ccuugccuaugauugauua

SEQ ID NO: 1053455 - RNA, 19 nt, Homo sapiens
aaaccaaccgccugcauga

SEQ ID NO: 1053456 - RNA, 19 nt, Homo sapiens
ggaaacuguguguauguau

SEQ ID NO: 1053457 - RNA, 19 nt, Homo sapiens
cccaagagcagccagauug

SEQ ID NO: 1053458 - RNA, 19 nt, Homo sapiens
gaaacaauaggaaccaaaa

SEQ ID NO: 1053459 - RNA, 19 nt, Homo sapiens
aaagcuuaguccuagcaua

SEQ ID NO: 1053460 - RNA, 19 nt, Homo sapiens
ugaccuugccuaugauuga

SEQ ID NO: 1053461 - RNA, 19 nt, Homo sapiens
cguagagaaucacaaaugg

SEQ ID NO: 1053462 - RNA, 19 nt, Homo sapiens
uauggaaacuguguguaug

SEQ ID NO: 1053463 - RNA, 19 nt, Homo sapiens
gcacuuccccuacugauug

SEQ ID NO: 1053464 - RNA, 19 nt, Homo sapiens
gugcaguggugugaucuug

SEQ ID NO: 1053465 - RNA, 19 nt, Homo sapiens
gaucucuccuucccuggau

SEQ ID NO: 1053466 - RNA, 19 nt, Homo sapiens
ucauuaaagccaagucauu

SEQ ID NO: 1053467 - RNA, 19 nt, Homo sapiens
uugcuucccuugucuucua

SEQ ID NO: 1053468 - RNA, 19 nt, Homo sapiens
ggacccaugcgcaagaguu

SEQ ID NO: 1053469 - RNA, 19 nt, Homo sapiens
aaagccaagucauucauag

SEQ ID NO: 1053470 - RNA, 19 nt, Homo sapiens
gcccuucuuucuaaacuca

SEQ ID NO: 1053471 - RNA, 19 nt, Homo sapiens
ggcuuccgcuucuucacua

SEQ ID NO: 1053472 - RNA, 19 nt, Homo sapiens
aauuugaacuggagagauc

SEQ ID NO: 1053473 - RNA, 19 nt, Homo sapiens
ggacccaggcccuucuuuc

SEQ ID NO: 1053474 - RNA, 19 nt, Homo sapiens
uggaaggcccugugaagaa

SEQ ID NO: 1053475 - RNA, 19 nt, Homo sapiens
aagcagguuucaucucaau

SEQ ID NO: 1053476 - RNA, 19 nt, Homo sapiens
gugcugggauuacagacau

SEQ ID NO: 1053477 - RNA, 19 nt, Homo sapiens
guaaugguggcguagagaa

SEQ ID NO: 1053478 - RNA, 19 nt, Homo sapiens
ucaguugguucucaguuag

SEQ ID NO: 1053479 - RNA, 19 nt, Homo sapiens
ugccucagccucccaagua

SEQ ID NO: 1053480 - RNA, 19 nt, Homo sapiens
aagcuuaguccuagcauau

SEQ ID NO: 1053481 - RNA, 19 nt, Homo sapiens
cuacaagggacccacagaa

SEQ ID NO: 1053482 - RNA, 19 nt, Homo sapiens
guagagaaucacaaaugga

SEQ ID NO: 1053483 - RNA, 19 nt, Homo sapiens
aagagagggugugggauug

SEQ ID NO: 1053484 - RNA, 19 nt, Homo sapiens
ccaauaggacaggaagauu

SEQ ID NO: 1053485 - RNA, 19 nt, Homo sapiens
gaauuacagggaaguuaca

SEQ ID NO: 1053486 - RNA, 19 nt, Homo sapiens
acuaacucauuuacggaua

SEQ ID NO: 1053487 - RNA, 19 nt, Homo sapiens
cacuaucucuguaaagucu

SEQ ID NO: 1053488 - RNA, 19 nt, Homo sapiens
cccaguccgucaggaauuu

SEQ ID NO: 1053489 - RNA, 19 nt, Homo sapiens
ggaccgagaggcauuugag

SEQ ID NO: 1053490 - RNA, 19 nt, Homo sapiens
cagggaagcagguuucauc

SEQ ID NO: 1053491 - RNA, 19 nt, Homo sapiens
gaccuugccuaugauugau

SEQ ID NO: 1053492 - RNA, 19 nt, Homo sapiens
ccgccugcaugaccggaua

SEQ ID NO: 1053493 - RNA, 19 nt, Homo sapiens
cgucaggaauuuuguagaa

SEQ ID NO: 1053494 - RNA, 19 nt, Homo sapiens
gagacgggguuucauuaug

SEQ ID NO: 1053495 - RNA, 19 nt, Homo sapiens
gauugucuccaucucuuga

SEQ ID NO: 1053496 - RNA, 19 nt, Homo sapiens
cuaacucauuuacggauag

SEQ ID NO: 1053497 - RNA, 19 nt, Homo sapiens
cauuaaagccaagucauuc

SEQ ID NO: 1053498 - RNA, 19 nt, Homo sapiens
cuaccucagucaccugugu

SEQ ID NO: 1053499 - RNA, 19 nt, Homo sapiens
gaagaaggguguuguguua

SEQ ID NO: 1053500 - RNA, 19 nt, Homo sapiens
ggacuaacguucaugauau

SEQ ID NO: 1053501 - RNA, 19 nt, Homo sapiens
ggaagaaacugcauuaaaa

SEQ ID NO: 1053502 - RNA, 19 nt, Homo sapiens
ggaaguaguugacgaugaa

SEQ ID NO: 1053503 - RNA, 19 nt, Homo sapiens
gaaagccacuugccucuuc

SEQ ID NO: 1053504 - RNA, 19 nt, Homo sapiens
uaaagugucuccuggauau

SEQ ID NO: 1053505 - RNA, 19 nt, Homo sapiens
gaaacugaguccaacacua

SEQ ID NO: 1053506 - RNA, 19 nt, Homo sapiens
ugagaaauaugguagauug

SEQ ID NO: 1053507 - RNA, 19 nt, Homo sapiens
gagcaaggguccuaugaug

SEQ ID NO: 1053508 - RNA, 19 nt, Homo sapiens
ccaaacauguacagacuuu

SEQ ID NO: 1053509 - RNA, 19 nt, Homo sapiens
caagaugaacucaaagaua

SEQ ID NO: 1053510 - RNA, 19 nt, Homo sapiens
ggaggaagaaacugcauua

SEQ ID NO: 1053511 - RNA, 19 nt, Homo sapiens
guagagcccaucaauauuu

SEQ ID NO: 1053512 - RNA, 19 nt, Homo sapiens
agaacaagaugaacucaaa

SEQ ID NO: 1053513 - RNA, 19 nt, Homo sapiens
gaagagguaucagaaagug

SEQ ID NO: 1053514 - RNA, 19 nt, Homo sapiens
ccaauaaacugcacguauc

SEQ ID NO: 1053515 - RNA, 19 nt, Homo sapiens
ccgcugagcuggccaaguu

SEQ ID NO: 1053516 - RNA, 19 nt, Homo sapiens
ccaaauaauugacucuuag

SEQ ID NO: 1053517 - RNA, 19 nt, Homo sapiens
caagugugcuacaguuuga

SEQ ID NO: 1053518 - RNA, 19 nt, Homo sapiens
gccauacuuucucagauua

SEQ ID NO: 1053519 - RNA, 19 nt, Homo sapiens
uagcaugugucacgaguuu

SEQ ID NO: 1053520 - RNA, 19 nt, Homo sapiens
gauccggacuuccugacua

SEQ ID NO: 1053521 - RNA, 19 nt, Homo sapiens
cagcguacauacugaauga

SEQ ID NO: 1053522 - RNA, 19 nt, Homo sapiens
guagauuggguuucauuua

SEQ ID NO: 1053523 - RNA, 19 nt, Homo sapiens
gggaacaacugaagacuac

SEQ ID NO: 1053524 - RNA, 19 nt, Homo sapiens
cagggacacuauaaagaua

SEQ ID NO: 1053525 - RNA, 19 nt, Homo sapiens
gaaucugcauggaauauca

SEQ ID NO: 1053526 - RNA, 19 nt, Homo sapiens
cuauggauuuggaaacuua

SEQ ID NO: 1053527 - RNA, 19 nt, Homo sapiens
aagaugaacucaaagauag

SEQ ID NO: 1053528 - RNA, 19 nt, Homo sapiens
gcugaguacugcuucauug

SEQ ID NO: 1053529 - RNA, 19 nt, Homo sapiens
ggacaacuuuaugacauug

SEQ ID NO: 1053530 - RNA, 19 nt, Homo sapiens
guaaaccgcagcaauauuc

SEQ ID NO: 1053531 - RNA, 19 nt, Homo sapiens
caagagagccugucgucaa

SEQ ID NO: 1053532 - RNA, 19 nt, Homo sapiens
ggacugacaaauauucaaa

SEQ ID NO: 1053533 - RNA, 19 nt, Homo sapiens
gaacugagugauguuauug

SEQ ID NO: 1053534 - RNA, 19 nt, Homo sapiens
gggacaacuuuaugacauu

SEQ ID NO: 1053535 - RNA, 19 nt, Homo sapiens
ggaagaaggguguuguguu

SEQ ID NO: 1053536 - RNA, 19 nt, Homo sapiens
gaaauaggugcuucugaga

SEQ ID NO: 1053537 - RNA, 19 nt, Homo sapiens
guacuugacacccaauaaa

SEQ ID NO: 1053538 - RNA, 19 nt, Homo sapiens
ugaaugaucucuacaucuc

SEQ ID NO: 1053539 - RNA, 19 nt, Homo sapiens
acacuaugcugguuugaga

SEQ ID NO: 1053540 - RNA, 19 nt, Homo sapiens
aaucuuaucugcuggacaa

SEQ ID NO: 1053541 - RNA, 19 nt, Homo sapiens
ggaagucucccuuacaaag

SEQ ID NO: 1053542 - RNA, 19 nt, Homo sapiens
ugaacugagugauguuauu

SEQ ID NO: 1053543 - RNA, 19 nt, Homo sapiens
aauaggugcuucugagauu

SEQ ID NO: 1053544 - RNA, 19 nt, Homo sapiens
gaauguagagcccaucaau

SEQ ID NO: 1053545 - RNA, 19 nt, Homo sapiens
guuggcagcucuugcagaa

SEQ ID NO: 1053546 - RNA, 19 nt, Homo sapiens
gugaagagguaucagaaag

SEQ ID NO: 1053547 - RNA, 19 nt, Homo sapiens
gcccgugucuccagaaugu

SEQ ID NO: 1053548 - RNA, 19 nt, Homo sapiens
aaacugaguccaacacuau

SEQ ID NO: 1053549 - RNA, 19 nt, Homo sapiens
gagagaagaauguugaauc

SEQ ID NO: 1053550 - RNA, 19 nt, Homo sapiens
guggguagguuauaugcaa

SEQ ID NO: 1053551 - RNA, 19 nt, Homo sapiens
ggauguggguagguuauau

SEQ ID NO: 1053552 - RNA, 19 nt, Homo sapiens
gaagugagcaaggguccua

SEQ ID NO: 1053553 - RNA, 19 nt, Homo sapiens
gguagguuauaugcaaaua

SEQ ID NO: 1053554 - RNA, 19 nt, Homo sapiens
gauauuaaggauccagauu

SEQ ID NO: 1053555 - RNA, 19 nt, Homo sapiens
gaugaacugagugauguua

SEQ ID NO: 1053556 - RNA, 19 nt, Homo sapiens
gacagucaguucuuugcaa

SEQ ID NO: 1053557 - RNA, 19 nt, Homo sapiens
gguuagaacuggaagaacu

SEQ ID NO: 1053558 - RNA, 19 nt, Homo sapiens
cauguuaacugcucuucug

SEQ ID NO: 1053559 - RNA, 19 nt, Homo sapiens
gagauucauccauguggua

SEQ ID NO: 1053560 - RNA, 19 nt, Homo sapiens
gggacacuauaaagauauu

SEQ ID NO: 1053561 - RNA, 19 nt, Homo sapiens
gcagacacccugugaagag

SEQ ID NO: 1053562 - RNA, 19 nt, Homo sapiens
ucauugaccucucgaugga

SEQ ID NO: 1053563 - RNA, 19 nt, Homo sapiens
ucaaccaacugcagaucaa

SEQ ID NO: 1053564 - RNA, 19 nt, Homo sapiens
uagauuggguuucauuuac

SEQ ID NO: 1053565 - RNA, 19 nt, Homo sapiens
gcaauauucaggagagaga

SEQ ID NO: 1053566 - RNA, 19 nt, Homo sapiens
ccaacacuaugcugguuug

SEQ ID NO: 1053567 - RNA, 19 nt, Homo sapiens
agagaagaauguugaaucu

SEQ ID NO: 1053568 - RNA, 19 nt, Homo sapiens
gcuacaguuugauugauau

SEQ ID NO: 1053569 - RNA, 19 nt, Homo sapiens
cgucaagugugcuacaguu

SEQ ID NO: 1053570 - RNA, 19 nt, Homo sapiens
uauuaaggauccagauuuc

SEQ ID NO: 1053571 - RNA, 19 nt, Homo sapiens
gaggaacggacccaucauu

SEQ ID NO: 1053572 - RNA, 19 nt, Homo sapiens
gggcaccacugcuguaaac

SEQ ID NO: 1053573 - RNA, 19 nt, Homo sapiens
gcaaggguccuaugaugca

SEQ ID NO: 1053574 - RNA, 19 nt, Homo sapiens
ugaugcagauaaaggaauu

SEQ ID NO: 1053575 - RNA, 19 nt, Homo sapiens
gagagccugucgucaagug

SEQ ID NO: 1053576 - RNA, 19 nt, Homo sapiens
ccgcgacugugaagauaaa

SEQ ID NO: 1053577 - RNA, 19 nt, Homo sapiens
gagcagacacccugugaag

SEQ ID NO: 1053578 - RNA, 19 nt, Homo sapiens
gaagacuacaguucagguu

SEQ ID NO: 1053579 - RNA, 19 nt, Homo sapiens
gaaggagagaagaauguug

SEQ ID NO: 1053580 - RNA, 19 nt, Homo sapiens
agaaguaucagcuacgaaa

SEQ ID NO: 1053581 - RNA, 19 nt, Homo sapiens
agcagugccuuucuuauug

SEQ ID NO: 1053582 - RNA, 19 nt, Homo sapiens
cgugucaucuggaaacgaa

SEQ ID NO: 1053583 - RNA, 19 nt, Homo sapiens
gguccuaugaugcagauaa

SEQ ID NO: 1053584 - RNA, 19 nt, Homo sapiens
aagcagugccuuucuuauu

SEQ ID NO: 1053585 - RNA, 19 nt, Homo sapiens
ugaaacccgugucacugaa

SEQ ID NO: 1053586 - RNA, 19 nt, Homo sapiens
guccuaugaugcagauaaa

SEQ ID NO: 1053587 - RNA, 19 nt, Homo sapiens
gccaagccauacuuucuca

SEQ ID NO: 1053588 - RNA, 19 nt, Homo sapiens
uaugguagauuggguuuca

SEQ ID NO: 1053589 - RNA, 19 nt, Homo sapiens
gagagagacggcugucaga

SEQ ID NO: 1053590 - RNA, 19 nt, Homo sapiens
ucagaaagucaaauccaaa

SEQ ID NO: 1053591 - RNA, 19 nt, Homo sapiens
caauaaacugcacguauca

SEQ ID NO: 1053592 - RNA, 19 nt, Homo sapiens
ggaggauguggguagguua

SEQ ID NO: 1053593 - RNA, 19 nt, Homo sapiens
gggcugaacauguuaacug

SEQ ID NO: 1053594 - RNA, 19 nt, Homo sapiens
agacuacaguucagguuuc

SEQ ID NO: 1053595 - RNA, 19 nt, Homo sapiens
aggaagaaacugcauuaaa

SEQ ID NO: 1053596 - RNA, 19 nt, Homo sapiens
gacuaacguucaugauauc

SEQ ID NO: 1053597 - RNA, 19 nt, Homo sapiens
gacacccugugaagaggua

SEQ ID NO: 1053598 - RNA, 19 nt, Homo sapiens
gaguuugauugggaaauug

SEQ ID NO: 1053599 - RNA, 19 nt, Homo sapiens
ggaaacagcugcucauuca

SEQ ID NO: 1053600 - RNA, 19 nt, Homo sapiens
uaaaucagcuguuguauuc

SEQ ID NO: 1053601 - RNA, 19 nt, Homo sapiens
gaaagaugcucuggagaaa

SEQ ID NO: 1053602 - RNA, 19 nt, Homo sapiens
aaggaaagcugacugauaa

SEQ ID NO: 1053603 - RNA, 19 nt, Homo sapiens
aaagauagcucagguuauu

SEQ ID NO: 1053604 - RNA, 19 nt, Homo sapiens
gggagaaauugcacacuua

SEQ ID NO: 1053605 - RNA, 19 nt, Homo sapiens
gaagaaugcuuaucaacuc

SEQ ID NO: 1053606 - RNA, 19 nt, Homo sapiens
ccaaggaucuuaacugugu

SEQ ID NO: 1053607 - RNA, 19 nt, Homo sapiens
gcagaaauguuacaacgau

SEQ ID NO: 1053608 - RNA, 19 nt, Homo sapiens
guauagcgguuauuagaaa

SEQ ID NO: 1053609 - RNA, 19 nt, Homo sapiens
guuaagagguggugauaga

SEQ ID NO: 1053610 - RNA, 19 nt, Homo sapiens
ggagaagaaugcuuaucaa

SEQ ID NO: 1053611 - RNA, 19 nt, Homo sapiens
ccacugggcuacuguaaau

SEQ ID NO: 1053612 - RNA, 19 nt, Homo sapiens
aagagaagcagaaauguua

SEQ ID NO: 1053613 - RNA, 19 nt, Homo sapiens
gaaauacagcugaaagaug

SEQ ID NO: 1053614 - RNA, 19 nt, Homo sapiens
gcugcaaccucacgaauug

SEQ ID NO: 1053615 - RNA, 19 nt, Homo sapiens
caacugaaggccagauaua

SEQ ID NO: 1053616 - RNA, 19 nt, Homo sapiens
gaaauugcacacuuaaaga

SEQ ID NO: 1053617 - RNA, 19 nt, Homo sapiens
gguuauugcuaauggguua

SEQ ID NO: 1053618 - RNA, 19 nt, Homo sapiens
gaagagaagcagaaauguu

SEQ ID NO: 1053619 - RNA, 19 nt, Homo sapiens
gaaaagauagcucagguua

SEQ ID NO: 1053620 - RNA, 19 nt, Homo sapiens
uaacacaguuggaauccuu

SEQ ID NO: 1053621 - RNA, 19 nt, Homo sapiens
ucagagaugucuuccagaa

SEQ ID NO: 1053622 - RNA, 19 nt, Homo sapiens
ccauguagcccucucauuu

SEQ ID NO: 1053623 - RNA, 19 nt, Homo sapiens
gcauaaaacugccuaucua

SEQ ID NO: 1053624 - RNA, 19 nt, Homo sapiens
ggcauguacuuuagacuuu

SEQ ID NO: 1053625 - RNA, 19 nt, Homo sapiens
gaaagcugacugauaaaga

SEQ ID NO: 1053626 - RNA, 19 nt, Homo sapiens
gaacugagugaauuucgaa

SEQ ID NO: 1053627 - RNA, 19 nt, Homo sapiens
agagaaagacguauugaaa

SEQ ID NO: 1053628 - RNA, 19 nt, Homo sapiens
ggagggagcagguguugaa

SEQ ID NO: 1053629 - RNA, 19 nt, Homo sapiens
ggaaaggaaagcugacuga

SEQ ID NO: 1053630 - RNA, 19 nt, Homo sapiens
gcauuucucuuggcaguga

SEQ ID NO: 1053631 - RNA, 19 nt, Homo sapiens
caauuuaaaucagcuguug

SEQ ID NO: 1053632 - RNA, 19 nt, Homo sapiens
agaaagacguauugaaaca

SEQ ID NO: 1053633 - RNA, 19 nt, Homo sapiens
ucacagagaaggacaaaga

SEQ ID NO: 1053634 - RNA, 19 nt, Homo sapiens
agaaggagaagaaugcuua

SEQ ID NO: 1053635 - RNA, 19 nt, Homo sapiens
ggagaaauugcacacuuaa

SEQ ID NO: 1053636 - RNA, 19 nt, Homo sapiens
caaauccgaaacuacauua

SEQ ID NO: 1053637 - RNA, 19 nt, Homo sapiens
aaaggaaagcugacugaua

SEQ ID NO: 1053638 - RNA, 19 nt, Homo sapiens
ucucuucgaucgcuucuuu

SEQ ID NO: 1053639 - RNA, 19 nt, Homo sapiens
gaagagaaugauauugcua

SEQ ID NO: 1053640 - RNA, 19 nt, Homo sapiens
ggaagaugauaggcauaaa

SEQ ID NO: 1053641 - RNA, 19 nt, Homo sapiens
cagaaguaccaaagauuua

SEQ ID NO: 1053642 - RNA, 19 nt, Homo sapiens
ccagaaguaccaaagauuu

SEQ ID NO: 1053643 - RNA, 19 nt, Homo sapiens
agagaaggacaaagaaaua

SEQ ID NO: 1053644 - RNA, 19 nt, Homo sapiens
gaaugucccaagugcaaua

SEQ ID NO: 1053645 - RNA, 19 nt, Homo sapiens
uaagagguggugauagaua

SEQ ID NO: 1053646 - RNA, 19 nt, Homo sapiens
gcuagugaaucauguaucu

SEQ ID NO: 1053647 - RNA, 19 nt, Homo sapiens
guugaaagccuuaucugaa

SEQ ID NO: 1053648 - RNA, 19 nt, Homo sapiens
guagcccucucauuugauu

SEQ ID NO: 1053649 - RNA, 19 nt, Homo sapiens
ugaaagaugcucuggagaa

SEQ ID NO: 1053650 - RNA, 19 nt, Homo sapiens
ggaagagaaugauauugcu

SEQ ID NO: 1053651 - RNA, 19 nt, Homo sapiens
gaagagaaagacguauuga

SEQ ID NO: 1053652 - RNA, 19 nt, Homo sapiens
gaagagacaacgagagaag

SEQ ID NO: 1053653 - RNA, 19 nt, Homo sapiens
caaaauacuuggugaggaa

SEQ ID NO: 1053654 - RNA, 19 nt, Homo sapiens
ggaaauacagcugaaagau

SEQ ID NO: 1053655 - RNA, 19 nt, Homo sapiens
agccuuaucugaagagaaa

SEQ ID NO: 1053656 - RNA, 19 nt, Homo sapiens
ggacuuggcgaccauuuca

SEQ ID NO: 1053657 - RNA, 19 nt, Homo sapiens
gggauuuucuugaucuuua

SEQ ID NO: 1053658 - RNA, 19 nt, Homo sapiens
ggggaaaacuugaagaaga

SEQ ID NO: 1053659 - RNA, 19 nt, Homo sapiens
ggaagucuauguaaaagga

SEQ ID NO: 1053660 - RNA, 19 nt, Homo sapiens
ccaauacacuccguuuauc

SEQ ID NO: 1053661 - RNA, 19 nt, Homo sapiens
gauauaguacuaccgcauu

SEQ ID NO: 1053662 - RNA, 19 nt, Homo sapiens
gggcuacuguaaaugagaa

SEQ ID NO: 1053663 - RNA, 19 nt, Homo sapiens
acgaauugcugaacuugaa

SEQ ID NO: 1053664 - RNA, 19 nt, Homo sapiens
ucaaauaacacaguuggaa

SEQ ID NO: 1053665 - RNA, 19 nt, Homo sapiens
gcauguacuuuagacuuug

SEQ ID NO: 1053666 - RNA, 19 nt, Homo sapiens
agcaguggcucguguauga

SEQ ID NO: 1053667 - RNA, 19 nt, Homo sapiens
gaaagacguauugaaacaa

SEQ ID NO: 1053668 - RNA, 19 nt, Homo sapiens
aaagaaauacagcgacuga

SEQ ID NO: 1053669 - RNA, 19 nt, Homo sapiens
gcgaucugcuuguccaugu

SEQ ID NO: 1053670 - RNA, 19 nt, Homo sapiens
ccaagugcaauauacagua

SEQ ID NO: 1053671 - RNA, 19 nt, Homo sapiens
gcagcaagaagaacaaaca

SEQ ID NO: 1053672 - RNA, 19 nt, Homo sapiens
uuacacaucucugcuaaag

SEQ ID NO: 1053673 - RNA, 19 nt, Homo sapiens
gcuccaaacugcuucaacu

SEQ ID NO: 1053674 - RNA, 19 nt, Homo sapiens
ugaaagccuuaucugaaga

SEQ ID NO: 1053675 - RNA, 19 nt, Homo sapiens
cuuaucaacucacagagaa

SEQ ID NO: 1053676 - RNA, 19 nt, Homo sapiens
gaucgaagccuaguaacuc

SEQ ID NO: 1053677 - RNA, 19 nt, Homo sapiens
caaauaacacaguuggaau

SEQ ID NO: 1053678 - RNA, 19 nt, Homo sapiens
gcuaaagcagcaagaagaa

SEQ ID NO: 1053679 - RNA, 19 nt, Homo sapiens
aagaagagaagcagaaaug

SEQ ID NO: 1053680 - RNA, 19 nt, Homo sapiens
ucuuaaagcugggcaaugu

SEQ ID NO: 1053681 - RNA, 19 nt, Homo sapiens
aaccaaggaucuuaacugu

SEQ ID NO: 1053682 - RNA, 19 nt, Homo sapiens
guggaauacuguucaaagu

SEQ ID NO: 1053683 - RNA, 19 nt, Homo sapiens
gagaaauugcacacuuaaa

SEQ ID NO: 1053684 - RNA, 19 nt, Homo sapiens
ugcuucaacucaucaauaa

SEQ ID NO: 1053685 - RNA, 19 nt, Homo sapiens
gaucgcuucuuuggacuug

SEQ ID NO: 1053686 - RNA, 19 nt, Homo sapiens
cgacugagagaccaacuga

SEQ ID NO: 1053687 - RNA, 19 nt, Homo sapiens
gcacauucugcuuagcuaa

SEQ ID NO: 1053688 - RNA, 19 nt, Homo sapiens
caacaugugcagcaucaau

SEQ ID NO: 1053689 - RNA, 19 nt, Homo sapiens
aaggguagcucuguuggaa

SEQ ID NO: 1053690 - RNA, 19 nt, Homo sapiens
guugaacgacaaaccauaa

SEQ ID NO: 1053691 - RNA, 19 nt, Homo sapiens
gagaaagacguauugaaac

SEQ ID NO: 1053692 - RNA, 19 nt, Homo sapiens
cauauuguauagcgguuau

SEQ ID NO: 1053693 - RNA, 19 nt, Homo sapiens
uagaaaaccuacaauccua

SEQ ID NO: 1053694 - RNA, 19 nt, Homo sapiens
ccagcaugcuagugaauca

SEQ ID NO: 1053695 - RNA, 19 nt, Homo sapiens
gaagaagagauccgaagag

SEQ ID NO: 1053696 - RNA, 19 nt, Homo sapiens
gcagcgggaagucuaugua

SEQ ID NO: 1053697 - RNA, 19 nt, Homo sapiens
caaacugcuucaacucauc

SEQ ID NO: 1053698 - RNA, 19 nt, Homo sapiens
ccaaacugcuucaacucau

SEQ ID NO: 1053699 - RNA, 19 nt, Homo sapiens
ucaaaugccuucacucuuu

SEQ ID NO: 1053700 - RNA, 19 nt, Homo sapiens
agacaaagcuaaugaagaa

SEQ ID NO: 1053701 - RNA, 19 nt, Homo sapiens
ugaagaaggucuggcauua

SEQ ID NO: 1053702 - RNA, 19 nt, Homo sapiens
ggaacucauuuauugguua

SEQ ID NO: 1053703 - RNA, 19 nt, Homo sapiens
ugaagaagccuauaagaaa

SEQ ID NO: 1053704 - RNA, 19 nt, Homo sapiens
caagugagguggaagaaga

SEQ ID NO: 1053705 - RNA, 19 nt, Homo sapiens
ggaaagggcacgagacaaa

SEQ ID NO: 1053706 - RNA, 19 nt, Homo sapiens
ggaauugccuuaaggaucu

SEQ ID NO: 1053707 - RNA, 19 nt, Homo sapiens
gaagaagccuauaagaaac

SEQ ID NO: 1053708 - RNA, 19 nt, Homo sapiens
guuaagauaugccugcuau

SEQ ID NO: 1053709 - RNA, 19 nt, Homo sapiens
caggagcugugauaaguaa

SEQ ID NO: 1053710 - RNA, 19 nt, Homo sapiens
cuaaaggacuuggauauuc

SEQ ID NO: 1053711 - RNA, 19 nt, Homo sapiens
guuaaugacugggaauauu

SEQ ID NO: 1053712 - RNA, 19 nt, Homo sapiens
gaagaagaggagagaguaa

SEQ ID NO: 1053713 - RNA, 19 nt, Homo sapiens
gguagagaccacagaguua

SEQ ID NO: 1053714 - RNA, 19 nt, Homo sapiens
ggacuuggauauucuucau

SEQ ID NO: 1053715 - RNA, 19 nt, Homo sapiens
gggaaguaguuaagauaug

SEQ ID NO: 1053716 - RNA, 19 nt, Homo sapiens
uaaggcuucugcaggauuu

SEQ ID NO: 1053717 - RNA, 19 nt, Homo sapiens
uaaaggacuuggauauucu

SEQ ID NO: 1053718 - RNA, 19 nt, Homo sapiens
ggaaguaguuaagauaugc

SEQ ID NO: 1053719 - RNA, 19 nt, Homo sapiens
ccuuaaggaucuaauaguu

SEQ ID NO: 1053720 - RNA, 19 nt, Homo sapiens
cuaacaaacuacaguauac

SEQ ID NO: 1053721 - RNA, 19 nt, Homo sapiens
gagcaugucaaccuucauu

SEQ ID NO: 1053722 - RNA, 19 nt, Homo sapiens
caucuaauguaguucugaa

SEQ ID NO: 1053723 - RNA, 19 nt, Homo sapiens
guaucaagucuacugaaua

SEQ ID NO: 1053724 - RNA, 19 nt, Homo sapiens
ggaagaagaagaggagaga

SEQ ID NO: 1053725 - RNA, 19 nt, Homo sapiens
guagagaccacagaguuaa

SEQ ID NO: 1053726 - RNA, 19 nt, Homo sapiens
gagacaaagcuaaugaaga

SEQ ID NO: 1053727 - RNA, 19 nt, Homo sapiens
ccugcuaucuuuaacuuug

SEQ ID NO: 1053728 - RNA, 19 nt, Homo sapiens
cuccugauaugcacuuuaa

SEQ ID NO: 1053729 - RNA, 19 nt, Homo sapiens
cuucauaauucaucacaga

SEQ ID NO: 1053730 - RNA, 19 nt, Homo sapiens
ugaagagcaugucaaccuu

SEQ ID NO: 1053731 - RNA, 19 nt, Homo sapiens
caagucuacugaauaugga

SEQ ID NO: 1053732 - RNA, 19 nt, Homo sapiens
guaguucuaucauuagcau

SEQ ID NO: 1053733 - RNA, 19 nt, Homo sapiens
cacccacacuucagaaaga

SEQ ID NO: 1053734 - RNA, 19 nt, Homo sapiens
gggaauauucagagccuaa

SEQ ID NO: 1053735 - RNA, 19 nt, Homo sapiens
ggagguaguaucaaaauuu

SEQ ID NO: 1053736 - RNA, 19 nt, Homo sapiens
gaaccuuagcacauuuauu

SEQ ID NO: 1053737 - RNA, 19 nt, Homo sapiens
ugccaaaucuaggaaacua

SEQ ID NO: 1053738 - RNA, 19 nt, Homo sapiens
cuacaggaagaaauagaua

SEQ ID NO: 1053739 - RNA, 19 nt, Homo sapiens
ucaaagcacccacacuuca

SEQ ID NO: 1053740 - RNA, 19 nt, Homo sapiens
uuaccuaacucccuagucu

SEQ ID NO: 1053741 - RNA, 19 nt, Homo sapiens
guaaaacuguuaaccuaug

SEQ ID NO: 1053742 - RNA, 19 nt, Homo sapiens
aaauaggaauugccuuaag

SEQ ID NO: 1053743 - RNA, 19 nt, Homo sapiens
caaagcuaaugaagaaggu

SEQ ID NO: 1053744 - RNA, 19 nt, Homo sapiens
ucagaaaacucucaaagca

SEQ ID NO: 1053745 - RNA, 19 nt, Homo sapiens
caaaugccuucacucuuuu

SEQ ID NO: 1053746 - RNA, 19 nt, Homo sapiens
gagcugugauaaguaagug

SEQ ID NO: 1053747 - RNA, 19 nt, Homo sapiens
gaauugccuuaaggaucua

SEQ ID NO: 1053748 - RNA, 19 nt, Homo sapiens
gcaguugccaaaucuagga

SEQ ID NO: 1053749 - RNA, 19 nt, Homo sapiens
uguaucaagucuacugaau

SEQ ID NO: 1053750 - RNA, 19 nt, Homo sapiens
gcacgagacaaagcuaaug

SEQ ID NO: 1053751 - RNA, 19 nt, Homo sapiens
aagaaggucuggcauuacu

SEQ ID NO: 1053752 - RNA, 19 nt, Homo sapiens
uugaagaagccuauaagaa

SEQ ID NO: 1053753 - RNA, 19 nt, Homo sapiens
agaagaagaggagagagua

SEQ ID NO: 1053754 - RNA, 19 nt, Homo sapiens
gaagaaggucuggcauuac

SEQ ID NO: 1053755 - RNA, 19 nt, Homo sapiens
ggucaucuggaacuugaaa

SEQ ID NO: 1053756 - RNA, 19 nt, Homo sapiens
gaaggucuggcauuacuac

SEQ ID NO: 1053757 - RNA, 19 nt, Homo sapiens
gcuucugcaggauuuauua

SEQ ID NO: 1053758 - RNA, 19 nt, Homo sapiens
gaguuaaugacugggaaua

SEQ ID NO: 1053759 - RNA, 19 nt, Homo sapiens
ucucaaagcacccacacuu

SEQ ID NO: 1053760 - RNA, 19 nt, Homo sapiens
ggaauauucagagccuaaa

SEQ ID NO: 1053761 - RNA, 19 nt, Homo sapiens
gaaagggcacgagacaaag

SEQ ID NO: 1053762 - RNA, 19 nt, Homo sapiens
cuuaguguuugcuaucauu

SEQ ID NO: 1053763 - RNA, 19 nt, Homo sapiens
ucaagucuacugaauaugg

SEQ ID NO: 1053764 - RNA, 19 nt, Homo sapiens
guauuugccuaaaaccaua

SEQ ID NO: 1053765 - RNA, 19 nt, Homo sapiens
guaguucugaagacuguuu

SEQ ID NO: 1053766 - RNA, 19 nt, Homo sapiens
uggcauuacuacaggaaga

SEQ ID NO: 1053767 - RNA, 19 nt, Homo sapiens
ucauugaagaagccuauaa

SEQ ID NO: 1053768 - RNA, 19 nt, Homo sapiens
acuaauguaucaagucuac

SEQ ID NO: 1053769 - RNA, 19 nt, Homo sapiens
cuggucaucuggaacuuga

SEQ ID NO: 1053770 - RNA, 19 nt, Homo sapiens
gagaccacagaguuaauga

SEQ ID NO: 1053771 - RNA, 19 nt, Homo sapiens
auucagagccuaaagaaca

SEQ ID NO: 1053772 - RNA, 19 nt, Homo sapiens
cuucuuugguuguuuagug

SEQ ID NO: 1053773 - RNA, 19 nt, Homo sapiens
aauaggaauugccuuaagg

SEQ ID NO: 1053774 - RNA, 19 nt, Homo sapiens
guaguggaguacucucucu

SEQ ID NO: 1053775 - RNA, 19 nt, Homo sapiens
cuacugucaucaaaacaua

SEQ ID NO: 1053776 - RNA, 19 nt, Homo sapiens
ucacagaugaagagcaugu

SEQ ID NO: 1053777 - RNA, 19 nt, Homo sapiens
ucuaaaggacuuggauauu

SEQ ID NO: 1053778 - RNA, 19 nt, Homo sapiens
gcacccacacuucagaaag

SEQ ID NO: 1053779 - RNA, 19 nt, Homo sapiens
gggcacgagacaaagcuaa

SEQ ID NO: 1053780 - RNA, 19 nt, Homo sapiens
guucuaucauuagcaucua

SEQ ID NO: 1053781 - RNA, 19 nt, Homo sapiens
aagagcaugucaaccuuca

SEQ ID NO: 1053782 - RNA, 19 nt, Homo sapiens
ccaauggcuuacaguuucu

SEQ ID NO: 1053783 - RNA, 19 nt, Homo sapiens
uuauaaugccugaauggaa

SEQ ID NO: 1053784 - RNA, 19 nt, Homo sapiens
uuaaugacugggaauauuc

SEQ ID NO: 1053785 - RNA, 19 nt, Homo sapiens
ccacacuucagaaagaaau

SEQ ID NO: 1053786 - RNA, 19 nt, Homo sapiens
gaggagagaguaaaacaga

SEQ ID NO: 1053787 - RNA, 19 nt, Homo sapiens
ugccugcuaucuuuaacuu

SEQ ID NO: 1053788 - RNA, 19 nt, Homo sapiens
gcugugauaaguaaguguu

SEQ ID NO: 1053789 - RNA, 19 nt, Homo sapiens
uggaacucauuuauugguu

SEQ ID NO: 1053790 - RNA, 19 nt, Homo sapiens
guaaaacagaugcaucaaa

SEQ ID NO: 1053791 - RNA, 19 nt, Homo sapiens
ccucaaaugccuucacucu

SEQ ID NO: 1053792 - RNA, 19 nt, Homo sapiens
gaccacagaguuaaugacu

SEQ ID NO: 1053793 - RNA, 19 nt, Homo sapiens
cacgagacaaagcuaauga

SEQ ID NO: 1053794 - RNA, 19 nt, Homo sapiens
ucaggagcugugauaagua

SEQ ID NO: 1053795 - RNA, 19 nt, Homo sapiens
uaauguaguucugaagacu

SEQ ID NO: 1053796 - RNA, 19 nt, Homo sapiens
ucugcaggauuuauuaucu

SEQ ID NO: 1053797 - RNA, 19 nt, Homo sapiens
gcuaaggcuucugcaggau

SEQ ID NO: 1053798 - RNA, 19 nt, Homo sapiens
aaagaaauuuuggcgcuaa

SEQ ID NO: 1053799 - RNA, 19 nt, Homo sapiens
ggaaauaguuugcagauaa

SEQ ID NO: 1053800 - RNA, 19 nt, Homo sapiens
gaacaaagcugaugcaacu

SEQ ID NO: 1053801 - RNA, 19 nt, Homo sapiens
ggaaauagcuacaguuuua

SEQ ID NO: 1053802 - RNA, 19 nt, Homo sapiens
gaacauggauccaagaaau

SEQ ID NO: 1053803 - RNA, 19 nt, Homo sapiens
caagaaaucucacucuaaa

SEQ ID NO: 1053804 - RNA, 19 nt, Homo sapiens
gcauauagaucacuuguau

SEQ ID NO: 1053805 - RNA, 19 nt, Homo sapiens
gaagaaaccuuuggacaca

SEQ ID NO: 1053806 - RNA, 19 nt, Homo sapiens
guaaugaaauaaccuguga

SEQ ID NO: 1053807 - RNA, 19 nt, Homo sapiens
ggaugaagcuauagacaug

SEQ ID NO: 1053808 - RNA, 19 nt, Homo sapiens
gaagggaaaucuagucagu

SEQ ID NO: 1053809 - RNA, 19 nt, Homo sapiens
gaauaaugcucccagacuu

SEQ ID NO: 1053810 - RNA, 19 nt, Homo sapiens
agaagaagcuggaggcauu

SEQ ID NO: 1053811 - RNA, 19 nt, Homo sapiens
gcacacagcauguucaaug

SEQ ID NO: 1053812 - RNA, 19 nt, Homo sapiens
ggaguaacccuacaacuau

SEQ ID NO: 1053813 - RNA, 19 nt, Homo sapiens
ugacagugcuuauuuaaag

SEQ ID NO: 1053814 - RNA, 19 nt, Homo sapiens
guaaggaagugguaucuag

SEQ ID NO: 1053815 - RNA, 19 nt, Homo sapiens
uuacagaaccucauaguuu

SEQ ID NO: 1053816 - RNA, 19 nt, Homo sapiens
gcaguguucuaauuggaua

SEQ ID NO: 1053817 - RNA, 19 nt, Homo sapiens
gaucagagagugacaguga

SEQ ID NO: 1053818 - RNA, 19 nt, Homo sapiens
gaguaacccuacaacuaua

SEQ ID NO: 1053819 - RNA, 19 nt, Homo sapiens
gaugacaccuccuucuguu

SEQ ID NO: 1053820 - RNA, 19 nt, Homo sapiens
cuacaaauguuuagcuguu

SEQ ID NO: 1053821 - RNA, 19 nt, Homo sapiens
gaagugguaucuagucagu

SEQ ID NO: 1053822 - RNA, 19 nt, Homo sapiens
gacuagguguaaugaaaua

SEQ ID NO: 1053823 - RNA, 19 nt, Homo sapiens
ccauaaagauugugcuaau

SEQ ID NO: 1053824 - RNA, 19 nt, Homo sapiens
uuauaaagccugugcauuu

SEQ ID NO: 1053825 - RNA, 19 nt, Homo sapiens
uacaagacauggagaagaa

SEQ ID NO: 1053826 - RNA, 19 nt, Homo sapiens
aaagagcacagcccaaaua

SEQ ID NO: 1053827 - RNA, 19 nt, Homo sapiens
cuaaaucccuccuucacuu

SEQ ID NO: 1053828 - RNA, 19 nt, Homo sapiens
gcaccaguguaauaaaugu

SEQ ID NO: 1053829 - RNA, 19 nt, Homo sapiens
agacaaagcaguaaaggaa

SEQ ID NO: 1053830 - RNA, 19 nt, Homo sapiens
gcauguaaagcacaaagua

SEQ ID NO: 1053831 - RNA, 19 nt, Homo sapiens
guauguagcaguucuuaaa

SEQ ID NO: 1053832 - RNA, 19 nt, Homo sapiens
gagaguaguuuuauucuga

SEQ ID NO: 1053833 - RNA, 19 nt, Homo sapiens
gggaaauaguuugcagaua

SEQ ID NO: 1053834 - RNA, 19 nt, Homo sapiens
cugcuuagauuguauaugu

SEQ ID NO: 1053835 - RNA, 19 nt, Homo sapiens
ccaagaaaucucacucuaa

SEQ ID NO: 1053836 - RNA, 19 nt, Homo sapiens
gcacaaaguauguuucagu

SEQ ID NO: 1053837 - RNA, 19 nt, Homo sapiens
caagccagguauucuuaaa

SEQ ID NO: 1053838 - RNA, 19 nt, Homo sapiens
gagcacagcccaaauaaaa

SEQ ID NO: 1053839 - RNA, 19 nt, Homo sapiens
uauagaggccuaauaagaa

SEQ ID NO: 1053840 - RNA, 19 nt, Homo sapiens
uguaguaugugacagaauu

SEQ ID NO: 1053841 - RNA, 19 nt, Homo sapiens
uacagaaccucauaguuug

SEQ ID NO: 1053842 - RNA, 19 nt, Homo sapiens
cuacaacuauauguccuua

SEQ ID NO: 1053843 - RNA, 19 nt, Homo sapiens
aaagaaaggguguaaaugu

SEQ ID NO: 1053844 - RNA, 19 nt, Homo sapiens
cuaguaagaucugacauau

SEQ ID NO: 1053845 - RNA, 19 nt, Homo sapiens
gagcaguguucuaauugga

SEQ ID NO: 1053846 - RNA, 19 nt, Homo sapiens
guuuagcuguuacucauuu

SEQ ID NO: 1053847 - RNA, 19 nt, Homo sapiens
ugacauaugcugaaguuau

SEQ ID NO: 1053848 - RNA, 19 nt, Homo sapiens
cacaaaguauguuucaguu

SEQ ID NO: 1053849 - RNA, 19 nt, Homo sapiens
aauauuggcuacuggugua

SEQ ID NO: 1053850 - RNA, 19 nt, Homo sapiens
guucagccacuuccaauuu

SEQ ID NO: 1053851 - RNA, 19 nt, Homo sapiens
gacaugagauucgacuguu

SEQ ID NO: 1053852 - RNA, 19 nt, Homo sapiens
cagcaccaguguaauaaau

SEQ ID NO: 1053853 - RNA, 19 nt, Homo sapiens
cuuccaauuucuaccauua

SEQ ID NO: 1053854 - RNA, 19 nt, Homo sapiens
caguacacaugaugauaaa

SEQ ID NO: 1053855 - RNA, 19 nt, Homo sapiens
ccaguacacaugaugauaa

SEQ ID NO: 1053856 - RNA, 19 nt, Homo sapiens
gaaaagaaaggguguaaau

SEQ ID NO: 1053857 - RNA, 19 nt, Homo sapiens
aguaagaucugacauaugc

SEQ ID NO: 1053858 - RNA, 19 nt, Homo sapiens
ggacugacuagguguaaug

SEQ ID NO: 1053859 - RNA, 19 nt, Homo sapiens
guucuuaaaucagcaguau

SEQ ID NO: 1053860 - RNA, 19 nt, Homo sapiens
cugacuagguguaaugaaa

SEQ ID NO: 1053861 - RNA, 19 nt, Homo sapiens
cuaugguucuguugguuua

SEQ ID NO: 1053862 - RNA, 19 nt, Homo sapiens
gcauuaacgugacuagcau

SEQ ID NO: 1053863 - RNA, 19 nt, Homo sapiens
aagaaaggguguaaaugug

SEQ ID NO: 1053864 - RNA, 19 nt, Homo sapiens
gacagugcuuauuuaaaga

SEQ ID NO: 1053865 - RNA, 19 nt, Homo sapiens
cuucagaugucauugaugu

SEQ ID NO: 1053866 - RNA, 19 nt, Homo sapiens
gcagauaauggaggaguaa

SEQ ID NO: 1053867 - RNA, 19 nt, Homo sapiens
ugccggagcuccugcauau

SEQ ID NO: 1053868 - RNA, 19 nt, Homo sapiens
ugaugcaacugauuuauac

SEQ ID NO: 1053869 - RNA, 19 nt, Homo sapiens
uaccaagacuguguacaaa

SEQ ID NO: 1053870 - RNA, 19 nt, Homo sapiens
gaaagagcacagcccaaau

SEQ ID NO: 1053871 - RNA, 19 nt, Homo sapiens
ugaaagagcacagcccaaa

SEQ ID NO: 1053872 - RNA, 19 nt, Homo sapiens
agggaaaucuagucaguug

SEQ ID NO: 1053873 - RNA, 19 nt, Homo sapiens
uauagcaacuguucccaau

SEQ ID NO: 1053874 - RNA, 19 nt, Homo sapiens
uuagggugcuguucauuau

SEQ ID NO: 1053875 - RNA, 19 nt, Homo sapiens
gauuaaauguaaggaagug

SEQ ID NO: 1053876 - RNA, 19 nt, Homo sapiens
acaugagauucgacuguua

SEQ ID NO: 1053877 - RNA, 19 nt, Homo sapiens
gaaggagaguaguuuuauu

SEQ ID NO: 1053878 - RNA, 19 nt, Homo sapiens
uaaaugaaggagaguaguu

SEQ ID NO: 1053879 - RNA, 19 nt, Homo sapiens
uguagcaguucuuaaauca

SEQ ID NO: 1053880 - RNA, 19 nt, Homo sapiens
uaccauuucugaucaugaa

SEQ ID NO: 1053881 - RNA, 19 nt, Homo sapiens
uaccagcaccaguguaaua

SEQ ID NO: 1053882 - RNA, 19 nt, Homo sapiens
aaugugauguguccaguau

SEQ ID NO: 1053883 - RNA, 19 nt, Homo sapiens
ucuagucaguugcuugaaa

SEQ ID NO: 1053884 - RNA, 19 nt, Homo sapiens
gcacuucuuccgguuaauu

SEQ ID NO: 1053885 - RNA, 19 nt, Homo sapiens
ucuagucaguccauaaaga

SEQ ID NO: 1053886 - RNA, 19 nt, Homo sapiens
uagcaacuguucccaaugg

SEQ ID NO: 1053887 - RNA, 19 nt, Homo sapiens
cacacagcauguucaauga

SEQ ID NO: 1053888 - RNA, 19 nt, Homo sapiens
ucugacauaugcugaaguu

SEQ ID NO: 1053889 - RNA, 19 nt, Homo sapiens
gcuuugacagugcuuauuu

SEQ ID NO: 1053890 - RNA, 19 nt, Homo sapiens
ggaauaaugcucccagacu

SEQ ID NO: 1053891 - RNA, 19 nt, Homo sapiens
aaguuuggaugaagcuaua

SEQ ID NO: 1053892 - RNA, 19 nt, Homo sapiens
cuaaagccauaggaagaaa

SEQ ID NO: 1053893 - RNA, 19 nt, Homo sapiens
aaacaaggacugacuaggu

SEQ ID NO: 1053894 - RNA, 19 nt, Homo sapiens
gaaaucuagucaguugcuu

SEQ ID NO: 1053895 - RNA, 19 nt, Homo sapiens
uccaagaaaucucacucua

SEQ ID NO: 1053896 - RNA, 19 nt, Homo sapiens
gagcaaaauuucucuucaa

SEQ ID NO: 1053897 - RNA, 19 nt, Homo sapiens
ugaauaugcuccuaguuuu

SEQ ID NO: 1053898 - RNA, 19 nt, Homo sapiens
gaagaagcuggaggcauuu

SEQ ID NO: 1053899 - RNA, 19 nt, Homo sapiens
gaagggaagacaacuauaa

SEQ ID NO: 1053900 - RNA, 19 nt, Homo sapiens
ccaccgagcaggucuauua

SEQ ID NO: 1053901 - RNA, 19 nt, Homo sapiens
gagcaggucuauuaccaaa

SEQ ID NO: 1053902 - RNA, 19 nt, Homo sapiens
ggaagacaacuauaauuga

SEQ ID NO: 1053903 - RNA, 19 nt, Homo sapiens
gcaggucuauuaccaaauc

SEQ ID NO: 1053904 - RNA, 19 nt, Homo sapiens
gggaagacaacuauaauug

SEQ ID NO: 1053905 - RNA, 19 nt, Homo sapiens
guauaacuaugacgauguu

SEQ ID NO: 1053906 - RNA, 19 nt, Homo sapiens
ggaagaacaccgcaagauc

SEQ ID NO: 1053907 - RNA, 19 nt, Homo sapiens
gcacaaguauaacuaugac

SEQ ID NO: 1053908 - RNA, 19 nt, Homo sapiens
guuggaaccugaagcacaa

SEQ ID NO: 1053909 - RNA, 19 nt, Homo sapiens
gaaccugaagcacaaguau

SEQ ID NO: 1053910 - RNA, 19 nt, Homo sapiens
caagaagggaagacaacua

SEQ ID NO: 1053911 - RNA, 19 nt, Homo sapiens
gaagcacaaguauaacuau

SEQ ID NO: 1053912 - RNA, 19 nt, Homo sapiens
gaacaccuuggaagcugua

SEQ ID NO: 1053913 - RNA, 19 nt, Homo sapiens
gucauaaacuggguucaug

SEQ ID NO: 1053914 - RNA, 19 nt, Homo sapiens
ucacagcgacucccaagga

SEQ ID NO: 1053915 - RNA, 19 nt, Homo sapiens
uugagucacugaucucuug

SEQ ID NO: 1053916 - RNA, 19 nt, Homo sapiens
gcccuuggccacaacuaua

SEQ ID NO: 1053917 - RNA, 19 nt, Homo sapiens
guaggaggcccacucacaa

SEQ ID NO: 1053918 - RNA, 19 nt, Homo sapiens
gacgauguucugcugcuua

SEQ ID NO: 1053919 - RNA, 19 nt, Homo sapiens
gcccaacgcagugucauaa

SEQ ID NO: 1053920 - RNA, 19 nt, Homo sapiens
cgaaagaucacaggccuau

SEQ ID NO: 1053921 - RNA, 19 nt, Homo sapiens
ugaagcacaaguauaacua

SEQ ID NO: 1053922 - RNA, 19 nt, Homo sapiens
aaacaggucccauccucuu

SEQ ID NO: 1053923 - RNA, 19 nt, Homo sapiens
ggaaccugaagcacaagua

SEQ ID NO: 1053924 - RNA, 19 nt, Homo sapiens
ggacagugggacuaacuuc

SEQ ID NO: 1053925 - RNA, 19 nt, Homo sapiens
gaaggaguuguuccgaaga

SEQ ID NO: 1053926 - RNA, 19 nt, Homo sapiens
ccaacgcagugucauaaac

SEQ ID NO: 1053927 - RNA, 19 nt, Homo sapiens
cgucaagcccaucuacaaa

SEQ ID NO: 1053928 - RNA, 19 nt, Homo sapiens
aagcacaaguauaacuaug

SEQ ID NO: 1053929 - RNA, 19 nt, Homo sapiens
gagcauugagucacugauc

SEQ ID NO: 1053930 - RNA, 19 nt, Homo sapiens
aagaagggaagacaacuau

SEQ ID NO: 1053931 - RNA, 19 nt, Homo sapiens
caaugucugcuacucaaga

SEQ ID NO: 1053932 - RNA, 19 nt, Homo sapiens
cgaggagugugugaagaug

SEQ ID NO: 1053933 - RNA, 19 nt, Homo sapiens
gaucgaggagugugugaag

SEQ ID NO: 1053934 - RNA, 19 nt, Homo sapiens
ccgagcaggucuauuacca

SEQ ID NO: 1053935 - RNA, 19 nt, Homo sapiens
caacgcagugucauaaacu

SEQ ID NO: 1053936 - RNA, 19 nt, Homo sapiens
gagaguccaaauccuccua

SEQ ID NO: 1053937 - RNA, 19 nt, Homo sapiens
uaacuaugacgauguucug

SEQ ID NO: 1053938 - RNA, 19 nt, Homo sapiens
aaugucugcuacucaagaa

SEQ ID NO: 1053939 - RNA, 19 nt, Homo sapiens
ccaaggagaguccaaaucc

SEQ ID NO: 1053940 - RNA, 19 nt, Homo sapiens
gcaagaucgaggagugugu

SEQ ID NO: 1053941 - RNA, 19 nt, Homo sapiens
accugaagcacaaguauaa

SEQ ID NO: 1053942 - RNA, 19 nt, Homo sapiens
gacagugggacuaacuuca

SEQ ID NO: 1053943 - RNA, 19 nt, Homo sapiens
aaagaucacaggccuaugc

SEQ ID NO: 1053944 - RNA, 19 nt, Homo sapiens
caaguauaacuaugacgau

SEQ ID NO: 1053945 - RNA, 19 nt, Homo sapiens
caccuuggaagcuguauca

SEQ ID NO: 1053946 - RNA, 19 nt, Homo sapiens
agaagggaagacaacuaua

SEQ ID NO: 1053947 - RNA, 19 nt, Homo sapiens
acccuuggccugcacagua

SEQ ID NO: 1053948 - RNA, 19 nt, Homo sapiens
gagcaaaccccaacucaac

SEQ ID NO: 1053949 - RNA, 19 nt, Homo sapiens
ggccugcacaguagcaaug

SEQ ID NO: 1053950 - RNA, 19 nt, Homo sapiens
aaccugaagcacaaguaua

SEQ ID NO: 1053951 - RNA, 19 nt, Homo sapiens
ggucuauuaccaaaucaca

SEQ ID NO: 1053952 - RNA, 19 nt, Homo sapiens
gaauauaacuucaggacaa

SEQ ID NO: 1053953 - RNA, 19 nt, Homo sapiens
gcacuuguauuuccguaua

SEQ ID NO: 1053954 - RNA, 19 nt, Homo sapiens
ggauacagcgugcuuauua

SEQ ID NO: 1053955 - RNA, 19 nt, Homo sapiens
aaacugguguucugaaaua

SEQ ID NO: 1053956 - RNA, 19 nt, Homo sapiens
ugaggaagcaguuuaaaua

SEQ ID NO: 1053957 - RNA, 19 nt, Homo sapiens
agagagaccugaaagaaau

SEQ ID NO: 1053958 - RNA, 19 nt, Homo sapiens
ucauuacucugaccacaua

SEQ ID NO: 1053959 - RNA, 19 nt, Homo sapiens
gauaugaggaagcaguuua

SEQ ID NO: 1053960 - RNA, 19 nt, Homo sapiens
aaauagcccuguucucauu

SEQ ID NO: 1053961 - RNA, 19 nt, Homo sapiens
ccugacaccucacaccuua

SEQ ID NO: 1053962 - RNA, 19 nt, Homo sapiens
gagagagaccugaaagaaa

SEQ ID NO: 1053963 - RNA, 19 nt, Homo sapiens
ggagggaucaugugaguug

SEQ ID NO: 1053964 - RNA, 19 nt, Homo sapiens
ggaaacaggcgcuccucua

SEQ ID NO: 1053965 - RNA, 19 nt, Homo sapiens
ggaaggauaugaggaagca

SEQ ID NO: 1053966 - RNA, 19 nt, Homo sapiens
ggagaaagggguucauuua

SEQ ID NO: 1053967 - RNA, 19 nt, Homo sapiens
gauacagcgugcuuauuau

SEQ ID NO: 1053968 - RNA, 19 nt, Homo sapiens
gagggagagugacuucauu

SEQ ID NO: 1053969 - RNA, 19 nt, Homo sapiens
guaaugaagugugaaucuu

SEQ ID NO: 1053970 - RNA, 19 nt, Homo sapiens
cccaagggcuuauucauca

SEQ ID NO: 1053971 - RNA, 19 nt, Homo sapiens
ucaggacaauucaaacuau

SEQ ID NO: 1053972 - RNA, 19 nt, Homo sapiens
ugacuucauucuccauuug

SEQ ID NO: 1053973 - RNA, 19 nt, Homo sapiens
aaacucagaaggugcauuu

SEQ ID NO: 1053974 - RNA, 19 nt, Homo sapiens
gggaccagcuguacuacga

SEQ ID NO: 1053975 - RNA, 19 nt, Homo sapiens
uagguaaacuucacuacug

SEQ ID NO: 1053976 - RNA, 19 nt, Homo sapiens
gcacuaugguguggacaug

SEQ ID NO: 1053977 - RNA, 19 nt, Homo sapiens
ugaauuuucugcccuuuua

SEQ ID NO: 1053978 - RNA, 19 nt, Homo sapiens
gugcuaaaguugaugaaca

SEQ ID NO: 1053979 - RNA, 19 nt, Homo sapiens
aaacuucacuacugguaau

SEQ ID NO: 1053980 - RNA, 19 nt, Homo sapiens
gcaagacacggacguuuca

SEQ ID NO: 1053981 - RNA, 19 nt, Homo sapiens
gaaccaaguggcugaagga

SEQ ID NO: 1053982 - RNA, 19 nt, Homo sapiens
uuaaauagcccuguucuca

SEQ ID NO: 1053983 - RNA, 19 nt, Homo sapiens
gagcuucuguaugcuaaga

SEQ ID NO: 1053984 - RNA, 19 nt, Homo sapiens
gugugaaucuuguuaucaa

SEQ ID NO: 1053985 - RNA, 19 nt, Homo sapiens
caugugaguuggccuacuu

SEQ ID NO: 1053986 - RNA, 19 nt, Homo sapiens
ugaacacauuaauccguua

SEQ ID NO: 1053987 - RNA, 19 nt, Homo sapiens
gggaagaacacggaugaaa

SEQ ID NO: 1053988 - RNA, 19 nt, Homo sapiens
guucugaaauagccuaaca

SEQ ID NO: 1053989 - RNA, 19 nt, Homo sapiens
ucugauguuuccuuccuua

SEQ ID NO: 1053990 - RNA, 19 nt, Homo sapiens
cuucacuacugguaauuaa

SEQ ID NO: 1053991 - RNA, 19 nt, Homo sapiens
guaaacuucacuacuggua

SEQ ID NO: 1053992 - RNA, 19 nt, Homo sapiens
gaaacaggcgcuccucuac

SEQ ID NO: 1053993 - RNA, 19 nt, Homo sapiens
gaagugugaaucuuguuau

SEQ ID NO: 1053994 - RNA, 19 nt, Homo sapiens
ugaguuggccuacuuacaa

SEQ ID NO: 1053995 - RNA, 19 nt, Homo sapiens
caucauagggugcuaaagu

SEQ ID NO: 1053996 - RNA, 19 nt, Homo sapiens
gaacacggaugaaaauguc

SEQ ID NO: 1053997 - RNA, 19 nt, Homo sapiens
ccagcuaccucccaaagca

SEQ ID NO: 1053998 - RNA, 19 nt, Homo sapiens
gcugugaguuauaaugcuu

SEQ ID NO: 1053999 - RNA, 19 nt, Homo sapiens
ugaagugugaaucuuguua

SEQ ID NO: 1054000 - RNA, 19 nt, Homo sapiens
caucaccauggguaaauua

SEQ ID NO: 1054001 - RNA, 19 nt, Homo sapiens
gagagaccugaaagaaaua

SEQ ID NO: 1054002 - RNA, 19 nt, Homo sapiens
guacagcauaccuaagaaa

SEQ ID NO: 1054003 - RNA, 19 nt, Homo sapiens
gaggaagcaguuuaaauag

SEQ ID NO: 1054004 - RNA, 19 nt, Homo sapiens
ggaagaacacggaugaaaa

SEQ ID NO: 1054005 - RNA, 19 nt, Homo sapiens
gagcaagacacggacguuu

SEQ ID NO: 1054006 - RNA, 19 nt, Homo sapiens
gcagcgcuuugcucagcua

SEQ ID NO: 1054007 - RNA, 19 nt, Homo sapiens
acauugacauucucacguu

SEQ ID NO: 1054008 - RNA, 19 nt, Homo sapiens
cuucauacauuuccaguac

SEQ ID NO: 1054009 - RNA, 19 nt, Homo sapiens
gaagaacacggaugaaaau

SEQ ID NO: 1054010 - RNA, 19 nt, Homo sapiens
gaaaguugugaauuuagga

SEQ ID NO: 1054011 - RNA, 19 nt, Homo sapiens
cagcauaccuaagaaacuc

SEQ ID NO: 1054012 - RNA, 19 nt, Homo sapiens
gcuuauuauugggcauuua

SEQ ID NO: 1054013 - RNA, 19 nt, Homo sapiens
gaacgagccggugcaagug

SEQ ID NO: 1054014 - RNA, 19 nt, Homo sapiens
agagagagaccugaaagaa

SEQ ID NO: 1054015 - RNA, 19 nt, Homo sapiens
gugacuucauucuccauuu

SEQ ID NO: 1054016 - RNA, 19 nt, Homo sapiens
uaaugaagugugaaucuug

SEQ ID NO: 1054017 - RNA, 19 nt, Homo sapiens
uuuaaacucucucauuugg

SEQ ID NO: 1054018 - RNA, 19 nt, Homo sapiens
gcaccggcauucugagcau

SEQ ID NO: 1054019 - RNA, 19 nt, Homo sapiens
ggagaucccacgugcaagu

SEQ ID NO: 1054020 - RNA, 19 nt, Homo sapiens
ugaaaguugugaauuuagg

SEQ ID NO: 1054021 - RNA, 19 nt, Homo sapiens
guacuucuuccucauuguu

SEQ ID NO: 1054022 - RNA, 19 nt, Homo sapiens
caguacgacuuuaguaucu

SEQ ID NO: 1054023 - RNA, 19 nt, Homo sapiens
caggacaauucaaacuaug

SEQ ID NO: 1054024 - RNA, 19 nt, Homo sapiens
gauguuuccuuccuuaucc

SEQ ID NO: 1054025 - RNA, 19 nt, Homo sapiens
gaccugaaagaaauaguau

SEQ ID NO: 1054026 - RNA, 19 nt, Homo sapiens
agaaagggguucauuuaga

SEQ ID NO: 1054027 - RNA, 19 nt, Homo sapiens
ugugugcugugaguuauaa

SEQ ID NO: 1054028 - RNA, 19 nt, Homo sapiens
aguggagacuguagaguug

SEQ ID NO: 1054029 - RNA, 19 nt, Homo sapiens
ucagaaggugcauuuaaga

SEQ ID NO: 1054030 - RNA, 19 nt, Homo sapiens
acucagaaggugcauuuaa

SEQ ID NO: 1054031 - RNA, 19 nt, Homo sapiens
guacgacuuuaguaucucu

SEQ ID NO: 1054032 - RNA, 19 nt, Homo sapiens
gaaagggguucauuuagac

SEQ ID NO: 1054033 - RNA, 19 nt, Homo sapiens
caacggauacagcgugcuu

SEQ ID NO: 1054034 - RNA, 19 nt, Homo sapiens
gaguuggccuacuuacaag

SEQ ID NO: 1054035 - RNA, 19 nt, Homo sapiens
caccucacaccuuaucuaa

SEQ ID NO: 1054036 - RNA, 19 nt, Homo sapiens
ggagggagagugacuucau

SEQ ID NO: 1054037 - RNA, 19 nt, Homo sapiens
ugaacgagccggugcaagu

SEQ ID NO: 1054038 - RNA, 19 nt, Homo sapiens
uaaacuucacuacugguaa

SEQ ID NO: 1054039 - RNA, 19 nt, Homo sapiens
ggacugagcguugccuuuu

SEQ ID NO: 1054040 - RNA, 19 nt, Homo sapiens
cauugacauucucacguuu

SEQ ID NO: 1054041 - RNA, 19 nt, Homo sapiens
aaugaagugugaaucuugu

SEQ ID NO: 1054042 - RNA, 19 nt, Homo sapiens
uaagagagagaccugaaag

SEQ ID NO: 1054043 - RNA, 19 nt, Homo sapiens
gagaucccacgugcaagua

SEQ ID NO: 1054044 - RNA, 19 nt, Homo sapiens
ggacguuucaggagagauc

SEQ ID NO: 1054045 - RNA, 19 nt, Homo sapiens
ucgagcuucuguaugcuaa

SEQ ID NO: 1054046 - RNA, 19 nt, Homo sapiens
gcgcuuugcucagcuagag

SEQ ID NO: 1054047 - RNA, 19 nt, Homo sapiens
agaccugaaagaaauagua

SEQ ID NO: 1054048 - RNA, 19 nt, Homo sapiens
cauagggugcuaaaguuga

SEQ ID NO: 1054049 - RNA, 19 nt, Homo sapiens
uaaauagcccuguucucau

SEQ ID NO: 1054050 - RNA, 19 nt, Homo sapiens
agaaggugcauuuaagaga

SEQ ID NO: 1054051 - RNA, 19 nt, Homo sapiens
ccuaagaaacucagaaggu

SEQ ID NO: 1054052 - RNA, 19 nt, Homo sapiens
gagcuaagauugcuuguaa

SEQ ID NO: 1054053 - RNA, 19 nt, Homo sapiens
gauaguggcuucucaaaga

SEQ ID NO: 1054054 - RNA, 19 nt, Homo sapiens
gaaggaggcucauuugaca

SEQ ID NO: 1054055 - RNA, 19 nt, Homo sapiens
gcgcucagcuuccuuauug

SEQ ID NO: 1054056 - RNA, 19 nt, Homo sapiens
ucaaagaucucuaagacuu

SEQ ID NO: 1054057 - RNA, 19 nt, Homo sapiens
ggaaauacaaggauaaaug

SEQ ID NO: 1054058 - RNA, 19 nt, Homo sapiens
caaacaagcagcuggauaa

SEQ ID NO: 1054059 - RNA, 19 nt, Homo sapiens
uaagagacauugggacuuu

SEQ ID NO: 1054060 - RNA, 19 nt, Homo sapiens
ucgcuaaacuucugacuuu

SEQ ID NO: 1054061 - RNA, 19 nt, Homo sapiens
gcaacugaguguagauuug

SEQ ID NO: 1054062 - RNA, 19 nt, Homo sapiens
cuaaggacaucuuugauug

SEQ ID NO: 1054063 - RNA, 19 nt, Homo sapiens
gcuaagauugcuuguaaua

SEQ ID NO: 1054064 - RNA, 19 nt, Homo sapiens
ccucaagucuggaaagaaa

SEQ ID NO: 1054065 - RNA, 19 nt, Homo sapiens
gaagauauccaccuaugug

SEQ ID NO: 1054066 - RNA, 19 nt, Homo sapiens
guaguaccauuguauguau

SEQ ID NO: 1054067 - RNA, 19 nt, Homo sapiens
acaagcagcuggauaagga

SEQ ID NO: 1054068 - RNA, 19 nt, Homo sapiens
gugcucaucuugaaacuug

SEQ ID NO: 1054069 - RNA, 19 nt, Homo sapiens
ggaauagcaucuuugucuu

SEQ ID NO: 1054070 - RNA, 19 nt, Homo sapiens
acaacucacugcaucauuu

SEQ ID NO: 1054071 - RNA, 19 nt, Homo sapiens
ggucugagguucuguccaa

SEQ ID NO: 1054072 - RNA, 19 nt, Homo sapiens
gaaacuaaauugggaaggu

SEQ ID NO: 1054073 - RNA, 19 nt, Homo sapiens
gaaauuggcuugggcucau

SEQ ID NO: 1054074 - RNA, 19 nt, Homo sapiens
ucaaagagaacagaagaua

SEQ ID NO: 1054075 - RNA, 19 nt, Homo sapiens
gacuuucucuuucuacaaa

SEQ ID NO: 1054076 - RNA, 19 nt, Homo sapiens
gaaauacaaggauaaaugg

SEQ ID NO: 1054077 - RNA, 19 nt, Homo sapiens
cuacagugccuaacuauug

SEQ ID NO: 1054078 - RNA, 19 nt, Homo sapiens
gcagcaggcuccaaacaag

SEQ ID NO: 1054079 - RNA, 19 nt, Homo sapiens
gugccuaacuauugggaua

SEQ ID NO: 1054080 - RNA, 19 nt, Homo sapiens
ggaaccagacaguaacuuu

SEQ ID NO: 1054081 - RNA, 19 nt, Homo sapiens
ucaggaagauauccaccua

SEQ ID NO: 1054082 - RNA, 19 nt, Homo sapiens
gaacuuugauuuccauucc

SEQ ID NO: 1054083 - RNA, 19 nt, Homo sapiens
gugcaggaauagcaucuuu

SEQ ID NO: 1054084 - RNA, 19 nt, Homo sapiens
gaucuuacaugcagacacu

SEQ ID NO: 1054085 - RNA, 19 nt, Homo sapiens
ugacaaaggaucaaaggaa

SEQ ID NO: 1054086 - RNA, 19 nt, Homo sapiens
gaacaaggucucccuaagg

SEQ ID NO: 1054087 - RNA, 19 nt, Homo sapiens
uaaagcaacugaguguaga

SEQ ID NO: 1054088 - RNA, 19 nt, Homo sapiens
gaacaaguuuuaugaaugg

SEQ ID NO: 1054089 - RNA, 19 nt, Homo sapiens
gaauagcaucuuugucuug

SEQ ID NO: 1054090 - RNA, 19 nt, Homo sapiens
gggcacauguaaagauuca

SEQ ID NO: 1054091 - RNA, 19 nt, Homo sapiens
ggaauggucugagguucug

SEQ ID NO: 1054092 - RNA, 19 nt, Homo sapiens
acacugggcccuggaaaua

SEQ ID NO: 1054093 - RNA, 19 nt, Homo sapiens
ccugauguccuuagagaua

SEQ ID NO: 1054094 - RNA, 19 nt, Homo sapiens
gaaagcacugggucaaaga

SEQ ID NO: 1054095 - RNA, 19 nt, Homo sapiens
ccagccuucuguucuauuu

SEQ ID NO: 1054096 - RNA, 19 nt, Homo sapiens
ccaaagugcugggauuaca

SEQ ID NO: 1054097 - RNA, 19 nt, Homo sapiens
gaagguacaauaaguagag

SEQ ID NO: 1054098 - RNA, 19 nt, Homo sapiens
ucaccaagcuuuugucuau

SEQ ID NO: 1054099 - RNA, 19 nt, Homo sapiens
ggucaaagagaacagaaga

SEQ ID NO: 1054100 - RNA, 19 nt, Homo sapiens
auugagaagugcaggaaua

SEQ ID NO: 1054101 - RNA, 19 nt, Homo sapiens
gaauccauuugguacauca

SEQ ID NO: 1054102 - RNA, 19 nt, Homo sapiens
ucucaaagaucucuaagac

SEQ ID NO: 1054103 - RNA, 19 nt, Homo sapiens
aaggugcuauugcugcuua

SEQ ID NO: 1054104 - RNA, 19 nt, Homo sapiens
ccaaacaagcagcuggaua

SEQ ID NO: 1054105 - RNA, 19 nt, Homo sapiens
gagaacagaagauacagau

SEQ ID NO: 1054106 - RNA, 19 nt, Homo sapiens
guccaucucuucuacaaca

SEQ ID NO: 1054107 - RNA, 19 nt, Homo sapiens
gaacaucagaagacucauc

SEQ ID NO: 1054108 - RNA, 19 nt, Homo sapiens
gcaggaauagcaucuuugu

SEQ ID NO: 1054109 - RNA, 19 nt, Homo sapiens
aaagagaacagaagauaca

SEQ ID NO: 1054110 - RNA, 19 nt, Homo sapiens
uuaaagucauugcuguuug

SEQ ID NO: 1054111 - RNA, 19 nt, Homo sapiens
aacaaggucucccuaagga

SEQ ID NO: 1054112 - RNA, 19 nt, Homo sapiens
uacgaucugugacaauuga

SEQ ID NO: 1054113 - RNA, 19 nt, Homo sapiens
ucauuucauucaacccaua

SEQ ID NO: 1054114 - RNA, 19 nt, Homo sapiens
guuaaagucauugcuguuu

SEQ ID NO: 1054115 - RNA, 19 nt, Homo sapiens
gagaagugcaggaauagca

SEQ ID NO: 1054116 - RNA, 19 nt, Homo sapiens
guagugaugagccagguuu

SEQ ID NO: 1054117 - RNA, 19 nt, Homo sapiens
gcagauaguggcuucucaa

SEQ ID NO: 1054118 - RNA, 19 nt, Homo sapiens
ccuaaggacaucuuugauu

SEQ ID NO: 1054119 - RNA, 19 nt, Homo sapiens
ugaacaaggucucccuaag

SEQ ID NO: 1054120 - RNA, 19 nt, Homo sapiens
gcacauguaaagauucauc

SEQ ID NO: 1054121 - RNA, 19 nt, Homo sapiens
gauauccaccuaugugcaa

SEQ ID NO: 1054122 - RNA, 19 nt, Homo sapiens
uagcagguaugcaaagaag

SEQ ID NO: 1054123 - RNA, 19 nt, Homo sapiens
ggcuuuacuucgaaauauu

SEQ ID NO: 1054124 - RNA, 19 nt, Homo sapiens
gagaacagcgacacaagag

SEQ ID NO: 1054125 - RNA, 19 nt, Homo sapiens
gggaauccauuugguacau

SEQ ID NO: 1054126 - RNA, 19 nt, Homo sapiens
ugguugagguccuguuuga

SEQ ID NO: 1054127 - RNA, 19 nt, Homo sapiens
aggaagauauccaccuaug

SEQ ID NO: 1054128 - RNA, 19 nt, Homo sapiens
agaaagcacugggucaaag

SEQ ID NO: 1054129 - RNA, 19 nt, Homo sapiens
aagcagaacccuuuauagu

SEQ ID NO: 1054130 - RNA, 19 nt, Homo sapiens
gaucuauccacuucaugaa

SEQ ID NO: 1054131 - RNA, 19 nt, Homo sapiens
ucuaugaucaucugucuga

SEQ ID NO: 1054132 - RNA, 19 nt, Homo sapiens
gcuaaacuucugacuuuca

SEQ ID NO: 1054133 - RNA, 19 nt, Homo sapiens
agccuucuguucuauuuaa

SEQ ID NO: 1054134 - RNA, 19 nt, Homo sapiens
ggaagauauccaccuaugu

SEQ ID NO: 1054135 - RNA, 19 nt, Homo sapiens
uaaagucauugcuguuugc

SEQ ID NO: 1054136 - RNA, 19 nt, Homo sapiens
ccuuagagauaauauggau

SEQ ID NO: 1054137 - RNA, 19 nt, Homo sapiens
gaucugugacaauugagaa

SEQ ID NO: 1054138 - RNA, 19 nt, Homo sapiens
cuuacgaucugugacaauu

SEQ ID NO: 1054139 - RNA, 19 nt, Homo sapiens
gcucagcuuccuuauugaa

SEQ ID NO: 1054140 - RNA, 19 nt, Homo sapiens
uagaacaucagaagacuca

SEQ ID NO: 1054141 - RNA, 19 nt, Homo sapiens
acacuucaccuccacaguu

SEQ ID NO: 1054142 - RNA, 19 nt, Homo sapiens
uggcguggcuuuacuucga

SEQ ID NO: 1054143 - RNA, 19 nt, Homo sapiens
cauaauaagaacuggaaug

SEQ ID NO: 1054144 - RNA, 19 nt, Homo sapiens
uggcuuuacuucgaaauau

SEQ ID NO: 1054145 - RNA, 19 nt, Homo sapiens
ggucuuccaucuguauauc

SEQ ID NO: 1054146 - RNA, 19 nt, Homo sapiens
gaaccagacaguaacuuuu

SEQ ID NO: 1054147 - RNA, 19 nt, Homo sapiens
ggaauccauuugguacauc

SEQ ID NO: 1054148 - RNA, 19 nt, Homo sapiens
cuaaacuucugacuuucau

SEQ ID NO: 1054149 - RNA, 19 nt, Homo sapiens
uuuaccaccuugugaauuc

SEQ ID NO: 1054150 - RNA, 19 nt, Homo sapiens
uugcuacagugccuaacua

SEQ ID NO: 1054151 - RNA, 19 nt, Homo sapiens
cacuucaccuccacaguug

SEQ ID NO: 1054152 - RNA, 19 nt, Homo sapiens
gcacaagacuuaguuuauu

SEQ ID NO: 1054153 - RNA, 19 nt, Homo sapiens
gaggaaagguuauuuguca

SEQ ID NO: 1054154 - RNA, 19 nt, Homo sapiens
aaacuacgguucacaauau

SEQ ID NO: 1054155 - RNA, 19 nt, Homo sapiens
ucuguuaacuguugucuua

SEQ ID NO: 1054156 - RNA, 19 nt, Homo sapiens
gagaauaaauugaguacca

SEQ ID NO: 1054157 - RNA, 19 nt, Homo sapiens
gaaagaaacagauggagau

SEQ ID NO: 1054158 - RNA, 19 nt, Homo sapiens
gaaagucaucuaacugaaa

SEQ ID NO: 1054159 - RNA, 19 nt, Homo sapiens
ggaaagaguaaaugaagaa

SEQ ID NO: 1054160 - RNA, 19 nt, Homo sapiens
ggagauaaguuuugugauu

SEQ ID NO: 1054161 - RNA, 19 nt, Homo sapiens
gcaagaauguaguaacucu

SEQ ID NO: 1054162 - RNA, 19 nt, Homo sapiens
gaaagguuauuugucaaug

SEQ ID NO: 1054163 - RNA, 19 nt, Homo sapiens
gaaccugugauuagcauuu

SEQ ID NO: 1054164 - RNA, 19 nt, Homo sapiens
ggagauagcaguguggaaa

SEQ ID NO: 1054165 - RNA, 19 nt, Homo sapiens
ucaccuaucuucauuacug

SEQ ID NO: 1054166 - RNA, 19 nt, Homo sapiens
gcaguuaaagcacuacaaa

SEQ ID NO: 1054167 - RNA, 19 nt, Homo sapiens
gaagaaagucaucuaacug

SEQ ID NO: 1054168 - RNA, 19 nt, Homo sapiens
ggaaaggaggaaagaguaa

SEQ ID NO: 1054169 - RNA, 19 nt, Homo sapiens
gaagagaaagaaacagaug

SEQ ID NO: 1054170 - RNA, 19 nt, Homo sapiens
ccucuggaguuuaaaguuu

SEQ ID NO: 1054171 - RNA, 19 nt, Homo sapiens
guccugagcucuccauuca

SEQ ID NO: 1054172 - RNA, 19 nt, Homo sapiens
uaaauugaguaccacagaa

SEQ ID NO: 1054173 - RNA, 19 nt, Homo sapiens
ccugagcucuccauucaaa

SEQ ID NO: 1054174 - RNA, 19 nt, Homo sapiens
ugaagaaagucaucuaacu

SEQ ID NO: 1054175 - RNA, 19 nt, Homo sapiens
gaucaccuaucuucauuac

SEQ ID NO: 1054176 - RNA, 19 nt, Homo sapiens
uaacuuaaacgagucagua

SEQ ID NO: 1054177 - RNA, 19 nt, Homo sapiens
auagauagcuuugguuuag

SEQ ID NO: 1054178 - RNA, 19 nt, Homo sapiens
caacgauucuuuggaggaa

SEQ ID NO: 1054179 - RNA, 19 nt, Homo sapiens
aagaucaugugaccaauug

SEQ ID NO: 1054180 - RNA, 19 nt, Homo sapiens
gaaaggaggaaagaguaaa

SEQ ID NO: 1054181 - RNA, 19 nt, Homo sapiens
ggaggaaagaguaaaugaa

SEQ ID NO: 1054182 - RNA, 19 nt, Homo sapiens
ggagagagugguauuaugg

SEQ ID NO: 1054183 - RNA, 19 nt, Homo sapiens
gcaaagucuucaaggagau

SEQ ID NO: 1054184 - RNA, 19 nt, Homo sapiens
ggaguuuaaaguuuccuua

SEQ ID NO: 1054185 - RNA, 19 nt, Homo sapiens
uaguaacucugaucagcua

SEQ ID NO: 1054186 - RNA, 19 nt, Homo sapiens
cacaagacuuaguuuauuc

SEQ ID NO: 1054187 - RNA, 19 nt, Homo sapiens
cuuaaacgagucaguaaua

SEQ ID NO: 1054188 - RNA, 19 nt, Homo sapiens
gaggaaagaguaaaugaag

SEQ ID NO: 1054189 - RNA, 19 nt, Homo sapiens
guuaaugaguuucuugaag

SEQ ID NO: 1054190 - RNA, 19 nt, Homo sapiens
guuuaaaguuuccuuaugg

SEQ ID NO: 1054191 - RNA, 19 nt, Homo sapiens
guagugugcaggucauuaa

SEQ ID NO: 1054192 - RNA, 19 nt, Homo sapiens
uuacaugcuuucaacaaga

SEQ ID NO: 1054193 - RNA, 19 nt, Homo sapiens
ggaaagguuauuugucaau

SEQ ID NO: 1054194 - RNA, 19 nt, Homo sapiens
ccaauugugcauucaguuu

SEQ ID NO: 1054195 - RNA, 19 nt, Homo sapiens
ccagagagccauggacauu

SEQ ID NO: 1054196 - RNA, 19 nt, Homo sapiens
gugauuagcauuucuucaa

SEQ ID NO: 1054197 - RNA, 19 nt, Homo sapiens
caacugauucugauucauc

SEQ ID NO: 1054198 - RNA, 19 nt, Homo sapiens
gguauuaugguguaaacaa

SEQ ID NO: 1054199 - RNA, 19 nt, Homo sapiens
agagugguauuauggugua

SEQ ID NO: 1054200 - RNA, 19 nt, Homo sapiens
ggacaaagaaaccuugacu

SEQ ID NO: 1054201 - RNA, 19 nt, Homo sapiens
uucaaacaaugcagugaua

SEQ ID NO: 1054202 - RNA, 19 nt, Homo sapiens
gugugcaggucauuaaaga

SEQ ID NO: 1054203 - RNA, 19 nt, Homo sapiens
guuaaagcacuacaaauag

SEQ ID NO: 1054204 - RNA, 19 nt, Homo sapiens
uuaaagaucaugugaccaa

SEQ ID NO: 1054205 - RNA, 19 nt, Homo sapiens
uauagcaguuaaagcacua

SEQ ID NO: 1054206 - RNA, 19 nt, Homo sapiens
agaaagucaucuaacugaa

SEQ ID NO: 1054207 - RNA, 19 nt, Homo sapiens
aaaguuuccuuauggagau

SEQ ID NO: 1054208 - RNA, 19 nt, Homo sapiens
cagaauucuuugcuauaug

SEQ ID NO: 1054209 - RNA, 19 nt, Homo sapiens
ugauucaucuauagcaguu

SEQ ID NO: 1054210 - RNA, 19 nt, Homo sapiens
aagaaagucaucuaacuga

SEQ ID NO: 1054211 - RNA, 19 nt, Homo sapiens
cugaucagcuacaaggaaa

SEQ ID NO: 1054212 - RNA, 19 nt, Homo sapiens
guucuucaaguuacugaua

SEQ ID NO: 1054213 - RNA, 19 nt, Homo sapiens
gguuauuugucaaugaaga

SEQ ID NO: 1054214 - RNA, 19 nt, Homo sapiens
aaacaaugcagugauagaa

SEQ ID NO: 1054215 - RNA, 19 nt, Homo sapiens
caaacaaugcagugauaga

SEQ ID NO: 1054216 - RNA, 19 nt, Homo sapiens
gccuuuguguccuccguua

SEQ ID NO: 1054217 - RNA, 19 nt, Homo sapiens
gaccaauugugcauucagu

SEQ ID NO: 1054218 - RNA, 19 nt, Homo sapiens
agauagcuuugguuuaguu

SEQ ID NO: 1054219 - RNA, 19 nt, Homo sapiens
ccagagaauaaauugagua

SEQ ID NO: 1054220 - RNA, 19 nt, Homo sapiens
guaaacaacgauucuuugg

SEQ ID NO: 1054221 - RNA, 19 nt, Homo sapiens
ccgcacaagacuuaguuua

SEQ ID NO: 1054222 - RNA, 19 nt, Homo sapiens
gaucaugugaccaauugug

SEQ ID NO: 1054223 - RNA, 19 nt, Homo sapiens
caaaguugcaagaauguag

SEQ ID NO: 1054224 - RNA, 19 nt, Homo sapiens
ucaaacagucuauguccuu

SEQ ID NO: 1054225 - RNA, 19 nt, Homo sapiens
gagauaaguuuugugauuc

SEQ ID NO: 1054226 - RNA, 19 nt, Homo sapiens
acaaagaaaccuugacucu

SEQ ID NO: 1054227 - RNA, 19 nt, Homo sapiens
uugauucuguuaacuguug

SEQ ID NO: 1054228 - RNA, 19 nt, Homo sapiens
guuacaugcuuucaacaag

SEQ ID NO: 1054229 - RNA, 19 nt, Homo sapiens
uagcuuugguuuaguuaca

SEQ ID NO: 1054230 - RNA, 19 nt, Homo sapiens
gauagcuuugguuuaguua

SEQ ID NO: 1054231 - RNA, 19 nt, Homo sapiens
gauucugauucaucuauag

SEQ ID NO: 1054232 - RNA, 19 nt, Homo sapiens
uaacucugaucagcuacaa

SEQ ID NO: 1054233 - RNA, 19 nt, Homo sapiens
guguaaacaacgauucuuu

SEQ ID NO: 1054234 - RNA, 19 nt, Homo sapiens
ugugauuccuguaauagau

SEQ ID NO: 1054235 - RNA, 19 nt, Homo sapiens
ggaggaaagguuauuuguc

SEQ ID NO: 1054236 - RNA, 19 nt, Homo sapiens
ugauagaacuggcaaaauc

SEQ ID NO: 1054237 - RNA, 19 nt, Homo sapiens
gaggacggaggccacgaua

SEQ ID NO: 1054238 - RNA, 19 nt, Homo sapiens
gguagugugcaggucauua

SEQ ID NO: 1054239 - RNA, 19 nt, Homo sapiens
gacauuggagagaguggua

SEQ ID NO: 1054240 - RNA, 19 nt, Homo sapiens
gauuagcauuucuucaaac

SEQ ID NO: 1054241 - RNA, 19 nt, Homo sapiens
gccgcaaagucuucaagga

SEQ ID NO: 1054242 - RNA, 19 nt, Homo sapiens
cuucuccgcacaagacuua

SEQ ID NO: 1054243 - RNA, 19 nt, Homo sapiens
aggaaagaguaaaugaaga

SEQ ID NO: 1054244 - RNA, 19 nt, Homo sapiens
uggagagagugguauuaug

SEQ ID NO: 1054245 - RNA, 19 nt, Homo sapiens
gcaggucauuaaagaucau

SEQ ID NO: 1054246 - RNA, 19 nt, Homo sapiens
agaaacagauggagaucac

SEQ ID NO: 1054247 - RNA, 19 nt, Homo sapiens
uuaguuacaugcuuucaac

SEQ ID NO: 1054248 - RNA, 19 nt, Homo sapiens
gaauguaguaacucugauc

SEQ ID NO: 1054249 - RNA, 19 nt, Homo sapiens
uaaacaacgauucuuugga

SEQ ID NO: 1054250 - RNA, 19 nt, Homo sapiens
uaacugaagagaaagaaac

SEQ ID NO: 1054251 - RNA, 19 nt, Homo sapiens
ucucaaaugauacuuggaa

SEQ ID NO: 1054252 - RNA, 19 nt, Homo sapiens
gaaaugaaauaguggcuaa

SEQ ID NO: 1054253 - RNA, 19 nt, Homo sapiens
gaauggaacuuuaauggaa

SEQ ID NO: 1054254 - RNA, 19 nt, Homo sapiens
gaacuugguaucucuauua

SEQ ID NO: 1054255 - RNA, 19 nt, Homo sapiens
gaagaaagcaagucauaaa

SEQ ID NO: 1054256 - RNA, 19 nt, Homo sapiens
gcacugaccucuucuugga

SEQ ID NO: 1054257 - RNA, 19 nt, Homo sapiens
gaaggaaucuuugguuaau

SEQ ID NO: 1054258 - RNA, 19 nt, Homo sapiens
gcacaucuuuggaguaguu

SEQ ID NO: 1054259 - RNA, 19 nt, Homo sapiens
uagaaggaaucuuugguua

SEQ ID NO: 1054260 - RNA, 19 nt, Homo sapiens
guuaggagaugucugcuuu

SEQ ID NO: 1054261 - RNA, 19 nt, Homo sapiens
gaaacacuaucagaagaaa

SEQ ID NO: 1054262 - RNA, 19 nt, Homo sapiens
gaaaugagaacacuuuaca

SEQ ID NO: 1054263 - RNA, 19 nt, Homo sapiens
gagaagcccucuuuauuuu

SEQ ID NO: 1054264 - RNA, 19 nt, Homo sapiens
uuauuaagcuucucacuga

SEQ ID NO: 1054265 - RNA, 19 nt, Homo sapiens
acaaugggcugaaacaguu

SEQ ID NO: 1054266 - RNA, 19 nt, Homo sapiens
ugagaagcccucuuuauuu

SEQ ID NO: 1054267 - RNA, 19 nt, Homo sapiens
gggaaacacuaucagaaga

SEQ ID NO: 1054268 - RNA, 19 nt, Homo sapiens
ugagaacacuuuacagaug

SEQ ID NO: 1054269 - RNA, 19 nt, Homo sapiens
gcccagaacuuuauagagu

SEQ ID NO: 1054270 - RNA, 19 nt, Homo sapiens
gcagaugucuacuuggaau

SEQ ID NO: 1054271 - RNA, 19 nt, Homo sapiens
gaaagaggcaagacuacaa

SEQ ID NO: 1054272 - RNA, 19 nt, Homo sapiens
gaaagcagaaagagugaaa

SEQ ID NO: 1054273 - RNA, 19 nt, Homo sapiens
gagaacacuuuacagaugu

SEQ ID NO: 1054274 - RNA, 19 nt, Homo sapiens
ugaugaaccagacauauua

SEQ ID NO: 1054275 - RNA, 19 nt, Homo sapiens
uccaaucagugcauauuua

SEQ ID NO: 1054276 - RNA, 19 nt, Homo sapiens
gcaaagcauagguaaauau

SEQ ID NO: 1054277 - RNA, 19 nt, Homo sapiens
ggcagggaauggaacuuua

SEQ ID NO: 1054278 - RNA, 19 nt, Homo sapiens
uaaacugcauugccuauuc

SEQ ID NO: 1054279 - RNA, 19 nt, Homo sapiens
cuacugguguucaauuauu

SEQ ID NO: 1054280 - RNA, 19 nt, Homo sapiens
cagcugagaugauuugagu

SEQ ID NO: 1054281 - RNA, 19 nt, Homo sapiens
cagcagaugucuacuugga

SEQ ID NO: 1054282 - RNA, 19 nt, Homo sapiens
guaaaugucacucuguuug

SEQ ID NO: 1054283 - RNA, 19 nt, Homo sapiens
gguggaggcugcagugaga

SEQ ID NO: 1054284 - RNA, 19 nt, Homo sapiens
uaauucagauugagcaguu

SEQ ID NO: 1054285 - RNA, 19 nt, Homo sapiens
cagcgaaacuuaccugaag

SEQ ID NO: 1054286 - RNA, 19 nt, Homo sapiens
cagcagaucaaacacauuu

SEQ ID NO: 1054287 - RNA, 19 nt, Homo sapiens
acauaaugcuuguguauca

SEQ ID NO: 1054288 - RNA, 19 nt, Homo sapiens
ucaguguguugaauacaua

SEQ ID NO: 1054289 - RNA, 19 nt, Homo sapiens
gaagcagguccaugucuuu

SEQ ID NO: 1054290 - RNA, 19 nt, Homo sapiens
ugaaacaguugguauagca

SEQ ID NO: 1054291 - RNA, 19 nt, Homo sapiens
ggaaacacuaucagaagaa

SEQ ID NO: 1054292 - RNA, 19 nt, Homo sapiens
uaaagaacuugguaucucu

SEQ ID NO: 1054293 - RNA, 19 nt, Homo sapiens
uauaagcgccucucgguuu

SEQ ID NO: 1054294 - RNA, 19 nt, Homo sapiens
gcagaucaaacacauuuau

SEQ ID NO: 1054295 - RNA, 19 nt, Homo sapiens
gcuggcauaugcuaauuug

SEQ ID NO: 1054296 - RNA, 19 nt, Homo sapiens
ucacugagaagcccucuuu

SEQ ID NO: 1054297 - RNA, 19 nt, Homo sapiens
gcagggaauggaacuuuaa

SEQ ID NO: 1054298 - RNA, 19 nt, Homo sapiens
ggccagaugaguauguuua

SEQ ID NO: 1054299 - RNA, 19 nt, Homo sapiens
gaugucuacuuggaauaua

SEQ ID NO: 1054300 - RNA, 19 nt, Homo sapiens
ccaaaccugugguaacaau

SEQ ID NO: 1054301 - RNA, 19 nt, Homo sapiens
gaaaccccgucucuaauaa

SEQ ID NO: 1054302 - RNA, 19 nt, Homo sapiens
ggaauggaacuuuaaugga

SEQ ID NO: 1054303 - RNA, 19 nt, Homo sapiens
cacagcagaugucuacuug

SEQ ID NO: 1054304 - RNA, 19 nt, Homo sapiens
aagaagaaagcaagucaua

SEQ ID NO: 1054305 - RNA, 19 nt, Homo sapiens
gcacagcagaugucuacuu

SEQ ID NO: 1054306 - RNA, 19 nt, Homo sapiens
acaugaaccuccaaggaaa

SEQ ID NO: 1054307 - RNA, 19 nt, Homo sapiens
guacaugaaccuccaagga

SEQ ID NO: 1054308 - RNA, 19 nt, Homo sapiens
gguaucaguguguugaaua

SEQ ID NO: 1054309 - RNA, 19 nt, Homo sapiens
gcgauuuacucuucuccaa

SEQ ID NO: 1054310 - RNA, 19 nt, Homo sapiens
uuacugucaucaccauuaa

SEQ ID NO: 1054311 - RNA, 19 nt, Homo sapiens
ccagcacuguaguuaagua

SEQ ID NO: 1054312 - RNA, 19 nt, Homo sapiens
ggcaugcacugaccucuuc

SEQ ID NO: 1054313 - RNA, 19 nt, Homo sapiens
gaaguaacaaagacacaau

SEQ ID NO: 1054314 - RNA, 19 nt, Homo sapiens
gaauacauaaugcuugugu

SEQ ID NO: 1054315 - RNA, 19 nt, Homo sapiens
gacacaauuagaacaguua

SEQ ID NO: 1054316 - RNA, 19 nt, Homo sapiens
guaacaaucucugaugaac

SEQ ID NO: 1054317 - RNA, 19 nt, Homo sapiens
cugagaagcccucuuuauu

SEQ ID NO: 1054318 - RNA, 19 nt, Homo sapiens
gugcaaagcauagguaaau

SEQ ID NO: 1054319 - RNA, 19 nt, Homo sapiens
guuacugucaucaccauua

SEQ ID NO: 1054320 - RNA, 19 nt, Homo sapiens
gacaugcuaucagguauca

SEQ ID NO: 1054321 - RNA, 19 nt, Homo sapiens
gcagaaagagugaaaauuc

SEQ ID NO: 1054322 - RNA, 19 nt, Homo sapiens
gaaccacuuuuaucuauuc

SEQ ID NO: 1054323 - RNA, 19 nt, Homo sapiens
cuugguaucucuauuaaag

SEQ ID NO: 1054324 - RNA, 19 nt, Homo sapiens
cuaaagaacuugguaucuc

SEQ ID NO: 1054325 - RNA, 19 nt, Homo sapiens
aaugguggcuugcuucuca

SEQ ID NO: 1054326 - RNA, 19 nt, Homo sapiens
cagugcauauuuacaagaa

SEQ ID NO: 1054327 - RNA, 19 nt, Homo sapiens
uaagggcaauacagccaaa

SEQ ID NO: 1054328 - RNA, 19 nt, Homo sapiens
gucaagagauccagaccau

SEQ ID NO: 1054329 - RNA, 19 nt, Homo sapiens
agauugagcaguuaaaguu

SEQ ID NO: 1054330 - RNA, 19 nt, Homo sapiens
gaagaaccacuuuuaucua

SEQ ID NO: 1054331 - RNA, 19 nt, Homo sapiens
gggaauggaacuuuaaugg

SEQ ID NO: 1054332 - RNA, 19 nt, Homo sapiens
agaaggaaucuuugguuaa

SEQ ID NO: 1054333 - RNA, 19 nt, Homo sapiens
agacacaauuagaacaguu

SEQ ID NO: 1054334 - RNA, 19 nt, Homo sapiens
uccaugaaaugaaauagug

SEQ ID NO: 1054335 - RNA, 19 nt, Homo sapiens
gcaggagaaucgcgugaac

SEQ ID NO: 1054336 - RNA, 19 nt, Homo sapiens
aaaauuagcuggacauggu

SEQ ID NO: 1054337 - RNA, 19 nt, Homo sapiens
ggaaguaacaaagacacaa

SEQ ID NO: 1054338 - RNA, 19 nt, Homo sapiens
gaacaucuaacuggaagca

SEQ ID NO: 1054339 - RNA, 19 nt, Homo sapiens
agacuacaaugggcugaaa

SEQ ID NO: 1054340 - RNA, 19 nt, Homo sapiens
gguaaaugucacucuguuu

SEQ ID NO: 1054341 - RNA, 19 nt, Homo sapiens
gguaacaaucucugaugaa

SEQ ID NO: 1054342 - RNA, 19 nt, Homo sapiens
gaagcacagaguucaguau

SEQ ID NO: 1054343 - RNA, 19 nt, Homo sapiens
agaagcagguccaugucuu

SEQ ID NO: 1054344 - RNA, 19 nt, Homo sapiens
aaaugucacucuguuuguu

SEQ ID NO: 1054345 - RNA, 19 nt, Homo sapiens
gaaaauugugcaaagcaua

SEQ ID NO: 1054346 - RNA, 19 nt, Homo sapiens
gauugagcaguuaaaguuu

SEQ ID NO: 1054347 - RNA, 19 nt, Homo sapiens
cgcuacugguguucaauua

SEQ ID NO: 1054348 - RNA, 19 nt, Homo sapiens
gggcagggaauggaacuuu

SEQ ID NO: 1054349 - RNA, 19 nt, Homo sapiens
caaagacacaauuagaaca

SEQ ID NO: 1054350 - RNA, 19 nt, Homo sapiens
aaaccuacacguugauguu

SEQ ID NO: 1054351 - RNA, 19 nt, Homo sapiens
ugcaaagcauagguaaaua

SEQ ID NO: 1054352 - RNA, 19 nt, Homo sapiens
gaacaaagcagcugaauuu

SEQ ID NO: 1054353 - RNA, 19 nt, Homo sapiens
gaaacuagcugaaggaaga

SEQ ID NO: 1054354 - RNA, 19 nt, Homo sapiens
gaacaagaaucuccaguga

SEQ ID NO: 1054355 - RNA, 19 nt, Homo sapiens
gaaaguaaagcccaaauuu

SEQ ID NO: 1054356 - RNA, 19 nt, Homo sapiens
ggauacaucugauuuaaug

SEQ ID NO: 1054357 - RNA, 19 nt, Homo sapiens
gcagauacaugaacaacuu

SEQ ID NO: 1054358 - RNA, 19 nt, Homo sapiens
gcaaggcuaucaugccaua

SEQ ID NO: 1054359 - RNA, 19 nt, Homo sapiens
gaagauguaucgaaugugu

SEQ ID NO: 1054360 - RNA, 19 nt, Homo sapiens
gaacaacuuugauagugaa

SEQ ID NO: 1054361 - RNA, 19 nt, Homo sapiens
ucgauuaccugccaauuua

SEQ ID NO: 1054362 - RNA, 19 nt, Homo sapiens
caaccaugauguucgauua

SEQ ID NO: 1054363 - RNA, 19 nt, Homo sapiens
ccugaaagcugucaauaaa

SEQ ID NO: 1054364 - RNA, 19 nt, Homo sapiens
gaauguguauggugaugua

SEQ ID NO: 1054365 - RNA, 19 nt, Homo sapiens
gcacagagccguggucauu

SEQ ID NO: 1054366 - RNA, 19 nt, Homo sapiens
ggacaaacaaacccaauuu

SEQ ID NO: 1054367 - RNA, 19 nt, Homo sapiens
gaagaaaucgucacauugu

SEQ ID NO: 1054368 - RNA, 19 nt, Homo sapiens
ggagagaaaucagcauuau

SEQ ID NO: 1054369 - RNA, 19 nt, Homo sapiens
gcagauggauaaaggaaga

SEQ ID NO: 1054370 - RNA, 19 nt, Homo sapiens
aaacguagcucucagaagu

SEQ ID NO: 1054371 - RNA, 19 nt, Homo sapiens
ggaggaauuugccuacuug

SEQ ID NO: 1054372 - RNA, 19 nt, Homo sapiens
gagagguuguuuaagauuu

SEQ ID NO: 1054373 - RNA, 19 nt, Homo sapiens
gaaauguugcuucuacuuu

SEQ ID NO: 1054374 - RNA, 19 nt, Homo sapiens
gaauuugccuacuugagaa

SEQ ID NO: 1054375 - RNA, 19 nt, Homo sapiens
gacaaagaauuuacaagga

SEQ ID NO: 1054376 - RNA, 19 nt, Homo sapiens
agacgaagcuauggagaua

SEQ ID NO: 1054377 - RNA, 19 nt, Homo sapiens
caaagcagcugaauuuuau

SEQ ID NO: 1054378 - RNA, 19 nt, Homo sapiens
guaccaaucuguuuuguaa

SEQ ID NO: 1054379 - RNA, 19 nt, Homo sapiens
ggaauuugccuacuugaga

SEQ ID NO: 1054380 - RNA, 19 nt, Homo sapiens
caggauacaucugauuuaa

SEQ ID NO: 1054381 - RNA, 19 nt, Homo sapiens
ggaagaaaucgucacauug

SEQ ID NO: 1054382 - RNA, 19 nt, Homo sapiens
uagaauuccuugacaaaga

SEQ ID NO: 1054383 - RNA, 19 nt, Homo sapiens
guauggugauguagaaauu

SEQ ID NO: 1054384 - RNA, 19 nt, Homo sapiens
ugggagagguuguuuaaga

SEQ ID NO: 1054385 - RNA, 19 nt, Homo sapiens
gaaucuuccucacugauau

SEQ ID NO: 1054386 - RNA, 19 nt, Homo sapiens
gugaauggcagauggauaa

SEQ ID NO: 1054387 - RNA, 19 nt, Homo sapiens
gcugggaguugcucuauuc

SEQ ID NO: 1054388 - RNA, 19 nt, Homo sapiens
gagccaaguuccacugguu

SEQ ID NO: 1054389 - RNA, 19 nt, Homo sapiens
ggagauauuuugcauagaa

SEQ ID NO: 1054390 - RNA, 19 nt, Homo sapiens
ccaagagucugagaagcua

SEQ ID NO: 1054391 - RNA, 19 nt, Homo sapiens
gcucgggccuguguaauug

SEQ ID NO: 1054392 - RNA, 19 nt, Homo sapiens
ugaacaacuuugauaguga

SEQ ID NO: 1054393 - RNA, 19 nt, Homo sapiens
gaauguuguuggaaugaga

SEQ ID NO: 1054394 - RNA, 19 nt, Homo sapiens
cacuaggucuacucaaaua

SEQ ID NO: 1054395 - RNA, 19 nt, Homo sapiens
aggaagaaaucgucacauu

SEQ ID NO: 1054396 - RNA, 19 nt, Homo sapiens
gggagagguuguuuaagau

SEQ ID NO: 1054397 - RNA, 19 nt, Homo sapiens
ucucagaaguacauaauag

SEQ ID NO: 1054398 - RNA, 19 nt, Homo sapiens
gauuuaaugucaccuagca

SEQ ID NO: 1054399 - RNA, 19 nt, Homo sapiens
gucacuaggucuacucaaa

SEQ ID NO: 1054400 - RNA, 19 nt, Homo sapiens
ugauguccuuccucuaaua

SEQ ID NO: 1054401 - RNA, 19 nt, Homo sapiens
agaauuccuugacaaagaa

SEQ ID NO: 1054402 - RNA, 19 nt, Homo sapiens
acaagaaucuccagugaac

SEQ ID NO: 1054403 - RNA, 19 nt, Homo sapiens
gcacagguucugcauuaau

SEQ ID NO: 1054404 - RNA, 19 nt, Homo sapiens
caacuuugauagugaagca

SEQ ID NO: 1054405 - RNA, 19 nt, Homo sapiens
ggcugaaacuauugaagaa

SEQ ID NO: 1054406 - RNA, 19 nt, Homo sapiens
cauacugccuccauuuaau

SEQ ID NO: 1054407 - RNA, 19 nt, Homo sapiens
gaaguguuagaaagcuuua

SEQ ID NO: 1054408 - RNA, 19 nt, Homo sapiens
aagaaaucgucacauugua

SEQ ID NO: 1054409 - RNA, 19 nt, Homo sapiens
ccaggauacaucugauuua

SEQ ID NO: 1054410 - RNA, 19 nt, Homo sapiens
cuaacuccuugguugcuua

SEQ ID NO: 1054411 - RNA, 19 nt, Homo sapiens
gaagaaaaccaucugaguu

SEQ ID NO: 1054412 - RNA, 19 nt, Homo sapiens
gccauacugccuccauuua

SEQ ID NO: 1054413 - RNA, 19 nt, Homo sapiens
gagagaaaucagcauuauu

SEQ ID NO: 1054414 - RNA, 19 nt, Homo sapiens
cguaauaaacacauccaua

SEQ ID NO: 1054415 - RNA, 19 nt, Homo sapiens
ggagagguuguuuaagauu

SEQ ID NO: 1054416 - RNA, 19 nt, Homo sapiens
cgacauguuugugaauuuc

SEQ ID NO: 1054417 - RNA, 19 nt, Homo sapiens
gaucaucuaucagggucaa

SEQ ID NO: 1054418 - RNA, 19 nt, Homo sapiens
uuagaacgaucagaaaugu

SEQ ID NO: 1054419 - RNA, 19 nt, Homo sapiens
aguccagugugaaauguua

SEQ ID NO: 1054420 - RNA, 19 nt, Homo sapiens
cagcauuaaggaacgauua

SEQ ID NO: 1054421 - RNA, 19 nt, Homo sapiens
cacagguucugcauuaaug

SEQ ID NO: 1054422 - RNA, 19 nt, Homo sapiens
acgaagcuauggagauauu

SEQ ID NO: 1054423 - RNA, 19 nt, Homo sapiens
uagaagggcugacggaaaa

SEQ ID NO: 1054424 - RNA, 19 nt, Homo sapiens
uugaggcgcuucccugaaa

SEQ ID NO: 1054425 - RNA, 19 nt, Homo sapiens
ggucauuguugcuguuaca

SEQ ID NO: 1054426 - RNA, 19 nt, Homo sapiens
ggaauuacuacccaaucaa

SEQ ID NO: 1054427 - RNA, 19 nt, Homo sapiens
gcaaacguagcucucagaa

SEQ ID NO: 1054428 - RNA, 19 nt, Homo sapiens
cgaaaguaaagcccaaauu

SEQ ID NO: 1054429 - RNA, 19 nt, Homo sapiens
ucuaucagggucaauauaa

SEQ ID NO: 1054430 - RNA, 19 nt, Homo sapiens
gauacuuggcuuugguuaa

SEQ ID NO: 1054431 - RNA, 19 nt, Homo sapiens
ggauuugcuuggccuggaa

SEQ ID NO: 1054432 - RNA, 19 nt, Homo sapiens
caauaaagccgaacuugcu

SEQ ID NO: 1054433 - RNA, 19 nt, Homo sapiens
uaaaggaagacgaagcuau

SEQ ID NO: 1054434 - RNA, 19 nt, Homo sapiens
gggaguuggugccgcaaga

SEQ ID NO: 1054435 - RNA, 19 nt, Homo sapiens
auuagaggcugaaacuauu

SEQ ID NO: 1054436 - RNA, 19 nt, Homo sapiens
gcgagaaucuuuuccugaa

SEQ ID NO: 1054437 - RNA, 19 nt, Homo sapiens
ccauacugccuccauuuaa

SEQ ID NO: 1054438 - RNA, 19 nt, Homo sapiens
cauucaagauggaggcaaa

SEQ ID NO: 1054439 - RNA, 19 nt, Homo sapiens
cuaucagggucaauauaaa

SEQ ID NO: 1054440 - RNA, 19 nt, Homo sapiens
gaaaucgucacauuguagu

SEQ ID NO: 1054441 - RNA, 19 nt, Homo sapiens
ccaugcuggucuucuuuaa

SEQ ID NO: 1054442 - RNA, 19 nt, Homo sapiens
uguccuuccucuaauaauu

SEQ ID NO: 1054443 - RNA, 19 nt, Homo sapiens
gauguccuuccucuaauaa

SEQ ID NO: 1054444 - RNA, 19 nt, Homo sapiens
uauuagaggcugaaacuau

SEQ ID NO: 1054445 - RNA, 19 nt, Homo sapiens
acuuuaacauccaguauga

SEQ ID NO: 1054446 - RNA, 19 nt, Homo sapiens
uugauaugcuggaggaauu

SEQ ID NO: 1054447 - RNA, 19 nt, Homo sapiens
uugaagauguaucgaaugu

SEQ ID NO: 1054448 - RNA, 19 nt, Homo sapiens
ugugaaauguuacuaaagg

SEQ ID NO: 1054449 - RNA, 19 nt, Homo sapiens
ugugauguccuuccucuaa

SEQ ID NO: 1054450 - RNA, 19 nt, Homo sapiens
uggaauuacuacccaauca

SEQ ID NO: 1054451 - RNA, 19 nt, Homo sapiens
ggucgaguccagugugaaa

SEQ ID NO: 1054452 - RNA, 19 nt, Homo sapiens
gaaagaagccuaccgauau

SEQ ID NO: 1054453 - RNA, 19 nt, Homo sapiens
gaacauguuuguagucuga

SEQ ID NO: 1054454 - RNA, 19 nt, Homo sapiens
gaaggcugcugauaugaua

SEQ ID NO: 1054455 - RNA, 19 nt, Homo sapiens
gagacuggcuuucagauuu

SEQ ID NO: 1054456 - RNA, 19 nt, Homo sapiens
gaagauacccaggcuguua

SEQ ID NO: 1054457 - RNA, 19 nt, Homo sapiens
ggaaagaagccuaccgaua

SEQ ID NO: 1054458 - RNA, 19 nt, Homo sapiens
gagaaaugcugaagagaga

SEQ ID NO: 1054459 - RNA, 19 nt, Homo sapiens
ggagaaauuuccacaaagu

SEQ ID NO: 1054460 - RNA, 19 nt, Homo sapiens
gauaugauacggagaaauu

SEQ ID NO: 1054461 - RNA, 19 nt, Homo sapiens
ggguaaaucugccacauau

SEQ ID NO: 1054462 - RNA, 19 nt, Homo sapiens
gcucucagauugaaugcua

SEQ ID NO: 1054463 - RNA, 19 nt, Homo sapiens
gggaagcucuauagcauug

SEQ ID NO: 1054464 - RNA, 19 nt, Homo sapiens
ucugagagcugagaauaua

SEQ ID NO: 1054465 - RNA, 19 nt, Homo sapiens
gaugaaaccuaccuaccuu

SEQ ID NO: 1054466 - RNA, 19 nt, Homo sapiens
gaaauggguucagagaaau

SEQ ID NO: 1054467 - RNA, 19 nt, Homo sapiens
gugccaagcucucagauug

SEQ ID NO: 1054468 - RNA, 19 nt, Homo sapiens
ggacacugaagauggauua

SEQ ID NO: 1054469 - RNA, 19 nt, Homo sapiens
aaagaagccuaccgauauu

SEQ ID NO: 1054470 - RNA, 19 nt, Homo sapiens
uaaaggcuguaauuacuug

SEQ ID NO: 1054471 - RNA, 19 nt, Homo sapiens
acaaagugauucaggauga

SEQ ID NO: 1054472 - RNA, 19 nt, Homo sapiens
guaaaucugccacauauuc

SEQ ID NO: 1054473 - RNA, 19 nt, Homo sapiens
ccaagugucugaugagauc

SEQ ID NO: 1054474 - RNA, 19 nt, Homo sapiens
ccaaaugucuguggucaau

SEQ ID NO: 1054475 - RNA, 19 nt, Homo sapiens
gagauacuuugaagaacuu

SEQ ID NO: 1054476 - RNA, 19 nt, Homo sapiens
uacccaggcuguuauuuaa

SEQ ID NO: 1054477 - RNA, 19 nt, Homo sapiens
gaagaccgguuuguauaca

SEQ ID NO: 1054478 - RNA, 19 nt, Homo sapiens
cauguugucccaagaguua

SEQ ID NO: 1054479 - RNA, 19 nt, Homo sapiens
uaacagaauccuacgugua

SEQ ID NO: 1054480 - RNA, 19 nt, Homo sapiens
gcagaaggaccgcaucaga

SEQ ID NO: 1054481 - RNA, 19 nt, Homo sapiens
ucccaagaguuauuguuua

SEQ ID NO: 1054482 - RNA, 19 nt, Homo sapiens
gaggacagauggguaaauc

SEQ ID NO: 1054483 - RNA, 19 nt, Homo sapiens
ggacauggcaacuuuaguc

SEQ ID NO: 1054484 - RNA, 19 nt, Homo sapiens
uggaggacauggcaacuuu

SEQ ID NO: 1054485 - RNA, 19 nt, Homo sapiens
gguauaacccaaauuugaa

SEQ ID NO: 1054486 - RNA, 19 nt, Homo sapiens
aaacgaagaggcaguaaga

SEQ ID NO: 1054487 - RNA, 19 nt, Homo sapiens
guauguugcuggaucaaug

SEQ ID NO: 1054488 - RNA, 19 nt, Homo sapiens
ucucaagcgugccgauuaa

SEQ ID NO: 1054489 - RNA, 19 nt, Homo sapiens
guagucugaugacaagaaa

SEQ ID NO: 1054490 - RNA, 19 nt, Homo sapiens
gaugaggacagauggguaa

SEQ ID NO: 1054491 - RNA, 19 nt, Homo sapiens
ucagacagaugcaagagau

SEQ ID NO: 1054492 - RNA, 19 nt, Homo sapiens
gaugugaucaugguuauug

SEQ ID NO: 1054493 - RNA, 19 nt, Homo sapiens
gagcugagaauauacaauc

SEQ ID NO: 1054494 - RNA, 19 nt, Homo sapiens
acacagagauacccuaugc

SEQ ID NO: 1054495 - RNA, 19 nt, Homo sapiens
ugaaguuugugucaaguug

SEQ ID NO: 1054496 - RNA, 19 nt, Homo sapiens
agagagauacuuugaagaa

SEQ ID NO: 1054497 - RNA, 19 nt, Homo sapiens
ucugaaggcugcugauaug

SEQ ID NO: 1054498 - RNA, 19 nt, Homo sapiens
agacucaguucaauacaug

SEQ ID NO: 1054499 - RNA, 19 nt, Homo sapiens
uaaacaguaucggaaagaa

SEQ ID NO: 1054500 - RNA, 19 nt, Homo sapiens
gcccagaagccgaggauuu

SEQ ID NO: 1054501 - RNA, 19 nt, Homo sapiens
gcugguagccaauaaugaa

SEQ ID NO: 1054502 - RNA, 19 nt, Homo sapiens
gccaagcucucagauugaa

SEQ ID NO: 1054503 - RNA, 19 nt, Homo sapiens
gcacacagagauacccuau

SEQ ID NO: 1054504 - RNA, 19 nt, Homo sapiens
gaagcucuauagcauugga

SEQ ID NO: 1054505 - RNA, 19 nt, Homo sapiens
uaaugaaguuugugucaag

SEQ ID NO: 1054506 - RNA, 19 nt, Homo sapiens
agagagagauacuuugaag

SEQ ID NO: 1054507 - RNA, 19 nt, Homo sapiens
acggagaaauuuccacaaa

SEQ ID NO: 1054508 - RNA, 19 nt, Homo sapiens
gagacucaguucaauacau

SEQ ID NO: 1054509 - RNA, 19 nt, Homo sapiens
auccugagcuugauaaaug

SEQ ID NO: 1054510 - RNA, 19 nt, Homo sapiens
agaaagguauaacccaaau

SEQ ID NO: 1054511 - RNA, 19 nt, Homo sapiens
ggaaauuacaguugauucu

SEQ ID NO: 1054512 - RNA, 19 nt, Homo sapiens
uguggucaauucaaacuuu

SEQ ID NO: 1054513 - RNA, 19 nt, Homo sapiens
aaaugucuguggucaauuc

SEQ ID NO: 1054514 - RNA, 19 nt, Homo sapiens
gccgacagguuccuacuca

SEQ ID NO: 1054515 - RNA, 19 nt, Homo sapiens
gguagccaauaaugaaguu

SEQ ID NO: 1054516 - RNA, 19 nt, Homo sapiens
gaaaugcugaagagagaga

SEQ ID NO: 1054517 - RNA, 19 nt, Homo sapiens
cuucaucucucaaauugug

SEQ ID NO: 1054518 - RNA, 19 nt, Homo sapiens
ugucaaagcacuagccauu

SEQ ID NO: 1054519 - RNA, 19 nt, Homo sapiens
ggaggacauggcaacuuua

SEQ ID NO: 1054520 - RNA, 19 nt, Homo sapiens
ucaaagggaagcucuauag

SEQ ID NO: 1054521 - RNA, 19 nt, Homo sapiens
ggcugcaucucuucaggua

SEQ ID NO: 1054522 - RNA, 19 nt, Homo sapiens
agagagagagagauacuuu

SEQ ID NO: 1054523 - RNA, 19 nt, Homo sapiens
gaagagagagagagauacu

SEQ ID NO: 1054524 - RNA, 19 nt, Homo sapiens
gauauugugcggagaggaa

SEQ ID NO: 1054525 - RNA, 19 nt, Homo sapiens
ccagccaagugucugauga

SEQ ID NO: 1054526 - RNA, 19 nt, Homo sapiens
ggacaugcuguugcaguaa

SEQ ID NO: 1054527 - RNA, 19 nt, Homo sapiens
ugccacauauucauaauca

SEQ ID NO: 1054528 - RNA, 19 nt, Homo sapiens
gaaauuacaguugauucug

SEQ ID NO: 1054529 - RNA, 19 nt, Homo sapiens
agacuggcuuucagauuug

SEQ ID NO: 1054530 - RNA, 19 nt, Homo sapiens
gaaauuuccacaaagugau

SEQ ID NO: 1054531 - RNA, 19 nt, Homo sapiens
cgacagguuccuacucauu

SEQ ID NO: 1054532 - RNA, 19 nt, Homo sapiens
auacccaggcuguuauuua

SEQ ID NO: 1054533 - RNA, 19 nt, Homo sapiens
ugucuguggucaauucaaa

SEQ ID NO: 1054534 - RNA, 19 nt, Homo sapiens
aagggaagcucuauagcau

SEQ ID NO: 1054535 - RNA, 19 nt, Homo sapiens
gaaagguauaacccaaauu

SEQ ID NO: 1054536 - RNA, 19 nt, Homo sapiens
aaaccuaccuaccuuacuc

SEQ ID NO: 1054537 - RNA, 19 nt, Homo sapiens
uggacaugcuguugcagua

SEQ ID NO: 1054538 - RNA, 19 nt, Homo sapiens
uaagugaaugugugggaua

SEQ ID NO: 1054539 - RNA, 19 nt, Homo sapiens
uggaagccguaaucgagua

SEQ ID NO: 1054540 - RNA, 19 nt, Homo sapiens
ggaugcuucuuccuccuau

SEQ ID NO: 1054541 - RNA, 19 nt, Homo sapiens
cugaugagauccuugaaag

SEQ ID NO: 1054542 - RNA, 19 nt, Homo sapiens
ggccucuucugcgacauua

SEQ ID NO: 1054543 - RNA, 19 nt, Homo sapiens
guggaaucuuugccgcuua

SEQ ID NO: 1054544 - RNA, 19 nt, Homo sapiens
cacugaagauggauuaaag

SEQ ID NO: 1054545 - RNA, 19 nt, Homo sapiens
gagagagagauacuuugaa

SEQ ID NO: 1054546 - RNA, 19 nt, Homo sapiens
gcugauaugauacggagaa

SEQ ID NO: 1054547 - RNA, 19 nt, Homo sapiens
gcagccauuugcuauuaca

SEQ ID NO: 1054548 - RNA, 19 nt, Homo sapiens
uguggcaauucauagcuua

SEQ ID NO: 1054549 - RNA, 19 nt, Homo sapiens
cccaagaguuauuguuuag

SEQ ID NO: 1054550 - RNA, 19 nt, Homo sapiens
uugaagaccgguuuguaua

SEQ ID NO: 1054551 - RNA, 19 nt, Homo sapiens
aacuucaucucucaaauug

SEQ ID NO: 1054552 - RNA, 19 nt, Homo sapiens
ggagauacaccgaaagaua

SEQ ID NO: 1054553 - RNA, 19 nt, Homo sapiens
gaacuuacccaaucucaug

SEQ ID NO: 1054554 - RNA, 19 nt, Homo sapiens
uagaugagcugcuacagaa

SEQ ID NO: 1054555 - RNA, 19 nt, Homo sapiens
cuaaacagcugaaagaaca

SEQ ID NO: 1054556 - RNA, 19 nt, Homo sapiens
gaugcugucuguucgauuu

SEQ ID NO: 1054557 - RNA, 19 nt, Homo sapiens
uagaggaacuuuaauggaa

SEQ ID NO: 1054558 - RNA, 19 nt, Homo sapiens
gcguugaucugcccauuaa

SEQ ID NO: 1054559 - RNA, 19 nt, Homo sapiens
ucauagcucuguuccauuu

SEQ ID NO: 1054560 - RNA, 19 nt, Homo sapiens
ccaaagauguagcuaaaca

SEQ ID NO: 1054561 - RNA, 19 nt, Homo sapiens
gaucaucauucaguuguuu

SEQ ID NO: 1054562 - RNA, 19 nt, Homo sapiens
guuguuagcuggugccaaa

SEQ ID NO: 1054563 - RNA, 19 nt, Homo sapiens
uguaacaucugguuugauu

SEQ ID NO: 1054564 - RNA, 19 nt, Homo sapiens
gaaccucauugcuacaguu

SEQ ID NO: 1054565 - RNA, 19 nt, Homo sapiens
gcuauaacgcucuucauuu

SEQ ID NO: 1054566 - RNA, 19 nt, Homo sapiens
gaaaugggcaccgagcuaa

SEQ ID NO: 1054567 - RNA, 19 nt, Homo sapiens
gaacagcagaugguaauga

SEQ ID NO: 1054568 - RNA, 19 nt, Homo sapiens
gaaagaacagcagauggua

SEQ ID NO: 1054569 - RNA, 19 nt, Homo sapiens
uggcagagguacugaguuu

SEQ ID NO: 1054570 - RNA, 19 nt, Homo sapiens
caacaucugugagaccauu

SEQ ID NO: 1054571 - RNA, 19 nt, Homo sapiens
gauagagcuuuauucaaug

SEQ ID NO: 1054572 - RNA, 19 nt, Homo sapiens
uaucuaccuugcuguguua

SEQ ID NO: 1054573 - RNA, 19 nt, Homo sapiens
uucaugagcuuaauaggua

SEQ ID NO: 1054574 - RNA, 19 nt, Homo sapiens
gcagagguacugaguuuga

SEQ ID NO: 1054575 - RNA, 19 nt, Homo sapiens
cggcagaacuuacccaauc

SEQ ID NO: 1054576 - RNA, 19 nt, Homo sapiens
gaggaacuuuaauggaauu

SEQ ID NO: 1054577 - RNA, 19 nt, Homo sapiens
gaaaggaaaauccaguuua

SEQ ID NO: 1054578 - RNA, 19 nt, Homo sapiens
uguguuugcuguuguuaua

SEQ ID NO: 1054579 - RNA, 19 nt, Homo sapiens
gcuguuagaugagcugcua

SEQ ID NO: 1054580 - RNA, 19 nt, Homo sapiens
ggcaagccauuguguaugu

SEQ ID NO: 1054581 - RNA, 19 nt, Homo sapiens
ugggaugggugcuuuguuu

SEQ ID NO: 1054582 - RNA, 19 nt, Homo sapiens
gagauacaccgaaagauag

SEQ ID NO: 1054583 - RNA, 19 nt, Homo sapiens
guuugagggugcagucaua

SEQ ID NO: 1054584 - RNA, 19 nt, Homo sapiens
ggauuucccucuuuauugc

SEQ ID NO: 1054585 - RNA, 19 nt, Homo sapiens
gaaguuaucaaaccauucu

SEQ ID NO: 1054586 - RNA, 19 nt, Homo sapiens
agaaaugggugccggaauc

SEQ ID NO: 1054587 - RNA, 19 nt, Homo sapiens
caauagaggaacuuuaaug

SEQ ID NO: 1054588 - RNA, 19 nt, Homo sapiens
guaucuaccuugcuguguu

SEQ ID NO: 1054589 - RNA, 19 nt, Homo sapiens
uaaagaacaggccgaaguu

SEQ ID NO: 1054590 - RNA, 19 nt, Homo sapiens
caugugcauucuucucuaa

SEQ ID NO: 1054591 - RNA, 19 nt, Homo sapiens
gaaauucagaaaccggaaa

SEQ ID NO: 1054592 - RNA, 19 nt, Homo sapiens
agccaaagauguagcuaaa

SEQ ID NO: 1054593 - RNA, 19 nt, Homo sapiens
ucagaaaccggaaaggaaa

SEQ ID NO: 1054594 - RNA, 19 nt, Homo sapiens
gaaucugucuccugaucau

SEQ ID NO: 1054595 - RNA, 19 nt, Homo sapiens
ggacugcuauaacgcucuu

SEQ ID NO: 1054596 - RNA, 19 nt, Homo sapiens
ccaaggauuucgcguugau

SEQ ID NO: 1054597 - RNA, 19 nt, Homo sapiens
cuauaacgcucuucauuuu

SEQ ID NO: 1054598 - RNA, 19 nt, Homo sapiens
ugacugacccguuucugaa

SEQ ID NO: 1054599 - RNA, 19 nt, Homo sapiens
ccaccgagauaccucuaug

SEQ ID NO: 1054600 - RNA, 19 nt, Homo sapiens
ucuaagacauggauugaag

SEQ ID NO: 1054601 - RNA, 19 nt, Homo sapiens
gcacguucuuacccaguug

SEQ ID NO: 1054602 - RNA, 19 nt, Homo sapiens
uguccaaccuguauguuau

SEQ ID NO: 1054603 - RNA, 19 nt, Homo sapiens
guuuguugcugguuugauu

SEQ ID NO: 1054604 - RNA, 19 nt, Homo sapiens
uccaauagaggaacuuuaa

SEQ ID NO: 1054605 - RNA, 19 nt, Homo sapiens
ccucacaguuucuuguuuc

SEQ ID NO: 1054606 - RNA, 19 nt, Homo sapiens
ugauugugcugcuguuaga

SEQ ID NO: 1054607 - RNA, 19 nt, Homo sapiens
ugucagaucccacuguuug

SEQ ID NO: 1054608 - RNA, 19 nt, Homo sapiens
ggccuuuguuacuaucuuu

SEQ ID NO: 1054609 - RNA, 19 nt, Homo sapiens
gaguuauucuggcuuccaa

SEQ ID NO: 1054610 - RNA, 19 nt, Homo sapiens
ugaaaugggcaccgagcua

SEQ ID NO: 1054611 - RNA, 19 nt, Homo sapiens
cuagcagucacuauuauuu

SEQ ID NO: 1054612 - RNA, 19 nt, Homo sapiens
ucgauuuaguggcaacuuu

SEQ ID NO: 1054613 - RNA, 19 nt, Homo sapiens
cuaccuugcuguguuaaau

SEQ ID NO: 1054614 - RNA, 19 nt, Homo sapiens
gagcuuuacgggaggcuuu

SEQ ID NO: 1054615 - RNA, 19 nt, Homo sapiens
gcacacaacauucaaaaca

SEQ ID NO: 1054616 - RNA, 19 nt, Homo sapiens
acggugagauggauucguu

SEQ ID NO: 1054617 - RNA, 19 nt, Homo sapiens
auaccucuaugguucauga

SEQ ID NO: 1054618 - RNA, 19 nt, Homo sapiens
aaagaacagcagaugguaa

SEQ ID NO: 1054619 - RNA, 19 nt, Homo sapiens
ugaaagaacagcagauggu

SEQ ID NO: 1054620 - RNA, 19 nt, Homo sapiens
ccaugucguuguuuauauc

SEQ ID NO: 1054621 - RNA, 19 nt, Homo sapiens
cggaaucugucuccugauc

SEQ ID NO: 1054622 - RNA, 19 nt, Homo sapiens
caaaaucauugaaguugga

SEQ ID NO: 1054623 - RNA, 19 nt, Homo sapiens
guugucagaucccacuguu

SEQ ID NO: 1054624 - RNA, 19 nt, Homo sapiens
gcuagcagucacuauuauu

SEQ ID NO: 1054625 - RNA, 19 nt, Homo sapiens
cgccaugggcaucaaauuu

SEQ ID NO: 1054626 - RNA, 19 nt, Homo sapiens
agucauagcucuguuccau

SEQ ID NO: 1054627 - RNA, 19 nt, Homo sapiens
cauugaaguuggagauaca

SEQ ID NO: 1054628 - RNA, 19 nt, Homo sapiens
guaacaucugguuugauua

SEQ ID NO: 1054629 - RNA, 19 nt, Homo sapiens
agaggaacuuuaauggaau

SEQ ID NO: 1054630 - RNA, 19 nt, Homo sapiens
auuaguacccgcugccuua

SEQ ID NO: 1054631 - RNA, 19 nt, Homo sapiens
ucaugugcauucuucucua

SEQ ID NO: 1054632 - RNA, 19 nt, Homo sapiens
caaccuguauguuauuucc

SEQ ID NO: 1054633 - RNA, 19 nt, Homo sapiens
ccaauuguaacaucugguu

SEQ ID NO: 1054634 - RNA, 19 nt, Homo sapiens
cagcugcguuuggcgguuu

SEQ ID NO: 1054635 - RNA, 19 nt, Homo sapiens
guguccaaccuguauguua

SEQ ID NO: 1054636 - RNA, 19 nt, Homo sapiens
caauggagcccagaaacug

SEQ ID NO: 1054637 - RNA, 19 nt, Homo sapiens
acagugagacggugagaug

SEQ ID NO: 1054638 - RNA, 19 nt, Homo sapiens
uguguuaaaucaugacagu

SEQ ID NO: 1054639 - RNA, 19 nt, Homo sapiens
aagucugugugcagcauua

SEQ ID NO: 1054640 - RNA, 19 nt, Homo sapiens
uuaaagaacaggccgaagu

SEQ ID NO: 1054641 - RNA, 19 nt, Homo sapiens
guccaugucguuguuuaua

SEQ ID NO: 1054642 - RNA, 19 nt, Homo sapiens
uguuaaaucaugacaguga

SEQ ID NO: 1054643 - RNA, 19 nt, Homo sapiens
acacuuugacggaucguuu

SEQ ID NO: 1054644 - RNA, 19 nt, Homo sapiens
ucaaaacacuucauauugc

SEQ ID NO: 1054645 - RNA, 19 nt, Homo sapiens
aaaccaguguaucuaccuu

SEQ ID NO: 1054646 - RNA, 19 nt, Homo sapiens
ggaggccuuuguuacuauc

SEQ ID NO: 1054647 - RNA, 19 nt, Homo sapiens
uuggaggccuuuguuacua

SEQ ID NO: 1054648 - RNA, 19 nt, Homo sapiens
ggaggacccgcacguucuu

SEQ ID NO: 1054649 - RNA, 19 nt, Homo sapiens
ggaaaggaaaauccaguuu

SEQ ID NO: 1054650 - RNA, 19 nt, Homo sapiens
gccauuguguaugucauga

SEQ ID NO: 1054651 - RNA, 19 nt, Homo sapiens
cugcagauccuuucuacug

SEQ ID NO: 1054652 - RNA, 19 nt, Homo sapiens
gcacauaacuugucacuuu

SEQ ID NO: 1054653 - RNA, 19 nt, Homo sapiens
gaacaaagcacauaacuug

SEQ ID NO: 1054654 - RNA, 19 nt, Homo sapiens
gaagcuagaugguggauga

SEQ ID NO: 1054655 - RNA, 19 nt, Homo sapiens
gcaggaaggguauauauuu

SEQ ID NO: 1054656 - RNA, 19 nt, Homo sapiens
ccuaaaggcugaagaacua

SEQ ID NO: 1054657 - RNA, 19 nt, Homo sapiens
gaucauaccuuaccuacca

SEQ ID NO: 1054658 - RNA, 19 nt, Homo sapiens
agacauugcuuucuuauca

SEQ ID NO: 1054659 - RNA, 19 nt, Homo sapiens
uaauaggacucaguacaua

SEQ ID NO: 1054660 - RNA, 19 nt, Homo sapiens
caccugagcuggcuagaaa

SEQ ID NO: 1054661 - RNA, 19 nt, Homo sapiens
gaagucauaugcccuagau

SEQ ID NO: 1054662 - RNA, 19 nt, Homo sapiens
ccacagacauugcuuucuu

SEQ ID NO: 1054663 - RNA, 19 nt, Homo sapiens
cacauaacuugucacuuua

SEQ ID NO: 1054664 - RNA, 19 nt, Homo sapiens
gcuacagccuugcuugaaa

SEQ ID NO: 1054665 - RNA, 19 nt, Homo sapiens
acaacaagcugguguaugg

SEQ ID NO: 1054666 - RNA, 19 nt, Homo sapiens
gaaaggauucucuugacuu

SEQ ID NO: 1054667 - RNA, 19 nt, Homo sapiens
gcgggacucugacaaagaa

SEQ ID NO: 1054668 - RNA, 19 nt, Homo sapiens
caaagcacauaacuuguca

SEQ ID NO: 1054669 - RNA, 19 nt, Homo sapiens
ggguauauauuuccaagug

SEQ ID NO: 1054670 - RNA, 19 nt, Homo sapiens
gaacuucaaagcuauagga

SEQ ID NO: 1054671 - RNA, 19 nt, Homo sapiens
cagaguggcuuuagcuuca

SEQ ID NO: 1054672 - RNA, 19 nt, Homo sapiens
cacagacauugcuuucuua

SEQ ID NO: 1054673 - RNA, 19 nt, Homo sapiens
gaccugagaccuuccaauu

SEQ ID NO: 1054674 - RNA, 19 nt, Homo sapiens
aaaggauucucuugacuug

SEQ ID NO: 1054675 - RNA, 19 nt, Homo sapiens
ggaagaacuggaagucauu

SEQ ID NO: 1054676 - RNA, 19 nt, Homo sapiens
cuucaaagcuauaggaaca

SEQ ID NO: 1054677 - RNA, 19 nt, Homo sapiens
ucacuggccuucaugacuu

SEQ ID NO: 1054678 - RNA, 19 nt, Homo sapiens
auucuaaccucuaaccuaa

SEQ ID NO: 1054679 - RNA, 19 nt, Homo sapiens
ggaaaccacacaaaucugu

SEQ ID NO: 1054680 - RNA, 19 nt, Homo sapiens
gaaggaggauuuggcuauc

SEQ ID NO: 1054681 - RNA, 19 nt, Homo sapiens
gaucaggaaaccacacaaa

SEQ ID NO: 1054682 - RNA, 19 nt, Homo sapiens
cauaugcccuagauggaaa

SEQ ID NO: 1054683 - RNA, 19 nt, Homo sapiens
acaaugagcgggacucuga

SEQ ID NO: 1054684 - RNA, 19 nt, Homo sapiens
cggcgaagguuuccguuug

SEQ ID NO: 1054685 - RNA, 19 nt, Homo sapiens
cucaguacauauagucuua

SEQ ID NO: 1054686 - RNA, 19 nt, Homo sapiens
caggaaggguauauauuuc

SEQ ID NO: 1054687 - RNA, 19 nt, Homo sapiens
ccaacucccuggacuauac

SEQ ID NO: 1054688 - RNA, 19 nt, Homo sapiens
caugugaauucuaccugua

SEQ ID NO: 1054689 - RNA, 19 nt, Homo sapiens
ugacuaauaggacucagua

SEQ ID NO: 1054690 - RNA, 19 nt, Homo sapiens
ucaaagcuauaggaacaaa

SEQ ID NO: 1054691 - RNA, 19 nt, Homo sapiens
caaggagcauguggacaaa

SEQ ID NO: 1054692 - RNA, 19 nt, Homo sapiens
guucacagaugcugagagu

SEQ ID NO: 1054693 - RNA, 19 nt, Homo sapiens
cuacagagaacuagggaaa

SEQ ID NO: 1054694 - RNA, 19 nt, Homo sapiens
ggaacaaagcacauaacuu

SEQ ID NO: 1054695 - RNA, 19 nt, Homo sapiens
gaagaacuggaagucauuu

SEQ ID NO: 1054696 - RNA, 19 nt, Homo sapiens
ggaugagagugcugacugu

SEQ ID NO: 1054697 - RNA, 19 nt, Homo sapiens
ggauuccugugccuccuuu

SEQ ID NO: 1054698 - RNA, 19 nt, Homo sapiens
ggagccacguucacagaug

SEQ ID NO: 1054699 - RNA, 19 nt, Homo sapiens
gggcuggaccacuugauaa

SEQ ID NO: 1054700 - RNA, 19 nt, Homo sapiens
gcacaggggugaugagcaa

SEQ ID NO: 1054701 - RNA, 19 nt, Homo sapiens
agaaggaccuggaagaacu

SEQ ID NO: 1054702 - RNA, 19 nt, Homo sapiens
ucaaggagcauguggacaa

SEQ ID NO: 1054703 - RNA, 19 nt, Homo sapiens
gaaaaguugccuagaauau

SEQ ID NO: 1054704 - RNA, 19 nt, Homo sapiens
cgaaggaggauuuggcuau

SEQ ID NO: 1054705 - RNA, 19 nt, Homo sapiens
gaugccacauggaagagaa

SEQ ID NO: 1054706 - RNA, 19 nt, Homo sapiens
uuacgagacuaaccacguu

SEQ ID NO: 1054707 - RNA, 19 nt, Homo sapiens
cuccagagcuuccuaaagg

SEQ ID NO: 1054708 - RNA, 19 nt, Homo sapiens
ugagcgagaagaagucaua

SEQ ID NO: 1054709 - RNA, 19 nt, Homo sapiens
gagcgggacucugacaaag

SEQ ID NO: 1054710 - RNA, 19 nt, Homo sapiens
ucccuugaguaaucucuua

SEQ ID NO: 1054711 - RNA, 19 nt, Homo sapiens
gcugugagacugugaagau

SEQ ID NO: 1054712 - RNA, 19 nt, Homo sapiens
acucauggcuuccguuucu

SEQ ID NO: 1054713 - RNA, 19 nt, Homo sapiens
guacucauggcuuccguuu

SEQ ID NO: 1054714 - RNA, 19 nt, Homo sapiens
ggaccuggaagaacuggaa

SEQ ID NO: 1054715 - RNA, 19 nt, Homo sapiens
gcuagaugguggaugaagu

SEQ ID NO: 1054716 - RNA, 19 nt, Homo sapiens
caagugcuacagagaacua

SEQ ID NO: 1054717 - RNA, 19 nt, Homo sapiens
gaagaacuacagccaggau

SEQ ID NO: 1054718 - RNA, 19 nt, Homo sapiens
aagaugaagugagcuguga

SEQ ID NO: 1054719 - RNA, 19 nt, Homo sapiens
ccugagaccuuccaauugc

SEQ ID NO: 1054720 - RNA, 19 nt, Homo sapiens
ccuuagaccuugcugagau

SEQ ID NO: 1054721 - RNA, 19 nt, Homo sapiens
uggaagaacuggaagucau

SEQ ID NO: 1054722 - RNA, 19 nt, Homo sapiens
ggaaugacagcagugguau

SEQ ID NO: 1054723 - RNA, 19 nt, Homo sapiens
aaacggacccagcgucaug

SEQ ID NO: 1054724 - RNA, 19 nt, Homo sapiens
ugccagaugucacgaagga

SEQ ID NO: 1054725 - RNA, 19 nt, Homo sapiens
caacaacaagcugguguau

SEQ ID NO: 1054726 - RNA, 19 nt, Homo sapiens
caggaaaccacacaaaucu

SEQ ID NO: 1054727 - RNA, 19 nt, Homo sapiens
ggcgaagguuuccguuugu

SEQ ID NO: 1054728 - RNA, 19 nt, Homo sapiens
guuguucucucccuugagu

SEQ ID NO: 1054729 - RNA, 19 nt, Homo sapiens
cuaaccuaaucuagaauug

SEQ ID NO: 1054730 - RNA, 19 nt, Homo sapiens
ucuaaccucuaaccuaauc

SEQ ID NO: 1054731 - RNA, 19 nt, Homo sapiens
ucaggaaaccacacaaauc

SEQ ID NO: 1054732 - RNA, 19 nt, Homo sapiens
ccuaucaugugaauucuac

SEQ ID NO: 1054733 - RNA, 19 nt, Homo sapiens
uauaggaacaaagcacaua

SEQ ID NO: 1054734 - RNA, 19 nt, Homo sapiens
aagaugcccuccagagcuu

SEQ ID NO: 1054735 - RNA, 19 nt, Homo sapiens
cuacagccuugcuugaaag

SEQ ID NO: 1054736 - RNA, 19 nt, Homo sapiens
gcgagaagaagucauaugc

SEQ ID NO: 1054737 - RNA, 19 nt, Homo sapiens
gaugaagugagcugugaga

SEQ ID NO: 1054738 - RNA, 19 nt, Homo sapiens
uggaaugacagcaguggua

SEQ ID NO: 1054739 - RNA, 19 nt, Homo sapiens
cuccagcucugucuacuuc

SEQ ID NO: 1054740 - RNA, 19 nt, Homo sapiens
caaagcaggaaggguauau

SEQ ID NO: 1054741 - RNA, 19 nt, Homo sapiens
gcauguggacaaagccauu

SEQ ID NO: 1054742 - RNA, 19 nt, Homo sapiens
gaggugagcgagaagaagu

SEQ ID NO: 1054743 - RNA, 19 nt, Homo sapiens
aggauucucuugacuugga

SEQ ID NO: 1054744 - RNA, 19 nt, Homo sapiens
auaggacucaguacauaua

SEQ ID NO: 1054745 - RNA, 19 nt, Homo sapiens
agaacuacagccaggauuu

SEQ ID NO: 1054746 - RNA, 19 nt, Homo sapiens
uaaccucuaaccuaaucua

SEQ ID NO: 1054747 - RNA, 19 nt, Homo sapiens
gaacuacagccaggauuuu

SEQ ID NO: 1054748 - RNA, 19 nt, Homo sapiens
cuggaccacuugauaacuu

SEQ ID NO: 1054749 - RNA, 19 nt, Homo sapiens
cuaauaggacucaguacau

SEQ ID NO: 1054750 - RNA, 19 nt, Homo sapiens
cagccaaugcggagucuga

SEQ ID NO: 1054751 - RNA, 19 nt, Homo sapiens
gguaagggucugaguggau

SEQ ID NO: 1054752 - RNA, 19 nt, Homo sapiens
gggaaaccgugcccaauua

SEQ ID NO: 1054753 - RNA, 19 nt, Homo sapiens
ggacaggaguuaccacuga

SEQ ID NO: 1054754 - RNA, 19 nt, Homo sapiens
gaaaguuccugaagcauca

SEQ ID NO: 1054755 - RNA, 19 nt, Homo sapiens
gaacagguccgaauucuuc

SEQ ID NO: 1054756 - RNA, 19 nt, Homo sapiens
gaaggucgcaggcucauuu

SEQ ID NO: 1054757 - RNA, 19 nt, Homo sapiens
aauaagaacuuccucagaa

SEQ ID NO: 1054758 - RNA, 19 nt, Homo sapiens
gaaagaacagguccgaauu

SEQ ID NO: 1054759 - RNA, 19 nt, Homo sapiens
aggcugagaugucuaauaa

SEQ ID NO: 1054760 - RNA, 19 nt, Homo sapiens
uagaauaccuaaaggaguu

SEQ ID NO: 1054761 - RNA, 19 nt, Homo sapiens
gcugagaugucuaauaaag

SEQ ID NO: 1054762 - RNA, 19 nt, Homo sapiens
agacucagcuucagcauuc

SEQ ID NO: 1054763 - RNA, 19 nt, Homo sapiens
ggaagaggaagauguagaa

SEQ ID NO: 1054764 - RNA, 19 nt, Homo sapiens
ugacaacuguggccuuuau

SEQ ID NO: 1054765 - RNA, 19 nt, Homo sapiens
uaauaaagcuagugaccau

SEQ ID NO: 1054766 - RNA, 19 nt, Homo sapiens
ccagaaaguuccugaagca

SEQ ID NO: 1054767 - RNA, 19 nt, Homo sapiens
ucacugccuuuauuauuga

SEQ ID NO: 1054768 - RNA, 19 nt, Homo sapiens
gcugacaacuguggccuuu

SEQ ID NO: 1054769 - RNA, 19 nt, Homo sapiens
gcaaaguguuacucaccaa

SEQ ID NO: 1054770 - RNA, 19 nt, Homo sapiens
ugacauauccaaagacuca

SEQ ID NO: 1054771 - RNA, 19 nt, Homo sapiens
gcauucacugccuuuauua

SEQ ID NO: 1054772 - RNA, 19 nt, Homo sapiens
aaaggugucagccucauua

SEQ ID NO: 1054773 - RNA, 19 nt, Homo sapiens
aagauuggcugccucaugu

SEQ ID NO: 1054774 - RNA, 19 nt, Homo sapiens
ccacguggcucuguguguu

SEQ ID NO: 1054775 - RNA, 19 nt, Homo sapiens
auaagaacuuccucagaaa

SEQ ID NO: 1054776 - RNA, 19 nt, Homo sapiens
aagaugacauauccaaaga

SEQ ID NO: 1054777 - RNA, 19 nt, Homo sapiens
gaugacauauccaaagacu

SEQ ID NO: 1054778 - RNA, 19 nt, Homo sapiens
ugaggaagaggaagaugua

SEQ ID NO: 1054779 - RNA, 19 nt, Homo sapiens
guacagcccaguccacgaa

SEQ ID NO: 1054780 - RNA, 19 nt, Homo sapiens
gcaguguaaugacaauagu

SEQ ID NO: 1054781 - RNA, 19 nt, Homo sapiens
auguugagguucagaguua

SEQ ID NO: 1054782 - RNA, 19 nt, Homo sapiens
gcugagcaguguaaugaca

SEQ ID NO: 1054783 - RNA, 19 nt, Homo sapiens
cuauguggcugacaacugu

SEQ ID NO: 1054784 - RNA, 19 nt, Homo sapiens
gaaaggugucagccucauu

SEQ ID NO: 1054785 - RNA, 19 nt, Homo sapiens
gaucacugguugguggaaa

SEQ ID NO: 1054786 - RNA, 19 nt, Homo sapiens
gcugguggguguuuguaau

SEQ ID NO: 1054787 - RNA, 19 nt, Homo sapiens
gugaugccgucauacaguu

SEQ ID NO: 1054788 - RNA, 19 nt, Homo sapiens
gggcuucgcuacgauaaag

SEQ ID NO: 1054789 - RNA, 19 nt, Homo sapiens
gaagaggaagauguagaaa

SEQ ID NO: 1054790 - RNA, 19 nt, Homo sapiens
cggaugcccauuaucaaua

SEQ ID NO: 1054791 - RNA, 19 nt, Homo sapiens
aaggugaaauuugaggaua

SEQ ID NO: 1054792 - RNA, 19 nt, Homo sapiens
ugagaugucuaauaaagcu

SEQ ID NO: 1054793 - RNA, 19 nt, Homo sapiens
gucauacaguuacaggaaa

SEQ ID NO: 1054794 - RNA, 19 nt, Homo sapiens
aaggugugaugccgucaua

SEQ ID NO: 1054795 - RNA, 19 nt, Homo sapiens
caagauuggcugccucaug

SEQ ID NO: 1054796 - RNA, 19 nt, Homo sapiens
uaagaugacauauccaaag

SEQ ID NO: 1054797 - RNA, 19 nt, Homo sapiens
gguggaaaauaaacuauga

SEQ ID NO: 1054798 - RNA, 19 nt, Homo sapiens
gccggcagcuguggugauu

SEQ ID NO: 1054799 - RNA, 19 nt, Homo sapiens
guaaaguccaggccauuuc

SEQ ID NO: 1054800 - RNA, 19 nt, Homo sapiens
ggugaaauuugaggauauc

SEQ ID NO: 1054801 - RNA, 19 nt, Homo sapiens
agaaagaacagguccgaau

SEQ ID NO: 1054802 - RNA, 19 nt, Homo sapiens
agcauucacugccuuuauu

SEQ ID NO: 1054803 - RNA, 19 nt, Homo sapiens
uaaacuaugagcagcagaa

SEQ ID NO: 1054804 - RNA, 19 nt, Homo sapiens
ucacaaguaugaggaagag

SEQ ID NO: 1054805 - RNA, 19 nt, Homo sapiens
ugccaagccugaccauguu

SEQ ID NO: 1054806 - RNA, 19 nt, Homo sapiens
cguaacgccacaaggaaua

SEQ ID NO: 1054807 - RNA, 19 nt, Homo sapiens
guuaagaugacauauccaa

SEQ ID NO: 1054808 - RNA, 19 nt, Homo sapiens
gccagucgauaagcugaaa

SEQ ID NO: 1054809 - RNA, 19 nt, Homo sapiens
caaaguguuacucaccaaa

SEQ ID NO: 1054810 - RNA, 19 nt, Homo sapiens
ccaccaagaagcacuuugu

SEQ ID NO: 1054811 - RNA, 19 nt, Homo sapiens
aaagaacagguccgaauuc

SEQ ID NO: 1054812 - RNA, 19 nt, Homo sapiens
cgucauacaguuacaggaa

SEQ ID NO: 1054813 - RNA, 19 nt, Homo sapiens
uucacugccuuuauuauug

SEQ ID NO: 1054814 - RNA, 19 nt, Homo sapiens
ggugucagccucauuaagg

SEQ ID NO: 1054815 - RNA, 19 nt, Homo sapiens
aaauaagaacuuccucaga

SEQ ID NO: 1054816 - RNA, 19 nt, Homo sapiens
caacgagugaugaaguuuc

SEQ ID NO: 1054817 - RNA, 19 nt, Homo sapiens
acaggaggcugagcagugu

SEQ ID NO: 1054818 - RNA, 19 nt, Homo sapiens
gucgcaggcucauuucaga

SEQ ID NO: 1054819 - RNA, 19 nt, Homo sapiens
ggaguugccagucgauaag

SEQ ID NO: 1054820 - RNA, 19 nt, Homo sapiens
agaacuuccucagaaagaa

SEQ ID NO: 1054821 - RNA, 19 nt, Homo sapiens
ccacugaggacgcagaagu

SEQ ID NO: 1054822 - RNA, 19 nt, Homo sapiens
agaggaagauguagaaacc

SEQ ID NO: 1054823 - RNA, 19 nt, Homo sapiens
caccaaaggcuguguggau

SEQ ID NO: 1054824 - RNA, 19 nt, Homo sapiens
ucgccaagcaccagcuaua

SEQ ID NO: 1054825 - RNA, 19 nt, Homo sapiens
ccugucgcgucacugauuu

SEQ ID NO: 1054826 - RNA, 19 nt, Homo sapiens
caaguaugaggaagaggaa

SEQ ID NO: 1054827 - RNA, 19 nt, Homo sapiens
guaacgccacaaggaauaa

SEQ ID NO: 1054828 - RNA, 19 nt, Homo sapiens
ucacagcugaucacugguu

SEQ ID NO: 1054829 - RNA, 19 nt, Homo sapiens
gauuggcugccucauguug

SEQ ID NO: 1054830 - RNA, 19 nt, Homo sapiens
ggaaaccgugcccaauuac

SEQ ID NO: 1054831 - RNA, 19 nt, Homo sapiens
gagcaguguaaugacaaua

SEQ ID NO: 1054832 - RNA, 19 nt, Homo sapiens
cagcauucacugccuuuau

SEQ ID NO: 1054833 - RNA, 19 nt, Homo sapiens
aggcugagcaguguaauga

SEQ ID NO: 1054834 - RNA, 19 nt, Homo sapiens
gaacuuccucagaaagaac

SEQ ID NO: 1054835 - RNA, 19 nt, Homo sapiens
cggcagcuguggugauugg

SEQ ID NO: 1054836 - RNA, 19 nt, Homo sapiens
uaucaauaaucuggaaugg

SEQ ID NO: 1054837 - RNA, 19 nt, Homo sapiens
ccucguaacgccacaagga

SEQ ID NO: 1054838 - RNA, 19 nt, Homo sapiens
ccaagcaccagcuauaggu

SEQ ID NO: 1054839 - RNA, 19 nt, Homo sapiens
caggcugagaugucuaaua

SEQ ID NO: 1054840 - RNA, 19 nt, Homo sapiens
gggucuauguggcugacaa

SEQ ID NO: 1054841 - RNA, 19 nt, Homo sapiens
ggguaugggcgcacauuuc

SEQ ID NO: 1054842 - RNA, 19 nt, Homo sapiens
gccaagccugaccauguua

SEQ ID NO: 1054843 - RNA, 19 nt, Homo sapiens
uaagaacuuccucagaaag

SEQ ID NO: 1054844 - RNA, 19 nt, Homo sapiens
gaaaccggagccagucaag

SEQ ID NO: 1054845 - RNA, 19 nt, Homo sapiens
gccugaccauguuaagaug

SEQ ID NO: 1054846 - RNA, 19 nt, Homo sapiens
ccaagccugaccauguuaa

SEQ ID NO: 1054847 - RNA, 19 nt, Homo sapiens
ccaggagcaacgagagaaa

SEQ ID NO: 1054848 - RNA, 19 nt, Homo sapiens
aagaacuuccucagaaaga

SEQ ID NO: 1054849 - RNA, 19 nt, Homo sapiens
ggugugaugccgucauaca

SEQ ID NO: 1054850 - RNA, 19 nt, Homo sapiens
gagcaacgagagaaacaac

SEQ ID NO: 1054851 - RNA, 19 nt, Homo sapiens
guucuucuuuagccgucua

SEQ ID NO: 1054852 - RNA, 19 nt, Homo sapiens
ggugagaacuuuagaauug

SEQ ID NO: 1054853 - RNA, 19 nt, Homo sapiens
ggaaaagucucaagaagua

SEQ ID NO: 1054854 - RNA, 19 nt, Homo sapiens
ggaccaaagucacuaaugu

SEQ ID NO: 1054855 - RNA, 19 nt, Homo sapiens
gaaaggaagagauaagaaa

SEQ ID NO: 1054856 - RNA, 19 nt, Homo sapiens
ucccagagauugcaaguua

SEQ ID NO: 1054857 - RNA, 19 nt, Homo sapiens
gaaacucacuucaguaucg

SEQ ID NO: 1054858 - RNA, 19 nt, Homo sapiens
ggagacagcgggugaguuu

SEQ ID NO: 1054859 - RNA, 19 nt, Homo sapiens
gaaccaugacuguuacaua

SEQ ID NO: 1054860 - RNA, 19 nt, Homo sapiens
gcaaacgaguaguauaugu

SEQ ID NO: 1054861 - RNA, 19 nt, Homo sapiens
ggaaagaagggauuauuca

SEQ ID NO: 1054862 - RNA, 19 nt, Homo sapiens
aaccaugacuguuacauaa

SEQ ID NO: 1054863 - RNA, 19 nt, Homo sapiens
aagaguggauguucaaauu

SEQ ID NO: 1054864 - RNA, 19 nt, Homo sapiens
caaauaagauauggaccaa

SEQ ID NO: 1054865 - RNA, 19 nt, Homo sapiens
cauaaaggcugucaguagu

SEQ ID NO: 1054866 - RNA, 19 nt, Homo sapiens
caaauuagugggcaaagaa

SEQ ID NO: 1054867 - RNA, 19 nt, Homo sapiens
gaguggauguucaaauuag

SEQ ID NO: 1054868 - RNA, 19 nt, Homo sapiens
ggaaaggaagagauaagaa

SEQ ID NO: 1054869 - RNA, 19 nt, Homo sapiens
caaacgaguaguauaugua

SEQ ID NO: 1054870 - RNA, 19 nt, Homo sapiens
gaaagaagggauuauucau

SEQ ID NO: 1054871 - RNA, 19 nt, Homo sapiens
gacguauggugcaauggua

SEQ ID NO: 1054872 - RNA, 19 nt, Homo sapiens
aauaagauauggaccaaag

SEQ ID NO: 1054873 - RNA, 19 nt, Homo sapiens
agacaaauggcaaauaaga

SEQ ID NO: 1054874 - RNA, 19 nt, Homo sapiens
caaaagcgaccauaaauau

SEQ ID NO: 1054875 - RNA, 19 nt, Homo sapiens
aagaagggauuauucauac

SEQ ID NO: 1054876 - RNA, 19 nt, Homo sapiens
cgggugaguuuguagauga

SEQ ID NO: 1054877 - RNA, 19 nt, Homo sapiens
gaccaaagucacuaauguu

SEQ ID NO: 1054878 - RNA, 19 nt, Homo sapiens
uguuugggauguugcuuua

SEQ ID NO: 1054879 - RNA, 19 nt, Homo sapiens
ucaaauuagugggcaaaga

SEQ ID NO: 1054880 - RNA, 19 nt, Homo sapiens
gaacaugggacuacaucag

SEQ ID NO: 1054881 - RNA, 19 nt, Homo sapiens
gacagcgggugaguuugua

SEQ ID NO: 1054882 - RNA, 19 nt, Homo sapiens
acacauggauggugagaac

SEQ ID NO: 1054883 - RNA, 19 nt, Homo sapiens
auauguagauggaaaggaa

SEQ ID NO: 1054884 - RNA, 19 nt, Homo sapiens
caagaucgaauuugaacau

SEQ ID NO: 1054885 - RNA, 19 nt, Homo sapiens
uccacaagaucgaauuuga

SEQ ID NO: 1054886 - RNA, 19 nt, Homo sapiens
gagauugcaaguuaaugaa

SEQ ID NO: 1054887 - RNA, 19 nt, Homo sapiens
ccacaagaucgaauuugaa

SEQ ID NO: 1054888 - RNA, 19 nt, Homo sapiens
ccaugacuguuacauaaag

SEQ ID NO: 1054889 - RNA, 19 nt, Homo sapiens
ucgggaaccaugacuguua

SEQ ID NO: 1054890 - RNA, 19 nt, Homo sapiens
gaaaagaguggauguucaa

SEQ ID NO: 1054891 - RNA, 19 nt, Homo sapiens
auagagaaaucccagagau

SEQ ID NO: 1054892 - RNA, 19 nt, Homo sapiens
gcggaaagaagggauuauu

SEQ ID NO: 1054893 - RNA, 19 nt, Homo sapiens
aaagcgaccauaaauauag

SEQ ID NO: 1054894 - RNA, 19 nt, Homo sapiens
agaguggauguucaaauua

SEQ ID NO: 1054895 - RNA, 19 nt, Homo sapiens
aguaguauauguagaugga

SEQ ID NO: 1054896 - RNA, 19 nt, Homo sapiens
cauuguggauaauagagaa

SEQ ID NO: 1054897 - RNA, 19 nt, Homo sapiens
cauggauggugagaacuuu

SEQ ID NO: 1054898 - RNA, 19 nt, Homo sapiens
agagauugcaaguuaauga

SEQ ID NO: 1054899 - RNA, 19 nt, Homo sapiens
gaagggauuauucauacuc

SEQ ID NO: 1054900 - RNA, 19 nt, Homo sapiens
uguuggagcugcaaagaca

SEQ ID NO: 1054901 - RNA, 19 nt, Homo sapiens
guagaugaugggacugaaa

SEQ ID NO: 1054902 - RNA, 19 nt, Homo sapiens
ggacguauggugcaauggu

SEQ ID NO: 1054903 - RNA, 19 nt, Homo sapiens
gugagaacuuuagaauugu

SEQ ID NO: 1054904 - RNA, 19 nt, Homo sapiens
guauauggaggacagauca

SEQ ID NO: 1054905 - RNA, 19 nt, Homo sapiens
auacucucauuguggauaa

SEQ ID NO: 1054906 - RNA, 19 nt, Homo sapiens
gggauguugcuuuaaguga

SEQ ID NO: 1054907 - RNA, 19 nt, Homo sapiens
gaagcggaaagaagggauu

SEQ ID NO: 1054908 - RNA, 19 nt, Homo sapiens
acauaaaggcugucaguag

SEQ ID NO: 1054909 - RNA, 19 nt, Homo sapiens
gagacgcuggcccuccuua

SEQ ID NO: 1054910 - RNA, 19 nt, Homo sapiens
gacaaauggcaaauaagau

SEQ ID NO: 1054911 - RNA, 19 nt, Homo sapiens
aagcgaccauaaauauaga

SEQ ID NO: 1054912 - RNA, 19 nt, Homo sapiens
gauggaaaggaagagauaa

SEQ ID NO: 1054913 - RNA, 19 nt, Homo sapiens
ccagagauugcaaguuaau

SEQ ID NO: 1054914 - RNA, 19 nt, Homo sapiens
agauggaaaggaagagaua

SEQ ID NO: 1054915 - RNA, 19 nt, Homo sapiens
aggcaaacgaguaguauau

SEQ ID NO: 1054916 - RNA, 19 nt, Homo sapiens
gggauuauucauacucuca

SEQ ID NO: 1054917 - RNA, 19 nt, Homo sapiens
ugacggaguccacaagauc

SEQ ID NO: 1054918 - RNA, 19 nt, Homo sapiens
cgaguaguauauguagaug

SEQ ID NO: 1054919 - RNA, 19 nt, Homo sapiens
gacaaaagcgaccauaaau

SEQ ID NO: 1054920 - RNA, 19 nt, Homo sapiens
gaagagauaagaaaagagu

SEQ ID NO: 1054921 - RNA, 19 nt, Homo sapiens
aaacgaguaguauauguag

SEQ ID NO: 1054922 - RNA, 19 nt, Homo sapiens
uaagauauggaccaaaguc

SEQ ID NO: 1054923 - RNA, 19 nt, Homo sapiens
cccagagauugcaaguuaa

SEQ ID NO: 1054924 - RNA, 19 nt, Homo sapiens
accaaagucacuaauguuu

SEQ ID NO: 1054925 - RNA, 19 nt, Homo sapiens
cggaaagaagggauuauuc

SEQ ID NO: 1054926 - RNA, 19 nt, Homo sapiens
gcgggugaguuuguagaug

SEQ ID NO: 1054927 - RNA, 19 nt, Homo sapiens
gauggugagaacuuuagaa

SEQ ID NO: 1054928 - RNA, 19 nt, Homo sapiens
ggaaauuaaugggaaaagu

SEQ ID NO: 1054929 - RNA, 19 nt, Homo sapiens
gaauuugaacaugggacua

SEQ ID NO: 1054930 - RNA, 19 nt, Homo sapiens
gauauggaccaaagucacu

SEQ ID NO: 1054931 - RNA, 19 nt, Homo sapiens
aaugacagaucucguagcu

SEQ ID NO: 1054932 - RNA, 19 nt, Homo sapiens
agacagcgggugaguuugu

SEQ ID NO: 1054933 - RNA, 19 nt, Homo sapiens
guagcuguuugggauguug

SEQ ID NO: 1054934 - RNA, 19 nt, Homo sapiens
uuacauaaaggcugucagu

SEQ ID NO: 1054935 - RNA, 19 nt, Homo sapiens
caggcaaacgaguaguaua

SEQ ID NO: 1054936 - RNA, 19 nt, Homo sapiens
gaaauuaaugggaaaaguc

SEQ ID NO: 1054937 - RNA, 19 nt, Homo sapiens
uagacgcuaucagugguuu

SEQ ID NO: 1054938 - RNA, 19 nt, Homo sapiens
acaaaagcgaccauaaaua

SEQ ID NO: 1054939 - RNA, 19 nt, Homo sapiens
gugacggaguccacaagau

SEQ ID NO: 1054940 - RNA, 19 nt, Homo sapiens
aaagaguggauguucaaau

SEQ ID NO: 1054941 - RNA, 19 nt, Homo sapiens
ucuggaaauuaaugggaaa

SEQ ID NO: 1054942 - RNA, 19 nt, Homo sapiens
agacaaaagcgaccauaaa

SEQ ID NO: 1054943 - RNA, 19 nt, Homo sapiens
acaugaaacuaacauucca

SEQ ID NO: 1054944 - RNA, 19 nt, Homo sapiens
guagugggaagcggaaaga

SEQ ID NO: 1054945 - RNA, 19 nt, Homo sapiens
uacaucaggcaaacgagua

SEQ ID NO: 1054946 - RNA, 19 nt, Homo sapiens
cauacucucauuguggaua

SEQ ID NO: 1054947 - RNA, 19 nt, Homo sapiens
ucagugguuuugcuuauga

SEQ ID NO: 1054948 - RNA, 19 nt, Homo sapiens
aaauuagugggcaaagaaa

SEQ ID NO: 1054949 - RNA, 19 nt, Homo sapiens
guagauggaaaggaagaga

SEQ ID NO: 1054950 - RNA, 19 nt, Homo sapiens
ggcaaacgaguaguauaug

SEQ ID NO: 1054951 - RNA, 19 nt, Homo sapiens
cuuaagaaguaaagaucag

SEQ ID NO: 1054952 - RNA, 19 nt, Homo sapiens
gcagcaagcuuaguuauaa

SEQ ID NO: 1054953 - RNA, 19 nt, Homo sapiens
gaccaaagcuccaaccaaa

SEQ ID NO: 1054954 - RNA, 19 nt, Homo sapiens
gaaaccaucuugcaugcua

SEQ ID NO: 1054955 - RNA, 19 nt, Homo sapiens
caaaugaugucgucucuga

SEQ ID NO: 1054956 - RNA, 19 nt, Homo sapiens
caagugaaaugaaaguuga

SEQ ID NO: 1054957 - RNA, 19 nt, Homo sapiens
aaaggaaggucaucauauu

SEQ ID NO: 1054958 - RNA, 19 nt, Homo sapiens
acauagaggugauaaguaa

SEQ ID NO: 1054959 - RNA, 19 nt, Homo sapiens
guuauuaccuggccuauuc

SEQ ID NO: 1054960 - RNA, 19 nt, Homo sapiens
caaccugaaugugaacuua

SEQ ID NO: 1054961 - RNA, 19 nt, Homo sapiens
gcaacugaaucuaaauaug

SEQ ID NO: 1054962 - RNA, 19 nt, Homo sapiens
gaugagcgguuccagagaa

SEQ ID NO: 1054963 - RNA, 19 nt, Homo sapiens
gcaagcaacuaaggagauu

SEQ ID NO: 1054964 - RNA, 19 nt, Homo sapiens
gaagaccucugucguggau

SEQ ID NO: 1054965 - RNA, 19 nt, Homo sapiens
caaaggagcaguacagaga

SEQ ID NO: 1054966 - RNA, 19 nt, Homo sapiens
cucaaagucugguagauua

SEQ ID NO: 1054967 - RNA, 19 nt, Homo sapiens
guaaugcuccuucaguuaa

SEQ ID NO: 1054968 - RNA, 19 nt, Homo sapiens
gcuauaauccucacuguau

SEQ ID NO: 1054969 - RNA, 19 nt, Homo sapiens
cagccaaagucgauucuaa

SEQ ID NO: 1054970 - RNA, 19 nt, Homo sapiens
gauacugccuucuccuuug

SEQ ID NO: 1054971 - RNA, 19 nt, Homo sapiens
gcaccuguguguuugaaga

SEQ ID NO: 1054972 - RNA, 19 nt, Homo sapiens
ggaguugucgaccuucuua

SEQ ID NO: 1054973 - RNA, 19 nt, Homo sapiens
ccacaguucuucuugacuu

SEQ ID NO: 1054974 - RNA, 19 nt, Homo sapiens
uaaagcaguuccugacuca

SEQ ID NO: 1054975 - RNA, 19 nt, Homo sapiens
uaacuuugaugcaacugaa

SEQ ID NO: 1054976 - RNA, 19 nt, Homo sapiens
caaaaggacugggauaauu

SEQ ID NO: 1054977 - RNA, 19 nt, Homo sapiens
gcuucuauauuuccaauug

SEQ ID NO: 1054978 - RNA, 19 nt, Homo sapiens
gcaagugaaaugaaaguug

SEQ ID NO: 1054979 - RNA, 19 nt, Homo sapiens
gaauccaccugaaguuaca

SEQ ID NO: 1054980 - RNA, 19 nt, Homo sapiens
uuaaguaauuccuggauug

SEQ ID NO: 1054981 - RNA, 19 nt, Homo sapiens
aaaccgaguuccaugcaaa

SEQ ID NO: 1054982 - RNA, 19 nt, Homo sapiens
ugaaagcugugauguccaa

SEQ ID NO: 1054983 - RNA, 19 nt, Homo sapiens
gcaaacaccugugguaucc

SEQ ID NO: 1054984 - RNA, 19 nt, Homo sapiens
ugacagccaugauuacauc

SEQ ID NO: 1054985 - RNA, 19 nt, Homo sapiens
gaccaucacacacaugaaa

SEQ ID NO: 1054986 - RNA, 19 nt, Homo sapiens
aaaagugccuucucuguaa

SEQ ID NO: 1054987 - RNA, 19 nt, Homo sapiens
gaugacaacccggauauug

SEQ ID NO: 1054988 - RNA, 19 nt, Homo sapiens
cagccaugauuacaucuuu

SEQ ID NO: 1054989 - RNA, 19 nt, Homo sapiens
gaaaaugacagccaugauu

SEQ ID NO: 1054990 - RNA, 19 nt, Homo sapiens
ugaugcaacugaaucuaaa

SEQ ID NO: 1054991 - RNA, 19 nt, Homo sapiens
ucacugggcaucuacuuaa

SEQ ID NO: 1054992 - RNA, 19 nt, Homo sapiens
acaguaaacagacaucuuu

SEQ ID NO: 1054993 - RNA, 19 nt, Homo sapiens
gaagaccaacucucagaug

SEQ ID NO: 1054994 - RNA, 19 nt, Homo sapiens
gagccacacuugaaaauga

SEQ ID NO: 1054995 - RNA, 19 nt, Homo sapiens
aaagauucauguucacaga

SEQ ID NO: 1054996 - RNA, 19 nt, Homo sapiens
gaucaagauuguucuacag

SEQ ID NO: 1054997 - RNA, 19 nt, Homo sapiens
ucagcccucucugcaauua

SEQ ID NO: 1054998 - RNA, 19 nt, Homo sapiens
uuacugaccuucuuaaagc

SEQ ID NO: 1054999 - RNA, 19 nt, Homo sapiens
ccuuagagcagcaagcuua

SEQ ID NO: 1055000 - RNA, 19 nt, Homo sapiens
cagaauccaccugaaguua

SEQ ID NO: 1055001 - RNA, 19 nt, Homo sapiens
ggauuugauuccacaguuc

SEQ ID NO: 1055002 - RNA, 19 nt, Homo sapiens
gagaaaagauaaccuuaag

SEQ ID NO: 1055003 - RNA, 19 nt, Homo sapiens
gcaagcuuaguuauaauga

SEQ ID NO: 1055004 - RNA, 19 nt, Homo sapiens
gaucugugccugccuuaau

SEQ ID NO: 1055005 - RNA, 19 nt, Homo sapiens
ccaaagucgauucuaaauu

SEQ ID NO: 1055006 - RNA, 19 nt, Homo sapiens
gagcgguuccagagaagua

SEQ ID NO: 1055007 - RNA, 19 nt, Homo sapiens
aagaccaacucucagauga

SEQ ID NO: 1055008 - RNA, 19 nt, Homo sapiens
ccaaagcuccaaccaaaca

SEQ ID NO: 1055009 - RNA, 19 nt, Homo sapiens
gagguucaugucugaguua

SEQ ID NO: 1055010 - RNA, 19 nt, Homo sapiens
ggcaucuacuuaacacuga

SEQ ID NO: 1055011 - RNA, 19 nt, Homo sapiens
guucaugucugaguuacug

SEQ ID NO: 1055012 - RNA, 19 nt, Homo sapiens
guugucgaccuucuuauaa

SEQ ID NO: 1055013 - RNA, 19 nt, Homo sapiens
cuauaauccucacuguauu

SEQ ID NO: 1055014 - RNA, 19 nt, Homo sapiens
gagcagcaagcuuaguuau

SEQ ID NO: 1055015 - RNA, 19 nt, Homo sapiens
ggcuuuagcuaaugcuguu

SEQ ID NO: 1055016 - RNA, 19 nt, Homo sapiens
ugauguguuuccuggauuu

SEQ ID NO: 1055017 - RNA, 19 nt, Homo sapiens
agauucauguucacagaaa

SEQ ID NO: 1055018 - RNA, 19 nt, Homo sapiens
caucagcccaucucuguug

SEQ ID NO: 1055019 - RNA, 19 nt, Homo sapiens
aaauggcugucucggguuu

SEQ ID NO: 1055020 - RNA, 19 nt, Homo sapiens
caugcuggcuuuagcuaau

SEQ ID NO: 1055021 - RNA, 19 nt, Homo sapiens
aaagugccuucucuguaaa

SEQ ID NO: 1055022 - RNA, 19 nt, Homo sapiens
caacccggauauugucugu

SEQ ID NO: 1055023 - RNA, 19 nt, Homo sapiens
cagcaagcuuaguuauaau

SEQ ID NO: 1055024 - RNA, 19 nt, Homo sapiens
caucuugcaugcuagaagu

SEQ ID NO: 1055025 - RNA, 19 nt, Homo sapiens
ucucugaagugggaauauu

SEQ ID NO: 1055026 - RNA, 19 nt, Homo sapiens
ccacugaaagcuugacuca

SEQ ID NO: 1055027 - RNA, 19 nt, Homo sapiens
cuccuuugauugugaagua

SEQ ID NO: 1055028 - RNA, 19 nt, Homo sapiens
aaaaugacagccaugauua

SEQ ID NO: 1055029 - RNA, 19 nt, Homo sapiens
ggucaucauauuccucaaa

SEQ ID NO: 1055030 - RNA, 19 nt, Homo sapiens
guaauuccuggauugcuuu

SEQ ID NO: 1055031 - RNA, 19 nt, Homo sapiens
aaguaaugcuccuucaguu

SEQ ID NO: 1055032 - RNA, 19 nt, Homo sapiens
agaacaagacgaugacaug

SEQ ID NO: 1055033 - RNA, 19 nt, Homo sapiens
uacugccucuggacucuua

SEQ ID NO: 1055034 - RNA, 19 nt, Homo sapiens
ucaguuaacagugaucaaa

SEQ ID NO: 1055035 - RNA, 19 nt, Homo sapiens
caacccagcaguuucagau

SEQ ID NO: 1055036 - RNA, 19 nt, Homo sapiens
caauaacuuugaugcaacu

SEQ ID NO: 1055037 - RNA, 19 nt, Homo sapiens
ugaguuacugaccuucuua

SEQ ID NO: 1055038 - RNA, 19 nt, Homo sapiens
aguaaugcuccuucaguua

SEQ ID NO: 1055039 - RNA, 19 nt, Homo sapiens
ggcaucagcccaucucugu

SEQ ID NO: 1055040 - RNA, 19 nt, Homo sapiens
cacaguucuucuugacuuu

SEQ ID NO: 1055041 - RNA, 19 nt, Homo sapiens
gaugugaagccacugaaag

SEQ ID NO: 1055042 - RNA, 19 nt, Homo sapiens
uaaaaggaaggucaucaua

SEQ ID NO: 1055043 - RNA, 19 nt, Homo sapiens
gaaguagccccaaaugaug

SEQ ID NO: 1055044 - RNA, 19 nt, Homo sapiens
auacugccuucuccuuuga

SEQ ID NO: 1055045 - RNA, 19 nt, Homo sapiens
ggaugugaagccacugaaa

SEQ ID NO: 1055046 - RNA, 19 nt, Homo sapiens
cuucagcccucucugcaau

SEQ ID NO: 1055047 - RNA, 19 nt, Homo sapiens
ccagaauccaccugaaguu

SEQ ID NO: 1055048 - RNA, 19 nt, Homo sapiens
uaucucaacccagcaguuu

SEQ ID NO: 1055049 - RNA, 19 nt, Homo sapiens
gccaaagucgauucuaaau

SEQ ID NO: 1055050 - RNA, 19 nt, Homo sapiens
gcugggacaagcagggaua

SEQ ID NO: 1055051 - RNA, 19 nt, Homo sapiens
gggcaaacaccugugguau

SEQ ID NO: 1055052 - RNA, 19 nt, Homo sapiens
gcacaaauuucacucauua

SEQ ID NO: 1055053 - RNA, 19 nt, Homo sapiens
gaaguucucucuugugaau

SEQ ID NO: 1055054 - RNA, 19 nt, Homo sapiens
gaaauccgccugugcuaua

SEQ ID NO: 1055055 - RNA, 19 nt, Homo sapiens
uuacaggaguucaguauuu

SEQ ID NO: 1055056 - RNA, 19 nt, Homo sapiens
gacaugcccuuauauauuc

SEQ ID NO: 1055057 - RNA, 19 nt, Homo sapiens
gacuagagcugaagaugaa

SEQ ID NO: 1055058 - RNA, 19 nt, Homo sapiens
caaccaagcuuucguguac

SEQ ID NO: 1055059 - RNA, 19 nt, Homo sapiens
gagauuuccuuaugcauau

SEQ ID NO: 1055060 - RNA, 19 nt, Homo sapiens
gagaugaucccuuugauau

SEQ ID NO: 1055061 - RNA, 19 nt, Homo sapiens
aaacagccauuaaggauug

SEQ ID NO: 1055062 - RNA, 19 nt, Homo sapiens
caacuuaggagucauugua

SEQ ID NO: 1055063 - RNA, 19 nt, Homo sapiens
ggcaaagacuggaagcuaa

SEQ ID NO: 1055064 - RNA, 19 nt, Homo sapiens
caaauacgccaugcaguua

SEQ ID NO: 1055065 - RNA, 19 nt, Homo sapiens
gaagaaaaguguuguggaa

SEQ ID NO: 1055066 - RNA, 19 nt, Homo sapiens
gaaggagacuuagacacaa

SEQ ID NO: 1055067 - RNA, 19 nt, Homo sapiens
cgacaggcauccacaguug

SEQ ID NO: 1055068 - RNA, 19 nt, Homo sapiens
gaguuuagcuuugaguuug

SEQ ID NO: 1055069 - RNA, 19 nt, Homo sapiens
caauggagcccucaaggua

SEQ ID NO: 1055070 - RNA, 19 nt, Homo sapiens
gcaaaguucuguaucuucu

SEQ ID NO: 1055071 - RNA, 19 nt, Homo sapiens
cuggagagcuaacaucuaa

SEQ ID NO: 1055072 - RNA, 19 nt, Homo sapiens
ugaaggacccggaaucuuu

SEQ ID NO: 1055073 - RNA, 19 nt, Homo sapiens
ugacaugcccuuauauauu

SEQ ID NO: 1055074 - RNA, 19 nt, Homo sapiens
gagcaucaacugccucuuu

SEQ ID NO: 1055075 - RNA, 19 nt, Homo sapiens
gaaacaagcaccucgagau

SEQ ID NO: 1055076 - RNA, 19 nt, Homo sapiens
ggaguucaguauuuggaaa

SEQ ID NO: 1055077 - RNA, 19 nt, Homo sapiens
aaagagaagugcgguugua

SEQ ID NO: 1055078 - RNA, 19 nt, Homo sapiens
ggacuagagcugaagauga

SEQ ID NO: 1055079 - RNA, 19 nt, Homo sapiens
uaucaaagcagccaauuau

SEQ ID NO: 1055080 - RNA, 19 nt, Homo sapiens
ggaaagcaaaguucuguau

SEQ ID NO: 1055081 - RNA, 19 nt, Homo sapiens
cgacaggucuuuccucucu

SEQ ID NO: 1055082 - RNA, 19 nt, Homo sapiens
ucauaucaauuucccagua

SEQ ID NO: 1055083 - RNA, 19 nt, Homo sapiens
caaugacuguccauaagaa

SEQ ID NO: 1055084 - RNA, 19 nt, Homo sapiens
ucaaagcagccaauuauga

SEQ ID NO: 1055085 - RNA, 19 nt, Homo sapiens
agucaaauuugccucauaa

SEQ ID NO: 1055086 - RNA, 19 nt, Homo sapiens
auagugacaugcccuuaua

SEQ ID NO: 1055087 - RNA, 19 nt, Homo sapiens
gagaagugcgguuguaaug

SEQ ID NO: 1055088 - RNA, 19 nt, Homo sapiens
caugaggacugcuacaaau

SEQ ID NO: 1055089 - RNA, 19 nt, Homo sapiens
gcaaagacuggaagcuaaa

SEQ ID NO: 1055090 - RNA, 19 nt, Homo sapiens
uuaaggcaguaacacaaua

SEQ ID NO: 1055091 - RNA, 19 nt, Homo sapiens
agaaguucauggucaagua

SEQ ID NO: 1055092 - RNA, 19 nt, Homo sapiens
ccaguucaauccuauacuu

SEQ ID NO: 1055093 - RNA, 19 nt, Homo sapiens
uaaaagcccuaaauaguga

SEQ ID NO: 1055094 - RNA, 19 nt, Homo sapiens
ccaggaacaaauuaucuua

SEQ ID NO: 1055095 - RNA, 19 nt, Homo sapiens
ggagagcuaacaucuaaga

SEQ ID NO: 1055096 - RNA, 19 nt, Homo sapiens
ccuuugauaucacuuauga

SEQ ID NO: 1055097 - RNA, 19 nt, Homo sapiens
gaagugggccaaaggaauc

SEQ ID NO: 1055098 - RNA, 19 nt, Homo sapiens
cagcuggucuuugguuaaa

SEQ ID NO: 1055099 - RNA, 19 nt, Homo sapiens
ccaauuaugacuucuauca

SEQ ID NO: 1055100 - RNA, 19 nt, Homo sapiens
gaaggacccggaaucuuug

SEQ ID NO: 1055101 - RNA, 19 nt, Homo sapiens
aaagauugguuguucuaga

SEQ ID NO: 1055102 - RNA, 19 nt, Homo sapiens
aaacgugacuacaacuuuc

SEQ ID NO: 1055103 - RNA, 19 nt, Homo sapiens
gaaaaugugcaguuaauga

SEQ ID NO: 1055104 - RNA, 19 nt, Homo sapiens
gaugcuccuuugcagauaa

SEQ ID NO: 1055105 - RNA, 19 nt, Homo sapiens
gcugaaaccucauuaugcu

SEQ ID NO: 1055106 - RNA, 19 nt, Homo sapiens
ggaacaaauuaucuuaugc

SEQ ID NO: 1055107 - RNA, 19 nt, Homo sapiens
gagauaauccagaaguuca

SEQ ID NO: 1055108 - RNA, 19 nt, Homo sapiens
gagccugaguuuagcuuug

SEQ ID NO: 1055109 - RNA, 19 nt, Homo sapiens
cauuaaggauuguccaguu

SEQ ID NO: 1055110 - RNA, 19 nt, Homo sapiens
ccaauccacagauagcuua

SEQ ID NO: 1055111 - RNA, 19 nt, Homo sapiens
ucaacugccucuuuacugu

SEQ ID NO: 1055112 - RNA, 19 nt, Homo sapiens
aagauugguuguucuagaa

SEQ ID NO: 1055113 - RNA, 19 nt, Homo sapiens
ugagauuuccuuaugcaua

SEQ ID NO: 1055114 - RNA, 19 nt, Homo sapiens
ggaccaacagggcuuuauu

SEQ ID NO: 1055115 - RNA, 19 nt, Homo sapiens
cauaucaauuucccaguau

SEQ ID NO: 1055116 - RNA, 19 nt, Homo sapiens
acacaaugacuguccauaa

SEQ ID NO: 1055117 - RNA, 19 nt, Homo sapiens
gaacuuccuacuuaucaga

SEQ ID NO: 1055118 - RNA, 19 nt, Homo sapiens
uaaggaaaaugugcaguua

SEQ ID NO: 1055119 - RNA, 19 nt, Homo sapiens
gcccuuauauauucuguca

SEQ ID NO: 1055120 - RNA, 19 nt, Homo sapiens
ggaagugggccaaaggaau

SEQ ID NO: 1055121 - RNA, 19 nt, Homo sapiens
ugaagaugaaggagacuua

SEQ ID NO: 1055122 - RNA, 19 nt, Homo sapiens
cgagaugaucccuuugaua

SEQ ID NO: 1055123 - RNA, 19 nt, Homo sapiens
caggccagcuaguggauuu

SEQ ID NO: 1055124 - RNA, 19 nt, Homo sapiens
uaaacgugacuacaacuuu

SEQ ID NO: 1055125 - RNA, 19 nt, Homo sapiens
ucauuaugcucaacuuaug

SEQ ID NO: 1055126 - RNA, 19 nt, Homo sapiens
ugaggacugcuacaaauuu

SEQ ID NO: 1055127 - RNA, 19 nt, Homo sapiens
cacaaugacuguccauaag

SEQ ID NO: 1055128 - RNA, 19 nt, Homo sapiens
gugccuaccagucaaauuu

SEQ ID NO: 1055129 - RNA, 19 nt, Homo sapiens
aagcuaaacugccgaccuu

SEQ ID NO: 1055130 - RNA, 19 nt, Homo sapiens
ccacagugccuaccaguca

SEQ ID NO: 1055131 - RNA, 19 nt, Homo sapiens
agcaucaacugccucuuua

SEQ ID NO: 1055132 - RNA, 19 nt, Homo sapiens
aaagcaaaguucuguaucu

SEQ ID NO: 1055133 - RNA, 19 nt, Homo sapiens
guauguguuuacuguguuu

SEQ ID NO: 1055134 - RNA, 19 nt, Homo sapiens
ggaugcugauaaacuuaaa

SEQ ID NO: 1055135 - RNA, 19 nt, Homo sapiens
acaaauacgccaugcaguu

SEQ ID NO: 1055136 - RNA, 19 nt, Homo sapiens
cagacaagcccaagaaaca

SEQ ID NO: 1055137 - RNA, 19 nt, Homo sapiens
gcucugggccugacaaagu

SEQ ID NO: 1055138 - RNA, 19 nt, Homo sapiens
ugaaggagacuuagacaca

SEQ ID NO: 1055139 - RNA, 19 nt, Homo sapiens
uaacuuucauacagguuug

SEQ ID NO: 1055140 - RNA, 19 nt, Homo sapiens
gaaagcaaaguucuguauc

SEQ ID NO: 1055141 - RNA, 19 nt, Homo sapiens
cagauucggaugcugauaa

SEQ ID NO: 1055142 - RNA, 19 nt, Homo sapiens
gaaccaaguacuccagauc

SEQ ID NO: 1055143 - RNA, 19 nt, Homo sapiens
gaggaggacccaguaggua

SEQ ID NO: 1055144 - RNA, 19 nt, Homo sapiens
ccugauggccuuuggguuu

SEQ ID NO: 1055145 - RNA, 19 nt, Homo sapiens
gggcugaaaccucauuaug

SEQ ID NO: 1055146 - RNA, 19 nt, Homo sapiens
acaagcaccucgagaugau

SEQ ID NO: 1055147 - RNA, 19 nt, Homo sapiens
uaaagucuuggaaggauuu

SEQ ID NO: 1055148 - RNA, 19 nt, Homo sapiens
ggaaacuaauuuguucuac

SEQ ID NO: 1055149 - RNA, 19 nt, Homo sapiens
gaaagagaagugcgguugu

SEQ ID NO: 1055150 - RNA, 19 nt, Homo sapiens
ggagauaauccagaaguuc

SEQ ID NO: 1055151 - RNA, 19 nt, Homo sapiens
gaaaaguguuguggaaaau

SEQ ID NO: 1055152 - RNA, 19 nt, Homo sapiens
gauccucuccuuagucuua

SEQ ID NO: 1055153 - RNA, 19 nt, Homo sapiens
ggacaugauccucuccuua

SEQ ID NO: 1055154 - RNA, 19 nt, Homo sapiens
uauagaccguguauguuua

SEQ ID NO: 1055155 - RNA, 19 nt, Homo sapiens
gacugaagcacauguaaua

SEQ ID NO: 1055156 - RNA, 19 nt, Homo sapiens
guacuuguccuuucccuuu

SEQ ID NO: 1055157 - RNA, 19 nt, Homo sapiens
ugaagcacauguaauauag

SEQ ID NO: 1055158 - RNA, 19 nt, Homo sapiens
uaauauagaccguguaugu

SEQ ID NO: 1055159 - RNA, 19 nt, Homo sapiens
gguguucagugguguauau

SEQ ID NO: 1055160 - RNA, 19 nt, Homo sapiens
gugaugcugugucuguaua

SEQ ID NO: 1055161 - RNA, 19 nt, Homo sapiens
ugaagcagaggcugaguua

SEQ ID NO: 1055162 - RNA, 19 nt, Homo sapiens
gggcacggcuccuaagauc

SEQ ID NO: 1055163 - RNA, 19 nt, Homo sapiens
ggacagacagacaugcaaa

SEQ ID NO: 1055164 - RNA, 19 nt, Homo sapiens
guucagugguguauauuuc

SEQ ID NO: 1055165 - RNA, 19 nt, Homo sapiens
gagaaccauuccugggauu

SEQ ID NO: 1055166 - RNA, 19 nt, Homo sapiens
gacauggauuaaaccagua

SEQ ID NO: 1055167 - RNA, 19 nt, Homo sapiens
cuacauuugacauggauua

SEQ ID NO: 1055168 - RNA, 19 nt, Homo sapiens
aaacuacauuugacaugga

SEQ ID NO: 1055169 - RNA, 19 nt, Homo sapiens
ggauuaaaccaguauaaac

SEQ ID NO: 1055170 - RNA, 19 nt, Homo sapiens
gacaugauccucuccuuag

SEQ ID NO: 1055171 - RNA, 19 nt, Homo sapiens
cugaagcacauguaauaua

SEQ ID NO: 1055172 - RNA, 19 nt, Homo sapiens
gaugcugugucuguauauu

SEQ ID NO: 1055173 - RNA, 19 nt, Homo sapiens
aaaccaguauaaacaguca

SEQ ID NO: 1055174 - RNA, 19 nt, Homo sapiens
gacaacuccucgcccucua

SEQ ID NO: 1055175 - RNA, 19 nt, Homo sapiens
guaaacuacauuugacaug

SEQ ID NO: 1055176 - RNA, 19 nt, Homo sapiens
auauagaccguguauguuu

SEQ ID NO: 1055177 - RNA, 19 nt, Homo sapiens
cauuugacauggauuaaac

SEQ ID NO: 1055178 - RNA, 19 nt, Homo sapiens
gcacggcuccuaagaucca

SEQ ID NO: 1055179 - RNA, 19 nt, Homo sapiens
gaagcacauguaauauaga

SEQ ID NO: 1055180 - RNA, 19 nt, Homo sapiens
ucagugguguauauuucuu

SEQ ID NO: 1055181 - RNA, 19 nt, Homo sapiens
gaaccauuccugggauuag

SEQ ID NO: 1055182 - RNA, 19 nt, Homo sapiens
ggugugaugcugugucugu

SEQ ID NO: 1055183 - RNA, 19 nt, Homo sapiens
gggacaugauccucuccuu

SEQ ID NO: 1055184 - RNA, 19 nt, Homo sapiens
gcucauggggcucuuuaua

SEQ ID NO: 1055185 - RNA, 19 nt, Homo sapiens
caugcaaacaccagacuga

SEQ ID NO: 1055186 - RNA, 19 nt, Homo sapiens
cccuuugguuguaugauuu

SEQ ID NO: 1055187 - RNA, 19 nt, Homo sapiens
ugacagacggacagacaga

SEQ ID NO: 1055188 - RNA, 19 nt, Homo sapiens
ccugcuggcucccaccuau

SEQ ID NO: 1055189 - RNA, 19 nt, Homo sapiens
acaccagacugaagcacau

SEQ ID NO: 1055190 - RNA, 19 nt, Homo sapiens
cagacugaagcacauguaa

SEQ ID NO: 1055191 - RNA, 19 nt, Homo sapiens
ccagacugaagcacaugua

SEQ ID NO: 1055192 - RNA, 19 nt, Homo sapiens
uguaauauagaccguguau

SEQ ID NO: 1055193 - RNA, 19 nt, Homo sapiens
ucccuucccucucccaugu

SEQ ID NO: 1055194 - RNA, 19 nt, Homo sapiens
aagcacauguaauauagac

SEQ ID NO: 1055195 - RNA, 19 nt, Homo sapiens
gugugaugcugugucugua

SEQ ID NO: 1055196 - RNA, 19 nt, Homo sapiens
gggauuagagcugccuuuc

SEQ ID NO: 1055197 - RNA, 19 nt, Homo sapiens
aagcagaggcugaguuagg

SEQ ID NO: 1055198 - RNA, 19 nt, Homo sapiens
ggacagugaugcugacuug

SEQ ID NO: 1055199 - RNA, 19 nt, Homo sapiens
gaacagcgacaucgagaaa

SEQ ID NO: 1055200 - RNA, 19 nt, Homo sapiens
gauccucuccuuagucuua

SEQ ID NO: 1055201 - RNA, 19 nt, Homo sapiens
ggacaugauccucuccuua

SEQ ID NO: 1055202 - RNA, 19 nt, Homo sapiens
guacacacacacacauuua

SEQ ID NO: 1055203 - RNA, 19 nt, Homo sapiens
cagaagaccugcaagaaca

SEQ ID NO: 1055204 - RNA, 19 nt, Homo sapiens
uauagaccguguauguuua

SEQ ID NO: 1055205 - RNA, 19 nt, Homo sapiens
gacugaagcacauguaaua

SEQ ID NO: 1055206 - RNA, 19 nt, Homo sapiens
guacauacaugcacauacu

SEQ ID NO: 1055207 - RNA, 19 nt, Homo sapiens
uaacguccauccaguguug

SEQ ID NO: 1055208 - RNA, 19 nt, Homo sapiens
guacuuguccuuucccuuu

SEQ ID NO: 1055209 - RNA, 19 nt, Homo sapiens
gcgcacacauggcucauug

SEQ ID NO: 1055210 - RNA, 19 nt, Homo sapiens
ugaagcacauguaauauag

SEQ ID NO: 1055211 - RNA, 19 nt, Homo sapiens
gaggcuggcuguagguaaa

SEQ ID NO: 1055212 - RNA, 19 nt, Homo sapiens
uaauauagaccguguaugu

SEQ ID NO: 1055213 - RNA, 19 nt, Homo sapiens
gguguucagugguguauau

SEQ ID NO: 1055214 - RNA, 19 nt, Homo sapiens
gaacuugaacggcagcuau

SEQ ID NO: 1055215 - RNA, 19 nt, Homo sapiens
gugaugcugugucuguaua

SEQ ID NO: 1055216 - RNA, 19 nt, Homo sapiens
ugaagcagaggcugaguua

SEQ ID NO: 1055217 - RNA, 19 nt, Homo sapiens
gggcacggcuccuaagauc

SEQ ID NO: 1055218 - RNA, 19 nt, Homo sapiens
gauauuuacccgcaggaua

SEQ ID NO: 1055219 - RNA, 19 nt, Homo sapiens
caccugaguucucuaaaug

SEQ ID NO: 1055220 - RNA, 19 nt, Homo sapiens
gaccagagcccucccuguu

SEQ ID NO: 1055221 - RNA, 19 nt, Homo sapiens
ccaggagccaggauauuua

SEQ ID NO: 1055222 - RNA, 19 nt, Homo sapiens
ggacagacagacaugcaaa

SEQ ID NO: 1055223 - RNA, 19 nt, Homo sapiens
guucagugguguauauuuc

SEQ ID NO: 1055224 - RNA, 19 nt, Homo sapiens
gaacaacaaccgcuuugag

SEQ ID NO: 1055225 - RNA, 19 nt, Homo sapiens
gagaaccauuccugggauu

SEQ ID NO: 1055226 - RNA, 19 nt, Homo sapiens
gacauggauuaaaccagua

SEQ ID NO: 1055227 - RNA, 19 nt, Homo sapiens
gcacacagguuccccaugu

SEQ ID NO: 1055228 - RNA, 19 nt, Homo sapiens
cuacauuugacauggauua

SEQ ID NO: 1055229 - RNA, 19 nt, Homo sapiens
gccaggagccaggauauuu

SEQ ID NO: 1055230 - RNA, 19 nt, Homo sapiens
aaacuacauuugacaugga

SEQ ID NO: 1055231 - RNA, 19 nt, Homo sapiens
aaacaugcguacacacaca

SEQ ID NO: 1055232 - RNA, 19 nt, Homo sapiens
ggccaccacucuccuggaa

SEQ ID NO: 1055233 - RNA, 19 nt, Homo sapiens
ggauuaaaccaguauaaac

SEQ ID NO: 1055234 - RNA, 19 nt, Homo sapiens
gacaugauccucuccuuag

SEQ ID NO: 1055235 - RNA, 19 nt, Homo sapiens
cugaagcacauguaauaua

SEQ ID NO: 1055236 - RNA, 19 nt, Homo sapiens
gagaacaacaaccgcuuug

SEQ ID NO: 1055237 - RNA, 19 nt, Homo sapiens
ggacccagccuuguucuca

SEQ ID NO: 1055238 - RNA, 19 nt, Homo sapiens
acaccugaguucucuaaau

SEQ ID NO: 1055239 - RNA, 19 nt, Homo sapiens
ggacaucgagcaugagaac

SEQ ID NO: 1055240 - RNA, 19 nt, Homo sapiens
gaugcugugucuguauauu

SEQ ID NO: 1055241 - RNA, 19 nt, Homo sapiens
gugaccgucucccuuugua

SEQ ID NO: 1055242 - RNA, 19 nt, Homo sapiens
aagagaacccggacaguga

SEQ ID NO: 1055243 - RNA, 19 nt, Homo sapiens
gacaacuccucgcccucua

SEQ ID NO: 1055244 - RNA, 19 nt, Homo sapiens
aagaagcucugcccucagu

SEQ ID NO: 1055245 - RNA, 19 nt, Homo sapiens
ccagagcccucccuguucu

SEQ ID NO: 1055246 - RNA, 19 nt, Homo sapiens
gcccggagacaguaauaaa

SEQ ID NO: 1055247 - RNA, 19 nt, Homo sapiens
cggcagacccgacugaaug

SEQ ID NO: 1055248 - RNA, 19 nt, Homo sapiens
caucacaccugaguucucu

SEQ ID NO: 1055249 - RNA, 19 nt, Homo sapiens
guaaacuacauuugacaug

SEQ ID NO: 1055250 - RNA, 19 nt, Homo sapiens
auauagaccguguauguuu

SEQ ID NO: 1055251 - RNA, 19 nt, Homo sapiens
gcaagaacagcgacaucga

SEQ ID NO: 1055252 - RNA, 19 nt, Homo sapiens
gcgcaucacaccugaguuc

SEQ ID NO: 1055253 - RNA, 19 nt, Homo sapiens
cuaaaugggccagugauga

SEQ ID NO: 1055254 - RNA, 19 nt, Homo sapiens
cauuugacauggauuaaac

SEQ ID NO: 1055255 - RNA, 19 nt, Homo sapiens
acacacuggugcagagaga

SEQ ID NO: 1055256 - RNA, 19 nt, Homo sapiens
gcucacagaagcugccuau

SEQ ID NO: 1055257 - RNA, 19 nt, Homo sapiens
ucacaccugaguucucuaa

SEQ ID NO: 1055258 - RNA, 19 nt, Homo sapiens
gcacggcuccuaagaucca

SEQ ID NO: 1055259 - RNA, 19 nt, Homo sapiens
ucacagaagcugccuaugc

SEQ ID NO: 1055260 - RNA, 19 nt, Homo sapiens
gugccugccugcucacaga

SEQ ID NO: 1055261 - RNA, 19 nt, Homo sapiens
ggaagccacaauacacaga

SEQ ID NO: 1055262 - RNA, 19 nt, Homo sapiens
gaagcacauguaauauaga

SEQ ID NO: 1055263 - RNA, 19 nt, Homo sapiens
cgacugaaugcucggauug

SEQ ID NO: 1055264 - RNA, 19 nt, Homo sapiens
uccaugaguucacugcauu

SEQ ID NO: 1055265 - RNA, 19 nt, Homo sapiens
caaccgcuuugaggaguau

SEQ ID NO: 1055266 - RNA, 19 nt, Homo sapiens
gcucuggcuucaucaugug

SEQ ID NO: 1055267 - RNA, 19 nt, Homo sapiens
ucaaacaugcguacacaca

SEQ ID NO: 1055268 - RNA, 19 nt, Homo sapiens
acagugaccgucucccuuu

SEQ ID NO: 1055269 - RNA, 19 nt, Homo sapiens
ggaggcuggcuguagguaa

SEQ ID NO: 1055270 - RNA, 19 nt, Homo sapiens
ccgaggcucuggcuucauc

SEQ ID NO: 1055271 - RNA, 19 nt, Homo sapiens
ucagugguguauauuucuu

SEQ ID NO: 1055272 - RNA, 19 nt, Homo sapiens
aaacggaggaagcaagaug

SEQ ID NO: 1055273 - RNA, 19 nt, Homo sapiens
ucaucugcauggacucgua

SEQ ID NO: 1055274 - RNA, 19 nt, Homo sapiens
gaaccauuccugggauuag

SEQ ID NO: 1055275 - RNA, 19 nt, Homo sapiens
uaaaugggccagugaugag

SEQ ID NO: 1055276 - RNA, 19 nt, Homo sapiens
ggugugaugcugugucugu

SEQ ID NO: 1055277 - RNA, 19 nt, Homo sapiens
gggacaugauccucuccuu

SEQ ID NO: 1055278 - RNA, 19 nt, Homo sapiens
ugagaacaacaaccgcuuu

SEQ ID NO: 1055279 - RNA, 19 nt, Homo sapiens
ggaucuacuugugagcuau

SEQ ID NO: 1055280 - RNA, 19 nt, Homo sapiens
gcggaggaucuacuuguga

SEQ ID NO: 1055281 - RNA, 19 nt, Homo sapiens
ugaaacggaggaagcaaga

SEQ ID NO: 1055282 - RNA, 19 nt, Homo sapiens
gagccaggagccaggauau

SEQ ID NO: 1055283 - RNA, 19 nt, Homo sapiens
gcucauggggcucuuuaua

SEQ ID NO: 1055284 - RNA, 19 nt, Homo sapiens
cccuuugguuguaugauuu

SEQ ID NO: 1055285 - RNA, 19 nt, Homo sapiens
caugcaaacaccagacuga

SEQ ID NO: 1055286 - RNA, 19 nt, Homo sapiens
ggcucuggcuucaucaugu

SEQ ID NO: 1055287 - RNA, 19 nt, Homo sapiens
ugacagacggacagacaga

SEQ ID NO: 1055288 - RNA, 19 nt, Homo sapiens
ccugcuggcucccaccuau

SEQ ID NO: 1055289 - RNA, 19 nt, Homo sapiens
ugagugguguggacagaag

SEQ ID NO: 1055290 - RNA, 19 nt, Homo sapiens
gaaggcccacugcaucaca

SEQ ID NO: 1055291 - RNA, 19 nt, Homo sapiens
ugaaggcucgggucagaga

SEQ ID NO: 1055292 - RNA, 19 nt, Homo sapiens
cagcugugaccacguuuga

SEQ ID NO: 1055293 - RNA, 19 nt, Homo sapiens
gcaagcaggaggccaugca

SEQ ID NO: 1055294 - RNA, 19 nt, Homo sapiens
cugcauggcugaggaugau

SEQ ID NO: 1055295 - RNA, 19 nt, Homo sapiens
acaccagacugaagcacau

SEQ ID NO: 1055296 - RNA, 19 nt, Homo sapiens
cguacacacacacacauuu

SEQ ID NO: 1055297 - RNA, 19 nt, Homo sapiens
auacaugcacauacucaaa

SEQ ID NO: 1055298 - RNA, 19 nt, Homo sapiens
caacgcagcuggaauguua

SEQ ID NO: 1055299 - RNA, 19 nt, Homo sapiens
caaaucagcucucaauaaa

SEQ ID NO: 1055300 - RNA, 19 nt, Homo sapiens
gaagaugguugugaaguua

SEQ ID NO: 1055301 - RNA, 19 nt, Homo sapiens
gcacaugguucaaagcuaa

SEQ ID NO: 1055302 - RNA, 19 nt, Homo sapiens
cagcaaaccugaauuucua

SEQ ID NO: 1055303 - RNA, 19 nt, Homo sapiens
gaagacagcuggaucacau

SEQ ID NO: 1055304 - RNA, 19 nt, Homo sapiens
gaaguauuauguagggaua

SEQ ID NO: 1055305 - RNA, 19 nt, Homo sapiens
gcacggagauaaugagaau

SEQ ID NO: 1055306 - RNA, 19 nt, Homo sapiens
gagaggaacucaggagauu

SEQ ID NO: 1055307 - RNA, 19 nt, Homo sapiens
gaaauacagcucuucauga

SEQ ID NO: 1055308 - RNA, 19 nt, Homo sapiens
gaucugauguugggacuaa

SEQ ID NO: 1055309 - RNA, 19 nt, Homo sapiens
aaacuuagcuuggacagaa

SEQ ID NO: 1055310 - RNA, 19 nt, Homo sapiens
gaaaaugagugaccauaaa

SEQ ID NO: 1055311 - RNA, 19 nt, Homo sapiens
gauuagaaauugagguuga

SEQ ID NO: 1055312 - RNA, 19 nt, Homo sapiens
gaguacacauagcauauaa

SEQ ID NO: 1055313 - RNA, 19 nt, Homo sapiens
aaauacagcucuucaugaa

SEQ ID NO: 1055314 - RNA, 19 nt, Homo sapiens
ccacgaagaugguugugaa

SEQ ID NO: 1055315 - RNA, 19 nt, Homo sapiens
ggaagaggguacuggagaa

SEQ ID NO: 1055316 - RNA, 19 nt, Homo sapiens
ggacuucauuuaagaauac

SEQ ID NO: 1055317 - RNA, 19 nt, Homo sapiens
gaacaaggcagugaauuuc

SEQ ID NO: 1055318 - RNA, 19 nt, Homo sapiens
gugauaaacugaauguaug

SEQ ID NO: 1055319 - RNA, 19 nt, Homo sapiens
acaagaaccuuuaccugaa

SEQ ID NO: 1055320 - RNA, 19 nt, Homo sapiens
gaaaaugacugcugguuca

SEQ ID NO: 1055321 - RNA, 19 nt, Homo sapiens
gcacauauauauucuuucc

SEQ ID NO: 1055322 - RNA, 19 nt, Homo sapiens
cgaagaugguugugaaguu

SEQ ID NO: 1055323 - RNA, 19 nt, Homo sapiens
acaaaucagcucucaauaa

SEQ ID NO: 1055324 - RNA, 19 nt, Homo sapiens
gcacauguacagaggagua

SEQ ID NO: 1055325 - RNA, 19 nt, Homo sapiens
ggacugugauaaacugaau

SEQ ID NO: 1055326 - RNA, 19 nt, Homo sapiens
gguaugaaguauuauguag

SEQ ID NO: 1055327 - RNA, 19 nt, Homo sapiens
aaauugagguugagaggaa

SEQ ID NO: 1055328 - RNA, 19 nt, Homo sapiens
gggacuucauuuaagaaua

SEQ ID NO: 1055329 - RNA, 19 nt, Homo sapiens
gaauuauagucaagucuca

SEQ ID NO: 1055330 - RNA, 19 nt, Homo sapiens
uauaagccaucaguacuaa

SEQ ID NO: 1055331 - RNA, 19 nt, Homo sapiens
ccacgggacuucauuuaag

SEQ ID NO: 1055332 - RNA, 19 nt, Homo sapiens
ggaguacacauagcauaua

SEQ ID NO: 1055333 - RNA, 19 nt, Homo sapiens
ugaacaaggcagugaauuu

SEQ ID NO: 1055334 - RNA, 19 nt, Homo sapiens
caugaacacucccaucugu

SEQ ID NO: 1055335 - RNA, 19 nt, Homo sapiens
ucuaaagacugcagacaga

SEQ ID NO: 1055336 - RNA, 19 nt, Homo sapiens
uguaaguggcuccuaauua

SEQ ID NO: 1055337 - RNA, 19 nt, Homo sapiens
gaccaacucgcucaaacua

SEQ ID NO: 1055338 - RNA, 19 nt, Homo sapiens
ugacaaaucagcucucaau

SEQ ID NO: 1055339 - RNA, 19 nt, Homo sapiens
ugaaggagaagguaauuug

SEQ ID NO: 1055340 - RNA, 19 nt, Homo sapiens
gaaaucagacacuccagau

SEQ ID NO: 1055341 - RNA, 19 nt, Homo sapiens
gguaauaauugcacauggu

SEQ ID NO: 1055342 - RNA, 19 nt, Homo sapiens
gagauuagaaauugagguu

SEQ ID NO: 1055343 - RNA, 19 nt, Homo sapiens
gaaaagaaggagcagcuua

SEQ ID NO: 1055344 - RNA, 19 nt, Homo sapiens
agucaagucucaaacaaga

SEQ ID NO: 1055345 - RNA, 19 nt, Homo sapiens
gacuaugaaccaccaaaua

SEQ ID NO: 1055346 - RNA, 19 nt, Homo sapiens
gagcaaaacuccaucucaa

SEQ ID NO: 1055347 - RNA, 19 nt, Homo sapiens
gcucagaaauacagcucuu

SEQ ID NO: 1055348 - RNA, 19 nt, Homo sapiens
ggagaagacagcuggauca

SEQ ID NO: 1055349 - RNA, 19 nt, Homo sapiens
ccugcuggcuguucuguuu

SEQ ID NO: 1055350 - RNA, 19 nt, Homo sapiens
guauaagccaucaguacua

SEQ ID NO: 1055351 - RNA, 19 nt, Homo sapiens
acucuuugcugccaaguuu

SEQ ID NO: 1055352 - RNA, 19 nt, Homo sapiens
agagagcaccgccacuuua

SEQ ID NO: 1055353 - RNA, 19 nt, Homo sapiens
gagagagcaccgccacuuu

SEQ ID NO: 1055354 - RNA, 19 nt, Homo sapiens
gcagagaggagcagacauc

SEQ ID NO: 1055355 - RNA, 19 nt, Homo sapiens
gacaaucgacccgucauaa

SEQ ID NO: 1055356 - RNA, 19 nt, Homo sapiens
ggaaagcuuaucucugcua

SEQ ID NO: 1055357 - RNA, 19 nt, Homo sapiens
caaagguguuucacguaga

SEQ ID NO: 1055358 - RNA, 19 nt, Homo sapiens
uaaagagaauugguuaugg

SEQ ID NO: 1055359 - RNA, 19 nt, Homo sapiens
gcaagaggcgagagagaga

SEQ ID NO: 1055360 - RNA, 19 nt, Homo sapiens
caucaauauucccaucauu

SEQ ID NO: 1055361 - RNA, 19 nt, Homo sapiens
cauacgaccuggcucugaa

SEQ ID NO: 1055362 - RNA, 19 nt, Homo sapiens
gaagcuugguacccaugaa

SEQ ID NO: 1055363 - RNA, 19 nt, Homo sapiens
gcuggaauguuaaccuuag

SEQ ID NO: 1055364 - RNA, 19 nt, Homo sapiens
caacugcugugaugaagac

SEQ ID NO: 1055365 - RNA, 19 nt, Homo sapiens
ucucaaacaagaaccuuua

SEQ ID NO: 1055366 - RNA, 19 nt, Homo sapiens
ggaauguuaaccuuagaaa

SEQ ID NO: 1055367 - RNA, 19 nt, Homo sapiens
uaugguguguucuuugauu

SEQ ID NO: 1055368 - RNA, 19 nt, Homo sapiens
gaggaguacacauagcaua

SEQ ID NO: 1055369 - RNA, 19 nt, Homo sapiens
guucaaagcuaaaagguau

SEQ ID NO: 1055370 - RNA, 19 nt, Homo sapiens
gacaaagguguuucacgua

SEQ ID NO: 1055371 - RNA, 19 nt, Homo sapiens
cauauaaacaugucuguag

SEQ ID NO: 1055372 - RNA, 19 nt, Homo sapiens
gugcagcucuggcuauucu

SEQ ID NO: 1055373 - RNA, 19 nt, Homo sapiens
cuaugaaccaccaaauaua

SEQ ID NO: 1055374 - RNA, 19 nt, Homo sapiens
gcagcaaaccugaauuucu

SEQ ID NO: 1055375 - RNA, 19 nt, Homo sapiens
auggacagcucccaguaua

SEQ ID NO: 1055376 - RNA, 19 nt, Homo sapiens
gcaaaacuccaucucaaaa

SEQ ID NO: 1055377 - RNA, 19 nt, Homo sapiens
ggauaaagaauuucaagac

SEQ ID NO: 1055378 - RNA, 19 nt, Homo sapiens
ucaccugucugcccgauuc

SEQ ID NO: 1055379 - RNA, 19 nt, Homo sapiens
caccugagauacuguguca

SEQ ID NO: 1055380 - RNA, 19 nt, Homo sapiens
gacaaaucagcucucaaua

SEQ ID NO: 1055381 - RNA, 19 nt, Homo sapiens
guaauaauugcacaugguu

SEQ ID NO: 1055382 - RNA, 19 nt, Homo sapiens
gaaaccccgucucuacuaa

SEQ ID NO: 1055383 - RNA, 19 nt, Homo sapiens
gaacuagccucucaaaagc

SEQ ID NO: 1055384 - RNA, 19 nt, Homo sapiens
ggacuaagagggacauagg

SEQ ID NO: 1055385 - RNA, 19 nt, Homo sapiens
gagcucagaugggcuugug

SEQ ID NO: 1055386 - RNA, 19 nt, Homo sapiens
ugacaucagcgucgacuug

SEQ ID NO: 1055387 - RNA, 19 nt, Homo sapiens
aagcuaaccaugaaauuga

SEQ ID NO: 1055388 - RNA, 19 nt, Homo sapiens
uaagcaccaugaagcgauu

SEQ ID NO: 1055389 - RNA, 19 nt, Homo sapiens
aaccguggcuguuaugaau

SEQ ID NO: 1055390 - RNA, 19 nt, Homo sapiens
gagcagcuuauaccugaaa

SEQ ID NO: 1055391 - RNA, 19 nt, Homo sapiens
cagcuggaauguuaaccuu

SEQ ID NO: 1055392 - RNA, 19 nt, Homo sapiens
agacagaguggcauuguga

SEQ ID NO: 1055393 - RNA, 19 nt, Homo sapiens
gcauauaaacaugucugua

SEQ ID NO: 1055394 - RNA, 19 nt, Homo sapiens
gguauaagcacauguacag

SEQ ID NO: 1055395 - RNA, 19 nt, Homo sapiens
ggcugaggcuggcguauca

SEQ ID NO: 1055396 - RNA, 19 nt, Homo sapiens
gcuuauaccugaaaacaga

SEQ ID NO: 1055397 - RNA, 19 nt, Homo sapiens
aaagaaggagcagcuuaua

SEQ ID NO: 1055398 - RNA, 19 nt, Homo sapiens
gagaggaccuggcacaaua

SEQ ID NO: 1055399 - RNA, 19 nt, Homo sapiens
ggaaaugccuuuagaagca

SEQ ID NO: 1055400 - RNA, 19 nt, Homo sapiens
caauauacuuugcugcuua

SEQ ID NO: 1055401 - RNA, 19 nt, Homo sapiens
gaaauagcgucuaaauauc

SEQ ID NO: 1055402 - RNA, 19 nt, Homo sapiens
gacaggugcuuguuguuua

SEQ ID NO: 1055403 - RNA, 19 nt, Homo sapiens
acaaagccauccuuaauuu

SEQ ID NO: 1055404 - RNA, 19 nt, Homo sapiens
gaacaagacuacgugaaga

SEQ ID NO: 1055405 - RNA, 19 nt, Homo sapiens
ccaaugaaauagcgucuaa

SEQ ID NO: 1055406 - RNA, 19 nt, Homo sapiens
gggcaugucugcuucauau

SEQ ID NO: 1055407 - RNA, 19 nt, Homo sapiens
gaaagaagcaucagauuuu

SEQ ID NO: 1055408 - RNA, 19 nt, Homo sapiens
acaaugagaucgucaguau

SEQ ID NO: 1055409 - RNA, 19 nt, Homo sapiens
aaugagaucgucaguauua

SEQ ID NO: 1055410 - RNA, 19 nt, Homo sapiens
caucuucugugacgcuuua

SEQ ID NO: 1055411 - RNA, 19 nt, Homo sapiens
cagagacuguuauccauuu

SEQ ID NO: 1055412 - RNA, 19 nt, Homo sapiens
aaacaaagccauccuuaau

SEQ ID NO: 1055413 - RNA, 19 nt, Homo sapiens
gagaucgucaguauuauuu

SEQ ID NO: 1055414 - RNA, 19 nt, Homo sapiens
ccuaugaauuggugguuua

SEQ ID NO: 1055415 - RNA, 19 nt, Homo sapiens
uaagacugcuucuacaaug

SEQ ID NO: 1055416 - RNA, 19 nt, Homo sapiens
gaagcacuccucucucaaa

SEQ ID NO: 1055417 - RNA, 19 nt, Homo sapiens
ugaaagaagcaucagauuu

SEQ ID NO: 1055418 - RNA, 19 nt, Homo sapiens
ugaagagucugugaaagaa

SEQ ID NO: 1055419 - RNA, 19 nt, Homo sapiens
gauaguauuggcagucaua

SEQ ID NO: 1055420 - RNA, 19 nt, Homo sapiens
aaacacacaugguaauagu

SEQ ID NO: 1055421 - RNA, 19 nt, Homo sapiens
agccuaauguggauauuua

SEQ ID NO: 1055422 - RNA, 19 nt, Homo sapiens
gcacuccucucucaaaauu

SEQ ID NO: 1055423 - RNA, 19 nt, Homo sapiens
uagaagcacuccucucuca

SEQ ID NO: 1055424 - RNA, 19 nt, Homo sapiens
gggccucguuccuuguuua

SEQ ID NO: 1055425 - RNA, 19 nt, Homo sapiens
aaacacagccauuaugaug

SEQ ID NO: 1055426 - RNA, 19 nt, Homo sapiens
ccucgugucuucucugauu

SEQ ID NO: 1055427 - RNA, 19 nt, Homo sapiens
guuacgaacuugaauuauc

SEQ ID NO: 1055428 - RNA, 19 nt, Homo sapiens
uaacagcaaugacaaugag

SEQ ID NO: 1055429 - RNA, 19 nt, Homo sapiens
uaaacaaagccauccuuaa

SEQ ID NO: 1055430 - RNA, 19 nt, Homo sapiens
ccaaacacagccauuauga

SEQ ID NO: 1055431 - RNA, 19 nt, Homo sapiens
guugauuucucggcuauuu

SEQ ID NO: 1055432 - RNA, 19 nt, Homo sapiens
ccucagagccuccaaggaa

SEQ ID NO: 1055433 - RNA, 19 nt, Homo sapiens
gugaagagucugugaaaga

SEQ ID NO: 1055434 - RNA, 19 nt, Homo sapiens
ccaaacacacaugguaaua

SEQ ID NO: 1055435 - RNA, 19 nt, Homo sapiens
cuaaacaaagccauccuua

SEQ ID NO: 1055436 - RNA, 19 nt, Homo sapiens
gaggacugcuguacugcaa

SEQ ID NO: 1055437 - RNA, 19 nt, Homo sapiens
gcugacaggugcuuguugu

SEQ ID NO: 1055438 - RNA, 19 nt, Homo sapiens
uaacuucuggccuuuguuu

SEQ ID NO: 1055439 - RNA, 19 nt, Homo sapiens
gaauauaagacugcuucua

SEQ ID NO: 1055440 - RNA, 19 nt, Homo sapiens
ccaaguacauaugauuuca

SEQ ID NO: 1055441 - RNA, 19 nt, Homo sapiens
gauggccaccuaugaauug

SEQ ID NO: 1055442 - RNA, 19 nt, Homo sapiens
ugaauuaucaccucuuugu

SEQ ID NO: 1055443 - RNA, 19 nt, Homo sapiens
gguuaugggucucuuuauc

SEQ ID NO: 1055444 - RNA, 19 nt, Homo sapiens
uauagcauauccacauguu

SEQ ID NO: 1055445 - RNA, 19 nt, Homo sapiens
ucagacagauggacuaaaa

SEQ ID NO: 1055446 - RNA, 19 nt, Homo sapiens
ccauuuggcuuauaaagac

SEQ ID NO: 1055447 - RNA, 19 nt, Homo sapiens
auacuuugcugcuuauuca

SEQ ID NO: 1055448 - RNA, 19 nt, Homo sapiens
acacacaugguaauaguuu

SEQ ID NO: 1055449 - RNA, 19 nt, Homo sapiens
gccuaaaggugaucuugga

SEQ ID NO: 1055450 - RNA, 19 nt, Homo sapiens
ucugacaacucaucuagug

SEQ ID NO: 1055451 - RNA, 19 nt, Homo sapiens
gggaacauguaacuauucu

SEQ ID NO: 1055452 - RNA, 19 nt, Homo sapiens
cagcauggcagacagaaga

SEQ ID NO: 1055453 - RNA, 19 nt, Homo sapiens
ugaauguguucguaaagug

SEQ ID NO: 1055454 - RNA, 19 nt, Homo sapiens
gcaaggaaaaguugaauga

SEQ ID NO: 1055455 - RNA, 19 nt, Homo sapiens
gggacacgcuggugcaucu

SEQ ID NO: 1055456 - RNA, 19 nt, Homo sapiens
ccacauuacuuggccuuuc

SEQ ID NO: 1055457 - RNA, 19 nt, Homo sapiens
guaacuauucuaaguggaa

SEQ ID NO: 1055458 - RNA, 19 nt, Homo sapiens
uaaaguguaucagacagau

SEQ ID NO: 1055459 - RNA, 19 nt, Homo sapiens
ucugugacgcuuuauauuu

SEQ ID NO: 1055460 - RNA, 19 nt, Homo sapiens
uauucaaacugcaaggaaa

SEQ ID NO: 1055461 - RNA, 19 nt, Homo sapiens
uaacauaccaaacacacau

SEQ ID NO: 1055462 - RNA, 19 nt, Homo sapiens
ugacaggugcuuguuguuu

SEQ ID NO: 1055463 - RNA, 19 nt, Homo sapiens
gggcugugccgguugcuuu

SEQ ID NO: 1055464 - RNA, 19 nt, Homo sapiens
gcgaaugggugcuuuugaa

SEQ ID NO: 1055465 - RNA, 19 nt, Homo sapiens
gcuuauaaagacucgguua

SEQ ID NO: 1055466 - RNA, 19 nt, Homo sapiens
uaaaggugaucuuggaaaa

SEQ ID NO: 1055467 - RNA, 19 nt, Homo sapiens
ugugguacaugaaugaaug

SEQ ID NO: 1055468 - RNA, 19 nt, Homo sapiens
gaagguuaugggucucuuu

SEQ ID NO: 1055469 - RNA, 19 nt, Homo sapiens
ugccacaacuauagcauau

SEQ ID NO: 1055470 - RNA, 19 nt, Homo sapiens
ggaccuggcacaauauuuu

SEQ ID NO: 1055471 - RNA, 19 nt, Homo sapiens
uauaacuucuggccuuugu

SEQ ID NO: 1055472 - RNA, 19 nt, Homo sapiens
ggacugcuguacugcaaaa

SEQ ID NO: 1055473 - RNA, 19 nt, Homo sapiens
gcauauccacauguuguaa

SEQ ID NO: 1055474 - RNA, 19 nt, Homo sapiens
ccacaacuauagcauaucc

SEQ ID NO: 1055475 - RNA, 19 nt, Homo sapiens
cuugaauuaucaccucuuu

SEQ ID NO: 1055476 - RNA, 19 nt, Homo sapiens
gcgucuaaauaucuuguau

SEQ ID NO: 1055477 - RNA, 19 nt, Homo sapiens
aaucacaccacauuacuug

SEQ ID NO: 1055478 - RNA, 19 nt, Homo sapiens
gagacagauuccaaacaca

SEQ ID NO: 1055479 - RNA, 19 nt, Homo sapiens
ugagacagauuccaaacac

SEQ ID NO: 1055480 - RNA, 19 nt, Homo sapiens
ggaaaauggugaagagucu

SEQ ID NO: 1055481 - RNA, 19 nt, Homo sapiens
ggcauguccucgugucuuc

SEQ ID NO: 1055482 - RNA, 19 nt, Homo sapiens
gggacaaaauaacuaguaa

SEQ ID NO: 1055483 - RNA, 19 nt, Homo sapiens
guauuggcagucauaaauu

SEQ ID NO: 1055484 - RNA, 19 nt, Homo sapiens
gaauguguucguaaagugu

SEQ ID NO: 1055485 - RNA, 19 nt, Homo sapiens
gaaaggcgaaugggugcuu

SEQ ID NO: 1055486 - RNA, 19 nt, Homo sapiens
ucaccucuuugucauacuu

SEQ ID NO: 1055487 - RNA, 19 nt, Homo sapiens
aacaaagccauccuuaauu

SEQ ID NO: 1055488 - RNA, 19 nt, Homo sapiens
gacucuaucuuugcuuguu

SEQ ID NO: 1055489 - RNA, 19 nt, Homo sapiens
uagcauauccacauguugu

SEQ ID NO: 1055490 - RNA, 19 nt, Homo sapiens
gugaaagaagcaucagauu

SEQ ID NO: 1055491 - RNA, 19 nt, Homo sapiens
guaaaguguaucagacaga

SEQ ID NO: 1055492 - RNA, 19 nt, Homo sapiens
ggacuaggccccaauuuag

SEQ ID NO: 1055493 - RNA, 19 nt, Homo sapiens
ugagaucgucaguauuauu

SEQ ID NO: 1055494 - RNA, 19 nt, Homo sapiens
cacgaggacugcuguacug

SEQ ID NO: 1055495 - RNA, 19 nt, Homo sapiens
gguauaucagagacuguua

SEQ ID NO: 1055496 - RNA, 19 nt, Homo sapiens
gauucuacccaaguacaua

SEQ ID NO: 1055497 - RNA, 19 nt, Homo sapiens
cugugacgcuuuauauuuc

SEQ ID NO: 1055498 - RNA, 19 nt, Homo sapiens
ccacagugcucaccuauaa

SEQ ID NO: 1055499 - RNA, 19 nt, Homo sapiens
ucacauagcucaugaauac

SEQ ID NO: 1055500 - RNA, 19 nt, Homo sapiens
gaauagcccuuaacaugaa

SEQ ID NO: 1055501 - RNA, 19 nt, Homo sapiens
gcaagauucugaugaaaga

SEQ ID NO: 1055502 - RNA, 19 nt, Homo sapiens
gcagcaaguugguuguuua

SEQ ID NO: 1055503 - RNA, 19 nt, Homo sapiens
gaacuacauuucagaucua

SEQ ID NO: 1055504 - RNA, 19 nt, Homo sapiens
gcaaguugguuguuuaaga

SEQ ID NO: 1055505 - RNA, 19 nt, Homo sapiens
ggagucagcuugcucucua

SEQ ID NO: 1055506 - RNA, 19 nt, Homo sapiens
gauagaggguuuggacaua

SEQ ID NO: 1055507 - RNA, 19 nt, Homo sapiens
cagcgaaucugcuauaguu

SEQ ID NO: 1055508 - RNA, 19 nt, Homo sapiens
caauaucacuucugugcua

SEQ ID NO: 1055509 - RNA, 19 nt, Homo sapiens
ggaauagcccuuaacauga

SEQ ID NO: 1055510 - RNA, 19 nt, Homo sapiens
ggacauagagucagcuaaa

SEQ ID NO: 1055511 - RNA, 19 nt, Homo sapiens
ugauacagcucuuucaauu

SEQ ID NO: 1055512 - RNA, 19 nt, Homo sapiens
aaacuuccaugcuugauuu

SEQ ID NO: 1055513 - RNA, 19 nt, Homo sapiens
gggaauagcccuuaacaug

SEQ ID NO: 1055514 - RNA, 19 nt, Homo sapiens
caaguugguuguuuaagaa

SEQ ID NO: 1055515 - RNA, 19 nt, Homo sapiens
gaacacauacugacucuuc

SEQ ID NO: 1055516 - RNA, 19 nt, Homo sapiens
caacucagcuccaacucuu

SEQ ID NO: 1055517 - RNA, 19 nt, Homo sapiens
gcaaacugcucuaugaaag

SEQ ID NO: 1055518 - RNA, 19 nt, Homo sapiens
agagaagguucaauacaua

SEQ ID NO: 1055519 - RNA, 19 nt, Homo sapiens
gcccuuaacaugaaauuua

SEQ ID NO: 1055520 - RNA, 19 nt, Homo sapiens
ccagaagacucuagauaau

SEQ ID NO: 1055521 - RNA, 19 nt, Homo sapiens
ccuccaaccuucccaauuu

SEQ ID NO: 1055522 - RNA, 19 nt, Homo sapiens
caagagaguguguuucuaa

SEQ ID NO: 1055523 - RNA, 19 nt, Homo sapiens
gaaagagacacaaagaaau

SEQ ID NO: 1055524 - RNA, 19 nt, Homo sapiens
gauaucagacucuccuaua

SEQ ID NO: 1055525 - RNA, 19 nt, Homo sapiens
gaucagcugugguuugugu

SEQ ID NO: 1055526 - RNA, 19 nt, Homo sapiens
ccagugauauuaagaaaca

SEQ ID NO: 1055527 - RNA, 19 nt, Homo sapiens
cauaaacuuucaggucuua

SEQ ID NO: 1055528 - RNA, 19 nt, Homo sapiens
uaacauagucuacccagaa

SEQ ID NO: 1055529 - RNA, 19 nt, Homo sapiens
caauuugugugucaagaaa

SEQ ID NO: 1055530 - RNA, 19 nt, Homo sapiens
ucacuucugugcuaauuga

SEQ ID NO: 1055531 - RNA, 19 nt, Homo sapiens
caccuuagauccugucuug

SEQ ID NO: 1055532 - RNA, 19 nt, Homo sapiens
ggacaagacacaccuuaga

SEQ ID NO: 1055533 - RNA, 19 nt, Homo sapiens
uaugcggccuuaugauuua

SEQ ID NO: 1055534 - RNA, 19 nt, Homo sapiens
ggagcaaccuucacuaaaa

SEQ ID NO: 1055535 - RNA, 19 nt, Homo sapiens
gaaaauaccagccuccuuu

SEQ ID NO: 1055536 - RNA, 19 nt, Homo sapiens
uaagggaccugcugcuuuc

SEQ ID NO: 1055537 - RNA, 19 nt, Homo sapiens
ggacaacugcauggucuua

SEQ ID NO: 1055538 - RNA, 19 nt, Homo sapiens
gauauugucagcuuugauu

SEQ ID NO: 1055539 - RNA, 19 nt, Homo sapiens
ugaaugcccugccucuuga

SEQ ID NO: 1055540 - RNA, 19 nt, Homo sapiens
gagaacccauagaggaauu

SEQ ID NO: 1055541 - RNA, 19 nt, Homo sapiens
gaaguuuguuuggcauuga

SEQ ID NO: 1055542 - RNA, 19 nt, Homo sapiens
agaaagagacacaaagaaa

SEQ ID NO: 1055543 - RNA, 19 nt, Homo sapiens
cauagcucaugaauacuua

SEQ ID NO: 1055544 - RNA, 19 nt, Homo sapiens
gaugcuuucuuuccuuauu

SEQ ID NO: 1055545 - RNA, 19 nt, Homo sapiens
ggcaugaacuacugaacuu

SEQ ID NO: 1055546 - RNA, 19 nt, Homo sapiens
gggaauucuucuuaucaaa

SEQ ID NO: 1055547 - RNA, 19 nt, Homo sapiens
auacagcucuuucaauugu

SEQ ID NO: 1055548 - RNA, 19 nt, Homo sapiens
aaugcaaacugcucuauga

SEQ ID NO: 1055549 - RNA, 19 nt, Homo sapiens
ggaaguuuguuuggcauug

SEQ ID NO: 1055550 - RNA, 19 nt, Homo sapiens
gaauuuaugcggccuuaug

SEQ ID NO: 1055551 - RNA, 19 nt, Homo sapiens
gagagugugugcaucuguu

SEQ ID NO: 1055552 - RNA, 19 nt, Homo sapiens
caaaauaguucaggauuga

SEQ ID NO: 1055553 - RNA, 19 nt, Homo sapiens
gucucaaggucauuacuua

SEQ ID NO: 1055554 - RNA, 19 nt, Homo sapiens
gaauguaagucuggagcuu

SEQ ID NO: 1055555 - RNA, 19 nt, Homo sapiens
gcugggagccauuuauuga

SEQ ID NO: 1055556 - RNA, 19 nt, Homo sapiens
ccaaggacauuuuaugaaa

SEQ ID NO: 1055557 - RNA, 19 nt, Homo sapiens
agagucagcuaaaucagaa

SEQ ID NO: 1055558 - RNA, 19 nt, Homo sapiens
gaaagugaguaggguucaa

SEQ ID NO: 1055559 - RNA, 19 nt, Homo sapiens
caucuucaauucagaguca

SEQ ID NO: 1055560 - RNA, 19 nt, Homo sapiens
gaugaugcuuucuuuccuu

SEQ ID NO: 1055561 - RNA, 19 nt, Homo sapiens
uacaggaaauucugacuau

SEQ ID NO: 1055562 - RNA, 19 nt, Homo sapiens
aagagaagguucaauacau

SEQ ID NO: 1055563 - RNA, 19 nt, Homo sapiens
cuaauugaccaguauguaa

SEQ ID NO: 1055564 - RNA, 19 nt, Homo sapiens
ccaaaccucuuuucuuauu

SEQ ID NO: 1055565 - RNA, 19 nt, Homo sapiens
gucccucucuuucuucuuu

SEQ ID NO: 1055566 - RNA, 19 nt, Homo sapiens
cuuacaaugugguuucuuu

SEQ ID NO: 1055567 - RNA, 19 nt, Homo sapiens
ucagcuugcucucuauuga

SEQ ID NO: 1055568 - RNA, 19 nt, Homo sapiens
uguaugugcuuccucauug

SEQ ID NO: 1055569 - RNA, 19 nt, Homo sapiens
ccuaaauccugguaauaau

SEQ ID NO: 1055570 - RNA, 19 nt, Homo sapiens
guauguaaguaccaaggaa

SEQ ID NO: 1055571 - RNA, 19 nt, Homo sapiens
uguaacagguacggaauuu

SEQ ID NO: 1055572 - RNA, 19 nt, Homo sapiens
ggccuggucugcaagauuc

SEQ ID NO: 1055573 - RNA, 19 nt, Homo sapiens
ccaagagaguguguuucua

SEQ ID NO: 1055574 - RNA, 19 nt, Homo sapiens
cuuagugugugaaguaauu

SEQ ID NO: 1055575 - RNA, 19 nt, Homo sapiens
guucuuagugugugaagua

SEQ ID NO: 1055576 - RNA, 19 nt, Homo sapiens
gcccugugcuguucauaga

SEQ ID NO: 1055577 - RNA, 19 nt, Homo sapiens
gaacuggugcaccugagaa

SEQ ID NO: 1055578 - RNA, 19 nt, Homo sapiens
gggcuguaauuccaccuuu

SEQ ID NO: 1055579 - RNA, 19 nt, Homo sapiens
uaacagguacggaauuugu

SEQ ID NO: 1055580 - RNA, 19 nt, Homo sapiens
aaaugcuggugcugaguua

SEQ ID NO: 1055581 - RNA, 19 nt, Homo sapiens
aaagagacacaaagaaaug

SEQ ID NO: 1055582 - RNA, 19 nt, Homo sapiens
uuauaaaugugggcuguaa

SEQ ID NO: 1055583 - RNA, 19 nt, Homo sapiens
cuaaaucacuuuugaccua

SEQ ID NO: 1055584 - RNA, 19 nt, Homo sapiens
gaacccauagaggaauuua

SEQ ID NO: 1055585 - RNA, 19 nt, Homo sapiens
uguaagaacuagcccugaa

SEQ ID NO: 1055586 - RNA, 19 nt, Homo sapiens
caaaccaaguccauuaacu

SEQ ID NO: 1055587 - RNA, 19 nt, Homo sapiens
gaaccucugaagucucuuu

SEQ ID NO: 1055588 - RNA, 19 nt, Homo sapiens
gugcugaguuaaagcuuga

SEQ ID NO: 1055589 - RNA, 19 nt, Homo sapiens
gaaaugcaaacugcucuau

SEQ ID NO: 1055590 - RNA, 19 nt, Homo sapiens
cugcauggauugugauguu

SEQ ID NO: 1055591 - RNA, 19 nt, Homo sapiens
caggauugauggaugcauu

SEQ ID NO: 1055592 - RNA, 19 nt, Homo sapiens
ggaggucaaggucaaugua

SEQ ID NO: 1055593 - RNA, 19 nt, Homo sapiens
gugaagaguggaguaguua

SEQ ID NO: 1055594 - RNA, 19 nt, Homo sapiens
uacaguacauuccaggauu

SEQ ID NO: 1055595 - RNA, 19 nt, Homo sapiens
cccagaagacucuagauaa

SEQ ID NO: 1055596 - RNA, 19 nt, Homo sapiens
caacacguaauuccuaaau

SEQ ID NO: 1055597 - RNA, 19 nt, Homo sapiens
ucacugagaaauucaaaug

SEQ ID NO: 1055598 - RNA, 19 nt, Homo sapiens
agaaagagcugguaaauaa

SEQ ID NO: 1055599 - RNA, 19 nt, Homo sapiens
gaucagaacucaccaaaug

SEQ ID NO: 1055600 - RNA, 19 nt, Homo sapiens
ggauggaacugaaggauuu

SEQ ID NO: 1055601 - RNA, 19 nt, Homo sapiens
gaacauucuuggaggcuua

SEQ ID NO: 1055602 - RNA, 19 nt, Homo sapiens
gaaacucugugaaggcaua

SEQ ID NO: 1055603 - RNA, 19 nt, Homo sapiens
gaaagaagagcccuugaaa

SEQ ID NO: 1055604 - RNA, 19 nt, Homo sapiens
ccaaagugaugaugacuaa

SEQ ID NO: 1055605 - RNA, 19 nt, Homo sapiens
gcauagggcuacuuucaaa

SEQ ID NO: 1055606 - RNA, 19 nt, Homo sapiens
gaagagaggaguugcuuaa

SEQ ID NO: 1055607 - RNA, 19 nt, Homo sapiens
gaauacauuucucccuaua

SEQ ID NO: 1055608 - RNA, 19 nt, Homo sapiens
ucaaagcucucuucaaugu

SEQ ID NO: 1055609 - RNA, 19 nt, Homo sapiens
acacacagccucagacuua

SEQ ID NO: 1055610 - RNA, 19 nt, Homo sapiens
ccucaaagcucucuucaau

SEQ ID NO: 1055611 - RNA, 19 nt, Homo sapiens
gcacccauuuguacauaua

SEQ ID NO: 1055612 - RNA, 19 nt, Homo sapiens
auacagagcugcaguuaga

SEQ ID NO: 1055613 - RNA, 19 nt, Homo sapiens
caacaugcuugauaaacuu

SEQ ID NO: 1055614 - RNA, 19 nt, Homo sapiens
uggauagucugcugaaaua

SEQ ID NO: 1055615 - RNA, 19 nt, Homo sapiens
gcaaggaccggaaauuuau

SEQ ID NO: 1055616 - RNA, 19 nt, Homo sapiens
acacguacauacauucaua

SEQ ID NO: 1055617 - RNA, 19 nt, Homo sapiens
uaccauaugugaucaguuu

SEQ ID NO: 1055618 - RNA, 19 nt, Homo sapiens
ugaguuagaugauucuuug

SEQ ID NO: 1055619 - RNA, 19 nt, Homo sapiens
gaacugaaccaccaucugu

SEQ ID NO: 1055620 - RNA, 19 nt, Homo sapiens
gaacacuaguaccauagaa

SEQ ID NO: 1055621 - RNA, 19 nt, Homo sapiens
gaagaggagauaauuggua

SEQ ID NO: 1055622 - RNA, 19 nt, Homo sapiens
cagaagagcuacacagcaa

SEQ ID NO: 1055623 - RNA, 19 nt, Homo sapiens
gaccggaaauuuaucaaug

SEQ ID NO: 1055624 - RNA, 19 nt, Homo sapiens
gaauugguccuaugaagaa

SEQ ID NO: 1055625 - RNA, 19 nt, Homo sapiens
caagaucccuagcagaaga

SEQ ID NO: 1055626 - RNA, 19 nt, Homo sapiens
ggacacagacacugaagaa

SEQ ID NO: 1055627 - RNA, 19 nt, Homo sapiens
gcaagcgacuucuuagauc

SEQ ID NO: 1055628 - RNA, 19 nt, Homo sapiens
acacagacacugaagaaua

SEQ ID NO: 1055629 - RNA, 19 nt, Homo sapiens
gagaauccagcauauuuaa

SEQ ID NO: 1055630 - RNA, 19 nt, Homo sapiens
ccagaugccugaucagaug

SEQ ID NO: 1055631 - RNA, 19 nt, Homo sapiens
ucuuaucacuggucauuua

SEQ ID NO: 1055632 - RNA, 19 nt, Homo sapiens
uaauguaccugaacacuag

SEQ ID NO: 1055633 - RNA, 19 nt, Homo sapiens
gaagagcccuugaaaacaa

SEQ ID NO: 1055634 - RNA, 19 nt, Homo sapiens
acacagagcagacaagaaa

SEQ ID NO: 1055635 - RNA, 19 nt, Homo sapiens
guuggaaggugcauaaaga

SEQ ID NO: 1055636 - RNA, 19 nt, Homo sapiens
agaaacacauuaacugguu

SEQ ID NO: 1055637 - RNA, 19 nt, Homo sapiens
ccaguacucugucaucgaa

SEQ ID NO: 1055638 - RNA, 19 nt, Homo sapiens
guucuacguuucuaccaua

SEQ ID NO: 1055639 - RNA, 19 nt, Homo sapiens
gaauccagcauauuuaaga

SEQ ID NO: 1055640 - RNA, 19 nt, Homo sapiens
uagaugaaaugacagaaga

SEQ ID NO: 1055641 - RNA, 19 nt, Homo sapiens
uaauggaccuccucucuca

SEQ ID NO: 1055642 - RNA, 19 nt, Homo sapiens
uaacgcagaucuuggaaag

SEQ ID NO: 1055643 - RNA, 19 nt, Homo sapiens
uaucagaguucccaguuau

SEQ ID NO: 1055644 - RNA, 19 nt, Homo sapiens
guaucagaguucccaguua

SEQ ID NO: 1055645 - RNA, 19 nt, Homo sapiens
gaaagagcugguaaauaaa

SEQ ID NO: 1055646 - RNA, 19 nt, Homo sapiens
gcucaacucucaauauugc

SEQ ID NO: 1055647 - RNA, 19 nt, Homo sapiens
gcaaagagagaguggauag

SEQ ID NO: 1055648 - RNA, 19 nt, Homo sapiens
aaagcucucuucaauguga

SEQ ID NO: 1055649 - RNA, 19 nt, Homo sapiens
gcucaucaguggcuaaagu

SEQ ID NO: 1055650 - RNA, 19 nt, Homo sapiens
gaaacacaauuaguuacug

SEQ ID NO: 1055651 - RNA, 19 nt, Homo sapiens
cuaagacccugucauuaau

SEQ ID NO: 1055652 - RNA, 19 nt, Homo sapiens
uaaaacagcugagaaagaa

SEQ ID NO: 1055653 - RNA, 19 nt, Homo sapiens
ggaggaagaggagauaauu

SEQ ID NO: 1055654 - RNA, 19 nt, Homo sapiens
ccaacaacaugucaagugu

SEQ ID NO: 1055655 - RNA, 19 nt, Homo sapiens
ucucaucaguuccguguaa

SEQ ID NO: 1055656 - RNA, 19 nt, Homo sapiens
ggagaaaguaucagaguuc

SEQ ID NO: 1055657 - RNA, 19 nt, Homo sapiens
aggaagcacucaaccagua

SEQ ID NO: 1055658 - RNA, 19 nt, Homo sapiens
gagcagacaagaaagaaga

SEQ ID NO: 1055659 - RNA, 19 nt, Homo sapiens
gcagaaagagcugguaaau

SEQ ID NO: 1055660 - RNA, 19 nt, Homo sapiens
uaacugguuuacucauuga

SEQ ID NO: 1055661 - RNA, 19 nt, Homo sapiens
acuaagacccugucauuaa

SEQ ID NO: 1055662 - RNA, 19 nt, Homo sapiens
ccaugaaacuugucaacau

SEQ ID NO: 1055663 - RNA, 19 nt, Homo sapiens
gaaaugacagaagaacaaa

SEQ ID NO: 1055664 - RNA, 19 nt, Homo sapiens
gaaggugcauaaagagagu

SEQ ID NO: 1055665 - RNA, 19 nt, Homo sapiens
ucuguaaccuccugagaaa

SEQ ID NO: 1055666 - RNA, 19 nt, Homo sapiens
cagcucagccuggaacuua

SEQ ID NO: 1055667 - RNA, 19 nt, Homo sapiens
ccugaacacuaguaccaua

SEQ ID NO: 1055668 - RNA, 19 nt, Homo sapiens
uaaaggacaucccaacaac

SEQ ID NO: 1055669 - RNA, 19 nt, Homo sapiens
ugagaauccagcauauuua

SEQ ID NO: 1055670 - RNA, 19 nt, Homo sapiens
cgagggcagucuuaacuug

SEQ ID NO: 1055671 - RNA, 19 nt, Homo sapiens
gaaaacaagggaaugauuu

SEQ ID NO: 1055672 - RNA, 19 nt, Homo sapiens
ggcaacgacucuagaugaa

SEQ ID NO: 1055673 - RNA, 19 nt, Homo sapiens
ggucacaauugcgcuauga

SEQ ID NO: 1055674 - RNA, 19 nt, Homo sapiens
acauauaggucauucauac

SEQ ID NO: 1055675 - RNA, 19 nt, Homo sapiens
gccaagaucccuagcagaa

SEQ ID NO: 1055676 - RNA, 19 nt, Homo sapiens
gaaguacuccgcauucucu

SEQ ID NO: 1055677 - RNA, 19 nt, Homo sapiens
caaguggaccgaugaguau

SEQ ID NO: 1055678 - RNA, 19 nt, Homo sapiens
cagcacccauuuguacaua

SEQ ID NO: 1055679 - RNA, 19 nt, Homo sapiens
cagaaagagcugguaaaua

SEQ ID NO: 1055680 - RNA, 19 nt, Homo sapiens
ccaguucucagcuuauuaa

SEQ ID NO: 1055681 - RNA, 19 nt, Homo sapiens
gacaagggaagcagcuaua

SEQ ID NO: 1055682 - RNA, 19 nt, Homo sapiens
gcaaugcagucaaccuuuu

SEQ ID NO: 1055683 - RNA, 19 nt, Homo sapiens
gaagagcuacacagcaaug

SEQ ID NO: 1055684 - RNA, 19 nt, Homo sapiens
ucaaguggaccgaugagua

SEQ ID NO: 1055685 - RNA, 19 nt, Homo sapiens
cgacaucaggucacaauug

SEQ ID NO: 1055686 - RNA, 19 nt, Homo sapiens
ggagucagcagcacccauu

SEQ ID NO: 1055687 - RNA, 19 nt, Homo sapiens
caagcgacuucuuagauca

SEQ ID NO: 1055688 - RNA, 19 nt, Homo sapiens
aaagaaagaaacucuguga

SEQ ID NO: 1055689 - RNA, 19 nt, Homo sapiens
cacauuaacugguuuacuc

SEQ ID NO: 1055690 - RNA, 19 nt, Homo sapiens
cugcucaacucucaauauu

SEQ ID NO: 1055691 - RNA, 19 nt, Homo sapiens
ugaaaugacagaagaacaa

SEQ ID NO: 1055692 - RNA, 19 nt, Homo sapiens
caacgacucuagaugaacu

SEQ ID NO: 1055693 - RNA, 19 nt, Homo sapiens
aaucguagguccaacugaa

SEQ ID NO: 1055694 - RNA, 19 nt, Homo sapiens
gcagaagauuuagccaugu

SEQ ID NO: 1055695 - RNA, 19 nt, Homo sapiens
gcaauguuccagucucuug

SEQ ID NO: 1055696 - RNA, 19 nt, Homo sapiens
uagggcuacuuucaaauuu

SEQ ID NO: 1055697 - RNA, 19 nt, Homo sapiens
gcagcuguccuucgucauu

SEQ ID NO: 1055698 - RNA, 19 nt, Homo sapiens
gcaaagauguucaguauug

SEQ ID NO: 1055699 - RNA, 19 nt, Homo sapiens
gaaagaggcugcuauuaga

SEQ ID NO: 1055700 - RNA, 19 nt, Homo sapiens
gaagacagcucaucugguu

SEQ ID NO: 1055701 - RNA, 19 nt, Homo sapiens
guacauagaugaaacaaga

SEQ ID NO: 1055702 - RNA, 19 nt, Homo sapiens
gaaacaagauuggccauaa

SEQ ID NO: 1055703 - RNA, 19 nt, Homo sapiens
cagcaaagauguucaguau

SEQ ID NO: 1055704 - RNA, 19 nt, Homo sapiens
caggugaaaugauauguua

SEQ ID NO: 1055705 - RNA, 19 nt, Homo sapiens
cacaguagcugcacaguuu

SEQ ID NO: 1055706 - RNA, 19 nt, Homo sapiens
gcacagaacguacguguau

SEQ ID NO: 1055707 - RNA, 19 nt, Homo sapiens
ggaaagaggcugcuauuag

SEQ ID NO: 1055708 - RNA, 19 nt, Homo sapiens
ccagugaaauguauugauu

SEQ ID NO: 1055709 - RNA, 19 nt, Homo sapiens
gaacacaaagugaagguuu

SEQ ID NO: 1055710 - RNA, 19 nt, Homo sapiens
uaacaucucuuugaggaaa

SEQ ID NO: 1055711 - RNA, 19 nt, Homo sapiens
cuucuuacaugucaucuua

SEQ ID NO: 1055712 - RNA, 19 nt, Homo sapiens
uaaagcaauugcaucgaua

SEQ ID NO: 1055713 - RNA, 19 nt, Homo sapiens
aaacaagauuggccauaaa

SEQ ID NO: 1055714 - RNA, 19 nt, Homo sapiens
uaaauacaguggacgcaaa

SEQ ID NO: 1055715 - RNA, 19 nt, Homo sapiens
ucaguggaauugucaagua

SEQ ID NO: 1055716 - RNA, 19 nt, Homo sapiens
guacugugguuauguuguu

SEQ ID NO: 1055717 - RNA, 19 nt, Homo sapiens
caagauuggccauaaauug

SEQ ID NO: 1055718 - RNA, 19 nt, Homo sapiens
guucuaauaugcuaguuug

SEQ ID NO: 1055719 - RNA, 19 nt, Homo sapiens
gccaacaggcuauaucaua

SEQ ID NO: 1055720 - RNA, 19 nt, Homo sapiens
ucaagacgguuguaagaug

SEQ ID NO: 1055721 - RNA, 19 nt, Homo sapiens
ggugagcacuucuguguuc

SEQ ID NO: 1055722 - RNA, 19 nt, Homo sapiens
gaaucaguccuucguguaa

SEQ ID NO: 1055723 - RNA, 19 nt, Homo sapiens
guaauugaguacauagaug

SEQ ID NO: 1055724 - RNA, 19 nt, Homo sapiens
agauagcgaucccuaauga

SEQ ID NO: 1055725 - RNA, 19 nt, Homo sapiens
gaagcugugugauggaugu

SEQ ID NO: 1055726 - RNA, 19 nt, Homo sapiens
cagcucaucugguuucuuc

SEQ ID NO: 1055727 - RNA, 19 nt, Homo sapiens
ccgaauaucuggagaaacu

SEQ ID NO: 1055728 - RNA, 19 nt, Homo sapiens
caucuuaacaucucuuuga

SEQ ID NO: 1055729 - RNA, 19 nt, Homo sapiens
gcuaguagaguauaugcua

SEQ ID NO: 1055730 - RNA, 19 nt, Homo sapiens
auacgugaauagacucuua

SEQ ID NO: 1055731 - RNA, 19 nt, Homo sapiens
gaauaucuggagaaacuaa

SEQ ID NO: 1055732 - RNA, 19 nt, Homo sapiens
gguauucgcuucaaaauca

SEQ ID NO: 1055733 - RNA, 19 nt, Homo sapiens
caagacgguuguaagaugu

SEQ ID NO: 1055734 - RNA, 19 nt, Homo sapiens
gaaaaggcauuuaggaaag

SEQ ID NO: 1055735 - RNA, 19 nt, Homo sapiens
ccauuuaguuugucuagau

SEQ ID NO: 1055736 - RNA, 19 nt, Homo sapiens
gugacacucuuccucauga

SEQ ID NO: 1055737 - RNA, 19 nt, Homo sapiens
ugaugugucugccuucauu

SEQ ID NO: 1055738 - RNA, 19 nt, Homo sapiens
gauuggccauaaauuggua

SEQ ID NO: 1055739 - RNA, 19 nt, Homo sapiens
ccuaaccacuucuuacaug

SEQ ID NO: 1055740 - RNA, 19 nt, Homo sapiens
ggaggaagcgagagugguu

SEQ ID NO: 1055741 - RNA, 19 nt, Homo sapiens
gaagauucgguuagcauug

SEQ ID NO: 1055742 - RNA, 19 nt, Homo sapiens
cacugaagguucuuugauu

SEQ ID NO: 1055743 - RNA, 19 nt, Homo sapiens
gacgagguccuguuaguga

SEQ ID NO: 1055744 - RNA, 19 nt, Homo sapiens
guaagauguuugaggacaa

SEQ ID NO: 1055745 - RNA, 19 nt, Homo sapiens
agacacuacuugaaauaug

SEQ ID NO: 1055746 - RNA, 19 nt, Homo sapiens
caaaagugguucuaauaug

SEQ ID NO: 1055747 - RNA, 19 nt, Homo sapiens
uguaucagguguuucagaa

SEQ ID NO: 1055748 - RNA, 19 nt, Homo sapiens
gauguuugagaguucauua

SEQ ID NO: 1055749 - RNA, 19 nt, Homo sapiens
gaagcgagagugguucaaa

SEQ ID NO: 1055750 - RNA, 19 nt, Homo sapiens
ggaagauucgguuagcauu

SEQ ID NO: 1055751 - RNA, 19 nt, Homo sapiens
cuucagcuccuuacaaauu

SEQ ID NO: 1055752 - RNA, 19 nt, Homo sapiens
guaaucaccguguggcaaa

SEQ ID NO: 1055753 - RNA, 19 nt, Homo sapiens
gacacuacuugaaauaugg

SEQ ID NO: 1055754 - RNA, 19 nt, Homo sapiens
gauggauguuugagaguuc

SEQ ID NO: 1055755 - RNA, 19 nt, Homo sapiens
gauaugguacugugguuau

SEQ ID NO: 1055756 - RNA, 19 nt, Homo sapiens
gucuucagcuccuuacaaa

SEQ ID NO: 1055757 - RNA, 19 nt, Homo sapiens
gggcaaaauuguugucauu

SEQ ID NO: 1055758 - RNA, 19 nt, Homo sapiens
ugagacacuacuugaaaua

SEQ ID NO: 1055759 - RNA, 19 nt, Homo sapiens
cuaaugaacagcaaagaug

SEQ ID NO: 1055760 - RNA, 19 nt, Homo sapiens
gcaauugcaucgauaaaag

SEQ ID NO: 1055761 - RNA, 19 nt, Homo sapiens
uguuugaggacaagaauua

SEQ ID NO: 1055762 - RNA, 19 nt, Homo sapiens
cgaagaagcgggagucaag

SEQ ID NO: 1055763 - RNA, 19 nt, Homo sapiens
caaagauguucaguauugu

SEQ ID NO: 1055764 - RNA, 19 nt, Homo sapiens
gcugugugauggauguuug

SEQ ID NO: 1055765 - RNA, 19 nt, Homo sapiens
caugggaugugugauauca

SEQ ID NO: 1055766 - RNA, 19 nt, Homo sapiens
gccaugggaugugugauau

SEQ ID NO: 1055767 - RNA, 19 nt, Homo sapiens
cuaccugguuucugcauau

SEQ ID NO: 1055768 - RNA, 19 nt, Homo sapiens
ucugguuguuguacucuua

SEQ ID NO: 1055769 - RNA, 19 nt, Homo sapiens
gagguccuguuagugagua

SEQ ID NO: 1055770 - RNA, 19 nt, Homo sapiens
caucugagacacuacuuga

SEQ ID NO: 1055771 - RNA, 19 nt, Homo sapiens
guacucuuauacgugaaua

SEQ ID NO: 1055772 - RNA, 19 nt, Homo sapiens
ccagugaucaguggaauug

SEQ ID NO: 1055773 - RNA, 19 nt, Homo sapiens
gaugugaacccagugauca

SEQ ID NO: 1055774 - RNA, 19 nt, Homo sapiens
gcugaaagaaacauugaug

SEQ ID NO: 1055775 - RNA, 19 nt, Homo sapiens
auguacaggugaaaugaua

SEQ ID NO: 1055776 - RNA, 19 nt, Homo sapiens
auaaagcaauugcaucgau

SEQ ID NO: 1055777 - RNA, 19 nt, Homo sapiens
ucagcugccuccagaacaa

SEQ ID NO: 1055778 - RNA, 19 nt, Homo sapiens
guauugugcugaaagaaac

SEQ ID NO: 1055779 - RNA, 19 nt, Homo sapiens
ccucgaggaugaagugcaa

SEQ ID NO: 1055780 - RNA, 19 nt, Homo sapiens
uccgagagguguacgaaga

SEQ ID NO: 1055781 - RNA, 19 nt, Homo sapiens
uucagcuccuuacaaauua

SEQ ID NO: 1055782 - RNA, 19 nt, Homo sapiens
cugcacaguuuuaagauua

SEQ ID NO: 1055783 - RNA, 19 nt, Homo sapiens
ccagauagcgaucccuaau

SEQ ID NO: 1055784 - RNA, 19 nt, Homo sapiens
uaucauaggcaguuuccaa

SEQ ID NO: 1055785 - RNA, 19 nt, Homo sapiens
ccaaucuggugcuaguaga

SEQ ID NO: 1055786 - RNA, 19 nt, Homo sapiens
gguaauugaguacauagau

SEQ ID NO: 1055787 - RNA, 19 nt, Homo sapiens
gcaaaauaauguugugagu

SEQ ID NO: 1055788 - RNA, 19 nt, Homo sapiens
gagacacuacuugaaauau

SEQ ID NO: 1055789 - RNA, 19 nt, Homo sapiens
guacaggugaaaugauaug

SEQ ID NO: 1055790 - RNA, 19 nt, Homo sapiens
ucugagacacuacuugaaa

SEQ ID NO: 1055791 - RNA, 19 nt, Homo sapiens
cccaguuguuacauaauuu

SEQ ID NO: 1055792 - RNA, 19 nt, Homo sapiens
cggagcugcuggaggauug

SEQ ID NO: 1055793 - RNA, 19 nt, Homo sapiens
caugauaccagugaaaugu

SEQ ID NO: 1055794 - RNA, 19 nt, Homo sapiens
aagauuaugccaucaccua

SEQ ID NO: 1055795 - RNA, 19 nt, Homo sapiens
gaaauaugguuggcaucac

SEQ ID NO: 1055796 - RNA, 19 nt, Homo sapiens
ccaagaagacagcucaucu

SEQ ID NO: 1055797 - RNA, 19 nt, Homo sapiens
caggugagcacuucugugu

SEQ ID NO: 1055798 - RNA, 19 nt, Homo sapiens
gauguugggaucauuauua

SEQ ID NO: 1055799 - RNA, 19 nt, Homo sapiens
gcaagaacggugggauuua

SEQ ID NO: 1055800 - RNA, 19 nt, Homo sapiens
ggaggaagcagcagggaaa

SEQ ID NO: 1055801 - RNA, 19 nt, Homo sapiens
gcacacagaggaguacuuu

SEQ ID NO: 1055802 - RNA, 19 nt, Homo sapiens
ccacaucagucucaacauc

SEQ ID NO: 1055803 - RNA, 19 nt, Homo sapiens
ggguggaucucgugacuau

SEQ ID NO: 1055804 - RNA, 19 nt, Homo sapiens
gcacucguuucaaguccua

SEQ ID NO: 1055805 - RNA, 19 nt, Homo sapiens
ggacuucgagggcaauuug

SEQ ID NO: 1055806 - RNA, 19 nt, Homo sapiens
gguccucgccuaucuguuu

SEQ ID NO: 1055807 - RNA, 19 nt, Homo sapiens
ggagggaacuuuucaguca

SEQ ID NO: 1055808 - RNA, 19 nt, Homo sapiens
cgagacaggucgcugacaa

SEQ ID NO: 1055809 - RNA, 19 nt, Homo sapiens
ucaggaagguggccaagau

SEQ ID NO: 1055810 - RNA, 19 nt, Homo sapiens
acaggucgcugacaaagug

SEQ ID NO: 1055811 - RNA, 19 nt, Homo sapiens
gaucugcgaccauuucugu

SEQ ID NO: 1055812 - RNA, 19 nt, Homo sapiens
ugggcuaccugaccaagua

SEQ ID NO: 1055813 - RNA, 19 nt, Homo sapiens
caagaacggugggauuuac

SEQ ID NO: 1055814 - RNA, 19 nt, Homo sapiens
gcagagugauauuccucaa

SEQ ID NO: 1055815 - RNA, 19 nt, Homo sapiens
gcucaaggaucccaguuuu

SEQ ID NO: 1055816 - RNA, 19 nt, Homo sapiens
gaacggugggauuuacuug

SEQ ID NO: 1055817 - RNA, 19 nt, Homo sapiens
ggaagcgucuuugcucaag

SEQ ID NO: 1055818 - RNA, 19 nt, Homo sapiens
gcguggagaucaucaccaa

SEQ ID NO: 1055819 - RNA, 19 nt, Homo sapiens
gaagauccugcucaucaga

SEQ ID NO: 1055820 - RNA, 19 nt, Homo sapiens
cuacaacugcagagugaua

SEQ ID NO: 1055821 - RNA, 19 nt, Homo sapiens
aaaagaggcuggaauaaag

SEQ ID NO: 1055822 - RNA, 19 nt, Homo sapiens
aaacagaggagcaagauac

SEQ ID NO: 1055823 - RNA, 19 nt, Homo sapiens
ggaagauccugcucaucag

SEQ ID NO: 1055824 - RNA, 19 nt, Homo sapiens
agagugauauuccucaaca

SEQ ID NO: 1055825 - RNA, 19 nt, Homo sapiens
gguuugaucugcgaccauu

SEQ ID NO: 1055826 - RNA, 19 nt, Homo sapiens
gagugaagguggacuuugc

SEQ ID NO: 1055827 - RNA, 19 nt, Homo sapiens
ggacugaggccgguuccuu

SEQ ID NO: 1055828 - RNA, 19 nt, Homo sapiens
gcaaacuccucggcaugug

SEQ ID NO: 1055829 - RNA, 19 nt, Homo sapiens
agaccucuguggacgcaua

SEQ ID NO: 1055830 - RNA, 19 nt, Homo sapiens
gaacggaagcgucuuugcu

SEQ ID NO: 1055831 - RNA, 19 nt, Homo sapiens
aagcuggccuuggcaguuu

SEQ ID NO: 1055832 - RNA, 19 nt, Homo sapiens
ggaugguccucgccuaucu

SEQ ID NO: 1055833 - RNA, 19 nt, Homo sapiens
cgacggcugugccaugauc

SEQ ID NO: 1055834 - RNA, 19 nt, Homo sapiens
ugggacaccugcauuggaa

SEQ ID NO: 1055835 - RNA, 19 nt, Homo sapiens
gaguggaaaugaggaagug

SEQ ID NO: 1055836 - RNA, 19 nt, Homo sapiens
ggacaacagguuugaucug

SEQ ID NO: 1055837 - RNA, 19 nt, Homo sapiens
gaccauuucuguacaacac

SEQ ID NO: 1055838 - RNA, 19 nt, Homo sapiens
gaggacaacagguuugauc

SEQ ID NO: 1055839 - RNA, 19 nt, Homo sapiens
gagacaggucgcugacaaa

SEQ ID NO: 1055840 - RNA, 19 nt, Homo sapiens
gcaccaucgugaaccagau

SEQ ID NO: 1055841 - RNA, 19 nt, Homo sapiens
gaacuuuucagucaaauuc

SEQ ID NO: 1055842 - RNA, 19 nt, Homo sapiens
augcggagcucucggucua

SEQ ID NO: 1055843 - RNA, 19 nt, Homo sapiens
aggaagugcuggcugaugu

SEQ ID NO: 1055844 - RNA, 19 nt, Homo sapiens
gcggagcucucggucuaug

SEQ ID NO: 1055845 - RNA, 19 nt, Homo sapiens
cgcuacaacugcagaguga

SEQ ID NO: 1055846 - RNA, 19 nt, Homo sapiens
ccugcuggcucugggauuu

SEQ ID NO: 1055847 - RNA, 19 nt, Homo sapiens
cagcaagaacggugggauu

SEQ ID NO: 1055848 - RNA, 19 nt, Homo sapiens
acacagaggaguacuuucu

SEQ ID NO: 1055849 - RNA, 19 nt, Homo sapiens
gcaguuucggugcauagaa

SEQ ID NO: 1055850 - RNA, 19 nt, Homo sapiens
caacugcagagugauauuc

SEQ ID NO: 1055851 - RNA, 19 nt, Homo sapiens
gaaacguccgcuacaacug

SEQ ID NO: 1055852 - RNA, 19 nt, Homo sapiens
gcauacugaccaccugcua

SEQ ID NO: 1055853 - RNA, 19 nt, Homo sapiens
caugaacggaagcgucuuu

SEQ ID NO: 1055854 - RNA, 19 nt, Homo sapiens
gaccgacgaggaagauaug

SEQ ID NO: 1055855 - RNA, 19 nt, Homo sapiens
gaagccaccacaucagucu

SEQ ID NO: 1055856 - RNA, 19 nt, Homo sapiens
gggaccgccuguacuacga

SEQ ID NO: 1055857 - RNA, 19 nt, Homo sapiens
ccauuucuguacaacacaa

SEQ ID NO: 1055858 - RNA, 19 nt, Homo sapiens
caaguacuccaugaacaga

SEQ ID NO: 1055859 - RNA, 19 nt, Homo sapiens
gacaugggacaccugcauu

SEQ ID NO: 1055860 - RNA, 19 nt, Homo sapiens
ucagucaaauuccucaaaa

SEQ ID NO: 1055861 - RNA, 19 nt, Homo sapiens
cuacagcccugaggacaac

SEQ ID NO: 1055862 - RNA, 19 nt, Homo sapiens
cuacagggcggagauuuca

SEQ ID NO: 1055863 - RNA, 19 nt, Homo sapiens
uacgacggcugugccauga

SEQ ID NO: 1055864 - RNA, 19 nt, Homo sapiens
acaccugcauuggaaguga

SEQ ID NO: 1055865 - RNA, 19 nt, Homo sapiens
ggacaccugcauuggaagu

SEQ ID NO: 1055866 - RNA, 19 nt, Homo sapiens
guugggaucauuauuacga

SEQ ID NO: 1055867 - RNA, 19 nt, Homo sapiens
caccucaucaucagcauug

SEQ ID NO: 1055868 - RNA, 19 nt, Homo sapiens
ugacaaagugaagcgguuu

SEQ ID NO: 1055869 - RNA, 19 nt, Homo sapiens
ucagggccuucguccaguu

SEQ ID NO: 1055870 - RNA, 19 nt, Homo sapiens
aaaugugcaggcucgaaua

SEQ ID NO: 1055871 - RNA, 19 nt, Homo sapiens
gaguuggcccagcagauug

SEQ ID NO: 1055872 - RNA, 19 nt, Homo sapiens
gcuacagggcggagauuuc

SEQ ID NO: 1055873 - RNA, 19 nt, Homo sapiens
agaguuggcccagcagauu

SEQ ID NO: 1055874 - RNA, 19 nt, Homo sapiens
ggaguggaaaugaggaagu

SEQ ID NO: 1055875 - RNA, 19 nt, Homo sapiens
aagcgucuuugcucaagga

SEQ ID NO: 1055876 - RNA, 19 nt, Homo sapiens
ggauguugggaucauuauu

SEQ ID NO: 1055877 - RNA, 19 nt, Homo sapiens
cgaggagucggcacacaga

SEQ ID NO: 1055878 - RNA, 19 nt, Homo sapiens
gauuggaagccaccacauc

SEQ ID NO: 1055879 - RNA, 19 nt, Homo sapiens
cuacauggccagcaagaac

SEQ ID NO: 1055880 - RNA, 19 nt, Homo sapiens
cgaaacguccgcuacaacu

SEQ ID NO: 1055881 - RNA, 19 nt, Homo sapiens
cauuggaagugagaucugu

SEQ ID NO: 1055882 - RNA, 19 nt, Homo sapiens
gcaccucaucaucagcauu

SEQ ID NO: 1055883 - RNA, 19 nt, Homo sapiens
uccaaguacuccaugaaca

SEQ ID NO: 1055884 - RNA, 19 nt, Homo sapiens
gagaguuggcccagcagau

SEQ ID NO: 1055885 - RNA, 19 nt, Homo sapiens
cuacggauguugggaucau

SEQ ID NO: 1055886 - RNA, 19 nt, Homo sapiens
cauagaaaaucaggugcua

SEQ ID NO: 1055887 - RNA, 19 nt, Homo sapiens
ccuacagcauguucugcaa

SEQ ID NO: 1055888 - RNA, 19 nt, Homo sapiens
gcucucggucuaugggaaa

SEQ ID NO: 1055889 - RNA, 19 nt, Homo sapiens
gaggaagugcuggcugaug

SEQ ID NO: 1055890 - RNA, 19 nt, Homo sapiens
uggaggacguccggagcua

SEQ ID NO: 1055891 - RNA, 19 nt, Homo sapiens
caggguggaucucgugacu

SEQ ID NO: 1055892 - RNA, 19 nt, Homo sapiens
guaccacgccgagaacuac

SEQ ID NO: 1055893 - RNA, 19 nt, Homo sapiens
caagaugaccacgcucaca

SEQ ID NO: 1055894 - RNA, 19 nt, Homo sapiens
caugaacagacacaagaug

SEQ ID NO: 1055895 - RNA, 19 nt, Homo sapiens
ccaaguacuccaugaacag

SEQ ID NO: 1055896 - RNA, 19 nt, Homo sapiens
cuacagcauguucugcaaa

SEQ ID NO: 1055897 - RNA, 19 nt, Homo sapiens
gaggaguggaaaugaggaa

SEQ ID NO: 1055898 - RNA, 19 nt, Homo sapiens
ggaagaaagugaagcuuga

SEQ ID NO: 1055899 - RNA, 19 nt, Homo sapiens
gaccagagguugagaggaa

SEQ ID NO: 1055900 - RNA, 19 nt, Homo sapiens
ccaaggagcucuuacagau

SEQ ID NO: 1055901 - RNA, 19 nt, Homo sapiens
caacgucaccaauaaauuu

SEQ ID NO: 1055902 - RNA, 19 nt, Homo sapiens
gcagaaguauggugagguu

SEQ ID NO: 1055903 - RNA, 19 nt, Homo sapiens
ccagaaacuugaugagaaa

SEQ ID NO: 1055904 - RNA, 19 nt, Homo sapiens
ggauaacccucugaagauu

SEQ ID NO: 1055905 - RNA, 19 nt, Homo sapiens
gaaguuggccugguggaua

SEQ ID NO: 1055906 - RNA, 19 nt, Homo sapiens
gcacugcugugguggaguu

SEQ ID NO: 1055907 - RNA, 19 nt, Homo sapiens
ggacaaagagguaaagaag

SEQ ID NO: 1055908 - RNA, 19 nt, Homo sapiens
gagaggacccagaaacuug

SEQ ID NO: 1055909 - RNA, 19 nt, Homo sapiens
cccagaaacuugaugagaa

SEQ ID NO: 1055910 - RNA, 19 nt, Homo sapiens
gauaacccucugaagauuu

SEQ ID NO: 1055911 - RNA, 19 nt, Homo sapiens
ggagaaggcagcggacaaa

SEQ ID NO: 1055912 - RNA, 19 nt, Homo sapiens
gaaggcagcggacaaagag

SEQ ID NO: 1055913 - RNA, 19 nt, Homo sapiens
ccaggacacuagagcaaga

SEQ ID NO: 1055914 - RNA, 19 nt, Homo sapiens
gaaggaggaugagucaaaa

SEQ ID NO: 1055915 - RNA, 19 nt, Homo sapiens
gaacucuuccaccagcuuu

SEQ ID NO: 1055916 - RNA, 19 nt, Homo sapiens
guggauaacccucugaaga

SEQ ID NO: 1055917 - RNA, 19 nt, Homo sapiens
caagaaggaggaugaguca

SEQ ID NO: 1055918 - RNA, 19 nt, Homo sapiens
agaaggaggaugagucaaa

SEQ ID NO: 1055919 - RNA, 19 nt, Homo sapiens
aaagguggcuacuccaaag

SEQ ID NO: 1055920 - RNA, 19 nt, Homo sapiens
cagcagagaggacccagaa

SEQ ID NO: 1055921 - RNA, 19 nt, Homo sapiens
aaguuggccugguggauaa

SEQ ID NO: 1055922 - RNA, 19 nt, Homo sapiens
ggacccagaaacuugauga

SEQ ID NO: 1055923 - RNA, 19 nt, Homo sapiens
ucuucaacgucaccaauaa

SEQ ID NO: 1055924 - RNA, 19 nt, Homo sapiens
gcagagaggacccagaaac

SEQ ID NO: 1055925 - RNA, 19 nt, Homo sapiens
gagcgugaccagagguuga

SEQ ID NO: 1055926 - RNA, 19 nt, Homo sapiens
gaucgaacgccugagagaa

SEQ ID NO: 1055927 - RNA, 19 nt, Homo sapiens
gagaaaaggaagaaaguga

SEQ ID NO: 1055928 - RNA, 19 nt, Homo sapiens
gaaguauggugagguucuc

SEQ ID NO: 1055929 - RNA, 19 nt, Homo sapiens
ccauggcagugaccaagga

SEQ ID NO: 1055930 - RNA, 19 nt, Homo sapiens
uggauaacccucugaagau

SEQ ID NO: 1055931 - RNA, 19 nt, Homo sapiens
ucaacgucaccaauaaauu

SEQ ID NO: 1055932 - RNA, 19 nt, Homo sapiens
ccaggagagugaggaggaa

SEQ ID NO: 1055933 - RNA, 19 nt, Homo sapiens
auaacccucugaagauuuc

SEQ ID NO: 1055934 - RNA, 19 nt, Homo sapiens
gaaccauggcagugaccaa

SEQ ID NO: 1055935 - RNA, 19 nt, Homo sapiens
caaggagcucuuacagaug

SEQ ID NO: 1055936 - RNA, 19 nt, Homo sapiens
agaaggcagcggacaaaga

SEQ ID NO: 1055937 - RNA, 19 nt, Homo sapiens
guucucaaccuggugcuuu

SEQ ID NO: 1055938 - RNA, 19 nt, Homo sapiens
caggaaagccaagaagcaa

SEQ ID NO: 1055939 - RNA, 19 nt, Homo sapiens
gacguccuccuacggcuuu

SEQ ID NO: 1055940 - RNA, 19 nt, Homo sapiens
cuccaaagacguccuccua

SEQ ID NO: 1055941 - RNA, 19 nt, Homo sapiens
gacacuagagcaagagauc

SEQ ID NO: 1055942 - RNA, 19 nt, Homo sapiens
gaaaggcagaaaauacuga

SEQ ID NO: 1055943 - RNA, 19 nt, Homo sapiens
gagguaaagaaggcguaua

SEQ ID NO: 1055944 - RNA, 19 nt, Homo sapiens
gaaggcguauaggcagaag

SEQ ID NO: 1055945 - RNA, 19 nt, Homo sapiens
ucgaacgccugagagaaga

SEQ ID NO: 1055946 - RNA, 19 nt, Homo sapiens
ucaggaaagccaagaagca

SEQ ID NO: 1055947 - RNA, 19 nt, Homo sapiens
ggaccuguacgcgcugcua

SEQ ID NO: 1055948 - RNA, 19 nt, Homo sapiens
ugucagagagggacuacga

SEQ ID NO: 1055949 - RNA, 19 nt, Homo sapiens
agagaucgaacgccugaga

SEQ ID NO: 1055950 - RNA, 19 nt, Homo sapiens
cucugaagauuuccugguu

SEQ ID NO: 1055951 - RNA, 19 nt, Homo sapiens
ugaccaaggagcucuuaca

SEQ ID NO: 1055952 - RNA, 19 nt, Homo sapiens
gaccaaggagcucuuacag

SEQ ID NO: 1055953 - RNA, 19 nt, Homo sapiens
ccucagcccuuuucuucaa

SEQ ID NO: 1055954 - RNA, 19 nt, Homo sapiens
ggaguuugcaaccgucaag

SEQ ID NO: 1055955 - RNA, 19 nt, Homo sapiens
gaggaaaggcagaaaauac

SEQ ID NO: 1055956 - RNA, 19 nt, Homo sapiens
cggacaaagagguaaagaa

SEQ ID NO: 1055957 - RNA, 19 nt, Homo sapiens
agagaggacccagaaacuu

SEQ ID NO: 1055958 - RNA, 19 nt, Homo sapiens
cagagaggacccagaaacu

SEQ ID NO: 1055959 - RNA, 19 nt, Homo sapiens
ggucaggaaagccaagaag

SEQ ID NO: 1055960 - RNA, 19 nt, Homo sapiens
gaaaucaaccagacuauua

SEQ ID NO: 1055961 - RNA, 19 nt, Homo sapiens
gaaaugaguuuguucagaa

SEQ ID NO: 1055962 - RNA, 19 nt, Homo sapiens
gaacaaaacugaagaauca

SEQ ID NO: 1055963 - RNA, 19 nt, Homo sapiens
ugaagaagaugcugcuuua

SEQ ID NO: 1055964 - RNA, 19 nt, Homo sapiens
gaaacugccuucuaaagug

SEQ ID NO: 1055965 - RNA, 19 nt, Homo sapiens
ggacuauccugauuauuau

SEQ ID NO: 1055966 - RNA, 19 nt, Homo sapiens
ugacauggcuucucccaaa

SEQ ID NO: 1055967 - RNA, 19 nt, Homo sapiens
caacaaaguuccaguuagu

SEQ ID NO: 1055968 - RNA, 19 nt, Homo sapiens
gagcauauguuugaaguau

SEQ ID NO: 1055969 - RNA, 19 nt, Homo sapiens
gaaacuaaaugaggucuau

SEQ ID NO: 1055970 - RNA, 19 nt, Homo sapiens
ggacagauucagaaauaua

SEQ ID NO: 1055971 - RNA, 19 nt, Homo sapiens
ggaagaguaugaugauguu

SEQ ID NO: 1055972 - RNA, 19 nt, Homo sapiens
caagaaagcagaauaugaa

SEQ ID NO: 1055973 - RNA, 19 nt, Homo sapiens
gaagaaaccugccccauga

SEQ ID NO: 1055974 - RNA, 19 nt, Homo sapiens
gcacucagcuauaccacaa

SEQ ID NO: 1055975 - RNA, 19 nt, Homo sapiens
gaucugaguugccugacua

SEQ ID NO: 1055976 - RNA, 19 nt, Homo sapiens
ggagugugaucugaauuua

SEQ ID NO: 1055977 - RNA, 19 nt, Homo sapiens
ccacauaucgucuguauug

SEQ ID NO: 1055978 - RNA, 19 nt, Homo sapiens
gcauauguuugaaguauug

SEQ ID NO: 1055979 - RNA, 19 nt, Homo sapiens
ugacgaagaugaugaugaa

SEQ ID NO: 1055980 - RNA, 19 nt, Homo sapiens
acaagcagaugaagaaauu

SEQ ID NO: 1055981 - RNA, 19 nt, Homo sapiens
gagcuuauccacaaucuuu

SEQ ID NO: 1055982 - RNA, 19 nt, Homo sapiens
gcuauaaugugcccaauuc

SEQ ID NO: 1055983 - RNA, 19 nt, Homo sapiens
guuaggaguugucggaaua

SEQ ID NO: 1055984 - RNA, 19 nt, Homo sapiens
gaagaaaucaaccagacua

SEQ ID NO: 1055985 - RNA, 19 nt, Homo sapiens
gcaaguguguggucauguu

SEQ ID NO: 1055986 - RNA, 19 nt, Homo sapiens
acaaggaggucguuuauca

SEQ ID NO: 1055987 - RNA, 19 nt, Homo sapiens
ucggacagauucagaaaua

SEQ ID NO: 1055988 - RNA, 19 nt, Homo sapiens
ggaagaugcuacagcgauu

SEQ ID NO: 1055989 - RNA, 19 nt, Homo sapiens
gcucccagguuuauaauga

SEQ ID NO: 1055990 - RNA, 19 nt, Homo sapiens
ggaggagacuuuccaaucu

SEQ ID NO: 1055991 - RNA, 19 nt, Homo sapiens
gaagaaauucaaaggauug

SEQ ID NO: 1055992 - RNA, 19 nt, Homo sapiens
acaaugagccggagucuuu

SEQ ID NO: 1055993 - RNA, 19 nt, Homo sapiens
caacaaguaccaagauauu

SEQ ID NO: 1055994 - RNA, 19 nt, Homo sapiens
ugacaaauaugcuggugaa

SEQ ID NO: 1055995 - RNA, 19 nt, Homo sapiens
ccaauggacuugaaaauaa

SEQ ID NO: 1055996 - RNA, 19 nt, Homo sapiens
gccaugaacucuauaauac

SEQ ID NO: 1055997 - RNA, 19 nt, Homo sapiens
caacaugaguggcuacauc

SEQ ID NO: 1055998 - RNA, 19 nt, Homo sapiens
gaaagacugugggaggauu

SEQ ID NO: 1055999 - RNA, 19 nt, Homo sapiens
caaauaugcuggugaagag

SEQ ID NO: 1056000 - RNA, 19 nt, Homo sapiens
ugacauguauucucggaaa

SEQ ID NO: 1056001 - RNA, 19 nt, Homo sapiens
gagauggagcugcauauuu

SEQ ID NO: 1056002 - RNA, 19 nt, Homo sapiens
ugacuuugcugauucaaga

SEQ ID NO: 1056003 - RNA, 19 nt, Homo sapiens
gaacagggcagacuucucu

SEQ ID NO: 1056004 - RNA, 19 nt, Homo sapiens
gagaugagggcugugauua

SEQ ID NO: 1056005 - RNA, 19 nt, Homo sapiens
cauaucgucuguauugaaa

SEQ ID NO: 1056006 - RNA, 19 nt, Homo sapiens
gaucccaacuuuccuaaca

SEQ ID NO: 1056007 - RNA, 19 nt, Homo sapiens
caauauggcucagaaagug

SEQ ID NO: 1056008 - RNA, 19 nt, Homo sapiens
ggucguuuaucagcaauua

SEQ ID NO: 1056009 - RNA, 19 nt, Homo sapiens
gagcauaacauccgcaaug

SEQ ID NO: 1056010 - RNA, 19 nt, Homo sapiens
cagaagacuuugugaccua

SEQ ID NO: 1056011 - RNA, 19 nt, Homo sapiens
gccaacaaguaccaagaua

SEQ ID NO: 1056012 - RNA, 19 nt, Homo sapiens
cauaaagaguuguggauca

SEQ ID NO: 1056013 - RNA, 19 nt, Homo sapiens
gagagccgcuacaaugaga

SEQ ID NO: 1056014 - RNA, 19 nt, Homo sapiens
gagugacuauuacaacaaa

SEQ ID NO: 1056015 - RNA, 19 nt, Homo sapiens
gaacgagcaagaaggauga

SEQ ID NO: 1056016 - RNA, 19 nt, Homo sapiens
ggaaauguccaauggugaa

SEQ ID NO: 1056017 - RNA, 19 nt, Homo sapiens
gaagaugucccuguggaaa

SEQ ID NO: 1056018 - RNA, 19 nt, Homo sapiens
auaaugauguggagaaaga

SEQ ID NO: 1056019 - RNA, 19 nt, Homo sapiens
ugaguugccugacuacuau

SEQ ID NO: 1056020 - RNA, 19 nt, Homo sapiens
ccaagaaagcagaauauga

SEQ ID NO: 1056021 - RNA, 19 nt, Homo sapiens
agugguagaugaugaaauu

SEQ ID NO: 1056022 - RNA, 19 nt, Homo sapiens
ggagaaagagagaaaggaa

SEQ ID NO: 1056023 - RNA, 19 nt, Homo sapiens
gcauaaugauguggagaaa

SEQ ID NO: 1056024 - RNA, 19 nt, Homo sapiens
cuacagcgauucuuuagca

SEQ ID NO: 1056025 - RNA, 19 nt, Homo sapiens
gcacauauccuggagaagu

SEQ ID NO: 1056026 - RNA, 19 nt, Homo sapiens
gaggagacuuuccaaucuu

SEQ ID NO: 1056027 - RNA, 19 nt, Homo sapiens
aagcaucacuuccuuuaug

SEQ ID NO: 1056028 - RNA, 19 nt, Homo sapiens
caauggcacuucaauaugg

SEQ ID NO: 1056029 - RNA, 19 nt, Homo sapiens
ggaggucguuuaucagcaa

SEQ ID NO: 1056030 - RNA, 19 nt, Homo sapiens
gcaaaguccuauuauaagc

SEQ ID NO: 1056031 - RNA, 19 nt, Homo sapiens
aaagaguuguggaucagua

SEQ ID NO: 1056032 - RNA, 19 nt, Homo sapiens
gaugagggcugugauuaag

SEQ ID NO: 1056033 - RNA, 19 nt, Homo sapiens
ggucauguuugucaaggaa

SEQ ID NO: 1056034 - RNA, 19 nt, Homo sapiens
gaagaauacagacaacuca

SEQ ID NO: 1056035 - RNA, 19 nt, Homo sapiens
guacaaggaggucguuuau

SEQ ID NO: 1056036 - RNA, 19 nt, Homo sapiens
uaagucaagucuucgaaug

SEQ ID NO: 1056037 - RNA, 19 nt, Homo sapiens
cgaagaugaugaugaagau

SEQ ID NO: 1056038 - RNA, 19 nt, Homo sapiens
caaaggcagugcaaagaag

SEQ ID NO: 1056039 - RNA, 19 nt, Homo sapiens
cuaaagugguagaugauga

SEQ ID NO: 1056040 - RNA, 19 nt, Homo sapiens
acaaugcaaaguccuauua

SEQ ID NO: 1056041 - RNA, 19 nt, Homo sapiens
gagaugaugauauugaaga

SEQ ID NO: 1056042 - RNA, 19 nt, Homo sapiens
guuagaagguggagaugau

SEQ ID NO: 1056043 - RNA, 19 nt, Homo sapiens
guaccaagauauugacucu

SEQ ID NO: 1056044 - RNA, 19 nt, Homo sapiens
gaagagggaaugauagaag

SEQ ID NO: 1056045 - RNA, 19 nt, Homo sapiens
gcgacaagcagaugaagaa

SEQ ID NO: 1056046 - RNA, 19 nt, Homo sapiens
caaaagaaauagaggaaga

SEQ ID NO: 1056047 - RNA, 19 nt, Homo sapiens
ucugugagcucuucauuag

SEQ ID NO: 1056048 - RNA, 19 nt, Homo sapiens
ggaaggcuccaaacggaaa

SEQ ID NO: 1056049 - RNA, 19 nt, Homo sapiens
ugaguaaucuggaagaaac

SEQ ID NO: 1056050 - RNA, 19 nt, Homo sapiens
agccaggacuguagcuuua

SEQ ID NO: 1056051 - RNA, 19 nt, Homo sapiens
caaaauacaugacuccaau

SEQ ID NO: 1056052 - RNA, 19 nt, Homo sapiens
cauccgcaaugacaaauau

SEQ ID NO: 1056053 - RNA, 19 nt, Homo sapiens
uaagaaagcagcgaaugaa

SEQ ID NO: 1056054 - RNA, 19 nt, Homo sapiens
uaaccaagggcagcuaaua

SEQ ID NO: 1056055 - RNA, 19 nt, Homo sapiens
agaagcagaugacgaagau

SEQ ID NO: 1056056 - RNA, 19 nt, Homo sapiens
caaccagacuauuaugaag

SEQ ID NO: 1056057 - RNA, 19 nt, Homo sapiens
gcaccaaagcgaagaaauc

SEQ ID NO: 1056058 - RNA, 19 nt, Homo sapiens
caacugaaauaccagaaaa

SEQ ID NO: 1056059 - RNA, 19 nt, Homo sapiens
cggaaagugugcuguguug

SEQ ID NO: 1056060 - RNA, 19 nt, Homo sapiens
gaacaaaggaggauaauuu

SEQ ID NO: 1056061 - RNA, 19 nt, Homo sapiens
gaaaucaaccagacuauua

SEQ ID NO: 1056062 - RNA, 19 nt, Homo sapiens
gaaaugaguuuguucagaa

SEQ ID NO: 1056063 - RNA, 19 nt, Homo sapiens
gaacaaaacugaagaauca

SEQ ID NO: 1056064 - RNA, 19 nt, Homo sapiens
ugaagaagaugcugcuuua

SEQ ID NO: 1056065 - RNA, 19 nt, Homo sapiens
gaaacugccuucuaaagug

SEQ ID NO: 1056066 - RNA, 19 nt, Homo sapiens
ggacuauccugauuauuau

SEQ ID NO: 1056067 - RNA, 19 nt, Homo sapiens
gggacuauccugauuauua

SEQ ID NO: 1056068 - RNA, 19 nt, Homo sapiens
gaaagaagauucaguugcu

SEQ ID NO: 1056069 - RNA, 19 nt, Homo sapiens
ugacauggcuucucccaaa

SEQ ID NO: 1056070 - RNA, 19 nt, Homo sapiens
caacaaaguuccaguuagu

SEQ ID NO: 1056071 - RNA, 19 nt, Homo sapiens
gagcauauguuugaaguau

SEQ ID NO: 1056072 - RNA, 19 nt, Homo sapiens
gaaacuaaaugaggucuau

SEQ ID NO: 1056073 - RNA, 19 nt, Homo sapiens
ggacagauucagaaauaua

SEQ ID NO: 1056074 - RNA, 19 nt, Homo sapiens
ggaagaguaugaugauguu

SEQ ID NO: 1056075 - RNA, 19 nt, Homo sapiens
caagaaagcagaauaugaa

SEQ ID NO: 1056076 - RNA, 19 nt, Homo sapiens
gaagaaaccugccccauga

SEQ ID NO: 1056077 - RNA, 19 nt, Homo sapiens
gcacucagcuauaccacaa

SEQ ID NO: 1056078 - RNA, 19 nt, Homo sapiens
gaucugaguugccugacua

SEQ ID NO: 1056079 - RNA, 19 nt, Homo sapiens
ggagugugaucugaauuua

SEQ ID NO: 1056080 - RNA, 19 nt, Homo sapiens
ccacauaucgucuguauug

SEQ ID NO: 1056081 - RNA, 19 nt, Homo sapiens
gcauauguuugaaguauug

SEQ ID NO: 1056082 - RNA, 19 nt, Homo sapiens
ugacgaagaugaugaugaa

SEQ ID NO: 1056083 - RNA, 19 nt, Homo sapiens
acaagcagaugaagaaauu

SEQ ID NO: 1056084 - RNA, 19 nt, Homo sapiens
gagcuuauccacaaucuuu

SEQ ID NO: 1056085 - RNA, 19 nt, Homo sapiens
gcuauaaugugcccaauuc

SEQ ID NO: 1056086 - RNA, 19 nt, Homo sapiens
guuaggaguugucggaaua

SEQ ID NO: 1056087 - RNA, 19 nt, Homo sapiens
gaagaaaucaaccagacua

SEQ ID NO: 1056088 - RNA, 19 nt, Homo sapiens
gcaaguguguggucauguu

SEQ ID NO: 1056089 - RNA, 19 nt, Homo sapiens
acaaggaggucguuuauca

SEQ ID NO: 1056090 - RNA, 19 nt, Homo sapiens
ucggacagauucagaaaua

SEQ ID NO: 1056091 - RNA, 19 nt, Homo sapiens
ggaagaugcuacagcgauu

SEQ ID NO: 1056092 - RNA, 19 nt, Homo sapiens
gcucccagguuuauaauga

SEQ ID NO: 1056093 - RNA, 19 nt, Homo sapiens
ggaggagacuuuccaaucu

SEQ ID NO: 1056094 - RNA, 19 nt, Homo sapiens
gaagaaauucaaaggauug

SEQ ID NO: 1056095 - RNA, 19 nt, Homo sapiens
caacaaguaccaagauauu

SEQ ID NO: 1056096 - RNA, 19 nt, Homo sapiens
ugacaaauaugcuggugaa

SEQ ID NO: 1056097 - RNA, 19 nt, Homo sapiens
gaagagagaaaucccacua

SEQ ID NO: 1056098 - RNA, 19 nt, Homo sapiens
ccaauggacuugaaaauaa

SEQ ID NO: 1056099 - RNA, 19 nt, Homo sapiens
gccaugaacucuauaauac

SEQ ID NO: 1056100 - RNA, 19 nt, Homo sapiens
caacaugaguggcuacauc

SEQ ID NO: 1056101 - RNA, 19 nt, Homo sapiens
gaaagacugugggaggauu

SEQ ID NO: 1056102 - RNA, 19 nt, Homo sapiens
caaauaugcuggugaagag

SEQ ID NO: 1056103 - RNA, 19 nt, Homo sapiens
ugacauguauucucggaaa

SEQ ID NO: 1056104 - RNA, 19 nt, Homo sapiens
gagauggagcugcauauuu

SEQ ID NO: 1056105 - RNA, 19 nt, Homo sapiens
ugacuuugcugauucaaga

SEQ ID NO: 1056106 - RNA, 19 nt, Homo sapiens
gaacagggcagacuucucu

SEQ ID NO: 1056107 - RNA, 19 nt, Homo sapiens
gagaugagggcugugauua

SEQ ID NO: 1056108 - RNA, 19 nt, Homo sapiens
cauaucgucuguauugaaa

SEQ ID NO: 1056109 - RNA, 19 nt, Homo sapiens
gaucccaacuuuccuaaca

SEQ ID NO: 1056110 - RNA, 19 nt, Homo sapiens
caauauggcucagaaagug

SEQ ID NO: 1056111 - RNA, 19 nt, Homo sapiens
ggucguuuaucagcaauua

SEQ ID NO: 1056112 - RNA, 19 nt, Homo sapiens
gagcauaacauccgcaaug

SEQ ID NO: 1056113 - RNA, 19 nt, Homo sapiens
cagaagacuuugugaccua

SEQ ID NO: 1056114 - RNA, 19 nt, Homo sapiens
acaaugaaccggagucuuu

SEQ ID NO: 1056115 - RNA, 19 nt, Homo sapiens
gccaacaaguaccaagaua

SEQ ID NO: 1056116 - RNA, 19 nt, Homo sapiens
cauaaagaguuguggauca

SEQ ID NO: 1056117 - RNA, 19 nt, Homo sapiens
gagagccgcuacaaugaga

SEQ ID NO: 1056118 - RNA, 19 nt, Homo sapiens
gagugacuauuacaacaaa

SEQ ID NO: 1056119 - RNA, 19 nt, Homo sapiens
gaacgagcaagaaggauga

SEQ ID NO: 1056120 - RNA, 19 nt, Homo sapiens
ggaaauguccaauggugaa

SEQ ID NO: 1056121 - RNA, 19 nt, Homo sapiens
gaagaugucccuguggaaa

SEQ ID NO: 1056122 - RNA, 19 nt, Homo sapiens
auaaugauguggagaaaga

SEQ ID NO: 1056123 - RNA, 19 nt, Homo sapiens
ugaguugccugacuacuau

SEQ ID NO: 1056124 - RNA, 19 nt, Homo sapiens
ccaagaaagcagaauauga

SEQ ID NO: 1056125 - RNA, 19 nt, Homo sapiens
agugguagaugaugaaauu

SEQ ID NO: 1056126 - RNA, 19 nt, Homo sapiens
gaggagacuuuccaaucuu

SEQ ID NO: 1056127 - RNA, 19 nt, Homo sapiens
ggagaaagagagaaaggaa

SEQ ID NO: 1056128 - RNA, 19 nt, Homo sapiens
gcauaaugauguggagaaa

SEQ ID NO: 1056129 - RNA, 19 nt, Homo sapiens
cuacagcgauucuuuagca

SEQ ID NO: 1056130 - RNA, 19 nt, Homo sapiens
gaaccggagucuuugaucu

SEQ ID NO: 1056131 - RNA, 19 nt, Homo sapiens
gcacauauccuggagaagu

SEQ ID NO: 1056132 - RNA, 19 nt, Homo sapiens
aagcaucacuuccuuuaug

SEQ ID NO: 1056133 - RNA, 19 nt, Homo sapiens
caauggcacuucaauaugg

SEQ ID NO: 1056134 - RNA, 19 nt, Homo sapiens
ggaggucguuuaucagcaa

SEQ ID NO: 1056135 - RNA, 19 nt, Homo sapiens
gcaaaguccuauuauaagc

SEQ ID NO: 1056136 - RNA, 19 nt, Homo sapiens
aaagaguuguggaucagua

SEQ ID NO: 1056137 - RNA, 19 nt, Homo sapiens
gaugagggcugugauuaag

SEQ ID NO: 1056138 - RNA, 19 nt, Homo sapiens
ggucauguuugucaaggaa

SEQ ID NO: 1056139 - RNA, 19 nt, Homo sapiens
gaaaucccacuagcaagua

SEQ ID NO: 1056140 - RNA, 19 nt, Homo sapiens
gaagaauacagacaacuca

SEQ ID NO: 1056141 - RNA, 19 nt, Homo sapiens
guacaaggaggucguuuau

SEQ ID NO: 1056142 - RNA, 19 nt, Homo sapiens
uaagucaagucuucgaaug

SEQ ID NO: 1056143 - RNA, 19 nt, Homo sapiens
cgaagaugaugaugaagau

SEQ ID NO: 1056144 - RNA, 19 nt, Homo sapiens
caaaggcagugcaaagaag

SEQ ID NO: 1056145 - RNA, 19 nt, Homo sapiens
cuaaagugguagaugauga

SEQ ID NO: 1056146 - RNA, 19 nt, Homo sapiens
acaaugcaaaguccuauua

SEQ ID NO: 1056147 - RNA, 19 nt, Homo sapiens
gagaugaugauauugaaga

SEQ ID NO: 1056148 - RNA, 19 nt, Homo sapiens
guuagaagguggagaugau

SEQ ID NO: 1056149 - RNA, 19 nt, Homo sapiens
guaccaagauauugacucu

SEQ ID NO: 1056150 - RNA, 19 nt, Homo sapiens
gaagagggaaugauagaag

SEQ ID NO: 1056151 - RNA, 19 nt, Homo sapiens
gcgacaagcagaugaagaa

SEQ ID NO: 1056152 - RNA, 19 nt, Homo sapiens
caaaagaaauagaggaaga

SEQ ID NO: 1056153 - RNA, 19 nt, Homo sapiens
ucugugagcucuucauuag

SEQ ID NO: 1056154 - RNA, 19 nt, Homo sapiens
ggaaggcuccaaacggaaa

SEQ ID NO: 1056155 - RNA, 19 nt, Homo sapiens
ugaguaaucuggaagaaac

SEQ ID NO: 1056156 - RNA, 19 nt, Homo sapiens
agccaggacuguagcuuua

SEQ ID NO: 1056157 - RNA, 19 nt, Homo sapiens
caaaauacaugacuccaau

SEQ ID NO: 1056158 - RNA, 19 nt, Homo sapiens
cauccgcaaugacaaauau

SEQ ID NO: 1056159 - RNA, 19 nt, Homo sapiens
uaagaaagcagcgaaugaa

SEQ ID NO: 1056160 - RNA, 19 nt, Homo sapiens
gaggugaagugaccaaaug

SEQ ID NO: 1056161 - RNA, 19 nt, Homo sapiens
gaagugaccaaaugaaaga

SEQ ID NO: 1056162 - RNA, 19 nt, Homo sapiens
gaucagagagcagcagauu

SEQ ID NO: 1056163 - RNA, 19 nt, Homo sapiens
gaagggacauggaguugcu

SEQ ID NO: 1056164 - RNA, 19 nt, Homo sapiens
gagagcagcagauucaaau

SEQ ID NO: 1056165 - RNA, 19 nt, Homo sapiens
guuucuagcucaggcuuua

SEQ ID NO: 1056166 - RNA, 19 nt, Homo sapiens
ucagagagcagcagauuca

SEQ ID NO: 1056167 - RNA, 19 nt, Homo sapiens
gggaagaggagcagcuuug

SEQ ID NO: 1056168 - RNA, 19 nt, Homo sapiens
gugaagugaccaaaugaaa

SEQ ID NO: 1056169 - RNA, 19 nt, Homo sapiens
ggagcagcuuugccuggaa

SEQ ID NO: 1056170 - RNA, 19 nt, Homo sapiens
ccacagcucccaggugcua

SEQ ID NO: 1056171 - RNA, 19 nt, Homo sapiens
gguaaagucaauucaaucu

SEQ ID NO: 1056172 - RNA, 19 nt, Homo sapiens
auucaaauccugacgguuu

SEQ ID NO: 1056173 - RNA, 19 nt, Homo sapiens
gagcuuuggccucuacuuc

SEQ ID NO: 1056174 - RNA, 19 nt, Homo sapiens
gaagaggugaagugaccaa

SEQ ID NO: 1056175 - RNA, 19 nt, Homo sapiens
ccgcaugcacuauuacuga

SEQ ID NO: 1056176 - RNA, 19 nt, Homo sapiens
uaccggaccuguacaugag

SEQ ID NO: 1056177 - RNA, 19 nt, Homo sapiens
agacuccguuuacuugauc

SEQ ID NO: 1056178 - RNA, 19 nt, Homo sapiens
gugaccaaaugaaagaaag

SEQ ID NO: 1056179 - RNA, 19 nt, Homo sapiens
ggugaagugaccaaaugaa

SEQ ID NO: 1056180 - RNA, 19 nt, Homo sapiens
gcgaagggacauggaguug

SEQ ID NO: 1056181 - RNA, 19 nt, Homo sapiens
ugaagugaccaaaugaaag

SEQ ID NO: 1056182 - RNA, 19 nt, Homo sapiens
caauucaaucucuccaaga

SEQ ID NO: 1056183 - RNA, 19 nt, Homo sapiens
cgaugaagaggugaaguga

SEQ ID NO: 1056184 - RNA, 19 nt, Homo sapiens
agagagcagcagauucaaa

SEQ ID NO: 1056185 - RNA, 19 nt, Homo sapiens
gaaguggggauaaugguau

SEQ ID NO: 1056186 - RNA, 19 nt, Homo sapiens
ucacgucgcaggguuguca

SEQ ID NO: 1056187 - RNA, 19 nt, Homo sapiens
ggggagcggugguuucuag

SEQ ID NO: 1056188 - RNA, 19 nt, Homo sapiens
ggaaaugacugcuuuguaa

SEQ ID NO: 1056189 - RNA, 19 nt, Homo sapiens
gaacagaggucccggaaau

SEQ ID NO: 1056190 - RNA, 19 nt, Homo sapiens
gaagaucguugugaauuaa

SEQ ID NO: 1056191 - RNA, 19 nt, Homo sapiens
gaaacugagugcuuugaaa

SEQ ID NO: 1056192 - RNA, 19 nt, Homo sapiens
gaacacagagaaacaagua

SEQ ID NO: 1056193 - RNA, 19 nt, Homo sapiens
ucacuuaggucacuuucua

SEQ ID NO: 1056194 - RNA, 19 nt, Homo sapiens
aaaugcagcuccauguuua

SEQ ID NO: 1056195 - RNA, 19 nt, Homo sapiens
ggagaggcaagaauuaaua

SEQ ID NO: 1056196 - RNA, 19 nt, Homo sapiens
ugaaggaaaugacugcuuu

SEQ ID NO: 1056197 - RNA, 19 nt, Homo sapiens
gagauaaugucacguguag

SEQ ID NO: 1056198 - RNA, 19 nt, Homo sapiens
agaagaucguugugaauua

SEQ ID NO: 1056199 - RNA, 19 nt, Homo sapiens
gcacaaagcaaagcaggua

SEQ ID NO: 1056200 - RNA, 19 nt, Homo sapiens
ccacuucccucgcagcuuu

SEQ ID NO: 1056201 - RNA, 19 nt, Homo sapiens
aaaguagacuggagacaaa

SEQ ID NO: 1056202 - RNA, 19 nt, Homo sapiens
gauaaugucacguguagaa

SEQ ID NO: 1056203 - RNA, 19 nt, Homo sapiens
acagagagccuacaggaua

SEQ ID NO: 1056204 - RNA, 19 nt, Homo sapiens
gaacugacuuugcaucacu

SEQ ID NO: 1056205 - RNA, 19 nt, Homo sapiens
aaagugaguuucuaaagga

SEQ ID NO: 1056206 - RNA, 19 nt, Homo sapiens
ggagauagagguugcaaug

SEQ ID NO: 1056207 - RNA, 19 nt, Homo sapiens
ggacaaugcacaaagcaaa

SEQ ID NO: 1056208 - RNA, 19 nt, Homo sapiens
aaacugguauggaagauau

SEQ ID NO: 1056209 - RNA, 19 nt, Homo sapiens
gaaaugacugcuuuguaaa

SEQ ID NO: 1056210 - RNA, 19 nt, Homo sapiens
ccaaauggaguuaaagaaa

SEQ ID NO: 1056211 - RNA, 19 nt, Homo sapiens
gcaaagcagguacuagaaa

SEQ ID NO: 1056212 - RNA, 19 nt, Homo sapiens
caagaaaacugguauggaa

SEQ ID NO: 1056213 - RNA, 19 nt, Homo sapiens
cuuccaaacugauauauga

SEQ ID NO: 1056214 - RNA, 19 nt, Homo sapiens
gaaauucaaaggauacaga

SEQ ID NO: 1056215 - RNA, 19 nt, Homo sapiens
gaacagacaauauuugcau

SEQ ID NO: 1056216 - RNA, 19 nt, Homo sapiens
aaacagaaguugccagucu

SEQ ID NO: 1056217 - RNA, 19 nt, Homo sapiens
ccucgcagcuuuccucuga

SEQ ID NO: 1056218 - RNA, 19 nt, Homo sapiens
guaaacuucugaaaugcuu

SEQ ID NO: 1056219 - RNA, 19 nt, Homo sapiens
gaggacagcaaaucacuuu

SEQ ID NO: 1056220 - RNA, 19 nt, Homo sapiens
ucauuaaccuagaaacuga

SEQ ID NO: 1056221 - RNA, 19 nt, Homo sapiens
uaacugcugucccuggaaa

SEQ ID NO: 1056222 - RNA, 19 nt, Homo sapiens
gaaaugggccugagucacu

SEQ ID NO: 1056223 - RNA, 19 nt, Homo sapiens
uaaaugcagcuccauguuu

SEQ ID NO: 1056224 - RNA, 19 nt, Homo sapiens
caugugcuguuaacuauug

SEQ ID NO: 1056225 - RNA, 19 nt, Homo sapiens
uaacaaguccgucacaugu

SEQ ID NO: 1056226 - RNA, 19 nt, Homo sapiens
ggauacacgugagauaaug

SEQ ID NO: 1056227 - RNA, 19 nt, Homo sapiens
gagcuaaccguaacagaga

SEQ ID NO: 1056228 - RNA, 19 nt, Homo sapiens
ccuagaaacugagugcuuu

SEQ ID NO: 1056229 - RNA, 19 nt, Homo sapiens
ucacaugugcuguuaacua

SEQ ID NO: 1056230 - RNA, 19 nt, Homo sapiens
cacaugugcuguuaacuau

SEQ ID NO: 1056231 - RNA, 19 nt, Homo sapiens
gagaggcaagaauuaauaa

SEQ ID NO: 1056232 - RNA, 19 nt, Homo sapiens
gcugccaccuuuacaagaa

SEQ ID NO: 1056233 - RNA, 19 nt, Homo sapiens
guaaagcgaggguaaacuu

SEQ ID NO: 1056234 - RNA, 19 nt, Homo sapiens
cuucugaaaugcuuugauu

SEQ ID NO: 1056235 - RNA, 19 nt, Homo sapiens
ggguucaucuuugacauuu

SEQ ID NO: 1056236 - RNA, 19 nt, Homo sapiens
ucauagaacugacuuugca

SEQ ID NO: 1056237 - RNA, 19 nt, Homo sapiens
cauguugccugaugaaauc

SEQ ID NO: 1056238 - RNA, 19 nt, Homo sapiens
uguagaagaucguugugaa

SEQ ID NO: 1056239 - RNA, 19 nt, Homo sapiens
aggguaaacuucugaaaug

SEQ ID NO: 1056240 - RNA, 19 nt, Homo sapiens
acagagagaaucccacuuu

SEQ ID NO: 1056241 - RNA, 19 nt, Homo sapiens
gacaagaggcccaaaugga

SEQ ID NO: 1056242 - RNA, 19 nt, Homo sapiens
aaacuccaauguauacuuc

SEQ ID NO: 1056243 - RNA, 19 nt, Homo sapiens
acaaauagaugggcuggau

SEQ ID NO: 1056244 - RNA, 19 nt, Homo sapiens
caaggaaugaugaccauga

SEQ ID NO: 1056245 - RNA, 19 nt, Homo sapiens
ccagagacauguauuuuga

SEQ ID NO: 1056246 - RNA, 19 nt, Homo sapiens
gacuacauuuggacuacua

SEQ ID NO: 1056247 - RNA, 19 nt, Homo sapiens
aaugcaaacuccaauguau

SEQ ID NO: 1056248 - RNA, 19 nt, Homo sapiens
ugacuugccacgaguaauu

SEQ ID NO: 1056249 - RNA, 19 nt, Homo sapiens
cacagagaaacaaguauua

SEQ ID NO: 1056250 - RNA, 19 nt, Homo sapiens
gaggugggcagaucacuug

SEQ ID NO: 1056251 - RNA, 19 nt, Homo sapiens
uaaccauguugccugauga

SEQ ID NO: 1056252 - RNA, 19 nt, Homo sapiens
caaagcagguacuagaaaa

SEQ ID NO: 1056253 - RNA, 19 nt, Homo sapiens
gaggguaaacuucugaaau

SEQ ID NO: 1056254 - RNA, 19 nt, Homo sapiens
cuaaaggaaauucacagua

SEQ ID NO: 1056255 - RNA, 19 nt, Homo sapiens
guagacuggagacaaauaa

SEQ ID NO: 1056256 - RNA, 19 nt, Homo sapiens
uagaccagcuuggaguuaa

SEQ ID NO: 1056257 - RNA, 19 nt, Homo sapiens
ggcaagaauuaauaagcaa

SEQ ID NO: 1056258 - RNA, 19 nt, Homo sapiens
aaacaucaagcagugaaua

SEQ ID NO: 1056259 - RNA, 19 nt, Homo sapiens
cauggagaggcaagaauua

SEQ ID NO: 1056260 - RNA, 19 nt, Homo sapiens
guaaaugcagcuccauguu

SEQ ID NO: 1056261 - RNA, 19 nt, Homo sapiens
uagaagaucguugugaauu

SEQ ID NO: 1056262 - RNA, 19 nt, Homo sapiens
caagcaauccagaaucuuc

SEQ ID NO: 1056263 - RNA, 19 nt, Homo sapiens
cauauucacuggcaagacu

SEQ ID NO: 1056264 - RNA, 19 nt, Homo sapiens
caggauacacgugagauaa

SEQ ID NO: 1056265 - RNA, 19 nt, Homo sapiens
cagcuucucugggacaguu

SEQ ID NO: 1056266 - RNA, 19 nt, Homo sapiens
gaaaugauccguaaaagac

SEQ ID NO: 1056267 - RNA, 19 nt, Homo sapiens
aagcaaagcagguacuaga

SEQ ID NO: 1056268 - RNA, 19 nt, Homo sapiens
acacagagaaacaaguauu

SEQ ID NO: 1056269 - RNA, 19 nt, Homo sapiens
ucaaucagaauuuggaaga

SEQ ID NO: 1056270 - RNA, 19 nt, Homo sapiens
gacuuugcauucaaucaga

SEQ ID NO: 1056271 - RNA, 19 nt, Homo sapiens
gcaaugagccaagaucacu

SEQ ID NO: 1056272 - RNA, 19 nt, Homo sapiens
gcuuggaguuaaugcagaa

SEQ ID NO: 1056273 - RNA, 19 nt, Homo sapiens
ucuguugguuaaagucaua

SEQ ID NO: 1056274 - RNA, 19 nt, Homo sapiens
ggaagauauucuacagcau

SEQ ID NO: 1056275 - RNA, 19 nt, Homo sapiens
gaaggaaaugacugcuuug

SEQ ID NO: 1056276 - RNA, 19 nt, Homo sapiens
caaucagaauuuggaagaa

SEQ ID NO: 1056277 - RNA, 19 nt, Homo sapiens
agauagagguugcaaugag

SEQ ID NO: 1056278 - RNA, 19 nt, Homo sapiens
caaaagcaauugucucaag

SEQ ID NO: 1056279 - RNA, 19 nt, Homo sapiens
aaacaaagagguagagacu

SEQ ID NO: 1056280 - RNA, 19 nt, Homo sapiens
gagaacagacaauauuugc

SEQ ID NO: 1056281 - RNA, 19 nt, Homo sapiens
gagauagagguugcaauga

SEQ ID NO: 1056282 - RNA, 19 nt, Homo sapiens
gaaggaugccaugaaggaa

SEQ ID NO: 1056283 - RNA, 19 nt, Homo sapiens
ugaugaccaugaccuucua

SEQ ID NO: 1056284 - RNA, 19 nt, Homo sapiens
gcagcuccauguuuagcau

SEQ ID NO: 1056285 - RNA, 19 nt, Homo sapiens
caccgucucuacuaaaaua

SEQ ID NO: 1056286 - RNA, 19 nt, Homo sapiens
gcagcuuuccucugaaugu

SEQ ID NO: 1056287 - RNA, 19 nt, Homo sapiens
gaccaugaccuucuaacca

SEQ ID NO: 1056288 - RNA, 19 nt, Homo sapiens
ggacaacguuuaaacauua

SEQ ID NO: 1056289 - RNA, 19 nt, Homo sapiens
gaacauaugagaccaagua

SEQ ID NO: 1056290 - RNA, 19 nt, Homo sapiens
ccaggaagcuucauaaaga

SEQ ID NO: 1056291 - RNA, 19 nt, Homo sapiens
gaaaugccaugauaaagau

SEQ ID NO: 1056292 - RNA, 19 nt, Homo sapiens
ugaaccagauuuaccauua

SEQ ID NO: 1056293 - RNA, 19 nt, Homo sapiens
gaauagaguuggguuuaaa

SEQ ID NO: 1056294 - RNA, 19 nt, Homo sapiens
caagagagagauaauguua

SEQ ID NO: 1056295 - RNA, 19 nt, Homo sapiens
cgaaagagccauuguuaaa

SEQ ID NO: 1056296 - RNA, 19 nt, Homo sapiens
gaaagcgaguucaucuaaa

SEQ ID NO: 1056297 - RNA, 19 nt, Homo sapiens
gcgaguucaucuaaauuua

SEQ ID NO: 1056298 - RNA, 19 nt, Homo sapiens
caagggaacguauuagaua

SEQ ID NO: 1056299 - RNA, 19 nt, Homo sapiens
gaaccagauuuaccauuau

SEQ ID NO: 1056300 - RNA, 19 nt, Homo sapiens
gaagcagccugauaaaaua

SEQ ID NO: 1056301 - RNA, 19 nt, Homo sapiens
gcagaccucuaaagaauca

SEQ ID NO: 1056302 - RNA, 19 nt, Homo sapiens
gugcagaccucuaaagaau

SEQ ID NO: 1056303 - RNA, 19 nt, Homo sapiens
aaugagaaaugccaugaua

SEQ ID NO: 1056304 - RNA, 19 nt, Homo sapiens
uaaaugcacugaacgugaa

SEQ ID NO: 1056305 - RNA, 19 nt, Homo sapiens
uaaagaagcuccgaguaau

SEQ ID NO: 1056306 - RNA, 19 nt, Homo sapiens
gaaauucuacccaucuuga

SEQ ID NO: 1056307 - RNA, 19 nt, Homo sapiens
aaagagccauuguuaaaga

SEQ ID NO: 1056308 - RNA, 19 nt, Homo sapiens
ggugaaagguaacacagaa

SEQ ID NO: 1056309 - RNA, 19 nt, Homo sapiens
gggacaacguuuaaacauu

SEQ ID NO: 1056310 - RNA, 19 nt, Homo sapiens
gaagcucaauucagccaaa

SEQ ID NO: 1056311 - RNA, 19 nt, Homo sapiens
ggagcuacauucaaauuag

SEQ ID NO: 1056312 - RNA, 19 nt, Homo sapiens
uaaaauggcuugagaacuu

SEQ ID NO: 1056313 - RNA, 19 nt, Homo sapiens
cgaaagcgaguucaucuaa

SEQ ID NO: 1056314 - RNA, 19 nt, Homo sapiens
gaacguauuagauauggaa

SEQ ID NO: 1056315 - RNA, 19 nt, Homo sapiens
gaaagacagccaagagaga

SEQ ID NO: 1056316 - RNA, 19 nt, Homo sapiens
gauaaagauuucucagagu

SEQ ID NO: 1056317 - RNA, 19 nt, Homo sapiens
guccagauaucuuacuaaa

SEQ ID NO: 1056318 - RNA, 19 nt, Homo sapiens
cguauuagauauggaagua

SEQ ID NO: 1056319 - RNA, 19 nt, Homo sapiens
ccaaaugccuccccaagua

SEQ ID NO: 1056320 - RNA, 19 nt, Homo sapiens
ggaaaucaaaugagaaaca

SEQ ID NO: 1056321 - RNA, 19 nt, Homo sapiens
ggaaacaagguauuugaau

SEQ ID NO: 1056322 - RNA, 19 nt, Homo sapiens
gaauacaaacucuguggaa

SEQ ID NO: 1056323 - RNA, 19 nt, Homo sapiens
aaucaaacaugcuggaguu

SEQ ID NO: 1056324 - RNA, 19 nt, Homo sapiens
ugaauagaguuggguuuaa

SEQ ID NO: 1056325 - RNA, 19 nt, Homo sapiens
guaauaaagcaucgaagaa

SEQ ID NO: 1056326 - RNA, 19 nt, Homo sapiens
cauacaacauucuaaggaa

SEQ ID NO: 1056327 - RNA, 19 nt, Homo sapiens
uguaagaaauggaugguau

SEQ ID NO: 1056328 - RNA, 19 nt, Homo sapiens
ugagaaaugccaugauaaa

SEQ ID NO: 1056329 - RNA, 19 nt, Homo sapiens
ggaagcuucauaaagauaa

SEQ ID NO: 1056330 - RNA, 19 nt, Homo sapiens
aaagcgaguucaucuaaau

SEQ ID NO: 1056331 - RNA, 19 nt, Homo sapiens
ugugggagcuacauucaaa

SEQ ID NO: 1056332 - RNA, 19 nt, Homo sapiens
gaagaacggaaggauguaa

SEQ ID NO: 1056333 - RNA, 19 nt, Homo sapiens
uuacaaaggcagaagcaua

SEQ ID NO: 1056334 - RNA, 19 nt, Homo sapiens
aaaugggacuguaaauaug

SEQ ID NO: 1056335 - RNA, 19 nt, Homo sapiens
aaagaagcuccgaguaaua

SEQ ID NO: 1056336 - RNA, 19 nt, Homo sapiens
ccuaaggaguauuuacaaa

SEQ ID NO: 1056337 - RNA, 19 nt, Homo sapiens
ccacuuucauuguauuuca

SEQ ID NO: 1056338 - RNA, 19 nt, Homo sapiens
gaagacugguuaaaauuug

SEQ ID NO: 1056339 - RNA, 19 nt, Homo sapiens
auaaagaagcuccgaguaa

SEQ ID NO: 1056340 - RNA, 19 nt, Homo sapiens
agaaaugccaugauaaaga

SEQ ID NO: 1056341 - RNA, 19 nt, Homo sapiens
gggagcuacauucaaauua

SEQ ID NO: 1056342 - RNA, 19 nt, Homo sapiens
gaaaucaaaugagaaacac

SEQ ID NO: 1056343 - RNA, 19 nt, Homo sapiens
gaaagagccauuguuaaag

SEQ ID NO: 1056344 - RNA, 19 nt, Homo sapiens
uuucaaaccuacaaacaga

SEQ ID NO: 1056345 - RNA, 19 nt, Homo sapiens
caugcuggaguuuaaauua

SEQ ID NO: 1056346 - RNA, 19 nt, Homo sapiens
gguugaaaguugugggaaa

SEQ ID NO: 1056347 - RNA, 19 nt, Homo sapiens
uacaaaggcagaagcauaa

SEQ ID NO: 1056348 - RNA, 19 nt, Homo sapiens
ggaaugcuuauacaaauca

SEQ ID NO: 1056349 - RNA, 19 nt, Homo sapiens
agaguuugguucccacuuu

SEQ ID NO: 1056350 - RNA, 19 nt, Homo sapiens
gcacugaacgugaaagcau

SEQ ID NO: 1056351 - RNA, 19 nt, Homo sapiens
agaccaagggaacguauua

SEQ ID NO: 1056352 - RNA, 19 nt, Homo sapiens
uaaggaguauuuacaaagg

SEQ ID NO: 1056353 - RNA, 19 nt, Homo sapiens
uacaaacucuguggaagaa

SEQ ID NO: 1056354 - RNA, 19 nt, Homo sapiens
gauaagagacaggaaaaua

SEQ ID NO: 1056355 - RNA, 19 nt, Homo sapiens
aagcauuucucucaccaaa

SEQ ID NO: 1056356 - RNA, 19 nt, Homo sapiens
ggaagcagccugauaaaau

SEQ ID NO: 1056357 - RNA, 19 nt, Homo sapiens
gugggaagcagccugauaa

SEQ ID NO: 1056358 - RNA, 19 nt, Homo sapiens
gaagaaaaucugugugaaa

SEQ ID NO: 1056359 - RNA, 19 nt, Homo sapiens
ucugcaaguuucaggaaua

SEQ ID NO: 1056360 - RNA, 19 nt, Homo sapiens
aaagauuucucagaguuug

SEQ ID NO: 1056361 - RNA, 19 nt, Homo sapiens
uagcaguccuguaaaauaa

SEQ ID NO: 1056362 - RNA, 19 nt, Homo sapiens
aacgaaagagccauuguua

SEQ ID NO: 1056363 - RNA, 19 nt, Homo sapiens
aagaagcuccgaguaauaa

SEQ ID NO: 1056364 - RNA, 19 nt, Homo sapiens
gcagaagcauaaagaagcu

SEQ ID NO: 1056365 - RNA, 19 nt, Homo sapiens
guagccauguguaagaaau

SEQ ID NO: 1056366 - RNA, 19 nt, Homo sapiens
aaagauaagagacaggaaa

SEQ ID NO: 1056367 - RNA, 19 nt, Homo sapiens
guaagaaauggaugguauu

SEQ ID NO: 1056368 - RNA, 19 nt, Homo sapiens
ugaaaguugugggaaauca

SEQ ID NO: 1056369 - RNA, 19 nt, Homo sapiens
gagcuacauucaaauuagg

SEQ ID NO: 1056370 - RNA, 19 nt, Homo sapiens
cauaugagaccaaguaaac

SEQ ID NO: 1056371 - RNA, 19 nt, Homo sapiens
cauaaagaagcuccgagua

SEQ ID NO: 1056372 - RNA, 19 nt, Homo sapiens
gugaaacugaacacaauuu

SEQ ID NO: 1056373 - RNA, 19 nt, Homo sapiens
ucaguuaaggacuuguuua

SEQ ID NO: 1056374 - RNA, 19 nt, Homo sapiens
ucaaauuaggugacucuuu

SEQ ID NO: 1056375 - RNA, 19 nt, Homo sapiens
gggaaacaagguauuugaa

SEQ ID NO: 1056376 - RNA, 19 nt, Homo sapiens
ggaagaacggaaggaugua

SEQ ID NO: 1056377 - RNA, 19 nt, Homo sapiens
aaacaagaacagaaaggaa

SEQ ID NO: 1056378 - RNA, 19 nt, Homo sapiens
ugugggaaaucaaaugaga

SEQ ID NO: 1056379 - RNA, 19 nt, Homo sapiens
guugaaaguugugggaaau

SEQ ID NO: 1056380 - RNA, 19 nt, Homo sapiens
gguucccacuuucauugua

SEQ ID NO: 1056381 - RNA, 19 nt, Homo sapiens
gccaagagagagauaaugu

SEQ ID NO: 1056382 - RNA, 19 nt, Homo sapiens
caaauacuaagucuguaga

SEQ ID NO: 1056383 - RNA, 19 nt, Homo sapiens
caggaagcuucauaaagau

SEQ ID NO: 1056384 - RNA, 19 nt, Homo sapiens
ucaccaaauuagaaaguuc

SEQ ID NO: 1056385 - RNA, 19 nt, Homo sapiens
gaaaguugugggaaaucaa

SEQ ID NO: 1056386 - RNA, 19 nt, Homo sapiens
cagaaagacagccaagaga

SEQ ID NO: 1056387 - RNA, 19 nt, Homo sapiens
cugcaaguuucaggaauaa

SEQ ID NO: 1056388 - RNA, 19 nt, Homo sapiens
gcaacucacucgaauguua

SEQ ID NO: 1056389 - RNA, 19 nt, Homo sapiens
ggaagaguguuaucuauuu

SEQ ID NO: 1056390 - RNA, 19 nt, Homo sapiens
ggugacagaugcacaauua

SEQ ID NO: 1056391 - RNA, 19 nt, Homo sapiens
gauguagucuuguuucaua

SEQ ID NO: 1056392 - RNA, 19 nt, Homo sapiens
gaagaaaggucuguuuaug

SEQ ID NO: 1056393 - RNA, 19 nt, Homo sapiens
ggauaguccuguaguguua

SEQ ID NO: 1056394 - RNA, 19 nt, Homo sapiens
gaaagcaacucacucgaau

SEQ ID NO: 1056395 - RNA, 19 nt, Homo sapiens
ccaaguaguucugcaaaua

SEQ ID NO: 1056396 - RNA, 19 nt, Homo sapiens
ggguagauaugguaaauuu

SEQ ID NO: 1056397 - RNA, 19 nt, Homo sapiens
gaauguccuuucugaauuu

SEQ ID NO: 1056398 - RNA, 19 nt, Homo sapiens
ugagaaaucuuuagagaga

SEQ ID NO: 1056399 - RNA, 19 nt, Homo sapiens
uaaaguagccugagacauu

SEQ ID NO: 1056400 - RNA, 19 nt, Homo sapiens
gaagaaggcagacauuuau

SEQ ID NO: 1056401 - RNA, 19 nt, Homo sapiens
gaaagagcauaaauuggaa

SEQ ID NO: 1056402 - RNA, 19 nt, Homo sapiens
gaacuuucccuguuuguuu

SEQ ID NO: 1056403 - RNA, 19 nt, Homo sapiens
cuacuaaacugcuuuguau

SEQ ID NO: 1056404 - RNA, 19 nt, Homo sapiens
cagcaaacauucuuccuaa

SEQ ID NO: 1056405 - RNA, 19 nt, Homo sapiens
aaagacacgugaaaugaua

SEQ ID NO: 1056406 - RNA, 19 nt, Homo sapiens
guauguugcuggcagauua

SEQ ID NO: 1056407 - RNA, 19 nt, Homo sapiens
ccaagaaguaucucuauua

SEQ ID NO: 1056408 - RNA, 19 nt, Homo sapiens
uuaaagagcuugaugagau

SEQ ID NO: 1056409 - RNA, 19 nt, Homo sapiens
gacaauacagucugauuua

SEQ ID NO: 1056410 - RNA, 19 nt, Homo sapiens
agaagaagcugucggaguu

SEQ ID NO: 1056411 - RNA, 19 nt, Homo sapiens
gaauguccuucacuuguaa

SEQ ID NO: 1056412 - RNA, 19 nt, Homo sapiens
gaagaguguuaucuauuug

SEQ ID NO: 1056413 - RNA, 19 nt, Homo sapiens
gcucauccaugcacuacua

SEQ ID NO: 1056414 - RNA, 19 nt, Homo sapiens
aaacagggaugucacuuug

SEQ ID NO: 1056415 - RNA, 19 nt, Homo sapiens
agaaaggucuguuuaugaa

SEQ ID NO: 1056416 - RNA, 19 nt, Homo sapiens
guucacagguuacuaauca

SEQ ID NO: 1056417 - RNA, 19 nt, Homo sapiens
auacauggcuuauuccaaa

SEQ ID NO: 1056418 - RNA, 19 nt, Homo sapiens
gccaguaucugcucuaaau

SEQ ID NO: 1056419 - RNA, 19 nt, Homo sapiens
caagaaguaucucuauuag

SEQ ID NO: 1056420 - RNA, 19 nt, Homo sapiens
ugaagaaggcagacauuua

SEQ ID NO: 1056421 - RNA, 19 nt, Homo sapiens
gaggauagcuucuuuaccu

SEQ ID NO: 1056422 - RNA, 19 nt, Homo sapiens
gaagcgaacuuaugaacag

SEQ ID NO: 1056423 - RNA, 19 nt, Homo sapiens
cguauuaacugaacacaga

SEQ ID NO: 1056424 - RNA, 19 nt, Homo sapiens
guuaagcuguggauuugua

SEQ ID NO: 1056425 - RNA, 19 nt, Homo sapiens
ggucgguaauuuaacauaa

SEQ ID NO: 1056426 - RNA, 19 nt, Homo sapiens
gggaagaaaggucuguuua

SEQ ID NO: 1056427 - RNA, 19 nt, Homo sapiens
guuguugguuaacguauua

SEQ ID NO: 1056428 - RNA, 19 nt, Homo sapiens
uaaagagcuugaugagauu

SEQ ID NO: 1056429 - RNA, 19 nt, Homo sapiens
ggaacugguuucuauuugu

SEQ ID NO: 1056430 - RNA, 19 nt, Homo sapiens
ggaguugauugagacuuua

SEQ ID NO: 1056431 - RNA, 19 nt, Homo sapiens
uaacugaacacagacaaua

SEQ ID NO: 1056432 - RNA, 19 nt, Homo sapiens
gaacugguuucuauuuguc

SEQ ID NO: 1056433 - RNA, 19 nt, Homo sapiens
ggagacaucuacagugaag

SEQ ID NO: 1056434 - RNA, 19 nt, Homo sapiens
cagauuggcggcagaaaua

SEQ ID NO: 1056435 - RNA, 19 nt, Homo sapiens
gcgaacuuaugaacagaua

SEQ ID NO: 1056436 - RNA, 19 nt, Homo sapiens
ggaagaaaggucuguuuau

SEQ ID NO: 1056437 - RNA, 19 nt, Homo sapiens
gguuguacauguuaugaaa

SEQ ID NO: 1056438 - RNA, 19 nt, Homo sapiens
gagcauaaauuggaagagu

SEQ ID NO: 1056439 - RNA, 19 nt, Homo sapiens
caagaaaugggauuaguug

SEQ ID NO: 1056440 - RNA, 19 nt, Homo sapiens
gauugagacuuuauuaugg

SEQ ID NO: 1056441 - RNA, 19 nt, Homo sapiens
caaccucccuguccagaug

SEQ ID NO: 1056442 - RNA, 19 nt, Homo sapiens
aaaguagccugagacauuu

SEQ ID NO: 1056443 - RNA, 19 nt, Homo sapiens
aaaccaaacaggaagcuua

SEQ ID NO: 1056444 - RNA, 19 nt, Homo sapiens
ggugauuuauccauucaaa

SEQ ID NO: 1056445 - RNA, 19 nt, Homo sapiens
agagaaagagcauaaauug

SEQ ID NO: 1056446 - RNA, 19 nt, Homo sapiens
aauagugacucccuugauu

SEQ ID NO: 1056447 - RNA, 19 nt, Homo sapiens
agaaagagcauaaauugga

SEQ ID NO: 1056448 - RNA, 19 nt, Homo sapiens
ggaagcccuugcagagaaa

SEQ ID NO: 1056449 - RNA, 19 nt, Homo sapiens
gaugaacuuucccuguuug

SEQ ID NO: 1056450 - RNA, 19 nt, Homo sapiens
acauaaagcuacuaaacug

SEQ ID NO: 1056451 - RNA, 19 nt, Homo sapiens
gaauccaccuaaccaugaa

SEQ ID NO: 1056452 - RNA, 19 nt, Homo sapiens
ccaauuaugucucucuagu

SEQ ID NO: 1056453 - RNA, 19 nt, Homo sapiens
ccuuagaggucgguaauuu

SEQ ID NO: 1056454 - RNA, 19 nt, Homo sapiens
uuaagcauguuucaaguga

SEQ ID NO: 1056455 - RNA, 19 nt, Homo sapiens
ugagauuugugauaaguga

SEQ ID NO: 1056456 - RNA, 19 nt, Homo sapiens
ggaacaacgaguaauuuau

SEQ ID NO: 1056457 - RNA, 19 nt, Homo sapiens
caaacaggaagcuuacuuu

SEQ ID NO: 1056458 - RNA, 19 nt, Homo sapiens
aagaugaacuuucccuguu

SEQ ID NO: 1056459 - RNA, 19 nt, Homo sapiens
gcccaguucuucucuguau

SEQ ID NO: 1056460 - RNA, 19 nt, Homo sapiens
gcagcaaacauucuuccua

SEQ ID NO: 1056461 - RNA, 19 nt, Homo sapiens
gaugagauuugugauaagu

SEQ ID NO: 1056462 - RNA, 19 nt, Homo sapiens
ggagacagguuagguggau

SEQ ID NO: 1056463 - RNA, 19 nt, Homo sapiens
cgggagacaucuacaguga

SEQ ID NO: 1056464 - RNA, 19 nt, Homo sapiens
gauaagugauaguacucaa

SEQ ID NO: 1056465 - RNA, 19 nt, Homo sapiens
gcacuacuaauaauacaug

SEQ ID NO: 1056466 - RNA, 19 nt, Homo sapiens
cuaauuaggaguugauuga

SEQ ID NO: 1056467 - RNA, 19 nt, Homo sapiens
gcagagaaagagcauaaau

SEQ ID NO: 1056468 - RNA, 19 nt, Homo sapiens
uaaacaagcucuguauggu

SEQ ID NO: 1056469 - RNA, 19 nt, Homo sapiens
ucugagaaaucuuuagaga

SEQ ID NO: 1056470 - RNA, 19 nt, Homo sapiens
gacagaugcacaauuauga

SEQ ID NO: 1056471 - RNA, 19 nt, Homo sapiens
ucuaauagcucaagaacac

SEQ ID NO: 1056472 - RNA, 19 nt, Homo sapiens
cuaaggauguagucuuguu

SEQ ID NO: 1056473 - RNA, 19 nt, Homo sapiens
gcuacuaaacugcuuugua

SEQ ID NO: 1056474 - RNA, 19 nt, Homo sapiens
acagagacacauauaagua

SEQ ID NO: 1056475 - RNA, 19 nt, Homo sapiens
gagaaagaaacacuaacaa

SEQ ID NO: 1056476 - RNA, 19 nt, Homo sapiens
guauagaaaggaaacauug

SEQ ID NO: 1056477 - RNA, 19 nt, Homo sapiens
gaaccaggaaucugagaau

SEQ ID NO: 1056478 - RNA, 19 nt, Homo sapiens
gggcugcuaugguuugaau

SEQ ID NO: 1056479 - RNA, 19 nt, Homo sapiens
ggauuuguacucaauaaug

SEQ ID NO: 1056480 - RNA, 19 nt, Homo sapiens
guggauuuguacucaauaa

SEQ ID NO: 1056481 - RNA, 19 nt, Homo sapiens
uuucugacccuguguguua

SEQ ID NO: 1056482 - RNA, 19 nt, Homo sapiens
cagagaaagagcauaaauu

SEQ ID NO: 1056483 - RNA, 19 nt, Homo sapiens
gauagcuucuuuaccuguu

SEQ ID NO: 1056484 - RNA, 19 nt, Homo sapiens
agaaucagcugugcucaau

SEQ ID NO: 1056485 - RNA, 19 nt, Homo sapiens
ugucaaaucaguuuccuuu

SEQ ID NO: 1056486 - RNA, 19 nt, Homo sapiens
aaucagcugugcucaauag

SEQ ID NO: 1056487 - RNA, 19 nt, Homo sapiens
guaacgugguucacagguu

SEQ ID NO: 1056488 - RNA, 19 nt, Homo sapiens
caaaggugaugaagaagua

SEQ ID NO: 1056489 - RNA, 19 nt, Homo sapiens
aaacagaacuuugcucuug

SEQ ID NO: 1056490 - RNA, 19 nt, Homo sapiens
ggaagggaccaauuaauuu

SEQ ID NO: 1056491 - RNA, 19 nt, Homo sapiens
gaaccagcauucagaaguu

SEQ ID NO: 1056492 - RNA, 19 nt, Homo sapiens
cuacugaagugauuuauga

SEQ ID NO: 1056493 - RNA, 19 nt, Homo sapiens
cauaacaucuuccgcauga

SEQ ID NO: 1056494 - RNA, 19 nt, Homo sapiens
ccacccaucuacaauguua

SEQ ID NO: 1056495 - RNA, 19 nt, Homo sapiens
gaagggagcagagauguuu

SEQ ID NO: 1056496 - RNA, 19 nt, Homo sapiens
gguauaaaguuccuauuuc

SEQ ID NO: 1056497 - RNA, 19 nt, Homo sapiens
cagaagcacuggcucaauu

SEQ ID NO: 1056498 - RNA, 19 nt, Homo sapiens
gaaagcaaauggccaugau

SEQ ID NO: 1056499 - RNA, 19 nt, Homo sapiens
auacagagcuggcuaaaca

SEQ ID NO: 1056500 - RNA, 19 nt, Homo sapiens
cagcagauguuuauaguuc

SEQ ID NO: 1056501 - RNA, 19 nt, Homo sapiens
gggagaggcuuuauuucuu

SEQ ID NO: 1056502 - RNA, 19 nt, Homo sapiens
uggcaaaggugaugaagaa

SEQ ID NO: 1056503 - RNA, 19 nt, Homo sapiens
uuucaacacuccacuauuu

SEQ ID NO: 1056504 - RNA, 19 nt, Homo sapiens
gggaagggaccaauuaauu

SEQ ID NO: 1056505 - RNA, 19 nt, Homo sapiens
gaacgccgauucaauucga

SEQ ID NO: 1056506 - RNA, 19 nt, Homo sapiens
gaguggauaugugcaauaa

SEQ ID NO: 1056507 - RNA, 19 nt, Homo sapiens
ggagaggcuuuauuucuuc

SEQ ID NO: 1056508 - RNA, 19 nt, Homo sapiens
aagaaucucugaguacaua

SEQ ID NO: 1056509 - RNA, 19 nt, Homo sapiens
acaagagacugguugguuu

SEQ ID NO: 1056510 - RNA, 19 nt, Homo sapiens
cagacucgcucuuuacuga

SEQ ID NO: 1056511 - RNA, 19 nt, Homo sapiens
ccacacaacagcuuucuaa

SEQ ID NO: 1056512 - RNA, 19 nt, Homo sapiens
ggagggaaacuaagaaaug

SEQ ID NO: 1056513 - RNA, 19 nt, Homo sapiens
gcgggaaucucauguguca

SEQ ID NO: 1056514 - RNA, 19 nt, Homo sapiens
gaacauagaggcgcagaau

SEQ ID NO: 1056515 - RNA, 19 nt, Homo sapiens
gcauuucuuugugcaguua

SEQ ID NO: 1056516 - RNA, 19 nt, Homo sapiens
cagaauuccuugaucagaa

SEQ ID NO: 1056517 - RNA, 19 nt, Homo sapiens
gagcuuaaucuucuccaua

SEQ ID NO: 1056518 - RNA, 19 nt, Homo sapiens
cuacagaauuccuugauca

SEQ ID NO: 1056519 - RNA, 19 nt, Homo sapiens
ugacucccauuacaaguuu

SEQ ID NO: 1056520 - RNA, 19 nt, Homo sapiens
acaggaaccucauccagaa

SEQ ID NO: 1056521 - RNA, 19 nt, Homo sapiens
agacaugguucaaagcauu

SEQ ID NO: 1056522 - RNA, 19 nt, Homo sapiens
gaccuaauagcauuucuuu

SEQ ID NO: 1056523 - RNA, 19 nt, Homo sapiens
gcugagagcagaaaggaaa

SEQ ID NO: 1056524 - RNA, 19 nt, Homo sapiens
guuaaacgaucaaccagau

SEQ ID NO: 1056525 - RNA, 19 nt, Homo sapiens
uaaacaacaucuccagaca

SEQ ID NO: 1056526 - RNA, 19 nt, Homo sapiens
gcugguuaccuuaaucuua

SEQ ID NO: 1056527 - RNA, 19 nt, Homo sapiens
gagcagagauguuuuccaa

SEQ ID NO: 1056528 - RNA, 19 nt, Homo sapiens
gagcaugaccucucaaugg

SEQ ID NO: 1056529 - RNA, 19 nt, Homo sapiens
ucagggaagggaccaauua

SEQ ID NO: 1056530 - RNA, 19 nt, Homo sapiens
uaacgucucugacauacag

SEQ ID NO: 1056531 - RNA, 19 nt, Homo sapiens
ccauaccacuaaccaauga

SEQ ID NO: 1056532 - RNA, 19 nt, Homo sapiens
caccacagaucaacaggaa

SEQ ID NO: 1056533 - RNA, 19 nt, Homo sapiens
ccuaauagcauuucuuugu

SEQ ID NO: 1056534 - RNA, 19 nt, Homo sapiens
ggaaauccaaaugaacaua

SEQ ID NO: 1056535 - RNA, 19 nt, Homo sapiens
aaacagacagcacuacuga

SEQ ID NO: 1056536 - RNA, 19 nt, Homo sapiens
uaaucuugaugccuugaua

SEQ ID NO: 1056537 - RNA, 19 nt, Homo sapiens
uuccagacaucaagcaaua

SEQ ID NO: 1056538 - RNA, 19 nt, Homo sapiens
gaaacuaagaaaugguuga

SEQ ID NO: 1056539 - RNA, 19 nt, Homo sapiens
gagcguguuugaagaagau

SEQ ID NO: 1056540 - RNA, 19 nt, Homo sapiens
gcgcagaauccgaagcaua

SEQ ID NO: 1056541 - RNA, 19 nt, Homo sapiens
ggucaccagucaaucuuug

SEQ ID NO: 1056542 - RNA, 19 nt, Homo sapiens
acacaaugguucuaccuau

SEQ ID NO: 1056543 - RNA, 19 nt, Homo sapiens
gagggaaacuaagaaaugg

SEQ ID NO: 1056544 - RNA, 19 nt, Homo sapiens
gaagcacuggcucaauuaa

SEQ ID NO: 1056545 - RNA, 19 nt, Homo sapiens
ucagaaggauccagaagca

SEQ ID NO: 1056546 - RNA, 19 nt, Homo sapiens
acaauuugcugcucaucaa

SEQ ID NO: 1056547 - RNA, 19 nt, Homo sapiens
gggugcagcucuaccaguu

SEQ ID NO: 1056548 - RNA, 19 nt, Homo sapiens
cuugaugccuugauacuga

SEQ ID NO: 1056549 - RNA, 19 nt, Homo sapiens
gaagcgaugagacaaguau

SEQ ID NO: 1056550 - RNA, 19 nt, Homo sapiens
gauauugugcuuccugcua

SEQ ID NO: 1056551 - RNA, 19 nt, Homo sapiens
gcgccacacuuccuguuga

SEQ ID NO: 1056552 - RNA, 19 nt, Homo sapiens
ugacauacaggcacacuga

SEQ ID NO: 1056553 - RNA, 19 nt, Homo sapiens
uggaugagcuuaaucuucu

SEQ ID NO: 1056554 - RNA, 19 nt, Homo sapiens
cuaauagcauuucuuugug

SEQ ID NO: 1056555 - RNA, 19 nt, Homo sapiens
caacugcuggcauaugaaa

SEQ ID NO: 1056556 - RNA, 19 nt, Homo sapiens
gcaaaagccuagauuuaca

SEQ ID NO: 1056557 - RNA, 19 nt, Homo sapiens
gaaauccaaaugaacauag

SEQ ID NO: 1056558 - RNA, 19 nt, Homo sapiens
gagcugaucgcgccuggaa

SEQ ID NO: 1056559 - RNA, 19 nt, Homo sapiens
caagauuguucccaaagca

SEQ ID NO: 1056560 - RNA, 19 nt, Homo sapiens
guggauaugugcaauaaac

SEQ ID NO: 1056561 - RNA, 19 nt, Homo sapiens
gaauuacuuucuguugaug

SEQ ID NO: 1056562 - RNA, 19 nt, Homo sapiens
ucaaagcauucagguagaa

SEQ ID NO: 1056563 - RNA, 19 nt, Homo sapiens
ccaaacguauggacagcuu

SEQ ID NO: 1056564 - RNA, 19 nt, Homo sapiens
uuauugagguucagaagga

SEQ ID NO: 1056565 - RNA, 19 nt, Homo sapiens
aacaacaucuccagacaga

SEQ ID NO: 1056566 - RNA, 19 nt, Homo sapiens
gaagggaccaauuaauuuu

SEQ ID NO: 1056567 - RNA, 19 nt, Homo sapiens
guugauagauccacagacu

SEQ ID NO: 1056568 - RNA, 19 nt, Homo sapiens
gcagugacucccauuacaa

SEQ ID NO: 1056569 - RNA, 19 nt, Homo sapiens
gaagaguggauaugugcaa

SEQ ID NO: 1056570 - RNA, 19 nt, Homo sapiens
gcaaaggugaugaagaagu

SEQ ID NO: 1056571 - RNA, 19 nt, Homo sapiens
aaucguuuguggaauguaa

SEQ ID NO: 1056572 - RNA, 19 nt, Homo sapiens
cgcagaauccgaagcauaa

SEQ ID NO: 1056573 - RNA, 19 nt, Homo sapiens
uaaacgaucaaccagauga

SEQ ID NO: 1056574 - RNA, 19 nt, Homo sapiens
caaagcaacagccagucua

SEQ ID NO: 1056575 - RNA, 19 nt, Homo sapiens
guauaaaguuccuauuucc

SEQ ID NO: 1056576 - RNA, 19 nt, Homo sapiens
gauaggcuuugcccaugga

SEQ ID NO: 1056577 - RNA, 19 nt, Homo sapiens
aguaagcacuuuaaaggau

SEQ ID NO: 1056578 - RNA, 19 nt, Homo sapiens
uggacaagcuccugcuaga

SEQ ID NO: 1056579 - RNA, 19 nt, Homo sapiens
ugucaucucuuuucaguuu

SEQ ID NO: 1056580 - RNA, 19 nt, Homo sapiens
caagcagugacucccauua

SEQ ID NO: 1056581 - RNA, 19 nt, Homo sapiens
ugaugaaucuguuuacacu

SEQ ID NO: 1056582 - RNA, 19 nt, Homo sapiens
ucuccucccuucaguacua

SEQ ID NO: 1056583 - RNA, 19 nt, Homo sapiens
gguucuaccuaucauacaa

SEQ ID NO: 1056584 - RNA, 19 nt, Homo sapiens
agagcuggcuaaacaguug

SEQ ID NO: 1056585 - RNA, 19 nt, Homo sapiens
ccagacaucaagcaauaaa

SEQ ID NO: 1056586 - RNA, 19 nt, Homo sapiens
agaagaaucucugaguaca

SEQ ID NO: 1056587 - RNA, 19 nt, Homo sapiens
ugggaucaauggcaguuaa

SEQ ID NO: 1056588 - RNA, 19 nt, Homo sapiens
gaaacccugucuuuacaaa

SEQ ID NO: 1056589 - RNA, 19 nt, Homo sapiens
gagaacagcaagaaacuaa

SEQ ID NO: 1056590 - RNA, 19 nt, Homo sapiens
gugaugagguggagaagaa

SEQ ID NO: 1056591 - RNA, 19 nt, Homo sapiens
gggaaacccugucuuuaca

SEQ ID NO: 1056592 - RNA, 19 nt, Homo sapiens
ccugaguucucgaccauua

SEQ ID NO: 1056593 - RNA, 19 nt, Homo sapiens
gagcugaucuacgugagaa

SEQ ID NO: 1056594 - RNA, 19 nt, Homo sapiens
ggacaaagccaaggucauc

SEQ ID NO: 1056595 - RNA, 19 nt, Homo sapiens
aagggaagcuggacgugua

SEQ ID NO: 1056596 - RNA, 19 nt, Homo sapiens
gaagauauggcccuuugga

SEQ ID NO: 1056597 - RNA, 19 nt, Homo sapiens
acagaaaguugugcauaaa

SEQ ID NO: 1056598 - RNA, 19 nt, Homo sapiens
ccugaaagcuggccacaca

SEQ ID NO: 1056599 - RNA, 19 nt, Homo sapiens
gcugagacccuguuuggaa

SEQ ID NO: 1056600 - RNA, 19 nt, Homo sapiens
ccaccgagcugaucuacgu

SEQ ID NO: 1056601 - RNA, 19 nt, Homo sapiens
gaccacauuucccaaagga

SEQ ID NO: 1056602 - RNA, 19 nt, Homo sapiens
ugacagaagacacagauga

SEQ ID NO: 1056603 - RNA, 19 nt, Homo sapiens
ggaauguggugguggaaac

SEQ ID NO: 1056604 - RNA, 19 nt, Homo sapiens
agaagaaccugcgcccauu

SEQ ID NO: 1056605 - RNA, 19 nt, Homo sapiens
gacagaagacacagaugaa

SEQ ID NO: 1056606 - RNA, 19 nt, Homo sapiens
gcgaagagcaagagagcuu

SEQ ID NO: 1056607 - RNA, 19 nt, Homo sapiens
caucagagguaugaggaau

SEQ ID NO: 1056608 - RNA, 19 nt, Homo sapiens
gagugggacugcugaugga

SEQ ID NO: 1056609 - RNA, 19 nt, Homo sapiens
ggaucaagaacuguaaauu

SEQ ID NO: 1056610 - RNA, 19 nt, Homo sapiens
ugauccaccucacugaauu

SEQ ID NO: 1056611 - RNA, 19 nt, Homo sapiens
uugaagauauggcccuuug

SEQ ID NO: 1056612 - RNA, 19 nt, Homo sapiens
ggaaugcagaggaccuuug

SEQ ID NO: 1056613 - RNA, 19 nt, Homo sapiens
gaggacaugcucagagaga

SEQ ID NO: 1056614 - RNA, 19 nt, Homo sapiens
gaggugaggcugcacacuu

SEQ ID NO: 1056615 - RNA, 19 nt, Homo sapiens
ggaccacauuucccaaagg

SEQ ID NO: 1056616 - RNA, 19 nt, Homo sapiens
cagaagacacagaugaaga

SEQ ID NO: 1056617 - RNA, 19 nt, Homo sapiens
cugagacccuguuuggaaa

SEQ ID NO: 1056618 - RNA, 19 nt, Homo sapiens
ccucccgcauugagacuua

SEQ ID NO: 1056619 - RNA, 19 nt, Homo sapiens
gaaggcagaggaguauguu

SEQ ID NO: 1056620 - RNA, 19 nt, Homo sapiens
agaaagcucaagaucauga

SEQ ID NO: 1056621 - RNA, 19 nt, Homo sapiens
agacacagaugaagaugcu

SEQ ID NO: 1056622 - RNA, 19 nt, Homo sapiens
gaagaaccugcgcccauuc

SEQ ID NO: 1056623 - RNA, 19 nt, Homo sapiens
aggugaggcugcacacuuu

SEQ ID NO: 1056624 - RNA, 19 nt, Homo sapiens
cgaggccugucacccauga

SEQ ID NO: 1056625 - RNA, 19 nt, Homo sapiens
ggaaacccugucuuuacaa

SEQ ID NO: 1056626 - RNA, 19 nt, Homo sapiens
gauugaagccguggaguca

SEQ ID NO: 1056627 - RNA, 19 nt, Homo sapiens
ggcccugaaugccaugauu

SEQ ID NO: 1056628 - RNA, 19 nt, Homo sapiens
gaugcucugugacuugcuu

SEQ ID NO: 1056629 - RNA, 19 nt, Homo sapiens
gcacacuuucagcauguuu

SEQ ID NO: 1056630 - RNA, 19 nt, Homo sapiens
uugaagccguggagucauu

SEQ ID NO: 1056631 - RNA, 19 nt, Homo sapiens
aaacuaacccucucuucca

SEQ ID NO: 1056632 - RNA, 19 nt, Homo sapiens
aaaguggcuuccugacguu

SEQ ID NO: 1056633 - RNA, 19 nt, Homo sapiens
ggaggugacccaggagaga

SEQ ID NO: 1056634 - RNA, 19 nt, Homo sapiens
caaccuggucugaggaaga

SEQ ID NO: 1056635 - RNA, 19 nt, Homo sapiens
gagacccuguuuggaaaug

SEQ ID NO: 1056636 - RNA, 19 nt, Homo sapiens
acacaucccugcgcccaau

SEQ ID NO: 1056637 - RNA, 19 nt, Homo sapiens
ccuguaaucccagcacuuu

SEQ ID NO: 1056638 - RNA, 19 nt, Homo sapiens
ggacaugcucagagagauc

SEQ ID NO: 1056639 - RNA, 19 nt, Homo sapiens
gaagacacagaugaagaug

SEQ ID NO: 1056640 - RNA, 19 nt, Homo sapiens
gcugaaggcagaggaguau

SEQ ID NO: 1056641 - RNA, 19 nt, Homo sapiens
ucucugaugugcuccuugu

SEQ ID NO: 1056642 - RNA, 19 nt, Homo sapiens
gaaugcagaggaccuuugg

SEQ ID NO: 1056643 - RNA, 19 nt, Homo sapiens
gggagcuccugacccucua

SEQ ID NO: 1056644 - RNA, 19 nt, Homo sapiens
gcagaggaguauguucaac

SEQ ID NO: 1056645 - RNA, 19 nt, Homo sapiens
gagucauuccugcgacaua

SEQ ID NO: 1056646 - RNA, 19 nt, Homo sapiens
cagcugagacccuguuugg

SEQ ID NO: 1056647 - RNA, 19 nt, Homo sapiens
agaagacacagaugaagau

SEQ ID NO: 1056648 - RNA, 19 nt, Homo sapiens
ccagugaugagguggagaa

SEQ ID NO: 1056649 - RNA, 19 nt, Homo sapiens
gggccucuguuccugaaag

SEQ ID NO: 1056650 - RNA, 19 nt, Homo sapiens
aaccuggucugaggaagaa

SEQ ID NO: 1056651 - RNA, 19 nt, Homo sapiens
gaacagcaagaaacuaacc

SEQ ID NO: 1056652 - RNA, 19 nt, Homo sapiens
acaguggccugaccaucga

SEQ ID NO: 1056653 - RNA, 19 nt, Homo sapiens
gaggugacccaggagagaa

SEQ ID NO: 1056654 - RNA, 19 nt, Homo sapiens
cgagaacagcaagaaacua

SEQ ID NO: 1056655 - RNA, 19 nt, Homo sapiens
ucagagguaugaggaaugc

SEQ ID NO: 1056656 - RNA, 19 nt, Homo sapiens
gcugauccaccucacugaa

SEQ ID NO: 1056657 - RNA, 19 nt, Homo sapiens
ggugacagaagacacagau

SEQ ID NO: 1056658 - RNA, 19 nt, Homo sapiens
ugaaggcagaggaguaugu

SEQ ID NO: 1056659 - RNA, 19 nt, Homo sapiens
agucauuccugcgacauau

SEQ ID NO: 1056660 - RNA, 19 nt, Homo sapiens
gcacuacuggcagacucua

SEQ ID NO: 1056661 - RNA, 19 nt, Homo sapiens
gggaucaagaacuguaaau

SEQ ID NO: 1056662 - RNA, 19 nt, Homo sapiens
ccuggacauugaagauaug

SEQ ID NO: 1056663 - RNA, 19 nt, Homo sapiens
ucugugacuugcuuaucaa

SEQ ID NO: 1056664 - RNA, 19 nt, Homo sapiens
ggacugcugauggaagugu

SEQ ID NO: 1056665 - RNA, 19 nt, Homo sapiens
cugcacacuuucagcaugu

SEQ ID NO: 1056666 - RNA, 19 nt, Homo sapiens
gaggaccuuuggcaugcau

SEQ ID NO: 1056667 - RNA, 19 nt, Homo sapiens
uccuggacauugaagauau

SEQ ID NO: 1056668 - RNA, 19 nt, Homo sapiens
ccugggcaauauagggaaa

SEQ ID NO: 1056669 - RNA, 19 nt, Homo sapiens
gcccugaaugccaugauug

SEQ ID NO: 1056670 - RNA, 19 nt, Homo sapiens
gcuccaugcugugcucaag

SEQ ID NO: 1056671 - RNA, 19 nt, Homo sapiens
ugaaagcuggccacacauc

SEQ ID NO: 1056672 - RNA, 19 nt, Homo sapiens
ucugaugugcuccuuguga

SEQ ID NO: 1056673 - RNA, 19 nt, Homo sapiens
caccagcgcaucaccaagu

SEQ ID NO: 1056674 - RNA, 19 nt, Homo sapiens
gagaaagcucaagaucaug

SEQ ID NO: 1056675 - RNA, 19 nt, Homo sapiens
gaaauaaacugugacuaca

SEQ ID NO: 1056676 - RNA, 19 nt, Homo sapiens
caucagaaauaaacuguga

SEQ ID NO: 1056677 - RNA, 19 nt, Homo sapiens
acaagucccuguaugauga

SEQ ID NO: 1056678 - RNA, 19 nt, Homo sapiens
ggagugagcccagugagaa

SEQ ID NO: 1056679 - RNA, 19 nt, Homo sapiens
ccaccgugcucuucgagaa

SEQ ID NO: 1056680 - RNA, 19 nt, Homo sapiens
ggucaacgguggcucaaac

SEQ ID NO: 1056681 - RNA, 19 nt, Homo sapiens
gaacagcucaaggucuuug

SEQ ID NO: 1056682 - RNA, 19 nt, Homo sapiens
ucagccacaucagaaauaa

SEQ ID NO: 1056683 - RNA, 19 nt, Homo sapiens
ucagacaagucccuguaug

SEQ ID NO: 1056684 - RNA, 19 nt, Homo sapiens
agaaauaaacugugacuac

SEQ ID NO: 1056685 - RNA, 19 nt, Homo sapiens
cagacaagucccuguauga

SEQ ID NO: 1056686 - RNA, 19 nt, Homo sapiens
acgcaagacugagaaagaa

SEQ ID NO: 1056687 - RNA, 19 nt, Homo sapiens
gcgaauuccuggaguacgu

SEQ ID NO: 1056688 - RNA, 19 nt, Homo sapiens
caucagacaagucccugua

SEQ ID NO: 1056689 - RNA, 19 nt, Homo sapiens
ccugcaagguggaguucua

SEQ ID NO: 1056690 - RNA, 19 nt, Homo sapiens
gacaagucccuguaugaug

SEQ ID NO: 1056691 - RNA, 19 nt, Homo sapiens
gcacuggagcugccuuugg

SEQ ID NO: 1056692 - RNA, 19 nt, Homo sapiens
uaaacugugacuacacuug

SEQ ID NO: 1056693 - RNA, 19 nt, Homo sapiens
aauaaacugugacuacacu

SEQ ID NO: 1056694 - RNA, 19 nt, Homo sapiens
augaacagcucaaggucuu

SEQ ID NO: 1056695 - RNA, 19 nt, Homo sapiens
gggcaccccuguccagaaa

SEQ ID NO: 1056696 - RNA, 19 nt, Homo sapiens
cgaagacacagagggcuuu

SEQ ID NO: 1056697 - RNA, 19 nt, Homo sapiens
ucugcaaccuugaugaaca

SEQ ID NO: 1056698 - RNA, 19 nt, Homo sapiens
acagagagauccgggacau

SEQ ID NO: 1056699 - RNA, 19 nt, Homo sapiens
gauucagccacaucagaaa

SEQ ID NO: 1056700 - RNA, 19 nt, Homo sapiens
gaggagacgccacccacau

SEQ ID NO: 1056701 - RNA, 19 nt, Homo sapiens
ccacaucagaaauaaacug

SEQ ID NO: 1056702 - RNA, 19 nt, Homo sapiens
gaagacacagagggcuuug

SEQ ID NO: 1056703 - RNA, 19 nt, Homo sapiens
agacucagacgaagacaca

SEQ ID NO: 1056704 - RNA, 19 nt, Homo sapiens
cacgcaagacugagaaaga

SEQ ID NO: 1056705 - RNA, 19 nt, Homo sapiens
ugugcgaauuccuggagua

SEQ ID NO: 1056706 - RNA, 19 nt, Homo sapiens
uccggaaccuucuguugga

SEQ ID NO: 1056707 - RNA, 19 nt, Homo sapiens
gcuccggaaccuucuguug

SEQ ID NO: 1056708 - RNA, 19 nt, Homo sapiens
uagauucagccacaucaga

SEQ ID NO: 1056709 - RNA, 19 nt, Homo sapiens
agacacagagggcuuugga

SEQ ID NO: 1056710 - RNA, 19 nt, Homo sapiens
cugagggccugugcgaauu

SEQ ID NO: 1056711 - RNA, 19 nt, Homo sapiens
gccaccuucuccagcauug

SEQ ID NO: 1056712 - RNA, 19 nt, Homo sapiens
cccggcagcucgaaugaca

SEQ ID NO: 1056713 - RNA, 19 nt, Homo sapiens
gugcccaaccucaagaaga

SEQ ID NO: 1056714 - RNA, 19 nt, Homo sapiens
cuucucgccucaccacuuc

SEQ ID NO: 1056715 - RNA, 19 nt, Homo sapiens
gcucugcuacgucaucagu

SEQ ID NO: 1056716 - RNA, 19 nt, Homo sapiens
agacaagucccuguaugau

SEQ ID NO: 1056717 - RNA, 19 nt, Homo sapiens
cagcacggcaaacggagaa

SEQ ID NO: 1056718 - RNA, 19 nt, Homo sapiens
ggacccugccucucacaag

SEQ ID NO: 1056719 - RNA, 19 nt, Homo sapiens
agauucagccacaucagaa

SEQ ID NO: 1056720 - RNA, 19 nt, Homo sapiens
gcgcucugcuacgucauca

SEQ ID NO: 1056721 - RNA, 19 nt, Homo sapiens
cccugucgguguccuuuga

SEQ ID NO: 1056722 - RNA, 19 nt, Homo sapiens
cucacaagcuacugguguu

SEQ ID NO: 1056723 - RNA, 19 nt, Homo sapiens
gcaaaggauucuauucuua

SEQ ID NO: 1056724 - RNA, 19 nt, Homo sapiens
ggacagcacuuauaaugaa

SEQ ID NO: 1056725 - RNA, 19 nt, Homo sapiens
gaaaguagcacgaucauau

SEQ ID NO: 1056726 - RNA, 19 nt, Homo sapiens
gcacugaaauaguuagaug

SEQ ID NO: 1056727 - RNA, 19 nt, Homo sapiens
caagggaugucuucaguga

SEQ ID NO: 1056728 - RNA, 19 nt, Homo sapiens
caaaugggccucucuggua

SEQ ID NO: 1056729 - RNA, 19 nt, Homo sapiens
gaacccacccguugaguuu

SEQ ID NO: 1056730 - RNA, 19 nt, Homo sapiens
ggacacggaugcggaguuu

SEQ ID NO: 1056731 - RNA, 19 nt, Homo sapiens
gaacagcaaaggauucuau

SEQ ID NO: 1056732 - RNA, 19 nt, Homo sapiens
guagcacgaucauauugua

SEQ ID NO: 1056733 - RNA, 19 nt, Homo sapiens
gauuuagacucucugauug

SEQ ID NO: 1056734 - RNA, 19 nt, Homo sapiens
gguugaagaugacaaauuc

SEQ ID NO: 1056735 - RNA, 19 nt, Homo sapiens
guacagcauuuacucuuau

SEQ ID NO: 1056736 - RNA, 19 nt, Homo sapiens
uaaaugacgugaccagcuu

SEQ ID NO: 1056737 - RNA, 19 nt, Homo sapiens
gucaugagguggaacagua

SEQ ID NO: 1056738 - RNA, 19 nt, Homo sapiens
caaaucacaacccaagaua

SEQ ID NO: 1056739 - RNA, 19 nt, Homo sapiens
gaagugagauuuuaugaag

SEQ ID NO: 1056740 - RNA, 19 nt, Homo sapiens
gaugggacagcacuuauaa

SEQ ID NO: 1056741 - RNA, 19 nt, Homo sapiens
ccaaugacaucgagcuguu

SEQ ID NO: 1056742 - RNA, 19 nt, Homo sapiens
gacuauacauucucucaga

SEQ ID NO: 1056743 - RNA, 19 nt, Homo sapiens
gaaaagaguacagcauuua

SEQ ID NO: 1056744 - RNA, 19 nt, Homo sapiens
gaaacuaagagaaauguag

SEQ ID NO: 1056745 - RNA, 19 nt, Homo sapiens
caaaauacccucuaccuuu

SEQ ID NO: 1056746 - RNA, 19 nt, Homo sapiens
gacuaugaaugcacaacua

SEQ ID NO: 1056747 - RNA, 19 nt, Homo sapiens
caaauuccaccguuucuga

SEQ ID NO: 1056748 - RNA, 19 nt, Homo sapiens
gcaggcgccucguucauuc

SEQ ID NO: 1056749 - RNA, 19 nt, Homo sapiens
cccaacaacuucauuccua

SEQ ID NO: 1056750 - RNA, 19 nt, Homo sapiens
uaaagccuguaauuucuga

SEQ ID NO: 1056751 - RNA, 19 nt, Homo sapiens
uuagagggaugaaacaguu

SEQ ID NO: 1056752 - RNA, 19 nt, Homo sapiens
gaccagcuuugacuaugaa

SEQ ID NO: 1056753 - RNA, 19 nt, Homo sapiens
auaaauagcacucagagaa

SEQ ID NO: 1056754 - RNA, 19 nt, Homo sapiens
cgacaggagagauuucuuu

SEQ ID NO: 1056755 - RNA, 19 nt, Homo sapiens
caguaaugcuuguuugaug

SEQ ID NO: 1056756 - RNA, 19 nt, Homo sapiens
aaucaaggaccgaauguuu

SEQ ID NO: 1056757 - RNA, 19 nt, Homo sapiens
agagguggcccuuugauuu

SEQ ID NO: 1056758 - RNA, 19 nt, Homo sapiens
acaauacucuggugacaca

SEQ ID NO: 1056759 - RNA, 19 nt, Homo sapiens
gaugcggaguuuguugaua

SEQ ID NO: 1056760 - RNA, 19 nt, Homo sapiens
gagguggcccuuugauuug

SEQ ID NO: 1056761 - RNA, 19 nt, Homo sapiens
cuucauggcucaucugcuu

SEQ ID NO: 1056762 - RNA, 19 nt, Homo sapiens
gaaugcuugucauggauau

SEQ ID NO: 1056763 - RNA, 19 nt, Homo sapiens
gacagcacuuauaaugaaa

SEQ ID NO: 1056764 - RNA, 19 nt, Homo sapiens
gaaaucaaggaccgaaugu

SEQ ID NO: 1056765 - RNA, 19 nt, Homo sapiens
gcagaaccuuggugauuuu

SEQ ID NO: 1056766 - RNA, 19 nt, Homo sapiens
ggaguuuguugauaucgau

SEQ ID NO: 1056767 - RNA, 19 nt, Homo sapiens
guaaggccauucucaucga

SEQ ID NO: 1056768 - RNA, 19 nt, Homo sapiens
ugaccagcuuugacuauga

SEQ ID NO: 1056769 - RNA, 19 nt, Homo sapiens
guaaucgaauaccaacuuc

SEQ ID NO: 1056770 - RNA, 19 nt, Homo sapiens
cuggacaacuuaauauuuc

SEQ ID NO: 1056771 - RNA, 19 nt, Homo sapiens
ugauuuagacucucugauu

SEQ ID NO: 1056772 - RNA, 19 nt, Homo sapiens
gcacgaucauauuguacug

SEQ ID NO: 1056773 - RNA, 19 nt, Homo sapiens
ccaagauacucagauagga

SEQ ID NO: 1056774 - RNA, 19 nt, Homo sapiens
aacccaagauacucagaua

SEQ ID NO: 1056775 - RNA, 19 nt, Homo sapiens
caucgaugaucaggucuuu

SEQ ID NO: 1056776 - RNA, 19 nt, Homo sapiens
gaaugcacaacuacagauu

SEQ ID NO: 1056777 - RNA, 19 nt, Homo sapiens
agggaugucuucagugauu

SEQ ID NO: 1056778 - RNA, 19 nt, Homo sapiens
aaauagcacucagagaaug

SEQ ID NO: 1056779 - RNA, 19 nt, Homo sapiens
ugaaagagaaacccaacaa

SEQ ID NO: 1056780 - RNA, 19 nt, Homo sapiens
uagcagaaccuuggugauu

SEQ ID NO: 1056781 - RNA, 19 nt, Homo sapiens
ccaaaagucugcugaaaag

SEQ ID NO: 1056782 - RNA, 19 nt, Homo sapiens
gggagugacuauacauucu

SEQ ID NO: 1056783 - RNA, 19 nt, Homo sapiens
ccggagcuaugacaacauu

SEQ ID NO: 1056784 - RNA, 19 nt, Homo sapiens
ggaugucuucagugauuua

SEQ ID NO: 1056785 - RNA, 19 nt, Homo sapiens
uaaauagcacucagagaau

SEQ ID NO: 1056786 - RNA, 19 nt, Homo sapiens
cagaugguguauuuccaaa

SEQ ID NO: 1056787 - RNA, 19 nt, Homo sapiens
caagauacucagauaggaa

SEQ ID NO: 1056788 - RNA, 19 nt, Homo sapiens
gaucucgaccugcuuugaa

SEQ ID NO: 1056789 - RNA, 19 nt, Homo sapiens
ccugaauccuccuuaauag

SEQ ID NO: 1056790 - RNA, 19 nt, Homo sapiens
guccacaguuuauaaaugg

SEQ ID NO: 1056791 - RNA, 19 nt, Homo sapiens
acaaauacgacgagaguug

SEQ ID NO: 1056792 - RNA, 19 nt, Homo sapiens
ugcuauugcugaauucuaa

SEQ ID NO: 1056793 - RNA, 19 nt, Homo sapiens
gaaacccaacaacuucauu

SEQ ID NO: 1056794 - RNA, 19 nt, Homo sapiens
gaaaguaaugcccagucuu

SEQ ID NO: 1056795 - RNA, 19 nt, Homo sapiens
ggaagaagaaaauuggaua

SEQ ID NO: 1056796 - RNA, 19 nt, Homo sapiens
cuuaaagccuguaauuucu

SEQ ID NO: 1056797 - RNA, 19 nt, Homo sapiens
cugcagcccuuuucuuuua

SEQ ID NO: 1056798 - RNA, 19 nt, Homo sapiens
aaaugggccucucugguau

SEQ ID NO: 1056799 - RNA, 19 nt, Homo sapiens
cgaccugcuuugaaaccua

SEQ ID NO: 1056800 - RNA, 19 nt, Homo sapiens
gaaccuuggugauuuuguu

SEQ ID NO: 1056801 - RNA, 19 nt, Homo sapiens
gggacagcacuuauaauga

SEQ ID NO: 1056802 - RNA, 19 nt, Homo sapiens
gauugcauuuauuggcuaa

SEQ ID NO: 1056803 - RNA, 19 nt, Homo sapiens
aagagaaacccaacaacuu

SEQ ID NO: 1056804 - RNA, 19 nt, Homo sapiens
gagaauauaaagugaaugc

SEQ ID NO: 1056805 - RNA, 19 nt, Homo sapiens
gaagggaacaaaauagaaa

SEQ ID NO: 1056806 - RNA, 19 nt, Homo sapiens
ucuuaaagccuguaauuuc

SEQ ID NO: 1056807 - RNA, 19 nt, Homo sapiens
ggaauaaaagcucuaagaa

SEQ ID NO: 1056808 - RNA, 19 nt, Homo sapiens
ggcuauaccugugguugaa

SEQ ID NO: 1056809 - RNA, 19 nt, Homo sapiens
ugaauguguuuguuguuuc

SEQ ID NO: 1056810 - RNA, 19 nt, Homo sapiens
gacuuaaguuugugaaggu

SEQ ID NO: 1056811 - RNA, 19 nt, Homo sapiens
auaaagagaagcagcuauu

SEQ ID NO: 1056812 - RNA, 19 nt, Homo sapiens
uuucugaugugcuguguau

SEQ ID NO: 1056813 - RNA, 19 nt, Homo sapiens
acgaucauauuguacugua

SEQ ID NO: 1056814 - RNA, 19 nt, Homo sapiens
aaaguagcacgaucauauu

SEQ ID NO: 1056815 - RNA, 19 nt, Homo sapiens
agagaaacccaacaacuuc

SEQ ID NO: 1056816 - RNA, 19 nt, Homo sapiens
ccguugaguuuguggguaa

SEQ ID NO: 1056817 - RNA, 19 nt, Homo sapiens
ggugguggccagagcagua

SEQ ID NO: 1056818 - RNA, 19 nt, Homo sapiens
agcagaaccuuggugauuu

SEQ ID NO: 1056819 - RNA, 19 nt, Homo sapiens
caaaggauucuauucuuac

SEQ ID NO: 1056820 - RNA, 19 nt, Homo sapiens
cagcaaaggauucuauucu

SEQ ID NO: 1056821 - RNA, 19 nt, Homo sapiens
acaucgagcuguuucagau

SEQ ID NO: 1056822 - RNA, 19 nt, Homo sapiens
gagaaacccaacaacuuca

SEQ ID NO: 1056823 - RNA, 19 nt, Homo sapiens
gcaaugagaagcuuuauua

SEQ ID NO: 1056824 - RNA, 19 nt, Homo sapiens
ccauagaccuugaccauua

SEQ ID NO: 1056825 - RNA, 19 nt, Homo sapiens
gcaaucagcauuagaauuu

SEQ ID NO: 1056826 - RNA, 19 nt, Homo sapiens
gcaaaugucuaaaugaaga

SEQ ID NO: 1056827 - RNA, 19 nt, Homo sapiens
gaacagguguccuucuaaa

SEQ ID NO: 1056828 - RNA, 19 nt, Homo sapiens
ccaaacuccuucucauuua

SEQ ID NO: 1056829 - RNA, 19 nt, Homo sapiens
caaagaaccuaguagagaa

SEQ ID NO: 1056830 - RNA, 19 nt, Homo sapiens
ggagauagaaguugaauug

SEQ ID NO: 1056831 - RNA, 19 nt, Homo sapiens
guauaugacuguccuguuu

SEQ ID NO: 1056832 - RNA, 19 nt, Homo sapiens
gaaacagucucuaaaugug

SEQ ID NO: 1056833 - RNA, 19 nt, Homo sapiens
gcagguggauuucuccuuu

SEQ ID NO: 1056834 - RNA, 19 nt, Homo sapiens
gauauccgccuuacucuua

SEQ ID NO: 1056835 - RNA, 19 nt, Homo sapiens
ccaaaucucuaacacguuu

SEQ ID NO: 1056836 - RNA, 19 nt, Homo sapiens
ugaaauaacugucgcugaa

SEQ ID NO: 1056837 - RNA, 19 nt, Homo sapiens
gggcaaaugucuaaaugaa

SEQ ID NO: 1056838 - RNA, 19 nt, Homo sapiens
uuaaagggcuaauuuggua

SEQ ID NO: 1056839 - RNA, 19 nt, Homo sapiens
gaaagcaugcugauauaaa

SEQ ID NO: 1056840 - RNA, 19 nt, Homo sapiens
guacacaucuuucuggaau

SEQ ID NO: 1056841 - RNA, 19 nt, Homo sapiens
gaaagguacugcuaaaguc

SEQ ID NO: 1056842 - RNA, 19 nt, Homo sapiens
gaaguugaauugaguucuu

SEQ ID NO: 1056843 - RNA, 19 nt, Homo sapiens
ggaaaguuauagcuugauu

SEQ ID NO: 1056844 - RNA, 19 nt, Homo sapiens
gcaaagaaccuaguagaga

SEQ ID NO: 1056845 - RNA, 19 nt, Homo sapiens
gauagaaguugaauugagu

SEQ ID NO: 1056846 - RNA, 19 nt, Homo sapiens
gcacugaaauaagcaagaa

SEQ ID NO: 1056847 - RNA, 19 nt, Homo sapiens
ggaaacagucucuaaaugu

SEQ ID NO: 1056848 - RNA, 19 nt, Homo sapiens
ccacugagaagcagaauuu

SEQ ID NO: 1056849 - RNA, 19 nt, Homo sapiens
ggaauugcauauccugcua

SEQ ID NO: 1056850 - RNA, 19 nt, Homo sapiens
caaacuccuucucauuuaa

SEQ ID NO: 1056851 - RNA, 19 nt, Homo sapiens
gaaagauccuauuuaaagg

SEQ ID NO: 1056852 - RNA, 19 nt, Homo sapiens
aaauaacugucgcugaaua

SEQ ID NO: 1056853 - RNA, 19 nt, Homo sapiens
ugaauugaguucuuucuug

SEQ ID NO: 1056854 - RNA, 19 nt, Homo sapiens
uaaagaggaugugcacuga

SEQ ID NO: 1056855 - RNA, 19 nt, Homo sapiens
ucaauuaccuggaugucaa

SEQ ID NO: 1056856 - RNA, 19 nt, Homo sapiens
gaaucgagccaaggacuua

SEQ ID NO: 1056857 - RNA, 19 nt, Homo sapiens
gcuuauggccuucacauuu

SEQ ID NO: 1056858 - RNA, 19 nt, Homo sapiens
gggcuaauuugguauugaa

SEQ ID NO: 1056859 - RNA, 19 nt, Homo sapiens
gccaaacuccuucucauuu

SEQ ID NO: 1056860 - RNA, 19 nt, Homo sapiens
gacauuaaauccucuugau

SEQ ID NO: 1056861 - RNA, 19 nt, Homo sapiens
ugacagaugacaaguauga

SEQ ID NO: 1056862 - RNA, 19 nt, Homo sapiens
uaaaugacccucagcguau

SEQ ID NO: 1056863 - RNA, 19 nt, Homo sapiens
gaauaaggagcaaugagaa

SEQ ID NO: 1056864 - RNA, 19 nt, Homo sapiens
ccacuccucugaugugcua

SEQ ID NO: 1056865 - RNA, 19 nt, Homo sapiens
gagaaacagcgacuaguga

SEQ ID NO: 1056866 - RNA, 19 nt, Homo sapiens
agaauuuccugcuauuuga

SEQ ID NO: 1056867 - RNA, 19 nt, Homo sapiens
acagaaagguacugcuaaa

SEQ ID NO: 1056868 - RNA, 19 nt, Homo sapiens
guuugaaucugcauaaugu

SEQ ID NO: 1056869 - RNA, 19 nt, Homo sapiens
guccauguguugucucuaa

SEQ ID NO: 1056870 - RNA, 19 nt, Homo sapiens
uuaaaugucucugcucuga

SEQ ID NO: 1056871 - RNA, 19 nt, Homo sapiens
cagaaacuguccaaacaug

SEQ ID NO: 1056872 - RNA, 19 nt, Homo sapiens
aaaagaagauggaaaguga

SEQ ID NO: 1056873 - RNA, 19 nt, Homo sapiens
gucaaaggguuaauacaga

SEQ ID NO: 1056874 - RNA, 19 nt, Homo sapiens
gagagcgcaucgcaaagaa

SEQ ID NO: 1056875 - RNA, 19 nt, Homo sapiens
gaagauggaaagugaggaa

SEQ ID NO: 1056876 - RNA, 19 nt, Homo sapiens
acccagaccugacauuaaa

SEQ ID NO: 1056877 - RNA, 19 nt, Homo sapiens
uugaaagcaugcugauaua

SEQ ID NO: 1056878 - RNA, 19 nt, Homo sapiens
ucucaucccucuuagcauu

SEQ ID NO: 1056879 - RNA, 19 nt, Homo sapiens
ggaauuguaaguuucaguu

SEQ ID NO: 1056880 - RNA, 19 nt, Homo sapiens
gaaggaauuguaaguuuca

SEQ ID NO: 1056881 - RNA, 19 nt, Homo sapiens
ugaaggaauuguaaguuuc

SEQ ID NO: 1056882 - RNA, 19 nt, Homo sapiens
gaagaaaagucucucucaa

SEQ ID NO: 1056883 - RNA, 19 nt, Homo sapiens
ucucugcucugacugaauu

SEQ ID NO: 1056884 - RNA, 19 nt, Homo sapiens
guacaguagugcaaucaca

SEQ ID NO: 1056885 - RNA, 19 nt, Homo sapiens
gaaacagcgacuagugaaa

SEQ ID NO: 1056886 - RNA, 19 nt, Homo sapiens
guaagaagcgacuacuaga

SEQ ID NO: 1056887 - RNA, 19 nt, Homo sapiens
ggagaaaaguccagacaau

SEQ ID NO: 1056888 - RNA, 19 nt, Homo sapiens
guggaaaguuauagcuuga

SEQ ID NO: 1056889 - RNA, 19 nt, Homo sapiens
cgaaggaucaggaaguuug

SEQ ID NO: 1056890 - RNA, 19 nt, Homo sapiens
gcauuagaauuuguaagga

SEQ ID NO: 1056891 - RNA, 19 nt, Homo sapiens
gauggucucuggaauugca

SEQ ID NO: 1056892 - RNA, 19 nt, Homo sapiens
cuucagggcuucuccauag

SEQ ID NO: 1056893 - RNA, 19 nt, Homo sapiens
caacugaacccacagaaac

SEQ ID NO: 1056894 - RNA, 19 nt, Homo sapiens
gcaacugaacccacagaaa

SEQ ID NO: 1056895 - RNA, 19 nt, Homo sapiens
cuaaaugugaggcugaaua

SEQ ID NO: 1056896 - RNA, 19 nt, Homo sapiens
cuagucaucagucuuauuu

SEQ ID NO: 1056897 - RNA, 19 nt, Homo sapiens
acacaucuuucuggaauga

SEQ ID NO: 1056898 - RNA, 19 nt, Homo sapiens
ucuggagacucuaaggaua

SEQ ID NO: 1056899 - RNA, 19 nt, Homo sapiens
gcacgugccaccauacuca

SEQ ID NO: 1056900 - RNA, 19 nt, Homo sapiens
ugaauaaggagcaaugaga

SEQ ID NO: 1056901 - RNA, 19 nt, Homo sapiens
ucacagccuuugucucuca

SEQ ID NO: 1056902 - RNA, 19 nt, Homo sapiens
gaaugaccacuuuaacuca

SEQ ID NO: 1056903 - RNA, 19 nt, Homo sapiens
gaaaguuauagcuugauug

SEQ ID NO: 1056904 - RNA, 19 nt, Homo sapiens
gacccagaccugacauuaa

SEQ ID NO: 1056905 - RNA, 19 nt, Homo sapiens
ucaaaggguuaauacagau

SEQ ID NO: 1056906 - RNA, 19 nt, Homo sapiens
aaagcaugcugauauaaag

SEQ ID NO: 1056907 - RNA, 19 nt, Homo sapiens
ggaguacaguagugcaauc

SEQ ID NO: 1056908 - RNA, 19 nt, Homo sapiens
guacuagagcgguggguaa

SEQ ID NO: 1056909 - RNA, 19 nt, Homo sapiens
cagaauuuccugcuauuug

SEQ ID NO: 1056910 - RNA, 19 nt, Homo sapiens
aggaaacagucucuaaaug

SEQ ID NO: 1056911 - RNA, 19 nt, Homo sapiens
ggaguaacaucagaaacag

SEQ ID NO: 1056912 - RNA, 19 nt, Homo sapiens
guagugagggcaaugagaa

SEQ ID NO: 1056913 - RNA, 19 nt, Homo sapiens
cauagaccuugaccauuau

SEQ ID NO: 1056914 - RNA, 19 nt, Homo sapiens
gacagaaagguacugcuaa

SEQ ID NO: 1056915 - RNA, 19 nt, Homo sapiens
cagaaacaggugagaauga

SEQ ID NO: 1056916 - RNA, 19 nt, Homo sapiens
gagaaugaccacuuuaacu

SEQ ID NO: 1056917 - RNA, 19 nt, Homo sapiens
aaagugaggaagacaguaa

SEQ ID NO: 1056918 - RNA, 19 nt, Homo sapiens
ucacuuuagguaucucuua

SEQ ID NO: 1056919 - RNA, 19 nt, Homo sapiens
caucagucuuauuucagua

SEQ ID NO: 1056920 - RNA, 19 nt, Homo sapiens
gugagaaugaccacuuuaa

SEQ ID NO: 1056921 - RNA, 19 nt, Homo sapiens
uagggcaaaugucuaaaug

SEQ ID NO: 1056922 - RNA, 19 nt, Homo sapiens
agacucugcuaaauaaugu

SEQ ID NO: 1056923 - RNA, 19 nt, Homo sapiens
gaacaucugcucaaauuaa

SEQ ID NO: 1056924 - RNA, 19 nt, Homo sapiens
gguauaaacuugccuuuga

SEQ ID NO: 1056925 - RNA, 19 nt, Homo sapiens
gaaguaacgugcaaccauu

SEQ ID NO: 1056926 - RNA, 19 nt, Homo sapiens
gaacaaagaggacaccaaa

SEQ ID NO: 1056927 - RNA, 19 nt, Homo sapiens
gaggauaaauugaaggaaa

SEQ ID NO: 1056928 - RNA, 19 nt, Homo sapiens
ggcaauggcuuacauaaug

SEQ ID NO: 1056929 - RNA, 19 nt, Homo sapiens
gaucccaagucauuaauuu

SEQ ID NO: 1056930 - RNA, 19 nt, Homo sapiens
gcaaugcucccacuuaauu

SEQ ID NO: 1056931 - RNA, 19 nt, Homo sapiens
gaacauuggucuaaagucu

SEQ ID NO: 1056932 - RNA, 19 nt, Homo sapiens
gaaaaucccuguccacauu

SEQ ID NO: 1056933 - RNA, 19 nt, Homo sapiens
gcacagaagcaacuuauga

SEQ ID NO: 1056934 - RNA, 19 nt, Homo sapiens
ggaagcaaaugaagaaaca

SEQ ID NO: 1056935 - RNA, 19 nt, Homo sapiens
aagaacaucugcucaaauu

SEQ ID NO: 1056936 - RNA, 19 nt, Homo sapiens
ugucuaggcuguugcaaua

SEQ ID NO: 1056937 - RNA, 19 nt, Homo sapiens
caaggacccugaccugaaa

SEQ ID NO: 1056938 - RNA, 19 nt, Homo sapiens
cauccucccuugacaguua

SEQ ID NO: 1056939 - RNA, 19 nt, Homo sapiens
gcacaaaggcaucaggaaa

SEQ ID NO: 1056940 - RNA, 19 nt, Homo sapiens
gcaauguuguguacucuga

SEQ ID NO: 1056941 - RNA, 19 nt, Homo sapiens
ccaaacaggucacaaucaa

SEQ ID NO: 1056942 - RNA, 19 nt, Homo sapiens
gcacacacacugucacaaa

SEQ ID NO: 1056943 - RNA, 19 nt, Homo sapiens
acaaggagcugagauuuau

SEQ ID NO: 1056944 - RNA, 19 nt, Homo sapiens
aaacuuggguauaaacuug

SEQ ID NO: 1056945 - RNA, 19 nt, Homo sapiens
gacaaggagcugagauuua

SEQ ID NO: 1056946 - RNA, 19 nt, Homo sapiens
gagaauccaucagcacaaa

SEQ ID NO: 1056947 - RNA, 19 nt, Homo sapiens
gguggaagcuuucaacaag

SEQ ID NO: 1056948 - RNA, 19 nt, Homo sapiens
gaaaucaagagaacaguga

SEQ ID NO: 1056949 - RNA, 19 nt, Homo sapiens
ugaagggccuccaaacuug

SEQ ID NO: 1056950 - RNA, 19 nt, Homo sapiens
ccagaagcaucucaaguga

SEQ ID NO: 1056951 - RNA, 19 nt, Homo sapiens
gcauuaagccugcaacuca

SEQ ID NO: 1056952 - RNA, 19 nt, Homo sapiens
gcucugaagucucacauuc

SEQ ID NO: 1056953 - RNA, 19 nt, Homo sapiens
ugacagaugccaccaauga

SEQ ID NO: 1056954 - RNA, 19 nt, Homo sapiens
gaagcugccuuaaauacuc

SEQ ID NO: 1056955 - RNA, 19 nt, Homo sapiens
gacagaaagugcaaagugu

SEQ ID NO: 1056956 - RNA, 19 nt, Homo sapiens
uaaagcagcuauugagucu

SEQ ID NO: 1056957 - RNA, 19 nt, Homo sapiens
cagcaaaucagaacaaaga

SEQ ID NO: 1056958 - RNA, 19 nt, Homo sapiens
caaauaaagcaggcaauaa

SEQ ID NO: 1056959 - RNA, 19 nt, Homo sapiens
ggacaaggagcugagauuu

SEQ ID NO: 1056960 - RNA, 19 nt, Homo sapiens
ucaauccagucccuguuua

SEQ ID NO: 1056961 - RNA, 19 nt, Homo sapiens
uaacugaacauuggucuaa

SEQ ID NO: 1056962 - RNA, 19 nt, Homo sapiens
acaaagcuguuaagagaga

SEQ ID NO: 1056963 - RNA, 19 nt, Homo sapiens
gggaugcuucugacuauua

SEQ ID NO: 1056964 - RNA, 19 nt, Homo sapiens
gccagaugcugcuuccuaa

SEQ ID NO: 1056965 - RNA, 19 nt, Homo sapiens
gcauuugacaucccagaua

SEQ ID NO: 1056966 - RNA, 19 nt, Homo sapiens
acacaucccucagcacaaa

SEQ ID NO: 1056967 - RNA, 19 nt, Homo sapiens
gaaguuggaagaaccaguu

SEQ ID NO: 1056968 - RNA, 19 nt, Homo sapiens
gcagacagcguccgugaug

SEQ ID NO: 1056969 - RNA, 19 nt, Homo sapiens
caggguauguucugucuug

SEQ ID NO: 1056970 - RNA, 19 nt, Homo sapiens
aaacagaguucuuaguaac

SEQ ID NO: 1056971 - RNA, 19 nt, Homo sapiens
aaacugaagcugccuuaaa

SEQ ID NO: 1056972 - RNA, 19 nt, Homo sapiens
gcacaaaucggaugguucu

SEQ ID NO: 1056973 - RNA, 19 nt, Homo sapiens
aaacuugccuuugagcauu

SEQ ID NO: 1056974 - RNA, 19 nt, Homo sapiens
agaagcaacuuaugaugga

SEQ ID NO: 1056975 - RNA, 19 nt, Homo sapiens
agacaucacuggcuacaca

SEQ ID NO: 1056976 - RNA, 19 nt, Homo sapiens
gccagcagcgccaucauua

SEQ ID NO: 1056977 - RNA, 19 nt, Homo sapiens
ggugaaagccacggucaua

SEQ ID NO: 1056978 - RNA, 19 nt, Homo sapiens
cagauauggucgauccuaa

SEQ ID NO: 1056979 - RNA, 19 nt, Homo sapiens
ucuaggcuguugcaauaua

SEQ ID NO: 1056980 - RNA, 19 nt, Homo sapiens
gagagccgcugacaagucu

SEQ ID NO: 1056981 - RNA, 19 nt, Homo sapiens
ggagcaaaguccuugaaag

SEQ ID NO: 1056982 - RNA, 19 nt, Homo sapiens
ggcaguuccugaauucaaa

SEQ ID NO: 1056983 - RNA, 19 nt, Homo sapiens
gaaaagaaaucuccaucuc

SEQ ID NO: 1056984 - RNA, 19 nt, Homo sapiens
uccaaacuguguagacaua

SEQ ID NO: 1056985 - RNA, 19 nt, Homo sapiens
ggacuccuuugcacuugaa

SEQ ID NO: 1056986 - RNA, 19 nt, Homo sapiens
gaaggaaagcucugacaag

SEQ ID NO: 1056987 - RNA, 19 nt, Homo sapiens
gacaugcgaucaagcuuca

SEQ ID NO: 1056988 - RNA, 19 nt, Homo sapiens
gagaugugccugccucuga

SEQ ID NO: 1056989 - RNA, 19 nt, Homo sapiens
gcaauggcuuacauaaugg

SEQ ID NO: 1056990 - RNA, 19 nt, Homo sapiens
acaagaacaucugcucaaa

SEQ ID NO: 1056991 - RNA, 19 nt, Homo sapiens
cggcauggccuucaucaaa

SEQ ID NO: 1056992 - RNA, 19 nt, Homo sapiens
gaacuccgccaagugcuaa

SEQ ID NO: 1056993 - RNA, 19 nt, Homo sapiens
cagcagcgccaucauuaaa

SEQ ID NO: 1056994 - RNA, 19 nt, Homo sapiens
gagaacagcagcaaaggau

SEQ ID NO: 1056995 - RNA, 19 nt, Homo sapiens
ggggaaaacuccagcaaaa

SEQ ID NO: 1056996 - RNA, 19 nt, Homo sapiens
aaugguaguuuguuuguug

SEQ ID NO: 1056997 - RNA, 19 nt, Homo sapiens
ggcauggccuucaucaaau

SEQ ID NO: 1056998 - RNA, 19 nt, Homo sapiens
agacguaccuuuaccaaac

SEQ ID NO: 1056999 - RNA, 19 nt, Homo sapiens
gaacagugaccaggguauu

SEQ ID NO: 1057000 - RNA, 19 nt, Homo sapiens
gaaaagcagaggauaaauu

SEQ ID NO: 1057001 - RNA, 19 nt, Homo sapiens
ggaugcuucugacuauuau

SEQ ID NO: 1057002 - RNA, 19 nt, Homo sapiens
ugacaagucuccugaaucc

SEQ ID NO: 1057003 - RNA, 19 nt, Homo sapiens
gcugacaagucuccugaau

SEQ ID NO: 1057004 - RNA, 19 nt, Homo sapiens
gagcucagccgagaaauag

SEQ ID NO: 1057005 - RNA, 19 nt, Homo sapiens
gaugagcucagccgagaaa

SEQ ID NO: 1057006 - RNA, 19 nt, Homo sapiens
ggaggaaacagaaauaaaa

SEQ ID NO: 1057007 - RNA, 19 nt, Homo sapiens
ccaaugaggaggaaacaga

SEQ ID NO: 1057008 - RNA, 19 nt, Homo sapiens
uguccagacuguucucuuu

SEQ ID NO: 1057009 - RNA, 19 nt, Homo sapiens
ggcaggaucccaagucauu

SEQ ID NO: 1057010 - RNA, 19 nt, Homo sapiens
caguaaagauggagcaaag

SEQ ID NO: 1057011 - RNA, 19 nt, Homo sapiens
ggagaaagacggccacaac

SEQ ID NO: 1057012 - RNA, 19 nt, Homo sapiens
gaaagccacggucauaucu

SEQ ID NO: 1057013 - RNA, 19 nt, Homo sapiens
gaucaagcuucaggucgaa

SEQ ID NO: 1057014 - RNA, 19 nt, Homo sapiens
cauuugacaucccagauau

SEQ ID NO: 1057015 - RNA, 19 nt, Homo sapiens
gaaaaccauuugaguuguu

SEQ ID NO: 1057016 - RNA, 19 nt, Homo sapiens
gcagcuuccucccuucaug

SEQ ID NO: 1057017 - RNA, 19 nt, Homo sapiens
ggaaagagaaauuggaaaa

SEQ ID NO: 1057018 - RNA, 19 nt, Homo sapiens
gcagauacgaguggacaaa

SEQ ID NO: 1057019 - RNA, 19 nt, Homo sapiens
caacaaaugcagccuccuu

SEQ ID NO: 1057020 - RNA, 19 nt, Homo sapiens
acaaauaaagcaggcaaua

SEQ ID NO: 1057021 - RNA, 19 nt, Homo sapiens
ggacuacgauaagcugaag

SEQ ID NO: 1057022 - RNA, 19 nt, Homo sapiens
cuccagugcugaagaguuu

SEQ ID NO: 1057023 - RNA, 19 nt, Homo sapiens
ggacaaaccuggaauagau

SEQ ID NO: 1057024 - RNA, 19 nt, Homo sapiens
caaauuggcuuucaucuug

SEQ ID NO: 1057025 - RNA, 19 nt, Homo sapiens
guacauaugucuuuccuuu

SEQ ID NO: 1057026 - RNA, 19 nt, Homo sapiens
ggaagcagcucaaauuaga

SEQ ID NO: 1057027 - RNA, 19 nt, Homo sapiens
ggaggaagcuaccaagauu

SEQ ID NO: 1057028 - RNA, 19 nt, Homo sapiens
gaagaucgcucgggaauuc

SEQ ID NO: 1057029 - RNA, 19 nt, Homo sapiens
caaacuggcuuuacuuuau

SEQ ID NO: 1057030 - RNA, 19 nt, Homo sapiens
gcuaugagccucuuaaauu

SEQ ID NO: 1057031 - RNA, 19 nt, Homo sapiens
guacaaaugugaauagaca

SEQ ID NO: 1057032 - RNA, 19 nt, Homo sapiens
caacauggauggaucugaa

SEQ ID NO: 1057033 - RNA, 19 nt, Homo sapiens
gaucugaaaugcuguugaa

SEQ ID NO: 1057034 - RNA, 19 nt, Homo sapiens
gcagauacuuguacucaug

SEQ ID NO: 1057035 - RNA, 19 nt, Homo sapiens
gaaaugaaagguugcauau

SEQ ID NO: 1057036 - RNA, 19 nt, Homo sapiens
gcacaaacgugaagaugca

SEQ ID NO: 1057037 - RNA, 19 nt, Homo sapiens
gaagcaugcugaaacaaga

SEQ ID NO: 1057038 - RNA, 19 nt, Homo sapiens
guaaaucuccuaucaacuu

SEQ ID NO: 1057039 - RNA, 19 nt, Homo sapiens
cuaugagccucuuaaauuu

SEQ ID NO: 1057040 - RNA, 19 nt, Homo sapiens
aaugaaagguugcauauca

SEQ ID NO: 1057041 - RNA, 19 nt, Homo sapiens
gaacagacagguuucaaca

SEQ ID NO: 1057042 - RNA, 19 nt, Homo sapiens
gaguuuaucucaagcuguu

SEQ ID NO: 1057043 - RNA, 19 nt, Homo sapiens
uaacacaggagucgaguaa

SEQ ID NO: 1057044 - RNA, 19 nt, Homo sapiens
caguugugcucucuaguua

SEQ ID NO: 1057045 - RNA, 19 nt, Homo sapiens
gauuguagguuugaucauu

SEQ ID NO: 1057046 - RNA, 19 nt, Homo sapiens
gaagaugggcaacggauug

SEQ ID NO: 1057047 - RNA, 19 nt, Homo sapiens
uaacagagagaaacauuug

SEQ ID NO: 1057048 - RNA, 19 nt, Homo sapiens
cucaguaacuugaauauug

SEQ ID NO: 1057049 - RNA, 19 nt, Homo sapiens
gacaguuuccaaagaauua

SEQ ID NO: 1057050 - RNA, 19 nt, Homo sapiens
ggacacacuuacugcaguu

SEQ ID NO: 1057051 - RNA, 19 nt, Homo sapiens
gcucaggguuaacgcagua

SEQ ID NO: 1057052 - RNA, 19 nt, Homo sapiens
cagcauugguuauugcauu

SEQ ID NO: 1057053 - RNA, 19 nt, Homo sapiens
ggcaacggauuguagguuu

SEQ ID NO: 1057054 - RNA, 19 nt, Homo sapiens
ggaaguacaaauuggcuuu

SEQ ID NO: 1057055 - RNA, 19 nt, Homo sapiens
ccaaacuggcuuuacuuua

SEQ ID NO: 1057056 - RNA, 19 nt, Homo sapiens
acagacagguuucaacaug

SEQ ID NO: 1057057 - RNA, 19 nt, Homo sapiens
auaagaaggucgucucaga

SEQ ID NO: 1057058 - RNA, 19 nt, Homo sapiens
caaauaaggaacaacaaga

SEQ ID NO: 1057059 - RNA, 19 nt, Homo sapiens
guuguaagacguagaguuu

SEQ ID NO: 1057060 - RNA, 19 nt, Homo sapiens
agaaugcguuauuucagua

SEQ ID NO: 1057061 - RNA, 19 nt, Homo sapiens
gagcaacgcaugaagaaca

SEQ ID NO: 1057062 - RNA, 19 nt, Homo sapiens
gcuuucaucuugcaaacaa

SEQ ID NO: 1057063 - RNA, 19 nt, Homo sapiens
uaucaugcauucagguuau

SEQ ID NO: 1057064 - RNA, 19 nt, Homo sapiens
gauaauucccaucugcuuu

SEQ ID NO: 1057065 - RNA, 19 nt, Homo sapiens
gcaacggauuguagguuug

SEQ ID NO: 1057066 - RNA, 19 nt, Homo sapiens
ggacaguuuccaaagaauu

SEQ ID NO: 1057067 - RNA, 19 nt, Homo sapiens
ggaauucuuacucucgaua

SEQ ID NO: 1057068 - RNA, 19 nt, Homo sapiens
gguuagaucaguauaauuc

SEQ ID NO: 1057069 - RNA, 19 nt, Homo sapiens
uguaagacguagaguuuau

SEQ ID NO: 1057070 - RNA, 19 nt, Homo sapiens
cagaaugcguuauuucagu

SEQ ID NO: 1057071 - RNA, 19 nt, Homo sapiens
aaacuggcuuuacuuuaug

SEQ ID NO: 1057072 - RNA, 19 nt, Homo sapiens
acacaggagucgaguaaca

SEQ ID NO: 1057073 - RNA, 19 nt, Homo sapiens
ugaaaugaaagguugcaua

SEQ ID NO: 1057074 - RNA, 19 nt, Homo sapiens
acauaugucuuuccuuuag

SEQ ID NO: 1057075 - RNA, 19 nt, Homo sapiens
gcaaauaaggaacaacaag

SEQ ID NO: 1057076 - RNA, 19 nt, Homo sapiens
ccuaaugugugcugcagaa

SEQ ID NO: 1057077 - RNA, 19 nt, Homo sapiens
gacaaaccuggaauagaua

SEQ ID NO: 1057078 - RNA, 19 nt, Homo sapiens
guacagcauugguuauugc

SEQ ID NO: 1057079 - RNA, 19 nt, Homo sapiens
cagggacaguuuccaaaga

SEQ ID NO: 1057080 - RNA, 19 nt, Homo sapiens
uaaaucuccuaucaacuuc

SEQ ID NO: 1057081 - RNA, 19 nt, Homo sapiens
ccacguagaauuauacaca

SEQ ID NO: 1057082 - RNA, 19 nt, Homo sapiens
gcggaaaagugauguuaaa

SEQ ID NO: 1057083 - RNA, 19 nt, Homo sapiens
guaacagagagaaacauuu

SEQ ID NO: 1057084 - RNA, 19 nt, Homo sapiens
gcauucagguuauuuucua

SEQ ID NO: 1057085 - RNA, 19 nt, Homo sapiens
auacagugcucaggguuaa

SEQ ID NO: 1057086 - RNA, 19 nt, Homo sapiens
uaaggacaaaccuggaaua

SEQ ID NO: 1057087 - RNA, 19 nt, Homo sapiens
gaauucuuacucucgauaa

SEQ ID NO: 1057088 - RNA, 19 nt, Homo sapiens
caacuugagcaacgcauga

SEQ ID NO: 1057089 - RNA, 19 nt, Homo sapiens
uagaaggaaguacaaauug

SEQ ID NO: 1057090 - RNA, 19 nt, Homo sapiens
aaugugugcugcagaaaug

SEQ ID NO: 1057091 - RNA, 19 nt, Homo sapiens
ucagcagaaugcguuauuu

SEQ ID NO: 1057092 - RNA, 19 nt, Homo sapiens
ggaggugcaucagcagaau

SEQ ID NO: 1057093 - RNA, 19 nt, Homo sapiens
ggaagcaugcugaaacaag

SEQ ID NO: 1057094 - RNA, 19 nt, Homo sapiens
guacauccaugccauugcu

SEQ ID NO: 1057095 - RNA, 19 nt, Homo sapiens
agaaacagcuauggcaaca

SEQ ID NO: 1057096 - RNA, 19 nt, Homo sapiens
guacaaauuggcuuucauc

SEQ ID NO: 1057097 - RNA, 19 nt, Homo sapiens
ugaagcauaucauuugcau

SEQ ID NO: 1057098 - RNA, 19 nt, Homo sapiens
gcucgggaauucuuacucu

SEQ ID NO: 1057099 - RNA, 19 nt, Homo sapiens
ggggcuaguuugugaaaua

SEQ ID NO: 1057100 - RNA, 19 nt, Homo sapiens
gaaggucgucucagaugau

SEQ ID NO: 1057101 - RNA, 19 nt, Homo sapiens
agacguagaguuuaucuca

SEQ ID NO: 1057102 - RNA, 19 nt, Homo sapiens
gaucauuccggcaaauugu

SEQ ID NO: 1057103 - RNA, 19 nt, Homo sapiens
auacuuguacucaugcuua

SEQ ID NO: 1057104 - RNA, 19 nt, Homo sapiens
gaggaagcuaccaagauuu

SEQ ID NO: 1057105 - RNA, 19 nt, Homo sapiens
ggaaaccauaccugaguug

SEQ ID NO: 1057106 - RNA, 19 nt, Homo sapiens
agaaggaaguacaaauugg

SEQ ID NO: 1057107 - RNA, 19 nt, Homo sapiens
gugcaugucuuuggaagca

SEQ ID NO: 1057108 - RNA, 19 nt, Homo sapiens
gaauagauagcaaaacuga

SEQ ID NO: 1057109 - RNA, 19 nt, Homo sapiens
agacagguuucaacaugga

SEQ ID NO: 1057110 - RNA, 19 nt, Homo sapiens
ggucuucguugccguacau

SEQ ID NO: 1057111 - RNA, 19 nt, Homo sapiens
agaaggucgucucagauga

SEQ ID NO: 1057112 - RNA, 19 nt, Homo sapiens
aaccauaccugaguuguag

SEQ ID NO: 1057113 - RNA, 19 nt, Homo sapiens
uaauuugcuuugucacuca

SEQ ID NO: 1057114 - RNA, 19 nt, Homo sapiens
gaagaacagacagguuuca

SEQ ID NO: 1057115 - RNA, 19 nt, Homo sapiens
ggaagaugggcaacggauu

SEQ ID NO: 1057116 - RNA, 19 nt, Homo sapiens
gggaagcagcucaaauuag

SEQ ID NO: 1057117 - RNA, 19 nt, Homo sapiens
gauuugggcugagcugaca

SEQ ID NO: 1057118 - RNA, 19 nt, Homo sapiens
ggaaacacuugaggcuucu

SEQ ID NO: 1057119 - RNA, 19 nt, Homo sapiens
aaaccauaccugaguugua

SEQ ID NO: 1057120 - RNA, 19 nt, Homo sapiens
guugugcucucuaguuagu

SEQ ID NO: 1057121 - RNA, 19 nt, Homo sapiens
ucuuguaaaucuccuauca

SEQ ID NO: 1057122 - RNA, 19 nt, Homo sapiens
gcuaguuugugaaauaggu

SEQ ID NO: 1057123 - RNA, 19 nt, Homo sapiens
gaaaugagcuacauaaucu

SEQ ID NO: 1057124 - RNA, 19 nt, Homo sapiens
gaagggauauuuaaacuug

SEQ ID NO: 1057125 - RNA, 19 nt, Homo sapiens
gauagaagcuucccgaaau

SEQ ID NO: 1057126 - RNA, 19 nt, Homo sapiens
gaacugaugcuguuuguuu

SEQ ID NO: 1057127 - RNA, 19 nt, Homo sapiens
gaaauuugcugcuauucaa

SEQ ID NO: 1057128 - RNA, 19 nt, Homo sapiens
gauggaaggugcagacuuu

SEQ ID NO: 1057129 - RNA, 19 nt, Homo sapiens
caaagaauguggcaacuug

SEQ ID NO: 1057130 - RNA, 19 nt, Homo sapiens
gaucagcccucaaagaaug

SEQ ID NO: 1057131 - RNA, 19 nt, Homo sapiens
gaacuaaagcauccuguuu

SEQ ID NO: 1057132 - RNA, 19 nt, Homo sapiens
caaaagcguucaugaauuu

SEQ ID NO: 1057133 - RNA, 19 nt, Homo sapiens
gcauagguuuguuaauuga

SEQ ID NO: 1057134 - RNA, 19 nt, Homo sapiens
gaauaucccuaauccuuca

SEQ ID NO: 1057135 - RNA, 19 nt, Homo sapiens
gcagaggagucaaugcuau

SEQ ID NO: 1057136 - RNA, 19 nt, Homo sapiens
gaagaugaauaucccuaau

SEQ ID NO: 1057137 - RNA, 19 nt, Homo sapiens
ggacauguuuuguaguuua

SEQ ID NO: 1057138 - RNA, 19 nt, Homo sapiens
gagaaacagcuaauugaaa

SEQ ID NO: 1057139 - RNA, 19 nt, Homo sapiens
aaagguaacgucacaauaa

SEQ ID NO: 1057140 - RNA, 19 nt, Homo sapiens
ugaagcauguugcauacua

SEQ ID NO: 1057141 - RNA, 19 nt, Homo sapiens
acucuuaacuccugacuuu

SEQ ID NO: 1057142 - RNA, 19 nt, Homo sapiens
agaagaagcugaagcaucu

SEQ ID NO: 1057143 - RNA, 19 nt, Homo sapiens
gaagguaacuaaagguaac

SEQ ID NO: 1057144 - RNA, 19 nt, Homo sapiens
gcacagacacuacuugcuu

SEQ ID NO: 1057145 - RNA, 19 nt, Homo sapiens
gucuacagguuguuuaaua

SEQ ID NO: 1057146 - RNA, 19 nt, Homo sapiens
gaucaauguugguucuuug

SEQ ID NO: 1057147 - RNA, 19 nt, Homo sapiens
agaauacgguccuuccuaa

SEQ ID NO: 1057148 - RNA, 19 nt, Homo sapiens
acagugggcuucaacauga

SEQ ID NO: 1057149 - RNA, 19 nt, Homo sapiens
cugcauagguuuguuaauu

SEQ ID NO: 1057150 - RNA, 19 nt, Homo sapiens
ggacugcauagguuuguua

SEQ ID NO: 1057151 - RNA, 19 nt, Homo sapiens
ggaauuggaacuagaaugu

SEQ ID NO: 1057152 - RNA, 19 nt, Homo sapiens
gaugagaaacagcuaauug

SEQ ID NO: 1057153 - RNA, 19 nt, Homo sapiens
aaaugaaucugucugcuau

SEQ ID NO: 1057154 - RNA, 19 nt, Homo sapiens
gaaugucagucuuuguuca

SEQ ID NO: 1057155 - RNA, 19 nt, Homo sapiens
gagcauuccacccaauaua

SEQ ID NO: 1057156 - RNA, 19 nt, Homo sapiens
uaaagaaucagcuagaguu

SEQ ID NO: 1057157 - RNA, 19 nt, Homo sapiens
ggaugguucuguaaaugaa

SEQ ID NO: 1057158 - RNA, 19 nt, Homo sapiens
gauggaugguucuguaaau

SEQ ID NO: 1057159 - RNA, 19 nt, Homo sapiens
cgacuuccguauacauaaa

SEQ ID NO: 1057160 - RNA, 19 nt, Homo sapiens
caugauagaugcugcagau

SEQ ID NO: 1057161 - RNA, 19 nt, Homo sapiens
gcacuuauguagacugcau

SEQ ID NO: 1057162 - RNA, 19 nt, Homo sapiens
aaucagugcugcugcauga

SEQ ID NO: 1057163 - RNA, 19 nt, Homo sapiens
gguugagaauugaagauuu

SEQ ID NO: 1057164 - RNA, 19 nt, Homo sapiens
agagagaucuuccuaaugc

SEQ ID NO: 1057165 - RNA, 19 nt, Homo sapiens
ccagauggcaguugggaua

SEQ ID NO: 1057166 - RNA, 19 nt, Homo sapiens
ugaagcaucucuugaaguc

SEQ ID NO: 1057167 - RNA, 19 nt, Homo sapiens
gcuauucaauuucuugcaa

SEQ ID NO: 1057168 - RNA, 19 nt, Homo sapiens
cagaucagcccucaaagaa

SEQ ID NO: 1057169 - RNA, 19 nt, Homo sapiens
auacauugcuuuccgcauu

SEQ ID NO: 1057170 - RNA, 19 nt, Homo sapiens
ccauuagacaucuugauua

SEQ ID NO: 1057171 - RNA, 19 nt, Homo sapiens
ggaagguaacuaaagguaa

SEQ ID NO: 1057172 - RNA, 19 nt, Homo sapiens
gcauuaaccucugcaugug

SEQ ID NO: 1057173 - RNA, 19 nt, Homo sapiens
uaaacuugcuacuguuguu

SEQ ID NO: 1057174 - RNA, 19 nt, Homo sapiens
ccuaauccuucauaaagaa

SEQ ID NO: 1057175 - RNA, 19 nt, Homo sapiens
gcacugcugaagaugaaua

SEQ ID NO: 1057176 - RNA, 19 nt, Homo sapiens
cuucucagcuuuauucaau

SEQ ID NO: 1057177 - RNA, 19 nt, Homo sapiens
agagaaauuugcugcuauu

SEQ ID NO: 1057178 - RNA, 19 nt, Homo sapiens
uaaagguaacgucacaaua

SEQ ID NO: 1057179 - RNA, 19 nt, Homo sapiens
cauauagaccacuguagua

SEQ ID NO: 1057180 - RNA, 19 nt, Homo sapiens
ggacauauuaauacugguu

SEQ ID NO: 1057181 - RNA, 19 nt, Homo sapiens
acaaggaauuccagugcua

SEQ ID NO: 1057182 - RNA, 19 nt, Homo sapiens
ugacucaugugggauauau

SEQ ID NO: 1057183 - RNA, 19 nt, Homo sapiens
ccacacacaguauuuagaa

SEQ ID NO: 1057184 - RNA, 19 nt, Homo sapiens
aagguaacgucacaauaaa

SEQ ID NO: 1057185 - RNA, 19 nt, Homo sapiens
cgaaaugagcuacauaauc

SEQ ID NO: 1057186 - RNA, 19 nt, Homo sapiens
auaaagaucugggacauag

SEQ ID NO: 1057187 - RNA, 19 nt, Homo sapiens
agacugccauggccuuaaa

SEQ ID NO: 1057188 - RNA, 19 nt, Homo sapiens
gugagauucugccugauga

SEQ ID NO: 1057189 - RNA, 19 nt, Homo sapiens
acaaaugcaugugaaaugu

SEQ ID NO: 1057190 - RNA, 19 nt, Homo sapiens
cagagucuauuucucaugu

SEQ ID NO: 1057191 - RNA, 19 nt, Homo sapiens
uuauuuagguggaugcauu

SEQ ID NO: 1057192 - RNA, 19 nt, Homo sapiens
caauaaagaucugggacau

SEQ ID NO: 1057193 - RNA, 19 nt, Homo sapiens
cuagaguugucaugauaaa

SEQ ID NO: 1057194 - RNA, 19 nt, Homo sapiens
gugcacugcugaagaugaa

SEQ ID NO: 1057195 - RNA, 19 nt, Homo sapiens
aaaccacaguuacaaggaa

SEQ ID NO: 1057196 - RNA, 19 nt, Homo sapiens
uagcuaaaccuuaaugugu

SEQ ID NO: 1057197 - RNA, 19 nt, Homo sapiens
ggaggaauuggaacuagaa

SEQ ID NO: 1057198 - RNA, 19 nt, Homo sapiens
ugugaaccauuacaaagaa

SEQ ID NO: 1057199 - RNA, 19 nt, Homo sapiens
cacagacacuacuugcuuu

SEQ ID NO: 1057200 - RNA, 19 nt, Homo sapiens
caaaugcaugugaaaugua

SEQ ID NO: 1057201 - RNA, 19 nt, Homo sapiens
gguaacgucacaauaaaga

SEQ ID NO: 1057202 - RNA, 19 nt, Homo sapiens
gauaaagucagcacacaca

SEQ ID NO: 1057203 - RNA, 19 nt, Homo sapiens
cuucuuggcuauaauccua

SEQ ID NO: 1057204 - RNA, 19 nt, Homo sapiens
ccaaaagcguucaugaauu

SEQ ID NO: 1057205 - RNA, 19 nt, Homo sapiens
aagauauccugcuuucuga

SEQ ID NO: 1057206 - RNA, 19 nt, Homo sapiens
ggaggcaccagaucaaugu

SEQ ID NO: 1057207 - RNA, 19 nt, Homo sapiens
caugugggauauauguaaa

SEQ ID NO: 1057208 - RNA, 19 nt, Homo sapiens
uaaaccauguguagagcuu

SEQ ID NO: 1057209 - RNA, 19 nt, Homo sapiens
uagagaaauuugcugcuau

SEQ ID NO: 1057210 - RNA, 19 nt, Homo sapiens
gcucuucucagcuuuauuc

SEQ ID NO: 1057211 - RNA, 19 nt, Homo sapiens
uuacugcucuucucagcuu

SEQ ID NO: 1057212 - RNA, 19 nt, Homo sapiens
acaauauacugcacugugu

SEQ ID NO: 1057213 - RNA, 19 nt, Homo sapiens
gccauuagacaucuugauu

SEQ ID NO: 1057214 - RNA, 19 nt, Homo sapiens
gaucauuauuucugucucu

SEQ ID NO: 1057215 - RNA, 19 nt, Homo sapiens
ggauaugggaggaacuaaa

SEQ ID NO: 1057216 - RNA, 19 nt, Homo sapiens
uacugacacugacuugaua

SEQ ID NO: 1057217 - RNA, 19 nt, Homo sapiens
uauagaguccaguagcuua

SEQ ID NO: 1057218 - RNA, 19 nt, Homo sapiens
caugugcacugcugaagau

SEQ ID NO: 1057219 - RNA, 19 nt, Homo sapiens
gauagaugcugcagaucgu

SEQ ID NO: 1057220 - RNA, 19 nt, Homo sapiens
aaucagaucagcccucaaa

SEQ ID NO: 1057221 - RNA, 19 nt, Homo sapiens
gaccuauagcuaaaccuua

SEQ ID NO: 1057222 - RNA, 19 nt, Homo sapiens
caacuugcuugugccuaaa

SEQ ID NO: 1057223 - RNA, 19 nt, Homo sapiens
ggaguaagauuaugaaaug

SEQ ID NO: 1057224 - RNA, 19 nt, Homo sapiens
guacaaagauccacaagau

SEQ ID NO: 1057225 - RNA, 19 nt, Homo sapiens
gcagaaagguuuagguuca

SEQ ID NO: 1057226 - RNA, 19 nt, Homo sapiens
cgaaugagcugguucuuuc

SEQ ID NO: 1057227 - RNA, 19 nt, Homo sapiens
cgucaaagcuguuaagaau

SEQ ID NO: 1057228 - RNA, 19 nt, Homo sapiens
caucauagcuuuugcguua

SEQ ID NO: 1057229 - RNA, 19 nt, Homo sapiens
gaaacaugauugcggauga

SEQ ID NO: 1057230 - RNA, 19 nt, Homo sapiens
gaaacccugucucuacuaa

SEQ ID NO: 1057231 - RNA, 19 nt, Homo sapiens
gagaggaucuugucguaga

SEQ ID NO: 1057232 - RNA, 19 nt, Homo sapiens
gcaacucagugugaauuua

SEQ ID NO: 1057233 - RNA, 19 nt, Homo sapiens
gaacugcuaucuacugcuu

SEQ ID NO: 1057234 - RNA, 19 nt, Homo sapiens
uaacuacgaugaagaagga

SEQ ID NO: 1057235 - RNA, 19 nt, Homo sapiens
ugacagaacuuggguguga

SEQ ID NO: 1057236 - RNA, 19 nt, Homo sapiens
ucagagagcauuugucuaa

SEQ ID NO: 1057237 - RNA, 19 nt, Homo sapiens
agaaauggcuguugcguau

SEQ ID NO: 1057238 - RNA, 19 nt, Homo sapiens
gggagaggaucuugucgua

SEQ ID NO: 1057239 - RNA, 19 nt, Homo sapiens
ucaaagcuguuaagaaugu

SEQ ID NO: 1057240 - RNA, 19 nt, Homo sapiens
cagccaaguuuaaagauuu

SEQ ID NO: 1057241 - RNA, 19 nt, Homo sapiens
uagcagagauggucacaga

SEQ ID NO: 1057242 - RNA, 19 nt, Homo sapiens
gaaggacacagccaaguuu

SEQ ID NO: 1057243 - RNA, 19 nt, Homo sapiens
cgagagaacugcuaucuac

SEQ ID NO: 1057244 - RNA, 19 nt, Homo sapiens
agagagcauuugucuaaua

SEQ ID NO: 1057245 - RNA, 19 nt, Homo sapiens
ugagaagcuucauaaagua

SEQ ID NO: 1057246 - RNA, 19 nt, Homo sapiens
gacaagguccgccaguuua

SEQ ID NO: 1057247 - RNA, 19 nt, Homo sapiens
ggacacagccaaguuuaaa

SEQ ID NO: 1057248 - RNA, 19 nt, Homo sapiens
ggaacgcuguggacaagaa

SEQ ID NO: 1057249 - RNA, 19 nt, Homo sapiens
cggaugauaugucuaacua

SEQ ID NO: 1057250 - RNA, 19 nt, Homo sapiens
gaauuuagcagaaaggaau

SEQ ID NO: 1057251 - RNA, 19 nt, Homo sapiens
ccagaacucuaaugggaaa

SEQ ID NO: 1057252 - RNA, 19 nt, Homo sapiens
ucacaccguuuauauauca

SEQ ID NO: 1057253 - RNA, 19 nt, Homo sapiens
gccagcaauucacgauuua

SEQ ID NO: 1057254 - RNA, 19 nt, Homo sapiens
cugagaagcuucauaaagu

SEQ ID NO: 1057255 - RNA, 19 nt, Homo sapiens
gggccucucuuacuuaaau

SEQ ID NO: 1057256 - RNA, 19 nt, Homo sapiens
cagcagaguuuaucucaca

SEQ ID NO: 1057257 - RNA, 19 nt, Homo sapiens
ggagaugcauaagcuuaaa

SEQ ID NO: 1057258 - RNA, 19 nt, Homo sapiens
auacuaagguagagccaua

SEQ ID NO: 1057259 - RNA, 19 nt, Homo sapiens
ugaccuagcugcgguguga

SEQ ID NO: 1057260 - RNA, 19 nt, Homo sapiens
acaaagauccacaagauga

SEQ ID NO: 1057261 - RNA, 19 nt, Homo sapiens
gugaaagcuuuacaucauu

SEQ ID NO: 1057262 - RNA, 19 nt, Homo sapiens
gagcuuggcccguucuuau

SEQ ID NO: 1057263 - RNA, 19 nt, Homo sapiens
gagagcauuugucuaauac

SEQ ID NO: 1057264 - RNA, 19 nt, Homo sapiens
gugcacauuuggaagcuaa

SEQ ID NO: 1057265 - RNA, 19 nt, Homo sapiens
uuaagcaggaguaagauua

SEQ ID NO: 1057266 - RNA, 19 nt, Homo sapiens
ugugaaagcuuuacaucau

SEQ ID NO: 1057267 - RNA, 19 nt, Homo sapiens
guacaucguugucugaaaa

SEQ ID NO: 1057268 - RNA, 19 nt, Homo sapiens
cagaaugaguggagacuag

SEQ ID NO: 1057269 - RNA, 19 nt, Homo sapiens
aguguuaucuggaagguuu

SEQ ID NO: 1057270 - RNA, 19 nt, Homo sapiens
ggauguagacuuauaagca

SEQ ID NO: 1057271 - RNA, 19 nt, Homo sapiens
cagcaauucacgauuuaua

SEQ ID NO: 1057272 - RNA, 19 nt, Homo sapiens
aagcuuaaaucgucucaga

SEQ ID NO: 1057273 - RNA, 19 nt, Homo sapiens
aaauggcuguugcguauug

SEQ ID NO: 1057274 - RNA, 19 nt, Homo sapiens
cagcuggguuggcuucuga

SEQ ID NO: 1057275 - RNA, 19 nt, Homo sapiens
uuaggaaauuucugcauga

SEQ ID NO: 1057276 - RNA, 19 nt, Homo sapiens
gauuugucaucauagcuuu

SEQ ID NO: 1057277 - RNA, 19 nt, Homo sapiens
uuggagauuugucaucaua

SEQ ID NO: 1057278 - RNA, 19 nt, Homo sapiens
ggucauagcguggaaguuc

SEQ ID NO: 1057279 - RNA, 19 nt, Homo sapiens
gcugaagucuguccuugca

SEQ ID NO: 1057280 - RNA, 19 nt, Homo sapiens
uauuugaccugccugagaa

SEQ ID NO: 1057281 - RNA, 19 nt, Homo sapiens
agauuuaccagcucuauuu

SEQ ID NO: 1057282 - RNA, 19 nt, Homo sapiens
acggacagcuucuuccaaa

SEQ ID NO: 1057283 - RNA, 19 nt, Homo sapiens
uuaauguucuuccuaagug

SEQ ID NO: 1057284 - RNA, 19 nt, Homo sapiens
ggacuuacccugggcuuca

SEQ ID NO: 1057285 - RNA, 19 nt, Homo sapiens
ggcaggagauucgcuugaa

SEQ ID NO: 1057286 - RNA, 19 nt, Homo sapiens
ugccagcaauucacgauuu

SEQ ID NO: 1057287 - RNA, 19 nt, Homo sapiens
cgaugggauucaacaguuu

SEQ ID NO: 1057288 - RNA, 19 nt, Homo sapiens
gaauaugcacggccaguag

SEQ ID NO: 1057289 - RNA, 19 nt, Homo sapiens
gggcagaaagguuuagguu

SEQ ID NO: 1057290 - RNA, 19 nt, Homo sapiens
gggcagcaacucaguguga

SEQ ID NO: 1057291 - RNA, 19 nt, Homo sapiens
gggcugguauugaguugug

SEQ ID NO: 1057292 - RNA, 19 nt, Homo sapiens
gagaagcuucauaaaguau

SEQ ID NO: 1057293 - RNA, 19 nt, Homo sapiens
ucgaugggauucaacaguu

SEQ ID NO: 1057294 - RNA, 19 nt, Homo sapiens
gggagaugcauaagcuuaa

SEQ ID NO: 1057295 - RNA, 19 nt, Homo sapiens
ggugaaacccugucucuac

SEQ ID NO: 1057296 - RNA, 19 nt, Homo sapiens
ggacuuuggaaacaugauu

SEQ ID NO: 1057297 - RNA, 19 nt, Homo sapiens
ucucacaccguuuauauau

SEQ ID NO: 1057298 - RNA, 19 nt, Homo sapiens
uuaagaaugugcccuaagg

SEQ ID NO: 1057299 - RNA, 19 nt, Homo sapiens
caaagauccacaagaugaa

SEQ ID NO: 1057300 - RNA, 19 nt, Homo sapiens
gcaggaguaagauuaugaa

SEQ ID NO: 1057301 - RNA, 19 nt, Homo sapiens
gcggaacgcuguggacaag

SEQ ID NO: 1057302 - RNA, 19 nt, Homo sapiens
ggcccguucuuauagauga

SEQ ID NO: 1057303 - RNA, 19 nt, Homo sapiens
acagccaaguuuaaagauu

SEQ ID NO: 1057304 - RNA, 19 nt, Homo sapiens
gaacucuaaugggaaacug

SEQ ID NO: 1057305 - RNA, 19 nt, Homo sapiens
ggagagucgccgcagauga

SEQ ID NO: 1057306 - RNA, 19 nt, Homo sapiens
gguauugaguuguggacau

SEQ ID NO: 1057307 - RNA, 19 nt, Homo sapiens
guggagggcugguauugag

SEQ ID NO: 1057308 - RNA, 19 nt, Homo sapiens
gcaccauguuaucaucugu

SEQ ID NO: 1057309 - RNA, 19 nt, Homo sapiens
uuggugagcugaagucugu

SEQ ID NO: 1057310 - RNA, 19 nt, Homo sapiens
ugauaugucuaacuacgau

SEQ ID NO: 1057311 - RNA, 19 nt, Homo sapiens
caacucagugugaauuuag

SEQ ID NO: 1057312 - RNA, 19 nt, Homo sapiens
uaucucacaccguuuauau

SEQ ID NO: 1057313 - RNA, 19 nt, Homo sapiens
guuuaucucacaccguuua

SEQ ID NO: 1057314 - RNA, 19 nt, Homo sapiens
gcacgauuccagcagaguu

SEQ ID NO: 1057315 - RNA, 19 nt, Homo sapiens
ggagauuugucaucauagc

SEQ ID NO: 1057316 - RNA, 19 nt, Homo sapiens
uuagaucucuggaacacau

SEQ ID NO: 1057317 - RNA, 19 nt, Homo sapiens
uuaaaguucuaagggauug

SEQ ID NO: 1057318 - RNA, 19 nt, Homo sapiens
ccaaaaccuucaucugauu

SEQ ID NO: 1057319 - RNA, 19 nt, Homo sapiens
gcgagagaacugcuaucua

SEQ ID NO: 1057320 - RNA, 19 nt, Homo sapiens
ggaaccuccugcuggacuu

SEQ ID NO: 1057321 - RNA, 19 nt, Homo sapiens
gcuggacuuuggaaacaug

SEQ ID NO: 1057322 - RNA, 19 nt, Homo sapiens
cacaaaagaucaauuccaa

SEQ ID NO: 1057323 - RNA, 19 nt, Homo sapiens
gaacauggcuuaaugaaag

SEQ ID NO: 1057324 - RNA, 19 nt, Homo sapiens
ggagaaagcuguaaaucuu

SEQ ID NO: 1057325 - RNA, 19 nt, Homo sapiens
aauaguagcucuucuagua

SEQ ID NO: 1057326 - RNA, 19 nt, Homo sapiens
ggaaguaacaguuuaguaa

SEQ ID NO: 1057327 - RNA, 19 nt, Homo sapiens
gaagaggagugucgaaaug

SEQ ID NO: 1057328 - RNA, 19 nt, Homo sapiens
gcagguaucuggccaaugu

SEQ ID NO: 1057329 - RNA, 19 nt, Homo sapiens
ggucagcucuugauuauuc

SEQ ID NO: 1057330 - RNA, 19 nt, Homo sapiens
uguaauaucuggcguguuu

SEQ ID NO: 1057331 - RNA, 19 nt, Homo sapiens
caacacuccucuacaguuu

SEQ ID NO: 1057332 - RNA, 19 nt, Homo sapiens
aagaagagguuauagauga

SEQ ID NO: 1057333 - RNA, 19 nt, Homo sapiens
gaaagaagagguuauagau

SEQ ID NO: 1057334 - RNA, 19 nt, Homo sapiens
caaagacaaugcagacuug

SEQ ID NO: 1057335 - RNA, 19 nt, Homo sapiens
gcaaaugguguuucgguua

SEQ ID NO: 1057336 - RNA, 19 nt, Homo sapiens
gggaggaaguaacaguuua

SEQ ID NO: 1057337 - RNA, 19 nt, Homo sapiens
gaaauaggcaaggauagua

SEQ ID NO: 1057338 - RNA, 19 nt, Homo sapiens
gaagaagggaugacucaaa

SEQ ID NO: 1057339 - RNA, 19 nt, Homo sapiens
gcaacucuguuucaaaugu

SEQ ID NO: 1057340 - RNA, 19 nt, Homo sapiens
gaaguaaguagacaagaaa

SEQ ID NO: 1057341 - RNA, 19 nt, Homo sapiens
gaaccuaggccgagcauau

SEQ ID NO: 1057342 - RNA, 19 nt, Homo sapiens
gaaacaagaagcuaaggaa

SEQ ID NO: 1057343 - RNA, 19 nt, Homo sapiens
caacgacccuaaacauguu

SEQ ID NO: 1057344 - RNA, 19 nt, Homo sapiens
ggaggaaugagacaugaua

SEQ ID NO: 1057345 - RNA, 19 nt, Homo sapiens
ugaaguaaguagacaagaa

SEQ ID NO: 1057346 - RNA, 19 nt, Homo sapiens
ccauaugguugccagcuua

SEQ ID NO: 1057347 - RNA, 19 nt, Homo sapiens
caagaaauaggcaaggaua

SEQ ID NO: 1057348 - RNA, 19 nt, Homo sapiens
gauaggaagccuuuacauu

SEQ ID NO: 1057349 - RNA, 19 nt, Homo sapiens
gaucagcccuuggaacaga

SEQ ID NO: 1057350 - RNA, 19 nt, Homo sapiens
gcuguaacauuugaacuuu

SEQ ID NO: 1057351 - RNA, 19 nt, Homo sapiens
guugccagcuuauuucuuu

SEQ ID NO: 1057352 - RNA, 19 nt, Homo sapiens
uagcaacucuguuucaaau

SEQ ID NO: 1057353 - RNA, 19 nt, Homo sapiens
uaggaagccuuuacauuug

SEQ ID NO: 1057354 - RNA, 19 nt, Homo sapiens
gaagagaaagaagagguua

SEQ ID NO: 1057355 - RNA, 19 nt, Homo sapiens
caaccgugcugcaucuaaa

SEQ ID NO: 1057356 - RNA, 19 nt, Homo sapiens
ccagucacaucucuuacua

SEQ ID NO: 1057357 - RNA, 19 nt, Homo sapiens
cagggaagauagaaaggua

SEQ ID NO: 1057358 - RNA, 19 nt, Homo sapiens
acaccuugcuguaacauuu

SEQ ID NO: 1057359 - RNA, 19 nt, Homo sapiens
gaauauaugacagguguaa

SEQ ID NO: 1057360 - RNA, 19 nt, Homo sapiens
ccaccaagaauacuguuua

SEQ ID NO: 1057361 - RNA, 19 nt, Homo sapiens
gcaaugaguuguguugaag

SEQ ID NO: 1057362 - RNA, 19 nt, Homo sapiens
aaacagcacuggcagcaau

SEQ ID NO: 1057363 - RNA, 19 nt, Homo sapiens
gcaacgacccuaaacaugu

SEQ ID NO: 1057364 - RNA, 19 nt, Homo sapiens
ggaaggauaccgagugguu

SEQ ID NO: 1057365 - RNA, 19 nt, Homo sapiens
gcucagcacucucuaaagg

SEQ ID NO: 1057366 - RNA, 19 nt, Homo sapiens
gcgguaagcccaucagauu

SEQ ID NO: 1057367 - RNA, 19 nt, Homo sapiens
gaagagggaggaaguaaca

SEQ ID NO: 1057368 - RNA, 19 nt, Homo sapiens
gcacagucuucucucuuug

SEQ ID NO: 1057369 - RNA, 19 nt, Homo sapiens
gauauaggccaauugcauu

SEQ ID NO: 1057370 - RNA, 19 nt, Homo sapiens
gagaguaacaucacagaga

SEQ ID NO: 1057371 - RNA, 19 nt, Homo sapiens
guaagaagcgcuggauaaa

SEQ ID NO: 1057372 - RNA, 19 nt, Homo sapiens
caaaugguguuucgguuag

SEQ ID NO: 1057373 - RNA, 19 nt, Homo sapiens
aagcagagacuauaaagaa

SEQ ID NO: 1057374 - RNA, 19 nt, Homo sapiens
uaucugcgguuuccaauuc

SEQ ID NO: 1057375 - RNA, 19 nt, Homo sapiens
auaggaagccuuuacauuu

SEQ ID NO: 1057376 - RNA, 19 nt, Homo sapiens
uaggauaccuugacuccaa

SEQ ID NO: 1057377 - RNA, 19 nt, Homo sapiens
gcagaaugucaccaaguua

SEQ ID NO: 1057378 - RNA, 19 nt, Homo sapiens
gcaaagacaaugcagacuu

SEQ ID NO: 1057379 - RNA, 19 nt, Homo sapiens
ggaaugagacaugauauag

SEQ ID NO: 1057380 - RNA, 19 nt, Homo sapiens
ugaaagggccugugaagga

SEQ ID NO: 1057381 - RNA, 19 nt, Homo sapiens
gaacucagcaccuauacca

SEQ ID NO: 1057382 - RNA, 19 nt, Homo sapiens
gcagauuauuugaguagau

SEQ ID NO: 1057383 - RNA, 19 nt, Homo sapiens
gggagcagauuauuugagu

SEQ ID NO: 1057384 - RNA, 19 nt, Homo sapiens
gagggugccuggcucuuug

SEQ ID NO: 1057385 - RNA, 19 nt, Homo sapiens
gagaauaucagcaguaggu

SEQ ID NO: 1057386 - RNA, 19 nt, Homo sapiens
acauucagcuccuguaaga

SEQ ID NO: 1057387 - RNA, 19 nt, Homo sapiens
gagaaggcccagagacauu

SEQ ID NO: 1057388 - RNA, 19 nt, Homo sapiens
caagagaauaucagcagua

SEQ ID NO: 1057389 - RNA, 19 nt, Homo sapiens
gcacauucagcuccuguaa

SEQ ID NO: 1057390 - RNA, 19 nt, Homo sapiens
cagaaugguugaaugacaa

SEQ ID NO: 1057391 - RNA, 19 nt, Homo sapiens
ggaugcugguuucuuugua

SEQ ID NO: 1057392 - RNA, 19 nt, Homo sapiens
ggcaauaaauuucauuagg

SEQ ID NO: 1057393 - RNA, 19 nt, Homo sapiens
guagguauguaaauguuca

SEQ ID NO: 1057394 - RNA, 19 nt, Homo sapiens
aaagguagguauguaaaug

SEQ ID NO: 1057395 - RNA, 19 nt, Homo sapiens
gcaacacuccucuacaguu

SEQ ID NO: 1057396 - RNA, 19 nt, Homo sapiens
caacuguggugucaauuac

SEQ ID NO: 1057397 - RNA, 19 nt, Homo sapiens
gaugcugguuucuuuguau

SEQ ID NO: 1057398 - RNA, 19 nt, Homo sapiens
gagagugggcccagugaaa

SEQ ID NO: 1057399 - RNA, 19 nt, Homo sapiens
uaaaagagccaaucucaaa

SEQ ID NO: 1057400 - RNA, 19 nt, Homo sapiens
aggaggagcugcccuucua

SEQ ID NO: 1057401 - RNA, 19 nt, Homo sapiens
agaguaacaucacagagaa

SEQ ID NO: 1057402 - RNA, 19 nt, Homo sapiens
cugcagaccucaagagaau

SEQ ID NO: 1057403 - RNA, 19 nt, Homo sapiens
gaaauggaagucucgcuau

SEQ ID NO: 1057404 - RNA, 19 nt, Homo sapiens
gacuagaacucagcaccua

SEQ ID NO: 1057405 - RNA, 19 nt, Homo sapiens
aaacaagccuuagaagaag

SEQ ID NO: 1057406 - RNA, 19 nt, Homo sapiens
ccaacuguggugucaauua

SEQ ID NO: 1057407 - RNA, 19 nt, Homo sapiens
gggaaugcuucgaauuuua

SEQ ID NO: 1057408 - RNA, 19 nt, Homo sapiens
ggagcagauuauuugagua

SEQ ID NO: 1057409 - RNA, 19 nt, Homo sapiens
cagagacuauaaagaaguu

SEQ ID NO: 1057410 - RNA, 19 nt, Homo sapiens
cuacucaacucaggucauu

SEQ ID NO: 1057411 - RNA, 19 nt, Homo sapiens
gauagaccuucccuacuca

SEQ ID NO: 1057412 - RNA, 19 nt, Homo sapiens
uaccaggucuuauccauuc

SEQ ID NO: 1057413 - RNA, 19 nt, Homo sapiens
ccaagaauacuguuuaucu

SEQ ID NO: 1057414 - RNA, 19 nt, Homo sapiens
ucuaguaucugcaaagaca

SEQ ID NO: 1057415 - RNA, 19 nt, Homo sapiens
caacucuguuucaaauguu

SEQ ID NO: 1057416 - RNA, 19 nt, Homo sapiens
ggagaaaacaggccauuaa

SEQ ID NO: 1057417 - RNA, 19 nt, Homo sapiens
cagcuuauuucuuucacuu

SEQ ID NO: 1057418 - RNA, 19 nt, Homo sapiens
gacaugauauaggccaauu

SEQ ID NO: 1057419 - RNA, 19 nt, Homo sapiens
ucaccagucacaucucuua

SEQ ID NO: 1057420 - RNA, 19 nt, Homo sapiens
ugucaaggguacauuguug

SEQ ID NO: 1057421 - RNA, 19 nt, Homo sapiens
caauguguguccaccaaga

SEQ ID NO: 1057422 - RNA, 19 nt, Homo sapiens
uuacagcccuuccagauac

SEQ ID NO: 1057423 - RNA, 19 nt, Homo sapiens
ccaggcaggugaugucuuu

SEQ ID NO: 1057424 - RNA, 19 nt, Homo sapiens
ucaaugagaugguccacuu

SEQ ID NO: 1057425 - RNA, 19 nt, Homo sapiens
caacaaggaacaccaagaa

SEQ ID NO: 1057426 - RNA, 19 nt, Homo sapiens
ucaaugaccgcaucaauga

SEQ ID NO: 1057427 - RNA, 19 nt, Homo sapiens
aguccaagcucaaagagua

SEQ ID NO: 1057428 - RNA, 19 nt, Homo sapiens
caaggaacaccaagaagaa

SEQ ID NO: 1057429 - RNA, 19 nt, Homo sapiens
ugacaaguauguucuuaag

SEQ ID NO: 1057430 - RNA, 19 nt, Homo sapiens
ggacaaauggagcaacuuc

SEQ ID NO: 1057431 - RNA, 19 nt, Homo sapiens
ggacuacgccaucaugaca

SEQ ID NO: 1057432 - RNA, 19 nt, Homo sapiens
gaaacucgcccugcacuca

SEQ ID NO: 1057433 - RNA, 19 nt, Homo sapiens
gaaagcagcgccugaagcu

SEQ ID NO: 1057434 - RNA, 19 nt, Homo sapiens
gagacacucuugggagaug

SEQ ID NO: 1057435 - RNA, 19 nt, Homo sapiens
cgacaucgccauagcaaca

SEQ ID NO: 1057436 - RNA, 19 nt, Homo sapiens
ggagaaugcagacaucauc

SEQ ID NO: 1057437 - RNA, 19 nt, Homo sapiens
gaagcgagccaccgagaag

SEQ ID NO: 1057438 - RNA, 19 nt, Homo sapiens
gcaacaaggaacaccaaga

SEQ ID NO: 1057439 - RNA, 19 nt, Homo sapiens
agcagcaacuucucaauga

SEQ ID NO: 1057440 - RNA, 19 nt, Homo sapiens
gggagcgccuggugagaau

SEQ ID NO: 1057441 - RNA, 19 nt, Homo sapiens
gcaaccaaccagagcaguu

SEQ ID NO: 1057442 - RNA, 19 nt, Homo sapiens
acaaggaacaccaagaaga

SEQ ID NO: 1057443 - RNA, 19 nt, Homo sapiens
ggcaggugaugucuuuguu

SEQ ID NO: 1057444 - RNA, 19 nt, Homo sapiens
gagaauguauuuugacaag

SEQ ID NO: 1057445 - RNA, 19 nt, Homo sapiens
gcacagcaacaaguucaug

SEQ ID NO: 1057446 - RNA, 19 nt, Homo sapiens
gcaacaguccaagcucaaa

SEQ ID NO: 1057447 - RNA, 19 nt, Homo sapiens
ccaaggacgcccugaaucu

SEQ ID NO: 1057448 - RNA, 19 nt, Homo sapiens
gagcugcggcacaagaaug

SEQ ID NO: 1057449 - RNA, 19 nt, Homo sapiens
cagcagcaacuucucaaug

SEQ ID NO: 1057450 - RNA, 19 nt, Homo sapiens
ggaagcgagccaccgagaa

SEQ ID NO: 1057451 - RNA, 19 nt, Homo sapiens
gaagaaccgcagccuguac

SEQ ID NO: 1057452 - RNA, 19 nt, Homo sapiens
ggacggcuggcaccuuguu

SEQ ID NO: 1057453 - RNA, 19 nt, Homo sapiens
gaagaugugcuggcugaag

SEQ ID NO: 1057454 - RNA, 19 nt, Homo sapiens
gcgagcagauccgccugaa

SEQ ID NO: 1057455 - RNA, 19 nt, Homo sapiens
gggucuguuuaccuaauaa

SEQ ID NO: 1057456 - RNA, 19 nt, Homo sapiens
caggugaugucuuuguucu

SEQ ID NO: 1057457 - RNA, 19 nt, Homo sapiens
gcgagccaccgagaagaua

SEQ ID NO: 1057458 - RNA, 19 nt, Homo sapiens
ggucuacucagccaagaau

SEQ ID NO: 1057459 - RNA, 19 nt, Homo sapiens
gcgggagaaugcagacauc

SEQ ID NO: 1057460 - RNA, 19 nt, Homo sapiens
cagcagcaccagcagaaga

SEQ ID NO: 1057461 - RNA, 19 nt, Homo sapiens
ucguggcucuucggcauua

SEQ ID NO: 1057462 - RNA, 19 nt, Homo sapiens
caucaaugaccgcaucaau

SEQ ID NO: 1057463 - RNA, 19 nt, Homo sapiens
gacgcuguuugccaagaaa

SEQ ID NO: 1057464 - RNA, 19 nt, Homo sapiens
cuggagcacucgcguuaug

SEQ ID NO: 1057465 - RNA, 19 nt, Homo sapiens
gauggacacccgcgugcaa

SEQ ID NO: 1057466 - RNA, 19 nt, Homo sapiens
caaccaaccagagcaguuc

SEQ ID NO: 1057467 - RNA, 19 nt, Homo sapiens
agauggagcugcggcacaa

SEQ ID NO: 1057468 - RNA, 19 nt, Homo sapiens
cagcacagcaacaaguuca

SEQ ID NO: 1057469 - RNA, 19 nt, Homo sapiens
agacgcuguuugccaagaa

SEQ ID NO: 1057470 - RNA, 19 nt, Homo sapiens
gcuggggucuguuuaccua

SEQ ID NO: 1057471 - RNA, 19 nt, Homo sapiens
gcaggugaugucuuuguuc

SEQ ID NO: 1057472 - RNA, 19 nt, Homo sapiens
ccagggcccaguaucaaga

SEQ ID NO: 1057473 - RNA, 19 nt, Homo sapiens
gcaccgggaagacgcuguu

SEQ ID NO: 1057474 - RNA, 19 nt, Homo sapiens
gcuacgaggaccaacugaa

SEQ ID NO: 1057475 - RNA, 19 nt, Homo sapiens
agaagaaccgcagccugua

SEQ ID NO: 1057476 - RNA, 19 nt, Homo sapiens
ggacacccgcgugcaagau

SEQ ID NO: 1057477 - RNA, 19 nt, Homo sapiens
gcucuucggcauuaacaag

SEQ ID NO: 1057478 - RNA, 19 nt, Homo sapiens
caaggacgcccugaaucug

SEQ ID NO: 1057479 - RNA, 19 nt, Homo sapiens
cgagccaccgagaagauaa

SEQ ID NO: 1057480 - RNA, 19 nt, Homo sapiens
acaaauggagcaacuucga

SEQ ID NO: 1057481 - RNA, 19 nt, Homo sapiens
caacaguccaagcucaaag

SEQ ID NO: 1057482 - RNA, 19 nt, Homo sapiens
acucuugggagaugcauuu

SEQ ID NO: 1057483 - RNA, 19 nt, Homo sapiens
cuacgaggaccaacugaag

SEQ ID NO: 1057484 - RNA, 19 nt, Homo sapiens
ucgacugggccaucaauga

SEQ ID NO: 1057485 - RNA, 19 nt, Homo sapiens
ggaggaguccgugcagaag

SEQ ID NO: 1057486 - RNA, 19 nt, Homo sapiens
gagcgccuggugagaaugu

SEQ ID NO: 1057487 - RNA, 19 nt, Homo sapiens
gcagcagcaacuucucaau

SEQ ID NO: 1057488 - RNA, 19 nt, Homo sapiens
gcacucaggcauggacuac

SEQ ID NO: 1057489 - RNA, 19 nt, Homo sapiens
ggaggguguugugcucagu

SEQ ID NO: 1057490 - RNA, 19 nt, Homo sapiens
ggauuccgugccuuuguga

SEQ ID NO: 1057491 - RNA, 19 nt, Homo sapiens
gagccaggcaggugauguc

SEQ ID NO: 1057492 - RNA, 19 nt, Homo sapiens
ucaaugaggagaauuuacg

SEQ ID NO: 1057493 - RNA, 19 nt, Homo sapiens
ggcccaguaucaagacaag

SEQ ID NO: 1057494 - RNA, 19 nt, Homo sapiens
gcugaggagaggaggaaga

SEQ ID NO: 1057495 - RNA, 19 nt, Homo sapiens
ggaacaaggucuuaauaaa

SEQ ID NO: 1057496 - RNA, 19 nt, Homo sapiens
ccacaucuaugguaauuaa

SEQ ID NO: 1057497 - RNA, 19 nt, Homo sapiens
gaaauuggaugcauauaag

SEQ ID NO: 1057498 - RNA, 19 nt, Homo sapiens
gcaaagagaaccaaagaaa

SEQ ID NO: 1057499 - RNA, 19 nt, Homo sapiens
gaggaaaguuuguugagaa

SEQ ID NO: 1057500 - RNA, 19 nt, Homo sapiens
ggaaauguccuuggcuuua

SEQ ID NO: 1057501 - RNA, 19 nt, Homo sapiens
ggucagaauuauuguguaa

SEQ ID NO: 1057502 - RNA, 19 nt, Homo sapiens
caagggacuuuguauuauu

SEQ ID NO: 1057503 - RNA, 19 nt, Homo sapiens
ggaauagaauaucaggaaa

SEQ ID NO: 1057504 - RNA, 19 nt, Homo sapiens
ucaaguuucuguucuguuu

SEQ ID NO: 1057505 - RNA, 19 nt, Homo sapiens
guucuuaacucaaguagga

SEQ ID NO: 1057506 - RNA, 19 nt, Homo sapiens
guaaagugcucugcccuaa

SEQ ID NO: 1057507 - RNA, 19 nt, Homo sapiens
gguauggguuggaucauuu

SEQ ID NO: 1057508 - RNA, 19 nt, Homo sapiens
uaagugaguucuucagcua

SEQ ID NO: 1057509 - RNA, 19 nt, Homo sapiens
caacagcucuuuuaaguga

SEQ ID NO: 1057510 - RNA, 19 nt, Homo sapiens
aaagaaaggcuguuaauuc

SEQ ID NO: 1057511 - RNA, 19 nt, Homo sapiens
gaaaguuuguugagaagca

SEQ ID NO: 1057512 - RNA, 19 nt, Homo sapiens
ggaggaaaguuuguugaga

SEQ ID NO: 1057513 - RNA, 19 nt, Homo sapiens
gcaaagaaaggcuguuaau

SEQ ID NO: 1057514 - RNA, 19 nt, Homo sapiens
aaacgucccugcaaaguuc

SEQ ID NO: 1057515 - RNA, 19 nt, Homo sapiens
gcaugcaaaucuuauuguu

SEQ ID NO: 1057516 - RNA, 19 nt, Homo sapiens
ucugaacacugacuacuuu

SEQ ID NO: 1057517 - RNA, 19 nt, Homo sapiens
aaagugcucugcccuaaga

SEQ ID NO: 1057518 - RNA, 19 nt, Homo sapiens
guaauagguuugggaaaga

SEQ ID NO: 1057519 - RNA, 19 nt, Homo sapiens
gggaauagaauaucaggaa

SEQ ID NO: 1057520 - RNA, 19 nt, Homo sapiens
ggaaggaguggaagaguug

SEQ ID NO: 1057521 - RNA, 19 nt, Homo sapiens
gccagaaauuggaugcaua

SEQ ID NO: 1057522 - RNA, 19 nt, Homo sapiens
gaaauguccuuggcuuuac

SEQ ID NO: 1057523 - RNA, 19 nt, Homo sapiens
gaaacgucccugcaaaguu

SEQ ID NO: 1057524 - RNA, 19 nt, Homo sapiens
aaccgauucuccauaaaua

SEQ ID NO: 1057525 - RNA, 19 nt, Homo sapiens
caaagaaaggcuguuaauu

SEQ ID NO: 1057526 - RNA, 19 nt, Homo sapiens
uuuaggagcugcuucauuc

SEQ ID NO: 1057527 - RNA, 19 nt, Homo sapiens
ggccacaucuaugguaauu

SEQ ID NO: 1057528 - RNA, 19 nt, Homo sapiens
guccuuggcuuuacgauuc

SEQ ID NO: 1057529 - RNA, 19 nt, Homo sapiens
ccugagauuucuaugguuu

SEQ ID NO: 1057530 - RNA, 19 nt, Homo sapiens
ccaggaacaucagcaaaga

SEQ ID NO: 1057531 - RNA, 19 nt, Homo sapiens
uggguuggaucauuuguuu

SEQ ID NO: 1057532 - RNA, 19 nt, Homo sapiens
caaugggaauagaauauca

SEQ ID NO: 1057533 - RNA, 19 nt, Homo sapiens
gcaaaguucugagacacau

SEQ ID NO: 1057534 - RNA, 19 nt, Homo sapiens
gauaccaaucccuccauua

SEQ ID NO: 1057535 - RNA, 19 nt, Homo sapiens
uagagaaccauauucauug

SEQ ID NO: 1057536 - RNA, 19 nt, Homo sapiens
ggacuugaguaaaauggua

SEQ ID NO: 1057537 - RNA, 19 nt, Homo sapiens
caggaacaaggucuuaaua

SEQ ID NO: 1057538 - RNA, 19 nt, Homo sapiens
ucagcaggcuucuaaucaa

SEQ ID NO: 1057539 - RNA, 19 nt, Homo sapiens
uggaagaguuggaaaauuu

SEQ ID NO: 1057540 - RNA, 19 nt, Homo sapiens
ugagggaguuaauacaguu

SEQ ID NO: 1057541 - RNA, 19 nt, Homo sapiens
ucuaaacugccaccuguua

SEQ ID NO: 1057542 - RNA, 19 nt, Homo sapiens
cagcaaagagaaccaaaga

SEQ ID NO: 1057543 - RNA, 19 nt, Homo sapiens
caaguaggaguaaaccaaa

SEQ ID NO: 1057544 - RNA, 19 nt, Homo sapiens
cuuaauaaccugagauuuc

SEQ ID NO: 1057545 - RNA, 19 nt, Homo sapiens
caccacacccagcuaauuu

SEQ ID NO: 1057546 - RNA, 19 nt, Homo sapiens
ucaauugcuuugccaggaa

SEQ ID NO: 1057547 - RNA, 19 nt, Homo sapiens
auuaaccgauucuccauaa

SEQ ID NO: 1057548 - RNA, 19 nt, Homo sapiens
gaacaucagcaaagagaac

SEQ ID NO: 1057549 - RNA, 19 nt, Homo sapiens
cuauguguauuguuccuuu

SEQ ID NO: 1057550 - RNA, 19 nt, Homo sapiens
ugagacacauccuccugaa

SEQ ID NO: 1057551 - RNA, 19 nt, Homo sapiens
gugauggacuugaguaaaa

SEQ ID NO: 1057552 - RNA, 19 nt, Homo sapiens
ugacucguuuguucuuuau

SEQ ID NO: 1057553 - RNA, 19 nt, Homo sapiens
aagaaaggcuguuaauucc

SEQ ID NO: 1057554 - RNA, 19 nt, Homo sapiens
gaucagcaggcuucuaauc

SEQ ID NO: 1057555 - RNA, 19 nt, Homo sapiens
gaacacugacuacuuuagg

SEQ ID NO: 1057556 - RNA, 19 nt, Homo sapiens
ucacaggaacaaggucuua

SEQ ID NO: 1057557 - RNA, 19 nt, Homo sapiens
ggguucaccugcaguuuca

SEQ ID NO: 1057558 - RNA, 19 nt, Homo sapiens
uccauuaccuucuaaacug

SEQ ID NO: 1057559 - RNA, 19 nt, Homo sapiens
uaauagguuugggaaagaa

SEQ ID NO: 1057560 - RNA, 19 nt, Homo sapiens
uguaauagguuugggaaag

SEQ ID NO: 1057561 - RNA, 19 nt, Homo sapiens
ucaaguaggaguaaaccaa

SEQ ID NO: 1057562 - RNA, 19 nt, Homo sapiens
uaaccgauucuccauaaau

SEQ ID NO: 1057563 - RNA, 19 nt, Homo sapiens
ugagauuucuaugguuuga

SEQ ID NO: 1057564 - RNA, 19 nt, Homo sapiens
gcaagaagggagagugagu

SEQ ID NO: 1057565 - RNA, 19 nt, Homo sapiens
ggaaacgucccugcaaagu

SEQ ID NO: 1057566 - RNA, 19 nt, Homo sapiens
uggaaggaguggaagaguu

SEQ ID NO: 1057567 - RNA, 19 nt, Homo sapiens
ccucuugaguagcuaggua

SEQ ID NO: 1057568 - RNA, 19 nt, Homo sapiens
caucuaugguaauuaaugg

SEQ ID NO: 1057569 - RNA, 19 nt, Homo sapiens
ccagaaauuggaugcauau

SEQ ID NO: 1057570 - RNA, 19 nt, Homo sapiens
ggucaaguuucuguucugu

SEQ ID NO: 1057571 - RNA, 19 nt, Homo sapiens
aagcaagggaggaaaguuu

SEQ ID NO: 1057572 - RNA, 19 nt, Homo sapiens
gcaguuucaugcuggucaa

SEQ ID NO: 1057573 - RNA, 19 nt, Homo sapiens
gcuccaaaggccagaaauu

SEQ ID NO: 1057574 - RNA, 19 nt, Homo sapiens
uuacgauucugcuuguaga

SEQ ID NO: 1057575 - RNA, 19 nt, Homo sapiens
gcuuuacgauucugcuugu

SEQ ID NO: 1057576 - RNA, 19 nt, Homo sapiens
uaaugacaguuuccaacau

SEQ ID NO: 1057577 - RNA, 19 nt, Homo sapiens
gcaaaucuuauuguuagug

SEQ ID NO: 1057578 - RNA, 19 nt, Homo sapiens
gacacauccuccugaagug

SEQ ID NO: 1057579 - RNA, 19 nt, Homo sapiens
ucaaacuccuggacucaag

SEQ ID NO: 1057580 - RNA, 19 nt, Homo sapiens
ccgauucuccauaaauaaa

SEQ ID NO: 1057581 - RNA, 19 nt, Homo sapiens
aggaacaaggucuuaauaa

SEQ ID NO: 1057582 - RNA, 19 nt, Homo sapiens
caucuguuguauuuagaga

SEQ ID NO: 1057583 - RNA, 19 nt, Homo sapiens
ggagcugcuucauuccaau

SEQ ID NO: 1057584 - RNA, 19 nt, Homo sapiens
aaacuucuccccugcuuua

SEQ ID NO: 1057585 - RNA, 19 nt, Homo sapiens
ggcaaagaaaggcuguuaa

SEQ ID NO: 1057586 - RNA, 19 nt, Homo sapiens
gcauugugauggacuugag

SEQ ID NO: 1057587 - RNA, 19 nt, Homo sapiens
guucuucagcuaagcauug

SEQ ID NO: 1057588 - RNA, 19 nt, Homo sapiens
ccaccacacccagcuaauu

SEQ ID NO: 1057589 - RNA, 19 nt, Homo sapiens
caaucucaguucagugcaa

SEQ ID NO: 1057590 - RNA, 19 nt, Homo sapiens
agacacauccuccugaagu

SEQ ID NO: 1057591 - RNA, 19 nt, Homo sapiens
ugucaaaggcaguaaagug

SEQ ID NO: 1057592 - RNA, 19 nt, Homo sapiens
cacuuauccugauuuaaug

SEQ ID NO: 1057593 - RNA, 19 nt, Homo sapiens
uuuauuaguuggugguaug

SEQ ID NO: 1057594 - RNA, 19 nt, Homo sapiens
gagcugcuucauuccaauu

SEQ ID NO: 1057595 - RNA, 19 nt, Homo sapiens
gcaaagaccaacauuauua

SEQ ID NO: 1057596 - RNA, 19 nt, Homo sapiens
gaacaaaccugguauaaaa

SEQ ID NO: 1057597 - RNA, 19 nt, Homo sapiens
caacagagcccauucauaa

SEQ ID NO: 1057598 - RNA, 19 nt, Homo sapiens
gcaguuaauugaugcuuua

SEQ ID NO: 1057599 - RNA, 19 nt, Homo sapiens
gaaacaaaccucacugaaa

SEQ ID NO: 1057600 - RNA, 19 nt, Homo sapiens
caaacacacuuuaaagcua

SEQ ID NO: 1057601 - RNA, 19 nt, Homo sapiens
gaacucacuuuauugauca

SEQ ID NO: 1057602 - RNA, 19 nt, Homo sapiens
ggaguaacaucucagaaga

SEQ ID NO: 1057603 - RNA, 19 nt, Homo sapiens
aaacaaaccucacugaaag

SEQ ID NO: 1057604 - RNA, 19 nt, Homo sapiens
caacacaccucaggagaaa

SEQ ID NO: 1057605 - RNA, 19 nt, Homo sapiens
uugaaagacucuaugguua

SEQ ID NO: 1057606 - RNA, 19 nt, Homo sapiens
gagcuuagacuguauuuca

SEQ ID NO: 1057607 - RNA, 19 nt, Homo sapiens
gaacaccuuucuagauaca

SEQ ID NO: 1057608 - RNA, 19 nt, Homo sapiens
guacagacugcaauagaua

SEQ ID NO: 1057609 - RNA, 19 nt, Homo sapiens
uaacaggccaguucaguuu

SEQ ID NO: 1057610 - RNA, 19 nt, Homo sapiens
gaucugaugugauguaugc

SEQ ID NO: 1057611 - RNA, 19 nt, Homo sapiens
acagagugauguuccaaua

SEQ ID NO: 1057612 - RNA, 19 nt, Homo sapiens
ggaaagagagaauuaucaa

SEQ ID NO: 1057613 - RNA, 19 nt, Homo sapiens
aaagacagcuaugaugaaa

SEQ ID NO: 1057614 - RNA, 19 nt, Homo sapiens
gaaaguaccuacagaaaag

SEQ ID NO: 1057615 - RNA, 19 nt, Homo sapiens
gaaagacucuaugguuagu

SEQ ID NO: 1057616 - RNA, 19 nt, Homo sapiens
ucaacagucuucucaauca

SEQ ID NO: 1057617 - RNA, 19 nt, Homo sapiens
gcuaauuccugccucaaga

SEQ ID NO: 1057618 - RNA, 19 nt, Homo sapiens
cuacaaggcuggaacucaa

SEQ ID NO: 1057619 - RNA, 19 nt, Homo sapiens
uaacaucucagaagacuau

SEQ ID NO: 1057620 - RNA, 19 nt, Homo sapiens
cuaagaaagugcaguuaau

SEQ ID NO: 1057621 - RNA, 19 nt, Homo sapiens
uggaacauuugcaguauaa

SEQ ID NO: 1057622 - RNA, 19 nt, Homo sapiens
ggacagagugcucagaguu

SEQ ID NO: 1057623 - RNA, 19 nt, Homo sapiens
gaagcugggcagaaagaua

SEQ ID NO: 1057624 - RNA, 19 nt, Homo sapiens
aaaccucacugaaagcauu

SEQ ID NO: 1057625 - RNA, 19 nt, Homo sapiens
cagcaguguucaagacuuu

SEQ ID NO: 1057626 - RNA, 19 nt, Homo sapiens
gcuaagaaagugcaguuaa

SEQ ID NO: 1057627 - RNA, 19 nt, Homo sapiens
uauaagguauugcaggaaa

SEQ ID NO: 1057628 - RNA, 19 nt, Homo sapiens
aagagaagcugggcagaaa

SEQ ID NO: 1057629 - RNA, 19 nt, Homo sapiens
ucuacuaucuccauccuaa

SEQ ID NO: 1057630 - RNA, 19 nt, Homo sapiens
ccaauagauuuacuugaug

SEQ ID NO: 1057631 - RNA, 19 nt, Homo sapiens
agacagcuaugaugaaauc

SEQ ID NO: 1057632 - RNA, 19 nt, Homo sapiens
acagggaucugaugugaug

SEQ ID NO: 1057633 - RNA, 19 nt, Homo sapiens
gaccaacauuauuaccuuu

SEQ ID NO: 1057634 - RNA, 19 nt, Homo sapiens
auaaagaugaugccaguua

SEQ ID NO: 1057635 - RNA, 19 nt, Homo sapiens
gaaaagacagcuaugauga

SEQ ID NO: 1057636 - RNA, 19 nt, Homo sapiens
ccaaggaucauguaagaga

SEQ ID NO: 1057637 - RNA, 19 nt, Homo sapiens
gacaacauuucuacuaucu

SEQ ID NO: 1057638 - RNA, 19 nt, Homo sapiens
gguacagacugcaauagau

SEQ ID NO: 1057639 - RNA, 19 nt, Homo sapiens
ggagguauuuuguguauug

SEQ ID NO: 1057640 - RNA, 19 nt, Homo sapiens
gagaagaccuuuuguuugg

SEQ ID NO: 1057641 - RNA, 19 nt, Homo sapiens
gaaaacaguuccucuccuu

SEQ ID NO: 1057642 - RNA, 19 nt, Homo sapiens
aaagugcaguuaauugaug

SEQ ID NO: 1057643 - RNA, 19 nt, Homo sapiens
uaucaacagucuucucaau

SEQ ID NO: 1057644 - RNA, 19 nt, Homo sapiens
guacgcaagugggaaauuc

SEQ ID NO: 1057645 - RNA, 19 nt, Homo sapiens
uuacagggaucugauguga

SEQ ID NO: 1057646 - RNA, 19 nt, Homo sapiens
caaggaucauguaagagaa

SEQ ID NO: 1057647 - RNA, 19 nt, Homo sapiens
agagugauguuccaauaga

SEQ ID NO: 1057648 - RNA, 19 nt, Homo sapiens
gaugccaguuacagccuua

SEQ ID NO: 1057649 - RNA, 19 nt, Homo sapiens
gaaagugcaguuaauugau

SEQ ID NO: 1057650 - RNA, 19 nt, Homo sapiens
caacagucuucucaaucaa

SEQ ID NO: 1057651 - RNA, 19 nt, Homo sapiens
gcgcuuauacagauuacua

SEQ ID NO: 1057652 - RNA, 19 nt, Homo sapiens
gagauuagaggcuucacaa

SEQ ID NO: 1057653 - RNA, 19 nt, Homo sapiens
aaagcaaccugcacaucuu

SEQ ID NO: 1057654 - RNA, 19 nt, Homo sapiens
aagauucgcucaauugaag

SEQ ID NO: 1057655 - RNA, 19 nt, Homo sapiens
guuacagccuuaucuuaga

SEQ ID NO: 1057656 - RNA, 19 nt, Homo sapiens
aucaggagaugcagaauaa

SEQ ID NO: 1057657 - RNA, 19 nt, Homo sapiens
gaugugauguaugcaguug

SEQ ID NO: 1057658 - RNA, 19 nt, Homo sapiens
ucccaaggaucauguaaga

SEQ ID NO: 1057659 - RNA, 19 nt, Homo sapiens
cagaucaccuacaggaaga

SEQ ID NO: 1057660 - RNA, 19 nt, Homo sapiens
agaaagugcaguuaauuga

SEQ ID NO: 1057661 - RNA, 19 nt, Homo sapiens
ugggagagaugacggaaug

SEQ ID NO: 1057662 - RNA, 19 nt, Homo sapiens
guuaugugcuuuggcauga

SEQ ID NO: 1057663 - RNA, 19 nt, Homo sapiens
aagauuacaucagucauga

SEQ ID NO: 1057664 - RNA, 19 nt, Homo sapiens
gagaagcugggcagaaaga

SEQ ID NO: 1057665 - RNA, 19 nt, Homo sapiens
ugagggaaauacgaacuuu

SEQ ID NO: 1057666 - RNA, 19 nt, Homo sapiens
agaacucacuuuauugauc

SEQ ID NO: 1057667 - RNA, 19 nt, Homo sapiens
ggaaaguggaccaggagaa

SEQ ID NO: 1057668 - RNA, 19 nt, Homo sapiens
ucagaagacuaugaagcua

SEQ ID NO: 1057669 - RNA, 19 nt, Homo sapiens
gcagcaguguucaagacuu

SEQ ID NO: 1057670 - RNA, 19 nt, Homo sapiens
gaaccagucaugaaucagu

SEQ ID NO: 1057671 - RNA, 19 nt, Homo sapiens
agacugcaauagauaaugu

SEQ ID NO: 1057672 - RNA, 19 nt, Homo sapiens
gauguaugcaguugaaguu

SEQ ID NO: 1057673 - RNA, 19 nt, Homo sapiens
gacagagugcucagaguuu

SEQ ID NO: 1057674 - RNA, 19 nt, Homo sapiens
agaccaacauuauuaccuu

SEQ ID NO: 1057675 - RNA, 19 nt, Homo sapiens
cauacgagauaaaugaagu

SEQ ID NO: 1057676 - RNA, 19 nt, Homo sapiens
aacgacaacuuccuucuug

SEQ ID NO: 1057677 - RNA, 19 nt, Homo sapiens
guucuacgauuugaucaga

SEQ ID NO: 1057678 - RNA, 19 nt, Homo sapiens
ugacagcuuugacauugug

SEQ ID NO: 1057679 - RNA, 19 nt, Homo sapiens
agacacagagcuacacaaa

SEQ ID NO: 1057680 - RNA, 19 nt, Homo sapiens
aauacgaacuuucugauac

SEQ ID NO: 1057681 - RNA, 19 nt, Homo sapiens
ugacaacauuucuacuauc

SEQ ID NO: 1057682 - RNA, 19 nt, Homo sapiens
gcauaugugacuccaagaa

SEQ ID NO: 1057683 - RNA, 19 nt, Homo sapiens
uaaagaugaugccaguuac

SEQ ID NO: 1057684 - RNA, 19 nt, Homo sapiens
cugcaaagaccaacauuau

SEQ ID NO: 1057685 - RNA, 19 nt, Homo sapiens
ugaacaaaccugguauaaa

SEQ ID NO: 1057686 - RNA, 19 nt, Homo sapiens
uauaugaacaaaccuggua

SEQ ID NO: 1057687 - RNA, 19 nt, Homo sapiens
aagcugggcagaaagauaa

SEQ ID NO: 1057688 - RNA, 19 nt, Homo sapiens
uaaagcuaauccacccaaa

SEQ ID NO: 1057689 - RNA, 19 nt, Homo sapiens
cuagauacacaacuugaaa

SEQ ID NO: 1057690 - RNA, 19 nt, Homo sapiens
cagcugugauucugaguca

SEQ ID NO: 1057691 - RNA, 19 nt, Homo sapiens
gaacauuugcaguauaagg

SEQ ID NO: 1057692 - RNA, 19 nt, Homo sapiens
gaaaguggaccaggagaag

SEQ ID NO: 1057693 - RNA, 19 nt, Homo sapiens
uauccagggugguugugua

SEQ ID NO: 1057694 - RNA, 19 nt, Homo sapiens
ugguggaaguguauaguuu

SEQ ID NO: 1057695 - RNA, 19 nt, Homo sapiens
gaucugaaguuucgaauug

SEQ ID NO: 1057696 - RNA, 19 nt, Homo sapiens
uaagauagcccuaaaugua

SEQ ID NO: 1057697 - RNA, 19 nt, Homo sapiens
gaagaauucugcuuuaagu

SEQ ID NO: 1057698 - RNA, 19 nt, Homo sapiens
gaaauuugaugaaggugaa

SEQ ID NO: 1057699 - RNA, 19 nt, Homo sapiens
gaaagucucucuucugaac

SEQ ID NO: 1057700 - RNA, 19 nt, Homo sapiens
ggacugaacuauaguaacu

SEQ ID NO: 1057701 - RNA, 19 nt, Homo sapiens
ccaaauccaucacacauug

SEQ ID NO: 1057702 - RNA, 19 nt, Homo sapiens
gcugggaacuggcaauaaa

SEQ ID NO: 1057703 - RNA, 19 nt, Homo sapiens
gaugucggcuuauuuauag

SEQ ID NO: 1057704 - RNA, 19 nt, Homo sapiens
gaugagggcuugcuguaug

SEQ ID NO: 1057705 - RNA, 19 nt, Homo sapiens
guaccaaucucuugaucaa

SEQ ID NO: 1057706 - RNA, 19 nt, Homo sapiens
uauaguaacugucuaggaa

SEQ ID NO: 1057707 - RNA, 19 nt, Homo sapiens
gaugaggucuuuguauuug

SEQ ID NO: 1057708 - RNA, 19 nt, Homo sapiens
acucagagaugucggcuua

SEQ ID NO: 1057709 - RNA, 19 nt, Homo sapiens
cuagaaggcuuauguggaa

SEQ ID NO: 1057710 - RNA, 19 nt, Homo sapiens
uggcuuaugugaaacuuua

SEQ ID NO: 1057711 - RNA, 19 nt, Homo sapiens
cagagucacugaagaaaga

SEQ ID NO: 1057712 - RNA, 19 nt, Homo sapiens
gaauauguguggcagugaa

SEQ ID NO: 1057713 - RNA, 19 nt, Homo sapiens
cuaaaggaauucauugcua

SEQ ID NO: 1057714 - RNA, 19 nt, Homo sapiens
gauaggaauucacugauag

SEQ ID NO: 1057715 - RNA, 19 nt, Homo sapiens
gaaggugacuuugggaugu

SEQ ID NO: 1057716 - RNA, 19 nt, Homo sapiens
uagaggaacuucugaacuu

SEQ ID NO: 1057717 - RNA, 19 nt, Homo sapiens
cuauaggucuucuggauuu

SEQ ID NO: 1057718 - RNA, 19 nt, Homo sapiens
gauagaaaucgaucaguuu

SEQ ID NO: 1057719 - RNA, 19 nt, Homo sapiens
uaacaacuguggccaagug

SEQ ID NO: 1057720 - RNA, 19 nt, Homo sapiens
ugaaggaagugauagaaau

SEQ ID NO: 1057721 - RNA, 19 nt, Homo sapiens
gcacauacucuagcacuaa

SEQ ID NO: 1057722 - RNA, 19 nt, Homo sapiens
caagagaucgcgucuauuc

SEQ ID NO: 1057723 - RNA, 19 nt, Homo sapiens
gaacuauaguaacugucua

SEQ ID NO: 1057724 - RNA, 19 nt, Homo sapiens
ggaauuugcuuuaucuacu

SEQ ID NO: 1057725 - RNA, 19 nt, Homo sapiens
ccauaaagcuguuuugaaa

SEQ ID NO: 1057726 - RNA, 19 nt, Homo sapiens
gagaacaggucuuucaaaa

SEQ ID NO: 1057727 - RNA, 19 nt, Homo sapiens
gagugaggcccuaaagaua

SEQ ID NO: 1057728 - RNA, 19 nt, Homo sapiens
uggaaagucucucuucuga

SEQ ID NO: 1057729 - RNA, 19 nt, Homo sapiens
gauaugaugcagaggauuu

SEQ ID NO: 1057730 - RNA, 19 nt, Homo sapiens
ccagugaauuagucgguua

SEQ ID NO: 1057731 - RNA, 19 nt, Homo sapiens
acugauagcugaaauagau

SEQ ID NO: 1057732 - RNA, 19 nt, Homo sapiens
ccaccaccuucuucuauaa

SEQ ID NO: 1057733 - RNA, 19 nt, Homo sapiens
gccaaaguauucauauuuc

SEQ ID NO: 1057734 - RNA, 19 nt, Homo sapiens
cuuacuagcuucagaaaug

SEQ ID NO: 1057735 - RNA, 19 nt, Homo sapiens
agauaggaauucacugaua

SEQ ID NO: 1057736 - RNA, 19 nt, Homo sapiens
uaagaguguucaacuguga

SEQ ID NO: 1057737 - RNA, 19 nt, Homo sapiens
ugacaaugaugaggucuuu

SEQ ID NO: 1057738 - RNA, 19 nt, Homo sapiens
caggauaugacaacucuua

SEQ ID NO: 1057739 - RNA, 19 nt, Homo sapiens
gacaggaucuugcucucuu

SEQ ID NO: 1057740 - RNA, 19 nt, Homo sapiens
aaugugaccuuucguaaau

SEQ ID NO: 1057741 - RNA, 19 nt, Homo sapiens
gaggauguguccaguuugu

SEQ ID NO: 1057742 - RNA, 19 nt, Homo sapiens
ggaaugaagacaugaagga

SEQ ID NO: 1057743 - RNA, 19 nt, Homo sapiens
ggaagccaaaguauucaua

SEQ ID NO: 1057744 - RNA, 19 nt, Homo sapiens
agagaugucggcuuauuua

SEQ ID NO: 1057745 - RNA, 19 nt, Homo sapiens
ggagugaggcccuaaagau

SEQ ID NO: 1057746 - RNA, 19 nt, Homo sapiens
caguaaauguggagccuuu

SEQ ID NO: 1057747 - RNA, 19 nt, Homo sapiens
caucauguguguccguuga

SEQ ID NO: 1057748 - RNA, 19 nt, Homo sapiens
ggaauacaguggugugaac

SEQ ID NO: 1057749 - RNA, 19 nt, Homo sapiens
ccacuucucauauuagauu

SEQ ID NO: 1057750 - RNA, 19 nt, Homo sapiens
gaccacuucucauauuaga

SEQ ID NO: 1057751 - RNA, 19 nt, Homo sapiens
cuauugcucuuacuugaaa

SEQ ID NO: 1057752 - RNA, 19 nt, Homo sapiens
ugccuuaguugcuaguuua

SEQ ID NO: 1057753 - RNA, 19 nt, Homo sapiens
gaauuacuguggagaaugc

SEQ ID NO: 1057754 - RNA, 19 nt, Homo sapiens
caagugggaucagguucua

SEQ ID NO: 1057755 - RNA, 19 nt, Homo sapiens
guacguuacugacaaugau

SEQ ID NO: 1057756 - RNA, 19 nt, Homo sapiens
gaagacaugcuacaacuac

SEQ ID NO: 1057757 - RNA, 19 nt, Homo sapiens
gacaguaguuuauuugaac

SEQ ID NO: 1057758 - RNA, 19 nt, Homo sapiens
ucagagaugucggcuuauu

SEQ ID NO: 1057759 - RNA, 19 nt, Homo sapiens
acaagugggugaagacaug

SEQ ID NO: 1057760 - RNA, 19 nt, Homo sapiens
uaaaugugaccuuucguaa

SEQ ID NO: 1057761 - RNA, 19 nt, Homo sapiens
caacccuuguuuccagaua

SEQ ID NO: 1057762 - RNA, 19 nt, Homo sapiens
cagaggauuuagaagaauu

SEQ ID NO: 1057763 - RNA, 19 nt, Homo sapiens
gccagaagaugcuauaggu

SEQ ID NO: 1057764 - RNA, 19 nt, Homo sapiens
ggacaauggcgagguauau

SEQ ID NO: 1057765 - RNA, 19 nt, Homo sapiens
caccgaagauggagugguu

SEQ ID NO: 1057766 - RNA, 19 nt, Homo sapiens
ugagugaguucccuuagug

SEQ ID NO: 1057767 - RNA, 19 nt, Homo sapiens
cuuaguugcuaguuuagua

SEQ ID NO: 1057768 - RNA, 19 nt, Homo sapiens
guauuuggacugaacuaua

SEQ ID NO: 1057769 - RNA, 19 nt, Homo sapiens
ccaaguuccuaauauaagu

SEQ ID NO: 1057770 - RNA, 19 nt, Homo sapiens
gaacuuuucuuacuagcuu

SEQ ID NO: 1057771 - RNA, 19 nt, Homo sapiens
ugaguucccuuagugaauu

SEQ ID NO: 1057772 - RNA, 19 nt, Homo sapiens
ucauuaagguagaacuuga

SEQ ID NO: 1057773 - RNA, 19 nt, Homo sapiens
gcagaggauuuagaagaau

SEQ ID NO: 1057774 - RNA, 19 nt, Homo sapiens
gagaaugccuuuucgcuau

SEQ ID NO: 1057775 - RNA, 19 nt, Homo sapiens
gauccauguuccagucgua

SEQ ID NO: 1057776 - RNA, 19 nt, Homo sapiens
gauugaagcccagugaauu

SEQ ID NO: 1057777 - RNA, 19 nt, Homo sapiens
aaagauaggaauucacuga

SEQ ID NO: 1057778 - RNA, 19 nt, Homo sapiens
cagcacaauuucaccuuga

SEQ ID NO: 1057779 - RNA, 19 nt, Homo sapiens
gaacauaacaaggguguac

SEQ ID NO: 1057780 - RNA, 19 nt, Homo sapiens
gaaggaagugauagaaauc

SEQ ID NO: 1057781 - RNA, 19 nt, Homo sapiens
ggagaaagaaaggguggua

SEQ ID NO: 1057782 - RNA, 19 nt, Homo sapiens
gaagauggagugguuuaug

SEQ ID NO: 1057783 - RNA, 19 nt, Homo sapiens
aauaauggaagccaaagua

SEQ ID NO: 1057784 - RNA, 19 nt, Homo sapiens
ggauaugacaacucuuauu

SEQ ID NO: 1057785 - RNA, 19 nt, Homo sapiens
aauuaugacugcugaauca

SEQ ID NO: 1057786 - RNA, 19 nt, Homo sapiens
uaucaacaaucuucugaca

SEQ ID NO: 1057787 - RNA, 19 nt, Homo sapiens
gaacuucugaacuuggaaa

SEQ ID NO: 1057788 - RNA, 19 nt, Homo sapiens
ggcgacaucuuacugugaa

SEQ ID NO: 1057789 - RNA, 19 nt, Homo sapiens
guauuggaaugaagacaug

SEQ ID NO: 1057790 - RNA, 19 nt, Homo sapiens
uaugaugggugguguuugu

SEQ ID NO: 1057791 - RNA, 19 nt, Homo sapiens
ccuggagccugaauacauu

SEQ ID NO: 1057792 - RNA, 19 nt, Homo sapiens
cucaagagaucgcgucuau

SEQ ID NO: 1057793 - RNA, 19 nt, Homo sapiens
agacaugaaggaagugaua

SEQ ID NO: 1057794 - RNA, 19 nt, Homo sapiens
gaagccaaaguauucauau

SEQ ID NO: 1057795 - RNA, 19 nt, Homo sapiens
gaagagcgcucgucuguuu

SEQ ID NO: 1057796 - RNA, 19 nt, Homo sapiens
ggaagcagcucacacauuu

SEQ ID NO: 1057797 - RNA, 19 nt, Homo sapiens
gaacaagccuuaagagaau

SEQ ID NO: 1057798 - RNA, 19 nt, Homo sapiens
caagauagaucgagaccua

SEQ ID NO: 1057799 - RNA, 19 nt, Homo sapiens
ucacagagauggaugcuaa

SEQ ID NO: 1057800 - RNA, 19 nt, Homo sapiens
gagcagaaguucauggauu

SEQ ID NO: 1057801 - RNA, 19 nt, Homo sapiens
gagaauauuucguugaaga

SEQ ID NO: 1057802 - RNA, 19 nt, Homo sapiens
guacagagccaugguauaa

SEQ ID NO: 1057803 - RNA, 19 nt, Homo sapiens
guauaaggcuggucuguau

SEQ ID NO: 1057804 - RNA, 19 nt, Homo sapiens
gucauaagcuggagucuga

SEQ ID NO: 1057805 - RNA, 19 nt, Homo sapiens
gaacguagagggagcagaa

SEQ ID NO: 1057806 - RNA, 19 nt, Homo sapiens
gaacucaacucuguauuuu

SEQ ID NO: 1057807 - RNA, 19 nt, Homo sapiens
gcagagugcccuacaacua

SEQ ID NO: 1057808 - RNA, 19 nt, Homo sapiens
caucagaucuuccuucucu

SEQ ID NO: 1057809 - RNA, 19 nt, Homo sapiens
gaaccgaauuauuggauca

SEQ ID NO: 1057810 - RNA, 19 nt, Homo sapiens
gaagcccucucgagcguaa

SEQ ID NO: 1057811 - RNA, 19 nt, Homo sapiens
acacugaaccgaauuauug

SEQ ID NO: 1057812 - RNA, 19 nt, Homo sapiens
agcagaacauugagaauua

SEQ ID NO: 1057813 - RNA, 19 nt, Homo sapiens
acucaaaucugguuaugaa

SEQ ID NO: 1057814 - RNA, 19 nt, Homo sapiens
gaacaucacauucgucuac

SEQ ID NO: 1057815 - RNA, 19 nt, Homo sapiens
cagagaggauuuaacaaug

SEQ ID NO: 1057816 - RNA, 19 nt, Homo sapiens
cgaacaagccuuaagagaa

SEQ ID NO: 1057817 - RNA, 19 nt, Homo sapiens
gagccaugguauaaauuaa

SEQ ID NO: 1057818 - RNA, 19 nt, Homo sapiens
gggccuacaucaagcuuaa

SEQ ID NO: 1057819 - RNA, 19 nt, Homo sapiens
gaucuuccuucucuuccua

SEQ ID NO: 1057820 - RNA, 19 nt, Homo sapiens
gcacucaaaucugguuaug

SEQ ID NO: 1057821 - RNA, 19 nt, Homo sapiens
guucauggauucucaaugg

SEQ ID NO: 1057822 - RNA, 19 nt, Homo sapiens
uuaugaggcugaugacuuu

SEQ ID NO: 1057823 - RNA, 19 nt, Homo sapiens
acacacacacacacaauua

SEQ ID NO: 1057824 - RNA, 19 nt, Homo sapiens
uagacaauguggauuacua

SEQ ID NO: 1057825 - RNA, 19 nt, Homo sapiens
gccaaagccuaucuucuau

SEQ ID NO: 1057826 - RNA, 19 nt, Homo sapiens
guaugaagcuauugcagau

SEQ ID NO: 1057827 - RNA, 19 nt, Homo sapiens
ggcgacagcugguguugaa

SEQ ID NO: 1057828 - RNA, 19 nt, Homo sapiens
ggacccacuuuauagagaa

SEQ ID NO: 1057829 - RNA, 19 nt, Homo sapiens
cgaauuauuggaucagaua

SEQ ID NO: 1057830 - RNA, 19 nt, Homo sapiens
gcuggagucugagcugaua

SEQ ID NO: 1057831 - RNA, 19 nt, Homo sapiens
caauaaacuuacacuggaa

SEQ ID NO: 1057832 - RNA, 19 nt, Homo sapiens
gaauaucaacccuaaagau

SEQ ID NO: 1057833 - RNA, 19 nt, Homo sapiens
gaaggucgagucccacuga

SEQ ID NO: 1057834 - RNA, 19 nt, Homo sapiens
gcauuucgaacaagccuua

SEQ ID NO: 1057835 - RNA, 19 nt, Homo sapiens
augcaggaguuaaacauua

SEQ ID NO: 1057836 - RNA, 19 nt, Homo sapiens
gacugugacugccucuaua

SEQ ID NO: 1057837 - RNA, 19 nt, Homo sapiens
cgaaaaggcucgaaggauu

SEQ ID NO: 1057838 - RNA, 19 nt, Homo sapiens
gcacuaugauuaccuacag

SEQ ID NO: 1057839 - RNA, 19 nt, Homo sapiens
uagaagaaaugaccucagu

SEQ ID NO: 1057840 - RNA, 19 nt, Homo sapiens
ggugauggauacagaggaa

SEQ ID NO: 1057841 - RNA, 19 nt, Homo sapiens
ccucagagauuugaagaau

SEQ ID NO: 1057842 - RNA, 19 nt, Homo sapiens
uaucaggcauuucgaacaa

SEQ ID NO: 1057843 - RNA, 19 nt, Homo sapiens
caauuaaguugcugcagau

SEQ ID NO: 1057844 - RNA, 19 nt, Homo sapiens
gaauacaggcugaugaagu

SEQ ID NO: 1057845 - RNA, 19 nt, Homo sapiens
gaaggaggagaauucauau

SEQ ID NO: 1057846 - RNA, 19 nt, Homo sapiens
ggcaguggcuauucacaga

SEQ ID NO: 1057847 - RNA, 19 nt, Homo sapiens
acagagccaugguauaaau

SEQ ID NO: 1057848 - RNA, 19 nt, Homo sapiens
ccacaguacuccagaaagg

SEQ ID NO: 1057849 - RNA, 19 nt, Homo sapiens
uuaaguugcugcagauuca

SEQ ID NO: 1057850 - RNA, 19 nt, Homo sapiens
gcgcugagcugccccuuuu

SEQ ID NO: 1057851 - RNA, 19 nt, Homo sapiens
ccagcucucuuucuugguu

SEQ ID NO: 1057852 - RNA, 19 nt, Homo sapiens
cccuaaagaugagcuauaa

SEQ ID NO: 1057853 - RNA, 19 nt, Homo sapiens
uuacacauuucgagacuau

SEQ ID NO: 1057854 - RNA, 19 nt, Homo sapiens
ccagagaggauuuaacaau

SEQ ID NO: 1057855 - RNA, 19 nt, Homo sapiens
ggaagcaugaacugaauau

SEQ ID NO: 1057856 - RNA, 19 nt, Homo sapiens
ugaacucaacucuguauuu

SEQ ID NO: 1057857 - RNA, 19 nt, Homo sapiens
caaaucugguuaugaaggu

SEQ ID NO: 1057858 - RNA, 19 nt, Homo sapiens
caaagccuaucuucuaugc

SEQ ID NO: 1057859 - RNA, 19 nt, Homo sapiens
agccacacauggagaguua

SEQ ID NO: 1057860 - RNA, 19 nt, Homo sapiens
ucauguagagguuguagua

SEQ ID NO: 1057861 - RNA, 19 nt, Homo sapiens
gauccacccuccacaguac

SEQ ID NO: 1057862 - RNA, 19 nt, Homo sapiens
ggucuaaccauguugucua

SEQ ID NO: 1057863 - RNA, 19 nt, Homo sapiens
aauacaggcugaugaagug

SEQ ID NO: 1057864 - RNA, 19 nt, Homo sapiens
gaaugaugacuuugaagga

SEQ ID NO: 1057865 - RNA, 19 nt, Homo sapiens
agagaggauuuaacaaugu

SEQ ID NO: 1057866 - RNA, 19 nt, Homo sapiens
cagcugguguugaagcauu

SEQ ID NO: 1057867 - RNA, 19 nt, Homo sapiens
ugccaaagccuaucuucua

SEQ ID NO: 1057868 - RNA, 19 nt, Homo sapiens
gaguuacaaugcaggaguu

SEQ ID NO: 1057869 - RNA, 19 nt, Homo sapiens
acacccagcucucuuucuu

SEQ ID NO: 1057870 - RNA, 19 nt, Homo sapiens
cagcagaacauugagaauu

SEQ ID NO: 1057871 - RNA, 19 nt, Homo sapiens
gagagucugcuggaugaua

SEQ ID NO: 1057872 - RNA, 19 nt, Homo sapiens
uguagagguuguaguagaa

SEQ ID NO: 1057873 - RNA, 19 nt, Homo sapiens
gcgaauacaggcugaugaa

SEQ ID NO: 1057874 - RNA, 19 nt, Homo sapiens
caauguggauuacuaugag

SEQ ID NO: 1057875 - RNA, 19 nt, Homo sapiens
gcagaacauugagaauuac

SEQ ID NO: 1057876 - RNA, 19 nt, Homo sapiens
gaucgagaccuaagagaag

SEQ ID NO: 1057877 - RNA, 19 nt, Homo sapiens
gguauaaggcuggucugua

SEQ ID NO: 1057878 - RNA, 19 nt, Homo sapiens
cauccaugcugacaacugu

SEQ ID NO: 1057879 - RNA, 19 nt, Homo sapiens
ggccagagaggauuuaaca

SEQ ID NO: 1057880 - RNA, 19 nt, Homo sapiens
uuacaaugcaggaguuaaa

SEQ ID NO: 1057881 - RNA, 19 nt, Homo sapiens
guuaaugucagucaucaga

SEQ ID NO: 1057882 - RNA, 19 nt, Homo sapiens
gccaugguauaaauuaaca

SEQ ID NO: 1057883 - RNA, 19 nt, Homo sapiens
ggucgagucccacugaaga

SEQ ID NO: 1057884 - RNA, 19 nt, Homo sapiens
ccagggccuugguggaauu

SEQ ID NO: 1057885 - RNA, 19 nt, Homo sapiens
acauggaaaugcagcagaa

SEQ ID NO: 1057886 - RNA, 19 nt, Homo sapiens
cuaaccauguugucuagga

SEQ ID NO: 1057887 - RNA, 19 nt, Homo sapiens
gcucuccuauauaugaaug

SEQ ID NO: 1057888 - RNA, 19 nt, Homo sapiens
gugguccucuacucuauga

SEQ ID NO: 1057889 - RNA, 19 nt, Homo sapiens
gauaaaaucagcugcagaa

SEQ ID NO: 1057890 - RNA, 19 nt, Homo sapiens
uaaugucagucaucagauc

SEQ ID NO: 1057891 - RNA, 19 nt, Homo sapiens
agcaugaacugaauaucaa

SEQ ID NO: 1057892 - RNA, 19 nt, Homo sapiens
agacuauagugcucuccua

SEQ ID NO: 1057893 - RNA, 19 nt, Homo sapiens
gcgcucgucuguuuuauga

SEQ ID NO: 1057894 - RNA, 19 nt, Homo sapiens
ccaguggaaucaugcuugu

SEQ ID NO: 1057895 - RNA, 19 nt, Homo sapiens
gaaaguagcuacagaugaa

SEQ ID NO: 1057896 - RNA, 19 nt, Homo sapiens
ggaaggagcuuuggccaua

SEQ ID NO: 1057897 - RNA, 19 nt, Homo sapiens
ggacagauuucuaauaaag

SEQ ID NO: 1057898 - RNA, 19 nt, Homo sapiens
gaauacacaucuugccuuu

SEQ ID NO: 1057899 - RNA, 19 nt, Homo sapiens
ggacuuguguucaaauuau

SEQ ID NO: 1057900 - RNA, 19 nt, Homo sapiens
ggaaagagacacuaagaaa

SEQ ID NO: 1057901 - RNA, 19 nt, Homo sapiens
guuauacccugaagaauuu

SEQ ID NO: 1057902 - RNA, 19 nt, Homo sapiens
gaaaacaucuccccaggua

SEQ ID NO: 1057903 - RNA, 19 nt, Homo sapiens
gaacuaaugccauguagga

SEQ ID NO: 1057904 - RNA, 19 nt, Homo sapiens
cgggacagauuucuaauaa

SEQ ID NO: 1057905 - RNA, 19 nt, Homo sapiens
gcagagaccacauuaauuc

SEQ ID NO: 1057906 - RNA, 19 nt, Homo sapiens
aagaucaagugacguauua

SEQ ID NO: 1057907 - RNA, 19 nt, Homo sapiens
ggacagaggugcccuaucc

SEQ ID NO: 1057908 - RNA, 19 nt, Homo sapiens
uaaauggacuuguguucaa

SEQ ID NO: 1057909 - RNA, 19 nt, Homo sapiens
gugcauauacagcaaauua

SEQ ID NO: 1057910 - RNA, 19 nt, Homo sapiens
uugaguaacugaugucaua

SEQ ID NO: 1057911 - RNA, 19 nt, Homo sapiens
caacauaucacugaaagaa

SEQ ID NO: 1057912 - RNA, 19 nt, Homo sapiens
gggaagaauuaggaaauaa

SEQ ID NO: 1057913 - RNA, 19 nt, Homo sapiens
gaugaaaggucugcugaga

SEQ ID NO: 1057914 - RNA, 19 nt, Homo sapiens
caaacaaacgcacaaauug

SEQ ID NO: 1057915 - RNA, 19 nt, Homo sapiens
ggucauguauaagcaauaa

SEQ ID NO: 1057916 - RNA, 19 nt, Homo sapiens
gcagaacgcaagugcauuu

SEQ ID NO: 1057917 - RNA, 19 nt, Homo sapiens
gaaaccaacauaucacuga

SEQ ID NO: 1057918 - RNA, 19 nt, Homo sapiens
aaaggaagccacagauaua

SEQ ID NO: 1057919 - RNA, 19 nt, Homo sapiens
guaauuggauaguaaaugg

SEQ ID NO: 1057920 - RNA, 19 nt, Homo sapiens
guuggagaauucacacuua

SEQ ID NO: 1057921 - RNA, 19 nt, Homo sapiens
gagcuuuggccauauauuu

SEQ ID NO: 1057922 - RNA, 19 nt, Homo sapiens
uagcaggugucacaacuaa

SEQ ID NO: 1057923 - RNA, 19 nt, Homo sapiens
guauugcucucuguuuaua

SEQ ID NO: 1057924 - RNA, 19 nt, Homo sapiens
gcaaacacaagaagucaaa

SEQ ID NO: 1057925 - RNA, 19 nt, Homo sapiens
aagaagaguuggagaauuc

SEQ ID NO: 1057926 - RNA, 19 nt, Homo sapiens
uaaagugcuuggucuuaaa

SEQ ID NO: 1057927 - RNA, 19 nt, Homo sapiens
uaacauccauagacaacuu

SEQ ID NO: 1057928 - RNA, 19 nt, Homo sapiens
caugguaauuggauaguaa

SEQ ID NO: 1057929 - RNA, 19 nt, Homo sapiens
ggagaauucacacuuauug

SEQ ID NO: 1057930 - RNA, 19 nt, Homo sapiens
ugucauagauaauccugua

SEQ ID NO: 1057931 - RNA, 19 nt, Homo sapiens
ggagcaaguuaaaucuuug

SEQ ID NO: 1057932 - RNA, 19 nt, Homo sapiens
guagauacaacuaugauga

SEQ ID NO: 1057933 - RNA, 19 nt, Homo sapiens
ggaaaguagcuacagauga

SEQ ID NO: 1057934 - RNA, 19 nt, Homo sapiens
cacaagaagucaaagaaau

SEQ ID NO: 1057935 - RNA, 19 nt, Homo sapiens
gaggugcccuaucccuuaa

SEQ ID NO: 1057936 - RNA, 19 nt, Homo sapiens
ggacaugggccuaagaaca

SEQ ID NO: 1057937 - RNA, 19 nt, Homo sapiens
ggccauggaacauuuauuu

SEQ ID NO: 1057938 - RNA, 19 nt, Homo sapiens
acaugacuguggauauuua

SEQ ID NO: 1057939 - RNA, 19 nt, Homo sapiens
gcucagaggaugacuaaau

SEQ ID NO: 1057940 - RNA, 19 nt, Homo sapiens
gagcucagaggaugacuaa

SEQ ID NO: 1057941 - RNA, 19 nt, Homo sapiens
gcagauuccucgagugagu

SEQ ID NO: 1057942 - RNA, 19 nt, Homo sapiens
gaucaagugacguauuauu

SEQ ID NO: 1057943 - RNA, 19 nt, Homo sapiens
gugcuuugauccuucuaua

SEQ ID NO: 1057944 - RNA, 19 nt, Homo sapiens
caaauuaaaggacccagaa

SEQ ID NO: 1057945 - RNA, 19 nt, Homo sapiens
guagugaucagcaagauau

SEQ ID NO: 1057946 - RNA, 19 nt, Homo sapiens
uggagcaaguuaaaucuuu

SEQ ID NO: 1057947 - RNA, 19 nt, Homo sapiens
cuaguuccauugcuguaua

SEQ ID NO: 1057948 - RNA, 19 nt, Homo sapiens
acaaacaaacgcacaaauu

SEQ ID NO: 1057949 - RNA, 19 nt, Homo sapiens
gaggaaagagacacuaaga

SEQ ID NO: 1057950 - RNA, 19 nt, Homo sapiens
ucaaagaaaucccacaaaa

SEQ ID NO: 1057951 - RNA, 19 nt, Homo sapiens
aaagaagaguuggagaauu

SEQ ID NO: 1057952 - RNA, 19 nt, Homo sapiens
ccaagcagagaccacauua

SEQ ID NO: 1057953 - RNA, 19 nt, Homo sapiens
cuaaaucuguucaugaagu

SEQ ID NO: 1057954 - RNA, 19 nt, Homo sapiens
gcuaaauccuggaauaaaa

SEQ ID NO: 1057955 - RNA, 19 nt, Homo sapiens
gacaugggccuaagaacaa

SEQ ID NO: 1057956 - RNA, 19 nt, Homo sapiens
ccaggaaauuggcucuauu

SEQ ID NO: 1057957 - RNA, 19 nt, Homo sapiens
gaaggagcuuuggccauau

SEQ ID NO: 1057958 - RNA, 19 nt, Homo sapiens
gacauuccaugaguuggua

SEQ ID NO: 1057959 - RNA, 19 nt, Homo sapiens
acaguagcaugacaguaua

SEQ ID NO: 1057960 - RNA, 19 nt, Homo sapiens
agaaagaucaagugacgua

SEQ ID NO: 1057961 - RNA, 19 nt, Homo sapiens
ccagucugccuuuggauua

SEQ ID NO: 1057962 - RNA, 19 nt, Homo sapiens
uagauaauccuguaccaaa

SEQ ID NO: 1057963 - RNA, 19 nt, Homo sapiens
gcuuugauccuucuauauu

SEQ ID NO: 1057964 - RNA, 19 nt, Homo sapiens
ggaaucugguauuuuguua

SEQ ID NO: 1057965 - RNA, 19 nt, Homo sapiens
cauacaaccuggaauuucu

SEQ ID NO: 1057966 - RNA, 19 nt, Homo sapiens
uagcaugcauuguuucugu

SEQ ID NO: 1057967 - RNA, 19 nt, Homo sapiens
guacucaauugucaguguu

SEQ ID NO: 1057968 - RNA, 19 nt, Homo sapiens
auaaagugcuuggucuuaa

SEQ ID NO: 1057969 - RNA, 19 nt, Homo sapiens
ucacagugguuauaaagag

SEQ ID NO: 1057970 - RNA, 19 nt, Homo sapiens
gggacagauuucuaauaaa

SEQ ID NO: 1057971 - RNA, 19 nt, Homo sapiens
aaggcuaaauccuggaaua

SEQ ID NO: 1057972 - RNA, 19 nt, Homo sapiens
cuguauugcucucuguuua

SEQ ID NO: 1057973 - RNA, 19 nt, Homo sapiens
gaaacagacaguagugauc

SEQ ID NO: 1057974 - RNA, 19 nt, Homo sapiens
gaaagagacacuaagaaaa

SEQ ID NO: 1057975 - RNA, 19 nt, Homo sapiens
gcaaguuaaaucuuuguug

SEQ ID NO: 1057976 - RNA, 19 nt, Homo sapiens
guauaagacaccagcagua

SEQ ID NO: 1057977 - RNA, 19 nt, Homo sapiens
gcccagagcagguaaguuc

SEQ ID NO: 1057978 - RNA, 19 nt, Homo sapiens
guaaaugguuuucuaguuc

SEQ ID NO: 1057979 - RNA, 19 nt, Homo sapiens
agagguggauuggaacuaa

SEQ ID NO: 1057980 - RNA, 19 nt, Homo sapiens
ggacaaacaaacgcacaaa

SEQ ID NO: 1057981 - RNA, 19 nt, Homo sapiens
ugaggaaagugaggaaaga

SEQ ID NO: 1057982 - RNA, 19 nt, Homo sapiens
aaagggaaacaaccacaua

SEQ ID NO: 1057983 - RNA, 19 nt, Homo sapiens
cccuaucccuuaacuauga

SEQ ID NO: 1057984 - RNA, 19 nt, Homo sapiens
cugaagaauuugaaacaga

SEQ ID NO: 1057985 - RNA, 19 nt, Homo sapiens
gcaguagauacaacuauga

SEQ ID NO: 1057986 - RNA, 19 nt, Homo sapiens
gcuauacugugauccuuag

SEQ ID NO: 1057987 - RNA, 19 nt, Homo sapiens
cugaaaccaaguugaauua

SEQ ID NO: 1057988 - RNA, 19 nt, Homo sapiens
gaagcaaacaugccagaca

SEQ ID NO: 1057989 - RNA, 19 nt, Homo sapiens
gacgucuugucuucuauuu

SEQ ID NO: 1057990 - RNA, 19 nt, Homo sapiens
caacuaugaugacauucca

SEQ ID NO: 1057991 - RNA, 19 nt, Homo sapiens
gggaagaaagaucaaguga

SEQ ID NO: 1057992 - RNA, 19 nt, Homo sapiens
gaaagaaggcuggcagaac

SEQ ID NO: 1057993 - RNA, 19 nt, Homo sapiens
ugugauccuuaguauguua

SEQ ID NO: 1057994 - RNA, 19 nt, Homo sapiens
gauaauccuguaccaaaug

SEQ ID NO: 1057995 - RNA, 19 nt, Homo sapiens
gaaaggaucagcuuaauca

SEQ ID NO: 1057996 - RNA, 19 nt, Homo sapiens
gacagcaucuggauuauga

SEQ ID NO: 1057997 - RNA, 19 nt, Homo sapiens
gagcugaaauaugcuaaua

SEQ ID NO: 1057998 - RNA, 19 nt, Homo sapiens
ccaaguagaucaguuagaa

SEQ ID NO: 1057999 - RNA, 19 nt, Homo sapiens
gaagggaggagucauauau

SEQ ID NO: 1058000 - RNA, 19 nt, Homo sapiens
ccacacaaaucaucucuau

SEQ ID NO: 1058001 - RNA, 19 nt, Homo sapiens
ccaaaagucugcuuaauuu

SEQ ID NO: 1058002 - RNA, 19 nt, Homo sapiens
gcagaaaggaucagcuuaa

SEQ ID NO: 1058003 - RNA, 19 nt, Homo sapiens
gaauguaacucaucuuggu

SEQ ID NO: 1058004 - RNA, 19 nt, Homo sapiens
gcaauuuggugguauuuag

SEQ ID NO: 1058005 - RNA, 19 nt, Homo sapiens
ggagauuacuacccaaaug

SEQ ID NO: 1058006 - RNA, 19 nt, Homo sapiens
ucaauaccguuccuuauga

SEQ ID NO: 1058007 - RNA, 19 nt, Homo sapiens
gcauucaaguguuucauug

SEQ ID NO: 1058008 - RNA, 19 nt, Homo sapiens
gauaauugcagaaagguuu

SEQ ID NO: 1058009 - RNA, 19 nt, Homo sapiens
gggauaaggugggaauuga

SEQ ID NO: 1058010 - RNA, 19 nt, Homo sapiens
gcacacaucccucagcuau

SEQ ID NO: 1058011 - RNA, 19 nt, Homo sapiens
ugaacaaacucaucagugu

SEQ ID NO: 1058012 - RNA, 19 nt, Homo sapiens
acacaucccucagcuauga

SEQ ID NO: 1058013 - RNA, 19 nt, Homo sapiens
guagaucaguuagaaagaa

SEQ ID NO: 1058014 - RNA, 19 nt, Homo sapiens
ugaguuaucuaaugucaga

SEQ ID NO: 1058015 - RNA, 19 nt, Homo sapiens
aaaggcaccugaggaauuu

SEQ ID NO: 1058016 - RNA, 19 nt, Homo sapiens
gaacacagaagcacacauc

SEQ ID NO: 1058017 - RNA, 19 nt, Homo sapiens
aaacacugcucgccucuug

SEQ ID NO: 1058018 - RNA, 19 nt, Homo sapiens
gggaggaugugguauuuca

SEQ ID NO: 1058019 - RNA, 19 nt, Homo sapiens
uuaaauaucuacccaugga

SEQ ID NO: 1058020 - RNA, 19 nt, Homo sapiens
ucagucuccuucagaaaua

SEQ ID NO: 1058021 - RNA, 19 nt, Homo sapiens
aauuugaacuccucaguaa

SEQ ID NO: 1058022 - RNA, 19 nt, Homo sapiens
gaauuugaacuccucagua

SEQ ID NO: 1058023 - RNA, 19 nt, Homo sapiens
acacugacacuaccuauuu

SEQ ID NO: 1058024 - RNA, 19 nt, Homo sapiens
guauuucacuucagacuuc

SEQ ID NO: 1058025 - RNA, 19 nt, Homo sapiens
guaauauuguucagggaaa

SEQ ID NO: 1058026 - RNA, 19 nt, Homo sapiens
ggaguuaaauuaggaaguc

SEQ ID NO: 1058027 - RNA, 19 nt, Homo sapiens
gcagcucucuuccucaugu

SEQ ID NO: 1058028 - RNA, 19 nt, Homo sapiens
ucaguaaagugccauugaa

SEQ ID NO: 1058029 - RNA, 19 nt, Homo sapiens
acacaaaucaucucuauag

SEQ ID NO: 1058030 - RNA, 19 nt, Homo sapiens
cuugugagguuccauauga

SEQ ID NO: 1058031 - RNA, 19 nt, Homo sapiens
gcuaugcacaucuuaguuu

SEQ ID NO: 1058032 - RNA, 19 nt, Homo sapiens
acaccggacucuaacgaua

SEQ ID NO: 1058033 - RNA, 19 nt, Homo sapiens
caagagcccuguggcauuc

SEQ ID NO: 1058034 - RNA, 19 nt, Homo sapiens
uaccuaggccuguggauua

SEQ ID NO: 1058035 - RNA, 19 nt, Homo sapiens
gcaucuggauuaugaauac

SEQ ID NO: 1058036 - RNA, 19 nt, Homo sapiens
gcagaacagguacuucaaa

SEQ ID NO: 1058037 - RNA, 19 nt, Homo sapiens
uagcauaagcucagggaua

SEQ ID NO: 1058038 - RNA, 19 nt, Homo sapiens
aaucaucucuauaggaguu

SEQ ID NO: 1058039 - RNA, 19 nt, Homo sapiens
gcgacuaccuugagacagu

SEQ ID NO: 1058040 - RNA, 19 nt, Homo sapiens
ucauaugggcagaauaaua

SEQ ID NO: 1058041 - RNA, 19 nt, Homo sapiens
gggccagucuuaaauaucu

SEQ ID NO: 1058042 - RNA, 19 nt, Homo sapiens
gaugugguauuucacuuca

SEQ ID NO: 1058043 - RNA, 19 nt, Homo sapiens
caaguuccaucgguagauu

SEQ ID NO: 1058044 - RNA, 19 nt, Homo sapiens
gagguuccauaugauaauu

SEQ ID NO: 1058045 - RNA, 19 nt, Homo sapiens
ccaaacauuguaagaauug

SEQ ID NO: 1058046 - RNA, 19 nt, Homo sapiens
caacuggcguguccuacau

SEQ ID NO: 1058047 - RNA, 19 nt, Homo sapiens
ggauugggccagucuuaaa

SEQ ID NO: 1058048 - RNA, 19 nt, Homo sapiens
uauugaagauguuggagaa

SEQ ID NO: 1058049 - RNA, 19 nt, Homo sapiens
cagaaaggaucagcuuaau

SEQ ID NO: 1058050 - RNA, 19 nt, Homo sapiens
cauccagccuagaauacua

SEQ ID NO: 1058051 - RNA, 19 nt, Homo sapiens
gcacaucuuaguuuccaaa

SEQ ID NO: 1058052 - RNA, 19 nt, Homo sapiens
ggacaccuuaacacucuua

SEQ ID NO: 1058053 - RNA, 19 nt, Homo sapiens
ccugauaaagcaacaauuu

SEQ ID NO: 1058054 - RNA, 19 nt, Homo sapiens
gaucagguacaacaacuau

SEQ ID NO: 1058055 - RNA, 19 nt, Homo sapiens
aaagagcuguauuugauca

SEQ ID NO: 1058056 - RNA, 19 nt, Homo sapiens
acagagaaguuggcagaaa

SEQ ID NO: 1058057 - RNA, 19 nt, Homo sapiens
gaaaguacacagggcuauu

SEQ ID NO: 1058058 - RNA, 19 nt, Homo sapiens
agcauaagcucagggauaa

SEQ ID NO: 1058059 - RNA, 19 nt, Homo sapiens
auucuucucuguagucuaa

SEQ ID NO: 1058060 - RNA, 19 nt, Homo sapiens
gcugaagggaggagucaua

SEQ ID NO: 1058061 - RNA, 19 nt, Homo sapiens
caaacucuacuucagauug

SEQ ID NO: 1058062 - RNA, 19 nt, Homo sapiens
gaggagaccugagaaugag

SEQ ID NO: 1058063 - RNA, 19 nt, Homo sapiens
ggaugagaccacacucuuu

SEQ ID NO: 1058064 - RNA, 19 nt, Homo sapiens
gguguggguucuaucuauu

SEQ ID NO: 1058065 - RNA, 19 nt, Homo sapiens
ggguguggguucuaucuau

SEQ ID NO: 1058066 - RNA, 19 nt, Homo sapiens
ugaggagaccugagaauga

SEQ ID NO: 1058067 - RNA, 19 nt, Homo sapiens
gagagaugacauaaccaua

SEQ ID NO: 1058068 - RNA, 19 nt, Homo sapiens
gagaugauguauuaaacac

SEQ ID NO: 1058069 - RNA, 19 nt, Homo sapiens
ugaagauguuggagaaugu

SEQ ID NO: 1058070 - RNA, 19 nt, Homo sapiens
cagagaaguuggcagaaag

SEQ ID NO: 1058071 - RNA, 19 nt, Homo sapiens
ugagagagaugacauaacc

SEQ ID NO: 1058072 - RNA, 19 nt, Homo sapiens
aaacucuacuucagauugu

SEQ ID NO: 1058073 - RNA, 19 nt, Homo sapiens
cuguguggcugcuauuuaa

SEQ ID NO: 1058074 - RNA, 19 nt, Homo sapiens
gagauuacuacccaaaugu

SEQ ID NO: 1058075 - RNA, 19 nt, Homo sapiens
gaaucuguccguuucucua

SEQ ID NO: 1058076 - RNA, 19 nt, Homo sapiens
ucagguacaacaacuauga

SEQ ID NO: 1058077 - RNA, 19 nt, Homo sapiens
ggugguauuuaggauguaa

SEQ ID NO: 1058078 - RNA, 19 nt, Homo sapiens
gcuagcgacuaccuugaga

SEQ ID NO: 1058079 - RNA, 19 nt, Homo sapiens
gggcagcucucuuccucau

SEQ ID NO: 1058080 - RNA, 19 nt, Homo sapiens
guaaagugccauugaagca

SEQ ID NO: 1058081 - RNA, 19 nt, Homo sapiens
acgagggacugaagaaguu

SEQ ID NO: 1058082 - RNA, 19 nt, Homo sapiens
caugcuaauugccaagauu

SEQ ID NO: 1058083 - RNA, 19 nt, Homo sapiens
uaggacaccuuaacacucu

SEQ ID NO: 1058084 - RNA, 19 nt, Homo sapiens
cuccaaacauuguaagaau

SEQ ID NO: 1058085 - RNA, 19 nt, Homo sapiens
uuucauaugggcagaauaa

SEQ ID NO: 1058086 - RNA, 19 nt, Homo sapiens
ccaacuguguggcugcuau

SEQ ID NO: 1058087 - RNA, 19 nt, Homo sapiens
guccaucgcugguauacag

SEQ ID NO: 1058088 - RNA, 19 nt, Homo sapiens
gcuaauugccaagauuuga

SEQ ID NO: 1058089 - RNA, 19 nt, Homo sapiens
ccacagauugucccaccua

SEQ ID NO: 1058090 - RNA, 19 nt, Homo sapiens
cugaaacccuagauucuuc

SEQ ID NO: 1058091 - RNA, 19 nt, Homo sapiens
cuacagggcuaugcacauc

SEQ ID NO: 1058092 - RNA, 19 nt, Homo sapiens
cuacugccuuuguaacuuc

SEQ ID NO: 1058093 - RNA, 19 nt, Homo sapiens
uggcaggguccuauuuaua

SEQ ID NO: 1058094 - RNA, 19 nt, Homo sapiens
caauaccguuccuuaugau

SEQ ID NO: 1058095 - RNA, 19 nt, Homo sapiens
acacugagcuuacuuaaua

SEQ ID NO: 1058096 - RNA, 19 nt, Homo sapiens
gaacaaggagucaaauuua

SEQ ID NO: 1058097 - RNA, 19 nt, Homo sapiens
gaaacaauuugcucuguaa

SEQ ID NO: 1058098 - RNA, 19 nt, Homo sapiens
gaaggagaguuuaugguuu

SEQ ID NO: 1058099 - RNA, 19 nt, Homo sapiens
gcaagcuucugcaggauua

SEQ ID NO: 1058100 - RNA, 19 nt, Homo sapiens
caaacuccaucucccaaua

SEQ ID NO: 1058101 - RNA, 19 nt, Homo sapiens
gcaaaggaaugagcagauu

SEQ ID NO: 1058102 - RNA, 19 nt, Homo sapiens
caagagagacuccuacauu

SEQ ID NO: 1058103 - RNA, 19 nt, Homo sapiens
gaaaaucaccucuuuauga

SEQ ID NO: 1058104 - RNA, 19 nt, Homo sapiens
cagcagaagccaagaaaua

SEQ ID NO: 1058105 - RNA, 19 nt, Homo sapiens
gacuauuacuugaugguua

SEQ ID NO: 1058106 - RNA, 19 nt, Homo sapiens
cagaggagaugcuucaaga

SEQ ID NO: 1058107 - RNA, 19 nt, Homo sapiens
gaaccuguguguagugugu

SEQ ID NO: 1058108 - RNA, 19 nt, Homo sapiens
caagaacguuauuggauau

SEQ ID NO: 1058109 - RNA, 19 nt, Homo sapiens
ccauccagcugucuugaua

SEQ ID NO: 1058110 - RNA, 19 nt, Homo sapiens
cagaggaccagguaauuua

SEQ ID NO: 1058111 - RNA, 19 nt, Homo sapiens
gauuauggccucguuguua

SEQ ID NO: 1058112 - RNA, 19 nt, Homo sapiens
ggagaaaagucuuggaaaa

SEQ ID NO: 1058113 - RNA, 19 nt, Homo sapiens
acacagacguggucacaga

SEQ ID NO: 1058114 - RNA, 19 nt, Homo sapiens
ugaacaaggagucaaauuu

SEQ ID NO: 1058115 - RNA, 19 nt, Homo sapiens
caacagaaucucagcagaa

SEQ ID NO: 1058116 - RNA, 19 nt, Homo sapiens
gagaaacaauuugcucugu

SEQ ID NO: 1058117 - RNA, 19 nt, Homo sapiens
ggagcguuguuucaucuuu

SEQ ID NO: 1058118 - RNA, 19 nt, Homo sapiens
caguauaucgguccuguua

SEQ ID NO: 1058119 - RNA, 19 nt, Homo sapiens
acacaacucagaauacuaa

SEQ ID NO: 1058120 - RNA, 19 nt, Homo sapiens
ggagugggaugcucagaag

SEQ ID NO: 1058121 - RNA, 19 nt, Homo sapiens
agaaacaauuugcucugua

SEQ ID NO: 1058122 - RNA, 19 nt, Homo sapiens
gaagaaaagcucaguggua

SEQ ID NO: 1058123 - RNA, 19 nt, Homo sapiens
caacuacuaugacaaccau

SEQ ID NO: 1058124 - RNA, 19 nt, Homo sapiens
gccaugccauuuccaacua

SEQ ID NO: 1058125 - RNA, 19 nt, Homo sapiens
aaagagaaccuguguguag

SEQ ID NO: 1058126 - RNA, 19 nt, Homo sapiens
gcagaaagaaccacaaacu

SEQ ID NO: 1058127 - RNA, 19 nt, Homo sapiens
auacuaaccuagacuaauc

SEQ ID NO: 1058128 - RNA, 19 nt, Homo sapiens
gaauacuaaccuagacuaa

SEQ ID NO: 1058129 - RNA, 19 nt, Homo sapiens
caacugggaugcugagacu

SEQ ID NO: 1058130 - RNA, 19 nt, Homo sapiens
agaccagaaucuccaauga

SEQ ID NO: 1058131 - RNA, 19 nt, Homo sapiens
gaggagcguuguuucaucu

SEQ ID NO: 1058132 - RNA, 19 nt, Homo sapiens
ggacacugagcuuacuuaa

SEQ ID NO: 1058133 - RNA, 19 nt, Homo sapiens
ccacacacuuccacccuau

SEQ ID NO: 1058134 - RNA, 19 nt, Homo sapiens
accagaaucuccaaugaaa

SEQ ID NO: 1058135 - RNA, 19 nt, Homo sapiens
ccucugcacuugugauaga

SEQ ID NO: 1058136 - RNA, 19 nt, Homo sapiens
gcaggauuauggccucguu

SEQ ID NO: 1058137 - RNA, 19 nt, Homo sapiens
ugaaggagaguuuaugguu

SEQ ID NO: 1058138 - RNA, 19 nt, Homo sapiens
aagagagacuccuacauuc

SEQ ID NO: 1058139 - RNA, 19 nt, Homo sapiens
uuggugagcuggugaguga

SEQ ID NO: 1058140 - RNA, 19 nt, Homo sapiens
agagucaucuggucagguu

SEQ ID NO: 1058141 - RNA, 19 nt, Homo sapiens
uuggugauguuuacucuaa

SEQ ID NO: 1058142 - RNA, 19 nt, Homo sapiens
gagcguuguuucaucuuuc

SEQ ID NO: 1058143 - RNA, 19 nt, Homo sapiens
gaccagaaucuccaaugaa

SEQ ID NO: 1058144 - RNA, 19 nt, Homo sapiens
aagcuaaucuguggaggaa

SEQ ID NO: 1058145 - RNA, 19 nt, Homo sapiens
ugaccagaauccaacaaga

SEQ ID NO: 1058146 - RNA, 19 nt, Homo sapiens
uaagaagucuaagauggau

SEQ ID NO: 1058147 - RNA, 19 nt, Homo sapiens
ggauacccuuucucuagga

SEQ ID NO: 1058148 - RNA, 19 nt, Homo sapiens
caagagcucuauuuuggaa

SEQ ID NO: 1058149 - RNA, 19 nt, Homo sapiens
ucccguaacucaugugguu

SEQ ID NO: 1058150 - RNA, 19 nt, Homo sapiens
guauaucgguccuguuagg

SEQ ID NO: 1058151 - RNA, 19 nt, Homo sapiens
ugaagguggugcaguguca

SEQ ID NO: 1058152 - RNA, 19 nt, Homo sapiens
gagaaccuguguguagugu

SEQ ID NO: 1058153 - RNA, 19 nt, Homo sapiens
gcacuugugauagaagaaa

SEQ ID NO: 1058154 - RNA, 19 nt, Homo sapiens
gcuaaucuguggaggaaaa

SEQ ID NO: 1058155 - RNA, 19 nt, Homo sapiens
uaugaggacuucucugucu

SEQ ID NO: 1058156 - RNA, 19 nt, Homo sapiens
gggcagaaagaaccacaaa

SEQ ID NO: 1058157 - RNA, 19 nt, Homo sapiens
ccccagaacugcaagauuu

SEQ ID NO: 1058158 - RNA, 19 nt, Homo sapiens
ugacacaacucagaauacu

SEQ ID NO: 1058159 - RNA, 19 nt, Homo sapiens
ucacagaggagaugcuuca

SEQ ID NO: 1058160 - RNA, 19 nt, Homo sapiens
uuaaagagaaccugugugu

SEQ ID NO: 1058161 - RNA, 19 nt, Homo sapiens
acaauuugcucuguaaugg

SEQ ID NO: 1058162 - RNA, 19 nt, Homo sapiens
gggacacugagcuuacuua

SEQ ID NO: 1058163 - RNA, 19 nt, Homo sapiens
caaauggccuccccaagug

SEQ ID NO: 1058164 - RNA, 19 nt, Homo sapiens
agaagcugcuccggaaauu

SEQ ID NO: 1058165 - RNA, 19 nt, Homo sapiens
ccaaguggccugugugucu

SEQ ID NO: 1058166 - RNA, 19 nt, Homo sapiens
cggagagccugccuacuca

SEQ ID NO: 1058167 - RNA, 19 nt, Homo sapiens
gccagaaaaucaccucuuu

SEQ ID NO: 1058168 - RNA, 19 nt, Homo sapiens
cagaagccaagaaauaaga

SEQ ID NO: 1058169 - RNA, 19 nt, Homo sapiens
gcuucaugcucucccguaa

SEQ ID NO: 1058170 - RNA, 19 nt, Homo sapiens
gugccucgguuuaucucua

SEQ ID NO: 1058171 - RNA, 19 nt, Homo sapiens
caaaggaaugagcagauug

SEQ ID NO: 1058172 - RNA, 19 nt, Homo sapiens
ugccagggaugcccagauu

SEQ ID NO: 1058173 - RNA, 19 nt, Homo sapiens
gugaguggguaaauuugga

SEQ ID NO: 1058174 - RNA, 19 nt, Homo sapiens
uggagacuauuacuugaug

SEQ ID NO: 1058175 - RNA, 19 nt, Homo sapiens
ucacagaggaccagguaau

SEQ ID NO: 1058176 - RNA, 19 nt, Homo sapiens
caaguggccugugugucuu

SEQ ID NO: 1058177 - RNA, 19 nt, Homo sapiens
gcugcuuuccucccaguua

SEQ ID NO: 1058178 - RNA, 19 nt, Homo sapiens
gcagaagccaagaaauaag

SEQ ID NO: 1058179 - RNA, 19 nt, Homo sapiens
gauacccuuucucuaggaa

SEQ ID NO: 1058180 - RNA, 19 nt, Homo sapiens
caacaagagcucuauuuug

SEQ ID NO: 1058181 - RNA, 19 nt, Homo sapiens
caaaagaggagcguuguuu

SEQ ID NO: 1058182 - RNA, 19 nt, Homo sapiens
ucacucagcuuuuccuuuc

SEQ ID NO: 1058183 - RNA, 19 nt, Homo sapiens
ccuggagacuauuacuuga

SEQ ID NO: 1058184 - RNA, 19 nt, Homo sapiens
caucauuaauugucaaagc

SEQ ID NO: 1058185 - RNA, 19 nt, Homo sapiens
gacugugaguggguaaauu

SEQ ID NO: 1058186 - RNA, 19 nt, Homo sapiens
gcucagaagaugccagcaa

SEQ ID NO: 1058187 - RNA, 19 nt, Homo sapiens
uaaagagaaccugugugua

SEQ ID NO: 1058188 - RNA, 19 nt, Homo sapiens
aaagaggagcguuguuuca

SEQ ID NO: 1058189 - RNA, 19 nt, Homo sapiens
uaacacagacguggucaca

SEQ ID NO: 1058190 - RNA, 19 nt, Homo sapiens
gacaucccauuucgaagca

SEQ ID NO: 1058191 - RNA, 19 nt, Homo sapiens
acagaggaccagguaauuu

SEQ ID NO: 1058192 - RNA, 19 nt, Homo sapiens
gcaauaugaggacuucucu

SEQ ID NO: 1058193 - RNA, 19 nt, Homo sapiens
cccaauagaacuuugaaau

SEQ ID NO: 1058194 - RNA, 19 nt, Homo sapiens
gcaagagagacuccuacau

SEQ ID NO: 1058195 - RNA, 19 nt, Homo sapiens
ccacuacucuuccaaauuu

SEQ ID NO: 1058196 - RNA, 19 nt, Homo sapiens
gcaagaagcucacgaugga

SEQ ID NO: 1058197 - RNA, 19 nt, Homo sapiens
gaagauagccgaagucaug

SEQ ID NO: 1058198 - RNA, 19 nt, Homo sapiens
gaaagaagaccaaaucaga

SEQ ID NO: 1058199 - RNA, 19 nt, Homo sapiens
ggaagcagccaaaggauua

SEQ ID NO: 1058200 - RNA, 19 nt, Homo sapiens
gcauucacgucaaauauaa

SEQ ID NO: 1058201 - RNA, 19 nt, Homo sapiens
gccaaaggauuaccugaua

SEQ ID NO: 1058202 - RNA, 19 nt, Homo sapiens
ggacaaauccuucagaaag

SEQ ID NO: 1058203 - RNA, 19 nt, Homo sapiens
gaaucaagcuggaccuguu

SEQ ID NO: 1058204 - RNA, 19 nt, Homo sapiens
gaagcagccauuagauuua

SEQ ID NO: 1058205 - RNA, 19 nt, Homo sapiens
gcagacaaguggaacaaga

SEQ ID NO: 1058206 - RNA, 19 nt, Homo sapiens
gacaaauccuucagaaaga

SEQ ID NO: 1058207 - RNA, 19 nt, Homo sapiens
uaacauccaagucugauua

SEQ ID NO: 1058208 - RNA, 19 nt, Homo sapiens
ucagagaacuagaacuaaa

SEQ ID NO: 1058209 - RNA, 19 nt, Homo sapiens
cagaacaaguuacauaaug

SEQ ID NO: 1058210 - RNA, 19 nt, Homo sapiens
aaacacaaccuuggaauaa

SEQ ID NO: 1058211 - RNA, 19 nt, Homo sapiens
guuaaaggcugaccugcaa

SEQ ID NO: 1058212 - RNA, 19 nt, Homo sapiens
gagauagaauaccgagaaa

SEQ ID NO: 1058213 - RNA, 19 nt, Homo sapiens
gccauuagauuuaaagauc

SEQ ID NO: 1058214 - RNA, 19 nt, Homo sapiens
cacaaggacuuaauggaaa

SEQ ID NO: 1058215 - RNA, 19 nt, Homo sapiens
gagauugaguauauggaaa

SEQ ID NO: 1058216 - RNA, 19 nt, Homo sapiens
uccaggagcuucggaaaua

SEQ ID NO: 1058217 - RNA, 19 nt, Homo sapiens
ucagaaagaucaggaaauc

SEQ ID NO: 1058218 - RNA, 19 nt, Homo sapiens
ugaagcagccauuagauuu

SEQ ID NO: 1058219 - RNA, 19 nt, Homo sapiens
agaaugcaccgaaaccuua

SEQ ID NO: 1058220 - RNA, 19 nt, Homo sapiens
gagcauuccuuccucaucu

SEQ ID NO: 1058221 - RNA, 19 nt, Homo sapiens
gaucagagaacuagaagca

SEQ ID NO: 1058222 - RNA, 19 nt, Homo sapiens
gaagaccucacagaacuuu

SEQ ID NO: 1058223 - RNA, 19 nt, Homo sapiens
ccaaaggauuaccugauau

SEQ ID NO: 1058224 - RNA, 19 nt, Homo sapiens
gagcgucucuggcagucaa

SEQ ID NO: 1058225 - RNA, 19 nt, Homo sapiens
acacaaccuuggaauaaau

SEQ ID NO: 1058226 - RNA, 19 nt, Homo sapiens
uagaagaccucacagaacu

SEQ ID NO: 1058227 - RNA, 19 nt, Homo sapiens
aaacacagcaccuggagaa

SEQ ID NO: 1058228 - RNA, 19 nt, Homo sapiens
ucagaagcgucuaugauuc

SEQ ID NO: 1058229 - RNA, 19 nt, Homo sapiens
aaucagagaacuagaacua

SEQ ID NO: 1058230 - RNA, 19 nt, Homo sapiens
acaugaaggugaaagaaga

SEQ ID NO: 1058231 - RNA, 19 nt, Homo sapiens
agaaacaguuaauggaaga

SEQ ID NO: 1058232 - RNA, 19 nt, Homo sapiens
cgagggauccgcucagaaa

SEQ ID NO: 1058233 - RNA, 19 nt, Homo sapiens
caagagcuccgcagucaga

SEQ ID NO: 1058234 - RNA, 19 nt, Homo sapiens
gaagucauagcgccacaaa

SEQ ID NO: 1058235 - RNA, 19 nt, Homo sapiens
cagaucagcucccuuucga

SEQ ID NO: 1058236 - RNA, 19 nt, Homo sapiens
ggaacuguaucuguuguca

SEQ ID NO: 1058237 - RNA, 19 nt, Homo sapiens
ccaaaucagagaacuagaa

SEQ ID NO: 1058238 - RNA, 19 nt, Homo sapiens
aagcagccauuagauuuaa

SEQ ID NO: 1058239 - RNA, 19 nt, Homo sapiens
gauuagaacugcccaucag

SEQ ID NO: 1058240 - RNA, 19 nt, Homo sapiens
gcaccuggagaacagcuua

SEQ ID NO: 1058241 - RNA, 19 nt, Homo sapiens
ggacaugaaggugaaagaa

SEQ ID NO: 1058242 - RNA, 19 nt, Homo sapiens
gcuaaaagcugagcaggaa

SEQ ID NO: 1058243 - RNA, 19 nt, Homo sapiens
gcagaacaaguuacauaau

SEQ ID NO: 1058244 - RNA, 19 nt, Homo sapiens
acacaaggacuuaauggaa

SEQ ID NO: 1058245 - RNA, 19 nt, Homo sapiens
gaggaagaaguuagaagaa

SEQ ID NO: 1058246 - RNA, 19 nt, Homo sapiens
gcaggaagcccgaaguuuu

SEQ ID NO: 1058247 - RNA, 19 nt, Homo sapiens
agaaagaucaggaaaucaa

SEQ ID NO: 1058248 - RNA, 19 nt, Homo sapiens
ggugaaagaagaccaaauc

SEQ ID NO: 1058249 - RNA, 19 nt, Homo sapiens
aagcagaaaugcacuagca

SEQ ID NO: 1058250 - RNA, 19 nt, Homo sapiens
caacuuugccagagauaga

SEQ ID NO: 1058251 - RNA, 19 nt, Homo sapiens
uaauaugccugcuguucau

SEQ ID NO: 1058252 - RNA, 19 nt, Homo sapiens
ccacaacuuugccagagau

SEQ ID NO: 1058253 - RNA, 19 nt, Homo sapiens
uaccugauauggauucuuc

SEQ ID NO: 1058254 - RNA, 19 nt, Homo sapiens
cgaggaagcagccaaagga

SEQ ID NO: 1058255 - RNA, 19 nt, Homo sapiens
ucuggauccucuuuguuua

SEQ ID NO: 1058256 - RNA, 19 nt, Homo sapiens
cggaaggcauugcaaagga

SEQ ID NO: 1058257 - RNA, 19 nt, Homo sapiens
guagagaaacaguuaaugg

SEQ ID NO: 1058258 - RNA, 19 nt, Homo sapiens
guacguauggcacacagaa

SEQ ID NO: 1058259 - RNA, 19 nt, Homo sapiens
gaaggccagcuguguguug

SEQ ID NO: 1058260 - RNA, 19 nt, Homo sapiens
gagaaugcaccgaaaccuu

SEQ ID NO: 1058261 - RNA, 19 nt, Homo sapiens
aacaagagcuccgcaguca

SEQ ID NO: 1058262 - RNA, 19 nt, Homo sapiens
uggauccucuuuguuuaua

SEQ ID NO: 1058263 - RNA, 19 nt, Homo sapiens
gcugcuagcacauauguau

SEQ ID NO: 1058264 - RNA, 19 nt, Homo sapiens
cgauggacaugaaggugaa

SEQ ID NO: 1058265 - RNA, 19 nt, Homo sapiens
guagcauucacgucaaaua

SEQ ID NO: 1058266 - RNA, 19 nt, Homo sapiens
gagcaggaagcccgaaguu

SEQ ID NO: 1058267 - RNA, 19 nt, Homo sapiens
agucauagcgccacaaaug

SEQ ID NO: 1058268 - RNA, 19 nt, Homo sapiens
aggauuaccugauauggau

SEQ ID NO: 1058269 - RNA, 19 nt, Homo sapiens
caaaggauuaccugauaug

SEQ ID NO: 1058270 - RNA, 19 nt, Homo sapiens
aaagauaacauccaagucu

SEQ ID NO: 1058271 - RNA, 19 nt, Homo sapiens
aacuguaucuguugucauu

SEQ ID NO: 1058272 - RNA, 19 nt, Homo sapiens
ggaaaucaaggaccuaaaa

SEQ ID NO: 1058273 - RNA, 19 nt, Homo sapiens
auaaugcugugcaaaugaa

SEQ ID NO: 1058274 - RNA, 19 nt, Homo sapiens
cugcagaacaaguuacaua

SEQ ID NO: 1058275 - RNA, 19 nt, Homo sapiens
guacacacaaggacuuaau

SEQ ID NO: 1058276 - RNA, 19 nt, Homo sapiens
agagauagaauaccgagaa

SEQ ID NO: 1058277 - RNA, 19 nt, Homo sapiens
aaacuuucauguagaccuu

SEQ ID NO: 1058278 - RNA, 19 nt, Homo sapiens
cauccaagucugauuagaa

SEQ ID NO: 1058279 - RNA, 19 nt, Homo sapiens
gggaaaagauaacauccaa

SEQ ID NO: 1058280 - RNA, 19 nt, Homo sapiens
gaaggugaaagaagaccaa

SEQ ID NO: 1058281 - RNA, 19 nt, Homo sapiens
gggauccgcucagaaaugg

SEQ ID NO: 1058282 - RNA, 19 nt, Homo sapiens
gaacgaguuuuacaugcaa

SEQ ID NO: 1058283 - RNA, 19 nt, Homo sapiens
cgucuaugauuccuucaga

SEQ ID NO: 1058284 - RNA, 19 nt, Homo sapiens
gcucgagauugcccaagga

SEQ ID NO: 1058285 - RNA, 19 nt, Homo sapiens
acauaaugcugugcaaaug

SEQ ID NO: 1058286 - RNA, 19 nt, Homo sapiens
gcuggaacaagacauuaaa

SEQ ID NO: 1058287 - RNA, 19 nt, Homo sapiens
ucuaugauuccuucagaua

SEQ ID NO: 1058288 - RNA, 19 nt, Homo sapiens
gaaaagauaacauccaagu

SEQ ID NO: 1058289 - RNA, 19 nt, Homo sapiens
guccuggaguucagauuug

SEQ ID NO: 1058290 - RNA, 19 nt, Homo sapiens
gaccaaaucagagaacuag

SEQ ID NO: 1058291 - RNA, 19 nt, Homo sapiens
cauaaugcugugcaaauga

SEQ ID NO: 1058292 - RNA, 19 nt, Homo sapiens
cuaauaaccagcuaagcaa

SEQ ID NO: 1058293 - RNA, 19 nt, Homo sapiens
cagaaaugcacuagcaaga

SEQ ID NO: 1058294 - RNA, 19 nt, Homo sapiens
gagaagaagcagaaaugca

SEQ ID NO: 1058295 - RNA, 19 nt, Homo sapiens
gaaaggcacaggaauauuu

SEQ ID NO: 1058296 - RNA, 19 nt, Homo sapiens
ccauaucacuucacucuua

SEQ ID NO: 1058297 - RNA, 19 nt, Homo sapiens
gcaguggacucaucaauug

SEQ ID NO: 1058298 - RNA, 19 nt, Homo sapiens
ggccaaagauuaccgagua

SEQ ID NO: 1058299 - RNA, 19 nt, Homo sapiens
ucacuucacucuuaacaug

SEQ ID NO: 1058300 - RNA, 19 nt, Homo sapiens
aaagaaaggcacaggaaua

SEQ ID NO: 1058301 - RNA, 19 nt, Homo sapiens
gcaaagaaaggcacaggaa

SEQ ID NO: 1058302 - RNA, 19 nt, Homo sapiens
ugugaaacccucucauuua

SEQ ID NO: 1058303 - RNA, 19 nt, Homo sapiens
ggaccaaguuucccaacau

SEQ ID NO: 1058304 - RNA, 19 nt, Homo sapiens
gaccaaguuucccaacauu

SEQ ID NO: 1058305 - RNA, 19 nt, Homo sapiens
ggaggcagguagagcaguu

SEQ ID NO: 1058306 - RNA, 19 nt, Homo sapiens
gaggaaugaucuuguccaa

SEQ ID NO: 1058307 - RNA, 19 nt, Homo sapiens
gugaaacccucucauuuac

SEQ ID NO: 1058308 - RNA, 19 nt, Homo sapiens
gcuuauaucucuucaccau

SEQ ID NO: 1058309 - RNA, 19 nt, Homo sapiens
cauaucacuucacucuuaa

SEQ ID NO: 1058310 - RNA, 19 nt, Homo sapiens
gcucuaaguugaccucucu

SEQ ID NO: 1058311 - RNA, 19 nt, Homo sapiens
caaagauuaccgaguauau

SEQ ID NO: 1058312 - RNA, 19 nt, Homo sapiens
gagggcaaguggaagaaga

SEQ ID NO: 1058313 - RNA, 19 nt, Homo sapiens
uaaguugaccucucuauag

SEQ ID NO: 1058314 - RNA, 19 nt, Homo sapiens
guuaauagcagcagcacaa

SEQ ID NO: 1058315 - RNA, 19 nt, Homo sapiens
gaaacccucucauuuacac

SEQ ID NO: 1058316 - RNA, 19 nt, Homo sapiens
ccacaucucuccuaauucc

SEQ ID NO: 1058317 - RNA, 19 nt, Homo sapiens
acaaccaccuccaacacua

SEQ ID NO: 1058318 - RNA, 19 nt, Homo sapiens
ggaggugccuaacgucaag

SEQ ID NO: 1058319 - RNA, 19 nt, Homo sapiens
ugaaggucguggagaugua

SEQ ID NO: 1058320 - RNA, 19 nt, Homo sapiens
gcagguagagcaguucuga

SEQ ID NO: 1058321 - RNA, 19 nt, Homo sapiens
ggaccuugccgacucuauu

SEQ ID NO: 1058322 - RNA, 19 nt, Homo sapiens
ggagacggcggaagcauuc

SEQ ID NO: 1058323 - RNA, 19 nt, Homo sapiens
gaccauaucacuucacucu

SEQ ID NO: 1058324 - RNA, 19 nt, Homo sapiens
aauagcagcagcacaauga

SEQ ID NO: 1058325 - RNA, 19 nt, Homo sapiens
gugugaaacccucucauuu

SEQ ID NO: 1058326 - RNA, 19 nt, Homo sapiens
ccaaguuucugugcauuca

SEQ ID NO: 1058327 - RNA, 19 nt, Homo sapiens
gcauagucgucaagaacug

SEQ ID NO: 1058328 - RNA, 19 nt, Homo sapiens
cagcagcaguggacucauc

SEQ ID NO: 1058329 - RNA, 19 nt, Homo sapiens
ggacguguucgacauggaa

SEQ ID NO: 1058330 - RNA, 19 nt, Homo sapiens
gaugagggcaaguggaaga

SEQ ID NO: 1058331 - RNA, 19 nt, Homo sapiens
gcagcagcacaaugauuaa

SEQ ID NO: 1058332 - RNA, 19 nt, Homo sapiens
uaauugcacucugguuaau

SEQ ID NO: 1058333 - RNA, 19 nt, Homo sapiens
cagcgagaauuggacauga

SEQ ID NO: 1058334 - RNA, 19 nt, Homo sapiens
caaagaaaggcacaggaau

SEQ ID NO: 1058335 - RNA, 19 nt, Homo sapiens
cuaauuccacuucaccuuu

SEQ ID NO: 1058336 - RNA, 19 nt, Homo sapiens
cuaaguugaccucucuaua

SEQ ID NO: 1058337 - RNA, 19 nt, Homo sapiens
acuaugacaugcugaagga

SEQ ID NO: 1058338 - RNA, 19 nt, Homo sapiens
ccaaagauuaccgaguaua

SEQ ID NO: 1058339 - RNA, 19 nt, Homo sapiens
gccaaagauuaccgaguau

SEQ ID NO: 1058340 - RNA, 19 nt, Homo sapiens
uucccaacauucccuauaa

SEQ ID NO: 1058341 - RNA, 19 nt, Homo sapiens
caugaggaaugaucuuguc

SEQ ID NO: 1058342 - RNA, 19 nt, Homo sapiens
gcagcacaaugauuaaaau

SEQ ID NO: 1058343 - RNA, 19 nt, Homo sapiens
agcagcagcacaaugauua

SEQ ID NO: 1058344 - RNA, 19 nt, Homo sapiens
aagaaaggcacaggaauau

SEQ ID NO: 1058345 - RNA, 19 nt, Homo sapiens
ggucacgccuccuggaacu

SEQ ID NO: 1058346 - RNA, 19 nt, Homo sapiens
ccauggaggugccuaacgu

SEQ ID NO: 1058347 - RNA, 19 nt, Homo sapiens
uuucuucucccuuggcuua

SEQ ID NO: 1058348 - RNA, 19 nt, Homo sapiens
ccagcauagucgucaagaa

SEQ ID NO: 1058349 - RNA, 19 nt, Homo sapiens
gaagaacaaaugggagauc

SEQ ID NO: 1058350 - RNA, 19 nt, Homo sapiens
ucccuuggcuuauaucucu

SEQ ID NO: 1058351 - RNA, 19 nt, Homo sapiens
gaaugucagcuccuguuag

SEQ ID NO: 1058352 - RNA, 19 nt, Homo sapiens
gauaugcugccaccuccuu

SEQ ID NO: 1058353 - RNA, 19 nt, Homo sapiens
uuacugcacaggcaaagaa

SEQ ID NO: 1058354 - RNA, 19 nt, Homo sapiens
agaaugucagcuccuguua

SEQ ID NO: 1058355 - RNA, 19 nt, Homo sapiens
ccuuugcccuggaccauau

SEQ ID NO: 1058356 - RNA, 19 nt, Homo sapiens
ggggauggcugaagaugga

SEQ ID NO: 1058357 - RNA, 19 nt, Homo sapiens
gccaugggcauuucuguca

SEQ ID NO: 1058358 - RNA, 19 nt, Homo sapiens
ggccauggcaggaagaauc

SEQ ID NO: 1058359 - RNA, 19 nt, Homo sapiens
auuaauugcacucugguua

SEQ ID NO: 1058360 - RNA, 19 nt, Homo sapiens
ccccacaucucuccuaauu

SEQ ID NO: 1058361 - RNA, 19 nt, Homo sapiens
gcucugaacuaguuuuaag

SEQ ID NO: 1058362 - RNA, 19 nt, Homo sapiens
cuaccucucccuccuguga

SEQ ID NO: 1058363 - RNA, 19 nt, Homo sapiens
ccaaauccuaccaaucuca

SEQ ID NO: 1058364 - RNA, 19 nt, Homo sapiens
uaacaugaggaaugaucuu

SEQ ID NO: 1058365 - RNA, 19 nt, Homo sapiens
caaccaccuccaacacuau

SEQ ID NO: 1058366 - RNA, 19 nt, Homo sapiens
ccagauggagguggcgaua

SEQ ID NO: 1058367 - RNA, 19 nt, Homo sapiens
gggcuacuuccaagaaugu

SEQ ID NO: 1058368 - RNA, 19 nt, Homo sapiens
cagcauagucgucaagaac

SEQ ID NO: 1058369 - RNA, 19 nt, Homo sapiens
gaccuugccgacucuauuc

SEQ ID NO: 1058370 - RNA, 19 nt, Homo sapiens
cgauggacguguucgacau

SEQ ID NO: 1058371 - RNA, 19 nt, Homo sapiens
uagcagcagcacaaugauu

SEQ ID NO: 1058372 - RNA, 19 nt, Homo sapiens
cauuuacacuguggcauca

SEQ ID NO: 1058373 - RNA, 19 nt, Homo sapiens
ccagaggccuagcccuuuu

SEQ ID NO: 1058374 - RNA, 19 nt, Homo sapiens
guuccaaaccacuuucuuc

SEQ ID NO: 1058375 - RNA, 19 nt, Homo sapiens
gagaggauagacugcuguu

SEQ ID NO: 1058376 - RNA, 19 nt, Homo sapiens
ucucugggcucaguaccuu

SEQ ID NO: 1058377 - RNA, 19 nt, Homo sapiens
ucaaccagggucugaguga

SEQ ID NO: 1058378 - RNA, 19 nt, Homo sapiens
cagcagcacaaugauuaaa

SEQ ID NO: 1058379 - RNA, 19 nt, Homo sapiens
gcaucaaaauccacaaaag

SEQ ID NO: 1058380 - RNA, 19 nt, Homo sapiens
uaauuccacuucaccuuuu

SEQ ID NO: 1058381 - RNA, 19 nt, Homo sapiens
aauuggacaugaagcuaga

SEQ ID NO: 1058382 - RNA, 19 nt, Homo sapiens
ugucagcuccuguuagcaa

SEQ ID NO: 1058383 - RNA, 19 nt, Homo sapiens
ccaaguuccugcggacgau

SEQ ID NO: 1058384 - RNA, 19 nt, Homo sapiens
ccacuuguacagccuagga

SEQ ID NO: 1058385 - RNA, 19 nt, Homo sapiens
aaagauuaccgaguauaug

SEQ ID NO: 1058386 - RNA, 19 nt, Homo sapiens
caucuacucagcgagaauu

SEQ ID NO: 1058387 - RNA, 19 nt, Homo sapiens
gacugcuguugcugucuuu

SEQ ID NO: 1058388 - RNA, 19 nt, Homo sapiens
cuccaaauccuaccaaucu

SEQ ID NO: 1058389 - RNA, 19 nt, Homo sapiens
acucuuaacaugaggaaug

SEQ ID NO: 1058390 - RNA, 19 nt, Homo sapiens
ugccuaacgucaaggacuu

SEQ ID NO: 1058391 - RNA, 19 nt, Homo sapiens
uuuacacuguggcaucaaa

SEQ ID NO: 1058392 - RNA, 19 nt, Homo sapiens
ugugugaaacccucucauu

SEQ ID NO: 1058393 - RNA, 19 nt, Homo sapiens
uauaucucuucaccauuug

SEQ ID NO: 1058394 - RNA, 19 nt, Homo sapiens
gauggacguguucgacaug

SEQ ID NO: 1058395 - RNA, 19 nt, Homo sapiens
ggagacacuuggccuguua

SEQ ID NO: 1058396 - RNA, 19 nt, Homo sapiens
gcacaaacacaauguauga

SEQ ID NO: 1058397 - RNA, 19 nt, Homo sapiens
gaagacaaccuccaucuau

SEQ ID NO: 1058398 - RNA, 19 nt, Homo sapiens
cagcuggucuggauagaua

SEQ ID NO: 1058399 - RNA, 19 nt, Homo sapiens
gcauggcacuccugaagaa

SEQ ID NO: 1058400 - RNA, 19 nt, Homo sapiens
caaccuccaucuauuuauu

SEQ ID NO: 1058401 - RNA, 19 nt, Homo sapiens
gcaaguucaugaccacauu

SEQ ID NO: 1058402 - RNA, 19 nt, Homo sapiens
ugaagaaccuugacugcuu

SEQ ID NO: 1058403 - RNA, 19 nt, Homo sapiens
gcucuugucuaaagugauu

SEQ ID NO: 1058404 - RNA, 19 nt, Homo sapiens
ccaggucucuugucucuug

SEQ ID NO: 1058405 - RNA, 19 nt, Homo sapiens
ggacauggaacuuucaaug

SEQ ID NO: 1058406 - RNA, 19 nt, Homo sapiens
gacaaccuccaucuauuua

SEQ ID NO: 1058407 - RNA, 19 nt, Homo sapiens
ccugggagcuuguuaggaa

SEQ ID NO: 1058408 - RNA, 19 nt, Homo sapiens
caccugaucugcaucuuug

SEQ ID NO: 1058409 - RNA, 19 nt, Homo sapiens
cgacucagacccugcauuu

SEQ ID NO: 1058410 - RNA, 19 nt, Homo sapiens
ggagagcuguggugggaau

SEQ ID NO: 1058411 - RNA, 19 nt, Homo sapiens
guccagagcuaccgaguuc

SEQ ID NO: 1058412 - RNA, 19 nt, Homo sapiens
acacuuggccuguuagauu

SEQ ID NO: 1058413 - RNA, 19 nt, Homo sapiens
gaacgccuguggcuugaag

SEQ ID NO: 1058414 - RNA, 19 nt, Homo sapiens
gugggaaccugaacuagga

SEQ ID NO: 1058415 - RNA, 19 nt, Homo sapiens
caaguuaccuccagaucag

SEQ ID NO: 1058416 - RNA, 19 nt, Homo sapiens
gcccuugucugucuuggaa

SEQ ID NO: 1058417 - RNA, 19 nt, Homo sapiens
gagcagagggugaaguuuc

SEQ ID NO: 1058418 - RNA, 19 nt, Homo sapiens
gagaacgccuguggcuuga

SEQ ID NO: 1058419 - RNA, 19 nt, Homo sapiens
guacgugccuccaaguuac

SEQ ID NO: 1058420 - RNA, 19 nt, Homo sapiens
cauggaacuuucaaugcua

SEQ ID NO: 1058421 - RNA, 19 nt, Homo sapiens
aagacaaccuccaucuauu

SEQ ID NO: 1058422 - RNA, 19 nt, Homo sapiens
agacaaccuccaucuauuu

SEQ ID NO: 1058423 - RNA, 19 nt, Homo sapiens
ggugaaguuucucucaguu

SEQ ID NO: 1058424 - RNA, 19 nt, Homo sapiens
gagaacagcagagucaguu

SEQ ID NO: 1058425 - RNA, 19 nt, Homo sapiens
ccugagaacugaccuggau

SEQ ID NO: 1058426 - RNA, 19 nt, Homo sapiens
aagcuucagucugcaauaa

SEQ ID NO: 1058427 - RNA, 19 nt, Homo sapiens
ccagagaacagcagaguca

SEQ ID NO: 1058428 - RNA, 19 nt, Homo sapiens
gagaugugcccguggagaa

SEQ ID NO: 1058429 - RNA, 19 nt, Homo sapiens
gcccaggucucuugucucu

SEQ ID NO: 1058430 - RNA, 19 nt, Homo sapiens
uuacuacuccuaaggcuaa

SEQ ID NO: 1058431 - RNA, 19 nt, Homo sapiens
aguaaucccugcucagaau

SEQ ID NO: 1058432 - RNA, 19 nt, Homo sapiens
gccaguugcugcccugaga

SEQ ID NO: 1058433 - RNA, 19 nt, Homo sapiens
uuaagucccucaccagcaa

SEQ ID NO: 1058434 - RNA, 19 nt, Homo sapiens
ucucugaugugcacaaaca

SEQ ID NO: 1058435 - RNA, 19 nt, Homo sapiens
cccucaaccuggcaucuua

SEQ ID NO: 1058436 - RNA, 19 nt, Homo sapiens
cugcagcucuugucuaaag

SEQ ID NO: 1058437 - RNA, 19 nt, Homo sapiens
gaacagcagagucaguuac

SEQ ID NO: 1058438 - RNA, 19 nt, Homo sapiens
guagugggcucuggaaugc

SEQ ID NO: 1058439 - RNA, 19 nt, Homo sapiens
ucagucagcuccgagaugu

SEQ ID NO: 1058440 - RNA, 19 nt, Homo sapiens
uaaagaaugcauugguuuc

SEQ ID NO: 1058441 - RNA, 19 nt, Homo sapiens
gagcuguggugggaauaug

SEQ ID NO: 1058442 - RNA, 19 nt, Homo sapiens
gcaucaaccuccgcuucaa

SEQ ID NO: 1058443 - RNA, 19 nt, Homo sapiens
gagaagacaaccuccaucu

SEQ ID NO: 1058444 - RNA, 19 nt, Homo sapiens
gcacuuuagaguuugagaa

SEQ ID NO: 1058445 - RNA, 19 nt, Homo sapiens
gggagacacuuggccuguu

SEQ ID NO: 1058446 - RNA, 19 nt, Homo sapiens
gcaaagccaggccguccaa

SEQ ID NO: 1058447 - RNA, 19 nt, Homo sapiens
uagauagcuuacagcagua

SEQ ID NO: 1058448 - RNA, 19 nt, Homo sapiens
ggucuggauagauagcuua

SEQ ID NO: 1058449 - RNA, 19 nt, Homo sapiens
cacuuggccuguuagauug

SEQ ID NO: 1058450 - RNA, 19 nt, Homo sapiens
ggccagauccaccucauca

SEQ ID NO: 1058451 - RNA, 19 nt, Homo sapiens
uaagcacuuuagaguuuga

SEQ ID NO: 1058452 - RNA, 19 nt, Homo sapiens
ccuauaagcacuuuagagu

SEQ ID NO: 1058453 - RNA, 19 nt, Homo sapiens
gaccagagccuugcaacuc

SEQ ID NO: 1058454 - RNA, 19 nt, Homo sapiens
caaaggguuuucaggauga

SEQ ID NO: 1058455 - RNA, 19 nt, Homo sapiens
ggagagguggcccagagaa

SEQ ID NO: 1058456 - RNA, 19 nt, Homo sapiens
ucacgucagcucugucauu

SEQ ID NO: 1058457 - RNA, 19 nt, Homo sapiens
caagucacgucagcucugu

SEQ ID NO: 1058458 - RNA, 19 nt, Homo sapiens
gggugcagcuggucuggau

SEQ ID NO: 1058459 - RNA, 19 nt, Homo sapiens
gcuucagucugcaauaaag

SEQ ID NO: 1058460 - RNA, 19 nt, Homo sapiens
ugaaguuucucucaguucu

SEQ ID NO: 1058461 - RNA, 19 nt, Homo sapiens
gggugaaguuucucucagu

SEQ ID NO: 1058462 - RNA, 19 nt, Homo sapiens
gcucagaccacugcucaga

SEQ ID NO: 1058463 - RNA, 19 nt, Homo sapiens
cagcucuugucuaaaguga

SEQ ID NO: 1058464 - RNA, 19 nt, Homo sapiens
ccaaguuaccuccagauca

SEQ ID NO: 1058465 - RNA, 19 nt, Homo sapiens
gcuggucuccuuucccauu

SEQ ID NO: 1058466 - RNA, 19 nt, Homo sapiens
gcuaacaacgagcuuaagu

SEQ ID NO: 1058467 - RNA, 19 nt, Homo sapiens
gaucuccugcccucucuga

SEQ ID NO: 1058468 - RNA, 19 nt, Homo sapiens
gaguucaucuguggguguu

SEQ ID NO: 1058469 - RNA, 19 nt, Homo sapiens
ucaucacccuggcuaacaa

SEQ ID NO: 1058470 - RNA, 19 nt, Homo sapiens
cccuauaccucccgacuca

SEQ ID NO: 1058471 - RNA, 19 nt, Homo sapiens
gcucagaaugcucccaguu

SEQ ID NO: 1058472 - RNA, 19 nt, Homo sapiens
gaugaccugguucuucuga

SEQ ID NO: 1058473 - RNA, 19 nt, Homo sapiens
ggacuggugggaaccugaa

SEQ ID NO: 1058474 - RNA, 19 nt, Homo sapiens
caccaggagaugaggguua

SEQ ID NO: 1058475 - RNA, 19 nt, Homo sapiens
acucagacccugcauuuua

SEQ ID NO: 1058476 - RNA, 19 nt, Homo sapiens
ccagagccuugcaacucaa

SEQ ID NO: 1058477 - RNA, 19 nt, Homo sapiens
ccacuuuacuacuccuaag

SEQ ID NO: 1058478 - RNA, 19 nt, Homo sapiens
ccccagagcuugaggcaaa

SEQ ID NO: 1058479 - RNA, 19 nt, Homo sapiens
ccaccugaucugcaucuuu

SEQ ID NO: 1058480 - RNA, 19 nt, Homo sapiens
accugcagcucuugucuaa

SEQ ID NO: 1058481 - RNA, 19 nt, Homo sapiens
cacgucagcucugucauuc

SEQ ID NO: 1058482 - RNA, 19 nt, Homo sapiens
gcaguagugggcucuggaa

SEQ ID NO: 1058483 - RNA, 19 nt, Homo sapiens
guccucaccucaggccuuu

SEQ ID NO: 1058484 - RNA, 19 nt, Homo sapiens
gugcacaaacacaauguau

SEQ ID NO: 1058485 - RNA, 19 nt, Homo sapiens
agaagacaaccuccaucua

SEQ ID NO: 1058486 - RNA, 19 nt, Homo sapiens
cugaugaccugguucuucu

SEQ ID NO: 1058487 - RNA, 19 nt, Homo sapiens
acaagguccugcggaaugu

SEQ ID NO: 1058488 - RNA, 19 nt, Homo sapiens
gguuucuccuuguugaaga

SEQ ID NO: 1058489 - RNA, 19 nt, Homo sapiens
cccaggacauggaacuuuc

SEQ ID NO: 1058490 - RNA, 19 nt, Homo sapiens
ccauuggcaucuacaaggu

SEQ ID NO: 1058491 - RNA, 19 nt, Homo sapiens
aguacgugccuccaaguua

SEQ ID NO: 1058492 - RNA, 19 nt, Homo sapiens
agugcaagcuggucuccuu

SEQ ID NO: 1058493 - RNA, 19 nt, Homo sapiens
acugauaggucgggccauu

SEQ ID NO: 1058494 - RNA, 19 nt, Homo sapiens
ugaucugcaucuuuguuug

SEQ ID NO: 1058495 - RNA, 19 nt, Homo sapiens
ggagacacuuggccuguua

SEQ ID NO: 1058496 - RNA, 19 nt, Homo sapiens
gcacaaacacaauguauga

SEQ ID NO: 1058497 - RNA, 19 nt, Homo sapiens
gauaaagaaugcauugguu

SEQ ID NO: 1058498 - RNA, 19 nt, Homo sapiens
gaagacaaccuccaucuau

SEQ ID NO: 1058499 - RNA, 19 nt, Homo sapiens
cagcuggucuggauagaua

SEQ ID NO: 1058500 - RNA, 19 nt, Homo sapiens
gcauggcacuccugaagaa

SEQ ID NO: 1058501 - RNA, 19 nt, Homo sapiens
caaccuccaucuauuuauu

SEQ ID NO: 1058502 - RNA, 19 nt, Homo sapiens
ugaagaaccuugacugcuu

SEQ ID NO: 1058503 - RNA, 19 nt, Homo sapiens
gcucuugucuaaagugauu

SEQ ID NO: 1058504 - RNA, 19 nt, Homo sapiens
ccaggucucuugucucuug

SEQ ID NO: 1058505 - RNA, 19 nt, Homo sapiens
ggacauggaacuuucaaug

SEQ ID NO: 1058506 - RNA, 19 nt, Homo sapiens
gacaaccuccaucuauuua

SEQ ID NO: 1058507 - RNA, 19 nt, Homo sapiens
ccugggagcuuguuaggaa

SEQ ID NO: 1058508 - RNA, 19 nt, Homo sapiens
caccugaucugcaucuuug

SEQ ID NO: 1058509 - RNA, 19 nt, Homo sapiens
cgacucagacccugcauuu

SEQ ID NO: 1058510 - RNA, 19 nt, Homo sapiens
ggagagcuguggugggaau

SEQ ID NO: 1058511 - RNA, 19 nt, Homo sapiens
ggacuucccugagcagcuu

SEQ ID NO: 1058512 - RNA, 19 nt, Homo sapiens
guccagagcuaccgaguuc

SEQ ID NO: 1058513 - RNA, 19 nt, Homo sapiens
acacuuggccuguuagauu

SEQ ID NO: 1058514 - RNA, 19 nt, Homo sapiens
gaacgccuguggcuugaag

SEQ ID NO: 1058515 - RNA, 19 nt, Homo sapiens
gugggaaccugaacuagga

SEQ ID NO: 1058516 - RNA, 19 nt, Homo sapiens
gcccuugucugucuuggaa

SEQ ID NO: 1058517 - RNA, 19 nt, Homo sapiens
gagcagagggugaaguuuc

SEQ ID NO: 1058518 - RNA, 19 nt, Homo sapiens
gagaacgccuguggcuuga

SEQ ID NO: 1058519 - RNA, 19 nt, Homo sapiens
cauggaacuuucaaugcua

SEQ ID NO: 1058520 - RNA, 19 nt, Homo sapiens
aagacaaccuccaucuauu

SEQ ID NO: 1058521 - RNA, 19 nt, Homo sapiens
agacaaccuccaucuauuu

SEQ ID NO: 1058522 - RNA, 19 nt, Homo sapiens
ggugaaguuucucucaguu

SEQ ID NO: 1058523 - RNA, 19 nt, Homo sapiens
gagaacagcagagucaguu

SEQ ID NO: 1058524 - RNA, 19 nt, Homo sapiens
ccaucaaccuggaggagaa

SEQ ID NO: 1058525 - RNA, 19 nt, Homo sapiens
ccugagaacugaccuggau

SEQ ID NO: 1058526 - RNA, 19 nt, Homo sapiens
ccagagaacagcagaguca

SEQ ID NO: 1058527 - RNA, 19 nt, Homo sapiens
gcccaggucucuugucucu

SEQ ID NO: 1058528 - RNA, 19 nt, Homo sapiens
uuacuacuccuaaggcuaa

SEQ ID NO: 1058529 - RNA, 19 nt, Homo sapiens
aguaaucccugcucagaau

SEQ ID NO: 1058530 - RNA, 19 nt, Homo sapiens
gccaguugcugcccugaga

SEQ ID NO: 1058531 - RNA, 19 nt, Homo sapiens
ucucugaugugcacaaaca

SEQ ID NO: 1058532 - RNA, 19 nt, Homo sapiens
cccucaaccuggcaucuua

SEQ ID NO: 1058533 - RNA, 19 nt, Homo sapiens
cugcagcucuugucuaaag

SEQ ID NO: 1058534 - RNA, 19 nt, Homo sapiens
gaacagcagagucaguuac

SEQ ID NO: 1058535 - RNA, 19 nt, Homo sapiens
ccaguuaccuccagaucag

SEQ ID NO: 1058536 - RNA, 19 nt, Homo sapiens
guagugggcucuggaaugc

SEQ ID NO: 1058537 - RNA, 19 nt, Homo sapiens
uaaagaaugcauugguuuc

SEQ ID NO: 1058538 - RNA, 19 nt, Homo sapiens
gagcuguggugggaauaug

SEQ ID NO: 1058539 - RNA, 19 nt, Homo sapiens
gcaucaaccuccgcuucaa

SEQ ID NO: 1058540 - RNA, 19 nt, Homo sapiens
ggacaguacccagcaagug

SEQ ID NO: 1058541 - RNA, 19 nt, Homo sapiens
gagaagacaaccuccaucu

SEQ ID NO: 1058542 - RNA, 19 nt, Homo sapiens
gcacuuuagaguuugagaa

SEQ ID NO: 1058543 - RNA, 19 nt, Homo sapiens
gggagacacuuggccuguu

SEQ ID NO: 1058544 - RNA, 19 nt, Homo sapiens
gcaaagccaggccguccaa

SEQ ID NO: 1058545 - RNA, 19 nt, Homo sapiens
uagauagcuuacagcagua

SEQ ID NO: 1058546 - RNA, 19 nt, Homo sapiens
ggucuggauagauagcuua

SEQ ID NO: 1058547 - RNA, 19 nt, Homo sapiens
aagcuucagucugcgauaa

SEQ ID NO: 1058548 - RNA, 19 nt, Homo sapiens
cacuuggccuguuagauug

SEQ ID NO: 1058549 - RNA, 19 nt, Homo sapiens
uaagcacuuuagaguuuga

SEQ ID NO: 1058550 - RNA, 19 nt, Homo sapiens
ccuauaagcacuuuagagu

SEQ ID NO: 1058551 - RNA, 19 nt, Homo sapiens
gaccagagccuugcaacuc

SEQ ID NO: 1058552 - RNA, 19 nt, Homo sapiens
caaaggguuuucaggauga

SEQ ID NO: 1058553 - RNA, 19 nt, Homo sapiens
ggagagguggcccagagaa

SEQ ID NO: 1058554 - RNA, 19 nt, Homo sapiens
ucacgucagcucugucauu

SEQ ID NO: 1058555 - RNA, 19 nt, Homo sapiens
caagucacgucagcucugu

SEQ ID NO: 1058556 - RNA, 19 nt, Homo sapiens
gggugcagcuggucuggau

SEQ ID NO: 1058557 - RNA, 19 nt, Homo sapiens
ugaaguuucucucaguucu

SEQ ID NO: 1058558 - RNA, 19 nt, Homo sapiens
gggugaaguuucucucagu

SEQ ID NO: 1058559 - RNA, 19 nt, Homo sapiens
gcucagaccacugcucaga

SEQ ID NO: 1058560 - RNA, 19 nt, Homo sapiens
cagcucuugucuaaaguga

SEQ ID NO: 1058561 - RNA, 19 nt, Homo sapiens
gaucuccugcccucucuga

SEQ ID NO: 1058562 - RNA, 19 nt, Homo sapiens
gaguucaucuguggguguu

SEQ ID NO: 1058563 - RNA, 19 nt, Homo sapiens
cccuauaccucccgacuca

SEQ ID NO: 1058564 - RNA, 19 nt, Homo sapiens
gcucagaaugcucccaguu

SEQ ID NO: 1058565 - RNA, 19 nt, Homo sapiens
gaugaccugguucuucuga

SEQ ID NO: 1058566 - RNA, 19 nt, Homo sapiens
ggacuggugggaaccugaa

SEQ ID NO: 1058567 - RNA, 19 nt, Homo sapiens
guacgugccuccaguuacc

SEQ ID NO: 1058568 - RNA, 19 nt, Homo sapiens
caccaggagaugaggguua

SEQ ID NO: 1058569 - RNA, 19 nt, Homo sapiens
acucagacccugcauuuua

SEQ ID NO: 1058570 - RNA, 19 nt, Homo sapiens
ccagagccuugcaacucaa

SEQ ID NO: 1058571 - RNA, 19 nt, Homo sapiens
ccacuuuacuacuccuaag

SEQ ID NO: 1058572 - RNA, 19 nt, Homo sapiens
ccccagagcuugaggcaaa

SEQ ID NO: 1058573 - RNA, 19 nt, Homo sapiens
ccaccugaucugcaucuuu

SEQ ID NO: 1058574 - RNA, 19 nt, Homo sapiens
accugcagcucuugucuaa

SEQ ID NO: 1058575 - RNA, 19 nt, Homo sapiens
cacgucagcucugucauuc

SEQ ID NO: 1058576 - RNA, 19 nt, Homo sapiens
gcaguagugggcucuggaa

SEQ ID NO: 1058577 - RNA, 19 nt, Homo sapiens
guccucaccucaggccuuu

SEQ ID NO: 1058578 - RNA, 19 nt, Homo sapiens
gugcacaaacacaauguau

SEQ ID NO: 1058579 - RNA, 19 nt, Homo sapiens
agaagacaaccuccaucua

SEQ ID NO: 1058580 - RNA, 19 nt, Homo sapiens
gcaguacgugccuccaguu

SEQ ID NO: 1058581 - RNA, 19 nt, Homo sapiens
cugaugaccugguucuucu

SEQ ID NO: 1058582 - RNA, 19 nt, Homo sapiens
gguuucuccuuguugaaga

SEQ ID NO: 1058583 - RNA, 19 nt, Homo sapiens
cccaggacauggaacuuuc

SEQ ID NO: 1058584 - RNA, 19 nt, Homo sapiens
caguacgugccuccaguua

SEQ ID NO: 1058585 - RNA, 19 nt, Homo sapiens
acugauaggucgggccauu

SEQ ID NO: 1058586 - RNA, 19 nt, Homo sapiens
ugaucugcaucuuuguuug

SEQ ID NO: 1058587 - RNA, 19 nt, Homo sapiens
gcagggcccagucuucagu

SEQ ID NO: 1058588 - RNA, 19 nt, Homo sapiens
cuccaucuauuuauugcuu

SEQ ID NO: 1058589 - RNA, 19 nt, Homo sapiens
cgauaaagaaugcauuggu

SEQ ID NO: 1058590 - RNA, 19 nt, Homo sapiens
ccaaaucagagcucacagu

SEQ ID NO: 1058591 - RNA, 19 nt, Homo sapiens
uagaugugcccguggagaa

SEQ ID NO: 1058592 - RNA, 19 nt, Homo sapiens
acauggaacuuucaaugcu

SEQ ID NO: 1058593 - RNA, 19 nt, Homo sapiens
gagggugaaguuucucuca

SEQ ID NO: 1058594 - RNA, 19 nt, Homo sapiens
cuuuagaguuugagaagca

SEQ ID NO: 1058595 - RNA, 19 nt, Homo sapiens
agaccaaccucacauauga

SEQ ID NO: 1058596 - RNA, 19 nt, Homo sapiens
gaaaugucaucucccuaga

SEQ ID NO: 1058597 - RNA, 19 nt, Homo sapiens
agaagcaguuguuguaauu

SEQ ID NO: 1058598 - RNA, 19 nt, Homo sapiens
cuacaaugcugaugacaug

SEQ ID NO: 1058599 - RNA, 19 nt, Homo sapiens
cagcaucgauguucuguag

SEQ ID NO: 1058600 - RNA, 19 nt, Homo sapiens
uggaagagcuggagaagca

SEQ ID NO: 1058601 - RNA, 19 nt, Homo sapiens
acuuguagcugguuuaauu

SEQ ID NO: 1058602 - RNA, 19 nt, Homo sapiens
gcaucuaucucaguuagga

SEQ ID NO: 1058603 - RNA, 19 nt, Homo sapiens
gggccuagauucugcacuu

SEQ ID NO: 1058604 - RNA, 19 nt, Homo sapiens
uacaagagauucuguuugg

SEQ ID NO: 1058605 - RNA, 19 nt, Homo sapiens
gagguugcauucccuacuu

SEQ ID NO: 1058606 - RNA, 19 nt, Homo sapiens
caacacaccaucccaaagu

SEQ ID NO: 1058607 - RNA, 19 nt, Homo sapiens
gaucaacaccguccucauc

SEQ ID NO: 1058608 - RNA, 19 nt, Homo sapiens
gcaagggagucugggaaau

SEQ ID NO: 1058609 - RNA, 19 nt, Homo sapiens
gaagcaguuguuguaauua

SEQ ID NO: 1058610 - RNA, 19 nt, Homo sapiens
gcaagacugagccuaaaug

SEQ ID NO: 1058611 - RNA, 19 nt, Homo sapiens
cagaagcaguuguuguaau

SEQ ID NO: 1058612 - RNA, 19 nt, Homo sapiens
ggacuaccuuccagugucu

SEQ ID NO: 1058613 - RNA, 19 nt, Homo sapiens
ugaccgacaucgagcagaa

SEQ ID NO: 1058614 - RNA, 19 nt, Homo sapiens
ucacucaguucccaaaucu

SEQ ID NO: 1058615 - RNA, 19 nt, Homo sapiens
ggaagccacuaugccagaa

SEQ ID NO: 1058616 - RNA, 19 nt, Homo sapiens
ugucagacuuggcaucuau

SEQ ID NO: 1058617 - RNA, 19 nt, Homo sapiens
acacagcacccucuuaugu

SEQ ID NO: 1058618 - RNA, 19 nt, Homo sapiens
cuggcaagcucugcucuua

SEQ ID NO: 1058619 - RNA, 19 nt, Homo sapiens
gaacucccagcgccagauu

SEQ ID NO: 1058620 - RNA, 19 nt, Homo sapiens
gggacagggugaggguaua

SEQ ID NO: 1058621 - RNA, 19 nt, Homo sapiens
ggagaccucaggccaguug

SEQ ID NO: 1058622 - RNA, 19 nt, Homo sapiens
ucaacaccguccucaucua

SEQ ID NO: 1058623 - RNA, 19 nt, Homo sapiens
gagaccaaccucacauaug

SEQ ID NO: 1058624 - RNA, 19 nt, Homo sapiens
gcgcuucucugcuucuucu

SEQ ID NO: 1058625 - RNA, 19 nt, Homo sapiens
ugauagggauacagcuuug

SEQ ID NO: 1058626 - RNA, 19 nt, Homo sapiens
gcugcaagacugagccuaa

SEQ ID NO: 1058627 - RNA, 19 nt, Homo sapiens
agacaaggauuuacuaccu

SEQ ID NO: 1058628 - RNA, 19 nt, Homo sapiens
acacacagcacccucuuau

SEQ ID NO: 1058629 - RNA, 19 nt, Homo sapiens
ggcaagcucugcucuuacu

SEQ ID NO: 1058630 - RNA, 19 nt, Homo sapiens
agacuuggcaucuaucuca

SEQ ID NO: 1058631 - RNA, 19 nt, Homo sapiens
gaccucaggccaguuguuu

SEQ ID NO: 1058632 - RNA, 19 nt, Homo sapiens
caacaccguccucaucuag

SEQ ID NO: 1058633 - RNA, 19 nt, Homo sapiens
uugcucaucuucuacaaug

SEQ ID NO: 1058634 - RNA, 19 nt, Homo sapiens
caagggagucugggaaaug

SEQ ID NO: 1058635 - RNA, 19 nt, Homo sapiens
uccagaagcaguuguugua

SEQ ID NO: 1058636 - RNA, 19 nt, Homo sapiens
guccuaggguugccugaga

SEQ ID NO: 1058637 - RNA, 19 nt, Homo sapiens
uaagucagauccagaaccu

SEQ ID NO: 1058638 - RNA, 19 nt, Homo sapiens
ugucagagcauggccagua

SEQ ID NO: 1058639 - RNA, 19 nt, Homo sapiens
gcaguuguuguaauuagga

SEQ ID NO: 1058640 - RNA, 19 nt, Homo sapiens
aagcaguuguuguaauuag

SEQ ID NO: 1058641 - RNA, 19 nt, Homo sapiens
gcaucgauguucuguagcu

SEQ ID NO: 1058642 - RNA, 19 nt, Homo sapiens
aacacaccaucccaaagua

SEQ ID NO: 1058643 - RNA, 19 nt, Homo sapiens
acucaguucccaaaucuaa

SEQ ID NO: 1058644 - RNA, 19 nt, Homo sapiens
gacaagccucccuggauga

SEQ ID NO: 1058645 - RNA, 19 nt, Homo sapiens
gacacacagcacccucuua

SEQ ID NO: 1058646 - RNA, 19 nt, Homo sapiens
ugcauucccuacuuccuaa

SEQ ID NO: 1058647 - RNA, 19 nt, Homo sapiens
ucggacgacugcaccauug

SEQ ID NO: 1058648 - RNA, 19 nt, Homo sapiens
cugcaagacugagccuaaa

SEQ ID NO: 1058649 - RNA, 19 nt, Homo sapiens
ugucaucucccuagaagga

SEQ ID NO: 1058650 - RNA, 19 nt, Homo sapiens
ccugguggcuugcaaaauu

SEQ ID NO: 1058651 - RNA, 19 nt, Homo sapiens
uggcaucuaucucaguuag

SEQ ID NO: 1058652 - RNA, 19 nt, Homo sapiens
ccagaagcaguuguuguaa

SEQ ID NO: 1058653 - RNA, 19 nt, Homo sapiens
gacauguccuggcucuaca

SEQ ID NO: 1058654 - RNA, 19 nt, Homo sapiens
gaagccacuaugccagaaa

SEQ ID NO: 1058655 - RNA, 19 nt, Homo sapiens
guagcugguuuaauuagac

SEQ ID NO: 1058656 - RNA, 19 nt, Homo sapiens
ccacuuguagcugguuuaa

SEQ ID NO: 1058657 - RNA, 19 nt, Homo sapiens
cccaguagcucugaacaag

SEQ ID NO: 1058658 - RNA, 19 nt, Homo sapiens
gaucugcuggucagugaug

SEQ ID NO: 1058659 - RNA, 19 nt, Homo sapiens
uguccuggcucuacaccuu

SEQ ID NO: 1058660 - RNA, 19 nt, Homo sapiens
gccagaaggccaugcuaga

SEQ ID NO: 1058661 - RNA, 19 nt, Homo sapiens
caagacugagccuaaaugu

SEQ ID NO: 1058662 - RNA, 19 nt, Homo sapiens
cgccaaagcgcuucgaugu

SEQ ID NO: 1058663 - RNA, 19 nt, Homo sapiens
aaugucaucucccuagaag

SEQ ID NO: 1058664 - RNA, 19 nt, Homo sapiens
aaaagcaacugcaggacaa

SEQ ID NO: 1058665 - RNA, 19 nt, Homo sapiens
aaggcuugcucaucuucua

SEQ ID NO: 1058666 - RNA, 19 nt, Homo sapiens
ggacgacugcaccauugug

SEQ ID NO: 1058667 - RNA, 19 nt, Homo sapiens
ggaggagugggcugcaaga

SEQ ID NO: 1058668 - RNA, 19 nt, Homo sapiens
gccucaagcuggccaacau

SEQ ID NO: 1058669 - RNA, 19 nt, Homo sapiens
uaugucccauggccuaaga

SEQ ID NO: 1058670 - RNA, 19 nt, Homo sapiens
guaguuggcagcccgaaag

SEQ ID NO: 1058671 - RNA, 19 nt, Homo sapiens
gcaagggcagcauccagau

SEQ ID NO: 1058672 - RNA, 19 nt, Homo sapiens
uuacaagagauucuguuug

SEQ ID NO: 1058673 - RNA, 19 nt, Homo sapiens
uguagcugguuuaauuaga

SEQ ID NO: 1058674 - RNA, 19 nt, Homo sapiens
ccuccagccuccagucugu

SEQ ID NO: 1058675 - RNA, 19 nt, Homo sapiens
ggaccacugccaccugcaa

SEQ ID NO: 1058676 - RNA, 19 nt, Homo sapiens
caagcucugcucuuacuuc

SEQ ID NO: 1058677 - RNA, 19 nt, Homo sapiens
gugucuuccuggacuauga

SEQ ID NO: 1058678 - RNA, 19 nt, Homo sapiens
ugucggugcuggguucuga

SEQ ID NO: 1058679 - RNA, 19 nt, Homo sapiens
cacaacacaccaucccaaa

SEQ ID NO: 1058680 - RNA, 19 nt, Homo sapiens
gggcugcgagcacuacuuc

SEQ ID NO: 1058681 - RNA, 19 nt, Homo sapiens
aagcucugcucuuacuuca

SEQ ID NO: 1058682 - RNA, 19 nt, Homo sapiens
ccaucugccugagcaucua

SEQ ID NO: 1058683 - RNA, 19 nt, Homo sapiens
aagggagucugggaaaugu

SEQ ID NO: 1058684 - RNA, 19 nt, Homo sapiens
ucaguucccaaaucuaaau

SEQ ID NO: 1058685 - RNA, 19 nt, Homo sapiens
cuacuucucccacugaucu

SEQ ID NO: 1058686 - RNA, 19 nt, Homo sapiens
acugcaccauuguggcuua

SEQ ID NO: 1058687 - RNA, 19 nt, Homo sapiens
ggccuagauucugcacuug

SEQ ID NO: 1058688 - RNA, 19 nt, Homo sapiens
caacuucaggcccuucaag

SEQ ID NO: 1058689 - RNA, 19 nt, Homo sapiens
gaccaaccucacauaugaa

SEQ ID NO: 1058690 - RNA, 19 nt, Homo sapiens
cuuggcaucuaucucaguu

SEQ ID NO: 1058691 - RNA, 19 nt, Homo sapiens
caaccucacauaugaagac

SEQ ID NO: 1058692 - RNA, 19 nt, Homo sapiens
gucagagcauggccaguag

SEQ ID NO: 1058693 - RNA, 19 nt, Homo sapiens
gcacgauggcaaccaguac

SEQ ID NO: 1058694 - RNA, 19 nt, Homo sapiens
cgacaucgagcagaaaguc

SEQ ID NO: 1058695 - RNA, 19 nt, Homo sapiens
ggcacaagaugcacaauua

SEQ ID NO: 1058696 - RNA, 19 nt, Homo sapiens
gaccugcucugcaagaaua

SEQ ID NO: 1058697 - RNA, 19 nt, Homo sapiens
gaaaggugcugacuaaacu

SEQ ID NO: 1058698 - RNA, 19 nt, Homo sapiens
caaaccagauccaaucaaa

SEQ ID NO: 1058699 - RNA, 19 nt, Homo sapiens
uggcaaagauucauacuau

SEQ ID NO: 1058700 - RNA, 19 nt, Homo sapiens
gaaauggcaaagauucaua

SEQ ID NO: 1058701 - RNA, 19 nt, Homo sapiens
ugaaugagguggauuacug

SEQ ID NO: 1058702 - RNA, 19 nt, Homo sapiens
guuaaucgccuuagaaaug

SEQ ID NO: 1058703 - RNA, 19 nt, Homo sapiens
agaaugggcugugcuauga

SEQ ID NO: 1058704 - RNA, 19 nt, Homo sapiens
gaauugagcaugacaucuu

SEQ ID NO: 1058705 - RNA, 19 nt, Homo sapiens
ggccaagaauugagcauga

SEQ ID NO: 1058706 - RNA, 19 nt, Homo sapiens
ggaugucucuccagcucua

SEQ ID NO: 1058707 - RNA, 19 nt, Homo sapiens
acaaugaccugcucugcaa

SEQ ID NO: 1058708 - RNA, 19 nt, Homo sapiens
cccagaaagugauucauuu

SEQ ID NO: 1058709 - RNA, 19 nt, Homo sapiens
gcagccaccuccucugaga

SEQ ID NO: 1058710 - RNA, 19 nt, Homo sapiens
agaaugaggucagaaacuu

SEQ ID NO: 1058711 - RNA, 19 nt, Homo sapiens
gcacaagaugcacaauuau

SEQ ID NO: 1058712 - RNA, 19 nt, Homo sapiens
ggcaggaucccaucagaaa

SEQ ID NO: 1058713 - RNA, 19 nt, Homo sapiens
cuaccaagcuuuugacauu

SEQ ID NO: 1058714 - RNA, 19 nt, Homo sapiens
guacuccaccaucgacuuu

SEQ ID NO: 1058715 - RNA, 19 nt, Homo sapiens
ccaccaggcuugggaggaa

SEQ ID NO: 1058716 - RNA, 19 nt, Homo sapiens
gcccagaaagugauucauu

SEQ ID NO: 1058717 - RNA, 19 nt, Homo sapiens
ugccuuauauguguguuua

SEQ ID NO: 1058718 - RNA, 19 nt, Homo sapiens
ccaggcgucucacuucuuc

SEQ ID NO: 1058719 - RNA, 19 nt, Homo sapiens
ugaauaugcuggcuacaac

SEQ ID NO: 1058720 - RNA, 19 nt, Homo sapiens
caagaugcacaauuauuuc

SEQ ID NO: 1058721 - RNA, 19 nt, Homo sapiens
gguccuagcugugugucuu

SEQ ID NO: 1058722 - RNA, 19 nt, Homo sapiens
gcaaaggcucuacgugcaa

SEQ ID NO: 1058723 - RNA, 19 nt, Homo sapiens
gggagaaugaggucagaaa

SEQ ID NO: 1058724 - RNA, 19 nt, Homo sapiens
ccagaaagugauucauuug

SEQ ID NO: 1058725 - RNA, 19 nt, Homo sapiens
gcgugaaugagguggauua

SEQ ID NO: 1058726 - RNA, 19 nt, Homo sapiens
caaaccagcaucacaccaa

SEQ ID NO: 1058727 - RNA, 19 nt, Homo sapiens
gguacgcagugauccgauu

SEQ ID NO: 1058728 - RNA, 19 nt, Homo sapiens
ccuuagaaauggcaaagau

SEQ ID NO: 1058729 - RNA, 19 nt, Homo sapiens
cacaagaugcacaauuauu

SEQ ID NO: 1058730 - RNA, 19 nt, Homo sapiens
gcaaagauucauacuaucc

SEQ ID NO: 1058731 - RNA, 19 nt, Homo sapiens
gaauuggggcugccuuaua

SEQ ID NO: 1058732 - RNA, 19 nt, Homo sapiens
cugcaagaauaucaucuau

SEQ ID NO: 1058733 - RNA, 19 nt, Homo sapiens
ggugcugacuaaacugguu

SEQ ID NO: 1058734 - RNA, 19 nt, Homo sapiens
caccaucgacuuugauuuc

SEQ ID NO: 1058735 - RNA, 19 nt, Homo sapiens
gaaugaggucagaaacuuc

SEQ ID NO: 1058736 - RNA, 19 nt, Homo sapiens
cagcagccaccuccucuga

SEQ ID NO: 1058737 - RNA, 19 nt, Homo sapiens
gacauuggcaaccauuuca

SEQ ID NO: 1058738 - RNA, 19 nt, Homo sapiens
ggcaaagauucauacuauc

SEQ ID NO: 1058739 - RNA, 19 nt, Homo sapiens
cagaaugggcugugcuaug

SEQ ID NO: 1058740 - RNA, 19 nt, Homo sapiens
gcucuccugugcuucuguu

SEQ ID NO: 1058741 - RNA, 19 nt, Homo sapiens
ggucacgugcgguucauug

SEQ ID NO: 1058742 - RNA, 19 nt, Homo sapiens
cuacugcaccuuccagaau

SEQ ID NO: 1058743 - RNA, 19 nt, Homo sapiens
cuccagcucuacuuuaugu

SEQ ID NO: 1058744 - RNA, 19 nt, Homo sapiens
cugcagaugucccuaaggu

SEQ ID NO: 1058745 - RNA, 19 nt, Homo sapiens
gagaaugaggucagaaacu

SEQ ID NO: 1058746 - RNA, 19 nt, Homo sapiens
ucagguuaaucgccuuaga

SEQ ID NO: 1058747 - RNA, 19 nt, Homo sapiens
cagaaagugauucauuugu

SEQ ID NO: 1058748 - RNA, 19 nt, Homo sapiens
uaagguagagguguuggaa

SEQ ID NO: 1058749 - RNA, 19 nt, Homo sapiens
gcugugcuaugaguacaug

SEQ ID NO: 1058750 - RNA, 19 nt, Homo sapiens
gcugguggccugcuaugug

SEQ ID NO: 1058751 - RNA, 19 nt, Homo sapiens
uuagaaauggcaaagauuc

SEQ ID NO: 1058752 - RNA, 19 nt, Homo sapiens
cagguuaaucgccuuagaa

SEQ ID NO: 1058753 - RNA, 19 nt, Homo sapiens
gggcaggaucccaucagaa

SEQ ID NO: 1058754 - RNA, 19 nt, Homo sapiens
acaagcugguggccugcua

SEQ ID NO: 1058755 - RNA, 19 nt, Homo sapiens
uuaaucgccuuagaaaugg

SEQ ID NO: 1058756 - RNA, 19 nt, Homo sapiens
gaaacaugcuccccaacgu

SEQ ID NO: 1058757 - RNA, 19 nt, Homo sapiens
ugacauuggcaaccauuuc

SEQ ID NO: 1058758 - RNA, 19 nt, Homo sapiens
ggcuacaacuaccaagcuu

SEQ ID NO: 1058759 - RNA, 19 nt, Homo sapiens
caucuaugacagcaucaaa

SEQ ID NO: 1058760 - RNA, 19 nt, Homo sapiens
ggaguccccugugguguuu

SEQ ID NO: 1058761 - RNA, 19 nt, Homo sapiens
gagaucaaccccagccuuu

SEQ ID NO: 1058762 - RNA, 19 nt, Homo sapiens
gagcucaauucugcacucu

SEQ ID NO: 1058763 - RNA, 19 nt, Homo sapiens
gugcaagucaacaaguuug

SEQ ID NO: 1058764 - RNA, 19 nt, Homo sapiens
gcuacaacuaccaagcuuu

SEQ ID NO: 1058765 - RNA, 19 nt, Homo sapiens
ccacugaagaccucauucu

SEQ ID NO: 1058766 - RNA, 19 nt, Homo sapiens
gauucaaccaguacuucaa

SEQ ID NO: 1058767 - RNA, 19 nt, Homo sapiens
acuuugauuuccucaggua

SEQ ID NO: 1058768 - RNA, 19 nt, Homo sapiens
ggacccggacgacauccuu

SEQ ID NO: 1058769 - RNA, 19 nt, Homo sapiens
agaaaggugcugacuaaac

SEQ ID NO: 1058770 - RNA, 19 nt, Homo sapiens
gcuccaaaccagcaucaca

SEQ ID NO: 1058771 - RNA, 19 nt, Homo sapiens
ggagaaugaggucagaaac

SEQ ID NO: 1058772 - RNA, 19 nt, Homo sapiens
cccauccucuggcacaaga

SEQ ID NO: 1058773 - RNA, 19 nt, Homo sapiens
gccuccaccucccuuucua

SEQ ID NO: 1058774 - RNA, 19 nt, Homo sapiens
ucccuaagguagagguguu

SEQ ID NO: 1058775 - RNA, 19 nt, Homo sapiens
uagaaauggcaaagauuca

SEQ ID NO: 1058776 - RNA, 19 nt, Homo sapiens
ucucuccagcucuacuuua

SEQ ID NO: 1058777 - RNA, 19 nt, Homo sapiens
ccaaaccagauccaaucaa

SEQ ID NO: 1058778 - RNA, 19 nt, Homo sapiens
uacugcaccuuccagaaug

SEQ ID NO: 1058779 - RNA, 19 nt, Homo sapiens
caaagauucauacuaucca

SEQ ID NO: 1058780 - RNA, 19 nt, Homo sapiens
ccaccaucgacuuugauuu

SEQ ID NO: 1058781 - RNA, 19 nt, Homo sapiens
acuccaccaucgacuuuga

SEQ ID NO: 1058782 - RNA, 19 nt, Homo sapiens
aauaugcuggcuacaacua

SEQ ID NO: 1058783 - RNA, 19 nt, Homo sapiens
aauugagcaugacaucuuc

SEQ ID NO: 1058784 - RNA, 19 nt, Homo sapiens
aaacaggcauggggagauu

SEQ ID NO: 1058785 - RNA, 19 nt, Homo sapiens
gcaggaucccaucagaaag

SEQ ID NO: 1058786 - RNA, 19 nt, Homo sapiens
ucacaccaacucugacaca

SEQ ID NO: 1058787 - RNA, 19 nt, Homo sapiens
uggcacaagaugcacaauu

SEQ ID NO: 1058788 - RNA, 19 nt, Homo sapiens
guacgcagugauccgauuc

SEQ ID NO: 1058789 - RNA, 19 nt, Homo sapiens
cagaugucccuaagguaga

SEQ ID NO: 1058790 - RNA, 19 nt, Homo sapiens
ggagaaagaugaucauauu

SEQ ID NO: 1058791 - RNA, 19 nt, Homo sapiens
gaacagugaucacaaauug

SEQ ID NO: 1058792 - RNA, 19 nt, Homo sapiens
gguguaagcugaauauaua

SEQ ID NO: 1058793 - RNA, 19 nt, Homo sapiens
guaauuaggugacaguaua

SEQ ID NO: 1058794 - RNA, 19 nt, Homo sapiens
caucuucaguccuuuauua

SEQ ID NO: 1058795 - RNA, 19 nt, Homo sapiens
gaaucaaacuucacucuug

SEQ ID NO: 1058796 - RNA, 19 nt, Homo sapiens
gaauaaagcacaucagaau

SEQ ID NO: 1058797 - RNA, 19 nt, Homo sapiens
ccaaauccaguacaaauua

SEQ ID NO: 1058798 - RNA, 19 nt, Homo sapiens
gauuguagauggagaaaga

SEQ ID NO: 1058799 - RNA, 19 nt, Homo sapiens
gcacugaucuauguauuuc

SEQ ID NO: 1058800 - RNA, 19 nt, Homo sapiens
gcacaacaacaauuaauga

SEQ ID NO: 1058801 - RNA, 19 nt, Homo sapiens
ggagaagcacaauaaauuu

SEQ ID NO: 1058802 - RNA, 19 nt, Homo sapiens
acaaauugcugcagucuga

SEQ ID NO: 1058803 - RNA, 19 nt, Homo sapiens
uauguggccugcaagauua

SEQ ID NO: 1058804 - RNA, 19 nt, Homo sapiens
ggucagugcuuccauugaa

SEQ ID NO: 1058805 - RNA, 19 nt, Homo sapiens
gauauaguccuguacaauu

SEQ ID NO: 1058806 - RNA, 19 nt, Homo sapiens
uaaaccagccaaucaauaa

SEQ ID NO: 1058807 - RNA, 19 nt, Homo sapiens
cauaagauguccuguguca

SEQ ID NO: 1058808 - RNA, 19 nt, Homo sapiens
ggaugaagguaguuacguu

SEQ ID NO: 1058809 - RNA, 19 nt, Homo sapiens
cuacugugcuaacuucuaa

SEQ ID NO: 1058810 - RNA, 19 nt, Homo sapiens
uaagauguccugugucauu

SEQ ID NO: 1058811 - RNA, 19 nt, Homo sapiens
gugcugucaugcuauaaua

SEQ ID NO: 1058812 - RNA, 19 nt, Homo sapiens
ugaaggcauucucuuauau

SEQ ID NO: 1058813 - RNA, 19 nt, Homo sapiens
gaaauucggcucaguaaaa

SEQ ID NO: 1058814 - RNA, 19 nt, Homo sapiens
gaaguacauuagcagcauu

SEQ ID NO: 1058815 - RNA, 19 nt, Homo sapiens
gaaggcauucucuuauauu

SEQ ID NO: 1058816 - RNA, 19 nt, Homo sapiens
cugaaggcauucucuuaua

SEQ ID NO: 1058817 - RNA, 19 nt, Homo sapiens
uacauuagcagcauugaua

SEQ ID NO: 1058818 - RNA, 19 nt, Homo sapiens
agagaacagugaucacaaa

SEQ ID NO: 1058819 - RNA, 19 nt, Homo sapiens
gaacaauugacgccugauu

SEQ ID NO: 1058820 - RNA, 19 nt, Homo sapiens
aaauugcacugaucuaugu

SEQ ID NO: 1058821 - RNA, 19 nt, Homo sapiens
ugaaauauuugccaucucu

SEQ ID NO: 1058822 - RNA, 19 nt, Homo sapiens
gggaaugccucuguucuuc

SEQ ID NO: 1058823 - RNA, 19 nt, Homo sapiens
gguaaauaauucccagguu

SEQ ID NO: 1058824 - RNA, 19 nt, Homo sapiens
gcuuugcagugguugaaua

SEQ ID NO: 1058825 - RNA, 19 nt, Homo sapiens
uaauaaacccggcuuacuu

SEQ ID NO: 1058826 - RNA, 19 nt, Homo sapiens
ucucagaucuauccuguuc

SEQ ID NO: 1058827 - RNA, 19 nt, Homo sapiens
gaauuuggcaaguguguug

SEQ ID NO: 1058828 - RNA, 19 nt, Homo sapiens
ccucacagcuugccacauc

SEQ ID NO: 1058829 - RNA, 19 nt, Homo sapiens
gcagcaaaguccagguuuc

SEQ ID NO: 1058830 - RNA, 19 nt, Homo sapiens
ggcauucucuuauauugau

SEQ ID NO: 1058831 - RNA, 19 nt, Homo sapiens
uuggguagaugauguaauu

SEQ ID NO: 1058832 - RNA, 19 nt, Homo sapiens
gagacuauguggccugcaa

SEQ ID NO: 1058833 - RNA, 19 nt, Homo sapiens
uguccugugucauuacuua

SEQ ID NO: 1058834 - RNA, 19 nt, Homo sapiens
gaacauuaaaguacaugga

SEQ ID NO: 1058835 - RNA, 19 nt, Homo sapiens
gaucauauuuacagacacu

SEQ ID NO: 1058836 - RNA, 19 nt, Homo sapiens
aaagaaauucggcucagua

SEQ ID NO: 1058837 - RNA, 19 nt, Homo sapiens
gcagcuggauauuagugaa

SEQ ID NO: 1058838 - RNA, 19 nt, Homo sapiens
gaaaaccacuuagaacaau

SEQ ID NO: 1058839 - RNA, 19 nt, Homo sapiens
gcgcacgcuuguucauaaa

SEQ ID NO: 1058840 - RNA, 19 nt, Homo sapiens
aggagaagcacaauaaauu

SEQ ID NO: 1058841 - RNA, 19 nt, Homo sapiens
gaaaagaaaaccacuuaga

SEQ ID NO: 1058842 - RNA, 19 nt, Homo sapiens
ccugacccaucccuaauaa

SEQ ID NO: 1058843 - RNA, 19 nt, Homo sapiens
aagauguccugugucauua

SEQ ID NO: 1058844 - RNA, 19 nt, Homo sapiens
uaaaagaguugagugauga

SEQ ID NO: 1058845 - RNA, 19 nt, Homo sapiens
cuaaaccagccaaucaaua

SEQ ID NO: 1058846 - RNA, 19 nt, Homo sapiens
caaacuacagcccauagaa

SEQ ID NO: 1058847 - RNA, 19 nt, Homo sapiens
agucuugucuccacuuuga

SEQ ID NO: 1058848 - RNA, 19 nt, Homo sapiens
acacuacugugcuaacuuc

SEQ ID NO: 1058849 - RNA, 19 nt, Homo sapiens
ccaagggaaugccucuguu

SEQ ID NO: 1058850 - RNA, 19 nt, Homo sapiens
aauugacgccugauuauaa

SEQ ID NO: 1058851 - RNA, 19 nt, Homo sapiens
caauugacgccugauuaua

SEQ ID NO: 1058852 - RNA, 19 nt, Homo sapiens
uguuagcccugugugauua

SEQ ID NO: 1058853 - RNA, 19 nt, Homo sapiens
gaaauuugggaauguguuc

SEQ ID NO: 1058854 - RNA, 19 nt, Homo sapiens
ucacaacacgcauuggaaa

SEQ ID NO: 1058855 - RNA, 19 nt, Homo sapiens
aaacaggagaagcacaaua

SEQ ID NO: 1058856 - RNA, 19 nt, Homo sapiens
gcacuaguguagaccuaag

SEQ ID NO: 1058857 - RNA, 19 nt, Homo sapiens
gauauuuaccucucacugu

SEQ ID NO: 1058858 - RNA, 19 nt, Homo sapiens
caaauugcacugaucuaug

SEQ ID NO: 1058859 - RNA, 19 nt, Homo sapiens
gaaucuuucucauauacca

SEQ ID NO: 1058860 - RNA, 19 nt, Homo sapiens
uaaagcacaucagaaucuu

SEQ ID NO: 1058861 - RNA, 19 nt, Homo sapiens
gcaaaguccagguuuccuu

SEQ ID NO: 1058862 - RNA, 19 nt, Homo sapiens
auucacacauggagaaauu

SEQ ID NO: 1058863 - RNA, 19 nt, Homo sapiens
gcugcagucugaaggcauu

SEQ ID NO: 1058864 - RNA, 19 nt, Homo sapiens
agagucaucuucaguccuu

SEQ ID NO: 1058865 - RNA, 19 nt, Homo sapiens
uuauauaccugggacaaga

SEQ ID NO: 1058866 - RNA, 19 nt, Homo sapiens
cagccaaucaauaacauaa

SEQ ID NO: 1058867 - RNA, 19 nt, Homo sapiens
ccauguccauucauuaaca

SEQ ID NO: 1058868 - RNA, 19 nt, Homo sapiens
guaaaaccacucuucauaa

SEQ ID NO: 1058869 - RNA, 19 nt, Homo sapiens
uaaaccagccguucuugga

SEQ ID NO: 1058870 - RNA, 19 nt, Homo sapiens
gaaugccucuguucuucuc

SEQ ID NO: 1058871 - RNA, 19 nt, Homo sapiens
gcugucaugcuauaauaaa

SEQ ID NO: 1058872 - RNA, 19 nt, Homo sapiens
auacagccauguccauuca

SEQ ID NO: 1058873 - RNA, 19 nt, Homo sapiens
ucauaagacuggaauugca

SEQ ID NO: 1058874 - RNA, 19 nt, Homo sapiens
aacaggagaagcacaauaa

SEQ ID NO: 1058875 - RNA, 19 nt, Homo sapiens
cuaagaaacccaagggaau

SEQ ID NO: 1058876 - RNA, 19 nt, Homo sapiens
gcaaacuacagcccauaga

SEQ ID NO: 1058877 - RNA, 19 nt, Homo sapiens
gccaaauccaguacaaauu

SEQ ID NO: 1058878 - RNA, 19 nt, Homo sapiens
gauuaugcacagguaaaua

SEQ ID NO: 1058879 - RNA, 19 nt, Homo sapiens
aaagcugccucuaagaauc

SEQ ID NO: 1058880 - RNA, 19 nt, Homo sapiens
cauaaaagcugccucuaag

SEQ ID NO: 1058881 - RNA, 19 nt, Homo sapiens
ugaauaaagcacaucagaa

SEQ ID NO: 1058882 - RNA, 19 nt, Homo sapiens
cuucaguccuuuauuagau

SEQ ID NO: 1058883 - RNA, 19 nt, Homo sapiens
gguagaugauguaauuagg

SEQ ID NO: 1058884 - RNA, 19 nt, Homo sapiens
aacaauugacgccugauua

SEQ ID NO: 1058885 - RNA, 19 nt, Homo sapiens
gcaggcagcagacgguaug

SEQ ID NO: 1058886 - RNA, 19 nt, Homo sapiens
cuauggugcugucaugcua

SEQ ID NO: 1058887 - RNA, 19 nt, Homo sapiens
auccaucucuccugcauuu

SEQ ID NO: 1058888 - RNA, 19 nt, Homo sapiens
caagauauaguccuguaca

SEQ ID NO: 1058889 - RNA, 19 nt, Homo sapiens
aaauauggguuggguagau

SEQ ID NO: 1058890 - RNA, 19 nt, Homo sapiens
gaaacgagcuggauuuguu

SEQ ID NO: 1058891 - RNA, 19 nt, Homo sapiens
ggaccucucugaauacaua

SEQ ID NO: 1058892 - RNA, 19 nt, Homo sapiens
gcauggaccucucugaaua

SEQ ID NO: 1058893 - RNA, 19 nt, Homo sapiens
ggccaaagcugucuugaaa

SEQ ID NO: 1058894 - RNA, 19 nt, Homo sapiens
ccaaagcugucuugaaauu

SEQ ID NO: 1058895 - RNA, 19 nt, Homo sapiens
ugaagacgcucacugauga

SEQ ID NO: 1058896 - RNA, 19 nt, Homo sapiens
ccaaaugggucucuuuaga

SEQ ID NO: 1058897 - RNA, 19 nt, Homo sapiens
ggaauaugguggacuauca

SEQ ID NO: 1058898 - RNA, 19 nt, Homo sapiens
ggauuggccugcagcauaa

SEQ ID NO: 1058899 - RNA, 19 nt, Homo sapiens
gaacacaggcagacuauuc

SEQ ID NO: 1058900 - RNA, 19 nt, Homo sapiens
gaagaaauagugaagagaa

SEQ ID NO: 1058901 - RNA, 19 nt, Homo sapiens
caaaggaauuucaggagaa

SEQ ID NO: 1058902 - RNA, 19 nt, Homo sapiens
gcaaaguugugaagcuauu

SEQ ID NO: 1058903 - RNA, 19 nt, Homo sapiens
gaucagagugaauguauuu

SEQ ID NO: 1058904 - RNA, 19 nt, Homo sapiens
gaaaagacccugaggagua

SEQ ID NO: 1058905 - RNA, 19 nt, Homo sapiens
gggaagauacucucacuaa

SEQ ID NO: 1058906 - RNA, 19 nt, Homo sapiens
uaagaagugucucgucauu

SEQ ID NO: 1058907 - RNA, 19 nt, Homo sapiens
gugggaagauuuaaugaaa

SEQ ID NO: 1058908 - RNA, 19 nt, Homo sapiens
ccacaaggccucugaaguu

SEQ ID NO: 1058909 - RNA, 19 nt, Homo sapiens
gguaauacuucaucacaug

SEQ ID NO: 1058910 - RNA, 19 nt, Homo sapiens
gcacugccaucucuagaau

SEQ ID NO: 1058911 - RNA, 19 nt, Homo sapiens
gcaagaaguugaagaacag

SEQ ID NO: 1058912 - RNA, 19 nt, Homo sapiens
guuccaagauccagacuuu

SEQ ID NO: 1058913 - RNA, 19 nt, Homo sapiens
caagaacucucccaaugau

SEQ ID NO: 1058914 - RNA, 19 nt, Homo sapiens
gaaguuagaggccaaacaa

SEQ ID NO: 1058915 - RNA, 19 nt, Homo sapiens
ugaagcggcuggagaugua

SEQ ID NO: 1058916 - RNA, 19 nt, Homo sapiens
aggaacaucuggauuauga

SEQ ID NO: 1058917 - RNA, 19 nt, Homo sapiens
agaagugucucgucauuga

SEQ ID NO: 1058918 - RNA, 19 nt, Homo sapiens
gggccaggcugaacuaguu

SEQ ID NO: 1058919 - RNA, 19 nt, Homo sapiens
gaauggaacacugaacaua

SEQ ID NO: 1058920 - RNA, 19 nt, Homo sapiens
ggccaucucucgcaucuau

SEQ ID NO: 1058921 - RNA, 19 nt, Homo sapiens
caacaucacucggauaguc

SEQ ID NO: 1058922 - RNA, 19 nt, Homo sapiens
gcaccacugcugagaauaa

SEQ ID NO: 1058923 - RNA, 19 nt, Homo sapiens
ugaacucacucaagcaauu

SEQ ID NO: 1058924 - RNA, 19 nt, Homo sapiens
cagaagugcuugcuguuau

SEQ ID NO: 1058925 - RNA, 19 nt, Homo sapiens
uacaagaacucucccaaug

SEQ ID NO: 1058926 - RNA, 19 nt, Homo sapiens
gauguugucuugugcuguu

SEQ ID NO: 1058927 - RNA, 19 nt, Homo sapiens
gggcaucuguguuugauca

SEQ ID NO: 1058928 - RNA, 19 nt, Homo sapiens
ggaaugaaguuuugaacaa

SEQ ID NO: 1058929 - RNA, 19 nt, Homo sapiens
uaacaaagcagugaucaga

SEQ ID NO: 1058930 - RNA, 19 nt, Homo sapiens
ucagugcugugguguuaua

SEQ ID NO: 1058931 - RNA, 19 nt, Homo sapiens
gggauuggccugcagcaua

SEQ ID NO: 1058932 - RNA, 19 nt, Homo sapiens
caaaugggucucuuuagaa

SEQ ID NO: 1058933 - RNA, 19 nt, Homo sapiens
aaacagagcaagaaguuga

SEQ ID NO: 1058934 - RNA, 19 nt, Homo sapiens
ggcagacuauucaguauau

SEQ ID NO: 1058935 - RNA, 19 nt, Homo sapiens
gcugugguguuauaagaaa

SEQ ID NO: 1058936 - RNA, 19 nt, Homo sapiens
cgaaggauguggucaugga

SEQ ID NO: 1058937 - RNA, 19 nt, Homo sapiens
gaacaucuggauuaugaga

SEQ ID NO: 1058938 - RNA, 19 nt, Homo sapiens
gauuugaugcucugcaaua

SEQ ID NO: 1058939 - RNA, 19 nt, Homo sapiens
ggccaggacuguagaaaca

SEQ ID NO: 1058940 - RNA, 19 nt, Homo sapiens
ggaagggucguucgcauug

SEQ ID NO: 1058941 - RNA, 19 nt, Homo sapiens
guauauacauccugcagau

SEQ ID NO: 1058942 - RNA, 19 nt, Homo sapiens
uaaccuccauacucuguuu

SEQ ID NO: 1058943 - RNA, 19 nt, Homo sapiens
gaacagagagacaaagaac

SEQ ID NO: 1058944 - RNA, 19 nt, Homo sapiens
ccaaacagagcaagaaguu

SEQ ID NO: 1058945 - RNA, 19 nt, Homo sapiens
ucagucggcucuucucuug

SEQ ID NO: 1058946 - RNA, 19 nt, Homo sapiens
gggaaaagauguugggaaa

SEQ ID NO: 1058947 - RNA, 19 nt, Homo sapiens
ccagggcccuccuuuccua

SEQ ID NO: 1058948 - RNA, 19 nt, Homo sapiens
gaagauacucucacuaacu

SEQ ID NO: 1058949 - RNA, 19 nt, Homo sapiens
gaugaagaguggaaugaag

SEQ ID NO: 1058950 - RNA, 19 nt, Homo sapiens
cacaaggccucugaaguuu

SEQ ID NO: 1058951 - RNA, 19 nt, Homo sapiens
ugugaacuguacuauguua

SEQ ID NO: 1058952 - RNA, 19 nt, Homo sapiens
ccacaaacauucgcuacug

SEQ ID NO: 1058953 - RNA, 19 nt, Homo sapiens
cuucagugcugugguguua

SEQ ID NO: 1058954 - RNA, 19 nt, Homo sapiens
ggaccugccuccuuuacuc

SEQ ID NO: 1058955 - RNA, 19 nt, Homo sapiens
cuacguggcuucucacuac

SEQ ID NO: 1058956 - RNA, 19 nt, Homo sapiens
gauguggugggaagauuua

SEQ ID NO: 1058957 - RNA, 19 nt, Homo sapiens
ggcaauaccuucggcaugu

SEQ ID NO: 1058958 - RNA, 19 nt, Homo sapiens
gcagacuauucaguauaua

SEQ ID NO: 1058959 - RNA, 19 nt, Homo sapiens
gagcauggaccucucugaa

SEQ ID NO: 1058960 - RNA, 19 nt, Homo sapiens
caucacauguuauccaaag

SEQ ID NO: 1058961 - RNA, 19 nt, Homo sapiens
gggcccuccuuuccuauaa

SEQ ID NO: 1058962 - RNA, 19 nt, Homo sapiens
ggaagauacucucacuaac

SEQ ID NO: 1058963 - RNA, 19 nt, Homo sapiens
gugaagcuauuuaaugaag

SEQ ID NO: 1058964 - RNA, 19 nt, Homo sapiens
gagauacccucuuuugcua

SEQ ID NO: 1058965 - RNA, 19 nt, Homo sapiens
cuugugaacuguacuaugu

SEQ ID NO: 1058966 - RNA, 19 nt, Homo sapiens
guggagaaguggcugaaug

SEQ ID NO: 1058967 - RNA, 19 nt, Homo sapiens
gaacuaguugugauugaug

SEQ ID NO: 1058968 - RNA, 19 nt, Homo sapiens
cacaagauccugggcaaua

SEQ ID NO: 1058969 - RNA, 19 nt, Homo sapiens
gugcugugguguuauaaga

SEQ ID NO: 1058970 - RNA, 19 nt, Homo sapiens
gcagccuucuggaaagauu

SEQ ID NO: 1058971 - RNA, 19 nt, Homo sapiens
guacuccaauaucuuuguu

SEQ ID NO: 1058972 - RNA, 19 nt, Homo sapiens
gggaagauuuaaugaaagg

SEQ ID NO: 1058973 - RNA, 19 nt, Homo sapiens
gagaaacucgggcaucugu

SEQ ID NO: 1058974 - RNA, 19 nt, Homo sapiens
aaacaagaacccaaacaga

SEQ ID NO: 1058975 - RNA, 19 nt, Homo sapiens
ccagaagugcuugcuguua

SEQ ID NO: 1058976 - RNA, 19 nt, Homo sapiens
gggaugcaguggagaagug

SEQ ID NO: 1058977 - RNA, 19 nt, Homo sapiens
gaauuuaacaaagcaguga

SEQ ID NO: 1058978 - RNA, 19 nt, Homo sapiens
uccauacucuguuugaauu

SEQ ID NO: 1058979 - RNA, 19 nt, Homo sapiens
gaaaagauguugggaaagg

SEQ ID NO: 1058980 - RNA, 19 nt, Homo sapiens
ccgcaaaguugugaagcua

SEQ ID NO: 1058981 - RNA, 19 nt, Homo sapiens
agccuuaacuccaaacuug

SEQ ID NO: 1058982 - RNA, 19 nt, Homo sapiens
caacgagacccacaagauc

SEQ ID NO: 1058983 - RNA, 19 nt, Homo sapiens
cauagcagccacaaacauu

SEQ ID NO: 1058984 - RNA, 19 nt, Homo sapiens
gaaacucgggcaucugugu

SEQ ID NO: 1058985 - RNA, 19 nt, Homo sapiens
gaucaggugguaauacuuc

SEQ ID NO: 1058986 - RNA, 19 nt, Homo sapiens
gaaaagaucaggugguaau

SEQ ID NO: 1058987 - RNA, 19 nt, Homo sapiens
gccugaagcuugugaacug

SEQ ID NO: 1058988 - RNA, 19 nt, Homo sapiens
gagaacacaggcagacuau

SEQ ID NO: 1058989 - RNA, 19 nt, Homo sapiens
ucaggaacaucuggauuau

SEQ ID NO: 1058990 - RNA, 19 nt, Homo sapiens
gaaaucaacugucagaauu

SEQ ID NO: 1058991 - RNA, 19 nt, Homo sapiens
gaaaugagauuccugaaau

SEQ ID NO: 1058992 - RNA, 19 nt, Homo sapiens
gaauaagucucucauaaug

SEQ ID NO: 1058993 - RNA, 19 nt, Homo sapiens
ugaagaaccugcuguguuu

SEQ ID NO: 1058994 - RNA, 19 nt, Homo sapiens
uaaaugaugucucugauga

SEQ ID NO: 1058995 - RNA, 19 nt, Homo sapiens
agaauuaccucaggaaaua

SEQ ID NO: 1058996 - RNA, 19 nt, Homo sapiens
ggauuugacugcuaauauu

SEQ ID NO: 1058997 - RNA, 19 nt, Homo sapiens
gaauaggaaugugguguuu

SEQ ID NO: 1058998 - RNA, 19 nt, Homo sapiens
cuaaaggacuggacucaaa

SEQ ID NO: 1058999 - RNA, 19 nt, Homo sapiens
ccacuucuguguagaguuu

SEQ ID NO: 1059000 - RNA, 19 nt, Homo sapiens
gcucagaugguguaaauuu

SEQ ID NO: 1059001 - RNA, 19 nt, Homo sapiens
gaagguggaucagaauaga

SEQ ID NO: 1059002 - RNA, 19 nt, Homo sapiens
cugaauaagucucucauaa

SEQ ID NO: 1059003 - RNA, 19 nt, Homo sapiens
uuaaagcaguguugcauuu

SEQ ID NO: 1059004 - RNA, 19 nt, Homo sapiens
caacuugaaugcagacaga

SEQ ID NO: 1059005 - RNA, 19 nt, Homo sapiens
ggagcccucuuacaucuaa

SEQ ID NO: 1059006 - RNA, 19 nt, Homo sapiens
uaaccuggcuucacuggaa

SEQ ID NO: 1059007 - RNA, 19 nt, Homo sapiens
ucccagaacuuauuagaaa

SEQ ID NO: 1059008 - RNA, 19 nt, Homo sapiens
ggauggaaaucaacuguca

SEQ ID NO: 1059009 - RNA, 19 nt, Homo sapiens
gaacugagagagaaucuuc

SEQ ID NO: 1059010 - RNA, 19 nt, Homo sapiens
ugacaugaaugcugcuaaa

SEQ ID NO: 1059011 - RNA, 19 nt, Homo sapiens
gaacuugauuuaggaaaca

SEQ ID NO: 1059012 - RNA, 19 nt, Homo sapiens
gcggcucccuccagaaaua

SEQ ID NO: 1059013 - RNA, 19 nt, Homo sapiens
gaggagaucuaccgcuaug

SEQ ID NO: 1059014 - RNA, 19 nt, Homo sapiens
ggacuggacucaaacaaaa

SEQ ID NO: 1059015 - RNA, 19 nt, Homo sapiens
ggaaaucaacugucagaau

SEQ ID NO: 1059016 - RNA, 19 nt, Homo sapiens
uguaaacaauggcaucuuu

SEQ ID NO: 1059017 - RNA, 19 nt, Homo sapiens
uaaaugacaucucacuaca

SEQ ID NO: 1059018 - RNA, 19 nt, Homo sapiens
cagcucagaugguguaaau

SEQ ID NO: 1059019 - RNA, 19 nt, Homo sapiens
agaauagacucacacaguu

SEQ ID NO: 1059020 - RNA, 19 nt, Homo sapiens
gaaauaggaaaucugaaga

SEQ ID NO: 1059021 - RNA, 19 nt, Homo sapiens
uagaagaacuugauuuagg

SEQ ID NO: 1059022 - RNA, 19 nt, Homo sapiens
ggacuuagugauaaugaaa

SEQ ID NO: 1059023 - RNA, 19 nt, Homo sapiens
ucagugggcaaguaaauua

SEQ ID NO: 1059024 - RNA, 19 nt, Homo sapiens
ggaguuaaagcacaugaaa

SEQ ID NO: 1059025 - RNA, 19 nt, Homo sapiens
caugaaugcugcuaaagga

SEQ ID NO: 1059026 - RNA, 19 nt, Homo sapiens
ugagaaagaugaagaagac

SEQ ID NO: 1059027 - RNA, 19 nt, Homo sapiens
cauaaugagugcaguguca

SEQ ID NO: 1059028 - RNA, 19 nt, Homo sapiens
gaacgagcgugcugucaac

SEQ ID NO: 1059029 - RNA, 19 nt, Homo sapiens
gaaugcagacagaaauaaa

SEQ ID NO: 1059030 - RNA, 19 nt, Homo sapiens
uaacggauuuagucauuuc

SEQ ID NO: 1059031 - RNA, 19 nt, Homo sapiens
ggaaauaggaaaucugaag

SEQ ID NO: 1059032 - RNA, 19 nt, Homo sapiens
gacauucagugggcaagua

SEQ ID NO: 1059033 - RNA, 19 nt, Homo sapiens
agaagaacuugauuuagga

SEQ ID NO: 1059034 - RNA, 19 nt, Homo sapiens
cuagaugugucucgaaaug

SEQ ID NO: 1059035 - RNA, 19 nt, Homo sapiens
gaaagaugaagaagacaau

SEQ ID NO: 1059036 - RNA, 19 nt, Homo sapiens
uggagaacuugguaaauga

SEQ ID NO: 1059037 - RNA, 19 nt, Homo sapiens
ugacuucauuaacggauuu

SEQ ID NO: 1059038 - RNA, 19 nt, Homo sapiens
agaaauagcaaacuucaug

SEQ ID NO: 1059039 - RNA, 19 nt, Homo sapiens
guaaacauacgaccuuugu

SEQ ID NO: 1059040 - RNA, 19 nt, Homo sapiens
gaguuucaccuccaaguuu

SEQ ID NO: 1059041 - RNA, 19 nt, Homo sapiens
gaauagacucacacaguug

SEQ ID NO: 1059042 - RNA, 19 nt, Homo sapiens
guacgugacaacagacuaa

SEQ ID NO: 1059043 - RNA, 19 nt, Homo sapiens
aaaagacaguggagaauuu

SEQ ID NO: 1059044 - RNA, 19 nt, Homo sapiens
caacagacuaacucggaua

SEQ ID NO: 1059045 - RNA, 19 nt, Homo sapiens
gaagaaccugcuguguuua

SEQ ID NO: 1059046 - RNA, 19 nt, Homo sapiens
cgaaaugagauuccugaaa

SEQ ID NO: 1059047 - RNA, 19 nt, Homo sapiens
gaugagagauaguuuuaug

SEQ ID NO: 1059048 - RNA, 19 nt, Homo sapiens
cgaggucaaucaugccauu

SEQ ID NO: 1059049 - RNA, 19 nt, Homo sapiens
gauuuuaaccugugucuua

SEQ ID NO: 1059050 - RNA, 19 nt, Homo sapiens
aagaugaaccaaaggauuu

SEQ ID NO: 1059051 - RNA, 19 nt, Homo sapiens
gaacagugugaugagaaua

SEQ ID NO: 1059052 - RNA, 19 nt, Homo sapiens
gguaaaugaugucucugau

SEQ ID NO: 1059053 - RNA, 19 nt, Homo sapiens
gcagacagaaauaaauuag

SEQ ID NO: 1059054 - RNA, 19 nt, Homo sapiens
cagaauagacucacacagu

SEQ ID NO: 1059055 - RNA, 19 nt, Homo sapiens
cuaaagaaacugucaaucu

SEQ ID NO: 1059056 - RNA, 19 nt, Homo sapiens
guaaaugacaucucacuac

SEQ ID NO: 1059057 - RNA, 19 nt, Homo sapiens
gaacuagaugugucucgaa

SEQ ID NO: 1059058 - RNA, 19 nt, Homo sapiens
uaaacaauggcaucuuuga

SEQ ID NO: 1059059 - RNA, 19 nt, Homo sapiens
guggagaauuuacggaaug

SEQ ID NO: 1059060 - RNA, 19 nt, Homo sapiens
aagcuuggacuuagugaua

SEQ ID NO: 1059061 - RNA, 19 nt, Homo sapiens
ggaacagguugcugcaucu

SEQ ID NO: 1059062 - RNA, 19 nt, Homo sapiens
acaguugccugaagcaguu

SEQ ID NO: 1059063 - RNA, 19 nt, Homo sapiens
ggaacgagcgugcugucaa

SEQ ID NO: 1059064 - RNA, 19 nt, Homo sapiens
uuacgaaagcuuggacuua

SEQ ID NO: 1059065 - RNA, 19 nt, Homo sapiens
guugcugcaucuaccuuua

SEQ ID NO: 1059066 - RNA, 19 nt, Homo sapiens
gaccuacugaugagagaua

SEQ ID NO: 1059067 - RNA, 19 nt, Homo sapiens
cuggagaacuugguaaaug

SEQ ID NO: 1059068 - RNA, 19 nt, Homo sapiens
ugacugccuugaaguugaa

SEQ ID NO: 1059069 - RNA, 19 nt, Homo sapiens
guguuuagaugucucugaa

SEQ ID NO: 1059070 - RNA, 19 nt, Homo sapiens
caggaaauaggaaaucuga

SEQ ID NO: 1059071 - RNA, 19 nt, Homo sapiens
gaagaacuugauuuaggaa

SEQ ID NO: 1059072 - RNA, 19 nt, Homo sapiens
cugacuagguugccagaaa

SEQ ID NO: 1059073 - RNA, 19 nt, Homo sapiens
aaagacaguggagaauuua

SEQ ID NO: 1059074 - RNA, 19 nt, Homo sapiens
uaaaagaucucugguugga

SEQ ID NO: 1059075 - RNA, 19 nt, Homo sapiens
aaagaugaaccaaaggauu

SEQ ID NO: 1059076 - RNA, 19 nt, Homo sapiens
ugaacagugugaugagaau

SEQ ID NO: 1059077 - RNA, 19 nt, Homo sapiens
acaauggcaucuuugaaca

SEQ ID NO: 1059078 - RNA, 19 nt, Homo sapiens
ccacuugugccuuacugua

SEQ ID NO: 1059079 - RNA, 19 nt, Homo sapiens
gcacuggagaacuugguaa

SEQ ID NO: 1059080 - RNA, 19 nt, Homo sapiens
guggugcacuggagaacuu

SEQ ID NO: 1059081 - RNA, 19 nt, Homo sapiens
ggaaugugguguuuuaaag

SEQ ID NO: 1059082 - RNA, 19 nt, Homo sapiens
gaauuuacggaaugacaug

SEQ ID NO: 1059083 - RNA, 19 nt, Homo sapiens
gaacagguugcugcaucua

SEQ ID NO: 1059084 - RNA, 19 nt, Homo sapiens
uaggaaaucugaagaaccu

SEQ ID NO: 1059085 - RNA, 19 nt, Homo sapiens
aaugacaucucacuacagu

SEQ ID NO: 1059086 - RNA, 19 nt, Homo sapiens
ccagauauacaaccacaau

SEQ ID NO: 1059087 - RNA, 19 nt, Homo sapiens
ugacuagguugccagaaag

SEQ ID NO: 1059088 - RNA, 19 nt, Homo sapiens
uacgaaagcuuggacuuag

SEQ ID NO: 1059089 - RNA, 19 nt, Homo sapiens
gguaugugccauuuguaaa

SEQ ID NO: 1059090 - RNA, 19 nt, Homo sapiens
gaaaucaacugucagaauu

SEQ ID NO: 1059091 - RNA, 19 nt, Homo sapiens
gaaaugagauuccugaaau

SEQ ID NO: 1059092 - RNA, 19 nt, Homo sapiens
ggaauuaugucaaagaaug

SEQ ID NO: 1059093 - RNA, 19 nt, Homo sapiens
ugaagaaccugcuguguuu

SEQ ID NO: 1059094 - RNA, 19 nt, Homo sapiens
gcaaacaccucauaacuac

SEQ ID NO: 1059095 - RNA, 19 nt, Homo sapiens
agaauuaccucaggaaaua

SEQ ID NO: 1059096 - RNA, 19 nt, Homo sapiens
gaagcgagcuaacccaaga

SEQ ID NO: 1059097 - RNA, 19 nt, Homo sapiens
aaagaaggcuuacaauuag

SEQ ID NO: 1059098 - RNA, 19 nt, Homo sapiens
ggacugagaggcauuuaaa

SEQ ID NO: 1059099 - RNA, 19 nt, Homo sapiens
ucacaaaggcauacacaua

SEQ ID NO: 1059100 - RNA, 19 nt, Homo sapiens
gggcagagauuuacauugg

SEQ ID NO: 1059101 - RNA, 19 nt, Homo sapiens
uuaaaggugugaacucuaa

SEQ ID NO: 1059102 - RNA, 19 nt, Homo sapiens
gaagguggaucagaauaga

SEQ ID NO: 1059103 - RNA, 19 nt, Homo sapiens
ggaggugucuaguguguug

SEQ ID NO: 1059104 - RNA, 19 nt, Homo sapiens
caacuugaaugcagacaga

SEQ ID NO: 1059105 - RNA, 19 nt, Homo sapiens
ggagcccucuuacaucuaa

SEQ ID NO: 1059106 - RNA, 19 nt, Homo sapiens
uaaccuggcuucacuggaa

SEQ ID NO: 1059107 - RNA, 19 nt, Homo sapiens
ucccagaacuuauuagaaa

SEQ ID NO: 1059108 - RNA, 19 nt, Homo sapiens
ggagaaagaaagagauuga

SEQ ID NO: 1059109 - RNA, 19 nt, Homo sapiens
gaggaauuaugucaaagaa

SEQ ID NO: 1059110 - RNA, 19 nt, Homo sapiens
ggauggaaaucaacuguca

SEQ ID NO: 1059111 - RNA, 19 nt, Homo sapiens
gaacugagagagaaucuuc

SEQ ID NO: 1059112 - RNA, 19 nt, Homo sapiens
gaacuugauuuaggaaaca

SEQ ID NO: 1059113 - RNA, 19 nt, Homo sapiens
gcggcucccuccagaaaua

SEQ ID NO: 1059114 - RNA, 19 nt, Homo sapiens
ggaaaucaacugucagaau

SEQ ID NO: 1059115 - RNA, 19 nt, Homo sapiens
gaggagaucuaccgcuaug

SEQ ID NO: 1059116 - RNA, 19 nt, Homo sapiens
gaaggugaaugggaagcua

SEQ ID NO: 1059117 - RNA, 19 nt, Homo sapiens
uaaaugacaucucacuaca

SEQ ID NO: 1059118 - RNA, 19 nt, Homo sapiens
agaauagacucacacaguu

SEQ ID NO: 1059119 - RNA, 19 nt, Homo sapiens
gaaauaggaaaucugaaga

SEQ ID NO: 1059120 - RNA, 19 nt, Homo sapiens
uagaagaacuugauuuagg

SEQ ID NO: 1059121 - RNA, 19 nt, Homo sapiens
ggacuuagugauaaugaaa

SEQ ID NO: 1059122 - RNA, 19 nt, Homo sapiens
acaaggaggugucuagugu

SEQ ID NO: 1059123 - RNA, 19 nt, Homo sapiens
gaucaucaguaacauuaag

SEQ ID NO: 1059124 - RNA, 19 nt, Homo sapiens
gaaugcagacagaaauaaa

SEQ ID NO: 1059125 - RNA, 19 nt, Homo sapiens
uaacggauuuagucauuuc

SEQ ID NO: 1059126 - RNA, 19 nt, Homo sapiens
ggaaauaggaaaucugaag

SEQ ID NO: 1059127 - RNA, 19 nt, Homo sapiens
acaaugaggaggaagcuua

SEQ ID NO: 1059128 - RNA, 19 nt, Homo sapiens
gaaagagauugacauuuug

SEQ ID NO: 1059129 - RNA, 19 nt, Homo sapiens
ggugugaacucuaaaucug

SEQ ID NO: 1059130 - RNA, 19 nt, Homo sapiens
agaagaacuugauuuagga

SEQ ID NO: 1059131 - RNA, 19 nt, Homo sapiens
cuagaugugucucgaaaug

SEQ ID NO: 1059132 - RNA, 19 nt, Homo sapiens
ugucuaguguguuguuuaa

SEQ ID NO: 1059133 - RNA, 19 nt, Homo sapiens
gaaagaaagagauugacau

SEQ ID NO: 1059134 - RNA, 19 nt, Homo sapiens
ugacuucauuaacggauuu

SEQ ID NO: 1059135 - RNA, 19 nt, Homo sapiens
agaaauagcaaacuucaug

SEQ ID NO: 1059136 - RNA, 19 nt, Homo sapiens
gaauagacucacacaguug

SEQ ID NO: 1059137 - RNA, 19 nt, Homo sapiens
ccucauaacuacaccgaau

SEQ ID NO: 1059138 - RNA, 19 nt, Homo sapiens
guggaaaugcugacaauga

SEQ ID NO: 1059139 - RNA, 19 nt, Homo sapiens
ggaggaauuaugucaaaga

SEQ ID NO: 1059140 - RNA, 19 nt, Homo sapiens
gaagaaccugcuguguuua

SEQ ID NO: 1059141 - RNA, 19 nt, Homo sapiens
cgaaaugagauuccugaaa

SEQ ID NO: 1059142 - RNA, 19 nt, Homo sapiens
cuaaaucugugaguauaga

SEQ ID NO: 1059143 - RNA, 19 nt, Homo sapiens
acaaaggcauacacauaga

SEQ ID NO: 1059144 - RNA, 19 nt, Homo sapiens
gcagacagaaauaaauuag

SEQ ID NO: 1059145 - RNA, 19 nt, Homo sapiens
cagaauagacucacacagu

SEQ ID NO: 1059146 - RNA, 19 nt, Homo sapiens
cuaaagaaacugucaaucu

SEQ ID NO: 1059147 - RNA, 19 nt, Homo sapiens
guaaaugacaucucacuac

SEQ ID NO: 1059148 - RNA, 19 nt, Homo sapiens
gaacuagaugugucucgaa

SEQ ID NO: 1059149 - RNA, 19 nt, Homo sapiens
caagggagguggaaaugcu

SEQ ID NO: 1059150 - RNA, 19 nt, Homo sapiens
aaagacgcauguguuguuu

SEQ ID NO: 1059151 - RNA, 19 nt, Homo sapiens
acaguugccugaagcaguu

SEQ ID NO: 1059152 - RNA, 19 nt, Homo sapiens
aagcuuggacuuagugaua

SEQ ID NO: 1059153 - RNA, 19 nt, Homo sapiens
ugagaggcauuuaaauucu

SEQ ID NO: 1059154 - RNA, 19 nt, Homo sapiens
uaaaugggagaaagaaaga

SEQ ID NO: 1059155 - RNA, 19 nt, Homo sapiens
uuacgaaagcuuggacuua

SEQ ID NO: 1059156 - RNA, 19 nt, Homo sapiens
gagaggcauuuaaauucug

SEQ ID NO: 1059157 - RNA, 19 nt, Homo sapiens
guagcuguauggacugaga

SEQ ID NO: 1059158 - RNA, 19 nt, Homo sapiens
ggaugagguugaacaaacu

SEQ ID NO: 1059159 - RNA, 19 nt, Homo sapiens
guguuuagaugucucugaa

SEQ ID NO: 1059160 - RNA, 19 nt, Homo sapiens
caggaaauaggaaaucuga

SEQ ID NO: 1059161 - RNA, 19 nt, Homo sapiens
gaagaacuugauuuaggaa

SEQ ID NO: 1059162 - RNA, 19 nt, Homo sapiens
cugacuagguugccagaaa

SEQ ID NO: 1059163 - RNA, 19 nt, Homo sapiens
caaacaaggaggugucuag

SEQ ID NO: 1059164 - RNA, 19 nt, Homo sapiens
agagccaacuggaggaauu

SEQ ID NO: 1059165 - RNA, 19 nt, Homo sapiens
uaaaagaucucugguugga

SEQ ID NO: 1059166 - RNA, 19 nt, Homo sapiens
gagccaacuggaggaauua

SEQ ID NO: 1059167 - RNA, 19 nt, Homo sapiens
acacauagaggaaggugaa

SEQ ID NO: 1059168 - RNA, 19 nt, Homo sapiens
gguuugauauacagagaau

SEQ ID NO: 1059169 - RNA, 19 nt, Homo sapiens
cuggaggaauuaugucaaa

SEQ ID NO: 1059170 - RNA, 19 nt, Homo sapiens
uaggaaaucugaagaaccu

SEQ ID NO: 1059171 - RNA, 19 nt, Homo sapiens
aaugacaucucacuacagu

SEQ ID NO: 1059172 - RNA, 19 nt, Homo sapiens
ugacuagguugccagaaag

SEQ ID NO: 1059173 - RNA, 19 nt, Homo sapiens
gguaugugcuuuuagagaa

SEQ ID NO: 1059174 - RNA, 19 nt, Homo sapiens
ucacugaguuaguucuuac

SEQ ID NO: 1059175 - RNA, 19 nt, Homo sapiens
gaaaacagguuggaaagac

SEQ ID NO: 1059176 - RNA, 19 nt, Homo sapiens
uacgaaagcuuggacuuag

SEQ ID NO: 1059177 - RNA, 19 nt, Homo sapiens
ugcaaacaccucauaacua

SEQ ID NO: 1059178 - RNA, 19 nt, Homo sapiens
ugacaccauuggcagaaau

SEQ ID NO: 1059179 - RNA, 19 nt, Homo sapiens
ggaaacccacugacuaggu

SEQ ID NO: 1059180 - RNA, 19 nt, Homo sapiens
ugaaauuccagaaagcauu

SEQ ID NO: 1059181 - RNA, 19 nt, Homo sapiens
ccagaaauagcaaacuuca

SEQ ID NO: 1059182 - RNA, 19 nt, Homo sapiens
acugagaggcauuuaaauu

SEQ ID NO: 1059183 - RNA, 19 nt, Homo sapiens
cacaaaggcauacacauag

SEQ ID NO: 1059184 - RNA, 19 nt, Homo sapiens
uggaugagguugaacaaac

SEQ ID NO: 1059185 - RNA, 19 nt, Homo sapiens
guggaugccuuuggguuug

SEQ ID NO: 1059186 - RNA, 19 nt, Homo sapiens
aaauuaguguccuuaccaa

SEQ ID NO: 1059187 - RNA, 19 nt, Homo sapiens
ugaaugcagacagaaauaa

SEQ ID NO: 1059188 - RNA, 19 nt, Homo sapiens
ucuugaagguggaucagaa

SEQ ID NO: 1059189 - RNA, 19 nt, Homo sapiens
cagaauuaccucaggaaau

SEQ ID NO: 1059190 - RNA, 19 nt, Homo sapiens
gaaagaagcagaagaagaa

SEQ ID NO: 1059191 - RNA, 19 nt, Homo sapiens
gaagggagguggaucucua

SEQ ID NO: 1059192 - RNA, 19 nt, Homo sapiens
uaaagaaugugaacaguug

SEQ ID NO: 1059193 - RNA, 19 nt, Homo sapiens
guacacgucuuaguuauuu

SEQ ID NO: 1059194 - RNA, 19 nt, Homo sapiens
ccacaaagauguaauccaa

SEQ ID NO: 1059195 - RNA, 19 nt, Homo sapiens
gaaggucacuacucacauu

SEQ ID NO: 1059196 - RNA, 19 nt, Homo sapiens
guucauagguuaacuuguu

SEQ ID NO: 1059197 - RNA, 19 nt, Homo sapiens
gcacuuugauucccauuug

SEQ ID NO: 1059198 - RNA, 19 nt, Homo sapiens
ucaggcaucucuuugcuua

SEQ ID NO: 1059199 - RNA, 19 nt, Homo sapiens
ggucacuacucacauuaua

SEQ ID NO: 1059200 - RNA, 19 nt, Homo sapiens
ggagaaagaagcagaagaa

SEQ ID NO: 1059201 - RNA, 19 nt, Homo sapiens
aaacaaauuucucgugaug

SEQ ID NO: 1059202 - RNA, 19 nt, Homo sapiens
guuaaugucugcccucuga

SEQ ID NO: 1059203 - RNA, 19 nt, Homo sapiens
gaacauucauuccccuuua

SEQ ID NO: 1059204 - RNA, 19 nt, Homo sapiens
agaaagcccugugugaaua

SEQ ID NO: 1059205 - RNA, 19 nt, Homo sapiens
gaccaaagccuguaacugu

SEQ ID NO: 1059206 - RNA, 19 nt, Homo sapiens
caaguuuccuuucgucauu

SEQ ID NO: 1059207 - RNA, 19 nt, Homo sapiens
gcaacagccucaaccucua

SEQ ID NO: 1059208 - RNA, 19 nt, Homo sapiens
caugaaagcccaccaaaga

SEQ ID NO: 1059209 - RNA, 19 nt, Homo sapiens
aaacuuggcuguuaauguc

SEQ ID NO: 1059210 - RNA, 19 nt, Homo sapiens
ucucagugauucaacuuua

SEQ ID NO: 1059211 - RNA, 19 nt, Homo sapiens
caacagcacagcuaacuug

SEQ ID NO: 1059212 - RNA, 19 nt, Homo sapiens
ccaaaggcaucaauuccaa

SEQ ID NO: 1059213 - RNA, 19 nt, Homo sapiens
gaauaagacuuuggacucu

SEQ ID NO: 1059214 - RNA, 19 nt, Homo sapiens
uauuagcccuugcaaguuu

SEQ ID NO: 1059215 - RNA, 19 nt, Homo sapiens
gaauucagacacacuauau

SEQ ID NO: 1059216 - RNA, 19 nt, Homo sapiens
caggaggucccaagaguua

SEQ ID NO: 1059217 - RNA, 19 nt, Homo sapiens
ggaguuggcuuugaagaag

SEQ ID NO: 1059218 - RNA, 19 nt, Homo sapiens
gcagaaagcccugugugaa

SEQ ID NO: 1059219 - RNA, 19 nt, Homo sapiens
ggugaacaguaguaauauu

SEQ ID NO: 1059220 - RNA, 19 nt, Homo sapiens
uaucguagccguccacaaa

SEQ ID NO: 1059221 - RNA, 19 nt, Homo sapiens
gaagggaggcaucagauca

SEQ ID NO: 1059222 - RNA, 19 nt, Homo sapiens
gaaagggccaggcucaaga

SEQ ID NO: 1059223 - RNA, 19 nt, Homo sapiens
cgaagacuaucagaauauu

SEQ ID NO: 1059224 - RNA, 19 nt, Homo sapiens
gaaagcccugugugaauaa

SEQ ID NO: 1059225 - RNA, 19 nt, Homo sapiens
gguuagaaguggaagaaau

SEQ ID NO: 1059226 - RNA, 19 nt, Homo sapiens
caccaugacuaguaaaugu

SEQ ID NO: 1059227 - RNA, 19 nt, Homo sapiens
gauaaagaaugugaacagu

SEQ ID NO: 1059228 - RNA, 19 nt, Homo sapiens
gaacaaggaagacguacca

SEQ ID NO: 1059229 - RNA, 19 nt, Homo sapiens
gaagagaccaaagccugua

SEQ ID NO: 1059230 - RNA, 19 nt, Homo sapiens
gguguaugguaguaaguaa

SEQ ID NO: 1059231 - RNA, 19 nt, Homo sapiens
gcggaugaauugcuugaau

SEQ ID NO: 1059232 - RNA, 19 nt, Homo sapiens
gaaagcccaccaaagaaga

SEQ ID NO: 1059233 - RNA, 19 nt, Homo sapiens
ucagauauguuggaaguca

SEQ ID NO: 1059234 - RNA, 19 nt, Homo sapiens
gaucuggcccugagguaaa

SEQ ID NO: 1059235 - RNA, 19 nt, Homo sapiens
guaacuguccagcuucuaa

SEQ ID NO: 1059236 - RNA, 19 nt, Homo sapiens
guuguuagauguucucagu

SEQ ID NO: 1059237 - RNA, 19 nt, Homo sapiens
acaaauuucucgugaugau

SEQ ID NO: 1059238 - RNA, 19 nt, Homo sapiens
caucgaagacuaucagaau

SEQ ID NO: 1059239 - RNA, 19 nt, Homo sapiens
aaaagugacuacucagaua

SEQ ID NO: 1059240 - RNA, 19 nt, Homo sapiens
ggaaaauucuagaacauuc

SEQ ID NO: 1059241 - RNA, 19 nt, Homo sapiens
caaguugacaccaugacua

SEQ ID NO: 1059242 - RNA, 19 nt, Homo sapiens
guucagguguaugguagua

SEQ ID NO: 1059243 - RNA, 19 nt, Homo sapiens
gaaauuccugugcauguuc

SEQ ID NO: 1059244 - RNA, 19 nt, Homo sapiens
guuagaaguggaagaaauu

SEQ ID NO: 1059245 - RNA, 19 nt, Homo sapiens
gcccugagguaaacgauag

SEQ ID NO: 1059246 - RNA, 19 nt, Homo sapiens
caaggaagacguaccaagu

SEQ ID NO: 1059247 - RNA, 19 nt, Homo sapiens
guugacaccaugacuagua

SEQ ID NO: 1059248 - RNA, 19 nt, Homo sapiens
uguuagauguucucaguga

SEQ ID NO: 1059249 - RNA, 19 nt, Homo sapiens
gaagaacuccaggcaggaa

SEQ ID NO: 1059250 - RNA, 19 nt, Homo sapiens
ugacuacucagauauguug

SEQ ID NO: 1059251 - RNA, 19 nt, Homo sapiens
gaagaagcccauggcgaaa

SEQ ID NO: 1059252 - RNA, 19 nt, Homo sapiens
caaugaauccagaaagguu

SEQ ID NO: 1059253 - RNA, 19 nt, Homo sapiens
gccaggaggucccaagagu

SEQ ID NO: 1059254 - RNA, 19 nt, Homo sapiens
cagcuuccauccuccaguu

SEQ ID NO: 1059255 - RNA, 19 nt, Homo sapiens
caagaagggaggcaucaga

SEQ ID NO: 1059256 - RNA, 19 nt, Homo sapiens
aggcaucucuuugcuuaaa

SEQ ID NO: 1059257 - RNA, 19 nt, Homo sapiens
cagaaagcccugugugaau

SEQ ID NO: 1059258 - RNA, 19 nt, Homo sapiens
gagagugguuuccguuugc

SEQ ID NO: 1059259 - RNA, 19 nt, Homo sapiens
guauuaacauggugaacag

SEQ ID NO: 1059260 - RNA, 19 nt, Homo sapiens
agaaauuccugugcauguu

SEQ ID NO: 1059261 - RNA, 19 nt, Homo sapiens
ugaggugggugaugcugaa

SEQ ID NO: 1059262 - RNA, 19 nt, Homo sapiens
aaagaacaaggaagacgua

SEQ ID NO: 1059263 - RNA, 19 nt, Homo sapiens
agagagugguuuccguuug

SEQ ID NO: 1059264 - RNA, 19 nt, Homo sapiens
gagguuagaaguggaagaa

SEQ ID NO: 1059265 - RNA, 19 nt, Homo sapiens
ugaauucagacacacuaua

SEQ ID NO: 1059266 - RNA, 19 nt, Homo sapiens
uaccaggccugccguuuca

SEQ ID NO: 1059267 - RNA, 19 nt, Homo sapiens
guaccaagucaaccaaguu

SEQ ID NO: 1059268 - RNA, 19 nt, Homo sapiens
guugaaagaacaaggaaga

SEQ ID NO: 1059269 - RNA, 19 nt, Homo sapiens
agaagccggugaugccaaa

SEQ ID NO: 1059270 - RNA, 19 nt, Homo sapiens
gcaaauuaaguguccuguu

SEQ ID NO: 1059271 - RNA, 19 nt, Homo sapiens
guuaacaaguugacaccau

SEQ ID NO: 1059272 - RNA, 19 nt, Homo sapiens
cauuagggcuucguugugu

SEQ ID NO: 1059273 - RNA, 19 nt, Homo sapiens
agaaagaagcagaagaaga

SEQ ID NO: 1059274 - RNA, 19 nt, Homo sapiens
acucagauauguuggaagu

SEQ ID NO: 1059275 - RNA, 19 nt, Homo sapiens
ucagacacacuauauuaga

SEQ ID NO: 1059276 - RNA, 19 nt, Homo sapiens
ggaagcagugcccuggaaa

SEQ ID NO: 1059277 - RNA, 19 nt, Homo sapiens
ggaggcagagguugcaaug

SEQ ID NO: 1059278 - RNA, 19 nt, Homo sapiens
gaaaccccaucucuacaaa

SEQ ID NO: 1059279 - RNA, 19 nt, Homo sapiens
ggaguugaaagaacaagga

SEQ ID NO: 1059280 - RNA, 19 nt, Homo sapiens
cgucuugguugacucagaa

SEQ ID NO: 1059281 - RNA, 19 nt, Homo sapiens
ccgccuuccucuuguguaa

SEQ ID NO: 1059282 - RNA, 19 nt, Homo sapiens
gggcuucguuguguuaaca

SEQ ID NO: 1059283 - RNA, 19 nt, Homo sapiens
gugaacaguaguaauauuc

SEQ ID NO: 1059284 - RNA, 19 nt, Homo sapiens
uuguaaaugugacugauga

SEQ ID NO: 1059285 - RNA, 19 nt, Homo sapiens
cuacucagauauguuggaa

SEQ ID NO: 1059286 - RNA, 19 nt, Homo sapiens
gagaguugguaagaggauu

SEQ ID NO: 1059287 - RNA, 19 nt, Homo sapiens
gaucaagggcagcagaaag

SEQ ID NO: 1059288 - RNA, 19 nt, Homo sapiens
gccuguaacuguccagcuu

SEQ ID NO: 1059289 - RNA, 19 nt, Homo sapiens
ucauucacaugcucuuguu

SEQ ID NO: 1059290 - RNA, 19 nt, Homo sapiens
uaaccaagcuggccuacua

SEQ ID NO: 1059291 - RNA, 19 nt, Homo sapiens
gcgaguggcuucagagauu

SEQ ID NO: 1059292 - RNA, 19 nt, Homo sapiens
gugaugacgugccugauua

SEQ ID NO: 1059293 - RNA, 19 nt, Homo sapiens
agagagaucuauacaggua

SEQ ID NO: 1059294 - RNA, 19 nt, Homo sapiens
ucaaggaccucaucgaaga

SEQ ID NO: 1059295 - RNA, 19 nt, Homo sapiens
gaaacugcguucaaaucaa

SEQ ID NO: 1059296 - RNA, 19 nt, Homo sapiens
aagaggaaguuacaagaaa

SEQ ID NO: 1059297 - RNA, 19 nt, Homo sapiens
ggaaacugcguucaaauca

SEQ ID NO: 1059298 - RNA, 19 nt, Homo sapiens
ggacaauccuaaccaguac

SEQ ID NO: 1059299 - RNA, 19 nt, Homo sapiens
gcagauaacaguggaauag

SEQ ID NO: 1059300 - RNA, 19 nt, Homo sapiens
gcaacuucgugcucaagaa

SEQ ID NO: 1059301 - RNA, 19 nt, Homo sapiens
acacagaacgugaacauga

SEQ ID NO: 1059302 - RNA, 19 nt, Homo sapiens
ccucauaaaugugccuuaa

SEQ ID NO: 1059303 - RNA, 19 nt, Homo sapiens
ccuaugagauuucaguuca

SEQ ID NO: 1059304 - RNA, 19 nt, Homo sapiens
gcgcuucgccaucgacaua

SEQ ID NO: 1059305 - RNA, 19 nt, Homo sapiens
gaccucagccgccuggaua

SEQ ID NO: 1059306 - RNA, 19 nt, Homo sapiens
ggaaucuauuuaacugcua

SEQ ID NO: 1059307 - RNA, 19 nt, Homo sapiens
gcaaagaggaaguuacaag

SEQ ID NO: 1059308 - RNA, 19 nt, Homo sapiens
caucggagcguuccugaaa

SEQ ID NO: 1059309 - RNA, 19 nt, Homo sapiens
cagggaaacugcguucaaa

SEQ ID NO: 1059310 - RNA, 19 nt, Homo sapiens
gacccuggcucguggauuc

SEQ ID NO: 1059311 - RNA, 19 nt, Homo sapiens
caaagaggaaguuacaaga

SEQ ID NO: 1059312 - RNA, 19 nt, Homo sapiens
cgaguggcuucagagauua

SEQ ID NO: 1059313 - RNA, 19 nt, Homo sapiens
gaccaagaguucuccaaag

SEQ ID NO: 1059314 - RNA, 19 nt, Homo sapiens
ggacacagaacgugaacau

SEQ ID NO: 1059315 - RNA, 19 nt, Homo sapiens
gacauaggcgggucguuaa

SEQ ID NO: 1059316 - RNA, 19 nt, Homo sapiens
gaucccuacuccaaaguga

SEQ ID NO: 1059317 - RNA, 19 nt, Homo sapiens
gcucgacugcacuucauua

SEQ ID NO: 1059318 - RNA, 19 nt, Homo sapiens
gggagacguucauauugga

SEQ ID NO: 1059319 - RNA, 19 nt, Homo sapiens
gcuugucacuugucaggaa

SEQ ID NO: 1059320 - RNA, 19 nt, Homo sapiens
caaagaccaucucgucaac

SEQ ID NO: 1059321 - RNA, 19 nt, Homo sapiens
guacuuuggaggcuucuuu

SEQ ID NO: 1059322 - RNA, 19 nt, Homo sapiens
ccuaucuucuugucaauau

SEQ ID NO: 1059323 - RNA, 19 nt, Homo sapiens
caagcuggccuacuauuca

SEQ ID NO: 1059324 - RNA, 19 nt, Homo sapiens
gcacgcaccaaauagaguu

SEQ ID NO: 1059325 - RNA, 19 nt, Homo sapiens
cgaagagccugcugcacau

SEQ ID NO: 1059326 - RNA, 19 nt, Homo sapiens
accaagaguucuccaaaga

SEQ ID NO: 1059327 - RNA, 19 nt, Homo sapiens
gggaaacugcguucaaauc

SEQ ID NO: 1059328 - RNA, 19 nt, Homo sapiens
gcgcggaucugguggucau

SEQ ID NO: 1059329 - RNA, 19 nt, Homo sapiens
gcaucaacuucuucuccaa

SEQ ID NO: 1059330 - RNA, 19 nt, Homo sapiens
aagaagacauggcgaagag

SEQ ID NO: 1059331 - RNA, 19 nt, Homo sapiens
guucaaggaccucaucgaa

SEQ ID NO: 1059332 - RNA, 19 nt, Homo sapiens
aaacugcguucaaaucaac

SEQ ID NO: 1059333 - RNA, 19 nt, Homo sapiens
acucugcgcuccaggaaga

SEQ ID NO: 1059334 - RNA, 19 nt, Homo sapiens
gauaacaguggaauagaca

SEQ ID NO: 1059335 - RNA, 19 nt, Homo sapiens
aaagaggaaguuacaagaa

SEQ ID NO: 1059336 - RNA, 19 nt, Homo sapiens
cgacaaggaggacgugaug

SEQ ID NO: 1059337 - RNA, 19 nt, Homo sapiens
aagagaagcugcggcugaa

SEQ ID NO: 1059338 - RNA, 19 nt, Homo sapiens
ucaaagaccaucucgucaa

SEQ ID NO: 1059339 - RNA, 19 nt, Homo sapiens
ucagcgucaucuucaagua

SEQ ID NO: 1059340 - RNA, 19 nt, Homo sapiens
cgaccaagaguucuccaaa

SEQ ID NO: 1059341 - RNA, 19 nt, Homo sapiens
gauuucaguucaagaagag

SEQ ID NO: 1059342 - RNA, 19 nt, Homo sapiens
gagcugagcaggacaaucc

SEQ ID NO: 1059343 - RNA, 19 nt, Homo sapiens
gggacagucuggacaagag

SEQ ID NO: 1059344 - RNA, 19 nt, Homo sapiens
gaggaaguuacaagaaaga

SEQ ID NO: 1059345 - RNA, 19 nt, Homo sapiens
ggaagugcaggcgcuguuu

SEQ ID NO: 1059346 - RNA, 19 nt, Homo sapiens
gccgugcuguccacacaaa

SEQ ID NO: 1059347 - RNA, 19 nt, Homo sapiens
gagaaguuccggcagaagu

SEQ ID NO: 1059348 - RNA, 19 nt, Homo sapiens
aauacuggcucaccugcuu

SEQ ID NO: 1059349 - RNA, 19 nt, Homo sapiens
ccuauagcaucaacuucuu

SEQ ID NO: 1059350 - RNA, 19 nt, Homo sapiens
ugagaauaccuacaucgaa

SEQ ID NO: 1059351 - RNA, 19 nt, Homo sapiens
ugagauuucaguucaagaa

SEQ ID NO: 1059352 - RNA, 19 nt, Homo sapiens
ccugggagacguucauauu

SEQ ID NO: 1059353 - RNA, 19 nt, Homo sapiens
cagcagcccuucgccuaug

SEQ ID NO: 1059354 - RNA, 19 nt, Homo sapiens
cggcagaaguacuggaaca

SEQ ID NO: 1059355 - RNA, 19 nt, Homo sapiens
agauuucaguucaagaaga

SEQ ID NO: 1059356 - RNA, 19 nt, Homo sapiens
gaggcgagacgcagcuuug

SEQ ID NO: 1059357 - RNA, 19 nt, Homo sapiens
gcacucugcgcuccaggaa

SEQ ID NO: 1059358 - RNA, 19 nt, Homo sapiens
gaagaagcaaagaggaagu

SEQ ID NO: 1059359 - RNA, 19 nt, Homo sapiens
gagaagcugcggcugaaag

SEQ ID NO: 1059360 - RNA, 19 nt, Homo sapiens
ugaagcagcgggagaaugg

SEQ ID NO: 1059361 - RNA, 19 nt, Homo sapiens
gcagcagcccuucgccuau

SEQ ID NO: 1059362 - RNA, 19 nt, Homo sapiens
gugcaggcgcuguuucuga

SEQ ID NO: 1059363 - RNA, 19 nt, Homo sapiens
ucgccaaggugcggucuuu

SEQ ID NO: 1059364 - RNA, 19 nt, Homo sapiens
ggcugaaagucgacaagga

SEQ ID NO: 1059365 - RNA, 19 nt, Homo sapiens
gccuggacuucaucaaaga

SEQ ID NO: 1059366 - RNA, 19 nt, Homo sapiens
ucacuugucaggaaugugu

SEQ ID NO: 1059367 - RNA, 19 nt, Homo sapiens
agaaguuccggcagaagua

SEQ ID NO: 1059368 - RNA, 19 nt, Homo sapiens
ugggagacguucauauugg

SEQ ID NO: 1059369 - RNA, 19 nt, Homo sapiens
gcucuucagcgucaucuuc

SEQ ID NO: 1059370 - RNA, 19 nt, Homo sapiens
caagcuggccgucaucaag

SEQ ID NO: 1059371 - RNA, 19 nt, Homo sapiens
agaggaaguuacaagaaag

SEQ ID NO: 1059372 - RNA, 19 nt, Homo sapiens
gaagugcaggcgcuguuuc

SEQ ID NO: 1059373 - RNA, 19 nt, Homo sapiens
caacgguacagcacaaagu

SEQ ID NO: 1059374 - RNA, 19 nt, Homo sapiens
aagcuggccuacuauucaa

SEQ ID NO: 1059375 - RNA, 19 nt, Homo sapiens
gccggacucuucugcuugu

SEQ ID NO: 1059376 - RNA, 19 nt, Homo sapiens
ccacagcgagucccucauc

SEQ ID NO: 1059377 - RNA, 19 nt, Homo sapiens
aagcaaagaggaaguuaca

SEQ ID NO: 1059378 - RNA, 19 nt, Homo sapiens
gaaguacuggaacaagcuu

SEQ ID NO: 1059379 - RNA, 19 nt, Homo sapiens
cacagaacgugaacaugag

SEQ ID NO: 1059380 - RNA, 19 nt, Homo sapiens
gaagcaaagaggaaguuac

SEQ ID NO: 1059381 - RNA, 19 nt, Homo sapiens
cuacuuuggguuugaagaa

SEQ ID NO: 1059382 - RNA, 19 nt, Homo sapiens
gcagaaguacuggaacaag

SEQ ID NO: 1059383 - RNA, 19 nt, Homo sapiens
ggagacguucauauuggaa

SEQ ID NO: 1059384 - RNA, 19 nt, Homo sapiens
ccaagcuggccuacuauuc

SEQ ID NO: 1059385 - RNA, 19 nt, Homo sapiens
ucaccuauagcaucaacuu

SEQ ID NO: 1059386 - RNA, 19 nt, Homo sapiens
ggauuccgacccugaguuc

SEQ ID NO: 1059387 - RNA, 19 nt, Homo sapiens
cgagagggcggagaaguuc

SEQ ID NO: 1059388 - RNA, 19 nt, Homo sapiens
caugaucagcaacgacauu

SEQ ID NO: 1059389 - RNA, 19 nt, Homo sapiens
cccaugaggccuucgugua

SEQ ID NO: 1059390 - RNA, 19 nt, Homo sapiens
ggacaugaccauuaaauau

SEQ ID NO: 1059391 - RNA, 19 nt, Homo sapiens
uaaagaagaugaaguugga

SEQ ID NO: 1059392 - RNA, 19 nt, Homo sapiens
caccagaguuucucaauga

SEQ ID NO: 1059393 - RNA, 19 nt, Homo sapiens
gaagccaucuccacaggaa

SEQ ID NO: 1059394 - RNA, 19 nt, Homo sapiens
ccagagagcaaacacuuua

SEQ ID NO: 1059395 - RNA, 19 nt, Homo sapiens
gcucuaaccucaaccugaa

SEQ ID NO: 1059396 - RNA, 19 nt, Homo sapiens
acaggaagcucaacuuaau

SEQ ID NO: 1059397 - RNA, 19 nt, Homo sapiens
aaacagauuuccuucaugu

SEQ ID NO: 1059398 - RNA, 19 nt, Homo sapiens
gugaaauucucaugaaaga

SEQ ID NO: 1059399 - RNA, 19 nt, Homo sapiens
ugaagcaguugauaaagaa

SEQ ID NO: 1059400 - RNA, 19 nt, Homo sapiens
gaugaagagugacaaagug

SEQ ID NO: 1059401 - RNA, 19 nt, Homo sapiens
guacgggucucugauagaa

SEQ ID NO: 1059402 - RNA, 19 nt, Homo sapiens
gcuggaggcuggcagauga

SEQ ID NO: 1059403 - RNA, 19 nt, Homo sapiens
ccagggaggucuacaagga

SEQ ID NO: 1059404 - RNA, 19 nt, Homo sapiens
gaucugaagcaguugauaa

SEQ ID NO: 1059405 - RNA, 19 nt, Homo sapiens
caagccaaaucuccuauau

SEQ ID NO: 1059406 - RNA, 19 nt, Homo sapiens
ccacaggaagcucaacuua

SEQ ID NO: 1059407 - RNA, 19 nt, Homo sapiens
gcuagaagaugaagaacca

SEQ ID NO: 1059408 - RNA, 19 nt, Homo sapiens
gagagucccuagagauuca

SEQ ID NO: 1059409 - RNA, 19 nt, Homo sapiens
gaaacuucuuagacucuuu

SEQ ID NO: 1059410 - RNA, 19 nt, Homo sapiens
ccacagccagugaccauua

SEQ ID NO: 1059411 - RNA, 19 nt, Homo sapiens
gaagagagaaaucgacauc

SEQ ID NO: 1059412 - RNA, 19 nt, Homo sapiens
gcuaggagcugggaagaca

SEQ ID NO: 1059413 - RNA, 19 nt, Homo sapiens
ucaaguaccucaccaacca

SEQ ID NO: 1059414 - RNA, 19 nt, Homo sapiens
uggagaagauguugaggaa

SEQ ID NO: 1059415 - RNA, 19 nt, Homo sapiens
uggaggagcuggagaagau

SEQ ID NO: 1059416 - RNA, 19 nt, Homo sapiens
gaaagaagagagaaaucga

SEQ ID NO: 1059417 - RNA, 19 nt, Homo sapiens
ucaaaugcaugaagaagag

SEQ ID NO: 1059418 - RNA, 19 nt, Homo sapiens
gacaucaguuccucacaga

SEQ ID NO: 1059419 - RNA, 19 nt, Homo sapiens
augaagggauugagacuaa

SEQ ID NO: 1059420 - RNA, 19 nt, Homo sapiens
uggacaagaugaagaguga

SEQ ID NO: 1059421 - RNA, 19 nt, Homo sapiens
ccagugaccauuacuuuga

SEQ ID NO: 1059422 - RNA, 19 nt, Homo sapiens
aaguggagaugcucuauug

SEQ ID NO: 1059423 - RNA, 19 nt, Homo sapiens
cuuagacucuuuccacauu

SEQ ID NO: 1059424 - RNA, 19 nt, Homo sapiens
ccaaauccuuuccacuuca

SEQ ID NO: 1059425 - RNA, 19 nt, Homo sapiens
cuuugaagcuuagaaauga

SEQ ID NO: 1059426 - RNA, 19 nt, Homo sapiens
cugaagcaguugauaaaga

SEQ ID NO: 1059427 - RNA, 19 nt, Homo sapiens
cugaggaucugaagcaguu

SEQ ID NO: 1059428 - RNA, 19 nt, Homo sapiens
ggaagaagaaauauuuguc

SEQ ID NO: 1059429 - RNA, 19 nt, Homo sapiens
ugucucuucugaccacuua

SEQ ID NO: 1059430 - RNA, 19 nt, Homo sapiens
ccaccagaguuucucaaug

SEQ ID NO: 1059431 - RNA, 19 nt, Homo sapiens
acauuaugcuuccaacuau

SEQ ID NO: 1059432 - RNA, 19 nt, Homo sapiens
cagguggacaugaccauua

SEQ ID NO: 1059433 - RNA, 19 nt, Homo sapiens
caugucaucuuucaaaugc

SEQ ID NO: 1059434 - RNA, 19 nt, Homo sapiens
gcacacucuuccuuacuag

SEQ ID NO: 1059435 - RNA, 19 nt, Homo sapiens
gcucaucuagaccucuuua

SEQ ID NO: 1059436 - RNA, 19 nt, Homo sapiens
ggcccuaccuggacaagau

SEQ ID NO: 1059437 - RNA, 19 nt, Homo sapiens
ggacugcacacucuuccuu

SEQ ID NO: 1059438 - RNA, 19 nt, Homo sapiens
cagagagucccuagagauu

SEQ ID NO: 1059439 - RNA, 19 nt, Homo sapiens
ugaacuaccucauccaacu

SEQ ID NO: 1059440 - RNA, 19 nt, Homo sapiens
gcagugcucuaaccucaac

SEQ ID NO: 1059441 - RNA, 19 nt, Homo sapiens
uuuaguagcuccugggaau

SEQ ID NO: 1059442 - RNA, 19 nt, Homo sapiens
accauuacuuugaagcuua

SEQ ID NO: 1059443 - RNA, 19 nt, Homo sapiens
gaccauuacuuugaagcuu

SEQ ID NO: 1059444 - RNA, 19 nt, Homo sapiens
gcacuggcuucgcccaagu

SEQ ID NO: 1059445 - RNA, 19 nt, Homo sapiens
gcacaauacaagccaaauc

SEQ ID NO: 1059446 - RNA, 19 nt, Homo sapiens
cuagaccucuuuacugcuu

SEQ ID NO: 1059447 - RNA, 19 nt, Homo sapiens
aauggagucuucuuugguu

SEQ ID NO: 1059448 - RNA, 19 nt, Homo sapiens
gaugagccaugucucuucu

SEQ ID NO: 1059449 - RNA, 19 nt, Homo sapiens
ccucuuuacugcuuuggaa

SEQ ID NO: 1059450 - RNA, 19 nt, Homo sapiens
cagcagccagccuuuagua

SEQ ID NO: 1059451 - RNA, 19 nt, Homo sapiens
gccagcagcucaucuagac

SEQ ID NO: 1059452 - RNA, 19 nt, Homo sapiens
caagaugaagagugacaaa

SEQ ID NO: 1059453 - RNA, 19 nt, Homo sapiens
gcucagcagccagccuuua

SEQ ID NO: 1059454 - RNA, 19 nt, Homo sapiens
ugggagaaguggucaaaca

SEQ ID NO: 1059455 - RNA, 19 nt, Homo sapiens
cuucugaccacuuacauuu

SEQ ID NO: 1059456 - RNA, 19 nt, Homo sapiens
ugagccaugucucuucuga

SEQ ID NO: 1059457 - RNA, 19 nt, Homo sapiens
ugaaggaauugaaguccau

SEQ ID NO: 1059458 - RNA, 19 nt, Homo sapiens
agaagcaucuggaacaacu

SEQ ID NO: 1059459 - RNA, 19 nt, Homo sapiens
ugaagaaccagacuuugug

SEQ ID NO: 1059460 - RNA, 19 nt, Homo sapiens
gccagagagucccuagaga

SEQ ID NO: 1059461 - RNA, 19 nt, Homo sapiens
ccacuuacauuuugaucaa

SEQ ID NO: 1059462 - RNA, 19 nt, Homo sapiens
ggaaagaagagagaaaucg

SEQ ID NO: 1059463 - RNA, 19 nt, Homo sapiens
cacaggaagcucaacuuaa

SEQ ID NO: 1059464 - RNA, 19 nt, Homo sapiens
gggagaaccccacaaaauu

SEQ ID NO: 1059465 - RNA, 19 nt, Homo sapiens
caccaaccaugaaacagau

SEQ ID NO: 1059466 - RNA, 19 nt, Homo sapiens
uggcugcccuccauaggaa

SEQ ID NO: 1059467 - RNA, 19 nt, Homo sapiens
uuacugcuuuggaagaaga

SEQ ID NO: 1059468 - RNA, 19 nt, Homo sapiens
ucaccaaccaugaaacaga

SEQ ID NO: 1059469 - RNA, 19 nt, Homo sapiens
gggagaaguggucaaacaa

SEQ ID NO: 1059470 - RNA, 19 nt, Homo sapiens
gaggcuggcagaugaguug

SEQ ID NO: 1059471 - RNA, 19 nt, Homo sapiens
gagagaaaucgacaucagu

SEQ ID NO: 1059472 - RNA, 19 nt, Homo sapiens
guagucccauuaugucaag

SEQ ID NO: 1059473 - RNA, 19 nt, Homo sapiens
ccuaguagucccauuaugu

SEQ ID NO: 1059474 - RNA, 19 nt, Homo sapiens
ggauugagacuaaaacuau

SEQ ID NO: 1059475 - RNA, 19 nt, Homo sapiens
ugcacacucuuccuuacua

SEQ ID NO: 1059476 - RNA, 19 nt, Homo sapiens
agaugaagaaccagacuuu

SEQ ID NO: 1059477 - RNA, 19 nt, Homo sapiens
caaacacuuuacaguccaa

SEQ ID NO: 1059478 - RNA, 19 nt, Homo sapiens
ccaucuggcuggugaacug

SEQ ID NO: 1059479 - RNA, 19 nt, Homo sapiens
cccaaauccuuuccacuuc

SEQ ID NO: 1059480 - RNA, 19 nt, Homo sapiens
caucuagaccucuuuacug

SEQ ID NO: 1059481 - RNA, 19 nt, Homo sapiens
uuaauggagucuucuuugg

SEQ ID NO: 1059482 - RNA, 19 nt, Homo sapiens
ccagagagucccuagagau

SEQ ID NO: 1059483 - RNA, 19 nt, Homo sapiens
cuucaugucaucuuucaaa

SEQ ID NO: 1059484 - RNA, 19 nt, Homo sapiens
ggagaaguggucaaacaag

SEQ ID NO: 1059485 - RNA, 19 nt, Homo sapiens
gaucccaaagccauugaaa

SEQ ID NO: 1059486 - RNA, 19 nt, Homo sapiens
cagugaccauuacuuugaa

SEQ ID NO: 1059487 - RNA, 19 nt, Homo sapiens
gauaaagaagaugaaguug

SEQ ID NO: 1059488 - RNA, 19 nt, Homo sapiens
aacauuaugcuuccaacua

SEQ ID NO: 1059489 - RNA, 19 nt, Homo sapiens
gccagggacugcacacucu

SEQ ID NO: 1059490 - RNA, 19 nt, Homo sapiens
gagacaagcuguuauguug

SEQ ID NO: 1059491 - RNA, 19 nt, Homo sapiens
gaagcaagcuguccaguca

SEQ ID NO: 1059492 - RNA, 19 nt, Homo sapiens
gaacaucugugucacuuca

SEQ ID NO: 1059493 - RNA, 19 nt, Homo sapiens
gcagaugguacuaauauua

SEQ ID NO: 1059494 - RNA, 19 nt, Homo sapiens
ggacacagccaaaucuuaa

SEQ ID NO: 1059495 - RNA, 19 nt, Homo sapiens
ugaaggaucucaucaguau

SEQ ID NO: 1059496 - RNA, 19 nt, Homo sapiens
uaagauuggugucccauuu

SEQ ID NO: 1059497 - RNA, 19 nt, Homo sapiens
ucaguauccuugagauuua

SEQ ID NO: 1059498 - RNA, 19 nt, Homo sapiens
gcacuuugauucugugaug

SEQ ID NO: 1059499 - RNA, 19 nt, Homo sapiens
gaauaaguuuccagaacaa

SEQ ID NO: 1059500 - RNA, 19 nt, Homo sapiens
uggcaaagcuuuaaguuca

SEQ ID NO: 1059501 - RNA, 19 nt, Homo sapiens
gaauaucacugggcagaug

SEQ ID NO: 1059502 - RNA, 19 nt, Homo sapiens
uagagaaacuuggaucaaa

SEQ ID NO: 1059503 - RNA, 19 nt, Homo sapiens
ugugauaguuuccgaguaa

SEQ ID NO: 1059504 - RNA, 19 nt, Homo sapiens
uaagaguaguguagaaaug

SEQ ID NO: 1059505 - RNA, 19 nt, Homo sapiens
ugaauaaguuuccagaaca

SEQ ID NO: 1059506 - RNA, 19 nt, Homo sapiens
agaacuaucucauugcuau

SEQ ID NO: 1059507 - RNA, 19 nt, Homo sapiens
guuaaccuguagcuuauaa

SEQ ID NO: 1059508 - RNA, 19 nt, Homo sapiens
aacucuagcugucuauuua

SEQ ID NO: 1059509 - RNA, 19 nt, Homo sapiens
gaacacuguggauuucuuu

SEQ ID NO: 1059510 - RNA, 19 nt, Homo sapiens
uauugucucuugagccuua

SEQ ID NO: 1059511 - RNA, 19 nt, Homo sapiens
gggcagaugguacuaauau

SEQ ID NO: 1059512 - RNA, 19 nt, Homo sapiens
aauaaaccaugaaggugua

SEQ ID NO: 1059513 - RNA, 19 nt, Homo sapiens
ggcaaagacuauucuaaag

SEQ ID NO: 1059514 - RNA, 19 nt, Homo sapiens
gauaagagaauggaggaaa

SEQ ID NO: 1059515 - RNA, 19 nt, Homo sapiens
ugaccacucuuguuguuau

SEQ ID NO: 1059516 - RNA, 19 nt, Homo sapiens
ccaugaagguguacacauc

SEQ ID NO: 1059517 - RNA, 19 nt, Homo sapiens
aaucuuaaguacuguguga

SEQ ID NO: 1059518 - RNA, 19 nt, Homo sapiens
gacuagugauacaaacuuu

SEQ ID NO: 1059519 - RNA, 19 nt, Homo sapiens
ggauugcugugaacacugu

SEQ ID NO: 1059520 - RNA, 19 nt, Homo sapiens
ugaggcacaacaaguauua

SEQ ID NO: 1059521 - RNA, 19 nt, Homo sapiens
gaguguauguguuuaaagg

SEQ ID NO: 1059522 - RNA, 19 nt, Homo sapiens
ggaucucaaugaauggauu

SEQ ID NO: 1059523 - RNA, 19 nt, Homo sapiens
aaaccacaauaaaccauga

SEQ ID NO: 1059524 - RNA, 19 nt, Homo sapiens
uggcaaagacuauucuaaa

SEQ ID NO: 1059525 - RNA, 19 nt, Homo sapiens
gaacuucauccuaauaagg

SEQ ID NO: 1059526 - RNA, 19 nt, Homo sapiens
ggagcaaccaaaguuauuu

SEQ ID NO: 1059527 - RNA, 19 nt, Homo sapiens
agaagcaacucuaggaagu

SEQ ID NO: 1059528 - RNA, 19 nt, Homo sapiens
caaauguucugcaccaaaa

SEQ ID NO: 1059529 - RNA, 19 nt, Homo sapiens
gcaaagcuuuaaguucauc

SEQ ID NO: 1059530 - RNA, 19 nt, Homo sapiens
ccacuuggguuuuaucuug

SEQ ID NO: 1059531 - RNA, 19 nt, Homo sapiens
aagguagguuggugugaua

SEQ ID NO: 1059532 - RNA, 19 nt, Homo sapiens
uuaaccagaucaacauguu

SEQ ID NO: 1059533 - RNA, 19 nt, Homo sapiens
uuaguuagcauccacauau

SEQ ID NO: 1059534 - RNA, 19 nt, Homo sapiens
aaagaagaauaucccugaa

SEQ ID NO: 1059535 - RNA, 19 nt, Homo sapiens
guuucaaguuuguauggua

SEQ ID NO: 1059536 - RNA, 19 nt, Homo sapiens
guagguuggugugauaguu

SEQ ID NO: 1059537 - RNA, 19 nt, Homo sapiens
gaagugggaaucugagaca

SEQ ID NO: 1059538 - RNA, 19 nt, Homo sapiens
gcagaagcaacucuaggaa

SEQ ID NO: 1059539 - RNA, 19 nt, Homo sapiens
gugaguguauguguuuaaa

SEQ ID NO: 1059540 - RNA, 19 nt, Homo sapiens
ugagugaguguauguguuu

SEQ ID NO: 1059541 - RNA, 19 nt, Homo sapiens
gggagcaaccaaaguuauu

SEQ ID NO: 1059542 - RNA, 19 nt, Homo sapiens
uagaacaucugugucacuu

SEQ ID NO: 1059543 - RNA, 19 nt, Homo sapiens
agccaaaucuuaaguacug

SEQ ID NO: 1059544 - RNA, 19 nt, Homo sapiens
guuauagacuagugauaca

SEQ ID NO: 1059545 - RNA, 19 nt, Homo sapiens
gaagaauaucccugaagga

SEQ ID NO: 1059546 - RNA, 19 nt, Homo sapiens
ccaaacuggcaaagcuuua

SEQ ID NO: 1059547 - RNA, 19 nt, Homo sapiens
guguauguguuuaaaggaa

SEQ ID NO: 1059548 - RNA, 19 nt, Homo sapiens
gagugaguguauguguuua

SEQ ID NO: 1059549 - RNA, 19 nt, Homo sapiens
gaagguguacacauccuau

SEQ ID NO: 1059550 - RNA, 19 nt, Homo sapiens
ucucauugcuaucuguuau

SEQ ID NO: 1059551 - RNA, 19 nt, Homo sapiens
caaacuggcaaagcuuuaa

SEQ ID NO: 1059552 - RNA, 19 nt, Homo sapiens
gcaaagacuauucuaaagc

SEQ ID NO: 1059553 - RNA, 19 nt, Homo sapiens
ggcagaugguacuaauauu

SEQ ID NO: 1059554 - RNA, 19 nt, Homo sapiens
guacugaggcacaacaagu

SEQ ID NO: 1059555 - RNA, 19 nt, Homo sapiens
gaaacaaaaugggagaaau

SEQ ID NO: 1059556 - RNA, 19 nt, Homo sapiens
gagagugagugaguguaug

SEQ ID NO: 1059557 - RNA, 19 nt, Homo sapiens
ggugggagcaaccaaaguu

SEQ ID NO: 1059558 - RNA, 19 nt, Homo sapiens
aagcgucuguucaggguuu

SEQ ID NO: 1059559 - RNA, 19 nt, Homo sapiens
cacauaucauugaggaauu

SEQ ID NO: 1059560 - RNA, 19 nt, Homo sapiens
ccacauaucauugaggaau

SEQ ID NO: 1059561 - RNA, 19 nt, Homo sapiens
guuguaauaugugaugguu

SEQ ID NO: 1059562 - RNA, 19 nt, Homo sapiens
aaucugagacaagcuguua

SEQ ID NO: 1059563 - RNA, 19 nt, Homo sapiens
aaacucuagcugucuauuu

SEQ ID NO: 1059564 - RNA, 19 nt, Homo sapiens
gugagugaguguauguguu

SEQ ID NO: 1059565 - RNA, 19 nt, Homo sapiens
guguguaucagaaguaauu

SEQ ID NO: 1059566 - RNA, 19 nt, Homo sapiens
ccuaauaacacaaucagau

SEQ ID NO: 1059567 - RNA, 19 nt, Homo sapiens
aguaaacucuagcugucua

SEQ ID NO: 1059568 - RNA, 19 nt, Homo sapiens
cagaucaacauguuauaug

SEQ ID NO: 1059569 - RNA, 19 nt, Homo sapiens
ugaacacuguggauuucuu

SEQ ID NO: 1059570 - RNA, 19 nt, Homo sapiens
guguacacauccuauaaca

SEQ ID NO: 1059571 - RNA, 19 nt, Homo sapiens
ggauggucuuccaggcuuu

SEQ ID NO: 1059572 - RNA, 19 nt, Homo sapiens
ugguuaaccuguagcuuau

SEQ ID NO: 1059573 - RNA, 19 nt, Homo sapiens
uaucacauagucauacuug

SEQ ID NO: 1059574 - RNA, 19 nt, Homo sapiens
caccucaacaccuccuuua

SEQ ID NO: 1059575 - RNA, 19 nt, Homo sapiens
ucaaauguucugcaccaaa

SEQ ID NO: 1059576 - RNA, 19 nt, Homo sapiens
gaucaacauguuauaugga

SEQ ID NO: 1059577 - RNA, 19 nt, Homo sapiens
gccugugucuacugauaaa

SEQ ID NO: 1059578 - RNA, 19 nt, Homo sapiens
ugcuagaacuaucucauug

SEQ ID NO: 1059579 - RNA, 19 nt, Homo sapiens
ugagacaagcuguuauguu

SEQ ID NO: 1059580 - RNA, 19 nt, Homo sapiens
gcuuuaaguucaucagcau

SEQ ID NO: 1059581 - RNA, 19 nt, Homo sapiens
guuaagaguaguguagaaa

SEQ ID NO: 1059582 - RNA, 19 nt, Homo sapiens
ugugaccacucuuguuguu

SEQ ID NO: 1059583 - RNA, 19 nt, Homo sapiens
aaagguagguuggugugau

SEQ ID NO: 1059584 - RNA, 19 nt, Homo sapiens
acacuguggauuucuuuaa

SEQ ID NO: 1059585 - RNA, 19 nt, Homo sapiens
uggaagacuugccaaacug

SEQ ID NO: 1059586 - RNA, 19 nt, Homo sapiens
ggugugcuaccuauucuug

SEQ ID NO: 1059587 - RNA, 19 nt, Homo sapiens
guagaaaugcaugaacuuc

SEQ ID NO: 1059588 - RNA, 19 nt, Homo sapiens
ggauuucuuuaaccagauc

SEQ ID NO: 1059589 - RNA, 19 nt, Homo sapiens
cagcagccgcucuucuaaa

SEQ ID NO: 1059590 - RNA, 19 nt, Homo sapiens
guaaagaucuggaauauga

SEQ ID NO: 1059591 - RNA, 19 nt, Homo sapiens
gcaaauagauugucugaau

SEQ ID NO: 1059592 - RNA, 19 nt, Homo sapiens
caacugagcaggcauauua

SEQ ID NO: 1059593 - RNA, 19 nt, Homo sapiens
gaaaggaucuuaaguacca

SEQ ID NO: 1059594 - RNA, 19 nt, Homo sapiens
gaugugauccgccuuauua

SEQ ID NO: 1059595 - RNA, 19 nt, Homo sapiens
gaaagcauguacuuaaaug

SEQ ID NO: 1059596 - RNA, 19 nt, Homo sapiens
ggacagauauuaccgucaa

SEQ ID NO: 1059597 - RNA, 19 nt, Homo sapiens
gagcaggcauauuaaguuu

SEQ ID NO: 1059598 - RNA, 19 nt, Homo sapiens
caagauggacauuacauua

SEQ ID NO: 1059599 - RNA, 19 nt, Homo sapiens
ggccauuccuccuuuguua

SEQ ID NO: 1059600 - RNA, 19 nt, Homo sapiens
ucaaagauguggaagaaga

SEQ ID NO: 1059601 - RNA, 19 nt, Homo sapiens
cagcagagauacagaaaug

SEQ ID NO: 1059602 - RNA, 19 nt, Homo sapiens
caaggcagcugucaaagau

SEQ ID NO: 1059603 - RNA, 19 nt, Homo sapiens
gcacaucacccucaucaga

SEQ ID NO: 1059604 - RNA, 19 nt, Homo sapiens
ggaaaacccugaaggaauu

SEQ ID NO: 1059605 - RNA, 19 nt, Homo sapiens
gaagcaacauuuacacaag

SEQ ID NO: 1059606 - RNA, 19 nt, Homo sapiens
uaaaucagcucgaaagcau

SEQ ID NO: 1059607 - RNA, 19 nt, Homo sapiens
ucagaaaggaucuuaagua

SEQ ID NO: 1059608 - RNA, 19 nt, Homo sapiens
gaaaucacauguggagugu

SEQ ID NO: 1059609 - RNA, 19 nt, Homo sapiens
ugauagagcuccgugaauu

SEQ ID NO: 1059610 - RNA, 19 nt, Homo sapiens
ggacaauguuuaaggagau

SEQ ID NO: 1059611 - RNA, 19 nt, Homo sapiens
guauggaacuuuacuacug

SEQ ID NO: 1059612 - RNA, 19 nt, Homo sapiens
aaacacagccagagcgaua

SEQ ID NO: 1059613 - RNA, 19 nt, Homo sapiens
caucagaacccgauugcua

SEQ ID NO: 1059614 - RNA, 19 nt, Homo sapiens
gugaauggaucuacugugu

SEQ ID NO: 1059615 - RNA, 19 nt, Homo sapiens
ggacauuacauuauuagug

SEQ ID NO: 1059616 - RNA, 19 nt, Homo sapiens
cagaaaggaucuuaaguac

SEQ ID NO: 1059617 - RNA, 19 nt, Homo sapiens
gcagagauacagaaauguu

SEQ ID NO: 1059618 - RNA, 19 nt, Homo sapiens
ugucaaagauguggaagaa

SEQ ID NO: 1059619 - RNA, 19 nt, Homo sapiens
ggccuuagcuggcgaaguc

SEQ ID NO: 1059620 - RNA, 19 nt, Homo sapiens
agaaggaugugauugguau

SEQ ID NO: 1059621 - RNA, 19 nt, Homo sapiens
gcaggcauauuaaguuugg

SEQ ID NO: 1059622 - RNA, 19 nt, Homo sapiens
gcaaggcagcugucaaaga

SEQ ID NO: 1059623 - RNA, 19 nt, Homo sapiens
gaagcauauucauguaaug

SEQ ID NO: 1059624 - RNA, 19 nt, Homo sapiens
gcuauacagucucugaaau

SEQ ID NO: 1059625 - RNA, 19 nt, Homo sapiens
ucgaaagcauguacuuaaa

SEQ ID NO: 1059626 - RNA, 19 nt, Homo sapiens
gaacuuuacuacuggaaaa

SEQ ID NO: 1059627 - RNA, 19 nt, Homo sapiens
gauagcagucagauccuua

SEQ ID NO: 1059628 - RNA, 19 nt, Homo sapiens
uagauugucugaauuaguc

SEQ ID NO: 1059629 - RNA, 19 nt, Homo sapiens
gaagauggacuccuaaagc

SEQ ID NO: 1059630 - RNA, 19 nt, Homo sapiens
cauauuaaguuuggucaga

SEQ ID NO: 1059631 - RNA, 19 nt, Homo sapiens
cagugaagauggacuccua

SEQ ID NO: 1059632 - RNA, 19 nt, Homo sapiens
ggccaggucuuacuuugau

SEQ ID NO: 1059633 - RNA, 19 nt, Homo sapiens
ccagagcgauauauucauc

SEQ ID NO: 1059634 - RNA, 19 nt, Homo sapiens
cuaaagcucuggaaaccau

SEQ ID NO: 1059635 - RNA, 19 nt, Homo sapiens
gcacgagaaggaugugauu

SEQ ID NO: 1059636 - RNA, 19 nt, Homo sapiens
cagagauacagaaauguua

SEQ ID NO: 1059637 - RNA, 19 nt, Homo sapiens
uaacgaagcaacauuuaca

SEQ ID NO: 1059638 - RNA, 19 nt, Homo sapiens
gggaggacuuugugcucua

SEQ ID NO: 1059639 - RNA, 19 nt, Homo sapiens
gauggaaguagcaaagaaa

SEQ ID NO: 1059640 - RNA, 19 nt, Homo sapiens
uauacagucucugaaauug

SEQ ID NO: 1059641 - RNA, 19 nt, Homo sapiens
gcucgaaagcauguacuua

SEQ ID NO: 1059642 - RNA, 19 nt, Homo sapiens
gagaaggaugugauuggua

SEQ ID NO: 1059643 - RNA, 19 nt, Homo sapiens
gaagaccacagaauguuca

SEQ ID NO: 1059644 - RNA, 19 nt, Homo sapiens
caucucgucucauggcauu

SEQ ID NO: 1059645 - RNA, 19 nt, Homo sapiens
uaaguuuggucagaaauca

SEQ ID NO: 1059646 - RNA, 19 nt, Homo sapiens
gauagagcuccgugaauug

SEQ ID NO: 1059647 - RNA, 19 nt, Homo sapiens
caaacacgguggucaucau

SEQ ID NO: 1059648 - RNA, 19 nt, Homo sapiens
guuaacgaagcaacauuua

SEQ ID NO: 1059649 - RNA, 19 nt, Homo sapiens
cagaguggacaauguuuaa

SEQ ID NO: 1059650 - RNA, 19 nt, Homo sapiens
ggagagauacggcuauguc

SEQ ID NO: 1059651 - RNA, 19 nt, Homo sapiens
aaagagaagagcagcaauu

SEQ ID NO: 1059652 - RNA, 19 nt, Homo sapiens
ggaauaugaagaccacaga

SEQ ID NO: 1059653 - RNA, 19 nt, Homo sapiens
ccauugggauacuguguug

SEQ ID NO: 1059654 - RNA, 19 nt, Homo sapiens
caguuuacaucgggcguua

SEQ ID NO: 1059655 - RNA, 19 nt, Homo sapiens
gaccacagaauguucaaau

SEQ ID NO: 1059656 - RNA, 19 nt, Homo sapiens
aagcaacauuuacacaaga

SEQ ID NO: 1059657 - RNA, 19 nt, Homo sapiens
gauauauucaucuggagaa

SEQ ID NO: 1059658 - RNA, 19 nt, Homo sapiens
gacaauguuuaaggagauu

SEQ ID NO: 1059659 - RNA, 19 nt, Homo sapiens
ucagaguggacaauguuua

SEQ ID NO: 1059660 - RNA, 19 nt, Homo sapiens
gagauacggcuaugucgau

SEQ ID NO: 1059661 - RNA, 19 nt, Homo sapiens
gcaaacuggagagaacuuu

SEQ ID NO: 1059662 - RNA, 19 nt, Homo sapiens
ccacagaauguucaaauac

SEQ ID NO: 1059663 - RNA, 19 nt, Homo sapiens
cuguaaagaucuggaauau

SEQ ID NO: 1059664 - RNA, 19 nt, Homo sapiens
gcagcagcaucagggauug

SEQ ID NO: 1059665 - RNA, 19 nt, Homo sapiens
cgaaagcauguacuuaaau

SEQ ID NO: 1059666 - RNA, 19 nt, Homo sapiens
aagcuucaguucugguaaa

SEQ ID NO: 1059667 - RNA, 19 nt, Homo sapiens
gaauaugaagaccacagaa

SEQ ID NO: 1059668 - RNA, 19 nt, Homo sapiens
cgaagcaacauuuacacaa

SEQ ID NO: 1059669 - RNA, 19 nt, Homo sapiens
ugucaccugucuaagcuuu

SEQ ID NO: 1059670 - RNA, 19 nt, Homo sapiens
gauucagaguggacaaugu

SEQ ID NO: 1059671 - RNA, 19 nt, Homo sapiens
acuacugugucucugaaua

SEQ ID NO: 1059672 - RNA, 19 nt, Homo sapiens
cgucaacagugugauucua

SEQ ID NO: 1059673 - RNA, 19 nt, Homo sapiens
ugauggcacuguaaagauc

SEQ ID NO: 1059674 - RNA, 19 nt, Homo sapiens
acagaaauguuagcaacug

SEQ ID NO: 1059675 - RNA, 19 nt, Homo sapiens
caaagauguggaagaagaa

SEQ ID NO: 1059676 - RNA, 19 nt, Homo sapiens
agauggaaguagcaaagaa

SEQ ID NO: 1059677 - RNA, 19 nt, Homo sapiens
gaaggagaacaguuuacau

SEQ ID NO: 1059678 - RNA, 19 nt, Homo sapiens
accacagaauguucaaaua

SEQ ID NO: 1059679 - RNA, 19 nt, Homo sapiens
uuacacaagauggacauua

SEQ ID NO: 1059680 - RNA, 19 nt, Homo sapiens
ggaacuuuacuacuggaaa

SEQ ID NO: 1059681 - RNA, 19 nt, Homo sapiens
uggacagcauugagaguuu

SEQ ID NO: 1059682 - RNA, 19 nt, Homo sapiens
cuauacagucucugaaauu

SEQ ID NO: 1059683 - RNA, 19 nt, Homo sapiens
agaacccgauugcuaccua

SEQ ID NO: 1059684 - RNA, 19 nt, Homo sapiens
aaacuggagagaacuuuga

SEQ ID NO: 1059685 - RNA, 19 nt, Homo sapiens
gaucaaacacgguggucau

SEQ ID NO: 1059686 - RNA, 19 nt, Homo sapiens
gcuguccucugcauguguu

SEQ ID NO: 1059687 - RNA, 19 nt, Homo sapiens
uguggagugugcucgauuu

SEQ ID NO: 1059688 - RNA, 19 nt, Homo sapiens
ugacagugcacgagaagga

SEQ ID NO: 1059689 - RNA, 19 nt, Homo sapiens
gcacuguaaagaucuggaa

SEQ ID NO: 1059690 - RNA, 19 nt, Homo sapiens
ggaaaucgaugaugcauug

SEQ ID NO: 1059691 - RNA, 19 nt, Homo sapiens
ccacagaacuggaaccaua

SEQ ID NO: 1059692 - RNA, 19 nt, Homo sapiens
caaaguaacugguggcuau

SEQ ID NO: 1059693 - RNA, 19 nt, Homo sapiens
gaagaacuguugaaacuag

SEQ ID NO: 1059694 - RNA, 19 nt, Homo sapiens
gcagaugcccucuugaaua

SEQ ID NO: 1059695 - RNA, 19 nt, Homo sapiens
gagauaaguuugaaaguuc

SEQ ID NO: 1059696 - RNA, 19 nt, Homo sapiens
gaaacuagcaacaucuaua

SEQ ID NO: 1059697 - RNA, 19 nt, Homo sapiens
ccaacaagauucagaagaa

SEQ ID NO: 1059698 - RNA, 19 nt, Homo sapiens
gcgcauagcugguaaaauu

SEQ ID NO: 1059699 - RNA, 19 nt, Homo sapiens
gaccacagaucucuccuuu

SEQ ID NO: 1059700 - RNA, 19 nt, Homo sapiens
ggaaccaacuucuuucuca

SEQ ID NO: 1059701 - RNA, 19 nt, Homo sapiens
uaacuuagccauuccaauu

SEQ ID NO: 1059702 - RNA, 19 nt, Homo sapiens
caucacagcugcaucaaau

SEQ ID NO: 1059703 - RNA, 19 nt, Homo sapiens
gaagagaagccugauguaa

SEQ ID NO: 1059704 - RNA, 19 nt, Homo sapiens
acacauagauuucaucaca

SEQ ID NO: 1059705 - RNA, 19 nt, Homo sapiens
gcauagcuguccaaguuaa

SEQ ID NO: 1059706 - RNA, 19 nt, Homo sapiens
gcaagcaaauccuggcauu

SEQ ID NO: 1059707 - RNA, 19 nt, Homo sapiens
gcaguuacaauucaugaua

SEQ ID NO: 1059708 - RNA, 19 nt, Homo sapiens
agauagauaugaugccuua

SEQ ID NO: 1059709 - RNA, 19 nt, Homo sapiens
gcaaauccuggcauuguua

SEQ ID NO: 1059710 - RNA, 19 nt, Homo sapiens
ggaauuuggucaagguuau

SEQ ID NO: 1059711 - RNA, 19 nt, Homo sapiens
cagaugcccucuugaauau

SEQ ID NO: 1059712 - RNA, 19 nt, Homo sapiens
aggcauagcuguccaaguu

SEQ ID NO: 1059713 - RNA, 19 nt, Homo sapiens
cagaagaacuguugaaacu

SEQ ID NO: 1059714 - RNA, 19 nt, Homo sapiens
ugauuucggugaugaauuu

SEQ ID NO: 1059715 - RNA, 19 nt, Homo sapiens
gaagcuguacuuaaacaua

SEQ ID NO: 1059716 - RNA, 19 nt, Homo sapiens
uaaaugcagucaaagagaa

SEQ ID NO: 1059717 - RNA, 19 nt, Homo sapiens
gcaaaucuaaggccucuuu

SEQ ID NO: 1059718 - RNA, 19 nt, Homo sapiens
gauagagaaauccaacuua

SEQ ID NO: 1059719 - RNA, 19 nt, Homo sapiens
gauccugacuugauagaga

SEQ ID NO: 1059720 - RNA, 19 nt, Homo sapiens
ggaaugacagguuuaaaug

SEQ ID NO: 1059721 - RNA, 19 nt, Homo sapiens
gaauucaagccuuccaaua

SEQ ID NO: 1059722 - RNA, 19 nt, Homo sapiens
gcagaagaccuagaaauug

SEQ ID NO: 1059723 - RNA, 19 nt, Homo sapiens
ccaauaagguuguucaaac

SEQ ID NO: 1059724 - RNA, 19 nt, Homo sapiens
ggacuggcagcacaaauaa

SEQ ID NO: 1059725 - RNA, 19 nt, Homo sapiens
ggacaauuccuaacauuuc

SEQ ID NO: 1059726 - RNA, 19 nt, Homo sapiens
agaagaagaucaaugacuu

SEQ ID NO: 1059727 - RNA, 19 nt, Homo sapiens
ggcugaagcuguacuuaaa

SEQ ID NO: 1059728 - RNA, 19 nt, Homo sapiens
cagcagauauuguugaauc

SEQ ID NO: 1059729 - RNA, 19 nt, Homo sapiens
gaagaagaucaaugacuuu

SEQ ID NO: 1059730 - RNA, 19 nt, Homo sapiens
cgacagagguacguucuug

SEQ ID NO: 1059731 - RNA, 19 nt, Homo sapiens
ugauggagaugaagauuug

SEQ ID NO: 1059732 - RNA, 19 nt, Homo sapiens
gggacacacugaaguuauu

SEQ ID NO: 1059733 - RNA, 19 nt, Homo sapiens
cuuaagagcuugcauugga

SEQ ID NO: 1059734 - RNA, 19 nt, Homo sapiens
agagaagccugauguaaau

SEQ ID NO: 1059735 - RNA, 19 nt, Homo sapiens
cauccaaagugccuuauug

SEQ ID NO: 1059736 - RNA, 19 nt, Homo sapiens
ugaggcaccuuuagagauu

SEQ ID NO: 1059737 - RNA, 19 nt, Homo sapiens
ggugaugaauuugaaguuu

SEQ ID NO: 1059738 - RNA, 19 nt, Homo sapiens
gcuauccauuugaaguuua

SEQ ID NO: 1059739 - RNA, 19 nt, Homo sapiens
gaugaugcauuguauaguc

SEQ ID NO: 1059740 - RNA, 19 nt, Homo sapiens
aaagagaaguauggaauug

SEQ ID NO: 1059741 - RNA, 19 nt, Homo sapiens
ccauaaggcucuucagcuu

SEQ ID NO: 1059742 - RNA, 19 nt, Homo sapiens
ccacugagaccauuuacaa

SEQ ID NO: 1059743 - RNA, 19 nt, Homo sapiens
uugcagaacuaaauccaua

SEQ ID NO: 1059744 - RNA, 19 nt, Homo sapiens
cagaagaccuagaaauugg

SEQ ID NO: 1059745 - RNA, 19 nt, Homo sapiens
gcacuaagggacacacuga

SEQ ID NO: 1059746 - RNA, 19 nt, Homo sapiens
aaacauaacgcaagcaaau

SEQ ID NO: 1059747 - RNA, 19 nt, Homo sapiens
ucucagugcccuccaauua

SEQ ID NO: 1059748 - RNA, 19 nt, Homo sapiens
gauuaaggcaguuacaauu

SEQ ID NO: 1059749 - RNA, 19 nt, Homo sapiens
uggcagugcuuucauuuga

SEQ ID NO: 1059750 - RNA, 19 nt, Homo sapiens
gaaauuggucccagugugu

SEQ ID NO: 1059751 - RNA, 19 nt, Homo sapiens
cguagacagucguugcuua

SEQ ID NO: 1059752 - RNA, 19 nt, Homo sapiens
cauaggcugugaaauguug

SEQ ID NO: 1059753 - RNA, 19 nt, Homo sapiens
uaaauaccaguguguagua

SEQ ID NO: 1059754 - RNA, 19 nt, Homo sapiens
gucccaguguguagaauua

SEQ ID NO: 1059755 - RNA, 19 nt, Homo sapiens
gggacuggcagcacaaaua

SEQ ID NO: 1059756 - RNA, 19 nt, Homo sapiens
gaacuggaaccauauuuac

SEQ ID NO: 1059757 - RNA, 19 nt, Homo sapiens
caacuucuuucucagugaa

SEQ ID NO: 1059758 - RNA, 19 nt, Homo sapiens
ggucuugguuuggaaauug

SEQ ID NO: 1059759 - RNA, 19 nt, Homo sapiens
gccgggaccuccaguaaga

SEQ ID NO: 1059760 - RNA, 19 nt, Homo sapiens
agacauugauggagaugaa

SEQ ID NO: 1059761 - RNA, 19 nt, Homo sapiens
ggaagagaagccugaugua

SEQ ID NO: 1059762 - RNA, 19 nt, Homo sapiens
uuaauggaaugacagguuu

SEQ ID NO: 1059763 - RNA, 19 nt, Homo sapiens
agaaauauguggaucuuac

SEQ ID NO: 1059764 - RNA, 19 nt, Homo sapiens
gaugagaggaaugcaauuu

SEQ ID NO: 1059765 - RNA, 19 nt, Homo sapiens
agaugaaacugcaaggaaa

SEQ ID NO: 1059766 - RNA, 19 nt, Homo sapiens
gaugcccucuugaauauuc

SEQ ID NO: 1059767 - RNA, 19 nt, Homo sapiens
gcagauguacauggaauuu

SEQ ID NO: 1059768 - RNA, 19 nt, Homo sapiens
gauacuacuucagucauga

SEQ ID NO: 1059769 - RNA, 19 nt, Homo sapiens
caaagagaaguauggaauu

SEQ ID NO: 1059770 - RNA, 19 nt, Homo sapiens
caaagcgcauagcugguaa

SEQ ID NO: 1059771 - RNA, 19 nt, Homo sapiens
ggcaagagauaaguuugaa

SEQ ID NO: 1059772 - RNA, 19 nt, Homo sapiens
caaccacugagaccauuua

SEQ ID NO: 1059773 - RNA, 19 nt, Homo sapiens
gaaaggaaugauuacaguu

SEQ ID NO: 1059774 - RNA, 19 nt, Homo sapiens
gccauaggcugugaaaugu

SEQ ID NO: 1059775 - RNA, 19 nt, Homo sapiens
uagauaugaugccuuaaga

SEQ ID NO: 1059776 - RNA, 19 nt, Homo sapiens
gggaagaggcguccuguuc

SEQ ID NO: 1059777 - RNA, 19 nt, Homo sapiens
caacaaauaacggugauau

SEQ ID NO: 1059778 - RNA, 19 nt, Homo sapiens
agaacuaaauccauacguu

SEQ ID NO: 1059779 - RNA, 19 nt, Homo sapiens
cagugaagaugauguuguu

SEQ ID NO: 1059780 - RNA, 19 nt, Homo sapiens
cuauucaucugcagaagaa

SEQ ID NO: 1059781 - RNA, 19 nt, Homo sapiens
gaaguuauuguaccgcauu

SEQ ID NO: 1059782 - RNA, 19 nt, Homo sapiens
uacagauccugacuugaua

SEQ ID NO: 1059783 - RNA, 19 nt, Homo sapiens
caaagagaaaggaaugauu

SEQ ID NO: 1059784 - RNA, 19 nt, Homo sapiens
gucagaaacugcaaaauuu

SEQ ID NO: 1059785 - RNA, 19 nt, Homo sapiens
aggcaaaccugaaugugaa

SEQ ID NO: 1059786 - RNA, 19 nt, Homo sapiens
gggcugaagcuguacuuaa

SEQ ID NO: 1059787 - RNA, 19 nt, Homo sapiens
acacagcaaugcagaagau

SEQ ID NO: 1059788 - RNA, 19 nt, Homo sapiens
uuacuuagcagaagaccua

SEQ ID NO: 1059789 - RNA, 19 nt, Homo sapiens
agaaaggaaugauuacagu

SEQ ID NO: 1059790 - RNA, 19 nt, Homo sapiens
ggacagagaaugccagaaa

SEQ ID NO: 1059791 - RNA, 19 nt, Homo sapiens
ccaaagaaauaaagugaug

SEQ ID NO: 1059792 - RNA, 19 nt, Homo sapiens
gcagggauguauagaaaga

SEQ ID NO: 1059793 - RNA, 19 nt, Homo sapiens
cagcagggauguauagaaa

SEQ ID NO: 1059794 - RNA, 19 nt, Homo sapiens
ggaguucagugcccucuuu

SEQ ID NO: 1059795 - RNA, 19 nt, Homo sapiens
gauauccucuuucguuguu

SEQ ID NO: 1059796 - RNA, 19 nt, Homo sapiens
gaacauuaggcucgaauau

SEQ ID NO: 1059797 - RNA, 19 nt, Homo sapiens
gaaacugguucuggaguga

SEQ ID NO: 1059798 - RNA, 19 nt, Homo sapiens
aaccacagcuggccucuaa

SEQ ID NO: 1059799 - RNA, 19 nt, Homo sapiens
gcuuaugccuguaauccua

SEQ ID NO: 1059800 - RNA, 19 nt, Homo sapiens
gaacaucuacuccaucuac

SEQ ID NO: 1059801 - RNA, 19 nt, Homo sapiens
ggaggcccaucuucaguga

SEQ ID NO: 1059802 - RNA, 19 nt, Homo sapiens
ggagaugcaggcucuguuu

SEQ ID NO: 1059803 - RNA, 19 nt, Homo sapiens
gcagaacguuaucuucagu

SEQ ID NO: 1059804 - RNA, 19 nt, Homo sapiens
guuguuugcuggucauauu

SEQ ID NO: 1059805 - RNA, 19 nt, Homo sapiens
caucuggucucccguagga

SEQ ID NO: 1059806 - RNA, 19 nt, Homo sapiens
cagcuacucucaccucugu

SEQ ID NO: 1059807 - RNA, 19 nt, Homo sapiens
gacagagaaugccagaaau

SEQ ID NO: 1059808 - RNA, 19 nt, Homo sapiens
ggaagcgagcccucuauga

SEQ ID NO: 1059809 - RNA, 19 nt, Homo sapiens
gcaggaggcugaggagaag

SEQ ID NO: 1059810 - RNA, 19 nt, Homo sapiens
agacugaauuugccuuguu

SEQ ID NO: 1059811 - RNA, 19 nt, Homo sapiens
ccaagagcuuucccuccua

SEQ ID NO: 1059812 - RNA, 19 nt, Homo sapiens
ccagaggccuguccaaacu

SEQ ID NO: 1059813 - RNA, 19 nt, Homo sapiens
gcaucucacgguccacuua

SEQ ID NO: 1059814 - RNA, 19 nt, Homo sapiens
gaacacacugguacccuau

SEQ ID NO: 1059815 - RNA, 19 nt, Homo sapiens
gcaggugggagacugaauu

SEQ ID NO: 1059816 - RNA, 19 nt, Homo sapiens
gggcagaacguuaucuuca

SEQ ID NO: 1059817 - RNA, 19 nt, Homo sapiens
gagccuguauccagaagau

SEQ ID NO: 1059818 - RNA, 19 nt, Homo sapiens
gaagguggagcgagaagug

SEQ ID NO: 1059819 - RNA, 19 nt, Homo sapiens
gaccucaucucuuagaaaa

SEQ ID NO: 1059820 - RNA, 19 nt, Homo sapiens
acauuaggcucgaauaugg

SEQ ID NO: 1059821 - RNA, 19 nt, Homo sapiens
ccaaggguauauuuguguu

SEQ ID NO: 1059822 - RNA, 19 nt, Homo sapiens
ccugucaccuucugccuuu

SEQ ID NO: 1059823 - RNA, 19 nt, Homo sapiens
cagcuggccucuaaaggau

SEQ ID NO: 1059824 - RNA, 19 nt, Homo sapiens
ggaguuggaagccguaugu

SEQ ID NO: 1059825 - RNA, 19 nt, Homo sapiens
ucacugcccgcuccacaua

SEQ ID NO: 1059826 - RNA, 19 nt, Homo sapiens
agaacguuaucuucaguuu

SEQ ID NO: 1059827 - RNA, 19 nt, Homo sapiens
ucucacgguccacuuauua

SEQ ID NO: 1059828 - RNA, 19 nt, Homo sapiens
gaucgacuccaaagugaug

SEQ ID NO: 1059829 - RNA, 19 nt, Homo sapiens
guucgagaguaacguuuga

SEQ ID NO: 1059830 - RNA, 19 nt, Homo sapiens
gcacugaggcaccggagau

SEQ ID NO: 1059831 - RNA, 19 nt, Homo sapiens
ggaacauuaggcucgaaua

SEQ ID NO: 1059832 - RNA, 19 nt, Homo sapiens
ccucuuuacucaguuguuu

SEQ ID NO: 1059833 - RNA, 19 nt, Homo sapiens
gaagcgagcccucuaugac

SEQ ID NO: 1059834 - RNA, 19 nt, Homo sapiens
ucacgguccacuuauuaua

SEQ ID NO: 1059835 - RNA, 19 nt, Homo sapiens
gcauggaggagcuagagaa

SEQ ID NO: 1059836 - RNA, 19 nt, Homo sapiens
gcagcagggauguauagaa

SEQ ID NO: 1059837 - RNA, 19 nt, Homo sapiens
ccacugggcagaacguuau

SEQ ID NO: 1059838 - RNA, 19 nt, Homo sapiens
caaaaggaguguuauagca

SEQ ID NO: 1059839 - RNA, 19 nt, Homo sapiens
ggagacaaaaggaguguua

SEQ ID NO: 1059840 - RNA, 19 nt, Homo sapiens
gaaacugugggaccagaga

SEQ ID NO: 1059841 - RNA, 19 nt, Homo sapiens
caaggguauauuuguguua

SEQ ID NO: 1059842 - RNA, 19 nt, Homo sapiens
uaaguccaaggguauauuu

SEQ ID NO: 1059843 - RNA, 19 nt, Homo sapiens
gaagaugcuccacggaaca

SEQ ID NO: 1059844 - RNA, 19 nt, Homo sapiens
gggucacacuccaggauga

SEQ ID NO: 1059845 - RNA, 19 nt, Homo sapiens
gaacguuaucuucaguuuc

SEQ ID NO: 1059846 - RNA, 19 nt, Homo sapiens
guuggaagccguauguaug

SEQ ID NO: 1059847 - RNA, 19 nt, Homo sapiens
ggaagagugaggcggaaga

SEQ ID NO: 1059848 - RNA, 19 nt, Homo sapiens
gcccuggaauggucuuaau

SEQ ID NO: 1059849 - RNA, 19 nt, Homo sapiens
gaaccuggccucagcuacu

SEQ ID NO: 1059850 - RNA, 19 nt, Homo sapiens
gacugaauuugccuuguuc

SEQ ID NO: 1059851 - RNA, 19 nt, Homo sapiens
ggaguguuauagcaugauc

SEQ ID NO: 1059852 - RNA, 19 nt, Homo sapiens
ugagugggcaucucccuuu

SEQ ID NO: 1059853 - RNA, 19 nt, Homo sapiens
ucaguuguuucccaaagga

SEQ ID NO: 1059854 - RNA, 19 nt, Homo sapiens
uguaugcucucgccucugu

SEQ ID NO: 1059855 - RNA, 19 nt, Homo sapiens
caugaucgacuccaaagug

SEQ ID NO: 1059856 - RNA, 19 nt, Homo sapiens
guccaaggguauauuugug

SEQ ID NO: 1059857 - RNA, 19 nt, Homo sapiens
ggcaggaggcugaggagaa

SEQ ID NO: 1059858 - RNA, 19 nt, Homo sapiens
aguuguaccuggagcauug

SEQ ID NO: 1059859 - RNA, 19 nt, Homo sapiens
cggaacaucuacuccaucu

SEQ ID NO: 1059860 - RNA, 19 nt, Homo sapiens
gcuacucccuaugcucuga

SEQ ID NO: 1059861 - RNA, 19 nt, Homo sapiens
ggcauccucuuuacucagu

SEQ ID NO: 1059862 - RNA, 19 nt, Homo sapiens
cgucaaggccuccuguuuc

SEQ ID NO: 1059863 - RNA, 19 nt, Homo sapiens
gcagcagcagggauguaua

SEQ ID NO: 1059864 - RNA, 19 nt, Homo sapiens
ggccaaggcaggaggauca

SEQ ID NO: 1059865 - RNA, 19 nt, Homo sapiens
cacagugucuacccuaagu

SEQ ID NO: 1059866 - RNA, 19 nt, Homo sapiens
ccacagggugacuuaaaug

SEQ ID NO: 1059867 - RNA, 19 nt, Homo sapiens
ggaugugacagcugugaug

SEQ ID NO: 1059868 - RNA, 19 nt, Homo sapiens
gccgugcgcuacucccuau

SEQ ID NO: 1059869 - RNA, 19 nt, Homo sapiens
aacguuaucuucaguuucu

SEQ ID NO: 1059870 - RNA, 19 nt, Homo sapiens
gguccugucuuccuucacu

SEQ ID NO: 1059871 - RNA, 19 nt, Homo sapiens
ggaagccguauguauguca

SEQ ID NO: 1059872 - RNA, 19 nt, Homo sapiens
gagaugcaggcucuguuug

SEQ ID NO: 1059873 - RNA, 19 nt, Homo sapiens
gggcaugaucgacuccaaa

SEQ ID NO: 1059874 - RNA, 19 nt, Homo sapiens
cagagaaugccagaaauca

SEQ ID NO: 1059875 - RNA, 19 nt, Homo sapiens
caaccuacuaugucuggaa

SEQ ID NO: 1059876 - RNA, 19 nt, Homo sapiens
gagacugaauuugccuugu

SEQ ID NO: 1059877 - RNA, 19 nt, Homo sapiens
gagcagcagcagggaugua

SEQ ID NO: 1059878 - RNA, 19 nt, Homo sapiens
gagugggcaucucccuuuc

SEQ ID NO: 1059879 - RNA, 19 nt, Homo sapiens
cccacagggugacuuaaau

SEQ ID NO: 1059880 - RNA, 19 nt, Homo sapiens
caggugggagacugaauuu

SEQ ID NO: 1059881 - RNA, 19 nt, Homo sapiens
ggcagaacguuaucuucag

SEQ ID NO: 1059882 - RNA, 19 nt, Homo sapiens
gcccagaggccuguccaaa

SEQ ID NO: 1059883 - RNA, 19 nt, Homo sapiens
ccugggcaauguagugaga

SEQ ID NO: 1059884 - RNA, 19 nt, Homo sapiens
cacuugaggcuaggaguua

SEQ ID NO: 1059885 - RNA, 19 nt, Homo sapiens
gagcuuucccuccuacaag

SEQ ID NO: 1059886 - RNA, 19 nt, Homo sapiens
gccggaugcuggugaugga

SEQ ID NO: 1059887 - RNA, 19 nt, Homo sapiens
ccacagcuggccucuaaag

SEQ ID NO: 1059888 - RNA, 19 nt, Homo sapiens
gaaccacagcuggccucua

SEQ ID NO: 1059889 - RNA, 19 nt, Homo sapiens
cagcagcagggauguauag

SEQ ID NO: 1059890 - RNA, 19 nt, Homo sapiens
gcaaauacauagucaggua

SEQ ID NO: 1059891 - RNA, 19 nt, Homo sapiens
gaaauuggguccagaaagg

SEQ ID NO: 1059892 - RNA, 19 nt, Homo sapiens
caggaagucucacaucaua

SEQ ID NO: 1059893 - RNA, 19 nt, Homo sapiens
gagaagaguccuaagcuaa

SEQ ID NO: 1059894 - RNA, 19 nt, Homo sapiens
ugacaggugugcuauguga

SEQ ID NO: 1059895 - RNA, 19 nt, Homo sapiens
cgguagaucucauaagaaa

SEQ ID NO: 1059896 - RNA, 19 nt, Homo sapiens
gggcugggcuggucagaau

SEQ ID NO: 1059897 - RNA, 19 nt, Homo sapiens
gagaaugacuauggacaga

SEQ ID NO: 1059898 - RNA, 19 nt, Homo sapiens
guagaucucauaagaaaga

SEQ ID NO: 1059899 - RNA, 19 nt, Homo sapiens
gcacagaaguagcccaaac

SEQ ID NO: 1059900 - RNA, 19 nt, Homo sapiens
gaagagagucgguagaucu

SEQ ID NO: 1059901 - RNA, 19 nt, Homo sapiens
ggaagucucacaucauaga

SEQ ID NO: 1059902 - RNA, 19 nt, Homo sapiens
agaaagagcagguugagaa

SEQ ID NO: 1059903 - RNA, 19 nt, Homo sapiens
gaagaaauuggguccagaa

SEQ ID NO: 1059904 - RNA, 19 nt, Homo sapiens
ugagaagaguccuaagcua

SEQ ID NO: 1059905 - RNA, 19 nt, Homo sapiens
gaagucgugcaaauacaua

SEQ ID NO: 1059906 - RNA, 19 nt, Homo sapiens
aagaaagaauccagucuga

SEQ ID NO: 1059907 - RNA, 19 nt, Homo sapiens
guacacagaccgcaaguuc

SEQ ID NO: 1059908 - RNA, 19 nt, Homo sapiens
gaagaguccuaagcuaaca

SEQ ID NO: 1059909 - RNA, 19 nt, Homo sapiens
gaagugaggagaaucagau

SEQ ID NO: 1059910 - RNA, 19 nt, Homo sapiens
gaaugacuauggacagaag

SEQ ID NO: 1059911 - RNA, 19 nt, Homo sapiens
gucgguagaucucauaaga

SEQ ID NO: 1059912 - RNA, 19 nt, Homo sapiens
gcagauggguaugcugguu

SEQ ID NO: 1059913 - RNA, 19 nt, Homo sapiens
gaaagggaagugaggagaa

SEQ ID NO: 1059914 - RNA, 19 nt, Homo sapiens
acacaaggccuuugccauu

SEQ ID NO: 1059915 - RNA, 19 nt, Homo sapiens
cgcaggaacccaucucuua

SEQ ID NO: 1059916 - RNA, 19 nt, Homo sapiens
ggcaggaagucucacauca

SEQ ID NO: 1059917 - RNA, 19 nt, Homo sapiens
gcagcagccugaagugaag

SEQ ID NO: 1059918 - RNA, 19 nt, Homo sapiens
gcugacaggugugcuaugu

SEQ ID NO: 1059919 - RNA, 19 nt, Homo sapiens
gaccgcaaguucaccauca

SEQ ID NO: 1059920 - RNA, 19 nt, Homo sapiens
ccacggugcugugaguauu

SEQ ID NO: 1059921 - RNA, 19 nt, Homo sapiens
gaccagcaggacaagauua

SEQ ID NO: 1059922 - RNA, 19 nt, Homo sapiens
cacaaggccuuugccauug

SEQ ID NO: 1059923 - RNA, 19 nt, Homo sapiens
gcaaugagaggaccuacca

SEQ ID NO: 1059924 - RNA, 19 nt, Homo sapiens
gcaaggugaucucagucau

SEQ ID NO: 1059925 - RNA, 19 nt, Homo sapiens
uaggcaaagucuugagaaa

SEQ ID NO: 1059926 - RNA, 19 nt, Homo sapiens
ucauagcccucgcugucua

SEQ ID NO: 1059927 - RNA, 19 nt, Homo sapiens
ucaccaggucuaauguuua

SEQ ID NO: 1059928 - RNA, 19 nt, Homo sapiens
uagcugugauggcgaaaga

SEQ ID NO: 1059929 - RNA, 19 nt, Homo sapiens
agaaguagcccaaacucuu

SEQ ID NO: 1059930 - RNA, 19 nt, Homo sapiens
cagggugggugauggagaa

SEQ ID NO: 1059931 - RNA, 19 nt, Homo sapiens
gaaccugucagccucuuuc

SEQ ID NO: 1059932 - RNA, 19 nt, Homo sapiens
ugacuucccucuggagaau

SEQ ID NO: 1059933 - RNA, 19 nt, Homo sapiens
gcaggaacccaucucuuag

SEQ ID NO: 1059934 - RNA, 19 nt, Homo sapiens
aaggugaucucagucauug

SEQ ID NO: 1059935 - RNA, 19 nt, Homo sapiens
ucacagccaucguuaucau

SEQ ID NO: 1059936 - RNA, 19 nt, Homo sapiens
gaaagagcagguugagaag

SEQ ID NO: 1059937 - RNA, 19 nt, Homo sapiens
gacaucaccaggucuaaug

SEQ ID NO: 1059938 - RNA, 19 nt, Homo sapiens
ggauggcuguguucaaugc

SEQ ID NO: 1059939 - RNA, 19 nt, Homo sapiens
guacgucacagccaucguu

SEQ ID NO: 1059940 - RNA, 19 nt, Homo sapiens
ugcauugccuuccuaauca

SEQ ID NO: 1059941 - RNA, 19 nt, Homo sapiens
caagcuccauuucaugagu

SEQ ID NO: 1059942 - RNA, 19 nt, Homo sapiens
ccagggcugugccucauuc

SEQ ID NO: 1059943 - RNA, 19 nt, Homo sapiens
gcagugugcccgucuucaa

SEQ ID NO: 1059944 - RNA, 19 nt, Homo sapiens
ccaucguuaucaucaagua

SEQ ID NO: 1059945 - RNA, 19 nt, Homo sapiens
aaucagaucccagaccuuu

SEQ ID NO: 1059946 - RNA, 19 nt, Homo sapiens
gugcaggguuacucaacuu

SEQ ID NO: 1059947 - RNA, 19 nt, Homo sapiens
uagcgugacuacccagaga

SEQ ID NO: 1059948 - RNA, 19 nt, Homo sapiens
ucccauagcuaauagacau

SEQ ID NO: 1059949 - RNA, 19 nt, Homo sapiens
caccaucugcuucggauuu

SEQ ID NO: 1059950 - RNA, 19 nt, Homo sapiens
aaagggaagugaggagaau

SEQ ID NO: 1059951 - RNA, 19 nt, Homo sapiens
gggaguaucugcuuuugug

SEQ ID NO: 1059952 - RNA, 19 nt, Homo sapiens
caccaggucuaauguuuac

SEQ ID NO: 1059953 - RNA, 19 nt, Homo sapiens
gagccuggccacuuccaaa

SEQ ID NO: 1059954 - RNA, 19 nt, Homo sapiens
uuguggaucucuuggcaua

SEQ ID NO: 1059955 - RNA, 19 nt, Homo sapiens
caaggugaucucagucauu

SEQ ID NO: 1059956 - RNA, 19 nt, Homo sapiens
caucaucaguggccuuguc

SEQ ID NO: 1059957 - RNA, 19 nt, Homo sapiens
cacccugucucuuucauca

SEQ ID NO: 1059958 - RNA, 19 nt, Homo sapiens
gaugcaugcucacgugucu

SEQ ID NO: 1059959 - RNA, 19 nt, Homo sapiens
gcaggaagucucacaucau

SEQ ID NO: 1059960 - RNA, 19 nt, Homo sapiens
gaucucauaagaaagaauc

SEQ ID NO: 1059961 - RNA, 19 nt, Homo sapiens
ccugggagccuucaucuuc

SEQ ID NO: 1059962 - RNA, 19 nt, Homo sapiens
ggaagugaggagaaucaga

SEQ ID NO: 1059963 - RNA, 19 nt, Homo sapiens
guauuccuccguuagcuuu

SEQ ID NO: 1059964 - RNA, 19 nt, Homo sapiens
gggagaaagagcagguuga

SEQ ID NO: 1059965 - RNA, 19 nt, Homo sapiens
gaagccagcacagaaguag

SEQ ID NO: 1059966 - RNA, 19 nt, Homo sapiens
cagcaggacaagauuauag

SEQ ID NO: 1059967 - RNA, 19 nt, Homo sapiens
gguugggaguaucugcuuu

SEQ ID NO: 1059968 - RNA, 19 nt, Homo sapiens
aagagcagguugagaagag

SEQ ID NO: 1059969 - RNA, 19 nt, Homo sapiens
caggucuaauguuuacaaa

SEQ ID NO: 1059970 - RNA, 19 nt, Homo sapiens
gacaagauuauagcuguga

SEQ ID NO: 1059971 - RNA, 19 nt, Homo sapiens
ugugaguauuccuccguua

SEQ ID NO: 1059972 - RNA, 19 nt, Homo sapiens
cccugucucuuucaucaaa

SEQ ID NO: 1059973 - RNA, 19 nt, Homo sapiens
ccugaggcaugugguugua

SEQ ID NO: 1059974 - RNA, 19 nt, Homo sapiens
aagcuccauuucaugagua

SEQ ID NO: 1059975 - RNA, 19 nt, Homo sapiens
auagucagguagauucaga

SEQ ID NO: 1059976 - RNA, 19 nt, Homo sapiens
gauggaagaggucaaacca

SEQ ID NO: 1059977 - RNA, 19 nt, Homo sapiens
ggugaucucagucauugga

SEQ ID NO: 1059978 - RNA, 19 nt, Homo sapiens
caagcugacaggugugcua

SEQ ID NO: 1059979 - RNA, 19 nt, Homo sapiens
gaggugguaugggcugugu

SEQ ID NO: 1059980 - RNA, 19 nt, Homo sapiens
caggucagcaucaacaaug

SEQ ID NO: 1059981 - RNA, 19 nt, Homo sapiens
ggagaaagagcagguugag

SEQ ID NO: 1059982 - RNA, 19 nt, Homo sapiens
ggaauccacgggugaagag

SEQ ID NO: 1059983 - RNA, 19 nt, Homo sapiens
caggaacccaucucuuaga

SEQ ID NO: 1059984 - RNA, 19 nt, Homo sapiens
gcaugcagcagccugaagu

SEQ ID NO: 1059985 - RNA, 19 nt, Homo sapiens
ucaaugccaugcccaccau

SEQ ID NO: 1059986 - RNA, 19 nt, Homo sapiens
cuggauggcuguguucaau

SEQ ID NO: 1059987 - RNA, 19 nt, Homo sapiens
gcauugccuuccuaaucau

SEQ ID NO: 1059988 - RNA, 19 nt, Homo sapiens
gagcacccuguccugagua

SEQ ID NO: 1059989 - RNA, 19 nt, Homo sapiens
ugaagagagucgguagauc

SEQ ID NO: 1059990 - RNA, 19 nt, Homo sapiens
ggacauggauuaccaaguu

SEQ ID NO: 1059991 - RNA, 19 nt, Homo sapiens
cagcauagaugaacacuuu

SEQ ID NO: 1059992 - RNA, 19 nt, Homo sapiens
caacuucacuacucauauu

SEQ ID NO: 1059993 - RNA, 19 nt, Homo sapiens
caaauucugugcccauuga

SEQ ID NO: 1059994 - RNA, 19 nt, Homo sapiens
gcaauucaguggauuaagu

SEQ ID NO: 1059995 - RNA, 19 nt, Homo sapiens
ccucacaucuccacuuuaa

SEQ ID NO: 1059996 - RNA, 19 nt, Homo sapiens
gaagaagggacuagccaua

SEQ ID NO: 1059997 - RNA, 19 nt, Homo sapiens
gaacugaggcauuggaaga

SEQ ID NO: 1059998 - RNA, 19 nt, Homo sapiens
ccacugauaucacugaaga

SEQ ID NO: 1059999 - RNA, 19 nt, Homo sapiens
uaaguggaaucauacagua

SEQ ID NO: 1060000 - RNA, 19 nt, Homo sapiens
agaaggaacugaugaacuu

SEQ ID NO: 1060001 - RNA, 19 nt, Homo sapiens
gaagagcugcuaacaguga

SEQ ID NO: 1060002 - RNA, 19 nt, Homo sapiens
ugaauuugcccuagacuua

SEQ ID NO: 1060003 - RNA, 19 nt, Homo sapiens
ucauguaaguggaaucaua

SEQ ID NO: 1060004 - RNA, 19 nt, Homo sapiens
gaagugcugucugaagaaa

SEQ ID NO: 1060005 - RNA, 19 nt, Homo sapiens
caagaagaguuugaagaaa

SEQ ID NO: 1060006 - RNA, 19 nt, Homo sapiens
gguccuggcuuucugauau

SEQ ID NO: 1060007 - RNA, 19 nt, Homo sapiens
gcaguacccucaggaagaa

SEQ ID NO: 1060008 - RNA, 19 nt, Homo sapiens
cuacuuaucuggacaugga

SEQ ID NO: 1060009 - RNA, 19 nt, Homo sapiens
gaguaagcuuccugagaua

SEQ ID NO: 1060010 - RNA, 19 nt, Homo sapiens
gaagaaaagucacguuugu

SEQ ID NO: 1060011 - RNA, 19 nt, Homo sapiens
ugaaagagcuaagcaugga

SEQ ID NO: 1060012 - RNA, 19 nt, Homo sapiens
gaucaacccuacuuaucug

SEQ ID NO: 1060013 - RNA, 19 nt, Homo sapiens
gcagaaaccacugauauca

SEQ ID NO: 1060014 - RNA, 19 nt, Homo sapiens
agaguaagcuuccugagau

SEQ ID NO: 1060015 - RNA, 19 nt, Homo sapiens
cgaagcagauugucaaguc

SEQ ID NO: 1060016 - RNA, 19 nt, Homo sapiens
gaccuggaaucaaccauug

SEQ ID NO: 1060017 - RNA, 19 nt, Homo sapiens
ggaaaauucuguuugaaga

SEQ ID NO: 1060018 - RNA, 19 nt, Homo sapiens
caugguagcuugccugaca

SEQ ID NO: 1060019 - RNA, 19 nt, Homo sapiens
gaacagguuucugggacuu

SEQ ID NO: 1060020 - RNA, 19 nt, Homo sapiens
uaagaugcauccauguuuc

SEQ ID NO: 1060021 - RNA, 19 nt, Homo sapiens
gaagaccggucacuacacu

SEQ ID NO: 1060022 - RNA, 19 nt, Homo sapiens
gaaauucacgaaagucugu

SEQ ID NO: 1060023 - RNA, 19 nt, Homo sapiens
gcuugcagcuacguacuua

SEQ ID NO: 1060024 - RNA, 19 nt, Homo sapiens
gaaggagugcaugaaguua

SEQ ID NO: 1060025 - RNA, 19 nt, Homo sapiens
ugagaaagcugaggagagu

SEQ ID NO: 1060026 - RNA, 19 nt, Homo sapiens
ggaagaagucauugucaug

SEQ ID NO: 1060027 - RNA, 19 nt, Homo sapiens
auaaguggcugguuucaug

SEQ ID NO: 1060028 - RNA, 19 nt, Homo sapiens
gcccuagacuuaauucugu

SEQ ID NO: 1060029 - RNA, 19 nt, Homo sapiens
caucuccacuuuaaggaaa

SEQ ID NO: 1060030 - RNA, 19 nt, Homo sapiens
gaagaugaagagcugcuaa

SEQ ID NO: 1060031 - RNA, 19 nt, Homo sapiens
gagaguaagcuuccugaga

SEQ ID NO: 1060032 - RNA, 19 nt, Homo sapiens
gcuacguacuuaucucuug

SEQ ID NO: 1060033 - RNA, 19 nt, Homo sapiens
gaauuugcccuagacuuaa

SEQ ID NO: 1060034 - RNA, 19 nt, Homo sapiens
guucugaaauucuccugaa

SEQ ID NO: 1060035 - RNA, 19 nt, Homo sapiens
ugacauguccugugcuaaa

SEQ ID NO: 1060036 - RNA, 19 nt, Homo sapiens
cuacucauauuucucaugu

SEQ ID NO: 1060037 - RNA, 19 nt, Homo sapiens
caaggagaacuacauggua

SEQ ID NO: 1060038 - RNA, 19 nt, Homo sapiens
ugccaaaggugaagaugaa

SEQ ID NO: 1060039 - RNA, 19 nt, Homo sapiens
gagaagagagccucacauc

SEQ ID NO: 1060040 - RNA, 19 nt, Homo sapiens
cugaccagcuuacccauuu

SEQ ID NO: 1060041 - RNA, 19 nt, Homo sapiens
aagaaagaaucaaguguuc

SEQ ID NO: 1060042 - RNA, 19 nt, Homo sapiens
aagaagaguuugaagaaag

SEQ ID NO: 1060043 - RNA, 19 nt, Homo sapiens
ugucugaagugcugucuga

SEQ ID NO: 1060044 - RNA, 19 nt, Homo sapiens
cagauugucaagucucuua

SEQ ID NO: 1060045 - RNA, 19 nt, Homo sapiens
aaagucacguuugucuaua

SEQ ID NO: 1060046 - RNA, 19 nt, Homo sapiens
gcagugagccgagauugug

SEQ ID NO: 1060047 - RNA, 19 nt, Homo sapiens
gaaaccccaucucuacuaa

SEQ ID NO: 1060048 - RNA, 19 nt, Homo sapiens
ggauuaccaaguucaaauu

SEQ ID NO: 1060049 - RNA, 19 nt, Homo sapiens
cccacaagaucaugagauu

SEQ ID NO: 1060050 - RNA, 19 nt, Homo sapiens
gauuuccgguccuggcuuu

SEQ ID NO: 1060051 - RNA, 19 nt, Homo sapiens
caauucaguggauuaagua

SEQ ID NO: 1060052 - RNA, 19 nt, Homo sapiens
aaugugacccuucguaauu

SEQ ID NO: 1060053 - RNA, 19 nt, Homo sapiens
augaagagcugcuaacagu

SEQ ID NO: 1060054 - RNA, 19 nt, Homo sapiens
ugacaaacauggagaaacc

SEQ ID NO: 1060055 - RNA, 19 nt, Homo sapiens
caucauccaucuccagaag

SEQ ID NO: 1060056 - RNA, 19 nt, Homo sapiens
caaccgagaccuugagcuu

SEQ ID NO: 1060057 - RNA, 19 nt, Homo sapiens
ugacucggccucccaacua

SEQ ID NO: 1060058 - RNA, 19 nt, Homo sapiens
cugaagugcugucugaaga

SEQ ID NO: 1060059 - RNA, 19 nt, Homo sapiens
gacaggagcauggguggua

SEQ ID NO: 1060060 - RNA, 19 nt, Homo sapiens
cuacguacuuaucucuuga

SEQ ID NO: 1060061 - RNA, 19 nt, Homo sapiens
uagcuugccugacaguguu

SEQ ID NO: 1060062 - RNA, 19 nt, Homo sapiens
uaagcuuccugagauauug

SEQ ID NO: 1060063 - RNA, 19 nt, Homo sapiens
ggacuuccaugagaaucug

SEQ ID NO: 1060064 - RNA, 19 nt, Homo sapiens
ucacguuugucuauaagug

SEQ ID NO: 1060065 - RNA, 19 nt, Homo sapiens
gaagcagauugucaagucu

SEQ ID NO: 1060066 - RNA, 19 nt, Homo sapiens
gugguacccuggaccugua

SEQ ID NO: 1060067 - RNA, 19 nt, Homo sapiens
cauguccugugcuaaauau

SEQ ID NO: 1060068 - RNA, 19 nt, Homo sapiens
caaagaaagaaucaagugu

SEQ ID NO: 1060069 - RNA, 19 nt, Homo sapiens
ggaucaacccuacuuaucu

SEQ ID NO: 1060070 - RNA, 19 nt, Homo sapiens
gucuauaaguggcugguuu

SEQ ID NO: 1060071 - RNA, 19 nt, Homo sapiens
ucauccaucuccagaaguu

SEQ ID NO: 1060072 - RNA, 19 nt, Homo sapiens
ccauagcaaggcugaauuu

SEQ ID NO: 1060073 - RNA, 19 nt, Homo sapiens
ugaaggagugcaugaaguu

SEQ ID NO: 1060074 - RNA, 19 nt, Homo sapiens
guaagcuuccugagauauu

SEQ ID NO: 1060075 - RNA, 19 nt, Homo sapiens
ccugagaaauucacgaaag

SEQ ID NO: 1060076 - RNA, 19 nt, Homo sapiens
gacauguccugugcuaaau

SEQ ID NO: 1060077 - RNA, 19 nt, Homo sapiens
gcauccauguuuccagugu

SEQ ID NO: 1060078 - RNA, 19 nt, Homo sapiens
uuaagaugcauccauguuu

SEQ ID NO: 1060079 - RNA, 19 nt, Homo sapiens
ucacuacucauauuucuca

SEQ ID NO: 1060080 - RNA, 19 nt, Homo sapiens
agaaagcugaggagaguaa

SEQ ID NO: 1060081 - RNA, 19 nt, Homo sapiens
uggauuaaguacauucuca

SEQ ID NO: 1060082 - RNA, 19 nt, Homo sapiens
agaaaccacugauaucacu

SEQ ID NO: 1060083 - RNA, 19 nt, Homo sapiens
agaagaguuugaagaaagu

SEQ ID NO: 1060084 - RNA, 19 nt, Homo sapiens
ggacaugccgggaguugca

SEQ ID NO: 1060085 - RNA, 19 nt, Homo sapiens
cuccugagccagagaauaa

SEQ ID NO: 1060086 - RNA, 19 nt, Homo sapiens
gcccucacaucccacaaga

SEQ ID NO: 1060087 - RNA, 19 nt, Homo sapiens
guaaguggaaucauacagu

SEQ ID NO: 1060088 - RNA, 19 nt, Homo sapiens
caccgaagccuggaacaaa

SEQ ID NO: 1060089 - RNA, 19 nt, Homo sapiens
uggcauuggucuacagaga

SEQ ID NO: 1060090 - RNA, 19 nt, Homo sapiens
gcagaaacuugucucauaa

SEQ ID NO: 1060091 - RNA, 19 nt, Homo sapiens
ggcagaaacuugucucaua

SEQ ID NO: 1060092 - RNA, 19 nt, Homo sapiens
gagagaaugucacagauga

SEQ ID NO: 1060093 - RNA, 19 nt, Homo sapiens
gaacaaguguaauuuccuu

SEQ ID NO: 1060094 - RNA, 19 nt, Homo sapiens
ucaaauguaugcaguacua

SEQ ID NO: 1060095 - RNA, 19 nt, Homo sapiens
ccacauauauaacaggauu

SEQ ID NO: 1060096 - RNA, 19 nt, Homo sapiens
caccaaagcuacaaaccua

SEQ ID NO: 1060097 - RNA, 19 nt, Homo sapiens
gagcagacccuuuagaaau

SEQ ID NO: 1060098 - RNA, 19 nt, Homo sapiens
caaagaugcuggcacauag

SEQ ID NO: 1060099 - RNA, 19 nt, Homo sapiens
guauaacugugugcaaaua

SEQ ID NO: 1060100 - RNA, 19 nt, Homo sapiens
caagagggaagcaauuaua

SEQ ID NO: 1060101 - RNA, 19 nt, Homo sapiens
gcccaucgauucccuacua

SEQ ID NO: 1060102 - RNA, 19 nt, Homo sapiens
cauaaggguucuucaguga

SEQ ID NO: 1060103 - RNA, 19 nt, Homo sapiens
gcgaugagcguccuuuaaa

SEQ ID NO: 1060104 - RNA, 19 nt, Homo sapiens
cugcaaggauagcucauua

SEQ ID NO: 1060105 - RNA, 19 nt, Homo sapiens
aaacaagugccguacguua

SEQ ID NO: 1060106 - RNA, 19 nt, Homo sapiens
gaagacgagccacguauga

SEQ ID NO: 1060107 - RNA, 19 nt, Homo sapiens
gagcaacccuacagagcaa

SEQ ID NO: 1060108 - RNA, 19 nt, Homo sapiens
caaauaaacaccuaaccuu

SEQ ID NO: 1060109 - RNA, 19 nt, Homo sapiens
ccaaagaugcuggcacaua

SEQ ID NO: 1060110 - RNA, 19 nt, Homo sapiens
gcccaaagccaucuucuga

SEQ ID NO: 1060111 - RNA, 19 nt, Homo sapiens
ggugggcucuggcuucaaa

SEQ ID NO: 1060112 - RNA, 19 nt, Homo sapiens
gaggagagccgcuacaagu

SEQ ID NO: 1060113 - RNA, 19 nt, Homo sapiens
uaacaagggcccaucgauu

SEQ ID NO: 1060114 - RNA, 19 nt, Homo sapiens
cagagagccuugcugagaa

SEQ ID NO: 1060115 - RNA, 19 nt, Homo sapiens
guaauuuccuucccuccuu

SEQ ID NO: 1060116 - RNA, 19 nt, Homo sapiens
gcagagauauacacacacu

SEQ ID NO: 1060117 - RNA, 19 nt, Homo sapiens
gagcacuacucuucacugu

SEQ ID NO: 1060118 - RNA, 19 nt, Homo sapiens
agucugagguugauaucua

SEQ ID NO: 1060119 - RNA, 19 nt, Homo sapiens
cauagagccugcaaaugga

SEQ ID NO: 1060120 - RNA, 19 nt, Homo sapiens
ucugagauuucaacuugua

SEQ ID NO: 1060121 - RNA, 19 nt, Homo sapiens
ucaacgacaugcucuggaa

SEQ ID NO: 1060122 - RNA, 19 nt, Homo sapiens
gaauggcuccuuauaccaa

SEQ ID NO: 1060123 - RNA, 19 nt, Homo sapiens
ggagagcaccaucaaguuc

SEQ ID NO: 1060124 - RNA, 19 nt, Homo sapiens
gucaaggccuucaauguca

SEQ ID NO: 1060125 - RNA, 19 nt, Homo sapiens
ucucauaaauuggcacuga

SEQ ID NO: 1060126 - RNA, 19 nt, Homo sapiens
gccuagagcagacccuuua

SEQ ID NO: 1060127 - RNA, 19 nt, Homo sapiens
gcagguaaagcagagauuu

SEQ ID NO: 1060128 - RNA, 19 nt, Homo sapiens
ccagagagaaugucacaga

SEQ ID NO: 1060129 - RNA, 19 nt, Homo sapiens
gcuggacaaucacacgaaa

SEQ ID NO: 1060130 - RNA, 19 nt, Homo sapiens
gcagacccuuuagaaauca

SEQ ID NO: 1060131 - RNA, 19 nt, Homo sapiens
agucagaagucaccauaga

SEQ ID NO: 1060132 - RNA, 19 nt, Homo sapiens
agagauauacacacacuuu

SEQ ID NO: 1060133 - RNA, 19 nt, Homo sapiens
gcagaucaugcuauuguga

SEQ ID NO: 1060134 - RNA, 19 nt, Homo sapiens
ggagagccgcuacaaguuc

SEQ ID NO: 1060135 - RNA, 19 nt, Homo sapiens
gggaauggcuccuuauacc

SEQ ID NO: 1060136 - RNA, 19 nt, Homo sapiens
ugugacauuugcagagaua

SEQ ID NO: 1060137 - RNA, 19 nt, Homo sapiens
gcccugagcccguuagguu

SEQ ID NO: 1060138 - RNA, 19 nt, Homo sapiens
gagaagacgagccacguau

SEQ ID NO: 1060139 - RNA, 19 nt, Homo sapiens
ggucaaggccuucaauguc

SEQ ID NO: 1060140 - RNA, 19 nt, Homo sapiens
caaauggauccuccuguga

SEQ ID NO: 1060141 - RNA, 19 nt, Homo sapiens
caauggagacccaccaaug

SEQ ID NO: 1060142 - RNA, 19 nt, Homo sapiens
gaagagcccacugcaagga

SEQ ID NO: 1060143 - RNA, 19 nt, Homo sapiens
uaauuuccuucccuccuuu

SEQ ID NO: 1060144 - RNA, 19 nt, Homo sapiens
cggaguagcugggauuaca

SEQ ID NO: 1060145 - RNA, 19 nt, Homo sapiens
caacacacccagccaccaa

SEQ ID NO: 1060146 - RNA, 19 nt, Homo sapiens
guaccuggccucccucuuc

SEQ ID NO: 1060147 - RNA, 19 nt, Homo sapiens
ccaaagcuacaaaccuaaa

SEQ ID NO: 1060148 - RNA, 19 nt, Homo sapiens
aaagucagaagucaccaua

SEQ ID NO: 1060149 - RNA, 19 nt, Homo sapiens
ugacauuugcagagauaua

SEQ ID NO: 1060150 - RNA, 19 nt, Homo sapiens
gcaaauaaacaccuaaccu

SEQ ID NO: 1060151 - RNA, 19 nt, Homo sapiens
gcucaagagggaagcaauu

SEQ ID NO: 1060152 - RNA, 19 nt, Homo sapiens
ggagaagagcccacugcaa

SEQ ID NO: 1060153 - RNA, 19 nt, Homo sapiens
agugaaggcugcccagaga

SEQ ID NO: 1060154 - RNA, 19 nt, Homo sapiens
aaaccacugugccuucuca

SEQ ID NO: 1060155 - RNA, 19 nt, Homo sapiens
ucacugccguccauugcaa

SEQ ID NO: 1060156 - RNA, 19 nt, Homo sapiens
aagcagagauuuuagcauu

SEQ ID NO: 1060157 - RNA, 19 nt, Homo sapiens
cagagagaaugucacagau

SEQ ID NO: 1060158 - RNA, 19 nt, Homo sapiens
uagagcagacccuuuagaa

SEQ ID NO: 1060159 - RNA, 19 nt, Homo sapiens
gagauggacaagccacuga

SEQ ID NO: 1060160 - RNA, 19 nt, Homo sapiens
caagugccguacguuaaga

SEQ ID NO: 1060161 - RNA, 19 nt, Homo sapiens
caaagugguauaacugugu

SEQ ID NO: 1060162 - RNA, 19 nt, Homo sapiens
gagagccgcuacaaguucu

SEQ ID NO: 1060163 - RNA, 19 nt, Homo sapiens
gaguucagcuucguucagu

SEQ ID NO: 1060164 - RNA, 19 nt, Homo sapiens
gagggaagcaauuauaagg

SEQ ID NO: 1060165 - RNA, 19 nt, Homo sapiens
acagagagccuugcugaga

SEQ ID NO: 1060166 - RNA, 19 nt, Homo sapiens
gcacauaaggguucuucag

SEQ ID NO: 1060167 - RNA, 19 nt, Homo sapiens
caaauuccugggacucaaa

SEQ ID NO: 1060168 - RNA, 19 nt, Homo sapiens
cagggaauggcuccuuaua

SEQ ID NO: 1060169 - RNA, 19 nt, Homo sapiens
gcaaggauagcucauuagg

SEQ ID NO: 1060170 - RNA, 19 nt, Homo sapiens
gagaguagggccagugaag

SEQ ID NO: 1060171 - RNA, 19 nt, Homo sapiens
gugggaggauggagggauu

SEQ ID NO: 1060172 - RNA, 19 nt, Homo sapiens
ucagaaugauauacacaca

SEQ ID NO: 1060173 - RNA, 19 nt, Homo sapiens
gggagagcaccaucaaguu

SEQ ID NO: 1060174 - RNA, 19 nt, Homo sapiens
caggaaagccagaacaagu

SEQ ID NO: 1060175 - RNA, 19 nt, Homo sapiens
ccaaauuccugggacucaa

SEQ ID NO: 1060176 - RNA, 19 nt, Homo sapiens
gagagcaccaucaaguuca

SEQ ID NO: 1060177 - RNA, 19 nt, Homo sapiens
aagagggaagcaauuauaa

SEQ ID NO: 1060178 - RNA, 19 nt, Homo sapiens
caucgauucccuacuaaug

SEQ ID NO: 1060179 - RNA, 19 nt, Homo sapiens
uugcagagauauacacaca

SEQ ID NO: 1060180 - RNA, 19 nt, Homo sapiens
ugguauaacugugugcaaa

SEQ ID NO: 1060181 - RNA, 19 nt, Homo sapiens
ggugcaaagugguauaacu

SEQ ID NO: 1060182 - RNA, 19 nt, Homo sapiens
cgagaagacgagccacgua

SEQ ID NO: 1060183 - RNA, 19 nt, Homo sapiens
gucugagguugauaucuaa

SEQ ID NO: 1060184 - RNA, 19 nt, Homo sapiens
gcugagcggcagaaacuug

SEQ ID NO: 1060185 - RNA, 19 nt, Homo sapiens
agagcccacugcaaggaua

SEQ ID NO: 1060186 - RNA, 19 nt, Homo sapiens
gagcaacuuuuccaccaaa

SEQ ID NO: 1060187 - RNA, 19 nt, Homo sapiens
ggcgaugagcguccuuuaa

SEQ ID NO: 1060188 - RNA, 19 nt, Homo sapiens
auaaacaccuaaccuucug

SEQ ID NO: 1060189 - RNA, 19 nt, Homo sapiens
cagaaacuugucucauaaa

SEQ ID NO: 1060190 - RNA, 19 nt, Homo sapiens
caaauaugguccugaguaa

SEQ ID NO: 1060191 - RNA, 19 nt, Homo sapiens
gaggaugugucucuucuga

SEQ ID NO: 1060192 - RNA, 19 nt, Homo sapiens
gcacagcagugaaccaaca

SEQ ID NO: 1060193 - RNA, 19 nt, Homo sapiens
gcagagggauccaggaauc

SEQ ID NO: 1060194 - RNA, 19 nt, Homo sapiens
ugaggaagcuggauaucaa

SEQ ID NO: 1060195 - RNA, 19 nt, Homo sapiens
caaauccagucuucauuca

SEQ ID NO: 1060196 - RNA, 19 nt, Homo sapiens
ucagggacauugcucauug

SEQ ID NO: 1060197 - RNA, 19 nt, Homo sapiens
caacgugcgugcccaugaa

SEQ ID NO: 1060198 - RNA, 19 nt, Homo sapiens
ucaaauaugguccugagua

SEQ ID NO: 1060199 - RNA, 19 nt, Homo sapiens
gcauucaaauccagucuuc

SEQ ID NO: 1060200 - RNA, 19 nt, Homo sapiens
ccucugaucucccauaagu

SEQ ID NO: 1060201 - RNA, 19 nt, Homo sapiens
ucgcagcuguucccugaua

SEQ ID NO: 1060202 - RNA, 19 nt, Homo sapiens
gggcagaggagaaggcuuu

SEQ ID NO: 1060203 - RNA, 19 nt, Homo sapiens
guggcaagguggaguguuu

SEQ ID NO: 1060204 - RNA, 19 nt, Homo sapiens
cuucugaccugcacucuug

SEQ ID NO: 1060205 - RNA, 19 nt, Homo sapiens
ggaagagcgagagguguua

SEQ ID NO: 1060206 - RNA, 19 nt, Homo sapiens
gccaucuacucgucguuua

SEQ ID NO: 1060207 - RNA, 19 nt, Homo sapiens
ucauucagcugggaucaaa

SEQ ID NO: 1060208 - RNA, 19 nt, Homo sapiens
caagguggaguguuucauu

SEQ ID NO: 1060209 - RNA, 19 nt, Homo sapiens
cuagggacaugaaguaugg

SEQ ID NO: 1060210 - RNA, 19 nt, Homo sapiens
gcaugcagacucacgugua

SEQ ID NO: 1060211 - RNA, 19 nt, Homo sapiens
gagagccacuuacgaugca

SEQ ID NO: 1060212 - RNA, 19 nt, Homo sapiens
caaaggcagucgcaaagac

SEQ ID NO: 1060213 - RNA, 19 nt, Homo sapiens
gcagugcaguaugcuguga

SEQ ID NO: 1060214 - RNA, 19 nt, Homo sapiens
gcucugaugugacccuuac

SEQ ID NO: 1060215 - RNA, 19 nt, Homo sapiens
ccagugaggcagugcagua

SEQ ID NO: 1060216 - RNA, 19 nt, Homo sapiens
gcaaaggcagucgcaaaga

SEQ ID NO: 1060217 - RNA, 19 nt, Homo sapiens
uauccacgcucaccaucaa

SEQ ID NO: 1060218 - RNA, 19 nt, Homo sapiens
gggaggaugugucucuucu

SEQ ID NO: 1060219 - RNA, 19 nt, Homo sapiens
ggagaaagaaaggcuagga

SEQ ID NO: 1060220 - RNA, 19 nt, Homo sapiens
acagggaaagugaagguua

SEQ ID NO: 1060221 - RNA, 19 nt, Homo sapiens
ggaggaguaugagaugaag

SEQ ID NO: 1060222 - RNA, 19 nt, Homo sapiens
ggccuagggacaugaagua

SEQ ID NO: 1060223 - RNA, 19 nt, Homo sapiens
cagggaaagugaagguuag

SEQ ID NO: 1060224 - RNA, 19 nt, Homo sapiens
ggacuacggccagcgauuc

SEQ ID NO: 1060225 - RNA, 19 nt, Homo sapiens
cacuuacgaugcauucuga

SEQ ID NO: 1060226 - RNA, 19 nt, Homo sapiens
caccuuggcuacccacugu

SEQ ID NO: 1060227 - RNA, 19 nt, Homo sapiens
gcucuugucuacagaacag

SEQ ID NO: 1060228 - RNA, 19 nt, Homo sapiens
ggacagggaaagugaaggu

SEQ ID NO: 1060229 - RNA, 19 nt, Homo sapiens
guuuaaggaugauguggau

SEQ ID NO: 1060230 - RNA, 19 nt, Homo sapiens
ucaaauccagucuucauuc

SEQ ID NO: 1060231 - RNA, 19 nt, Homo sapiens
acucgucguuuaaggauga

SEQ ID NO: 1060232 - RNA, 19 nt, Homo sapiens
gaggugccgcucuauguga

SEQ ID NO: 1060233 - RNA, 19 nt, Homo sapiens
gggaggugccgcucuaugu

SEQ ID NO: 1060234 - RNA, 19 nt, Homo sapiens
gaaaggcuaggaccauguc

SEQ ID NO: 1060235 - RNA, 19 nt, Homo sapiens
gggaggaguaugagaugaa

SEQ ID NO: 1060236 - RNA, 19 nt, Homo sapiens
aagguggaguguuucauug

SEQ ID NO: 1060237 - RNA, 19 nt, Homo sapiens
aaagugaagguuagggaaa

SEQ ID NO: 1060238 - RNA, 19 nt, Homo sapiens
caugcagacucacguguag

SEQ ID NO: 1060239 - RNA, 19 nt, Homo sapiens
gugaaccgagagccacuua

SEQ ID NO: 1060240 - RNA, 19 nt, Homo sapiens
cugcucaucuucuucuuca

SEQ ID NO: 1060241 - RNA, 19 nt, Homo sapiens
gcauccugcucaucuucuu

SEQ ID NO: 1060242 - RNA, 19 nt, Homo sapiens
aggaugauguggaucugaa

SEQ ID NO: 1060243 - RNA, 19 nt, Homo sapiens
cagcaacccgggucaugaa

SEQ ID NO: 1060244 - RNA, 19 nt, Homo sapiens
gaucucccauaaguggaaa

SEQ ID NO: 1060245 - RNA, 19 nt, Homo sapiens
gcccagcucaacaccuaua

SEQ ID NO: 1060246 - RNA, 19 nt, Homo sapiens
ggaggugccgcucuaugug

SEQ ID NO: 1060247 - RNA, 19 nt, Homo sapiens
ccgcaaaggcagucgcaaa

SEQ ID NO: 1060248 - RNA, 19 nt, Homo sapiens
ugucauggaggccgacuuu

SEQ ID NO: 1060249 - RNA, 19 nt, Homo sapiens
gcagcuguucccugauauu

SEQ ID NO: 1060250 - RNA, 19 nt, Homo sapiens
ccagggaugggcaggcuuu

SEQ ID NO: 1060251 - RNA, 19 nt, Homo sapiens
aauaugguccugaguaaca

SEQ ID NO: 1060252 - RNA, 19 nt, Homo sapiens
ccagggcagugcucuaugc

SEQ ID NO: 1060253 - RNA, 19 nt, Homo sapiens
ccaccaauggcuacuacaa

SEQ ID NO: 1060254 - RNA, 19 nt, Homo sapiens
gccagcgucuccacagcaa

SEQ ID NO: 1060255 - RNA, 19 nt, Homo sapiens
gaaccgagagccacuuacg

SEQ ID NO: 1060256 - RNA, 19 nt, Homo sapiens
gcucaucuucuucuucauc

SEQ ID NO: 1060257 - RNA, 19 nt, Homo sapiens
ccacuuugcuccccggauu

SEQ ID NO: 1060258 - RNA, 19 nt, Homo sapiens
gcagugcucuaugcugacu

SEQ ID NO: 1060259 - RNA, 19 nt, Homo sapiens
cuucaucgccuugguauuc

SEQ ID NO: 1060260 - RNA, 19 nt, Homo sapiens
acuguucgcucuugucuac

SEQ ID NO: 1060261 - RNA, 19 nt, Homo sapiens
gauuguaguugaccccaaa

SEQ ID NO: 1060262 - RNA, 19 nt, Homo sapiens
acucuugccugacccuaga

SEQ ID NO: 1060263 - RNA, 19 nt, Homo sapiens
cuuccuggcuuuaacucuu

SEQ ID NO: 1060264 - RNA, 19 nt, Homo sapiens
ccaucuacucgucguuuaa

SEQ ID NO: 1060265 - RNA, 19 nt, Homo sapiens
gugaggcagugcaguaugc

SEQ ID NO: 1060266 - RNA, 19 nt, Homo sapiens
ucauggaggccgacuuuca

SEQ ID NO: 1060267 - RNA, 19 nt, Homo sapiens
cccuggcacugcauucaaa

SEQ ID NO: 1060268 - RNA, 19 nt, Homo sapiens
augcccagcucaacaccua

SEQ ID NO: 1060269 - RNA, 19 nt, Homo sapiens
gccacucgauucuccuaca

SEQ ID NO: 1060270 - RNA, 19 nt, Homo sapiens
ccacuuacgaugcauucug

SEQ ID NO: 1060271 - RNA, 19 nt, Homo sapiens
aaagaaaggcuaggaccau

SEQ ID NO: 1060272 - RNA, 19 nt, Homo sapiens
ccuacgagaacuaugagaa

SEQ ID NO: 1060273 - RNA, 19 nt, Homo sapiens
ccaaacccacaaccacaga

SEQ ID NO: 1060274 - RNA, 19 nt, Homo sapiens
gccagucccucuguugucu

SEQ ID NO: 1060275 - RNA, 19 nt, Homo sapiens
uacgagaacuaugagaagu

SEQ ID NO: 1060276 - RNA, 19 nt, Homo sapiens
ggccaucuacucgucguuu

SEQ ID NO: 1060277 - RNA, 19 nt, Homo sapiens
ccacaaccacagacauugg

SEQ ID NO: 1060278 - RNA, 19 nt, Homo sapiens
uggaagagcgagagguguu

SEQ ID NO: 1060279 - RNA, 19 nt, Homo sapiens
uaaggaugauguggaucug

SEQ ID NO: 1060280 - RNA, 19 nt, Homo sapiens
ggucaugaaggccaucuac

SEQ ID NO: 1060281 - RNA, 19 nt, Homo sapiens
guacuguucgcucuugucu

SEQ ID NO: 1060282 - RNA, 19 nt, Homo sapiens
uguccuacgagaacuauga

SEQ ID NO: 1060283 - RNA, 19 nt, Homo sapiens
gcauagcaugggccuggaa

SEQ ID NO: 1060284 - RNA, 19 nt, Homo sapiens
ggaagcuggauaucaaggu

SEQ ID NO: 1060285 - RNA, 19 nt, Homo sapiens
gaaaguggauuacaccaaa

SEQ ID NO: 1060286 - RNA, 19 nt, Homo sapiens
gcacauaacauuaaucuag

SEQ ID NO: 1060287 - RNA, 19 nt, Homo sapiens
ccagauguguccaggcuua

SEQ ID NO: 1060288 - RNA, 19 nt, Homo sapiens
cagcaacccucaguacaua

SEQ ID NO: 1060289 - RNA, 19 nt, Homo sapiens
gaaagaaagucaggucaag

SEQ ID NO: 1060290 - RNA, 19 nt, Homo sapiens
caaacuugauuucccagua

SEQ ID NO: 1060291 - RNA, 19 nt, Homo sapiens
ucaaugcccucgccaacua

SEQ ID NO: 1060292 - RNA, 19 nt, Homo sapiens
ggccuuagauuacuauuca

SEQ ID NO: 1060293 - RNA, 19 nt, Homo sapiens
acacaaacccauaaacuaa

SEQ ID NO: 1060294 - RNA, 19 nt, Homo sapiens
caacuaagguuaaaagcua

SEQ ID NO: 1060295 - RNA, 19 nt, Homo sapiens
gcaauacugacauuucuuu

SEQ ID NO: 1060296 - RNA, 19 nt, Homo sapiens
gcccaccagugacaauuua

SEQ ID NO: 1060297 - RNA, 19 nt, Homo sapiens
cccauaaacuaacugcuua

SEQ ID NO: 1060298 - RNA, 19 nt, Homo sapiens
caucaucuguacagucuuu

SEQ ID NO: 1060299 - RNA, 19 nt, Homo sapiens
ccugcaaccuuucuuuaua

SEQ ID NO: 1060300 - RNA, 19 nt, Homo sapiens
gaagcucuaggaauaauuu

SEQ ID NO: 1060301 - RNA, 19 nt, Homo sapiens
guccauaacugcugagaga

SEQ ID NO: 1060302 - RNA, 19 nt, Homo sapiens
gaacgauguuggaaagaca

SEQ ID NO: 1060303 - RNA, 19 nt, Homo sapiens
gagcaauacugacauuucu

SEQ ID NO: 1060304 - RNA, 19 nt, Homo sapiens
gacaauuuacugugaguua

SEQ ID NO: 1060305 - RNA, 19 nt, Homo sapiens
gaacaugcaauucuuucuu

SEQ ID NO: 1060306 - RNA, 19 nt, Homo sapiens
aaagaugacaugaguagua

SEQ ID NO: 1060307 - RNA, 19 nt, Homo sapiens
gcucugcacuggcaaacuu

SEQ ID NO: 1060308 - RNA, 19 nt, Homo sapiens
gacacaaacccauaaacua

SEQ ID NO: 1060309 - RNA, 19 nt, Homo sapiens
gaacuggccaucauugugu

SEQ ID NO: 1060310 - RNA, 19 nt, Homo sapiens
gccaauaaacuuucucaaa

SEQ ID NO: 1060311 - RNA, 19 nt, Homo sapiens
agaauucagugacguggua

SEQ ID NO: 1060312 - RNA, 19 nt, Homo sapiens
uuagugagauucuauguca

SEQ ID NO: 1060313 - RNA, 19 nt, Homo sapiens
aaagagcaauacugacauu

SEQ ID NO: 1060314 - RNA, 19 nt, Homo sapiens
cauuugaggucuagaucua

SEQ ID NO: 1060315 - RNA, 19 nt, Homo sapiens
guaauucaccacuaucuga

SEQ ID NO: 1060316 - RNA, 19 nt, Homo sapiens
gcagaugcgccaagaagaa

SEQ ID NO: 1060317 - RNA, 19 nt, Homo sapiens
caaugucacuggugucuca

SEQ ID NO: 1060318 - RNA, 19 nt, Homo sapiens
aaagucaggucaagugaug

SEQ ID NO: 1060319 - RNA, 19 nt, Homo sapiens
gcgcuaaauuguccaggaa

SEQ ID NO: 1060320 - RNA, 19 nt, Homo sapiens
caccacgccuagcuaauuu

SEQ ID NO: 1060321 - RNA, 19 nt, Homo sapiens
ugacaugaguaguaauuca

SEQ ID NO: 1060322 - RNA, 19 nt, Homo sapiens
gaugacaugaguaguaauu

SEQ ID NO: 1060323 - RNA, 19 nt, Homo sapiens
ugcugaagcucuaggaaua

SEQ ID NO: 1060324 - RNA, 19 nt, Homo sapiens
ggucagggaucaucaucug

SEQ ID NO: 1060325 - RNA, 19 nt, Homo sapiens
gcucaggugguuccaauuu

SEQ ID NO: 1060326 - RNA, 19 nt, Homo sapiens
guaauucucugcacaucca

SEQ ID NO: 1060327 - RNA, 19 nt, Homo sapiens
gcucagugcugugaaagug

SEQ ID NO: 1060328 - RNA, 19 nt, Homo sapiens
aagaugacaugaguaguaa

SEQ ID NO: 1060329 - RNA, 19 nt, Homo sapiens
ggaaagaaagucaggucaa

SEQ ID NO: 1060330 - RNA, 19 nt, Homo sapiens
ucagugacgugguaggaaa

SEQ ID NO: 1060331 - RNA, 19 nt, Homo sapiens
caaucgcgguuaucaaugu

SEQ ID NO: 1060332 - RNA, 19 nt, Homo sapiens
gaaacugcgugcuguaagc

SEQ ID NO: 1060333 - RNA, 19 nt, Homo sapiens
ggauucggcuuaucuucug

SEQ ID NO: 1060334 - RNA, 19 nt, Homo sapiens
ucagaagguuggagccauu

SEQ ID NO: 1060335 - RNA, 19 nt, Homo sapiens
ucaggugguuccaauuuau

SEQ ID NO: 1060336 - RNA, 19 nt, Homo sapiens
cggaaguccucuaccguuu

SEQ ID NO: 1060337 - RNA, 19 nt, Homo sapiens
gcacuggcaaacuugauuu

SEQ ID NO: 1060338 - RNA, 19 nt, Homo sapiens
gcaauucuuucuuccaaaa

SEQ ID NO: 1060339 - RNA, 19 nt, Homo sapiens
ucaaagagcaauacugaca

SEQ ID NO: 1060340 - RNA, 19 nt, Homo sapiens
acuaacugcuuaagaauuc

SEQ ID NO: 1060341 - RNA, 19 nt, Homo sapiens
gaaccaagcaaggaucaau

SEQ ID NO: 1060342 - RNA, 19 nt, Homo sapiens
ucugaaagaugacaugagu

SEQ ID NO: 1060343 - RNA, 19 nt, Homo sapiens
uaacgaacgauguuggaaa

SEQ ID NO: 1060344 - RNA, 19 nt, Homo sapiens
gcugggcgcucuuucucaa

SEQ ID NO: 1060345 - RNA, 19 nt, Homo sapiens
ucucaaagagcaauacuga

SEQ ID NO: 1060346 - RNA, 19 nt, Homo sapiens
ucaagaagccagggauaaa

SEQ ID NO: 1060347 - RNA, 19 nt, Homo sapiens
gcccagcuggcauuuguua

SEQ ID NO: 1060348 - RNA, 19 nt, Homo sapiens
uaucuuuccuugggccuua

SEQ ID NO: 1060349 - RNA, 19 nt, Homo sapiens
ccucaggcacauaacauua

SEQ ID NO: 1060350 - RNA, 19 nt, Homo sapiens
gguacacgccaauuugaaa

SEQ ID NO: 1060351 - RNA, 19 nt, Homo sapiens
cagccaaccuugucaaugc

SEQ ID NO: 1060352 - RNA, 19 nt, Homo sapiens
gcucaaccagggaauugua

SEQ ID NO: 1060353 - RNA, 19 nt, Homo sapiens
cugcaaccuuucuuuauau

SEQ ID NO: 1060354 - RNA, 19 nt, Homo sapiens
gagagaacuugcugaagcu

SEQ ID NO: 1060355 - RNA, 19 nt, Homo sapiens
cuacauggaugcccugaac

SEQ ID NO: 1060356 - RNA, 19 nt, Homo sapiens
gcacauccagcuggugaaa

SEQ ID NO: 1060357 - RNA, 19 nt, Homo sapiens
ccaccacgccuagcuaauu

SEQ ID NO: 1060358 - RNA, 19 nt, Homo sapiens
agacugauaauuccuggua

SEQ ID NO: 1060359 - RNA, 19 nt, Homo sapiens
aaacaguugggaaaucuuu

SEQ ID NO: 1060360 - RNA, 19 nt, Homo sapiens
ugaaagaugacaugaguag

SEQ ID NO: 1060361 - RNA, 19 nt, Homo sapiens
gcuauauuguggcccaaga

SEQ ID NO: 1060362 - RNA, 19 nt, Homo sapiens
acacgccaauuugaaagua

SEQ ID NO: 1060363 - RNA, 19 nt, Homo sapiens
gaguggaaaucagaagguu

SEQ ID NO: 1060364 - RNA, 19 nt, Homo sapiens
agaacuugcugaagcucua

SEQ ID NO: 1060365 - RNA, 19 nt, Homo sapiens
caagcaauccuuccaccuu

SEQ ID NO: 1060366 - RNA, 19 nt, Homo sapiens
ucagggaucaucaucugua

SEQ ID NO: 1060367 - RNA, 19 nt, Homo sapiens
gaucuucauuccagcucuu

SEQ ID NO: 1060368 - RNA, 19 nt, Homo sapiens
ggauuacaccaaauuaagu

SEQ ID NO: 1060369 - RNA, 19 nt, Homo sapiens
ggcaaucgcgguuaucaau

SEQ ID NO: 1060370 - RNA, 19 nt, Homo sapiens
ggaucgcgcugauguuugc

SEQ ID NO: 1060371 - RNA, 19 nt, Homo sapiens
cucaggugguuccaauuua

SEQ ID NO: 1060372 - RNA, 19 nt, Homo sapiens
aagcaauccuccuguguca

SEQ ID NO: 1060373 - RNA, 19 nt, Homo sapiens
gcugagagaacuugcugaa

SEQ ID NO: 1060374 - RNA, 19 nt, Homo sapiens
gaaagucaggucaagugau

SEQ ID NO: 1060375 - RNA, 19 nt, Homo sapiens
ucagguacacgccaauuug

SEQ ID NO: 1060376 - RNA, 19 nt, Homo sapiens
aaacuugauuucccaguac

SEQ ID NO: 1060377 - RNA, 19 nt, Homo sapiens
agaccuaugucacgaucuu

SEQ ID NO: 1060378 - RNA, 19 nt, Homo sapiens
caaaguguugggauuauag

SEQ ID NO: 1060379 - RNA, 19 nt, Homo sapiens
caggugugcccauggauuu

SEQ ID NO: 1060380 - RNA, 19 nt, Homo sapiens
gguacacaccguuaauuca

SEQ ID NO: 1060381 - RNA, 19 nt, Homo sapiens
gugcgguggugcgaucaua

SEQ ID NO: 1060382 - RNA, 19 nt, Homo sapiens
ucagucagaucagcagaug

SEQ ID NO: 1060383 - RNA, 19 nt, Homo sapiens
gaccgagacaucauuaauc

SEQ ID NO: 1060384 - RNA, 19 nt, Homo sapiens
guccugcuguuaagcugua

SEQ ID NO: 1060385 - RNA, 19 nt, Homo sapiens
gaacauuccuccuggcuua

SEQ ID NO: 1060386 - RNA, 19 nt, Homo sapiens
guacaugugucguaucaua

SEQ ID NO: 1060387 - RNA, 19 nt, Homo sapiens
gcaggaauuugcugauuaa

SEQ ID NO: 1060388 - RNA, 19 nt, Homo sapiens
caucaaacuuccuucauuu

SEQ ID NO: 1060389 - RNA, 19 nt, Homo sapiens
ggaaaugguuauugaggaa

SEQ ID NO: 1060390 - RNA, 19 nt, Homo sapiens
ggcaggaauuugcugauua

SEQ ID NO: 1060391 - RNA, 19 nt, Homo sapiens
gaauagacauacagcugaa

SEQ ID NO: 1060392 - RNA, 19 nt, Homo sapiens
gcaccgcgcagcucaguua

SEQ ID NO: 1060393 - RNA, 19 nt, Homo sapiens
ggaaguacaugugucguau

SEQ ID NO: 1060394 - RNA, 19 nt, Homo sapiens
ucacgggaccuuugaaaua

SEQ ID NO: 1060395 - RNA, 19 nt, Homo sapiens
gcugggcacuauuuacaua

SEQ ID NO: 1060396 - RNA, 19 nt, Homo sapiens
ggccugaacugaccucuga

SEQ ID NO: 1060397 - RNA, 19 nt, Homo sapiens
aaacugacuucgaggaauu

SEQ ID NO: 1060398 - RNA, 19 nt, Homo sapiens
gagauaauaacaccuugua

SEQ ID NO: 1060399 - RNA, 19 nt, Homo sapiens
ccaucaaacuuccuucauu

SEQ ID NO: 1060400 - RNA, 19 nt, Homo sapiens
ggagaagguuggugcuuuc

SEQ ID NO: 1060401 - RNA, 19 nt, Homo sapiens
aauaacaccuuguaacuca

SEQ ID NO: 1060402 - RNA, 19 nt, Homo sapiens
gaagguuggugcuuucaca

SEQ ID NO: 1060403 - RNA, 19 nt, Homo sapiens
acauacagcugaauaggaa

SEQ ID NO: 1060404 - RNA, 19 nt, Homo sapiens
gaaccagacuagcauuucu

SEQ ID NO: 1060405 - RNA, 19 nt, Homo sapiens
ggguugaguuggccauuaa

SEQ ID NO: 1060406 - RNA, 19 nt, Homo sapiens
ucaaaccgcuucucucagu

SEQ ID NO: 1060407 - RNA, 19 nt, Homo sapiens
gcagcgaucuugggauaug

SEQ ID NO: 1060408 - RNA, 19 nt, Homo sapiens
gaggaauucuuucuaaggu

SEQ ID NO: 1060409 - RNA, 19 nt, Homo sapiens
ccauggcccuucuuuauuc

SEQ ID NO: 1060410 - RNA, 19 nt, Homo sapiens
ggaaacagauacaguaccu

SEQ ID NO: 1060411 - RNA, 19 nt, Homo sapiens
cauccuaagucauuuggaa

SEQ ID NO: 1060412 - RNA, 19 nt, Homo sapiens
uguguugaguuuccucuua

SEQ ID NO: 1060413 - RNA, 19 nt, Homo sapiens
uugaauugcugguagagua

SEQ ID NO: 1060414 - RNA, 19 nt, Homo sapiens
ggaggccucugaugaccaa

SEQ ID NO: 1060415 - RNA, 19 nt, Homo sapiens
cuuagaaacuugccugaga

SEQ ID NO: 1060416 - RNA, 19 nt, Homo sapiens
ccaagcaugugguggauca

SEQ ID NO: 1060417 - RNA, 19 nt, Homo sapiens
caagggcuuucacauccua

SEQ ID NO: 1060418 - RNA, 19 nt, Homo sapiens
caacuacaugugacugaua

SEQ ID NO: 1060419 - RNA, 19 nt, Homo sapiens
ugaggaaacagauacagua

SEQ ID NO: 1060420 - RNA, 19 nt, Homo sapiens
cacguaagcuuucuacuac

SEQ ID NO: 1060421 - RNA, 19 nt, Homo sapiens
caacgacgagggacuuuga

SEQ ID NO: 1060422 - RNA, 19 nt, Homo sapiens
ccuauauccugaagaagaa

SEQ ID NO: 1060423 - RNA, 19 nt, Homo sapiens
ugacuucgaggaauucuuu

SEQ ID NO: 1060424 - RNA, 19 nt, Homo sapiens
acacguaagcuuucuacua

SEQ ID NO: 1060425 - RNA, 19 nt, Homo sapiens
acaugugacugauagcuuu

SEQ ID NO: 1060426 - RNA, 19 nt, Homo sapiens
ucaaauaccuggccccauu

SEQ ID NO: 1060427 - RNA, 19 nt, Homo sapiens
gauaauaacaccuuguaac

SEQ ID NO: 1060428 - RNA, 19 nt, Homo sapiens
gauggucucugcugcucuu

SEQ ID NO: 1060429 - RNA, 19 nt, Homo sapiens
gcucuugccucuaguucau

SEQ ID NO: 1060430 - RNA, 19 nt, Homo sapiens
gaugguggacgcaguaaug

SEQ ID NO: 1060431 - RNA, 19 nt, Homo sapiens
ccagggacuuagaaacuug

SEQ ID NO: 1060432 - RNA, 19 nt, Homo sapiens
cauuacagcugggcacuau

SEQ ID NO: 1060433 - RNA, 19 nt, Homo sapiens
guauaucccacuucuguga

SEQ ID NO: 1060434 - RNA, 19 nt, Homo sapiens
caaacuuccuucauuuaac

SEQ ID NO: 1060435 - RNA, 19 nt, Homo sapiens
ggaugugucuaguccgaau

SEQ ID NO: 1060436 - RNA, 19 nt, Homo sapiens
uaauagaagccaugggauu

SEQ ID NO: 1060437 - RNA, 19 nt, Homo sapiens
uuaauggagugaaguauac

SEQ ID NO: 1060438 - RNA, 19 nt, Homo sapiens
ccgcuucucucaguuuauu

SEQ ID NO: 1060439 - RNA, 19 nt, Homo sapiens
caugcugucuccugucuug

SEQ ID NO: 1060440 - RNA, 19 nt, Homo sapiens
gcaacuacaugugacugau

SEQ ID NO: 1060441 - RNA, 19 nt, Homo sapiens
gguagaguaugugaggaaa

SEQ ID NO: 1060442 - RNA, 19 nt, Homo sapiens
gggaaguacaugugucgua

SEQ ID NO: 1060443 - RNA, 19 nt, Homo sapiens
augcagcgaucuugggaua

SEQ ID NO: 1060444 - RNA, 19 nt, Homo sapiens
gcccugcgcauguauacua

SEQ ID NO: 1060445 - RNA, 19 nt, Homo sapiens
uuacagcugggcacuauuu

SEQ ID NO: 1060446 - RNA, 19 nt, Homo sapiens
gaaacuugccugagauggu

SEQ ID NO: 1060447 - RNA, 19 nt, Homo sapiens
gagcugagccaggcaggaa

SEQ ID NO: 1060448 - RNA, 19 nt, Homo sapiens
gcuucucucaguuuauuua

SEQ ID NO: 1060449 - RNA, 19 nt, Homo sapiens
gccauggcccuucuuuauu

SEQ ID NO: 1060450 - RNA, 19 nt, Homo sapiens
ccaaggaagggauggugua

SEQ ID NO: 1060451 - RNA, 19 nt, Homo sapiens
gugugugugugagauaaua

SEQ ID NO: 1060452 - RNA, 19 nt, Homo sapiens
gaccaagggcuuucacauc

SEQ ID NO: 1060453 - RNA, 19 nt, Homo sapiens
uagaguaugugaggaaaca

SEQ ID NO: 1060454 - RNA, 19 nt, Homo sapiens
ccugauacauucaauucau

SEQ ID NO: 1060455 - RNA, 19 nt, Homo sapiens
gcggagcucuagagugaag

SEQ ID NO: 1060456 - RNA, 19 nt, Homo sapiens
ccacuucugugaaaacauu

SEQ ID NO: 1060457 - RNA, 19 nt, Homo sapiens
gcaaaaggaggacguagaa

SEQ ID NO: 1060458 - RNA, 19 nt, Homo sapiens
uaagcuuucuacuaccaaa

SEQ ID NO: 1060459 - RNA, 19 nt, Homo sapiens
aaucaaaccgcuucucuca

SEQ ID NO: 1060460 - RNA, 19 nt, Homo sapiens
gcuuucacauccuaaguca

SEQ ID NO: 1060461 - RNA, 19 nt, Homo sapiens
gcgcguagcgaccucuuug

SEQ ID NO: 1060462 - RNA, 19 nt, Homo sapiens
aggagaagguuggugcuuu

SEQ ID NO: 1060463 - RNA, 19 nt, Homo sapiens
caaaucaaaccgcuucucu

SEQ ID NO: 1060464 - RNA, 19 nt, Homo sapiens
ggugagguauaucccacuu

SEQ ID NO: 1060465 - RNA, 19 nt, Homo sapiens
gaaaaggggacaccggaaa

SEQ ID NO: 1060466 - RNA, 19 nt, Homo sapiens
gggaugguguagguucaaa

SEQ ID NO: 1060467 - RNA, 19 nt, Homo sapiens
ggaaccagacuagcauuuc

SEQ ID NO: 1060468 - RNA, 19 nt, Homo sapiens
aauggaagauuaagauugc

SEQ ID NO: 1060469 - RNA, 19 nt, Homo sapiens
gacauacagcugaauagga

SEQ ID NO: 1060470 - RNA, 19 nt, Homo sapiens
caaaccgcuucucucaguu

SEQ ID NO: 1060471 - RNA, 19 nt, Homo sapiens
ugagguauaucccacuucu

SEQ ID NO: 1060472 - RNA, 19 nt, Homo sapiens
uuucacauccuaagucauu

SEQ ID NO: 1060473 - RNA, 19 nt, Homo sapiens
uuagaaacuugccugagau

SEQ ID NO: 1060474 - RNA, 19 nt, Homo sapiens
acccggaaaugguuauuga

SEQ ID NO: 1060475 - RNA, 19 nt, Homo sapiens
uaacaccuuguaacucauu

SEQ ID NO: 1060476 - RNA, 19 nt, Homo sapiens
aaguacaugugucguauca

SEQ ID NO: 1060477 - RNA, 19 nt, Homo sapiens
ggagugggaaguacaugug

SEQ ID NO: 1060478 - RNA, 19 nt, Homo sapiens
gagccagucccaagcaugu

SEQ ID NO: 1060479 - RNA, 19 nt, Homo sapiens
uucgaggaauucuuucuaa

SEQ ID NO: 1060480 - RNA, 19 nt, Homo sapiens
gaccuuugaaauacaguaa

SEQ ID NO: 1060481 - RNA, 19 nt, Homo sapiens
aaccgcuucucucaguuua

SEQ ID NO: 1060482 - RNA, 19 nt, Homo sapiens
gaacugaaugaggaacaug

SEQ ID NO: 1060483 - RNA, 19 nt, Homo sapiens
ugccauggcccuucuuuau

SEQ ID NO: 1060484 - RNA, 19 nt, Homo sapiens
ccuaggagcagauuguaau

SEQ ID NO: 1060485 - RNA, 19 nt, Homo sapiens
gaacaacguuaauguggua

SEQ ID NO: 1060486 - RNA, 19 nt, Homo sapiens
gaacuccucucauuucuug

SEQ ID NO: 1060487 - RNA, 19 nt, Homo sapiens
gaagauaucugggagagaa

SEQ ID NO: 1060488 - RNA, 19 nt, Homo sapiens
ggaaggacauugauauaug

SEQ ID NO: 1060489 - RNA, 19 nt, Homo sapiens
gaaggacauugauauauga

SEQ ID NO: 1060490 - RNA, 19 nt, Homo sapiens
gcauugaacuccucucauu

SEQ ID NO: 1060491 - RNA, 19 nt, Homo sapiens
gaaaacagaugucuugaaa

SEQ ID NO: 1060492 - RNA, 19 nt, Homo sapiens
gaacaugucuugguaccuu

SEQ ID NO: 1060493 - RNA, 19 nt, Homo sapiens
aaacagaugucuugaaaca

SEQ ID NO: 1060494 - RNA, 19 nt, Homo sapiens
ggaaauggaugaacuuagg

SEQ ID NO: 1060495 - RNA, 19 nt, Homo sapiens
acacagauguugagaaguu

SEQ ID NO: 1060496 - RNA, 19 nt, Homo sapiens
gcagauauuccaccuguaa

SEQ ID NO: 1060497 - RNA, 19 nt, Homo sapiens
ggaguaauuucucagcauu

SEQ ID NO: 1060498 - RNA, 19 nt, Homo sapiens
ugaaagaugugaauguaga

SEQ ID NO: 1060499 - RNA, 19 nt, Homo sapiens
gaaaacagcugacauggau

SEQ ID NO: 1060500 - RNA, 19 nt, Homo sapiens
caaaggaagugcugaugga

SEQ ID NO: 1060501 - RNA, 19 nt, Homo sapiens
guaugugucugaugauauu

SEQ ID NO: 1060502 - RNA, 19 nt, Homo sapiens
gcacugacauuagcagaau

SEQ ID NO: 1060503 - RNA, 19 nt, Homo sapiens
gaaaggcacugacauuagc

SEQ ID NO: 1060504 - RNA, 19 nt, Homo sapiens
gagaaagaaugcagagauc

SEQ ID NO: 1060505 - RNA, 19 nt, Homo sapiens
gccagaacaugucuuggua

SEQ ID NO: 1060506 - RNA, 19 nt, Homo sapiens
ccaccuaacuccagugaau

SEQ ID NO: 1060507 - RNA, 19 nt, Homo sapiens
ccaggucucugcugaauuc

SEQ ID NO: 1060508 - RNA, 19 nt, Homo sapiens
gagaagaaaguaaaugaga

SEQ ID NO: 1060509 - RNA, 19 nt, Homo sapiens
gaagaaaugaagaagaaga

SEQ ID NO: 1060510 - RNA, 19 nt, Homo sapiens
uagaagacaucccaaagga

SEQ ID NO: 1060511 - RNA, 19 nt, Homo sapiens
gaauaagugauggacauua

SEQ ID NO: 1060512 - RNA, 19 nt, Homo sapiens
ccaaugucgucuucaguuu

SEQ ID NO: 1060513 - RNA, 19 nt, Homo sapiens
gacauuagcagaauaagug

SEQ ID NO: 1060514 - RNA, 19 nt, Homo sapiens
gccauuggauuguuuccua

SEQ ID NO: 1060515 - RNA, 19 nt, Homo sapiens
gaacuaagcauuuuacuca

SEQ ID NO: 1060516 - RNA, 19 nt, Homo sapiens
cugaaugaaugaucuguaa

SEQ ID NO: 1060517 - RNA, 19 nt, Homo sapiens
gcugaauucucuuguugaa

SEQ ID NO: 1060518 - RNA, 19 nt, Homo sapiens
uagcugugcuccuuccaua

SEQ ID NO: 1060519 - RNA, 19 nt, Homo sapiens
gaacuuaggagcuauucau

SEQ ID NO: 1060520 - RNA, 19 nt, Homo sapiens
ggagugcucuguugaucau

SEQ ID NO: 1060521 - RNA, 19 nt, Homo sapiens
ccaccuaugugacaacuuc

SEQ ID NO: 1060522 - RNA, 19 nt, Homo sapiens
caacguuaaugugguauau

SEQ ID NO: 1060523 - RNA, 19 nt, Homo sapiens
gcuagugcuuccauuuauu

SEQ ID NO: 1060524 - RNA, 19 nt, Homo sapiens
gcuuuagacuucauauuuc

SEQ ID NO: 1060525 - RNA, 19 nt, Homo sapiens
ugagugaccuuuugauuuu

SEQ ID NO: 1060526 - RNA, 19 nt, Homo sapiens
cagaauaagugauggacau

SEQ ID NO: 1060527 - RNA, 19 nt, Homo sapiens
gcuaaaugccucuuucuuc

SEQ ID NO: 1060528 - RNA, 19 nt, Homo sapiens
guacggggcuaucaucuuu

SEQ ID NO: 1060529 - RNA, 19 nt, Homo sapiens
guaauuaugcgaauguuuc

SEQ ID NO: 1060530 - RNA, 19 nt, Homo sapiens
gaagaaaguaaaugagauc

SEQ ID NO: 1060531 - RNA, 19 nt, Homo sapiens
gcaagaugaacaacguuaa

SEQ ID NO: 1060532 - RNA, 19 nt, Homo sapiens
auucaaggcugcaagauga

SEQ ID NO: 1060533 - RNA, 19 nt, Homo sapiens
gagagaauauagaagacau

SEQ ID NO: 1060534 - RNA, 19 nt, Homo sapiens
gauuugagguacagcaugu

SEQ ID NO: 1060535 - RNA, 19 nt, Homo sapiens
gcugugcccuugaucaaau

SEQ ID NO: 1060536 - RNA, 19 nt, Homo sapiens
cuugacagcauauaacuua

SEQ ID NO: 1060537 - RNA, 19 nt, Homo sapiens
cagcgagccuuucagcuau

SEQ ID NO: 1060538 - RNA, 19 nt, Homo sapiens
ggcucaaacuuuaaacauu

SEQ ID NO: 1060539 - RNA, 19 nt, Homo sapiens
ucuguguucugaaguauaa

SEQ ID NO: 1060540 - RNA, 19 nt, Homo sapiens
gggcauguuuaauuuacuu

SEQ ID NO: 1060541 - RNA, 19 nt, Homo sapiens
uagaaggaacuaagcauuu

SEQ ID NO: 1060542 - RNA, 19 nt, Homo sapiens
gcagaaguccauauugcaa

SEQ ID NO: 1060543 - RNA, 19 nt, Homo sapiens
gaagcagaaguccauauug

SEQ ID NO: 1060544 - RNA, 19 nt, Homo sapiens
gaacuugacagcauauaac

SEQ ID NO: 1060545 - RNA, 19 nt, Homo sapiens
gaaguccauauugcaauua

SEQ ID NO: 1060546 - RNA, 19 nt, Homo sapiens
uaggagcuauucaucacua

SEQ ID NO: 1060547 - RNA, 19 nt, Homo sapiens
gguggcagcucagaaacaa

SEQ ID NO: 1060548 - RNA, 19 nt, Homo sapiens
agaaguccauauugcaauu

SEQ ID NO: 1060549 - RNA, 19 nt, Homo sapiens
caaaucaggauggcaauga

SEQ ID NO: 1060550 - RNA, 19 nt, Homo sapiens
ucaucugccuacacuauuu

SEQ ID NO: 1060551 - RNA, 19 nt, Homo sapiens
gaaggccaauagcauucaa

SEQ ID NO: 1060552 - RNA, 19 nt, Homo sapiens
cauacacacagcaggauua

SEQ ID NO: 1060553 - RNA, 19 nt, Homo sapiens
guagauagcgcuuuugaaa

SEQ ID NO: 1060554 - RNA, 19 nt, Homo sapiens
ggcuagugcuuccauuuau

SEQ ID NO: 1060555 - RNA, 19 nt, Homo sapiens
gcagcagcguuaauucauc

SEQ ID NO: 1060556 - RNA, 19 nt, Homo sapiens
gacagcauauaacuuaaag

SEQ ID NO: 1060557 - RNA, 19 nt, Homo sapiens
ggauggcaaugauucagau

SEQ ID NO: 1060558 - RNA, 19 nt, Homo sapiens
gugaagagaggaaugagaa

SEQ ID NO: 1060559 - RNA, 19 nt, Homo sapiens
cagcauguccugaaugaau

SEQ ID NO: 1060560 - RNA, 19 nt, Homo sapiens
uuacuucacuaacugcuau

SEQ ID NO: 1060561 - RNA, 19 nt, Homo sapiens
gaucaugguguucuacuuc

SEQ ID NO: 1060562 - RNA, 19 nt, Homo sapiens
uuucucagauguauucuug

SEQ ID NO: 1060563 - RNA, 19 nt, Homo sapiens
gcucuggucuaucccugaa

SEQ ID NO: 1060564 - RNA, 19 nt, Homo sapiens
uggaugaacuuaggagcua

SEQ ID NO: 1060565 - RNA, 19 nt, Homo sapiens
gaagaagagggaaauggau

SEQ ID NO: 1060566 - RNA, 19 nt, Homo sapiens
aagcauggcuggccugaag

SEQ ID NO: 1060567 - RNA, 19 nt, Homo sapiens
gaagaaaacagcugacaug

SEQ ID NO: 1060568 - RNA, 19 nt, Homo sapiens
gcacauucugucauucaaa

SEQ ID NO: 1060569 - RNA, 19 nt, Homo sapiens
ggauguccuuucucagaug

SEQ ID NO: 1060570 - RNA, 19 nt, Homo sapiens
agucugauguuccgcaauu

SEQ ID NO: 1060571 - RNA, 19 nt, Homo sapiens
acauguugguggguaauua

SEQ ID NO: 1060572 - RNA, 19 nt, Homo sapiens
ucaucuguguucugaagua

SEQ ID NO: 1060573 - RNA, 19 nt, Homo sapiens
gagcuauucaucacuaaug

SEQ ID NO: 1060574 - RNA, 19 nt, Homo sapiens
ggacugugcccaccuugug

SEQ ID NO: 1060575 - RNA, 19 nt, Homo sapiens
ucagcgagccuuucagcua

SEQ ID NO: 1060576 - RNA, 19 nt, Homo sapiens
aauaagugauggacauuag

SEQ ID NO: 1060577 - RNA, 19 nt, Homo sapiens
ugucuaggcucacgaucuu

SEQ ID NO: 1060578 - RNA, 19 nt, Homo sapiens
ccauuggauuguuuccuaa

SEQ ID NO: 1060579 - RNA, 19 nt, Homo sapiens
uaauagcacuuuggaacug

SEQ ID NO: 1060580 - RNA, 19 nt, Homo sapiens
uuaccugauuugugccuua

SEQ ID NO: 1060581 - RNA, 19 nt, Homo sapiens
gguuucaucuguguucuga

SEQ ID NO: 1060582 - RNA, 19 nt, Homo sapiens
uauauacgccguggucuaa

SEQ ID NO: 1060583 - RNA, 19 nt, Homo sapiens
gcugcagcuucuaguuuaa

SEQ ID NO: 1060584 - RNA, 19 nt, Homo sapiens
gucuuuaacucguucuuga

SEQ ID NO: 1060585 - RNA, 19 nt, Homo sapiens
ggaaggagcucuuuaugua

SEQ ID NO: 1060586 - RNA, 19 nt, Homo sapiens
caacagagaauaagaauga

SEQ ID NO: 1060587 - RNA, 19 nt, Homo sapiens
ggaccaggcuguacucuga

SEQ ID NO: 1060588 - RNA, 19 nt, Homo sapiens
ucaauaagcccucuucuaa

SEQ ID NO: 1060589 - RNA, 19 nt, Homo sapiens
guaaacauaucaccuacaa

SEQ ID NO: 1060590 - RNA, 19 nt, Homo sapiens
gaagacaacaaacgauaua

SEQ ID NO: 1060591 - RNA, 19 nt, Homo sapiens
gauacuagaugaggaguuu

SEQ ID NO: 1060592 - RNA, 19 nt, Homo sapiens
ccacccagcuguuaaaguu

SEQ ID NO: 1060593 - RNA, 19 nt, Homo sapiens
gcuaauggaucagaacgua

SEQ ID NO: 1060594 - RNA, 19 nt, Homo sapiens
gaugaacguucuauguauu

SEQ ID NO: 1060595 - RNA, 19 nt, Homo sapiens
gaugcuaggugaugugcua

SEQ ID NO: 1060596 - RNA, 19 nt, Homo sapiens
gaaagccaacagagaauaa

SEQ ID NO: 1060597 - RNA, 19 nt, Homo sapiens
gagcagaaagugaaguuaa

SEQ ID NO: 1060598 - RNA, 19 nt, Homo sapiens
gaacguauugccuggagua

SEQ ID NO: 1060599 - RNA, 19 nt, Homo sapiens
caacaaacgauauaacuca

SEQ ID NO: 1060600 - RNA, 19 nt, Homo sapiens
gcaauaaauccaguacuuu

SEQ ID NO: 1060601 - RNA, 19 nt, Homo sapiens
uaacucaacuauccagcaa

SEQ ID NO: 1060602 - RNA, 19 nt, Homo sapiens
ccauuuaggauguguauuu

SEQ ID NO: 1060603 - RNA, 19 nt, Homo sapiens
gaaaacagcccacuacuca

SEQ ID NO: 1060604 - RNA, 19 nt, Homo sapiens
ggaaagccaacagagaaua

SEQ ID NO: 1060605 - RNA, 19 nt, Homo sapiens
gaaaaugggccaggaauaa

SEQ ID NO: 1060606 - RNA, 19 nt, Homo sapiens
gcuaguguguguuugaaug

SEQ ID NO: 1060607 - RNA, 19 nt, Homo sapiens
caacuauccagcaaaguaa

SEQ ID NO: 1060608 - RNA, 19 nt, Homo sapiens
caauaaauccaguacuuug

SEQ ID NO: 1060609 - RNA, 19 nt, Homo sapiens
cugcugcacugaauaauga

SEQ ID NO: 1060610 - RNA, 19 nt, Homo sapiens
aaacauaucaccuacaauc

SEQ ID NO: 1060611 - RNA, 19 nt, Homo sapiens
ucaacuauccagcaaagua

SEQ ID NO: 1060612 - RNA, 19 nt, Homo sapiens
gauacgugauuucagcauu

SEQ ID NO: 1060613 - RNA, 19 nt, Homo sapiens
ugaugaacguucuauguau

SEQ ID NO: 1060614 - RNA, 19 nt, Homo sapiens
ggcaagcguuccaccauga

SEQ ID NO: 1060615 - RNA, 19 nt, Homo sapiens
caacucuugucuugacuga

SEQ ID NO: 1060616 - RNA, 19 nt, Homo sapiens
cauauuccauuuaggaugu

SEQ ID NO: 1060617 - RNA, 19 nt, Homo sapiens
uagauucucuggcauuuag

SEQ ID NO: 1060618 - RNA, 19 nt, Homo sapiens
auacagaagucaagaucaa

SEQ ID NO: 1060619 - RNA, 19 nt, Homo sapiens
agauggcccucguaccuua

SEQ ID NO: 1060620 - RNA, 19 nt, Homo sapiens
gaacucagaaacucaaugg

SEQ ID NO: 1060621 - RNA, 19 nt, Homo sapiens
gguguguacuuuaaucaau

SEQ ID NO: 1060622 - RNA, 19 nt, Homo sapiens
cuauguauuucaucggaua

SEQ ID NO: 1060623 - RNA, 19 nt, Homo sapiens
acucuugucuugacugauu

SEQ ID NO: 1060624 - RNA, 19 nt, Homo sapiens
uuaaugaaguacccgugua

SEQ ID NO: 1060625 - RNA, 19 nt, Homo sapiens
gcaagcuaccgacuagaaa

SEQ ID NO: 1060626 - RNA, 19 nt, Homo sapiens
acaguggcguggaaacuuu

SEQ ID NO: 1060627 - RNA, 19 nt, Homo sapiens
caggguggaucauguuaug

SEQ ID NO: 1060628 - RNA, 19 nt, Homo sapiens
uaagauauucugucuguag

SEQ ID NO: 1060629 - RNA, 19 nt, Homo sapiens
ggauguguauuuaaugcau

SEQ ID NO: 1060630 - RNA, 19 nt, Homo sapiens
aauaagcccucuucuaagg

SEQ ID NO: 1060631 - RNA, 19 nt, Homo sapiens
ggaccugugugguguguac

SEQ ID NO: 1060632 - RNA, 19 nt, Homo sapiens
gacuugcucucucuaaaca

SEQ ID NO: 1060633 - RNA, 19 nt, Homo sapiens
aaaugaagcucucuuugac

SEQ ID NO: 1060634 - RNA, 19 nt, Homo sapiens
cagagaauaagaaugauga

SEQ ID NO: 1060635 - RNA, 19 nt, Homo sapiens
cucagaaacucaauggaaa

SEQ ID NO: 1060636 - RNA, 19 nt, Homo sapiens
gggaaggagcucuuuaugu

SEQ ID NO: 1060637 - RNA, 19 nt, Homo sapiens
guaaugacgauaaaguguu

SEQ ID NO: 1060638 - RNA, 19 nt, Homo sapiens
ggcauuuagucucuucaaa

SEQ ID NO: 1060639 - RNA, 19 nt, Homo sapiens
caaacgauauaacucaacu

SEQ ID NO: 1060640 - RNA, 19 nt, Homo sapiens
auaaucaguuggacaucua

SEQ ID NO: 1060641 - RNA, 19 nt, Homo sapiens
gacaauaacagaaugacau

SEQ ID NO: 1060642 - RNA, 19 nt, Homo sapiens
cagcauauuccauuuagga

SEQ ID NO: 1060643 - RNA, 19 nt, Homo sapiens
uauugaagauuggaccuaa

SEQ ID NO: 1060644 - RNA, 19 nt, Homo sapiens
cauaucaccuacaaucagu

SEQ ID NO: 1060645 - RNA, 19 nt, Homo sapiens
aagaagacaacaaacgaua

SEQ ID NO: 1060646 - RNA, 19 nt, Homo sapiens
ccaagaagacaacaaacga

SEQ ID NO: 1060647 - RNA, 19 nt, Homo sapiens
acagauccaucaccucaug

SEQ ID NO: 1060648 - RNA, 19 nt, Homo sapiens
ugauuaauccacuugagua

SEQ ID NO: 1060649 - RNA, 19 nt, Homo sapiens
ugugugguguguacuuuaa

SEQ ID NO: 1060650 - RNA, 19 nt, Homo sapiens
gcuaggugaugugcuaaug

SEQ ID NO: 1060651 - RNA, 19 nt, Homo sapiens
aagugcagcucaccaaaga

SEQ ID NO: 1060652 - RNA, 19 nt, Homo sapiens
ggaagugcagcucaccaaa

SEQ ID NO: 1060653 - RNA, 19 nt, Homo sapiens
acaaucaguucagaaucua

SEQ ID NO: 1060654 - RNA, 19 nt, Homo sapiens
agcaauaaauccaguacuu

SEQ ID NO: 1060655 - RNA, 19 nt, Homo sapiens
uaaugaaguacccguguaa

SEQ ID NO: 1060656 - RNA, 19 nt, Homo sapiens
auucagugcucaagaguga

SEQ ID NO: 1060657 - RNA, 19 nt, Homo sapiens
gagccuguuuaauggauau

SEQ ID NO: 1060658 - RNA, 19 nt, Homo sapiens
gagagcagaaagugaaguu

SEQ ID NO: 1060659 - RNA, 19 nt, Homo sapiens
ggaccuaacaauggaaaga

SEQ ID NO: 1060660 - RNA, 19 nt, Homo sapiens
uacaaucaguucagaaucu

SEQ ID NO: 1060661 - RNA, 19 nt, Homo sapiens
cagcaaaguaaacauauca

SEQ ID NO: 1060662 - RNA, 19 nt, Homo sapiens
uaauggaucagaacguauu

SEQ ID NO: 1060663 - RNA, 19 nt, Homo sapiens
agcagaaagugaaguuaaa

SEQ ID NO: 1060664 - RNA, 19 nt, Homo sapiens
aauuauuccuggaugcuaa

SEQ ID NO: 1060665 - RNA, 19 nt, Homo sapiens
gcucaagagugaagaaaau

SEQ ID NO: 1060666 - RNA, 19 nt, Homo sapiens
caaggccuauugauucagu

SEQ ID NO: 1060667 - RNA, 19 nt, Homo sapiens
ggucuccacccagcuguua

SEQ ID NO: 1060668 - RNA, 19 nt, Homo sapiens
ggagcucuuuauguacuuu

SEQ ID NO: 1060669 - RNA, 19 nt, Homo sapiens
gugcagcucaccaaagauu

SEQ ID NO: 1060670 - RNA, 19 nt, Homo sapiens
gaagugcagcucaccaaag

SEQ ID NO: 1060671 - RNA, 19 nt, Homo sapiens
ccuccucuguuucauagaa

SEQ ID NO: 1060672 - RNA, 19 nt, Homo sapiens
ccgacuagaaauacuauaa

SEQ ID NO: 1060673 - RNA, 19 nt, Homo sapiens
uaugcaagcuaccgacuag

SEQ ID NO: 1060674 - RNA, 19 nt, Homo sapiens
uaggugaugugcuaaugga

SEQ ID NO: 1060675 - RNA, 19 nt, Homo sapiens
gaacguucuauguauuuca

SEQ ID NO: 1060676 - RNA, 19 nt, Homo sapiens
uuuagucucuucaaacugu

SEQ ID NO: 1060677 - RNA, 19 nt, Homo sapiens
aaacaguauugaagauugg

SEQ ID NO: 1060678 - RNA, 19 nt, Homo sapiens
uggaaaaccucauacagaa

SEQ ID NO: 1060679 - RNA, 19 nt, Homo sapiens
caucaugauuaauccacuu

SEQ ID NO: 1060680 - RNA, 19 nt, Homo sapiens
guuugguccuccucuguuu

SEQ ID NO: 1060681 - RNA, 19 nt, Homo sapiens
ccagcaaaguaaacauauc

SEQ ID NO: 1060682 - RNA, 19 nt, Homo sapiens
gacaacaaacgauauaacu

SEQ ID NO: 1060683 - RNA, 19 nt, Homo sapiens
ugaaguacccguguaauac

SEQ ID NO: 1060684 - RNA, 19 nt, Homo sapiens
ggacaauaacagaaugaca

SEQ ID NO: 1060685 - RNA, 19 nt, Homo sapiens
gggaauaacucaaauguau

SEQ ID NO: 1060686 - RNA, 19 nt, Homo sapiens
uuaaagagcuggccaauga

SEQ ID NO: 1060687 - RNA, 19 nt, Homo sapiens
gaagcuggguuaacucuuu

SEQ ID NO: 1060688 - RNA, 19 nt, Homo sapiens
gaacgagugugacaauaug

SEQ ID NO: 1060689 - RNA, 19 nt, Homo sapiens
ggaucuaacucucaaggua

SEQ ID NO: 1060690 - RNA, 19 nt, Homo sapiens
gaagucaccucgcguuguu

SEQ ID NO: 1060691 - RNA, 19 nt, Homo sapiens
gaauaggguuuguagaaga

SEQ ID NO: 1060692 - RNA, 19 nt, Homo sapiens
aaacggagcuaucaacaau

SEQ ID NO: 1060693 - RNA, 19 nt, Homo sapiens
ggacagauguacauagaag

SEQ ID NO: 1060694 - RNA, 19 nt, Homo sapiens
ccagaaaguccaagauaua

SEQ ID NO: 1060695 - RNA, 19 nt, Homo sapiens
ggaaguggaucgcuaugau

SEQ ID NO: 1060696 - RNA, 19 nt, Homo sapiens
gaaggugccuacucauugu

SEQ ID NO: 1060697 - RNA, 19 nt, Homo sapiens
agaagagacuaauggauaa

SEQ ID NO: 1060698 - RNA, 19 nt, Homo sapiens
uagaagagacuaauggaua

SEQ ID NO: 1060699 - RNA, 19 nt, Homo sapiens
agacaagugugguuaacua

SEQ ID NO: 1060700 - RNA, 19 nt, Homo sapiens
gauggcagguguccagaaa

SEQ ID NO: 1060701 - RNA, 19 nt, Homo sapiens
uggauaaaccuacaaguua

SEQ ID NO: 1060702 - RNA, 19 nt, Homo sapiens
cauagaaggugccuacuca

SEQ ID NO: 1060703 - RNA, 19 nt, Homo sapiens
gcacaauuacuuucauuug

SEQ ID NO: 1060704 - RNA, 19 nt, Homo sapiens
guacucacuugaagaaaug

SEQ ID NO: 1060705 - RNA, 19 nt, Homo sapiens
guaaugaaggcucuacuuu

SEQ ID NO: 1060706 - RNA, 19 nt, Homo sapiens
gucaagaugucacugguaa

SEQ ID NO: 1060707 - RNA, 19 nt, Homo sapiens
gaacacaauugcucuucuc

SEQ ID NO: 1060708 - RNA, 19 nt, Homo sapiens
caaagggaauaacucaaau

SEQ ID NO: 1060709 - RNA, 19 nt, Homo sapiens
ccaaagggaauaacucaaa

SEQ ID NO: 1060710 - RNA, 19 nt, Homo sapiens
gguuaacucuuuacugugu

SEQ ID NO: 1060711 - RNA, 19 nt, Homo sapiens
augaauaucugcucaauca

SEQ ID NO: 1060712 - RNA, 19 nt, Homo sapiens
ggaacgagugugacaauau

SEQ ID NO: 1060713 - RNA, 19 nt, Homo sapiens
uguauuagguuaagcucua

SEQ ID NO: 1060714 - RNA, 19 nt, Homo sapiens
gcuagaauguuuguugaug

SEQ ID NO: 1060715 - RNA, 19 nt, Homo sapiens
ccucugacaugcucuuuga

SEQ ID NO: 1060716 - RNA, 19 nt, Homo sapiens
caacaauccuguacucacu

SEQ ID NO: 1060717 - RNA, 19 nt, Homo sapiens
uuagagaacuguccacauc

SEQ ID NO: 1060718 - RNA, 19 nt, Homo sapiens
gggcacaauuacuuucauu

SEQ ID NO: 1060719 - RNA, 19 nt, Homo sapiens
uaggacagauguacauaga

SEQ ID NO: 1060720 - RNA, 19 nt, Homo sapiens
ugucaucacuuccacuuug

SEQ ID NO: 1060721 - RNA, 19 nt, Homo sapiens
caugcucuuugauuuguua

SEQ ID NO: 1060722 - RNA, 19 nt, Homo sapiens
cacaauugcucuucucugu

SEQ ID NO: 1060723 - RNA, 19 nt, Homo sapiens
gaauguuuguugauguaug

SEQ ID NO: 1060724 - RNA, 19 nt, Homo sapiens
uaaucuggcuuccgauaau

SEQ ID NO: 1060725 - RNA, 19 nt, Homo sapiens
gacaugcucuuugauuugu

SEQ ID NO: 1060726 - RNA, 19 nt, Homo sapiens
gaaaguccaagauauaguc

SEQ ID NO: 1060727 - RNA, 19 nt, Homo sapiens
gcaccugggucaagauguc

SEQ ID NO: 1060728 - RNA, 19 nt, Homo sapiens
ccaagguccggguaucuua

SEQ ID NO: 1060729 - RNA, 19 nt, Homo sapiens
gaauaucugcucaaucauc

SEQ ID NO: 1060730 - RNA, 19 nt, Homo sapiens
cgaggaagcuggguuaacu

SEQ ID NO: 1060731 - RNA, 19 nt, Homo sapiens
ccuaugcacuguacacaau

SEQ ID NO: 1060732 - RNA, 19 nt, Homo sapiens
caagugugguuaacuacau

SEQ ID NO: 1060733 - RNA, 19 nt, Homo sapiens
ccaaucagacugugaaauc

SEQ ID NO: 1060734 - RNA, 19 nt, Homo sapiens
uggguuaacucuuuacugu

SEQ ID NO: 1060735 - RNA, 19 nt, Homo sapiens
gaacuguccacaucaaugg

SEQ ID NO: 1060736 - RNA, 19 nt, Homo sapiens
gauaauccaaagggaauaa

SEQ ID NO: 1060737 - RNA, 19 nt, Homo sapiens
aagcuggguuaacucuuua

SEQ ID NO: 1060738 - RNA, 19 nt, Homo sapiens
gaucuaacucucaagguau

SEQ ID NO: 1060739 - RNA, 19 nt, Homo sapiens
gggaggaacagcauguaaa

SEQ ID NO: 1060740 - RNA, 19 nt, Homo sapiens
ggaauaacucaaauguaug

SEQ ID NO: 1060741 - RNA, 19 nt, Homo sapiens
guaaucuggcuuccgauaa

SEQ ID NO: 1060742 - RNA, 19 nt, Homo sapiens
ggaacacaauugcucuucu

SEQ ID NO: 1060743 - RNA, 19 nt, Homo sapiens
ugacagaaaugaguaugca

SEQ ID NO: 1060744 - RNA, 19 nt, Homo sapiens
cugacaugcucuuugauuu

SEQ ID NO: 1060745 - RNA, 19 nt, Homo sapiens
uggcagguguccagaaaga

SEQ ID NO: 1060746 - RNA, 19 nt, Homo sapiens
gaagagacuaauggauaaa

SEQ ID NO: 1060747 - RNA, 19 nt, Homo sapiens
gaaguggaucgcuaugaug

SEQ ID NO: 1060748 - RNA, 19 nt, Homo sapiens
cacaauuacuuucauuugg

SEQ ID NO: 1060749 - RNA, 19 nt, Homo sapiens
ucaaucaucgggcacaauu

SEQ ID NO: 1060750 - RNA, 19 nt, Homo sapiens
gagugugacaauaugaaua

SEQ ID NO: 1060751 - RNA, 19 nt, Homo sapiens
cggcuagaauguuuguuga

SEQ ID NO: 1060752 - RNA, 19 nt, Homo sapiens
caagcacccugucaugucu

SEQ ID NO: 1060753 - RNA, 19 nt, Homo sapiens
cuucaaagaggacuuggua

SEQ ID NO: 1060754 - RNA, 19 nt, Homo sapiens
uagccuagccuuugacaga

SEQ ID NO: 1060755 - RNA, 19 nt, Homo sapiens
ugacaugcucuuugauuug

SEQ ID NO: 1060756 - RNA, 19 nt, Homo sapiens
gccaaugacuuuugaauag

SEQ ID NO: 1060757 - RNA, 19 nt, Homo sapiens
uaaaugggaagaaacuguu

SEQ ID NO: 1060758 - RNA, 19 nt, Homo sapiens
ggagcugagugaggaguug

SEQ ID NO: 1060759 - RNA, 19 nt, Homo sapiens
ugaauaggguuuguagaag

SEQ ID NO: 1060760 - RNA, 19 nt, Homo sapiens
gcaacgagccacauaagcu

SEQ ID NO: 1060761 - RNA, 19 nt, Homo sapiens
uccagaaaguccaagauau

SEQ ID NO: 1060762 - RNA, 19 nt, Homo sapiens
agaaggugccuacucauug

SEQ ID NO: 1060763 - RNA, 19 nt, Homo sapiens
cuagaauguuuguugaugu

SEQ ID NO: 1060764 - RNA, 19 nt, Homo sapiens
ggcaaaacccuaugacuuu

SEQ ID NO: 1060765 - RNA, 19 nt, Homo sapiens
uguagagccuaauagaaga

SEQ ID NO: 1060766 - RNA, 19 nt, Homo sapiens
uaucaacaauccuguacuc

SEQ ID NO: 1060767 - RNA, 19 nt, Homo sapiens
agagaacuguccacaucaa

SEQ ID NO: 1060768 - RNA, 19 nt, Homo sapiens
ggagacaagugugguuaac

SEQ ID NO: 1060769 - RNA, 19 nt, Homo sapiens
gaacgucuucucgguccua

SEQ ID NO: 1060770 - RNA, 19 nt, Homo sapiens
ggacuucagcgccauugau

SEQ ID NO: 1060771 - RNA, 19 nt, Homo sapiens
caagaguagugaggacuuc

SEQ ID NO: 1060772 - RNA, 19 nt, Homo sapiens
aagaggacuugguagcauu

SEQ ID NO: 1060773 - RNA, 19 nt, Homo sapiens
uagaaggugccuacucauu

SEQ ID NO: 1060774 - RNA, 19 nt, Homo sapiens
guugauguaugaguuuaga

SEQ ID NO: 1060775 - RNA, 19 nt, Homo sapiens
ucaugucugugucuuacaa

SEQ ID NO: 1060776 - RNA, 19 nt, Homo sapiens
uguacucacuugaagaaau

SEQ ID NO: 1060777 - RNA, 19 nt, Homo sapiens
gcacuaggacagauguaca

SEQ ID NO: 1060778 - RNA, 19 nt, Homo sapiens
ggacaaaagagugugauuu

SEQ ID NO: 1060779 - RNA, 19 nt, Homo sapiens
gguaaugaaggcucuacuu

SEQ ID NO: 1060780 - RNA, 19 nt, Homo sapiens
ccuguuugguucauuguau

SEQ ID NO: 1060781 - RNA, 19 nt, Homo sapiens
uugaauaggguuuguagaa

SEQ ID NO: 1060782 - RNA, 19 nt, Homo sapiens
guguagagccuaauagaag

SEQ ID NO: 1060783 - RNA, 19 nt, Homo sapiens
gguguagagccuaauagaa

SEQ ID NO: 1060784 - RNA, 19 nt, Homo sapiens
caaggaaguggaucgcuau

SEQ ID NO: 1060785 - RNA, 19 nt, Homo sapiens
caaaugagcugauggaaga

SEQ ID NO: 1060786 - RNA, 19 nt, Homo sapiens
gaacagagcuccugacaac

SEQ ID NO: 1060787 - RNA, 19 nt, Homo sapiens
caagaagacugccaaugaa

SEQ ID NO: 1060788 - RNA, 19 nt, Homo sapiens
caagaaggauugucagaga

SEQ ID NO: 1060789 - RNA, 19 nt, Homo sapiens
ucaagaaccucaacaugaa

SEQ ID NO: 1060790 - RNA, 19 nt, Homo sapiens
ccaaugaauuucccuguuu

SEQ ID NO: 1060791 - RNA, 19 nt, Homo sapiens
ccaaucaacucauucagaa

SEQ ID NO: 1060792 - RNA, 19 nt, Homo sapiens
gaagacugccaaugaauuu

SEQ ID NO: 1060793 - RNA, 19 nt, Homo sapiens
gcacacaugucagcauuga

SEQ ID NO: 1060794 - RNA, 19 nt, Homo sapiens
gaacucauaggcucaagua

SEQ ID NO: 1060795 - RNA, 19 nt, Homo sapiens
guucagcucuugacacaaa

SEQ ID NO: 1060796 - RNA, 19 nt, Homo sapiens
ggaacuaucuccucucucu

SEQ ID NO: 1060797 - RNA, 19 nt, Homo sapiens
gaauuacaguuccaagaug

SEQ ID NO: 1060798 - RNA, 19 nt, Homo sapiens
ucaagaagacugccaauga

SEQ ID NO: 1060799 - RNA, 19 nt, Homo sapiens
ggaagaugauggcccagaa

SEQ ID NO: 1060800 - RNA, 19 nt, Homo sapiens
ccaaagugcuggaauuaca

SEQ ID NO: 1060801 - RNA, 19 nt, Homo sapiens
cgaaggaacuauuugaaca

SEQ ID NO: 1060802 - RNA, 19 nt, Homo sapiens
gggccuagaacccaaauua

SEQ ID NO: 1060803 - RNA, 19 nt, Homo sapiens
gauggaagaucuguuugaa

SEQ ID NO: 1060804 - RNA, 19 nt, Homo sapiens
gaagccaccuauagagaga

SEQ ID NO: 1060805 - RNA, 19 nt, Homo sapiens
gauaaacagugccaagaag

SEQ ID NO: 1060806 - RNA, 19 nt, Homo sapiens
gaagggacugaguuucuua

SEQ ID NO: 1060807 - RNA, 19 nt, Homo sapiens
gaagagauccagccacauc

SEQ ID NO: 1060808 - RNA, 19 nt, Homo sapiens
uuucauguauccagaguua

SEQ ID NO: 1060809 - RNA, 19 nt, Homo sapiens
ucacuucccuguacucuca

SEQ ID NO: 1060810 - RNA, 19 nt, Homo sapiens
uuaaagagcugggaaccuu

SEQ ID NO: 1060811 - RNA, 19 nt, Homo sapiens
gacagggucuugccauguu

SEQ ID NO: 1060812 - RNA, 19 nt, Homo sapiens
gagaagaggagguggagaa

SEQ ID NO: 1060813 - RNA, 19 nt, Homo sapiens
ggcgguggcuguaacauga

SEQ ID NO: 1060814 - RNA, 19 nt, Homo sapiens
ggaagcaaaugagcugaug

SEQ ID NO: 1060815 - RNA, 19 nt, Homo sapiens
gcaccaggauaugucuuaa

SEQ ID NO: 1060816 - RNA, 19 nt, Homo sapiens
cuagagagguaggaaauau

SEQ ID NO: 1060817 - RNA, 19 nt, Homo sapiens
gcauaggguguaaccaaua

SEQ ID NO: 1060818 - RNA, 19 nt, Homo sapiens
cagcacacaugucagcauu

SEQ ID NO: 1060819 - RNA, 19 nt, Homo sapiens
uugaacagcugaagaugaa

SEQ ID NO: 1060820 - RNA, 19 nt, Homo sapiens
caaugaauuucccuguuug

SEQ ID NO: 1060821 - RNA, 19 nt, Homo sapiens
acacaaauccaccuucuug

SEQ ID NO: 1060822 - RNA, 19 nt, Homo sapiens
gaacagcugaagaugaaga

SEQ ID NO: 1060823 - RNA, 19 nt, Homo sapiens
uagaggaaguugucaagau

SEQ ID NO: 1060824 - RNA, 19 nt, Homo sapiens
ccggauuccucacccaaua

SEQ ID NO: 1060825 - RNA, 19 nt, Homo sapiens
caagcaagguuuucaugua

SEQ ID NO: 1060826 - RNA, 19 nt, Homo sapiens
cuaugcagcugauugaaga

SEQ ID NO: 1060827 - RNA, 19 nt, Homo sapiens
ucuguuaucuucacuguuc

SEQ ID NO: 1060828 - RNA, 19 nt, Homo sapiens
gcugauggaagaucuguuu

SEQ ID NO: 1060829 - RNA, 19 nt, Homo sapiens
gccagggccuuucgcugua

SEQ ID NO: 1060830 - RNA, 19 nt, Homo sapiens
uggccaaccuacuaaauga

SEQ ID NO: 1060831 - RNA, 19 nt, Homo sapiens
agaggaaguugucaagaug

SEQ ID NO: 1060832 - RNA, 19 nt, Homo sapiens
gaacaccggcucccauucu

SEQ ID NO: 1060833 - RNA, 19 nt, Homo sapiens
ggaaaaugcugugaagaga

SEQ ID NO: 1060834 - RNA, 19 nt, Homo sapiens
cuuuaggacugaagcauuu

SEQ ID NO: 1060835 - RNA, 19 nt, Homo sapiens
ccaaggcugaggacaauuu

SEQ ID NO: 1060836 - RNA, 19 nt, Homo sapiens
gccaaugaauuucccuguu

SEQ ID NO: 1060837 - RNA, 19 nt, Homo sapiens
gaaaacaccagcccaauca

SEQ ID NO: 1060838 - RNA, 19 nt, Homo sapiens
gguguaguccugaaacuga

SEQ ID NO: 1060839 - RNA, 19 nt, Homo sapiens
gccaguagcaccaggauau

SEQ ID NO: 1060840 - RNA, 19 nt, Homo sapiens
gcgcauaggguguaaccaa

SEQ ID NO: 1060841 - RNA, 19 nt, Homo sapiens
gacagaagcguucaucagu

SEQ ID NO: 1060842 - RNA, 19 nt, Homo sapiens
gcuauugccuaagggugua

SEQ ID NO: 1060843 - RNA, 19 nt, Homo sapiens
gagccucaagcuaacuuua

SEQ ID NO: 1060844 - RNA, 19 nt, Homo sapiens
ccacugcuauugccuaagg

SEQ ID NO: 1060845 - RNA, 19 nt, Homo sapiens
gcuccugacaacaucauua

SEQ ID NO: 1060846 - RNA, 19 nt, Homo sapiens
caccaaggcugaggacaau

SEQ ID NO: 1060847 - RNA, 19 nt, Homo sapiens
cauaggguguaaccaauag

SEQ ID NO: 1060848 - RNA, 19 nt, Homo sapiens
ucuuugagcuaggagaaua

SEQ ID NO: 1060849 - RNA, 19 nt, Homo sapiens
ccaggagucucuaaacaac

SEQ ID NO: 1060850 - RNA, 19 nt, Homo sapiens
ccucuuccauguuucgaaa

SEQ ID NO: 1060851 - RNA, 19 nt, Homo sapiens
agaaggagguagagaaggu

SEQ ID NO: 1060852 - RNA, 19 nt, Homo sapiens
ggaauauacuuuugcuuca

SEQ ID NO: 1060853 - RNA, 19 nt, Homo sapiens
ugaagggacugaguuucuu

SEQ ID NO: 1060854 - RNA, 19 nt, Homo sapiens
guuccaacccuguaacuug

SEQ ID NO: 1060855 - RNA, 19 nt, Homo sapiens
ugacacaaauccaccuucu

SEQ ID NO: 1060856 - RNA, 19 nt, Homo sapiens
ucagauagcgaaggaacua

SEQ ID NO: 1060857 - RNA, 19 nt, Homo sapiens
guacuuaaaccccagauuu

SEQ ID NO: 1060858 - RNA, 19 nt, Homo sapiens
aauuacaguuccaagauga

SEQ ID NO: 1060859 - RNA, 19 nt, Homo sapiens
gaaggauugucagagaaca

SEQ ID NO: 1060860 - RNA, 19 nt, Homo sapiens
ugauggugcuagagaggua

SEQ ID NO: 1060861 - RNA, 19 nt, Homo sapiens
ggagguagagaagguuaaa

SEQ ID NO: 1060862 - RNA, 19 nt, Homo sapiens
gcagaaggagguagagaag

SEQ ID NO: 1060863 - RNA, 19 nt, Homo sapiens
aagaaggauugucagagaa

SEQ ID NO: 1060864 - RNA, 19 nt, Homo sapiens
cgauaaacagugccaagaa

SEQ ID NO: 1060865 - RNA, 19 nt, Homo sapiens
aggacaagcuucccucugu

SEQ ID NO: 1060866 - RNA, 19 nt, Homo sapiens
cucauaggcucaaguaauc

SEQ ID NO: 1060867 - RNA, 19 nt, Homo sapiens
gccuagaacccaaauuaga

SEQ ID NO: 1060868 - RNA, 19 nt, Homo sapiens
gcuagagagguaggaaaua

SEQ ID NO: 1060869 - RNA, 19 nt, Homo sapiens
caucuguuaucuucacugu

SEQ ID NO: 1060870 - RNA, 19 nt, Homo sapiens
gaaucaagaaccucaacau

SEQ ID NO: 1060871 - RNA, 19 nt, Homo sapiens
agagagguaggaaauauga

SEQ ID NO: 1060872 - RNA, 19 nt, Homo sapiens
uuucuuaacccucuaauca

SEQ ID NO: 1060873 - RNA, 19 nt, Homo sapiens
agaguuacuuccagugugu

SEQ ID NO: 1060874 - RNA, 19 nt, Homo sapiens
agaagacugccaaugaauu

SEQ ID NO: 1060875 - RNA, 19 nt, Homo sapiens
ugacugcagcccucauaaa

SEQ ID NO: 1060876 - RNA, 19 nt, Homo sapiens
ccuacuaaaugaacaacau

SEQ ID NO: 1060877 - RNA, 19 nt, Homo sapiens
ggaacuacuggccaaccua

SEQ ID NO: 1060878 - RNA, 19 nt, Homo sapiens
gcuaggagaauaagagucu

SEQ ID NO: 1060879 - RNA, 19 nt, Homo sapiens
ggaaauaugacuggaacca

SEQ ID NO: 1060880 - RNA, 19 nt, Homo sapiens
gaugggauucuccaacaug

SEQ ID NO: 1060881 - RNA, 19 nt, Homo sapiens
uguguucccugaaggcaaa

SEQ ID NO: 1060882 - RNA, 19 nt, Homo sapiens
ggauuucuuugagcuagga

SEQ ID NO: 1060883 - RNA, 19 nt, Homo sapiens
ggauuuagaggaaguuguc

SEQ ID NO: 1060884 - RNA, 19 nt, Homo sapiens
gucucacccuuaauuguuu

SEQ ID NO: 1060885 - RNA, 19 nt, Homo sapiens
caaaugagcugauggaaga

SEQ ID NO: 1060886 - RNA, 19 nt, Homo sapiens
gaacagagcuccugacaac

SEQ ID NO: 1060887 - RNA, 19 nt, Homo sapiens
caagaagacugccaaugaa

SEQ ID NO: 1060888 - RNA, 19 nt, Homo sapiens
caagaaggauugucagaga

SEQ ID NO: 1060889 - RNA, 19 nt, Homo sapiens
ucaagaaccucaacaugaa

SEQ ID NO: 1060890 - RNA, 19 nt, Homo sapiens
ccaaugaauuucccuguuu

SEQ ID NO: 1060891 - RNA, 19 nt, Homo sapiens
ccaaucaacucauucagaa

SEQ ID NO: 1060892 - RNA, 19 nt, Homo sapiens
gaagacugccaaugaauuu

SEQ ID NO: 1060893 - RNA, 19 nt, Homo sapiens
gcacacaugucagcauuga

SEQ ID NO: 1060894 - RNA, 19 nt, Homo sapiens
guucagcucuugacacaaa

SEQ ID NO: 1060895 - RNA, 19 nt, Homo sapiens
ggaacuaucuccucucucu

SEQ ID NO: 1060896 - RNA, 19 nt, Homo sapiens
gacaacaaguaccuucuaa

SEQ ID NO: 1060897 - RNA, 19 nt, Homo sapiens
ucaagaagacugccaauga

SEQ ID NO: 1060898 - RNA, 19 nt, Homo sapiens
ggaagaugauggcccagaa

SEQ ID NO: 1060899 - RNA, 19 nt, Homo sapiens
cgaaggaacuauuugaaca

SEQ ID NO: 1060900 - RNA, 19 nt, Homo sapiens
gggccuagaacccaaauua

SEQ ID NO: 1060901 - RNA, 19 nt, Homo sapiens
gauggaagaucuguuugaa

SEQ ID NO: 1060902 - RNA, 19 nt, Homo sapiens
gaagccaccuauagagaga

SEQ ID NO: 1060903 - RNA, 19 nt, Homo sapiens
gauaaacagugccaagaag

SEQ ID NO: 1060904 - RNA, 19 nt, Homo sapiens
gaagagauccagccacauc

SEQ ID NO: 1060905 - RNA, 19 nt, Homo sapiens
uuucauguauccagaguua

SEQ ID NO: 1060906 - RNA, 19 nt, Homo sapiens
ucacuucccuguacucuca

SEQ ID NO: 1060907 - RNA, 19 nt, Homo sapiens
ggacaacaaguaccuucua

SEQ ID NO: 1060908 - RNA, 19 nt, Homo sapiens
uuaaagagcugggaaccuu

SEQ ID NO: 1060909 - RNA, 19 nt, Homo sapiens
ggcgguggcuguaacauga

SEQ ID NO: 1060910 - RNA, 19 nt, Homo sapiens
ggaagcaaaugagcugaug

SEQ ID NO: 1060911 - RNA, 19 nt, Homo sapiens
gcaccaggauaugucuuaa

SEQ ID NO: 1060912 - RNA, 19 nt, Homo sapiens
cuagagagguaggaaauau

SEQ ID NO: 1060913 - RNA, 19 nt, Homo sapiens
gcauaggguguaaccaaua

SEQ ID NO: 1060914 - RNA, 19 nt, Homo sapiens
cagcacacaugucagcauu

SEQ ID NO: 1060915 - RNA, 19 nt, Homo sapiens
uugaacagcugaagaugaa

SEQ ID NO: 1060916 - RNA, 19 nt, Homo sapiens
caaugaauuucccuguuug

SEQ ID NO: 1060917 - RNA, 19 nt, Homo sapiens
acacaaauccaccuucuug

SEQ ID NO: 1060918 - RNA, 19 nt, Homo sapiens
gaacagcugaagaugaaga

SEQ ID NO: 1060919 - RNA, 19 nt, Homo sapiens
uagaggaaguugucaagau

SEQ ID NO: 1060920 - RNA, 19 nt, Homo sapiens
ccggauuccucacccaaua

SEQ ID NO: 1060921 - RNA, 19 nt, Homo sapiens
caagcaagguuuucaugua

SEQ ID NO: 1060922 - RNA, 19 nt, Homo sapiens
cuaugcagcugauugaaga

SEQ ID NO: 1060923 - RNA, 19 nt, Homo sapiens
ucuguuaucuucacuguuc

SEQ ID NO: 1060924 - RNA, 19 nt, Homo sapiens
gcugauggaagaucuguuu

SEQ ID NO: 1060925 - RNA, 19 nt, Homo sapiens
gccagggccuuucgcugua

SEQ ID NO: 1060926 - RNA, 19 nt, Homo sapiens
uggccaaccuacuaaauga

SEQ ID NO: 1060927 - RNA, 19 nt, Homo sapiens
agaggaaguugucaagaug

SEQ ID NO: 1060928 - RNA, 19 nt, Homo sapiens
gaacaccggcucccauucu

SEQ ID NO: 1060929 - RNA, 19 nt, Homo sapiens
ggaaaaugcugugaagaga

SEQ ID NO: 1060930 - RNA, 19 nt, Homo sapiens
gccaaugaauuucccuguu

SEQ ID NO: 1060931 - RNA, 19 nt, Homo sapiens
gaaaacaccagcccaauca

SEQ ID NO: 1060932 - RNA, 19 nt, Homo sapiens
gguguaguccugaaacuga

SEQ ID NO: 1060933 - RNA, 19 nt, Homo sapiens
gccaguagcaccaggauau

SEQ ID NO: 1060934 - RNA, 19 nt, Homo sapiens
gcgcauaggguguaaccaa

SEQ ID NO: 1060935 - RNA, 19 nt, Homo sapiens
gacagaagcguucaucagu

SEQ ID NO: 1060936 - RNA, 19 nt, Homo sapiens
gcuauugccuaagggugua

SEQ ID NO: 1060937 - RNA, 19 nt, Homo sapiens
gagccucaagcuaacuuua

SEQ ID NO: 1060938 - RNA, 19 nt, Homo sapiens
ccacugcuauugccuaagg

SEQ ID NO: 1060939 - RNA, 19 nt, Homo sapiens
gcuccugacaacaucauua

SEQ ID NO: 1060940 - RNA, 19 nt, Homo sapiens
cauaggguguaaccaauag

SEQ ID NO: 1060941 - RNA, 19 nt, Homo sapiens
ucuuugagcuaggagaaua

SEQ ID NO: 1060942 - RNA, 19 nt, Homo sapiens
ccaggagucucuaaacaac

SEQ ID NO: 1060943 - RNA, 19 nt, Homo sapiens
ccucuuccauguuucgaaa

SEQ ID NO: 1060944 - RNA, 19 nt, Homo sapiens
agaaggagguagagaaggu

SEQ ID NO: 1060945 - RNA, 19 nt, Homo sapiens
ggaauauacuuuugcuuca

SEQ ID NO: 1060946 - RNA, 19 nt, Homo sapiens
guuccaacccuguaacuug

SEQ ID NO: 1060947 - RNA, 19 nt, Homo sapiens
ugacacaaauccaccuucu

SEQ ID NO: 1060948 - RNA, 19 nt, Homo sapiens
ucagauagcgaaggaacua

SEQ ID NO: 1060949 - RNA, 19 nt, Homo sapiens
guacuuaaaccccagauuu

SEQ ID NO: 1060950 - RNA, 19 nt, Homo sapiens
gaaggauugucagagaaca

SEQ ID NO: 1060951 - RNA, 19 nt, Homo sapiens
ugauggugcuagagaggua

SEQ ID NO: 1060952 - RNA, 19 nt, Homo sapiens
ggagguagagaagguuaaa

SEQ ID NO: 1060953 - RNA, 19 nt, Homo sapiens
gcagaaggagguagagaag

SEQ ID NO: 1060954 - RNA, 19 nt, Homo sapiens
aagaaggauugucagagaa

SEQ ID NO: 1060955 - RNA, 19 nt, Homo sapiens
cgauaaacagugccaagaa

SEQ ID NO: 1060956 - RNA, 19 nt, Homo sapiens
aggacaagcuucccucugu

SEQ ID NO: 1060957 - RNA, 19 nt, Homo sapiens
gccuagaacccaaauuaga

SEQ ID NO: 1060958 - RNA, 19 nt, Homo sapiens
gcuagagagguaggaaaua

SEQ ID NO: 1060959 - RNA, 19 nt, Homo sapiens
caucuguuaucuucacugu

SEQ ID NO: 1060960 - RNA, 19 nt, Homo sapiens
gaaucaagaaccucaacau

SEQ ID NO: 1060961 - RNA, 19 nt, Homo sapiens
agagagguaggaaauauga

SEQ ID NO: 1060962 - RNA, 19 nt, Homo sapiens
agaguuacuuccagugugu

SEQ ID NO: 1060963 - RNA, 19 nt, Homo sapiens
agaagacugccaaugaauu

SEQ ID NO: 1060964 - RNA, 19 nt, Homo sapiens
ugacugcagcccucauaaa

SEQ ID NO: 1060965 - RNA, 19 nt, Homo sapiens
ggaacuacuggccaaccua

SEQ ID NO: 1060966 - RNA, 19 nt, Homo sapiens
ccuacuaaaugaacaacau

SEQ ID NO: 1060967 - RNA, 19 nt, Homo sapiens
gcuaggagaauaagagucu

SEQ ID NO: 1060968 - RNA, 19 nt, Homo sapiens
ggaaauaugacuggaacca

SEQ ID NO: 1060969 - RNA, 19 nt, Homo sapiens
gaugggauucuccaacaug

SEQ ID NO: 1060970 - RNA, 19 nt, Homo sapiens
uguguucccugaaggcaaa

SEQ ID NO: 1060971 - RNA, 19 nt, Homo sapiens
ggauuucuuugagcuagga

SEQ ID NO: 1060972 - RNA, 19 nt, Homo sapiens
ggauuuagaggaaguuguc

SEQ ID NO: 1060973 - RNA, 19 nt, Homo sapiens
gucucacccuuaauuguuu

SEQ ID NO: 1060974 - RNA, 19 nt, Homo sapiens
cuaccacugugaagauugu

SEQ ID NO: 1060975 - RNA, 19 nt, Homo sapiens
cccucaagcucuacgguuu

SEQ ID NO: 1060976 - RNA, 19 nt, Homo sapiens
ccagcccaaucaacucauu

SEQ ID NO: 1060977 - RNA, 19 nt, Homo sapiens
cuaaaugaacaacaucaga

SEQ ID NO: 1060978 - RNA, 19 nt, Homo sapiens
uaacaccccucaagcucua

SEQ ID NO: 1060979 - RNA, 19 nt, Homo sapiens
uauccacccugcaucuguu

SEQ ID NO: 1060980 - RNA, 19 nt, Homo sapiens
uagcgaaggaacuauuuga

SEQ ID NO: 1060981 - RNA, 19 nt, Homo sapiens
gaaggaacuauuugaacag

SEQ ID NO: 1060982 - RNA, 19 nt, Homo sapiens
aagaaggcuuggagacaga

SEQ ID NO: 1060983 - RNA, 19 nt, Homo sapiens
aggcugaggacaacaagua

SEQ ID NO: 1060984 - RNA, 19 nt, Homo sapiens
guaacuugaugggagcuau

SEQ ID NO: 1060985 - RNA, 19 nt, Homo sapiens
caaaugagcugauggaaga

SEQ ID NO: 1060986 - RNA, 19 nt, Homo sapiens
gaacagagcuccugacaac

SEQ ID NO: 1060987 - RNA, 19 nt, Homo sapiens
caagaagacugccaaugaa

SEQ ID NO: 1060988 - RNA, 19 nt, Homo sapiens
caagaaggauugucagaga

SEQ ID NO: 1060989 - RNA, 19 nt, Homo sapiens
ucaagaaccucaacaugaa

SEQ ID NO: 1060990 - RNA, 19 nt, Homo sapiens
ccaaugaauuucccuguuu

SEQ ID NO: 1060991 - RNA, 19 nt, Homo sapiens
ccaaucaacucauucagaa

SEQ ID NO: 1060992 - RNA, 19 nt, Homo sapiens
gaagacugccaaugaauuu

SEQ ID NO: 1060993 - RNA, 19 nt, Homo sapiens
gcacacaugucagcauuga

SEQ ID NO: 1060994 - RNA, 19 nt, Homo sapiens
guucagcucuugacacaaa

SEQ ID NO: 1060995 - RNA, 19 nt, Homo sapiens
ggaacuaucuccucucucu

SEQ ID NO: 1060996 - RNA, 19 nt, Homo sapiens
ucaagaagacugccaauga

SEQ ID NO: 1060997 - RNA, 19 nt, Homo sapiens
ggaagaugauggcccagaa

SEQ ID NO: 1060998 - RNA, 19 nt, Homo sapiens
cgaaggaacuauuugaaca

SEQ ID NO: 1060999 - RNA, 19 nt, Homo sapiens
gggccuagaacccaaauua

SEQ ID NO: 1061000 - RNA, 19 nt, Homo sapiens
gauggaagaucuguuugaa

SEQ ID NO: 1061001 - RNA, 19 nt, Homo sapiens
gaagccaccuauagagaga

SEQ ID NO: 1061002 - RNA, 19 nt, Homo sapiens
gauaaacagugccaagaag

SEQ ID NO: 1061003 - RNA, 19 nt, Homo sapiens
gaagggacugaguuucuua

SEQ ID NO: 1061004 - RNA, 19 nt, Homo sapiens
gaagagauccagccacauc

SEQ ID NO: 1061005 - RNA, 19 nt, Homo sapiens
uuucauguauccagaguua

SEQ ID NO: 1061006 - RNA, 19 nt, Homo sapiens
gagaagaggagguggagaa

SEQ ID NO: 1061007 - RNA, 19 nt, Homo sapiens
uuaaagagcugggaaccuu

SEQ ID NO: 1061008 - RNA, 19 nt, Homo sapiens
ggcgguggcuguaacauga

SEQ ID NO: 1061009 - RNA, 19 nt, Homo sapiens
ggaagcaaaugagcugaug

SEQ ID NO: 1061010 - RNA, 19 nt, Homo sapiens
gcaccaggauaugucuuaa

SEQ ID NO: 1061011 - RNA, 19 nt, Homo sapiens
cuagagagguaggaaauau

SEQ ID NO: 1061012 - RNA, 19 nt, Homo sapiens
gcauaggguguaaccaaua

SEQ ID NO: 1061013 - RNA, 19 nt, Homo sapiens
cagcacacaugucagcauu

SEQ ID NO: 1061014 - RNA, 19 nt, Homo sapiens
uugaacagcugaagaugaa

SEQ ID NO: 1061015 - RNA, 19 nt, Homo sapiens
caaugaauuucccuguuug

SEQ ID NO: 1061016 - RNA, 19 nt, Homo sapiens
acacaaauccaccuucuug

SEQ ID NO: 1061017 - RNA, 19 nt, Homo sapiens
gaacagcugaagaugaaga

SEQ ID NO: 1061018 - RNA, 19 nt, Homo sapiens
uagaggaaguugucaagau

SEQ ID NO: 1061019 - RNA, 19 nt, Homo sapiens
ccggauuccucacccaaua

SEQ ID NO: 1061020 - RNA, 19 nt, Homo sapiens
caagcaagguuuucaugua

SEQ ID NO: 1061021 - RNA, 19 nt, Homo sapiens
cuaugcagcugauugaaga

SEQ ID NO: 1061022 - RNA, 19 nt, Homo sapiens
gcugauggaagaucuguuu

SEQ ID NO: 1061023 - RNA, 19 nt, Homo sapiens
ucuguuaucuucacuguuc

SEQ ID NO: 1061024 - RNA, 19 nt, Homo sapiens
gccagggccuuucgcugua

SEQ ID NO: 1061025 - RNA, 19 nt, Homo sapiens
uggccaaccuacuaaauga

SEQ ID NO: 1061026 - RNA, 19 nt, Homo sapiens
agaggaaguugucaagaug

SEQ ID NO: 1061027 - RNA, 19 nt, Homo sapiens
gaacaccggcucccauucu

SEQ ID NO: 1061028 - RNA, 19 nt, Homo sapiens
ggaaaaugcugugaagaga

SEQ ID NO: 1061029 - RNA, 19 nt, Homo sapiens
cuuuaggacugaagcauuu

SEQ ID NO: 1061030 - RNA, 19 nt, Homo sapiens
ccaaggcugaggacaauuu

SEQ ID NO: 1061031 - RNA, 19 nt, Homo sapiens
gccaaugaauuucccuguu

SEQ ID NO: 1061032 - RNA, 19 nt, Homo sapiens
gaaaacaccagcccaauca

SEQ ID NO: 1061033 - RNA, 19 nt, Homo sapiens
gguguaguccugaaacuga

SEQ ID NO: 1061034 - RNA, 19 nt, Homo sapiens
gccaguagcaccaggauau

SEQ ID NO: 1061035 - RNA, 19 nt, Homo sapiens
gcgcauaggguguaaccaa

SEQ ID NO: 1061036 - RNA, 19 nt, Homo sapiens
gagccucaagcuaacuuua

SEQ ID NO: 1061037 - RNA, 19 nt, Homo sapiens
gacagaagcguucaucagu

SEQ ID NO: 1061038 - RNA, 19 nt, Homo sapiens
gcuauugccuaagggugua

SEQ ID NO: 1061039 - RNA, 19 nt, Homo sapiens
ccacugcuauugccuaagg

SEQ ID NO: 1061040 - RNA, 19 nt, Homo sapiens
gcuccugacaacaucauua

SEQ ID NO: 1061041 - RNA, 19 nt, Homo sapiens
caccaaggcugaggacaau

SEQ ID NO: 1061042 - RNA, 19 nt, Homo sapiens
cauaggguguaaccaauag

SEQ ID NO: 1061043 - RNA, 19 nt, Homo sapiens
ucuuugagcuaggagaaua

SEQ ID NO: 1061044 - RNA, 19 nt, Homo sapiens
ccaggagucucuaaacaac

SEQ ID NO: 1061045 - RNA, 19 nt, Homo sapiens
ccucuuccauguuucgaaa

SEQ ID NO: 1061046 - RNA, 19 nt, Homo sapiens
agaaggagguagagaaggu

SEQ ID NO: 1061047 - RNA, 19 nt, Homo sapiens
ggaauauacuuuugcuuca

SEQ ID NO: 1061048 - RNA, 19 nt, Homo sapiens
ugaagggacugaguuucuu

SEQ ID NO: 1061049 - RNA, 19 nt, Homo sapiens
guuccaacccuguaacuug

SEQ ID NO: 1061050 - RNA, 19 nt, Homo sapiens
ugacacaaauccaccuucu

SEQ ID NO: 1061051 - RNA, 19 nt, Homo sapiens
ucagauagcgaaggaacua

SEQ ID NO: 1061052 - RNA, 19 nt, Homo sapiens
guacuuaaaccccagauuu

SEQ ID NO: 1061053 - RNA, 19 nt, Homo sapiens
gaaggauugucagagaaca

SEQ ID NO: 1061054 - RNA, 19 nt, Homo sapiens
ugauggugcuagagaggua

SEQ ID NO: 1061055 - RNA, 19 nt, Homo sapiens
ggagguagagaagguuaaa

SEQ ID NO: 1061056 - RNA, 19 nt, Homo sapiens
gcagaaggagguagagaag

SEQ ID NO: 1061057 - RNA, 19 nt, Homo sapiens
aagaaggauugucagagaa

SEQ ID NO: 1061058 - RNA, 19 nt, Homo sapiens
cgauaaacagugccaagaa

SEQ ID NO: 1061059 - RNA, 19 nt, Homo sapiens
aggacaagcuucccucugu

SEQ ID NO: 1061060 - RNA, 19 nt, Homo sapiens
gccuagaacccaaauuaga

SEQ ID NO: 1061061 - RNA, 19 nt, Homo sapiens
gcuagagagguaggaaaua

SEQ ID NO: 1061062 - RNA, 19 nt, Homo sapiens
caucuguuaucuucacugu

SEQ ID NO: 1061063 - RNA, 19 nt, Homo sapiens
gaaucaagaaccucaacau

SEQ ID NO: 1061064 - RNA, 19 nt, Homo sapiens
agagagguaggaaauauga

SEQ ID NO: 1061065 - RNA, 19 nt, Homo sapiens
uuucuuaacccucuaauca

SEQ ID NO: 1061066 - RNA, 19 nt, Homo sapiens
ggaacuacuggccaaccua

SEQ ID NO: 1061067 - RNA, 19 nt, Homo sapiens
agaguuacuuccagugugu

SEQ ID NO: 1061068 - RNA, 19 nt, Homo sapiens
agaagacugccaaugaauu

SEQ ID NO: 1061069 - RNA, 19 nt, Homo sapiens
ugacugcagcccucauaaa

SEQ ID NO: 1061070 - RNA, 19 nt, Homo sapiens
ccuacuaaaugaacaacau

SEQ ID NO: 1061071 - RNA, 19 nt, Homo sapiens
gcuaggagaauaagagucu

SEQ ID NO: 1061072 - RNA, 19 nt, Homo sapiens
ggaaauaugacuggaacca

SEQ ID NO: 1061073 - RNA, 19 nt, Homo sapiens
uguguucccugaaggcaaa

SEQ ID NO: 1061074 - RNA, 19 nt, Homo sapiens
gaugggauucuccaacaug

SEQ ID NO: 1061075 - RNA, 19 nt, Homo sapiens
ggauuucuuugagcuagga

SEQ ID NO: 1061076 - RNA, 19 nt, Homo sapiens
ggauuuagaggaaguuguc

SEQ ID NO: 1061077 - RNA, 19 nt, Homo sapiens
cuaaaugaacaacaucaga

SEQ ID NO: 1061078 - RNA, 19 nt, Homo sapiens
gucucacccuuaauuguuu

SEQ ID NO: 1061079 - RNA, 19 nt, Homo sapiens
cuaccacugugaagauugu

SEQ ID NO: 1061080 - RNA, 19 nt, Homo sapiens
ccagcccaaucaacucauu

SEQ ID NO: 1061081 - RNA, 19 nt, Homo sapiens
cccucaagcucuacgguuu

SEQ ID NO: 1061082 - RNA, 19 nt, Homo sapiens
uauccacccugcaucuguu

SEQ ID NO: 1061083 - RNA, 19 nt, Homo sapiens
aagaaggcuuggagacaga

SEQ ID NO: 1061084 - RNA, 19 nt, Homo sapiens
uagcgaaggaacuauuuga

SEQ ID NO: 1061085 - RNA, 19 nt, Homo sapiens
caaaugagcugauggaaga

SEQ ID NO: 1061086 - RNA, 19 nt, Homo sapiens
gaacagagcuccugacaac

SEQ ID NO: 1061087 - RNA, 19 nt, Homo sapiens
ucaagaagacuguuuguua

SEQ ID NO: 1061088 - RNA, 19 nt, Homo sapiens
caagaaggauugucagaga

SEQ ID NO: 1061089 - RNA, 19 nt, Homo sapiens
ucaagaaccucaacaugaa

SEQ ID NO: 1061090 - RNA, 19 nt, Homo sapiens
ccaaucaacucauucagaa

SEQ ID NO: 1061091 - RNA, 19 nt, Homo sapiens
gcacacaugucagcauuga

SEQ ID NO: 1061092 - RNA, 19 nt, Homo sapiens
caagaagacuguuuguuag

SEQ ID NO: 1061093 - RNA, 19 nt, Homo sapiens
guucagcucuugacacaaa

SEQ ID NO: 1061094 - RNA, 19 nt, Homo sapiens
ggaacuaucuccucucucu

SEQ ID NO: 1061095 - RNA, 19 nt, Homo sapiens
ggaagaugauggcccagaa

SEQ ID NO: 1061096 - RNA, 19 nt, Homo sapiens
cgaaggaacuauuugaaca

SEQ ID NO: 1061097 - RNA, 19 nt, Homo sapiens
gggccuagaacccaaauua

SEQ ID NO: 1061098 - RNA, 19 nt, Homo sapiens
gauggaagaucuguuugaa

SEQ ID NO: 1061099 - RNA, 19 nt, Homo sapiens
gaagccaccuauagagaga

SEQ ID NO: 1061100 - RNA, 19 nt, Homo sapiens
gauaaacagugccaagaag

SEQ ID NO: 1061101 - RNA, 19 nt, Homo sapiens
gaagggacugaguuucuua

SEQ ID NO: 1061102 - RNA, 19 nt, Homo sapiens
gaagagauccagccacauc

SEQ ID NO: 1061103 - RNA, 19 nt, Homo sapiens
ucacuucccuguacucuca

SEQ ID NO: 1061104 - RNA, 19 nt, Homo sapiens
uuaaagagcugggaaccuu

SEQ ID NO: 1061105 - RNA, 19 nt, Homo sapiens
gagaagaggagguggagaa

SEQ ID NO: 1061106 - RNA, 19 nt, Homo sapiens
ggcgguggcuguaacauga

SEQ ID NO: 1061107 - RNA, 19 nt, Homo sapiens
ggaagcaaaugagcugaug

SEQ ID NO: 1061108 - RNA, 19 nt, Homo sapiens
gaagacuguuuguuagcuu

SEQ ID NO: 1061109 - RNA, 19 nt, Homo sapiens
gcaccaggauaugucuuaa

SEQ ID NO: 1061110 - RNA, 19 nt, Homo sapiens
cuagagagguaggaaauau

SEQ ID NO: 1061111 - RNA, 19 nt, Homo sapiens
gcauaggguguaaccaaua

SEQ ID NO: 1061112 - RNA, 19 nt, Homo sapiens
cagcacacaugucagcauu

SEQ ID NO: 1061113 - RNA, 19 nt, Homo sapiens
uugaacagcugaagaugaa

SEQ ID NO: 1061114 - RNA, 19 nt, Homo sapiens
acacaaauccaccuucuug

SEQ ID NO: 1061115 - RNA, 19 nt, Homo sapiens
gaacagcugaagaugaaga

SEQ ID NO: 1061116 - RNA, 19 nt, Homo sapiens
uagaggaaguugucaagau

SEQ ID NO: 1061117 - RNA, 19 nt, Homo sapiens
ccggauuccucacccaaua

SEQ ID NO: 1061118 - RNA, 19 nt, Homo sapiens
cuaugcagcugauugaaga

SEQ ID NO: 1061119 - RNA, 19 nt, Homo sapiens
ucuguuaucuucacuguuc

SEQ ID NO: 1061120 - RNA, 19 nt, Homo sapiens
gcugauggaagaucuguuu

SEQ ID NO: 1061121 - RNA, 19 nt, Homo sapiens
gccagggccuuucgcugua

SEQ ID NO: 1061122 - RNA, 19 nt, Homo sapiens
uggccaaccuacuaaauga

SEQ ID NO: 1061123 - RNA, 19 nt, Homo sapiens
agaggaaguugucaagaug

SEQ ID NO: 1061124 - RNA, 19 nt, Homo sapiens
gaacaccggcucccauucu

SEQ ID NO: 1061125 - RNA, 19 nt, Homo sapiens
ggaaaaugcugugaagaga

SEQ ID NO: 1061126 - RNA, 19 nt, Homo sapiens
cuuuaggacugaagcauuu

SEQ ID NO: 1061127 - RNA, 19 nt, Homo sapiens
gaaaacaccagcccaauca

SEQ ID NO: 1061128 - RNA, 19 nt, Homo sapiens
gguguaguccugaaacuga

SEQ ID NO: 1061129 - RNA, 19 nt, Homo sapiens
gccaguagcaccaggauau

SEQ ID NO: 1061130 - RNA, 19 nt, Homo sapiens
gcgcauaggguguaaccaa

SEQ ID NO: 1061131 - RNA, 19 nt, Homo sapiens
gacagaagcguucaucagu

SEQ ID NO: 1061132 - RNA, 19 nt, Homo sapiens
gcuauugccuaagggugua

SEQ ID NO: 1061133 - RNA, 19 nt, Homo sapiens
gagccucaagcuaacuuua

SEQ ID NO: 1061134 - RNA, 19 nt, Homo sapiens
ccacugcuauugccuaagg

SEQ ID NO: 1061135 - RNA, 19 nt, Homo sapiens
gcuccugacaacaucauua

SEQ ID NO: 1061136 - RNA, 19 nt, Homo sapiens
cauaggguguaaccaauag

SEQ ID NO: 1061137 - RNA, 19 nt, Homo sapiens
ucuuugagcuaggagaaua

SEQ ID NO: 1061138 - RNA, 19 nt, Homo sapiens
ccaggagucucuaaacaac

SEQ ID NO: 1061139 - RNA, 19 nt, Homo sapiens
ccucuuccauguuucgaaa

SEQ ID NO: 1061140 - RNA, 19 nt, Homo sapiens
agaaggagguagagaaggu

SEQ ID NO: 1061141 - RNA, 19 nt, Homo sapiens
ggaauauacuuuugcuuca

SEQ ID NO: 1061142 - RNA, 19 nt, Homo sapiens
ugaagggacugaguuucuu

SEQ ID NO: 1061143 - RNA, 19 nt, Homo sapiens
guuccaacccuguaacuug

SEQ ID NO: 1061144 - RNA, 19 nt, Homo sapiens
ugacacaaauccaccuucu

SEQ ID NO: 1061145 - RNA, 19 nt, Homo sapiens
ucagauagcgaaggaacua

SEQ ID NO: 1061146 - RNA, 19 nt, Homo sapiens
guacuuaaaccccagauuu

SEQ ID NO: 1061147 - RNA, 19 nt, Homo sapiens
gaaggauugucagagaaca

SEQ ID NO: 1061148 - RNA, 19 nt, Homo sapiens
ugauggugcuagagaggua

SEQ ID NO: 1061149 - RNA, 19 nt, Homo sapiens
ggagguagagaagguuaaa

SEQ ID NO: 1061150 - RNA, 19 nt, Homo sapiens
gcagaaggagguagagaag

SEQ ID NO: 1061151 - RNA, 19 nt, Homo sapiens
aagaaggauugucagagaa

SEQ ID NO: 1061152 - RNA, 19 nt, Homo sapiens
cgauaaacagugccaagaa

SEQ ID NO: 1061153 - RNA, 19 nt, Homo sapiens
aggacaagcuucccucugu

SEQ ID NO: 1061154 - RNA, 19 nt, Homo sapiens
gccuagaacccaaauuaga

SEQ ID NO: 1061155 - RNA, 19 nt, Homo sapiens
gcuagagagguaggaaaua

SEQ ID NO: 1061156 - RNA, 19 nt, Homo sapiens
caucuguuaucuucacugu

SEQ ID NO: 1061157 - RNA, 19 nt, Homo sapiens
gaaucaagaaccucaacau

SEQ ID NO: 1061158 - RNA, 19 nt, Homo sapiens
ggaacuacuggccaaccua

SEQ ID NO: 1061159 - RNA, 19 nt, Homo sapiens
agagagguaggaaauauga

SEQ ID NO: 1061160 - RNA, 19 nt, Homo sapiens
uuucuuaacccucuaauca

SEQ ID NO: 1061161 - RNA, 19 nt, Homo sapiens
ugacugcagcccucauaaa

SEQ ID NO: 1061162 - RNA, 19 nt, Homo sapiens
ccuacuaaaugaacaacau

SEQ ID NO: 1061163 - RNA, 19 nt, Homo sapiens
gcuaggagaauaagagucu

SEQ ID NO: 1061164 - RNA, 19 nt, Homo sapiens
ggaaauaugacuggaacca

SEQ ID NO: 1061165 - RNA, 19 nt, Homo sapiens
gaugggauucuccaacaug

SEQ ID NO: 1061166 - RNA, 19 nt, Homo sapiens
ggauuucuuugagcuagga

SEQ ID NO: 1061167 - RNA, 19 nt, Homo sapiens
ggauuuagaggaaguuguc

SEQ ID NO: 1061168 - RNA, 19 nt, Homo sapiens
gucucacccuuaauuguuu

SEQ ID NO: 1061169 - RNA, 19 nt, Homo sapiens
cuaccacugugaagauugu

SEQ ID NO: 1061170 - RNA, 19 nt, Homo sapiens
ccagcccaaucaacucauu

SEQ ID NO: 1061171 - RNA, 19 nt, Homo sapiens
cuaaaugaacaacaucaga

SEQ ID NO: 1061172 - RNA, 19 nt, Homo sapiens
cccucaagcucuacgguuu

SEQ ID NO: 1061173 - RNA, 19 nt, Homo sapiens
uauccacccugcaucuguu

SEQ ID NO: 1061174 - RNA, 19 nt, Homo sapiens
aagaaggcuuggagacaga

SEQ ID NO: 1061175 - RNA, 19 nt, Homo sapiens
uaacaccccucaagcucua

SEQ ID NO: 1061176 - RNA, 19 nt, Homo sapiens
guaacuugaugggagcuau

SEQ ID NO: 1061177 - RNA, 19 nt, Homo sapiens
uuccaacccuguaacuuga

SEQ ID NO: 1061178 - RNA, 19 nt, Homo sapiens
uagcgaaggaacuauuuga

SEQ ID NO: 1061179 - RNA, 19 nt, Homo sapiens
gaaggaacuauuugaacag

SEQ ID NO: 1061180 - RNA, 19 nt, Homo sapiens
uaaacagugccaagaagga

SEQ ID NO: 1061181 - RNA, 19 nt, Homo sapiens
cuacuggccaaccuacuaa

SEQ ID NO: 1061182 - RNA, 19 nt, Homo sapiens
ucagaucaaggccuagaaa

SEQ ID NO: 1061183 - RNA, 19 nt, Homo sapiens
guaggaaauaugacuggaa

SEQ ID NO: 1061184 - RNA, 19 nt, Homo sapiens
cggcucccauucugguuaa

SEQ ID NO: 1061185 - RNA, 19 nt, Homo sapiens
caaaugagcugauggaaga

SEQ ID NO: 1061186 - RNA, 19 nt, Homo sapiens
gaacagagcuccugacaac

SEQ ID NO: 1061187 - RNA, 19 nt, Homo sapiens
ggaguuaggugucaaguga

SEQ ID NO: 1061188 - RNA, 19 nt, Homo sapiens
caagaagacugccaaugaa

SEQ ID NO: 1061189 - RNA, 19 nt, Homo sapiens
caagaaggauugucagaga

SEQ ID NO: 1061190 - RNA, 19 nt, Homo sapiens
ucaagaaccucaacaugaa

SEQ ID NO: 1061191 - RNA, 19 nt, Homo sapiens
ccaaugaauuucccuguuu

SEQ ID NO: 1061192 - RNA, 19 nt, Homo sapiens
ccaaucaacucauucagaa

SEQ ID NO: 1061193 - RNA, 19 nt, Homo sapiens
gaagacugccaaugaauuu

SEQ ID NO: 1061194 - RNA, 19 nt, Homo sapiens
gcacacaugucagcauuga

SEQ ID NO: 1061195 - RNA, 19 nt, Homo sapiens
guucagcucuugacacaaa

SEQ ID NO: 1061196 - RNA, 19 nt, Homo sapiens
ggaacuaucuccucucucu

SEQ ID NO: 1061197 - RNA, 19 nt, Homo sapiens
ucaagaagacugccaauga

SEQ ID NO: 1061198 - RNA, 19 nt, Homo sapiens
ggaagaugauggcccagaa

SEQ ID NO: 1061199 - RNA, 19 nt, Homo sapiens
cgaaggaacuauuugaaca

SEQ ID NO: 1061200 - RNA, 19 nt, Homo sapiens
gggccuagaacccaaauua

SEQ ID NO: 1061201 - RNA, 19 nt, Homo sapiens
gauggaagaucuguuugaa

SEQ ID NO: 1061202 - RNA, 19 nt, Homo sapiens
gaagccaccuauagagaga

SEQ ID NO: 1061203 - RNA, 19 nt, Homo sapiens
gauaaacagugccaagaag

SEQ ID NO: 1061204 - RNA, 19 nt, Homo sapiens
gaagggacugaguuucuua

SEQ ID NO: 1061205 - RNA, 19 nt, Homo sapiens
gaagagauccagccacauc

SEQ ID NO: 1061206 - RNA, 19 nt, Homo sapiens
uuucauguauccagaguua

SEQ ID NO: 1061207 - RNA, 19 nt, Homo sapiens
uuaaagagcugggaaccuu

SEQ ID NO: 1061208 - RNA, 19 nt, Homo sapiens
ggaagcaaaugagcugaug

SEQ ID NO: 1061209 - RNA, 19 nt, Homo sapiens
ggcgguggcuguaacauga

SEQ ID NO: 1061210 - RNA, 19 nt, Homo sapiens
gcaccaggauaugucuuaa

SEQ ID NO: 1061211 - RNA, 19 nt, Homo sapiens
cuagagagguaggaaauau

SEQ ID NO: 1061212 - RNA, 19 nt, Homo sapiens
gcauaggguguaaccaaua

SEQ ID NO: 1061213 - RNA, 19 nt, Homo sapiens
cagcacacaugucagcauu

SEQ ID NO: 1061214 - RNA, 19 nt, Homo sapiens
uugaacagcugaagaugaa

SEQ ID NO: 1061215 - RNA, 19 nt, Homo sapiens
caaugaauuucccuguuug

SEQ ID NO: 1061216 - RNA, 19 nt, Homo sapiens
acacaaauccaccuucuug

SEQ ID NO: 1061217 - RNA, 19 nt, Homo sapiens
gaacagcugaagaugaaga

SEQ ID NO: 1061218 - RNA, 19 nt, Homo sapiens
uagaggaaguugucaagau

SEQ ID NO: 1061219 - RNA, 19 nt, Homo sapiens
ccggauuccucacccaaua

SEQ ID NO: 1061220 - RNA, 19 nt, Homo sapiens
caagcaagguuuucaugua

SEQ ID NO: 1061221 - RNA, 19 nt, Homo sapiens
cuaugcagcugauugaaga

SEQ ID NO: 1061222 - RNA, 19 nt, Homo sapiens
ucuguuaucuucacuguuc

SEQ ID NO: 1061223 - RNA, 19 nt, Homo sapiens
gcugauggaagaucuguuu

SEQ ID NO: 1061224 - RNA, 19 nt, Homo sapiens
gccagggccuuucgcugua

SEQ ID NO: 1061225 - RNA, 19 nt, Homo sapiens
uggccaaccuacuaaauga

SEQ ID NO: 1061226 - RNA, 19 nt, Homo sapiens
agaggaaguugucaagaug

SEQ ID NO: 1061227 - RNA, 19 nt, Homo sapiens
gaacaccggcucccauucu

SEQ ID NO: 1061228 - RNA, 19 nt, Homo sapiens
ggaaaaugcugugaagaga

SEQ ID NO: 1061229 - RNA, 19 nt, Homo sapiens
cuuuaggacugaagcauuu

SEQ ID NO: 1061230 - RNA, 19 nt, Homo sapiens
ccaaggcugaggacaauuu

SEQ ID NO: 1061231 - RNA, 19 nt, Homo sapiens
gccaaugaauuucccuguu

SEQ ID NO: 1061232 - RNA, 19 nt, Homo sapiens
cagcuucuguuacugaugu

SEQ ID NO: 1061233 - RNA, 19 nt, Homo sapiens
gaaaacaccagcccaauca

SEQ ID NO: 1061234 - RNA, 19 nt, Homo sapiens
gguguaguccugaaacuga

SEQ ID NO: 1061235 - RNA, 19 nt, Homo sapiens
gccaguagcaccaggauau

SEQ ID NO: 1061236 - RNA, 19 nt, Homo sapiens
gcgcauaggguguaaccaa

SEQ ID NO: 1061237 - RNA, 19 nt, Homo sapiens
gagccucaagcuaacuuua

SEQ ID NO: 1061238 - RNA, 19 nt, Homo sapiens
gacagaagcguucaucagu

SEQ ID NO: 1061239 - RNA, 19 nt, Homo sapiens
gcuauugccuaagggugua

SEQ ID NO: 1061240 - RNA, 19 nt, Homo sapiens
ccacugcuauugccuaagg

SEQ ID NO: 1061241 - RNA, 19 nt, Homo sapiens
gcuccugacaacaucauua

SEQ ID NO: 1061242 - RNA, 19 nt, Homo sapiens
caccaaggcugaggacaau

SEQ ID NO: 1061243 - RNA, 19 nt, Homo sapiens
cauaggguguaaccaauag

SEQ ID NO: 1061244 - RNA, 19 nt, Homo sapiens
ucuuugagcuaggagaaua

SEQ ID NO: 1061245 - RNA, 19 nt, Homo sapiens
ccaggagucucuaaacaac

SEQ ID NO: 1061246 - RNA, 19 nt, Homo sapiens
ccucuuccauguuucgaaa

SEQ ID NO: 1061247 - RNA, 19 nt, Homo sapiens
agaaggagguagagaaggu

SEQ ID NO: 1061248 - RNA, 19 nt, Homo sapiens
ggaauauacuuuugcuuca

SEQ ID NO: 1061249 - RNA, 19 nt, Homo sapiens
ugaagggacugaguuucuu

SEQ ID NO: 1061250 - RNA, 19 nt, Homo sapiens
guuccaacccuguaacuug

SEQ ID NO: 1061251 - RNA, 19 nt, Homo sapiens
ugacacaaauccaccuucu

SEQ ID NO: 1061252 - RNA, 19 nt, Homo sapiens
ucagauagcgaaggaacua

SEQ ID NO: 1061253 - RNA, 19 nt, Homo sapiens
gccaagcuguaucuguuug

SEQ ID NO: 1061254 - RNA, 19 nt, Homo sapiens
guacuuaaaccccagauuu

SEQ ID NO: 1061255 - RNA, 19 nt, Homo sapiens
gaaggauugucagagaaca

SEQ ID NO: 1061256 - RNA, 19 nt, Homo sapiens
ugauggugcuagagaggua

SEQ ID NO: 1061257 - RNA, 19 nt, Homo sapiens
gagaaaaggaagcaaauga

SEQ ID NO: 1061258 - RNA, 19 nt, Homo sapiens
ggagguagagaagguuaaa

SEQ ID NO: 1061259 - RNA, 19 nt, Homo sapiens
gcagaaggagguagagaag

SEQ ID NO: 1061260 - RNA, 19 nt, Homo sapiens
aagaaggauugucagagaa

SEQ ID NO: 1061261 - RNA, 19 nt, Homo sapiens
cgauaaacagugccaagaa

SEQ ID NO: 1061262 - RNA, 19 nt, Homo sapiens
aggacaagcuucccucugu

SEQ ID NO: 1061263 - RNA, 19 nt, Homo sapiens
agugaagucuccuuguuau

SEQ ID NO: 1061264 - RNA, 19 nt, Homo sapiens
gccuagaacccaaauuaga

SEQ ID NO: 1061265 - RNA, 19 nt, Homo sapiens
gcuagagagguaggaaaua

SEQ ID NO: 1061266 - RNA, 19 nt, Homo sapiens
aggccaagcuguaucuguu

SEQ ID NO: 1061267 - RNA, 19 nt, Homo sapiens
caucuguuaucuucacugu

SEQ ID NO: 1061268 - RNA, 19 nt, Homo sapiens
gaaucaagaaccucaacau

SEQ ID NO: 1061269 - RNA, 19 nt, Homo sapiens
aagugaagucuccuuguua

SEQ ID NO: 1061270 - RNA, 19 nt, Homo sapiens
agagagguaggaaauauga

SEQ ID NO: 1061271 - RNA, 19 nt, Homo sapiens
uuucuuaacccucuaauca

SEQ ID NO: 1061272 - RNA, 19 nt, Homo sapiens
agaguuacuuccagugugu

SEQ ID NO: 1061273 - RNA, 19 nt, Homo sapiens
agaagacugccaaugaauu

SEQ ID NO: 1061274 - RNA, 19 nt, Homo sapiens
ugacugcagcccucauaaa

SEQ ID NO: 1061275 - RNA, 19 nt, Homo sapiens
ccuacuaaaugaacaacau

SEQ ID NO: 1061276 - RNA, 19 nt, Homo sapiens
ggaacuacuggccaaccua

SEQ ID NO: 1061277 - RNA, 19 nt, Homo sapiens
aacaguagcuggcauccau

SEQ ID NO: 1061278 - RNA, 19 nt, Homo sapiens
gcucuacgccagcuucugu

SEQ ID NO: 1061279 - RNA, 19 nt, Homo sapiens
gcuaggagaauaagagucu

SEQ ID NO: 1061280 - RNA, 19 nt, Homo sapiens
ggaaauaugacuggaacca

SEQ ID NO: 1061281 - RNA, 19 nt, Homo sapiens
cgacgaacccagggagaaa

SEQ ID NO: 1061282 - RNA, 19 nt, Homo sapiens
uguguucccugaaggcaaa

SEQ ID NO: 1061283 - RNA, 19 nt, Homo sapiens
gaugggauucuccaacaug

SEQ ID NO: 1061284 - RNA, 19 nt, Homo sapiens
ggauuucuuugagcuagga

SEQ ID NO: 1061285 - RNA, 19 nt, Homo sapiens
ggaaacaggugcagaauuu

SEQ ID NO: 1061286 - RNA, 19 nt, Homo sapiens
gcauugggauuaucaaaua

SEQ ID NO: 1061287 - RNA, 19 nt, Homo sapiens
gguaugaccugaaauguuu

SEQ ID NO: 1061288 - RNA, 19 nt, Homo sapiens
caauaaaugugcacuguaa

SEQ ID NO: 1061289 - RNA, 19 nt, Homo sapiens
gcacgguuaugaaauauuu

SEQ ID NO: 1061290 - RNA, 19 nt, Homo sapiens
gacaucagauccugcauua

SEQ ID NO: 1061291 - RNA, 19 nt, Homo sapiens
gaggagcuguuaacuagua

SEQ ID NO: 1061292 - RNA, 19 nt, Homo sapiens
gaucgaaccuggucauugu

SEQ ID NO: 1061293 - RNA, 19 nt, Homo sapiens
ggaaacagaauacaguuaa

SEQ ID NO: 1061294 - RNA, 19 nt, Homo sapiens
uuacaaagaugguguccua

SEQ ID NO: 1061295 - RNA, 19 nt, Homo sapiens
gaagaggagcuguuaacua

SEQ ID NO: 1061296 - RNA, 19 nt, Homo sapiens
gacaaucacugaaucaugu

SEQ ID NO: 1061297 - RNA, 19 nt, Homo sapiens
gaucauugcucaugcuuuc

SEQ ID NO: 1061298 - RNA, 19 nt, Homo sapiens
guggaaagauuugcuuaua

SEQ ID NO: 1061299 - RNA, 19 nt, Homo sapiens
gaucagacaacuagacuuu

SEQ ID NO: 1061300 - RNA, 19 nt, Homo sapiens
ugaaucaugugcucuguaa

SEQ ID NO: 1061301 - RNA, 19 nt, Homo sapiens
ggacaugaggauuggauua

SEQ ID NO: 1061302 - RNA, 19 nt, Homo sapiens
uaaugugccuucagacuuu

SEQ ID NO: 1061303 - RNA, 19 nt, Homo sapiens
ucacaagauugccugauaa

SEQ ID NO: 1061304 - RNA, 19 nt, Homo sapiens
ccagaaggagaauuuauua

SEQ ID NO: 1061305 - RNA, 19 nt, Homo sapiens
ucacauauuugcucaacaa

SEQ ID NO: 1061306 - RNA, 19 nt, Homo sapiens
uuucagcccuccauacuua

SEQ ID NO: 1061307 - RNA, 19 nt, Homo sapiens
gaauacaguuaacccaaga

SEQ ID NO: 1061308 - RNA, 19 nt, Homo sapiens
caagauugccugauaagaa

SEQ ID NO: 1061309 - RNA, 19 nt, Homo sapiens
gaaagagcaugcagcuauc

SEQ ID NO: 1061310 - RNA, 19 nt, Homo sapiens
ggaugacgauaacauaaga

SEQ ID NO: 1061311 - RNA, 19 nt, Homo sapiens
ugaucaaguuccagaaaua

SEQ ID NO: 1061312 - RNA, 19 nt, Homo sapiens
aagaggagcuguuaacuag

SEQ ID NO: 1061313 - RNA, 19 nt, Homo sapiens
gaugaagagucaggaguuu

SEQ ID NO: 1061314 - RNA, 19 nt, Homo sapiens
gaagauacacagagucaau

SEQ ID NO: 1061315 - RNA, 19 nt, Homo sapiens
caacaucuuuagaaacuca

SEQ ID NO: 1061316 - RNA, 19 nt, Homo sapiens
gaagcuguauauaaaguca

SEQ ID NO: 1061317 - RNA, 19 nt, Homo sapiens
cagauggccuucucaccua

SEQ ID NO: 1061318 - RNA, 19 nt, Homo sapiens
gcaugcagcuaucauucuu

SEQ ID NO: 1061319 - RNA, 19 nt, Homo sapiens
gacgauaacauaagacuga

SEQ ID NO: 1061320 - RNA, 19 nt, Homo sapiens
gcaagcuguucacaagauu

SEQ ID NO: 1061321 - RNA, 19 nt, Homo sapiens
caucagauccugcauuaug

SEQ ID NO: 1061322 - RNA, 19 nt, Homo sapiens
agucaaagccaaagucaua

SEQ ID NO: 1061323 - RNA, 19 nt, Homo sapiens
gaaacaagucaaagccaaa

SEQ ID NO: 1061324 - RNA, 19 nt, Homo sapiens
gaaacaggugcagaauuua

SEQ ID NO: 1061325 - RNA, 19 nt, Homo sapiens
gaucaaguuccagaaauaa

SEQ ID NO: 1061326 - RNA, 19 nt, Homo sapiens
agaaggugcugagugguua

SEQ ID NO: 1061327 - RNA, 19 nt, Homo sapiens
gaacacuacaucuuggaaa

SEQ ID NO: 1061328 - RNA, 19 nt, Homo sapiens
uuacugagccucccacuga

SEQ ID NO: 1061329 - RNA, 19 nt, Homo sapiens
agaaagagcaugcagcuau

SEQ ID NO: 1061330 - RNA, 19 nt, Homo sapiens
guacugaucagacaacuag

SEQ ID NO: 1061331 - RNA, 19 nt, Homo sapiens
ggaaauagaggauaaucag

SEQ ID NO: 1061332 - RNA, 19 nt, Homo sapiens
gaaauugcaaggccucaga

SEQ ID NO: 1061333 - RNA, 19 nt, Homo sapiens
aaacucaggaugacgauaa

SEQ ID NO: 1061334 - RNA, 19 nt, Homo sapiens
guaaggcagcuaagaaaga

SEQ ID NO: 1061335 - RNA, 19 nt, Homo sapiens
ggacaaucacugaaucaug

SEQ ID NO: 1061336 - RNA, 19 nt, Homo sapiens
ggacaucagauccugcauu

SEQ ID NO: 1061337 - RNA, 19 nt, Homo sapiens
guagaauuauuuggucuug

SEQ ID NO: 1061338 - RNA, 19 nt, Homo sapiens
gugcacaguagaauuauuu

SEQ ID NO: 1061339 - RNA, 19 nt, Homo sapiens
gaaacagaauacaguuaac

SEQ ID NO: 1061340 - RNA, 19 nt, Homo sapiens
ggaauacuuugggauuuua

SEQ ID NO: 1061341 - RNA, 19 nt, Homo sapiens
gcagccagugagauuauua

SEQ ID NO: 1061342 - RNA, 19 nt, Homo sapiens
aagauugccugauaagaau

SEQ ID NO: 1061343 - RNA, 19 nt, Homo sapiens
ugggcacgguuaugaaaua

SEQ ID NO: 1061344 - RNA, 19 nt, Homo sapiens
gcuccguggugcucuauga

SEQ ID NO: 1061345 - RNA, 19 nt, Homo sapiens
gucaacaucuuuagaaacu

SEQ ID NO: 1061346 - RNA, 19 nt, Homo sapiens
cuagcaagcuguucacaag

SEQ ID NO: 1061347 - RNA, 19 nt, Homo sapiens
ggauuggaguguggaaaga

SEQ ID NO: 1061348 - RNA, 19 nt, Homo sapiens
agaauuauuuggucuugug

SEQ ID NO: 1061349 - RNA, 19 nt, Homo sapiens
gaaauguuuggcaaugauu

SEQ ID NO: 1061350 - RNA, 19 nt, Homo sapiens
ugaaauguuuggcaaugau

SEQ ID NO: 1061351 - RNA, 19 nt, Homo sapiens
caggugacuuggcaugaaa

SEQ ID NO: 1061352 - RNA, 19 nt, Homo sapiens
ggauccagaaggagaauuu

SEQ ID NO: 1061353 - RNA, 19 nt, Homo sapiens
cuccagagauugucauuuc

SEQ ID NO: 1061354 - RNA, 19 nt, Homo sapiens
gagccacugucccugcauu

SEQ ID NO: 1061355 - RNA, 19 nt, Homo sapiens
ggcaaugauuaaucgguuu

SEQ ID NO: 1061356 - RNA, 19 nt, Homo sapiens
guaccaauauuagcaugug

SEQ ID NO: 1061357 - RNA, 19 nt, Homo sapiens
cuucagacuuuaaacuuug

SEQ ID NO: 1061358 - RNA, 19 nt, Homo sapiens
guaaugugccuucagacuu

SEQ ID NO: 1061359 - RNA, 19 nt, Homo sapiens
acacagagucaauaaaugu

SEQ ID NO: 1061360 - RNA, 19 nt, Homo sapiens
uggaagaauugcaguggaa

SEQ ID NO: 1061361 - RNA, 19 nt, Homo sapiens
caaagaugguguccuacag

SEQ ID NO: 1061362 - RNA, 19 nt, Homo sapiens
gcagcuaucauucuuugga

SEQ ID NO: 1061363 - RNA, 19 nt, Homo sapiens
ccuucagacuuuaaacuuu

SEQ ID NO: 1061364 - RNA, 19 nt, Homo sapiens
gcuccacccuucucaacga

SEQ ID NO: 1061365 - RNA, 19 nt, Homo sapiens
gagcaugcagcuaucauuc

SEQ ID NO: 1061366 - RNA, 19 nt, Homo sapiens
caugugcucuguaaucaag

SEQ ID NO: 1061367 - RNA, 19 nt, Homo sapiens
gaagagaaaagaccaauca

SEQ ID NO: 1061368 - RNA, 19 nt, Homo sapiens
ucaggaugacgauaacaua

SEQ ID NO: 1061369 - RNA, 19 nt, Homo sapiens
uucacaagauugccugaua

SEQ ID NO: 1061370 - RNA, 19 nt, Homo sapiens
gaaugggcagccuuuggua

SEQ ID NO: 1061371 - RNA, 19 nt, Homo sapiens
cagcaaguauuucuucacu

SEQ ID NO: 1061372 - RNA, 19 nt, Homo sapiens
gaaccuggucauuguggaa

SEQ ID NO: 1061373 - RNA, 19 nt, Homo sapiens
cagcuaucauucuuuggaa

SEQ ID NO: 1061374 - RNA, 19 nt, Homo sapiens
ugcuuuggcucucugcuua

SEQ ID NO: 1061375 - RNA, 19 nt, Homo sapiens
uauguacacugaucguuuc

SEQ ID NO: 1061376 - RNA, 19 nt, Homo sapiens
gaauuuaguuuuccacagu

SEQ ID NO: 1061377 - RNA, 19 nt, Homo sapiens
auuaaucgguuucaguuug

SEQ ID NO: 1061378 - RNA, 19 nt, Homo sapiens
ucgaguaggugaaguaggu

SEQ ID NO: 1061379 - RNA, 19 nt, Homo sapiens
gauaacauaagacugaaag

SEQ ID NO: 1061380 - RNA, 19 nt, Homo sapiens
caggaugacgauaacauaa

SEQ ID NO: 1061381 - RNA, 19 nt, Homo sapiens
ggaaugggcagccuuuggu

SEQ ID NO: 1061382 - RNA, 19 nt, Homo sapiens
gucaauaaaugugcacugu

SEQ ID NO: 1061383 - RNA, 19 nt, Homo sapiens
gacagcaaguauuucuuca

SEQ ID NO: 1061384 - RNA, 19 nt, Homo sapiens
gggcacgguuaugaaauau

SEQ ID NO: 1061385 - RNA, 19 nt, Homo sapiens
gaagagaaguugacuaaga

SEQ ID NO: 1061386 - RNA, 19 nt, Homo sapiens
gagaagcccucccuuauuu

SEQ ID NO: 1061387 - RNA, 19 nt, Homo sapiens
ggaaugaauugccagauaa

SEQ ID NO: 1061388 - RNA, 19 nt, Homo sapiens
gagagaaucuucauagaga

SEQ ID NO: 1061389 - RNA, 19 nt, Homo sapiens
aaacugaaguggaaacuaa

SEQ ID NO: 1061390 - RNA, 19 nt, Homo sapiens
gaaaguuaguucauaguug

SEQ ID NO: 1061391 - RNA, 19 nt, Homo sapiens
gaaguuacauuugcccuaa

SEQ ID NO: 1061392 - RNA, 19 nt, Homo sapiens
ggaauugccuggagauuuc

SEQ ID NO: 1061393 - RNA, 19 nt, Homo sapiens
gcacaagcuuauaaaugua

SEQ ID NO: 1061394 - RNA, 19 nt, Homo sapiens
caacagcugugaagacuug

SEQ ID NO: 1061395 - RNA, 19 nt, Homo sapiens
gagaaauacuuugguguuu

SEQ ID NO: 1061396 - RNA, 19 nt, Homo sapiens
uaaccuguguugcuuauaa

SEQ ID NO: 1061397 - RNA, 19 nt, Homo sapiens
augaagagcugauagauaa

SEQ ID NO: 1061398 - RNA, 19 nt, Homo sapiens
guucauaguuguugccuuu

SEQ ID NO: 1061399 - RNA, 19 nt, Homo sapiens
ccagggaauuugaaacaua

SEQ ID NO: 1061400 - RNA, 19 nt, Homo sapiens
ggaaacauguauugcucua

SEQ ID NO: 1061401 - RNA, 19 nt, Homo sapiens
gaaagagcaugaagaguac

SEQ ID NO: 1061402 - RNA, 19 nt, Homo sapiens
gaaccacugucaaguaauc

SEQ ID NO: 1061403 - RNA, 19 nt, Homo sapiens
agaaagagcaugaagagua

SEQ ID NO: 1061404 - RNA, 19 nt, Homo sapiens
gaaauacuuugguguuuac

SEQ ID NO: 1061405 - RNA, 19 nt, Homo sapiens
gaucagaguuacauugcuu

SEQ ID NO: 1061406 - RNA, 19 nt, Homo sapiens
aaauaagucuccuguuuga

SEQ ID NO: 1061407 - RNA, 19 nt, Homo sapiens
guggagagcuuucuaucuu

SEQ ID NO: 1061408 - RNA, 19 nt, Homo sapiens
aaacuggacuucuucauca

SEQ ID NO: 1061409 - RNA, 19 nt, Homo sapiens
gaaguugacuaagauaaca

SEQ ID NO: 1061410 - RNA, 19 nt, Homo sapiens
gaaagaagcacaguauauc

SEQ ID NO: 1061411 - RNA, 19 nt, Homo sapiens
ucacauagcagaaugauca

SEQ ID NO: 1061412 - RNA, 19 nt, Homo sapiens
caaaucaugucaauaaagg

SEQ ID NO: 1061413 - RNA, 19 nt, Homo sapiens
ugacuucaguuugcuauuu

SEQ ID NO: 1061414 - RNA, 19 nt, Homo sapiens
gaguaucacugaauuucuu

SEQ ID NO: 1061415 - RNA, 19 nt, Homo sapiens
uaagagagacuguuugaug

SEQ ID NO: 1061416 - RNA, 19 nt, Homo sapiens
aaacauguauugcucuaga

SEQ ID NO: 1061417 - RNA, 19 nt, Homo sapiens
aagaaccacugucaaguaa

SEQ ID NO: 1061418 - RNA, 19 nt, Homo sapiens
gauaaucuuucuggaauuc

SEQ ID NO: 1061419 - RNA, 19 nt, Homo sapiens
gagcaggcuuucagagcua

SEQ ID NO: 1061420 - RNA, 19 nt, Homo sapiens
uagucaagcuucagucuuu

SEQ ID NO: 1061421 - RNA, 19 nt, Homo sapiens
agaguuacauugcuuauuc

SEQ ID NO: 1061422 - RNA, 19 nt, Homo sapiens
gaguauugccuaaguguaa

SEQ ID NO: 1061423 - RNA, 19 nt, Homo sapiens
caauaaagguagucaggau

SEQ ID NO: 1061424 - RNA, 19 nt, Homo sapiens
gcagauugcugagugugaa

SEQ ID NO: 1061425 - RNA, 19 nt, Homo sapiens
ggccgagccuggaguauug

SEQ ID NO: 1061426 - RNA, 19 nt, Homo sapiens
aagagagacuguuugauga

SEQ ID NO: 1061427 - RNA, 19 nt, Homo sapiens
gaaauaggaagagcagauu

SEQ ID NO: 1061428 - RNA, 19 nt, Homo sapiens
gaagagcugauagauaauu

SEQ ID NO: 1061429 - RNA, 19 nt, Homo sapiens
aaacuaaccuguguugcuu

SEQ ID NO: 1061430 - RNA, 19 nt, Homo sapiens
aggaaugaauugccagaua

SEQ ID NO: 1061431 - RNA, 19 nt, Homo sapiens
ugaaagaagcacaguauau

SEQ ID NO: 1061432 - RNA, 19 nt, Homo sapiens
gaaaaguaguaaagccaua

SEQ ID NO: 1061433 - RNA, 19 nt, Homo sapiens
gaaugcauaagacauguuu

SEQ ID NO: 1061434 - RNA, 19 nt, Homo sapiens
acugauacguagacacuua

SEQ ID NO: 1061435 - RNA, 19 nt, Homo sapiens
aaagaaccacugucaagua

SEQ ID NO: 1061436 - RNA, 19 nt, Homo sapiens
gcaccugcguccaaguuug

SEQ ID NO: 1061437 - RNA, 19 nt, Homo sapiens
gaaacuggacuucuucauc

SEQ ID NO: 1061438 - RNA, 19 nt, Homo sapiens
guaaagccauagacuugug

SEQ ID NO: 1061439 - RNA, 19 nt, Homo sapiens
gacacuuacuuggaaauuu

SEQ ID NO: 1061440 - RNA, 19 nt, Homo sapiens
ggaaacggacuaaagaaca

SEQ ID NO: 1061441 - RNA, 19 nt, Homo sapiens
ggguggaacuucacucaga

SEQ ID NO: 1061442 - RNA, 19 nt, Homo sapiens
cguagacacuuacuuggaa

SEQ ID NO: 1061443 - RNA, 19 nt, Homo sapiens
ggaaauaggaagagcagau

SEQ ID NO: 1061444 - RNA, 19 nt, Homo sapiens
gcagaaagagcaugaagag

SEQ ID NO: 1061445 - RNA, 19 nt, Homo sapiens
ccacauucuugacaacuau

SEQ ID NO: 1061446 - RNA, 19 nt, Homo sapiens
uuaaaugagugcuaucugu

SEQ ID NO: 1061447 - RNA, 19 nt, Homo sapiens
gauucaguauccagaguuu

SEQ ID NO: 1061448 - RNA, 19 nt, Homo sapiens
uggagagcuuucuaucuua

SEQ ID NO: 1061449 - RNA, 19 nt, Homo sapiens
gcacugaguaucacugaau

SEQ ID NO: 1061450 - RNA, 19 nt, Homo sapiens
ucaggaaacugugagcaaa

SEQ ID NO: 1061451 - RNA, 19 nt, Homo sapiens
gagaaguugacuaagauaa

SEQ ID NO: 1061452 - RNA, 19 nt, Homo sapiens
ugugaaccuuccuuuguua

SEQ ID NO: 1061453 - RNA, 19 nt, Homo sapiens
ggcauuauucuaacugaua

SEQ ID NO: 1061454 - RNA, 19 nt, Homo sapiens
caaagagaaaugugugauu

SEQ ID NO: 1061455 - RNA, 19 nt, Homo sapiens
uaagugaaguuacauuugc

SEQ ID NO: 1061456 - RNA, 19 nt, Homo sapiens
acaagaccuucauugcaua

SEQ ID NO: 1061457 - RNA, 19 nt, Homo sapiens
cacaagaccuucauugcau

SEQ ID NO: 1061458 - RNA, 19 nt, Homo sapiens
gggcuggcgugcagaaaga

SEQ ID NO: 1061459 - RNA, 19 nt, Homo sapiens
uuaaugagcugguaaacac

SEQ ID NO: 1061460 - RNA, 19 nt, Homo sapiens
gagcaucaaauguguaugu

SEQ ID NO: 1061461 - RNA, 19 nt, Homo sapiens
uaaaccacauucuugacaa

SEQ ID NO: 1061462 - RNA, 19 nt, Homo sapiens
gagcugauagauaauuuga

SEQ ID NO: 1061463 - RNA, 19 nt, Homo sapiens
uggaagagaaguugacuaa

SEQ ID NO: 1061464 - RNA, 19 nt, Homo sapiens
gaaccuuccuuuguuacug

SEQ ID NO: 1061465 - RNA, 19 nt, Homo sapiens
gagcaggucgaaaauauua

SEQ ID NO: 1061466 - RNA, 19 nt, Homo sapiens
gaaacggacuaaagaacac

SEQ ID NO: 1061467 - RNA, 19 nt, Homo sapiens
gaagaguacaugaagaauc

SEQ ID NO: 1061468 - RNA, 19 nt, Homo sapiens
gggaauugccuggagauuu

SEQ ID NO: 1061469 - RNA, 19 nt, Homo sapiens
guagacacuuacuuggaaa

SEQ ID NO: 1061470 - RNA, 19 nt, Homo sapiens
ggagagcuuucuaucuuac

SEQ ID NO: 1061471 - RNA, 19 nt, Homo sapiens
gaaacuaaccuguguugcu

SEQ ID NO: 1061472 - RNA, 19 nt, Homo sapiens
gaccgucccucaugcaaca

SEQ ID NO: 1061473 - RNA, 19 nt, Homo sapiens
aagagaaguugacuaagau

SEQ ID NO: 1061474 - RNA, 19 nt, Homo sapiens
auaaagacuuggcauggaa

SEQ ID NO: 1061475 - RNA, 19 nt, Homo sapiens
cccuagggaugauucuuua

SEQ ID NO: 1061476 - RNA, 19 nt, Homo sapiens
agcacaagcuuauaaaugu

SEQ ID NO: 1061477 - RNA, 19 nt, Homo sapiens
gagaaucuucauagagaaa

SEQ ID NO: 1061478 - RNA, 19 nt, Homo sapiens
gauggaagcccuagaucug

SEQ ID NO: 1061479 - RNA, 19 nt, Homo sapiens
gaugauucuuuacccaguu

SEQ ID NO: 1061480 - RNA, 19 nt, Homo sapiens
ugagaagcccucccuuauu

SEQ ID NO: 1061481 - RNA, 19 nt, Homo sapiens
ggagagaaucuucauagag

SEQ ID NO: 1061482 - RNA, 19 nt, Homo sapiens
cuacuugcuuuauuacaga

SEQ ID NO: 1061483 - RNA, 19 nt, Homo sapiens
gacaacagcugugaagacu

SEQ ID NO: 1061484 - RNA, 19 nt, Homo sapiens
aagaguacaugaagaaucu

SEQ ID NO: 1061485 - RNA, 19 nt, Homo sapiens
ggaaagccauucaucuuaa

SEQ ID NO: 1061486 - RNA, 19 nt, Homo sapiens
aaacagauauugccaacua

SEQ ID NO: 1061487 - RNA, 19 nt, Homo sapiens
gguggaaucuucuuaaauu

SEQ ID NO: 1061488 - RNA, 19 nt, Homo sapiens
ggacuuggauucaggguuu

SEQ ID NO: 1061489 - RNA, 19 nt, Homo sapiens
gcaauaaucaucucuguuu

SEQ ID NO: 1061490 - RNA, 19 nt, Homo sapiens
ggaauggucuaaagaaaug

SEQ ID NO: 1061491 - RNA, 19 nt, Homo sapiens
gcaaagauguucccaugga

SEQ ID NO: 1061492 - RNA, 19 nt, Homo sapiens
uaagucacauuccagauua

SEQ ID NO: 1061493 - RNA, 19 nt, Homo sapiens
gaacguaaauaacuuugga

SEQ ID NO: 1061494 - RNA, 19 nt, Homo sapiens
ggaaagguaucagggauuu

SEQ ID NO: 1061495 - RNA, 19 nt, Homo sapiens
uaagaaggcugcaaggauu

SEQ ID NO: 1061496 - RNA, 19 nt, Homo sapiens
ggaauucauuucacaggua

SEQ ID NO: 1061497 - RNA, 19 nt, Homo sapiens
gaaagccauucaucuuaaa

SEQ ID NO: 1061498 - RNA, 19 nt, Homo sapiens
gcagguuauucauagauua

SEQ ID NO: 1061499 - RNA, 19 nt, Homo sapiens
uggaagagguugagaguuu

SEQ ID NO: 1061500 - RNA, 19 nt, Homo sapiens
gggaacaucuggaaaggaa

SEQ ID NO: 1061501 - RNA, 19 nt, Homo sapiens
gcucauagcuaccaacaca

SEQ ID NO: 1061502 - RNA, 19 nt, Homo sapiens
ccagguaucuagcaaugua

SEQ ID NO: 1061503 - RNA, 19 nt, Homo sapiens
caaagaagaugacacugau

SEQ ID NO: 1061504 - RNA, 19 nt, Homo sapiens
gcaaagaagaugacacuga

SEQ ID NO: 1061505 - RNA, 19 nt, Homo sapiens
gggcacuacuuacugaaua

SEQ ID NO: 1061506 - RNA, 19 nt, Homo sapiens
caccaaaguugaaaugaaa

SEQ ID NO: 1061507 - RNA, 19 nt, Homo sapiens
guucuuggcuucuacugua

SEQ ID NO: 1061508 - RNA, 19 nt, Homo sapiens
gcagggcacuacuuacuga

SEQ ID NO: 1061509 - RNA, 19 nt, Homo sapiens
guaagaaacucacuucacu

SEQ ID NO: 1061510 - RNA, 19 nt, Homo sapiens
ugaaagcccugacuugguu

SEQ ID NO: 1061511 - RNA, 19 nt, Homo sapiens
caauguaggugaugucaug

SEQ ID NO: 1061512 - RNA, 19 nt, Homo sapiens
gaacagacuauaacuagga

SEQ ID NO: 1061513 - RNA, 19 nt, Homo sapiens
acacacagcuaagagauaa

SEQ ID NO: 1061514 - RNA, 19 nt, Homo sapiens
gaaggaauggucuaaagaa

SEQ ID NO: 1061515 - RNA, 19 nt, Homo sapiens
aagagcaccuuguauagua

SEQ ID NO: 1061516 - RNA, 19 nt, Homo sapiens
agaauuaccuguucacuag

SEQ ID NO: 1061517 - RNA, 19 nt, Homo sapiens
caaggccaauauaggauua

SEQ ID NO: 1061518 - RNA, 19 nt, Homo sapiens
caaauaauacucagccaaa

SEQ ID NO: 1061519 - RNA, 19 nt, Homo sapiens
gacccuagccagagauuua

SEQ ID NO: 1061520 - RNA, 19 nt, Homo sapiens
gauuucaagucuccuaauu

SEQ ID NO: 1061521 - RNA, 19 nt, Homo sapiens
gcaaucugcuuggaauuug

SEQ ID NO: 1061522 - RNA, 19 nt, Homo sapiens
ucuagugacugaagaaauu

SEQ ID NO: 1061523 - RNA, 19 nt, Homo sapiens
gaauggacccacuuuaaga

SEQ ID NO: 1061524 - RNA, 19 nt, Homo sapiens
uaauggugcucccaaauau

SEQ ID NO: 1061525 - RNA, 19 nt, Homo sapiens
gaaaauauagcccuuguuu

SEQ ID NO: 1061526 - RNA, 19 nt, Homo sapiens
guaaggaauucauuucaca

SEQ ID NO: 1061527 - RNA, 19 nt, Homo sapiens
gggaaggguugaccaguug

SEQ ID NO: 1061528 - RNA, 19 nt, Homo sapiens
ggaaaguacuggugaugag

SEQ ID NO: 1061529 - RNA, 19 nt, Homo sapiens
gcaagacuuugugaauuug

SEQ ID NO: 1061530 - RNA, 19 nt, Homo sapiens
ugaaugagcaaaccacuuu

SEQ ID NO: 1061531 - RNA, 19 nt, Homo sapiens
caggaaggguuuaaagaga

SEQ ID NO: 1061532 - RNA, 19 nt, Homo sapiens
gauuugagcuacaucuugu

SEQ ID NO: 1061533 - RNA, 19 nt, Homo sapiens
aaaggaaagugaaggaaug

SEQ ID NO: 1061534 - RNA, 19 nt, Homo sapiens
gagaauuaccuguucacua

SEQ ID NO: 1061535 - RNA, 19 nt, Homo sapiens
ggguaaaguacaaauguua

SEQ ID NO: 1061536 - RNA, 19 nt, Homo sapiens
ggaauacaaaguacagauu

SEQ ID NO: 1061537 - RNA, 19 nt, Homo sapiens
ucaccaaaguugaaaugaa

SEQ ID NO: 1061538 - RNA, 19 nt, Homo sapiens
gacccaggcucuuauagau

SEQ ID NO: 1061539 - RNA, 19 nt, Homo sapiens
gaccacagccacuuuagaa

SEQ ID NO: 1061540 - RNA, 19 nt, Homo sapiens
ggaacuucuuuaaacauga

SEQ ID NO: 1061541 - RNA, 19 nt, Homo sapiens
gcacgccuucgaaauguua

SEQ ID NO: 1061542 - RNA, 19 nt, Homo sapiens
gaccauaacucugcuguac

SEQ ID NO: 1061543 - RNA, 19 nt, Homo sapiens
aaaugucaguuaccaguuu

SEQ ID NO: 1061544 - RNA, 19 nt, Homo sapiens
ccacauuuguucauucugu

SEQ ID NO: 1061545 - RNA, 19 nt, Homo sapiens
ggaagagcaccuuguauag

SEQ ID NO: 1061546 - RNA, 19 nt, Homo sapiens
uaaggagaauuaccuguuc

SEQ ID NO: 1061547 - RNA, 19 nt, Homo sapiens
gccuaaaccucucaccaaa

SEQ ID NO: 1061548 - RNA, 19 nt, Homo sapiens
gaaaggaggaaagguauca

SEQ ID NO: 1061549 - RNA, 19 nt, Homo sapiens
uuucaagucuccuaauuug

SEQ ID NO: 1061550 - RNA, 19 nt, Homo sapiens
uuaaauccuucucuaguga

SEQ ID NO: 1061551 - RNA, 19 nt, Homo sapiens
gaacaaggucgcuucucuu

SEQ ID NO: 1061552 - RNA, 19 nt, Homo sapiens
gugcaacaauuccagcaaa

SEQ ID NO: 1061553 - RNA, 19 nt, Homo sapiens
gaucccugcuguucccuaa

SEQ ID NO: 1061554 - RNA, 19 nt, Homo sapiens
gaaugugaaggcugagaua

SEQ ID NO: 1061555 - RNA, 19 nt, Homo sapiens
ccagagaggaaguuaauga

SEQ ID NO: 1061556 - RNA, 19 nt, Homo sapiens
uaacuugaauaccagucua

SEQ ID NO: 1061557 - RNA, 19 nt, Homo sapiens
ccaggaacuucuuuaaaca

SEQ ID NO: 1061558 - RNA, 19 nt, Homo sapiens
aagcaagacuuugugaauu

SEQ ID NO: 1061559 - RNA, 19 nt, Homo sapiens
uaggugaugucaugucauu

SEQ ID NO: 1061560 - RNA, 19 nt, Homo sapiens
cuaaaccucucaccaaagu

SEQ ID NO: 1061561 - RNA, 19 nt, Homo sapiens
uggaaagccauucaucuua

SEQ ID NO: 1061562 - RNA, 19 nt, Homo sapiens
gaugaacagacuauaacua

SEQ ID NO: 1061563 - RNA, 19 nt, Homo sapiens
cgauaugucuguccaucuu

SEQ ID NO: 1061564 - RNA, 19 nt, Homo sapiens
ccaaguguuuagguaauaa

SEQ ID NO: 1061565 - RNA, 19 nt, Homo sapiens
agcaagacuuugugaauuu

SEQ ID NO: 1061566 - RNA, 19 nt, Homo sapiens
gaagaaauugugaguacau

SEQ ID NO: 1061567 - RNA, 19 nt, Homo sapiens
ugucugagcacuagaaauu

SEQ ID NO: 1061568 - RNA, 19 nt, Homo sapiens
cagagacaaauguuacuua

SEQ ID NO: 1061569 - RNA, 19 nt, Homo sapiens
guaaagcaacccaagauca

SEQ ID NO: 1061570 - RNA, 19 nt, Homo sapiens
ggaaaguguuagugauugg

SEQ ID NO: 1061571 - RNA, 19 nt, Homo sapiens
uaaugagacuagaaagaga

SEQ ID NO: 1061572 - RNA, 19 nt, Homo sapiens
gagaguagcagcagcaaag

SEQ ID NO: 1061573 - RNA, 19 nt, Homo sapiens
ccacgaaggacuaaguaaa

SEQ ID NO: 1061574 - RNA, 19 nt, Homo sapiens
gggcaauaaucaucucugu

SEQ ID NO: 1061575 - RNA, 19 nt, Homo sapiens
gugaaggaauggucuaaag

SEQ ID NO: 1061576 - RNA, 19 nt, Homo sapiens
gaagagcaccuuguauagu

SEQ ID NO: 1061577 - RNA, 19 nt, Homo sapiens
ucuaguaucccugcuaaua

SEQ ID NO: 1061578 - RNA, 19 nt, Homo sapiens
gaaggaaaaugagcccuaa

SEQ ID NO: 1061579 - RNA, 19 nt, Homo sapiens
aaauauagcccuuguuugg

SEQ ID NO: 1061580 - RNA, 19 nt, Homo sapiens
caagcaagacuuugugaau

SEQ ID NO: 1061581 - RNA, 19 nt, Homo sapiens
aggaagagcaccuuguaua

SEQ ID NO: 1061582 - RNA, 19 nt, Homo sapiens
caacacagagguuucaagu

SEQ ID NO: 1061583 - RNA, 19 nt, Homo sapiens
uagauacacugccucaauc

SEQ ID NO: 1061584 - RNA, 19 nt, Homo sapiens
ccaggcaucugaacaggau

SEQ ID NO: 1061585 - RNA, 19 nt, Homo sapiens
ggacauggaucaauuauaa

SEQ ID NO: 1061586 - RNA, 19 nt, Homo sapiens
ucacaacucucacuuauuu

SEQ ID NO: 1061587 - RNA, 19 nt, Homo sapiens
gaaagaagagcuaugauaa

SEQ ID NO: 1061588 - RNA, 19 nt, Homo sapiens
gaaugaagauggugaaaga

SEQ ID NO: 1061589 - RNA, 19 nt, Homo sapiens
uagaagaggugacuaguaa

SEQ ID NO: 1061590 - RNA, 19 nt, Homo sapiens
uaaacaagguuaucaguug

SEQ ID NO: 1061591 - RNA, 19 nt, Homo sapiens
gagaagcccuuacuaaaca

SEQ ID NO: 1061592 - RNA, 19 nt, Homo sapiens
gaacaugauuaagcaguuu

SEQ ID NO: 1061593 - RNA, 19 nt, Homo sapiens
ggcaagaacuuacaggaaa

SEQ ID NO: 1061594 - RNA, 19 nt, Homo sapiens
gagauuccuugacaguuua

SEQ ID NO: 1061595 - RNA, 19 nt, Homo sapiens
gaagagaagucugguuugu

SEQ ID NO: 1061596 - RNA, 19 nt, Homo sapiens
gaacuacacagucgugauu

SEQ ID NO: 1061597 - RNA, 19 nt, Homo sapiens
gaagaaggaaugacgguaa

SEQ ID NO: 1061598 - RNA, 19 nt, Homo sapiens
aaacuuggauggccucaaa

SEQ ID NO: 1061599 - RNA, 19 nt, Homo sapiens
gaggaagcauccauugauu

SEQ ID NO: 1061600 - RNA, 19 nt, Homo sapiens
ggacugaagaggaucauuu

SEQ ID NO: 1061601 - RNA, 19 nt, Homo sapiens
aaacacacauucuauggaa

SEQ ID NO: 1061602 - RNA, 19 nt, Homo sapiens
gcagaacgcuuugaagaag

SEQ ID NO: 1061603 - RNA, 19 nt, Homo sapiens
gaacacgaacacucuaauu

SEQ ID NO: 1061604 - RNA, 19 nt, Homo sapiens
gagccuaaauuccauuguu

SEQ ID NO: 1061605 - RNA, 19 nt, Homo sapiens
ugaaagaagagcuaugaua

SEQ ID NO: 1061606 - RNA, 19 nt, Homo sapiens
gcaagaaaggcaaauguga

SEQ ID NO: 1061607 - RNA, 19 nt, Homo sapiens
gaacaaaucaaaggcuauu

SEQ ID NO: 1061608 - RNA, 19 nt, Homo sapiens
ggucacaaacgcacaauuu

SEQ ID NO: 1061609 - RNA, 19 nt, Homo sapiens
uaugagauaugcgguauuu

SEQ ID NO: 1061610 - RNA, 19 nt, Homo sapiens
ggaccagccugaaaugauc

SEQ ID NO: 1061611 - RNA, 19 nt, Homo sapiens
agagauuccuugacaguuu

SEQ ID NO: 1061612 - RNA, 19 nt, Homo sapiens
uguaagaccugccagaaug

SEQ ID NO: 1061613 - RNA, 19 nt, Homo sapiens
ccaauaauguacccagaga

SEQ ID NO: 1061614 - RNA, 19 nt, Homo sapiens
ggagaaaguucagcaagca

SEQ ID NO: 1061615 - RNA, 19 nt, Homo sapiens
aaacaagguuaucaguuga

SEQ ID NO: 1061616 - RNA, 19 nt, Homo sapiens
gcauuagccuuuggauuug

SEQ ID NO: 1061617 - RNA, 19 nt, Homo sapiens
agagaagucugguuuguuc

SEQ ID NO: 1061618 - RNA, 19 nt, Homo sapiens
gcuguuagcauuagccuuu

SEQ ID NO: 1061619 - RNA, 19 nt, Homo sapiens
uauuugggcuuugcuguua

SEQ ID NO: 1061620 - RNA, 19 nt, Homo sapiens
auaaaugugucuucuguug

SEQ ID NO: 1061621 - RNA, 19 nt, Homo sapiens
gaccucuucucaccuuuaa

SEQ ID NO: 1061622 - RNA, 19 nt, Homo sapiens
gagcauggaagaccaaguu

SEQ ID NO: 1061623 - RNA, 19 nt, Homo sapiens
gcacuacccugagcuaaac

SEQ ID NO: 1061624 - RNA, 19 nt, Homo sapiens
gagcagccacuuagcauug

SEQ ID NO: 1061625 - RNA, 19 nt, Homo sapiens
ccaaagacagccugaagaa

SEQ ID NO: 1061626 - RNA, 19 nt, Homo sapiens
caagaaaggcaaaugugaa

SEQ ID NO: 1061627 - RNA, 19 nt, Homo sapiens
gcaaagggauucgcaacag

SEQ ID NO: 1061628 - RNA, 19 nt, Homo sapiens
gaacaccacugugauucuc

SEQ ID NO: 1061629 - RNA, 19 nt, Homo sapiens
ccaggaauaugaagauagu

SEQ ID NO: 1061630 - RNA, 19 nt, Homo sapiens
gggaaauccugacuucauc

SEQ ID NO: 1061631 - RNA, 19 nt, Homo sapiens
ugaagauggugaaagaaga

SEQ ID NO: 1061632 - RNA, 19 nt, Homo sapiens
ugucacaacucucacuuau

SEQ ID NO: 1061633 - RNA, 19 nt, Homo sapiens
ggacacaagacaucagaga

SEQ ID NO: 1061634 - RNA, 19 nt, Homo sapiens
cuucucaccuuuaauauca

SEQ ID NO: 1061635 - RNA, 19 nt, Homo sapiens
ggauuuguguccagauugu

SEQ ID NO: 1061636 - RNA, 19 nt, Homo sapiens
gauagcacacagaaaguuu

SEQ ID NO: 1061637 - RNA, 19 nt, Homo sapiens
gaaaggcaaaugugaaucu

SEQ ID NO: 1061638 - RNA, 19 nt, Homo sapiens
ggaccucuucucaccuuua

SEQ ID NO: 1061639 - RNA, 19 nt, Homo sapiens
uggcagagauuccuugaca

SEQ ID NO: 1061640 - RNA, 19 nt, Homo sapiens
ccucuucucaccuuuaaua

SEQ ID NO: 1061641 - RNA, 19 nt, Homo sapiens
ucuauaagguucagguguu

SEQ ID NO: 1061642 - RNA, 19 nt, Homo sapiens
ccgagaagcccuuacuaaa

SEQ ID NO: 1061643 - RNA, 19 nt, Homo sapiens
gcucaggauuugaugacaa

SEQ ID NO: 1061644 - RNA, 19 nt, Homo sapiens
gguaugagauaugcgguau

SEQ ID NO: 1061645 - RNA, 19 nt, Homo sapiens
cccauucccauguaaauua

SEQ ID NO: 1061646 - RNA, 19 nt, Homo sapiens
cuugaucccuuucuucuau

SEQ ID NO: 1061647 - RNA, 19 nt, Homo sapiens
acacaagacaucagagaaa

SEQ ID NO: 1061648 - RNA, 19 nt, Homo sapiens
aagaaggaaugacgguaaa

SEQ ID NO: 1061649 - RNA, 19 nt, Homo sapiens
gcuaauaaaugugucuucu

SEQ ID NO: 1061650 - RNA, 19 nt, Homo sapiens
ggugaaagaagagcuauga

SEQ ID NO: 1061651 - RNA, 19 nt, Homo sapiens
gaucaugugaagaaagaaa

SEQ ID NO: 1061652 - RNA, 19 nt, Homo sapiens
uacuagaucucaucccauu

SEQ ID NO: 1061653 - RNA, 19 nt, Homo sapiens
caagacaucagagaaagaa

SEQ ID NO: 1061654 - RNA, 19 nt, Homo sapiens
gaagauggaccagccugaa

SEQ ID NO: 1061655 - RNA, 19 nt, Homo sapiens
caucagagccuaaauucca

SEQ ID NO: 1061656 - RNA, 19 nt, Homo sapiens
gaccaucagagccuaaauu

SEQ ID NO: 1061657 - RNA, 19 nt, Homo sapiens
gugagggcauggagucauu

SEQ ID NO: 1061658 - RNA, 19 nt, Homo sapiens
ucaagguacugaaggacaa

SEQ ID NO: 1061659 - RNA, 19 nt, Homo sapiens
agcauuagccuuuggauuu

SEQ ID NO: 1061660 - RNA, 19 nt, Homo sapiens
caaagggauucgcaacagu

SEQ ID NO: 1061661 - RNA, 19 nt, Homo sapiens
gcaagaacuuacaggaaaa

SEQ ID NO: 1061662 - RNA, 19 nt, Homo sapiens
gaagauagugguggaucaa

SEQ ID NO: 1061663 - RNA, 19 nt, Homo sapiens
ggaagagaagucugguuug

SEQ ID NO: 1061664 - RNA, 19 nt, Homo sapiens
uggaucaugugaagaaaga

SEQ ID NO: 1061665 - RNA, 19 nt, Homo sapiens
gguuaugucucccuucaag

SEQ ID NO: 1061666 - RNA, 19 nt, Homo sapiens
uaagacagcaccuccugaa

SEQ ID NO: 1061667 - RNA, 19 nt, Homo sapiens
caaggacgaauuacguaaa

SEQ ID NO: 1061668 - RNA, 19 nt, Homo sapiens
gggcaagaacuuacaggaa

SEQ ID NO: 1061669 - RNA, 19 nt, Homo sapiens
gcagagauuccuugacagu

SEQ ID NO: 1061670 - RNA, 19 nt, Homo sapiens
aagaagagcuaugauaacu

SEQ ID NO: 1061671 - RNA, 19 nt, Homo sapiens
gcaaaauuauggaucaugu

SEQ ID NO: 1061672 - RNA, 19 nt, Homo sapiens
gaggaagaacccuuugaga

SEQ ID NO: 1061673 - RNA, 19 nt, Homo sapiens
gguggacauggaucaauua

SEQ ID NO: 1061674 - RNA, 19 nt, Homo sapiens
gcacacagaaaguuuaaaa

SEQ ID NO: 1061675 - RNA, 19 nt, Homo sapiens
acccagagaucaacagguu

SEQ ID NO: 1061676 - RNA, 19 nt, Homo sapiens
ugucugugcuuucuaagau

SEQ ID NO: 1061677 - RNA, 19 nt, Homo sapiens
acacagucgugauuagaau

SEQ ID NO: 1061678 - RNA, 19 nt, Homo sapiens
ggugaaugguggacaugga

SEQ ID NO: 1061679 - RNA, 19 nt, Homo sapiens
caaagacagccugaagaaa

SEQ ID NO: 1061680 - RNA, 19 nt, Homo sapiens
ggaagcauccauugauuuu

SEQ ID NO: 1061681 - RNA, 19 nt, Homo sapiens
cuauaagguucagguguuu

SEQ ID NO: 1061682 - RNA, 19 nt, Homo sapiens
cacaaucuguucuauaagg

SEQ ID NO: 1061683 - RNA, 19 nt, Homo sapiens
caucagagaaagaacaaau

SEQ ID NO: 1061684 - RNA, 19 nt, Homo sapiens
ugaggaagugguacaguuu

SEQ ID NO: 1061685 - RNA, 19 nt, Homo sapiens
ggacucagcuggucuauuu

SEQ ID NO: 1061686 - RNA, 19 nt, Homo sapiens
gauaucagcucgcuuggua

SEQ ID NO: 1061687 - RNA, 19 nt, Homo sapiens
gcaguaggcuuccuuucua

SEQ ID NO: 1061688 - RNA, 19 nt, Homo sapiens
ggaacaggcuugagaaaca

SEQ ID NO: 1061689 - RNA, 19 nt, Homo sapiens
gaugugaucuuucaugugu

SEQ ID NO: 1061690 - RNA, 19 nt, Homo sapiens
cagcagauguuuauauaga

SEQ ID NO: 1061691 - RNA, 19 nt, Homo sapiens
aaacuaagcugccucucaa

SEQ ID NO: 1061692 - RNA, 19 nt, Homo sapiens
cacagcagauguuuauaua

SEQ ID NO: 1061693 - RNA, 19 nt, Homo sapiens
gaaguagaaugucugaaag

SEQ ID NO: 1061694 - RNA, 19 nt, Homo sapiens
gcacagcagauguuuauau

SEQ ID NO: 1061695 - RNA, 19 nt, Homo sapiens
gaugggugcugaaguauca

SEQ ID NO: 1061696 - RNA, 19 nt, Homo sapiens
cuccagaacuuucauguuu

SEQ ID NO: 1061697 - RNA, 19 nt, Homo sapiens
uaaacaaggugaugugauc

SEQ ID NO: 1061698 - RNA, 19 nt, Homo sapiens
ggaagaguaagggauauua

SEQ ID NO: 1061699 - RNA, 19 nt, Homo sapiens
gcaaugaaguagaaugucu

SEQ ID NO: 1061700 - RNA, 19 nt, Homo sapiens
ucaaggagguucucuucaa

SEQ ID NO: 1061701 - RNA, 19 nt, Homo sapiens
gaagaguaagggauauuaa

SEQ ID NO: 1061702 - RNA, 19 nt, Homo sapiens
ggccaguacuuauugcuaa

SEQ ID NO: 1061703 - RNA, 19 nt, Homo sapiens
gaucuuucauguguuagua

SEQ ID NO: 1061704 - RNA, 19 nt, Homo sapiens
gaugggagccuacucuuug

SEQ ID NO: 1061705 - RNA, 19 nt, Homo sapiens
gguccagucuguaaaguug

SEQ ID NO: 1061706 - RNA, 19 nt, Homo sapiens
agaauuaccuacagcuuug

SEQ ID NO: 1061707 - RNA, 19 nt, Homo sapiens
uaaaucugcucauccuuau

SEQ ID NO: 1061708 - RNA, 19 nt, Homo sapiens
ccauugauguugucacuug

SEQ ID NO: 1061709 - RNA, 19 nt, Homo sapiens
ccagaacuuucauguuuau

SEQ ID NO: 1061710 - RNA, 19 nt, Homo sapiens
ggcguuauguuuggaguua

SEQ ID NO: 1061711 - RNA, 19 nt, Homo sapiens
gcacgaggcaguagaggaa

SEQ ID NO: 1061712 - RNA, 19 nt, Homo sapiens
gcagugucgucuucuauca

SEQ ID NO: 1061713 - RNA, 19 nt, Homo sapiens
ugaaguagaaugucugaaa

SEQ ID NO: 1061714 - RNA, 19 nt, Homo sapiens
gauaguagagcacaucuuc

SEQ ID NO: 1061715 - RNA, 19 nt, Homo sapiens
uaugggaggugauauacuu

SEQ ID NO: 1061716 - RNA, 19 nt, Homo sapiens
gaacaaucuuggauguagu

SEQ ID NO: 1061717 - RNA, 19 nt, Homo sapiens
ugugaucuuucauguguua

SEQ ID NO: 1061718 - RNA, 19 nt, Homo sapiens
cagcacauuuggucagaaa

SEQ ID NO: 1061719 - RNA, 19 nt, Homo sapiens
ggugguauccuuacaauca

SEQ ID NO: 1061720 - RNA, 19 nt, Homo sapiens
ccacauucaugaagaagau

SEQ ID NO: 1061721 - RNA, 19 nt, Homo sapiens
uuaaaucugcucauccuua

SEQ ID NO: 1061722 - RNA, 19 nt, Homo sapiens
gcaaguggcagaaguugga

SEQ ID NO: 1061723 - RNA, 19 nt, Homo sapiens
uaaggcaggugcagcauca

SEQ ID NO: 1061724 - RNA, 19 nt, Homo sapiens
gcugaacaaucuuggaugu

SEQ ID NO: 1061725 - RNA, 19 nt, Homo sapiens
ccucuuaguuguuugaaau

SEQ ID NO: 1061726 - RNA, 19 nt, Homo sapiens
ccuacccacucaacaguua

SEQ ID NO: 1061727 - RNA, 19 nt, Homo sapiens
gaucaaugcuuuugucaug

SEQ ID NO: 1061728 - RNA, 19 nt, Homo sapiens
ccaguaaagagauugauuu

SEQ ID NO: 1061729 - RNA, 19 nt, Homo sapiens
ggagccuacucuuugaauu

SEQ ID NO: 1061730 - RNA, 19 nt, Homo sapiens
gaggggaagugaaagauaa

SEQ ID NO: 1061731 - RNA, 19 nt, Homo sapiens
cuacaauggcguuauguuu

SEQ ID NO: 1061732 - RNA, 19 nt, Homo sapiens
gagguaugccuguccagua

SEQ ID NO: 1061733 - RNA, 19 nt, Homo sapiens
ucuaucagcucuauuccuu

SEQ ID NO: 1061734 - RNA, 19 nt, Homo sapiens
cuacaugguucugauauca

SEQ ID NO: 1061735 - RNA, 19 nt, Homo sapiens
uguaugggcucucaucuca

SEQ ID NO: 1061736 - RNA, 19 nt, Homo sapiens
guucagcuuuaccuucuuu

SEQ ID NO: 1061737 - RNA, 19 nt, Homo sapiens
ugaacaaucuuggauguag

SEQ ID NO: 1061738 - RNA, 19 nt, Homo sapiens
ggcucuggcucuagcuuua

SEQ ID NO: 1061739 - RNA, 19 nt, Homo sapiens
uaagcugccucucaacaau

SEQ ID NO: 1061740 - RNA, 19 nt, Homo sapiens
uccagaacuuucauguuua

SEQ ID NO: 1061741 - RNA, 19 nt, Homo sapiens
ggaagugaaagauaagaau

SEQ ID NO: 1061742 - RNA, 19 nt, Homo sapiens
cuuauuucaucgaccauua

SEQ ID NO: 1061743 - RNA, 19 nt, Homo sapiens
agggaugggugcugaagua

SEQ ID NO: 1061744 - RNA, 19 nt, Homo sapiens
guggauggguacuuuguug

SEQ ID NO: 1061745 - RNA, 19 nt, Homo sapiens
uaguucagcuggcuaauag

SEQ ID NO: 1061746 - RNA, 19 nt, Homo sapiens
gaguaagggauauuaaaug

SEQ ID NO: 1061747 - RNA, 19 nt, Homo sapiens
gcaggugcagcaucaauga

SEQ ID NO: 1061748 - RNA, 19 nt, Homo sapiens
gaacaggcuugagaaacag

SEQ ID NO: 1061749 - RNA, 19 nt, Homo sapiens
ugauauacuuaguccauug

SEQ ID NO: 1061750 - RNA, 19 nt, Homo sapiens
guccucagcugaacaaucu

SEQ ID NO: 1061751 - RNA, 19 nt, Homo sapiens
caucucauguauuacuuga

SEQ ID NO: 1061752 - RNA, 19 nt, Homo sapiens
guugucacuugucaucuaa

SEQ ID NO: 1061753 - RNA, 19 nt, Homo sapiens
aaucuuggauguagucuag

SEQ ID NO: 1061754 - RNA, 19 nt, Homo sapiens
acaaggugaugugaucuuu

SEQ ID NO: 1061755 - RNA, 19 nt, Homo sapiens
acaaucauccugcuucuug

SEQ ID NO: 1061756 - RNA, 19 nt, Homo sapiens
gaccuugucuuagagaauc

SEQ ID NO: 1061757 - RNA, 19 nt, Homo sapiens
ccacuucugcuuccaaaga

SEQ ID NO: 1061758 - RNA, 19 nt, Homo sapiens
caguaggcuuccuuucuaa

SEQ ID NO: 1061759 - RNA, 19 nt, Homo sapiens
caaacuaagcugccucuca

SEQ ID NO: 1061760 - RNA, 19 nt, Homo sapiens
ggaugggagccuacucuuu

SEQ ID NO: 1061761 - RNA, 19 nt, Homo sapiens
aauaauacuuugccagaca

SEQ ID NO: 1061762 - RNA, 19 nt, Homo sapiens
guucagcuggcuaauagua

SEQ ID NO: 1061763 - RNA, 19 nt, Homo sapiens
guauggcucuggaauaacu

SEQ ID NO: 1061764 - RNA, 19 nt, Homo sapiens
gagggagaacucagauaaa

SEQ ID NO: 1061765 - RNA, 19 nt, Homo sapiens
gcagugccuucagauguau

SEQ ID NO: 1061766 - RNA, 19 nt, Homo sapiens
uaugggcucucaucucaga

SEQ ID NO: 1061767 - RNA, 19 nt, Homo sapiens
caugugggcuagaguaugg

SEQ ID NO: 1061768 - RNA, 19 nt, Homo sapiens
aggagaagcugagugcaaa

SEQ ID NO: 1061769 - RNA, 19 nt, Homo sapiens
gaaaagaguggguuaaagu

SEQ ID NO: 1061770 - RNA, 19 nt, Homo sapiens
uuguauggcucuggaauaa

SEQ ID NO: 1061771 - RNA, 19 nt, Homo sapiens
gugaugugaucuuucaugu

SEQ ID NO: 1061772 - RNA, 19 nt, Homo sapiens
gagccuacucuuugaauuc

SEQ ID NO: 1061773 - RNA, 19 nt, Homo sapiens
guucgucauugccaaauuc

SEQ ID NO: 1061774 - RNA, 19 nt, Homo sapiens
gguggaggcuguggcaaug

SEQ ID NO: 1061775 - RNA, 19 nt, Homo sapiens
uaaguuaugggaggugaua

SEQ ID NO: 1061776 - RNA, 19 nt, Homo sapiens
gcuuuguacucagauaauu

SEQ ID NO: 1061777 - RNA, 19 nt, Homo sapiens
gggcaaguccucagcugaa

SEQ ID NO: 1061778 - RNA, 19 nt, Homo sapiens
acugugauuugcuacauaa

SEQ ID NO: 1061779 - RNA, 19 nt, Homo sapiens
ccucuucagugccuacuau

SEQ ID NO: 1061780 - RNA, 19 nt, Homo sapiens
ucacuugucaucuaaacuu

SEQ ID NO: 1061781 - RNA, 19 nt, Homo sapiens
gauauacuuaguccauuga

SEQ ID NO: 1061782 - RNA, 19 nt, Homo sapiens
cagcacccauucucuuuua

SEQ ID NO: 1061783 - RNA, 19 nt, Homo sapiens
gccaguacuuauugcuaaa

SEQ ID NO: 1061784 - RNA, 19 nt, Homo sapiens
ucucauguauuacuugaca

SEQ ID NO: 1061785 - RNA, 19 nt, Homo sapiens
gaaccuagauccuugugaa

SEQ ID NO: 1061786 - RNA, 19 nt, Homo sapiens
ggagauguuucuauacuuu

SEQ ID NO: 1061787 - RNA, 19 nt, Homo sapiens
gacaauaggugaagaacaa

SEQ ID NO: 1061788 - RNA, 19 nt, Homo sapiens
gcaugaaccuugaacauca

SEQ ID NO: 1061789 - RNA, 19 nt, Homo sapiens
gaauguauuugcugcaguu

SEQ ID NO: 1061790 - RNA, 19 nt, Homo sapiens
gggauauucuugaaguuaa

SEQ ID NO: 1061791 - RNA, 19 nt, Homo sapiens
ggagaauggugacuuauac

SEQ ID NO: 1061792 - RNA, 19 nt, Homo sapiens
ggacacccaacaagaaaua

SEQ ID NO: 1061793 - RNA, 19 nt, Homo sapiens
aauuagaucuccuguguaa

SEQ ID NO: 1061794 - RNA, 19 nt, Homo sapiens
caucaaauaucggguacua

SEQ ID NO: 1061795 - RNA, 19 nt, Homo sapiens
gaaaucuccuuuacagaca

SEQ ID NO: 1061796 - RNA, 19 nt, Homo sapiens
caaagaauauaccacaagu

SEQ ID NO: 1061797 - RNA, 19 nt, Homo sapiens
guguauagccuucaaauga

SEQ ID NO: 1061798 - RNA, 19 nt, Homo sapiens
agaggagaauggugacuua

SEQ ID NO: 1061799 - RNA, 19 nt, Homo sapiens
acaguuagaugacuacaga

SEQ ID NO: 1061800 - RNA, 19 nt, Homo sapiens
ggcaaagaacugauaauuu

SEQ ID NO: 1061801 - RNA, 19 nt, Homo sapiens
ugaaauaccuaagaacugu

SEQ ID NO: 1061802 - RNA, 19 nt, Homo sapiens
ggacccaucuccacaacug

SEQ ID NO: 1061803 - RNA, 19 nt, Homo sapiens
caagccagccaaccuguua

SEQ ID NO: 1061804 - RNA, 19 nt, Homo sapiens
gaucuccuguguaagacua

SEQ ID NO: 1061805 - RNA, 19 nt, Homo sapiens
aaaccuguaugaacucaaa

SEQ ID NO: 1061806 - RNA, 19 nt, Homo sapiens
ggauaauauucucucauug

SEQ ID NO: 1061807 - RNA, 19 nt, Homo sapiens
gaauuguaguuguguggaa

SEQ ID NO: 1061808 - RNA, 19 nt, Homo sapiens
acacaugcaugaaccuuga

SEQ ID NO: 1061809 - RNA, 19 nt, Homo sapiens
cagacaaguucagagaaua

SEQ ID NO: 1061810 - RNA, 19 nt, Homo sapiens
ccagacaaguucagagaau

SEQ ID NO: 1061811 - RNA, 19 nt, Homo sapiens
guuuaaguauggcaaguuu

SEQ ID NO: 1061812 - RNA, 19 nt, Homo sapiens
gaagaucauggacuaguga

SEQ ID NO: 1061813 - RNA, 19 nt, Homo sapiens
acagaaggaucacuagaau

SEQ ID NO: 1061814 - RNA, 19 nt, Homo sapiens
uuagaugacuacagauuug

SEQ ID NO: 1061815 - RNA, 19 nt, Homo sapiens
gguaauaguuaaguuaugg

SEQ ID NO: 1061816 - RNA, 19 nt, Homo sapiens
gcugaucaucucauuauuu

SEQ ID NO: 1061817 - RNA, 19 nt, Homo sapiens
uguaugaacucaaauggau

SEQ ID NO: 1061818 - RNA, 19 nt, Homo sapiens
caaaugaagcgugugauug

SEQ ID NO: 1061819 - RNA, 19 nt, Homo sapiens
cuaaauggguacuagaaca

SEQ ID NO: 1061820 - RNA, 19 nt, Homo sapiens
gauagaacaguuauugugu

SEQ ID NO: 1061821 - RNA, 19 nt, Homo sapiens
uuauuuggcuuccuuuaga

SEQ ID NO: 1061822 - RNA, 19 nt, Homo sapiens
ugugaaagguacaaauaga

SEQ ID NO: 1061823 - RNA, 19 nt, Homo sapiens
cuucucagguccuaguaua

SEQ ID NO: 1061824 - RNA, 19 nt, Homo sapiens
auaccuugcugucuaguuu

SEQ ID NO: 1061825 - RNA, 19 nt, Homo sapiens
gcaagaaaaugcuacuuca

SEQ ID NO: 1061826 - RNA, 19 nt, Homo sapiens
ggaccaugcaggccuauga

SEQ ID NO: 1061827 - RNA, 19 nt, Homo sapiens
gcugauagaacaguuauug

SEQ ID NO: 1061828 - RNA, 19 nt, Homo sapiens
guauauccuccaaagaaua

SEQ ID NO: 1061829 - RNA, 19 nt, Homo sapiens
cauguucacuggagcuuau

SEQ ID NO: 1061830 - RNA, 19 nt, Homo sapiens
cuauauagcacaaacuuga

SEQ ID NO: 1061831 - RNA, 19 nt, Homo sapiens
uaguauauccuccaaagaa

SEQ ID NO: 1061832 - RNA, 19 nt, Homo sapiens
guacgcauuugggaguuaa

SEQ ID NO: 1061833 - RNA, 19 nt, Homo sapiens
gaagaacaaacccagaauc

SEQ ID NO: 1061834 - RNA, 19 nt, Homo sapiens
ggcagcaguuggcaaagaa

SEQ ID NO: 1061835 - RNA, 19 nt, Homo sapiens
gggaaugaccugugugugu

SEQ ID NO: 1061836 - RNA, 19 nt, Homo sapiens
gauacuaccagacaaguuc

SEQ ID NO: 1061837 - RNA, 19 nt, Homo sapiens
aaaauuagaucuccugugu

SEQ ID NO: 1061838 - RNA, 19 nt, Homo sapiens
ggauugcgcaguuuaagau

SEQ ID NO: 1061839 - RNA, 19 nt, Homo sapiens
cuguggagauguuucuaua

SEQ ID NO: 1061840 - RNA, 19 nt, Homo sapiens
ggaagagucagcaaacaag

SEQ ID NO: 1061841 - RNA, 19 nt, Homo sapiens
ucggagagcugaucaucug

SEQ ID NO: 1061842 - RNA, 19 nt, Homo sapiens
uuagaucuccuguguaaga

SEQ ID NO: 1061843 - RNA, 19 nt, Homo sapiens
uaacuguucuucagagacu

SEQ ID NO: 1061844 - RNA, 19 nt, Homo sapiens
guacugaaggcucaucaug

SEQ ID NO: 1061845 - RNA, 19 nt, Homo sapiens
ucaaaugaagcgugugauu

SEQ ID NO: 1061846 - RNA, 19 nt, Homo sapiens
guuagaugacuacagauuu

SEQ ID NO: 1061847 - RNA, 19 nt, Homo sapiens
ccuaguauauccuccaaag

SEQ ID NO: 1061848 - RNA, 19 nt, Homo sapiens
ggagcuuauuggagauuug

SEQ ID NO: 1061849 - RNA, 19 nt, Homo sapiens
ccaaacaggcaguuaaucu

SEQ ID NO: 1061850 - RNA, 19 nt, Homo sapiens
guuaagcgccuccuugauc

SEQ ID NO: 1061851 - RNA, 19 nt, Homo sapiens
gaugauggaauuguaguug

SEQ ID NO: 1061852 - RNA, 19 nt, Homo sapiens
acacugaacugcuaguacu

SEQ ID NO: 1061853 - RNA, 19 nt, Homo sapiens
ucaaauggauaggcaucuu

SEQ ID NO: 1061854 - RNA, 19 nt, Homo sapiens
uuggcuuccuuuagaauua

SEQ ID NO: 1061855 - RNA, 19 nt, Homo sapiens
acuuugagcugcuguugaa

SEQ ID NO: 1061856 - RNA, 19 nt, Homo sapiens
ugaagaucauggacuagug

SEQ ID NO: 1061857 - RNA, 19 nt, Homo sapiens
cucagaagauggcagugua

SEQ ID NO: 1061858 - RNA, 19 nt, Homo sapiens
guuaaucucaugcucagaa

SEQ ID NO: 1061859 - RNA, 19 nt, Homo sapiens
cuucagagacuagauguuu

SEQ ID NO: 1061860 - RNA, 19 nt, Homo sapiens
gguaccaauuuguuuagau

SEQ ID NO: 1061861 - RNA, 19 nt, Homo sapiens
gccuuucuccugcaaauuu

SEQ ID NO: 1061862 - RNA, 19 nt, Homo sapiens
guacaaauagagguaauag

SEQ ID NO: 1061863 - RNA, 19 nt, Homo sapiens
ccaggaacauguugcuucu

SEQ ID NO: 1061864 - RNA, 19 nt, Homo sapiens
acuuauaccuugcugucua

SEQ ID NO: 1061865 - RNA, 19 nt, Homo sapiens
gcuugcagcugagccugua

SEQ ID NO: 1061866 - RNA, 19 nt, Homo sapiens
gauggcaguguacgcauuu

SEQ ID NO: 1061867 - RNA, 19 nt, Homo sapiens
acuauaaccagccuuguaa

SEQ ID NO: 1061868 - RNA, 19 nt, Homo sapiens
uaaauggguacuagaacaa

SEQ ID NO: 1061869 - RNA, 19 nt, Homo sapiens
aguauuagcgucucaguug

SEQ ID NO: 1061870 - RNA, 19 nt, Homo sapiens
aaagggaacauauauacug

SEQ ID NO: 1061871 - RNA, 19 nt, Homo sapiens
gaauggugacuuauaccuu

SEQ ID NO: 1061872 - RNA, 19 nt, Homo sapiens
cuuugaagaucauggacua

SEQ ID NO: 1061873 - RNA, 19 nt, Homo sapiens
guggagauguuucuauacu

SEQ ID NO: 1061874 - RNA, 19 nt, Homo sapiens
cagaaucccuacacugaac

SEQ ID NO: 1061875 - RNA, 19 nt, Homo sapiens
gcauuugggaguuaagaga

SEQ ID NO: 1061876 - RNA, 19 nt, Homo sapiens
ccaagcgacugcccaaacu

SEQ ID NO: 1061877 - RNA, 19 nt, Homo sapiens
uuaagcgccuccuugauca

SEQ ID NO: 1061878 - RNA, 19 nt, Homo sapiens
ggauauucuugaaguuaag

SEQ ID NO: 1061879 - RNA, 19 nt, Homo sapiens
gagacagacuucuuuuaug

SEQ ID NO: 1061880 - RNA, 19 nt, Homo sapiens
caaauggauaggcaucuug

SEQ ID NO: 1061881 - RNA, 19 nt, Homo sapiens
gugaagaacaaacccagaa

SEQ ID NO: 1061882 - RNA, 19 nt, Homo sapiens
aaacaggcaguuaaucuca

SEQ ID NO: 1061883 - RNA, 19 nt, Homo sapiens
cacagaaggaucacuagaa

SEQ ID NO: 1061884 - RNA, 19 nt, Homo sapiens
uggcaaagaacugauaauu

SEQ ID NO: 1061885 - RNA, 19 nt, Homo sapiens
uaacacagcuagccagaua

SEQ ID NO: 1061886 - RNA, 19 nt, Homo sapiens
gaaaggaucuagaaagcaa

SEQ ID NO: 1061887 - RNA, 19 nt, Homo sapiens
uaaaguaacugccuuaauc

SEQ ID NO: 1061888 - RNA, 19 nt, Homo sapiens
guaagaaggugcaauccua

SEQ ID NO: 1061889 - RNA, 19 nt, Homo sapiens
ugagaaugauccagaauua

SEQ ID NO: 1061890 - RNA, 19 nt, Homo sapiens
uauaugagcuguguuagua

SEQ ID NO: 1061891 - RNA, 19 nt, Homo sapiens
gaaaugcaguuccuuagau

SEQ ID NO: 1061892 - RNA, 19 nt, Homo sapiens
ugagaucucuggauucuuu

SEQ ID NO: 1061893 - RNA, 19 nt, Homo sapiens
agaggaaacucaagccuua

SEQ ID NO: 1061894 - RNA, 19 nt, Homo sapiens
gaagcuggaugcugacaaa

SEQ ID NO: 1061895 - RNA, 19 nt, Homo sapiens
gacucuaucucaguaauua

SEQ ID NO: 1061896 - RNA, 19 nt, Homo sapiens
acucaagccuuaaauguuu

SEQ ID NO: 1061897 - RNA, 19 nt, Homo sapiens
ggaguuaccuuauauucag

SEQ ID NO: 1061898 - RNA, 19 nt, Homo sapiens
guaacugccuuaaucuuau

SEQ ID NO: 1061899 - RNA, 19 nt, Homo sapiens
gcuggaugcugacaaauau

SEQ ID NO: 1061900 - RNA, 19 nt, Homo sapiens
gaaggugcaauccuagaua

SEQ ID NO: 1061901 - RNA, 19 nt, Homo sapiens
gaaaagauccgaagagaga

SEQ ID NO: 1061902 - RNA, 19 nt, Homo sapiens
uaaagagucaccuucauuu

SEQ ID NO: 1061903 - RNA, 19 nt, Homo sapiens
guaaagagucaccuucauu

SEQ ID NO: 1061904 - RNA, 19 nt, Homo sapiens
gcaaagauaaacuaccaaa

SEQ ID NO: 1061905 - RNA, 19 nt, Homo sapiens
guaaugaaaggaucuagaa

SEQ ID NO: 1061906 - RNA, 19 nt, Homo sapiens
ucaguugagucccaaauga

SEQ ID NO: 1061907 - RNA, 19 nt, Homo sapiens
gauuaugccuaguuuguca

SEQ ID NO: 1061908 - RNA, 19 nt, Homo sapiens
gaagagagaggaacuacuc

SEQ ID NO: 1061909 - RNA, 19 nt, Homo sapiens
acucaacaauuccgagaua

SEQ ID NO: 1061910 - RNA, 19 nt, Homo sapiens
ccgcagggcuugcuucugu

SEQ ID NO: 1061911 - RNA, 19 nt, Homo sapiens
gaaacucaagccuuaaaug

SEQ ID NO: 1061912 - RNA, 19 nt, Homo sapiens
gcacacacugaguugcuua

SEQ ID NO: 1061913 - RNA, 19 nt, Homo sapiens
gcacuuggacgaugagauc

SEQ ID NO: 1061914 - RNA, 19 nt, Homo sapiens
gcuuggaguuaccuuauau

SEQ ID NO: 1061915 - RNA, 19 nt, Homo sapiens
uuaaucaccuccacacugu

SEQ ID NO: 1061916 - RNA, 19 nt, Homo sapiens
uguaaugacugagcagaaa

SEQ ID NO: 1061917 - RNA, 19 nt, Homo sapiens
aauaagugcugaucuacug

SEQ ID NO: 1061918 - RNA, 19 nt, Homo sapiens
gaagagcucccacccuaag

SEQ ID NO: 1061919 - RNA, 19 nt, Homo sapiens
gaaugauccagaauuagaa

SEQ ID NO: 1061920 - RNA, 19 nt, Homo sapiens
uaugagcuguguuaguauu

SEQ ID NO: 1061921 - RNA, 19 nt, Homo sapiens
guaaagguccccaauguaa

SEQ ID NO: 1061922 - RNA, 19 nt, Homo sapiens
agauuaagauguucuacga

SEQ ID NO: 1061923 - RNA, 19 nt, Homo sapiens
ggugugaugaugccauaua

SEQ ID NO: 1061924 - RNA, 19 nt, Homo sapiens
aguaacugccuuaaucuua

SEQ ID NO: 1061925 - RNA, 19 nt, Homo sapiens
ggaagagcucccacccuaa

SEQ ID NO: 1061926 - RNA, 19 nt, Homo sapiens
aaggugcaauccuagauaa

SEQ ID NO: 1061927 - RNA, 19 nt, Homo sapiens
agaaugauccagaauuaga

SEQ ID NO: 1061928 - RNA, 19 nt, Homo sapiens
aaacucaagccuuaaaugu

SEQ ID NO: 1061929 - RNA, 19 nt, Homo sapiens
gugcuggccugguauaugg

SEQ ID NO: 1061930 - RNA, 19 nt, Homo sapiens
ggcuuggaguuaccuuaua

SEQ ID NO: 1061931 - RNA, 19 nt, Homo sapiens
ucauggugcuggccuggua

SEQ ID NO: 1061932 - RNA, 19 nt, Homo sapiens
ggcaguacgugaaauuucu

SEQ ID NO: 1061933 - RNA, 19 nt, Homo sapiens
guggugugaugaugccaua

SEQ ID NO: 1061934 - RNA, 19 nt, Homo sapiens
caacaauuccgagauagga

SEQ ID NO: 1061935 - RNA, 19 nt, Homo sapiens
acacgugccucguaaaggu

SEQ ID NO: 1061936 - RNA, 19 nt, Homo sapiens
acuaacacgugccucguaa

SEQ ID NO: 1061937 - RNA, 19 nt, Homo sapiens
cgaaaugcaguuccuuaga

SEQ ID NO: 1061938 - RNA, 19 nt, Homo sapiens
gugugacucuaucucagua

SEQ ID NO: 1061939 - RNA, 19 nt, Homo sapiens
agugugagaucucuggauu

SEQ ID NO: 1061940 - RNA, 19 nt, Homo sapiens
aaaugcaguuccuuagaug

SEQ ID NO: 1061941 - RNA, 19 nt, Homo sapiens
uguguuaguucaugcauuc

SEQ ID NO: 1061942 - RNA, 19 nt, Homo sapiens
gguccauggcccuguguua

SEQ ID NO: 1061943 - RNA, 19 nt, Homo sapiens
caauuccgagauaggauua

SEQ ID NO: 1061944 - RNA, 19 nt, Homo sapiens
ccauggcccuguguuaguu

SEQ ID NO: 1061945 - RNA, 19 nt, Homo sapiens
cgaggagcauuugcacuug

SEQ ID NO: 1061946 - RNA, 19 nt, Homo sapiens
uuaaguaaacucugucuca

SEQ ID NO: 1061947 - RNA, 19 nt, Homo sapiens
ggaaacucaagccuuaaau

SEQ ID NO: 1061948 - RNA, 19 nt, Homo sapiens
caagugugacucuaucuca

SEQ ID NO: 1061949 - RNA, 19 nt, Homo sapiens
guucaugcauucaguugag

SEQ ID NO: 1061950 - RNA, 19 nt, Homo sapiens
uauuuugccugguuuguua

SEQ ID NO: 1061951 - RNA, 19 nt, Homo sapiens
gcugacaaauaugagaaug

SEQ ID NO: 1061952 - RNA, 19 nt, Homo sapiens
gcagaaaaucaaucacuuu

SEQ ID NO: 1061953 - RNA, 19 nt, Homo sapiens
ugucucaguuuuaggauua

SEQ ID NO: 1061954 - RNA, 19 nt, Homo sapiens
ggaucuagaaagcaacuug

SEQ ID NO: 1061955 - RNA, 19 nt, Homo sapiens
ggauggcaguggguacuuc

SEQ ID NO: 1061956 - RNA, 19 nt, Homo sapiens
aucaaucacuuucucuuug

SEQ ID NO: 1061957 - RNA, 19 nt, Homo sapiens
uaacacgugccucguaaag

SEQ ID NO: 1061958 - RNA, 19 nt, Homo sapiens
gggcaguacgugaaauuuc

SEQ ID NO: 1061959 - RNA, 19 nt, Homo sapiens
uugcuucugucaaguguga

SEQ ID NO: 1061960 - RNA, 19 nt, Homo sapiens
gccuuaaucuuauacucau

SEQ ID NO: 1061961 - RNA, 19 nt, Homo sapiens
cagcuagccagauagaaga

SEQ ID NO: 1061962 - RNA, 19 nt, Homo sapiens
gaggaaacucaagccuuaa

SEQ ID NO: 1061963 - RNA, 19 nt, Homo sapiens
uagaaaagauccgaagaga

SEQ ID NO: 1061964 - RNA, 19 nt, Homo sapiens
ccagauagaagacacuuuu

SEQ ID NO: 1061965 - RNA, 19 nt, Homo sapiens
ucaaucacuuucucuuugc

SEQ ID NO: 1061966 - RNA, 19 nt, Homo sapiens
gagaaugauccagaauuag

SEQ ID NO: 1061967 - RNA, 19 nt, Homo sapiens
gcuucacgguggacgagaa

SEQ ID NO: 1061968 - RNA, 19 nt, Homo sapiens
ugugagaucucuggauucu

SEQ ID NO: 1061969 - RNA, 19 nt, Homo sapiens
gugacucuaucucaguaau

SEQ ID NO: 1061970 - RNA, 19 nt, Homo sapiens
cccgaaaugcaguuccuua

SEQ ID NO: 1061971 - RNA, 19 nt, Homo sapiens
uguaaagagucaccuucau

SEQ ID NO: 1061972 - RNA, 19 nt, Homo sapiens
guuaguucaugcauucagu

SEQ ID NO: 1061973 - RNA, 19 nt, Homo sapiens
gcgggcaguacgugaaauu

SEQ ID NO: 1061974 - RNA, 19 nt, Homo sapiens
cgaaggccaugcggcuguu

SEQ ID NO: 1061975 - RNA, 19 nt, Homo sapiens
ccacuuccuuguucaaaau

SEQ ID NO: 1061976 - RNA, 19 nt, Homo sapiens
augcaaagauaaacuacca

SEQ ID NO: 1061977 - RNA, 19 nt, Homo sapiens
ccuaguuugucauaucaca

SEQ ID NO: 1061978 - RNA, 19 nt, Homo sapiens
uuaugccacuuccuuguuc

SEQ ID NO: 1061979 - RNA, 19 nt, Homo sapiens
auaugagaaugauccagaa

SEQ ID NO: 1061980 - RNA, 19 nt, Homo sapiens
acacagcuagccagauaga

SEQ ID NO: 1061981 - RNA, 19 nt, Homo sapiens
ggugcaauccuagauaaca

SEQ ID NO: 1061982 - RNA, 19 nt, Homo sapiens
ugccuaguuugucauauca

SEQ ID NO: 1061983 - RNA, 19 nt, Homo sapiens
gauccagaauuagaaaaga

SEQ ID NO: 1061984 - RNA, 19 nt, Homo sapiens
uucuguaacucaaucaaga

SEQ ID NO: 1061985 - RNA, 19 nt, Homo sapiens
gaagaacuccucagacuug

SEQ ID NO: 1061986 - RNA, 19 nt, Homo sapiens
gaacguggccuuccuguca

SEQ ID NO: 1061987 - RNA, 19 nt, Homo sapiens
gagaagaacuccucagacu

SEQ ID NO: 1061988 - RNA, 19 nt, Homo sapiens
gcaaagacaaagagaagaa

SEQ ID NO: 1061989 - RNA, 19 nt, Homo sapiens
gaaaagugaugauagaaga

SEQ ID NO: 1061990 - RNA, 19 nt, Homo sapiens
gcaaacagaccaaauggau

SEQ ID NO: 1061991 - RNA, 19 nt, Homo sapiens
acaaaguacugcagaaguu

SEQ ID NO: 1061992 - RNA, 19 nt, Homo sapiens
gaacuucguccuuccagaa

SEQ ID NO: 1061993 - RNA, 19 nt, Homo sapiens
uguaugaucuaguaacuug

SEQ ID NO: 1061994 - RNA, 19 nt, Homo sapiens
gaaccgacacuuccacaug

SEQ ID NO: 1061995 - RNA, 19 nt, Homo sapiens
aaacagaccaaauggauga

SEQ ID NO: 1061996 - RNA, 19 nt, Homo sapiens
aagaggagaugaaggaaga

SEQ ID NO: 1061997 - RNA, 19 nt, Homo sapiens
ggaaacgugugugucaguu

SEQ ID NO: 1061998 - RNA, 19 nt, Homo sapiens
caaaguacugcagaaguua

SEQ ID NO: 1061999 - RNA, 19 nt, Homo sapiens
aaacaugaccucacucuuc

SEQ ID NO: 1062000 - RNA, 19 nt, Homo sapiens
gaaacuaagaacuggauau

SEQ ID NO: 1062001 - RNA, 19 nt, Homo sapiens
gcaaagaaggcgcagacaa

SEQ ID NO: 1062002 - RNA, 19 nt, Homo sapiens
ugaaagaggagaugaagga

SEQ ID NO: 1062003 - RNA, 19 nt, Homo sapiens
gauagaagaggagaugaaa

SEQ ID NO: 1062004 - RNA, 19 nt, Homo sapiens
uacgugggcugcagcauuu

SEQ ID NO: 1062005 - RNA, 19 nt, Homo sapiens
acaaaguccugaccgcaaa

SEQ ID NO: 1062006 - RNA, 19 nt, Homo sapiens
caaagaaggcgcagacaag

SEQ ID NO: 1062007 - RNA, 19 nt, Homo sapiens
uagaagaggagaugaaaga

SEQ ID NO: 1062008 - RNA, 19 nt, Homo sapiens
agucugagauucuuccauu

SEQ ID NO: 1062009 - RNA, 19 nt, Homo sapiens
gagaauuuguagcgguuau

SEQ ID NO: 1062010 - RNA, 19 nt, Homo sapiens
gaauuuguagcgguuauuu

SEQ ID NO: 1062011 - RNA, 19 nt, Homo sapiens
gaacaaaguacugcagaag

SEQ ID NO: 1062012 - RNA, 19 nt, Homo sapiens
ugaacaaaguacugcagaa

SEQ ID NO: 1062013 - RNA, 19 nt, Homo sapiens
gaucgguccagcucagaua

SEQ ID NO: 1062014 - RNA, 19 nt, Homo sapiens
cuaguaacuugcaaacaga

SEQ ID NO: 1062015 - RNA, 19 nt, Homo sapiens
ucauucacuuguacuguaa

SEQ ID NO: 1062016 - RNA, 19 nt, Homo sapiens
gcaugagucugagauucuu

SEQ ID NO: 1062017 - RNA, 19 nt, Homo sapiens
gaaguuaaaccuguguugu

SEQ ID NO: 1062018 - RNA, 19 nt, Homo sapiens
ugauggagaugccacuuuc

SEQ ID NO: 1062019 - RNA, 19 nt, Homo sapiens
aaccgacacuuccacauga

SEQ ID NO: 1062020 - RNA, 19 nt, Homo sapiens
gguugguauuucacuauuu

SEQ ID NO: 1062021 - RNA, 19 nt, Homo sapiens
cggauuagcaagcaauaaa

SEQ ID NO: 1062022 - RNA, 19 nt, Homo sapiens
ucuaguaacuugcaaacag

SEQ ID NO: 1062023 - RNA, 19 nt, Homo sapiens
gaaagaggagaugaaggaa

SEQ ID NO: 1062024 - RNA, 19 nt, Homo sapiens
gaugauagaagaggagaug

SEQ ID NO: 1062025 - RNA, 19 nt, Homo sapiens
cgacacuuccacaugauuu

SEQ ID NO: 1062026 - RNA, 19 nt, Homo sapiens
cucauucacuuguacugua

SEQ ID NO: 1062027 - RNA, 19 nt, Homo sapiens
ucugagauguuuugcuuua

SEQ ID NO: 1062028 - RNA, 19 nt, Homo sapiens
ggaaacuaagaacuggaua

SEQ ID NO: 1062029 - RNA, 19 nt, Homo sapiens
ugaccucacucuuccucaa

SEQ ID NO: 1062030 - RNA, 19 nt, Homo sapiens
gggacaaguucagccagaa

SEQ ID NO: 1062031 - RNA, 19 nt, Homo sapiens
gaaacgugugugucaguug

SEQ ID NO: 1062032 - RNA, 19 nt, Homo sapiens
cagcaaagacaaagagaag

SEQ ID NO: 1062033 - RNA, 19 nt, Homo sapiens
aaguuaaaccuguguugua

SEQ ID NO: 1062034 - RNA, 19 nt, Homo sapiens
ggacccugauggaccugaa

SEQ ID NO: 1062035 - RNA, 19 nt, Homo sapiens
gcaaacagcaacccuucca

SEQ ID NO: 1062036 - RNA, 19 nt, Homo sapiens
ugccagauacagagaauuu

SEQ ID NO: 1062037 - RNA, 19 nt, Homo sapiens
agaugccacuuucguguga

SEQ ID NO: 1062038 - RNA, 19 nt, Homo sapiens
aguuaaaccuguguuguau

SEQ ID NO: 1062039 - RNA, 19 nt, Homo sapiens
caauggggcugacgauguu

SEQ ID NO: 1062040 - RNA, 19 nt, Homo sapiens
gaugaaagaggagaugaag

SEQ ID NO: 1062041 - RNA, 19 nt, Homo sapiens
ccagauacagagaauuugu

SEQ ID NO: 1062042 - RNA, 19 nt, Homo sapiens
ucaguucuuuccaucuguu

SEQ ID NO: 1062043 - RNA, 19 nt, Homo sapiens
gagaugaaagaggagauga

SEQ ID NO: 1062044 - RNA, 19 nt, Homo sapiens
aaaguacugcagaaguuaa

SEQ ID NO: 1062045 - RNA, 19 nt, Homo sapiens
gaccucacucuuccucaaa

SEQ ID NO: 1062046 - RNA, 19 nt, Homo sapiens
cuacgugggcugcagcauu

SEQ ID NO: 1062047 - RNA, 19 nt, Homo sapiens
ggagaugaaagaggagaug

SEQ ID NO: 1062048 - RNA, 19 nt, Homo sapiens
cgugugacugcgaacauua

SEQ ID NO: 1062049 - RNA, 19 nt, Homo sapiens
gaaaaccucggauuagcaa

SEQ ID NO: 1062050 - RNA, 19 nt, Homo sapiens
aagagaagaacuccucaga

SEQ ID NO: 1062051 - RNA, 19 nt, Homo sapiens
gcucugaagccuaguucug

SEQ ID NO: 1062052 - RNA, 19 nt, Homo sapiens
ugauagaagaggagaugaa

SEQ ID NO: 1062053 - RNA, 19 nt, Homo sapiens
gaaggaaaagugaugauag

SEQ ID NO: 1062054 - RNA, 19 nt, Homo sapiens
gagauguuuugcuuuaaga

SEQ ID NO: 1062055 - RNA, 19 nt, Homo sapiens
gggaaacuaagaacuggau

SEQ ID NO: 1062056 - RNA, 19 nt, Homo sapiens
cgguccagcucagauauug

SEQ ID NO: 1062057 - RNA, 19 nt, Homo sapiens
gaccaucugagcaccaugu

SEQ ID NO: 1062058 - RNA, 19 nt, Homo sapiens
caaaggagccccuggucuu

SEQ ID NO: 1062059 - RNA, 19 nt, Homo sapiens
gcagaaguuaaaccugugu

SEQ ID NO: 1062060 - RNA, 19 nt, Homo sapiens
ccaccugggaaacuaagaa

SEQ ID NO: 1062061 - RNA, 19 nt, Homo sapiens
gauauugagggcucugaag

SEQ ID NO: 1062062 - RNA, 19 nt, Homo sapiens
ccagcaaagacaaagagaa

SEQ ID NO: 1062063 - RNA, 19 nt, Homo sapiens
cagggaaaaccucggauua

SEQ ID NO: 1062064 - RNA, 19 nt, Homo sapiens
gaucuaguaacuugcaaac

SEQ ID NO: 1062065 - RNA, 19 nt, Homo sapiens
uaugccagauacagagaau

SEQ ID NO: 1062066 - RNA, 19 nt, Homo sapiens
guuaaaccuguguuguauu

SEQ ID NO: 1062067 - RNA, 19 nt, Homo sapiens
cugugugacucaguucuuu

SEQ ID NO: 1062068 - RNA, 19 nt, Homo sapiens
aaggaaaagugaugauaga

SEQ ID NO: 1062069 - RNA, 19 nt, Homo sapiens
gugugacugcgaacauuaa

SEQ ID NO: 1062070 - RNA, 19 nt, Homo sapiens
gacacuuccacaugauuug

SEQ ID NO: 1062071 - RNA, 19 nt, Homo sapiens
cugcaugagucugagauuc

SEQ ID NO: 1062072 - RNA, 19 nt, Homo sapiens
ugguugguauuucacuauu

SEQ ID NO: 1062073 - RNA, 19 nt, Homo sapiens
acucaguucuuuccaucug

SEQ ID NO: 1062074 - RNA, 19 nt, Homo sapiens
gggaaacgugugugucagu

SEQ ID NO: 1062075 - RNA, 19 nt, Homo sapiens
agaagaacuccucagacuu

SEQ ID NO: 1062076 - RNA, 19 nt, Homo sapiens
gccuaguucugucuucucu

SEQ ID NO: 1062077 - RNA, 19 nt, Homo sapiens
ugugucaguuggaccaugu

SEQ ID NO: 1062078 - RNA, 19 nt, Homo sapiens
gcaaagaacauggacauua

SEQ ID NO: 1062079 - RNA, 19 nt, Homo sapiens
caaagaacauggacauuau

SEQ ID NO: 1062080 - RNA, 19 nt, Homo sapiens
caacacaguuccugcagua

SEQ ID NO: 1062081 - RNA, 19 nt, Homo sapiens
ggaaugggcugaacguguu

SEQ ID NO: 1062082 - RNA, 19 nt, Homo sapiens
gaaaggacccaaaguguga

SEQ ID NO: 1062083 - RNA, 19 nt, Homo sapiens
gcacgucacugugguugua

SEQ ID NO: 1062084 - RNA, 19 nt, Homo sapiens
gaacauggacauuaucguu

SEQ ID NO: 1062085 - RNA, 19 nt, Homo sapiens
gaacguacauguguuugga

SEQ ID NO: 1062086 - RNA, 19 nt, Homo sapiens
ugucugagcuguagugaaa

SEQ ID NO: 1062087 - RNA, 19 nt, Homo sapiens
gaacugcacagcaagcuuu

SEQ ID NO: 1062088 - RNA, 19 nt, Homo sapiens
ccaaggaacugcacagcaa

SEQ ID NO: 1062089 - RNA, 19 nt, Homo sapiens
aaaggucacugcacaaaga

SEQ ID NO: 1062090 - RNA, 19 nt, Homo sapiens
ggagguggcuuucuuuagg

SEQ ID NO: 1062091 - RNA, 19 nt, Homo sapiens
gcagaacguacauguguuu

SEQ ID NO: 1062092 - RNA, 19 nt, Homo sapiens
caucagcuauggacauuca

SEQ ID NO: 1062093 - RNA, 19 nt, Homo sapiens
gcagugaaccgcaaugaca

SEQ ID NO: 1062094 - RNA, 19 nt, Homo sapiens
ggaauaaaaugcuuguuca

SEQ ID NO: 1062095 - RNA, 19 nt, Homo sapiens
ucacauaugcauuuaagga

SEQ ID NO: 1062096 - RNA, 19 nt, Homo sapiens
cagauuccgucacagagaa

SEQ ID NO: 1062097 - RNA, 19 nt, Homo sapiens
gaccgagccuucagcagau

SEQ ID NO: 1062098 - RNA, 19 nt, Homo sapiens
gggagaagcacgucacugu

SEQ ID NO: 1062099 - RNA, 19 nt, Homo sapiens
ccacccugcucacauguug

SEQ ID NO: 1062100 - RNA, 19 nt, Homo sapiens
ggcaucagcuauggacauu

SEQ ID NO: 1062101 - RNA, 19 nt, Homo sapiens
aaacagcgaugagcucgau

SEQ ID NO: 1062102 - RNA, 19 nt, Homo sapiens
gggaugagaaccaguacuu

SEQ ID NO: 1062103 - RNA, 19 nt, Homo sapiens
gugugaaucugcccaagga

SEQ ID NO: 1062104 - RNA, 19 nt, Homo sapiens
cacaggaagugcugccauu

SEQ ID NO: 1062105 - RNA, 19 nt, Homo sapiens
ucacgcaggcuuuguaugu

SEQ ID NO: 1062106 - RNA, 19 nt, Homo sapiens
gcagauuccgucacagaga

SEQ ID NO: 1062107 - RNA, 19 nt, Homo sapiens
acagagaagugguccaucu

SEQ ID NO: 1062108 - RNA, 19 nt, Homo sapiens
cgucacauaugcauuuaag

SEQ ID NO: 1062109 - RNA, 19 nt, Homo sapiens
uaaaucaaccuuggcauca

SEQ ID NO: 1062110 - RNA, 19 nt, Homo sapiens
ccaaaggucacugcacaaa

SEQ ID NO: 1062111 - RNA, 19 nt, Homo sapiens
guccaucuguccagguuga

SEQ ID NO: 1062112 - RNA, 19 nt, Homo sapiens
aagcguagguuaggagguu

SEQ ID NO: 1062113 - RNA, 19 nt, Homo sapiens
ggcgucacauaugcauuua

SEQ ID NO: 1062114 - RNA, 19 nt, Homo sapiens
ggacaccauugaggaccuu

SEQ ID NO: 1062115 - RNA, 19 nt, Homo sapiens
gugcugccauugagagugu

SEQ ID NO: 1062116 - RNA, 19 nt, Homo sapiens
aagcagaacguacaugugu

SEQ ID NO: 1062117 - RNA, 19 nt, Homo sapiens
gaagcagaacguacaugug

SEQ ID NO: 1062118 - RNA, 19 nt, Homo sapiens
gggcaaagaacauggacau

SEQ ID NO: 1062119 - RNA, 19 nt, Homo sapiens
acauucaggugcccuacaa

SEQ ID NO: 1062120 - RNA, 19 nt, Homo sapiens
cacaguuccugcaguacuu

SEQ ID NO: 1062121 - RNA, 19 nt, Homo sapiens
cagcagauuccgucacaga

SEQ ID NO: 1062122 - RNA, 19 nt, Homo sapiens
ucucugaggcuguuaaauc

SEQ ID NO: 1062123 - RNA, 19 nt, Homo sapiens
ggaagugcugccauugaga

SEQ ID NO: 1062124 - RNA, 19 nt, Homo sapiens
uaaaaugcuuguucagugu

SEQ ID NO: 1062125 - RNA, 19 nt, Homo sapiens
ggucacugcacaaagauuc

SEQ ID NO: 1062126 - RNA, 19 nt, Homo sapiens
caggaagugcugccauuga

SEQ ID NO: 1062127 - RNA, 19 nt, Homo sapiens
ggcuggagguggcuuucuu

SEQ ID NO: 1062128 - RNA, 19 nt, Homo sapiens
ggagaggugacaacuggau

SEQ ID NO: 1062129 - RNA, 19 nt, Homo sapiens
ucaggugcccuacaacaug

SEQ ID NO: 1062130 - RNA, 19 nt, Homo sapiens
ugaagcagaacguacaugu

SEQ ID NO: 1062131 - RNA, 19 nt, Homo sapiens
uggcgucacauaugcauuu

SEQ ID NO: 1062132 - RNA, 19 nt, Homo sapiens
ugacaagagcccucaugga

SEQ ID NO: 1062133 - RNA, 19 nt, Homo sapiens
gaagcacgucacugugguu

SEQ ID NO: 1062134 - RNA, 19 nt, Homo sapiens
gcuggagguggcuuucuuu

SEQ ID NO: 1062135 - RNA, 19 nt, Homo sapiens
ggacccaaagugugaaucu

SEQ ID NO: 1062136 - RNA, 19 nt, Homo sapiens
agacuguguuugccgaugu

SEQ ID NO: 1062137 - RNA, 19 nt, Homo sapiens
gagccgaucaagacugugu

SEQ ID NO: 1062138 - RNA, 19 nt, Homo sapiens
uggcauggcgucacauaug

SEQ ID NO: 1062139 - RNA, 19 nt, Homo sapiens
cgacaguggaggagucaug

SEQ ID NO: 1062140 - RNA, 19 nt, Homo sapiens
acucagcgguggccgugaa

SEQ ID NO: 1062141 - RNA, 19 nt, Homo sapiens
ggaugagaaccaguacuug

SEQ ID NO: 1062142 - RNA, 19 nt, Homo sapiens
cucugaggcuguuaaauca

SEQ ID NO: 1062143 - RNA, 19 nt, Homo sapiens
ucauggagcaguuugaaag

SEQ ID NO: 1062144 - RNA, 19 nt, Homo sapiens
aaaugcuuguucaguguga

SEQ ID NO: 1062145 - RNA, 19 nt, Homo sapiens
gcucacauguugggaaucc

SEQ ID NO: 1062146 - RNA, 19 nt, Homo sapiens
caccagggaggcugaguga

SEQ ID NO: 1062147 - RNA, 19 nt, Homo sapiens
cagcgguggccgugaacua

SEQ ID NO: 1062148 - RNA, 19 nt, Homo sapiens
acgcaggcuuuguauguuc

SEQ ID NO: 1062149 - RNA, 19 nt, Homo sapiens
cacgcaggcuuuguauguu

SEQ ID NO: 1062150 - RNA, 19 nt, Homo sapiens
ugagcuguagugaaaguuu

SEQ ID NO: 1062151 - RNA, 19 nt, Homo sapiens
ugcaguacuuccuggagaa

SEQ ID NO: 1062152 - RNA, 19 nt, Homo sapiens
gacccaaagugugaaucug

SEQ ID NO: 1062153 - RNA, 19 nt, Homo sapiens
gagcccucauggagcaguu

SEQ ID NO: 1062154 - RNA, 19 nt, Homo sapiens
caaaggucacugcacaaag

SEQ ID NO: 1062155 - RNA, 19 nt, Homo sapiens
cuuccacccugcucacaug

SEQ ID NO: 1062156 - RNA, 19 nt, Homo sapiens
ccgugucagugucggauga

SEQ ID NO: 1062157 - RNA, 19 nt, Homo sapiens
ggaacugcacagcaagcuu

SEQ ID NO: 1062158 - RNA, 19 nt, Homo sapiens
ucgaugagccgaucaagac

SEQ ID NO: 1062159 - RNA, 19 nt, Homo sapiens
acauggacauuaucguucu

SEQ ID NO: 1062160 - RNA, 19 nt, Homo sapiens
ggagggaaacagcgaugag

SEQ ID NO: 1062161 - RNA, 19 nt, Homo sapiens
aggaagugcugccauugag

SEQ ID NO: 1062162 - RNA, 19 nt, Homo sapiens
ucugagcuguagugaaagu

SEQ ID NO: 1062163 - RNA, 19 nt, Homo sapiens
ucguagcccuggagcacaa

SEQ ID NO: 1062164 - RNA, 19 nt, Homo sapiens
gaaagaagcuggacugaau

SEQ ID NO: 1062165 - RNA, 19 nt, Homo sapiens
ggaagaaucugaagccaua

SEQ ID NO: 1062166 - RNA, 19 nt, Homo sapiens
uaacugagcuugucaaaga

SEQ ID NO: 1062167 - RNA, 19 nt, Homo sapiens
gaaagagggucucacuuaa

SEQ ID NO: 1062168 - RNA, 19 nt, Homo sapiens
gcacagaaguguuagauuc

SEQ ID NO: 1062169 - RNA, 19 nt, Homo sapiens
gggcaaaccucaagaagaa

SEQ ID NO: 1062170 - RNA, 19 nt, Homo sapiens
gcaaggaggucgaagaaga

SEQ ID NO: 1062171 - RNA, 19 nt, Homo sapiens
ggaacaaggugauauugaa

SEQ ID NO: 1062172 - RNA, 19 nt, Homo sapiens
gaacuaagaccacuugaug

SEQ ID NO: 1062173 - RNA, 19 nt, Homo sapiens
gcacaaagacugaagauca

SEQ ID NO: 1062174 - RNA, 19 nt, Homo sapiens
cugaauaucuuuccuacua

SEQ ID NO: 1062175 - RNA, 19 nt, Homo sapiens
gaaccuggaugacuccuau

SEQ ID NO: 1062176 - RNA, 19 nt, Homo sapiens
gggaacaccuuacugaaga

SEQ ID NO: 1062177 - RNA, 19 nt, Homo sapiens
caaagaaggauuacagaaa

SEQ ID NO: 1062178 - RNA, 19 nt, Homo sapiens
ggaagagagugaggcauuu

SEQ ID NO: 1062179 - RNA, 19 nt, Homo sapiens
guacugagaauccuaauug

SEQ ID NO: 1062180 - RNA, 19 nt, Homo sapiens
agaaagagggucucacuua

SEQ ID NO: 1062181 - RNA, 19 nt, Homo sapiens
cagaagaguuugagacaga

SEQ ID NO: 1062182 - RNA, 19 nt, Homo sapiens
uaagaccacuugauguaaa

SEQ ID NO: 1062183 - RNA, 19 nt, Homo sapiens
gauucaagaugcucauauu

SEQ ID NO: 1062184 - RNA, 19 nt, Homo sapiens
gugaagggauggaugauug

SEQ ID NO: 1062185 - RNA, 19 nt, Homo sapiens
gaauacacuucugcaguaa

SEQ ID NO: 1062186 - RNA, 19 nt, Homo sapiens
guauaccacuuggauauuu

SEQ ID NO: 1062187 - RNA, 19 nt, Homo sapiens
gaagaagaguccaaacaac

SEQ ID NO: 1062188 - RNA, 19 nt, Homo sapiens
gaauaucuuuccuacuaga

SEQ ID NO: 1062189 - RNA, 19 nt, Homo sapiens
ccaaggcacagaaguguua

SEQ ID NO: 1062190 - RNA, 19 nt, Homo sapiens
aagagggucucacuuaauu

SEQ ID NO: 1062191 - RNA, 19 nt, Homo sapiens
agaaagacuuguaacauuc

SEQ ID NO: 1062192 - RNA, 19 nt, Homo sapiens
gaaagcuuaucgacagaug

SEQ ID NO: 1062193 - RNA, 19 nt, Homo sapiens
gaaaaccucugcauguuau

SEQ ID NO: 1062194 - RNA, 19 nt, Homo sapiens
gaacgagagaugaaaguau

SEQ ID NO: 1062195 - RNA, 19 nt, Homo sapiens
gaagguaaacauuggagaa

SEQ ID NO: 1062196 - RNA, 19 nt, Homo sapiens
cgacagauggcccuacuaa

SEQ ID NO: 1062197 - RNA, 19 nt, Homo sapiens
ggaaauacucaaagaagga

SEQ ID NO: 1062198 - RNA, 19 nt, Homo sapiens
ccaaggauauuagcaacaa

SEQ ID NO: 1062199 - RNA, 19 nt, Homo sapiens
gauuugagauuccaaggau

SEQ ID NO: 1062200 - RNA, 19 nt, Homo sapiens
gcaacacaauguaaugagu

SEQ ID NO: 1062201 - RNA, 19 nt, Homo sapiens
gaucuggacaguggaaaua

SEQ ID NO: 1062202 - RNA, 19 nt, Homo sapiens
gacugaagaucaaggaaga

SEQ ID NO: 1062203 - RNA, 19 nt, Homo sapiens
ugucaaagaugauguuaag

SEQ ID NO: 1062204 - RNA, 19 nt, Homo sapiens
ugguagaagugaaagcuua

SEQ ID NO: 1062205 - RNA, 19 nt, Homo sapiens
ggaugacuccuauuccuuu

SEQ ID NO: 1062206 - RNA, 19 nt, Homo sapiens
cacaaagacugaagaucaa

SEQ ID NO: 1062207 - RNA, 19 nt, Homo sapiens
ugaagaauguacugagaau

SEQ ID NO: 1062208 - RNA, 19 nt, Homo sapiens
ggacugaauaucuuuccua

SEQ ID NO: 1062209 - RNA, 19 nt, Homo sapiens
cugaagcacuuaaagaaga

SEQ ID NO: 1062210 - RNA, 19 nt, Homo sapiens
caagaaacacaucucuauu

SEQ ID NO: 1062211 - RNA, 19 nt, Homo sapiens
gaguauaccacuuggauau

SEQ ID NO: 1062212 - RNA, 19 nt, Homo sapiens
gagaugaaaguauuaagug

SEQ ID NO: 1062213 - RNA, 19 nt, Homo sapiens
ggaggaacaaggugauauu

SEQ ID NO: 1062214 - RNA, 19 nt, Homo sapiens
ggagcuccuucaucuuaaa

SEQ ID NO: 1062215 - RNA, 19 nt, Homo sapiens
uagauucucugaaacacaa

SEQ ID NO: 1062216 - RNA, 19 nt, Homo sapiens
ggaacaccuuacugaagaa

SEQ ID NO: 1062217 - RNA, 19 nt, Homo sapiens
gauggaugauuguggaaau

SEQ ID NO: 1062218 - RNA, 19 nt, Homo sapiens
aagacaaugugguggauuu

SEQ ID NO: 1062219 - RNA, 19 nt, Homo sapiens
aguguuagauucucugaaa

SEQ ID NO: 1062220 - RNA, 19 nt, Homo sapiens
ccuauuccuuucauuauug

SEQ ID NO: 1062221 - RNA, 19 nt, Homo sapiens
cgaagaagaguccaaacaa

SEQ ID NO: 1062222 - RNA, 19 nt, Homo sapiens
gaaauacuucucaaacaag

SEQ ID NO: 1062223 - RNA, 19 nt, Homo sapiens
gaaagacuuguaacauuca

SEQ ID NO: 1062224 - RNA, 19 nt, Homo sapiens
aacgagagaugaaaguauu

SEQ ID NO: 1062225 - RNA, 19 nt, Homo sapiens
aguggaaccuacuauguaa

SEQ ID NO: 1062226 - RNA, 19 nt, Homo sapiens
gaagcuggacugaauaucu

SEQ ID NO: 1062227 - RNA, 19 nt, Homo sapiens
acaagaaacacaucucuau

SEQ ID NO: 1062228 - RNA, 19 nt, Homo sapiens
ggaaaaccucugcauguua

SEQ ID NO: 1062229 - RNA, 19 nt, Homo sapiens
uaacaugccguaccaguca

SEQ ID NO: 1062230 - RNA, 19 nt, Homo sapiens
ucaagaugcucauauuaac

SEQ ID NO: 1062231 - RNA, 19 nt, Homo sapiens
gguaaacauuggagaacug

SEQ ID NO: 1062232 - RNA, 19 nt, Homo sapiens
cuacuagacacucucauuu

SEQ ID NO: 1062233 - RNA, 19 nt, Homo sapiens
ggacaccuuuggcccuguu

SEQ ID NO: 1062234 - RNA, 19 nt, Homo sapiens
ggaguauaccacuuggaua

SEQ ID NO: 1062235 - RNA, 19 nt, Homo sapiens
ugaagcacuuaaagaagaa

SEQ ID NO: 1062236 - RNA, 19 nt, Homo sapiens
gaacaaggugauauugaag

SEQ ID NO: 1062237 - RNA, 19 nt, Homo sapiens
ucaaacaagcuaguacuuu

SEQ ID NO: 1062238 - RNA, 19 nt, Homo sapiens
ccacuaugaucauguuucu

SEQ ID NO: 1062239 - RNA, 19 nt, Homo sapiens
gaagaucaaggaagagagu

SEQ ID NO: 1062240 - RNA, 19 nt, Homo sapiens
gcaaguggaaccuacuaug

SEQ ID NO: 1062241 - RNA, 19 nt, Homo sapiens
caucuuaaauucgguguag

SEQ ID NO: 1062242 - RNA, 19 nt, Homo sapiens
acaaugugguggauuuaug

SEQ ID NO: 1062243 - RNA, 19 nt, Homo sapiens
cagauggcccuacuaaguu

SEQ ID NO: 1062244 - RNA, 19 nt, Homo sapiens
cgguguagccacagaaaua

SEQ ID NO: 1062245 - RNA, 19 nt, Homo sapiens
caaguggaaccuacuaugu

SEQ ID NO: 1062246 - RNA, 19 nt, Homo sapiens
gcauuugguuggagcaagu

SEQ ID NO: 1062247 - RNA, 19 nt, Homo sapiens
gacaagaaacacaucucua

SEQ ID NO: 1062248 - RNA, 19 nt, Homo sapiens
gcuccuucaucuuaaauuc

SEQ ID NO: 1062249 - RNA, 19 nt, Homo sapiens
gagguccacuugagguuca

SEQ ID NO: 1062250 - RNA, 19 nt, Homo sapiens
ucacuuaauucaggaggaa

SEQ ID NO: 1062251 - RNA, 19 nt, Homo sapiens
gcuguacgacuccugcaua

SEQ ID NO: 1062252 - RNA, 19 nt, Homo sapiens
ugagggaacaccuuacuga

SEQ ID NO: 1062253 - RNA, 19 nt, Homo sapiens
gagcaaguggaaccuacua

SEQ ID NO: 1062254 - RNA, 19 nt, Homo sapiens
aagcuggacugaauaucuu

SEQ ID NO: 1062255 - RNA, 19 nt, Homo sapiens
ggacaguggaaauauggaa

SEQ ID NO: 1062256 - RNA, 19 nt, Homo sapiens
acuaagaccacuugaugua

SEQ ID NO: 1062257 - RNA, 19 nt, Homo sapiens
gugggaugcugaagguaaa

SEQ ID NO: 1062258 - RNA, 19 nt, Homo sapiens
acaccuuacugaagaaugu

SEQ ID NO: 1062259 - RNA, 19 nt, Homo sapiens
ggugggaugcugaagguaa

SEQ ID NO: 1062260 - RNA, 19 nt, Homo sapiens
cacuugagguucaugagaa

SEQ ID NO: 1062261 - RNA, 19 nt, Homo sapiens
gcugcucucuaccagauug

SEQ ID NO: 1062262 - RNA, 19 nt, Homo sapiens
acagauggcccuacuaagu

SEQ ID NO: 1062263 - RNA, 19 nt, Homo sapiens
ucaaagaaggauuacagaa

SEQ ID NO: 1062264 - RNA, 19 nt, Homo sapiens
gagcauaauugcauuguuu

SEQ ID NO: 1062265 - RNA, 19 nt, Homo sapiens
agagaaagcuguaguccua

SEQ ID NO: 1062266 - RNA, 19 nt, Homo sapiens
caaagacagucauagaaga

SEQ ID NO: 1062267 - RNA, 19 nt, Homo sapiens
uaacaucuccugaguagaa

SEQ ID NO: 1062268 - RNA, 19 nt, Homo sapiens
gaaggaaccaauaagaauu

SEQ ID NO: 1062269 - RNA, 19 nt, Homo sapiens
ccaaagugcuggaauuaca

SEQ ID NO: 1062270 - RNA, 19 nt, Homo sapiens
ggaaggaaccaauaagaau

SEQ ID NO: 1062271 - RNA, 19 nt, Homo sapiens
ggucggagguggagaacuu

SEQ ID NO: 1062272 - RNA, 19 nt, Homo sapiens
caaagcagcuagcaguugu

SEQ ID NO: 1062273 - RNA, 19 nt, Homo sapiens
gcucagcucuggcuucugu

SEQ ID NO: 1062274 - RNA, 19 nt, Homo sapiens
gcaguaacaucuccugagu

SEQ ID NO: 1062275 - RNA, 19 nt, Homo sapiens
ggaaugcaauggcgugauc

SEQ ID NO: 1062276 - RNA, 19 nt, Homo sapiens
aaacaaagacagucauaga

SEQ ID NO: 1062277 - RNA, 19 nt, Homo sapiens
cuagguaggugaaccagaa

SEQ ID NO: 1062278 - RNA, 19 nt, Homo sapiens
ggaaggaaagcauuugaau

SEQ ID NO: 1062279 - RNA, 19 nt, Homo sapiens
gcagggaaggaaccaauaa

SEQ ID NO: 1062280 - RNA, 19 nt, Homo sapiens
guaucaaaguaucccauaa

SEQ ID NO: 1062281 - RNA, 19 nt, Homo sapiens
ggagauagcguagccaugu

SEQ ID NO: 1062282 - RNA, 19 nt, Homo sapiens
gggaaggaaccaauaagaa

SEQ ID NO: 1062283 - RNA, 19 nt, Homo sapiens
gaaagggucuagccaugcu

SEQ ID NO: 1062284 - RNA, 19 nt, Homo sapiens
gaaggaaagcauuugaauc

SEQ ID NO: 1062285 - RNA, 19 nt, Homo sapiens
ugucuaggcugaaggaguu

SEQ ID NO: 1062286 - RNA, 19 nt, Homo sapiens
gcaaagcagccaaucaaag

SEQ ID NO: 1062287 - RNA, 19 nt, Homo sapiens
ggagggaaggaaagcauuu

SEQ ID NO: 1062288 - RNA, 19 nt, Homo sapiens
gcaaacugcccaucaugug

SEQ ID NO: 1062289 - RNA, 19 nt, Homo sapiens
agaaagcuguaguccuaaa

SEQ ID NO: 1062290 - RNA, 19 nt, Homo sapiens
uaaaggaaaccugaucuug

SEQ ID NO: 1062291 - RNA, 19 nt, Homo sapiens
caccacaccaggcuaauuu

SEQ ID NO: 1062292 - RNA, 19 nt, Homo sapiens
ugaaacaaagacagucaua

SEQ ID NO: 1062293 - RNA, 19 nt, Homo sapiens
gcauuugaauccuggaaag

SEQ ID NO: 1062294 - RNA, 19 nt, Homo sapiens
gagacuauauaucauuguc

SEQ ID NO: 1062295 - RNA, 19 nt, Homo sapiens
ucacuccaacuuccaauaa

SEQ ID NO: 1062296 - RNA, 19 nt, Homo sapiens
caaugacagucgagcuuug

SEQ ID NO: 1062297 - RNA, 19 nt, Homo sapiens
ugggauggcugcaggaguu

SEQ ID NO: 1062298 - RNA, 19 nt, Homo sapiens
ggaugaggcuacucuuaac

SEQ ID NO: 1062299 - RNA, 19 nt, Homo sapiens
gaaaccugaucuugcuauc

SEQ ID NO: 1062300 - RNA, 19 nt, Homo sapiens
uaauacagguaacaggaau

SEQ ID NO: 1062301 - RNA, 19 nt, Homo sapiens
uguccagccucaauuuaaa

SEQ ID NO: 1062302 - RNA, 19 nt, Homo sapiens
gcuagcaguuguuaagucu

SEQ ID NO: 1062303 - RNA, 19 nt, Homo sapiens
gcagcuagcaguuguuaag

SEQ ID NO: 1062304 - RNA, 19 nt, Homo sapiens
aguaacaucuccugaguag

SEQ ID NO: 1062305 - RNA, 19 nt, Homo sapiens
ggaguuggagggaaggaaa

SEQ ID NO: 1062306 - RNA, 19 nt, Homo sapiens
cacccaaagugcuggaauu

SEQ ID NO: 1062307 - RNA, 19 nt, Homo sapiens
cgucuccugucccaaagua

SEQ ID NO: 1062308 - RNA, 19 nt, Homo sapiens
gagauagcguagccaugug

SEQ ID NO: 1062309 - RNA, 19 nt, Homo sapiens
uggaugaggcuacucuuaa

SEQ ID NO: 1062310 - RNA, 19 nt, Homo sapiens
ccagcagccugugcaauau

SEQ ID NO: 1062311 - RNA, 19 nt, Homo sapiens
ggaaaccugaucuugcuau

SEQ ID NO: 1062312 - RNA, 19 nt, Homo sapiens
ccgagacuauauaucauug

SEQ ID NO: 1062313 - RNA, 19 nt, Homo sapiens
uagcaguuguuaagucuuc

SEQ ID NO: 1062314 - RNA, 19 nt, Homo sapiens
ucagcaggcuaggaacuaa

SEQ ID NO: 1062315 - RNA, 19 nt, Homo sapiens
gaaacaaagacagucauag

SEQ ID NO: 1062316 - RNA, 19 nt, Homo sapiens
aaaccacccucgccaccaa

SEQ ID NO: 1062317 - RNA, 19 nt, Homo sapiens
uaucaauugcugcugcuua

SEQ ID NO: 1062318 - RNA, 19 nt, Homo sapiens
cgauuuagcucugcuucug

SEQ ID NO: 1062319 - RNA, 19 nt, Homo sapiens
uaacugacaggugauuauu

SEQ ID NO: 1062320 - RNA, 19 nt, Homo sapiens
gcugcucccucgaaucuuc

SEQ ID NO: 1062321 - RNA, 19 nt, Homo sapiens
ccaggugacaguaaauuug

SEQ ID NO: 1062322 - RNA, 19 nt, Homo sapiens
cccagcgucugucuaauga

SEQ ID NO: 1062323 - RNA, 19 nt, Homo sapiens
aagcaaagcagccaaucaa

SEQ ID NO: 1062324 - RNA, 19 nt, Homo sapiens
caaagcagccaaucaaagc

SEQ ID NO: 1062325 - RNA, 19 nt, Homo sapiens
caugugcgauugugcagau

SEQ ID NO: 1062326 - RNA, 19 nt, Homo sapiens
cauggucggugaaacaaag

SEQ ID NO: 1062327 - RNA, 19 nt, Homo sapiens
gggaguaucgcaagaugug

SEQ ID NO: 1062328 - RNA, 19 nt, Homo sapiens
cagcugcuccgccuccuaa

SEQ ID NO: 1062329 - RNA, 19 nt, Homo sapiens
cuccugagcacaagcaaua

SEQ ID NO: 1062330 - RNA, 19 nt, Homo sapiens
gugcgauugugcagauuug

SEQ ID NO: 1062331 - RNA, 19 nt, Homo sapiens
gggaaggaaagcauuugaa

SEQ ID NO: 1062332 - RNA, 19 nt, Homo sapiens
ggacuucugcacccuguuc

SEQ ID NO: 1062333 - RNA, 19 nt, Homo sapiens
gucccaaaguaauaaauca

SEQ ID NO: 1062334 - RNA, 19 nt, Homo sapiens
gucccacccucaccauaaa

SEQ ID NO: 1062335 - RNA, 19 nt, Homo sapiens
cuaccucccugcccaguca

SEQ ID NO: 1062336 - RNA, 19 nt, Homo sapiens
caauugcugcugcuuaaau

SEQ ID NO: 1062337 - RNA, 19 nt, Homo sapiens
gaugaacagccaaucaaag

SEQ ID NO: 1062338 - RNA, 19 nt, Homo sapiens
cggcagagaaggcggcuuu

SEQ ID NO: 1062339 - RNA, 19 nt, Homo sapiens
ccagucagcaggcuaggaa

SEQ ID NO: 1062340 - RNA, 19 nt, Homo sapiens
cuccuaggcuucucccaaa

SEQ ID NO: 1062341 - RNA, 19 nt, Homo sapiens
ccuccaagccucaagauca

SEQ ID NO: 1062342 - RNA, 19 nt, Homo sapiens
cgcacugccuuuaggguaa

SEQ ID NO: 1062343 - RNA, 19 nt, Homo sapiens
caacuuccaauaacugaca

SEQ ID NO: 1062344 - RNA, 19 nt, Homo sapiens
cagagaaggcggcuuugga

SEQ ID NO: 1062345 - RNA, 19 nt, Homo sapiens
gcugcuccgccuccuaaua

SEQ ID NO: 1062346 - RNA, 19 nt, Homo sapiens
aucaauugcugcugcuuaa

SEQ ID NO: 1062347 - RNA, 19 nt, Homo sapiens
gaauuacaugggugagcua

SEQ ID NO: 1062348 - RNA, 19 nt, Homo sapiens
guaccgcgagcgcuucauu

SEQ ID NO: 1062349 - RNA, 19 nt, Homo sapiens
guguccagccucaauuuaa

SEQ ID NO: 1062350 - RNA, 19 nt, Homo sapiens
gauggaguuucgcgcuugu

SEQ ID NO: 1062351 - RNA, 19 nt, Homo sapiens
aaggaaaccugaucuugcu

SEQ ID NO: 1062352 - RNA, 19 nt, Homo sapiens
cgaugaacagccaaucaaa

SEQ ID NO: 1062353 - RNA, 19 nt, Homo sapiens
ucaaagcagcuagcaguug

SEQ ID NO: 1062354 - RNA, 19 nt, Homo sapiens
gcguagccaugugcgauug

SEQ ID NO: 1062355 - RNA, 19 nt, Homo sapiens
acaaagacagucauagaag

SEQ ID NO: 1062356 - RNA, 19 nt, Homo sapiens
aacaaagacagucauagaa

SEQ ID NO: 1062357 - RNA, 19 nt, Homo sapiens
gagaaagcuguaguccuaa

SEQ ID NO: 1062358 - RNA, 19 nt, Homo sapiens
gcagccugugcaauauuua

SEQ ID NO: 1062359 - RNA, 19 nt, Homo sapiens
accagcagccugugcaaua

SEQ ID NO: 1062360 - RNA, 19 nt, Homo sapiens
ccaggucuuucacccuuuc

SEQ ID NO: 1062361 - RNA, 19 nt, Homo sapiens
gacccucgaucagccauca

SEQ ID NO: 1062362 - RNA, 19 nt, Homo sapiens
caagccacgcccagcagua

SEQ ID NO: 1062363 - RNA, 19 nt, Homo sapiens
gacaguaaauuuggaucag

SEQ ID NO: 1062364 - RNA, 19 nt, Homo sapiens
caaagucucuuccucauuc

SEQ ID NO: 1062365 - RNA, 19 nt, Homo sapiens
ggacuaagccaccaguauu

SEQ ID NO: 1062366 - RNA, 19 nt, Homo sapiens
gagcuaagccagcacauga

SEQ ID NO: 1062367 - RNA, 19 nt, Homo sapiens
ggucuguuccuguaacuua

SEQ ID NO: 1062368 - RNA, 19 nt, Homo sapiens
gaggucaucuucccacuca

SEQ ID NO: 1062369 - RNA, 19 nt, Homo sapiens
ccagcucuguucccucuua

SEQ ID NO: 1062370 - RNA, 19 nt, Homo sapiens
gaugaccgcuucuuguaag

SEQ ID NO: 1062371 - RNA, 19 nt, Homo sapiens
gaaaucuccaucugggaua

SEQ ID NO: 1062372 - RNA, 19 nt, Homo sapiens
gccugaagcacuuuaauuu

SEQ ID NO: 1062373 - RNA, 19 nt, Homo sapiens
uuaacaaucuccaagacuu

SEQ ID NO: 1062374 - RNA, 19 nt, Homo sapiens
gcgcaaccaucuguacuug

SEQ ID NO: 1062375 - RNA, 19 nt, Homo sapiens
gcuuccaacugaaauaaga

SEQ ID NO: 1062376 - RNA, 19 nt, Homo sapiens
gggaagaagcugugaagug

SEQ ID NO: 1062377 - RNA, 19 nt, Homo sapiens
ugaaugcccuggaggaaca

SEQ ID NO: 1062378 - RNA, 19 nt, Homo sapiens
ccuacacgcugcuuaacaa

SEQ ID NO: 1062379 - RNA, 19 nt, Homo sapiens
ccgcagggcugagauuaga

SEQ ID NO: 1062380 - RNA, 19 nt, Homo sapiens
gugaugaccgcuucuugua

SEQ ID NO: 1062381 - RNA, 19 nt, Homo sapiens
caccagaggucagagauca

SEQ ID NO: 1062382 - RNA, 19 nt, Homo sapiens
aagcugcccuucacucaga

SEQ ID NO: 1062383 - RNA, 19 nt, Homo sapiens
gggcauggcugggacuaag

SEQ ID NO: 1062384 - RNA, 19 nt, Homo sapiens
gcuaagccagcacaugaaa

SEQ ID NO: 1062385 - RNA, 19 nt, Homo sapiens
ccuguggccucuccuguug

SEQ ID NO: 1062386 - RNA, 19 nt, Homo sapiens
caaagcugcccuucacuca

SEQ ID NO: 1062387 - RNA, 19 nt, Homo sapiens
gguggaacccgucaaguag

SEQ ID NO: 1062388 - RNA, 19 nt, Homo sapiens
acacgcugcuuaacaaucu

SEQ ID NO: 1062389 - RNA, 19 nt, Homo sapiens
ccaguuaucuaccugucau

SEQ ID NO: 1062390 - RNA, 19 nt, Homo sapiens
caucugggauauccgaauc

SEQ ID NO: 1062391 - RNA, 19 nt, Homo sapiens
agaggguggugauggcuaa

SEQ ID NO: 1062392 - RNA, 19 nt, Homo sapiens
gccagcacaugaaacugaa

SEQ ID NO: 1062393 - RNA, 19 nt, Homo sapiens
ucaccuacacgcugcuuaa

SEQ ID NO: 1062394 - RNA, 19 nt, Homo sapiens
acuauuaaaugccuguuca

SEQ ID NO: 1062395 - RNA, 19 nt, Homo sapiens
gagauuagaggguggugau

SEQ ID NO: 1062396 - RNA, 19 nt, Homo sapiens
aacuauugcuuccaacuga

SEQ ID NO: 1062397 - RNA, 19 nt, Homo sapiens
cagaggagccugggcagaa

SEQ ID NO: 1062398 - RNA, 19 nt, Homo sapiens
gggacuaagccaccaguau

SEQ ID NO: 1062399 - RNA, 19 nt, Homo sapiens
ccucaacaaccuuggcuuu

SEQ ID NO: 1062400 - RNA, 19 nt, Homo sapiens
cuggaaagcagcuguguga

SEQ ID NO: 1062401 - RNA, 19 nt, Homo sapiens
caaugucugucaccagucu

SEQ ID NO: 1062402 - RNA, 19 nt, Homo sapiens
ccaagauuguagugacugu

SEQ ID NO: 1062403 - RNA, 19 nt, Homo sapiens
ggacaccuaaggccaagau

SEQ ID NO: 1062404 - RNA, 19 nt, Homo sapiens
caaggagggccuggaaguu

SEQ ID NO: 1062405 - RNA, 19 nt, Homo sapiens
cuucaacgccaguuaucua

SEQ ID NO: 1062406 - RNA, 19 nt, Homo sapiens
caccuaaggccaagauugu

SEQ ID NO: 1062407 - RNA, 19 nt, Homo sapiens
uaacaaucuccaagacuuc

SEQ ID NO: 1062408 - RNA, 19 nt, Homo sapiens
ccaacugaaauaagacuau

SEQ ID NO: 1062409 - RNA, 19 nt, Homo sapiens
uacaaagucucuuccucau

SEQ ID NO: 1062410 - RNA, 19 nt, Homo sapiens
gacuaagccaccaguauuc

SEQ ID NO: 1062411 - RNA, 19 nt, Homo sapiens
agagcugccugucuugugu

SEQ ID NO: 1062412 - RNA, 19 nt, Homo sapiens
uguggaagcgggagauuga

SEQ ID NO: 1062413 - RNA, 19 nt, Homo sapiens
caacuauugcuuccaacug

SEQ ID NO: 1062414 - RNA, 19 nt, Homo sapiens
ugguggaacccgucaagua

SEQ ID NO: 1062415 - RNA, 19 nt, Homo sapiens
gcuuaacaaucuccaagac

SEQ ID NO: 1062416 - RNA, 19 nt, Homo sapiens
ugaugaccgcuucuuguaa

SEQ ID NO: 1062417 - RNA, 19 nt, Homo sapiens
ccaaggagggccuggaagu

SEQ ID NO: 1062418 - RNA, 19 nt, Homo sapiens
uacgagcguuucacuguca

SEQ ID NO: 1062419 - RNA, 19 nt, Homo sapiens
caacgccaguuaucuaccu

SEQ ID NO: 1062420 - RNA, 19 nt, Homo sapiens
gagcaucuacacccacuac

SEQ ID NO: 1062421 - RNA, 19 nt, Homo sapiens
gcagccugaagcacuuuaa

SEQ ID NO: 1062422 - RNA, 19 nt, Homo sapiens
ccuacgagcguuucacugu

SEQ ID NO: 1062423 - RNA, 19 nt, Homo sapiens
ucccgaagccaccucauga

SEQ ID NO: 1062424 - RNA, 19 nt, Homo sapiens
gcgacuacucgauguacuu

SEQ ID NO: 1062425 - RNA, 19 nt, Homo sapiens
ggccaagauuguagugacu

SEQ ID NO: 1062426 - RNA, 19 nt, Homo sapiens
acaaagucucuuccucauu

SEQ ID NO: 1062427 - RNA, 19 nt, Homo sapiens
acaccuaaggccaagauug

SEQ ID NO: 1062428 - RNA, 19 nt, Homo sapiens
gcugaaugcccuggaggaa

SEQ ID NO: 1062429 - RNA, 19 nt, Homo sapiens
gcgagcagagcgcuuucaa

SEQ ID NO: 1062430 - RNA, 19 nt, Homo sapiens
gcaccagaggucagagauc

SEQ ID NO: 1062431 - RNA, 19 nt, Homo sapiens
gaguuuacaaagucucuuc

SEQ ID NO: 1062432 - RNA, 19 nt, Homo sapiens
uaagccagcacaugaaacu

SEQ ID NO: 1062433 - RNA, 19 nt, Homo sapiens
gagcaugcacaggcuggaa

SEQ ID NO: 1062434 - RNA, 19 nt, Homo sapiens
ucaaggcuaccugcgauug

SEQ ID NO: 1062435 - RNA, 19 nt, Homo sapiens
gaacugaccugacaugugu

SEQ ID NO: 1062436 - RNA, 19 nt, Homo sapiens
gaacuuacgugugauguuu

SEQ ID NO: 1062437 - RNA, 19 nt, Homo sapiens
gauggcaccuguagucuua

SEQ ID NO: 1062438 - RNA, 19 nt, Homo sapiens
gaauuuagcaaucgcauua

SEQ ID NO: 1062439 - RNA, 19 nt, Homo sapiens
gcaggaaccuaucuuggua

SEQ ID NO: 1062440 - RNA, 19 nt, Homo sapiens
ggacaagacuucaguguac

SEQ ID NO: 1062441 - RNA, 19 nt, Homo sapiens
gaaacccuaucucuucuaa

SEQ ID NO: 1062442 - RNA, 19 nt, Homo sapiens
cgugugauguuuacuauua

SEQ ID NO: 1062443 - RNA, 19 nt, Homo sapiens
gcugugaacuuacguguga

SEQ ID NO: 1062444 - RNA, 19 nt, Homo sapiens
gaaguugugcaguuucuua

SEQ ID NO: 1062445 - RNA, 19 nt, Homo sapiens
gagccaagaucaugccauu

SEQ ID NO: 1062446 - RNA, 19 nt, Homo sapiens
cgacugaguguauucauua

SEQ ID NO: 1062447 - RNA, 19 nt, Homo sapiens
gcaccuuccuggccucuuu

SEQ ID NO: 1062448 - RNA, 19 nt, Homo sapiens
gcauuaggauacugauauu

SEQ ID NO: 1062449 - RNA, 19 nt, Homo sapiens
aaagagaaauaccgacuga

SEQ ID NO: 1062450 - RNA, 19 nt, Homo sapiens
gaauuaauguuccuuacag

SEQ ID NO: 1062451 - RNA, 19 nt, Homo sapiens
gaccuacccugaugguuug

SEQ ID NO: 1062452 - RNA, 19 nt, Homo sapiens
cggaagcuccucagucuua

SEQ ID NO: 1062453 - RNA, 19 nt, Homo sapiens
ucacacguuugcuuaaauu

SEQ ID NO: 1062454 - RNA, 19 nt, Homo sapiens
ccugacauguguauaguaa

SEQ ID NO: 1062455 - RNA, 19 nt, Homo sapiens
gaucauuguuguugaacug

SEQ ID NO: 1062456 - RNA, 19 nt, Homo sapiens
gacggaagcuccucagucu

SEQ ID NO: 1062457 - RNA, 19 nt, Homo sapiens
ugacauguguauaguaauc

SEQ ID NO: 1062458 - RNA, 19 nt, Homo sapiens
ucagaauacucgaaagaga

SEQ ID NO: 1062459 - RNA, 19 nt, Homo sapiens
guaaucucaugaacaagaa

SEQ ID NO: 1062460 - RNA, 19 nt, Homo sapiens
cgaccuacccugaugguuu

SEQ ID NO: 1062461 - RNA, 19 nt, Homo sapiens
aauuugggcugugaacuua

SEQ ID NO: 1062462 - RNA, 19 nt, Homo sapiens
guucacacguuugcuuaaa

SEQ ID NO: 1062463 - RNA, 19 nt, Homo sapiens
acacacaccugcuaguauc

SEQ ID NO: 1062464 - RNA, 19 nt, Homo sapiens
gcagugagccaagaucaug

SEQ ID NO: 1062465 - RNA, 19 nt, Homo sapiens
gcaggagaaucguuugaac

SEQ ID NO: 1062466 - RNA, 19 nt, Homo sapiens
cacguuugcuuaaauugaa

SEQ ID NO: 1062467 - RNA, 19 nt, Homo sapiens
gacugaguguauucauuaa

SEQ ID NO: 1062468 - RNA, 19 nt, Homo sapiens
gaaauaccgacugagugua

SEQ ID NO: 1062469 - RNA, 19 nt, Homo sapiens
gggaaacccuaucucuucu

SEQ ID NO: 1062470 - RNA, 19 nt, Homo sapiens
gugaggaguucgagaccaa

SEQ ID NO: 1062471 - RNA, 19 nt, Homo sapiens
caggaucauuguuguugaa

SEQ ID NO: 1062472 - RNA, 19 nt, Homo sapiens
cagaauacucgaaagagaa

SEQ ID NO: 1062473 - RNA, 19 nt, Homo sapiens
cagaucagacccucuaguu

SEQ ID NO: 1062474 - RNA, 19 nt, Homo sapiens
agacagaucagacccucua

SEQ ID NO: 1062475 - RNA, 19 nt, Homo sapiens
caggaaauuugggcuguga

SEQ ID NO: 1062476 - RNA, 19 nt, Homo sapiens
ucacacacaccugcuagua

SEQ ID NO: 1062477 - RNA, 19 nt, Homo sapiens
caucagaauacucgaaaga

SEQ ID NO: 1062478 - RNA, 19 nt, Homo sapiens
caaaugcucagacgacaca

SEQ ID NO: 1062479 - RNA, 19 nt, Homo sapiens
gaccugacauguguauagu

SEQ ID NO: 1062480 - RNA, 19 nt, Homo sapiens
gcaccuguagucuuagcua

SEQ ID NO: 1062481 - RNA, 19 nt, Homo sapiens
ggaaacccuaucucuucua

SEQ ID NO: 1062482 - RNA, 19 nt, Homo sapiens
guugugcaguuucuuaaca

SEQ ID NO: 1062483 - RNA, 19 nt, Homo sapiens
acugauauuuccacaaugu

SEQ ID NO: 1062484 - RNA, 19 nt, Homo sapiens
guuuggaaguugugcaguu

SEQ ID NO: 1062485 - RNA, 19 nt, Homo sapiens
ccgacugaguguauucauu

SEQ ID NO: 1062486 - RNA, 19 nt, Homo sapiens
caaaugaccacagcagcuu

SEQ ID NO: 1062487 - RNA, 19 nt, Homo sapiens
ggaccuugccucucacaca

SEQ ID NO: 1062488 - RNA, 19 nt, Homo sapiens
uuaacaagcagacagauca

SEQ ID NO: 1062489 - RNA, 19 nt, Homo sapiens
agaaauaccgacugagugu

SEQ ID NO: 1062490 - RNA, 19 nt, Homo sapiens
gcuuuucucuucuguguuu

SEQ ID NO: 1062491 - RNA, 19 nt, Homo sapiens
gggccaagacagugccuuu

SEQ ID NO: 1062492 - RNA, 19 nt, Homo sapiens
cuucauaggucccguaagc

SEQ ID NO: 1062493 - RNA, 19 nt, Homo sapiens
ggaagcuccucagucuuag

SEQ ID NO: 1062494 - RNA, 19 nt, Homo sapiens
agaauacucgaaagagaaa

SEQ ID NO: 1062495 - RNA, 19 nt, Homo sapiens
ggauucggcuuuucucuuc

SEQ ID NO: 1062496 - RNA, 19 nt, Homo sapiens
cugaguguauucauuaaag

SEQ ID NO: 1062497 - RNA, 19 nt, Homo sapiens
cggacaagacuucagugua

SEQ ID NO: 1062498 - RNA, 19 nt, Homo sapiens
ccuguaaucccagcacuuu

SEQ ID NO: 1062499 - RNA, 19 nt, Homo sapiens
ccugaugguuuggaaguug

SEQ ID NO: 1062500 - RNA, 19 nt, Homo sapiens
cacacgaccuacccugaug

SEQ ID NO: 1062501 - RNA, 19 nt, Homo sapiens
ccugaugaguucacugcuu

SEQ ID NO: 1062502 - RNA, 19 nt, Homo sapiens
cguucaaccugaugaguuc

SEQ ID NO: 1062503 - RNA, 19 nt, Homo sapiens
ccaagacagugccuuucca

SEQ ID NO: 1062504 - RNA, 19 nt, Homo sapiens
gcuaguaucuccgcaaccu

SEQ ID NO: 1062505 - RNA, 19 nt, Homo sapiens
uacgugugauguuuacuau

SEQ ID NO: 1062506 - RNA, 19 nt, Homo sapiens
gcaaucgcauuaggauacu

SEQ ID NO: 1062507 - RNA, 19 nt, Homo sapiens
caagaaagaauguguucac

SEQ ID NO: 1062508 - RNA, 19 nt, Homo sapiens
guauaguaaucucaugaac

SEQ ID NO: 1062509 - RNA, 19 nt, Homo sapiens
acaggaucauuguuguuga

SEQ ID NO: 1062510 - RNA, 19 nt, Homo sapiens
acuccuggcucuccuggaa

SEQ ID NO: 1062511 - RNA, 19 nt, Homo sapiens
ccaagaucaugccauugca

SEQ ID NO: 1062512 - RNA, 19 nt, Homo sapiens
ugaggcaggagaaucguuu

SEQ ID NO: 1062513 - RNA, 19 nt, Homo sapiens
uuacgugugauguuuacua

SEQ ID NO: 1062514 - RNA, 19 nt, Homo sapiens
aggaaccuaucuugguaaa

SEQ ID NO: 1062515 - RNA, 19 nt, Homo sapiens
ggcaucaucucagcugaca

SEQ ID NO: 1062516 - RNA, 19 nt, Homo sapiens
ggauggcaccuguagucuu

SEQ ID NO: 1062517 - RNA, 19 nt, Homo sapiens
cuucagguguggcccuuau

SEQ ID NO: 1062518 - RNA, 19 nt, Homo sapiens
aaauuugggcugugaacuu

SEQ ID NO: 1062519 - RNA, 19 nt, Homo sapiens
cgcauuaggauacugauau

SEQ ID NO: 1062520 - RNA, 19 nt, Homo sapiens
acacguuugcuuaaauuga

SEQ ID NO: 1062521 - RNA, 19 nt, Homo sapiens
ugaccugacauguguauag

SEQ ID NO: 1062522 - RNA, 19 nt, Homo sapiens
ugugggugcuuccugcauu

SEQ ID NO: 1062523 - RNA, 19 nt, Homo sapiens
ucacagggauucggcuuuu

SEQ ID NO: 1062524 - RNA, 19 nt, Homo sapiens
uuuggaaguugugcaguuu

SEQ ID NO: 1062525 - RNA, 19 nt, Homo sapiens
agacgacacacacgaccua

SEQ ID NO: 1062526 - RNA, 19 nt, Homo sapiens
agagaaauaccgacugagu

SEQ ID NO: 1062527 - RNA, 19 nt, Homo sapiens
caucaucucagcugacagu

SEQ ID NO: 1062528 - RNA, 19 nt, Homo sapiens
aacccuaucucuucuaaaa

SEQ ID NO: 1062529 - RNA, 19 nt, Homo sapiens
ugaacaagaaagaaugugu

SEQ ID NO: 1062530 - RNA, 19 nt, Homo sapiens
gugggugcuuccugcauug

SEQ ID NO: 1062531 - RNA, 19 nt, Homo sapiens
aguaaucucaugaacaaga

SEQ ID NO: 1062532 - RNA, 19 nt, Homo sapiens
ccuggcaccuggacuccuu

SEQ ID NO: 1062533 - RNA, 19 nt, Homo sapiens
gccaagaucaugccauugc

SEQ ID NO: 1062534 - RNA, 19 nt, Homo sapiens
ugaacugaccugacaugug

SEQ ID NO: 1062535 - RNA, 19 nt, Homo sapiens
caaagaaucucucauguuu

SEQ ID NO: 1062536 - RNA, 19 nt, Homo sapiens
caucaaaucucaggaauua

SEQ ID NO: 1062537 - RNA, 19 nt, Homo sapiens
ggagaaagaugauauuguu

SEQ ID NO: 1062538 - RNA, 19 nt, Homo sapiens
aaacgucucuuccaacuua

SEQ ID NO: 1062539 - RNA, 19 nt, Homo sapiens
gaaauaaggucccuaagag

SEQ ID NO: 1062540 - RNA, 19 nt, Homo sapiens
gaaggacuacuccaaauua

SEQ ID NO: 1062541 - RNA, 19 nt, Homo sapiens
caaauuaccuuucugcaau

SEQ ID NO: 1062542 - RNA, 19 nt, Homo sapiens
gaacagcauuugcaucaau

SEQ ID NO: 1062543 - RNA, 19 nt, Homo sapiens
gaggugaaauaacaaguaa

SEQ ID NO: 1062544 - RNA, 19 nt, Homo sapiens
uagcagaucuguuucuauu

SEQ ID NO: 1062545 - RNA, 19 nt, Homo sapiens
gaugagaguuugagaguca

SEQ ID NO: 1062546 - RNA, 19 nt, Homo sapiens
gcagaucuguuucuauugu

SEQ ID NO: 1062547 - RNA, 19 nt, Homo sapiens
aaucagcacuucacucuuu

SEQ ID NO: 1062548 - RNA, 19 nt, Homo sapiens
gcagacagcugaauuuuga

SEQ ID NO: 1062549 - RNA, 19 nt, Homo sapiens
ccuaagaggugaaauaaca

SEQ ID NO: 1062550 - RNA, 19 nt, Homo sapiens
guacaucugugaaagugaa

SEQ ID NO: 1062551 - RNA, 19 nt, Homo sapiens
gaacacaugcuaccagaug

SEQ ID NO: 1062552 - RNA, 19 nt, Homo sapiens
gcauuugcaucaauaauag

SEQ ID NO: 1062553 - RNA, 19 nt, Homo sapiens
gaagauaaagcagucagua

SEQ ID NO: 1062554 - RNA, 19 nt, Homo sapiens
uaacaaguaaucccuagua

SEQ ID NO: 1062555 - RNA, 19 nt, Homo sapiens
acaagggcauguaguuuaa

SEQ ID NO: 1062556 - RNA, 19 nt, Homo sapiens
gaaaucagcacuucacucu

SEQ ID NO: 1062557 - RNA, 19 nt, Homo sapiens
cuacacacauugaaauaug

SEQ ID NO: 1062558 - RNA, 19 nt, Homo sapiens
aaacagaaaucagcacuuc

SEQ ID NO: 1062559 - RNA, 19 nt, Homo sapiens
gcaaacgucucuuccaacu

SEQ ID NO: 1062560 - RNA, 19 nt, Homo sapiens
ugagugcuuucuacaauuu

SEQ ID NO: 1062561 - RNA, 19 nt, Homo sapiens
cagcaucuacuccuuauuu

SEQ ID NO: 1062562 - RNA, 19 nt, Homo sapiens
gcaagaagaagauaaagca

SEQ ID NO: 1062563 - RNA, 19 nt, Homo sapiens
uaccuaguguuucgaguua

SEQ ID NO: 1062564 - RNA, 19 nt, Homo sapiens
aagaaucucucauguuuca

SEQ ID NO: 1062565 - RNA, 19 nt, Homo sapiens
ggacuacuccaaauuagga

SEQ ID NO: 1062566 - RNA, 19 nt, Homo sapiens
uagccaagauuacaaugaa

SEQ ID NO: 1062567 - RNA, 19 nt, Homo sapiens
gggcauguaguuuaauuaa

SEQ ID NO: 1062568 - RNA, 19 nt, Homo sapiens
gcaaugauggguuugaaau

SEQ ID NO: 1062569 - RNA, 19 nt, Homo sapiens
gcaggccucuccuucaugu

SEQ ID NO: 1062570 - RNA, 19 nt, Homo sapiens
caugauacaucuaguacau

SEQ ID NO: 1062571 - RNA, 19 nt, Homo sapiens
agacagaaaugccagcaau

SEQ ID NO: 1062572 - RNA, 19 nt, Homo sapiens
ugaaauaaggucccuaaga

SEQ ID NO: 1062573 - RNA, 19 nt, Homo sapiens
aaugagaaauugggacuuu

SEQ ID NO: 1062574 - RNA, 19 nt, Homo sapiens
gacagcaucuacuccuuau

SEQ ID NO: 1062575 - RNA, 19 nt, Homo sapiens
gguuugaaaugugcaguuu

SEQ ID NO: 1062576 - RNA, 19 nt, Homo sapiens
gcaguuaguucaccuacac

SEQ ID NO: 1062577 - RNA, 19 nt, Homo sapiens
ugaaauaguuaacccuucu

SEQ ID NO: 1062578 - RNA, 19 nt, Homo sapiens
ccgcaaacgucucuuccaa

SEQ ID NO: 1062579 - RNA, 19 nt, Homo sapiens
ucaaagaaucucucauguu

SEQ ID NO: 1062580 - RNA, 19 nt, Homo sapiens
gacaauaaagacagaaaug

SEQ ID NO: 1062581 - RNA, 19 nt, Homo sapiens
gagaugagaguuugagagu

SEQ ID NO: 1062582 - RNA, 19 nt, Homo sapiens
aacaagggcauguaguuua

SEQ ID NO: 1062583 - RNA, 19 nt, Homo sapiens
ggauugugauauucccauu

SEQ ID NO: 1062584 - RNA, 19 nt, Homo sapiens
gggcaggccucuccuucau

SEQ ID NO: 1062585 - RNA, 19 nt, Homo sapiens
gaugauucccaguaccaua

SEQ ID NO: 1062586 - RNA, 19 nt, Homo sapiens
gaaauaguuaacccuucua

SEQ ID NO: 1062587 - RNA, 19 nt, Homo sapiens
agacagcaucuacuccuua

SEQ ID NO: 1062588 - RNA, 19 nt, Homo sapiens
ccaaauuaccuuucugcaa

SEQ ID NO: 1062589 - RNA, 19 nt, Homo sapiens
ggugaaauaacaaguaauc

SEQ ID NO: 1062590 - RNA, 19 nt, Homo sapiens
ugaaaugugcaguuuauca

SEQ ID NO: 1062591 - RNA, 19 nt, Homo sapiens
gaaaugugcaguuuaucag

SEQ ID NO: 1062592 - RNA, 19 nt, Homo sapiens
ugaaggacuacuccaaauu

SEQ ID NO: 1062593 - RNA, 19 nt, Homo sapiens
aacagcauuugcaucaaua

SEQ ID NO: 1062594 - RNA, 19 nt, Homo sapiens
aaugauggguuugaaaugu

SEQ ID NO: 1062595 - RNA, 19 nt, Homo sapiens
cagcaaugauggguuugaa

SEQ ID NO: 1062596 - RNA, 19 nt, Homo sapiens
ugacaugaacgaccgcaaa

SEQ ID NO: 1062597 - RNA, 19 nt, Homo sapiens
ucagggugacaauaaguua

SEQ ID NO: 1062598 - RNA, 19 nt, Homo sapiens
gauugugauauucccauua

SEQ ID NO: 1062599 - RNA, 19 nt, Homo sapiens
agauuacaaugaaggacua

SEQ ID NO: 1062600 - RNA, 19 nt, Homo sapiens
ccacagcuggugauuccua

SEQ ID NO: 1062601 - RNA, 19 nt, Homo sapiens
ucaaaucucaggaauuaag

SEQ ID NO: 1062602 - RNA, 19 nt, Homo sapiens
gcaucaaaucucaggaauu

SEQ ID NO: 1062603 - RNA, 19 nt, Homo sapiens
caucugugaaagugaaaua

SEQ ID NO: 1062604 - RNA, 19 nt, Homo sapiens
ugauacaucuaguacaucu

SEQ ID NO: 1062605 - RNA, 19 nt, Homo sapiens
ucagaacagcugcuacuug

SEQ ID NO: 1062606 - RNA, 19 nt, Homo sapiens
gggagaaagaugauauugu

SEQ ID NO: 1062607 - RNA, 19 nt, Homo sapiens
agaaaugccagcaaugaug

SEQ ID NO: 1062608 - RNA, 19 nt, Homo sapiens
acagaaaugccagcaauga

SEQ ID NO: 1062609 - RNA, 19 nt, Homo sapiens
aagggcauguaguuuaauu

SEQ ID NO: 1062610 - RNA, 19 nt, Homo sapiens
caaccaggagacuuaaaga

SEQ ID NO: 1062611 - RNA, 19 nt, Homo sapiens
gcaucuacuccuuauuuau

SEQ ID NO: 1062612 - RNA, 19 nt, Homo sapiens
agcaucuacuccuuauuua

SEQ ID NO: 1062613 - RNA, 19 nt, Homo sapiens
ugccagcaaugauggguuu

SEQ ID NO: 1062614 - RNA, 19 nt, Homo sapiens
uguagcagaucuguuucua

SEQ ID NO: 1062615 - RNA, 19 nt, Homo sapiens
guguuucgaguuagaauuu

SEQ ID NO: 1062616 - RNA, 19 nt, Homo sapiens
gcgcaucaaaucucaggaa

SEQ ID NO: 1062617 - RNA, 19 nt, Homo sapiens
uaguucaccuacacacauu

SEQ ID NO: 1062618 - RNA, 19 nt, Homo sapiens
cugugaaagugaaauaguu

SEQ ID NO: 1062619 - RNA, 19 nt, Homo sapiens
caaugaaggacuacuccaa

SEQ ID NO: 1062620 - RNA, 19 nt, Homo sapiens
cagaaauuaucaugaacag

SEQ ID NO: 1062621 - RNA, 19 nt, Homo sapiens
caaauuaggaguccaugac

SEQ ID NO: 1062622 - RNA, 19 nt, Homo sapiens
agaggugaaauaacaagua

SEQ ID NO: 1062623 - RNA, 19 nt, Homo sapiens
uuugagugcuuucuacaau

SEQ ID NO: 1062624 - RNA, 19 nt, Homo sapiens
ucaccuacacacauugaaa

SEQ ID NO: 1062625 - RNA, 19 nt, Homo sapiens
uaccagaugauucccagua

SEQ ID NO: 1062626 - RNA, 19 nt, Homo sapiens
ccuaguguuucgaguuaga

SEQ ID NO: 1062627 - RNA, 19 nt, Homo sapiens
agacauuguugguggagau

SEQ ID NO: 1062628 - RNA, 19 nt, Homo sapiens
uaguacaucugugaaagug

SEQ ID NO: 1062629 - RNA, 19 nt, Homo sapiens
cagaucuguuucuauuguu

SEQ ID NO: 1062630 - RNA, 19 nt, Homo sapiens
cuacuugccaggaucugua

SEQ ID NO: 1062631 - RNA, 19 nt, Homo sapiens
gagaaagaugauauuguuc

SEQ ID NO: 1062632 - RNA, 19 nt, Homo sapiens
ggugggagaaagaugauau

SEQ ID NO: 1062633 - RNA, 19 nt, Homo sapiens
ucucauguuucaggguaua

SEQ ID NO: 1062634 - RNA, 19 nt, Homo sapiens
ggugauuccuaugugcaaa

SEQ ID NO: 1062635 - RNA, 19 nt, Homo sapiens
gaacuucucccauuaauug

SEQ ID NO: 1062636 - RNA, 19 nt, Homo sapiens
gagaugggauuucacauuu

SEQ ID NO: 1062637 - RNA, 19 nt, Homo sapiens
ggaaacccauucuugauaa

SEQ ID NO: 1062638 - RNA, 19 nt, Homo sapiens
gaaacaccgucucuacuaa

SEQ ID NO: 1062639 - RNA, 19 nt, Homo sapiens
gcaagcaccuauuauggua

SEQ ID NO: 1062640 - RNA, 19 nt, Homo sapiens
gaucaauuguggacucaua

SEQ ID NO: 1062641 - RNA, 19 nt, Homo sapiens
gaagaagcgucuagauuca

SEQ ID NO: 1062642 - RNA, 19 nt, Homo sapiens
gaagaauuccuagaacuua

SEQ ID NO: 1062643 - RNA, 19 nt, Homo sapiens
uguaauagcuagcgucuuu

SEQ ID NO: 1062644 - RNA, 19 nt, Homo sapiens
ugacagaucuuaacgacaa

SEQ ID NO: 1062645 - RNA, 19 nt, Homo sapiens
ggagauugguuccuaguga

SEQ ID NO: 1062646 - RNA, 19 nt, Homo sapiens
ggaauuggguucagguguu

SEQ ID NO: 1062647 - RNA, 19 nt, Homo sapiens
gcccaaauguuguaucuau

SEQ ID NO: 1062648 - RNA, 19 nt, Homo sapiens
gaauggaagucuugagcaa

SEQ ID NO: 1062649 - RNA, 19 nt, Homo sapiens
gucaacagcccaacaaaua

SEQ ID NO: 1062650 - RNA, 19 nt, Homo sapiens
uggaauauguugggauuua

SEQ ID NO: 1062651 - RNA, 19 nt, Homo sapiens
aagagucacugggaaauua

SEQ ID NO: 1062652 - RNA, 19 nt, Homo sapiens
gcuauauugucccuacaua

SEQ ID NO: 1062653 - RNA, 19 nt, Homo sapiens
gggaaacccauucuugaua

SEQ ID NO: 1062654 - RNA, 19 nt, Homo sapiens
ggagaaaguuccaguuggu

SEQ ID NO: 1062655 - RNA, 19 nt, Homo sapiens
gaaguuggcccaguucuga

SEQ ID NO: 1062656 - RNA, 19 nt, Homo sapiens
auacugagccugaucauuu

SEQ ID NO: 1062657 - RNA, 19 nt, Homo sapiens
acaauuggguuaaacuuug

SEQ ID NO: 1062658 - RNA, 19 nt, Homo sapiens
cuucgaaacucacuaaaug

SEQ ID NO: 1062659 - RNA, 19 nt, Homo sapiens
ugguuuagcuggauuacua

SEQ ID NO: 1062660 - RNA, 19 nt, Homo sapiens
guucagguguucuguaaug

SEQ ID NO: 1062661 - RNA, 19 nt, Homo sapiens
ggguuaaacuuuggguaua

SEQ ID NO: 1062662 - RNA, 19 nt, Homo sapiens
gcagggaaacccauucuug

SEQ ID NO: 1062663 - RNA, 19 nt, Homo sapiens
ggguucagguguucuguaa

SEQ ID NO: 1062664 - RNA, 19 nt, Homo sapiens
gguggaauauguugggauu

SEQ ID NO: 1062665 - RNA, 19 nt, Homo sapiens
gagaagaauuccuagaacu

SEQ ID NO: 1062666 - RNA, 19 nt, Homo sapiens
caacuuucauccuaagaau

SEQ ID NO: 1062667 - RNA, 19 nt, Homo sapiens
gauaacaaccugggagaaa

SEQ ID NO: 1062668 - RNA, 19 nt, Homo sapiens
gaaggugggcaaaggaauu

SEQ ID NO: 1062669 - RNA, 19 nt, Homo sapiens
caccuauuaugguaacuua

SEQ ID NO: 1062670 - RNA, 19 nt, Homo sapiens
ggaauauguugggauuuau

SEQ ID NO: 1062671 - RNA, 19 nt, Homo sapiens
ggggaaggauuuaugaaua

SEQ ID NO: 1062672 - RNA, 19 nt, Homo sapiens
ugaagaagcgucuagauuc

SEQ ID NO: 1062673 - RNA, 19 nt, Homo sapiens
ugacugcaagcaccuauua

SEQ ID NO: 1062674 - RNA, 19 nt, Homo sapiens
gaucauuugcauuucguua

SEQ ID NO: 1062675 - RNA, 19 nt, Homo sapiens
ugaaacaccgucucuacua

SEQ ID NO: 1062676 - RNA, 19 nt, Homo sapiens
gggaaggauuuaugaauac

SEQ ID NO: 1062677 - RNA, 19 nt, Homo sapiens
gcaauucugcuauguuugu

SEQ ID NO: 1062678 - RNA, 19 nt, Homo sapiens
uccuagaacuuaugcauuu

SEQ ID NO: 1062679 - RNA, 19 nt, Homo sapiens
ucacuaugauuuacugugu

SEQ ID NO: 1062680 - RNA, 19 nt, Homo sapiens
gagaaaugccacugugcua

SEQ ID NO: 1062681 - RNA, 19 nt, Homo sapiens
gcacuggcaugguggucaa

SEQ ID NO: 1062682 - RNA, 19 nt, Homo sapiens
gagcucauauccuuauuuu

SEQ ID NO: 1062683 - RNA, 19 nt, Homo sapiens
cuacuauggugaugaucua

SEQ ID NO: 1062684 - RNA, 19 nt, Homo sapiens
ggauaaugcuuagaauucu

SEQ ID NO: 1062685 - RNA, 19 nt, Homo sapiens
aggcaauucugcuauguuu

SEQ ID NO: 1062686 - RNA, 19 nt, Homo sapiens
ucacaggcgugcaccauca

SEQ ID NO: 1062687 - RNA, 19 nt, Homo sapiens
gaacuggcccugcuguaca

SEQ ID NO: 1062688 - RNA, 19 nt, Homo sapiens
gugaagaagcgucuagauu

SEQ ID NO: 1062689 - RNA, 19 nt, Homo sapiens
ucauaucaauugcuggaaa

SEQ ID NO: 1062690 - RNA, 19 nt, Homo sapiens
aguuuaagcugauguguau

SEQ ID NO: 1062691 - RNA, 19 nt, Homo sapiens
gcuaguugcccaaauguug

SEQ ID NO: 1062692 - RNA, 19 nt, Homo sapiens
gggcuacaaugcaguauac

SEQ ID NO: 1062693 - RNA, 19 nt, Homo sapiens
ccgaaacgcuaaauauucu

SEQ ID NO: 1062694 - RNA, 19 nt, Homo sapiens
ggaaggauuuaugaauaca

SEQ ID NO: 1062695 - RNA, 19 nt, Homo sapiens
gcacuggcauccugaacag

SEQ ID NO: 1062696 - RNA, 19 nt, Homo sapiens
gcuagucguuggauuuauc

SEQ ID NO: 1062697 - RNA, 19 nt, Homo sapiens
caucuagacuccaucucaa

SEQ ID NO: 1062698 - RNA, 19 nt, Homo sapiens
ucaacagcccaacaaauaa

SEQ ID NO: 1062699 - RNA, 19 nt, Homo sapiens
gaauuggguucagguguuc

SEQ ID NO: 1062700 - RNA, 19 nt, Homo sapiens
aaucacacccuuaaccuuu

SEQ ID NO: 1062701 - RNA, 19 nt, Homo sapiens
ccagaguggauaaugcuua

SEQ ID NO: 1062702 - RNA, 19 nt, Homo sapiens
aaaccaguguaggaaauaa

SEQ ID NO: 1062703 - RNA, 19 nt, Homo sapiens
ggugaguccagcuaaauuu

SEQ ID NO: 1062704 - RNA, 19 nt, Homo sapiens
gggcuagucguuggauuua

SEQ ID NO: 1062705 - RNA, 19 nt, Homo sapiens
gauuuauguuugccucuga

SEQ ID NO: 1062706 - RNA, 19 nt, Homo sapiens
gccaguuccuccuguauuc

SEQ ID NO: 1062707 - RNA, 19 nt, Homo sapiens
ggauuacuaggaucaauug

SEQ ID NO: 1062708 - RNA, 19 nt, Homo sapiens
guucugaucgucucuaaug

SEQ ID NO: 1062709 - RNA, 19 nt, Homo sapiens
gaagcaccagggcauguuu

SEQ ID NO: 1062710 - RNA, 19 nt, Homo sapiens
gacaggguacagaguauuu

SEQ ID NO: 1062711 - RNA, 19 nt, Homo sapiens
cauugcaaauuucagcuuu

SEQ ID NO: 1062712 - RNA, 19 nt, Homo sapiens
gcuuagaauucuuuauugg

SEQ ID NO: 1062713 - RNA, 19 nt, Homo sapiens
gaaaugccacugugcuagu

SEQ ID NO: 1062714 - RNA, 19 nt, Homo sapiens
cuugagcaaugaagcuaua

SEQ ID NO: 1062715 - RNA, 19 nt, Homo sapiens
caacgcagugaaucuguuu

SEQ ID NO: 1062716 - RNA, 19 nt, Homo sapiens
caucaacuccccuguaaua

SEQ ID NO: 1062717 - RNA, 19 nt, Homo sapiens
ugagaugggauuucacauu

SEQ ID NO: 1062718 - RNA, 19 nt, Homo sapiens
ccggaaggaguuugaauuu

SEQ ID NO: 1062719 - RNA, 19 nt, Homo sapiens
caacaauuggguuaaacuu

SEQ ID NO: 1062720 - RNA, 19 nt, Homo sapiens
cuaaggcaauucugcuaug

SEQ ID NO: 1062721 - RNA, 19 nt, Homo sapiens
uuaaaccaguguaggaaau

SEQ ID NO: 1062722 - RNA, 19 nt, Homo sapiens
gucccuacauauuacuaua

SEQ ID NO: 1062723 - RNA, 19 nt, Homo sapiens
cagggaaacccauucuuga

SEQ ID NO: 1062724 - RNA, 19 nt, Homo sapiens
gagaaaguuccaguuggua

SEQ ID NO: 1062725 - RNA, 19 nt, Homo sapiens
gcaaaggaauuggguucag

SEQ ID NO: 1062726 - RNA, 19 nt, Homo sapiens
uaaggaaggugggcaaagg

SEQ ID NO: 1062727 - RNA, 19 nt, Homo sapiens
gaauauguugggauuuaug

SEQ ID NO: 1062728 - RNA, 19 nt, Homo sapiens
ggagcucauauccuuauuu

SEQ ID NO: 1062729 - RNA, 19 nt, Homo sapiens
caucguaaaugacuuucuc

SEQ ID NO: 1062730 - RNA, 19 nt, Homo sapiens
ucacaucguaaaugacuuu

SEQ ID NO: 1062731 - RNA, 19 nt, Homo sapiens
ugacuuacuucaggacaga

SEQ ID NO: 1062732 - RNA, 19 nt, Homo sapiens
ccugaacaguuaagaguca

SEQ ID NO: 1062733 - RNA, 19 nt, Homo sapiens
cuaaacaaguguaguaucc

SEQ ID NO: 1062734 - RNA, 19 nt, Homo sapiens
aagagaagaauuccuagaa

SEQ ID NO: 1062735 - RNA, 19 nt, Homo sapiens
ggaaacagaucuucacuug

SEQ ID NO: 1062736 - RNA, 19 nt, Homo sapiens
ggacgcugcuggcuuuaaa

SEQ ID NO: 1062737 - RNA, 19 nt, Homo sapiens
ccaaggaacucugcuucua

SEQ ID NO: 1062738 - RNA, 19 nt, Homo sapiens
ccaaugugcuggaauuaca

SEQ ID NO: 1062739 - RNA, 19 nt, Homo sapiens
gagaggguagccuggauua

SEQ ID NO: 1062740 - RNA, 19 nt, Homo sapiens
guaggugugugauugaguu

SEQ ID NO: 1062741 - RNA, 19 nt, Homo sapiens
gagaggcagcuaagucuuu

SEQ ID NO: 1062742 - RNA, 19 nt, Homo sapiens
gcucuuaaccacccuacua

SEQ ID NO: 1062743 - RNA, 19 nt, Homo sapiens
uugaagaucugcagugaga

SEQ ID NO: 1062744 - RNA, 19 nt, Homo sapiens
agaggacacugaaggcauu

SEQ ID NO: 1062745 - RNA, 19 nt, Homo sapiens
ggaggaagaggacacugaa

SEQ ID NO: 1062746 - RNA, 19 nt, Homo sapiens
uaauaaaugugcguugcuu

SEQ ID NO: 1062747 - RNA, 19 nt, Homo sapiens
ggugugugauugaguugaa

SEQ ID NO: 1062748 - RNA, 19 nt, Homo sapiens
ccuaugagaugaggaaaca

SEQ ID NO: 1062749 - RNA, 19 nt, Homo sapiens
gaauuacagguaugagcua

SEQ ID NO: 1062750 - RNA, 19 nt, Homo sapiens
gaacucacgucaggcaaaa

SEQ ID NO: 1062751 - RNA, 19 nt, Homo sapiens
gugcuggaauuacagguau

SEQ ID NO: 1062752 - RNA, 19 nt, Homo sapiens
cagcuuccuuacccuauga

SEQ ID NO: 1062753 - RNA, 19 nt, Homo sapiens
uaaccacccuacuauguac

SEQ ID NO: 1062754 - RNA, 19 nt, Homo sapiens
caagauguccaagcccuaa

SEQ ID NO: 1062755 - RNA, 19 nt, Homo sapiens
ggacuuuguagguguguga

SEQ ID NO: 1062756 - RNA, 19 nt, Homo sapiens
gugauugaguugaagaucu

SEQ ID NO: 1062757 - RNA, 19 nt, Homo sapiens
uuaaccacccuacuaugua

SEQ ID NO: 1062758 - RNA, 19 nt, Homo sapiens
caaagcaccaggcgaugga

SEQ ID NO: 1062759 - RNA, 19 nt, Homo sapiens
gauggccucuauucuggau

SEQ ID NO: 1062760 - RNA, 19 nt, Homo sapiens
gaggguuggucucaaacuc

SEQ ID NO: 1062761 - RNA, 19 nt, Homo sapiens
ugauugaguugaagaucug

SEQ ID NO: 1062762 - RNA, 19 nt, Homo sapiens
gaauaaaguccccaagaug

SEQ ID NO: 1062763 - RNA, 19 nt, Homo sapiens
cuaccgcgcucagcccaaa

SEQ ID NO: 1062764 - RNA, 19 nt, Homo sapiens
aaaggcaagggauggauuu

SEQ ID NO: 1062765 - RNA, 19 nt, Homo sapiens
ccucuauucuggauucaca

SEQ ID NO: 1062766 - RNA, 19 nt, Homo sapiens
gacuguaagguaauaaaug

SEQ ID NO: 1062767 - RNA, 19 nt, Homo sapiens
ggaaccagcccugccaaca

SEQ ID NO: 1062768 - RNA, 19 nt, Homo sapiens
ggccaucuguggaagaaac

SEQ ID NO: 1062769 - RNA, 19 nt, Homo sapiens
ccaaacccagggcucuuaa

SEQ ID NO: 1062770 - RNA, 19 nt, Homo sapiens
ucaaacuccugggcucaug

SEQ ID NO: 1062771 - RNA, 19 nt, Homo sapiens
gccaacaccuggauuuuag

SEQ ID NO: 1062772 - RNA, 19 nt, Homo sapiens
gaaccagcccugccaacac

SEQ ID NO: 1062773 - RNA, 19 nt, Homo sapiens
gaagccaccccauagauga

SEQ ID NO: 1062774 - RNA, 19 nt, Homo sapiens
uaugagaugaggaaacaga

SEQ ID NO: 1062775 - RNA, 19 nt, Homo sapiens
gggcaagggaugcaaagca

SEQ ID NO: 1062776 - RNA, 19 nt, Homo sapiens
caaggaacucugcuucuac

SEQ ID NO: 1062777 - RNA, 19 nt, Homo sapiens
uggugucccuccaggcuaa

SEQ ID NO: 1062778 - RNA, 19 nt, Homo sapiens
gugagaggguagccuggau

SEQ ID NO: 1062779 - RNA, 19 nt, Homo sapiens
agaauaaaguccccaagau

SEQ ID NO: 1062780 - RNA, 19 nt, Homo sapiens
cuccugggcucaugcaauc

SEQ ID NO: 1062781 - RNA, 19 nt, Homo sapiens
cuuuguaggugugugauug

SEQ ID NO: 1062782 - RNA, 19 nt, Homo sapiens
ggagccugggaaaguguua

SEQ ID NO: 1062783 - RNA, 19 nt, Homo sapiens
ggucaagggagagaacuca

SEQ ID NO: 1062784 - RNA, 19 nt, Homo sapiens
cucccaaugugcuggaauu

SEQ ID NO: 1062785 - RNA, 19 nt, Homo sapiens
aguugaagaucugcaguga

SEQ ID NO: 1062786 - RNA, 19 nt, Homo sapiens
cuuaaccacccuacuaugu

SEQ ID NO: 1062787 - RNA, 19 nt, Homo sapiens
cccaaacccagggcucuua

SEQ ID NO: 1062788 - RNA, 19 nt, Homo sapiens
ucagcuuccuuacccuaug

SEQ ID NO: 1062789 - RNA, 19 nt, Homo sapiens
cagagaggcagcuaagucu

SEQ ID NO: 1062790 - RNA, 19 nt, Homo sapiens
acagagaggcagcuaaguc

SEQ ID NO: 1062791 - RNA, 19 nt, Homo sapiens
gagccaaggagugcaagug

SEQ ID NO: 1062792 - RNA, 19 nt, Homo sapiens
cagcgaggguuggucucaa

SEQ ID NO: 1062793 - RNA, 19 nt, Homo sapiens
ucacuugccacaggacuug

SEQ ID NO: 1062794 - RNA, 19 nt, Homo sapiens
gaugaggaaacagaucuuc

SEQ ID NO: 1062795 - RNA, 19 nt, Homo sapiens
gaggagccaaggagugcaa

SEQ ID NO: 1062796 - RNA, 19 nt, Homo sapiens
ucccagccguggucagaga

SEQ ID NO: 1062797 - RNA, 19 nt, Homo sapiens
gcuggaauuacagguauga

SEQ ID NO: 1062798 - RNA, 19 nt, Homo sapiens
uggccucuauucuggauuc

SEQ ID NO: 1062799 - RNA, 19 nt, Homo sapiens
uuacagagaggcagcuaag

SEQ ID NO: 1062800 - RNA, 19 nt, Homo sapiens
gaggguagccuggauuagc

SEQ ID NO: 1062801 - RNA, 19 nt, Homo sapiens
agaccucugugaccucagu

SEQ ID NO: 1062802 - RNA, 19 nt, Homo sapiens
gaagcggacucccaaauuu

SEQ ID NO: 1062803 - RNA, 19 nt, Homo sapiens
cagauugccuucaucauuu

SEQ ID NO: 1062804 - RNA, 19 nt, Homo sapiens
gaagauuuguggccagauu

SEQ ID NO: 1062805 - RNA, 19 nt, Homo sapiens
gaacggagguggacauugc

SEQ ID NO: 1062806 - RNA, 19 nt, Homo sapiens
ucacugagauucugaugaa

SEQ ID NO: 1062807 - RNA, 19 nt, Homo sapiens
gaaaaugccugucucucua

SEQ ID NO: 1062808 - RNA, 19 nt, Homo sapiens
ggaugaugauggaaauaaa

SEQ ID NO: 1062809 - RNA, 19 nt, Homo sapiens
ucacaaggaugaugaugga

SEQ ID NO: 1062810 - RNA, 19 nt, Homo sapiens
ggaaugucuucgucaguga

SEQ ID NO: 1062811 - RNA, 19 nt, Homo sapiens
caaggaugaugauggaaau

SEQ ID NO: 1062812 - RNA, 19 nt, Homo sapiens
ggagaugcaugcccugaag

SEQ ID NO: 1062813 - RNA, 19 nt, Homo sapiens
ccagauugccuucaucauu

SEQ ID NO: 1062814 - RNA, 19 nt, Homo sapiens
gaaccaaggugcugauccu

SEQ ID NO: 1062815 - RNA, 19 nt, Homo sapiens
ucagugagcugcuggaaac

SEQ ID NO: 1062816 - RNA, 19 nt, Homo sapiens
uaaaaugacuggcgugaug

SEQ ID NO: 1062817 - RNA, 19 nt, Homo sapiens
gaugugcuaugcccagaau

SEQ ID NO: 1062818 - RNA, 19 nt, Homo sapiens
gaacugaggcccacguacu

SEQ ID NO: 1062819 - RNA, 19 nt, Homo sapiens
ucucucuacuugaaugaua

SEQ ID NO: 1062820 - RNA, 19 nt, Homo sapiens
gugcugauccuaccaccua

SEQ ID NO: 1062821 - RNA, 19 nt, Homo sapiens
gagaagcggacucccaaau

SEQ ID NO: 1062822 - RNA, 19 nt, Homo sapiens
agacuuccauuucuucaca

SEQ ID NO: 1062823 - RNA, 19 nt, Homo sapiens
gcuucacccuggcuagaaa

SEQ ID NO: 1062824 - RNA, 19 nt, Homo sapiens
ggauccagaaggaagauuu

SEQ ID NO: 1062825 - RNA, 19 nt, Homo sapiens
ugaaggagcgggaacagau

SEQ ID NO: 1062826 - RNA, 19 nt, Homo sapiens
gaccaagggaucacugaga

SEQ ID NO: 1062827 - RNA, 19 nt, Homo sapiens
gaaggagcgggaacagaug

SEQ ID NO: 1062828 - RNA, 19 nt, Homo sapiens
gccugucucucuacuugaa

SEQ ID NO: 1062829 - RNA, 19 nt, Homo sapiens
caagggaucacugagauuc

SEQ ID NO: 1062830 - RNA, 19 nt, Homo sapiens
agaagcggacucccaaauu

SEQ ID NO: 1062831 - RNA, 19 nt, Homo sapiens
cacccuggcuagaaauaau

SEQ ID NO: 1062832 - RNA, 19 nt, Homo sapiens
gauccagaaggaagauuug

SEQ ID NO: 1062833 - RNA, 19 nt, Homo sapiens
acaaggaugaugauggaaa

SEQ ID NO: 1062834 - RNA, 19 nt, Homo sapiens
gcaggauccagaaggaaga

SEQ ID NO: 1062835 - RNA, 19 nt, Homo sapiens
agagcaggauccagaagga

SEQ ID NO: 1062836 - RNA, 19 nt, Homo sapiens
uuucaccucuccagacuuc

SEQ ID NO: 1062837 - RNA, 19 nt, Homo sapiens
gaagagcaggauccagaag

SEQ ID NO: 1062838 - RNA, 19 nt, Homo sapiens
ugggcaaaguagccauuaa

SEQ ID NO: 1062839 - RNA, 19 nt, Homo sapiens
ggagguggacauugcaucu

SEQ ID NO: 1062840 - RNA, 19 nt, Homo sapiens
gguuggguuugcuuuggaa

SEQ ID NO: 1062841 - RNA, 19 nt, Homo sapiens
ggaaaaugccugucucucu

SEQ ID NO: 1062842 - RNA, 19 nt, Homo sapiens
ggguuggguuugcuuugga

SEQ ID NO: 1062843 - RNA, 19 nt, Homo sapiens
gugagcugcuggaaacucu

SEQ ID NO: 1062844 - RNA, 19 nt, Homo sapiens
gagcaggauccagaaggaa

SEQ ID NO: 1062845 - RNA, 19 nt, Homo sapiens
gugcuaugcccagaauauu

SEQ ID NO: 1062846 - RNA, 19 nt, Homo sapiens
ccauugaagggaugugcua

SEQ ID NO: 1062847 - RNA, 19 nt, Homo sapiens
gggcaaaguagccauuaac

SEQ ID NO: 1062848 - RNA, 19 nt, Homo sapiens
ggccgacgacugaguggaa

SEQ ID NO: 1062849 - RNA, 19 nt, Homo sapiens
uuccauuucuucacaagga

SEQ ID NO: 1062850 - RNA, 19 nt, Homo sapiens
ccaagggaucacugagauu

SEQ ID NO: 1062851 - RNA, 19 nt, Homo sapiens
ugaagagcaggauccagaa

SEQ ID NO: 1062852 - RNA, 19 nt, Homo sapiens
gagaugcaugcccugaaga

SEQ ID NO: 1062853 - RNA, 19 nt, Homo sapiens
gucaugggacugauugaga

SEQ ID NO: 1062854 - RNA, 19 nt, Homo sapiens
augccugucucucuacuug

SEQ ID NO: 1062855 - RNA, 19 nt, Homo sapiens
aggaugaugauggaaauaa

SEQ ID NO: 1062856 - RNA, 19 nt, Homo sapiens
accaagggaucacugagau

SEQ ID NO: 1062857 - RNA, 19 nt, Homo sapiens
ucuccagacuuccauuucu

SEQ ID NO: 1062858 - RNA, 19 nt, Homo sapiens
ucacgaggguuggguuugc

SEQ ID NO: 1062859 - RNA, 19 nt, Homo sapiens
cuccagacuuccauuucuu

SEQ ID NO: 1062860 - RNA, 19 nt, Homo sapiens
agauugccuucaucauuuc

SEQ ID NO: 1062861 - RNA, 19 nt, Homo sapiens
ggccagauugccuucauca

SEQ ID NO: 1062862 - RNA, 19 nt, Homo sapiens
gggagaugcaugcccugaa

SEQ ID NO: 1062863 - RNA, 19 nt, Homo sapiens
aagcggacucccaaauuug

SEQ ID NO: 1062864 - RNA, 19 nt, Homo sapiens
ggaacggagguggacauug

SEQ ID NO: 1062865 - RNA, 19 nt, Homo sapiens
gaggguuggguuugcuuug

SEQ ID NO: 1062866 - RNA, 19 nt, Homo sapiens
cauuucaccucuccagacu

SEQ ID NO: 1062867 - RNA, 19 nt, Homo sapiens
gugcguguccugcucuuca

SEQ ID NO: 1062868 - RNA, 19 nt, Homo sapiens
gaacaccaauuaaugcuaa

SEQ ID NO: 1062869 - RNA, 19 nt, Homo sapiens
gaaaggcucuggaaagaug

SEQ ID NO: 1062870 - RNA, 19 nt, Homo sapiens
gagcagaccucuacggauu

SEQ ID NO: 1062871 - RNA, 19 nt, Homo sapiens
ggaaggcucuugaugaaau

SEQ ID NO: 1062872 - RNA, 19 nt, Homo sapiens
gcagaaaacucaacaauau

SEQ ID NO: 1062873 - RNA, 19 nt, Homo sapiens
ucauagcacuugccauuua

SEQ ID NO: 1062874 - RNA, 19 nt, Homo sapiens
cagagaagcugaugcagaa

SEQ ID NO: 1062875 - RNA, 19 nt, Homo sapiens
cagaaguacuggaaucaua

SEQ ID NO: 1062876 - RNA, 19 nt, Homo sapiens
agagaaagcuguugugguu

SEQ ID NO: 1062877 - RNA, 19 nt, Homo sapiens
gaggaaaccugaagcaagu

SEQ ID NO: 1062878 - RNA, 19 nt, Homo sapiens
gaaccuuucuccaguuguu

SEQ ID NO: 1062879 - RNA, 19 nt, Homo sapiens
ggaagcagcuaggcaugaa

SEQ ID NO: 1062880 - RNA, 19 nt, Homo sapiens
ggaaaauggugauaaaaga

SEQ ID NO: 1062881 - RNA, 19 nt, Homo sapiens
gcaguuugaugaugaagau

SEQ ID NO: 1062882 - RNA, 19 nt, Homo sapiens
gugagcagguugauagaaa

SEQ ID NO: 1062883 - RNA, 19 nt, Homo sapiens
gauggaaggcucuugauga

SEQ ID NO: 1062884 - RNA, 19 nt, Homo sapiens
gagaacaaccaccacguuu

SEQ ID NO: 1062885 - RNA, 19 nt, Homo sapiens
ucaguaagaugauguuaag

SEQ ID NO: 1062886 - RNA, 19 nt, Homo sapiens
gaaacuggaggcagaaaug

SEQ ID NO: 1062887 - RNA, 19 nt, Homo sapiens
cagagaagccaaagagaaa

SEQ ID NO: 1062888 - RNA, 19 nt, Homo sapiens
cauagcacuugccauuuaa

SEQ ID NO: 1062889 - RNA, 19 nt, Homo sapiens
gaagaaaugauccgacaca

SEQ ID NO: 1062890 - RNA, 19 nt, Homo sapiens
gcaugaacaccaauuaaug

SEQ ID NO: 1062891 - RNA, 19 nt, Homo sapiens
gcaagugcgcauugaguaa

SEQ ID NO: 1062892 - RNA, 19 nt, Homo sapiens
gaugaucgcgguagagcua

SEQ ID NO: 1062893 - RNA, 19 nt, Homo sapiens
caaauacaacuaagacaug

SEQ ID NO: 1062894 - RNA, 19 nt, Homo sapiens
gcaaauacaacuaagacau

SEQ ID NO: 1062895 - RNA, 19 nt, Homo sapiens
aagaugauguuaagaggaa

SEQ ID NO: 1062896 - RNA, 19 nt, Homo sapiens
gcacgaaaggcucuggaaa

SEQ ID NO: 1062897 - RNA, 19 nt, Homo sapiens
gcaagcauuuucucaguuu

SEQ ID NO: 1062898 - RNA, 19 nt, Homo sapiens
gaagcaaauacaacuaaga

SEQ ID NO: 1062899 - RNA, 19 nt, Homo sapiens
ggaagcaaauacaacuaag

SEQ ID NO: 1062900 - RNA, 19 nt, Homo sapiens
gauagaaacaucagagaag

SEQ ID NO: 1062901 - RNA, 19 nt, Homo sapiens
aaucauagcacuugccauu

SEQ ID NO: 1062902 - RNA, 19 nt, Homo sapiens
gaaguuacccgaaguucag

SEQ ID NO: 1062903 - RNA, 19 nt, Homo sapiens
cacacugucuuuaaaucua

SEQ ID NO: 1062904 - RNA, 19 nt, Homo sapiens
gaaggcucuugaugaaaug

SEQ ID NO: 1062905 - RNA, 19 nt, Homo sapiens
ggacauuugaauuugagua

SEQ ID NO: 1062906 - RNA, 19 nt, Homo sapiens
ccauggagcaguuugauga

SEQ ID NO: 1062907 - RNA, 19 nt, Homo sapiens
ggagcaguuugaugaugaa

SEQ ID NO: 1062908 - RNA, 19 nt, Homo sapiens
caucaagaguuuccucaag

SEQ ID NO: 1062909 - RNA, 19 nt, Homo sapiens
acaagcaguuuauggaugu

SEQ ID NO: 1062910 - RNA, 19 nt, Homo sapiens
gaaaauguggcugaaguua

SEQ ID NO: 1062911 - RNA, 19 nt, Homo sapiens
gcagguugauagaaacauc

SEQ ID NO: 1062912 - RNA, 19 nt, Homo sapiens
gaggcgaacucaguaagau

SEQ ID NO: 1062913 - RNA, 19 nt, Homo sapiens
acgaaaggcucuggaaaga

SEQ ID NO: 1062914 - RNA, 19 nt, Homo sapiens
cuaucgacaucaagaguuu

SEQ ID NO: 1062915 - RNA, 19 nt, Homo sapiens
gcaguguaauucagaagag

SEQ ID NO: 1062916 - RNA, 19 nt, Homo sapiens
ucagagaagccaaagagaa

SEQ ID NO: 1062917 - RNA, 19 nt, Homo sapiens
gaacucaguaagaugaugu

SEQ ID NO: 1062918 - RNA, 19 nt, Homo sapiens
gaacaaccaccacguuuug

SEQ ID NO: 1062919 - RNA, 19 nt, Homo sapiens
agaaagcuguugugguugu

SEQ ID NO: 1062920 - RNA, 19 nt, Homo sapiens
ggaugucugggcaaucaua

SEQ ID NO: 1062921 - RNA, 19 nt, Homo sapiens
aaugaggcgucaagaagaa

SEQ ID NO: 1062922 - RNA, 19 nt, Homo sapiens
aaguucagcuugcagugua

SEQ ID NO: 1062923 - RNA, 19 nt, Homo sapiens
uggagcaguuugaugauga

SEQ ID NO: 1062924 - RNA, 19 nt, Homo sapiens
ugaagcaagugcgcauuga

SEQ ID NO: 1062925 - RNA, 19 nt, Homo sapiens
aagccaaacuacauggaaa

SEQ ID NO: 1062926 - RNA, 19 nt, Homo sapiens
cuaaugaggcaagaucuaa

SEQ ID NO: 1062927 - RNA, 19 nt, Homo sapiens
agaguuaagaccagaagua

SEQ ID NO: 1062928 - RNA, 19 nt, Homo sapiens
ggaagaacucagaaaccaa

SEQ ID NO: 1062929 - RNA, 19 nt, Homo sapiens
gcuaaugaggcaagaucua

SEQ ID NO: 1062930 - RNA, 19 nt, Homo sapiens
gaccguggcuucggcuuca

SEQ ID NO: 1062931 - RNA, 19 nt, Homo sapiens
guuaagaccagaaguacug

SEQ ID NO: 1062932 - RNA, 19 nt, Homo sapiens
gaaacaagacagaaaacaa

SEQ ID NO: 1062933 - RNA, 19 nt, Homo sapiens
cggaagcaaauacaacuaa

SEQ ID NO: 1062934 - RNA, 19 nt, Homo sapiens
aaacaucagagaagccaaa

SEQ ID NO: 1062935 - RNA, 19 nt, Homo sapiens
gaaaucugcccaccgacau

SEQ ID NO: 1062936 - RNA, 19 nt, Homo sapiens
caaacuacauggaaaaugg

SEQ ID NO: 1062937 - RNA, 19 nt, Homo sapiens
ggcaugaacaccaauuaau

SEQ ID NO: 1062938 - RNA, 19 nt, Homo sapiens
auggaaggcucuugaugaa

SEQ ID NO: 1062939 - RNA, 19 nt, Homo sapiens
ggacggcaccauucucaag

SEQ ID NO: 1062940 - RNA, 19 nt, Homo sapiens
caagugcgcauugaguaaa

SEQ ID NO: 1062941 - RNA, 19 nt, Homo sapiens
cuaccuagcggucucuuga

SEQ ID NO: 1062942 - RNA, 19 nt, Homo sapiens
ggagaaacaagacagaaaa

SEQ ID NO: 1062943 - RNA, 19 nt, Homo sapiens
guguaauucagaagaguua

SEQ ID NO: 1062944 - RNA, 19 nt, Homo sapiens
uaaugaggcgucaagaaga

SEQ ID NO: 1062945 - RNA, 19 nt, Homo sapiens
ucucuugauugucgauauu

SEQ ID NO: 1062946 - RNA, 19 nt, Homo sapiens
gaaagcuguugugguugug

SEQ ID NO: 1062947 - RNA, 19 nt, Homo sapiens
gagcuggacggcaccauuc

SEQ ID NO: 1062948 - RNA, 19 nt, Homo sapiens
gaaguucagcuugcagugu

SEQ ID NO: 1062949 - RNA, 19 nt, Homo sapiens
cuaaugaggcgucaagaag

SEQ ID NO: 1062950 - RNA, 19 nt, Homo sapiens
caucagagaagccaaagag

SEQ ID NO: 1062951 - RNA, 19 nt, Homo sapiens
ccugggacauuugaauuug

SEQ ID NO: 1062952 - RNA, 19 nt, Homo sapiens
cuagcggucucuugauugu

SEQ ID NO: 1062953 - RNA, 19 nt, Homo sapiens
ugaccuaggagaaacaaga

SEQ ID NO: 1062954 - RNA, 19 nt, Homo sapiens
uggaagaacucagaaacca

SEQ ID NO: 1062955 - RNA, 19 nt, Homo sapiens
gcagaaauggaagcagcua

SEQ ID NO: 1062956 - RNA, 19 nt, Homo sapiens
caaccugggacauuugaau

SEQ ID NO: 1062957 - RNA, 19 nt, Homo sapiens
ggcgaacucaguaagauga

SEQ ID NO: 1062958 - RNA, 19 nt, Homo sapiens
cauggaaaauggugauaaa

SEQ ID NO: 1062959 - RNA, 19 nt, Homo sapiens
gaucuaaugaggcgucaag

SEQ ID NO: 1062960 - RNA, 19 nt, Homo sapiens
gaaucauacuuccuuucag

SEQ ID NO: 1062961 - RNA, 19 nt, Homo sapiens
gaagaguuaagaccagaag

SEQ ID NO: 1062962 - RNA, 19 nt, Homo sapiens
cuggaaagauguggugaug

SEQ ID NO: 1062963 - RNA, 19 nt, Homo sapiens
gagcaagcauuuucucagu

SEQ ID NO: 1062964 - RNA, 19 nt, Homo sapiens
ucgcuucgcuacacaugga

SEQ ID NO: 1062965 - RNA, 19 nt, Homo sapiens
gauggggcauucuugcuaa

SEQ ID NO: 1062966 - RNA, 19 nt, Homo sapiens
gcagcagcgugagcagguu

SEQ ID NO: 1062967 - RNA, 19 nt, Homo sapiens
cuccaguuguuuccaauga

SEQ ID NO: 1062968 - RNA, 19 nt, Homo sapiens
gcaguacucuucucacuaa

SEQ ID NO: 1062969 - RNA, 19 nt, Homo sapiens
guaauaggcugaaugcaaa

SEQ ID NO: 1062970 - RNA, 19 nt, Homo sapiens
gauacaagauuccagcuuu

SEQ ID NO: 1062971 - RNA, 19 nt, Homo sapiens
gaaggagaauuaccauuau

SEQ ID NO: 1062972 - RNA, 19 nt, Homo sapiens
ggaguaggaugcagucaaa

SEQ ID NO: 1062973 - RNA, 19 nt, Homo sapiens
guacucuucucacuaauuu

SEQ ID NO: 1062974 - RNA, 19 nt, Homo sapiens
caaaggaaaucaucucuag

SEQ ID NO: 1062975 - RNA, 19 nt, Homo sapiens
gaaggagucuugcucuguu

SEQ ID NO: 1062976 - RNA, 19 nt, Homo sapiens
caaauuugccuuaguguuu

SEQ ID NO: 1062977 - RNA, 19 nt, Homo sapiens
caccacaccuggcuaauuu

SEQ ID NO: 1062978 - RNA, 19 nt, Homo sapiens
gaccugaauucaaauauug

SEQ ID NO: 1062979 - RNA, 19 nt, Homo sapiens
guaaucugcuuuccauauu

SEQ ID NO: 1062980 - RNA, 19 nt, Homo sapiens
ggaagaaugugcucaaagg

SEQ ID NO: 1062981 - RNA, 19 nt, Homo sapiens
ccgaguagcugggauuaua

SEQ ID NO: 1062982 - RNA, 19 nt, Homo sapiens
auagagaccugaauucaaa

SEQ ID NO: 1062983 - RNA, 19 nt, Homo sapiens
gaacaaggcuaugauccau

SEQ ID NO: 1062984 - RNA, 19 nt, Homo sapiens
gggagaggguaauauauug

SEQ ID NO: 1062985 - RNA, 19 nt, Homo sapiens
agaaggagaauuaccauua

SEQ ID NO: 1062986 - RNA, 19 nt, Homo sapiens
ggaugugacucaugauuca

SEQ ID NO: 1062987 - RNA, 19 nt, Homo sapiens
ggaauaggacaggucauua

SEQ ID NO: 1062988 - RNA, 19 nt, Homo sapiens
gagcagugguugucaaagu

SEQ ID NO: 1062989 - RNA, 19 nt, Homo sapiens
gacaaaccaucuaauaucu

SEQ ID NO: 1062990 - RNA, 19 nt, Homo sapiens
ugagacaaaccaucuaaua

SEQ ID NO: 1062991 - RNA, 19 nt, Homo sapiens
acaaggcuaugauccauuu

SEQ ID NO: 1062992 - RNA, 19 nt, Homo sapiens
caaaccaucuaauaucugu

SEQ ID NO: 1062993 - RNA, 19 nt, Homo sapiens
gagacaaaccaucuaauau

SEQ ID NO: 1062994 - RNA, 19 nt, Homo sapiens
gcuaugauccauuuaaaga

SEQ ID NO: 1062995 - RNA, 19 nt, Homo sapiens
ucauugagaaggagaauua

SEQ ID NO: 1062996 - RNA, 19 nt, Homo sapiens
caucagacauugaagagau

SEQ ID NO: 1062997 - RNA, 19 nt, Homo sapiens
agacacagaauacaugaua

SEQ ID NO: 1062998 - RNA, 19 nt, Homo sapiens
uaccucagcuucccgagua

SEQ ID NO: 1062999 - RNA, 19 nt, Homo sapiens
guccuuauaugaagagauu

SEQ ID NO: 1063000 - RNA, 19 nt, Homo sapiens
uuaauaggcugugauguug

SEQ ID NO: 1063001 - RNA, 19 nt, Homo sapiens
guaggaugcagucaaauuu

SEQ ID NO: 1063002 - RNA, 19 nt, Homo sapiens
gaaauguaaagcagcagua

SEQ ID NO: 1063003 - RNA, 19 nt, Homo sapiens
ggugaaaccugggaagaau

SEQ ID NO: 1063004 - RNA, 19 nt, Homo sapiens
ucaaauagagaccugaauu

SEQ ID NO: 1063005 - RNA, 19 nt, Homo sapiens
gacacagaauacaugauaa

SEQ ID NO: 1063006 - RNA, 19 nt, Homo sapiens
uaaagaagaucugaaccau

SEQ ID NO: 1063007 - RNA, 19 nt, Homo sapiens
caagugaucugcccaucuc

SEQ ID NO: 1063008 - RNA, 19 nt, Homo sapiens
ccucaguugugaauucuuu

SEQ ID NO: 1063009 - RNA, 19 nt, Homo sapiens
uaaagcagcaguacucuuc

SEQ ID NO: 1063010 - RNA, 19 nt, Homo sapiens
gguuggagcuggcaguuuc

SEQ ID NO: 1063011 - RNA, 19 nt, Homo sapiens
gaagugagacaaaccaucu

SEQ ID NO: 1063012 - RNA, 19 nt, Homo sapiens
gaauaggacaggucauuag

SEQ ID NO: 1063013 - RNA, 19 nt, Homo sapiens
caacuuacagggaauagga

SEQ ID NO: 1063014 - RNA, 19 nt, Homo sapiens
gaguauggcuguugcaaaa

SEQ ID NO: 1063015 - RNA, 19 nt, Homo sapiens
gguaaucugcuuuccauau

SEQ ID NO: 1063016 - RNA, 19 nt, Homo sapiens
gauuccagcuuucgucugu

SEQ ID NO: 1063017 - RNA, 19 nt, Homo sapiens
uugaagagauuuggagaaa

SEQ ID NO: 1063018 - RNA, 19 nt, Homo sapiens
ccaaagugcugggauuaca

SEQ ID NO: 1063019 - RNA, 19 nt, Homo sapiens
caagaauaaggucugguua

SEQ ID NO: 1063020 - RNA, 19 nt, Homo sapiens
gaaaggagaaguggaugug

SEQ ID NO: 1063021 - RNA, 19 nt, Homo sapiens
gugcugggauuacagguau

SEQ ID NO: 1063022 - RNA, 19 nt, Homo sapiens
gguccaggguccuuauaug

SEQ ID NO: 1063023 - RNA, 19 nt, Homo sapiens
caaauagagaccugaauuc

SEQ ID NO: 1063024 - RNA, 19 nt, Homo sapiens
ggagaauuaccauuauguu

SEQ ID NO: 1063025 - RNA, 19 nt, Homo sapiens
caagagaagugagacaaac

SEQ ID NO: 1063026 - RNA, 19 nt, Homo sapiens
gcccagccaucauuuaucu

SEQ ID NO: 1063027 - RNA, 19 nt, Homo sapiens
gcugugauguugaguuucu

SEQ ID NO: 1063028 - RNA, 19 nt, Homo sapiens
agacaaaccaucuaauauc

SEQ ID NO: 1063029 - RNA, 19 nt, Homo sapiens
gggaauaggacaggucauu

SEQ ID NO: 1063030 - RNA, 19 nt, Homo sapiens
ggcacgaucucagcucauu

SEQ ID NO: 1063031 - RNA, 19 nt, Homo sapiens
ggguguauuucccagguuu

SEQ ID NO: 1063032 - RNA, 19 nt, Homo sapiens
caccuggguucaagcaauu

SEQ ID NO: 1063033 - RNA, 19 nt, Homo sapiens
ccaccuggguucaagcaau

SEQ ID NO: 1063034 - RNA, 19 nt, Homo sapiens
gcagucaaauuugccuuag

SEQ ID NO: 1063035 - RNA, 19 nt, Homo sapiens
gaacaacuccauuuuaucu

SEQ ID NO: 1063036 - RNA, 19 nt, Homo sapiens
ccacaacgcccagccauca

SEQ ID NO: 1063037 - RNA, 19 nt, Homo sapiens
uugagaaucuaaaccaaga

SEQ ID NO: 1063038 - RNA, 19 nt, Homo sapiens
ccagccaucauuuaucuuu

SEQ ID NO: 1063039 - RNA, 19 nt, Homo sapiens
caucucagccucccaaagu

SEQ ID NO: 1063040 - RNA, 19 nt, Homo sapiens
agucaaauuugccuuagug

SEQ ID NO: 1063041 - RNA, 19 nt, Homo sapiens
uagcuugcauggaguagga

SEQ ID NO: 1063042 - RNA, 19 nt, Homo sapiens
ggacugcguuguuuaaaag

SEQ ID NO: 1063043 - RNA, 19 nt, Homo sapiens
uguaauaggcugaaugcaa

SEQ ID NO: 1063044 - RNA, 19 nt, Homo sapiens
caucuggaguucggugaaa

SEQ ID NO: 1063045 - RNA, 19 nt, Homo sapiens
ccaagagaagugagacaaa

SEQ ID NO: 1063046 - RNA, 19 nt, Homo sapiens
gaacuccugagcucaagug

SEQ ID NO: 1063047 - RNA, 19 nt, Homo sapiens
aggcugugauguugaguuu

SEQ ID NO: 1063048 - RNA, 19 nt, Homo sapiens
gaaucuaaaccaagagaag

SEQ ID NO: 1063049 - RNA, 19 nt, Homo sapiens
gagaaucuaaaccaagaga

SEQ ID NO: 1063050 - RNA, 19 nt, Homo sapiens
ugugauugccaguuuauuu

SEQ ID NO: 1063051 - RNA, 19 nt, Homo sapiens
gaggcgcucucgcuuugau

SEQ ID NO: 1063052 - RNA, 19 nt, Homo sapiens
caacgcccagccaucauuu

SEQ ID NO: 1063053 - RNA, 19 nt, Homo sapiens
cuccugagcucaagugauc

SEQ ID NO: 1063054 - RNA, 19 nt, Homo sapiens
ccaggguccuuauaugaag

SEQ ID NO: 1063055 - RNA, 19 nt, Homo sapiens
gagaaggagaauuaccauu

SEQ ID NO: 1063056 - RNA, 19 nt, Homo sapiens
gagaaguggaugugacuca

SEQ ID NO: 1063057 - RNA, 19 nt, Homo sapiens
gugauugccaguuuauuug

SEQ ID NO: 1063058 - RNA, 19 nt, Homo sapiens
aggcuaugauccauuuaaa

SEQ ID NO: 1063059 - RNA, 19 nt, Homo sapiens
aaguggaugugacucauga

SEQ ID NO: 1063060 - RNA, 19 nt, Homo sapiens
uauuugcagucucuuaaug

SEQ ID NO: 1063061 - RNA, 19 nt, Homo sapiens
gaaguggaugugacucaug

SEQ ID NO: 1063062 - RNA, 19 nt, Homo sapiens
gaggaaaggcucgguugga

SEQ ID NO: 1063063 - RNA, 19 nt, Homo sapiens
guccaggguccuuauauga

SEQ ID NO: 1063064 - RNA, 19 nt, Homo sapiens
uuucccagguuuccaauug

SEQ ID NO: 1063065 - RNA, 19 nt, Homo sapiens
ggagaggguaauauauugu

SEQ ID NO: 1063066 - RNA, 19 nt, Homo sapiens
ccaaauuuguugauuaccu

SEQ ID NO: 1063067 - RNA, 19 nt, Homo sapiens
cggaacaacuccauuuuau

SEQ ID NO: 1063068 - RNA, 19 nt, Homo sapiens
gaacuuggacuacugauua

SEQ ID NO: 1063069 - RNA, 19 nt, Homo sapiens
gggaaacagugggaaguaa

SEQ ID NO: 1063070 - RNA, 19 nt, Homo sapiens
gaucuccucccuuguuuaa

SEQ ID NO: 1063071 - RNA, 19 nt, Homo sapiens
uagcggaucucccacuuug

SEQ ID NO: 1063072 - RNA, 19 nt, Homo sapiens
guuggaaacuuuguaaugu

SEQ ID NO: 1063073 - RNA, 19 nt, Homo sapiens
ggagcgcgaugacuucgau

SEQ ID NO: 1063074 - RNA, 19 nt, Homo sapiens
uacagaugauggagaguuu

SEQ ID NO: 1063075 - RNA, 19 nt, Homo sapiens
aaacugagcgagacuagug

SEQ ID NO: 1063076 - RNA, 19 nt, Homo sapiens
ggacugguucaauucguuu

SEQ ID NO: 1063077 - RNA, 19 nt, Homo sapiens
gggaggugcguccuuguuu

SEQ ID NO: 1063078 - RNA, 19 nt, Homo sapiens
ucuccucccuuguuuaaau

SEQ ID NO: 1063079 - RNA, 19 nt, Homo sapiens
gaucaagcggcacgugcua

SEQ ID NO: 1063080 - RNA, 19 nt, Homo sapiens
guacagaugauggagaguu

SEQ ID NO: 1063081 - RNA, 19 nt, Homo sapiens
cuuggacuacugauuauua

SEQ ID NO: 1063082 - RNA, 19 nt, Homo sapiens
uggaggacuuugucacuug

SEQ ID NO: 1063083 - RNA, 19 nt, Homo sapiens
ggguauuguuggcuucuug

SEQ ID NO: 1063084 - RNA, 19 nt, Homo sapiens
uccaggaaauguucuuaga

SEQ ID NO: 1063085 - RNA, 19 nt, Homo sapiens
ggaggugcguccuuguuuu

SEQ ID NO: 1063086 - RNA, 19 nt, Homo sapiens
gagcgagacuaguguucag

SEQ ID NO: 1063087 - RNA, 19 nt, Homo sapiens
ucguuuaacucgaauucuu

SEQ ID NO: 1063088 - RNA, 19 nt, Homo sapiens
agacuaguguucaggaucu

SEQ ID NO: 1063089 - RNA, 19 nt, Homo sapiens
ugguuggacugguucaauu

SEQ ID NO: 1063090 - RNA, 19 nt, Homo sapiens
ggaucuccucccuuguuua

SEQ ID NO: 1063091 - RNA, 19 nt, Homo sapiens
gaaacagugggaaguaacu

SEQ ID NO: 1063092 - RNA, 19 nt, Homo sapiens
ggacuacacgcgcuacaac

SEQ ID NO: 1063093 - RNA, 19 nt, Homo sapiens
gaugcuggagauucuauga

SEQ ID NO: 1063094 - RNA, 19 nt, Homo sapiens
agacggucguagguucuua

SEQ ID NO: 1063095 - RNA, 19 nt, Homo sapiens
agaguuuggccucaaguuu

SEQ ID NO: 1063096 - RNA, 19 nt, Homo sapiens
gagaguuuggccucaaguu

SEQ ID NO: 1063097 - RNA, 19 nt, Homo sapiens
ggaaacagugggaaguaac

SEQ ID NO: 1063098 - RNA, 19 nt, Homo sapiens
ggcacgugcuagaguacaa

SEQ ID NO: 1063099 - RNA, 19 nt, Homo sapiens
gcauggcgcagcaccuuca

SEQ ID NO: 1063100 - RNA, 19 nt, Homo sapiens
ccaccgugcuccucaagcu

SEQ ID NO: 1063101 - RNA, 19 nt, Homo sapiens
auuguuggcuucuuguguu

SEQ ID NO: 1063102 - RNA, 19 nt, Homo sapiens
gacugugccuugggaaaca

SEQ ID NO: 1063103 - RNA, 19 nt, Homo sapiens
gugcucuccucaaggguau

SEQ ID NO: 1063104 - RNA, 19 nt, Homo sapiens
acaaugaggagcgcgauga

SEQ ID NO: 1063105 - RNA, 19 nt, Homo sapiens
cgagacuaguguucaggau

SEQ ID NO: 1063106 - RNA, 19 nt, Homo sapiens
uggacugguucaauucguu

SEQ ID NO: 1063107 - RNA, 19 nt, Homo sapiens
cuuagaacuuggacuacug

SEQ ID NO: 1063108 - RNA, 19 nt, Homo sapiens
gcggaucucccacuuugca

SEQ ID NO: 1063109 - RNA, 19 nt, Homo sapiens
ccuagcggaucucccacuu

SEQ ID NO: 1063110 - RNA, 19 nt, Homo sapiens
gaguuuggccucaaguuuu

SEQ ID NO: 1063111 - RNA, 19 nt, Homo sapiens
cacgcccuguuucccuuua

SEQ ID NO: 1063112 - RNA, 19 nt, Homo sapiens
gacggucguagguucuuaa

SEQ ID NO: 1063113 - RNA, 19 nt, Homo sapiens
gaaauaaccuacagucuua

SEQ ID NO: 1063114 - RNA, 19 nt, Homo sapiens
gaagagaucccuaaccuau

SEQ ID NO: 1063115 - RNA, 19 nt, Homo sapiens
gaacagacuuggcguugga

SEQ ID NO: 1063116 - RNA, 19 nt, Homo sapiens
ggauuucugugcuauuaua

SEQ ID NO: 1063117 - RNA, 19 nt, Homo sapiens
guaccgagcucuccugcua

SEQ ID NO: 1063118 - RNA, 19 nt, Homo sapiens
ugacucaugucuucuuuaa

SEQ ID NO: 1063119 - RNA, 19 nt, Homo sapiens
aaacagcucucguggcaaa

SEQ ID NO: 1063120 - RNA, 19 nt, Homo sapiens
caucuucccuugucucauu

SEQ ID NO: 1063121 - RNA, 19 nt, Homo sapiens
gcacagcauuagacaguau

SEQ ID NO: 1063122 - RNA, 19 nt, Homo sapiens
gucaggaacuuuauaaugu

SEQ ID NO: 1063123 - RNA, 19 nt, Homo sapiens
aaagucaacuguacauuuc

SEQ ID NO: 1063124 - RNA, 19 nt, Homo sapiens
ggacaguguuagccaguug

SEQ ID NO: 1063125 - RNA, 19 nt, Homo sapiens
caucacuggugguacuuua

SEQ ID NO: 1063126 - RNA, 19 nt, Homo sapiens
ggagcagacuggaagaaug

SEQ ID NO: 1063127 - RNA, 19 nt, Homo sapiens
ucuauuaucuccaucuuug

SEQ ID NO: 1063128 - RNA, 19 nt, Homo sapiens
agagaucccuaaccuauug

SEQ ID NO: 1063129 - RNA, 19 nt, Homo sapiens
gguaauggauugccucucu

SEQ ID NO: 1063130 - RNA, 19 nt, Homo sapiens
aaggauuucugugcuauua

SEQ ID NO: 1063131 - RNA, 19 nt, Homo sapiens
caacgucuuuggucaggaa

SEQ ID NO: 1063132 - RNA, 19 nt, Homo sapiens
ucagugagauucaguugau

SEQ ID NO: 1063133 - RNA, 19 nt, Homo sapiens
ggucaggaacuuuauaaug

SEQ ID NO: 1063134 - RNA, 19 nt, Homo sapiens
cuaaaggauuucugugcua

SEQ ID NO: 1063135 - RNA, 19 nt, Homo sapiens
ucaagugguuacucuggua

SEQ ID NO: 1063136 - RNA, 19 nt, Homo sapiens
ggaacuuuauaaugugcua

SEQ ID NO: 1063137 - RNA, 19 nt, Homo sapiens
ggugguacuuuaucuugaa

SEQ ID NO: 1063138 - RNA, 19 nt, Homo sapiens
uaaauuaccuuggguuucg

SEQ ID NO: 1063139 - RNA, 19 nt, Homo sapiens
uaaaggauuucugugcuau

SEQ ID NO: 1063140 - RNA, 19 nt, Homo sapiens
acgacaaacuuaacccuaa

SEQ ID NO: 1063141 - RNA, 19 nt, Homo sapiens
gaaccauggugggagagaa

SEQ ID NO: 1063142 - RNA, 19 nt, Homo sapiens
uagaagcacuguuguaaaa

SEQ ID NO: 1063143 - RNA, 19 nt, Homo sapiens
guauuugguucacccugua

SEQ ID NO: 1063144 - RNA, 19 nt, Homo sapiens
agaaauaaccuacagucuu

SEQ ID NO: 1063145 - RNA, 19 nt, Homo sapiens
gcucaggcguugcuguuuc

SEQ ID NO: 1063146 - RNA, 19 nt, Homo sapiens
cagaagagaucccuaaccu

SEQ ID NO: 1063147 - RNA, 19 nt, Homo sapiens
ccaaggaucuaaauuaccu

SEQ ID NO: 1063148 - RNA, 19 nt, Homo sapiens
caagucaagugguuacucu

SEQ ID NO: 1063149 - RNA, 19 nt, Homo sapiens
ggaaaucaacgucuuuggu

SEQ ID NO: 1063150 - RNA, 19 nt, Homo sapiens
cuauugcaguuccaaauug

SEQ ID NO: 1063151 - RNA, 19 nt, Homo sapiens
gguuguuucugcuauaguu

SEQ ID NO: 1063152 - RNA, 19 nt, Homo sapiens
cuucuuuacuggaggauuu

SEQ ID NO: 1063153 - RNA, 19 nt, Homo sapiens
agauaggccuggcacacua

SEQ ID NO: 1063154 - RNA, 19 nt, Homo sapiens
gugagacuguccagaucua

SEQ ID NO: 1063155 - RNA, 19 nt, Homo sapiens
ucaggaacuuuauaaugug

SEQ ID NO: 1063156 - RNA, 19 nt, Homo sapiens
uaccuuggguuucgcauau

SEQ ID NO: 1063157 - RNA, 19 nt, Homo sapiens
cugccaaggaucuaaauua

SEQ ID NO: 1063158 - RNA, 19 nt, Homo sapiens
gaaaacgugcucugacuuu

SEQ ID NO: 1063159 - RNA, 19 nt, Homo sapiens
gcaaaucagagaagcuugu

SEQ ID NO: 1063160 - RNA, 19 nt, Homo sapiens
cugaagagcccaucaagga

SEQ ID NO: 1063161 - RNA, 19 nt, Homo sapiens
caacuguacauuucauuca

SEQ ID NO: 1063162 - RNA, 19 nt, Homo sapiens
gagcaagaaagccaagaga

SEQ ID NO: 1063163 - RNA, 19 nt, Homo sapiens
uggacagguuccuucuuua

SEQ ID NO: 1063164 - RNA, 19 nt, Homo sapiens
ggacagguuccuucuuuac

SEQ ID NO: 1063165 - RNA, 19 nt, Homo sapiens
ugcaaguucucaauuguau

SEQ ID NO: 1063166 - RNA, 19 nt, Homo sapiens
uaacucaucacugguggua

SEQ ID NO: 1063167 - RNA, 19 nt, Homo sapiens
ccuguaaaguagccaagaa

SEQ ID NO: 1063168 - RNA, 19 nt, Homo sapiens
auggacagguuccuucuuu

SEQ ID NO: 1063169 - RNA, 19 nt, Homo sapiens
cuucuuaaaugguuguuuc

SEQ ID NO: 1063170 - RNA, 19 nt, Homo sapiens
ggucuauuaucuccaucuu

SEQ ID NO: 1063171 - RNA, 19 nt, Homo sapiens
cagcgacgauggagaagag

SEQ ID NO: 1063172 - RNA, 19 nt, Homo sapiens
gcuaaaacuucuuaaaugg

SEQ ID NO: 1063173 - RNA, 19 nt, Homo sapiens
gccuugugcuggaaaguga

SEQ ID NO: 1063174 - RNA, 19 nt, Homo sapiens
gagcagacuggaagaaugg

SEQ ID NO: 1063175 - RNA, 19 nt, Homo sapiens
guuccaaauugccaucuuc

SEQ ID NO: 1063176 - RNA, 19 nt, Homo sapiens
cccagaaguuggacgaaga

SEQ ID NO: 1063177 - RNA, 19 nt, Homo sapiens
caauauagcacuuuugaug

SEQ ID NO: 1063178 - RNA, 19 nt, Homo sapiens
uaaccuacagucuuaagau

SEQ ID NO: 1063179 - RNA, 19 nt, Homo sapiens
agacaaaggagcaagaaag

SEQ ID NO: 1063180 - RNA, 19 nt, Homo sapiens
ucccaugggucuauuaucu

SEQ ID NO: 1063181 - RNA, 19 nt, Homo sapiens
cuuagaagcacuguuguaa

SEQ ID NO: 1063182 - RNA, 19 nt, Homo sapiens
ucucucaaauggacagguu

SEQ ID NO: 1063183 - RNA, 19 nt, Homo sapiens
uaaaugguuguuucugcua

SEQ ID NO: 1063184 - RNA, 19 nt, Homo sapiens
caaaagaaauaaccuacag

SEQ ID NO: 1063185 - RNA, 19 nt, Homo sapiens
gagacaaaggagcaagaaa

SEQ ID NO: 1063186 - RNA, 19 nt, Homo sapiens
ucccuaaccuauuguuuua

SEQ ID NO: 1063187 - RNA, 19 nt, Homo sapiens
ggguuucgcauaugucuau

SEQ ID NO: 1063188 - RNA, 19 nt, Homo sapiens
ugccaaggaucuaaauuac

SEQ ID NO: 1063189 - RNA, 19 nt, Homo sapiens
gguucacccuguaaaguag

SEQ ID NO: 1063190 - RNA, 19 nt, Homo sapiens
gacugaauacgaccaaaug

SEQ ID NO: 1063191 - RNA, 19 nt, Homo sapiens
ccaagagacgggagaguca

SEQ ID NO: 1063192 - RNA, 19 nt, Homo sapiens
aaugguuguuucugcuaua

SEQ ID NO: 1063193 - RNA, 19 nt, Homo sapiens
gugcacagcauuagacagu

SEQ ID NO: 1063194 - RNA, 19 nt, Homo sapiens
guucugucaucuggacuuu

SEQ ID NO: 1063195 - RNA, 19 nt, Homo sapiens
gugguacuuuaucuugaaa

SEQ ID NO: 1063196 - RNA, 19 nt, Homo sapiens
acucaugucuucuuuaacg

SEQ ID NO: 1063197 - RNA, 19 nt, Homo sapiens
ucacccaauucacccagaa

SEQ ID NO: 1063198 - RNA, 19 nt, Homo sapiens
gagacugaauacgaccaaa

SEQ ID NO: 1063199 - RNA, 19 nt, Homo sapiens
gcuggaaagugagacaaag

SEQ ID NO: 1063200 - RNA, 19 nt, Homo sapiens
acagguuccuucuuuacug

SEQ ID NO: 1063201 - RNA, 19 nt, Homo sapiens
uaaaguagccaagaaaaga

SEQ ID NO: 1063202 - RNA, 19 nt, Homo sapiens
gggcuacuucugagacuga

SEQ ID NO: 1063203 - RNA, 19 nt, Homo sapiens
gaucccuaaccuauuguuu

SEQ ID NO: 1063204 - RNA, 19 nt, Homo sapiens
gcaaguucucaauuguauu

SEQ ID NO: 1063205 - RNA, 19 nt, Homo sapiens
ucccuugucucauuugcaa

SEQ ID NO: 1063206 - RNA, 19 nt, Homo sapiens
aaccuacagucuuaagaug

SEQ ID NO: 1063207 - RNA, 19 nt, Homo sapiens
ucagcuuucuauuuacaug

SEQ ID NO: 1063208 - RNA, 19 nt, Homo sapiens
caagagugaaguugugauc

SEQ ID NO: 1063209 - RNA, 19 nt, Homo sapiens
uuagaagcacuguuguaaa

SEQ ID NO: 1063210 - RNA, 19 nt, Homo sapiens
uugauucacuggcgucugu

SEQ ID NO: 1063211 - RNA, 19 nt, Homo sapiens
cauuagacaguauuugguu

SEQ ID NO: 1063212 - RNA, 19 nt, Homo sapiens
ggucagugagauucaguug

SEQ ID NO: 1063213 - RNA, 19 nt, Homo sapiens
gaaaugauguucugugaua

SEQ ID NO: 1063214 - RNA, 19 nt, Homo sapiens
gaauuugucugaaggguaa

SEQ ID NO: 1063215 - RNA, 19 nt, Homo sapiens
gagcuuguuucuaugauua

SEQ ID NO: 1063216 - RNA, 19 nt, Homo sapiens
caauggagcuuguuucuau

SEQ ID NO: 1063217 - RNA, 19 nt, Homo sapiens
ggagauaguucuaggaguu

SEQ ID NO: 1063218 - RNA, 19 nt, Homo sapiens
cgaaugggcucaggagaua

SEQ ID NO: 1063219 - RNA, 19 nt, Homo sapiens
caagggaaguacaaaguuu

SEQ ID NO: 1063220 - RNA, 19 nt, Homo sapiens
gugaugaagugauugauuu

SEQ ID NO: 1063221 - RNA, 19 nt, Homo sapiens
guaaagugccugaguauau

SEQ ID NO: 1063222 - RNA, 19 nt, Homo sapiens
uaaagaguauucccaaaug

SEQ ID NO: 1063223 - RNA, 19 nt, Homo sapiens
gaaaggaaaggcugaauca

SEQ ID NO: 1063224 - RNA, 19 nt, Homo sapiens
gaagaaagaagagcuuauu

SEQ ID NO: 1063225 - RNA, 19 nt, Homo sapiens
ucagugcacucuaggcuua

SEQ ID NO: 1063226 - RNA, 19 nt, Homo sapiens
gaacaagucagugaauauu

SEQ ID NO: 1063227 - RNA, 19 nt, Homo sapiens
ccaguaaagugccugagua

SEQ ID NO: 1063228 - RNA, 19 nt, Homo sapiens
uaaagugccugaguauauu

SEQ ID NO: 1063229 - RNA, 19 nt, Homo sapiens
gaaacucagugcacucuag

SEQ ID NO: 1063230 - RNA, 19 nt, Homo sapiens
gcgcagugaugaagugauu

SEQ ID NO: 1063231 - RNA, 19 nt, Homo sapiens
gaaggaugauaaugaagau

SEQ ID NO: 1063232 - RNA, 19 nt, Homo sapiens
gaauauuuggugccauuua

SEQ ID NO: 1063233 - RNA, 19 nt, Homo sapiens
ugacagagguuaucauacu

SEQ ID NO: 1063234 - RNA, 19 nt, Homo sapiens
gguaaggaguccaacaaga

SEQ ID NO: 1063235 - RNA, 19 nt, Homo sapiens
guaaggaguccaacaagaa

SEQ ID NO: 1063236 - RNA, 19 nt, Homo sapiens
caaaugcaacaacagaaua

SEQ ID NO: 1063237 - RNA, 19 nt, Homo sapiens
aaagaacgucaacgaauua

SEQ ID NO: 1063238 - RNA, 19 nt, Homo sapiens
ggcaguguauggaauguaa

SEQ ID NO: 1063239 - RNA, 19 nt, Homo sapiens
ggaaaggcugaaucacuua

SEQ ID NO: 1063240 - RNA, 19 nt, Homo sapiens
gaaacaggagaauacuaua

SEQ ID NO: 1063241 - RNA, 19 nt, Homo sapiens
cagcagaauuuaauagcaa

SEQ ID NO: 1063242 - RNA, 19 nt, Homo sapiens
acaagucagugaauauuug

SEQ ID NO: 1063243 - RNA, 19 nt, Homo sapiens
gcagaaaacuugauagagu

SEQ ID NO: 1063244 - RNA, 19 nt, Homo sapiens
gauguucugugauaugugu

SEQ ID NO: 1063245 - RNA, 19 nt, Homo sapiens
gaaagaagagcuuauuuug

SEQ ID NO: 1063246 - RNA, 19 nt, Homo sapiens
ggacagcuccucuggcaau

SEQ ID NO: 1063247 - RNA, 19 nt, Homo sapiens
caacagagcgaacaaaggu

SEQ ID NO: 1063248 - RNA, 19 nt, Homo sapiens
cagcuccucuggcaaugua

SEQ ID NO: 1063249 - RNA, 19 nt, Homo sapiens
gaaaguugaagccaguaaa

SEQ ID NO: 1063250 - RNA, 19 nt, Homo sapiens
cgaauuacagaccauuaua

SEQ ID NO: 1063251 - RNA, 19 nt, Homo sapiens
ccaaacaugcugaguauuc

SEQ ID NO: 1063252 - RNA, 19 nt, Homo sapiens
ggagaaacucuaccugaga

SEQ ID NO: 1063253 - RNA, 19 nt, Homo sapiens
ggagcuuguuucuaugauu

SEQ ID NO: 1063254 - RNA, 19 nt, Homo sapiens
aagaacaagucagugaaua

SEQ ID NO: 1063255 - RNA, 19 nt, Homo sapiens
ggugugaccuccuuuaaaa

SEQ ID NO: 1063256 - RNA, 19 nt, Homo sapiens
ucaggucgcuggauuugug

SEQ ID NO: 1063257 - RNA, 19 nt, Homo sapiens
gcagcagaauuuaauagca

SEQ ID NO: 1063258 - RNA, 19 nt, Homo sapiens
ugagagagcuaaaugucau

SEQ ID NO: 1063259 - RNA, 19 nt, Homo sapiens
uaacagcauugcgcaguga

SEQ ID NO: 1063260 - RNA, 19 nt, Homo sapiens
ugaaacaggagaauacuau

SEQ ID NO: 1063261 - RNA, 19 nt, Homo sapiens
acaaauggccaccugauga

SEQ ID NO: 1063262 - RNA, 19 nt, Homo sapiens
aggaaaggcugaaucacuu

SEQ ID NO: 1063263 - RNA, 19 nt, Homo sapiens
agacagugauggugauuca

SEQ ID NO: 1063264 - RNA, 19 nt, Homo sapiens
caugcugaguauucuguua

SEQ ID NO: 1063265 - RNA, 19 nt, Homo sapiens
caaauggccaccugaugaa

SEQ ID NO: 1063266 - RNA, 19 nt, Homo sapiens
ggugccauuuacaacauua

SEQ ID NO: 1063267 - RNA, 19 nt, Homo sapiens
uggaauauuuggugccauu

SEQ ID NO: 1063268 - RNA, 19 nt, Homo sapiens
gacagagguuaucauacuu

SEQ ID NO: 1063269 - RNA, 19 nt, Homo sapiens
agccaaaggucauuccaaa

SEQ ID NO: 1063270 - RNA, 19 nt, Homo sapiens
gaacgucaacgaauuacag

SEQ ID NO: 1063271 - RNA, 19 nt, Homo sapiens
aaaagaacgucaacgaauu

SEQ ID NO: 1063272 - RNA, 19 nt, Homo sapiens
gagaauaguggccauccuu

SEQ ID NO: 1063273 - RNA, 19 nt, Homo sapiens
cgaaggaugauaaugaaga

SEQ ID NO: 1063274 - RNA, 19 nt, Homo sapiens
cagaaaacuugauagagua

SEQ ID NO: 1063275 - RNA, 19 nt, Homo sapiens
ggaagaaagaagagcuuau

SEQ ID NO: 1063276 - RNA, 19 nt, Homo sapiens
gaauauccagccaaacaug

SEQ ID NO: 1063277 - RNA, 19 nt, Homo sapiens
gcagugaugaagugauuga

SEQ ID NO: 1063278 - RNA, 19 nt, Homo sapiens
uaaggaguccaacaagaaa

SEQ ID NO: 1063279 - RNA, 19 nt, Homo sapiens
gaaaggcugaaucacuuau

SEQ ID NO: 1063280 - RNA, 19 nt, Homo sapiens
gaagauggucgaggugaug

SEQ ID NO: 1063281 - RNA, 19 nt, Homo sapiens
ugcgguaucugccauuaaa

SEQ ID NO: 1063282 - RNA, 19 nt, Homo sapiens
acagaauacucagaaaguu

SEQ ID NO: 1063283 - RNA, 19 nt, Homo sapiens
gagaauacuauaugcuuca

SEQ ID NO: 1063284 - RNA, 19 nt, Homo sapiens
gcugcgguaucugccauua

SEQ ID NO: 1063285 - RNA, 19 nt, Homo sapiens
caacagaauacucagaaag

SEQ ID NO: 1063286 - RNA, 19 nt, Homo sapiens
caacaacagaauacucaga

SEQ ID NO: 1063287 - RNA, 19 nt, Homo sapiens
caaacaugcugaguauucu

SEQ ID NO: 1063288 - RNA, 19 nt, Homo sapiens
aaaagaauauccagccaaa

SEQ ID NO: 1063289 - RNA, 19 nt, Homo sapiens
gcaaagagggauaaaauag

SEQ ID NO: 1063290 - RNA, 19 nt, Homo sapiens
cccgaaggaugauaaugaa

SEQ ID NO: 1063291 - RNA, 19 nt, Homo sapiens
caaaugcuauauguggaau

SEQ ID NO: 1063292 - RNA, 19 nt, Homo sapiens
cagaauacucagaaaguug

SEQ ID NO: 1063293 - RNA, 19 nt, Homo sapiens
acaacagaauacucagaaa

SEQ ID NO: 1063294 - RNA, 19 nt, Homo sapiens
agccaaacaugcugaguau

SEQ ID NO: 1063295 - RNA, 19 nt, Homo sapiens
caagaacaagucagugaau

SEQ ID NO: 1063296 - RNA, 19 nt, Homo sapiens
gaacgcauggaagaaagaa

SEQ ID NO: 1063297 - RNA, 19 nt, Homo sapiens
gggaacgcauggaagaaag

SEQ ID NO: 1063298 - RNA, 19 nt, Homo sapiens
ccaaaugcaacaacagaau

SEQ ID NO: 1063299 - RNA, 19 nt, Homo sapiens
aaacagcaaagagggauaa

SEQ ID NO: 1063300 - RNA, 19 nt, Homo sapiens
aagaaaagauggucccaaa

SEQ ID NO: 1063301 - RNA, 19 nt, Homo sapiens
aagaauauccagccaaaca

SEQ ID NO: 1063302 - RNA, 19 nt, Homo sapiens
ugugacagagguuaucaua

SEQ ID NO: 1063303 - RNA, 19 nt, Homo sapiens
guacaagccaaaggucauu

SEQ ID NO: 1063304 - RNA, 19 nt, Homo sapiens
gaagacagaaaucaaaaga

SEQ ID NO: 1063305 - RNA, 19 nt, Homo sapiens
aaagugccugaguauauua

SEQ ID NO: 1063306 - RNA, 19 nt, Homo sapiens
agaauacucagaaaguuga

SEQ ID NO: 1063307 - RNA, 19 nt, Homo sapiens
gcgaaugggcucaggagau

SEQ ID NO: 1063308 - RNA, 19 nt, Homo sapiens
ccaugaagaagaaaugaug

SEQ ID NO: 1063309 - RNA, 19 nt, Homo sapiens
aaagauggucccaaacguu

SEQ ID NO: 1063310 - RNA, 19 nt, Homo sapiens
gugccugaguauauuaaga

SEQ ID NO: 1063311 - RNA, 19 nt, Homo sapiens
cuauaugcuucaagaacaa

SEQ ID NO: 1063312 - RNA, 19 nt, Homo sapiens
acuauaugcuucaagaaca

SEQ ID NO: 1063313 - RNA, 19 nt, Homo sapiens
gaaaugauguucugugaua

SEQ ID NO: 1063314 - RNA, 19 nt, Homo sapiens
gaauuugucugaaggguaa

SEQ ID NO: 1063315 - RNA, 19 nt, Homo sapiens
gagcuuguuucuaugauua

SEQ ID NO: 1063316 - RNA, 19 nt, Homo sapiens
caauggagcuuguuucuau

SEQ ID NO: 1063317 - RNA, 19 nt, Homo sapiens
ggagauaguucuaggaguu

SEQ ID NO: 1063318 - RNA, 19 nt, Homo sapiens
cgaaugggcucaggagaua

SEQ ID NO: 1063319 - RNA, 19 nt, Homo sapiens
caagggaaguacaaaguuu

SEQ ID NO: 1063320 - RNA, 19 nt, Homo sapiens
gugaugaagugauugauuu

SEQ ID NO: 1063321 - RNA, 19 nt, Homo sapiens
guaaagugccugaguauau

SEQ ID NO: 1063322 - RNA, 19 nt, Homo sapiens
uaaagaguauucccaaaug

SEQ ID NO: 1063323 - RNA, 19 nt, Homo sapiens
gaaaggaaaggcugaauca

SEQ ID NO: 1063324 - RNA, 19 nt, Homo sapiens
gaagaaagaagagcuuauu

SEQ ID NO: 1063325 - RNA, 19 nt, Homo sapiens
ucagugcacucuaggcuua

SEQ ID NO: 1063326 - RNA, 19 nt, Homo sapiens
gaacaagucagugaauauu

SEQ ID NO: 1063327 - RNA, 19 nt, Homo sapiens
ccaguaaagugccugagua

SEQ ID NO: 1063328 - RNA, 19 nt, Homo sapiens
uaaagugccugaguauauu

SEQ ID NO: 1063329 - RNA, 19 nt, Homo sapiens
gaaacucagugcacucuag

SEQ ID NO: 1063330 - RNA, 19 nt, Homo sapiens
gcgcagugaugaagugauu

SEQ ID NO: 1063331 - RNA, 19 nt, Homo sapiens
gaaggaugauaaugaagau

SEQ ID NO: 1063332 - RNA, 19 nt, Homo sapiens
gaauauuuggugccauuua

SEQ ID NO: 1063333 - RNA, 19 nt, Homo sapiens
ugacagagguuaucauacu

SEQ ID NO: 1063334 - RNA, 19 nt, Homo sapiens
gguaaggaguccaacaaga

SEQ ID NO: 1063335 - RNA, 19 nt, Homo sapiens
guaaggaguccaacaagaa

SEQ ID NO: 1063336 - RNA, 19 nt, Homo sapiens
caaaugcaacaacagaaua

SEQ ID NO: 1063337 - RNA, 19 nt, Homo sapiens
aaagaacgucaacgaauua

SEQ ID NO: 1063338 - RNA, 19 nt, Homo sapiens
ggcaguguauggaauguaa

SEQ ID NO: 1063339 - RNA, 19 nt, Homo sapiens
ggaaaggcugaaucacuua

SEQ ID NO: 1063340 - RNA, 19 nt, Homo sapiens
gaaacaggagaauacuaua

SEQ ID NO: 1063341 - RNA, 19 nt, Homo sapiens
cagcagaauuuaauagcaa

SEQ ID NO: 1063342 - RNA, 19 nt, Homo sapiens
acaagucagugaauauuug

SEQ ID NO: 1063343 - RNA, 19 nt, Homo sapiens
gcagaaaacuugauagagu

SEQ ID NO: 1063344 - RNA, 19 nt, Homo sapiens
gauguucugugauaugugu

SEQ ID NO: 1063345 - RNA, 19 nt, Homo sapiens
gaaagaagagcuuauuuug

SEQ ID NO: 1063346 - RNA, 19 nt, Homo sapiens
ggacagcuccucuggcaau

SEQ ID NO: 1063347 - RNA, 19 nt, Homo sapiens
caacagagcgaacaaaggu

SEQ ID NO: 1063348 - RNA, 19 nt, Homo sapiens
cagcuccucuggcaaugua

SEQ ID NO: 1063349 - RNA, 19 nt, Homo sapiens
gaaaguugaagccaguaaa

SEQ ID NO: 1063350 - RNA, 19 nt, Homo sapiens
cgaauuacagaccauuaua

SEQ ID NO: 1063351 - RNA, 19 nt, Homo sapiens
ccaaacaugcugaguauuc

SEQ ID NO: 1063352 - RNA, 19 nt, Homo sapiens
ggagaaacucuaccugaga

SEQ ID NO: 1063353 - RNA, 19 nt, Homo sapiens
ggagcuuguuucuaugauu

SEQ ID NO: 1063354 - RNA, 19 nt, Homo sapiens
aagaacaagucagugaaua

SEQ ID NO: 1063355 - RNA, 19 nt, Homo sapiens
ggugugaccuccuuuaaaa

SEQ ID NO: 1063356 - RNA, 19 nt, Homo sapiens
ucaggucgcuggauuugug

SEQ ID NO: 1063357 - RNA, 19 nt, Homo sapiens
gcagcagaauuuaauagca

SEQ ID NO: 1063358 - RNA, 19 nt, Homo sapiens
ugagagagcuaaaugucau

SEQ ID NO: 1063359 - RNA, 19 nt, Homo sapiens
uaacagcauugcgcaguga

SEQ ID NO: 1063360 - RNA, 19 nt, Homo sapiens
ugaaacaggagaauacuau

SEQ ID NO: 1063361 - RNA, 19 nt, Homo sapiens
acaaauggccaccugauga

SEQ ID NO: 1063362 - RNA, 19 nt, Homo sapiens
aggaaaggcugaaucacuu

SEQ ID NO: 1063363 - RNA, 19 nt, Homo sapiens
agacagugauggugauuca

SEQ ID NO: 1063364 - RNA, 19 nt, Homo sapiens
caugcugaguauucuguua

SEQ ID NO: 1063365 - RNA, 19 nt, Homo sapiens
caaauggccaccugaugaa

SEQ ID NO: 1063366 - RNA, 19 nt, Homo sapiens
ggugccauuuacaacauua

SEQ ID NO: 1063367 - RNA, 19 nt, Homo sapiens
uggaauauuuggugccauu

SEQ ID NO: 1063368 - RNA, 19 nt, Homo sapiens
gacagagguuaucauacuu

SEQ ID NO: 1063369 - RNA, 19 nt, Homo sapiens
agccaaaggucauuccaaa

SEQ ID NO: 1063370 - RNA, 19 nt, Homo sapiens
gaacgucaacgaauuacag

SEQ ID NO: 1063371 - RNA, 19 nt, Homo sapiens
aaaagaacgucaacgaauu

SEQ ID NO: 1063372 - RNA, 19 nt, Homo sapiens
gagaauaguggccauccuu

SEQ ID NO: 1063373 - RNA, 19 nt, Homo sapiens
cgaaggaugauaaugaaga

SEQ ID NO: 1063374 - RNA, 19 nt, Homo sapiens
cagaaaacuugauagagua

SEQ ID NO: 1063375 - RNA, 19 nt, Homo sapiens
ggaagaaagaagagcuuau

SEQ ID NO: 1063376 - RNA, 19 nt, Homo sapiens
gaauauccagccaaacaug

SEQ ID NO: 1063377 - RNA, 19 nt, Homo sapiens
gcagugaugaagugauuga

SEQ ID NO: 1063378 - RNA, 19 nt, Homo sapiens
uaaggaguccaacaagaaa

SEQ ID NO: 1063379 - RNA, 19 nt, Homo sapiens
gaaaggcugaaucacuuau

SEQ ID NO: 1063380 - RNA, 19 nt, Homo sapiens
gaagauggucgaggugaug

SEQ ID NO: 1063381 - RNA, 19 nt, Homo sapiens
ugcgguaucugccauuaaa

SEQ ID NO: 1063382 - RNA, 19 nt, Homo sapiens
acagaauacucagaaaguu

SEQ ID NO: 1063383 - RNA, 19 nt, Homo sapiens
gagaauacuauaugcuuca

SEQ ID NO: 1063384 - RNA, 19 nt, Homo sapiens
gcugcgguaucugccauua

SEQ ID NO: 1063385 - RNA, 19 nt, Homo sapiens
caacagaauacucagaaag

SEQ ID NO: 1063386 - RNA, 19 nt, Homo sapiens
caacaacagaauacucaga

SEQ ID NO: 1063387 - RNA, 19 nt, Homo sapiens
caaacaugcugaguauucu

SEQ ID NO: 1063388 - RNA, 19 nt, Homo sapiens
aaaagaauauccagccaaa

SEQ ID NO: 1063389 - RNA, 19 nt, Homo sapiens
gcaaagagggauaaaauag

SEQ ID NO: 1063390 - RNA, 19 nt, Homo sapiens
cccgaaggaugauaaugaa

SEQ ID NO: 1063391 - RNA, 19 nt, Homo sapiens
caaaugcuauauguggaau

SEQ ID NO: 1063392 - RNA, 19 nt, Homo sapiens
cagaauacucagaaaguug

SEQ ID NO: 1063393 - RNA, 19 nt, Homo sapiens
acaacagaauacucagaaa

SEQ ID NO: 1063394 - RNA, 19 nt, Homo sapiens
agccaaacaugcugaguau

SEQ ID NO: 1063395 - RNA, 19 nt, Homo sapiens
caagaacaagucagugaau

SEQ ID NO: 1063396 - RNA, 19 nt, Homo sapiens
gaacgcauggaagaaagaa

SEQ ID NO: 1063397 - RNA, 19 nt, Homo sapiens
gggaacgcauggaagaaag

SEQ ID NO: 1063398 - RNA, 19 nt, Homo sapiens
ccaaaugcaacaacagaau

SEQ ID NO: 1063399 - RNA, 19 nt, Homo sapiens
aaacagcaaagagggauaa

SEQ ID NO: 1063400 - RNA, 19 nt, Homo sapiens
aagaaaagauggucccaaa

SEQ ID NO: 1063401 - RNA, 19 nt, Homo sapiens
aagaauauccagccaaaca

SEQ ID NO: 1063402 - RNA, 19 nt, Homo sapiens
ugugacagagguuaucaua

SEQ ID NO: 1063403 - RNA, 19 nt, Homo sapiens
guacaagccaaaggucauu

SEQ ID NO: 1063404 - RNA, 19 nt, Homo sapiens
gaagacagaaaucaaaaga

SEQ ID NO: 1063405 - RNA, 19 nt, Homo sapiens
aaagugccugaguauauua

SEQ ID NO: 1063406 - RNA, 19 nt, Homo sapiens
agaauacucagaaaguuga

SEQ ID NO: 1063407 - RNA, 19 nt, Homo sapiens
gcgaaugggcucaggagau

SEQ ID NO: 1063408 - RNA, 19 nt, Homo sapiens
ccaugaagaagaaaugaug

SEQ ID NO: 1063409 - RNA, 19 nt, Homo sapiens
aaagauggucccaaacguu

SEQ ID NO: 1063410 - RNA, 19 nt, Homo sapiens
gugccugaguauauuaaga

SEQ ID NO: 1063411 - RNA, 19 nt, Homo sapiens
cuauaugcuucaagaacaa

SEQ ID NO: 1063412 - RNA, 19 nt, Homo sapiens
acuauaugcuucaagaaca

SEQ ID NO: 1063413 - RNA, 19 nt, Homo sapiens
gaaaggagauuuagaucaa

SEQ ID NO: 1063414 - RNA, 19 nt, Homo sapiens
gcaauuagaucacgccaaa

SEQ ID NO: 1063415 - RNA, 19 nt, Homo sapiens
gaaggaaauugaagugaaa

SEQ ID NO: 1063416 - RNA, 19 nt, Homo sapiens
gcaaguacuucacucaguu

SEQ ID NO: 1063417 - RNA, 19 nt, Homo sapiens
gagacuggaugacaauauu

SEQ ID NO: 1063418 - RNA, 19 nt, Homo sapiens
agaaguaccuccgagaaua

SEQ ID NO: 1063419 - RNA, 19 nt, Homo sapiens
gcucagaaguagccaaguu

SEQ ID NO: 1063420 - RNA, 19 nt, Homo sapiens
cgaaggaaauugaagugaa

SEQ ID NO: 1063421 - RNA, 19 nt, Homo sapiens
ggagaaaggagauuuagau

SEQ ID NO: 1063422 - RNA, 19 nt, Homo sapiens
gagcagaacaggugagaug

SEQ ID NO: 1063423 - RNA, 19 nt, Homo sapiens
uaaggagacuggaugacaa

SEQ ID NO: 1063424 - RNA, 19 nt, Homo sapiens
ggauguaagucugauugaa

SEQ ID NO: 1063425 - RNA, 19 nt, Homo sapiens
gaaguaccuccgagaauau

SEQ ID NO: 1063426 - RNA, 19 nt, Homo sapiens
gcaaugcucucagcucagu

SEQ ID NO: 1063427 - RNA, 19 nt, Homo sapiens
gcgccgaccucuuugucua

SEQ ID NO: 1063428 - RNA, 19 nt, Homo sapiens
gacaauauucgaacuguug

SEQ ID NO: 1063429 - RNA, 19 nt, Homo sapiens
ggacguaguaucaggcauu

SEQ ID NO: 1063430 - RNA, 19 nt, Homo sapiens
gugcauggcugagaggauu

SEQ ID NO: 1063431 - RNA, 19 nt, Homo sapiens
caccuaagcccaacacuga

SEQ ID NO: 1063432 - RNA, 19 nt, Homo sapiens
ucaagcacauauucuucua

SEQ ID NO: 1063433 - RNA, 19 nt, Homo sapiens
cagcugcgccgaccucuuu

SEQ ID NO: 1063434 - RNA, 19 nt, Homo sapiens
gcugauagaucgguuugug

SEQ ID NO: 1063435 - RNA, 19 nt, Homo sapiens
gaucaaacaggaaaucauc

SEQ ID NO: 1063436 - RNA, 19 nt, Homo sapiens
ggacggcaagugaaagaaa

SEQ ID NO: 1063437 - RNA, 19 nt, Homo sapiens
ucaguucugcguuaaauuu

SEQ ID NO: 1063438 - RNA, 19 nt, Homo sapiens
aaaggagggcucagaagua

SEQ ID NO: 1063439 - RNA, 19 nt, Homo sapiens
gaaccucggagagcugaua

SEQ ID NO: 1063440 - RNA, 19 nt, Homo sapiens
gaacaaaauuaggcugaaa

SEQ ID NO: 1063441 - RNA, 19 nt, Homo sapiens
gacaguauaaugacucaaa

SEQ ID NO: 1063442 - RNA, 19 nt, Homo sapiens
ccgagaauaugccuggaaa

SEQ ID NO: 1063443 - RNA, 19 nt, Homo sapiens
uauucgaacuguuguaaga

SEQ ID NO: 1063444 - RNA, 19 nt, Homo sapiens
ugagauggacguaguauca

SEQ ID NO: 1063445 - RNA, 19 nt, Homo sapiens
ucacccaccucuucaagug

SEQ ID NO: 1063446 - RNA, 19 nt, Homo sapiens
caacggagaaaggagauuu

SEQ ID NO: 1063447 - RNA, 19 nt, Homo sapiens
gaggauugcgguggaauuu

SEQ ID NO: 1063448 - RNA, 19 nt, Homo sapiens
gaucaagcacauauucuuc

SEQ ID NO: 1063449 - RNA, 19 nt, Homo sapiens
ccucaucucuacguguaua

SEQ ID NO: 1063450 - RNA, 19 nt, Homo sapiens
ccgcagauccggcagcuuu

SEQ ID NO: 1063451 - RNA, 19 nt, Homo sapiens
gaucuacuuggcaggaaua

SEQ ID NO: 1063452 - RNA, 19 nt, Homo sapiens
guagaucaagcacauauuc

SEQ ID NO: 1063453 - RNA, 19 nt, Homo sapiens
gacguaguaucaggcauuu

SEQ ID NO: 1063454 - RNA, 19 nt, Homo sapiens
ucacucaguucugcguuaa

SEQ ID NO: 1063455 - RNA, 19 nt, Homo sapiens
gcuauucaaagaacaacua

SEQ ID NO: 1063456 - RNA, 19 nt, Homo sapiens
ccagagcgaaggaaauuga

SEQ ID NO: 1063457 - RNA, 19 nt, Homo sapiens
cagacgcuaugccuggaua

SEQ ID NO: 1063458 - RNA, 19 nt, Homo sapiens
augcaugucugguugcuaa

SEQ ID NO: 1063459 - RNA, 19 nt, Homo sapiens
gcgaagacaauacggagaa

SEQ ID NO: 1063460 - RNA, 19 nt, Homo sapiens
cuacgucaccucugucauu

SEQ ID NO: 1063461 - RNA, 19 nt, Homo sapiens
cuggagagauggacacguu

SEQ ID NO: 1063462 - RNA, 19 nt, Homo sapiens
agauuuagaucaaccaaag

SEQ ID NO: 1063463 - RNA, 19 nt, Homo sapiens
cccgugauauuaagcaauu

SEQ ID NO: 1063464 - RNA, 19 nt, Homo sapiens
gacggcaagugaaagaaau

SEQ ID NO: 1063465 - RNA, 19 nt, Homo sapiens
ggagacuggaugacaauau

SEQ ID NO: 1063466 - RNA, 19 nt, Homo sapiens
gagcucugccucaucugua

SEQ ID NO: 1063467 - RNA, 19 nt, Homo sapiens
caccagagauggaggaacu

SEQ ID NO: 1063468 - RNA, 19 nt, Homo sapiens
caaacaggaaaucaucaaa

SEQ ID NO: 1063469 - RNA, 19 nt, Homo sapiens
ugaauguccuggagcacuu

SEQ ID NO: 1063470 - RNA, 19 nt, Homo sapiens
gagaaaggagauuuagauc

SEQ ID NO: 1063471 - RNA, 19 nt, Homo sapiens
ccaggacccucuagaucga

SEQ ID NO: 1063472 - RNA, 19 nt, Homo sapiens
caugucugguugcuaauau

SEQ ID NO: 1063473 - RNA, 19 nt, Homo sapiens
ggaggacccagcaauguuc

SEQ ID NO: 1063474 - RNA, 19 nt, Homo sapiens
agaaguugcuaaucuccuu

SEQ ID NO: 1063475 - RNA, 19 nt, Homo sapiens
ggauggacggcaagugaaa

SEQ ID NO: 1063476 - RNA, 19 nt, Homo sapiens
ggauugcgguggaauuuug

SEQ ID NO: 1063477 - RNA, 19 nt, Homo sapiens
gcaugucugguugcuaaua

SEQ ID NO: 1063478 - RNA, 19 nt, Homo sapiens
caggauggacggcaaguga

SEQ ID NO: 1063479 - RNA, 19 nt, Homo sapiens
ugacaauauucgaacuguu

SEQ ID NO: 1063480 - RNA, 19 nt, Homo sapiens
caggugagauggacguagu

SEQ ID NO: 1063481 - RNA, 19 nt, Homo sapiens
gggacaguauaaugacuca

SEQ ID NO: 1063482 - RNA, 19 nt, Homo sapiens
gcagaacaggugagaugga

SEQ ID NO: 1063483 - RNA, 19 nt, Homo sapiens
gcaagaugcaguggcagaa

SEQ ID NO: 1063484 - RNA, 19 nt, Homo sapiens
uaagucugauugaacgaau

SEQ ID NO: 1063485 - RNA, 19 nt, Homo sapiens
ccagaaguaccuccgagaa

SEQ ID NO: 1063486 - RNA, 19 nt, Homo sapiens
gagcgaaggaaauugaagu

SEQ ID NO: 1063487 - RNA, 19 nt, Homo sapiens
cagcaauguucuacgagau

SEQ ID NO: 1063488 - RNA, 19 nt, Homo sapiens
gaauaugccuggaaaaucc

SEQ ID NO: 1063489 - RNA, 19 nt, Homo sapiens
gagcugauagaucgguuug

SEQ ID NO: 1063490 - RNA, 19 nt, Homo sapiens
uaucgaaucccaagacaag

SEQ ID NO: 1063491 - RNA, 19 nt, Homo sapiens
aagaacaacuaacuuugag

SEQ ID NO: 1063492 - RNA, 19 nt, Homo sapiens
aagcacauauucuucuagu

SEQ ID NO: 1063493 - RNA, 19 nt, Homo sapiens
ggagagauggacacguuca

SEQ ID NO: 1063494 - RNA, 19 nt, Homo sapiens
gauguaagucugauugaac

SEQ ID NO: 1063495 - RNA, 19 nt, Homo sapiens
ccacccagcagcuagaaga

SEQ ID NO: 1063496 - RNA, 19 nt, Homo sapiens
aaggagggcucagaaguag

SEQ ID NO: 1063497 - RNA, 19 nt, Homo sapiens
ggaacuggcaacggagaaa

SEQ ID NO: 1063498 - RNA, 19 nt, Homo sapiens
ucugguugcuaauauucua

SEQ ID NO: 1063499 - RNA, 19 nt, Homo sapiens
gcauuguuuccaaguguuu

SEQ ID NO: 1063500 - RNA, 19 nt, Homo sapiens
uggacuaugaggagaaaua

SEQ ID NO: 1063501 - RNA, 19 nt, Homo sapiens
gccagcuuguggacuauga

SEQ ID NO: 1063502 - RNA, 19 nt, Homo sapiens
acggagaaguugcuaaucu

SEQ ID NO: 1063503 - RNA, 19 nt, Homo sapiens
gaagucgugaacaaaauua

SEQ ID NO: 1063504 - RNA, 19 nt, Homo sapiens
ugacugccaugagcaagau

SEQ ID NO: 1063505 - RNA, 19 nt, Homo sapiens
ccagacaauccauuucaug

SEQ ID NO: 1063506 - RNA, 19 nt, Homo sapiens
gagauuuagaucaaccaaa

SEQ ID NO: 1063507 - RNA, 19 nt, Homo sapiens
agaaaggagauuuagauca

SEQ ID NO: 1063508 - RNA, 19 nt, Homo sapiens
gaugagccaacaccagaga

SEQ ID NO: 1063509 - RNA, 19 nt, Homo sapiens
uaccagagcgaaggaaauu

SEQ ID NO: 1063510 - RNA, 19 nt, Homo sapiens
caccugaccaccucaauca

SEQ ID NO: 1063511 - RNA, 19 nt, Homo sapiens
ccuggcagcuuuuguugua

SEQ ID NO: 1063512 - RNA, 19 nt, Homo sapiens
ggaugacaauauucgaacu

SEQ ID NO: 1063513 - RNA, 19 nt, Homo sapiens
ggacaaagauggagucagu

SEQ ID NO: 1063514 - RNA, 19 nt, Homo sapiens
gaugauagccaaccugaua

SEQ ID NO: 1063515 - RNA, 19 nt, Homo sapiens
ggacaagaauuccuuaacu

SEQ ID NO: 1063516 - RNA, 19 nt, Homo sapiens
ggucagugcuauugaagaa

SEQ ID NO: 1063517 - RNA, 19 nt, Homo sapiens
caaagcaggauaaugguua

SEQ ID NO: 1063518 - RNA, 19 nt, Homo sapiens
ggacgauucuuuaauugau

SEQ ID NO: 1063519 - RNA, 19 nt, Homo sapiens
uauaaggucuauugggaua

SEQ ID NO: 1063520 - RNA, 19 nt, Homo sapiens
gaauuucucguaugaauga

SEQ ID NO: 1063521 - RNA, 19 nt, Homo sapiens
gacaagaauuccuuaacuu

SEQ ID NO: 1063522 - RNA, 19 nt, Homo sapiens
aaacagagccaaacagcua

SEQ ID NO: 1063523 - RNA, 19 nt, Homo sapiens
caaacuaacauuccuacua

SEQ ID NO: 1063524 - RNA, 19 nt, Homo sapiens
ugaagaagcuauuggauac

SEQ ID NO: 1063525 - RNA, 19 nt, Homo sapiens
gcaagacaguggugaaugg

SEQ ID NO: 1063526 - RNA, 19 nt, Homo sapiens
gcauuuaccuacaauuaag

SEQ ID NO: 1063527 - RNA, 19 nt, Homo sapiens
gugcuuccaucaauaauga

SEQ ID NO: 1063528 - RNA, 19 nt, Homo sapiens
gaucauuucuccucacgau

SEQ ID NO: 1063529 - RNA, 19 nt, Homo sapiens
gcagugaaacgacuaauag

SEQ ID NO: 1063530 - RNA, 19 nt, Homo sapiens
ugucauaagugcagaguug

SEQ ID NO: 1063531 - RNA, 19 nt, Homo sapiens
caaagacacguacauguug

SEQ ID NO: 1063532 - RNA, 19 nt, Homo sapiens
gaucaagaaaccauuaaga

SEQ ID NO: 1063533 - RNA, 19 nt, Homo sapiens
gcaguccacuucuccacaa

SEQ ID NO: 1063534 - RNA, 19 nt, Homo sapiens
aaagggauuucucaagcua

SEQ ID NO: 1063535 - RNA, 19 nt, Homo sapiens
uaaauucugggcugucaua

SEQ ID NO: 1063536 - RNA, 19 nt, Homo sapiens
ggccaaacccaacaaacua

SEQ ID NO: 1063537 - RNA, 19 nt, Homo sapiens
agaccuacauuccucauug

SEQ ID NO: 1063538 - RNA, 19 nt, Homo sapiens
ggacagagcccaaaaucaa

SEQ ID NO: 1063539 - RNA, 19 nt, Homo sapiens
caagaauuccuuaacuuug

SEQ ID NO: 1063540 - RNA, 19 nt, Homo sapiens
ucaaagacacguacauguu

SEQ ID NO: 1063541 - RNA, 19 nt, Homo sapiens
gauaauggagcucagauca

SEQ ID NO: 1063542 - RNA, 19 nt, Homo sapiens
gaaacuuugugcuggaauc

SEQ ID NO: 1063543 - RNA, 19 nt, Homo sapiens
ggaccuggaauuucucgua

SEQ ID NO: 1063544 - RNA, 19 nt, Homo sapiens
gaagaaggaacugaaugaa

SEQ ID NO: 1063545 - RNA, 19 nt, Homo sapiens
acaacuggcuaugaugaua

SEQ ID NO: 1063546 - RNA, 19 nt, Homo sapiens
uaucugccaugaucaagaa

SEQ ID NO: 1063547 - RNA, 19 nt, Homo sapiens
cagaaaaccuauggaguua

SEQ ID NO: 1063548 - RNA, 19 nt, Homo sapiens
cuacauuccucauuguuuc

SEQ ID NO: 1063549 - RNA, 19 nt, Homo sapiens
agaaggaacugaaugaacu

SEQ ID NO: 1063550 - RNA, 19 nt, Homo sapiens
gcagaaaggcaucgugauc

SEQ ID NO: 1063551 - RNA, 19 nt, Homo sapiens
gaccuggaauuucucguau

SEQ ID NO: 1063552 - RNA, 19 nt, Homo sapiens
ugaagaaggaacugaauga

SEQ ID NO: 1063553 - RNA, 19 nt, Homo sapiens
gugcagaguuggcuagcuu

SEQ ID NO: 1063554 - RNA, 19 nt, Homo sapiens
caaccacauuuaucaguca

SEQ ID NO: 1063555 - RNA, 19 nt, Homo sapiens
uauguaggauagccacuuu

SEQ ID NO: 1063556 - RNA, 19 nt, Homo sapiens
agaguuggcuagcuuccua

SEQ ID NO: 1063557 - RNA, 19 nt, Homo sapiens
caacaaacuaacauuccua

SEQ ID NO: 1063558 - RNA, 19 nt, Homo sapiens
acaauucagugacuuaaag

SEQ ID NO: 1063559 - RNA, 19 nt, Homo sapiens
ccuggaauuucucguauga

SEQ ID NO: 1063560 - RNA, 19 nt, Homo sapiens
gcuaugggaccuggaauuu

SEQ ID NO: 1063561 - RNA, 19 nt, Homo sapiens
gagccaaacagcuaauaga

SEQ ID NO: 1063562 - RNA, 19 nt, Homo sapiens
ggaucgcagugcucucaaa

SEQ ID NO: 1063563 - RNA, 19 nt, Homo sapiens
aaauguauguccucucugu

SEQ ID NO: 1063564 - RNA, 19 nt, Homo sapiens
gcagccaaaugaucaccuu

SEQ ID NO: 1063565 - RNA, 19 nt, Homo sapiens
ggagacaaaggugaaguuu

SEQ ID NO: 1063566 - RNA, 19 nt, Homo sapiens
ccgagugcuuccaucaaua

SEQ ID NO: 1063567 - RNA, 19 nt, Homo sapiens
gauaaagggauuucucaag

SEQ ID NO: 1063568 - RNA, 19 nt, Homo sapiens
guaacugcaucucacaauc

SEQ ID NO: 1063569 - RNA, 19 nt, Homo sapiens
uagcagaagguaauaaaga

SEQ ID NO: 1063570 - RNA, 19 nt, Homo sapiens
gcugucauauguaggauag

SEQ ID NO: 1063571 - RNA, 19 nt, Homo sapiens
ccuauggaguuaguaaauu

SEQ ID NO: 1063572 - RNA, 19 nt, Homo sapiens
cugagcagcugaagaagga

SEQ ID NO: 1063573 - RNA, 19 nt, Homo sapiens
ugaaauuucugccauuagg

SEQ ID NO: 1063574 - RNA, 19 nt, Homo sapiens
ggaaacauuaacuggcuuu

SEQ ID NO: 1063575 - RNA, 19 nt, Homo sapiens
cacaguaucacauuugaaa

SEQ ID NO: 1063576 - RNA, 19 nt, Homo sapiens
uaagcuggguuuaacuugu

SEQ ID NO: 1063577 - RNA, 19 nt, Homo sapiens
uaacuggcuuuaaguggau

SEQ ID NO: 1063578 - RNA, 19 nt, Homo sapiens
uggaauuucucguaugaau

SEQ ID NO: 1063579 - RNA, 19 nt, Homo sapiens
cgagugcuuccaucaauaa

SEQ ID NO: 1063580 - RNA, 19 nt, Homo sapiens
ucauuucuccucacgauaa

SEQ ID NO: 1063581 - RNA, 19 nt, Homo sapiens
uaugggaccuggaauuucu

SEQ ID NO: 1063582 - RNA, 19 nt, Homo sapiens
cuauggaguuaguaaauuc

SEQ ID NO: 1063583 - RNA, 19 nt, Homo sapiens
gaaaaccuauggaguuagu

SEQ ID NO: 1063584 - RNA, 19 nt, Homo sapiens
caugaucaagaaaccauua

SEQ ID NO: 1063585 - RNA, 19 nt, Homo sapiens
uugggacgauucuuuaauu

SEQ ID NO: 1063586 - RNA, 19 nt, Homo sapiens
gguagcagcagaagguuug

SEQ ID NO: 1063587 - RNA, 19 nt, Homo sapiens
gccaaacccaacaaacuaa

SEQ ID NO: 1063588 - RNA, 19 nt, Homo sapiens
gaccuacauuccucauugu

SEQ ID NO: 1063589 - RNA, 19 nt, Homo sapiens
gaaacauuaacuggcuuua

SEQ ID NO: 1063590 - RNA, 19 nt, Homo sapiens
ggcagugaaacgacuaaua

SEQ ID NO: 1063591 - RNA, 19 nt, Homo sapiens
agcagaagguaauaaagaa

SEQ ID NO: 1063592 - RNA, 19 nt, Homo sapiens
auucugggcugucauaugu

SEQ ID NO: 1063593 - RNA, 19 nt, Homo sapiens
aaguugagcuuggacauau

SEQ ID NO: 1063594 - RNA, 19 nt, Homo sapiens
ccucauuguuucauguuug

SEQ ID NO: 1063595 - RNA, 19 nt, Homo sapiens
aguacaaucugcagccaaa

SEQ ID NO: 1063596 - RNA, 19 nt, Homo sapiens
caaaacaucacagguauuu

SEQ ID NO: 1063597 - RNA, 19 nt, Homo sapiens
ucagugcuauugaagaaca

SEQ ID NO: 1063598 - RNA, 19 nt, Homo sapiens
cgacuaauagcagaaggua

SEQ ID NO: 1063599 - RNA, 19 nt, Homo sapiens
gaaacgacuaauagcagaa

SEQ ID NO: 1063600 - RNA, 19 nt, Homo sapiens
uugaagaagcuauuggaua

SEQ ID NO: 1063601 - RNA, 19 nt, Homo sapiens
aagaauuccuuaacuuugg

SEQ ID NO: 1063602 - RNA, 19 nt, Homo sapiens
cgacccggaugcugauaga

SEQ ID NO: 1063603 - RNA, 19 nt, Homo sapiens
ugacuacuuugaagaccuu

SEQ ID NO: 1063604 - RNA, 19 nt, Homo sapiens
uaaggucuauugggauaau

SEQ ID NO: 1063605 - RNA, 19 nt, Homo sapiens
ucagugacuuaaagcagaa

SEQ ID NO: 1063606 - RNA, 19 nt, Homo sapiens
uguaauugaugugccuuaa

SEQ ID NO: 1063607 - RNA, 19 nt, Homo sapiens
augaaugacuugaccauca

SEQ ID NO: 1063608 - RNA, 19 nt, Homo sapiens
aagcuggguuuaacuuguu

SEQ ID NO: 1063609 - RNA, 19 nt, Homo sapiens
aaugaucaccuucaccuuu

SEQ ID NO: 1063610 - RNA, 19 nt, Homo sapiens
gaagcuauuggauacaugu

SEQ ID NO: 1063611 - RNA, 19 nt, Homo sapiens
gaagaacuacgaaaauguu

SEQ ID NO: 1063612 - RNA, 19 nt, Homo sapiens
gggacgauucuuuaauuga

SEQ ID NO: 1063613 - RNA, 19 nt, Homo sapiens
gcagggcacucaaucagua

SEQ ID NO: 1063614 - RNA, 19 nt, Homo sapiens
aaagagaacuugagagaga

SEQ ID NO: 1063615 - RNA, 19 nt, Homo sapiens
ggucgcagcuucacucauu

SEQ ID NO: 1063616 - RNA, 19 nt, Homo sapiens
gagcaaaguugggaaaguu

SEQ ID NO: 1063617 - RNA, 19 nt, Homo sapiens
uagcagaucugacacuaaa

SEQ ID NO: 1063618 - RNA, 19 nt, Homo sapiens
gggacucgcuucauuauag

SEQ ID NO: 1063619 - RNA, 19 nt, Homo sapiens
ggucagagcguuacuggaa

SEQ ID NO: 1063620 - RNA, 19 nt, Homo sapiens
uaagcaguuucacccauua

SEQ ID NO: 1063621 - RNA, 19 nt, Homo sapiens
gaaacugucucaggaccuu

SEQ ID NO: 1063622 - RNA, 19 nt, Homo sapiens
acaaacaugugcaaccaaa

SEQ ID NO: 1063623 - RNA, 19 nt, Homo sapiens
gaaaaugauugguuuggaa

SEQ ID NO: 1063624 - RNA, 19 nt, Homo sapiens
agagagauuugcugggaua

SEQ ID NO: 1063625 - RNA, 19 nt, Homo sapiens
gaagguggucagagcguua

SEQ ID NO: 1063626 - RNA, 19 nt, Homo sapiens
guacaagggauugauuuaa

SEQ ID NO: 1063627 - RNA, 19 nt, Homo sapiens
gagguauuguuucaucauu

SEQ ID NO: 1063628 - RNA, 19 nt, Homo sapiens
aaagacuucugucauuuga

SEQ ID NO: 1063629 - RNA, 19 nt, Homo sapiens
ggauuucgcuucuguacag

SEQ ID NO: 1063630 - RNA, 19 nt, Homo sapiens
ggugaugucuguggaaaug

SEQ ID NO: 1063631 - RNA, 19 nt, Homo sapiens
ggacucgcuucauuauaga

SEQ ID NO: 1063632 - RNA, 19 nt, Homo sapiens
gagcuucucuuggaaaugg

SEQ ID NO: 1063633 - RNA, 19 nt, Homo sapiens
ggaagacuuuguugcagau

SEQ ID NO: 1063634 - RNA, 19 nt, Homo sapiens
ggacauauucagcagagaa

SEQ ID NO: 1063635 - RNA, 19 nt, Homo sapiens
ugaaagagaacuugagaga

SEQ ID NO: 1063636 - RNA, 19 nt, Homo sapiens
caaguuaacaggaucaaug

SEQ ID NO: 1063637 - RNA, 19 nt, Homo sapiens
gggauugauuuaaaccaaa

SEQ ID NO: 1063638 - RNA, 19 nt, Homo sapiens
gguauuguuucaucauuuc

SEQ ID NO: 1063639 - RNA, 19 nt, Homo sapiens
caaccggucucccuuagca

SEQ ID NO: 1063640 - RNA, 19 nt, Homo sapiens
caucauuucuguauugucu

SEQ ID NO: 1063641 - RNA, 19 nt, Homo sapiens
gccagaguauauaugcaua

SEQ ID NO: 1063642 - RNA, 19 nt, Homo sapiens
ggauaaggcgggacauuuc

SEQ ID NO: 1063643 - RNA, 19 nt, Homo sapiens
uuacauguuuggccagauu

SEQ ID NO: 1063644 - RNA, 19 nt, Homo sapiens
gggauaaggcgggacauuu

SEQ ID NO: 1063645 - RNA, 19 nt, Homo sapiens
gcagaccagccaauuaaga

SEQ ID NO: 1063646 - RNA, 19 nt, Homo sapiens
ggccacaguucaagccauu

SEQ ID NO: 1063647 - RNA, 19 nt, Homo sapiens
gcagauaauuacagcaaaa

SEQ ID NO: 1063648 - RNA, 19 nt, Homo sapiens
aaacaaacaugugcaacca

SEQ ID NO: 1063649 - RNA, 19 nt, Homo sapiens
gagcguuacuggaaaauug

SEQ ID NO: 1063650 - RNA, 19 nt, Homo sapiens
guguguaaguggacauauu

SEQ ID NO: 1063651 - RNA, 19 nt, Homo sapiens
gagauuugcugggauaagg

SEQ ID NO: 1063652 - RNA, 19 nt, Homo sapiens
cgagcagucagucaaguua

SEQ ID NO: 1063653 - RNA, 19 nt, Homo sapiens
gaaaguuguacaagggauu

SEQ ID NO: 1063654 - RNA, 19 nt, Homo sapiens
uaaagacuucugucauuug

SEQ ID NO: 1063655 - RNA, 19 nt, Homo sapiens
ccagaugccagaguauaua

SEQ ID NO: 1063656 - RNA, 19 nt, Homo sapiens
aaacuucuguggcugaaag

SEQ ID NO: 1063657 - RNA, 19 nt, Homo sapiens
ggcacggccucaucuguga

SEQ ID NO: 1063658 - RNA, 19 nt, Homo sapiens
gaaggcaacaggugucaca

SEQ ID NO: 1063659 - RNA, 19 nt, Homo sapiens
agacuucugucauuugauc

SEQ ID NO: 1063660 - RNA, 19 nt, Homo sapiens
gccauugcauuaaagacuu

SEQ ID NO: 1063661 - RNA, 19 nt, Homo sapiens
acagccagaugccagagua

SEQ ID NO: 1063662 - RNA, 19 nt, Homo sapiens
caugaaugaugacugaaca

SEQ ID NO: 1063663 - RNA, 19 nt, Homo sapiens
ugcaaugucugguggagaa

SEQ ID NO: 1063664 - RNA, 19 nt, Homo sapiens
gaucagcaaagacccgauu

SEQ ID NO: 1063665 - RNA, 19 nt, Homo sapiens
gcaggaggacuaggaguga

SEQ ID NO: 1063666 - RNA, 19 nt, Homo sapiens
aaaccaaauucgaggacuu

SEQ ID NO: 1063667 - RNA, 19 nt, Homo sapiens
uggaggaacugcaaugucu

SEQ ID NO: 1063668 - RNA, 19 nt, Homo sapiens
gcauuaaagacuucuguca

SEQ ID NO: 1063669 - RNA, 19 nt, Homo sapiens
gagguggaguccguucuug

SEQ ID NO: 1063670 - RNA, 19 nt, Homo sapiens
guggaggccucagcaagaa

SEQ ID NO: 1063671 - RNA, 19 nt, Homo sapiens
gagcagucagucaaguuaa

SEQ ID NO: 1063672 - RNA, 19 nt, Homo sapiens
caucgaaacgucaucaugu

SEQ ID NO: 1063673 - RNA, 19 nt, Homo sapiens
gcugaaagagaacuugaga

SEQ ID NO: 1063674 - RNA, 19 nt, Homo sapiens
uuccagaacuacaaguaaa

SEQ ID NO: 1063675 - RNA, 19 nt, Homo sapiens
guuaacaggaucaaugaga

SEQ ID NO: 1063676 - RNA, 19 nt, Homo sapiens
auaagcaguuucacccauu

SEQ ID NO: 1063677 - RNA, 19 nt, Homo sapiens
uugcagaccagccaauuaa

SEQ ID NO: 1063678 - RNA, 19 nt, Homo sapiens
cauggucaccggauugaaa

SEQ ID NO: 1063679 - RNA, 19 nt, Homo sapiens
ucagucaaguuaacaggau

SEQ ID NO: 1063680 - RNA, 19 nt, Homo sapiens
cagaccagccaauuaagaa

SEQ ID NO: 1063681 - RNA, 19 nt, Homo sapiens
ucccgagacuacaggauaa

SEQ ID NO: 1063682 - RNA, 19 nt, Homo sapiens
gaaaauugauagaccacau

SEQ ID NO: 1063683 - RNA, 19 nt, Homo sapiens
gaaaggcugggacgacagu

SEQ ID NO: 1063684 - RNA, 19 nt, Homo sapiens
uaaggcgggacauuucuuu

SEQ ID NO: 1063685 - RNA, 19 nt, Homo sapiens
ucugugccauugcauuaaa

SEQ ID NO: 1063686 - RNA, 19 nt, Homo sapiens
guacaaggccaugcugcuu

SEQ ID NO: 1063687 - RNA, 19 nt, Homo sapiens
agacuuuguugcagauaau

SEQ ID NO: 1063688 - RNA, 19 nt, Homo sapiens
gacauauucagcagagaaa

SEQ ID NO: 1063689 - RNA, 19 nt, Homo sapiens
uguacaagggauugauuua

SEQ ID NO: 1063690 - RNA, 19 nt, Homo sapiens
ucugcucccugguguguaa

SEQ ID NO: 1063691 - RNA, 19 nt, Homo sapiens
uugaugaucuugccauucu

SEQ ID NO: 1063692 - RNA, 19 nt, Homo sapiens
aauaggaaaccaagugcua

SEQ ID NO: 1063693 - RNA, 19 nt, Homo sapiens
aagacuuuguugcagauaa

SEQ ID NO: 1063694 - RNA, 19 nt, Homo sapiens
ggcgggacauuucuuugau

SEQ ID NO: 1063695 - RNA, 19 nt, Homo sapiens
ggagaacagaaaccagaga

SEQ ID NO: 1063696 - RNA, 19 nt, Homo sapiens
gaaaccagagagguacuau

SEQ ID NO: 1063697 - RNA, 19 nt, Homo sapiens
cuucugugccauugcauua

SEQ ID NO: 1063698 - RNA, 19 nt, Homo sapiens
gcaaaguugggaaaguugu

SEQ ID NO: 1063699 - RNA, 19 nt, Homo sapiens
gcagaucugacacuaaagg

SEQ ID NO: 1063700 - RNA, 19 nt, Homo sapiens
gucagagcguuacuggaaa

SEQ ID NO: 1063701 - RNA, 19 nt, Homo sapiens
cgaaacuucuguggcugaa

SEQ ID NO: 1063702 - RNA, 19 nt, Homo sapiens
gcagcagggcacucaauca

SEQ ID NO: 1063703 - RNA, 19 nt, Homo sapiens
ggaacgucuucuugucaca

SEQ ID NO: 1063704 - RNA, 19 nt, Homo sapiens
ggaaaaugauugguuugga

SEQ ID NO: 1063705 - RNA, 19 nt, Homo sapiens
acaagggauugauuuaaac

SEQ ID NO: 1063706 - RNA, 19 nt, Homo sapiens
gcacaguguccuccaguac

SEQ ID NO: 1063707 - RNA, 19 nt, Homo sapiens
ggcaaccggucucccuuag

SEQ ID NO: 1063708 - RNA, 19 nt, Homo sapiens
accuggaucugauuaagaa

SEQ ID NO: 1063709 - RNA, 19 nt, Homo sapiens
augcauauuugaacaguca

SEQ ID NO: 1063710 - RNA, 19 nt, Homo sapiens
gccagaugccagaguauau

SEQ ID NO: 1063711 - RNA, 19 nt, Homo sapiens
gggcauggucaccggauug

SEQ ID NO: 1063712 - RNA, 19 nt, Homo sapiens
gaagacuuuguugcagaua

SEQ ID NO: 1063713 - RNA, 19 nt, Homo sapiens
guacagagauucuauauuc

SEQ ID NO: 1063714 - RNA, 19 nt, Homo sapiens
gagcacagaugguguauuu

SEQ ID NO: 1063715 - RNA, 19 nt, Homo sapiens
caaauaugcugaaagguua

SEQ ID NO: 1063716 - RNA, 19 nt, Homo sapiens
caaauggucuugcucaauu

SEQ ID NO: 1063717 - RNA, 19 nt, Homo sapiens
ccagagauauuaauggaua

SEQ ID NO: 1063718 - RNA, 19 nt, Homo sapiens
gcagauaauuugcugauga

SEQ ID NO: 1063719 - RNA, 19 nt, Homo sapiens
gaagaauucucucaggaaa

SEQ ID NO: 1063720 - RNA, 19 nt, Homo sapiens
ggaauuaucaagugaagua

SEQ ID NO: 1063721 - RNA, 19 nt, Homo sapiens
cagaagagguggccuuaaa

SEQ ID NO: 1063722 - RNA, 19 nt, Homo sapiens
ucagggagcucuacuaaug

SEQ ID NO: 1063723 - RNA, 19 nt, Homo sapiens
ugaaaugacugagaacuuu

SEQ ID NO: 1063724 - RNA, 19 nt, Homo sapiens
uaaauaacgugucagcauu

SEQ ID NO: 1063725 - RNA, 19 nt, Homo sapiens
gagcugaaaugacugagaa

SEQ ID NO: 1063726 - RNA, 19 nt, Homo sapiens
caagauaccuguuccucaa

SEQ ID NO: 1063727 - RNA, 19 nt, Homo sapiens
gaacuuuccuuuccuccuu

SEQ ID NO: 1063728 - RNA, 19 nt, Homo sapiens
gacaaugcauucugccaua

SEQ ID NO: 1063729 - RNA, 19 nt, Homo sapiens
caauaggacugcaguuuau

SEQ ID NO: 1063730 - RNA, 19 nt, Homo sapiens
gcuaaugacuuuguaaaug

SEQ ID NO: 1063731 - RNA, 19 nt, Homo sapiens
cgagaaggauuuaaugaug

SEQ ID NO: 1063732 - RNA, 19 nt, Homo sapiens
gaacaccauugucaucuca

SEQ ID NO: 1063733 - RNA, 19 nt, Homo sapiens
caaguaacauacacucuga

SEQ ID NO: 1063734 - RNA, 19 nt, Homo sapiens
uaacagaccaucacagauu

SEQ ID NO: 1063735 - RNA, 19 nt, Homo sapiens
gcacuuacauauuguugau

SEQ ID NO: 1063736 - RNA, 19 nt, Homo sapiens
agaaagagcugaaaugacu

SEQ ID NO: 1063737 - RNA, 19 nt, Homo sapiens
caucgaauauggcaagauu

SEQ ID NO: 1063738 - RNA, 19 nt, Homo sapiens
gaaguggcaucgaauaugg

SEQ ID NO: 1063739 - RNA, 19 nt, Homo sapiens
gcaggcaacuuaucaugug

SEQ ID NO: 1063740 - RNA, 19 nt, Homo sapiens
gagcagagcagguggaaga

SEQ ID NO: 1063741 - RNA, 19 nt, Homo sapiens
gaaacaaggccaaauuaca

SEQ ID NO: 1063742 - RNA, 19 nt, Homo sapiens
ccaauaggacugcaguuua

SEQ ID NO: 1063743 - RNA, 19 nt, Homo sapiens
gagaaggauuuaaugaugu

SEQ ID NO: 1063744 - RNA, 19 nt, Homo sapiens
caucagaaguggcaucgaa

SEQ ID NO: 1063745 - RNA, 19 nt, Homo sapiens
gaucagggagcucuacuaa

SEQ ID NO: 1063746 - RNA, 19 nt, Homo sapiens
gcugaaagguuauauacca

SEQ ID NO: 1063747 - RNA, 19 nt, Homo sapiens
ucacaccaguuauucaauu

SEQ ID NO: 1063748 - RNA, 19 nt, Homo sapiens
gaugugagcaaacuaugua

SEQ ID NO: 1063749 - RNA, 19 nt, Homo sapiens
caacaugugcaucaaauau

SEQ ID NO: 1063750 - RNA, 19 nt, Homo sapiens
gacaacaugugcaucaaau

SEQ ID NO: 1063751 - RNA, 19 nt, Homo sapiens
guagaugucuugcuaacuc

SEQ ID NO: 1063752 - RNA, 19 nt, Homo sapiens
ggaugugccaggaaucuua

SEQ ID NO: 1063753 - RNA, 19 nt, Homo sapiens
caucaaauaugcugaaagg

SEQ ID NO: 1063754 - RNA, 19 nt, Homo sapiens
gaauuccuauugcaguaaa

SEQ ID NO: 1063755 - RNA, 19 nt, Homo sapiens
aaaugucucucucuuauca

SEQ ID NO: 1063756 - RNA, 19 nt, Homo sapiens
uaagaaagagcugaaauga

SEQ ID NO: 1063757 - RNA, 19 nt, Homo sapiens
gcccagagauauuaaugga

SEQ ID NO: 1063758 - RNA, 19 nt, Homo sapiens
caacuuaucauguggugaa

SEQ ID NO: 1063759 - RNA, 19 nt, Homo sapiens
gaagugcccaggaugauau

SEQ ID NO: 1063760 - RNA, 19 nt, Homo sapiens
uggaguagaugucuugcua

SEQ ID NO: 1063761 - RNA, 19 nt, Homo sapiens
ggaagaauucucucaggaa

SEQ ID NO: 1063762 - RNA, 19 nt, Homo sapiens
gcuacaauauggucacaga

SEQ ID NO: 1063763 - RNA, 19 nt, Homo sapiens
gaaguacagucucuuuggu

SEQ ID NO: 1063764 - RNA, 19 nt, Homo sapiens
guauaggaauuccaaagga

SEQ ID NO: 1063765 - RNA, 19 nt, Homo sapiens
ucaaauaugcugaaagguu

SEQ ID NO: 1063766 - RNA, 19 nt, Homo sapiens
gaaaccauccauuuacuca

SEQ ID NO: 1063767 - RNA, 19 nt, Homo sapiens
cagauaauuugcugaugaa

SEQ ID NO: 1063768 - RNA, 19 nt, Homo sapiens
gcucauuaaugucaucgaa

SEQ ID NO: 1063769 - RNA, 19 nt, Homo sapiens
guuauucaauugucugcua

SEQ ID NO: 1063770 - RNA, 19 nt, Homo sapiens
caaaguaauugaaguaucc

SEQ ID NO: 1063771 - RNA, 19 nt, Homo sapiens
aaaacaagcugaagaauca

SEQ ID NO: 1063772 - RNA, 19 nt, Homo sapiens
gagcaugguauuagugaaa

SEQ ID NO: 1063773 - RNA, 19 nt, Homo sapiens
caucacagauuggaaacuu

SEQ ID NO: 1063774 - RNA, 19 nt, Homo sapiens
gcagugagccgagaucaug

SEQ ID NO: 1063775 - RNA, 19 nt, Homo sapiens
ccuauuuacugaucacaaa

SEQ ID NO: 1063776 - RNA, 19 nt, Homo sapiens
gaguucaugcuccuauuua

SEQ ID NO: 1063777 - RNA, 19 nt, Homo sapiens
ugacugagaacuuuccuuu

SEQ ID NO: 1063778 - RNA, 19 nt, Homo sapiens
guaccggaauuaucaagug

SEQ ID NO: 1063779 - RNA, 19 nt, Homo sapiens
gcacagaugguguauuugg

SEQ ID NO: 1063780 - RNA, 19 nt, Homo sapiens
cacaguacaugaaccuauu

SEQ ID NO: 1063781 - RNA, 19 nt, Homo sapiens
cuacgcggcuuuaggauca

SEQ ID NO: 1063782 - RNA, 19 nt, Homo sapiens
caucaaagaggacaacaga

SEQ ID NO: 1063783 - RNA, 19 nt, Homo sapiens
ccaaaggaauaucuuguac

SEQ ID NO: 1063784 - RNA, 19 nt, Homo sapiens
aauaacgugucagcauuua

SEQ ID NO: 1063785 - RNA, 19 nt, Homo sapiens
ugacaaagcaagacugugu

SEQ ID NO: 1063786 - RNA, 19 nt, Homo sapiens
gcagugaguaucccuguug

SEQ ID NO: 1063787 - RNA, 19 nt, Homo sapiens
gauuugaugggcuacaaua

SEQ ID NO: 1063788 - RNA, 19 nt, Homo sapiens
gaauauggcaagauuugau

SEQ ID NO: 1063789 - RNA, 19 nt, Homo sapiens
gcagaugugagcaaacuau

SEQ ID NO: 1063790 - RNA, 19 nt, Homo sapiens
gaacagccuggucaacaug

SEQ ID NO: 1063791 - RNA, 19 nt, Homo sapiens
ccaaaguaauugaaguauc

SEQ ID NO: 1063792 - RNA, 19 nt, Homo sapiens
caagugaaguacagucucu

SEQ ID NO: 1063793 - RNA, 19 nt, Homo sapiens
cagggacucuaccacagua

SEQ ID NO: 1063794 - RNA, 19 nt, Homo sapiens
gaccaucacagauuggaaa

SEQ ID NO: 1063795 - RNA, 19 nt, Homo sapiens
gcaggagaaucacuugaac

SEQ ID NO: 1063796 - RNA, 19 nt, Homo sapiens
ggccaaaguaauugaagua

SEQ ID NO: 1063797 - RNA, 19 nt, Homo sapiens
ccauugucaucucauauug

SEQ ID NO: 1063798 - RNA, 19 nt, Homo sapiens
gauagcagagcaugguauu

SEQ ID NO: 1063799 - RNA, 19 nt, Homo sapiens
aaaguuagccucugucucu

SEQ ID NO: 1063800 - RNA, 19 nt, Homo sapiens
ggauuuagauggaauuccu

SEQ ID NO: 1063801 - RNA, 19 nt, Homo sapiens
cuaaugacuuuguaaaugc

SEQ ID NO: 1063802 - RNA, 19 nt, Homo sapiens
cuacauuacugugucagaa

SEQ ID NO: 1063803 - RNA, 19 nt, Homo sapiens
uggaauuccuauugcagua

SEQ ID NO: 1063804 - RNA, 19 nt, Homo sapiens
acaccauugucaucucaua

SEQ ID NO: 1063805 - RNA, 19 nt, Homo sapiens
gguggaagaggaacuuuga

SEQ ID NO: 1063806 - RNA, 19 nt, Homo sapiens
cugaaacaaggccaaauua

SEQ ID NO: 1063807 - RNA, 19 nt, Homo sapiens
gaggucagaagaucuagaa

SEQ ID NO: 1063808 - RNA, 19 nt, Homo sapiens
gacgagaaggauuuaauga

SEQ ID NO: 1063809 - RNA, 19 nt, Homo sapiens
aaagacaauuucagcacuu

SEQ ID NO: 1063810 - RNA, 19 nt, Homo sapiens
acugugggcuuguugguuu

SEQ ID NO: 1063811 - RNA, 19 nt, Homo sapiens
gagcucuacuaaugggaaa

SEQ ID NO: 1063812 - RNA, 19 nt, Homo sapiens
acaauugagugcgauuauu

SEQ ID NO: 1063813 - RNA, 19 nt, Homo sapiens
gcaaaugccugaccaccua

SEQ ID NO: 1063814 - RNA, 19 nt, Homo sapiens
gcucaacacuauuuaagua

SEQ ID NO: 1063815 - RNA, 19 nt, Homo sapiens
gaugaacgguaucuuagua

SEQ ID NO: 1063816 - RNA, 19 nt, Homo sapiens
agacauagcuauccaaaug

SEQ ID NO: 1063817 - RNA, 19 nt, Homo sapiens
ggaagucacugcuuuggaa

SEQ ID NO: 1063818 - RNA, 19 nt, Homo sapiens
gcauguggcugaauucauu

SEQ ID NO: 1063819 - RNA, 19 nt, Homo sapiens
ggacauguauagaaaguau

SEQ ID NO: 1063820 - RNA, 19 nt, Homo sapiens
gaaaaugcaucaucaguuu

SEQ ID NO: 1063821 - RNA, 19 nt, Homo sapiens
ccaaggacauguauagaaa

SEQ ID NO: 1063822 - RNA, 19 nt, Homo sapiens
gaaaauggcaguccuaaua

SEQ ID NO: 1063823 - RNA, 19 nt, Homo sapiens
ugaagaaggugauuaugaa

SEQ ID NO: 1063824 - RNA, 19 nt, Homo sapiens
agaaagaucugucaaucaa

SEQ ID NO: 1063825 - RNA, 19 nt, Homo sapiens
acagagaugugcuggcuua

SEQ ID NO: 1063826 - RNA, 19 nt, Homo sapiens
gggcugguuuacaauauua

SEQ ID NO: 1063827 - RNA, 19 nt, Homo sapiens
ggaagaggaugaagaaggu

SEQ ID NO: 1063828 - RNA, 19 nt, Homo sapiens
gguaggaaauuuagaaaca

SEQ ID NO: 1063829 - RNA, 19 nt, Homo sapiens
gaccauugccucccaguua

SEQ ID NO: 1063830 - RNA, 19 nt, Homo sapiens
caucaucaguuugcuauuu

SEQ ID NO: 1063831 - RNA, 19 nt, Homo sapiens
gaaagugccugaugaaaau

SEQ ID NO: 1063832 - RNA, 19 nt, Homo sapiens
gaaagagucuacagaacca

SEQ ID NO: 1063833 - RNA, 19 nt, Homo sapiens
gaucaagaaggaaacuuua

SEQ ID NO: 1063834 - RNA, 19 nt, Homo sapiens
gcagcagcauguucaguuu

SEQ ID NO: 1063835 - RNA, 19 nt, Homo sapiens
gaaccaaggacauguauag

SEQ ID NO: 1063836 - RNA, 19 nt, Homo sapiens
caagaaacuucaguaauuc

SEQ ID NO: 1063837 - RNA, 19 nt, Homo sapiens
gaagaaucauguuaagaag

SEQ ID NO: 1063838 - RNA, 19 nt, Homo sapiens
uuagaguggucuuggauua

SEQ ID NO: 1063839 - RNA, 19 nt, Homo sapiens
guagaugccuguucugauc

SEQ ID NO: 1063840 - RNA, 19 nt, Homo sapiens
acaugaagcucaacacuau

SEQ ID NO: 1063841 - RNA, 19 nt, Homo sapiens
ggaaaaguuuaacccauua

SEQ ID NO: 1063842 - RNA, 19 nt, Homo sapiens
guaaugaaguggagcaaag

SEQ ID NO: 1063843 - RNA, 19 nt, Homo sapiens
ggaggaagaggaugaagaa

SEQ ID NO: 1063844 - RNA, 19 nt, Homo sapiens
agaaugaacucacagagau

SEQ ID NO: 1063845 - RNA, 19 nt, Homo sapiens
gugaaacaauucuuuagga

SEQ ID NO: 1063846 - RNA, 19 nt, Homo sapiens
caucagauccugcuuugaa

SEQ ID NO: 1063847 - RNA, 19 nt, Homo sapiens
gcaaugaccguacauccaa

SEQ ID NO: 1063848 - RNA, 19 nt, Homo sapiens
uguaauaugugguaggaaa

SEQ ID NO: 1063849 - RNA, 19 nt, Homo sapiens
gcagaagcauuugaagaau

SEQ ID NO: 1063850 - RNA, 19 nt, Homo sapiens
cacaacaccuugccaguau

SEQ ID NO: 1063851 - RNA, 19 nt, Homo sapiens
gaaauucccauaaguguac

SEQ ID NO: 1063852 - RNA, 19 nt, Homo sapiens
guucuuccauuucauuuga

SEQ ID NO: 1063853 - RNA, 19 nt, Homo sapiens
acagaggacuuaugcagaa

SEQ ID NO: 1063854 - RNA, 19 nt, Homo sapiens
gaugacacuguuucaaaua

SEQ ID NO: 1063855 - RNA, 19 nt, Homo sapiens
agacauauaugccacagau

SEQ ID NO: 1063856 - RNA, 19 nt, Homo sapiens
caauggacacagugaaaua

SEQ ID NO: 1063857 - RNA, 19 nt, Homo sapiens
agaaggugauuaugaagaa

SEQ ID NO: 1063858 - RNA, 19 nt, Homo sapiens
caguuucgcuuauaugaga

SEQ ID NO: 1063859 - RNA, 19 nt, Homo sapiens
aaccaaaucugacaagugu

SEQ ID NO: 1063860 - RNA, 19 nt, Homo sapiens
guagugauauagucaaugg

SEQ ID NO: 1063861 - RNA, 19 nt, Homo sapiens
aaagaugccugacauagag

SEQ ID NO: 1063862 - RNA, 19 nt, Homo sapiens
gacaaacaguaaugaagug

SEQ ID NO: 1063863 - RNA, 19 nt, Homo sapiens
gcuauggccuuacagaaag

SEQ ID NO: 1063864 - RNA, 19 nt, Homo sapiens
cagacagacucaaauccua

SEQ ID NO: 1063865 - RNA, 19 nt, Homo sapiens
gaagcucaacacuauuuaa

SEQ ID NO: 1063866 - RNA, 19 nt, Homo sapiens
gaaaaugggaauucugaua

SEQ ID NO: 1063867 - RNA, 19 nt, Homo sapiens
gguuguguccggauauuua

SEQ ID NO: 1063868 - RNA, 19 nt, Homo sapiens
ugaagaagaugauuaugac

SEQ ID NO: 1063869 - RNA, 19 nt, Homo sapiens
ugaugaaagugccugauga

SEQ ID NO: 1063870 - RNA, 19 nt, Homo sapiens
ggaacugugugccauccaa

SEQ ID NO: 1063871 - RNA, 19 nt, Homo sapiens
gaaucaagaaacuucagua

SEQ ID NO: 1063872 - RNA, 19 nt, Homo sapiens
ggaugaagaaggugauuau

SEQ ID NO: 1063873 - RNA, 19 nt, Homo sapiens
ucaacaggaugaucaggaa

SEQ ID NO: 1063874 - RNA, 19 nt, Homo sapiens
ccacagaucaagaaggaaa

SEQ ID NO: 1063875 - RNA, 19 nt, Homo sapiens
caaagcacauuuucuagaa

SEQ ID NO: 1063876 - RNA, 19 nt, Homo sapiens
ccaagugaaacaauucuuu

SEQ ID NO: 1063877 - RNA, 19 nt, Homo sapiens
gagaugugcuggcuuagac

SEQ ID NO: 1063878 - RNA, 19 nt, Homo sapiens
caaucaagcaguaguguga

SEQ ID NO: 1063879 - RNA, 19 nt, Homo sapiens
aaauagagcaaacaccuuu

SEQ ID NO: 1063880 - RNA, 19 nt, Homo sapiens
gaaauagagcaaacaccuu

SEQ ID NO: 1063881 - RNA, 19 nt, Homo sapiens
agaagcauuugaagaauca

SEQ ID NO: 1063882 - RNA, 19 nt, Homo sapiens
gaaaaugguucagaaagau

SEQ ID NO: 1063883 - RNA, 19 nt, Homo sapiens
acauagagccaaauucuga

SEQ ID NO: 1063884 - RNA, 19 nt, Homo sapiens
acaaccaagugaaacaauu

SEQ ID NO: 1063885 - RNA, 19 nt, Homo sapiens
gggaaaaguuuaacccauu

SEQ ID NO: 1063886 - RNA, 19 nt, Homo sapiens
gaugaaagugccugaugaa

SEQ ID NO: 1063887 - RNA, 19 nt, Homo sapiens
ugaugacacuguuucaaau

SEQ ID NO: 1063888 - RNA, 19 nt, Homo sapiens
gcaguccuaauaauucuuu

SEQ ID NO: 1063889 - RNA, 19 nt, Homo sapiens
gucagacacucuuuggauu

SEQ ID NO: 1063890 - RNA, 19 nt, Homo sapiens
auacagaggcagcaaauug

SEQ ID NO: 1063891 - RNA, 19 nt, Homo sapiens
guaugaacaugaagcucaa

SEQ ID NO: 1063892 - RNA, 19 nt, Homo sapiens
guacauccaaccgauuuaa

SEQ ID NO: 1063893 - RNA, 19 nt, Homo sapiens
auuaugaccugaaucaaga

SEQ ID NO: 1063894 - RNA, 19 nt, Homo sapiens
gaaggaaacaaagaaguca

SEQ ID NO: 1063895 - RNA, 19 nt, Homo sapiens
uuaggcaacuagucagaaa

SEQ ID NO: 1063896 - RNA, 19 nt, Homo sapiens
caaacagaaucaggacaga

SEQ ID NO: 1063897 - RNA, 19 nt, Homo sapiens
aaagacucaucuaguaaug

SEQ ID NO: 1063898 - RNA, 19 nt, Homo sapiens
gaacaugaagcucaacacu

SEQ ID NO: 1063899 - RNA, 19 nt, Homo sapiens
cagaagcauuugaagaauc

SEQ ID NO: 1063900 - RNA, 19 nt, Homo sapiens
gauaaagacaaagcacauu

SEQ ID NO: 1063901 - RNA, 19 nt, Homo sapiens
aaaggcaauuugaagauuc

SEQ ID NO: 1063902 - RNA, 19 nt, Homo sapiens
cgacaaacaguaaugaagu

SEQ ID NO: 1063903 - RNA, 19 nt, Homo sapiens
accagaagauguuauugaa

SEQ ID NO: 1063904 - RNA, 19 nt, Homo sapiens
ucccauaaguguaccagaa

SEQ ID NO: 1063905 - RNA, 19 nt, Homo sapiens
gcauguguaauauguggua

SEQ ID NO: 1063906 - RNA, 19 nt, Homo sapiens
cagacacucuuuggauuug

SEQ ID NO: 1063907 - RNA, 19 nt, Homo sapiens
ugaucaagauaacguguau

SEQ ID NO: 1063908 - RNA, 19 nt, Homo sapiens
uagaguagaugccuguucu

SEQ ID NO: 1063909 - RNA, 19 nt, Homo sapiens
ugacauagagccaaauucu

SEQ ID NO: 1063910 - RNA, 19 nt, Homo sapiens
caaggaaagagucuacaga

SEQ ID NO: 1063911 - RNA, 19 nt, Homo sapiens
ucacugcuuuggaagaaau

SEQ ID NO: 1063912 - RNA, 19 nt, Homo sapiens
gugaaaagauuaagaugug

SEQ ID NO: 1063913 - RNA, 19 nt, Homo sapiens
ccaaucagcugcucuacua

SEQ ID NO: 1063914 - RNA, 19 nt, Homo sapiens
uagaagagguggagaagua

SEQ ID NO: 1063915 - RNA, 19 nt, Homo sapiens
caaaugaaauccagauguu

SEQ ID NO: 1063916 - RNA, 19 nt, Homo sapiens
ggacagaauccuuaaauga

SEQ ID NO: 1063917 - RNA, 19 nt, Homo sapiens
caauagaguucaagcaauu

SEQ ID NO: 1063918 - RNA, 19 nt, Homo sapiens
gaaaagaccuauuaugaga

SEQ ID NO: 1063919 - RNA, 19 nt, Homo sapiens
cagcagaggugguagaaga

SEQ ID NO: 1063920 - RNA, 19 nt, Homo sapiens
gcuaauggaugcagcagaa

SEQ ID NO: 1063921 - RNA, 19 nt, Homo sapiens
aaagguaucuucacuggaa

SEQ ID NO: 1063922 - RNA, 19 nt, Homo sapiens
cauuaaagaugccuucauu

SEQ ID NO: 1063923 - RNA, 19 nt, Homo sapiens
aaaggaggcuuaucugaug

SEQ ID NO: 1063924 - RNA, 19 nt, Homo sapiens
gaaaguuccuauucagaca

SEQ ID NO: 1063925 - RNA, 19 nt, Homo sapiens
ucaagaaaguuccuauuca

SEQ ID NO: 1063926 - RNA, 19 nt, Homo sapiens
agauagagcuguuggaaau

SEQ ID NO: 1063927 - RNA, 19 nt, Homo sapiens
gcaggaagcauccauagga

SEQ ID NO: 1063928 - RNA, 19 nt, Homo sapiens
gaaaccauaucauucuaca

SEQ ID NO: 1063929 - RNA, 19 nt, Homo sapiens
cgagggaaaugguguguug

SEQ ID NO: 1063930 - RNA, 19 nt, Homo sapiens
uguacaaccucccaguuua

SEQ ID NO: 1063931 - RNA, 19 nt, Homo sapiens
agaaucagccugucaguuu

SEQ ID NO: 1063932 - RNA, 19 nt, Homo sapiens
gaacuugacacaggagaaa

SEQ ID NO: 1063933 - RNA, 19 nt, Homo sapiens
gaucugcuguuguguguag

SEQ ID NO: 1063934 - RNA, 19 nt, Homo sapiens
ggaaaugguguguuguauu

SEQ ID NO: 1063935 - RNA, 19 nt, Homo sapiens
gaagccauccuuaauguuc

SEQ ID NO: 1063936 - RNA, 19 nt, Homo sapiens
gugaagccauccuuaaugu

SEQ ID NO: 1063937 - RNA, 19 nt, Homo sapiens
guacaaccucccaguuuaa

SEQ ID NO: 1063938 - RNA, 19 nt, Homo sapiens
caagaaaguuccuauucag

SEQ ID NO: 1063939 - RNA, 19 nt, Homo sapiens
guggagauguugaaggaaa

SEQ ID NO: 1063940 - RNA, 19 nt, Homo sapiens
gaaauuauaagagccauca

SEQ ID NO: 1063941 - RNA, 19 nt, Homo sapiens
gaagagguggagaaguaua

SEQ ID NO: 1063942 - RNA, 19 nt, Homo sapiens
ccuuuaaacuaccaaauga

SEQ ID NO: 1063943 - RNA, 19 nt, Homo sapiens
ugaaaacccuuacagaaaa

SEQ ID NO: 1063944 - RNA, 19 nt, Homo sapiens
ccaaggaugugucuucucu

SEQ ID NO: 1063945 - RNA, 19 nt, Homo sapiens
guauaagacuggcaucaag

SEQ ID NO: 1063946 - RNA, 19 nt, Homo sapiens
ggaugcagcagaacuggua

SEQ ID NO: 1063947 - RNA, 19 nt, Homo sapiens
guugauaucuugcucacau

SEQ ID NO: 1063948 - RNA, 19 nt, Homo sapiens
gggacagaauccuuaaaug

SEQ ID NO: 1063949 - RNA, 19 nt, Homo sapiens
ggaugugaauuagcugaaa

SEQ ID NO: 1063950 - RNA, 19 nt, Homo sapiens
cauaugugcuuggugcuaa

SEQ ID NO: 1063951 - RNA, 19 nt, Homo sapiens
gcagauagagcuguuggaa

SEQ ID NO: 1063952 - RNA, 19 nt, Homo sapiens
ggucauuccugucccaauc

SEQ ID NO: 1063953 - RNA, 19 nt, Homo sapiens
gggaaaugguguguuguau

SEQ ID NO: 1063954 - RNA, 19 nt, Homo sapiens
caaaggaggcuuaucugau

SEQ ID NO: 1063955 - RNA, 19 nt, Homo sapiens
uagcaaaucuucuccucau

SEQ ID NO: 1063956 - RNA, 19 nt, Homo sapiens
guuuauagcucuggcaaau

SEQ ID NO: 1063957 - RNA, 19 nt, Homo sapiens
uaaggguguugauaucuug

SEQ ID NO: 1063958 - RNA, 19 nt, Homo sapiens
ccaggaugcugauggaugu

SEQ ID NO: 1063959 - RNA, 19 nt, Homo sapiens
uuuaugaacuccacaggaa

SEQ ID NO: 1063960 - RNA, 19 nt, Homo sapiens
ucaauagaguucaagcaau

SEQ ID NO: 1063961 - RNA, 19 nt, Homo sapiens
uuauagcucuggcaaaugu

SEQ ID NO: 1063962 - RNA, 19 nt, Homo sapiens
cagcaugccacccgguuua

SEQ ID NO: 1063963 - RNA, 19 nt, Homo sapiens
caggaagcauccauaggaa

SEQ ID NO: 1063964 - RNA, 19 nt, Homo sapiens
gcugauggaugugaauuag

SEQ ID NO: 1063965 - RNA, 19 nt, Homo sapiens
aaacuuugaucugcuguug

SEQ ID NO: 1063966 - RNA, 19 nt, Homo sapiens
ccagugaagccauccuuaa

SEQ ID NO: 1063967 - RNA, 19 nt, Homo sapiens
cagcagaacugguaaaaca

SEQ ID NO: 1063968 - RNA, 19 nt, Homo sapiens
acucugagacgguucuuua

SEQ ID NO: 1063969 - RNA, 19 nt, Homo sapiens
ccaaaggaggcuuaucuga

SEQ ID NO: 1063970 - RNA, 19 nt, Homo sapiens
ccucuuggcuuguggagau

SEQ ID NO: 1063971 - RNA, 19 nt, Homo sapiens
ccauaucauucuacaggaa

SEQ ID NO: 1063972 - RNA, 19 nt, Homo sapiens
aaggaugugucuucucuga

SEQ ID NO: 1063973 - RNA, 19 nt, Homo sapiens
gcuguuguguguaggaaau

SEQ ID NO: 1063974 - RNA, 19 nt, Homo sapiens
cuacugaugacauuaaaga

SEQ ID NO: 1063975 - RNA, 19 nt, Homo sapiens
ggaagcauccauaggaaag

SEQ ID NO: 1063976 - RNA, 19 nt, Homo sapiens
guauaaggccacucugaga

SEQ ID NO: 1063977 - RNA, 19 nt, Homo sapiens
ggacagauggcacagaaac

SEQ ID NO: 1063978 - RNA, 19 nt, Homo sapiens
guaccagguuauaguuuua

SEQ ID NO: 1063979 - RNA, 19 nt, Homo sapiens
gacagaauccuuaaaugag

SEQ ID NO: 1063980 - RNA, 19 nt, Homo sapiens
ucaagcaauucagaagaaa

SEQ ID NO: 1063981 - RNA, 19 nt, Homo sapiens
agacuggcaucaagaaagu

SEQ ID NO: 1063982 - RNA, 19 nt, Homo sapiens
gcacaggagcagcagauag

SEQ ID NO: 1063983 - RNA, 19 nt, Homo sapiens
aaugguguguuguauuuga

SEQ ID NO: 1063984 - RNA, 19 nt, Homo sapiens
gaaucagccugucaguuuu

SEQ ID NO: 1063985 - RNA, 19 nt, Homo sapiens
ucgaaaccauaucauucua

SEQ ID NO: 1063986 - RNA, 19 nt, Homo sapiens
gccacgggcuugaaaccaa

SEQ ID NO: 1063987 - RNA, 19 nt, Homo sapiens
gaaugaugcuguguacaac

SEQ ID NO: 1063988 - RNA, 19 nt, Homo sapiens
gcuuguguauaucaacauu

SEQ ID NO: 1063989 - RNA, 19 nt, Homo sapiens
uaucgaaaccauaucauuc

SEQ ID NO: 1063990 - RNA, 19 nt, Homo sapiens
agaaugaugcuguguacaa

SEQ ID NO: 1063991 - RNA, 19 nt, Homo sapiens
uaauaaccaggaaacagua

SEQ ID NO: 1063992 - RNA, 19 nt, Homo sapiens
ccaaaugaaauccagaugu

SEQ ID NO: 1063993 - RNA, 19 nt, Homo sapiens
cagugaaacuccaucucaa

SEQ ID NO: 1063994 - RNA, 19 nt, Homo sapiens
guugaaggaaaguuugaua

SEQ ID NO: 1063995 - RNA, 19 nt, Homo sapiens
cuacuacugaugacauuaa

SEQ ID NO: 1063996 - RNA, 19 nt, Homo sapiens
gaaaacccuuacagaaaau

SEQ ID NO: 1063997 - RNA, 19 nt, Homo sapiens
uuaaggguguugauaucuu

SEQ ID NO: 1063998 - RNA, 19 nt, Homo sapiens
cacccaagaugcugaaugg

SEQ ID NO: 1063999 - RNA, 19 nt, Homo sapiens
guuuaaggguguugauauc

SEQ ID NO: 1064000 - RNA, 19 nt, Homo sapiens
ugagaaugaugcuguguac

SEQ ID NO: 1064001 - RNA, 19 nt, Homo sapiens
cugaaugggaggaguauaa

SEQ ID NO: 1064002 - RNA, 19 nt, Homo sapiens
gaauuuuccuuugcaguuu

SEQ ID NO: 1064003 - RNA, 19 nt, Homo sapiens
ucggacagauggcacagaa

SEQ ID NO: 1064004 - RNA, 19 nt, Homo sapiens
ggauugcagugagccaaga

SEQ ID NO: 1064005 - RNA, 19 nt, Homo sapiens
ggaaggaagcguucaucca

SEQ ID NO: 1064006 - RNA, 19 nt, Homo sapiens
guguacaaccucccaguuu

SEQ ID NO: 1064007 - RNA, 19 nt, Homo sapiens
uccuuaauguuccugauaa

SEQ ID NO: 1064008 - RNA, 19 nt, Homo sapiens
cggcacacauugcuaccuu

SEQ ID NO: 1064009 - RNA, 19 nt, Homo sapiens
cagcuccuaugucuguuau

SEQ ID NO: 1064010 - RNA, 19 nt, Homo sapiens
gaacuccacaggaaguagu

SEQ ID NO: 1064011 - RNA, 19 nt, Homo sapiens
uaauguuccugauaagucu

SEQ ID NO: 1064012 - RNA, 19 nt, Homo sapiens
cacaggagcagcagauaga

SEQ ID NO: 1064013 - RNA, 19 nt, Homo sapiens
gcuaaaggcuuacgugauu

SEQ ID NO: 1064014 - RNA, 19 nt, Homo sapiens
gaaggaagauucaaacaac

SEQ ID NO: 1064015 - RNA, 19 nt, Homo sapiens
caacaaacgaggacauuaa

SEQ ID NO: 1064016 - RNA, 19 nt, Homo sapiens
gggcaccugugacuucuua

SEQ ID NO: 1064017 - RNA, 19 nt, Homo sapiens
uagcacaacuuacgcauug

SEQ ID NO: 1064018 - RNA, 19 nt, Homo sapiens
gagagcugcuaaaggcuua

SEQ ID NO: 1064019 - RNA, 19 nt, Homo sapiens
uggcagugauuuauucaua

SEQ ID NO: 1064020 - RNA, 19 nt, Homo sapiens
ggaaagacauuagcacaac

SEQ ID NO: 1064021 - RNA, 19 nt, Homo sapiens
ugacaaaucacucccauga

SEQ ID NO: 1064022 - RNA, 19 nt, Homo sapiens
aaugaaaccuagcaaagaa

SEQ ID NO: 1064023 - RNA, 19 nt, Homo sapiens
gcaacaaacgaggacauua

SEQ ID NO: 1064024 - RNA, 19 nt, Homo sapiens
ucacaccaauuccugcuuu

SEQ ID NO: 1064025 - RNA, 19 nt, Homo sapiens
gcucagccaucucauuuua

SEQ ID NO: 1064026 - RNA, 19 nt, Homo sapiens
gcagagggcaguagagaug

SEQ ID NO: 1064027 - RNA, 19 nt, Homo sapiens
guauggcagugauuuauuc

SEQ ID NO: 1064028 - RNA, 19 nt, Homo sapiens
uuacucauccucuugcuua

SEQ ID NO: 1064029 - RNA, 19 nt, Homo sapiens
gaacuuggaaagacauuag

SEQ ID NO: 1064030 - RNA, 19 nt, Homo sapiens
aaaccuagcaaagaacuua

SEQ ID NO: 1064031 - RNA, 19 nt, Homo sapiens
uaauggaucugagcaaauc

SEQ ID NO: 1064032 - RNA, 19 nt, Homo sapiens
gugcaacagugaugagaga

SEQ ID NO: 1064033 - RNA, 19 nt, Homo sapiens
aaacaaccaacccugauuu

SEQ ID NO: 1064034 - RNA, 19 nt, Homo sapiens
aaacagaggcagagacaug

SEQ ID NO: 1064035 - RNA, 19 nt, Homo sapiens
guccaaagccacacugaaa

SEQ ID NO: 1064036 - RNA, 19 nt, Homo sapiens
ggacaugguuaaggagcuu

SEQ ID NO: 1064037 - RNA, 19 nt, Homo sapiens
gaaagacauuagcacaacu

SEQ ID NO: 1064038 - RNA, 19 nt, Homo sapiens
gcaaaucuuccucuagcuu

SEQ ID NO: 1064039 - RNA, 19 nt, Homo sapiens
gaaucggcuucuauaacuu

SEQ ID NO: 1064040 - RNA, 19 nt, Homo sapiens
ggcagugauuuauucauau

SEQ ID NO: 1064041 - RNA, 19 nt, Homo sapiens
caaacaaccaacccugauu

SEQ ID NO: 1064042 - RNA, 19 nt, Homo sapiens
guccaggagugaucucuga

SEQ ID NO: 1064043 - RNA, 19 nt, Homo sapiens
gcacuuguguauuggaaaa

SEQ ID NO: 1064044 - RNA, 19 nt, Homo sapiens
ggcguccgcugacaaauca

SEQ ID NO: 1064045 - RNA, 19 nt, Homo sapiens
gcgagaaggaagauucaaa

SEQ ID NO: 1064046 - RNA, 19 nt, Homo sapiens
gaacuuacggcaacaaacg

SEQ ID NO: 1064047 - RNA, 19 nt, Homo sapiens
gcugagagcaagcuugaga

SEQ ID NO: 1064048 - RNA, 19 nt, Homo sapiens
caaagacucccuaaaccau

SEQ ID NO: 1064049 - RNA, 19 nt, Homo sapiens
ccacucagcccaccauagu

SEQ ID NO: 1064050 - RNA, 19 nt, Homo sapiens
gggcugagagcaagcuuga

SEQ ID NO: 1064051 - RNA, 19 nt, Homo sapiens
gggagugauugccgucaug

SEQ ID NO: 1064052 - RNA, 19 nt, Homo sapiens
cgauggaacccacuacaga

SEQ ID NO: 1064053 - RNA, 19 nt, Homo sapiens
ucacugaccugcccaaccu

SEQ ID NO: 1064054 - RNA, 19 nt, Homo sapiens
ggaauuguguguauuuucu

SEQ ID NO: 1064055 - RNA, 19 nt, Homo sapiens
aaaugaaaccuagcaaaga

SEQ ID NO: 1064056 - RNA, 19 nt, Homo sapiens
ucuggagucugacauuaga

SEQ ID NO: 1064057 - RNA, 19 nt, Homo sapiens
cacaccaauuccugcuuua

SEQ ID NO: 1064058 - RNA, 19 nt, Homo sapiens
agucagagguggcacaucu

SEQ ID NO: 1064059 - RNA, 19 nt, Homo sapiens
ucauaguccucgugauugu

SEQ ID NO: 1064060 - RNA, 19 nt, Homo sapiens
uuucuggagucugacauua

SEQ ID NO: 1064061 - RNA, 19 nt, Homo sapiens
caaagaacuuacggcaaca

SEQ ID NO: 1064062 - RNA, 19 nt, Homo sapiens
gagaaggaagauucaaaca

SEQ ID NO: 1064063 - RNA, 19 nt, Homo sapiens
aagcuucccuggaccugaa

SEQ ID NO: 1064064 - RNA, 19 nt, Homo sapiens
caacaaagacaggacacau

SEQ ID NO: 1064065 - RNA, 19 nt, Homo sapiens
agaaggaagauucaaacaa

SEQ ID NO: 1064066 - RNA, 19 nt, Homo sapiens
caccugugacuucuuagua

SEQ ID NO: 1064067 - RNA, 19 nt, Homo sapiens
gaaagccagcgagaaggaa

SEQ ID NO: 1064068 - RNA, 19 nt, Homo sapiens
caacccugauuuccugcuu

SEQ ID NO: 1064069 - RNA, 19 nt, Homo sapiens
uagcacuuguguauuggaa

SEQ ID NO: 1064070 - RNA, 19 nt, Homo sapiens
ggaagauucaaacaaccaa

SEQ ID NO: 1064071 - RNA, 19 nt, Homo sapiens
ccagcacccuacaguguca

SEQ ID NO: 1064072 - RNA, 19 nt, Homo sapiens
gaaaacagaggcagagaca

SEQ ID NO: 1064073 - RNA, 19 nt, Homo sapiens
ccaaagacucccuaaacca

SEQ ID NO: 1064074 - RNA, 19 nt, Homo sapiens
cugcucagccaucucauuu

SEQ ID NO: 1064075 - RNA, 19 nt, Homo sapiens
uucuagcacuuguguauug

SEQ ID NO: 1064076 - RNA, 19 nt, Homo sapiens
gacauuagcacaacuuacg

SEQ ID NO: 1064077 - RNA, 19 nt, Homo sapiens
ccauaagccaucacuggaa

SEQ ID NO: 1064078 - RNA, 19 nt, Homo sapiens
guuaaggagcuuccacuca

SEQ ID NO: 1064079 - RNA, 19 nt, Homo sapiens
cuaaaggcuuacgugauug

SEQ ID NO: 1064080 - RNA, 19 nt, Homo sapiens
uuagaaagccagcgagaag

SEQ ID NO: 1064081 - RNA, 19 nt, Homo sapiens
aacaaacgaggacauuaaa

SEQ ID NO: 1064082 - RNA, 19 nt, Homo sapiens
uaaaccaugcagcucauug

SEQ ID NO: 1064083 - RNA, 19 nt, Homo sapiens
caagauugucuguccuuca

SEQ ID NO: 1064084 - RNA, 19 nt, Homo sapiens
aaaccuguauggcagugau

SEQ ID NO: 1064085 - RNA, 19 nt, Homo sapiens
cugagcaaaucuuccucua

SEQ ID NO: 1064086 - RNA, 19 nt, Homo sapiens
auuaauggaucugagcaaa

SEQ ID NO: 1064087 - RNA, 19 nt, Homo sapiens
caccagcacccuacagugu

SEQ ID NO: 1064088 - RNA, 19 nt, Homo sapiens
ccagcgagaaggaagauuc

SEQ ID NO: 1064089 - RNA, 19 nt, Homo sapiens
caacccagaacuuggaaag

SEQ ID NO: 1064090 - RNA, 19 nt, Homo sapiens
caccaauuccugcuuuaau

SEQ ID NO: 1064091 - RNA, 19 nt, Homo sapiens
caucugcucagccaucuca

SEQ ID NO: 1064092 - RNA, 19 nt, Homo sapiens
ccuacagugucaccaguuc

SEQ ID NO: 1064093 - RNA, 19 nt, Homo sapiens
ucaaacaaccaacccugau

SEQ ID NO: 1064094 - RNA, 19 nt, Homo sapiens
ccuguauggcagugauuua

SEQ ID NO: 1064095 - RNA, 19 nt, Homo sapiens
gauuuccugcuucuccuuu

SEQ ID NO: 1064096 - RNA, 19 nt, Homo sapiens
ggcaacaaacgaggacauu

SEQ ID NO: 1064097 - RNA, 19 nt, Homo sapiens
caaaaugaaaccuagcaaa

SEQ ID NO: 1064098 - RNA, 19 nt, Homo sapiens
caucucauuuuacagcuaa

SEQ ID NO: 1064099 - RNA, 19 nt, Homo sapiens
cucauccucuugcuuauag

SEQ ID NO: 1064100 - RNA, 19 nt, Homo sapiens
gaaaccuagcaaagaacuu

SEQ ID NO: 1064101 - RNA, 19 nt, Homo sapiens
gaucugagcaaaucuuccu

SEQ ID NO: 1064102 - RNA, 19 nt, Homo sapiens
aagauugucuguccuucag

SEQ ID NO: 1064103 - RNA, 19 nt, Homo sapiens
caaccaacccugauuuccu

SEQ ID NO: 1064104 - RNA, 19 nt, Homo sapiens
cgagaaggaagauucaaac

SEQ ID NO: 1064105 - RNA, 19 nt, Homo sapiens
cauauauuccuguccaaag

SEQ ID NO: 1064106 - RNA, 19 nt, Homo sapiens
gcaucugccugccauuucc

SEQ ID NO: 1064107 - RNA, 19 nt, Homo sapiens
aaagacauuagcacaacuu

SEQ ID NO: 1064108 - RNA, 19 nt, Homo sapiens
uggaaagacauuagcacaa

SEQ ID NO: 1064109 - RNA, 19 nt, Homo sapiens
uccaaauccucgcugugaa

SEQ ID NO: 1064110 - RNA, 19 nt, Homo sapiens
agacuuccaggcugauuug

SEQ ID NO: 1064111 - RNA, 19 nt, Homo sapiens
agaaagccagcgagaagga

SEQ ID NO: 1064112 - RNA, 19 nt, Homo sapiens
ccuaaaccaugcagcucau

SEQ ID NO: 1064113 - RNA, 19 nt, Homo sapiens
gaacuggauuugagacuua

SEQ ID NO: 1064114 - RNA, 19 nt, Homo sapiens
gaagggagaugccaaguga

SEQ ID NO: 1064115 - RNA, 19 nt, Homo sapiens
gcauaaagccuucaaauga

SEQ ID NO: 1064116 - RNA, 19 nt, Homo sapiens
gagauuugcuucugucuuu

SEQ ID NO: 1064117 - RNA, 19 nt, Homo sapiens
gaaauggacucaaacaaag

SEQ ID NO: 1064118 - RNA, 19 nt, Homo sapiens
gaaauuagaugaccgaacu

SEQ ID NO: 1064119 - RNA, 19 nt, Homo sapiens
ggagggagcuugaacugaa

SEQ ID NO: 1064120 - RNA, 19 nt, Homo sapiens
cuaaugacauggaaaguuu

SEQ ID NO: 1064121 - RNA, 19 nt, Homo sapiens
caauguagagcaacaauua

SEQ ID NO: 1064122 - RNA, 19 nt, Homo sapiens
caacauuccuucauuagug

SEQ ID NO: 1064123 - RNA, 19 nt, Homo sapiens
caagaacuaucaagaguau

SEQ ID NO: 1064124 - RNA, 19 nt, Homo sapiens
gacaauaagucuucagguu

SEQ ID NO: 1064125 - RNA, 19 nt, Homo sapiens
uccaagaccugaauuuaua

SEQ ID NO: 1064126 - RNA, 19 nt, Homo sapiens
ggaaggugcugccaucuca

SEQ ID NO: 1064127 - RNA, 19 nt, Homo sapiens
ggaaagauacagauuauag

SEQ ID NO: 1064128 - RNA, 19 nt, Homo sapiens
gaagagaggauucaaaugg

SEQ ID NO: 1064129 - RNA, 19 nt, Homo sapiens
cagagaagaugacuagaga

SEQ ID NO: 1064130 - RNA, 19 nt, Homo sapiens
gaaauaaaggauucccuaa

SEQ ID NO: 1064131 - RNA, 19 nt, Homo sapiens
uacaaacucuggagaaauu

SEQ ID NO: 1064132 - RNA, 19 nt, Homo sapiens
ucaguuaccuucagauguu

SEQ ID NO: 1064133 - RNA, 19 nt, Homo sapiens
gcauggaagucuugguaaa

SEQ ID NO: 1064134 - RNA, 19 nt, Homo sapiens
uuaagggaauccaguauuu

SEQ ID NO: 1064135 - RNA, 19 nt, Homo sapiens
ggugguaacuaaugaguau

SEQ ID NO: 1064136 - RNA, 19 nt, Homo sapiens
gaagaugaguucagacacu

SEQ ID NO: 1064137 - RNA, 19 nt, Homo sapiens
ugaaauggacucaaacaaa

SEQ ID NO: 1064138 - RNA, 19 nt, Homo sapiens
gguggagucucuuucauug

SEQ ID NO: 1064139 - RNA, 19 nt, Homo sapiens
ucacuaagcccaucgaaga

SEQ ID NO: 1064140 - RNA, 19 nt, Homo sapiens
gcaagaacuaucaagagua

SEQ ID NO: 1064141 - RNA, 19 nt, Homo sapiens
gggcaacagucacauacuu

SEQ ID NO: 1064142 - RNA, 19 nt, Homo sapiens
gagcaacaauuaucuacca

SEQ ID NO: 1064143 - RNA, 19 nt, Homo sapiens
gaaaaggaauugauaccaa

SEQ ID NO: 1064144 - RNA, 19 nt, Homo sapiens
ggaagugucccgucuacaa

SEQ ID NO: 1064145 - RNA, 19 nt, Homo sapiens
caaggaauuugaucacuag

SEQ ID NO: 1064146 - RNA, 19 nt, Homo sapiens
gaagcaagaacuaucaaga

SEQ ID NO: 1064147 - RNA, 19 nt, Homo sapiens
ggugagagcucugcaucaa

SEQ ID NO: 1064148 - RNA, 19 nt, Homo sapiens
ggaauccaguauuuauguu

SEQ ID NO: 1064149 - RNA, 19 nt, Homo sapiens
gaagacaguugccauucuc

SEQ ID NO: 1064150 - RNA, 19 nt, Homo sapiens
gauccaucccuaucaguua

SEQ ID NO: 1064151 - RNA, 19 nt, Homo sapiens
cuagugaccuggguaguuu

SEQ ID NO: 1064152 - RNA, 19 nt, Homo sapiens
auaaaggauucccuaagua

SEQ ID NO: 1064153 - RNA, 19 nt, Homo sapiens
gcgagccucucucuaguga

SEQ ID NO: 1064154 - RNA, 19 nt, Homo sapiens
ucaaauggaaggacaauau

SEQ ID NO: 1064155 - RNA, 19 nt, Homo sapiens
caacccauuucaacaguga

SEQ ID NO: 1064156 - RNA, 19 nt, Homo sapiens
cuuauuaacuucucuguca

SEQ ID NO: 1064157 - RNA, 19 nt, Homo sapiens
ggugguauguacucacaaa

SEQ ID NO: 1064158 - RNA, 19 nt, Homo sapiens
uuauagagcuagcauggaa

SEQ ID NO: 1064159 - RNA, 19 nt, Homo sapiens
gaacugguggagucucuuu

SEQ ID NO: 1064160 - RNA, 19 nt, Homo sapiens
aauaaaggauucccuaagu

SEQ ID NO: 1064161 - RNA, 19 nt, Homo sapiens
gagacuuaauccuguugua

SEQ ID NO: 1064162 - RNA, 19 nt, Homo sapiens
guauuuauguucacuccaa

SEQ ID NO: 1064163 - RNA, 19 nt, Homo sapiens
gguauguacucacaaagau

SEQ ID NO: 1064164 - RNA, 19 nt, Homo sapiens
ggagaagacaguugccauu

SEQ ID NO: 1064165 - RNA, 19 nt, Homo sapiens
gcugccaucucaauuguga

SEQ ID NO: 1064166 - RNA, 19 nt, Homo sapiens
ucagaacacagaaagauuu

SEQ ID NO: 1064167 - RNA, 19 nt, Homo sapiens
ccaggaagaugaguucaga

SEQ ID NO: 1064168 - RNA, 19 nt, Homo sapiens
ugaccgaacuguacgugaa

SEQ ID NO: 1064169 - RNA, 19 nt, Homo sapiens
agugaugccuucagaaauu

SEQ ID NO: 1064170 - RNA, 19 nt, Homo sapiens
ucacuagccuuaagggaau

SEQ ID NO: 1064171 - RNA, 19 nt, Homo sapiens
gaucccuggugguaacuaa

SEQ ID NO: 1064172 - RNA, 19 nt, Homo sapiens
gcagcgagccucucucuag

SEQ ID NO: 1064173 - RNA, 19 nt, Homo sapiens
ucuccgauccuuagauuua

SEQ ID NO: 1064174 - RNA, 19 nt, Homo sapiens
caauaagucuucagguucu

SEQ ID NO: 1064175 - RNA, 19 nt, Homo sapiens
uagagaaggguaccaagua

SEQ ID NO: 1064176 - RNA, 19 nt, Homo sapiens
ggcaacagucacauacuua

SEQ ID NO: 1064177 - RNA, 19 nt, Homo sapiens
gggcaacagugaaaauuuu

SEQ ID NO: 1064178 - RNA, 19 nt, Homo sapiens
uaagggaauccaguauuua

SEQ ID NO: 1064179 - RNA, 19 nt, Homo sapiens
agagaaggguaccaaguau

SEQ ID NO: 1064180 - RNA, 19 nt, Homo sapiens
guacacgugaucagaaauu

SEQ ID NO: 1064181 - RNA, 19 nt, Homo sapiens
guaaggaaagauacagauu

SEQ ID NO: 1064182 - RNA, 19 nt, Homo sapiens
uccuggagcuuguggauaa

SEQ ID NO: 1064183 - RNA, 19 nt, Homo sapiens
cauaaagccuucaaaugac

SEQ ID NO: 1064184 - RNA, 19 nt, Homo sapiens
gcaacagucacauacuuau

SEQ ID NO: 1064185 - RNA, 19 nt, Homo sapiens
cugcgcagcuggucccuaa

SEQ ID NO: 1064186 - RNA, 19 nt, Homo sapiens
cagccuggaugauuuaaca

SEQ ID NO: 1064187 - RNA, 19 nt, Homo sapiens
ggacacagacacaggaagu

SEQ ID NO: 1064188 - RNA, 19 nt, Homo sapiens
ucagagaucccugguggua

SEQ ID NO: 1064189 - RNA, 19 nt, Homo sapiens
gacaguuguuauucucaaa

SEQ ID NO: 1064190 - RNA, 19 nt, Homo sapiens
uauaggcucuuugcuguau

SEQ ID NO: 1064191 - RNA, 19 nt, Homo sapiens
ugagaagggucaucaucug

SEQ ID NO: 1064192 - RNA, 19 nt, Homo sapiens
aagcaugguuuccaagaug

SEQ ID NO: 1064193 - RNA, 19 nt, Homo sapiens
ucaagaguauagcauaaag

SEQ ID NO: 1064194 - RNA, 19 nt, Homo sapiens
gugaugccuucagaaauuu

SEQ ID NO: 1064195 - RNA, 19 nt, Homo sapiens
gagaagaugacuagagaag

SEQ ID NO: 1064196 - RNA, 19 nt, Homo sapiens
guugacagcaggauugaaa

SEQ ID NO: 1064197 - RNA, 19 nt, Homo sapiens
gggaauccaguauuuaugu

SEQ ID NO: 1064198 - RNA, 19 nt, Homo sapiens
gcuggucccuaaugacaug

SEQ ID NO: 1064199 - RNA, 19 nt, Homo sapiens
caaccugaaucuaaagcau

SEQ ID NO: 1064200 - RNA, 19 nt, Homo sapiens
ggacuucagaacacagaaa

SEQ ID NO: 1064201 - RNA, 19 nt, Homo sapiens
ggcaaaauccauuccauua

SEQ ID NO: 1064202 - RNA, 19 nt, Homo sapiens
aagagaggauucaaaugga

SEQ ID NO: 1064203 - RNA, 19 nt, Homo sapiens
uguggagacuuauuaacuu

SEQ ID NO: 1064204 - RNA, 19 nt, Homo sapiens
acauuccuguggagacuua

SEQ ID NO: 1064205 - RNA, 19 nt, Homo sapiens
ccugauacuuuucaucuua

SEQ ID NO: 1064206 - RNA, 19 nt, Homo sapiens
gcaacucagggcaauggua

SEQ ID NO: 1064207 - RNA, 19 nt, Homo sapiens
gaaagauacagauuauagg

SEQ ID NO: 1064208 - RNA, 19 nt, Homo sapiens
agagaggauucaaauggaa

SEQ ID NO: 1064209 - RNA, 19 nt, Homo sapiens
ugacaguuguuauucucaa

SEQ ID NO: 1064210 - RNA, 19 nt, Homo sapiens
uacacgugaucagaaauua

SEQ ID NO: 1064211 - RNA, 19 nt, Homo sapiens
caaaauccauuccauuagu

SEQ ID NO: 1064212 - RNA, 19 nt, Homo sapiens
ggagaugccaagugacaau

SEQ ID NO: 1064213 - RNA, 19 nt, Homo sapiens
gaauuuaccucuacucauu

SEQ ID NO: 1064214 - RNA, 19 nt, Homo sapiens
gaagaacacucauuacaug

SEQ ID NO: 1064215 - RNA, 19 nt, Homo sapiens
gaacaaagguaccaagcaa

SEQ ID NO: 1064216 - RNA, 19 nt, Homo sapiens
gaucagauguaguauguuu

SEQ ID NO: 1064217 - RNA, 19 nt, Homo sapiens
gcauguaucuggaucaauu

SEQ ID NO: 1064218 - RNA, 19 nt, Homo sapiens
ugacaucgauccagaaauu

SEQ ID NO: 1064219 - RNA, 19 nt, Homo sapiens
caagauggcuucccagaga

SEQ ID NO: 1064220 - RNA, 19 nt, Homo sapiens
ggaaacaucuacccuggaa

SEQ ID NO: 1064221 - RNA, 19 nt, Homo sapiens
gagaucagauguaguaugu

SEQ ID NO: 1064222 - RNA, 19 nt, Homo sapiens
ugacguguaugaucaguua

SEQ ID NO: 1064223 - RNA, 19 nt, Homo sapiens
gcaaagaucuacccaacuc

SEQ ID NO: 1064224 - RNA, 19 nt, Homo sapiens
ggugguagcuuucaaggaa

SEQ ID NO: 1064225 - RNA, 19 nt, Homo sapiens
gaagaugacccuccaguau

SEQ ID NO: 1064226 - RNA, 19 nt, Homo sapiens
gaaggaaguuucuguuucu

SEQ ID NO: 1064227 - RNA, 19 nt, Homo sapiens
caguggagcuucaguuuaa

SEQ ID NO: 1064228 - RNA, 19 nt, Homo sapiens
gcuaucagguuuaucugua

SEQ ID NO: 1064229 - RNA, 19 nt, Homo sapiens
gauggcagauccugaggua

SEQ ID NO: 1064230 - RNA, 19 nt, Homo sapiens
gaaacuugccauacaaauu

SEQ ID NO: 1064231 - RNA, 19 nt, Homo sapiens
gcccauaguggaagaauua

SEQ ID NO: 1064232 - RNA, 19 nt, Homo sapiens
gaccuauaauucaccaaua

SEQ ID NO: 1064233 - RNA, 19 nt, Homo sapiens
gaugaucuuugaugccuuu

SEQ ID NO: 1064234 - RNA, 19 nt, Homo sapiens
gcuaagagucuaacuaguu

SEQ ID NO: 1064235 - RNA, 19 nt, Homo sapiens
gcagacaguucgucaucaa

SEQ ID NO: 1064236 - RNA, 19 nt, Homo sapiens
agacugaacuucguacauu

SEQ ID NO: 1064237 - RNA, 19 nt, Homo sapiens
gaaaugauaccuuugacau

SEQ ID NO: 1064238 - RNA, 19 nt, Homo sapiens
gaacuuaacacuggacuuc

SEQ ID NO: 1064239 - RNA, 19 nt, Homo sapiens
ccgaauggaugacacauau

SEQ ID NO: 1064240 - RNA, 19 nt, Homo sapiens
ggaaguuucuguuucugau

SEQ ID NO: 1064241 - RNA, 19 nt, Homo sapiens
ugcauuagaucugugauua

SEQ ID NO: 1064242 - RNA, 19 nt, Homo sapiens
uguaaagacuggcauguau

SEQ ID NO: 1064243 - RNA, 19 nt, Homo sapiens
ggaagagaauacuauagca

SEQ ID NO: 1064244 - RNA, 19 nt, Homo sapiens
aaagugacguguaugauca

SEQ ID NO: 1064245 - RNA, 19 nt, Homo sapiens
aaaaguagcuaucagguuu

SEQ ID NO: 1064246 - RNA, 19 nt, Homo sapiens
ucaucagccucuuuauaua

SEQ ID NO: 1064247 - RNA, 19 nt, Homo sapiens
ggaugguacauuaugauua

SEQ ID NO: 1064248 - RNA, 19 nt, Homo sapiens
caaggaagagaauacuaua

SEQ ID NO: 1064249 - RNA, 19 nt, Homo sapiens
gugcagcuaugauuuacuu

SEQ ID NO: 1064250 - RNA, 19 nt, Homo sapiens
caguuaaucuucgcaguaa

SEQ ID NO: 1064251 - RNA, 19 nt, Homo sapiens
gacugaacuucguacauuu

SEQ ID NO: 1064252 - RNA, 19 nt, Homo sapiens
ucauugcacugaucacuga

SEQ ID NO: 1064253 - RNA, 19 nt, Homo sapiens
gcuaugauuuacuuagguu

SEQ ID NO: 1064254 - RNA, 19 nt, Homo sapiens
ugacuuuacucugacuaua

SEQ ID NO: 1064255 - RNA, 19 nt, Homo sapiens
cauuagaucugugauuaga

SEQ ID NO: 1064256 - RNA, 19 nt, Homo sapiens
ugacuugcuugguuucauu

SEQ ID NO: 1064257 - RNA, 19 nt, Homo sapiens
ccauuaaucugcagacagu

SEQ ID NO: 1064258 - RNA, 19 nt, Homo sapiens
ggaacacuguggauauucu

SEQ ID NO: 1064259 - RNA, 19 nt, Homo sapiens
agcaggaguuugucaauuu

SEQ ID NO: 1064260 - RNA, 19 nt, Homo sapiens
cagcaaacaucuccaucug

SEQ ID NO: 1064261 - RNA, 19 nt, Homo sapiens
guucugggcucgagguaga

SEQ ID NO: 1064262 - RNA, 19 nt, Homo sapiens
cagcaggaguuugucaauu

SEQ ID NO: 1064263 - RNA, 19 nt, Homo sapiens
uguuaugacuuuacucuga

SEQ ID NO: 1064264 - RNA, 19 nt, Homo sapiens
gacaguucgucaucaagaa

SEQ ID NO: 1064265 - RNA, 19 nt, Homo sapiens
caucuacccuggaaaugau

SEQ ID NO: 1064266 - RNA, 19 nt, Homo sapiens
aaacuugccauacaaauuc

SEQ ID NO: 1064267 - RNA, 19 nt, Homo sapiens
uaucuguacuuuagaggaa

SEQ ID NO: 1064268 - RNA, 19 nt, Homo sapiens
gaucuuugaugccuuuguc

SEQ ID NO: 1064269 - RNA, 19 nt, Homo sapiens
ucaaacaccuuuuccuaaa

SEQ ID NO: 1064270 - RNA, 19 nt, Homo sapiens
uauaauguguagcugaguu

SEQ ID NO: 1064271 - RNA, 19 nt, Homo sapiens
gauaaauggagaugauaug

SEQ ID NO: 1064272 - RNA, 19 nt, Homo sapiens
uacuuagucuggcuguuua

SEQ ID NO: 1064273 - RNA, 19 nt, Homo sapiens
cuauccagcuggucuuauu

SEQ ID NO: 1064274 - RNA, 19 nt, Homo sapiens
aaauugcaauggugacuau

SEQ ID NO: 1064275 - RNA, 19 nt, Homo sapiens
caucagccucuuuauauau

SEQ ID NO: 1064276 - RNA, 19 nt, Homo sapiens
caagcuaagagucuaacua

SEQ ID NO: 1064277 - RNA, 19 nt, Homo sapiens
ggaaauccaagcuaagagu

SEQ ID NO: 1064278 - RNA, 19 nt, Homo sapiens
uuagaggacuucagcuuca

SEQ ID NO: 1064279 - RNA, 19 nt, Homo sapiens
cagaagaacacucauuaca

SEQ ID NO: 1064280 - RNA, 19 nt, Homo sapiens
gacuuuacucugacuauaa

SEQ ID NO: 1064281 - RNA, 19 nt, Homo sapiens
caaagugacguguaugauc

SEQ ID NO: 1064282 - RNA, 19 nt, Homo sapiens
gaagagaauacuauagcau

SEQ ID NO: 1064283 - RNA, 19 nt, Homo sapiens
ugauauguuugccacguuu

SEQ ID NO: 1064284 - RNA, 19 nt, Homo sapiens
agaacucccugacuguuau

SEQ ID NO: 1064285 - RNA, 19 nt, Homo sapiens
ggacuuccacagacuccua

SEQ ID NO: 1064286 - RNA, 19 nt, Homo sapiens
ucaaggaagagaauacuau

SEQ ID NO: 1064287 - RNA, 19 nt, Homo sapiens
ggccuuaccaugacaaguu

SEQ ID NO: 1064288 - RNA, 19 nt, Homo sapiens
gcaggaguuugucaauuuu

SEQ ID NO: 1064289 - RNA, 19 nt, Homo sapiens
aaacugaaagccauuaauc

SEQ ID NO: 1064290 - RNA, 19 nt, Homo sapiens
aaacaucuacccuggaaau

SEQ ID NO: 1064291 - RNA, 19 nt, Homo sapiens
gagcuaauugagaccuaua

SEQ ID NO: 1064292 - RNA, 19 nt, Homo sapiens
gccuuaccaugacaaguuu

SEQ ID NO: 1064293 - RNA, 19 nt, Homo sapiens
cuggaucaauucagaagaa

SEQ ID NO: 1064294 - RNA, 19 nt, Homo sapiens
ggaaacuugccauacaaau

SEQ ID NO: 1064295 - RNA, 19 nt, Homo sapiens
ggaaaugauaccuuugaca

SEQ ID NO: 1064296 - RNA, 19 nt, Homo sapiens
ucaguuaaucuucgcagua

SEQ ID NO: 1064297 - RNA, 19 nt, Homo sapiens
caauuaagcaauaccaaca

SEQ ID NO: 1064298 - RNA, 19 nt, Homo sapiens
caucugaggagcuucuauu

SEQ ID NO: 1064299 - RNA, 19 nt, Homo sapiens
ucugauaaauggagaugau

SEQ ID NO: 1064300 - RNA, 19 nt, Homo sapiens
gaaauugaaacugaguguu

SEQ ID NO: 1064301 - RNA, 19 nt, Homo sapiens
auccagaaauugaaacuga

SEQ ID NO: 1064302 - RNA, 19 nt, Homo sapiens
aaggauauauggaccgaau

SEQ ID NO: 1064303 - RNA, 19 nt, Homo sapiens
gauuagaggacuucagcuu

SEQ ID NO: 1064304 - RNA, 19 nt, Homo sapiens
aagaacucccugacuguua

SEQ ID NO: 1064305 - RNA, 19 nt, Homo sapiens
ggagccagaugaaccuuuu

SEQ ID NO: 1064306 - RNA, 19 nt, Homo sapiens
gcaaucugcuauggcaauc

SEQ ID NO: 1064307 - RNA, 19 nt, Homo sapiens
ucagguuuaucuguacuuu

SEQ ID NO: 1064308 - RNA, 19 nt, Homo sapiens
ucauucaucagccucuuua

SEQ ID NO: 1064309 - RNA, 19 nt, Homo sapiens
uaacaguggagcuucaguu

SEQ ID NO: 1064310 - RNA, 19 nt, Homo sapiens
cgaaacaauuaagcaauac

SEQ ID NO: 1064311 - RNA, 19 nt, Homo sapiens
aaaguacaaccuccucauu

SEQ ID NO: 1064312 - RNA, 19 nt, Homo sapiens
gcauacuucuugggacuuc

SEQ ID NO: 1064313 - RNA, 19 nt, Homo sapiens
gaaaugaacuuacugguua

SEQ ID NO: 1064314 - RNA, 19 nt, Homo sapiens
ggaaugaccuuaaaugaga

SEQ ID NO: 1064315 - RNA, 19 nt, Homo sapiens
gcagagagguacaguaugu

SEQ ID NO: 1064316 - RNA, 19 nt, Homo sapiens
gaauuaacaugcgucuuua

SEQ ID NO: 1064317 - RNA, 19 nt, Homo sapiens
gaaauauccugcagugaau

SEQ ID NO: 1064318 - RNA, 19 nt, Homo sapiens
gaaguaaagguaugaguaa

SEQ ID NO: 1064319 - RNA, 19 nt, Homo sapiens
ugacagaggcuuaauguuu

SEQ ID NO: 1064320 - RNA, 19 nt, Homo sapiens
ccaguuggcugaaagguuu

SEQ ID NO: 1064321 - RNA, 19 nt, Homo sapiens
gaagugaccuauaggcaau

SEQ ID NO: 1064322 - RNA, 19 nt, Homo sapiens
gaagauaguccuacugaga

SEQ ID NO: 1064323 - RNA, 19 nt, Homo sapiens
gcaauggucauaucuguuu

SEQ ID NO: 1064324 - RNA, 19 nt, Homo sapiens
gcacugugauccuaagguu

SEQ ID NO: 1064325 - RNA, 19 nt, Homo sapiens
ucacacagccauauaguuu

SEQ ID NO: 1064326 - RNA, 19 nt, Homo sapiens
ggucauaucuguuuaucca

SEQ ID NO: 1064327 - RNA, 19 nt, Homo sapiens
ggacuguaaugaaagauca

SEQ ID NO: 1064328 - RNA, 19 nt, Homo sapiens
ugaauuaacaugcgucuuu

SEQ ID NO: 1064329 - RNA, 19 nt, Homo sapiens
guauauaguuccucaaucu

SEQ ID NO: 1064330 - RNA, 19 nt, Homo sapiens
gcagaaacgacuacagaaa

SEQ ID NO: 1064331 - RNA, 19 nt, Homo sapiens
aguaucaucuuguccuuua

SEQ ID NO: 1064332 - RNA, 19 nt, Homo sapiens
uaacaugcgucuuuaaagg

SEQ ID NO: 1064333 - RNA, 19 nt, Homo sapiens
agugagggauccaacauua

SEQ ID NO: 1064334 - RNA, 19 nt, Homo sapiens
gcugaaagguuugaaauac

SEQ ID NO: 1064335 - RNA, 19 nt, Homo sapiens
gucaggaaaugucaaauau

SEQ ID NO: 1064336 - RNA, 19 nt, Homo sapiens
ugaaauauccugcagugaa

SEQ ID NO: 1064337 - RNA, 19 nt, Homo sapiens
gaacuuacugguuauagug

SEQ ID NO: 1064338 - RNA, 19 nt, Homo sapiens
caacugacaugcuuuuauu

SEQ ID NO: 1064339 - RNA, 19 nt, Homo sapiens
ucagguaccuuauaugaag

SEQ ID NO: 1064340 - RNA, 19 nt, Homo sapiens
uggcagugaugauuaaauu

SEQ ID NO: 1064341 - RNA, 19 nt, Homo sapiens
guaacaagaauccaaagaa

SEQ ID NO: 1064342 - RNA, 19 nt, Homo sapiens
caaguaacauuggcagaga

SEQ ID NO: 1064343 - RNA, 19 nt, Homo sapiens
caauaacaaugacuuccuu

SEQ ID NO: 1064344 - RNA, 19 nt, Homo sapiens
gugcgaacauguaacaaga

SEQ ID NO: 1064345 - RNA, 19 nt, Homo sapiens
agaaacgacuacagaaaga

SEQ ID NO: 1064346 - RNA, 19 nt, Homo sapiens
aaauggcagugaugauuaa

SEQ ID NO: 1064347 - RNA, 19 nt, Homo sapiens
uauaggguaugaaugguuu

SEQ ID NO: 1064348 - RNA, 19 nt, Homo sapiens
caucagguaccuuauauga

SEQ ID NO: 1064349 - RNA, 19 nt, Homo sapiens
gaaucaauuugggcuuaaa

SEQ ID NO: 1064350 - RNA, 19 nt, Homo sapiens
gacagaggcuuaauguuuu

SEQ ID NO: 1064351 - RNA, 19 nt, Homo sapiens
cauggaagauuuucaagua

SEQ ID NO: 1064352 - RNA, 19 nt, Homo sapiens
gcgaacauguaacaagaau

SEQ ID NO: 1064353 - RNA, 19 nt, Homo sapiens
acuaucaaaugguugcuua

SEQ ID NO: 1064354 - RNA, 19 nt, Homo sapiens
caugagcccuacugccuaa

SEQ ID NO: 1064355 - RNA, 19 nt, Homo sapiens
ugaaguaaagguaugagua

SEQ ID NO: 1064356 - RNA, 19 nt, Homo sapiens
uaaugcaggugucaggaaa

SEQ ID NO: 1064357 - RNA, 19 nt, Homo sapiens
gaaugaccuuaaaugagaa

SEQ ID NO: 1064358 - RNA, 19 nt, Homo sapiens
gcagugaauauaugaauca

SEQ ID NO: 1064359 - RNA, 19 nt, Homo sapiens
aauuugggcuuguuauuug

SEQ ID NO: 1064360 - RNA, 19 nt, Homo sapiens
ugaguaauauaggguauga

SEQ ID NO: 1064361 - RNA, 19 nt, Homo sapiens
caauggucauaucuguuua

SEQ ID NO: 1064362 - RNA, 19 nt, Homo sapiens
aaaggacuguaaugaaaga

SEQ ID NO: 1064363 - RNA, 19 nt, Homo sapiens
ccaggcaacugacaugcuu

SEQ ID NO: 1064364 - RNA, 19 nt, Homo sapiens
ggguaugaaugguuuaauc

SEQ ID NO: 1064365 - RNA, 19 nt, Homo sapiens
ggauccaacauuacuuuaa

SEQ ID NO: 1064366 - RNA, 19 nt, Homo sapiens
cagaagauaguccuacuga

SEQ ID NO: 1064367 - RNA, 19 nt, Homo sapiens
uaacauuggcagagaggua

SEQ ID NO: 1064368 - RNA, 19 nt, Homo sapiens
uaucuacugucaaguuguu

SEQ ID NO: 1064369 - RNA, 19 nt, Homo sapiens
ugaaaugaacuuacugguu

SEQ ID NO: 1064370 - RNA, 19 nt, Homo sapiens
uagcaauggucauaucugu

SEQ ID NO: 1064371 - RNA, 19 nt, Homo sapiens
gacuggaagugaccuauag

SEQ ID NO: 1064372 - RNA, 19 nt, Homo sapiens
gaacauguaacaagaaucc

SEQ ID NO: 1064373 - RNA, 19 nt, Homo sapiens
gaccaccggauaauucuuu

SEQ ID NO: 1064374 - RNA, 19 nt, Homo sapiens
uugcugcaguccauaauuu

SEQ ID NO: 1064375 - RNA, 19 nt, Homo sapiens
uaauauaggguaugaaugg

SEQ ID NO: 1064376 - RNA, 19 nt, Homo sapiens
uacaguauguuaucccuau

SEQ ID NO: 1064377 - RNA, 19 nt, Homo sapiens
ugacccaccuccuggaaug

SEQ ID NO: 1064378 - RNA, 19 nt, Homo sapiens
agagagguacaguauguua

SEQ ID NO: 1064379 - RNA, 19 nt, Homo sapiens
gaagaguguucaaaauuca

SEQ ID NO: 1064380 - RNA, 19 nt, Homo sapiens
uauaucuacugucaaguug

SEQ ID NO: 1064381 - RNA, 19 nt, Homo sapiens
gaacuguuggcuuugcaaa

SEQ ID NO: 1064382 - RNA, 19 nt, Homo sapiens
uuaaauugcugcaguccau

SEQ ID NO: 1064383 - RNA, 19 nt, Homo sapiens
gagaagaguguucaaaauu

SEQ ID NO: 1064384 - RNA, 19 nt, Homo sapiens
ugucaggaaaugucaaaua

SEQ ID NO: 1064385 - RNA, 19 nt, Homo sapiens
gaccuuaaaugagaagagu

SEQ ID NO: 1064386 - RNA, 19 nt, Homo sapiens
ucaguuugucuuagcauua

SEQ ID NO: 1064387 - RNA, 19 nt, Homo sapiens
ugaaucaauuugggcuuaa

SEQ ID NO: 1064388 - RNA, 19 nt, Homo sapiens
guuuauaucuacugucaag

SEQ ID NO: 1064389 - RNA, 19 nt, Homo sapiens
gugcaucagguaccuuaua

SEQ ID NO: 1064390 - RNA, 19 nt, Homo sapiens
guuuauccauucuaacaga

SEQ ID NO: 1064391 - RNA, 19 nt, Homo sapiens
ugaaauacguaccccagua

SEQ ID NO: 1064392 - RNA, 19 nt, Homo sapiens
gaaagguuugaaauacgua

SEQ ID NO: 1064393 - RNA, 19 nt, Homo sapiens
caaaaucuguuucuacuac

SEQ ID NO: 1064394 - RNA, 19 nt, Homo sapiens
gguaugaaugguuuaauca

SEQ ID NO: 1064395 - RNA, 19 nt, Homo sapiens
gaaacgacuacagaaagaa

SEQ ID NO: 1064396 - RNA, 19 nt, Homo sapiens
ugaaagguuugaaauacgu

SEQ ID NO: 1064397 - RNA, 19 nt, Homo sapiens
ucaguaccaugugaguuaa

SEQ ID NO: 1064398 - RNA, 19 nt, Homo sapiens
gaaagguccaguucucagu

SEQ ID NO: 1064399 - RNA, 19 nt, Homo sapiens
guugaaagguccaguucuc

SEQ ID NO: 1064400 - RNA, 19 nt, Homo sapiens
gcuuacagcuagaugaaac

SEQ ID NO: 1064401 - RNA, 19 nt, Homo sapiens
ggaaaccccguaaacauuu

SEQ ID NO: 1064402 - RNA, 19 nt, Homo sapiens
gccuaaacacuauuucauu

SEQ ID NO: 1064403 - RNA, 19 nt, Homo sapiens
ggucauguuuacuggugaa

SEQ ID NO: 1064404 - RNA, 19 nt, Homo sapiens
gaugacauuuuguagcuuu

SEQ ID NO: 1064405 - RNA, 19 nt, Homo sapiens
gaaauacguaccccaguaa

SEQ ID NO: 1064406 - RNA, 19 nt, Homo sapiens
cucaaucucugaaguaaag

SEQ ID NO: 1064407 - RNA, 19 nt, Homo sapiens
ggcugaaagguuugaaaua

SEQ ID NO: 1064408 - RNA, 19 nt, Homo sapiens
gcaaaagucacuaucaaau

SEQ ID NO: 1064409 - RNA, 19 nt, Homo sapiens
gaaaccccguaaacauuuu

SEQ ID NO: 1064410 - RNA, 19 nt, Homo sapiens
cagaaacgacuacagaaag

SEQ ID NO: 1064411 - RNA, 19 nt, Homo sapiens
gggauccaacauuacuuua

SEQ ID NO: 1064412 - RNA, 19 nt, Homo sapiens
ccuaugaaaugaacuuacu

SEQ ID NO: 1064413 - RNA, 19 nt, Homo sapiens
ggaauaggguuguuacauu

SEQ ID NO: 1064414 - RNA, 19 nt, Homo sapiens
ggucauaaguuaaagcaua

SEQ ID NO: 1064415 - RNA, 19 nt, Homo sapiens
gaucgucacuccuuccuua

SEQ ID NO: 1064416 - RNA, 19 nt, Homo sapiens
gaagauaaaccaggaaaua

SEQ ID NO: 1064417 - RNA, 19 nt, Homo sapiens
gugcauggauuaagcaaua

SEQ ID NO: 1064418 - RNA, 19 nt, Homo sapiens
gaauaggguuguuacauug

SEQ ID NO: 1064419 - RNA, 19 nt, Homo sapiens
ugaacaaccuggaaaguuu

SEQ ID NO: 1064420 - RNA, 19 nt, Homo sapiens
ccacagagauuugcaaaga

SEQ ID NO: 1064421 - RNA, 19 nt, Homo sapiens
guaaacagcugugugaaga

SEQ ID NO: 1064422 - RNA, 19 nt, Homo sapiens
guuaagauguguaugguaa

SEQ ID NO: 1064423 - RNA, 19 nt, Homo sapiens
gaaaucagacacacuugua

SEQ ID NO: 1064424 - RNA, 19 nt, Homo sapiens
gagagaacgugaaauagga

SEQ ID NO: 1064425 - RNA, 19 nt, Homo sapiens
ccaagcgacuucucucaua

SEQ ID NO: 1064426 - RNA, 19 nt, Homo sapiens
gcagagaugucagaaacaa

SEQ ID NO: 1064427 - RNA, 19 nt, Homo sapiens
cgacuucucucauaucaug

SEQ ID NO: 1064428 - RNA, 19 nt, Homo sapiens
gaauguaugucuaagaaag

SEQ ID NO: 1064429 - RNA, 19 nt, Homo sapiens
uaaguagacugaaaucaug

SEQ ID NO: 1064430 - RNA, 19 nt, Homo sapiens
gaacgugaaauaggaaaua

SEQ ID NO: 1064431 - RNA, 19 nt, Homo sapiens
gcaccuagacagaagauaa

SEQ ID NO: 1064432 - RNA, 19 nt, Homo sapiens
ccagagaaaucguuuguca

SEQ ID NO: 1064433 - RNA, 19 nt, Homo sapiens
uaugagaggugaacccuuu

SEQ ID NO: 1064434 - RNA, 19 nt, Homo sapiens
guaaauggauacaaacuac

SEQ ID NO: 1064435 - RNA, 19 nt, Homo sapiens
gcaaaacugucuuguacua

SEQ ID NO: 1064436 - RNA, 19 nt, Homo sapiens
gagacacacuuuagaagau

SEQ ID NO: 1064437 - RNA, 19 nt, Homo sapiens
uaagacaaauccacaggaa

SEQ ID NO: 1064438 - RNA, 19 nt, Homo sapiens
ggaagcagcugggacuaug

SEQ ID NO: 1064439 - RNA, 19 nt, Homo sapiens
agucauaagucuuccuaua

SEQ ID NO: 1064440 - RNA, 19 nt, Homo sapiens
gaagcugaguggaagcaaa

SEQ ID NO: 1064441 - RNA, 19 nt, Homo sapiens
ggaaaggagaaacagauaa

SEQ ID NO: 1064442 - RNA, 19 nt, Homo sapiens
ggaaauagaagacuugaac

SEQ ID NO: 1064443 - RNA, 19 nt, Homo sapiens
uaacaaugugcauggauua

SEQ ID NO: 1064444 - RNA, 19 nt, Homo sapiens
aagaugaaauccagagaaa

SEQ ID NO: 1064445 - RNA, 19 nt, Homo sapiens
uggaggagcuggaaacaga

SEQ ID NO: 1064446 - RNA, 19 nt, Homo sapiens
gcucacgccugaaaucuca

SEQ ID NO: 1064447 - RNA, 19 nt, Homo sapiens
uaaggcaaauugaccuaaa

SEQ ID NO: 1064448 - RNA, 19 nt, Homo sapiens
gauaaaccaggaaauagaa

SEQ ID NO: 1064449 - RNA, 19 nt, Homo sapiens
gaacugacuccagauggua

SEQ ID NO: 1064450 - RNA, 19 nt, Homo sapiens
gaugaaauccagagaaauc

SEQ ID NO: 1064451 - RNA, 19 nt, Homo sapiens
gaagaugaaauccagagaa

SEQ ID NO: 1064452 - RNA, 19 nt, Homo sapiens
gggauggguuuauauagga

SEQ ID NO: 1064453 - RNA, 19 nt, Homo sapiens
aauaauguguguuggguuu

SEQ ID NO: 1064454 - RNA, 19 nt, Homo sapiens
uuuaucaccuuucccaaua

SEQ ID NO: 1064455 - RNA, 19 nt, Homo sapiens
ggcaacuccugaagcaaua

SEQ ID NO: 1064456 - RNA, 19 nt, Homo sapiens
cagcaagacccugucauua

SEQ ID NO: 1064457 - RNA, 19 nt, Homo sapiens
agaaacagauaaguccaua

SEQ ID NO: 1064458 - RNA, 19 nt, Homo sapiens
guaaaaggauggaaaacaa

SEQ ID NO: 1064459 - RNA, 19 nt, Homo sapiens
ccacugaggaaauaacuuu

SEQ ID NO: 1064460 - RNA, 19 nt, Homo sapiens
ggcgagaaauggaaauaga

SEQ ID NO: 1064461 - RNA, 19 nt, Homo sapiens
gaaaagaagacaaaacuga

SEQ ID NO: 1064462 - RNA, 19 nt, Homo sapiens
gaaaggagaaacagauaag

SEQ ID NO: 1064463 - RNA, 19 nt, Homo sapiens
guugggaaacucacaaaua

SEQ ID NO: 1064464 - RNA, 19 nt, Homo sapiens
agacacacuuuagaagaua

SEQ ID NO: 1064465 - RNA, 19 nt, Homo sapiens
ggaaccaaacaagguauua

SEQ ID NO: 1064466 - RNA, 19 nt, Homo sapiens
gggaaacucacaaauaugu

SEQ ID NO: 1064467 - RNA, 19 nt, Homo sapiens
caagcgacuucucucauau

SEQ ID NO: 1064468 - RNA, 19 nt, Homo sapiens
gaagacuugaacaacauua

SEQ ID NO: 1064469 - RNA, 19 nt, Homo sapiens
ggaaacaugaagaggguaa

SEQ ID NO: 1064470 - RNA, 19 nt, Homo sapiens
caaacuacaugggaaaaua

SEQ ID NO: 1064471 - RNA, 19 nt, Homo sapiens
gagcgucagcgcauucuuu

SEQ ID NO: 1064472 - RNA, 19 nt, Homo sapiens
uugggaaacucacaaauau

SEQ ID NO: 1064473 - RNA, 19 nt, Homo sapiens
ucauaagucuuccuauauc

SEQ ID NO: 1064474 - RNA, 19 nt, Homo sapiens
ucugaagccuauucuguuu

SEQ ID NO: 1064475 - RNA, 19 nt, Homo sapiens
ugauagaguuuggaaagaa

SEQ ID NO: 1064476 - RNA, 19 nt, Homo sapiens
accaagagaugauaaugaa

SEQ ID NO: 1064477 - RNA, 19 nt, Homo sapiens
ugaaacaucuccaaaauag

SEQ ID NO: 1064478 - RNA, 19 nt, Homo sapiens
caucauuacuccaggacaa

SEQ ID NO: 1064479 - RNA, 19 nt, Homo sapiens
gcugagagcccaucauuac

SEQ ID NO: 1064480 - RNA, 19 nt, Homo sapiens
gagggcaacuccugaagca

SEQ ID NO: 1064481 - RNA, 19 nt, Homo sapiens
agacugaaaucaugcaaag

SEQ ID NO: 1064482 - RNA, 19 nt, Homo sapiens
aggaauguaugucuaagaa

SEQ ID NO: 1064483 - RNA, 19 nt, Homo sapiens
gaaccaaacaagguauuau

SEQ ID NO: 1064484 - RNA, 19 nt, Homo sapiens
ugacgcagccaauagaauu

SEQ ID NO: 1064485 - RNA, 19 nt, Homo sapiens
cagcugggacuaugacuuu

SEQ ID NO: 1064486 - RNA, 19 nt, Homo sapiens
cacaugggaugaaguuaga

SEQ ID NO: 1064487 - RNA, 19 nt, Homo sapiens
gaagagugaugagcauguc

SEQ ID NO: 1064488 - RNA, 19 nt, Homo sapiens
gaaggaauggagaagcaaa

SEQ ID NO: 1064489 - RNA, 19 nt, Homo sapiens
guguuuaucugaagccuau

SEQ ID NO: 1064490 - RNA, 19 nt, Homo sapiens
ggagagaacgugaaauagg

SEQ ID NO: 1064491 - RNA, 19 nt, Homo sapiens
ggagauagcauggcaagca

SEQ ID NO: 1064492 - RNA, 19 nt, Homo sapiens
ucaggaagauguaacaacu

SEQ ID NO: 1064493 - RNA, 19 nt, Homo sapiens
cauaagucuuccuauauca

SEQ ID NO: 1064494 - RNA, 19 nt, Homo sapiens
agccuauucuguuuaguua

SEQ ID NO: 1064495 - RNA, 19 nt, Homo sapiens
aaugaugacuggacgaaug

SEQ ID NO: 1064496 - RNA, 19 nt, Homo sapiens
gaaauccagagaaaucguu

SEQ ID NO: 1064497 - RNA, 19 nt, Homo sapiens
ggacugggccuaagaagcu

SEQ ID NO: 1064498 - RNA, 19 nt, Homo sapiens
gcaagacccugucauuacc

SEQ ID NO: 1064499 - RNA, 19 nt, Homo sapiens
acaaauauguggaaaucag

SEQ ID NO: 1064500 - RNA, 19 nt, Homo sapiens
uagaagacuugaacaacau

SEQ ID NO: 1064501 - RNA, 19 nt, Homo sapiens
gagcaaccacugaggaaau

SEQ ID NO: 1064502 - RNA, 19 nt, Homo sapiens
gaacaaauggagagaacgu

SEQ ID NO: 1064503 - RNA, 19 nt, Homo sapiens
auacuucugucuccauuga

SEQ ID NO: 1064504 - RNA, 19 nt, Homo sapiens
gaaacagauaaguccauaa

SEQ ID NO: 1064505 - RNA, 19 nt, Homo sapiens
aggaagauguaacaacuau

SEQ ID NO: 1064506 - RNA, 19 nt, Homo sapiens
agacaacagccauaagaaa

SEQ ID NO: 1064507 - RNA, 19 nt, Homo sapiens
gagcugaucgucacuccuu

SEQ ID NO: 1064508 - RNA, 19 nt, Homo sapiens
cgagaaauggaaauagaaa

SEQ ID NO: 1064509 - RNA, 19 nt, Homo sapiens
ggaaaucagacacacuugu

SEQ ID NO: 1064510 - RNA, 19 nt, Homo sapiens
auagaagacuugaacaaca

SEQ ID NO: 1064511 - RNA, 19 nt, Homo sapiens
gagauagcauggcaagcau

SEQ ID NO: 1064512 - RNA, 19 nt, Homo sapiens
gagaucuugugucauuguu

SEQ ID NO: 1064513 - RNA, 19 nt, Homo sapiens
agacgacacugauaaauua

SEQ ID NO: 1064514 - RNA, 19 nt, Homo sapiens
guacagauguuuaugagaa

SEQ ID NO: 1064515 - RNA, 19 nt, Homo sapiens
ucacauaucuggaguuuca

SEQ ID NO: 1064516 - RNA, 19 nt, Homo sapiens
gagacaacguugaucauaa

SEQ ID NO: 1064517 - RNA, 19 nt, Homo sapiens
gagguaagcuggugucaug

SEQ ID NO: 1064518 - RNA, 19 nt, Homo sapiens
ccagggaacuaauaacuaa

SEQ ID NO: 1064519 - RNA, 19 nt, Homo sapiens
gaacagcaaagccauauau

SEQ ID NO: 1064520 - RNA, 19 nt, Homo sapiens
ggacccaagucaugagaaa

SEQ ID NO: 1064521 - RNA, 19 nt, Homo sapiens
aaacaaaggguuagucauu

SEQ ID NO: 1064522 - RNA, 19 nt, Homo sapiens
gcaaagccauauaugcaau

SEQ ID NO: 1064523 - RNA, 19 nt, Homo sapiens
gagcauggcuuaacuucag

SEQ ID NO: 1064524 - RNA, 19 nt, Homo sapiens
ggguuaagcucagcaguuu

SEQ ID NO: 1064525 - RNA, 19 nt, Homo sapiens
uaaaacaccuugaccuuaa

SEQ ID NO: 1064526 - RNA, 19 nt, Homo sapiens
ggagacaacguugaucaua

SEQ ID NO: 1064527 - RNA, 19 nt, Homo sapiens
gaccaugucuuccagauac

SEQ ID NO: 1064528 - RNA, 19 nt, Homo sapiens
aacaaaggguuagucauua

SEQ ID NO: 1064529 - RNA, 19 nt, Homo sapiens
caauuaaagugccucaugu

SEQ ID NO: 1064530 - RNA, 19 nt, Homo sapiens
ugacaacccucaaacaucu

SEQ ID NO: 1064531 - RNA, 19 nt, Homo sapiens
gucauuagcugagauguug

SEQ ID NO: 1064532 - RNA, 19 nt, Homo sapiens
gaaugaggauguggaaaca

SEQ ID NO: 1064533 - RNA, 19 nt, Homo sapiens
gaaccauacugaggaugaa

SEQ ID NO: 1064534 - RNA, 19 nt, Homo sapiens
gcugcaagcuagaugaaga

SEQ ID NO: 1064535 - RNA, 19 nt, Homo sapiens
agccauauaugcaauguuu

SEQ ID NO: 1064536 - RNA, 19 nt, Homo sapiens
gcugagauguugauuuuaa

SEQ ID NO: 1064537 - RNA, 19 nt, Homo sapiens
ggaggcccuugcagcuuua

SEQ ID NO: 1064538 - RNA, 19 nt, Homo sapiens
agacaacguugaucauaau

SEQ ID NO: 1064539 - RNA, 19 nt, Homo sapiens
gaugaagacgacacugaua

SEQ ID NO: 1064540 - RNA, 19 nt, Homo sapiens
gcaugacccucagguggua

SEQ ID NO: 1064541 - RNA, 19 nt, Homo sapiens
ggaaacaaaggguuaguca

SEQ ID NO: 1064542 - RNA, 19 nt, Homo sapiens
gaagggacccaagucauga

SEQ ID NO: 1064543 - RNA, 19 nt, Homo sapiens
ccaugcugcuugucacaua

SEQ ID NO: 1064544 - RNA, 19 nt, Homo sapiens
cagcaucuguucugauugu

SEQ ID NO: 1064545 - RNA, 19 nt, Homo sapiens
ggagaagauuuggaugaga

SEQ ID NO: 1064546 - RNA, 19 nt, Homo sapiens
aggcagggcucaaagaaga

SEQ ID NO: 1064547 - RNA, 19 nt, Homo sapiens
cgucugaucuagagaagga

SEQ ID NO: 1064548 - RNA, 19 nt, Homo sapiens
uagcugagauguugauuuu

SEQ ID NO: 1064549 - RNA, 19 nt, Homo sapiens
gagaagcugggauucauug

SEQ ID NO: 1064550 - RNA, 19 nt, Homo sapiens
aaaaguaacuaccccaauu

SEQ ID NO: 1064551 - RNA, 19 nt, Homo sapiens
cggaggcccuugcagcuuu

SEQ ID NO: 1064552 - RNA, 19 nt, Homo sapiens
ugaauacgcccuucucugu

SEQ ID NO: 1064553 - RNA, 19 nt, Homo sapiens
caagaaccauacugaggau

SEQ ID NO: 1064554 - RNA, 19 nt, Homo sapiens
cagaaccucuaaccaggaa

SEQ ID NO: 1064555 - RNA, 19 nt, Homo sapiens
gaagacgacacugauaaau

SEQ ID NO: 1064556 - RNA, 19 nt, Homo sapiens
ugagaauacucuaagaucu

SEQ ID NO: 1064557 - RNA, 19 nt, Homo sapiens
gagcagaaguccccaggaa

SEQ ID NO: 1064558 - RNA, 19 nt, Homo sapiens
ugucacauaucuggaguuu

SEQ ID NO: 1064559 - RNA, 19 nt, Homo sapiens
cagcaaagccauauaugca

SEQ ID NO: 1064560 - RNA, 19 nt, Homo sapiens
acaaaggguuagucauuag

SEQ ID NO: 1064561 - RNA, 19 nt, Homo sapiens
uugaacagcuugcuugaca

SEQ ID NO: 1064562 - RNA, 19 nt, Homo sapiens
ggaacagcaaagccauaua

SEQ ID NO: 1064563 - RNA, 19 nt, Homo sapiens
gaaccucuaaccaggaaga

SEQ ID NO: 1064564 - RNA, 19 nt, Homo sapiens
ccaauuaaagugccucaug

SEQ ID NO: 1064565 - RNA, 19 nt, Homo sapiens
aauacgcccuucucuguga

SEQ ID NO: 1064566 - RNA, 19 nt, Homo sapiens
uccagcaucuguucugauu

SEQ ID NO: 1064567 - RNA, 19 nt, Homo sapiens
gcaucugcuuuaaugagaa

SEQ ID NO: 1064568 - RNA, 19 nt, Homo sapiens
ggagaagcugggauucauu

SEQ ID NO: 1064569 - RNA, 19 nt, Homo sapiens
ugaagacgacacugauaaa

SEQ ID NO: 1064570 - RNA, 19 nt, Homo sapiens
ugagaaggguccuguucau

SEQ ID NO: 1064571 - RNA, 19 nt, Homo sapiens
gugcccauauccacagaaa

SEQ ID NO: 1064572 - RNA, 19 nt, Homo sapiens
caggagaagauuuggauga

SEQ ID NO: 1064573 - RNA, 19 nt, Homo sapiens
ggaaguacaagaccauguc

SEQ ID NO: 1064574 - RNA, 19 nt, Homo sapiens
gagcauuccuuuugacugu

SEQ ID NO: 1064575 - RNA, 19 nt, Homo sapiens
ucacagagcauuccuuuug

SEQ ID NO: 1064576 - RNA, 19 nt, Homo sapiens
agaauacucuaagaucuca

SEQ ID NO: 1064577 - RNA, 19 nt, Homo sapiens
gaaguugaacagcuugcuu

SEQ ID NO: 1064578 - RNA, 19 nt, Homo sapiens
gcaaauggagcagugaagu

SEQ ID NO: 1064579 - RNA, 19 nt, Homo sapiens
aaucacagagcauuccuuu

SEQ ID NO: 1064580 - RNA, 19 nt, Homo sapiens
aagacgacacugauaaauu

SEQ ID NO: 1064581 - RNA, 19 nt, Homo sapiens
gaaacaaaggguuagucau

SEQ ID NO: 1064582 - RNA, 19 nt, Homo sapiens
ucacccagggaacuaauaa

SEQ ID NO: 1064583 - RNA, 19 nt, Homo sapiens
gaacagcuugcuugacaac

SEQ ID NO: 1064584 - RNA, 19 nt, Homo sapiens
gagaaggguccuguucaug

SEQ ID NO: 1064585 - RNA, 19 nt, Homo sapiens
ggauguggaaacagaaguu

SEQ ID NO: 1064586 - RNA, 19 nt, Homo sapiens
gaggagaagcugggauuca

SEQ ID NO: 1064587 - RNA, 19 nt, Homo sapiens
gcaccugguacagauguuu

SEQ ID NO: 1064588 - RNA, 19 nt, Homo sapiens
agaagggacccaagucaug

SEQ ID NO: 1064589 - RNA, 19 nt, Homo sapiens
uagaugaagacgacacuga

SEQ ID NO: 1064590 - RNA, 19 nt, Homo sapiens
acaccuugaccuuaacuuu

SEQ ID NO: 1064591 - RNA, 19 nt, Homo sapiens
caggugcuguaaaauaaua

SEQ ID NO: 1064592 - RNA, 19 nt, Homo sapiens
cauccagcaucuguucuga

SEQ ID NO: 1064593 - RNA, 19 nt, Homo sapiens
gugaggagaagcugggauu

SEQ ID NO: 1064594 - RNA, 19 nt, Homo sapiens
gugaagucuuggugcagaa

SEQ ID NO: 1064595 - RNA, 19 nt, Homo sapiens
gugguugacucaggaaaca

SEQ ID NO: 1064596 - RNA, 19 nt, Homo sapiens
cacagaaaaugcagaaguu

SEQ ID NO: 1064597 - RNA, 19 nt, Homo sapiens
augaggauguggaaacaga

SEQ ID NO: 1064598 - RNA, 19 nt, Homo sapiens
caaauggagcagugaaguc

SEQ ID NO: 1064599 - RNA, 19 nt, Homo sapiens
cccaggaaacaaaggguua

SEQ ID NO: 1064600 - RNA, 19 nt, Homo sapiens
ccaaaggcacacaaucaca

SEQ ID NO: 1064601 - RNA, 19 nt, Homo sapiens
caccugguacagauguuua

SEQ ID NO: 1064602 - RNA, 19 nt, Homo sapiens
caucuuugagcaccuggua

SEQ ID NO: 1064603 - RNA, 19 nt, Homo sapiens
ugaacagcuugcuugacaa

SEQ ID NO: 1064604 - RNA, 19 nt, Homo sapiens
ugcagaaguugaacagcuu

SEQ ID NO: 1064605 - RNA, 19 nt, Homo sapiens
gugcaggugcuguaaaaua

SEQ ID NO: 1064606 - RNA, 19 nt, Homo sapiens
gacgacacugauaaauuaa

SEQ ID NO: 1064607 - RNA, 19 nt, Homo sapiens
gagcaccugguacagaugu

SEQ ID NO: 1064608 - RNA, 19 nt, Homo sapiens
ccucaggugguaacagaaa

SEQ ID NO: 1064609 - RNA, 19 nt, Homo sapiens
cagccuuaccaguuguuua

SEQ ID NO: 1064610 - RNA, 19 nt, Homo sapiens
cagugcagccuuaccaguu

SEQ ID NO: 1064611 - RNA, 19 nt, Homo sapiens
ugaaugaggauguggaaac

SEQ ID NO: 1064612 - RNA, 19 nt, Homo sapiens
ucagaagggacccaaguca

SEQ ID NO: 1064613 - RNA, 19 nt, Homo sapiens
guaagaugcugaggacuaa

SEQ ID NO: 1064614 - RNA, 19 nt, Homo sapiens
ccaauaaacagaacacuuu

SEQ ID NO: 1064615 - RNA, 19 nt, Homo sapiens
ggaggucacugcucucaga

SEQ ID NO: 1064616 - RNA, 19 nt, Homo sapiens
gggccuugcugguguguua

SEQ ID NO: 1064617 - RNA, 19 nt, Homo sapiens
gcaagaucguuucucuaaa

SEQ ID NO: 1064618 - RNA, 19 nt, Homo sapiens
cgacagagcaagaucguuu

SEQ ID NO: 1064619 - RNA, 19 nt, Homo sapiens
gaccaagccagaccaauaa

SEQ ID NO: 1064620 - RNA, 19 nt, Homo sapiens
ugggaaggcuggacucuuu

SEQ ID NO: 1064621 - RNA, 19 nt, Homo sapiens
gcugagaguucaagaccaa

SEQ ID NO: 1064622 - RNA, 19 nt, Homo sapiens
guggaggccucucaguuaa

SEQ ID NO: 1064623 - RNA, 19 nt, Homo sapiens
gaaaagccauggagacuuc

SEQ ID NO: 1064624 - RNA, 19 nt, Homo sapiens
caagaucguuucucuaaaa

SEQ ID NO: 1064625 - RNA, 19 nt, Homo sapiens
gguaagaugcugaggacua

SEQ ID NO: 1064626 - RNA, 19 nt, Homo sapiens
ggaaaccguuggcaucuac

SEQ ID NO: 1064627 - RNA, 19 nt, Homo sapiens
aggaugagcuucaacucua

SEQ ID NO: 1064628 - RNA, 19 nt, Homo sapiens
cagagaaacagaagaugua

SEQ ID NO: 1064629 - RNA, 19 nt, Homo sapiens
ggaggccucucaguuaaga

SEQ ID NO: 1064630 - RNA, 19 nt, Homo sapiens
cagaagauguagacuaugg

SEQ ID NO: 1064631 - RNA, 19 nt, Homo sapiens
aacagaagauguagacuau

SEQ ID NO: 1064632 - RNA, 19 nt, Homo sapiens
aaacagaagauguagacua

SEQ ID NO: 1064633 - RNA, 19 nt, Homo sapiens
gaccaaauguggcgguaca

SEQ ID NO: 1064634 - RNA, 19 nt, Homo sapiens
agaccaagccagaccaaua

SEQ ID NO: 1064635 - RNA, 19 nt, Homo sapiens
gcugguguguuaucacuau

SEQ ID NO: 1064636 - RNA, 19 nt, Homo sapiens
guacauaccugcgguucca

SEQ ID NO: 1064637 - RNA, 19 nt, Homo sapiens
ggaugagcuucaacucuau

SEQ ID NO: 1064638 - RNA, 19 nt, Homo sapiens
caagaacaauaugagagaa

SEQ ID NO: 1064639 - RNA, 19 nt, Homo sapiens
agacagauuuccacaagca

SEQ ID NO: 1064640 - RNA, 19 nt, Homo sapiens
gaucaucagaaacuaaaug

SEQ ID NO: 1064641 - RNA, 19 nt, Homo sapiens
ccucagagagcaaugauga

SEQ ID NO: 1064642 - RNA, 19 nt, Homo sapiens
gcagugagguacgaucaag

SEQ ID NO: 1064643 - RNA, 19 nt, Homo sapiens
ccaagaacaauaugagaga

SEQ ID NO: 1064644 - RNA, 19 nt, Homo sapiens
agagacagauuuccacaag

SEQ ID NO: 1064645 - RNA, 19 nt, Homo sapiens
gauguagacuauggagaga

SEQ ID NO: 1064646 - RNA, 19 nt, Homo sapiens
ccacagagaaacagaagau

SEQ ID NO: 1064647 - RNA, 19 nt, Homo sapiens
gagcaagaucguuucucua

SEQ ID NO: 1064648 - RNA, 19 nt, Homo sapiens
gcugaaggaccacaggaaa

SEQ ID NO: 1064649 - RNA, 19 nt, Homo sapiens
ggacuaguguaccguaucc

SEQ ID NO: 1064650 - RNA, 19 nt, Homo sapiens
aguggaggccucucaguua

SEQ ID NO: 1064651 - RNA, 19 nt, Homo sapiens
gaaucaggacuccgaagga

SEQ ID NO: 1064652 - RNA, 19 nt, Homo sapiens
agcaagaucguuucucuaa

SEQ ID NO: 1064653 - RNA, 19 nt, Homo sapiens
gaccaaccugggcaacaua

SEQ ID NO: 1064654 - RNA, 19 nt, Homo sapiens
caagccagaccaauaaaca

SEQ ID NO: 1064655 - RNA, 19 nt, Homo sapiens
gaacaauaugagagaaaca

SEQ ID NO: 1064656 - RNA, 19 nt, Homo sapiens
acagucaaguccacagaga

SEQ ID NO: 1064657 - RNA, 19 nt, Homo sapiens
caacagucaaguccacaga

SEQ ID NO: 1064658 - RNA, 19 nt, Homo sapiens
caaccugggcaacauagug

SEQ ID NO: 1064659 - RNA, 19 nt, Homo sapiens
gcaucucauuugggcagua

SEQ ID NO: 1064660 - RNA, 19 nt, Homo sapiens
gagaaacagaagauguaga

SEQ ID NO: 1064661 - RNA, 19 nt, Homo sapiens
gagagacagauuuccacaa

SEQ ID NO: 1064662 - RNA, 19 nt, Homo sapiens
caccuucgccucccuggaa

SEQ ID NO: 1064663 - RNA, 19 nt, Homo sapiens
gcccagacaagcugaagga

SEQ ID NO: 1064664 - RNA, 19 nt, Homo sapiens
uggaaaccguuggcaucua

SEQ ID NO: 1064665 - RNA, 19 nt, Homo sapiens
gguguguuaucacuauuac

SEQ ID NO: 1064666 - RNA, 19 nt, Homo sapiens
gaaguggaggccucucagu

SEQ ID NO: 1064667 - RNA, 19 nt, Homo sapiens
gaccagcaacccagagcaa

SEQ ID NO: 1064668 - RNA, 19 nt, Homo sapiens
gcugaggacuaaaaccauu

SEQ ID NO: 1064669 - RNA, 19 nt, Homo sapiens
acagagaaacagaagaugu

SEQ ID NO: 1064670 - RNA, 19 nt, Homo sapiens
agaccaaccugggcaacau

SEQ ID NO: 1064671 - RNA, 19 nt, Homo sapiens
ggcuaagggucgcuugaag

SEQ ID NO: 1064672 - RNA, 19 nt, Homo sapiens
ucaaaucccaggcuaucug

SEQ ID NO: 1064673 - RNA, 19 nt, Homo sapiens
ucugcaagcugugaucugu

SEQ ID NO: 1064674 - RNA, 19 nt, Homo sapiens
ccauguggucugaauguug

SEQ ID NO: 1064675 - RNA, 19 nt, Homo sapiens
uguagacuauggagagaca

SEQ ID NO: 1064676 - RNA, 19 nt, Homo sapiens
agucaaguccacagagaaa

SEQ ID NO: 1064677 - RNA, 19 nt, Homo sapiens
cuucaacucuauggagaug

SEQ ID NO: 1064678 - RNA, 19 nt, Homo sapiens
caauaugagagaaacaagu

SEQ ID NO: 1064679 - RNA, 19 nt, Homo sapiens
gggcugcagugagguacga

SEQ ID NO: 1064680 - RNA, 19 nt, Homo sapiens
aaacagaacacuuuuccuu

SEQ ID NO: 1064681 - RNA, 19 nt, Homo sapiens
uggcaucuacuucggacua

SEQ ID NO: 1064682 - RNA, 19 nt, Homo sapiens
caugcgcucucaggugcua

SEQ ID NO: 1064683 - RNA, 19 nt, Homo sapiens
agagcagcguucugagaga

SEQ ID NO: 1064684 - RNA, 19 nt, Homo sapiens
ugacaggguucaggaagac

SEQ ID NO: 1064685 - RNA, 19 nt, Homo sapiens
gguuccagcuacucaagag

SEQ ID NO: 1064686 - RNA, 19 nt, Homo sapiens
gacuauggagagacagauu

SEQ ID NO: 1064687 - RNA, 19 nt, Homo sapiens
ccagaccaauaaacagaac

SEQ ID NO: 1064688 - RNA, 19 nt, Homo sapiens
ggagaccaagccagaccaa

SEQ ID NO: 1064689 - RNA, 19 nt, Homo sapiens
gagacgcacaggagaccaa

SEQ ID NO: 1064690 - RNA, 19 nt, Homo sapiens
cccagcaaguggagaagug

SEQ ID NO: 1064691 - RNA, 19 nt, Homo sapiens
acuguaauccucgcacuuu

SEQ ID NO: 1064692 - RNA, 19 nt, Homo sapiens
agaaacagaagauguagac

SEQ ID NO: 1064693 - RNA, 19 nt, Homo sapiens
ucaaguccacagagaaaca

SEQ ID NO: 1064694 - RNA, 19 nt, Homo sapiens
cagauuuccacaagcaaga

SEQ ID NO: 1064695 - RNA, 19 nt, Homo sapiens
agaacaauaugagagaaac

SEQ ID NO: 1064696 - RNA, 19 nt, Homo sapiens
gagccauccugggagagau

SEQ ID NO: 1064697 - RNA, 19 nt, Homo sapiens
caacacacauuguagauua

SEQ ID NO: 1064698 - RNA, 19 nt, Homo sapiens
gaacucaacuucuuucaga

SEQ ID NO: 1064699 - RNA, 19 nt, Homo sapiens
gaaccaguauacagaaaua

SEQ ID NO: 1064700 - RNA, 19 nt, Homo sapiens
gaccaaaucuccuuucuug

SEQ ID NO: 1064701 - RNA, 19 nt, Homo sapiens
gcaacaaacccuugaauuu

SEQ ID NO: 1064702 - RNA, 19 nt, Homo sapiens
gaacauaucagagcucuuu

SEQ ID NO: 1064703 - RNA, 19 nt, Homo sapiens
gaagacaagucauuccuau

SEQ ID NO: 1064704 - RNA, 19 nt, Homo sapiens
gaaaccagcuuguauaaaa

SEQ ID NO: 1064705 - RNA, 19 nt, Homo sapiens
cagaauaccuugcuuaauc

SEQ ID NO: 1064706 - RNA, 19 nt, Homo sapiens
cugaugagcuuaaagauuu

SEQ ID NO: 1064707 - RNA, 19 nt, Homo sapiens
aaucugaucugguggaaua

SEQ ID NO: 1064708 - RNA, 19 nt, Homo sapiens
ggaauaucuuugucacaua

SEQ ID NO: 1064709 - RNA, 19 nt, Homo sapiens
gaaauguguucagauguaa

SEQ ID NO: 1064710 - RNA, 19 nt, Homo sapiens
gagaccauccuuccuauua

SEQ ID NO: 1064711 - RNA, 19 nt, Homo sapiens
caaguaguguguuuguaua

SEQ ID NO: 1064712 - RNA, 19 nt, Homo sapiens
gcaagagucucaagcuuca

SEQ ID NO: 1064713 - RNA, 19 nt, Homo sapiens
agacaagucauuccuauua

SEQ ID NO: 1064714 - RNA, 19 nt, Homo sapiens
gaaagaggcuggauaaccu

SEQ ID NO: 1064715 - RNA, 19 nt, Homo sapiens
gggccacacugauagaaua

SEQ ID NO: 1064716 - RNA, 19 nt, Homo sapiens
ugauugcacuacugaauua

SEQ ID NO: 1064717 - RNA, 19 nt, Homo sapiens
ugacaacaauggccaugua

SEQ ID NO: 1064718 - RNA, 19 nt, Homo sapiens
agaaauguguucagaugua

SEQ ID NO: 1064719 - RNA, 19 nt, Homo sapiens
aaagaaauguguucagaug

SEQ ID NO: 1064720 - RNA, 19 nt, Homo sapiens
gaugaaaccagcuuguaua

SEQ ID NO: 1064721 - RNA, 19 nt, Homo sapiens
caacaagcauucuauugau

SEQ ID NO: 1064722 - RNA, 19 nt, Homo sapiens
aaacagugcuucugacaau

SEQ ID NO: 1064723 - RNA, 19 nt, Homo sapiens
gcaugaaguuaaacaagaa

SEQ ID NO: 1064724 - RNA, 19 nt, Homo sapiens
ggcuguaacuaucuuaaua

SEQ ID NO: 1064725 - RNA, 19 nt, Homo sapiens
gaauaucuuugucacauag

SEQ ID NO: 1064726 - RNA, 19 nt, Homo sapiens
caacaaacccuugaauuuc

SEQ ID NO: 1064727 - RNA, 19 nt, Homo sapiens
aaucguagcugcaaaguca

SEQ ID NO: 1064728 - RNA, 19 nt, Homo sapiens
ucaagaauguagucagaaa

SEQ ID NO: 1064729 - RNA, 19 nt, Homo sapiens
gaacaacuucaucaagaaa

SEQ ID NO: 1064730 - RNA, 19 nt, Homo sapiens
ggucaucucuguaguuuac

SEQ ID NO: 1064731 - RNA, 19 nt, Homo sapiens
guaaguacuugcugucuuc

SEQ ID NO: 1064732 - RNA, 19 nt, Homo sapiens
gcucacgacuuauuuagau

SEQ ID NO: 1064733 - RNA, 19 nt, Homo sapiens
uaacacaguuuguaccaau

SEQ ID NO: 1064734 - RNA, 19 nt, Homo sapiens
gaaaauaccuccugauugc

SEQ ID NO: 1064735 - RNA, 19 nt, Homo sapiens
gguaacaagucgauggauu

SEQ ID NO: 1064736 - RNA, 19 nt, Homo sapiens
guaauucuguugugugugu

SEQ ID NO: 1064737 - RNA, 19 nt, Homo sapiens
ccacaaauuucauguacau

SEQ ID NO: 1064738 - RNA, 19 nt, Homo sapiens
gaagguacaaauuugagua

SEQ ID NO: 1064739 - RNA, 19 nt, Homo sapiens
ucaaagaaauguguucaga

SEQ ID NO: 1064740 - RNA, 19 nt, Homo sapiens
gagcaagagucucaagcuu

SEQ ID NO: 1064741 - RNA, 19 nt, Homo sapiens
ggacugugcuucgacgauu

SEQ ID NO: 1064742 - RNA, 19 nt, Homo sapiens
guacagcggugccuggaau

SEQ ID NO: 1064743 - RNA, 19 nt, Homo sapiens
ggauagagacugugcuuug

SEQ ID NO: 1064744 - RNA, 19 nt, Homo sapiens
cagagaggaucauuacaga

SEQ ID NO: 1064745 - RNA, 19 nt, Homo sapiens
gagaggaucauuacagaga

SEQ ID NO: 1064746 - RNA, 19 nt, Homo sapiens
gacaagucauuccuauuau

SEQ ID NO: 1064747 - RNA, 19 nt, Homo sapiens
gugaagaauuuccagaaga

SEQ ID NO: 1064748 - RNA, 19 nt, Homo sapiens
aguggacgcucacgacuua

SEQ ID NO: 1064749 - RNA, 19 nt, Homo sapiens
gggaauaucuuugucacau

SEQ ID NO: 1064750 - RNA, 19 nt, Homo sapiens
gauagagacugugcuuugu

SEQ ID NO: 1064751 - RNA, 19 nt, Homo sapiens
cauuguagauuacucagaa

SEQ ID NO: 1064752 - RNA, 19 nt, Homo sapiens
gacaugggccacacugaua

SEQ ID NO: 1064753 - RNA, 19 nt, Homo sapiens
guaaaugcaaguuugguuu

SEQ ID NO: 1064754 - RNA, 19 nt, Homo sapiens
guaaugagaagguacaaau

SEQ ID NO: 1064755 - RNA, 19 nt, Homo sapiens
uaacauugcaugccauuau

SEQ ID NO: 1064756 - RNA, 19 nt, Homo sapiens
guauuucaccuacugauuu

SEQ ID NO: 1064757 - RNA, 19 nt, Homo sapiens
gugaagaucauaaauccua

SEQ ID NO: 1064758 - RNA, 19 nt, Homo sapiens
guguucagauguaauguaa

SEQ ID NO: 1064759 - RNA, 19 nt, Homo sapiens
agaaauaucucaggcuaau

SEQ ID NO: 1064760 - RNA, 19 nt, Homo sapiens
gaagaaaauucgugaagau

SEQ ID NO: 1064761 - RNA, 19 nt, Homo sapiens
uaacuguggucaucucugu

SEQ ID NO: 1064762 - RNA, 19 nt, Homo sapiens
ucaguuaggauaugucuuu

SEQ ID NO: 1064763 - RNA, 19 nt, Homo sapiens
ggccauguauccguaagua

SEQ ID NO: 1064764 - RNA, 19 nt, Homo sapiens
gcccuuacucguauauuua

SEQ ID NO: 1064765 - RNA, 19 nt, Homo sapiens
gauguuguaugccugguau

SEQ ID NO: 1064766 - RNA, 19 nt, Homo sapiens
ugacaagcaugauuuggau

SEQ ID NO: 1064767 - RNA, 19 nt, Homo sapiens
gguugacccugaaagguuu

SEQ ID NO: 1064768 - RNA, 19 nt, Homo sapiens
gcuaaugucaucuguauag

SEQ ID NO: 1064769 - RNA, 19 nt, Homo sapiens
ugaauacugugccaggauu

SEQ ID NO: 1064770 - RNA, 19 nt, Homo sapiens
gaccauccuuccuauuaug

SEQ ID NO: 1064771 - RNA, 19 nt, Homo sapiens
gcauucgccucaaguagug

SEQ ID NO: 1064772 - RNA, 19 nt, Homo sapiens
aaucggaauuucuaacuga

SEQ ID NO: 1064773 - RNA, 19 nt, Homo sapiens
ggauuugacaccugaauau

SEQ ID NO: 1064774 - RNA, 19 nt, Homo sapiens
gagaugaaaccagcuugua

SEQ ID NO: 1064775 - RNA, 19 nt, Homo sapiens
acaacaagcauucuauuga

SEQ ID NO: 1064776 - RNA, 19 nt, Homo sapiens
guguguguguuauaugaua

SEQ ID NO: 1064777 - RNA, 19 nt, Homo sapiens
aacugaagcugaaaucauu

SEQ ID NO: 1064778 - RNA, 19 nt, Homo sapiens
gaaucggaauuucuaacug

SEQ ID NO: 1064779 - RNA, 19 nt, Homo sapiens
gaaacuuaaugaggcagaa

SEQ ID NO: 1064780 - RNA, 19 nt, Homo sapiens
aaagauagaccugcagaaa

SEQ ID NO: 1064781 - RNA, 19 nt, Homo sapiens
gaaagaacagacaaagaca

SEQ ID NO: 1064782 - RNA, 19 nt, Homo sapiens
ucucaggacuuuauagcuu

SEQ ID NO: 1064783 - RNA, 19 nt, Homo sapiens
gaagggaauaucuuuguca

SEQ ID NO: 1064784 - RNA, 19 nt, Homo sapiens
ggacgcucacgacuuauuu

SEQ ID NO: 1064785 - RNA, 19 nt, Homo sapiens
gaugaugaccuggauuuga

SEQ ID NO: 1064786 - RNA, 19 nt, Homo sapiens
uaaaagcccuuacucguau

SEQ ID NO: 1064787 - RNA, 19 nt, Homo sapiens
uacguugucuuccuuacua

SEQ ID NO: 1064788 - RNA, 19 nt, Homo sapiens
ucuggucagugaagaauuu

SEQ ID NO: 1064789 - RNA, 19 nt, Homo sapiens
gaaccuagaguugggaaga

SEQ ID NO: 1064790 - RNA, 19 nt, Homo sapiens
gugaauaacacaguuugua

SEQ ID NO: 1064791 - RNA, 19 nt, Homo sapiens
guggucaucucuguaguuu

SEQ ID NO: 1064792 - RNA, 19 nt, Homo sapiens
cauaggaauuguucagcaa

SEQ ID NO: 1064793 - RNA, 19 nt, Homo sapiens
caaaaugccuccaccacaa

SEQ ID NO: 1064794 - RNA, 19 nt, Homo sapiens
gcacuacugaauuaaauca

SEQ ID NO: 1064795 - RNA, 19 nt, Homo sapiens
uggaggaugucaagaaugu

SEQ ID NO: 1064796 - RNA, 19 nt, Homo sapiens
caacuucuuucagaggauu

SEQ ID NO: 1064797 - RNA, 19 nt, Homo sapiens
acaaaugacuccaaacuua

SEQ ID NO: 1064798 - RNA, 19 nt, Homo sapiens
gaagggagcucauauccaa

SEQ ID NO: 1064799 - RNA, 19 nt, Homo sapiens
gaacuuggccauaagaaua

SEQ ID NO: 1064800 - RNA, 19 nt, Homo sapiens
gaacagacgucuuaggaau

SEQ ID NO: 1064801 - RNA, 19 nt, Homo sapiens
gaacaagagugcaagauuc

SEQ ID NO: 1064802 - RNA, 19 nt, Homo sapiens
gaaaggagcuggucaacag

SEQ ID NO: 1064803 - RNA, 19 nt, Homo sapiens
gggagaaccugcuggauaa

SEQ ID NO: 1064804 - RNA, 19 nt, Homo sapiens
gaccagacuuuguuaauga

SEQ ID NO: 1064805 - RNA, 19 nt, Homo sapiens
gugaaacccugucuacuaa

SEQ ID NO: 1064806 - RNA, 19 nt, Homo sapiens
ugacagaacagacgucuua

SEQ ID NO: 1064807 - RNA, 19 nt, Homo sapiens
aaacggagguuacagagaa

SEQ ID NO: 1064808 - RNA, 19 nt, Homo sapiens
ggacaaugggauauuaaua

SEQ ID NO: 1064809 - RNA, 19 nt, Homo sapiens
gaagagcuguccugaccaa

SEQ ID NO: 1064810 - RNA, 19 nt, Homo sapiens
gggaacugcuggcccaaua

SEQ ID NO: 1064811 - RNA, 19 nt, Homo sapiens
gagauuagcuguggcuuuc

SEQ ID NO: 1064812 - RNA, 19 nt, Homo sapiens
gaacgaacuuggccauaag

SEQ ID NO: 1064813 - RNA, 19 nt, Homo sapiens
gcacgaggaucaggaauca

SEQ ID NO: 1064814 - RNA, 19 nt, Homo sapiens
cgaacgaacuuggccauaa

SEQ ID NO: 1064815 - RNA, 19 nt, Homo sapiens
ggaccagacuuuguuaaug

SEQ ID NO: 1064816 - RNA, 19 nt, Homo sapiens
acuccaaacuuacgacuua

SEQ ID NO: 1064817 - RNA, 19 nt, Homo sapiens
gagagaugcugaaacacaa

SEQ ID NO: 1064818 - RNA, 19 nt, Homo sapiens
ggaguacuuagacauauua

SEQ ID NO: 1064819 - RNA, 19 nt, Homo sapiens
ggugaaacccugucuacua

SEQ ID NO: 1064820 - RNA, 19 nt, Homo sapiens
caggagagaugcugaaaca

SEQ ID NO: 1064821 - RNA, 19 nt, Homo sapiens
gaucucgccuuucuguuga

SEQ ID NO: 1064822 - RNA, 19 nt, Homo sapiens
ggaacaagagugcaagauu

SEQ ID NO: 1064823 - RNA, 19 nt, Homo sapiens
guugaaagcagugaaauuu

SEQ ID NO: 1064824 - RNA, 19 nt, Homo sapiens
ggacacaguugaugaucuc

SEQ ID NO: 1064825 - RNA, 19 nt, Homo sapiens
gaaggugacgauguuguua

SEQ ID NO: 1064826 - RNA, 19 nt, Homo sapiens
acagacgucuuaggaauaa

SEQ ID NO: 1064827 - RNA, 19 nt, Homo sapiens
gaaacacaaacagguauaa

SEQ ID NO: 1064828 - RNA, 19 nt, Homo sapiens
gaucaggaaucaggagaga

SEQ ID NO: 1064829 - RNA, 19 nt, Homo sapiens
ggagucacagcuauugaua

SEQ ID NO: 1064830 - RNA, 19 nt, Homo sapiens
gcacuggaggcauggguua

SEQ ID NO: 1064831 - RNA, 19 nt, Homo sapiens
ucacagcuauugauaugau

SEQ ID NO: 1064832 - RNA, 19 nt, Homo sapiens
ggagaaccuugaagaacau

SEQ ID NO: 1064833 - RNA, 19 nt, Homo sapiens
gacuuuaccugucuaaugg

SEQ ID NO: 1064834 - RNA, 19 nt, Homo sapiens
ucauagacauggaguacuu

SEQ ID NO: 1064835 - RNA, 19 nt, Homo sapiens
agacaggguugauaaagug

SEQ ID NO: 1064836 - RNA, 19 nt, Homo sapiens
ggagagaugcugaaacaca

SEQ ID NO: 1064837 - RNA, 19 nt, Homo sapiens
gaaguuucgucuguuguau

SEQ ID NO: 1064838 - RNA, 19 nt, Homo sapiens
uuaaugaaguuucgucugu

SEQ ID NO: 1064839 - RNA, 19 nt, Homo sapiens
gaagaucauugagcaccaa

SEQ ID NO: 1064840 - RNA, 19 nt, Homo sapiens
uaaugaugcuacaguaaug

SEQ ID NO: 1064841 - RNA, 19 nt, Homo sapiens
gaugguggcccaauugaga

SEQ ID NO: 1064842 - RNA, 19 nt, Homo sapiens
gaagaggugaagaucauug

SEQ ID NO: 1064843 - RNA, 19 nt, Homo sapiens
cagauguguuugccacuuu

SEQ ID NO: 1064844 - RNA, 19 nt, Homo sapiens
aaucgaaucuccggcuuaa

SEQ ID NO: 1064845 - RNA, 19 nt, Homo sapiens
caguaccauucgccuauua

SEQ ID NO: 1064846 - RNA, 19 nt, Homo sapiens
guaaugaugcuacaguaau

SEQ ID NO: 1064847 - RNA, 19 nt, Homo sapiens
gaaccugcuggauaaguuu

SEQ ID NO: 1064848 - RNA, 19 nt, Homo sapiens
gaaacccugucuacuaaaa

SEQ ID NO: 1064849 - RNA, 19 nt, Homo sapiens
gcugaaacacaaacaggua

SEQ ID NO: 1064850 - RNA, 19 nt, Homo sapiens
agucacagcuauugauaug

SEQ ID NO: 1064851 - RNA, 19 nt, Homo sapiens
uggagaaccuugaagaaca

SEQ ID NO: 1064852 - RNA, 19 nt, Homo sapiens
ggaguucgacaccaucuug

SEQ ID NO: 1064853 - RNA, 19 nt, Homo sapiens
ugcuagaccuugaagagua

SEQ ID NO: 1064854 - RNA, 19 nt, Homo sapiens
cagaacagacgucuuagga

SEQ ID NO: 1064855 - RNA, 19 nt, Homo sapiens
uguggacaaugggauauua

SEQ ID NO: 1064856 - RNA, 19 nt, Homo sapiens
cagacaggguugauaaagu

SEQ ID NO: 1064857 - RNA, 19 nt, Homo sapiens
ccugguauuuagaacauaa

SEQ ID NO: 1064858 - RNA, 19 nt, Homo sapiens
gagcuguccugaccaagag

SEQ ID NO: 1064859 - RNA, 19 nt, Homo sapiens
uaacaaaugacuccaaacu

SEQ ID NO: 1064860 - RNA, 19 nt, Homo sapiens
ggacgaucauagacaugga

SEQ ID NO: 1064861 - RNA, 19 nt, Homo sapiens
gauaaagugaggacgauca

SEQ ID NO: 1064862 - RNA, 19 nt, Homo sapiens
cauggaguacuuagacaua

SEQ ID NO: 1064863 - RNA, 19 nt, Homo sapiens
caagaggaccagacuuugu

SEQ ID NO: 1064864 - RNA, 19 nt, Homo sapiens
gaugaucucgccuuucugu

SEQ ID NO: 1064865 - RNA, 19 nt, Homo sapiens
gacaguaccauucgccuau

SEQ ID NO: 1064866 - RNA, 19 nt, Homo sapiens
gcuagaccuugaagaguag

SEQ ID NO: 1064867 - RNA, 19 nt, Homo sapiens
cccaauacaccaaacagua

SEQ ID NO: 1064868 - RNA, 19 nt, Homo sapiens
ggacacaaaaccacuuuaa

SEQ ID NO: 1064869 - RNA, 19 nt, Homo sapiens
agaccaagaaggaggauuu

SEQ ID NO: 1064870 - RNA, 19 nt, Homo sapiens
uaacauggacacaguugau

SEQ ID NO: 1064871 - RNA, 19 nt, Homo sapiens
caccaaacaguaugaagaa

SEQ ID NO: 1064872 - RNA, 19 nt, Homo sapiens
gaacugcuggcccaauaca

SEQ ID NO: 1064873 - RNA, 19 nt, Homo sapiens
agaaccugcuggauaaguu

SEQ ID NO: 1064874 - RNA, 19 nt, Homo sapiens
gaucauugagcaccaaaca

SEQ ID NO: 1064875 - RNA, 19 nt, Homo sapiens
uaaauucagaguugacaga

SEQ ID NO: 1064876 - RNA, 19 nt, Homo sapiens
aagcuuggguugacgauag

SEQ ID NO: 1064877 - RNA, 19 nt, Homo sapiens
gaucauagacauggaguac

SEQ ID NO: 1064878 - RNA, 19 nt, Homo sapiens
gagaugguggcccaauuga

SEQ ID NO: 1064879 - RNA, 19 nt, Homo sapiens
ugaaacacaaacagguaua

SEQ ID NO: 1064880 - RNA, 19 nt, Homo sapiens
ugaaguuucgucuguugua

SEQ ID NO: 1064881 - RNA, 19 nt, Homo sapiens
aaugaaguuucgucuguug

SEQ ID NO: 1064882 - RNA, 19 nt, Homo sapiens
uaaugaaguuucgucuguu

SEQ ID NO: 1064883 - RNA, 19 nt, Homo sapiens
aggaagaggugaagaucau

SEQ ID NO: 1064884 - RNA, 19 nt, Homo sapiens
uggaguacuuagacauauu

SEQ ID NO: 1064885 - RNA, 19 nt, Homo sapiens
caagagugcaagauucaau

SEQ ID NO: 1064886 - RNA, 19 nt, Homo sapiens
gacauggaguacuuagaca

SEQ ID NO: 1064887 - RNA, 19 nt, Homo sapiens
ugaggacgaucauagacau

SEQ ID NO: 1064888 - RNA, 19 nt, Homo sapiens
aagagaugguggcccaauu

SEQ ID NO: 1064889 - RNA, 19 nt, Homo sapiens
gcagagauugcgccacugu

SEQ ID NO: 1064890 - RNA, 19 nt, Homo sapiens
ugacgauguuguuaugcuu

SEQ ID NO: 1064891 - RNA, 19 nt, Homo sapiens
caaaugacuccaaacuuac

SEQ ID NO: 1064892 - RNA, 19 nt, Homo sapiens
cuggagaagucgucaggaa

SEQ ID NO: 1064893 - RNA, 19 nt, Homo sapiens
cuucagacaggguugauaa

SEQ ID NO: 1064894 - RNA, 19 nt, Homo sapiens
ggccugguauuuagaacau

SEQ ID NO: 1064895 - RNA, 19 nt, Homo sapiens
ggaaaggagcuggucaaca

SEQ ID NO: 1064896 - RNA, 19 nt, Homo sapiens
agggagaaccugcuggaua

SEQ ID NO: 1064897 - RNA, 19 nt, Homo sapiens
gaacauuucugauagugaa

SEQ ID NO: 1064898 - RNA, 19 nt, Homo sapiens
gcacuuacaugcagauagu

SEQ ID NO: 1064899 - RNA, 19 nt, Homo sapiens
ccaaauacguggaagacaa

SEQ ID NO: 1064900 - RNA, 19 nt, Homo sapiens
gagauccucuaccucauaa

SEQ ID NO: 1064901 - RNA, 19 nt, Homo sapiens
gcacaucggugaccuucuc

SEQ ID NO: 1064902 - RNA, 19 nt, Homo sapiens
gcagaucggcuuucauguu

SEQ ID NO: 1064903 - RNA, 19 nt, Homo sapiens
gcucuuugcugcugguuug

SEQ ID NO: 1064904 - RNA, 19 nt, Homo sapiens
caagaggcaucugcuagaa

SEQ ID NO: 1064905 - RNA, 19 nt, Homo sapiens
gcagggaugacuauaggua

SEQ ID NO: 1064906 - RNA, 19 nt, Homo sapiens
cagaucggcuuucauguuc

SEQ ID NO: 1064907 - RNA, 19 nt, Homo sapiens
ccaccaacauuugaggaua

SEQ ID NO: 1064908 - RNA, 19 nt, Homo sapiens
ugguggagcuggcaaauga

SEQ ID NO: 1064909 - RNA, 19 nt, Homo sapiens
gaugcugucucgaacaaug

SEQ ID NO: 1064910 - RNA, 19 nt, Homo sapiens
gcuguuguaugcagauuug

SEQ ID NO: 1064911 - RNA, 19 nt, Homo sapiens
guacaccaguccguaggua

SEQ ID NO: 1064912 - RNA, 19 nt, Homo sapiens
gagagaccuuugucgaguu

SEQ ID NO: 1064913 - RNA, 19 nt, Homo sapiens
guggaagacucgcacuauu

SEQ ID NO: 1064914 - RNA, 19 nt, Homo sapiens
caaauacguggaagacaaa

SEQ ID NO: 1064915 - RNA, 19 nt, Homo sapiens
cagcauaacuggccccuaa

SEQ ID NO: 1064916 - RNA, 19 nt, Homo sapiens
gagauggcuuuccucauag

SEQ ID NO: 1064917 - RNA, 19 nt, Homo sapiens
aaccaaggauggaagugua

SEQ ID NO: 1064918 - RNA, 19 nt, Homo sapiens
ucugacagcuugauaacau

SEQ ID NO: 1064919 - RNA, 19 nt, Homo sapiens
cauguucccuugcccgauu

SEQ ID NO: 1064920 - RNA, 19 nt, Homo sapiens
cagaacuggugaagaccua

SEQ ID NO: 1064921 - RNA, 19 nt, Homo sapiens
gugcaacccuuugaagugu

SEQ ID NO: 1064922 - RNA, 19 nt, Homo sapiens
cacaggcaaugauggguuu

SEQ ID NO: 1064923 - RNA, 19 nt, Homo sapiens
gaaaaugucaggcucuuug

SEQ ID NO: 1064924 - RNA, 19 nt, Homo sapiens
guuccaagcuucaccuucu

SEQ ID NO: 1064925 - RNA, 19 nt, Homo sapiens
gaacuggugaagaccuauu

SEQ ID NO: 1064926 - RNA, 19 nt, Homo sapiens
uggcagaacuggugaagac

SEQ ID NO: 1064927 - RNA, 19 nt, Homo sapiens
aaacaagaggcaucugcua

SEQ ID NO: 1064928 - RNA, 19 nt, Homo sapiens
gugcagggaugacuauagg

SEQ ID NO: 1064929 - RNA, 19 nt, Homo sapiens
uccgagagguaacauauuc

SEQ ID NO: 1064930 - RNA, 19 nt, Homo sapiens
uauaaaacccgaguucuua

SEQ ID NO: 1064931 - RNA, 19 nt, Homo sapiens
aaugauggguuugugugua

SEQ ID NO: 1064932 - RNA, 19 nt, Homo sapiens
cuauguccauguucuguga

SEQ ID NO: 1064933 - RNA, 19 nt, Homo sapiens
aagcggaucugcccuguac

SEQ ID NO: 1064934 - RNA, 19 nt, Homo sapiens
gaaguggagacccgagaga

SEQ ID NO: 1064935 - RNA, 19 nt, Homo sapiens
caaacggucuguggugaag

SEQ ID NO: 1064936 - RNA, 19 nt, Homo sapiens
cugagcagcuggccugguu

SEQ ID NO: 1064937 - RNA, 19 nt, Homo sapiens
ugcagcagcuucaaacugu

SEQ ID NO: 1064938 - RNA, 19 nt, Homo sapiens
auaccgcgguugccuacua

SEQ ID NO: 1064939 - RNA, 19 nt, Homo sapiens
gacaguggguagacuaagg

SEQ ID NO: 1064940 - RNA, 19 nt, Homo sapiens
gcacuucauccuguucuga

SEQ ID NO: 1064941 - RNA, 19 nt, Homo sapiens
gcagcagcuucaaacuguu

SEQ ID NO: 1064942 - RNA, 19 nt, Homo sapiens
ggagugcagggaugacuau

SEQ ID NO: 1064943 - RNA, 19 nt, Homo sapiens
gguauugcuuuucuuguuu

SEQ ID NO: 1064944 - RNA, 19 nt, Homo sapiens
aagaugcugucucgaacaa

SEQ ID NO: 1064945 - RNA, 19 nt, Homo sapiens
gaagaugcugucucgaaca

SEQ ID NO: 1064946 - RNA, 19 nt, Homo sapiens
ggggaaaacgaacaaguua

SEQ ID NO: 1064947 - RNA, 19 nt, Homo sapiens
gggcuucccucugcuugug

SEQ ID NO: 1064948 - RNA, 19 nt, Homo sapiens
gggagcacuucauccuguu

SEQ ID NO: 1064949 - RNA, 19 nt, Homo sapiens
ggugcaacccuuugaagug

SEQ ID NO: 1064950 - RNA, 19 nt, Homo sapiens
gguugggugcugcgucuua

SEQ ID NO: 1064951 - RNA, 19 nt, Homo sapiens
gauccucuaccucauaaca

SEQ ID NO: 1064952 - RNA, 19 nt, Homo sapiens
ggaagacucgcacuauucg

SEQ ID NO: 1064953 - RNA, 19 nt, Homo sapiens
guaugcagauuuggaugug

SEQ ID NO: 1064954 - RNA, 19 nt, Homo sapiens
guucugcaguugccaccaa

SEQ ID NO: 1064955 - RNA, 19 nt, Homo sapiens
cacuggagaugagaacauu

SEQ ID NO: 1064956 - RNA, 19 nt, Homo sapiens
ggaagacaaagagaagaug

SEQ ID NO: 1064957 - RNA, 19 nt, Homo sapiens
guugggugcugcgucuuaa

SEQ ID NO: 1064958 - RNA, 19 nt, Homo sapiens
gaagcggaucugcccugua

SEQ ID NO: 1064959 - RNA, 19 nt, Homo sapiens
gguggaagacucgcacuau

SEQ ID NO: 1064960 - RNA, 19 nt, Homo sapiens
ggaugggacagcagaagug

SEQ ID NO: 1064961 - RNA, 19 nt, Homo sapiens
acaagaggcaucugcuaga

SEQ ID NO: 1064962 - RNA, 19 nt, Homo sapiens
ggcccuacgugcauucaca

SEQ ID NO: 1064963 - RNA, 19 nt, Homo sapiens
gcugcugguuugaauugga

SEQ ID NO: 1064964 - RNA, 19 nt, Homo sapiens
gacuauagguaggagagau

SEQ ID NO: 1064965 - RNA, 19 nt, Homo sapiens
cuucugugccagccaaaua

SEQ ID NO: 1064966 - RNA, 19 nt, Homo sapiens
ggcauucccagcaguauca

SEQ ID NO: 1064967 - RNA, 19 nt, Homo sapiens
uaacccucccugauggaua

SEQ ID NO: 1064968 - RNA, 19 nt, Homo sapiens
caucacugcugcgacuuuc

SEQ ID NO: 1064969 - RNA, 19 nt, Homo sapiens
caccaacauuugaggauac

SEQ ID NO: 1064970 - RNA, 19 nt, Homo sapiens
uccucuaccucauaacaaa

SEQ ID NO: 1064971 - RNA, 19 nt, Homo sapiens
uguauggugucaugagauc

SEQ ID NO: 1064972 - RNA, 19 nt, Homo sapiens
aacccucccugauggauau

SEQ ID NO: 1064973 - RNA, 19 nt, Homo sapiens
uggaagacucgcacuauuc

SEQ ID NO: 1064974 - RNA, 19 nt, Homo sapiens
agaggcaucugcuagaaaa

SEQ ID NO: 1064975 - RNA, 19 nt, Homo sapiens
cugcagaucggcuuucaug

SEQ ID NO: 1064976 - RNA, 19 nt, Homo sapiens
cuaaggcaguagcucaaag

SEQ ID NO: 1064977 - RNA, 19 nt, Homo sapiens
gucaugagauccucuaccu

SEQ ID NO: 1064978 - RNA, 19 nt, Homo sapiens
ccacugggagcacuucauc

SEQ ID NO: 1064979 - RNA, 19 nt, Homo sapiens
gcagcuggccugguuacga

SEQ ID NO: 1064980 - RNA, 19 nt, Homo sapiens
ggaaaacgaacaaguuagu

SEQ ID NO: 1064981 - RNA, 19 nt, Homo sapiens
agagaccuuugucgaguuc

SEQ ID NO: 1064982 - RNA, 19 nt, Homo sapiens
uguguauggugucaugaga

SEQ ID NO: 1064983 - RNA, 19 nt, Homo sapiens
gagauucccaucccuuggu

SEQ ID NO: 1064984 - RNA, 19 nt, Homo sapiens
guaacauauucccgaagca

SEQ ID NO: 1064985 - RNA, 19 nt, Homo sapiens
acaccaguccguagguauu

SEQ ID NO: 1064986 - RNA, 19 nt, Homo sapiens
uaaccaaggauggaagugu

SEQ ID NO: 1064987 - RNA, 19 nt, Homo sapiens
guuacgaguucugagacuu

SEQ ID NO: 1064988 - RNA, 19 nt, Homo sapiens
ucaccugccgacagcauaa

SEQ ID NO: 1064989 - RNA, 19 nt, Homo sapiens
augauggguuuguguguau

SEQ ID NO: 1064990 - RNA, 19 nt, Homo sapiens
gaagcacaucggugaccuu

SEQ ID NO: 1064991 - RNA, 19 nt, Homo sapiens
ccuacuaccaacaggcaua

SEQ ID NO: 1064992 - RNA, 19 nt, Homo sapiens
aaagaaggagguguugguu

SEQ ID NO: 1064993 - RNA, 19 nt, Homo sapiens
augcagauuuggauguguu

SEQ ID NO: 1064994 - RNA, 19 nt, Homo sapiens
uggguagacuaaggcagua

SEQ ID NO: 1064995 - RNA, 19 nt, Homo sapiens
caaacuguuccaagcuuca

SEQ ID NO: 1064996 - RNA, 19 nt, Homo sapiens
guauaaaacccgaguucuu

SEQ ID NO: 1064997 - RNA, 19 nt, Homo sapiens
gaggagagcuuguuucaua

SEQ ID NO: 1064998 - RNA, 19 nt, Homo sapiens
ucaaacagcucaagcaaua

SEQ ID NO: 1064999 - RNA, 19 nt, Homo sapiens
gaagaugaauccuugcuaa

SEQ ID NO: 1065000 - RNA, 19 nt, Homo sapiens
gcucagaaccgcaaacuua

SEQ ID NO: 1065001 - RNA, 19 nt, Homo sapiens
gaagcaugcuaauuguuua

SEQ ID NO: 1065002 - RNA, 19 nt, Homo sapiens
uaacaagcaucaccaauga

SEQ ID NO: 1065003 - RNA, 19 nt, Homo sapiens
cagaaugucucgaagauuu

SEQ ID NO: 1065004 - RNA, 19 nt, Homo sapiens
gaaauuugaucuucacuca

SEQ ID NO: 1065005 - RNA, 19 nt, Homo sapiens
gaagauauaugggaggaaa

SEQ ID NO: 1065006 - RNA, 19 nt, Homo sapiens
cagaacagauuguggauuu

SEQ ID NO: 1065007 - RNA, 19 nt, Homo sapiens
gaacugguuuguguauaua

SEQ ID NO: 1065008 - RNA, 19 nt, Homo sapiens
ggaaaugaaugagaagaaa

SEQ ID NO: 1065009 - RNA, 19 nt, Homo sapiens
gaccagauguuacaaauuc

SEQ ID NO: 1065010 - RNA, 19 nt, Homo sapiens
gaugaauccuugcuaauga

SEQ ID NO: 1065011 - RNA, 19 nt, Homo sapiens
gugaaacacuagacuauuu

SEQ ID NO: 1065012 - RNA, 19 nt, Homo sapiens
gagcagagaccagauguua

SEQ ID NO: 1065013 - RNA, 19 nt, Homo sapiens
agagcaaucugcauauuua

SEQ ID NO: 1065014 - RNA, 19 nt, Homo sapiens
uuauauagcuuccuccuaa

SEQ ID NO: 1065015 - RNA, 19 nt, Homo sapiens
uaaauuacuucaccucuug

SEQ ID NO: 1065016 - RNA, 19 nt, Homo sapiens
ggaaagaauacaacaguuu

SEQ ID NO: 1065017 - RNA, 19 nt, Homo sapiens
ggcaagaugugcugaauug

SEQ ID NO: 1065018 - RNA, 19 nt, Homo sapiens
ccaaauauaucuugugagu

SEQ ID NO: 1065019 - RNA, 19 nt, Homo sapiens
gagcaagugugcccucauu

SEQ ID NO: 1065020 - RNA, 19 nt, Homo sapiens
ucaaacgucuaaugccuua

SEQ ID NO: 1065021 - RNA, 19 nt, Homo sapiens
ccauucagcuuguucagua

SEQ ID NO: 1065022 - RNA, 19 nt, Homo sapiens
gagcagcuucuaucaaaua

SEQ ID NO: 1065023 - RNA, 19 nt, Homo sapiens
gaauacaacaguuugauga

SEQ ID NO: 1065024 - RNA, 19 nt, Homo sapiens
gaaagaauacaacaguuug

SEQ ID NO: 1065025 - RNA, 19 nt, Homo sapiens
gagaagauguaacacugaa

SEQ ID NO: 1065026 - RNA, 19 nt, Homo sapiens
gaagaagcaugauuuugua

SEQ ID NO: 1065027 - RNA, 19 nt, Homo sapiens
gacaucaacuuuacucuca

SEQ ID NO: 1065028 - RNA, 19 nt, Homo sapiens
gcagcgugccuaaacauua

SEQ ID NO: 1065029 - RNA, 19 nt, Homo sapiens
gaaaguacagacaagguaa

SEQ ID NO: 1065030 - RNA, 19 nt, Homo sapiens
caacaaaugacguccaauu

SEQ ID NO: 1065031 - RNA, 19 nt, Homo sapiens
agaagaagaucgacauuca

SEQ ID NO: 1065032 - RNA, 19 nt, Homo sapiens
gaaauauugccuuguuuga

SEQ ID NO: 1065033 - RNA, 19 nt, Homo sapiens
gagaaauucagaaguguaa

SEQ ID NO: 1065034 - RNA, 19 nt, Homo sapiens
caacuggucagcuaacuuu

SEQ ID NO: 1065035 - RNA, 19 nt, Homo sapiens
caacuuuacucucaauaca

SEQ ID NO: 1065036 - RNA, 19 nt, Homo sapiens
ugaaggaguuaauggauga

SEQ ID NO: 1065037 - RNA, 19 nt, Homo sapiens
gagaccagauguuacaaau

SEQ ID NO: 1065038 - RNA, 19 nt, Homo sapiens
guggugacuugcucaaaua

SEQ ID NO: 1065039 - RNA, 19 nt, Homo sapiens
gaaugaaaaugcccucuaa

SEQ ID NO: 1065040 - RNA, 19 nt, Homo sapiens
guacagacaagguaacuga

SEQ ID NO: 1065041 - RNA, 19 nt, Homo sapiens
agagagauguggugacuug

SEQ ID NO: 1065042 - RNA, 19 nt, Homo sapiens
gaaacugucuaccucucaa

SEQ ID NO: 1065043 - RNA, 19 nt, Homo sapiens
uaacuuugaugucccaaug

SEQ ID NO: 1065044 - RNA, 19 nt, Homo sapiens
gaggaagacggcaugguua

SEQ ID NO: 1065045 - RNA, 19 nt, Homo sapiens
gaauuagagugcguucauu

SEQ ID NO: 1065046 - RNA, 19 nt, Homo sapiens
acagagaaauucagaagug

SEQ ID NO: 1065047 - RNA, 19 nt, Homo sapiens
ggaaauauugccuuguuug

SEQ ID NO: 1065048 - RNA, 19 nt, Homo sapiens
gcaaggagccacaaagaag

SEQ ID NO: 1065049 - RNA, 19 nt, Homo sapiens
gaucuugccacccauguaa

SEQ ID NO: 1065050 - RNA, 19 nt, Homo sapiens
gcagaggacuggccaacca

SEQ ID NO: 1065051 - RNA, 19 nt, Homo sapiens
aaacagcucaagcaauaua

SEQ ID NO: 1065052 - RNA, 19 nt, Homo sapiens
cagcaaccuuuauauucua

SEQ ID NO: 1065053 - RNA, 19 nt, Homo sapiens
guggaaauauugccuuguu

SEQ ID NO: 1065054 - RNA, 19 nt, Homo sapiens
ggaggaagacggcaugguu

SEQ ID NO: 1065055 - RNA, 19 nt, Homo sapiens
gaacuucugcuaucaugga

SEQ ID NO: 1065056 - RNA, 19 nt, Homo sapiens
gauuguggauuucuuaaag

SEQ ID NO: 1065057 - RNA, 19 nt, Homo sapiens
cgaagcaugcuaauuguuu

SEQ ID NO: 1065058 - RNA, 19 nt, Homo sapiens
gaagcauguuguaaggaaa

SEQ ID NO: 1065059 - RNA, 19 nt, Homo sapiens
ugaagcauguuguaaggaa

SEQ ID NO: 1065060 - RNA, 19 nt, Homo sapiens
ccagaggcuuguggaaaua

SEQ ID NO: 1065061 - RNA, 19 nt, Homo sapiens
ccacccaacuggucagcua

SEQ ID NO: 1065062 - RNA, 19 nt, Homo sapiens
agaagaagauggagcaaag

SEQ ID NO: 1065063 - RNA, 19 nt, Homo sapiens
uaucagacaucaacuuuac

SEQ ID NO: 1065064 - RNA, 19 nt, Homo sapiens
auacacaaguggaaauuug

SEQ ID NO: 1065065 - RNA, 19 nt, Homo sapiens
gcagagaccagauguuaca

SEQ ID NO: 1065066 - RNA, 19 nt, Homo sapiens
gugcugaauugguuaaaug

SEQ ID NO: 1065067 - RNA, 19 nt, Homo sapiens
ucucgaagauuuagucuca

SEQ ID NO: 1065068 - RNA, 19 nt, Homo sapiens
agacacacuucuagaaaga

SEQ ID NO: 1065069 - RNA, 19 nt, Homo sapiens
gaucuagccuuuucugauu

SEQ ID NO: 1065070 - RNA, 19 nt, Homo sapiens
cacgguagaucuagccuuu

SEQ ID NO: 1065071 - RNA, 19 nt, Homo sapiens
gaguguauauggcuugugu

SEQ ID NO: 1065072 - RNA, 19 nt, Homo sapiens
gguagccugugaaauaaga

SEQ ID NO: 1065073 - RNA, 19 nt, Homo sapiens
gaaguuugcagaucaagau

SEQ ID NO: 1065074 - RNA, 19 nt, Homo sapiens
gaugagaaguuugcagauc

SEQ ID NO: 1065075 - RNA, 19 nt, Homo sapiens
guauauggcuuguguuuug

SEQ ID NO: 1065076 - RNA, 19 nt, Homo sapiens
ccagcaaccuuuauauucu

SEQ ID NO: 1065077 - RNA, 19 nt, Homo sapiens
uaacgaggauagcuaacug

SEQ ID NO: 1065078 - RNA, 19 nt, Homo sapiens
ucagugcaauccagauauu

SEQ ID NO: 1065079 - RNA, 19 nt, Homo sapiens
gaagaaccaccucaagaca

SEQ ID NO: 1065080 - RNA, 19 nt, Homo sapiens
ucacucaucaucccacaua

SEQ ID NO: 1065081 - RNA, 19 nt, Homo sapiens
agaacugguuuguguauau

SEQ ID NO: 1065082 - RNA, 19 nt, Homo sapiens
caccgaagcaugcuaauug

SEQ ID NO: 1065083 - RNA, 19 nt, Homo sapiens
aauaauggguagccuguga

SEQ ID NO: 1065084 - RNA, 19 nt, Homo sapiens
gaccagcaaccuuuauauu

SEQ ID NO: 1065085 - RNA, 19 nt, Homo sapiens
uaucagaugcaacaaauga

SEQ ID NO: 1065086 - RNA, 19 nt, Homo sapiens
ugcagcagcuuaucaaaga

SEQ ID NO: 1065087 - RNA, 19 nt, Homo sapiens
gaaacuaacaagaggaaca

SEQ ID NO: 1065088 - RNA, 19 nt, Homo sapiens
caaguggaaauuuguauug

SEQ ID NO: 1065089 - RNA, 19 nt, Homo sapiens
gaagaagaucgacauucaa

SEQ ID NO: 1065090 - RNA, 19 nt, Homo sapiens
gggaaaggauaugacaaug

SEQ ID NO: 1065091 - RNA, 19 nt, Homo sapiens
ccaaaaggauauucugaaa

SEQ ID NO: 1065092 - RNA, 19 nt, Homo sapiens
gaaaaugcccucuaagugu

SEQ ID NO: 1065093 - RNA, 19 nt, Homo sapiens
auaauacccuugugucuuc

SEQ ID NO: 1065094 - RNA, 19 nt, Homo sapiens
gaucgaguaucagacauca

SEQ ID NO: 1065095 - RNA, 19 nt, Homo sapiens
gaaaagaucagauacaagu

SEQ ID NO: 1065096 - RNA, 19 nt, Homo sapiens
agaaagagaagauguaaca

SEQ ID NO: 1065097 - RNA, 19 nt, Homo sapiens
caacagggauauuaugaua

SEQ ID NO: 1065098 - RNA, 19 nt, Homo sapiens
agaaagaccugcugaauuu

SEQ ID NO: 1065099 - RNA, 19 nt, Homo sapiens
ucacagagauuacaguaua

SEQ ID NO: 1065100 - RNA, 19 nt, Homo sapiens
guagaggguuucuugauua

SEQ ID NO: 1065101 - RNA, 19 nt, Homo sapiens
gggcaaaucaugagaauaa

SEQ ID NO: 1065102 - RNA, 19 nt, Homo sapiens
gaaagaagauacaguuacu

SEQ ID NO: 1065103 - RNA, 19 nt, Homo sapiens
ccaauucguuucuggauuu

SEQ ID NO: 1065104 - RNA, 19 nt, Homo sapiens
ggaccuaacuguggaagaa

SEQ ID NO: 1065105 - RNA, 19 nt, Homo sapiens
gaaaucaugaccuauguaa

SEQ ID NO: 1065106 - RNA, 19 nt, Homo sapiens
gaagccaacugcaaauaug

SEQ ID NO: 1065107 - RNA, 19 nt, Homo sapiens
gaagaacuaaggaauguaa

SEQ ID NO: 1065108 - RNA, 19 nt, Homo sapiens
gaauauauuugcccuaucu

SEQ ID NO: 1065109 - RNA, 19 nt, Homo sapiens
ucaaagagcugggcaaauc

SEQ ID NO: 1065110 - RNA, 19 nt, Homo sapiens
cagcuuaaguuacuaaugu

SEQ ID NO: 1065111 - RNA, 19 nt, Homo sapiens
gcaaagaaguauggguuau

SEQ ID NO: 1065112 - RNA, 19 nt, Homo sapiens
agaaaugauugccaaguuu

SEQ ID NO: 1065113 - RNA, 19 nt, Homo sapiens
gcucaaggcagaauauauu

SEQ ID NO: 1065114 - RNA, 19 nt, Homo sapiens
gcagugugcaucaauuuaa

SEQ ID NO: 1065115 - RNA, 19 nt, Homo sapiens
uaaaguagaggguuucuug

SEQ ID NO: 1065116 - RNA, 19 nt, Homo sapiens
gcaaggagaagacaaagug

SEQ ID NO: 1065117 - RNA, 19 nt, Homo sapiens
gaacuaaggaauguaaaug

SEQ ID NO: 1065118 - RNA, 19 nt, Homo sapiens
guacagagcaauguggaua

SEQ ID NO: 1065119 - RNA, 19 nt, Homo sapiens
gguauugccugcacauuag

SEQ ID NO: 1065120 - RNA, 19 nt, Homo sapiens
aaaccacacugaaagaaga

SEQ ID NO: 1065121 - RNA, 19 nt, Homo sapiens
aaagaaguauggguuauug

SEQ ID NO: 1065122 - RNA, 19 nt, Homo sapiens
uuuacaaacugcuugguua

SEQ ID NO: 1065123 - RNA, 19 nt, Homo sapiens
gcaaauaugggaaucuuag

SEQ ID NO: 1065124 - RNA, 19 nt, Homo sapiens
gaucggaauuggauguaau

SEQ ID NO: 1065125 - RNA, 19 nt, Homo sapiens
cauggaaacugaguacauu

SEQ ID NO: 1065126 - RNA, 19 nt, Homo sapiens
cagaauauauuugcccuau

SEQ ID NO: 1065127 - RNA, 19 nt, Homo sapiens
gagccacgauggaccuuga

SEQ ID NO: 1065128 - RNA, 19 nt, Homo sapiens
cagaaagaccugcugaauu

SEQ ID NO: 1065129 - RNA, 19 nt, Homo sapiens
cgauggaccuugaaaucuu

SEQ ID NO: 1065130 - RNA, 19 nt, Homo sapiens
gaagguguuucagauacaa

SEQ ID NO: 1065131 - RNA, 19 nt, Homo sapiens
gaaccaauggaguaucuga

SEQ ID NO: 1065132 - RNA, 19 nt, Homo sapiens
gcacagacuucaggcaaag

SEQ ID NO: 1065133 - RNA, 19 nt, Homo sapiens
aagaaaugauugccaaguu

SEQ ID NO: 1065134 - RNA, 19 nt, Homo sapiens
ugagauaucuaugcuguuc

SEQ ID NO: 1065135 - RNA, 19 nt, Homo sapiens
gauuagcuuugugauguaa

SEQ ID NO: 1065136 - RNA, 19 nt, Homo sapiens
uggaguaucugaaguuauc

SEQ ID NO: 1065137 - RNA, 19 nt, Homo sapiens
uaacauaccaauucguuuc

SEQ ID NO: 1065138 - RNA, 19 nt, Homo sapiens
ggaaaucaugaccuaugua

SEQ ID NO: 1065139 - RNA, 19 nt, Homo sapiens
uuaaggaguuauacaagga

SEQ ID NO: 1065140 - RNA, 19 nt, Homo sapiens
ucacaggauccacagcuua

SEQ ID NO: 1065141 - RNA, 19 nt, Homo sapiens
caaacugcuugguuaaagu

SEQ ID NO: 1065142 - RNA, 19 nt, Homo sapiens
caaaucgagugaucggaau

SEQ ID NO: 1065143 - RNA, 19 nt, Homo sapiens
gauggaccuugaaaucuuc

SEQ ID NO: 1065144 - RNA, 19 nt, Homo sapiens
aguagaggguuucuugauu

SEQ ID NO: 1065145 - RNA, 19 nt, Homo sapiens
caaagaaguauggguuauu

SEQ ID NO: 1065146 - RNA, 19 nt, Homo sapiens
cauuagcaauuucagcaaa

SEQ ID NO: 1065147 - RNA, 19 nt, Homo sapiens
uggaagaacuaaggaaugu

SEQ ID NO: 1065148 - RNA, 19 nt, Homo sapiens
ggcaaagaaguauggguua

SEQ ID NO: 1065149 - RNA, 19 nt, Homo sapiens
caguggaaaucaugaccua

SEQ ID NO: 1065150 - RNA, 19 nt, Homo sapiens
cauguauucucuaucauca

SEQ ID NO: 1065151 - RNA, 19 nt, Homo sapiens
cauccuaaaucugucauug

SEQ ID NO: 1065152 - RNA, 19 nt, Homo sapiens
aggcuggacuucuaccuaa

SEQ ID NO: 1065153 - RNA, 19 nt, Homo sapiens
aauggaguaucugaaguua

SEQ ID NO: 1065154 - RNA, 19 nt, Homo sapiens
guggagaucagcaaagauu

SEQ ID NO: 1065155 - RNA, 19 nt, Homo sapiens
gaacuucccauguauucuc

SEQ ID NO: 1065156 - RNA, 19 nt, Homo sapiens
ggauccacagcuuaaguua

SEQ ID NO: 1065157 - RNA, 19 nt, Homo sapiens
cagugugcaucaauuuaaa

SEQ ID NO: 1065158 - RNA, 19 nt, Homo sapiens
uugagaggcuggacuucua

SEQ ID NO: 1065159 - RNA, 19 nt, Homo sapiens
aauauuccauggacaccua

SEQ ID NO: 1065160 - RNA, 19 nt, Homo sapiens
aaagcacaauucauacuuc

SEQ ID NO: 1065161 - RNA, 19 nt, Homo sapiens
uugauuagcuuugugaugu

SEQ ID NO: 1065162 - RNA, 19 nt, Homo sapiens
ggcacagacuucaggcaaa

SEQ ID NO: 1065163 - RNA, 19 nt, Homo sapiens
uagacuugcuagccuauau

SEQ ID NO: 1065164 - RNA, 19 nt, Homo sapiens
ggagccauccuaaaucugu

SEQ ID NO: 1065165 - RNA, 19 nt, Homo sapiens
ugauuagcuuugugaugua

SEQ ID NO: 1065166 - RNA, 19 nt, Homo sapiens
aaacugcuugguuaaagua

SEQ ID NO: 1065167 - RNA, 19 nt, Homo sapiens
cgguauugccugcacauua

SEQ ID NO: 1065168 - RNA, 19 nt, Homo sapiens
caauggaguaucugaaguu

SEQ ID NO: 1065169 - RNA, 19 nt, Homo sapiens
ccaagaagaaguagugagu

SEQ ID NO: 1065170 - RNA, 19 nt, Homo sapiens
cacauggaguggccaagaa

SEQ ID NO: 1065171 - RNA, 19 nt, Homo sapiens
aaucaugaccuauguaaca

SEQ ID NO: 1065172 - RNA, 19 nt, Homo sapiens
agagcaauguggauauguu

SEQ ID NO: 1065173 - RNA, 19 nt, Homo sapiens
gaaaucuucaaccuuccua

SEQ ID NO: 1065174 - RNA, 19 nt, Homo sapiens
ggcaaaucaugagaauaaa

SEQ ID NO: 1065175 - RNA, 19 nt, Homo sapiens
ucccauguauucucuauca

SEQ ID NO: 1065176 - RNA, 19 nt, Homo sapiens
uccuaaaucugucauuguu

SEQ ID NO: 1065177 - RNA, 19 nt, Homo sapiens
gaaaauuacccuuugacuu

SEQ ID NO: 1065178 - RNA, 19 nt, Homo sapiens
guauccugcuacuuacuuu

SEQ ID NO: 1065179 - RNA, 19 nt, Homo sapiens
ccaauggaguaucugaagu

SEQ ID NO: 1065180 - RNA, 19 nt, Homo sapiens
ugaguacauuuccugcaaa

SEQ ID NO: 1065181 - RNA, 19 nt, Homo sapiens
ccucuuagaccucucagaa

SEQ ID NO: 1065182 - RNA, 19 nt, Homo sapiens
caaaaucugugucaguugu

SEQ ID NO: 1065183 - RNA, 19 nt, Homo sapiens
gaagacaaagugcucacau

SEQ ID NO: 1065184 - RNA, 19 nt, Homo sapiens
caauguggauauguucaga

SEQ ID NO: 1065185 - RNA, 19 nt, Homo sapiens
ccacagcuuaaguuacuaa

SEQ ID NO: 1065186 - RNA, 19 nt, Homo sapiens
acaaacugcuugguuaaag

SEQ ID NO: 1065187 - RNA, 19 nt, Homo sapiens
aaacauucaucugcagugu

SEQ ID NO: 1065188 - RNA, 19 nt, Homo sapiens
gaggguuucuugauuagcu

SEQ ID NO: 1065189 - RNA, 19 nt, Homo sapiens
uuacaaacugcuugguuaa

SEQ ID NO: 1065190 - RNA, 19 nt, Homo sapiens
aagacaaagugcucacaug

SEQ ID NO: 1065191 - RNA, 19 nt, Homo sapiens
cgagcaaggagaagacaaa

SEQ ID NO: 1065192 - RNA, 19 nt, Homo sapiens
cauauaacauaccaauucg

SEQ ID NO: 1065193 - RNA, 19 nt, Homo sapiens
uggaaaucaugaccuaugu

SEQ ID NO: 1065194 - RNA, 19 nt, Homo sapiens
ggaagaacuaaggaaugua

SEQ ID NO: 1065195 - RNA, 19 nt, Homo sapiens
cauuguauuucccuucuuc

SEQ ID NO: 1065196 - RNA, 19 nt, Homo sapiens
cacaggauccacagcuuaa

SEQ ID NO: 1065197 - RNA, 19 nt, Homo sapiens
gaaaggaacugcaauaaua

SEQ ID NO: 1065198 - RNA, 19 nt, Homo sapiens
caacaacgacgccgaauua

SEQ ID NO: 1065199 - RNA, 19 nt, Homo sapiens
gaaaagaccuacagacuaa

SEQ ID NO: 1065200 - RNA, 19 nt, Homo sapiens
gaauggaacucaaagacaa

SEQ ID NO: 1065201 - RNA, 19 nt, Homo sapiens
gaagagaugacaaaccaua

SEQ ID NO: 1065202 - RNA, 19 nt, Homo sapiens
gaaauugcuugcuuuagau

SEQ ID NO: 1065203 - RNA, 19 nt, Homo sapiens
caaaccaggugcaauuauu

SEQ ID NO: 1065204 - RNA, 19 nt, Homo sapiens
gaucagagccucaaacaca

SEQ ID NO: 1065205 - RNA, 19 nt, Homo sapiens
gaacucaaaucuccuaagg

SEQ ID NO: 1065206 - RNA, 19 nt, Homo sapiens
ggcauagucuccuccaaua

SEQ ID NO: 1065207 - RNA, 19 nt, Homo sapiens
gugaguggaucucuugaua

SEQ ID NO: 1065208 - RNA, 19 nt, Homo sapiens
gcugaaacaucauuacaga

SEQ ID NO: 1065209 - RNA, 19 nt, Homo sapiens
gaaaacgggugaauuuauu

SEQ ID NO: 1065210 - RNA, 19 nt, Homo sapiens
ggaguauggucaucacaaa

SEQ ID NO: 1065211 - RNA, 19 nt, Homo sapiens
cugguugacuuucuaauua

SEQ ID NO: 1065212 - RNA, 19 nt, Homo sapiens
gaucacaugcuuacaguuu

SEQ ID NO: 1065213 - RNA, 19 nt, Homo sapiens
agaaauugcuugcuuuaga

SEQ ID NO: 1065214 - RNA, 19 nt, Homo sapiens
gaaacaucauuacagauuc

SEQ ID NO: 1065215 - RNA, 19 nt, Homo sapiens
gagacaacaucaucauuag

SEQ ID NO: 1065216 - RNA, 19 nt, Homo sapiens
caacgagacuucauuucau

SEQ ID NO: 1065217 - RNA, 19 nt, Homo sapiens
ggaaagaaaccaugcaaag

SEQ ID NO: 1065218 - RNA, 19 nt, Homo sapiens
gcacagaauugauacuaac

SEQ ID NO: 1065219 - RNA, 19 nt, Homo sapiens
ccagagaaauugcuugcuu

SEQ ID NO: 1065220 - RNA, 19 nt, Homo sapiens
caugcaaagucucagaaua

SEQ ID NO: 1065221 - RNA, 19 nt, Homo sapiens
caggugcaauuauuucuuu

SEQ ID NO: 1065222 - RNA, 19 nt, Homo sapiens
cagagaaauugcuugcuuu

SEQ ID NO: 1065223 - RNA, 19 nt, Homo sapiens
aaccauaacugacaagaga

SEQ ID NO: 1065224 - RNA, 19 nt, Homo sapiens
agagacaacaucaucauua

SEQ ID NO: 1065225 - RNA, 19 nt, Homo sapiens
gaaagaaaccaugcaaagu

SEQ ID NO: 1065226 - RNA, 19 nt, Homo sapiens
gaguggaucucuugauaca

SEQ ID NO: 1065227 - RNA, 19 nt, Homo sapiens
gagaauguauacacaccuu

SEQ ID NO: 1065228 - RNA, 19 nt, Homo sapiens
aaacauaugaugcaaguga

SEQ ID NO: 1065229 - RNA, 19 nt, Homo sapiens
cuacaggccuccaggaaug

SEQ ID NO: 1065230 - RNA, 19 nt, Homo sapiens
gaacucaaagacaauauuc

SEQ ID NO: 1065231 - RNA, 19 nt, Homo sapiens
guuaacaaguggaauggaa

SEQ ID NO: 1065232 - RNA, 19 nt, Homo sapiens
agacagcacagaauugaua

SEQ ID NO: 1065233 - RNA, 19 nt, Homo sapiens
ggaguggaccagagaaauu

SEQ ID NO: 1065234 - RNA, 19 nt, Homo sapiens
guucugagguccgcucuuu

SEQ ID NO: 1065235 - RNA, 19 nt, Homo sapiens
gagaagcgguuugauacug

SEQ ID NO: 1065236 - RNA, 19 nt, Homo sapiens
gaugacaaaccauaacuga

SEQ ID NO: 1065237 - RNA, 19 nt, Homo sapiens
ggaguuguguggcggauca

SEQ ID NO: 1065238 - RNA, 19 nt, Homo sapiens
guaauuaccagcucagaug

SEQ ID NO: 1065239 - RNA, 19 nt, Homo sapiens
ccaauuguguagacgauau

SEQ ID NO: 1065240 - RNA, 19 nt, Homo sapiens
ggccaguguuuacauguuu

SEQ ID NO: 1065241 - RNA, 19 nt, Homo sapiens
uaacagggcaccagucguu

SEQ ID NO: 1065242 - RNA, 19 nt, Homo sapiens
gaacauuagugggacauac

SEQ ID NO: 1065243 - RNA, 19 nt, Homo sapiens
caacgacgccgaauuacau

SEQ ID NO: 1065244 - RNA, 19 nt, Homo sapiens
gagagcaucugcaacaaaa

SEQ ID NO: 1065245 - RNA, 19 nt, Homo sapiens
gcaguccgcuguguucaau

SEQ ID NO: 1065246 - RNA, 19 nt, Homo sapiens
cagcaacaccaacaacuuu

SEQ ID NO: 1065247 - RNA, 19 nt, Homo sapiens
aagaagagaugacaaacca

SEQ ID NO: 1065248 - RNA, 19 nt, Homo sapiens
caaaugagagacaacauca

SEQ ID NO: 1065249 - RNA, 19 nt, Homo sapiens
ugcaaagucucagaauaua

SEQ ID NO: 1065250 - RNA, 19 nt, Homo sapiens
ugacauaccuaccugaaaa

SEQ ID NO: 1065251 - RNA, 19 nt, Homo sapiens
cuagaaaggaacugcaaua

SEQ ID NO: 1065252 - RNA, 19 nt, Homo sapiens
gacaaaccauaacugacaa

SEQ ID NO: 1065253 - RNA, 19 nt, Homo sapiens
gagcagaaaagaugaauuu

SEQ ID NO: 1065254 - RNA, 19 nt, Homo sapiens
guggaucucuugauacauc

SEQ ID NO: 1065255 - RNA, 19 nt, Homo sapiens
agagagaaaugcaaagaag

SEQ ID NO: 1065256 - RNA, 19 nt, Homo sapiens
uuucauugcucccuaaaga

SEQ ID NO: 1065257 - RNA, 19 nt, Homo sapiens
ugacaaaccauaacugaca

SEQ ID NO: 1065258 - RNA, 19 nt, Homo sapiens
guuuacaguucaacaagaa

SEQ ID NO: 1065259 - RNA, 19 nt, Homo sapiens
agagugcugugaccuguuu

SEQ ID NO: 1065260 - RNA, 19 nt, Homo sapiens
acaggacaguguuuacaaa

SEQ ID NO: 1065261 - RNA, 19 nt, Homo sapiens
gggcaccagucguuaacaa

SEQ ID NO: 1065262 - RNA, 19 nt, Homo sapiens
gacaacaucaucauuagug

SEQ ID NO: 1065263 - RNA, 19 nt, Homo sapiens
ggagagagaaaugcaaaga

SEQ ID NO: 1065264 - RNA, 19 nt, Homo sapiens
ggaacucaaagacaauauu

SEQ ID NO: 1065265 - RNA, 19 nt, Homo sapiens
ggaauggaacucaaagaca

SEQ ID NO: 1065266 - RNA, 19 nt, Homo sapiens
gaauguauacacaccuuau

SEQ ID NO: 1065267 - RNA, 19 nt, Homo sapiens
caaagucucagaauauaca

SEQ ID NO: 1065268 - RNA, 19 nt, Homo sapiens
ucuccguucucucucauua

SEQ ID NO: 1065269 - RNA, 19 nt, Homo sapiens
aaucaaaccaggugcaauu

SEQ ID NO: 1065270 - RNA, 19 nt, Homo sapiens
gaaugggacugaagaaacc

SEQ ID NO: 1065271 - RNA, 19 nt, Homo sapiens
caaguggaauggaacucaa

SEQ ID NO: 1065272 - RNA, 19 nt, Homo sapiens
caucagacagcacagaauu

SEQ ID NO: 1065273 - RNA, 19 nt, Homo sapiens
gagagagaaaugcaaagaa

SEQ ID NO: 1065274 - RNA, 19 nt, Homo sapiens
acaagcagcucagacaugu

SEQ ID NO: 1065275 - RNA, 19 nt, Homo sapiens
gcaacaacgacgccgaauu

SEQ ID NO: 1065276 - RNA, 19 nt, Homo sapiens
aaaccugucuacacacguu

SEQ ID NO: 1065277 - RNA, 19 nt, Homo sapiens
ucugcugucucaucacaua

SEQ ID NO: 1065278 - RNA, 19 nt, Homo sapiens
ggaaugggacugaagaaac

SEQ ID NO: 1065279 - RNA, 19 nt, Homo sapiens
gaaaccuagucacauugga

SEQ ID NO: 1065280 - RNA, 19 nt, Homo sapiens
agaagcgguuugauacuga

SEQ ID NO: 1065281 - RNA, 19 nt, Homo sapiens
gagagacaacaucaucauu

SEQ ID NO: 1065282 - RNA, 19 nt, Homo sapiens
gcauagucuccuccaauaa

SEQ ID NO: 1065283 - RNA, 19 nt, Homo sapiens
gaaaagugcauacaucaga

SEQ ID NO: 1065284 - RNA, 19 nt, Homo sapiens
cauuagaaucugugacaua

SEQ ID NO: 1065285 - RNA, 19 nt, Homo sapiens
uagaaaggaacugcaauaa

SEQ ID NO: 1065286 - RNA, 19 nt, Homo sapiens
ggagacagggaauugcauu

SEQ ID NO: 1065287 - RNA, 19 nt, Homo sapiens
guucugaugacaacacuuu

SEQ ID NO: 1065288 - RNA, 19 nt, Homo sapiens
ucaacgagacuucauuuca

SEQ ID NO: 1065289 - RNA, 19 nt, Homo sapiens
agagaaauugcuugcuuua

SEQ ID NO: 1065290 - RNA, 19 nt, Homo sapiens
aaagaaaccaugcaaaguc

SEQ ID NO: 1065291 - RNA, 19 nt, Homo sapiens
aaaccaggugcaauuauuu

SEQ ID NO: 1065292 - RNA, 19 nt, Homo sapiens
cauuacaguuugaugguau

SEQ ID NO: 1065293 - RNA, 19 nt, Homo sapiens
ugagacaggccaguguuua

SEQ ID NO: 1065294 - RNA, 19 nt, Homo sapiens
gagagaaaugcaaagaaga

SEQ ID NO: 1065295 - RNA, 19 nt, Homo sapiens
ugucgcuacuggagaauuu

SEQ ID NO: 1065296 - RNA, 19 nt, Homo sapiens
gcucagacaugucgcuacu

SEQ ID NO: 1065297 - RNA, 19 nt, Homo sapiens
gaaaggaacugcaauaaua

SEQ ID NO: 1065298 - RNA, 19 nt, Homo sapiens
caacaacgacgccgaauua

SEQ ID NO: 1065299 - RNA, 19 nt, Homo sapiens
gaaaagaccuacagacuaa

SEQ ID NO: 1065300 - RNA, 19 nt, Homo sapiens
gaauggaacucaaagacaa

SEQ ID NO: 1065301 - RNA, 19 nt, Homo sapiens
gaagagaugacaaaccaua

SEQ ID NO: 1065302 - RNA, 19 nt, Homo sapiens
gaagaugaacauacacaua

SEQ ID NO: 1065303 - RNA, 19 nt, Homo sapiens
gaaauugcuugcuuuagau

SEQ ID NO: 1065304 - RNA, 19 nt, Homo sapiens
gaacauacacauacuaaca

SEQ ID NO: 1065305 - RNA, 19 nt, Homo sapiens
caaaccaggugcaauuauu

SEQ ID NO: 1065306 - RNA, 19 nt, Homo sapiens
gaucagagccucaaacaca

SEQ ID NO: 1065307 - RNA, 19 nt, Homo sapiens
gaacucaaaucuccuaagg

SEQ ID NO: 1065308 - RNA, 19 nt, Homo sapiens
gugaguggaucucuugaua

SEQ ID NO: 1065309 - RNA, 19 nt, Homo sapiens
gcugaaacaucauuacaga

SEQ ID NO: 1065310 - RNA, 19 nt, Homo sapiens
gaaaacgggugaauuuauu

SEQ ID NO: 1065311 - RNA, 19 nt, Homo sapiens
ggaguauggucaucacaaa

SEQ ID NO: 1065312 - RNA, 19 nt, Homo sapiens
cugguugacuuucuaauua

SEQ ID NO: 1065313 - RNA, 19 nt, Homo sapiens
gaucacaugcuuacaguuu

SEQ ID NO: 1065314 - RNA, 19 nt, Homo sapiens
agaaauugcuugcuuuaga

SEQ ID NO: 1065315 - RNA, 19 nt, Homo sapiens
gaaacaucauuacagauuc

SEQ ID NO: 1065316 - RNA, 19 nt, Homo sapiens
gagacaacaucaucauuag

SEQ ID NO: 1065317 - RNA, 19 nt, Homo sapiens
caacgagacuucauuucau

SEQ ID NO: 1065318 - RNA, 19 nt, Homo sapiens
ggaaagaaaccaugcaaag

SEQ ID NO: 1065319 - RNA, 19 nt, Homo sapiens
gcacagaauugauacuaac

SEQ ID NO: 1065320 - RNA, 19 nt, Homo sapiens
ccagagaaauugcuugcuu

SEQ ID NO: 1065321 - RNA, 19 nt, Homo sapiens
cagagaagaugaacauaca

SEQ ID NO: 1065322 - RNA, 19 nt, Homo sapiens
caugcaaagucucagaaua

SEQ ID NO: 1065323 - RNA, 19 nt, Homo sapiens
ggaaaugaaucaggaacug

SEQ ID NO: 1065324 - RNA, 19 nt, Homo sapiens
caggugcaauuauuucuuu

SEQ ID NO: 1065325 - RNA, 19 nt, Homo sapiens
cagagaaauugcuugcuuu

SEQ ID NO: 1065326 - RNA, 19 nt, Homo sapiens
gucacgaacuccaguagua

SEQ ID NO: 1065327 - RNA, 19 nt, Homo sapiens
aaccauaacugacaagaga

SEQ ID NO: 1065328 - RNA, 19 nt, Homo sapiens
agagacaacaucaucauua

SEQ ID NO: 1065329 - RNA, 19 nt, Homo sapiens
gaaagaaaccaugcaaagu

SEQ ID NO: 1065330 - RNA, 19 nt, Homo sapiens
gaguggaucucuugauaca

SEQ ID NO: 1065331 - RNA, 19 nt, Homo sapiens
gagaauguauacacaccuu

SEQ ID NO: 1065332 - RNA, 19 nt, Homo sapiens
aaacauaugaugcaaguga

SEQ ID NO: 1065333 - RNA, 19 nt, Homo sapiens
cuacaggccuccaggaaug

SEQ ID NO: 1065334 - RNA, 19 nt, Homo sapiens
gaacucaaagacaauauuc

SEQ ID NO: 1065335 - RNA, 19 nt, Homo sapiens
guuaacaaguggaauggaa

SEQ ID NO: 1065336 - RNA, 19 nt, Homo sapiens
agacagcacagaauugaua

SEQ ID NO: 1065337 - RNA, 19 nt, Homo sapiens
ggaguggaccagagaaauu

SEQ ID NO: 1065338 - RNA, 19 nt, Homo sapiens
guucugagguccgcucuuu

SEQ ID NO: 1065339 - RNA, 19 nt, Homo sapiens
gaacagcaacagcaacuca

SEQ ID NO: 1065340 - RNA, 19 nt, Homo sapiens
acagaugaaucguguggua

SEQ ID NO: 1065341 - RNA, 19 nt, Homo sapiens
gaugacaaaccauaacuga

SEQ ID NO: 1065342 - RNA, 19 nt, Homo sapiens
ggaguuguguggcggauca

SEQ ID NO: 1065343 - RNA, 19 nt, Homo sapiens
guaauuaccagcucagaug

SEQ ID NO: 1065344 - RNA, 19 nt, Homo sapiens
ugaagaacaugcuggugaa

SEQ ID NO: 1065345 - RNA, 19 nt, Homo sapiens
ccaauuguguagacgauau

SEQ ID NO: 1065346 - RNA, 19 nt, Homo sapiens
ggccaguguuuacauguuu

SEQ ID NO: 1065347 - RNA, 19 nt, Homo sapiens
gaacuccaguaguauugug

SEQ ID NO: 1065348 - RNA, 19 nt, Homo sapiens
uaacagggcaccagucguu

SEQ ID NO: 1065349 - RNA, 19 nt, Homo sapiens
gaacauuagugggacauac

SEQ ID NO: 1065350 - RNA, 19 nt, Homo sapiens
caacgacgccgaauuacau

SEQ ID NO: 1065351 - RNA, 19 nt, Homo sapiens
gagagcaucugcaacaaaa

SEQ ID NO: 1065352 - RNA, 19 nt, Homo sapiens
gcaguccgcuguguucaau

SEQ ID NO: 1065353 - RNA, 19 nt, Homo sapiens
cagcaacaccaacaacuuu

SEQ ID NO: 1065354 - RNA, 19 nt, Homo sapiens
gauaguagcagagaagaug

SEQ ID NO: 1065355 - RNA, 19 nt, Homo sapiens
caaggacaguuggaagaaa

SEQ ID NO: 1065356 - RNA, 19 nt, Homo sapiens
aagaagagaugacaaacca

SEQ ID NO: 1065357 - RNA, 19 nt, Homo sapiens
caaaugagagacaacauca

SEQ ID NO: 1065358 - RNA, 19 nt, Homo sapiens
ugcaaagucucagaauaua

SEQ ID NO: 1065359 - RNA, 19 nt, Homo sapiens
ccaagaagaacaagaggaa

SEQ ID NO: 1065360 - RNA, 19 nt, Homo sapiens
ggagcacacugcaaggaau

SEQ ID NO: 1065361 - RNA, 19 nt, Homo sapiens
ugaaguuguuggaguagaa

SEQ ID NO: 1065362 - RNA, 19 nt, Homo sapiens
ccagguagaugaagaacag

SEQ ID NO: 1065363 - RNA, 19 nt, Homo sapiens
cuagaaaggaacugcaaua

SEQ ID NO: 1065364 - RNA, 19 nt, Homo sapiens
gacaaaccauaacugacaa

SEQ ID NO: 1065365 - RNA, 19 nt, Homo sapiens
gagcagaaaagaugaauuu

SEQ ID NO: 1065366 - RNA, 19 nt, Homo sapiens
guggaucucuugauacauc

SEQ ID NO: 1065367 - RNA, 19 nt, Homo sapiens
agagagaaaugcaaagaag

SEQ ID NO: 1065368 - RNA, 19 nt, Homo sapiens
uuucauugcucccuaaaga

SEQ ID NO: 1065369 - RNA, 19 nt, Homo sapiens
agaggaagaugaagaacau

SEQ ID NO: 1065370 - RNA, 19 nt, Homo sapiens
ugacaaaccauaacugaca

SEQ ID NO: 1065371 - RNA, 19 nt, Homo sapiens
guuuacaguucaacaagaa

SEQ ID NO: 1065372 - RNA, 19 nt, Homo sapiens
agagugcugugaccuguuu

SEQ ID NO: 1065373 - RNA, 19 nt, Homo sapiens
acaggacaguguuuacaaa

SEQ ID NO: 1065374 - RNA, 19 nt, Homo sapiens
gggcaccagucguuaacaa

SEQ ID NO: 1065375 - RNA, 19 nt, Homo sapiens
gacaacaucaucauuagug

SEQ ID NO: 1065376 - RNA, 19 nt, Homo sapiens
ggagagagaaaugcaaaga

SEQ ID NO: 1065377 - RNA, 19 nt, Homo sapiens
ggaacucaaagacaauauu

SEQ ID NO: 1065378 - RNA, 19 nt, Homo sapiens
ggaauggaacucaaagaca

SEQ ID NO: 1065379 - RNA, 19 nt, Homo sapiens
gaauguauacacaccuuau

SEQ ID NO: 1065380 - RNA, 19 nt, Homo sapiens
caaagucucagaauauaca

SEQ ID NO: 1065381 - RNA, 19 nt, Homo sapiens
gcaaggacaguuggaagaa

SEQ ID NO: 1065382 - RNA, 19 nt, Homo sapiens
aaucaaaccaggugcaauu

SEQ ID NO: 1065383 - RNA, 19 nt, Homo sapiens
caagccagguagaugaaga

SEQ ID NO: 1065384 - RNA, 19 nt, Homo sapiens
gaaugggacugaagaaacc

SEQ ID NO: 1065385 - RNA, 19 nt, Homo sapiens
caaguggaauggaacucaa

SEQ ID NO: 1065386 - RNA, 19 nt, Homo sapiens
caucagacagcacagaauu

SEQ ID NO: 1065387 - RNA, 19 nt, Homo sapiens
gagagagaaaugcaaagaa

SEQ ID NO: 1065388 - RNA, 19 nt, Homo sapiens
acaagcagcucagacaugu

SEQ ID NO: 1065389 - RNA, 19 nt, Homo sapiens
gcaacaacgacgccgaauu

SEQ ID NO: 1065390 - RNA, 19 nt, Homo sapiens
gcagagaagaugaacauac

SEQ ID NO: 1065391 - RNA, 19 nt, Homo sapiens
aaaccugucuacacacguu

SEQ ID NO: 1065392 - RNA, 19 nt, Homo sapiens
ucugcugucucaucacaua

SEQ ID NO: 1065393 - RNA, 19 nt, Homo sapiens
ggaaugggacugaagaaac

SEQ ID NO: 1065394 - RNA, 19 nt, Homo sapiens
gaaaccuagucacauugga

SEQ ID NO: 1065395 - RNA, 19 nt, Homo sapiens
gagagacaacaucaucauu

SEQ ID NO: 1065396 - RNA, 19 nt, Homo sapiens
gaaaagugcauacaucaga

SEQ ID NO: 1065397 - RNA, 19 nt, Homo sapiens
gaauuaaccuccuaucuua

SEQ ID NO: 1065398 - RNA, 19 nt, Homo sapiens
caaagucggugguauauga

SEQ ID NO: 1065399 - RNA, 19 nt, Homo sapiens
guaaagaauuaaccuccua

SEQ ID NO: 1065400 - RNA, 19 nt, Homo sapiens
gauguugugcugacuauua

SEQ ID NO: 1065401 - RNA, 19 nt, Homo sapiens
gcacugcugucucauagau

SEQ ID NO: 1065402 - RNA, 19 nt, Homo sapiens
gaugggauuuguacucuug

SEQ ID NO: 1065403 - RNA, 19 nt, Homo sapiens
gacaucgucuccuaauauu

SEQ ID NO: 1065404 - RNA, 19 nt, Homo sapiens
gggcgacgcuaacuucaga

SEQ ID NO: 1065405 - RNA, 19 nt, Homo sapiens
gcagagcugugccgagauc

SEQ ID NO: 1065406 - RNA, 19 nt, Homo sapiens
cuccuaauauuucccuuua

SEQ ID NO: 1065407 - RNA, 19 nt, Homo sapiens
ucuaaugucugaaccucua

SEQ ID NO: 1065408 - RNA, 19 nt, Homo sapiens
caacgucacgggcaucgua

SEQ ID NO: 1065409 - RNA, 19 nt, Homo sapiens
aaaauaaacucacccgaaa

SEQ ID NO: 1065410 - RNA, 19 nt, Homo sapiens
gaacagcacggccgacaag

SEQ ID NO: 1065411 - RNA, 19 nt, Homo sapiens
agaaggcccugcacugcua

SEQ ID NO: 1065412 - RNA, 19 nt, Homo sapiens
gcuaacagacgauugaugu

SEQ ID NO: 1065413 - RNA, 19 nt, Homo sapiens
agugagagguggcuuagaa

SEQ ID NO: 1065414 - RNA, 19 nt, Homo sapiens
gcaaagcgucugacaugug

SEQ ID NO: 1065415 - RNA, 19 nt, Homo sapiens
ccacucaccauguaaagaa

SEQ ID NO: 1065416 - RNA, 19 nt, Homo sapiens
guggagaccugccucaaca

SEQ ID NO: 1065417 - RNA, 19 nt, Homo sapiens
agaauuaaccuccuaucuu

SEQ ID NO: 1065418 - RNA, 19 nt, Homo sapiens
ucucauagaugggauuugu

SEQ ID NO: 1065419 - RNA, 19 nt, Homo sapiens
cauaucaacuccuagaaac

SEQ ID NO: 1065420 - RNA, 19 nt, Homo sapiens
gacaugugguggcagcaaa

SEQ ID NO: 1065421 - RNA, 19 nt, Homo sapiens
uggccgugcuggacaauuu

SEQ ID NO: 1065422 - RNA, 19 nt, Homo sapiens
caagggcucugugguaucu

SEQ ID NO: 1065423 - RNA, 19 nt, Homo sapiens
ggagggcgacgcuaacuuc

SEQ ID NO: 1065424 - RNA, 19 nt, Homo sapiens
caacuggcgucucaacaac

SEQ ID NO: 1065425 - RNA, 19 nt, Homo sapiens
ggaaagccgcauccaguuc

SEQ ID NO: 1065426 - RNA, 19 nt, Homo sapiens
caucgucuccuaauauuuc

SEQ ID NO: 1065427 - RNA, 19 nt, Homo sapiens
cggcaaagcgucugacaug

SEQ ID NO: 1065428 - RNA, 19 nt, Homo sapiens
gaccgcauguugucuccaa

SEQ ID NO: 1065429 - RNA, 19 nt, Homo sapiens
ccauaucaacuccuagaaa

SEQ ID NO: 1065430 - RNA, 19 nt, Homo sapiens
cgauugaugucuugucucu

SEQ ID NO: 1065431 - RNA, 19 nt, Homo sapiens
gacgauugaugucuugucu

SEQ ID NO: 1065432 - RNA, 19 nt, Homo sapiens
ugguaucucuggccacauu

SEQ ID NO: 1065433 - RNA, 19 nt, Homo sapiens
gugccgagaucgaccuguu

SEQ ID NO: 1065434 - RNA, 19 nt, Homo sapiens
caacauugaacccaaaguc

SEQ ID NO: 1065435 - RNA, 19 nt, Homo sapiens
ggcuacaacuggcgucuca

SEQ ID NO: 1065436 - RNA, 19 nt, Homo sapiens
cucaccauguaaagaauua

SEQ ID NO: 1065437 - RNA, 19 nt, Homo sapiens
ucccuggccugcccuguuu

SEQ ID NO: 1065438 - RNA, 19 nt, Homo sapiens
gaacccaaagucgguggua

SEQ ID NO: 1065439 - RNA, 19 nt, Homo sapiens
gcugcuaacagacgauuga

SEQ ID NO: 1065440 - RNA, 19 nt, Homo sapiens
gacgcuaacuucagaaucc

SEQ ID NO: 1065441 - RNA, 19 nt, Homo sapiens
ggaucucaguggaggacaa

SEQ ID NO: 1065442 - RNA, 19 nt, Homo sapiens
gcauccaguuccagcugaa

SEQ ID NO: 1065443 - RNA, 19 nt, Homo sapiens
gucugaaccucuaaaucuu

SEQ ID NO: 1065444 - RNA, 19 nt, Homo sapiens
ugucugaaccucuaaaucu

SEQ ID NO: 1065445 - RNA, 19 nt, Homo sapiens
cuucaagggcucuguggua

SEQ ID NO: 1065446 - RNA, 19 nt, Homo sapiens
agaggaagaucuacaucgu

SEQ ID NO: 1065447 - RNA, 19 nt, Homo sapiens
cacgugcucugccacauuc

SEQ ID NO: 1065448 - RNA, 19 nt, Homo sapiens
ugacucacccuccuuccaa

SEQ ID NO: 1065449 - RNA, 19 nt, Homo sapiens
ccaucucacuucucuacug

SEQ ID NO: 1065450 - RNA, 19 nt, Homo sapiens
gcagcuccaucucacuucu

SEQ ID NO: 1065451 - RNA, 19 nt, Homo sapiens
ggcaaagcgucugacaugu

SEQ ID NO: 1065452 - RNA, 19 nt, Homo sapiens
gugucucucucgcugcuaa

SEQ ID NO: 1065453 - RNA, 19 nt, Homo sapiens
ggaguccuucgcaggcaua

SEQ ID NO: 1065454 - RNA, 19 nt, Homo sapiens
gcuggaggccuucaacuac

SEQ ID NO: 1065455 - RNA, 19 nt, Homo sapiens
ggagaccugccucaacauc

SEQ ID NO: 1065456 - RNA, 19 nt, Homo sapiens
auugaugucuugucucugu

SEQ ID NO: 1065457 - RNA, 19 nt, Homo sapiens
uagaugggauuuguacucu

SEQ ID NO: 1065458 - RNA, 19 nt, Homo sapiens
ccacgugcucugccacauu

SEQ ID NO: 1065459 - RNA, 19 nt, Homo sapiens
ccuccuaucuuagcagaca

SEQ ID NO: 1065460 - RNA, 19 nt, Homo sapiens
ggccagcuccucgauguug

SEQ ID NO: 1065461 - RNA, 19 nt, Homo sapiens
ggagaggaagaucuacauc

SEQ ID NO: 1065462 - RNA, 19 nt, Homo sapiens
ggccuuuccugcacacaag

SEQ ID NO: 1065463 - RNA, 19 nt, Homo sapiens
acaacuggcgucucaacaa

SEQ ID NO: 1065464 - RNA, 19 nt, Homo sapiens
auguugugcugacuauuaa

SEQ ID NO: 1065465 - RNA, 19 nt, Homo sapiens
ucugaaccucuaaaucuuu

SEQ ID NO: 1065466 - RNA, 19 nt, Homo sapiens
agugaggccuuucccuuca

SEQ ID NO: 1065467 - RNA, 19 nt, Homo sapiens
ucgauguugugcugacuau

SEQ ID NO: 1065468 - RNA, 19 nt, Homo sapiens
gcagugagagguggcuuag

SEQ ID NO: 1065469 - RNA, 19 nt, Homo sapiens
gcugccugcuggagaggaa

SEQ ID NO: 1065470 - RNA, 19 nt, Homo sapiens
gacccacucaccauguaaa

SEQ ID NO: 1065471 - RNA, 19 nt, Homo sapiens
aaaaccauaucaacuccua

SEQ ID NO: 1065472 - RNA, 19 nt, Homo sapiens
acccaaagucggugguaua

SEQ ID NO: 1065473 - RNA, 19 nt, Homo sapiens
ugugagcucaucaacauug

SEQ ID NO: 1065474 - RNA, 19 nt, Homo sapiens
uuucaggcauucagaugug

SEQ ID NO: 1065475 - RNA, 19 nt, Homo sapiens
uaacagagaggccuuuccu

SEQ ID NO: 1065476 - RNA, 19 nt, Homo sapiens
gugaggccuuucccuucaa

SEQ ID NO: 1065477 - RNA, 19 nt, Homo sapiens
cuacagcgccgaggugaca

SEQ ID NO: 1065478 - RNA, 19 nt, Homo sapiens
uaacuucagaaucccauag

SEQ ID NO: 1065479 - RNA, 19 nt, Homo sapiens
ccucuacauuugcccuguu

SEQ ID NO: 1065480 - RNA, 19 nt, Homo sapiens
gugcagcuccaucucacuu

SEQ ID NO: 1065481 - RNA, 19 nt, Homo sapiens
uucaagggcucugugguau

SEQ ID NO: 1065482 - RNA, 19 nt, Homo sapiens
ugugcugacuauuaacaga

SEQ ID NO: 1065483 - RNA, 19 nt, Homo sapiens
augcacgucugccugagaa

SEQ ID NO: 1065484 - RNA, 19 nt, Homo sapiens
ugcagacgcuggacaucau

SEQ ID NO: 1065485 - RNA, 19 nt, Homo sapiens
gugcagacgcuggacauca

SEQ ID NO: 1065486 - RNA, 19 nt, Homo sapiens
gaacuuggcuuaaauauag

SEQ ID NO: 1065487 - RNA, 19 nt, Homo sapiens
guaauaaggucccggagaa

SEQ ID NO: 1065488 - RNA, 19 nt, Homo sapiens
ggaccucucucucauuauu

SEQ ID NO: 1065489 - RNA, 19 nt, Homo sapiens
ggaaugaaaugggaacuga

SEQ ID NO: 1065490 - RNA, 19 nt, Homo sapiens
ccacuucgcauaucauuua

SEQ ID NO: 1065491 - RNA, 19 nt, Homo sapiens
caaaugguguuaucccuuu

SEQ ID NO: 1065492 - RNA, 19 nt, Homo sapiens
gaggaugucuuguauuaug

SEQ ID NO: 1065493 - RNA, 19 nt, Homo sapiens
gaccugagauuaaacuuga

SEQ ID NO: 1065494 - RNA, 19 nt, Homo sapiens
cauguucccucuucaguua

SEQ ID NO: 1065495 - RNA, 19 nt, Homo sapiens
ggauacaacucucuggaaa

SEQ ID NO: 1065496 - RNA, 19 nt, Homo sapiens
ccaugaaccuuccaaauug

SEQ ID NO: 1065497 - RNA, 19 nt, Homo sapiens
agacaucccugaauugaaa

SEQ ID NO: 1065498 - RNA, 19 nt, Homo sapiens
cugaggaugucuuguauua

SEQ ID NO: 1065499 - RNA, 19 nt, Homo sapiens
gaaccagauuuaagccuuu

SEQ ID NO: 1065500 - RNA, 19 nt, Homo sapiens
gaacugaugaaccagauuu

SEQ ID NO: 1065501 - RNA, 19 nt, Homo sapiens
gcauauaagccaauaaaga

SEQ ID NO: 1065502 - RNA, 19 nt, Homo sapiens
caauaacucugcaccaaau

SEQ ID NO: 1065503 - RNA, 19 nt, Homo sapiens
ggaacuuggcuuaaauaua

SEQ ID NO: 1065504 - RNA, 19 nt, Homo sapiens
uugcugaccuuucuacuuu

SEQ ID NO: 1065505 - RNA, 19 nt, Homo sapiens
gaugugaaguugacagcaa

SEQ ID NO: 1065506 - RNA, 19 nt, Homo sapiens
uaaaagacaucccugaauu

SEQ ID NO: 1065507 - RNA, 19 nt, Homo sapiens
uaaauaguaugugcacuga

SEQ ID NO: 1065508 - RNA, 19 nt, Homo sapiens
agaaugcuguuuauaguga

SEQ ID NO: 1065509 - RNA, 19 nt, Homo sapiens
auacaacucucuggaaauu

SEQ ID NO: 1065510 - RNA, 19 nt, Homo sapiens
gaucagcucuugcuuuuau

SEQ ID NO: 1065511 - RNA, 19 nt, Homo sapiens
gcacagggaaguugggaaa

SEQ ID NO: 1065512 - RNA, 19 nt, Homo sapiens
gaacugaguguguuuccuu

SEQ ID NO: 1065513 - RNA, 19 nt, Homo sapiens
caaguuccacugaaaguaa

SEQ ID NO: 1065514 - RNA, 19 nt, Homo sapiens
gcaauaaacacaacuucug

SEQ ID NO: 1065515 - RNA, 19 nt, Homo sapiens
ucggaccucucucucauua

SEQ ID NO: 1065516 - RNA, 19 nt, Homo sapiens
gauauuccgugagauguau

SEQ ID NO: 1065517 - RNA, 19 nt, Homo sapiens
cagcaagcaaugaugauua

SEQ ID NO: 1065518 - RNA, 19 nt, Homo sapiens
cuauaaagaugugaaguug

SEQ ID NO: 1065519 - RNA, 19 nt, Homo sapiens
ucagaaugcuguuuauagu

SEQ ID NO: 1065520 - RNA, 19 nt, Homo sapiens
gcacgaaagaggccaguug

SEQ ID NO: 1065521 - RNA, 19 nt, Homo sapiens
gcucaagggcuccaauuug

SEQ ID NO: 1065522 - RNA, 19 nt, Homo sapiens
gcugaccuuucuacuuuaa

SEQ ID NO: 1065523 - RNA, 19 nt, Homo sapiens
ccucuucaguuaaaccuaa

SEQ ID NO: 1065524 - RNA, 19 nt, Homo sapiens
ggacaacuggguauagaug

SEQ ID NO: 1065525 - RNA, 19 nt, Homo sapiens
ggaaagcacagggaaguug

SEQ ID NO: 1065526 - RNA, 19 nt, Homo sapiens
gagagaagcaauaaacaca

SEQ ID NO: 1065527 - RNA, 19 nt, Homo sapiens
gcauaucauuuaaguggau

SEQ ID NO: 1065528 - RNA, 19 nt, Homo sapiens
ggauacaucuguguugagu

SEQ ID NO: 1065529 - RNA, 19 nt, Homo sapiens
uggacagucuaaucuauaa

SEQ ID NO: 1065530 - RNA, 19 nt, Homo sapiens
gguggacagucuaaucuau

SEQ ID NO: 1065531 - RNA, 19 nt, Homo sapiens
caagagagaagcaauaaac

SEQ ID NO: 1065532 - RNA, 19 nt, Homo sapiens
cagcugccguguuugcuuu

SEQ ID NO: 1065533 - RNA, 19 nt, Homo sapiens
aaacuugaaucacugaaag

SEQ ID NO: 1065534 - RNA, 19 nt, Homo sapiens
gaaacucuucuucaaacuu

SEQ ID NO: 1065535 - RNA, 19 nt, Homo sapiens
ccaccaaaaucauacauaa

SEQ ID NO: 1065536 - RNA, 19 nt, Homo sapiens
ggacucauuuggguuuaau

SEQ ID NO: 1065537 - RNA, 19 nt, Homo sapiens
uugaaucacugaaagaaga

SEQ ID NO: 1065538 - RNA, 19 nt, Homo sapiens
gagaagcaauaaacacaac

SEQ ID NO: 1065539 - RNA, 19 nt, Homo sapiens
gcuuaagaccaaugugaua

SEQ ID NO: 1065540 - RNA, 19 nt, Homo sapiens
aacuaggacuggaagaaua

SEQ ID NO: 1065541 - RNA, 19 nt, Homo sapiens
gaaguugacagcaagcaau

SEQ ID NO: 1065542 - RNA, 19 nt, Homo sapiens
gaauugugggcucucauuu

SEQ ID NO: 1065543 - RNA, 19 nt, Homo sapiens
gcuccaauuuguacucuca

SEQ ID NO: 1065544 - RNA, 19 nt, Homo sapiens
caguuaaaccuaaguaguu

SEQ ID NO: 1065545 - RNA, 19 nt, Homo sapiens
cagaucagcucuugcuuuu

SEQ ID NO: 1065546 - RNA, 19 nt, Homo sapiens
gcucaaccacuucgcauau

SEQ ID NO: 1065547 - RNA, 19 nt, Homo sapiens
auacaucuguguugaguca

SEQ ID NO: 1065548 - RNA, 19 nt, Homo sapiens
gcacugagagcugaauugu

SEQ ID NO: 1065549 - RNA, 19 nt, Homo sapiens
gaaccuuugguauacauga

SEQ ID NO: 1065550 - RNA, 19 nt, Homo sapiens
gauacaacaugaccuuuug

SEQ ID NO: 1065551 - RNA, 19 nt, Homo sapiens
uaagaccaaugugauacaa

SEQ ID NO: 1065552 - RNA, 19 nt, Homo sapiens
aaagacaucccugaauuga

SEQ ID NO: 1065553 - RNA, 19 nt, Homo sapiens
gaaugcuguuuauagugaa

SEQ ID NO: 1065554 - RNA, 19 nt, Homo sapiens
gaagcaauaaacacaacuu

SEQ ID NO: 1065555 - RNA, 19 nt, Homo sapiens
uaacucugcaccaaauauu

SEQ ID NO: 1065556 - RNA, 19 nt, Homo sapiens
ugacagcaagcaaugauga

SEQ ID NO: 1065557 - RNA, 19 nt, Homo sapiens
agaccaaugugauacaaca

SEQ ID NO: 1065558 - RNA, 19 nt, Homo sapiens
aaaugagcauguacguauu

SEQ ID NO: 1065559 - RNA, 19 nt, Homo sapiens
cucaagggcuccaauuugu

SEQ ID NO: 1065560 - RNA, 19 nt, Homo sapiens
ucucauuauugcccagaua

SEQ ID NO: 1065561 - RNA, 19 nt, Homo sapiens
caucgcaugcugcugauuu

SEQ ID NO: 1065562 - RNA, 19 nt, Homo sapiens
caugaacuaugcaaacucu

SEQ ID NO: 1065563 - RNA, 19 nt, Homo sapiens
aaaguuaugccucuucuuc

SEQ ID NO: 1065564 - RNA, 19 nt, Homo sapiens
uuucagaccuguuuaugca

SEQ ID NO: 1065565 - RNA, 19 nt, Homo sapiens
caugaaccuuccaaauugu

SEQ ID NO: 1065566 - RNA, 19 nt, Homo sapiens
guggacagucuaaucuaua

SEQ ID NO: 1065567 - RNA, 19 nt, Homo sapiens
cagcuuaagaccaauguga

SEQ ID NO: 1065568 - RNA, 19 nt, Homo sapiens
ggaagucccacggcacuga

SEQ ID NO: 1065569 - RNA, 19 nt, Homo sapiens
uaggacaacuggguauaga

SEQ ID NO: 1065570 - RNA, 19 nt, Homo sapiens
gcaccuccugaacaucuua

SEQ ID NO: 1065571 - RNA, 19 nt, Homo sapiens
aacaauaacucugcaccaa

SEQ ID NO: 1065572 - RNA, 19 nt, Homo sapiens
agcuuucucuggauacuua

SEQ ID NO: 1065573 - RNA, 19 nt, Homo sapiens
ucaaccacuucgcauauca

SEQ ID NO: 1065574 - RNA, 19 nt, Homo sapiens
gggaacugaugaaccagau

SEQ ID NO: 1065575 - RNA, 19 nt, Homo sapiens
acaacucucuggaaauucu

SEQ ID NO: 1065576 - RNA, 19 nt, Homo sapiens
uaucaucuacgagaaauug

SEQ ID NO: 1065577 - RNA, 19 nt, Homo sapiens
caacaguacaucagacaag

SEQ ID NO: 1065578 - RNA, 19 nt, Homo sapiens
gaggaaagcacagggaagu

SEQ ID NO: 1065579 - RNA, 19 nt, Homo sapiens
gauacaacucucuggaaau

SEQ ID NO: 1065580 - RNA, 19 nt, Homo sapiens
accaugaaccuuccaaauu

SEQ ID NO: 1065581 - RNA, 19 nt, Homo sapiens
cgggauacaucuguguuga

SEQ ID NO: 1065582 - RNA, 19 nt, Homo sapiens
auaaagaugugaaguugac

SEQ ID NO: 1065583 - RNA, 19 nt, Homo sapiens
ggacagucuaaucuauaaa

SEQ ID NO: 1065584 - RNA, 19 nt, Homo sapiens
guggaacuuggcuuaaaua

SEQ ID NO: 1065585 - RNA, 19 nt, Homo sapiens
aaagaggccaguuggagaa

SEQ ID NO: 1065586 - RNA, 19 nt, Homo sapiens
gaagaaaggcaaagaaaua

SEQ ID NO: 1065587 - RNA, 19 nt, Homo sapiens
gaauauaacucagccauuu

SEQ ID NO: 1065588 - RNA, 19 nt, Homo sapiens
gaggaaagcuggucacgaa

SEQ ID NO: 1065589 - RNA, 19 nt, Homo sapiens
gaaagggaauuauggaaga

SEQ ID NO: 1065590 - RNA, 19 nt, Homo sapiens
gagaugaauugauagagua

SEQ ID NO: 1065591 - RNA, 19 nt, Homo sapiens
aaagaagccuguccaguuu

SEQ ID NO: 1065592 - RNA, 19 nt, Homo sapiens
gcaguuggaucuauguauu

SEQ ID NO: 1065593 - RNA, 19 nt, Homo sapiens
caaagaagccuguccaguu

SEQ ID NO: 1065594 - RNA, 19 nt, Homo sapiens
gaauuuagguucaaguaca

SEQ ID NO: 1065595 - RNA, 19 nt, Homo sapiens
gagcagaaacgaagugaaa

SEQ ID NO: 1065596 - RNA, 19 nt, Homo sapiens
gcaggaugcuucaaugcaa

SEQ ID NO: 1065597 - RNA, 19 nt, Homo sapiens
caagauagauacaaagaac

SEQ ID NO: 1065598 - RNA, 19 nt, Homo sapiens
ggaaccaguugacauugaa

SEQ ID NO: 1065599 - RNA, 19 nt, Homo sapiens
gcacagaaacaguuaagug

SEQ ID NO: 1065600 - RNA, 19 nt, Homo sapiens
gaagaaagggaauuaugga

SEQ ID NO: 1065601 - RNA, 19 nt, Homo sapiens
gaacuuaaucucuagaaag

SEQ ID NO: 1065602 - RNA, 19 nt, Homo sapiens
gaaauaaagaggcauuagu

SEQ ID NO: 1065603 - RNA, 19 nt, Homo sapiens
acaaagaacuucaggaaaa

SEQ ID NO: 1065604 - RNA, 19 nt, Homo sapiens
ggauagaaauagcauggau

SEQ ID NO: 1065605 - RNA, 19 nt, Homo sapiens
gcaacagaguaugauauga

SEQ ID NO: 1065606 - RNA, 19 nt, Homo sapiens
gaacaagagaugaauugau

SEQ ID NO: 1065607 - RNA, 19 nt, Homo sapiens
ucacgaagcccucagcauu

SEQ ID NO: 1065608 - RNA, 19 nt, Homo sapiens
gaaaggcaaagaaauaaag

SEQ ID NO: 1065609 - RNA, 19 nt, Homo sapiens
ggaagaaaggcaaagaaau

SEQ ID NO: 1065610 - RNA, 19 nt, Homo sapiens
gaacagaaggaaauauugg

SEQ ID NO: 1065611 - RNA, 19 nt, Homo sapiens
guacauuucugcaauugag

SEQ ID NO: 1065612 - RNA, 19 nt, Homo sapiens
ucaaguacaggauauauga

SEQ ID NO: 1065613 - RNA, 19 nt, Homo sapiens
uagcauggauuucaacauc

SEQ ID NO: 1065614 - RNA, 19 nt, Homo sapiens
caagucauccgccaaagaa

SEQ ID NO: 1065615 - RNA, 19 nt, Homo sapiens
ggcauuaccuaaccucuuc

SEQ ID NO: 1065616 - RNA, 19 nt, Homo sapiens
gaugagaugcuagaaugua

SEQ ID NO: 1065617 - RNA, 19 nt, Homo sapiens
ggcauuggauaaaucauau

SEQ ID NO: 1065618 - RNA, 19 nt, Homo sapiens
gugggagucuauuauauau

SEQ ID NO: 1065619 - RNA, 19 nt, Homo sapiens
uagaauugauuuccaguuc

SEQ ID NO: 1065620 - RNA, 19 nt, Homo sapiens
cagaaacaguuaagugcuu

SEQ ID NO: 1065621 - RNA, 19 nt, Homo sapiens
gaucaagucauccgccaaa

SEQ ID NO: 1065622 - RNA, 19 nt, Homo sapiens
acaccgauaugauagagaa

SEQ ID NO: 1065623 - RNA, 19 nt, Homo sapiens
gauuuccaguucaaggaua

SEQ ID NO: 1065624 - RNA, 19 nt, Homo sapiens
agaaggaacuguuaaaaga

SEQ ID NO: 1065625 - RNA, 19 nt, Homo sapiens
cacgaagcccucagcauua

SEQ ID NO: 1065626 - RNA, 19 nt, Homo sapiens
auuguaaagugccacauua

SEQ ID NO: 1065627 - RNA, 19 nt, Homo sapiens
ggaugaauauaaggcacua

SEQ ID NO: 1065628 - RNA, 19 nt, Homo sapiens
gaaaagaacaagagaugaa

SEQ ID NO: 1065629 - RNA, 19 nt, Homo sapiens
caaaagccauuguaaagug

SEQ ID NO: 1065630 - RNA, 19 nt, Homo sapiens
gaaacaguuaagugcuuua

SEQ ID NO: 1065631 - RNA, 19 nt, Homo sapiens
gcaacaaguagaagcuauu

SEQ ID NO: 1065632 - RNA, 19 nt, Homo sapiens
ccuaaccucuucugcaguu

SEQ ID NO: 1065633 - RNA, 19 nt, Homo sapiens
gaagcccucagcauuauug

SEQ ID NO: 1065634 - RNA, 19 nt, Homo sapiens
uaaggcagcaauaauagaa

SEQ ID NO: 1065635 - RNA, 19 nt, Homo sapiens
gcagcaacagaguaugaua

SEQ ID NO: 1065636 - RNA, 19 nt, Homo sapiens
aaacaagaauuggaagaca

SEQ ID NO: 1065637 - RNA, 19 nt, Homo sapiens
uugaugagaugcuagaaug

SEQ ID NO: 1065638 - RNA, 19 nt, Homo sapiens
caagagaugaauugauaga

SEQ ID NO: 1065639 - RNA, 19 nt, Homo sapiens
uguuaaggcagcaauaaua

SEQ ID NO: 1065640 - RNA, 19 nt, Homo sapiens
caaguagaagcuauugaaa

SEQ ID NO: 1065641 - RNA, 19 nt, Homo sapiens
aaaugcaucuacuuucaug

SEQ ID NO: 1065642 - RNA, 19 nt, Homo sapiens
ggaaauaaaacaccgauau

SEQ ID NO: 1065643 - RNA, 19 nt, Homo sapiens
gauagaaauagcauggauu

SEQ ID NO: 1065644 - RNA, 19 nt, Homo sapiens
caugaugacucuugaugag

SEQ ID NO: 1065645 - RNA, 19 nt, Homo sapiens
cggaaccaguugacauuga

SEQ ID NO: 1065646 - RNA, 19 nt, Homo sapiens
agaaacaguuaagugcuuu

SEQ ID NO: 1065647 - RNA, 19 nt, Homo sapiens
gaagacagaacaugcaaaa

SEQ ID NO: 1065648 - RNA, 19 nt, Homo sapiens
gaaggaugcaguuuuaaaa

SEQ ID NO: 1065649 - RNA, 19 nt, Homo sapiens
gaggaagaaaggcaaagaa

SEQ ID NO: 1065650 - RNA, 19 nt, Homo sapiens
acaaguagaagcuauugaa

SEQ ID NO: 1065651 - RNA, 19 nt, Homo sapiens
agagaugaauugauagagu

SEQ ID NO: 1065652 - RNA, 19 nt, Homo sapiens
gugaggaguugcuaaaugc

SEQ ID NO: 1065653 - RNA, 19 nt, Homo sapiens
caggaugcuucaaugcaaa

SEQ ID NO: 1065654 - RNA, 19 nt, Homo sapiens
ccauuagucuacaaaucaa

SEQ ID NO: 1065655 - RNA, 19 nt, Homo sapiens
acaguacauuucugcaauu

SEQ ID NO: 1065656 - RNA, 19 nt, Homo sapiens
auacaaagaacuucaggaa

SEQ ID NO: 1065657 - RNA, 19 nt, Homo sapiens
gaagagcagaaacgaagug

SEQ ID NO: 1065658 - RNA, 19 nt, Homo sapiens
acucagccauuuauaggaa

SEQ ID NO: 1065659 - RNA, 19 nt, Homo sapiens
uaaagugccacauuaccaa

SEQ ID NO: 1065660 - RNA, 19 nt, Homo sapiens
caacaaguagaagcuauug

SEQ ID NO: 1065661 - RNA, 19 nt, Homo sapiens
ucaagaacagaaggaaaua

SEQ ID NO: 1065662 - RNA, 19 nt, Homo sapiens
ugugaggaguugcuaaaug

SEQ ID NO: 1065663 - RNA, 19 nt, Homo sapiens
guacaggauauaugaaauc

SEQ ID NO: 1065664 - RNA, 19 nt, Homo sapiens
ugugggagucuauuauaua

SEQ ID NO: 1065665 - RNA, 19 nt, Homo sapiens
uccaaaucauguagaauug

SEQ ID NO: 1065666 - RNA, 19 nt, Homo sapiens
ggaaaaguguuuggaggaa

SEQ ID NO: 1065667 - RNA, 19 nt, Homo sapiens
cagagaaggaacuguuaaa

SEQ ID NO: 1065668 - RNA, 19 nt, Homo sapiens
guacguuucugagauuucu

SEQ ID NO: 1065669 - RNA, 19 nt, Homo sapiens
gaaauaaaacaccgauaug

SEQ ID NO: 1065670 - RNA, 19 nt, Homo sapiens
ugaugacucuugaugagau

SEQ ID NO: 1065671 - RNA, 19 nt, Homo sapiens
ucagcaaucucaagaacag

SEQ ID NO: 1065672 - RNA, 19 nt, Homo sapiens
uaacucagccauuuauagg

SEQ ID NO: 1065673 - RNA, 19 nt, Homo sapiens
acacuggcauuggauaaau

SEQ ID NO: 1065674 - RNA, 19 nt, Homo sapiens
ggaagacagaacaugcaaa

SEQ ID NO: 1065675 - RNA, 19 nt, Homo sapiens
ggaauuauggaagacagaa

SEQ ID NO: 1065676 - RNA, 19 nt, Homo sapiens
ggaggaagaaaggcaaaga

SEQ ID NO: 1065677 - RNA, 19 nt, Homo sapiens
caacagaguaugauaugac

SEQ ID NO: 1065678 - RNA, 19 nt, Homo sapiens
ccacacuggcauuggauaa

SEQ ID NO: 1065679 - RNA, 19 nt, Homo sapiens
uaagucaggaaacuguuaa

SEQ ID NO: 1065680 - RNA, 19 nt, Homo sapiens
uaaagaggcauuaguaucc

SEQ ID NO: 1065681 - RNA, 19 nt, Homo sapiens
cagaaggaaauauuggaaa

SEQ ID NO: 1065682 - RNA, 19 nt, Homo sapiens
augagaugcuagaauguaa

SEQ ID NO: 1065683 - RNA, 19 nt, Homo sapiens
cagcaacagaguaugauau

SEQ ID NO: 1065684 - RNA, 19 nt, Homo sapiens
uagcagcaacagaguauga

SEQ ID NO: 1065685 - RNA, 19 nt, Homo sapiens
guucaaggauaaaccaaaa

SEQ ID NO: 1065686 - RNA, 19 nt, Homo sapiens
gaauagaggucauauaguu

SEQ ID NO: 1065687 - RNA, 19 nt, Homo sapiens
gaauaucccuacaugauuu

SEQ ID NO: 1065688 - RNA, 19 nt, Homo sapiens
gaacgggacuuugcagaaa

SEQ ID NO: 1065689 - RNA, 19 nt, Homo sapiens
ccacaucacuuccuucuug

SEQ ID NO: 1065690 - RNA, 19 nt, Homo sapiens
ggacagguguugcgucuga

SEQ ID NO: 1065691 - RNA, 19 nt, Homo sapiens
ggagaggccucacgucaug

SEQ ID NO: 1065692 - RNA, 19 nt, Homo sapiens
gaacgaagcaggauguugu

SEQ ID NO: 1065693 - RNA, 19 nt, Homo sapiens
ggacuggcuucgauacuug

SEQ ID NO: 1065694 - RNA, 19 nt, Homo sapiens
ccucuuuggucuuaacuua

SEQ ID NO: 1065695 - RNA, 19 nt, Homo sapiens
ggaauaucccuacaugauu

SEQ ID NO: 1065696 - RNA, 19 nt, Homo sapiens
cagaugauauguccuugaa

SEQ ID NO: 1065697 - RNA, 19 nt, Homo sapiens
cacccacgcuccuacaaua

SEQ ID NO: 1065698 - RNA, 19 nt, Homo sapiens
agaagaauaugacagaugu

SEQ ID NO: 1065699 - RNA, 19 nt, Homo sapiens
ugaggcaaguggaaccuua

SEQ ID NO: 1065700 - RNA, 19 nt, Homo sapiens
gcucaagccuggugcacuu

SEQ ID NO: 1065701 - RNA, 19 nt, Homo sapiens
caagguugguuuauaagug

SEQ ID NO: 1065702 - RNA, 19 nt, Homo sapiens
gggcagagccaugacauuu

SEQ ID NO: 1065703 - RNA, 19 nt, Homo sapiens
uauaagugguuccugcuaa

SEQ ID NO: 1065704 - RNA, 19 nt, Homo sapiens
gcaucucccuucucuucua

SEQ ID NO: 1065705 - RNA, 19 nt, Homo sapiens
uagaagagcuaacguacuc

SEQ ID NO: 1065706 - RNA, 19 nt, Homo sapiens
uagggaauauggcucagua

SEQ ID NO: 1065707 - RNA, 19 nt, Homo sapiens
ggaugagguugauauguca

SEQ ID NO: 1065708 - RNA, 19 nt, Homo sapiens
gaauagugaugaagagcau

SEQ ID NO: 1065709 - RNA, 19 nt, Homo sapiens
ucaagaggauguucagcaa

SEQ ID NO: 1065710 - RNA, 19 nt, Homo sapiens
gaagcaggauguugucacu

SEQ ID NO: 1065711 - RNA, 19 nt, Homo sapiens
ggacuuugcagaaaugugu

SEQ ID NO: 1065712 - RNA, 19 nt, Homo sapiens
ucagaucucucuccagaag

SEQ ID NO: 1065713 - RNA, 19 nt, Homo sapiens
caagaauagaggucauaua

SEQ ID NO: 1065714 - RNA, 19 nt, Homo sapiens
agaaucagcaccauggaua

SEQ ID NO: 1065715 - RNA, 19 nt, Homo sapiens
aguggaaccuuaucaguga

SEQ ID NO: 1065716 - RNA, 19 nt, Homo sapiens
guauagaagagcuaacgua

SEQ ID NO: 1065717 - RNA, 19 nt, Homo sapiens
cguauaggcuguccugcaa

SEQ ID NO: 1065718 - RNA, 19 nt, Homo sapiens
ggaacgggacuuugcagaa

SEQ ID NO: 1065719 - RNA, 19 nt, Homo sapiens
gggcaugccuaccaaacau

SEQ ID NO: 1065720 - RNA, 19 nt, Homo sapiens
gcagaaaugugugcagacu

SEQ ID NO: 1065721 - RNA, 19 nt, Homo sapiens
gaagaugccauggacuuug

SEQ ID NO: 1065722 - RNA, 19 nt, Homo sapiens
aagaauagaggucauauag

SEQ ID NO: 1065723 - RNA, 19 nt, Homo sapiens
agaaaugugugcagacuac

SEQ ID NO: 1065724 - RNA, 19 nt, Homo sapiens
ucacagccuuuguuaccuu

SEQ ID NO: 1065725 - RNA, 19 nt, Homo sapiens
gcagaagaauaugacagau

SEQ ID NO: 1065726 - RNA, 19 nt, Homo sapiens
caagaacgaagcaggaugu

SEQ ID NO: 1065727 - RNA, 19 nt, Homo sapiens
gaauaaagugggaggucaa

SEQ ID NO: 1065728 - RNA, 19 nt, Homo sapiens
ucagugacuuggccaacaa

SEQ ID NO: 1065729 - RNA, 19 nt, Homo sapiens
caagcaccguggccaugaa

SEQ ID NO: 1065730 - RNA, 19 nt, Homo sapiens
caagagcuauaggcugguu

SEQ ID NO: 1065731 - RNA, 19 nt, Homo sapiens
gcuggugcaucgugggaaa

SEQ ID NO: 1065732 - RNA, 19 nt, Homo sapiens
uaaagugggaggucaaaca

SEQ ID NO: 1065733 - RNA, 19 nt, Homo sapiens
uggaugagguugauauguc

SEQ ID NO: 1065734 - RNA, 19 nt, Homo sapiens
ugaagagcaucaguggaaa

SEQ ID NO: 1065735 - RNA, 19 nt, Homo sapiens
aagaggauguucagcaauc

SEQ ID NO: 1065736 - RNA, 19 nt, Homo sapiens
ucuauggccucuacuaugg

SEQ ID NO: 1065737 - RNA, 19 nt, Homo sapiens
ugucauguuuacccucuuu

SEQ ID NO: 1065738 - RNA, 19 nt, Homo sapiens
gguuccugcuaaucuauaa

SEQ ID NO: 1065739 - RNA, 19 nt, Homo sapiens
ggcagaagaauaugacaga

SEQ ID NO: 1065740 - RNA, 19 nt, Homo sapiens
ugugcaagcucauucuuca

SEQ ID NO: 1065741 - RNA, 19 nt, Homo sapiens
gaagcuaugcaugcugaaa

SEQ ID NO: 1065742 - RNA, 19 nt, Homo sapiens
cagaagaugccauggacuu

SEQ ID NO: 1065743 - RNA, 19 nt, Homo sapiens
caagaucaaaccagaagau

SEQ ID NO: 1065744 - RNA, 19 nt, Homo sapiens
cuaggcgacuugaauaaag

SEQ ID NO: 1065745 - RNA, 19 nt, Homo sapiens
caucacuuccuucuugaaa

SEQ ID NO: 1065746 - RNA, 19 nt, Homo sapiens
aaacgugucccuacugcaa

SEQ ID NO: 1065747 - RNA, 19 nt, Homo sapiens
ugguggagguuccuaguga

SEQ ID NO: 1065748 - RNA, 19 nt, Homo sapiens
cagacuacauggcaucuac

SEQ ID NO: 1065749 - RNA, 19 nt, Homo sapiens
ugggacaacuggaagaauc

SEQ ID NO: 1065750 - RNA, 19 nt, Homo sapiens
cuaccaaacaucuuucaga

SEQ ID NO: 1065751 - RNA, 19 nt, Homo sapiens
ggagguuccuagugaucug

SEQ ID NO: 1065752 - RNA, 19 nt, Homo sapiens
ucacucccgucugaauaaa

SEQ ID NO: 1065753 - RNA, 19 nt, Homo sapiens
gaagaaucagcaccaugga

SEQ ID NO: 1065754 - RNA, 19 nt, Homo sapiens
ggagcuggaugagguugau

SEQ ID NO: 1065755 - RNA, 19 nt, Homo sapiens
ggccucacgucauguaugg

SEQ ID NO: 1065756 - RNA, 19 nt, Homo sapiens
cagaagaauaugacagaug

SEQ ID NO: 1065757 - RNA, 19 nt, Homo sapiens
ucuccucccugcccacaaa

SEQ ID NO: 1065758 - RNA, 19 nt, Homo sapiens
ggccuggaauagugaugaa

SEQ ID NO: 1065759 - RNA, 19 nt, Homo sapiens
caauauggugacccucuuu

SEQ ID NO: 1065760 - RNA, 19 nt, Homo sapiens
caucucccuucucuucuau

SEQ ID NO: 1065761 - RNA, 19 nt, Homo sapiens
guccuaggcgacuugaaua

SEQ ID NO: 1065762 - RNA, 19 nt, Homo sapiens
guugauaugucagaucucu

SEQ ID NO: 1065763 - RNA, 19 nt, Homo sapiens
guccugcaaucaugucuuc

SEQ ID NO: 1065764 - RNA, 19 nt, Homo sapiens
uauaggcuguccugcaauc

SEQ ID NO: 1065765 - RNA, 19 nt, Homo sapiens
gaucauugagaacacguau

SEQ ID NO: 1065766 - RNA, 19 nt, Homo sapiens
gcacccacgcuccuacaau

SEQ ID NO: 1065767 - RNA, 19 nt, Homo sapiens
uacgugaggcagaagaaua

SEQ ID NO: 1065768 - RNA, 19 nt, Homo sapiens
cacaucacuuccuucuuga

SEQ ID NO: 1065769 - RNA, 19 nt, Homo sapiens
gggaacgggagcuggauga

SEQ ID NO: 1065770 - RNA, 19 nt, Homo sapiens
ucauugagaacacguauag

SEQ ID NO: 1065771 - RNA, 19 nt, Homo sapiens
gaagaggggaucauugaga

SEQ ID NO: 1065772 - RNA, 19 nt, Homo sapiens
gccaagaauagaggucaua

SEQ ID NO: 1065773 - RNA, 19 nt, Homo sapiens
caaguggaaccuuaucagu

SEQ ID NO: 1065774 - RNA, 19 nt, Homo sapiens
gugacccucuuucagaugu

SEQ ID NO: 1065775 - RNA, 19 nt, Homo sapiens
uguugucacucccgucuga

SEQ ID NO: 1065776 - RNA, 19 nt, Homo sapiens
ccacgcuccuacaauaugg

SEQ ID NO: 1065777 - RNA, 19 nt, Homo sapiens
gaaccuuaucagugacuug

SEQ ID NO: 1065778 - RNA, 19 nt, Homo sapiens
acaauauggugacccucuu

SEQ ID NO: 1065779 - RNA, 19 nt, Homo sapiens
caaacaucuuucagacagu

SEQ ID NO: 1065780 - RNA, 19 nt, Homo sapiens
gcaaguggaaccuuaucag

SEQ ID NO: 1065781 - RNA, 19 nt, Homo sapiens
augaagagcaucaguggaa

SEQ ID NO: 1065782 - RNA, 19 nt, Homo sapiens
caucuaccauaggguucua

SEQ ID NO: 1065783 - RNA, 19 nt, Homo sapiens
uggcaucucccuucucuuc

SEQ ID NO: 1065784 - RNA, 19 nt, Homo sapiens
uuucagauguggguuguuc

SEQ ID NO: 1065785 - RNA, 19 nt, Homo sapiens
uuuacccucuuuggucuua

SEQ ID NO: 1065786 - RNA, 19 nt, Homo sapiens
gaagaugacuggaaacugu

SEQ ID NO: 1065787 - RNA, 19 nt, Homo sapiens
ggagaaaccaauagaaaua

SEQ ID NO: 1065788 - RNA, 19 nt, Homo sapiens
gaaagaaacggauuuacaa

SEQ ID NO: 1065789 - RNA, 19 nt, Homo sapiens
ggaccaacuuuauaugaaa

SEQ ID NO: 1065790 - RNA, 19 nt, Homo sapiens
uaacgagguuugugaaaug

SEQ ID NO: 1065791 - RNA, 19 nt, Homo sapiens
gaagaacuguaauaaaugc

SEQ ID NO: 1065792 - RNA, 19 nt, Homo sapiens
ggaacggauucucaucuuu

SEQ ID NO: 1065793 - RNA, 19 nt, Homo sapiens
gaggagaaaccaauagaaa

SEQ ID NO: 1065794 - RNA, 19 nt, Homo sapiens
gaacugaagaugacuggaa

SEQ ID NO: 1065795 - RNA, 19 nt, Homo sapiens
caagaaagaaacggauuua

SEQ ID NO: 1065796 - RNA, 19 nt, Homo sapiens
gcaagaaagaaacggauuu

SEQ ID NO: 1065797 - RNA, 19 nt, Homo sapiens
gauaauaggauaugguuuc

SEQ ID NO: 1065798 - RNA, 19 nt, Homo sapiens
cagaggagguggaggaaga

SEQ ID NO: 1065799 - RNA, 19 nt, Homo sapiens
guugaugccucauucuaaa

SEQ ID NO: 1065800 - RNA, 19 nt, Homo sapiens
gauaugguuucggaacuuu

SEQ ID NO: 1065801 - RNA, 19 nt, Homo sapiens
gaggaccaacuuuauauga

SEQ ID NO: 1065802 - RNA, 19 nt, Homo sapiens
gagagaaacagcaagugaa

SEQ ID NO: 1065803 - RNA, 19 nt, Homo sapiens
gaccacguguuuacuuuca

SEQ ID NO: 1065804 - RNA, 19 nt, Homo sapiens
ggauaugguuucggaacuu

SEQ ID NO: 1065805 - RNA, 19 nt, Homo sapiens
auauguggcuuucaaauuc

SEQ ID NO: 1065806 - RNA, 19 nt, Homo sapiens
gaaauaggaccucguuuug

SEQ ID NO: 1065807 - RNA, 19 nt, Homo sapiens
ugaaagaugugccgcaaaa

SEQ ID NO: 1065808 - RNA, 19 nt, Homo sapiens
gcaucggcgugucauaaga

SEQ ID NO: 1065809 - RNA, 19 nt, Homo sapiens
guguuuacuuucaccauuu

SEQ ID NO: 1065810 - RNA, 19 nt, Homo sapiens
guaaggauaagcuauuugu

SEQ ID NO: 1065811 - RNA, 19 nt, Homo sapiens
agaaacagcaagugaaaga

SEQ ID NO: 1065812 - RNA, 19 nt, Homo sapiens
guagaaauaggaccucguu

SEQ ID NO: 1065813 - RNA, 19 nt, Homo sapiens
gaacuuucagaucauagaa

SEQ ID NO: 1065814 - RNA, 19 nt, Homo sapiens
uuucggaacuuucagauca

SEQ ID NO: 1065815 - RNA, 19 nt, Homo sapiens
ucaccagaauucaucaguu

SEQ ID NO: 1065816 - RNA, 19 nt, Homo sapiens
cggaccaucugcuaaauuc

SEQ ID NO: 1065817 - RNA, 19 nt, Homo sapiens
gaaagaaagagccgaagac

SEQ ID NO: 1065818 - RNA, 19 nt, Homo sapiens
agacucuucuuccacauga

SEQ ID NO: 1065819 - RNA, 19 nt, Homo sapiens
caucacagcugcaaaauac

SEQ ID NO: 1065820 - RNA, 19 nt, Homo sapiens
gcuaaauuccuuguucaaa

SEQ ID NO: 1065821 - RNA, 19 nt, Homo sapiens
aacaggaucucuauaugug

SEQ ID NO: 1065822 - RNA, 19 nt, Homo sapiens
aaacaggaucucuauaugu

SEQ ID NO: 1065823 - RNA, 19 nt, Homo sapiens
gaacggauucucaucuuuu

SEQ ID NO: 1065824 - RNA, 19 nt, Homo sapiens
agaaagaaacggauuuaca

SEQ ID NO: 1065825 - RNA, 19 nt, Homo sapiens
gauuugaaagcaagaaaga

SEQ ID NO: 1065826 - RNA, 19 nt, Homo sapiens
ucacggaccaucugcuaaa

SEQ ID NO: 1065827 - RNA, 19 nt, Homo sapiens
gugaaaugaagaacuguaa

SEQ ID NO: 1065828 - RNA, 19 nt, Homo sapiens
aaggauaagcuauuuguga

SEQ ID NO: 1065829 - RNA, 19 nt, Homo sapiens
gaucauagaagaagaugcu

SEQ ID NO: 1065830 - RNA, 19 nt, Homo sapiens
gaggauggacagugggaaa

SEQ ID NO: 1065831 - RNA, 19 nt, Homo sapiens
agagaaacagcaagugaaa

SEQ ID NO: 1065832 - RNA, 19 nt, Homo sapiens
ggauaagcuauuugugauu

SEQ ID NO: 1065833 - RNA, 19 nt, Homo sapiens
augcaggacuugagaaugu

SEQ ID NO: 1065834 - RNA, 19 nt, Homo sapiens
aaacagcaagugaaagaug

SEQ ID NO: 1065835 - RNA, 19 nt, Homo sapiens
ggaacuuucagaucauaga

SEQ ID NO: 1065836 - RNA, 19 nt, Homo sapiens
gaugaauuaccacauuaug

SEQ ID NO: 1065837 - RNA, 19 nt, Homo sapiens
uuaacgagguuugugaaau

SEQ ID NO: 1065838 - RNA, 19 nt, Homo sapiens
uaacaccagcugaggagaa

SEQ ID NO: 1065839 - RNA, 19 nt, Homo sapiens
ggaggaccaacuuuauaug

SEQ ID NO: 1065840 - RNA, 19 nt, Homo sapiens
uggaccacguguuuacuuu

SEQ ID NO: 1065841 - RNA, 19 nt, Homo sapiens
aggauaagcuauuugugau

SEQ ID NO: 1065842 - RNA, 19 nt, Homo sapiens
aauggaaaccugauuuguu

SEQ ID NO: 1065843 - RNA, 19 nt, Homo sapiens
agagagaaacagcaaguga

SEQ ID NO: 1065844 - RNA, 19 nt, Homo sapiens
aggaccaacuuuauaugaa

SEQ ID NO: 1065845 - RNA, 19 nt, Homo sapiens
cguguuuacuuucaccauu

SEQ ID NO: 1065846 - RNA, 19 nt, Homo sapiens
gaauuaccacauuaugcuu

SEQ ID NO: 1065847 - RNA, 19 nt, Homo sapiens
ucguaaggauaagcuauuu

SEQ ID NO: 1065848 - RNA, 19 nt, Homo sapiens
ucaauggaaaccugauuug

SEQ ID NO: 1065849 - RNA, 19 nt, Homo sapiens
agaugcugcucuuguagaa

SEQ ID NO: 1065850 - RNA, 19 nt, Homo sapiens
gauuaacgagguuugugaa

SEQ ID NO: 1065851 - RNA, 19 nt, Homo sapiens
gagaaaccaauagaaauac

SEQ ID NO: 1065852 - RNA, 19 nt, Homo sapiens
ccacauuaugcuuuguuaa

SEQ ID NO: 1065853 - RNA, 19 nt, Homo sapiens
ucggaacuuucagaucaua

SEQ ID NO: 1065854 - RNA, 19 nt, Homo sapiens
aacugaagaugacuggaaa

SEQ ID NO: 1065855 - RNA, 19 nt, Homo sapiens
gcaucuauuuugaagcuaa

SEQ ID NO: 1065856 - RNA, 19 nt, Homo sapiens
gucaauggaaaccugauuu

SEQ ID NO: 1065857 - RNA, 19 nt, Homo sapiens
gaaauacaguggguaaaac

SEQ ID NO: 1065858 - RNA, 19 nt, Homo sapiens
auagaaauacaguggguaa

SEQ ID NO: 1065859 - RNA, 19 nt, Homo sapiens
gaaacagcaagugaaagau

SEQ ID NO: 1065860 - RNA, 19 nt, Homo sapiens
uggaggaccaacuuuauau

SEQ ID NO: 1065861 - RNA, 19 nt, Homo sapiens
ggagguggaggaagaagag

SEQ ID NO: 1065862 - RNA, 19 nt, Homo sapiens
ucugcuaaauuccuuguuc

SEQ ID NO: 1065863 - RNA, 19 nt, Homo sapiens
uauguggcuuucaaauuca

SEQ ID NO: 1065864 - RNA, 19 nt, Homo sapiens
cgagguuugugaaaugaag

SEQ ID NO: 1065865 - RNA, 19 nt, Homo sapiens
agaaagaaagagccgaaga

SEQ ID NO: 1065866 - RNA, 19 nt, Homo sapiens
ggauaauaggauaugguuu

SEQ ID NO: 1065867 - RNA, 19 nt, Homo sapiens
auucagaucuuuaguacac

SEQ ID NO: 1065868 - RNA, 19 nt, Homo sapiens
ucgcugaacugaagaugac

SEQ ID NO: 1065869 - RNA, 19 nt, Homo sapiens
aaaacaggaucucuauaug

SEQ ID NO: 1065870 - RNA, 19 nt, Homo sapiens
cagcugaggagaaaccaau

SEQ ID NO: 1065871 - RNA, 19 nt, Homo sapiens
aauaaggaacggauucuca

SEQ ID NO: 1065872 - RNA, 19 nt, Homo sapiens
ggaccucguuuugucuuaa

SEQ ID NO: 1065873 - RNA, 19 nt, Homo sapiens
augcugcucuuguagaaau

SEQ ID NO: 1065874 - RNA, 19 nt, Homo sapiens
ggaccacguguuuacuuuc

SEQ ID NO: 1065875 - RNA, 19 nt, Homo sapiens
ugauuaacgagguuuguga

SEQ ID NO: 1065876 - RNA, 19 nt, Homo sapiens
aggaacggauucucaucuu

SEQ ID NO: 1065877 - RNA, 19 nt, Homo sapiens
gaaacggauuuacaaaagg

SEQ ID NO: 1065878 - RNA, 19 nt, Homo sapiens
ugaggagaaaccaauagaa

SEQ ID NO: 1065879 - RNA, 19 nt, Homo sapiens
aacaccagcugaggagaaa

SEQ ID NO: 1065880 - RNA, 19 nt, Homo sapiens
aacagcaagugaaagaugu

SEQ ID NO: 1065881 - RNA, 19 nt, Homo sapiens
acuuucagaucauagaaga

SEQ ID NO: 1065882 - RNA, 19 nt, Homo sapiens
gaacucuuaauucagaucu

SEQ ID NO: 1065883 - RNA, 19 nt, Homo sapiens
accacauuaugcuuuguua

SEQ ID NO: 1065884 - RNA, 19 nt, Homo sapiens
uacccucgcugaacugaag

SEQ ID NO: 1065885 - RNA, 19 nt, Homo sapiens
cugcuaaauuccuuguuca

SEQ ID NO: 1065886 - RNA, 19 nt, Homo sapiens
ggucagaucuuaaaccuua

SEQ ID NO: 1065887 - RNA, 19 nt, Homo sapiens
gaaagaaucucucaagguu

SEQ ID NO: 1065888 - RNA, 19 nt, Homo sapiens
gaagaucucuaugaacuuu

SEQ ID NO: 1065889 - RNA, 19 nt, Homo sapiens
gaaauacguugcagugaug

SEQ ID NO: 1065890 - RNA, 19 nt, Homo sapiens
gggcuuaacuggguaauuu

SEQ ID NO: 1065891 - RNA, 19 nt, Homo sapiens
gaagaguccuuuccagcua

SEQ ID NO: 1065892 - RNA, 19 nt, Homo sapiens
guacuggccuuguucaauu

SEQ ID NO: 1065893 - RNA, 19 nt, Homo sapiens
gguaguaaaugucagagua

SEQ ID NO: 1065894 - RNA, 19 nt, Homo sapiens
ugacaaaugugguagacua

SEQ ID NO: 1065895 - RNA, 19 nt, Homo sapiens
acagauaccuugugugauu

SEQ ID NO: 1065896 - RNA, 19 nt, Homo sapiens
ggaaauacguugcagugau

SEQ ID NO: 1065897 - RNA, 19 nt, Homo sapiens
gaacuuugugcaagauuua

SEQ ID NO: 1065898 - RNA, 19 nt, Homo sapiens
agaagaauguucaugcuaa

SEQ ID NO: 1065899 - RNA, 19 nt, Homo sapiens
guacagauaccuuguguga

SEQ ID NO: 1065900 - RNA, 19 nt, Homo sapiens
gcagauaaccauaaaguca

SEQ ID NO: 1065901 - RNA, 19 nt, Homo sapiens
gggaagaagugcuauaucu

SEQ ID NO: 1065902 - RNA, 19 nt, Homo sapiens
caaaauggauugaugauga

SEQ ID NO: 1065903 - RNA, 19 nt, Homo sapiens
caaggaggcugaauauugg

SEQ ID NO: 1065904 - RNA, 19 nt, Homo sapiens
gcaccuggcugcucugauc

SEQ ID NO: 1065905 - RNA, 19 nt, Homo sapiens
gaagaauguucaugcuaau

SEQ ID NO: 1065906 - RNA, 19 nt, Homo sapiens
gaagugcuauaucuccuau

SEQ ID NO: 1065907 - RNA, 19 nt, Homo sapiens
ggaaauugaccauaaggaa

SEQ ID NO: 1065908 - RNA, 19 nt, Homo sapiens
gauauaaccacaagucaga

SEQ ID NO: 1065909 - RNA, 19 nt, Homo sapiens
aaaccaaugucaccacuug

SEQ ID NO: 1065910 - RNA, 19 nt, Homo sapiens
gaauuacuuuguuguagug

SEQ ID NO: 1065911 - RNA, 19 nt, Homo sapiens
gagcagagcaagcaauaga

SEQ ID NO: 1065912 - RNA, 19 nt, Homo sapiens
guagaagguuaaauuagga

SEQ ID NO: 1065913 - RNA, 19 nt, Homo sapiens
gaaauugaccauaaggaau

SEQ ID NO: 1065914 - RNA, 19 nt, Homo sapiens
gagagcagagcaagcaaua

SEQ ID NO: 1065915 - RNA, 19 nt, Homo sapiens
acaaggaggcugaauauug

SEQ ID NO: 1065916 - RNA, 19 nt, Homo sapiens
gugaagaucucuaugaacu

SEQ ID NO: 1065917 - RNA, 19 nt, Homo sapiens
gcagaaaugugaaaaggaa

SEQ ID NO: 1065918 - RNA, 19 nt, Homo sapiens
gcaauagaaguuggaauuu

SEQ ID NO: 1065919 - RNA, 19 nt, Homo sapiens
ccuaaagugaccauuauua

SEQ ID NO: 1065920 - RNA, 19 nt, Homo sapiens
gcucuuacgaacuuuaaua

SEQ ID NO: 1065921 - RNA, 19 nt, Homo sapiens
uggauuacaucaucagaaa

SEQ ID NO: 1065922 - RNA, 19 nt, Homo sapiens
ugagggaguucauuggaaa

SEQ ID NO: 1065923 - RNA, 19 nt, Homo sapiens
gaauaaguacuccuaaagu

SEQ ID NO: 1065924 - RNA, 19 nt, Homo sapiens
gauugaugaugaagaauuc

SEQ ID NO: 1065925 - RNA, 19 nt, Homo sapiens
gaaaaguacaguugagaua

SEQ ID NO: 1065926 - RNA, 19 nt, Homo sapiens
ggucauacguucuucaaaa

SEQ ID NO: 1065927 - RNA, 19 nt, Homo sapiens
gaggcugaauauuggcuua

SEQ ID NO: 1065928 - RNA, 19 nt, Homo sapiens
caaaugugguagacuaaag

SEQ ID NO: 1065929 - RNA, 19 nt, Homo sapiens
uaagguagauccccaauau

SEQ ID NO: 1065930 - RNA, 19 nt, Homo sapiens
gagaagaauguucaugcua

SEQ ID NO: 1065931 - RNA, 19 nt, Homo sapiens
gauugguuccuuucaguua

SEQ ID NO: 1065932 - RNA, 19 nt, Homo sapiens
aaauugcucuuacgaacuu

SEQ ID NO: 1065933 - RNA, 19 nt, Homo sapiens
ggucuagcauuuccuuuua

SEQ ID NO: 1065934 - RNA, 19 nt, Homo sapiens
gaauauuggcuuaggaaau

SEQ ID NO: 1065935 - RNA, 19 nt, Homo sapiens
ggaaaccugcguucuccua

SEQ ID NO: 1065936 - RNA, 19 nt, Homo sapiens
gaugaugaagaauuccuua

SEQ ID NO: 1065937 - RNA, 19 nt, Homo sapiens
gauaauugguuagucagau

SEQ ID NO: 1065938 - RNA, 19 nt, Homo sapiens
gacaacaagcuucaucuga

SEQ ID NO: 1065939 - RNA, 19 nt, Homo sapiens
gaagauguuuucuaagaga

SEQ ID NO: 1065940 - RNA, 19 nt, Homo sapiens
aaacagaucugccauuccu

SEQ ID NO: 1065941 - RNA, 19 nt, Homo sapiens
uaaaccauacuccaaauug

SEQ ID NO: 1065942 - RNA, 19 nt, Homo sapiens
aagaaucucucaagguuca

SEQ ID NO: 1065943 - RNA, 19 nt, Homo sapiens
gaugaggggucagaucuua

SEQ ID NO: 1065944 - RNA, 19 nt, Homo sapiens
ccauauauuucugacauga

SEQ ID NO: 1065945 - RNA, 19 nt, Homo sapiens
ggauugaugaugaagaauu

SEQ ID NO: 1065946 - RNA, 19 nt, Homo sapiens
ucagugagacauuuaacua

SEQ ID NO: 1065947 - RNA, 19 nt, Homo sapiens
aauaaguacuccuaaagug

SEQ ID NO: 1065948 - RNA, 19 nt, Homo sapiens
gcuggaaugacuguaauua

SEQ ID NO: 1065949 - RNA, 19 nt, Homo sapiens
guaguaaaugucagaguaa

SEQ ID NO: 1065950 - RNA, 19 nt, Homo sapiens
ugaacuuugugcaagauuu

SEQ ID NO: 1065951 - RNA, 19 nt, Homo sapiens
gaaugacuguaauuacucu

SEQ ID NO: 1065952 - RNA, 19 nt, Homo sapiens
caccugagcaauuccuuua

SEQ ID NO: 1065953 - RNA, 19 nt, Homo sapiens
ucagaguacuggccuuguu

SEQ ID NO: 1065954 - RNA, 19 nt, Homo sapiens
uaucuuggcuaaguaauag

SEQ ID NO: 1065955 - RNA, 19 nt, Homo sapiens
gacccagaauuugcugaua

SEQ ID NO: 1065956 - RNA, 19 nt, Homo sapiens
ccaaaucagaagagccuua

SEQ ID NO: 1065957 - RNA, 19 nt, Homo sapiens
agaagcagaaguuucauuu

SEQ ID NO: 1065958 - RNA, 19 nt, Homo sapiens
uacaugggaucaaauacuu

SEQ ID NO: 1065959 - RNA, 19 nt, Homo sapiens
aaaccauacuccaaauugu

SEQ ID NO: 1065960 - RNA, 19 nt, Homo sapiens
ggaagucagggucggauug

SEQ ID NO: 1065961 - RNA, 19 nt, Homo sapiens
guacaguugagauaguuaa

SEQ ID NO: 1065962 - RNA, 19 nt, Homo sapiens
caaaauggaccaaauaugu

SEQ ID NO: 1065963 - RNA, 19 nt, Homo sapiens
agaagagccuuauggucaa

SEQ ID NO: 1065964 - RNA, 19 nt, Homo sapiens
cuuacuaucuuguguuugu

SEQ ID NO: 1065965 - RNA, 19 nt, Homo sapiens
guuaggagcuccaguugcu

SEQ ID NO: 1065966 - RNA, 19 nt, Homo sapiens
uuacaaggaggcugaauau

SEQ ID NO: 1065967 - RNA, 19 nt, Homo sapiens
guuacaaggaggcugaaua

SEQ ID NO: 1065968 - RNA, 19 nt, Homo sapiens
ucucaagguucaaguggaa

SEQ ID NO: 1065969 - RNA, 19 nt, Homo sapiens
ccacaagucagaguacauu

SEQ ID NO: 1065970 - RNA, 19 nt, Homo sapiens
caguugagauaguuaagau

SEQ ID NO: 1065971 - RNA, 19 nt, Homo sapiens
uguggguacugcuuucaua

SEQ ID NO: 1065972 - RNA, 19 nt, Homo sapiens
uguagaagguuaaauuagg

SEQ ID NO: 1065973 - RNA, 19 nt, Homo sapiens
guaaaccauacuccaaauu

SEQ ID NO: 1065974 - RNA, 19 nt, Homo sapiens
caauguugccuuaauuuca

SEQ ID NO: 1065975 - RNA, 19 nt, Homo sapiens
uagcugcaauugauaaugg

SEQ ID NO: 1065976 - RNA, 19 nt, Homo sapiens
aaaggaaauugaccauaag

SEQ ID NO: 1065977 - RNA, 19 nt, Homo sapiens
aaaaguggguagaaaguuu

SEQ ID NO: 1065978 - RNA, 19 nt, Homo sapiens
uaagauauaaccacaaguc

SEQ ID NO: 1065979 - RNA, 19 nt, Homo sapiens
aaaguacaguugagauagu

SEQ ID NO: 1065980 - RNA, 19 nt, Homo sapiens
guacuugaaauuacagaug

SEQ ID NO: 1065981 - RNA, 19 nt, Homo sapiens
gugaauuacuuuguuguag

SEQ ID NO: 1065982 - RNA, 19 nt, Homo sapiens
ggugaauuacuuuguugua

SEQ ID NO: 1065983 - RNA, 19 nt, Homo sapiens
ucaguuauuuguugaaggu

SEQ ID NO: 1065984 - RNA, 19 nt, Homo sapiens
ugguuuggcuugucaguga

SEQ ID NO: 1065985 - RNA, 19 nt, Homo sapiens
caucugagcauuguaccua

SEQ ID NO: 1065986 - RNA, 19 nt, Homo sapiens
ggaaaugcuugaaguaaau

SEQ ID NO: 1065987 - RNA, 19 nt, Homo sapiens
gggcagaucugaacauugu

SEQ ID NO: 1065988 - RNA, 19 nt, Homo sapiens
ggauaaaccauuugcauuu

SEQ ID NO: 1065989 - RNA, 19 nt, Homo sapiens
gggaaaugcuugaaguaaa

SEQ ID NO: 1065990 - RNA, 19 nt, Homo sapiens
ggucuauucuggauucuaa

SEQ ID NO: 1065991 - RNA, 19 nt, Homo sapiens
ggagauucguuacauaaau

SEQ ID NO: 1065992 - RNA, 19 nt, Homo sapiens
ccaguuaguugaugaaguu

SEQ ID NO: 1065993 - RNA, 19 nt, Homo sapiens
caaagaugaugaauuguca

SEQ ID NO: 1065994 - RNA, 19 nt, Homo sapiens
gucauuaccuuauggaauu

SEQ ID NO: 1065995 - RNA, 19 nt, Homo sapiens
aaucaagugucuagaagua

SEQ ID NO: 1065996 - RNA, 19 nt, Homo sapiens
ucccaaagaugaugaauug

SEQ ID NO: 1065997 - RNA, 19 nt, Homo sapiens
ccaagauacucaugauuug

SEQ ID NO: 1065998 - RNA, 19 nt, Homo sapiens
ccagaaccauugcauuuau

SEQ ID NO: 1065999 - RNA, 19 nt, Homo sapiens
ccaaggaauuugugaaaca

SEQ ID NO: 1066000 - RNA, 19 nt, Homo sapiens
gacagcaucucaccauguu

SEQ ID NO: 1066001 - RNA, 19 nt, Homo sapiens
gccaagauacucaugauuu

SEQ ID NO: 1066002 - RNA, 19 nt, Homo sapiens
aaagaaaucuacucacucu

SEQ ID NO: 1066003 - RNA, 19 nt, Homo sapiens
ggacauggaagccuggaaa

SEQ ID NO: 1066004 - RNA, 19 nt, Homo sapiens
ggacugcacuaggucuaaa

SEQ ID NO: 1066005 - RNA, 19 nt, Homo sapiens
uguuggaucugaagacaua

SEQ ID NO: 1066006 - RNA, 19 nt, Homo sapiens
caauguagucccaucauaa

SEQ ID NO: 1066007 - RNA, 19 nt, Homo sapiens
gaugaugaauugucagaag

SEQ ID NO: 1066008 - RNA, 19 nt, Homo sapiens
caacuccuguacauucaaa

SEQ ID NO: 1066009 - RNA, 19 nt, Homo sapiens
gaaaucuacucacucuucu

SEQ ID NO: 1066010 - RNA, 19 nt, Homo sapiens
ccucuaacguaccaucuaa

SEQ ID NO: 1066011 - RNA, 19 nt, Homo sapiens
ggaacugacuucuguugag

SEQ ID NO: 1066012 - RNA, 19 nt, Homo sapiens
acaauguagucccaucaua

SEQ ID NO: 1066013 - RNA, 19 nt, Homo sapiens
aagaggaacugacuucugu

SEQ ID NO: 1066014 - RNA, 19 nt, Homo sapiens
ugccaaggcuggucucaaa

SEQ ID NO: 1066015 - RNA, 19 nt, Homo sapiens
gaagagaaagcagaguuga

SEQ ID NO: 1066016 - RNA, 19 nt, Homo sapiens
gaacgagaaauuaaucaag

SEQ ID NO: 1066017 - RNA, 19 nt, Homo sapiens
gaucugaagacauagcaaa

SEQ ID NO: 1066018 - RNA, 19 nt, Homo sapiens
ggaagagaaagcagaguug

SEQ ID NO: 1066019 - RNA, 19 nt, Homo sapiens
cagggagauucguuacaua

SEQ ID NO: 1066020 - RNA, 19 nt, Homo sapiens
cagaaccauugcauuuauu

SEQ ID NO: 1066021 - RNA, 19 nt, Homo sapiens
gcacucaacacgccacaga

SEQ ID NO: 1066022 - RNA, 19 nt, Homo sapiens
aucauacucuucucaguua

SEQ ID NO: 1066023 - RNA, 19 nt, Homo sapiens
ggugacagauccagacucu

SEQ ID NO: 1066024 - RNA, 19 nt, Homo sapiens
ccugugacuugacauguuu

SEQ ID NO: 1066025 - RNA, 19 nt, Homo sapiens
guuaguugaugaaguuguu

SEQ ID NO: 1066026 - RNA, 19 nt, Homo sapiens
gaaaccccaucucuacuaa

SEQ ID NO: 1066027 - RNA, 19 nt, Homo sapiens
gaacaaauaagucauuacc

SEQ ID NO: 1066028 - RNA, 19 nt, Homo sapiens
cagaagaacaaauaaguca

SEQ ID NO: 1066029 - RNA, 19 nt, Homo sapiens
aguaugggauccuacauug

SEQ ID NO: 1066030 - RNA, 19 nt, Homo sapiens
ugacaucucccaguuaguu

SEQ ID NO: 1066031 - RNA, 19 nt, Homo sapiens
gcaggagaauggugugaac

SEQ ID NO: 1066032 - RNA, 19 nt, Homo sapiens
ggucaagccaguaaagaau

SEQ ID NO: 1066033 - RNA, 19 nt, Homo sapiens
cuucucaguuauucagaua

SEQ ID NO: 1066034 - RNA, 19 nt, Homo sapiens
cauaaucaagugucuagaa

SEQ ID NO: 1066035 - RNA, 19 nt, Homo sapiens
ggagaccaaccuaagagaa

SEQ ID NO: 1066036 - RNA, 19 nt, Homo sapiens
ucaagugucuagaaguauc

SEQ ID NO: 1066037 - RNA, 19 nt, Homo sapiens
agaacuacauaaucaagug

SEQ ID NO: 1066038 - RNA, 19 nt, Homo sapiens
caucuaaggcuguucuuuc

SEQ ID NO: 1066039 - RNA, 19 nt, Homo sapiens
gugcaacuccuguacauuc

SEQ ID NO: 1066040 - RNA, 19 nt, Homo sapiens
aaccagaaccauugcauuu

SEQ ID NO: 1066041 - RNA, 19 nt, Homo sapiens
acaaaggucaagccaguaa

SEQ ID NO: 1066042 - RNA, 19 nt, Homo sapiens
gauguaaccaguggaaaug

SEQ ID NO: 1066043 - RNA, 19 nt, Homo sapiens
gggccaagauacucaugau

SEQ ID NO: 1066044 - RNA, 19 nt, Homo sapiens
uaagagaaccaggaaugaa

SEQ ID NO: 1066045 - RNA, 19 nt, Homo sapiens
gagaggagaccaaccuaag

SEQ ID NO: 1066046 - RNA, 19 nt, Homo sapiens
cgacaaaauucaugauuag

SEQ ID NO: 1066047 - RNA, 19 nt, Homo sapiens
acagagaccagccaucuug

SEQ ID NO: 1066048 - RNA, 19 nt, Homo sapiens
gaggaacugacuucuguug

SEQ ID NO: 1066049 - RNA, 19 nt, Homo sapiens
cugaagacauagcaaagga

SEQ ID NO: 1066050 - RNA, 19 nt, Homo sapiens
gcagagguucuucgucuca

SEQ ID NO: 1066051 - RNA, 19 nt, Homo sapiens
aagagaaccaggaaugaaa

SEQ ID NO: 1066052 - RNA, 19 nt, Homo sapiens
ucagggagauucguuacau

SEQ ID NO: 1066053 - RNA, 19 nt, Homo sapiens
uaucauacucuucucaguu

SEQ ID NO: 1066054 - RNA, 19 nt, Homo sapiens
gaacuacauaaucaagugu

SEQ ID NO: 1066055 - RNA, 19 nt, Homo sapiens
ccaaagaugaugaauuguc

SEQ ID NO: 1066056 - RNA, 19 nt, Homo sapiens
ucacucuucugugugcaua

SEQ ID NO: 1066057 - RNA, 19 nt, Homo sapiens
caaccagaaccauugcauu

SEQ ID NO: 1066058 - RNA, 19 nt, Homo sapiens
agaaaucuacucacucuuc

SEQ ID NO: 1066059 - RNA, 19 nt, Homo sapiens
gggagauucguuacauaaa

SEQ ID NO: 1066060 - RNA, 19 nt, Homo sapiens
ggcaucgcauucccaaaga

SEQ ID NO: 1066061 - RNA, 19 nt, Homo sapiens
aaugacaucucccaguuag

SEQ ID NO: 1066062 - RNA, 19 nt, Homo sapiens
aaaaugacaucucccaguu

SEQ ID NO: 1066063 - RNA, 19 nt, Homo sapiens
ccuaagagaaccaggaaug

SEQ ID NO: 1066064 - RNA, 19 nt, Homo sapiens
gucaagccaguaaagaaua

SEQ ID NO: 1066065 - RNA, 19 nt, Homo sapiens
agaaagcagaguugaagaa

SEQ ID NO: 1066066 - RNA, 19 nt, Homo sapiens
gagaaagcagaguugaaga

SEQ ID NO: 1066067 - RNA, 19 nt, Homo sapiens
caaaauucuuggucuauuc

SEQ ID NO: 1066068 - RNA, 19 nt, Homo sapiens
gaaguugcaccucuaacgu

SEQ ID NO: 1066069 - RNA, 19 nt, Homo sapiens
gaagccaaggaauuuguga

SEQ ID NO: 1066070 - RNA, 19 nt, Homo sapiens
gcacuaggucuaaaagaaa

SEQ ID NO: 1066071 - RNA, 19 nt, Homo sapiens
aaaugacaucucccaguua

SEQ ID NO: 1066072 - RNA, 19 nt, Homo sapiens
gaaaugcuugaaguaaaug

SEQ ID NO: 1066073 - RNA, 19 nt, Homo sapiens
ucucaaagccuggcaagga

SEQ ID NO: 1066074 - RNA, 19 nt, Homo sapiens
gagagaggagaccaaccua

SEQ ID NO: 1066075 - RNA, 19 nt, Homo sapiens
caagaacuacauaaucaag

SEQ ID NO: 1066076 - RNA, 19 nt, Homo sapiens
ggaagccuggaaagaugua

SEQ ID NO: 1066077 - RNA, 19 nt, Homo sapiens
uaagagucagcgccuuuaa

SEQ ID NO: 1066078 - RNA, 19 nt, Homo sapiens
ucgagaccguccuggcuaa

SEQ ID NO: 1066079 - RNA, 19 nt, Homo sapiens
gagaccagccaucuugcaa

SEQ ID NO: 1066080 - RNA, 19 nt, Homo sapiens
gauccuacauugcuuuuag

SEQ ID NO: 1066081 - RNA, 19 nt, Homo sapiens
gaaagcagaguugaagaac

SEQ ID NO: 1066082 - RNA, 19 nt, Homo sapiens
gcaccuguagucccagcua

SEQ ID NO: 1066083 - RNA, 19 nt, Homo sapiens
ccacagagaccagccaucu

SEQ ID NO: 1066084 - RNA, 19 nt, Homo sapiens
agacauagcaaaggacaug

SEQ ID NO: 1066085 - RNA, 19 nt, Homo sapiens
aggcuguucuuuccuguga

SEQ ID NO: 1066086 - RNA, 19 nt, Homo sapiens
gaacggaaguggagaguaa

SEQ ID NO: 1066087 - RNA, 19 nt, Homo sapiens
ggagaugauuguagaauua

SEQ ID NO: 1066088 - RNA, 19 nt, Homo sapiens
ucagaaagcuggaagauaa

SEQ ID NO: 1066089 - RNA, 19 nt, Homo sapiens
ggagucaaauuguuucuua

SEQ ID NO: 1066090 - RNA, 19 nt, Homo sapiens
gaaggcugcuacacuaaua

SEQ ID NO: 1066091 - RNA, 19 nt, Homo sapiens
gaaaaucgaucucuacaaa

SEQ ID NO: 1066092 - RNA, 19 nt, Homo sapiens
caauuugcaugacuacuua

SEQ ID NO: 1066093 - RNA, 19 nt, Homo sapiens
gaaagaagcaaauggagaa

SEQ ID NO: 1066094 - RNA, 19 nt, Homo sapiens
cuagaugagugucaauuua

SEQ ID NO: 1066095 - RNA, 19 nt, Homo sapiens
ggaaacagaacuugucgua

SEQ ID NO: 1066096 - RNA, 19 nt, Homo sapiens
aaagauggcuccaagcuau

SEQ ID NO: 1066097 - RNA, 19 nt, Homo sapiens
gcuagaaguuucaugauuc

SEQ ID NO: 1066098 - RNA, 19 nt, Homo sapiens
aaacagaacuugucguagu

SEQ ID NO: 1066099 - RNA, 19 nt, Homo sapiens
gaaccucaauuuaaccaau

SEQ ID NO: 1066100 - RNA, 19 nt, Homo sapiens
gaguggagcuggagagaga

SEQ ID NO: 1066101 - RNA, 19 nt, Homo sapiens
gcacaaagccacagagaag

SEQ ID NO: 1066102 - RNA, 19 nt, Homo sapiens
ggagagagggcuagaaguu

SEQ ID NO: 1066103 - RNA, 19 nt, Homo sapiens
cagauugcuuccuuuauuu

SEQ ID NO: 1066104 - RNA, 19 nt, Homo sapiens
acagauugcuuccuuuauu

SEQ ID NO: 1066105 - RNA, 19 nt, Homo sapiens
cagaagacauucaagacuu

SEQ ID NO: 1066106 - RNA, 19 nt, Homo sapiens
cauauaaggagucaaauug

SEQ ID NO: 1066107 - RNA, 19 nt, Homo sapiens
uccaagcuaugucauguua

SEQ ID NO: 1066108 - RNA, 19 nt, Homo sapiens
ugacgaaccucaauuuaac

SEQ ID NO: 1066109 - RNA, 19 nt, Homo sapiens
ucaacauccuggcuuagua

SEQ ID NO: 1066110 - RNA, 19 nt, Homo sapiens
uaacuaaggaccaccauug

SEQ ID NO: 1066111 - RNA, 19 nt, Homo sapiens
caaaauccauuaccaagaa

SEQ ID NO: 1066112 - RNA, 19 nt, Homo sapiens
gaagcaaacacaagcaaug

SEQ ID NO: 1066113 - RNA, 19 nt, Homo sapiens
aaggaaggcugcuacacua

SEQ ID NO: 1066114 - RNA, 19 nt, Homo sapiens
gagaaagaaagaucaauuc

SEQ ID NO: 1066115 - RNA, 19 nt, Homo sapiens
agaagcaaauggagaagaa

SEQ ID NO: 1066116 - RNA, 19 nt, Homo sapiens
uaagagaggaguaugaaga

SEQ ID NO: 1066117 - RNA, 19 nt, Homo sapiens
ggcuagaaguuucaugauu

SEQ ID NO: 1066118 - RNA, 19 nt, Homo sapiens
gcaauucaacagauaauag

SEQ ID NO: 1066119 - RNA, 19 nt, Homo sapiens
gaggagauccagaagcaaa

SEQ ID NO: 1066120 - RNA, 19 nt, Homo sapiens
acacagaggugcccaaugc

SEQ ID NO: 1066121 - RNA, 19 nt, Homo sapiens
guagauguuugauugacuu

SEQ ID NO: 1066122 - RNA, 19 nt, Homo sapiens
cauauucucuggcaaccuu

SEQ ID NO: 1066123 - RNA, 19 nt, Homo sapiens
gcaaauggagaagaaacua

SEQ ID NO: 1066124 - RNA, 19 nt, Homo sapiens
gauaagagaggaguaugaa

SEQ ID NO: 1066125 - RNA, 19 nt, Homo sapiens
ggagauuauucgcugcauu

SEQ ID NO: 1066126 - RNA, 19 nt, Homo sapiens
gaaggaaacagaacuuguc

SEQ ID NO: 1066127 - RNA, 19 nt, Homo sapiens
gaauuguguuaguggguaa

SEQ ID NO: 1066128 - RNA, 19 nt, Homo sapiens
gaugggauacuugaauuaa

SEQ ID NO: 1066129 - RNA, 19 nt, Homo sapiens
ggaugggauacuugaauua

SEQ ID NO: 1066130 - RNA, 19 nt, Homo sapiens
agaagaaacuagcagaaca

SEQ ID NO: 1066131 - RNA, 19 nt, Homo sapiens
gaaauacagcaauucaaca

SEQ ID NO: 1066132 - RNA, 19 nt, Homo sapiens
ggcaagagcccagaaauuc

SEQ ID NO: 1066133 - RNA, 19 nt, Homo sapiens
gaacaggaggcucacuaug

SEQ ID NO: 1066134 - RNA, 19 nt, Homo sapiens
ggauaagagaggaguauga

SEQ ID NO: 1066135 - RNA, 19 nt, Homo sapiens
cuaauaggauguaccaaag

SEQ ID NO: 1066136 - RNA, 19 nt, Homo sapiens
gagagagggcuagaaguuu

SEQ ID NO: 1066137 - RNA, 19 nt, Homo sapiens
gagaagauccugaaaaugu

SEQ ID NO: 1066138 - RNA, 19 nt, Homo sapiens
guagaaacucuuugacgaa

SEQ ID NO: 1066139 - RNA, 19 nt, Homo sapiens
ccacagagaagauccugaa

SEQ ID NO: 1066140 - RNA, 19 nt, Homo sapiens
gaucaauucuuuguuugca

SEQ ID NO: 1066141 - RNA, 19 nt, Homo sapiens
ccuuagacaugcagagaaa

SEQ ID NO: 1066142 - RNA, 19 nt, Homo sapiens
ggaccaccauuggccauug

SEQ ID NO: 1066143 - RNA, 19 nt, Homo sapiens
caugacagcguuacagauu

SEQ ID NO: 1066144 - RNA, 19 nt, Homo sapiens
gaaaagagaaagaagcaaa

SEQ ID NO: 1066145 - RNA, 19 nt, Homo sapiens
agaggaguaugaagagaaa

SEQ ID NO: 1066146 - RNA, 19 nt, Homo sapiens
gcaaacacaagcaaugcaa

SEQ ID NO: 1066147 - RNA, 19 nt, Homo sapiens
auauucagcuguaucugua

SEQ ID NO: 1066148 - RNA, 19 nt, Homo sapiens
gaaggcaagagcccagaaa

SEQ ID NO: 1066149 - RNA, 19 nt, Homo sapiens
guaaggaugggauacuuga

SEQ ID NO: 1066150 - RNA, 19 nt, Homo sapiens
ggagaagaaacuagcagaa

SEQ ID NO: 1066151 - RNA, 19 nt, Homo sapiens
gagaggaguaugaagagaa

SEQ ID NO: 1066152 - RNA, 19 nt, Homo sapiens
ccggaaagaugacuuaggu

SEQ ID NO: 1066153 - RNA, 19 nt, Homo sapiens
cgacaauggcagcccaaua

SEQ ID NO: 1066154 - RNA, 19 nt, Homo sapiens
uacagcaauucaacagaua

SEQ ID NO: 1066155 - RNA, 19 nt, Homo sapiens
gcuccaagcuaugucaugu

SEQ ID NO: 1066156 - RNA, 19 nt, Homo sapiens
cgagugcucuaguuucugu

SEQ ID NO: 1066157 - RNA, 19 nt, Homo sapiens
uuacagauugcuuccuuua

SEQ ID NO: 1066158 - RNA, 19 nt, Homo sapiens
aaagaugacuuaggugaca

SEQ ID NO: 1066159 - RNA, 19 nt, Homo sapiens
agagagggcuagaaguuuc

SEQ ID NO: 1066160 - RNA, 19 nt, Homo sapiens
gagauuauucgcugcauuc

SEQ ID NO: 1066161 - RNA, 19 nt, Homo sapiens
agaaagcgcggauaagaga

SEQ ID NO: 1066162 - RNA, 19 nt, Homo sapiens
ggaaggaaacagaacuugu

SEQ ID NO: 1066163 - RNA, 19 nt, Homo sapiens
agauggagaugauuguaga

SEQ ID NO: 1066164 - RNA, 19 nt, Homo sapiens
ccuugugaauucuuccuua

SEQ ID NO: 1066165 - RNA, 19 nt, Homo sapiens
gaggcucacuaugcuguaa

SEQ ID NO: 1066166 - RNA, 19 nt, Homo sapiens
gacaauggcagcccaauac

SEQ ID NO: 1066167 - RNA, 19 nt, Homo sapiens
acaccaauuugcaugacua

SEQ ID NO: 1066168 - RNA, 19 nt, Homo sapiens
uggagaugauuguagaauu

SEQ ID NO: 1066169 - RNA, 19 nt, Homo sapiens
ucgcggaagauuaaacuua

SEQ ID NO: 1066170 - RNA, 19 nt, Homo sapiens
ggagaguaaggaugggaua

SEQ ID NO: 1066171 - RNA, 19 nt, Homo sapiens
cagagaagauccugaaaau

SEQ ID NO: 1066172 - RNA, 19 nt, Homo sapiens
gaaacguccaaggagauua

SEQ ID NO: 1066173 - RNA, 19 nt, Homo sapiens
gcucauggaaggaaacaga

SEQ ID NO: 1066174 - RNA, 19 nt, Homo sapiens
cucaggcacucguaacuaa

SEQ ID NO: 1066175 - RNA, 19 nt, Homo sapiens
caacauccuggcuuaguau

SEQ ID NO: 1066176 - RNA, 19 nt, Homo sapiens
auacccaguucucuucuuu

SEQ ID NO: 1066177 - RNA, 19 nt, Homo sapiens
acaagagagggacaaauuu

SEQ ID NO: 1066178 - RNA, 19 nt, Homo sapiens
aacaagagagggacaaauu

SEQ ID NO: 1066179 - RNA, 19 nt, Homo sapiens
gauguuugauugacuuaac

SEQ ID NO: 1066180 - RNA, 19 nt, Homo sapiens
auugguagauguuugauug

SEQ ID NO: 1066181 - RNA, 19 nt, Homo sapiens
cauccuggcuuaguauugu

SEQ ID NO: 1066182 - RNA, 19 nt, Homo sapiens
ggaaggcugcuacacuaau

SEQ ID NO: 1066183 - RNA, 19 nt, Homo sapiens
uaagggaagcuccagaaga

SEQ ID NO: 1066184 - RNA, 19 nt, Homo sapiens
ccaauuugcaugacuacuu

SEQ ID NO: 1066185 - RNA, 19 nt, Homo sapiens
ugggauacuugaauuaauc

SEQ ID NO: 1066186 - RNA, 19 nt, Homo sapiens
ggaaauagauggcuuaaag

SEQ ID NO: 1066187 - RNA, 19 nt, Homo sapiens
aaacagagcuucuuuaaag

SEQ ID NO: 1066188 - RNA, 19 nt, Homo sapiens
gaacaaagccuccaagaag

SEQ ID NO: 1066189 - RNA, 19 nt, Homo sapiens
caaccaaaccuaagaauaa

SEQ ID NO: 1066190 - RNA, 19 nt, Homo sapiens
gaauugaacuaguagaaga

SEQ ID NO: 1066191 - RNA, 19 nt, Homo sapiens
acaaacaaaugccaagaua

SEQ ID NO: 1066192 - RNA, 19 nt, Homo sapiens
gcagaaacccuacaagcua

SEQ ID NO: 1066193 - RNA, 19 nt, Homo sapiens
gacaaggucuucgaauuaa

SEQ ID NO: 1066194 - RNA, 19 nt, Homo sapiens
gaaagucucagcaauagaa

SEQ ID NO: 1066195 - RNA, 19 nt, Homo sapiens
ggaaagugcauuugaguga

SEQ ID NO: 1066196 - RNA, 19 nt, Homo sapiens
guacuuuggucuucuaguu

SEQ ID NO: 1066197 - RNA, 19 nt, Homo sapiens
cagaaacccuacaagcuaa

SEQ ID NO: 1066198 - RNA, 19 nt, Homo sapiens
gcaccucccuggaucuuug

SEQ ID NO: 1066199 - RNA, 19 nt, Homo sapiens
gaaagugcauuugagugaa

SEQ ID NO: 1066200 - RNA, 19 nt, Homo sapiens
gaauucaggagguuauuaa

SEQ ID NO: 1066201 - RNA, 19 nt, Homo sapiens
ucccauaccuuguaauauu

SEQ ID NO: 1066202 - RNA, 19 nt, Homo sapiens
caagaagucugggauuaug

SEQ ID NO: 1066203 - RNA, 19 nt, Homo sapiens
gaagccacauccauaggaa

SEQ ID NO: 1066204 - RNA, 19 nt, Homo sapiens
gcucauuguugaaucguuu

SEQ ID NO: 1066205 - RNA, 19 nt, Homo sapiens
gaaaacagagcuucuuuaa

SEQ ID NO: 1066206 - RNA, 19 nt, Homo sapiens
acagucaucuucagacaaa

SEQ ID NO: 1066207 - RNA, 19 nt, Homo sapiens
gaagagagaaauauucaag

SEQ ID NO: 1066208 - RNA, 19 nt, Homo sapiens
aaacaaggcucuucaacac

SEQ ID NO: 1066209 - RNA, 19 nt, Homo sapiens
caacgcagcuguggaacga

SEQ ID NO: 1066210 - RNA, 19 nt, Homo sapiens
gaagugaagagagaaauau

SEQ ID NO: 1066211 - RNA, 19 nt, Homo sapiens
ggacuguacuuuggucuuc

SEQ ID NO: 1066212 - RNA, 19 nt, Homo sapiens
gggcaaauuucauucaucu

SEQ ID NO: 1066213 - RNA, 19 nt, Homo sapiens
gagcagaagcaccagguaa

SEQ ID NO: 1066214 - RNA, 19 nt, Homo sapiens
auucagagcuuaaagacaa

SEQ ID NO: 1066215 - RNA, 19 nt, Homo sapiens
caucauauuugaaggaaag

SEQ ID NO: 1066216 - RNA, 19 nt, Homo sapiens
uaacccaauucaacaaaga

SEQ ID NO: 1066217 - RNA, 19 nt, Homo sapiens
ucaagaaacuuuggacaca

SEQ ID NO: 1066218 - RNA, 19 nt, Homo sapiens
uacaagaagugaagagaga

SEQ ID NO: 1066219 - RNA, 19 nt, Homo sapiens
ggcaauggauccaaaccaa

SEQ ID NO: 1066220 - RNA, 19 nt, Homo sapiens
gaacuauucagggcaaauu

SEQ ID NO: 1066221 - RNA, 19 nt, Homo sapiens
agaagcaccagguaacuua

SEQ ID NO: 1066222 - RNA, 19 nt, Homo sapiens
caaggaaauagauggcuua

SEQ ID NO: 1066223 - RNA, 19 nt, Homo sapiens
agagagaaauauucaagga

SEQ ID NO: 1066224 - RNA, 19 nt, Homo sapiens
uaaggacccugaugaaguc

SEQ ID NO: 1066225 - RNA, 19 nt, Homo sapiens
agaccuagacauccaaaua

SEQ ID NO: 1066226 - RNA, 19 nt, Homo sapiens
uccaagaagucugggauua

SEQ ID NO: 1066227 - RNA, 19 nt, Homo sapiens
ggacacacuuuuagaaaug

SEQ ID NO: 1066228 - RNA, 19 nt, Homo sapiens
gguauccacugcugagaga

SEQ ID NO: 1066229 - RNA, 19 nt, Homo sapiens
ggaauuggaacccuguuug

SEQ ID NO: 1066230 - RNA, 19 nt, Homo sapiens
caaacaaaugccaagauaa

SEQ ID NO: 1066231 - RNA, 19 nt, Homo sapiens
gaagucugggauuauguua

SEQ ID NO: 1066232 - RNA, 19 nt, Homo sapiens
gcacaaagaauggaauagu

SEQ ID NO: 1066233 - RNA, 19 nt, Homo sapiens
aaggagcucuaaauauuga

SEQ ID NO: 1066234 - RNA, 19 nt, Homo sapiens
acaagaagcacaaagauca

SEQ ID NO: 1066235 - RNA, 19 nt, Homo sapiens
gcccuagacuuucccaaau

SEQ ID NO: 1066236 - RNA, 19 nt, Homo sapiens
cacaaagaauggaauagug

SEQ ID NO: 1066237 - RNA, 19 nt, Homo sapiens
agucugggauuauguuaaa

SEQ ID NO: 1066238 - RNA, 19 nt, Homo sapiens
acaaagaucacccaggaaa

SEQ ID NO: 1066239 - RNA, 19 nt, Homo sapiens
guuaaacaaccaaaccuaa

SEQ ID NO: 1066240 - RNA, 19 nt, Homo sapiens
gaaauagauggcuuaaagu

SEQ ID NO: 1066241 - RNA, 19 nt, Homo sapiens
ucucuaaaguguucucaga

SEQ ID NO: 1066242 - RNA, 19 nt, Homo sapiens
ucaccuagguacacuguca

SEQ ID NO: 1066243 - RNA, 19 nt, Homo sapiens
aaagaucacccaggaaauu

SEQ ID NO: 1066244 - RNA, 19 nt, Homo sapiens
acaggaagccacauccaua

SEQ ID NO: 1066245 - RNA, 19 nt, Homo sapiens
cccauaccuuguaauauuu

SEQ ID NO: 1066246 - RNA, 19 nt, Homo sapiens
ccaggaaauucaucaccaa

SEQ ID NO: 1066247 - RNA, 19 nt, Homo sapiens
ccaaauacaagaagcacaa

SEQ ID NO: 1066248 - RNA, 19 nt, Homo sapiens
uaaacaaccaaaccuaaga

SEQ ID NO: 1066249 - RNA, 19 nt, Homo sapiens
acgggaaacuucacaauca

SEQ ID NO: 1066250 - RNA, 19 nt, Homo sapiens
ccuagacuuucccaaauga

SEQ ID NO: 1066251 - RNA, 19 nt, Homo sapiens
cuacuccucucuaaagugu

SEQ ID NO: 1066252 - RNA, 19 nt, Homo sapiens
gcaaagcccaaugcaagaa

SEQ ID NO: 1066253 - RNA, 19 nt, Homo sapiens
caugggauauggaauugga

SEQ ID NO: 1066254 - RNA, 19 nt, Homo sapiens
ucacuuacaugggauaugg

SEQ ID NO: 1066255 - RNA, 19 nt, Homo sapiens
ggaaaacagagcuucuuua

SEQ ID NO: 1066256 - RNA, 19 nt, Homo sapiens
ccaagauaauucacaccaa

SEQ ID NO: 1066257 - RNA, 19 nt, Homo sapiens
cagauuaacagcagauuuc

SEQ ID NO: 1066258 - RNA, 19 nt, Homo sapiens
gagagaaauauucaaggaa

SEQ ID NO: 1066259 - RNA, 19 nt, Homo sapiens
guaacaaccccaugauaua

SEQ ID NO: 1066260 - RNA, 19 nt, Homo sapiens
uaaaucacgugggaccuau

SEQ ID NO: 1066261 - RNA, 19 nt, Homo sapiens
ugaaacaaauccuggaaaa

SEQ ID NO: 1066262 - RNA, 19 nt, Homo sapiens
caaaugccaagauaauuca

SEQ ID NO: 1066263 - RNA, 19 nt, Homo sapiens
aaacaauuaucagccaaga

SEQ ID NO: 1066264 - RNA, 19 nt, Homo sapiens
gguacacugucaucagguu

SEQ ID NO: 1066265 - RNA, 19 nt, Homo sapiens
ccaauucaacaaagacaaa

SEQ ID NO: 1066266 - RNA, 19 nt, Homo sapiens
ucugauuucucaccuuuga

SEQ ID NO: 1066267 - RNA, 19 nt, Homo sapiens
gauaagcucauuguugaau

SEQ ID NO: 1066268 - RNA, 19 nt, Homo sapiens
aaacacacacacacaaguu

SEQ ID NO: 1066269 - RNA, 19 nt, Homo sapiens
gcgaaacuaagcaucauau

SEQ ID NO: 1066270 - RNA, 19 nt, Homo sapiens
uggaaagucucagcaauag

SEQ ID NO: 1066271 - RNA, 19 nt, Homo sapiens
gcaaaaugcucuggaaagu

SEQ ID NO: 1066272 - RNA, 19 nt, Homo sapiens
acaaagaauggaauaguga

SEQ ID NO: 1066273 - RNA, 19 nt, Homo sapiens
gauccaaaccaagaagaaa

SEQ ID NO: 1066274 - RNA, 19 nt, Homo sapiens
caauggauccaaaccaaga

SEQ ID NO: 1066275 - RNA, 19 nt, Homo sapiens
ggaagccacauccauagga

SEQ ID NO: 1066276 - RNA, 19 nt, Homo sapiens
cauuaaaccacuaaagcua

SEQ ID NO: 1066277 - RNA, 19 nt, Homo sapiens
aaaggaaagugcauuugag

SEQ ID NO: 1066278 - RNA, 19 nt, Homo sapiens
aguuguaaguuggguauua

SEQ ID NO: 1066279 - RNA, 19 nt, Homo sapiens
uuacaugggauauggaauu

SEQ ID NO: 1066280 - RNA, 19 nt, Homo sapiens
gauaaaaggagcucuaaau

SEQ ID NO: 1066281 - RNA, 19 nt, Homo sapiens
aaggaaagauacagucauc

SEQ ID NO: 1066282 - RNA, 19 nt, Homo sapiens
acaauuaucagccaagaau

SEQ ID NO: 1066283 - RNA, 19 nt, Homo sapiens
ucaggagguuauuaagcua

SEQ ID NO: 1066284 - RNA, 19 nt, Homo sapiens
gaagagagacaacaaucac

SEQ ID NO: 1066285 - RNA, 19 nt, Homo sapiens
guuguaaguuggguauuau

SEQ ID NO: 1066286 - RNA, 19 nt, Homo sapiens
ggacggagcuggacacaug

SEQ ID NO: 1066287 - RNA, 19 nt, Homo sapiens
gcacaugacacucggauua

SEQ ID NO: 1066288 - RNA, 19 nt, Homo sapiens
ucacugcucuugacaauga

SEQ ID NO: 1066289 - RNA, 19 nt, Homo sapiens
ggagacagcagcccuauga

SEQ ID NO: 1066290 - RNA, 19 nt, Homo sapiens
gcaggagcauagagaaauu

SEQ ID NO: 1066291 - RNA, 19 nt, Homo sapiens
gaaaauaccuucugcaaac

SEQ ID NO: 1066292 - RNA, 19 nt, Homo sapiens
auacauguguguugaauga

SEQ ID NO: 1066293 - RNA, 19 nt, Homo sapiens
gagccaauccuucacuuaa

SEQ ID NO: 1066294 - RNA, 19 nt, Homo sapiens
caagaccucaucuacauaa

SEQ ID NO: 1066295 - RNA, 19 nt, Homo sapiens
uaaagugauuugucucuca

SEQ ID NO: 1066296 - RNA, 19 nt, Homo sapiens
uaaacagucccuuaaggua

SEQ ID NO: 1066297 - RNA, 19 nt, Homo sapiens
ugauuugucucucagauug

SEQ ID NO: 1066298 - RNA, 19 nt, Homo sapiens
aaacagucccuuaagguaa

SEQ ID NO: 1066299 - RNA, 19 nt, Homo sapiens
ugaauucacucccacaaag

SEQ ID NO: 1066300 - RNA, 19 nt, Homo sapiens
ugugacugcuuccguguua

SEQ ID NO: 1066301 - RNA, 19 nt, Homo sapiens
aggcugaacugcugucuga

SEQ ID NO: 1066302 - RNA, 19 nt, Homo sapiens
ggagagggacuuugagauc

SEQ ID NO: 1066303 - RNA, 19 nt, Homo sapiens
guagcccagugcuguauuu

SEQ ID NO: 1066304 - RNA, 19 nt, Homo sapiens
ucacagcacucagcacaug

SEQ ID NO: 1066305 - RNA, 19 nt, Homo sapiens
gcugagguccaucugguua

SEQ ID NO: 1066306 - RNA, 19 nt, Homo sapiens
gccaauccuucacuuaaau

SEQ ID NO: 1066307 - RNA, 19 nt, Homo sapiens
ggagccaauccuucacuua

SEQ ID NO: 1066308 - RNA, 19 nt, Homo sapiens
gcccagugcuguauuuuaa

SEQ ID NO: 1066309 - RNA, 19 nt, Homo sapiens
gcauggagccaauccuuca

SEQ ID NO: 1066310 - RNA, 19 nt, Homo sapiens
ucucccagcuccucucuug

SEQ ID NO: 1066311 - RNA, 19 nt, Homo sapiens
guucagacccucagaugug

SEQ ID NO: 1066312 - RNA, 19 nt, Homo sapiens
gcacucagcacaugacacu

SEQ ID NO: 1066313 - RNA, 19 nt, Homo sapiens
ccaucuggguguuucuaaa

SEQ ID NO: 1066314 - RNA, 19 nt, Homo sapiens
aacagucccuuaagguaaa

SEQ ID NO: 1066315 - RNA, 19 nt, Homo sapiens
cauaauugagcuaaucuug

SEQ ID NO: 1066316 - RNA, 19 nt, Homo sapiens
guccauacauguguguuga

SEQ ID NO: 1066317 - RNA, 19 nt, Homo sapiens
cuacauggcaggagcauag

SEQ ID NO: 1066318 - RNA, 19 nt, Homo sapiens
ccaagaccucaucuacaua

SEQ ID NO: 1066319 - RNA, 19 nt, Homo sapiens
cauccacucuagcucuuau

SEQ ID NO: 1066320 - RNA, 19 nt, Homo sapiens
accaagaccucaucuacau

SEQ ID NO: 1066321 - RNA, 19 nt, Homo sapiens
gacagaaccuacaaaagga

SEQ ID NO: 1066322 - RNA, 19 nt, Homo sapiens
ggaaaauaccuucugcaaa

SEQ ID NO: 1066323 - RNA, 19 nt, Homo sapiens
cacucuagcucuuauuaca

SEQ ID NO: 1066324 - RNA, 19 nt, Homo sapiens
gccuaucggugucccauca

SEQ ID NO: 1066325 - RNA, 19 nt, Homo sapiens
aaaccaagaccucaucuac

SEQ ID NO: 1066326 - RNA, 19 nt, Homo sapiens
uaacagccaggauaagcuu

SEQ ID NO: 1066327 - RNA, 19 nt, Homo sapiens
cugaggacauggacacuuc

SEQ ID NO: 1066328 - RNA, 19 nt, Homo sapiens
gacuuuagcaccucuauac

SEQ ID NO: 1066329 - RNA, 19 nt, Homo sapiens
ccauacauguguguugaau

SEQ ID NO: 1066330 - RNA, 19 nt, Homo sapiens
agccaauccuucacuuaaa

SEQ ID NO: 1066331 - RNA, 19 nt, Homo sapiens
gaaugaaugaguggacaga

SEQ ID NO: 1066332 - RNA, 19 nt, Homo sapiens
caaaccaagaccucaucua

SEQ ID NO: 1066333 - RNA, 19 nt, Homo sapiens
uaaagcaacuccccaccaa

SEQ ID NO: 1066334 - RNA, 19 nt, Homo sapiens
gaguccauguccucuacuu

SEQ ID NO: 1066335 - RNA, 19 nt, Homo sapiens
aagguaaagugauuugucu

SEQ ID NO: 1066336 - RNA, 19 nt, Homo sapiens
ugaaugaguggacagaugu

SEQ ID NO: 1066337 - RNA, 19 nt, Homo sapiens
cauguguguugaaugaaug

SEQ ID NO: 1066338 - RNA, 19 nt, Homo sapiens
cccuuaagguaaagugauu

SEQ ID NO: 1066339 - RNA, 19 nt, Homo sapiens
uuccugcacuuccaugaaa

SEQ ID NO: 1066340 - RNA, 19 nt, Homo sapiens
ggugaacguccauacaugu

SEQ ID NO: 1066341 - RNA, 19 nt, Homo sapiens
gcggagagggacuuugaga

SEQ ID NO: 1066342 - RNA, 19 nt, Homo sapiens
gacaaugacagaaccuaca

SEQ ID NO: 1066343 - RNA, 19 nt, Homo sapiens
acauguguguugaaugaau

SEQ ID NO: 1066344 - RNA, 19 nt, Homo sapiens
acugcugucugaacuggua

SEQ ID NO: 1066345 - RNA, 19 nt, Homo sapiens
gcacuuccaugaaaauaac

SEQ ID NO: 1066346 - RNA, 19 nt, Homo sapiens
ucacugggccuggaaaaua

SEQ ID NO: 1066347 - RNA, 19 nt, Homo sapiens
cuccaccucugcucucuga

SEQ ID NO: 1066348 - RNA, 19 nt, Homo sapiens
ucucucagauugccucucu

SEQ ID NO: 1066349 - RNA, 19 nt, Homo sapiens
uuauccagcugaguaaaug

SEQ ID NO: 1066350 - RNA, 19 nt, Homo sapiens
aauccuuguuucucucaaa

SEQ ID NO: 1066351 - RNA, 19 nt, Homo sapiens
gguaaagugauuugucucu

SEQ ID NO: 1066352 - RNA, 19 nt, Homo sapiens
uaagguaaagugauuuguc

SEQ ID NO: 1066353 - RNA, 19 nt, Homo sapiens
ggcaggagcauagagaaau

SEQ ID NO: 1066354 - RNA, 19 nt, Homo sapiens
cucuagcucuuauuacaga

SEQ ID NO: 1066355 - RNA, 19 nt, Homo sapiens
augaaugaguggacagaug

SEQ ID NO: 1066356 - RNA, 19 nt, Homo sapiens
ucacuaggacuggaaaaua

SEQ ID NO: 1066357 - RNA, 19 nt, Homo sapiens
uugcaguuauccaaauguu

SEQ ID NO: 1066358 - RNA, 19 nt, Homo sapiens
ugacuuuagcaccucuaua

SEQ ID NO: 1066359 - RNA, 19 nt, Homo sapiens
uggcggagagggacuuuga

SEQ ID NO: 1066360 - RNA, 19 nt, Homo sapiens
ggaagcagggaaugaugag

SEQ ID NO: 1066361 - RNA, 19 nt, Homo sapiens
gugauuugucucucagauu

SEQ ID NO: 1066362 - RNA, 19 nt, Homo sapiens
uggugaacguccauacaug

SEQ ID NO: 1066363 - RNA, 19 nt, Homo sapiens
ucaggcccauccacucuag

SEQ ID NO: 1066364 - RNA, 19 nt, Homo sapiens
ggucaggcccauccacucu

SEQ ID NO: 1066365 - RNA, 19 nt, Homo sapiens
ucugcucucugacccuuga

SEQ ID NO: 1066366 - RNA, 19 nt, Homo sapiens
ccaggaagcagggaaugau

SEQ ID NO: 1066367 - RNA, 19 nt, Homo sapiens
ugacagaaccuacaaaagg

SEQ ID NO: 1066368 - RNA, 19 nt, Homo sapiens
acaaugacagaaccuacaa

SEQ ID NO: 1066369 - RNA, 19 nt, Homo sapiens
gcuuccguguuacugcuuu

SEQ ID NO: 1066370 - RNA, 19 nt, Homo sapiens
agacagcagcccuaugaca

SEQ ID NO: 1066371 - RNA, 19 nt, Homo sapiens
gaggagacagcagcccuau

SEQ ID NO: 1066372 - RNA, 19 nt, Homo sapiens
caaugacagaaccuacaaa

SEQ ID NO: 1066373 - RNA, 19 nt, Homo sapiens
uccacucuagcucuuauua

SEQ ID NO: 1066374 - RNA, 19 nt, Homo sapiens
caggagcauagagaaauuu

SEQ ID NO: 1066375 - RNA, 19 nt, Homo sapiens
gagaaacgcucuacuaaug

SEQ ID NO: 1066376 - RNA, 19 nt, Homo sapiens
ggaauuaugcuguucauuu

SEQ ID NO: 1066377 - RNA, 19 nt, Homo sapiens
ucaagucgaugaccaauuu

SEQ ID NO: 1066378 - RNA, 19 nt, Homo sapiens
gcaagaauuuggaauggaa

SEQ ID NO: 1066379 - RNA, 19 nt, Homo sapiens
gcucaucccuucucccuuu

SEQ ID NO: 1066380 - RNA, 19 nt, Homo sapiens
gaaacuaccuaccucacuu

SEQ ID NO: 1066381 - RNA, 19 nt, Homo sapiens
ggaagaggcugaguggaaa

SEQ ID NO: 1066382 - RNA, 19 nt, Homo sapiens
gccaugaucuucugccaua

SEQ ID NO: 1066383 - RNA, 19 nt, Homo sapiens
gaagaucagugagcagauu

SEQ ID NO: 1066384 - RNA, 19 nt, Homo sapiens
gaauggaaguuaugaccaa

SEQ ID NO: 1066385 - RNA, 19 nt, Homo sapiens
gaaagaggccagaagauca

SEQ ID NO: 1066386 - RNA, 19 nt, Homo sapiens
gagcucugauuccuacaua

SEQ ID NO: 1066387 - RNA, 19 nt, Homo sapiens
cuaccuaccucacuucaaa

SEQ ID NO: 1066388 - RNA, 19 nt, Homo sapiens
gaaacgcucuacuaaugau

SEQ ID NO: 1066389 - RNA, 19 nt, Homo sapiens
gaaaauagccaacugagaa

SEQ ID NO: 1066390 - RNA, 19 nt, Homo sapiens
ggacgggaauccugacaau

SEQ ID NO: 1066391 - RNA, 19 nt, Homo sapiens
ucaacaagcugaucagaag

SEQ ID NO: 1066392 - RNA, 19 nt, Homo sapiens
gaauuuggaauggaaguua

SEQ ID NO: 1066393 - RNA, 19 nt, Homo sapiens
cagcagagcucucaaaaga

SEQ ID NO: 1066394 - RNA, 19 nt, Homo sapiens
gccgagagcugagcaagaa

SEQ ID NO: 1066395 - RNA, 19 nt, Homo sapiens
guucauugaucccaagaaa

SEQ ID NO: 1066396 - RNA, 19 nt, Homo sapiens
cuaccucacuucaaauuau

SEQ ID NO: 1066397 - RNA, 19 nt, Homo sapiens
gcagaaagcagacuugcau

SEQ ID NO: 1066398 - RNA, 19 nt, Homo sapiens
gagcaagaauuuggaaugg

SEQ ID NO: 1066399 - RNA, 19 nt, Homo sapiens
gcuccaagcucaaguucau

SEQ ID NO: 1066400 - RNA, 19 nt, Homo sapiens
ggaaagaggccagaagauc

SEQ ID NO: 1066401 - RNA, 19 nt, Homo sapiens
gagaaacacgaaagucuga

SEQ ID NO: 1066402 - RNA, 19 nt, Homo sapiens
gcagaucaaggaagagaaa

SEQ ID NO: 1066403 - RNA, 19 nt, Homo sapiens
uaacacaaaccaaguggaa

SEQ ID NO: 1066404 - RNA, 19 nt, Homo sapiens
ccaagggaauuaugcuguu

SEQ ID NO: 1066405 - RNA, 19 nt, Homo sapiens
auaauaaucuggucacagu

SEQ ID NO: 1066406 - RNA, 19 nt, Homo sapiens
gaucagaagcaaccuuguu

SEQ ID NO: 1066407 - RNA, 19 nt, Homo sapiens
gcguaugcaccauucauua

SEQ ID NO: 1066408 - RNA, 19 nt, Homo sapiens
gagaaagucaaagcagaua

SEQ ID NO: 1066409 - RNA, 19 nt, Homo sapiens
caaggaagagaaagucaaa

SEQ ID NO: 1066410 - RNA, 19 nt, Homo sapiens
gaaagcagacuugcauauc

SEQ ID NO: 1066411 - RNA, 19 nt, Homo sapiens
cuucagauuuggagagaaa

SEQ ID NO: 1066412 - RNA, 19 nt, Homo sapiens
ugaggcugaugucaugaua

SEQ ID NO: 1066413 - RNA, 19 nt, Homo sapiens
guuaugaccaagggaauua

SEQ ID NO: 1066414 - RNA, 19 nt, Homo sapiens
ggacgagauugagaaaaua

SEQ ID NO: 1066415 - RNA, 19 nt, Homo sapiens
gcaggaagcggcugucaag

SEQ ID NO: 1066416 - RNA, 19 nt, Homo sapiens
acaagugucugucgucauc

SEQ ID NO: 1066417 - RNA, 19 nt, Homo sapiens
uaugagaaacgcucuacua

SEQ ID NO: 1066418 - RNA, 19 nt, Homo sapiens
gcaccauucauuaugcuaa

SEQ ID NO: 1066419 - RNA, 19 nt, Homo sapiens
ccugaaauccagagacuuu

SEQ ID NO: 1066420 - RNA, 19 nt, Homo sapiens
cgauagaugugcagguugu

SEQ ID NO: 1066421 - RNA, 19 nt, Homo sapiens
gcaugaacauccugaacag

SEQ ID NO: 1066422 - RNA, 19 nt, Homo sapiens
gaaguuugcccagaaagug

SEQ ID NO: 1066423 - RNA, 19 nt, Homo sapiens
gagagaaacacgaaagucu

SEQ ID NO: 1066424 - RNA, 19 nt, Homo sapiens
uagaaagauuggacacaga

SEQ ID NO: 1066425 - RNA, 19 nt, Homo sapiens
gauaaauuguagcguaugc

SEQ ID NO: 1066426 - RNA, 19 nt, Homo sapiens
gagcugagcaagaauuugg

SEQ ID NO: 1066427 - RNA, 19 nt, Homo sapiens
gagagcugagcaagaauuu

SEQ ID NO: 1066428 - RNA, 19 nt, Homo sapiens
gauuggacacagaugauuu

SEQ ID NO: 1066429 - RNA, 19 nt, Homo sapiens
gaaacacgaaagucugaau

SEQ ID NO: 1066430 - RNA, 19 nt, Homo sapiens
gcagagcucucaaaagaag

SEQ ID NO: 1066431 - RNA, 19 nt, Homo sapiens
cgugguggcucaugccuau

SEQ ID NO: 1066432 - RNA, 19 nt, Homo sapiens
cggaagaggcugaguggaa

SEQ ID NO: 1066433 - RNA, 19 nt, Homo sapiens
gugagcagauugucauugg

SEQ ID NO: 1066434 - RNA, 19 nt, Homo sapiens
ccaauuugcagaucaagga

SEQ ID NO: 1066435 - RNA, 19 nt, Homo sapiens
cauacguaguugguucuua

SEQ ID NO: 1066436 - RNA, 19 nt, Homo sapiens
ggucuugccuucucuucuc

SEQ ID NO: 1066437 - RNA, 19 nt, Homo sapiens
cagaugauuuggacgagau

SEQ ID NO: 1066438 - RNA, 19 nt, Homo sapiens
ugaacauccugaacagaau

SEQ ID NO: 1066439 - RNA, 19 nt, Homo sapiens
guggaaguuugcccagaaa

SEQ ID NO: 1066440 - RNA, 19 nt, Homo sapiens
caagguguuuguucuggau

SEQ ID NO: 1066441 - RNA, 19 nt, Homo sapiens
ugaccaauuugcagaucaa

SEQ ID NO: 1066442 - RNA, 19 nt, Homo sapiens
gcccaguccuuacucaaca

SEQ ID NO: 1066443 - RNA, 19 nt, Homo sapiens
uggauaaauuguagcguau

SEQ ID NO: 1066444 - RNA, 19 nt, Homo sapiens
aaggauggauaaauuguag

SEQ ID NO: 1066445 - RNA, 19 nt, Homo sapiens
gaccccgacucaauaaaua

SEQ ID NO: 1066446 - RNA, 19 nt, Homo sapiens
gugaguuucugagcgcaua

SEQ ID NO: 1066447 - RNA, 19 nt, Homo sapiens
aaacagaugaagaggagaa

SEQ ID NO: 1066448 - RNA, 19 nt, Homo sapiens
ggaagagaaagucaaagca

SEQ ID NO: 1066449 - RNA, 19 nt, Homo sapiens
caauggacccuucacaagu

SEQ ID NO: 1066450 - RNA, 19 nt, Homo sapiens
cagaugaagaggagaaaga

SEQ ID NO: 1066451 - RNA, 19 nt, Homo sapiens
gaacagaauccaggagcau

SEQ ID NO: 1066452 - RNA, 19 nt, Homo sapiens
gaaguuccaggccuugugu

SEQ ID NO: 1066453 - RNA, 19 nt, Homo sapiens
agaggaugcugcccaggaa

SEQ ID NO: 1066454 - RNA, 19 nt, Homo sapiens
gaacauccugaacagaauc

SEQ ID NO: 1066455 - RNA, 19 nt, Homo sapiens
cagcagagacgagaaguuc

SEQ ID NO: 1066456 - RNA, 19 nt, Homo sapiens
gcucugauuccuacauaau

SEQ ID NO: 1066457 - RNA, 19 nt, Homo sapiens
caagggaauuaugcuguuc

SEQ ID NO: 1066458 - RNA, 19 nt, Homo sapiens
aauggacccuucacaagug

SEQ ID NO: 1066459 - RNA, 19 nt, Homo sapiens
ccaucaagcaguacuaugu

SEQ ID NO: 1066460 - RNA, 19 nt, Homo sapiens
ggaaguuugcccagaaagu

SEQ ID NO: 1066461 - RNA, 19 nt, Homo sapiens
gauccaaacuccccucugu

SEQ ID NO: 1066462 - RNA, 19 nt, Homo sapiens
ugagaaacgcucuacuaau

SEQ ID NO: 1066463 - RNA, 19 nt, Homo sapiens
ggacccuucacaaguguuu

SEQ ID NO: 1066464 - RNA, 19 nt, Homo sapiens
gcgcauauuuucacaagug

SEQ ID NO: 1066465 - RNA, 19 nt, Homo sapiens
ccagguggcucugcugagu

SEQ ID NO: 1066466 - RNA, 19 nt, Homo sapiens
ccaagaaaaucaagguguu

SEQ ID NO: 1066467 - RNA, 19 nt, Homo sapiens
cgagagcugagcaagaauu

SEQ ID NO: 1066468 - RNA, 19 nt, Homo sapiens
aaagauuggacacagauga

SEQ ID NO: 1066469 - RNA, 19 nt, Homo sapiens
uguggaaguuugcccagaa

SEQ ID NO: 1066470 - RNA, 19 nt, Homo sapiens
gcucuacuaaugauuuguu

SEQ ID NO: 1066471 - RNA, 19 nt, Homo sapiens
agaaacgcucuacuaauga

SEQ ID NO: 1066472 - RNA, 19 nt, Homo sapiens
gaaagauuggacacagaug

SEQ ID NO: 1066473 - RNA, 19 nt, Homo sapiens
gcaagcacagcaugaacau

SEQ ID NO: 1066474 - RNA, 19 nt, Homo sapiens
acgggaauccugacaauga

SEQ ID NO: 1066475 - RNA, 19 nt, Homo sapiens
ucacuuagauguaaacuga

SEQ ID NO: 1066476 - RNA, 19 nt, Homo sapiens
ggcauuagauacugaauaa

SEQ ID NO: 1066477 - RNA, 19 nt, Homo sapiens
guacaaagggagacaauaa

SEQ ID NO: 1066478 - RNA, 19 nt, Homo sapiens
gcaagggccugcucucaga

SEQ ID NO: 1066479 - RNA, 19 nt, Homo sapiens
gcaguugccuguaaucuca

SEQ ID NO: 1066480 - RNA, 19 nt, Homo sapiens
ggacucugauuauacaauu

SEQ ID NO: 1066481 - RNA, 19 nt, Homo sapiens
ggaaggaagagaaggaaua

SEQ ID NO: 1066482 - RNA, 19 nt, Homo sapiens
cgaaacggcucuucuggaa

SEQ ID NO: 1066483 - RNA, 19 nt, Homo sapiens
gcucaauccuccuaaauuc

SEQ ID NO: 1066484 - RNA, 19 nt, Homo sapiens
cagcacagccugcaaguuu

SEQ ID NO: 1066485 - RNA, 19 nt, Homo sapiens
ggacgguacucaccagaau

SEQ ID NO: 1066486 - RNA, 19 nt, Homo sapiens
caauaucacugcccugugu

SEQ ID NO: 1066487 - RNA, 19 nt, Homo sapiens
gaagagaaggaauacaguu

SEQ ID NO: 1066488 - RNA, 19 nt, Homo sapiens
gcguagagcucccgguaga

SEQ ID NO: 1066489 - RNA, 19 nt, Homo sapiens
gcauugggaauaaagauaa

SEQ ID NO: 1066490 - RNA, 19 nt, Homo sapiens
gaaccuacuguauaccuaa

SEQ ID NO: 1066491 - RNA, 19 nt, Homo sapiens
ggaaccuacuguauaccua

SEQ ID NO: 1066492 - RNA, 19 nt, Homo sapiens
ccuguaaucucaacuacuu

SEQ ID NO: 1066493 - RNA, 19 nt, Homo sapiens
guucaaacaaucugcauaa

SEQ ID NO: 1066494 - RNA, 19 nt, Homo sapiens
gagacucaguucaaacaau

SEQ ID NO: 1066495 - RNA, 19 nt, Homo sapiens
gaccuaccuuuaucucuga

SEQ ID NO: 1066496 - RNA, 19 nt, Homo sapiens
gaauacaguuagcaugucu

SEQ ID NO: 1066497 - RNA, 19 nt, Homo sapiens
guacaggacucguucuacu

SEQ ID NO: 1066498 - RNA, 19 nt, Homo sapiens
gacuuggacucugauuaua

SEQ ID NO: 1066499 - RNA, 19 nt, Homo sapiens
uagcaugucuuugauacuu

SEQ ID NO: 1066500 - RNA, 19 nt, Homo sapiens
gaaccugggcccaucaaau

SEQ ID NO: 1066501 - RNA, 19 nt, Homo sapiens
ucacugcccugugugcuaa

SEQ ID NO: 1066502 - RNA, 19 nt, Homo sapiens
caguagcaguugccuguaa

SEQ ID NO: 1066503 - RNA, 19 nt, Homo sapiens
guacuggcuucacuuagau

SEQ ID NO: 1066504 - RNA, 19 nt, Homo sapiens
acaguuagcaugucuuuga

SEQ ID NO: 1066505 - RNA, 19 nt, Homo sapiens
gcaugucuuugauacuuau

SEQ ID NO: 1066506 - RNA, 19 nt, Homo sapiens
gcaaguuuguccaguaggu

SEQ ID NO: 1066507 - RNA, 19 nt, Homo sapiens
uggcuucacuuagauguaa

SEQ ID NO: 1066508 - RNA, 19 nt, Homo sapiens
gagacuuggacucugauua

SEQ ID NO: 1066509 - RNA, 19 nt, Homo sapiens
ggaauaaagauaagguaca

SEQ ID NO: 1066510 - RNA, 19 nt, Homo sapiens
ccuccuaaauucccugauu

SEQ ID NO: 1066511 - RNA, 19 nt, Homo sapiens
aagagaaggaauacaguua

SEQ ID NO: 1066512 - RNA, 19 nt, Homo sapiens
aaccugggcccaucaaaua

SEQ ID NO: 1066513 - RNA, 19 nt, Homo sapiens
gcaggagaaucacuugaac

SEQ ID NO: 1066514 - RNA, 19 nt, Homo sapiens
gaaaccccaucucuacuaa

SEQ ID NO: 1066515 - RNA, 19 nt, Homo sapiens
ggaauacaguuagcauguc

SEQ ID NO: 1066516 - RNA, 19 nt, Homo sapiens
gccaagcugucaccgaaga

SEQ ID NO: 1066517 - RNA, 19 nt, Homo sapiens
gcauacugcuacccuauac

SEQ ID NO: 1066518 - RNA, 19 nt, Homo sapiens
gggcauuagauacugaaua

SEQ ID NO: 1066519 - RNA, 19 nt, Homo sapiens
gcaaguacagcgaguaguc

SEQ ID NO: 1066520 - RNA, 19 nt, Homo sapiens
uguaagagccaaggacuaa

SEQ ID NO: 1066521 - RNA, 19 nt, Homo sapiens
aaacggcucuucuggaaaa

SEQ ID NO: 1066522 - RNA, 19 nt, Homo sapiens
agacucaguucaaacaauc

SEQ ID NO: 1066523 - RNA, 19 nt, Homo sapiens
gaaacggcucuucuggaaa

SEQ ID NO: 1066524 - RNA, 19 nt, Homo sapiens
gcucuaccgccaccuguaa

SEQ ID NO: 1066525 - RNA, 19 nt, Homo sapiens
agacuuggacucugauuau

SEQ ID NO: 1066526 - RNA, 19 nt, Homo sapiens
gaaggaauacaguuagcau

SEQ ID NO: 1066527 - RNA, 19 nt, Homo sapiens
ccugcaaguuuguccagua

SEQ ID NO: 1066528 - RNA, 19 nt, Homo sapiens
ggaggacgacucuugaaag

SEQ ID NO: 1066529 - RNA, 19 nt, Homo sapiens
gcuaggcauugggaauaaa

SEQ ID NO: 1066530 - RNA, 19 nt, Homo sapiens
cggcuaugaugaaacgaaa

SEQ ID NO: 1066531 - RNA, 19 nt, Homo sapiens
gagccaaggacuaagauag

SEQ ID NO: 1066532 - RNA, 19 nt, Homo sapiens
uaagagccaaggacuaaga

SEQ ID NO: 1066533 - RNA, 19 nt, Homo sapiens
aguacuggcuucacuuaga

SEQ ID NO: 1066534 - RNA, 19 nt, Homo sapiens
guuagcaugucuuugauac

SEQ ID NO: 1066535 - RNA, 19 nt, Homo sapiens
gagaaggaauacaguuagc

SEQ ID NO: 1066536 - RNA, 19 nt, Homo sapiens
gaaggaagagaaggaauac

SEQ ID NO: 1066537 - RNA, 19 nt, Homo sapiens
ggcauugggaauaaagaua

SEQ ID NO: 1066538 - RNA, 19 nt, Homo sapiens
ggaagagaaggaauacagu

SEQ ID NO: 1066539 - RNA, 19 nt, Homo sapiens
cugcuacccuauacaauca

SEQ ID NO: 1066540 - RNA, 19 nt, Homo sapiens
gcacagccugcaaguuugu

SEQ ID NO: 1066541 - RNA, 19 nt, Homo sapiens
gcuuugaccugggcauuag

SEQ ID NO: 1066542 - RNA, 19 nt, Homo sapiens
ggcaggagaaucacuugaa

SEQ ID NO: 1066543 - RNA, 19 nt, Homo sapiens
acugacaacuccaaaauuu

SEQ ID NO: 1066544 - RNA, 19 nt, Homo sapiens
ugcccugugugcuaaauaa

SEQ ID NO: 1066545 - RNA, 19 nt, Homo sapiens
uacaaagggagacaauaaa

SEQ ID NO: 1066546 - RNA, 19 nt, Homo sapiens
ccauagacuuuguguccau

SEQ ID NO: 1066547 - RNA, 19 nt, Homo sapiens
gguacaaagggagacaaua

SEQ ID NO: 1066548 - RNA, 19 nt, Homo sapiens
guagagcucccgguagaug

SEQ ID NO: 1066549 - RNA, 19 nt, Homo sapiens
ggcucaauccuccuaaauu

SEQ ID NO: 1066550 - RNA, 19 nt, Homo sapiens
ccuguaaucccagcacuuu

SEQ ID NO: 1066551 - RNA, 19 nt, Homo sapiens
aagcuaggcauugggaaua

SEQ ID NO: 1066552 - RNA, 19 nt, Homo sapiens
ugacucagagcggcaagua

SEQ ID NO: 1066553 - RNA, 19 nt, Homo sapiens
gcccaucaaauauuccaaa

SEQ ID NO: 1066554 - RNA, 19 nt, Homo sapiens
caaagcguguggccaagcu

SEQ ID NO: 1066555 - RNA, 19 nt, Homo sapiens
gcugggcgcaguagcaguu

SEQ ID NO: 1066556 - RNA, 19 nt, Homo sapiens
ggcaaguacuggcuucacu

SEQ ID NO: 1066557 - RNA, 19 nt, Homo sapiens
cuccuaaauucccugauug

SEQ ID NO: 1066558 - RNA, 19 nt, Homo sapiens
cuuuaucucugauccuaga

SEQ ID NO: 1066559 - RNA, 19 nt, Homo sapiens
gauacugaauaaucaucca

SEQ ID NO: 1066560 - RNA, 19 nt, Homo sapiens
cagggucaccgaaagagaa

SEQ ID NO: 1066561 - RNA, 19 nt, Homo sapiens
gcuaugaugaaacgaaagu

SEQ ID NO: 1066562 - RNA, 19 nt, Homo sapiens
cuuggacucugauuauaca

SEQ ID NO: 1066563 - RNA, 19 nt, Homo sapiens
gggcucaauccuccuaaau

SEQ ID NO: 1066564 - RNA, 19 nt, Homo sapiens
agcaugucuuugauacuua

SEQ ID NO: 1066565 - RNA, 19 nt, Homo sapiens
auuggcauauucaaccaua

SEQ ID NO: 1066566 - RNA, 19 nt, Homo sapiens
caaauauuccaaaguaagc

SEQ ID NO: 1066567 - RNA, 19 nt, Homo sapiens
acuuagauguaaacugaga

SEQ ID NO: 1066568 - RNA, 19 nt, Homo sapiens
uuuggaaccuacuguauac

SEQ ID NO: 1066569 - RNA, 19 nt, Homo sapiens
ggccgaucaugggcaguuu

SEQ ID NO: 1066570 - RNA, 19 nt, Homo sapiens
gggcgaaacggcucuucug

SEQ ID NO: 1066571 - RNA, 19 nt, Homo sapiens
cggaggacgacucuugaaa

SEQ ID NO: 1066572 - RNA, 19 nt, Homo sapiens
ggguacaggacucguucua

SEQ ID NO: 1066573 - RNA, 19 nt, Homo sapiens
gcaguagcaguugccugua

SEQ ID NO: 1066574 - RNA, 19 nt, Homo sapiens
gauacuuauucccucucaa

SEQ ID NO: 1066575 - RNA, 19 nt, Homo sapiens
uaaagucacuguguguaga

SEQ ID NO: 1066576 - RNA, 19 nt, Homo sapiens
ggaggacagugggaugauu

SEQ ID NO: 1066577 - RNA, 19 nt, Homo sapiens
ggucuugucccuaggaauu

SEQ ID NO: 1066578 - RNA, 19 nt, Homo sapiens
ugauggcucugaagcugaa

SEQ ID NO: 1066579 - RNA, 19 nt, Homo sapiens
uaauaaagucacugugugu

SEQ ID NO: 1066580 - RNA, 19 nt, Homo sapiens
ucccaacgccuuccuauuc

SEQ ID NO: 1066581 - RNA, 19 nt, Homo sapiens
aaauuucacuuuccuucuc

SEQ ID NO: 1066582 - RNA, 19 nt, Homo sapiens
gaggacagugggaugauuc

SEQ ID NO: 1066583 - RNA, 19 nt, Homo sapiens
gagggcaguucaccagcau

SEQ ID NO: 1066584 - RNA, 19 nt, Homo sapiens
gagcugcaggacugaggua

SEQ ID NO: 1066585 - RNA, 19 nt, Homo sapiens
gcgccucccuugucugaac

SEQ ID NO: 1066586 - RNA, 19 nt, Homo sapiens
gcaguucaccagcauccau

SEQ ID NO: 1066587 - RNA, 19 nt, Homo sapiens
ggaaaggggucugggucuu

SEQ ID NO: 1066588 - RNA, 19 nt, Homo sapiens
ucccuaaugucuccuccuu

SEQ ID NO: 1066589 - RNA, 19 nt, Homo sapiens
aauaaagucacugugugua

SEQ ID NO: 1066590 - RNA, 19 nt, Homo sapiens
acaccaaggagcagauguu

SEQ ID NO: 1066591 - RNA, 19 nt, Homo sapiens
caaauuucacuuuccuucu

SEQ ID NO: 1066592 - RNA, 19 nt, Homo sapiens
aguaauaaagucacugugu

SEQ ID NO: 1066593 - RNA, 19 nt, Homo sapiens
caguucaccagcauccaua

SEQ ID NO: 1066594 - RNA, 19 nt, Homo sapiens
cccgaugggucgucagcaa

SEQ ID NO: 1066595 - RNA, 19 nt, Homo sapiens
gcacaccaaggagcagaug

SEQ ID NO: 1066596 - RNA, 19 nt, Homo sapiens
guauagagcugcuucaauu

SEQ ID NO: 1066597 - RNA, 19 nt, Homo sapiens
gaaagaaaccucaauuauc

SEQ ID NO: 1066598 - RNA, 19 nt, Homo sapiens
gaagagggacucauauaaa

SEQ ID NO: 1066599 - RNA, 19 nt, Homo sapiens
aaacagagaaggcuuauaa

SEQ ID NO: 1066600 - RNA, 19 nt, Homo sapiens
cuaaauggguguaguugua

SEQ ID NO: 1066601 - RNA, 19 nt, Homo sapiens
ggacucauauaaauaguug

SEQ ID NO: 1066602 - RNA, 19 nt, Homo sapiens
gcugauauauccacuggua

SEQ ID NO: 1066603 - RNA, 19 nt, Homo sapiens
gugaacacauuuacacaua

SEQ ID NO: 1066604 - RNA, 19 nt, Homo sapiens
gcaagucacuaguuugaga

SEQ ID NO: 1066605 - RNA, 19 nt, Homo sapiens
gaacuuugauucuuuagag

SEQ ID NO: 1066606 - RNA, 19 nt, Homo sapiens
uaaauagccuucauacugu

SEQ ID NO: 1066607 - RNA, 19 nt, Homo sapiens
gaacccauauuacaagaau

SEQ ID NO: 1066608 - RNA, 19 nt, Homo sapiens
uaagaaacgacuagaguua

SEQ ID NO: 1066609 - RNA, 19 nt, Homo sapiens
gacaauuucuuccagguuu

SEQ ID NO: 1066610 - RNA, 19 nt, Homo sapiens
gagaagagggacucauaua

SEQ ID NO: 1066611 - RNA, 19 nt, Homo sapiens
gaagaagucuauggaaaca

SEQ ID NO: 1066612 - RNA, 19 nt, Homo sapiens
gaacacauuuacacauauc

SEQ ID NO: 1066613 - RNA, 19 nt, Homo sapiens
acaacagacuucauccuua

SEQ ID NO: 1066614 - RNA, 19 nt, Homo sapiens
gggaagaaacucagacuuu

SEQ ID NO: 1066615 - RNA, 19 nt, Homo sapiens
caacagacuucauccuuag

SEQ ID NO: 1066616 - RNA, 19 nt, Homo sapiens
gacuccaucucuauaaaua

SEQ ID NO: 1066617 - RNA, 19 nt, Homo sapiens
gcugcuaaaugcuaucuuu

SEQ ID NO: 1066618 - RNA, 19 nt, Homo sapiens
gcauguauguacuugugua

SEQ ID NO: 1066619 - RNA, 19 nt, Homo sapiens
aaaggcaagucacuaguuu

SEQ ID NO: 1066620 - RNA, 19 nt, Homo sapiens
cgagcggacugcauuauga

SEQ ID NO: 1066621 - RNA, 19 nt, Homo sapiens
caacagauuugguggugau

SEQ ID NO: 1066622 - RNA, 19 nt, Homo sapiens
uuaaauagccuucauacug

SEQ ID NO: 1066623 - RNA, 19 nt, Homo sapiens
ucagauaguguguuguuua

SEQ ID NO: 1066624 - RNA, 19 nt, Homo sapiens
aaacacauaucaugcauac

SEQ ID NO: 1066625 - RNA, 19 nt, Homo sapiens
ggaaacacauaucaugcau

SEQ ID NO: 1066626 - RNA, 19 nt, Homo sapiens
ugacuaacuugcugcuaaa

SEQ ID NO: 1066627 - RNA, 19 nt, Homo sapiens
agaagcagauagaagguaa

SEQ ID NO: 1066628 - RNA, 19 nt, Homo sapiens
caucauaucauagcacuaa

SEQ ID NO: 1066629 - RNA, 19 nt, Homo sapiens
cuacaguugugaauuaguu

SEQ ID NO: 1066630 - RNA, 19 nt, Homo sapiens
ccacugguauuuacuaugg

SEQ ID NO: 1066631 - RNA, 19 nt, Homo sapiens
agaaucagauaguguguug

SEQ ID NO: 1066632 - RNA, 19 nt, Homo sapiens
ucaguggcuuuaugaagua

SEQ ID NO: 1066633 - RNA, 19 nt, Homo sapiens
aagagggacucauauaaau

SEQ ID NO: 1066634 - RNA, 19 nt, Homo sapiens
aauaaugaauggccacuga

SEQ ID NO: 1066635 - RNA, 19 nt, Homo sapiens
ugaagaagcuaagaaacga

SEQ ID NO: 1066636 - RNA, 19 nt, Homo sapiens
ucaauuaucaguggcuuua

SEQ ID NO: 1066637 - RNA, 19 nt, Homo sapiens
uuaagcccaucauaucaua

SEQ ID NO: 1066638 - RNA, 19 nt, Homo sapiens
gcagauagaagguaauuuu

SEQ ID NO: 1066639 - RNA, 19 nt, Homo sapiens
ccaccuucauuauuguaua

SEQ ID NO: 1066640 - RNA, 19 nt, Homo sapiens
caucuugguuauauacuga

SEQ ID NO: 1066641 - RNA, 19 nt, Homo sapiens
uaucaugcauaccuucaaa

SEQ ID NO: 1066642 - RNA, 19 nt, Homo sapiens
guauaugcacgauguaauu

SEQ ID NO: 1066643 - RNA, 19 nt, Homo sapiens
gaaacacauaucaugcaua

SEQ ID NO: 1066644 - RNA, 19 nt, Homo sapiens
uguaccaccuucauuauug

SEQ ID NO: 1066645 - RNA, 19 nt, Homo sapiens
cauuguaccaccuucauua

SEQ ID NO: 1066646 - RNA, 19 nt, Homo sapiens
ucacuuauuucagcaauuc

SEQ ID NO: 1066647 - RNA, 19 nt, Homo sapiens
agaagagggacucauauaa

SEQ ID NO: 1066648 - RNA, 19 nt, Homo sapiens
gauaaucuuccagcugaua

SEQ ID NO: 1066649 - RNA, 19 nt, Homo sapiens
cagcauguauguacuugug

SEQ ID NO: 1066650 - RNA, 19 nt, Homo sapiens
acgaagaagucuauggaaa

SEQ ID NO: 1066651 - RNA, 19 nt, Homo sapiens
cugacuaacuugcugcuaa

SEQ ID NO: 1066652 - RNA, 19 nt, Homo sapiens
cagauaguguguuguuuag

SEQ ID NO: 1066653 - RNA, 19 nt, Homo sapiens
caacauagcgagacuccau

SEQ ID NO: 1066654 - RNA, 19 nt, Homo sapiens
ucaaagaggacuucuaugg

SEQ ID NO: 1066655 - RNA, 19 nt, Homo sapiens
ggagaagagggacucauau

SEQ ID NO: 1066656 - RNA, 19 nt, Homo sapiens
ucaaacacuuuacuacagu

SEQ ID NO: 1066657 - RNA, 19 nt, Homo sapiens
gcaucaucuugguuauaua

SEQ ID NO: 1066658 - RNA, 19 nt, Homo sapiens
gagaaggcuuauaaaagua

SEQ ID NO: 1066659 - RNA, 19 nt, Homo sapiens
gauauauccacugguauuu

SEQ ID NO: 1066660 - RNA, 19 nt, Homo sapiens
gagggacucauauaaauag

SEQ ID NO: 1066661 - RNA, 19 nt, Homo sapiens
gaggauugcuugagcucau

SEQ ID NO: 1066662 - RNA, 19 nt, Homo sapiens
aaauuaagcccaucauauc

SEQ ID NO: 1066663 - RNA, 19 nt, Homo sapiens
gcuaagaaacgacuagagu

SEQ ID NO: 1066664 - RNA, 19 nt, Homo sapiens
cugagcaagugguagauaa

SEQ ID NO: 1066665 - RNA, 19 nt, Homo sapiens
caaacacuuuacuacaguu

SEQ ID NO: 1066666 - RNA, 19 nt, Homo sapiens
cuaaagcuguuggagaaga

SEQ ID NO: 1066667 - RNA, 19 nt, Homo sapiens
guaccaccuucauuauugu

SEQ ID NO: 1066668 - RNA, 19 nt, Homo sapiens
guuaucauaucaugcuuca

SEQ ID NO: 1066669 - RNA, 19 nt, Homo sapiens
aaauggguguaguuguaua

SEQ ID NO: 1066670 - RNA, 19 nt, Homo sapiens
ucacuaguuugagaugaaa

SEQ ID NO: 1066671 - RNA, 19 nt, Homo sapiens
agaagucuauggaaacaca

SEQ ID NO: 1066672 - RNA, 19 nt, Homo sapiens
uggagaagagggacucaua

SEQ ID NO: 1066673 - RNA, 19 nt, Homo sapiens
uaaagaguacuuacagcuu

SEQ ID NO: 1066674 - RNA, 19 nt, Homo sapiens
agaguuaccagaacauuug

SEQ ID NO: 1066675 - RNA, 19 nt, Homo sapiens
agagggacucauauaaaua

SEQ ID NO: 1066676 - RNA, 19 nt, Homo sapiens
ugauauauccacugguauu

SEQ ID NO: 1066677 - RNA, 19 nt, Homo sapiens
acuuacagcuugagggaaa

SEQ ID NO: 1066678 - RNA, 19 nt, Homo sapiens
cauaucaugcuucaacuau

SEQ ID NO: 1066679 - RNA, 19 nt, Homo sapiens
cgacuagaguuaccagaac

SEQ ID NO: 1066680 - RNA, 19 nt, Homo sapiens
guacauugcuacaguucac

SEQ ID NO: 1066681 - RNA, 19 nt, Homo sapiens
agagaaggcuuauaaaagu

SEQ ID NO: 1066682 - RNA, 19 nt, Homo sapiens
gucacuaguuugagaugaa

SEQ ID NO: 1066683 - RNA, 19 nt, Homo sapiens
uauauccacugguauuuac

SEQ ID NO: 1066684 - RNA, 19 nt, Homo sapiens
uaagauuacagaugcuuug

SEQ ID NO: 1066685 - RNA, 19 nt, Homo sapiens
gcaaaucuaaaugggugua

SEQ ID NO: 1066686 - RNA, 19 nt, Homo sapiens
cuaacuugcugcuaaaugc

SEQ ID NO: 1066687 - RNA, 19 nt, Homo sapiens
agaauacgaagaagucuau

SEQ ID NO: 1066688 - RNA, 19 nt, Homo sapiens
gcauuaaauagaagguuga

SEQ ID NO: 1066689 - RNA, 19 nt, Homo sapiens
uguauguacuuguguagug

SEQ ID NO: 1066690 - RNA, 19 nt, Homo sapiens
gacuagaguuaccagaaca

SEQ ID NO: 1066691 - RNA, 19 nt, Homo sapiens
cuucaaagaggacuucuau

SEQ ID NO: 1066692 - RNA, 19 nt, Homo sapiens
guuaaauagccauugcuuu

SEQ ID NO: 1066693 - RNA, 19 nt, Homo sapiens
ucuaaacagagaaggcuua

SEQ ID NO: 1066694 - RNA, 19 nt, Homo sapiens
cuaagaaacgacuagaguu

SEQ ID NO: 1066695 - RNA, 19 nt, Homo sapiens
uuuaaaccguacaauguug

SEQ ID NO: 1066696 - RNA, 19 nt, Homo sapiens
gcgcauagguuauuucaaa

SEQ ID NO: 1066697 - RNA, 19 nt, Homo sapiens
gaaacuccaucucuacuaa

SEQ ID NO: 1066698 - RNA, 19 nt, Homo sapiens
gaacugcauuuccuuuaaa

SEQ ID NO: 1066699 - RNA, 19 nt, Homo sapiens
uaaagggcauagcuaauaa

SEQ ID NO: 1066700 - RNA, 19 nt, Homo sapiens
guaaagggcauagcuaaua

SEQ ID NO: 1066701 - RNA, 19 nt, Homo sapiens
ugagagccaugcagacuua

SEQ ID NO: 1066702 - RNA, 19 nt, Homo sapiens
gaacaggagauccgucuaa

SEQ ID NO: 1066703 - RNA, 19 nt, Homo sapiens
ggaaggaguuggcagacaa

SEQ ID NO: 1066704 - RNA, 19 nt, Homo sapiens
gcaaaaccaugggaaauua

SEQ ID NO: 1066705 - RNA, 19 nt, Homo sapiens
ccaagagacugaaaccaaa

SEQ ID NO: 1066706 - RNA, 19 nt, Homo sapiens
aaacaaaguucaucuccuu

SEQ ID NO: 1066707 - RNA, 19 nt, Homo sapiens
gaacagaaugcaguugaua

SEQ ID NO: 1066708 - RNA, 19 nt, Homo sapiens
gaaacucgcucgccauguc

SEQ ID NO: 1066709 - RNA, 19 nt, Homo sapiens
uaaaugcacuaaugcgaaa

SEQ ID NO: 1066710 - RNA, 19 nt, Homo sapiens
gggcauagcuaauaacaac

SEQ ID NO: 1066711 - RNA, 19 nt, Homo sapiens
cugcauggauguuugaaua

SEQ ID NO: 1066712 - RNA, 19 nt, Homo sapiens
gacgagaaguuaauuauac

SEQ ID NO: 1066713 - RNA, 19 nt, Homo sapiens
ccaaguaugaucuuugaua

SEQ ID NO: 1066714 - RNA, 19 nt, Homo sapiens
gcauggauguuugaauaaa

SEQ ID NO: 1066715 - RNA, 19 nt, Homo sapiens
acaccagaguucauuguua

SEQ ID NO: 1066716 - RNA, 19 nt, Homo sapiens
aagacgaucucauggauuu

SEQ ID NO: 1066717 - RNA, 19 nt, Homo sapiens
caaagcugguuacacauga

SEQ ID NO: 1066718 - RNA, 19 nt, Homo sapiens
gcagagcucucaaaagaaa

SEQ ID NO: 1066719 - RNA, 19 nt, Homo sapiens
gaaaggcccauucuacuuc

SEQ ID NO: 1066720 - RNA, 19 nt, Homo sapiens
gaacagcugucugccuugu

SEQ ID NO: 1066721 - RNA, 19 nt, Homo sapiens
ggaaaggcccauucuacuu

SEQ ID NO: 1066722 - RNA, 19 nt, Homo sapiens
uagaugagcugagugagaa

SEQ ID NO: 1066723 - RNA, 19 nt, Homo sapiens
caugggaaauuaaauggaa

SEQ ID NO: 1066724 - RNA, 19 nt, Homo sapiens
uaaccuagguacuccaaau

SEQ ID NO: 1066725 - RNA, 19 nt, Homo sapiens
ggacgacgacuacuacuuc

SEQ ID NO: 1066726 - RNA, 19 nt, Homo sapiens
caccagaguucauuguuau

SEQ ID NO: 1066727 - RNA, 19 nt, Homo sapiens
acagauggguggucucuug

SEQ ID NO: 1066728 - RNA, 19 nt, Homo sapiens
gcagguuugugaauuuaug

SEQ ID NO: 1066729 - RNA, 19 nt, Homo sapiens
agaacugcauuuccuuuaa

SEQ ID NO: 1066730 - RNA, 19 nt, Homo sapiens
ucugaccacugcucaauuu

SEQ ID NO: 1066731 - RNA, 19 nt, Homo sapiens
caacuccacuuuugaauug

SEQ ID NO: 1066732 - RNA, 19 nt, Homo sapiens
gcccuguccugaauuauau

SEQ ID NO: 1066733 - RNA, 19 nt, Homo sapiens
gacaaaagcgcauagguua

SEQ ID NO: 1066734 - RNA, 19 nt, Homo sapiens
ggaacagaaugcaguugau

SEQ ID NO: 1066735 - RNA, 19 nt, Homo sapiens
gagccaugcagacuuauuu

SEQ ID NO: 1066736 - RNA, 19 nt, Homo sapiens
gaccucaauuccaaucuga

SEQ ID NO: 1066737 - RNA, 19 nt, Homo sapiens
gaaacagcacucaguaauc

SEQ ID NO: 1066738 - RNA, 19 nt, Homo sapiens
ggaguuggcagacaaguuc

SEQ ID NO: 1066739 - RNA, 19 nt, Homo sapiens
gaacaaaagacgagaaguu

SEQ ID NO: 1066740 - RNA, 19 nt, Homo sapiens
gaucaggaguuugagaaca

SEQ ID NO: 1066741 - RNA, 19 nt, Homo sapiens
uaaacaaacuacaccugau

SEQ ID NO: 1066742 - RNA, 19 nt, Homo sapiens
caggcagguuugugaauuu

SEQ ID NO: 1066743 - RNA, 19 nt, Homo sapiens
ccaggcagguuugugaauu

SEQ ID NO: 1066744 - RNA, 19 nt, Homo sapiens
ucauggauuugaucaagaa

SEQ ID NO: 1066745 - RNA, 19 nt, Homo sapiens
gaaaggaauagaagacgau

SEQ ID NO: 1066746 - RNA, 19 nt, Homo sapiens
gauacuacagucuagauga

SEQ ID NO: 1066747 - RNA, 19 nt, Homo sapiens
gcagugagccaagaucaug

SEQ ID NO: 1066748 - RNA, 19 nt, Homo sapiens
aaacaaacuacaccugauu

SEQ ID NO: 1066749 - RNA, 19 nt, Homo sapiens
gggcgcagacccacaguuu

SEQ ID NO: 1066750 - RNA, 19 nt, Homo sapiens
ggugucaucugccauugga

SEQ ID NO: 1066751 - RNA, 19 nt, Homo sapiens
gaggaguucugccggacuu

SEQ ID NO: 1066752 - RNA, 19 nt, Homo sapiens
gagaucaggaguuugagaa

SEQ ID NO: 1066753 - RNA, 19 nt, Homo sapiens
gcccugacuuggacuaaau

SEQ ID NO: 1066754 - RNA, 19 nt, Homo sapiens
gaacagccuggccaacaug

SEQ ID NO: 1066755 - RNA, 19 nt, Homo sapiens
gguauaggaggucaagaaa

SEQ ID NO: 1066756 - RNA, 19 nt, Homo sapiens
cacaugaccugcaaagucu

SEQ ID NO: 1066757 - RNA, 19 nt, Homo sapiens
agaagacgaucucauggau

SEQ ID NO: 1066758 - RNA, 19 nt, Homo sapiens
uaauaacaaccacacauug

SEQ ID NO: 1066759 - RNA, 19 nt, Homo sapiens
ggacgcguuucccgcagaa

SEQ ID NO: 1066760 - RNA, 19 nt, Homo sapiens
ugaaacagcacucaguaau

SEQ ID NO: 1066761 - RNA, 19 nt, Homo sapiens
cgaaaucccuugacaaaag

SEQ ID NO: 1066762 - RNA, 19 nt, Homo sapiens
gaauuggcccugacuugga

SEQ ID NO: 1066763 - RNA, 19 nt, Homo sapiens
guuagcauauggucaaagu

SEQ ID NO: 1066764 - RNA, 19 nt, Homo sapiens
gagcgaaugauccuggaaa

SEQ ID NO: 1066765 - RNA, 19 nt, Homo sapiens
cacaaccucuugcugaaau

SEQ ID NO: 1066766 - RNA, 19 nt, Homo sapiens
gaagacgaucucauggauu

SEQ ID NO: 1066767 - RNA, 19 nt, Homo sapiens
uuccaaagcugguuacaca

SEQ ID NO: 1066768 - RNA, 19 nt, Homo sapiens
uggacuaaaugcacuaaug

SEQ ID NO: 1066769 - RNA, 19 nt, Homo sapiens
uagaacugcauuuccuuua

SEQ ID NO: 1066770 - RNA, 19 nt, Homo sapiens
gagaacagccuggccaaca

SEQ ID NO: 1066771 - RNA, 19 nt, Homo sapiens
cuaauaacaaccacacauu

SEQ ID NO: 1066772 - RNA, 19 nt, Homo sapiens
gaaaaggaguucgguaaag

SEQ ID NO: 1066773 - RNA, 19 nt, Homo sapiens
gaccugcaaagucuauuaa

SEQ ID NO: 1066774 - RNA, 19 nt, Homo sapiens
gcugaaauccuguuuugua

SEQ ID NO: 1066775 - RNA, 19 nt, Homo sapiens
ccugcaaagucuauuaaau

SEQ ID NO: 1066776 - RNA, 19 nt, Homo sapiens
aaaggaaagcgaauggaaa

SEQ ID NO: 1066777 - RNA, 19 nt, Homo sapiens
ucugagacuucugaugaua

SEQ ID NO: 1066778 - RNA, 19 nt, Homo sapiens
ggcccuguccugaauuaua

SEQ ID NO: 1066779 - RNA, 19 nt, Homo sapiens
cacacaaccucuugcugaa

SEQ ID NO: 1066780 - RNA, 19 nt, Homo sapiens
gaaaauuguucaccgauac

SEQ ID NO: 1066781 - RNA, 19 nt, Homo sapiens
aaacagcacucaguaaucc

SEQ ID NO: 1066782 - RNA, 19 nt, Homo sapiens
acagcugucugccuuguug

SEQ ID NO: 1066783 - RNA, 19 nt, Homo sapiens
cagcgguuguucuguguga

SEQ ID NO: 1066784 - RNA, 19 nt, Homo sapiens
uaugaaacagcacucagua

SEQ ID NO: 1066785 - RNA, 19 nt, Homo sapiens
aggcagguuugugaauuua

SEQ ID NO: 1066786 - RNA, 19 nt, Homo sapiens
aauagaagacgaucucaug

SEQ ID NO: 1066787 - RNA, 19 nt, Homo sapiens
ggacuaaaugcacuaaugc

SEQ ID NO: 1066788 - RNA, 19 nt, Homo sapiens
caggagauccgucuaacug

SEQ ID NO: 1066789 - RNA, 19 nt, Homo sapiens
guucaucuccuuuccuuuc

SEQ ID NO: 1066790 - RNA, 19 nt, Homo sapiens
gucaaagucugccuaucga

SEQ ID NO: 1066791 - RNA, 19 nt, Homo sapiens
cuaaugcuguguuucucaa

SEQ ID NO: 1066792 - RNA, 19 nt, Homo sapiens
ugaccugcaaagucuauua

SEQ ID NO: 1066793 - RNA, 19 nt, Homo sapiens
gguuacacaugaccugcaa

SEQ ID NO: 1066794 - RNA, 19 nt, Homo sapiens
ccaaagcugguuacacaug

SEQ ID NO: 1066795 - RNA, 19 nt, Homo sapiens
ggucaaagucugccuaucg

SEQ ID NO: 1066796 - RNA, 19 nt, Homo sapiens
caaauccgcugcuaaauua

SEQ ID NO: 1066797 - RNA, 19 nt, Homo sapiens
gaaggaagauugaguuuca

SEQ ID NO: 1066798 - RNA, 19 nt, Homo sapiens
ggauaccacuccauuaaua

SEQ ID NO: 1066799 - RNA, 19 nt, Homo sapiens
aaagugagauuguagguua

SEQ ID NO: 1066800 - RNA, 19 nt, Homo sapiens
gauuguagguuaucaguaa

SEQ ID NO: 1066801 - RNA, 19 nt, Homo sapiens
ccauauuucucaccuauua

SEQ ID NO: 1066802 - RNA, 19 nt, Homo sapiens
ggauaaacuuucuacagua

SEQ ID NO: 1066803 - RNA, 19 nt, Homo sapiens
gaaguuacagcccauauuu

SEQ ID NO: 1066804 - RNA, 19 nt, Homo sapiens
ugaaccagcuaacucauua

SEQ ID NO: 1066805 - RNA, 19 nt, Homo sapiens
guacauaaauacacacaga

SEQ ID NO: 1066806 - RNA, 19 nt, Homo sapiens
gaaauaaagggucuacaaa

SEQ ID NO: 1066807 - RNA, 19 nt, Homo sapiens
guaaaugcauaguugguaa

SEQ ID NO: 1066808 - RNA, 19 nt, Homo sapiens
caucuugacuggagccuua

SEQ ID NO: 1066809 - RNA, 19 nt, Homo sapiens
acacagauauguugcuaaa

SEQ ID NO: 1066810 - RNA, 19 nt, Homo sapiens
gauauuacauuguccaaag

SEQ ID NO: 1066811 - RNA, 19 nt, Homo sapiens
ggaaauaaagggucuacaa

SEQ ID NO: 1066812 - RNA, 19 nt, Homo sapiens
caaauuagucucuccguuu

SEQ ID NO: 1066813 - RNA, 19 nt, Homo sapiens
gagcagaccuaaccuuugg

SEQ ID NO: 1066814 - RNA, 19 nt, Homo sapiens
uggcaccucuguuaucuua

SEQ ID NO: 1066815 - RNA, 19 nt, Homo sapiens
gacauucucuucuaucaau

SEQ ID NO: 1066816 - RNA, 19 nt, Homo sapiens
ggagagccuuaccuucuaa

SEQ ID NO: 1066817 - RNA, 19 nt, Homo sapiens
uaacagagcaugugaucaa

SEQ ID NO: 1066818 - RNA, 19 nt, Homo sapiens
ggagagaucaugcugagaa

SEQ ID NO: 1066819 - RNA, 19 nt, Homo sapiens
gggagagccuuaccuucua

SEQ ID NO: 1066820 - RNA, 19 nt, Homo sapiens
gggagaaaaugauguguua

SEQ ID NO: 1066821 - RNA, 19 nt, Homo sapiens
acacaaguauauucacgua

SEQ ID NO: 1066822 - RNA, 19 nt, Homo sapiens
cagauaaaguccauucuca

SEQ ID NO: 1066823 - RNA, 19 nt, Homo sapiens
aguaguaagugcuuucaua

SEQ ID NO: 1066824 - RNA, 19 nt, Homo sapiens
gguugucaaucugauauua

SEQ ID NO: 1066825 - RNA, 19 nt, Homo sapiens
gagagaucaugcugagaaa

SEQ ID NO: 1066826 - RNA, 19 nt, Homo sapiens
gauaaacuuucuacaguac

SEQ ID NO: 1066827 - RNA, 19 nt, Homo sapiens
acagauauguugcuaaagu

SEQ ID NO: 1066828 - RNA, 19 nt, Homo sapiens
gauaaaguccauucucaga

SEQ ID NO: 1066829 - RNA, 19 nt, Homo sapiens
uaaacuauauccugaagca

SEQ ID NO: 1066830 - RNA, 19 nt, Homo sapiens
uaucuuggcaccucuguua

SEQ ID NO: 1066831 - RNA, 19 nt, Homo sapiens
cugaugaacuguuuaugaa

SEQ ID NO: 1066832 - RNA, 19 nt, Homo sapiens
uguggagccuucucaauaa

SEQ ID NO: 1066833 - RNA, 19 nt, Homo sapiens
gaagauugaguuucauuca

SEQ ID NO: 1066834 - RNA, 19 nt, Homo sapiens
ggaguacucuauggaucua

SEQ ID NO: 1066835 - RNA, 19 nt, Homo sapiens
ucaaauccgcugcuaaauu

SEQ ID NO: 1066836 - RNA, 19 nt, Homo sapiens
gagaaugaaggaagauuga

SEQ ID NO: 1066837 - RNA, 19 nt, Homo sapiens
gcagguggcagcaguaguu

SEQ ID NO: 1066838 - RNA, 19 nt, Homo sapiens
uaucaaauccgcugcuaaa

SEQ ID NO: 1066839 - RNA, 19 nt, Homo sapiens
ugagugcuguggucaguuu

SEQ ID NO: 1066840 - RNA, 19 nt, Homo sapiens
cauuaagacuggaaucaug

SEQ ID NO: 1066841 - RNA, 19 nt, Homo sapiens
gcccauauuucucaccuau

SEQ ID NO: 1066842 - RNA, 19 nt, Homo sapiens
guacuuuacugggugacua

SEQ ID NO: 1066843 - RNA, 19 nt, Homo sapiens
ggcaagccaauaugauuua

SEQ ID NO: 1066844 - RNA, 19 nt, Homo sapiens
gauaccacuccauuaauaa

SEQ ID NO: 1066845 - RNA, 19 nt, Homo sapiens
uggauaaacuuucuacagu

SEQ ID NO: 1066846 - RNA, 19 nt, Homo sapiens
gagcugggcuaucaguagu

SEQ ID NO: 1066847 - RNA, 19 nt, Homo sapiens
ucacguacauaaauacaca

SEQ ID NO: 1066848 - RNA, 19 nt, Homo sapiens
gggcaagccaauaugauuu

SEQ ID NO: 1066849 - RNA, 19 nt, Homo sapiens
uggauuggaugcagaagaa

SEQ ID NO: 1066850 - RNA, 19 nt, Homo sapiens
cugcaucucugaccuguug

SEQ ID NO: 1066851 - RNA, 19 nt, Homo sapiens
gcuguugguucauagcaaa

SEQ ID NO: 1066852 - RNA, 19 nt, Homo sapiens
gcagugauaucuggaguac

SEQ ID NO: 1066853 - RNA, 19 nt, Homo sapiens
gcagaagaaguaucaaauc

SEQ ID NO: 1066854 - RNA, 19 nt, Homo sapiens
gaucuacauuugugccaau

SEQ ID NO: 1066855 - RNA, 19 nt, Homo sapiens
auagugggcugcagucuug

SEQ ID NO: 1066856 - RNA, 19 nt, Homo sapiens
acaaguauauucacguaca

SEQ ID NO: 1066857 - RNA, 19 nt, Homo sapiens
guuaagagaacgcgucuau

SEQ ID NO: 1066858 - RNA, 19 nt, Homo sapiens
uaaagggucuacaaaacua

SEQ ID NO: 1066859 - RNA, 19 nt, Homo sapiens
guaguaagugcuuucauau

SEQ ID NO: 1066860 - RNA, 19 nt, Homo sapiens
guacaucaagucuaaagug

SEQ ID NO: 1066861 - RNA, 19 nt, Homo sapiens
acacacagauauguugcua

SEQ ID NO: 1066862 - RNA, 19 nt, Homo sapiens
gugaagugaggcagaaaua

SEQ ID NO: 1066863 - RNA, 19 nt, Homo sapiens
gccaauaugauuuagacua

SEQ ID NO: 1066864 - RNA, 19 nt, Homo sapiens
cauuggagcugggcuauca

SEQ ID NO: 1066865 - RNA, 19 nt, Homo sapiens
ggaaucaugagcaacaaug

SEQ ID NO: 1066866 - RNA, 19 nt, Homo sapiens
uacaucaagucuaaaguga

SEQ ID NO: 1066867 - RNA, 19 nt, Homo sapiens
gaaacaaccacucuuuuga

SEQ ID NO: 1066868 - RNA, 19 nt, Homo sapiens
uagaguccauauacaaaga

SEQ ID NO: 1066869 - RNA, 19 nt, Homo sapiens
caucaaggaccacagcaaa

SEQ ID NO: 1066870 - RNA, 19 nt, Homo sapiens
gcugggcuaucaguaguaa

SEQ ID NO: 1066871 - RNA, 19 nt, Homo sapiens
gcugcuaaauuacauugga

SEQ ID NO: 1066872 - RNA, 19 nt, Homo sapiens
gcuguugucccaauuauca

SEQ ID NO: 1066873 - RNA, 19 nt, Homo sapiens
caacaauggagcagaccua

SEQ ID NO: 1066874 - RNA, 19 nt, Homo sapiens
ccagcuaacucauuaagac

SEQ ID NO: 1066875 - RNA, 19 nt, Homo sapiens
ggguggcgcacuacuauaa

SEQ ID NO: 1066876 - RNA, 19 nt, Homo sapiens
caaccacucuuuugaaugu

SEQ ID NO: 1066877 - RNA, 19 nt, Homo sapiens
cuacaucaucuacccauuu

SEQ ID NO: 1066878 - RNA, 19 nt, Homo sapiens
gcgaggagggagagccuua

SEQ ID NO: 1066879 - RNA, 19 nt, Homo sapiens
gcucaagguuuggcugguu

SEQ ID NO: 1066880 - RNA, 19 nt, Homo sapiens
caucaagucuaaagugaac

SEQ ID NO: 1066881 - RNA, 19 nt, Homo sapiens
gaucucagccacuguugga

SEQ ID NO: 1066882 - RNA, 19 nt, Homo sapiens
gaauuaaaauggggagaaa

SEQ ID NO: 1066883 - RNA, 19 nt, Homo sapiens
ggaguacuuugggcuauag

SEQ ID NO: 1066884 - RNA, 19 nt, Homo sapiens
aaauuagucucuccguuuc

SEQ ID NO: 1066885 - RNA, 19 nt, Homo sapiens
caagacacuuccugcaucu

SEQ ID NO: 1066886 - RNA, 19 nt, Homo sapiens
gcaggguggcgcacuacua

SEQ ID NO: 1066887 - RNA, 19 nt, Homo sapiens
ggagggagagccuuaccuu

SEQ ID NO: 1066888 - RNA, 19 nt, Homo sapiens
ccagugaagugaggcagaa

SEQ ID NO: 1066889 - RNA, 19 nt, Homo sapiens
uugccacucuugaagguua

SEQ ID NO: 1066890 - RNA, 19 nt, Homo sapiens
guggagccuucucaauaaa

SEQ ID NO: 1066891 - RNA, 19 nt, Homo sapiens
ggaugcagaagaaguauca

SEQ ID NO: 1066892 - RNA, 19 nt, Homo sapiens
ggagcagaccuaaccuuug

SEQ ID NO: 1066893 - RNA, 19 nt, Homo sapiens
gcaaggucccaucucuaaa

SEQ ID NO: 1066894 - RNA, 19 nt, Homo sapiens
uaauaucgcccaacucuac

SEQ ID NO: 1066895 - RNA, 19 nt, Homo sapiens
guauguaccuaguguugca

SEQ ID NO: 1066896 - RNA, 19 nt, Homo sapiens
gcacauacaucaucuucuu

SEQ ID NO: 1066897 - RNA, 19 nt, Homo sapiens
caacuuugcugaccuaugu

SEQ ID NO: 1066898 - RNA, 19 nt, Homo sapiens
ccauggaacuucuuuauca

SEQ ID NO: 1066899 - RNA, 19 nt, Homo sapiens
guacaacuuugcugaccua

SEQ ID NO: 1066900 - RNA, 19 nt, Homo sapiens
uaacugcacuggugaaggu

SEQ ID NO: 1066901 - RNA, 19 nt, Homo sapiens
gaacucccaggcacugaua

SEQ ID NO: 1066902 - RNA, 19 nt, Homo sapiens
ugaacuacuuugagagcua

SEQ ID NO: 1066903 - RNA, 19 nt, Homo sapiens
uggugaagguggacacuuu

SEQ ID NO: 1066904 - RNA, 19 nt, Homo sapiens
ucacuaccuuccuccugua

SEQ ID NO: 1066905 - RNA, 19 nt, Homo sapiens
uaauggccguugucucaga

SEQ ID NO: 1066906 - RNA, 19 nt, Homo sapiens
cagacauccugaacuacuu

SEQ ID NO: 1066907 - RNA, 19 nt, Homo sapiens
gaguggugauguccuuuua

SEQ ID NO: 1066908 - RNA, 19 nt, Homo sapiens
cggcaugaccggcuccuuu

SEQ ID NO: 1066909 - RNA, 19 nt, Homo sapiens
uaugugugcuugggcuuaa

SEQ ID NO: 1066910 - RNA, 19 nt, Homo sapiens
ggacgacuuucagcacagu

SEQ ID NO: 1066911 - RNA, 19 nt, Homo sapiens
gccaaggaguacuggaugu

SEQ ID NO: 1066912 - RNA, 19 nt, Homo sapiens
cuaccuuccuccuguacaa

SEQ ID NO: 1066913 - RNA, 19 nt, Homo sapiens
caacaucgagucccucaac

SEQ ID NO: 1066914 - RNA, 19 nt, Homo sapiens
ucaccuacgucuucuucau

SEQ ID NO: 1066915 - RNA, 19 nt, Homo sapiens
aggaggcacugcuugagaa

SEQ ID NO: 1066916 - RNA, 19 nt, Homo sapiens
gccuccagauucauugauu

SEQ ID NO: 1066917 - RNA, 19 nt, Homo sapiens
ccaacuuccugcuugucaa

SEQ ID NO: 1066918 - RNA, 19 nt, Homo sapiens
uaugccagguacuacauga

SEQ ID NO: 1066919 - RNA, 19 nt, Homo sapiens
gaccggcuccuuuccuaug

SEQ ID NO: 1066920 - RNA, 19 nt, Homo sapiens
ucagcgccguggccucauu

SEQ ID NO: 1066921 - RNA, 19 nt, Homo sapiens
ucucagaggacgacuuuca

SEQ ID NO: 1066922 - RNA, 19 nt, Homo sapiens
gcguccaccugaagacugu

SEQ ID NO: 1066923 - RNA, 19 nt, Homo sapiens
aaggaguacuggauguuca

SEQ ID NO: 1066924 - RNA, 19 nt, Homo sapiens
ucgguggccuccagauuca

SEQ ID NO: 1066925 - RNA, 19 nt, Homo sapiens
ugucucagaggacgacuuu

SEQ ID NO: 1066926 - RNA, 19 nt, Homo sapiens
cuacugccauggaacuucu

SEQ ID NO: 1066927 - RNA, 19 nt, Homo sapiens
caucgagucccucaacaag

SEQ ID NO: 1066928 - RNA, 19 nt, Homo sapiens
ccagugaugugaggaacag

SEQ ID NO: 1066929 - RNA, 19 nt, Homo sapiens
cauccuggccaucuucaug

SEQ ID NO: 1066930 - RNA, 19 nt, Homo sapiens
agacauccugaacuacuuu

SEQ ID NO: 1066931 - RNA, 19 nt, Homo sapiens
ccucuacgggccuaagauu

SEQ ID NO: 1066932 - RNA, 19 nt, Homo sapiens
caaggaguacuggauguuc

SEQ ID NO: 1066933 - RNA, 19 nt, Homo sapiens
ccaaggaguacuggauguu

SEQ ID NO: 1066934 - RNA, 19 nt, Homo sapiens
cgggaguggugauguccuu

SEQ ID NO: 1066935 - RNA, 19 nt, Homo sapiens
cuacgggccuaagauugug

SEQ ID NO: 1066936 - RNA, 19 nt, Homo sapiens
caggaggcacugcuugaga

SEQ ID NO: 1066937 - RNA, 19 nt, Homo sapiens
ccuccagauucauugauuc

SEQ ID NO: 1066938 - RNA, 19 nt, Homo sapiens
uacaugaggccuguucuug

SEQ ID NO: 1066939 - RNA, 19 nt, Homo sapiens
auccugaacuacuuugaga

SEQ ID NO: 1066940 - RNA, 19 nt, Homo sapiens
ggaguacuggauguucaaa

SEQ ID NO: 1066941 - RNA, 19 nt, Homo sapiens
ggaacucccaggcacugau

SEQ ID NO: 1066942 - RNA, 19 nt, Homo sapiens
ggcaugaccggcuccuuuc

SEQ ID NO: 1066943 - RNA, 19 nt, Homo sapiens
gguggccuccagauucauu

SEQ ID NO: 1066944 - RNA, 19 nt, Homo sapiens
ggaguaagguccuaagaua

SEQ ID NO: 1066945 - RNA, 19 nt, Homo sapiens
ggaaagacccaaaguguuu

SEQ ID NO: 1066946 - RNA, 19 nt, Homo sapiens
gaagggaucuacuauagga

SEQ ID NO: 1066947 - RNA, 19 nt, Homo sapiens
uaagauagcuggaugaauc

SEQ ID NO: 1066948 - RNA, 19 nt, Homo sapiens
cagaaggacugauguaugu

SEQ ID NO: 1066949 - RNA, 19 nt, Homo sapiens
gaacacagaaggacugaug

SEQ ID NO: 1066950 - RNA, 19 nt, Homo sapiens
guuaacagguugucuauag

SEQ ID NO: 1066951 - RNA, 19 nt, Homo sapiens
cuacagaaauggucacaug

SEQ ID NO: 1066952 - RNA, 19 nt, Homo sapiens
gagaagcgcugcaguuacu

SEQ ID NO: 1066953 - RNA, 19 nt, Homo sapiens
ggagagaauucgggaaaga

SEQ ID NO: 1066954 - RNA, 19 nt, Homo sapiens
gagaaggaaucaugguuuc

SEQ ID NO: 1066955 - RNA, 19 nt, Homo sapiens
ccacaucagcuucuguuua

SEQ ID NO: 1066956 - RNA, 19 nt, Homo sapiens
ggucacaugguucuauuua

SEQ ID NO: 1066957 - RNA, 19 nt, Homo sapiens
gaagugaacauuggagaaa

SEQ ID NO: 1066958 - RNA, 19 nt, Homo sapiens
ggagaaggaaucaugguuu

SEQ ID NO: 1066959 - RNA, 19 nt, Homo sapiens
ugaaggaggugaugcuguu

SEQ ID NO: 1066960 - RNA, 19 nt, Homo sapiens
gcgagaagcgcugcaguua

SEQ ID NO: 1066961 - RNA, 19 nt, Homo sapiens
gaaggaaucaugguuucua

SEQ ID NO: 1066962 - RNA, 19 nt, Homo sapiens
ugaaagggauagagaagug

SEQ ID NO: 1066963 - RNA, 19 nt, Homo sapiens
ggaaucaugguuucuagaa

SEQ ID NO: 1066964 - RNA, 19 nt, Homo sapiens
gguggagucuguguucuuu

SEQ ID NO: 1066965 - RNA, 19 nt, Homo sapiens
cagaaauggucacaugguu

SEQ ID NO: 1066966 - RNA, 19 nt, Homo sapiens
ggcaggaaauucugaggaa

SEQ ID NO: 1066967 - RNA, 19 nt, Homo sapiens
gaaggacugauguauguug

SEQ ID NO: 1066968 - RNA, 19 nt, Homo sapiens
cuagaagugccucucauua

SEQ ID NO: 1066969 - RNA, 19 nt, Homo sapiens
gcucagaagaugcuacaaa

SEQ ID NO: 1066970 - RNA, 19 nt, Homo sapiens
uaugaggucuccaacuuug

SEQ ID NO: 1066971 - RNA, 19 nt, Homo sapiens
gaacuggcaucccauucag

SEQ ID NO: 1066972 - RNA, 19 nt, Homo sapiens
gaagguggguggaguugac

SEQ ID NO: 1066973 - RNA, 19 nt, Homo sapiens
ggauagagaagugaacauu

SEQ ID NO: 1066974 - RNA, 19 nt, Homo sapiens
ucucauuaguggacuuuaa

SEQ ID NO: 1066975 - RNA, 19 nt, Homo sapiens
gcaauuaccuccccaagag

SEQ ID NO: 1066976 - RNA, 19 nt, Homo sapiens
aggaagggaucuacuauag

SEQ ID NO: 1066977 - RNA, 19 nt, Homo sapiens
gcaggaagggaucuacuau

SEQ ID NO: 1066978 - RNA, 19 nt, Homo sapiens
cacaucagcuucuguuuac

SEQ ID NO: 1066979 - RNA, 19 nt, Homo sapiens
ggaacuggcaucccauuca

SEQ ID NO: 1066980 - RNA, 19 nt, Homo sapiens
gguaaugccagguggguuu

SEQ ID NO: 1066981 - RNA, 19 nt, Homo sapiens
gauagagaagugaacauug

SEQ ID NO: 1066982 - RNA, 19 nt, Homo sapiens
gaaauggucacaugguucu

SEQ ID NO: 1066983 - RNA, 19 nt, Homo sapiens
gggaaagacccaaaguguu

SEQ ID NO: 1066984 - RNA, 19 nt, Homo sapiens
agaagugccucucauuagu

SEQ ID NO: 1066985 - RNA, 19 nt, Homo sapiens
ggaaaaugcucagaagaug

SEQ ID NO: 1066986 - RNA, 19 nt, Homo sapiens
gaucuacuauaggaaugaa

SEQ ID NO: 1066987 - RNA, 19 nt, Homo sapiens
aguaugaggucuccaacuu

SEQ ID NO: 1066988 - RNA, 19 nt, Homo sapiens
acacugagcuccggcuguu

SEQ ID NO: 1066989 - RNA, 19 nt, Homo sapiens
uuaguggacuuuaaagcaa

SEQ ID NO: 1066990 - RNA, 19 nt, Homo sapiens
gaaucaugguuucuagaag

SEQ ID NO: 1066991 - RNA, 19 nt, Homo sapiens
uagcaacugugagaaauca

SEQ ID NO: 1066992 - RNA, 19 nt, Homo sapiens
gaagugccucucauuagug

SEQ ID NO: 1066993 - RNA, 19 nt, Homo sapiens
gcucgcagcugagauguac

SEQ ID NO: 1066994 - RNA, 19 nt, Homo sapiens
gucacaugguucuauuuaa

SEQ ID NO: 1066995 - RNA, 19 nt, Homo sapiens
aaucaugguuucuagaagu

SEQ ID NO: 1066996 - RNA, 19 nt, Homo sapiens
ccacugaaagggauagaga

SEQ ID NO: 1066997 - RNA, 19 nt, Homo sapiens
caggaagggaucuacuaua

SEQ ID NO: 1066998 - RNA, 19 nt, Homo sapiens
guagaugggaggacauuuc

SEQ ID NO: 1066999 - RNA, 19 nt, Homo sapiens
gaauggcagcagugaggua

SEQ ID NO: 1067000 - RNA, 19 nt, Homo sapiens
gcagaugauguacuggaaa

SEQ ID NO: 1067001 - RNA, 19 nt, Homo sapiens
gaaagggauagagaaguga

SEQ ID NO: 1067002 - RNA, 19 nt, Homo sapiens
ggucgguacugcagacauc

SEQ ID NO: 1067003 - RNA, 19 nt, Homo sapiens
guaugaggucuccaacuuu

SEQ ID NO: 1067004 - RNA, 19 nt, Homo sapiens
auagagaagugaacauugg

SEQ ID NO: 1067005 - RNA, 19 nt, Homo sapiens
ggacucacaggccaacaug

SEQ ID NO: 1067006 - RNA, 19 nt, Homo sapiens
ucugagaacugggaaagau

SEQ ID NO: 1067007 - RNA, 19 nt, Homo sapiens
acacagaaggacugaugua

SEQ ID NO: 1067008 - RNA, 19 nt, Homo sapiens
ugaggaauauagcucuuag

SEQ ID NO: 1067009 - RNA, 19 nt, Homo sapiens
guugguggauccauguaug

SEQ ID NO: 1067010 - RNA, 19 nt, Homo sapiens
gcaguguggucaguaccuu

SEQ ID NO: 1067011 - RNA, 19 nt, Homo sapiens
uagaagugccucucauuag

SEQ ID NO: 1067012 - RNA, 19 nt, Homo sapiens
gggaucuacuauaggaaug

SEQ ID NO: 1067013 - RNA, 19 nt, Homo sapiens
guacccacaauuggacuua

SEQ ID NO: 1067014 - RNA, 19 nt, Homo sapiens
cgggaaaccagaauauguu

SEQ ID NO: 1067015 - RNA, 19 nt, Homo sapiens
gagaaagccaguagcaacu

SEQ ID NO: 1067016 - RNA, 19 nt, Homo sapiens
ggaggcuaauccuacuuca

SEQ ID NO: 1067017 - RNA, 19 nt, Homo sapiens
gaaggaggugaugcuguuu

SEQ ID NO: 1067018 - RNA, 19 nt, Homo sapiens
cgggaaagacccaaagugu

SEQ ID NO: 1067019 - RNA, 19 nt, Homo sapiens
uaguggacuuuaaagcaaa

SEQ ID NO: 1067020 - RNA, 19 nt, Homo sapiens
cacaaaagcagaugaugua

SEQ ID NO: 1067021 - RNA, 19 nt, Homo sapiens
ugugagaaaucagcaacuu

SEQ ID NO: 1067022 - RNA, 19 nt, Homo sapiens
gaguaagguccuaagauag

SEQ ID NO: 1067023 - RNA, 19 nt, Homo sapiens
guacugcagacaucucuuc

SEQ ID NO: 1067024 - RNA, 19 nt, Homo sapiens
gaauauguuugggguggua

SEQ ID NO: 1067025 - RNA, 19 nt, Homo sapiens
gcacaaaagcagaugaugu

SEQ ID NO: 1067026 - RNA, 19 nt, Homo sapiens
cagcagggguuaacagguu

SEQ ID NO: 1067027 - RNA, 19 nt, Homo sapiens
gguaggagccacacagacu

SEQ ID NO: 1067028 - RNA, 19 nt, Homo sapiens
acagaaggacugauguaug

SEQ ID NO: 1067029 - RNA, 19 nt, Homo sapiens
cagaugauguacuggaaaa

SEQ ID NO: 1067030 - RNA, 19 nt, Homo sapiens
aaaagcagaugauguacug

SEQ ID NO: 1067031 - RNA, 19 nt, Homo sapiens
gaaaacuccugcugauggu

SEQ ID NO: 1067032 - RNA, 19 nt, Homo sapiens
gagccugacaacuggauga

SEQ ID NO: 1067033 - RNA, 19 nt, Homo sapiens
ccucuuaucuucgggaaac

SEQ ID NO: 1067034 - RNA, 19 nt, Homo sapiens
gcucaguacccacaauugg

SEQ ID NO: 1067035 - RNA, 19 nt, Homo sapiens
gcgcucaguacccacaauu

SEQ ID NO: 1067036 - RNA, 19 nt, Homo sapiens
cagcuucuguuuaccuuuu

SEQ ID NO: 1067037 - RNA, 19 nt, Homo sapiens
gcccauggacgauuuaugc

SEQ ID NO: 1067038 - RNA, 19 nt, Homo sapiens
ucucugcuccuugugguua

SEQ ID NO: 1067039 - RNA, 19 nt, Homo sapiens
gggagagaauucgggaaag

SEQ ID NO: 1067040 - RNA, 19 nt, Homo sapiens
agccuugccucuuaucuuc

SEQ ID NO: 1067041 - RNA, 19 nt, Homo sapiens
gagaacacagaaggacuga

SEQ ID NO: 1067042 - RNA, 19 nt, Homo sapiens
ggaagggaucuacuauagg

SEQ ID NO: 1067043 - RNA, 19 nt, Homo sapiens
cagcaucucaggacucaca

SEQ ID NO: 1067044 - RNA, 19 nt, Homo sapiens
gccuagagcugcuguguua

SEQ ID NO: 1067045 - RNA, 19 nt, Homo sapiens
gcucugaugugcugcuaua

SEQ ID NO: 1067046 - RNA, 19 nt, Homo sapiens
gagagaaguugcugucaga

SEQ ID NO: 1067047 - RNA, 19 nt, Homo sapiens
uagccuggaugacauauuu

SEQ ID NO: 1067048 - RNA, 19 nt, Homo sapiens
agaaguugcugucagauga

SEQ ID NO: 1067049 - RNA, 19 nt, Homo sapiens
gcugagaagucaccugaug

SEQ ID NO: 1067050 - RNA, 19 nt, Homo sapiens
gaaaugcaucugccaauca

SEQ ID NO: 1067051 - RNA, 19 nt, Homo sapiens
ugacacgccuccuccuuga

SEQ ID NO: 1067052 - RNA, 19 nt, Homo sapiens
gcagguagagucaaugugu

SEQ ID NO: 1067053 - RNA, 19 nt, Homo sapiens
caggcaggcucgagauaaa

SEQ ID NO: 1067054 - RNA, 19 nt, Homo sapiens
cagccacgcuuguccuuga

SEQ ID NO: 1067055 - RNA, 19 nt, Homo sapiens
gagcugcuguguuacuuag

SEQ ID NO: 1067056 - RNA, 19 nt, Homo sapiens
acacaagccugcagaaagg

SEQ ID NO: 1067057 - RNA, 19 nt, Homo sapiens
gcaguauuaucaacaaggu

SEQ ID NO: 1067058 - RNA, 19 nt, Homo sapiens
gaaaccccaucucuacuaa

SEQ ID NO: 1067059 - RNA, 19 nt, Homo sapiens
ccacagucaucgaaacaca

SEQ ID NO: 1067060 - RNA, 19 nt, Homo sapiens
gaaccugggaggcagaguu

SEQ ID NO: 1067061 - RNA, 19 nt, Homo sapiens
gguccacgccuuccucauu

SEQ ID NO: 1067062 - RNA, 19 nt, Homo sapiens
ccacuuaggcaguauuauc

SEQ ID NO: 1067063 - RNA, 19 nt, Homo sapiens
ccaggcagguagagucaau

SEQ ID NO: 1067064 - RNA, 19 nt, Homo sapiens
gacacaagccugcagaaag

SEQ ID NO: 1067065 - RNA, 19 nt, Homo sapiens
ccacauggucagcugcuuu

SEQ ID NO: 1067066 - RNA, 19 nt, Homo sapiens
gaaguugcugucagaugaa

SEQ ID NO: 1067067 - RNA, 19 nt, Homo sapiens
gagaaguugcugucagaug

SEQ ID NO: 1067068 - RNA, 19 nt, Homo sapiens
acaagguccugcucagugu

SEQ ID NO: 1067069 - RNA, 19 nt, Homo sapiens
aaaauuagcuggguguaug

SEQ ID NO: 1067070 - RNA, 19 nt, Homo sapiens
guccacgccuuccucauuc

SEQ ID NO: 1067071 - RNA, 19 nt, Homo sapiens
gaggcagaguuugcaguga

SEQ ID NO: 1067072 - RNA, 19 nt, Homo sapiens
ucacagccuucccucaucu

SEQ ID NO: 1067073 - RNA, 19 nt, Homo sapiens
agaaaugcaucugccaauc

SEQ ID NO: 1067074 - RNA, 19 nt, Homo sapiens
ccaggcaggcucgagauaa

SEQ ID NO: 1067075 - RNA, 19 nt, Homo sapiens
gcccacuuaggcaguauua

SEQ ID NO: 1067076 - RNA, 19 nt, Homo sapiens
ccuguaaucccagcacuuu

SEQ ID NO: 1067077 - RNA, 19 nt, Homo sapiens
ugacacaagccugcagaaa

SEQ ID NO: 1067078 - RNA, 19 nt, Homo sapiens
caacgaccaguuuguccaa

SEQ ID NO: 1067079 - RNA, 19 nt, Homo sapiens
gcuguacuccugcgucuuc

SEQ ID NO: 1067080 - RNA, 19 nt, Homo sapiens
uaggcaguauuaucaacaa

SEQ ID NO: 1067081 - RNA, 19 nt, Homo sapiens
cagccgcaauccucagaug

SEQ ID NO: 1067082 - RNA, 19 nt, Homo sapiens
gaagugccuugcgccucaa

SEQ ID NO: 1067083 - RNA, 19 nt, Homo sapiens
ggacaagugggugacacaa

SEQ ID NO: 1067084 - RNA, 19 nt, Homo sapiens
caucacagccuucccucau

SEQ ID NO: 1067085 - RNA, 19 nt, Homo sapiens
ucaccggaguaagaaacua

SEQ ID NO: 1067086 - RNA, 19 nt, Homo sapiens
guagacacacagccagaug

SEQ ID NO: 1067087 - RNA, 19 nt, Homo sapiens
ggcagaggguagacacaca

SEQ ID NO: 1067088 - RNA, 19 nt, Homo sapiens
gcugggcgugcucucguua

SEQ ID NO: 1067089 - RNA, 19 nt, Homo sapiens
caacaagguccugcucagu

SEQ ID NO: 1067090 - RNA, 19 nt, Homo sapiens
uagagcugcuguguuacuu

SEQ ID NO: 1067091 - RNA, 19 nt, Homo sapiens
agcacuggcugugugauuu

SEQ ID NO: 1067092 - RNA, 19 nt, Homo sapiens
agacacacagccagaugaa

SEQ ID NO: 1067093 - RNA, 19 nt, Homo sapiens
aaaugcaucugccaaucag

SEQ ID NO: 1067094 - RNA, 19 nt, Homo sapiens
acagucaucgaaacacaaa

SEQ ID NO: 1067095 - RNA, 19 nt, Homo sapiens
guugggauggugcuucuga

SEQ ID NO: 1067096 - RNA, 19 nt, Homo sapiens
cacuuaggcaguauuauca

SEQ ID NO: 1067097 - RNA, 19 nt, Homo sapiens
cagccuggccaacauagug

SEQ ID NO: 1067098 - RNA, 19 nt, Homo sapiens
cuacccagcagcucugaug

SEQ ID NO: 1067099 - RNA, 19 nt, Homo sapiens
gagccuagagcugcugugu

SEQ ID NO: 1067100 - RNA, 19 nt, Homo sapiens
gaacuuccugagccuagag

SEQ ID NO: 1067101 - RNA, 19 nt, Homo sapiens
cugaugugcugcuauacca

SEQ ID NO: 1067102 - RNA, 19 nt, Homo sapiens
uagacacacagccagauga

SEQ ID NO: 1067103 - RNA, 19 nt, Homo sapiens
cagcagagaacccuuucca

SEQ ID NO: 1067104 - RNA, 19 nt, Homo sapiens
gaucuaccaucauuguuua

SEQ ID NO: 1067105 - RNA, 19 nt, Homo sapiens
gcagagaagugauugugaa

SEQ ID NO: 1067106 - RNA, 19 nt, Homo sapiens
guaaggacauugagggaaa

SEQ ID NO: 1067107 - RNA, 19 nt, Homo sapiens
cggcaaacaugaagcauuu

SEQ ID NO: 1067108 - RNA, 19 nt, Homo sapiens
caacuugaauguccuuuua

SEQ ID NO: 1067109 - RNA, 19 nt, Homo sapiens
ggcaguaacuccauagaga

SEQ ID NO: 1067110 - RNA, 19 nt, Homo sapiens
gcaaggcaaucuggcagua

SEQ ID NO: 1067111 - RNA, 19 nt, Homo sapiens
gauauuccacaaugucuua

SEQ ID NO: 1067112 - RNA, 19 nt, Homo sapiens
uaaggaaacugagagaaga

SEQ ID NO: 1067113 - RNA, 19 nt, Homo sapiens
gaaaauugauguuccaguu

SEQ ID NO: 1067114 - RNA, 19 nt, Homo sapiens
gagaagugauugugaaggu

SEQ ID NO: 1067115 - RNA, 19 nt, Homo sapiens
caaccugucuguguucuug

SEQ ID NO: 1067116 - RNA, 19 nt, Homo sapiens
gccagugccuucugacaaa

SEQ ID NO: 1067117 - RNA, 19 nt, Homo sapiens
gaggaaggacccacuaaga

SEQ ID NO: 1067118 - RNA, 19 nt, Homo sapiens
caugcuggcucuagaaaga

SEQ ID NO: 1067119 - RNA, 19 nt, Homo sapiens
ggagagggacacucacaaa

SEQ ID NO: 1067120 - RNA, 19 nt, Homo sapiens
uuaccuaacucuagcuuuc

SEQ ID NO: 1067121 - RNA, 19 nt, Homo sapiens
cacaaugucuuaccuaacu

SEQ ID NO: 1067122 - RNA, 19 nt, Homo sapiens
uaugauccuucuuggagua

SEQ ID NO: 1067123 - RNA, 19 nt, Homo sapiens
ggucugcgcuccugugcau

SEQ ID NO: 1067124 - RNA, 19 nt, Homo sapiens
uguccuaccucaaauuaau

SEQ ID NO: 1067125 - RNA, 19 nt, Homo sapiens
gaaggacccacuaagaaca

SEQ ID NO: 1067126 - RNA, 19 nt, Homo sapiens
ccagaggguuacugcuaaa

SEQ ID NO: 1067127 - RNA, 19 nt, Homo sapiens
cgacauccauuucuuucuc

SEQ ID NO: 1067128 - RNA, 19 nt, Homo sapiens
gaaucacccuggcauuguc

SEQ ID NO: 1067129 - RNA, 19 nt, Homo sapiens
uugcagggcucacagauuc

SEQ ID NO: 1067130 - RNA, 19 nt, Homo sapiens
guaacuccauagagaggaa

SEQ ID NO: 1067131 - RNA, 19 nt, Homo sapiens
caucugucuuucugaguuu

SEQ ID NO: 1067132 - RNA, 19 nt, Homo sapiens
aaacucaaacucugaucua

SEQ ID NO: 1067133 - RNA, 19 nt, Homo sapiens
ggaaggacccacuaagaac

SEQ ID NO: 1067134 - RNA, 19 nt, Homo sapiens
gcaaacaugaagcauuuua

SEQ ID NO: 1067135 - RNA, 19 nt, Homo sapiens
ggugucaaguacucuguug

SEQ ID NO: 1067136 - RNA, 19 nt, Homo sapiens
cccagaggguuacugcuaa

SEQ ID NO: 1067137 - RNA, 19 nt, Homo sapiens
cagcauaaaggaacaacuu

SEQ ID NO: 1067138 - RNA, 19 nt, Homo sapiens
aaagugaggagaauaaauc

SEQ ID NO: 1067139 - RNA, 19 nt, Homo sapiens
gcccagaggguuacugcua

SEQ ID NO: 1067140 - RNA, 19 nt, Homo sapiens
gguaauagaggauccuaag

SEQ ID NO: 1067141 - RNA, 19 nt, Homo sapiens
guucaugugcucccagaaa

SEQ ID NO: 1067142 - RNA, 19 nt, Homo sapiens
uggaaucuauggaagaauc

SEQ ID NO: 1067143 - RNA, 19 nt, Homo sapiens
ucccuucucuggaaucuau

SEQ ID NO: 1067144 - RNA, 19 nt, Homo sapiens
uagccucccuucucuggaa

SEQ ID NO: 1067145 - RNA, 19 nt, Homo sapiens
uaauguaugauccuucuug

SEQ ID NO: 1067146 - RNA, 19 nt, Homo sapiens
gauguuccaguuacaguga

SEQ ID NO: 1067147 - RNA, 19 nt, Homo sapiens
uccaugauauuccacaaug

SEQ ID NO: 1067148 - RNA, 19 nt, Homo sapiens
caaggccucuucuacaaaa

SEQ ID NO: 1067149 - RNA, 19 nt, Homo sapiens
ccucaggucucagggaguu

SEQ ID NO: 1067150 - RNA, 19 nt, Homo sapiens
cugugucacuucucucuuu

SEQ ID NO: 1067151 - RNA, 19 nt, Homo sapiens
cucaaggccucuucuacaa

SEQ ID NO: 1067152 - RNA, 19 nt, Homo sapiens
aaauugauguuccaguuac

SEQ ID NO: 1067153 - RNA, 19 nt, Homo sapiens
uccacaaugucuuaccuaa

SEQ ID NO: 1067154 - RNA, 19 nt, Homo sapiens
ucacuucucucuuuucuca

SEQ ID NO: 1067155 - RNA, 19 nt, Homo sapiens
ccacuaagaacaccauuuu

SEQ ID NO: 1067156 - RNA, 19 nt, Homo sapiens
uuugaggacuaggguguua

SEQ ID NO: 1067157 - RNA, 19 nt, Homo sapiens
guacucuguugugugcuuu

SEQ ID NO: 1067158 - RNA, 19 nt, Homo sapiens
gcauugccuuggcuaacau

SEQ ID NO: 1067159 - RNA, 19 nt, Homo sapiens
ccgaagccauccagaacug

SEQ ID NO: 1067160 - RNA, 19 nt, Homo sapiens
ucuggaaucuauggaagaa

SEQ ID NO: 1067161 - RNA, 19 nt, Homo sapiens
aggaaggacccacuaagaa

SEQ ID NO: 1067162 - RNA, 19 nt, Homo sapiens
acaucugucuuucugaguu

SEQ ID NO: 1067163 - RNA, 19 nt, Homo sapiens
gggaagaugcugagaccau

SEQ ID NO: 1067164 - RNA, 19 nt, Homo sapiens
ggaggaaggacccacuaag

SEQ ID NO: 1067165 - RNA, 19 nt, Homo sapiens
gaggguuacugcuaaaaug

SEQ ID NO: 1067166 - RNA, 19 nt, Homo sapiens
ucaaggccucuucuacaaa

SEQ ID NO: 1067167 - RNA, 19 nt, Homo sapiens
uguguccuaccucaaauua

SEQ ID NO: 1067168 - RNA, 19 nt, Homo sapiens
ugccuuggcuaacauuuua

SEQ ID NO: 1067169 - RNA, 19 nt, Homo sapiens
uuacuuguccuucugaauc

SEQ ID NO: 1067170 - RNA, 19 nt, Homo sapiens
cuaaggaaacugagagaag

SEQ ID NO: 1067171 - RNA, 19 nt, Homo sapiens
gagggacccagcucaacuu

SEQ ID NO: 1067172 - RNA, 19 nt, Homo sapiens
caaggcaaucuggcaguaa

SEQ ID NO: 1067173 - RNA, 19 nt, Homo sapiens
cuaacucuagcuuucuaua

SEQ ID NO: 1067174 - RNA, 19 nt, Homo sapiens
aaucgacauccauuucuuu

SEQ ID NO: 1067175 - RNA, 19 nt, Homo sapiens
ccaugauauuccacaaugu

SEQ ID NO: 1067176 - RNA, 19 nt, Homo sapiens
ucccacaucugucuuucug

SEQ ID NO: 1067177 - RNA, 19 nt, Homo sapiens
ucagugcugucccacaucu

SEQ ID NO: 1067178 - RNA, 19 nt, Homo sapiens
gacauccauuucuuucucu

SEQ ID NO: 1067179 - RNA, 19 nt, Homo sapiens
gucaaguacucuguugugu

SEQ ID NO: 1067180 - RNA, 19 nt, Homo sapiens
ucucaaggccucuucuaca

SEQ ID NO: 1067181 - RNA, 19 nt, Homo sapiens
ggcccacacugcagagaag

SEQ ID NO: 1067182 - RNA, 19 nt, Homo sapiens
cucaaacucugaucuacca

SEQ ID NO: 1067183 - RNA, 19 nt, Homo sapiens
uuccuggucuggccacauu

SEQ ID NO: 1067184 - RNA, 19 nt, Homo sapiens
ggaaucuauggaagaauca

SEQ ID NO: 1067185 - RNA, 19 nt, Homo sapiens
ugaaucacccuggcauugu

SEQ ID NO: 1067186 - RNA, 19 nt, Homo sapiens
cuucagugcugucccacau

SEQ ID NO: 1067187 - RNA, 19 nt, Homo sapiens
cuucuagccucccuucucu

SEQ ID NO: 1067188 - RNA, 19 nt, Homo sapiens
uuucuauacucaacagcaa

SEQ ID NO: 1067189 - RNA, 19 nt, Homo sapiens
auaaaucucagcauaaagg

SEQ ID NO: 1067190 - RNA, 19 nt, Homo sapiens
gacugccugucuguucuuu

SEQ ID NO: 1067191 - RNA, 19 nt, Homo sapiens
gggagagggacacucacaa

SEQ ID NO: 1067192 - RNA, 19 nt, Homo sapiens
uacuuguccuucugaauca

SEQ ID NO: 1067193 - RNA, 19 nt, Homo sapiens
ccuccugggugucaaguac

SEQ ID NO: 1067194 - RNA, 19 nt, Homo sapiens
uaacucuagcuuucuauac

SEQ ID NO: 1067195 - RNA, 19 nt, Homo sapiens
gcucuagaaagaugcaauc

SEQ ID NO: 1067196 - RNA, 19 nt, Homo sapiens
ucagggaguuuuccucuuc

SEQ ID NO: 1067197 - RNA, 19 nt, Homo sapiens
cacaaaagcaugucaaauc

SEQ ID NO: 1067198 - RNA, 19 nt, Homo sapiens
gagagggacacucacaaaa

SEQ ID NO: 1067199 - RNA, 19 nt, Homo sapiens
gaggggagcggguaauaga

SEQ ID NO: 1067200 - RNA, 19 nt, Homo sapiens
caugauauuccacaauguc

SEQ ID NO: 1067201 - RNA, 19 nt, Homo sapiens
uaaauggugguaggaggaa

SEQ ID NO: 1067202 - RNA, 19 nt, Homo sapiens
ucuucaaccugucuguguu

SEQ ID NO: 1067203 - RNA, 19 nt, Homo sapiens
gaaagaugcuugugaacua

SEQ ID NO: 1067204 - RNA, 19 nt, Homo sapiens
gagagagaguugaagauua

SEQ ID NO: 1067205 - RNA, 19 nt, Homo sapiens
gaugugaucugcagaaguu

SEQ ID NO: 1067206 - RNA, 19 nt, Homo sapiens
gcagugagcuggagcagau

SEQ ID NO: 1067207 - RNA, 19 nt, Homo sapiens
gaaagguacuuaaaucgau

SEQ ID NO: 1067208 - RNA, 19 nt, Homo sapiens
ggauaaagaguuucaguuu

SEQ ID NO: 1067209 - RNA, 19 nt, Homo sapiens
aaagaaagaugcuugugaa

SEQ ID NO: 1067210 - RNA, 19 nt, Homo sapiens
gacauucucuuauaugaug

SEQ ID NO: 1067211 - RNA, 19 nt, Homo sapiens
gaaugggacuuugaucuga

SEQ ID NO: 1067212 - RNA, 19 nt, Homo sapiens
ggacuuugaucugaagaaa

SEQ ID NO: 1067213 - RNA, 19 nt, Homo sapiens
gaagauugcuuuucauuuc

SEQ ID NO: 1067214 - RNA, 19 nt, Homo sapiens
gcacaauguagguguauuu

SEQ ID NO: 1067215 - RNA, 19 nt, Homo sapiens
gaaaaggccuugcgucuca

SEQ ID NO: 1067216 - RNA, 19 nt, Homo sapiens
ggaacuaaacgaugaauca

SEQ ID NO: 1067217 - RNA, 19 nt, Homo sapiens
gagauuaccugggucuaga

SEQ ID NO: 1067218 - RNA, 19 nt, Homo sapiens
gacagcaguuugagggaua

SEQ ID NO: 1067219 - RNA, 19 nt, Homo sapiens
ugacugcaguggccuaauu

SEQ ID NO: 1067220 - RNA, 19 nt, Homo sapiens
caaagaaagaugcuuguga

SEQ ID NO: 1067221 - RNA, 19 nt, Homo sapiens
gagagaggcccacaaacaa

SEQ ID NO: 1067222 - RNA, 19 nt, Homo sapiens
ggagagagaguugaagauu

SEQ ID NO: 1067223 - RNA, 19 nt, Homo sapiens
gauauaucauucaguguca

SEQ ID NO: 1067224 - RNA, 19 nt, Homo sapiens
acacuaaugcuuccuuuaa

SEQ ID NO: 1067225 - RNA, 19 nt, Homo sapiens
gagcagauugaguuacaua

SEQ ID NO: 1067226 - RNA, 19 nt, Homo sapiens
agagagaguugaagauuag

SEQ ID NO: 1067227 - RNA, 19 nt, Homo sapiens
gagcugugauaauagcaaa

SEQ ID NO: 1067228 - RNA, 19 nt, Homo sapiens
caauguagguguauuugag

SEQ ID NO: 1067229 - RNA, 19 nt, Homo sapiens
guugaucucccacaauuaa

SEQ ID NO: 1067230 - RNA, 19 nt, Homo sapiens
guauuagguuaacuggaua

SEQ ID NO: 1067231 - RNA, 19 nt, Homo sapiens
caaaggggauaaagaguuu

SEQ ID NO: 1067232 - RNA, 19 nt, Homo sapiens
cugaagaaauuaccaaaca

SEQ ID NO: 1067233 - RNA, 19 nt, Homo sapiens
gaacuaaacgaugaaucaa

SEQ ID NO: 1067234 - RNA, 19 nt, Homo sapiens
aaagaugcuugugaacuaa

SEQ ID NO: 1067235 - RNA, 19 nt, Homo sapiens
gauaucagcuaagccuugu

SEQ ID NO: 1067236 - RNA, 19 nt, Homo sapiens
aaagucauccauccauaua

SEQ ID NO: 1067237 - RNA, 19 nt, Homo sapiens
gaucucccacaauuaauuu

SEQ ID NO: 1067238 - RNA, 19 nt, Homo sapiens
gcaguggccuaauugucuu

SEQ ID NO: 1067239 - RNA, 19 nt, Homo sapiens
cagcucaaauuacgagaga

SEQ ID NO: 1067240 - RNA, 19 nt, Homo sapiens
uaucagcuaagccuuguua

SEQ ID NO: 1067241 - RNA, 19 nt, Homo sapiens
cacuaaugcuuccuuuaaa

SEQ ID NO: 1067242 - RNA, 19 nt, Homo sapiens
ucacacuaaugcuuccuuu

SEQ ID NO: 1067243 - RNA, 19 nt, Homo sapiens
ggaauuggaacuaaacgau

SEQ ID NO: 1067244 - RNA, 19 nt, Homo sapiens
ggauauggccuugagauuc

SEQ ID NO: 1067245 - RNA, 19 nt, Homo sapiens
gugaacuaauugaaaggua

SEQ ID NO: 1067246 - RNA, 19 nt, Homo sapiens
cgagagaggcccacaaaca

SEQ ID NO: 1067247 - RNA, 19 nt, Homo sapiens
ggaaugggacuuugaucug

SEQ ID NO: 1067248 - RNA, 19 nt, Homo sapiens
ccaaagcaccaaagggaaa

SEQ ID NO: 1067249 - RNA, 19 nt, Homo sapiens
guagguguauuugaguauu

SEQ ID NO: 1067250 - RNA, 19 nt, Homo sapiens
gaucugcagaaguuguuua

SEQ ID NO: 1067251 - RNA, 19 nt, Homo sapiens
gauauggccuugagauucc

SEQ ID NO: 1067252 - RNA, 19 nt, Homo sapiens
gcuaagccuuguuaacagu

SEQ ID NO: 1067253 - RNA, 19 nt, Homo sapiens
uuugugaaauggacaguaa

SEQ ID NO: 1067254 - RNA, 19 nt, Homo sapiens
gagaguuucauuugcguuu

SEQ ID NO: 1067255 - RNA, 19 nt, Homo sapiens
cagcuaagccuuguuaaca

SEQ ID NO: 1067256 - RNA, 19 nt, Homo sapiens
uuaacuggauaucagcuaa

SEQ ID NO: 1067257 - RNA, 19 nt, Homo sapiens
gagauuccagacauucuaa

SEQ ID NO: 1067258 - RNA, 19 nt, Homo sapiens
aguauuagguuaacuggau

SEQ ID NO: 1067259 - RNA, 19 nt, Homo sapiens
aauuggaacuaaacgauga

SEQ ID NO: 1067260 - RNA, 19 nt, Homo sapiens
cuaaaugcaaguaaucuga

SEQ ID NO: 1067261 - RNA, 19 nt, Homo sapiens
gagaggcccacaaacaaga

SEQ ID NO: 1067262 - RNA, 19 nt, Homo sapiens
gauuagggaaccagugauu

SEQ ID NO: 1067263 - RNA, 19 nt, Homo sapiens
gggauaaagaguuucaguu

SEQ ID NO: 1067264 - RNA, 19 nt, Homo sapiens
cugcagaaguuguuuaguc

SEQ ID NO: 1067265 - RNA, 19 nt, Homo sapiens
acuaaacgaugaaucaagu

SEQ ID NO: 1067266 - RNA, 19 nt, Homo sapiens
uagaaaagcagcucaaauu

SEQ ID NO: 1067267 - RNA, 19 nt, Homo sapiens
cugacauucucuuauauga

SEQ ID NO: 1067268 - RNA, 19 nt, Homo sapiens
gauacugacauucucuuau

SEQ ID NO: 1067269 - RNA, 19 nt, Homo sapiens
uaacuguagaccaagauuu

SEQ ID NO: 1067270 - RNA, 19 nt, Homo sapiens
gggagaccgucaucaagca

SEQ ID NO: 1067271 - RNA, 19 nt, Homo sapiens
gaguuucauuugcguuuca

SEQ ID NO: 1067272 - RNA, 19 nt, Homo sapiens
ugauucagaugaggaaaug

SEQ ID NO: 1067273 - RNA, 19 nt, Homo sapiens
uaaaucgauucagcaguga

SEQ ID NO: 1067274 - RNA, 19 nt, Homo sapiens
gggaaaaugugauaagaag

SEQ ID NO: 1067275 - RNA, 19 nt, Homo sapiens
gaucaccuaauuucacguu

SEQ ID NO: 1067276 - RNA, 19 nt, Homo sapiens
gggauauggccuugagauu

SEQ ID NO: 1067277 - RNA, 19 nt, Homo sapiens
uaaacgaugaaucaaguga

SEQ ID NO: 1067278 - RNA, 19 nt, Homo sapiens
gaucugaagaaauuaccaa

SEQ ID NO: 1067279 - RNA, 19 nt, Homo sapiens
uagguuaacuggauaucag

SEQ ID NO: 1067280 - RNA, 19 nt, Homo sapiens
ggacgucaccaugcccaaa

SEQ ID NO: 1067281 - RNA, 19 nt, Homo sapiens
uggagcagauugaguuaca

SEQ ID NO: 1067282 - RNA, 19 nt, Homo sapiens
ugaaagguacuuaaaucga

SEQ ID NO: 1067283 - RNA, 19 nt, Homo sapiens
cagugaugauuguuauguu

SEQ ID NO: 1067284 - RNA, 19 nt, Homo sapiens
guguauuuaugaucaccua

SEQ ID NO: 1067285 - RNA, 19 nt, Homo sapiens
agaaaagcagcucaaauua

SEQ ID NO: 1067286 - RNA, 19 nt, Homo sapiens
cauugauuaugguaccuaa

SEQ ID NO: 1067287 - RNA, 19 nt, Homo sapiens
gaaaagcagcucaaauuac

SEQ ID NO: 1067288 - RNA, 19 nt, Homo sapiens
agagcacaauguaggugua

SEQ ID NO: 1067289 - RNA, 19 nt, Homo sapiens
gcuugugaacuaauugaaa

SEQ ID NO: 1067290 - RNA, 19 nt, Homo sapiens
agugaugauuguuauguug

SEQ ID NO: 1067291 - RNA, 19 nt, Homo sapiens
gcuggagcagauugaguua

SEQ ID NO: 1067292 - RNA, 19 nt, Homo sapiens
gccuaauugucuucacuug

SEQ ID NO: 1067293 - RNA, 19 nt, Homo sapiens
ugagggauauggccuugag

SEQ ID NO: 1067294 - RNA, 19 nt, Homo sapiens
ugauacugacauucucuua

SEQ ID NO: 1067295 - RNA, 19 nt, Homo sapiens
ggccuugcgucucaaccuu

SEQ ID NO: 1067296 - RNA, 19 nt, Homo sapiens
gggaaugggacuuugaucu

SEQ ID NO: 1067297 - RNA, 19 nt, Homo sapiens
cuugugaacuaauugaaag

SEQ ID NO: 1067298 - RNA, 19 nt, Homo sapiens
agagguagguuuuauuugu

SEQ ID NO: 1067299 - RNA, 19 nt, Homo sapiens
auguugaucucccacaauu

SEQ ID NO: 1067300 - RNA, 19 nt, Homo sapiens
ugagauuccagacauucua

SEQ ID NO: 1067301 - RNA, 19 nt, Homo sapiens
agucauccauccauauagu

SEQ ID NO: 1067302 - RNA, 19 nt, Homo sapiens
gaugauuguuauguugauc

SEQ ID NO: 1067303 - RNA, 19 nt, Homo sapiens
ggaaagagcacauugauaa

SEQ ID NO: 1067304 - RNA, 19 nt, Homo sapiens
gaacagccaucaagaaaca

SEQ ID NO: 1067305 - RNA, 19 nt, Homo sapiens
uaucagaacuccuccuuaa

SEQ ID NO: 1067306 - RNA, 19 nt, Homo sapiens
gaagcaggauauccaaauu

SEQ ID NO: 1067307 - RNA, 19 nt, Homo sapiens
ggagaaaucuacccaugga

SEQ ID NO: 1067308 - RNA, 19 nt, Homo sapiens
gaacuugguugcuacuuuc

SEQ ID NO: 1067309 - RNA, 19 nt, Homo sapiens
caacaaggauggauuaaaa

SEQ ID NO: 1067310 - RNA, 19 nt, Homo sapiens
cuacaggaauggaugauuu

SEQ ID NO: 1067311 - RNA, 19 nt, Homo sapiens
ucaguuggcuaaacaaauu

SEQ ID NO: 1067312 - RNA, 19 nt, Homo sapiens
ugacuuaucuaaucaggaa

SEQ ID NO: 1067313 - RNA, 19 nt, Homo sapiens
ccucuagaaucaucaaaua

SEQ ID NO: 1067314 - RNA, 19 nt, Homo sapiens
caacaaaucauuccaguca

SEQ ID NO: 1067315 - RNA, 19 nt, Homo sapiens
accaggagcuacagaauua

SEQ ID NO: 1067316 - RNA, 19 nt, Homo sapiens
caacaaacuuaggacuaua

SEQ ID NO: 1067317 - RNA, 19 nt, Homo sapiens
ccaagaauauuucaaacug

SEQ ID NO: 1067318 - RNA, 19 nt, Homo sapiens
gcuacuaccucuaacaguu

SEQ ID NO: 1067319 - RNA, 19 nt, Homo sapiens
gaaacaagacauuaacuag

SEQ ID NO: 1067320 - RNA, 19 nt, Homo sapiens
uaacaguucucuugauauc

SEQ ID NO: 1067321 - RNA, 19 nt, Homo sapiens
ucuaacaguucucuugaua

SEQ ID NO: 1067322 - RNA, 19 nt, Homo sapiens
aagcaccacugcacaauuu

SEQ ID NO: 1067323 - RNA, 19 nt, Homo sapiens
gcaacaccuuugaaacauu

SEQ ID NO: 1067324 - RNA, 19 nt, Homo sapiens
uagaagaacuugguugcua

SEQ ID NO: 1067325 - RNA, 19 nt, Homo sapiens
ccagaggcaucuucucaaa

SEQ ID NO: 1067326 - RNA, 19 nt, Homo sapiens
gaaagaagcaggauaucca

SEQ ID NO: 1067327 - RNA, 19 nt, Homo sapiens
agacgucacuaacauauau

SEQ ID NO: 1067328 - RNA, 19 nt, Homo sapiens
acaccaagacuucauauaa

SEQ ID NO: 1067329 - RNA, 19 nt, Homo sapiens
gaacgucgcggaggaggua

SEQ ID NO: 1067330 - RNA, 19 nt, Homo sapiens
uaacauauauuggcacagu

SEQ ID NO: 1067331 - RNA, 19 nt, Homo sapiens
gagcucaguuggcuaaaca

SEQ ID NO: 1067332 - RNA, 19 nt, Homo sapiens
caacaccuuugaaacauuc

SEQ ID NO: 1067333 - RNA, 19 nt, Homo sapiens
cagaugaccaaguaaauaa

SEQ ID NO: 1067334 - RNA, 19 nt, Homo sapiens
guucccagaugaccaagua

SEQ ID NO: 1067335 - RNA, 19 nt, Homo sapiens
gcacauugauaacuuucug

SEQ ID NO: 1067336 - RNA, 19 nt, Homo sapiens
aaauugcgcuuaagugaau

SEQ ID NO: 1067337 - RNA, 19 nt, Homo sapiens
aaagagccaccaccacuua

SEQ ID NO: 1067338 - RNA, 19 nt, Homo sapiens
gacauaaggaaaucaauga

SEQ ID NO: 1067339 - RNA, 19 nt, Homo sapiens
gauagacgucacuaacaua

SEQ ID NO: 1067340 - RNA, 19 nt, Homo sapiens
cgaaacaagacauuaacua

SEQ ID NO: 1067341 - RNA, 19 nt, Homo sapiens
caagaacagccaucaagaa

SEQ ID NO: 1067342 - RNA, 19 nt, Homo sapiens
gcaagaacagccaucaaga

SEQ ID NO: 1067343 - RNA, 19 nt, Homo sapiens
gaugacaguucacuaagag

SEQ ID NO: 1067344 - RNA, 19 nt, Homo sapiens
ccagaugaccaaguaaaua

SEQ ID NO: 1067345 - RNA, 19 nt, Homo sapiens
ccaaacagauacugcucaa

SEQ ID NO: 1067346 - RNA, 19 nt, Homo sapiens
gcaacaccaagacuucaua

SEQ ID NO: 1067347 - RNA, 19 nt, Homo sapiens
guagaagcccgaaacaaga

SEQ ID NO: 1067348 - RNA, 19 nt, Homo sapiens
caggcaacguuuauauauu

SEQ ID NO: 1067349 - RNA, 19 nt, Homo sapiens
acaacaaacuuaggacuau

SEQ ID NO: 1067350 - RNA, 19 nt, Homo sapiens
gaaaauugcgcuuaaguga

SEQ ID NO: 1067351 - RNA, 19 nt, Homo sapiens
ucagaugacaguucacuaa

SEQ ID NO: 1067352 - RNA, 19 nt, Homo sapiens
aaucaacuaugcuaacaga

SEQ ID NO: 1067353 - RNA, 19 nt, Homo sapiens
gaacugaagaguaauaagc

SEQ ID NO: 1067354 - RNA, 19 nt, Homo sapiens
cuauaaagcccaacaagga

SEQ ID NO: 1067355 - RNA, 19 nt, Homo sapiens
gaacuccuccuuaaaauug

SEQ ID NO: 1067356 - RNA, 19 nt, Homo sapiens
gcuacagaauuaaacaugu

SEQ ID NO: 1067357 - RNA, 19 nt, Homo sapiens
gaaaagaacagggaaaaga

SEQ ID NO: 1067358 - RNA, 19 nt, Homo sapiens
agaacuugguugcuacuuu

SEQ ID NO: 1067359 - RNA, 19 nt, Homo sapiens
acaaaucauuccagucaga

SEQ ID NO: 1067360 - RNA, 19 nt, Homo sapiens
guuaaugguuucugauagu

SEQ ID NO: 1067361 - RNA, 19 nt, Homo sapiens
gcaccacugcacaauuuaa

SEQ ID NO: 1067362 - RNA, 19 nt, Homo sapiens
gcccaacaaggauggauua

SEQ ID NO: 1067363 - RNA, 19 nt, Homo sapiens
acccauggaugcaaucuuu

SEQ ID NO: 1067364 - RNA, 19 nt, Homo sapiens
cauuaagguucccagauga

SEQ ID NO: 1067365 - RNA, 19 nt, Homo sapiens
acauuaagguucccagaug

SEQ ID NO: 1067366 - RNA, 19 nt, Homo sapiens
aggaauggaugauuuaaag

SEQ ID NO: 1067367 - RNA, 19 nt, Homo sapiens
uggaggaggagaugacuua

SEQ ID NO: 1067368 - RNA, 19 nt, Homo sapiens
cuacagaauuaaacaugug

SEQ ID NO: 1067369 - RNA, 19 nt, Homo sapiens
gugauaauuuggaacugaa

SEQ ID NO: 1067370 - RNA, 19 nt, Homo sapiens
aaacagauacugcucaaag

SEQ ID NO: 1067371 - RNA, 19 nt, Homo sapiens
caugaaagaagcaggauau

SEQ ID NO: 1067372 - RNA, 19 nt, Homo sapiens
gagcacaacaaacuuagga

SEQ ID NO: 1067373 - RNA, 19 nt, Homo sapiens
guaauuauagagcggauug

SEQ ID NO: 1067374 - RNA, 19 nt, Homo sapiens
ggauugagcacaacaaacu

SEQ ID NO: 1067375 - RNA, 19 nt, Homo sapiens
ucaaagcuuucuccuccaa

SEQ ID NO: 1067376 - RNA, 19 nt, Homo sapiens
gaaaguuaaggaaggaaau

SEQ ID NO: 1067377 - RNA, 19 nt, Homo sapiens
aagaacagccaucaagaaa

SEQ ID NO: 1067378 - RNA, 19 nt, Homo sapiens
gggaaaagaccaaacaaaa

SEQ ID NO: 1067379 - RNA, 19 nt, Homo sapiens
ugauagacgucacuaacau

SEQ ID NO: 1067380 - RNA, 19 nt, Homo sapiens
gaauggaugauuuaaagca

SEQ ID NO: 1067381 - RNA, 19 nt, Homo sapiens
gaaagcaccacugcacaau

SEQ ID NO: 1067382 - RNA, 19 nt, Homo sapiens
ugauaucagugcuauaaag

SEQ ID NO: 1067383 - RNA, 19 nt, Homo sapiens
aagcaggauauccaaauua

SEQ ID NO: 1067384 - RNA, 19 nt, Homo sapiens
ucaggcaacguuuauauau

SEQ ID NO: 1067385 - RNA, 19 nt, Homo sapiens
caccaagacuucauauaac

SEQ ID NO: 1067386 - RNA, 19 nt, Homo sapiens
ggacacguuuguuuuagaa

SEQ ID NO: 1067387 - RNA, 19 nt, Homo sapiens
ucaaucaacuaugcuaaca

SEQ ID NO: 1067388 - RNA, 19 nt, Homo sapiens
ucaaaggagaguauaguug

SEQ ID NO: 1067389 - RNA, 19 nt, Homo sapiens
gcccgaaacaagacauuaa

SEQ ID NO: 1067390 - RNA, 19 nt, Homo sapiens
cgagaaaaccaaacagaua

SEQ ID NO: 1067391 - RNA, 19 nt, Homo sapiens
aagagcacauugauaacuu

SEQ ID NO: 1067392 - RNA, 19 nt, Homo sapiens
ggcaugauagaccaaauuu

SEQ ID NO: 1067393 - RNA, 19 nt, Homo sapiens
auuuggaacugaagaguaa

SEQ ID NO: 1067394 - RNA, 19 nt, Homo sapiens
ccaccaccacuuacgauuu

SEQ ID NO: 1067395 - RNA, 19 nt, Homo sapiens
gcaacagaaaguuaaggaa

SEQ ID NO: 1067396 - RNA, 19 nt, Homo sapiens
ggcagccuguuaaugguuu

SEQ ID NO: 1067397 - RNA, 19 nt, Homo sapiens
aacaagacauuaacuagag

SEQ ID NO: 1067398 - RNA, 19 nt, Homo sapiens
cacaguaauugccaaaaua

SEQ ID NO: 1067399 - RNA, 19 nt, Homo sapiens
gaagaguaauaagcacagu

SEQ ID NO: 1067400 - RNA, 19 nt, Homo sapiens
ugacauaaggaaaucaaug

SEQ ID NO: 1067401 - RNA, 19 nt, Homo sapiens
gaacuccuggcuacaagug

SEQ ID NO: 1067402 - RNA, 19 nt, Homo sapiens
ccagguuccaugaaagaua

SEQ ID NO: 1067403 - RNA, 19 nt, Homo sapiens
ccagaggucuuaagaacua

SEQ ID NO: 1067404 - RNA, 19 nt, Homo sapiens
cagauggaauucaaacuua

SEQ ID NO: 1067405 - RNA, 19 nt, Homo sapiens
ucuauucacuggaaaguaa

SEQ ID NO: 1067406 - RNA, 19 nt, Homo sapiens
gcagcccacugaucuguuu

SEQ ID NO: 1067407 - RNA, 19 nt, Homo sapiens
caccuuaucuggcugcuuu

SEQ ID NO: 1067408 - RNA, 19 nt, Homo sapiens
ggcaagggcuccaggaaga

SEQ ID NO: 1067409 - RNA, 19 nt, Homo sapiens
ggacccagauggaauucaa

SEQ ID NO: 1067410 - RNA, 19 nt, Homo sapiens
gggcacggccuuuguguaa

SEQ ID NO: 1067411 - RNA, 19 nt, Homo sapiens
ccaacaaacacaucucuuu

SEQ ID NO: 1067412 - RNA, 19 nt, Homo sapiens
gcucacgguugcugauaaa

SEQ ID NO: 1067413 - RNA, 19 nt, Homo sapiens
cauagggccuuguggaaga

SEQ ID NO: 1067414 - RNA, 19 nt, Homo sapiens
gaacuagcccaccuuaucu

SEQ ID NO: 1067415 - RNA, 19 nt, Homo sapiens
guugguguguuucugcuua

SEQ ID NO: 1067416 - RNA, 19 nt, Homo sapiens
gcaagcagcccacugaucu

SEQ ID NO: 1067417 - RNA, 19 nt, Homo sapiens
gaaggcugguggagugaug

SEQ ID NO: 1067418 - RNA, 19 nt, Homo sapiens
acagagagauguccuaacu

SEQ ID NO: 1067419 - RNA, 19 nt, Homo sapiens
uggaacgacuggagaugua

SEQ ID NO: 1067420 - RNA, 19 nt, Homo sapiens
uaugucaguugguguguuu

SEQ ID NO: 1067421 - RNA, 19 nt, Homo sapiens
gguggaaggugcugagagu

SEQ ID NO: 1067422 - RNA, 19 nt, Homo sapiens
gaaacagagagauguccua

SEQ ID NO: 1067423 - RNA, 19 nt, Homo sapiens
ccacugaucuguuuuguag

SEQ ID NO: 1067424 - RNA, 19 nt, Homo sapiens
gaagaccuacggcuccauu

SEQ ID NO: 1067425 - RNA, 19 nt, Homo sapiens
gggagcagcuaugucaguu

SEQ ID NO: 1067426 - RNA, 19 nt, Homo sapiens
gcacggccuuuguguaacu

SEQ ID NO: 1067427 - RNA, 19 nt, Homo sapiens
cagaugaaauuaguaacug

SEQ ID NO: 1067428 - RNA, 19 nt, Homo sapiens
ugaagacacugagcaaugg

SEQ ID NO: 1067429 - RNA, 19 nt, Homo sapiens
gauggcuucugcugcuaaa

SEQ ID NO: 1067430 - RNA, 19 nt, Homo sapiens
ccagauggaauucaaacuu

SEQ ID NO: 1067431 - RNA, 19 nt, Homo sapiens
uuugggagcuccagauuuc

SEQ ID NO: 1067432 - RNA, 19 nt, Homo sapiens
aaacagagagauguccuaa

SEQ ID NO: 1067433 - RNA, 19 nt, Homo sapiens
uuguguaacuggugaauau

SEQ ID NO: 1067434 - RNA, 19 nt, Homo sapiens
ccaaggcccugggguuuua

SEQ ID NO: 1067435 - RNA, 19 nt, Homo sapiens
cugauaaacagcuggauaa

SEQ ID NO: 1067436 - RNA, 19 nt, Homo sapiens
gcagaugaaauuaguaacu

SEQ ID NO: 1067437 - RNA, 19 nt, Homo sapiens
caacaaacacaucucuuuu

SEQ ID NO: 1067438 - RNA, 19 nt, Homo sapiens
guggaggcaucaauauauc

SEQ ID NO: 1067439 - RNA, 19 nt, Homo sapiens
agaacuagcccaccuuauc

SEQ ID NO: 1067440 - RNA, 19 nt, Homo sapiens
ccacugcuggucccuguuu

SEQ ID NO: 1067441 - RNA, 19 nt, Homo sapiens
gguggauuauggcuuuguu

SEQ ID NO: 1067442 - RNA, 19 nt, Homo sapiens
gggaggguguggagaaugc

SEQ ID NO: 1067443 - RNA, 19 nt, Homo sapiens
ggagcugaguuggguggaa

SEQ ID NO: 1067444 - RNA, 19 nt, Homo sapiens
cccgguggauuauggcuuu

SEQ ID NO: 1067445 - RNA, 19 nt, Homo sapiens
gauggaauucaaacuuaug

SEQ ID NO: 1067446 - RNA, 19 nt, Homo sapiens
guguggaggcaucaauaua

SEQ ID NO: 1067447 - RNA, 19 nt, Homo sapiens
ccagggaggguguggagaa

SEQ ID NO: 1067448 - RNA, 19 nt, Homo sapiens
gaauuugggagcuccagau

SEQ ID NO: 1067449 - RNA, 19 nt, Homo sapiens
gcaugaaacagagagaugu

SEQ ID NO: 1067450 - RNA, 19 nt, Homo sapiens
gguggagaaugaaguuguc

SEQ ID NO: 1067451 - RNA, 19 nt, Homo sapiens
uccauuaaccugcgcauga

SEQ ID NO: 1067452 - RNA, 19 nt, Homo sapiens
gcacagggguaugaguuug

SEQ ID NO: 1067453 - RNA, 19 nt, Homo sapiens
ggguguggaggcaucaaua

SEQ ID NO: 1067454 - RNA, 19 nt, Homo sapiens
ggauggcuucugcugcuaa

SEQ ID NO: 1067455 - RNA, 19 nt, Homo sapiens
cugcagaugaaauuaguaa

SEQ ID NO: 1067456 - RNA, 19 nt, Homo sapiens
ccgugaggcucgagucaau

SEQ ID NO: 1067457 - RNA, 19 nt, Homo sapiens
aaacuuaugccugcucuca

SEQ ID NO: 1067458 - RNA, 19 nt, Homo sapiens
guaauugggcacggccuuu

SEQ ID NO: 1067459 - RNA, 19 nt, Homo sapiens
uguggaggcaucaauauau

SEQ ID NO: 1067460 - RNA, 19 nt, Homo sapiens
agaccuacggcuccauuaa

SEQ ID NO: 1067461 - RNA, 19 nt, Homo sapiens
guguguuucugcuuauguu

SEQ ID NO: 1067462 - RNA, 19 nt, Homo sapiens
gauaaacagcuggauaaaa

SEQ ID NO: 1067463 - RNA, 19 nt, Homo sapiens
cuccagaggucuuaagaac

SEQ ID NO: 1067464 - RNA, 19 nt, Homo sapiens
augaagagucuaugaguga

SEQ ID NO: 1067465 - RNA, 19 nt, Homo sapiens
ggcgggagcagcuauguca

SEQ ID NO: 1067466 - RNA, 19 nt, Homo sapiens
gguguggaggcaucaauau

SEQ ID NO: 1067467 - RNA, 19 nt, Homo sapiens
acuguggcauccuaagaaa

SEQ ID NO: 1067468 - RNA, 19 nt, Homo sapiens
uuuaaacugagcucacaua

SEQ ID NO: 1067469 - RNA, 19 nt, Homo sapiens
cugaagacacugagcaaug

SEQ ID NO: 1067470 - RNA, 19 nt, Homo sapiens
ccauuaaccugcgcaugag

SEQ ID NO: 1067471 - RNA, 19 nt, Homo sapiens
ggcaugaaacagagagaug

SEQ ID NO: 1067472 - RNA, 19 nt, Homo sapiens
aaaugaagagucuaugagu

SEQ ID NO: 1067473 - RNA, 19 nt, Homo sapiens
ucucugaaccugggcauga

SEQ ID NO: 1067474 - RNA, 19 nt, Homo sapiens
ucacuguggcauccuaaga

SEQ ID NO: 1067475 - RNA, 19 nt, Homo sapiens
cagggaggguguggagaau

SEQ ID NO: 1067476 - RNA, 19 nt, Homo sapiens
ugauaaacagcuggauaaa

SEQ ID NO: 1067477 - RNA, 19 nt, Homo sapiens
guuuguggcugggcacuca

SEQ ID NO: 1067478 - RNA, 19 nt, Homo sapiens
gagucaauccggacacagu

SEQ ID NO: 1067479 - RNA, 19 nt, Homo sapiens
ugagacccauuuccagaac

SEQ ID NO: 1067480 - RNA, 19 nt, Homo sapiens
uagcugagguuuugcauac

SEQ ID NO: 1067481 - RNA, 19 nt, Homo sapiens
gaccuacggcuccauuaac

SEQ ID NO: 1067482 - RNA, 19 nt, Homo sapiens
ggagcagcuaugucaguug

SEQ ID NO: 1067483 - RNA, 19 nt, Homo sapiens
ggucaagucuggaugauua

SEQ ID NO: 1067484 - RNA, 19 nt, Homo sapiens
ggagacagaugagaaguaa

SEQ ID NO: 1067485 - RNA, 19 nt, Homo sapiens
caagagcuguaccaauuua

SEQ ID NO: 1067486 - RNA, 19 nt, Homo sapiens
uaucauggcuuuauaggaa

SEQ ID NO: 1067487 - RNA, 19 nt, Homo sapiens
ucaaagaaauguucacuca

SEQ ID NO: 1067488 - RNA, 19 nt, Homo sapiens
ggaauggaaucacuaguuc

SEQ ID NO: 1067489 - RNA, 19 nt, Homo sapiens
guaacaggcccuuaauuaa

SEQ ID NO: 1067490 - RNA, 19 nt, Homo sapiens
gauuaugccugcaguuuau

SEQ ID NO: 1067491 - RNA, 19 nt, Homo sapiens
ugagaaauguuaugaagga

SEQ ID NO: 1067492 - RNA, 19 nt, Homo sapiens
gcacagaacaagaaauaga

SEQ ID NO: 1067493 - RNA, 19 nt, Homo sapiens
aagaaucccuucaaagaaa

SEQ ID NO: 1067494 - RNA, 19 nt, Homo sapiens
gaaacacucuuuggagaau

SEQ ID NO: 1067495 - RNA, 19 nt, Homo sapiens
gaaaguaacauucucuauc

SEQ ID NO: 1067496 - RNA, 19 nt, Homo sapiens
ggaaguaccagacuaugaa

SEQ ID NO: 1067497 - RNA, 19 nt, Homo sapiens
gaaauguuaugaaggaaag

SEQ ID NO: 1067498 - RNA, 19 nt, Homo sapiens
guacagagaugggcuucaa

SEQ ID NO: 1067499 - RNA, 19 nt, Homo sapiens
ugauagaacuguugcuuau

SEQ ID NO: 1067500 - RNA, 19 nt, Homo sapiens
cagcacagaacaagaaaua

SEQ ID NO: 1067501 - RNA, 19 nt, Homo sapiens
ucaagaaucccuucaaaga

SEQ ID NO: 1067502 - RNA, 19 nt, Homo sapiens
ccauaaauacccaaagaua

SEQ ID NO: 1067503 - RNA, 19 nt, Homo sapiens
gaagaaagggaaggcauuu

SEQ ID NO: 1067504 - RNA, 19 nt, Homo sapiens
ggauuaugccugcaguuua

SEQ ID NO: 1067505 - RNA, 19 nt, Homo sapiens
uuaccuaccuacuugauuu

SEQ ID NO: 1067506 - RNA, 19 nt, Homo sapiens
ccaaagauauaaacugucu

SEQ ID NO: 1067507 - RNA, 19 nt, Homo sapiens
gaggaagauuugguagaua

SEQ ID NO: 1067508 - RNA, 19 nt, Homo sapiens
uauaagcucuguaacaauc

SEQ ID NO: 1067509 - RNA, 19 nt, Homo sapiens
aguaacaggcccuuaauua

SEQ ID NO: 1067510 - RNA, 19 nt, Homo sapiens
ggacacagcaacacagaga

SEQ ID NO: 1067511 - RNA, 19 nt, Homo sapiens
acauuaggcuccuguugua

SEQ ID NO: 1067512 - RNA, 19 nt, Homo sapiens
gaaaguaucauaggaaguc

SEQ ID NO: 1067513 - RNA, 19 nt, Homo sapiens
caaauuugccaauccauga

SEQ ID NO: 1067514 - RNA, 19 nt, Homo sapiens
ggauggaaguaccagacua

SEQ ID NO: 1067515 - RNA, 19 nt, Homo sapiens
caagaaucccuucaaagaa

SEQ ID NO: 1067516 - RNA, 19 nt, Homo sapiens
ugaccagacuugccuagaa

SEQ ID NO: 1067517 - RNA, 19 nt, Homo sapiens
gaucauuauuuccuaagug

SEQ ID NO: 1067518 - RNA, 19 nt, Homo sapiens
gaguaaacuugaccaaaca

SEQ ID NO: 1067519 - RNA, 19 nt, Homo sapiens
gaaaggacaacaacagaca

SEQ ID NO: 1067520 - RNA, 19 nt, Homo sapiens
uaccagacauuauuaagug

SEQ ID NO: 1067521 - RNA, 19 nt, Homo sapiens
gcuuaucugucuuccuuaa

SEQ ID NO: 1067522 - RNA, 19 nt, Homo sapiens
gaagaaacgguacagagau

SEQ ID NO: 1067523 - RNA, 19 nt, Homo sapiens
ggaaacacucuuuggagaa

SEQ ID NO: 1067524 - RNA, 19 nt, Homo sapiens
gcccugcucuugccaaaug

SEQ ID NO: 1067525 - RNA, 19 nt, Homo sapiens
guaaugaacagaauagaca

SEQ ID NO: 1067526 - RNA, 19 nt, Homo sapiens
ugaccaaguugacacuauu

SEQ ID NO: 1067527 - RNA, 19 nt, Homo sapiens
gaaagggaaggcauuuguu

SEQ ID NO: 1067528 - RNA, 19 nt, Homo sapiens
ugccaagucuagauugaua

SEQ ID NO: 1067529 - RNA, 19 nt, Homo sapiens
caaggaauuuggcauugug

SEQ ID NO: 1067530 - RNA, 19 nt, Homo sapiens
gagauucauucauacuuca

SEQ ID NO: 1067531 - RNA, 19 nt, Homo sapiens
ccuguuguaucuugguuua

SEQ ID NO: 1067532 - RNA, 19 nt, Homo sapiens
cauaggaagucuaccuuuc

SEQ ID NO: 1067533 - RNA, 19 nt, Homo sapiens
uagagugucuuauucaauc

SEQ ID NO: 1067534 - RNA, 19 nt, Homo sapiens
cuuauaagcucuguaacaa

SEQ ID NO: 1067535 - RNA, 19 nt, Homo sapiens
cuucugaucuuuaguaucu

SEQ ID NO: 1067536 - RNA, 19 nt, Homo sapiens
ugaguaaacuugaccaaac

SEQ ID NO: 1067537 - RNA, 19 nt, Homo sapiens
guaucaagguggucugguu

SEQ ID NO: 1067538 - RNA, 19 nt, Homo sapiens
ggaaaguaacauucucuau

SEQ ID NO: 1067539 - RNA, 19 nt, Homo sapiens
uaaauuacggguuaugaga

SEQ ID NO: 1067540 - RNA, 19 nt, Homo sapiens
cauguaauaugguuucauc

SEQ ID NO: 1067541 - RNA, 19 nt, Homo sapiens
ggaggucauuguagauauc

SEQ ID NO: 1067542 - RNA, 19 nt, Homo sapiens
gagguucuacccuuuauau

SEQ ID NO: 1067543 - RNA, 19 nt, Homo sapiens
guugaacacuuacauguac

SEQ ID NO: 1067544 - RNA, 19 nt, Homo sapiens
ccaggucuguugagcugua

SEQ ID NO: 1067545 - RNA, 19 nt, Homo sapiens
gaugauuacuguccuucug

SEQ ID NO: 1067546 - RNA, 19 nt, Homo sapiens
gaacuuccucaccauauca

SEQ ID NO: 1067547 - RNA, 19 nt, Homo sapiens
ccuaagugauggucuguau

SEQ ID NO: 1067548 - RNA, 19 nt, Homo sapiens
gugcugggauuacagaugu

SEQ ID NO: 1067549 - RNA, 19 nt, Homo sapiens
ucaggagguucuacccuuu

SEQ ID NO: 1067550 - RNA, 19 nt, Homo sapiens
aagaaaagguccucaauau

SEQ ID NO: 1067551 - RNA, 19 nt, Homo sapiens
gaagauuugguagauauug

SEQ ID NO: 1067552 - RNA, 19 nt, Homo sapiens
acaaucaggguuacaagua

SEQ ID NO: 1067553 - RNA, 19 nt, Homo sapiens
aagguggucugguugagua

SEQ ID NO: 1067554 - RNA, 19 nt, Homo sapiens
gaaguaccagacuaugaaa

SEQ ID NO: 1067555 - RNA, 19 nt, Homo sapiens
ugaagaaacgguacagaga

SEQ ID NO: 1067556 - RNA, 19 nt, Homo sapiens
gauaaggaaacacucuuug

SEQ ID NO: 1067557 - RNA, 19 nt, Homo sapiens
ccacaaauuugccaaucca

SEQ ID NO: 1067558 - RNA, 19 nt, Homo sapiens
ugagauucauucauacuuc

SEQ ID NO: 1067559 - RNA, 19 nt, Homo sapiens
aggaagauuugguagauau

SEQ ID NO: 1067560 - RNA, 19 nt, Homo sapiens
agucaagaaucccuucaaa

SEQ ID NO: 1067561 - RNA, 19 nt, Homo sapiens
gaagugcugggauuacaga

SEQ ID NO: 1067562 - RNA, 19 nt, Homo sapiens
uaacaggcccuuaauuaac

SEQ ID NO: 1067563 - RNA, 19 nt, Homo sapiens
aaagggaaggcauuuguuu

SEQ ID NO: 1067564 - RNA, 19 nt, Homo sapiens
agacagaugagaaguaaau

SEQ ID NO: 1067565 - RNA, 19 nt, Homo sapiens
uaucugucuuccuuaagua

SEQ ID NO: 1067566 - RNA, 19 nt, Homo sapiens
gaagccacuuucgcugauu

SEQ ID NO: 1067567 - RNA, 19 nt, Homo sapiens
gagcuguaccaauuuaaga

SEQ ID NO: 1067568 - RNA, 19 nt, Homo sapiens
auucugaccugccauaaau

SEQ ID NO: 1067569 - RNA, 19 nt, Homo sapiens
aacacucuuuggagaauua

SEQ ID NO: 1067570 - RNA, 19 nt, Homo sapiens
gagaaauguuaugaaggaa

SEQ ID NO: 1067571 - RNA, 19 nt, Homo sapiens
uaucagcacagaacaagaa

SEQ ID NO: 1067572 - RNA, 19 nt, Homo sapiens
aagaaacgguacagagaug

SEQ ID NO: 1067573 - RNA, 19 nt, Homo sapiens
uaagacauccuuccugagu

SEQ ID NO: 1067574 - RNA, 19 nt, Homo sapiens
ugccauaaauacccaaaga

SEQ ID NO: 1067575 - RNA, 19 nt, Homo sapiens
uaaggaaacacucuuugga

SEQ ID NO: 1067576 - RNA, 19 nt, Homo sapiens
cggguuaugagaaauguua

SEQ ID NO: 1067577 - RNA, 19 nt, Homo sapiens
gggagacagaugagaagua

SEQ ID NO: 1067578 - RNA, 19 nt, Homo sapiens
cagagucuccuccaucuug

SEQ ID NO: 1067579 - RNA, 19 nt, Homo sapiens
gaaaagguccucaauaugc

SEQ ID NO: 1067580 - RNA, 19 nt, Homo sapiens
agaggaagauuugguagau

SEQ ID NO: 1067581 - RNA, 19 nt, Homo sapiens
aaagacacuucuaccacaa

SEQ ID NO: 1067582 - RNA, 19 nt, Homo sapiens
agacauccuuccugaguca

SEQ ID NO: 1067583 - RNA, 19 nt, Homo sapiens
gcaaguagcuaagccuaua

SEQ ID NO: 1067584 - RNA, 19 nt, Homo sapiens
ggaagucuguucuuuggua

SEQ ID NO: 1067585 - RNA, 19 nt, Homo sapiens
caugaaagcuguccugauu

SEQ ID NO: 1067586 - RNA, 19 nt, Homo sapiens
gcaaguguauggauuauuc

SEQ ID NO: 1067587 - RNA, 19 nt, Homo sapiens
ggaacaagcugggauaugu

SEQ ID NO: 1067588 - RNA, 19 nt, Homo sapiens
gaugauggcugaugugugu

SEQ ID NO: 1067589 - RNA, 19 nt, Homo sapiens
ggaaaguucucuugugcaa

SEQ ID NO: 1067590 - RNA, 19 nt, Homo sapiens
gcacaugcuuugaaguauu

SEQ ID NO: 1067591 - RNA, 19 nt, Homo sapiens
gcaagaugcuccuggucua

SEQ ID NO: 1067592 - RNA, 19 nt, Homo sapiens
ucaagaaacugguggauca

SEQ ID NO: 1067593 - RNA, 19 nt, Homo sapiens
ugacugagcuguccucgau

SEQ ID NO: 1067594 - RNA, 19 nt, Homo sapiens
aauacaagcuccacugaaa

SEQ ID NO: 1067595 - RNA, 19 nt, Homo sapiens
guacaugggugaugagucu

SEQ ID NO: 1067596 - RNA, 19 nt, Homo sapiens
caucaaagcccaugaguuc

SEQ ID NO: 1067597 - RNA, 19 nt, Homo sapiens
gaacaccugcucaagcuuu

SEQ ID NO: 1067598 - RNA, 19 nt, Homo sapiens
gaugaggaguugaucaaga

SEQ ID NO: 1067599 - RNA, 19 nt, Homo sapiens
guagaccucuuaauuuauc

SEQ ID NO: 1067600 - RNA, 19 nt, Homo sapiens
ggucuaugaucucuacuug

SEQ ID NO: 1067601 - RNA, 19 nt, Homo sapiens
cauguagaccucuuaauuu

SEQ ID NO: 1067602 - RNA, 19 nt, Homo sapiens
aaagaaaccugccaaagac

SEQ ID NO: 1067603 - RNA, 19 nt, Homo sapiens
gaucucuacuugucuccua

SEQ ID NO: 1067604 - RNA, 19 nt, Homo sapiens
gcaaagagaacaugaaagc

SEQ ID NO: 1067605 - RNA, 19 nt, Homo sapiens
ugacaacaccagaggauuu

SEQ ID NO: 1067606 - RNA, 19 nt, Homo sapiens
gaacaagucccugaacaag

SEQ ID NO: 1067607 - RNA, 19 nt, Homo sapiens
acaaacaccuggcaugaca

SEQ ID NO: 1067608 - RNA, 19 nt, Homo sapiens
gggcaaagagaacaugaaa

SEQ ID NO: 1067609 - RNA, 19 nt, Homo sapiens
ggaggaacaagcugggaua

SEQ ID NO: 1067610 - RNA, 19 nt, Homo sapiens
aaaguucucuugugcaaca

SEQ ID NO: 1067611 - RNA, 19 nt, Homo sapiens
gaagucuguucuuugguau

SEQ ID NO: 1067612 - RNA, 19 nt, Homo sapiens
ucauguagaccucuuaauu

SEQ ID NO: 1067613 - RNA, 19 nt, Homo sapiens
ggaggaagguagacugaac

SEQ ID NO: 1067614 - RNA, 19 nt, Homo sapiens
gguggaagcagccaucaaa

SEQ ID NO: 1067615 - RNA, 19 nt, Homo sapiens
ucgaggagcuucaguacau

SEQ ID NO: 1067616 - RNA, 19 nt, Homo sapiens
gaaaccugccaaagacaaa

SEQ ID NO: 1067617 - RNA, 19 nt, Homo sapiens
gcguuaagcuacucacauc

SEQ ID NO: 1067618 - RNA, 19 nt, Homo sapiens
ucaggaaaguucucuugug

SEQ ID NO: 1067619 - RNA, 19 nt, Homo sapiens
ugaaagcuguccugauugg

SEQ ID NO: 1067620 - RNA, 19 nt, Homo sapiens
aagagaaggugauggaaca

SEQ ID NO: 1067621 - RNA, 19 nt, Homo sapiens
gcaagggcuuccugagagu

SEQ ID NO: 1067622 - RNA, 19 nt, Homo sapiens
ccugagaucuuccgcaagu

SEQ ID NO: 1067623 - RNA, 19 nt, Homo sapiens
ccuauagcauggugucuug

SEQ ID NO: 1067624 - RNA, 19 nt, Homo sapiens
acaagucccugaacaagag

SEQ ID NO: 1067625 - RNA, 19 nt, Homo sapiens
gcauccaccugaacaaguc

SEQ ID NO: 1067626 - RNA, 19 nt, Homo sapiens
cacagaaucucagggcaaa

SEQ ID NO: 1067627 - RNA, 19 nt, Homo sapiens
ucuaugaucucuacuuguc

SEQ ID NO: 1067628 - RNA, 19 nt, Homo sapiens
gaacaagcugggauaugug

SEQ ID NO: 1067629 - RNA, 19 nt, Homo sapiens
caaguggaggugagaauga

SEQ ID NO: 1067630 - RNA, 19 nt, Homo sapiens
guucuuugguauggaauuu

SEQ ID NO: 1067631 - RNA, 19 nt, Homo sapiens
ugacaaacaccuggcauga

SEQ ID NO: 1067632 - RNA, 19 nt, Homo sapiens
ccgaggacguggacgaguu

SEQ ID NO: 1067633 - RNA, 19 nt, Homo sapiens
gcaccagcccugagaucuu

SEQ ID NO: 1067634 - RNA, 19 nt, Homo sapiens
aaagcuguccugauuggua

SEQ ID NO: 1067635 - RNA, 19 nt, Homo sapiens
cacaugcuuugaaguauuc

SEQ ID NO: 1067636 - RNA, 19 nt, Homo sapiens
cgauguuaccugucaagua

SEQ ID NO: 1067637 - RNA, 19 nt, Homo sapiens
aaaucgauguuaccuguca

SEQ ID NO: 1067638 - RNA, 19 nt, Homo sapiens
augaggaguugaucaagaa

SEQ ID NO: 1067639 - RNA, 19 nt, Homo sapiens
ugggauaugugagcguuaa

SEQ ID NO: 1067640 - RNA, 19 nt, Homo sapiens
gcaaguggaggugagaaug

SEQ ID NO: 1067641 - RNA, 19 nt, Homo sapiens
aaaagaaaccugccaaaga

SEQ ID NO: 1067642 - RNA, 19 nt, Homo sapiens
gcuacucacauccuucaaa

SEQ ID NO: 1067643 - RNA, 19 nt, Homo sapiens
gagaucuuccgcaagugua

SEQ ID NO: 1067644 - RNA, 19 nt, Homo sapiens
caccagcccugagaucuuc

SEQ ID NO: 1067645 - RNA, 19 nt, Homo sapiens
gaauucugcuuuucugaug

SEQ ID NO: 1067646 - RNA, 19 nt, Homo sapiens
caccuggcaugacagaaug

SEQ ID NO: 1067647 - RNA, 19 nt, Homo sapiens
ugaacaagucccugaacaa

SEQ ID NO: 1067648 - RNA, 19 nt, Homo sapiens
acacgggacuggagaacca

SEQ ID NO: 1067649 - RNA, 19 nt, Homo sapiens
guucaggaaaguucucuug

SEQ ID NO: 1067650 - RNA, 19 nt, Homo sapiens
gagucgaggagcuucagua

SEQ ID NO: 1067651 - RNA, 19 nt, Homo sapiens
aagcuguccugauugguau

SEQ ID NO: 1067652 - RNA, 19 nt, Homo sapiens
caagagagucgaggagcuu

SEQ ID NO: 1067653 - RNA, 19 nt, Homo sapiens
agaaacugguggaucagau

SEQ ID NO: 1067654 - RNA, 19 nt, Homo sapiens
gcaagagaaggugauggaa

SEQ ID NO: 1067655 - RNA, 19 nt, Homo sapiens
gguacgccaugguuugaag

SEQ ID NO: 1067656 - RNA, 19 nt, Homo sapiens
cagaaucucagggcaaaga

SEQ ID NO: 1067657 - RNA, 19 nt, Homo sapiens
ucucuucuuugguauggaa

SEQ ID NO: 1067658 - RNA, 19 nt, Homo sapiens
ugagugugauggcccugaa

SEQ ID NO: 1067659 - RNA, 19 nt, Homo sapiens
aagaccaccuucuaguuca

SEQ ID NO: 1067660 - RNA, 19 nt, Homo sapiens
aguauucagugguccuuga

SEQ ID NO: 1067661 - RNA, 19 nt, Homo sapiens
guauggauuauuccucuga

SEQ ID NO: 1067662 - RNA, 19 nt, Homo sapiens
uauagcauggugucuugua

SEQ ID NO: 1067663 - RNA, 19 nt, Homo sapiens
cuucuuugguauggaauuu

SEQ ID NO: 1067664 - RNA, 19 nt, Homo sapiens
uaauacaagcuccacugaa

SEQ ID NO: 1067665 - RNA, 19 nt, Homo sapiens
gcggaggaagguagacuga

SEQ ID NO: 1067666 - RNA, 19 nt, Homo sapiens
cuacucacauccuucaaaa

SEQ ID NO: 1067667 - RNA, 19 nt, Homo sapiens
uggaacaccugcucaagcu

SEQ ID NO: 1067668 - RNA, 19 nt, Homo sapiens
gaagggugcaagagaaggu

SEQ ID NO: 1067669 - RNA, 19 nt, Homo sapiens
agaugcuccuggucuauga

SEQ ID NO: 1067670 - RNA, 19 nt, Homo sapiens
ccaagacggcggugcagau

SEQ ID NO: 1067671 - RNA, 19 nt, Homo sapiens
ucaagguucugacaaacac

SEQ ID NO: 1067672 - RNA, 19 nt, Homo sapiens
gacaacaccagaggauuuc

SEQ ID NO: 1067673 - RNA, 19 nt, Homo sapiens
ccgcaaguguauggauuau

SEQ ID NO: 1067674 - RNA, 19 nt, Homo sapiens
cagugguccuugaguugaa

SEQ ID NO: 1067675 - RNA, 19 nt, Homo sapiens
cgcaaaggcguuuccagaa

SEQ ID NO: 1067676 - RNA, 19 nt, Homo sapiens
cugaacaagucccugaaca

SEQ ID NO: 1067677 - RNA, 19 nt, Homo sapiens
uuaagcuacucacauccuu

SEQ ID NO: 1067678 - RNA, 19 nt, Homo sapiens
ggaguucgaggagguggaa

SEQ ID NO: 1067679 - RNA, 19 nt, Homo sapiens
ggcaugacagaauggaauu

SEQ ID NO: 1067680 - RNA, 19 nt, Homo sapiens
uuaauacaagcuccacuga

SEQ ID NO: 1067681 - RNA, 19 nt, Homo sapiens
caagaugcuccuggucuau

SEQ ID NO: 1067682 - RNA, 19 nt, Homo sapiens
uaaaacacgugaggaggaa

SEQ ID NO: 1067683 - RNA, 19 nt, Homo sapiens
gaacaguccucgacaguga

SEQ ID NO: 1067684 - RNA, 19 nt, Homo sapiens
ccaaguggcugcuauguaa

SEQ ID NO: 1067685 - RNA, 19 nt, Homo sapiens
gaaguucccugauggguuu

SEQ ID NO: 1067686 - RNA, 19 nt, Homo sapiens
cagcaacccucuagucuua

SEQ ID NO: 1067687 - RNA, 19 nt, Homo sapiens
ccaaaugucucuauccuuu

SEQ ID NO: 1067688 - RNA, 19 nt, Homo sapiens
gaacaaauccuaugaugug

SEQ ID NO: 1067689 - RNA, 19 nt, Homo sapiens
ccacaaagccagggaaaua

SEQ ID NO: 1067690 - RNA, 19 nt, Homo sapiens
guaaugaaguucccugaug

SEQ ID NO: 1067691 - RNA, 19 nt, Homo sapiens
caacagggccucucaagug

SEQ ID NO: 1067692 - RNA, 19 nt, Homo sapiens
aaucagaggucguaaugaa

SEQ ID NO: 1067693 - RNA, 19 nt, Homo sapiens
ggaaucaucuggcaagaac

SEQ ID NO: 1067694 - RNA, 19 nt, Homo sapiens
ggagcucacugcccagauu

SEQ ID NO: 1067695 - RNA, 19 nt, Homo sapiens
ucagguggcuggaggauga

SEQ ID NO: 1067696 - RNA, 19 nt, Homo sapiens
gcaagaacaaauccuauga

SEQ ID NO: 1067697 - RNA, 19 nt, Homo sapiens
gccgugcccucaacaauuu

SEQ ID NO: 1067698 - RNA, 19 nt, Homo sapiens
gaccgcaacuucuugaaug

SEQ ID NO: 1067699 - RNA, 19 nt, Homo sapiens
ggacagccuuauucccaaa

SEQ ID NO: 1067700 - RNA, 19 nt, Homo sapiens
ggaaucagaggucguaaug

SEQ ID NO: 1067701 - RNA, 19 nt, Homo sapiens
gacauggacuggucucuca

SEQ ID NO: 1067702 - RNA, 19 nt, Homo sapiens
gaauugagaacuuugaugu

SEQ ID NO: 1067703 - RNA, 19 nt, Homo sapiens
caaaccaccuggacaugga

SEQ ID NO: 1067704 - RNA, 19 nt, Homo sapiens
gaagacaacguuacugaag

SEQ ID NO: 1067705 - RNA, 19 nt, Homo sapiens
gccagcggcuagaugguua

SEQ ID NO: 1067706 - RNA, 19 nt, Homo sapiens
ugucaaagauaacggagaa

SEQ ID NO: 1067707 - RNA, 19 nt, Homo sapiens
gcagaaaucuaugccaaac

SEQ ID NO: 1067708 - RNA, 19 nt, Homo sapiens
uggcugcuauguaaauuaa

SEQ ID NO: 1067709 - RNA, 19 nt, Homo sapiens
uccuguggcuggagaauua

SEQ ID NO: 1067710 - RNA, 19 nt, Homo sapiens
aaacgucagugcuguggaa

SEQ ID NO: 1067711 - RNA, 19 nt, Homo sapiens
gcuguuagaugaaccuaca

SEQ ID NO: 1067712 - RNA, 19 nt, Homo sapiens
gggaagacaacguuacuga

SEQ ID NO: 1067713 - RNA, 19 nt, Homo sapiens
gcaaggaagggcgagauuu

SEQ ID NO: 1067714 - RNA, 19 nt, Homo sapiens
agaaaucuaugccaaacug

SEQ ID NO: 1067715 - RNA, 19 nt, Homo sapiens
aagaacaaauccuaugaug

SEQ ID NO: 1067716 - RNA, 19 nt, Homo sapiens
gagaaggacacgcucaaga

SEQ ID NO: 1067717 - RNA, 19 nt, Homo sapiens
ggaagacaacguuacugaa

SEQ ID NO: 1067718 - RNA, 19 nt, Homo sapiens
caaagauaacggagaacua

SEQ ID NO: 1067719 - RNA, 19 nt, Homo sapiens
uggagcagcuggaccuaaa

SEQ ID NO: 1067720 - RNA, 19 nt, Homo sapiens
agagugugcuggagaguga

SEQ ID NO: 1067721 - RNA, 19 nt, Homo sapiens
gaaaggagagucgguugga

SEQ ID NO: 1067722 - RNA, 19 nt, Homo sapiens
ugaaugccaucgccacaga

SEQ ID NO: 1067723 - RNA, 19 nt, Homo sapiens
gaacuuugaugugucuuuu

SEQ ID NO: 1067724 - RNA, 19 nt, Homo sapiens
ggaagucuaccaugcugaa

SEQ ID NO: 1067725 - RNA, 19 nt, Homo sapiens
caaggaaucagaggucgua

SEQ ID NO: 1067726 - RNA, 19 nt, Homo sapiens
cuacgacuguggaaccaaa

SEQ ID NO: 1067727 - RNA, 19 nt, Homo sapiens
gcagcuagaugagguggau

SEQ ID NO: 1067728 - RNA, 19 nt, Homo sapiens
ccuaugaugugcgaauuga

SEQ ID NO: 1067729 - RNA, 19 nt, Homo sapiens
caaggaagggcgagauuuc

SEQ ID NO: 1067730 - RNA, 19 nt, Homo sapiens
gacagugaaugcaaagaag

SEQ ID NO: 1067731 - RNA, 19 nt, Homo sapiens
cagacacgcucacaggaau

SEQ ID NO: 1067732 - RNA, 19 nt, Homo sapiens
ugagguggauuucuacuac

SEQ ID NO: 1067733 - RNA, 19 nt, Homo sapiens
agacaacguuacugaagau

SEQ ID NO: 1067734 - RNA, 19 nt, Homo sapiens
cgacagugaaugcaaagaa

SEQ ID NO: 1067735 - RNA, 19 nt, Homo sapiens
agaugaaccuacaaacaug

SEQ ID NO: 1067736 - RNA, 19 nt, Homo sapiens
agaccuucaucaagaguaa

SEQ ID NO: 1067737 - RNA, 19 nt, Homo sapiens
cgaguggccuuugcucaga

SEQ ID NO: 1067738 - RNA, 19 nt, Homo sapiens
caacguuacugaagaugcu

SEQ ID NO: 1067739 - RNA, 19 nt, Homo sapiens
aagacaacguuacugaaga

SEQ ID NO: 1067740 - RNA, 19 nt, Homo sapiens
uagaugaaccuacaaacau

SEQ ID NO: 1067741 - RNA, 19 nt, Homo sapiens
ccucgacagugaaugcaaa

SEQ ID NO: 1067742 - RNA, 19 nt, Homo sapiens
aaggaggauuugaccagua

SEQ ID NO: 1067743 - RNA, 19 nt, Homo sapiens
gaagagccgaguggccuuu

SEQ ID NO: 1067744 - RNA, 19 nt, Homo sapiens
ucaagaugcuggagaagcu

SEQ ID NO: 1067745 - RNA, 19 nt, Homo sapiens
gcacguugagcaagagguu

SEQ ID NO: 1067746 - RNA, 19 nt, Homo sapiens
gagagucgguuggaaucau

SEQ ID NO: 1067747 - RNA, 19 nt, Homo sapiens
ccuauccaguugucaaaga

SEQ ID NO: 1067748 - RNA, 19 nt, Homo sapiens
ccacaaaccaccuggacau

SEQ ID NO: 1067749 - RNA, 19 nt, Homo sapiens
uggagcaucuucugcacaa

SEQ ID NO: 1067750 - RNA, 19 nt, Homo sapiens
gaacugcuggcacgcaagu

SEQ ID NO: 1067751 - RNA, 19 nt, Homo sapiens
cugauggguuugagaaguu

SEQ ID NO: 1067752 - RNA, 19 nt, Homo sapiens
caaccagcagcgugaauau

SEQ ID NO: 1067753 - RNA, 19 nt, Homo sapiens
ggagaagcgcucagagaag

SEQ ID NO: 1067754 - RNA, 19 nt, Homo sapiens
ggccgugcccucaacaauu

SEQ ID NO: 1067755 - RNA, 19 nt, Homo sapiens
acggacaggucuucgacua

SEQ ID NO: 1067756 - RNA, 19 nt, Homo sapiens
cuacgugaccggcgucuug

SEQ ID NO: 1067757 - RNA, 19 nt, Homo sapiens
aaacuuccaggacugcuaa

SEQ ID NO: 1067758 - RNA, 19 nt, Homo sapiens
ucaaccagcagcgugaaua

SEQ ID NO: 1067759 - RNA, 19 nt, Homo sapiens
ugagaacuuugaugugucu

SEQ ID NO: 1067760 - RNA, 19 nt, Homo sapiens
caagaacaaauccuaugau

SEQ ID NO: 1067761 - RNA, 19 nt, Homo sapiens
gcucacaggaaucugaaga

SEQ ID NO: 1067762 - RNA, 19 nt, Homo sapiens
cagaggucguaaugaaguu

SEQ ID NO: 1067763 - RNA, 19 nt, Homo sapiens
caggagaagcgcucagaga

SEQ ID NO: 1067764 - RNA, 19 nt, Homo sapiens
caacuucuacauucuggau

SEQ ID NO: 1067765 - RNA, 19 nt, Homo sapiens
caucuucagucgccucucu

SEQ ID NO: 1067766 - RNA, 19 nt, Homo sapiens
gcugaggccuguggacaag

SEQ ID NO: 1067767 - RNA, 19 nt, Homo sapiens
aguggaacauggcgacuug

SEQ ID NO: 1067768 - RNA, 19 nt, Homo sapiens
gcacauccagguuuucauu

SEQ ID NO: 1067769 - RNA, 19 nt, Homo sapiens
ccaaacuggaggagauuga

SEQ ID NO: 1067770 - RNA, 19 nt, Homo sapiens
ggcaagaacaaauccuaug

SEQ ID NO: 1067771 - RNA, 19 nt, Homo sapiens
ggacgccccuauccaguug

SEQ ID NO: 1067772 - RNA, 19 nt, Homo sapiens
aaaggagagucgguuggaa

SEQ ID NO: 1067773 - RNA, 19 nt, Homo sapiens
ugaaugcaaagaaguuaga

SEQ ID NO: 1067774 - RNA, 19 nt, Homo sapiens
caaacuuccaggacugcua

SEQ ID NO: 1067775 - RNA, 19 nt, Homo sapiens
ucagacacgcucacaggaa

SEQ ID NO: 1067776 - RNA, 19 nt, Homo sapiens
ccacgaccgcaacuucuug

SEQ ID NO: 1067777 - RNA, 19 nt, Homo sapiens
ggagauugaggcugacaag

SEQ ID NO: 1067778 - RNA, 19 nt, Homo sapiens
ucugaagauuggcuauuuc

SEQ ID NO: 1067779 - RNA, 19 nt, Homo sapiens
caauucugcagcuagauga

SEQ ID NO: 1067780 - RNA, 19 nt, Homo sapiens
ccaauucugcagcuagaug

SEQ ID NO: 1067781 - RNA, 19 nt, Homo sapiens
aaagauaacggagaacuac

SEQ ID NO: 1067782 - RNA, 19 nt, Homo sapiens
gaaucagaggucguaauga

SEQ ID NO: 1067783 - RNA, 19 nt, Homo sapiens
caacuaagcugucuucaaa

SEQ ID NO: 1067784 - RNA, 19 nt, Homo sapiens
gaacaaggaugcauacuau

SEQ ID NO: 1067785 - RNA, 19 nt, Homo sapiens
ggacaaaccagcaacauuu

SEQ ID NO: 1067786 - RNA, 19 nt, Homo sapiens
gcaguagagugguauuaua

SEQ ID NO: 1067787 - RNA, 19 nt, Homo sapiens
agacaugcaucaaauagua

SEQ ID NO: 1067788 - RNA, 19 nt, Homo sapiens
cgacagacccuauuucaaa

SEQ ID NO: 1067789 - RNA, 19 nt, Homo sapiens
ggaacuggcuaaucauuuc

SEQ ID NO: 1067790 - RNA, 19 nt, Homo sapiens
ggaggacaccauuauguua

SEQ ID NO: 1067791 - RNA, 19 nt, Homo sapiens
gaaaggaacaucuauugug

SEQ ID NO: 1067792 - RNA, 19 nt, Homo sapiens
cagccaagguucagaaauu

SEQ ID NO: 1067793 - RNA, 19 nt, Homo sapiens
caaagaugguuacauuaga

SEQ ID NO: 1067794 - RNA, 19 nt, Homo sapiens
gcugaagaccugcaaguua

SEQ ID NO: 1067795 - RNA, 19 nt, Homo sapiens
ggauauacucuucagaaua

SEQ ID NO: 1067796 - RNA, 19 nt, Homo sapiens
ggaugcauacuauaacuua

SEQ ID NO: 1067797 - RNA, 19 nt, Homo sapiens
gacgggaacuggcuaauca

SEQ ID NO: 1067798 - RNA, 19 nt, Homo sapiens
ggaacaaggaugcauacua

SEQ ID NO: 1067799 - RNA, 19 nt, Homo sapiens
gcccuuguguucagaauuu

SEQ ID NO: 1067800 - RNA, 19 nt, Homo sapiens
ggaguugcauggaaugaga

SEQ ID NO: 1067801 - RNA, 19 nt, Homo sapiens
gauucuagauccacauuau

SEQ ID NO: 1067802 - RNA, 19 nt, Homo sapiens
guucagaaauugccucuca

SEQ ID NO: 1067803 - RNA, 19 nt, Homo sapiens
uaucagacaugcaucaaau

SEQ ID NO: 1067804 - RNA, 19 nt, Homo sapiens
gagauuacagggcagauaa

SEQ ID NO: 1067805 - RNA, 19 nt, Homo sapiens
ccacauacuuaccuuaauc

SEQ ID NO: 1067806 - RNA, 19 nt, Homo sapiens
gcuaaucauuuccaaagug

SEQ ID NO: 1067807 - RNA, 19 nt, Homo sapiens
cauggagacugguaugauu

SEQ ID NO: 1067808 - RNA, 19 nt, Homo sapiens
cagaugagccauacaaaga

SEQ ID NO: 1067809 - RNA, 19 nt, Homo sapiens
gcuuaucacuuuccagaug

SEQ ID NO: 1067810 - RNA, 19 nt, Homo sapiens
gaggacaccauuauguuaa

SEQ ID NO: 1067811 - RNA, 19 nt, Homo sapiens
acagagagguccauuccaa

SEQ ID NO: 1067812 - RNA, 19 nt, Homo sapiens
gggcauauauggcuaucau

SEQ ID NO: 1067813 - RNA, 19 nt, Homo sapiens
gauggaagggcccagauuu

SEQ ID NO: 1067814 - RNA, 19 nt, Homo sapiens
cugaagaccugcaaguuau

SEQ ID NO: 1067815 - RNA, 19 nt, Homo sapiens
gcucuugguucaaacauca

SEQ ID NO: 1067816 - RNA, 19 nt, Homo sapiens
agacugguaugauuuaugu

SEQ ID NO: 1067817 - RNA, 19 nt, Homo sapiens
gguucuaguuugaccauuu

SEQ ID NO: 1067818 - RNA, 19 nt, Homo sapiens
caucagggauacacagaga

SEQ ID NO: 1067819 - RNA, 19 nt, Homo sapiens
gaugagccauacaaagaug

SEQ ID NO: 1067820 - RNA, 19 nt, Homo sapiens
agaaggcacugaaacaugu

SEQ ID NO: 1067821 - RNA, 19 nt, Homo sapiens
acaaggaugcauacuauaa

SEQ ID NO: 1067822 - RNA, 19 nt, Homo sapiens
cuaaucauuuccaaaguga

SEQ ID NO: 1067823 - RNA, 19 nt, Homo sapiens
gucuaaugcuuaucacuuu

SEQ ID NO: 1067824 - RNA, 19 nt, Homo sapiens
gaagaccugcaaguuauuu

SEQ ID NO: 1067825 - RNA, 19 nt, Homo sapiens
ccucagcgaccaaauauga

SEQ ID NO: 1067826 - RNA, 19 nt, Homo sapiens
uuacagggcagauaaaguu

SEQ ID NO: 1067827 - RNA, 19 nt, Homo sapiens
uaucugcucuugguucaaa

SEQ ID NO: 1067828 - RNA, 19 nt, Homo sapiens
gcauauauggcuaucauca

SEQ ID NO: 1067829 - RNA, 19 nt, Homo sapiens
gcagugacauaaacaccau

SEQ ID NO: 1067830 - RNA, 19 nt, Homo sapiens
caguagagugguauuauaa

SEQ ID NO: 1067831 - RNA, 19 nt, Homo sapiens
caaaaggucuaaugcuuau

SEQ ID NO: 1067832 - RNA, 19 nt, Homo sapiens
gaaagcggaggacaccauu

SEQ ID NO: 1067833 - RNA, 19 nt, Homo sapiens
gaucuuaugcuggaaaugu

SEQ ID NO: 1067834 - RNA, 19 nt, Homo sapiens
uaagaggaggccuugauuu

SEQ ID NO: 1067835 - RNA, 19 nt, Homo sapiens
gggcugugcuuaucgaucu

SEQ ID NO: 1067836 - RNA, 19 nt, Homo sapiens
ggacauggugauuucagaa

SEQ ID NO: 1067837 - RNA, 19 nt, Homo sapiens
gggaacuggcuaaucauuu

SEQ ID NO: 1067838 - RNA, 19 nt, Homo sapiens
gcuagcuacuccuaaugaa

SEQ ID NO: 1067839 - RNA, 19 nt, Homo sapiens
ggaguuacauggucuuuuc

SEQ ID NO: 1067840 - RNA, 19 nt, Homo sapiens
agacugcaguagaguggua

SEQ ID NO: 1067841 - RNA, 19 nt, Homo sapiens
agaaauugccucucaagga

SEQ ID NO: 1067842 - RNA, 19 nt, Homo sapiens
uaaaccaauugaucgguau

SEQ ID NO: 1067843 - RNA, 19 nt, Homo sapiens
gaagaaacauggggaaaag

SEQ ID NO: 1067844 - RNA, 19 nt, Homo sapiens
aaacaccauuccuggagaa

SEQ ID NO: 1067845 - RNA, 19 nt, Homo sapiens
guucagaauuugccacagu

SEQ ID NO: 1067846 - RNA, 19 nt, Homo sapiens
ucagcuagcuacuccuaau

SEQ ID NO: 1067847 - RNA, 19 nt, Homo sapiens
ggucuaaugcuuaucacuu

SEQ ID NO: 1067848 - RNA, 19 nt, Homo sapiens
guaacgcccaucauugaaa

SEQ ID NO: 1067849 - RNA, 19 nt, Homo sapiens
acaguucaguguauauaug

SEQ ID NO: 1067850 - RNA, 19 nt, Homo sapiens
ccacaguucaguguauaua

SEQ ID NO: 1067851 - RNA, 19 nt, Homo sapiens
uaaauccugguucuaguuu

SEQ ID NO: 1067852 - RNA, 19 nt, Homo sapiens
ggagacugguaugauuuau

SEQ ID NO: 1067853 - RNA, 19 nt, Homo sapiens
gucaaagacugcaguagag

SEQ ID NO: 1067854 - RNA, 19 nt, Homo sapiens
gggacaaaccagcaacauu

SEQ ID NO: 1067855 - RNA, 19 nt, Homo sapiens
ucaagaaggcacugaaaca

SEQ ID NO: 1067856 - RNA, 19 nt, Homo sapiens
uaacgcccaucauugaaag

SEQ ID NO: 1067857 - RNA, 19 nt, Homo sapiens
gcuguaacgcccaucauug

SEQ ID NO: 1067858 - RNA, 19 nt, Homo sapiens
auacugcgcuuuguucaau

SEQ ID NO: 1067859 - RNA, 19 nt, Homo sapiens
caacacacagagaaauuca

SEQ ID NO: 1067860 - RNA, 19 nt, Homo sapiens
guucaaacaucagggauac

SEQ ID NO: 1067861 - RNA, 19 nt, Homo sapiens
acaaagaugguuacauuag

SEQ ID NO: 1067862 - RNA, 19 nt, Homo sapiens
gacuuuaccugucgaugca

SEQ ID NO: 1067863 - RNA, 19 nt, Homo sapiens
aagaggaggccuugauuug

SEQ ID NO: 1067864 - RNA, 19 nt, Homo sapiens
ucagcaggcucuagucgau

SEQ ID NO: 1067865 - RNA, 19 nt, Homo sapiens
caaacgcccuuguguucag

SEQ ID NO: 1067866 - RNA, 19 nt, Homo sapiens
ucgcggacauggugauuuc

SEQ ID NO: 1067867 - RNA, 19 nt, Homo sapiens
guguauauauggccuagca

SEQ ID NO: 1067868 - RNA, 19 nt, Homo sapiens
ggaaagcggaggacaccau

SEQ ID NO: 1067869 - RNA, 19 nt, Homo sapiens
aauccugguucuaguuuga

SEQ ID NO: 1067870 - RNA, 19 nt, Homo sapiens
ggauggaagggcccagauu

SEQ ID NO: 1067871 - RNA, 19 nt, Homo sapiens
uagcuacuccuaaugaaau

SEQ ID NO: 1067872 - RNA, 19 nt, Homo sapiens
gcggaggacaccauuaugu

SEQ ID NO: 1067873 - RNA, 19 nt, Homo sapiens
gacaugcaucaaauaguaa

SEQ ID NO: 1067874 - RNA, 19 nt, Homo sapiens
cauuagaaauccacauacu

SEQ ID NO: 1067875 - RNA, 19 nt, Homo sapiens
uggauauacucuucagaau

SEQ ID NO: 1067876 - RNA, 19 nt, Homo sapiens
ucaaaaggucuaaugcuua

SEQ ID NO: 1067877 - RNA, 19 nt, Homo sapiens
gacagacccuauuucaaaa

SEQ ID NO: 1067878 - RNA, 19 nt, Homo sapiens
caagaaggcacugaaacau

SEQ ID NO: 1067879 - RNA, 19 nt, Homo sapiens
ucgaugcaguuauaucugu

SEQ ID NO: 1067880 - RNA, 19 nt, Homo sapiens
ugagccagaagaagauaua

SEQ ID NO: 1067881 - RNA, 19 nt, Homo sapiens
cacauuaaauccugguucu

SEQ ID NO: 1067882 - RNA, 19 nt, Homo sapiens
gguacuaaaccaauugauc

SEQ ID NO: 1067883 - RNA, 19 nt, Homo sapiens
ggauauaguuggccuaaua

SEQ ID NO: 1067884 - RNA, 19 nt, Homo sapiens
gaaggaagcuguaugugaa

SEQ ID NO: 1067885 - RNA, 19 nt, Homo sapiens
gaaacaaggugcagagcua

SEQ ID NO: 1067886 - RNA, 19 nt, Homo sapiens
aaacuucgauuuccucaua

SEQ ID NO: 1067887 - RNA, 19 nt, Homo sapiens
caagaagacuuuaccauca

SEQ ID NO: 1067888 - RNA, 19 nt, Homo sapiens
ccagugaaauacagacuua

SEQ ID NO: 1067889 - RNA, 19 nt, Homo sapiens
gacgaaagcugauaugcaa

SEQ ID NO: 1067890 - RNA, 19 nt, Homo sapiens
gauacugacuugaguuauu

SEQ ID NO: 1067891 - RNA, 19 nt, Homo sapiens
aaacauaccugguuguaca

SEQ ID NO: 1067892 - RNA, 19 nt, Homo sapiens
ggaaggaagcuguauguga

SEQ ID NO: 1067893 - RNA, 19 nt, Homo sapiens
gcaauacuguuggaauuau

SEQ ID NO: 1067894 - RNA, 19 nt, Homo sapiens
aauaaagccuuguugauug

SEQ ID NO: 1067895 - RNA, 19 nt, Homo sapiens
gaacaagaacauaugagaa

SEQ ID NO: 1067896 - RNA, 19 nt, Homo sapiens
ucacuugaauguuagguuu

SEQ ID NO: 1067897 - RNA, 19 nt, Homo sapiens
caagucagauggcugcauu

SEQ ID NO: 1067898 - RNA, 19 nt, Homo sapiens
gcaugaacguuucgaaauc

SEQ ID NO: 1067899 - RNA, 19 nt, Homo sapiens
gaagaacaagaacauauga

SEQ ID NO: 1067900 - RNA, 19 nt, Homo sapiens
gaacuccaauguaucuugu

SEQ ID NO: 1067901 - RNA, 19 nt, Homo sapiens
gcacaugacaucaaauugu

SEQ ID NO: 1067902 - RNA, 19 nt, Homo sapiens
uccaagcucuuauuacuaa

SEQ ID NO: 1067903 - RNA, 19 nt, Homo sapiens
gugaacaccuggauauaug

SEQ ID NO: 1067904 - RNA, 19 nt, Homo sapiens
ugucaugacugaacgaauu

SEQ ID NO: 1067905 - RNA, 19 nt, Homo sapiens
agaaagagaugcgaaacaa

SEQ ID NO: 1067906 - RNA, 19 nt, Homo sapiens
gacauucugccuagauuua

SEQ ID NO: 1067907 - RNA, 19 nt, Homo sapiens
guaaauaaagccuuguuga

SEQ ID NO: 1067908 - RNA, 19 nt, Homo sapiens
gauuguugcugacaucuug

SEQ ID NO: 1067909 - RNA, 19 nt, Homo sapiens
ggagaagaccuuucagugu

SEQ ID NO: 1067910 - RNA, 19 nt, Homo sapiens
uaguggagcuacacauuaa

SEQ ID NO: 1067911 - RNA, 19 nt, Homo sapiens
gcagcuaguuaauauuuca

SEQ ID NO: 1067912 - RNA, 19 nt, Homo sapiens
cauaagaucacuugaaugu

SEQ ID NO: 1067913 - RNA, 19 nt, Homo sapiens
gagaauaaacucuuucaag

SEQ ID NO: 1067914 - RNA, 19 nt, Homo sapiens
gcaaacauaccugguugua

SEQ ID NO: 1067915 - RNA, 19 nt, Homo sapiens
gaagagucgugugguguga

SEQ ID NO: 1067916 - RNA, 19 nt, Homo sapiens
gaucuuaagugguuugacu

SEQ ID NO: 1067917 - RNA, 19 nt, Homo sapiens
gaagguacaagguauaauc

SEQ ID NO: 1067918 - RNA, 19 nt, Homo sapiens
ucaauuccaugucuuuguu

SEQ ID NO: 1067919 - RNA, 19 nt, Homo sapiens
aaacauaccaguuggauca

SEQ ID NO: 1067920 - RNA, 19 nt, Homo sapiens
gcauuaauuugcagcguau

SEQ ID NO: 1067921 - RNA, 19 nt, Homo sapiens
gaacuauacuaaucuucuc

SEQ ID NO: 1067922 - RNA, 19 nt, Homo sapiens
uaauauguaucgccuuaga

SEQ ID NO: 1067923 - RNA, 19 nt, Homo sapiens
gcuccaagcucuuauuacu

SEQ ID NO: 1067924 - RNA, 19 nt, Homo sapiens
gugcuaacaccacgaauaa

SEQ ID NO: 1067925 - RNA, 19 nt, Homo sapiens
ggaaccagaucacgauuuu

SEQ ID NO: 1067926 - RNA, 19 nt, Homo sapiens
ugacugaacgaauuuguuu

SEQ ID NO: 1067927 - RNA, 19 nt, Homo sapiens
ggguuacuauuaaagcaua

SEQ ID NO: 1067928 - RNA, 19 nt, Homo sapiens
aaagcgcagugccaaauuu

SEQ ID NO: 1067929 - RNA, 19 nt, Homo sapiens
gauauaguuggccuaauaa

SEQ ID NO: 1067930 - RNA, 19 nt, Homo sapiens
cauggacacucaggauaua

SEQ ID NO: 1067931 - RNA, 19 nt, Homo sapiens
gcauuugucugugucaaga

SEQ ID NO: 1067932 - RNA, 19 nt, Homo sapiens
cacaugacaucaaauuguu

SEQ ID NO: 1067933 - RNA, 19 nt, Homo sapiens
gaauugguuuguguacauu

SEQ ID NO: 1067934 - RNA, 19 nt, Homo sapiens
gcauggugcucuucuucuu

SEQ ID NO: 1067935 - RNA, 19 nt, Homo sapiens
gaauauaauggguauguuc

SEQ ID NO: 1067936 - RNA, 19 nt, Homo sapiens
aaguugacauuucugcuua

SEQ ID NO: 1067937 - RNA, 19 nt, Homo sapiens
gaugagagccugcagacau

SEQ ID NO: 1067938 - RNA, 19 nt, Homo sapiens
ugagaaggcugggaggauu

SEQ ID NO: 1067939 - RNA, 19 nt, Homo sapiens
cgcaggaacuccaauguau

SEQ ID NO: 1067940 - RNA, 19 nt, Homo sapiens
cuacaagucagugaaauaa

SEQ ID NO: 1067941 - RNA, 19 nt, Homo sapiens
ugugcuacauugucuauuu

SEQ ID NO: 1067942 - RNA, 19 nt, Homo sapiens
caacguggccuugcaguau

SEQ ID NO: 1067943 - RNA, 19 nt, Homo sapiens
uccuuaaccuguauugaua

SEQ ID NO: 1067944 - RNA, 19 nt, Homo sapiens
acacauccauggacacuca

SEQ ID NO: 1067945 - RNA, 19 nt, Homo sapiens
cugggaggauuguguauuu

SEQ ID NO: 1067946 - RNA, 19 nt, Homo sapiens
gaacuaaugacaacuugag

SEQ ID NO: 1067947 - RNA, 19 nt, Homo sapiens
gccuguggguuacuauuaa

SEQ ID NO: 1067948 - RNA, 19 nt, Homo sapiens
ccaguuggaucaugauaag

SEQ ID NO: 1067949 - RNA, 19 nt, Homo sapiens
ccucauaguccuuuaaguu

SEQ ID NO: 1067950 - RNA, 19 nt, Homo sapiens
cagaagaacaagaacauau

SEQ ID NO: 1067951 - RNA, 19 nt, Homo sapiens
ucauaguccuuuaaguuga

SEQ ID NO: 1067952 - RNA, 19 nt, Homo sapiens
ugacucugauucauuauag

SEQ ID NO: 1067953 - RNA, 19 nt, Homo sapiens
gcaauggucuugggcaaac

SEQ ID NO: 1067954 - RNA, 19 nt, Homo sapiens
gacggaauuucucugcaaa

SEQ ID NO: 1067955 - RNA, 19 nt, Homo sapiens
ggcaauacuguuggaauua

SEQ ID NO: 1067956 - RNA, 19 nt, Homo sapiens
ugaauugguuuguguacau

SEQ ID NO: 1067957 - RNA, 19 nt, Homo sapiens
cauaccaguuggaucauga

SEQ ID NO: 1067958 - RNA, 19 nt, Homo sapiens
gcuuacugcuacuggauuu

SEQ ID NO: 1067959 - RNA, 19 nt, Homo sapiens
auaaagccuuguugauuga

SEQ ID NO: 1067960 - RNA, 19 nt, Homo sapiens
gcauggaggaaucuaugua

SEQ ID NO: 1067961 - RNA, 19 nt, Homo sapiens
ugacggaauuucucugcaa

SEQ ID NO: 1067962 - RNA, 19 nt, Homo sapiens
ggugugaauugguuugugu

SEQ ID NO: 1067963 - RNA, 19 nt, Homo sapiens
ccacugggcucugguccuu

SEQ ID NO: 1067964 - RNA, 19 nt, Homo sapiens
uugugacucugauucauua

SEQ ID NO: 1067965 - RNA, 19 nt, Homo sapiens
gucaggauguucaaaggaa

SEQ ID NO: 1067966 - RNA, 19 nt, Homo sapiens
ggaagugucaggauguuca

SEQ ID NO: 1067967 - RNA, 19 nt, Homo sapiens
gcugacaucuuggccauca

SEQ ID NO: 1067968 - RNA, 19 nt, Homo sapiens
ggaggaaucuauguaaagc

SEQ ID NO: 1067969 - RNA, 19 nt, Homo sapiens
ugcauaagaucacuugaau

SEQ ID NO: 1067970 - RNA, 19 nt, Homo sapiens
gagaggcaauacuguugga

SEQ ID NO: 1067971 - RNA, 19 nt, Homo sapiens
agaagaccuuucaguguga

SEQ ID NO: 1067972 - RNA, 19 nt, Homo sapiens
cgaaaucaaagauaagaug

SEQ ID NO: 1067973 - RNA, 19 nt, Homo sapiens
aggcaauacuguuggaauu

SEQ ID NO: 1067974 - RNA, 19 nt, Homo sapiens
gaagucgcguuucuguagu

SEQ ID NO: 1067975 - RNA, 19 nt, Homo sapiens
aagaagacuuuaccaucaa

SEQ ID NO: 1067976 - RNA, 19 nt, Homo sapiens
uccaauguaucuugugauu

SEQ ID NO: 1067977 - RNA, 19 nt, Homo sapiens
gaaagaaggguuaaaaugg

SEQ ID NO: 1067978 - RNA, 19 nt, Homo sapiens
auuaagagccguauaccua

SEQ ID NO: 1067979 - RNA, 19 nt, Homo sapiens
caugaacguuucgaaauca

SEQ ID NO: 1067980 - RNA, 19 nt, Homo sapiens
gcuaacaccacgaauaaag

SEQ ID NO: 1067981 - RNA, 19 nt, Homo sapiens
ggaacuccaauguaucuug

SEQ ID NO: 1067982 - RNA, 19 nt, Homo sapiens
guguuuggaugaaaguaaa

SEQ ID NO: 1067983 - RNA, 19 nt, Homo sapiens
caacagaccuaauacauuu

SEQ ID NO: 1067984 - RNA, 19 nt, Homo sapiens
ucauuuagcugcugauuua

SEQ ID NO: 1067985 - RNA, 19 nt, Homo sapiens
ggaaguagcugaagcaaag

SEQ ID NO: 1067986 - RNA, 19 nt, Homo sapiens
gaucaacuccucucuguua

SEQ ID NO: 1067987 - RNA, 19 nt, Homo sapiens
ggccuuggauucaauauua

SEQ ID NO: 1067988 - RNA, 19 nt, Homo sapiens
gaaauuaugaugcgaagua

SEQ ID NO: 1067989 - RNA, 19 nt, Homo sapiens
ggagagagauauuuguaga

SEQ ID NO: 1067990 - RNA, 19 nt, Homo sapiens
uaacaucauugcugcauuu

SEQ ID NO: 1067991 - RNA, 19 nt, Homo sapiens
gaacaaaacucuccaaucu

SEQ ID NO: 1067992 - RNA, 19 nt, Homo sapiens
gaaauggagucgcgcuuug

SEQ ID NO: 1067993 - RNA, 19 nt, Homo sapiens
gcaagaggauguaauugau

SEQ ID NO: 1067994 - RNA, 19 nt, Homo sapiens
guuagaagaugauggauug

SEQ ID NO: 1067995 - RNA, 19 nt, Homo sapiens
acaaaggaguggagaagua

SEQ ID NO: 1067996 - RNA, 19 nt, Homo sapiens
gauaggaucauguuguuaa

SEQ ID NO: 1067997 - RNA, 19 nt, Homo sapiens
caaagugaauucugcaaug

SEQ ID NO: 1067998 - RNA, 19 nt, Homo sapiens
gcaggcaacagaccuaaua

SEQ ID NO: 1067999 - RNA, 19 nt, Homo sapiens
gcaaagaguccuucaaagu

SEQ ID NO: 1068000 - RNA, 19 nt, Homo sapiens
ccaaaguaguauagaagua

SEQ ID NO: 1068001 - RNA, 19 nt, Homo sapiens
guaaaguucuccaauucuu

SEQ ID NO: 1068002 - RNA, 19 nt, Homo sapiens
gcaauucuguccuacuguu

SEQ ID NO: 1068003 - RNA, 19 nt, Homo sapiens
cacagaaacuucaggcuuu

SEQ ID NO: 1068004 - RNA, 19 nt, Homo sapiens
gguaaaucaugacucagua

SEQ ID NO: 1068005 - RNA, 19 nt, Homo sapiens
gcaacagaccuaauacauu

SEQ ID NO: 1068006 - RNA, 19 nt, Homo sapiens
aaagaguccuucaaaguga

SEQ ID NO: 1068007 - RNA, 19 nt, Homo sapiens
caggaacauuuguacuuua

SEQ ID NO: 1068008 - RNA, 19 nt, Homo sapiens
ggauguaauugauagcauu

SEQ ID NO: 1068009 - RNA, 19 nt, Homo sapiens
ugacaaauguuagaagaug

SEQ ID NO: 1068010 - RNA, 19 nt, Homo sapiens
gaagagggccuuggauuca

SEQ ID NO: 1068011 - RNA, 19 nt, Homo sapiens
caacuccucucuguuaaug

SEQ ID NO: 1068012 - RNA, 19 nt, Homo sapiens
caacuuacaggaacauuug

SEQ ID NO: 1068013 - RNA, 19 nt, Homo sapiens
gcugaaagccgcacaagga

SEQ ID NO: 1068014 - RNA, 19 nt, Homo sapiens
caaagaguccuucaaagug

SEQ ID NO: 1068015 - RNA, 19 nt, Homo sapiens
agaagaugauggauugaaa

SEQ ID NO: 1068016 - RNA, 19 nt, Homo sapiens
caaaacagguucagauuuc

SEQ ID NO: 1068017 - RNA, 19 nt, Homo sapiens
ugagagagguauaugaaca

SEQ ID NO: 1068018 - RNA, 19 nt, Homo sapiens
caggaagaauagaauugua

SEQ ID NO: 1068019 - RNA, 19 nt, Homo sapiens
cuuaaagacugaaagaguu

SEQ ID NO: 1068020 - RNA, 19 nt, Homo sapiens
gaaggagaacaucaugaaa

SEQ ID NO: 1068021 - RNA, 19 nt, Homo sapiens
gacaaauguuagaagauga

SEQ ID NO: 1068022 - RNA, 19 nt, Homo sapiens
gacugugacugaggucuua

SEQ ID NO: 1068023 - RNA, 19 nt, Homo sapiens
caagaggauguaauugaua

SEQ ID NO: 1068024 - RNA, 19 nt, Homo sapiens
gcauaacagucucaucuac

SEQ ID NO: 1068025 - RNA, 19 nt, Homo sapiens
ggaucauguuguuaaauug

SEQ ID NO: 1068026 - RNA, 19 nt, Homo sapiens
acaggaacauuuguacuuu

SEQ ID NO: 1068027 - RNA, 19 nt, Homo sapiens
caucuacggcaguucauua

SEQ ID NO: 1068028 - RNA, 19 nt, Homo sapiens
ccagagaugcauacacuuu

SEQ ID NO: 1068029 - RNA, 19 nt, Homo sapiens
ggcaagaggauguaauuga

SEQ ID NO: 1068030 - RNA, 19 nt, Homo sapiens
auacacacccaaagucuua

SEQ ID NO: 1068031 - RNA, 19 nt, Homo sapiens
cucacuagcuucaagagua

SEQ ID NO: 1068032 - RNA, 19 nt, Homo sapiens
ggagaaguaccaccacaga

SEQ ID NO: 1068033 - RNA, 19 nt, Homo sapiens
gaggcaagaggauguaauu

SEQ ID NO: 1068034 - RNA, 19 nt, Homo sapiens
gggcaauucuguccuacug

SEQ ID NO: 1068035 - RNA, 19 nt, Homo sapiens
agaccaaaguaguauagaa

SEQ ID NO: 1068036 - RNA, 19 nt, Homo sapiens
gguugaaugugucuuuaau

SEQ ID NO: 1068037 - RNA, 19 nt, Homo sapiens
ccucaaacguggagaucaa

SEQ ID NO: 1068038 - RNA, 19 nt, Homo sapiens
aaguaaaguucuccaauuc

SEQ ID NO: 1068039 - RNA, 19 nt, Homo sapiens
gaaagccgcacaaggaaag

SEQ ID NO: 1068040 - RNA, 19 nt, Homo sapiens
agagauauuuguagagcaa

SEQ ID NO: 1068041 - RNA, 19 nt, Homo sapiens
uagcaguccugaagugaga

SEQ ID NO: 1068042 - RNA, 19 nt, Homo sapiens
gagagguauuggugcauau

SEQ ID NO: 1068043 - RNA, 19 nt, Homo sapiens
ggaagaauagaauuguaug

SEQ ID NO: 1068044 - RNA, 19 nt, Homo sapiens
agaaguaccaccacagaaa

SEQ ID NO: 1068045 - RNA, 19 nt, Homo sapiens
ugaaggagaacaucaugaa

SEQ ID NO: 1068046 - RNA, 19 nt, Homo sapiens
ugagggcaauucuguccua

SEQ ID NO: 1068047 - RNA, 19 nt, Homo sapiens
caaggaaagguuaaauuag

SEQ ID NO: 1068048 - RNA, 19 nt, Homo sapiens
gcacaaggaaagguuaaau

SEQ ID NO: 1068049 - RNA, 19 nt, Homo sapiens
acaaaacucuccaaucuau

SEQ ID NO: 1068050 - RNA, 19 nt, Homo sapiens
agagagguauuggugcaua

SEQ ID NO: 1068051 - RNA, 19 nt, Homo sapiens
ggaugucacuauuuuacua

SEQ ID NO: 1068052 - RNA, 19 nt, Homo sapiens
cagaagagggccuuggauu

SEQ ID NO: 1068053 - RNA, 19 nt, Homo sapiens
ccacuggaugucacuauuu

SEQ ID NO: 1068054 - RNA, 19 nt, Homo sapiens
guucaaccguacaucaaau

SEQ ID NO: 1068055 - RNA, 19 nt, Homo sapiens
guuaauggagugaguguug

SEQ ID NO: 1068056 - RNA, 19 nt, Homo sapiens
cagaugauuauuccaguuu

SEQ ID NO: 1068057 - RNA, 19 nt, Homo sapiens
gcauguuugugaucacugu

SEQ ID NO: 1068058 - RNA, 19 nt, Homo sapiens
uaaccucacuagcuucaag

SEQ ID NO: 1068059 - RNA, 19 nt, Homo sapiens
gcacaguauuuccccuaua

SEQ ID NO: 1068060 - RNA, 19 nt, Homo sapiens
gcaaaacagguucagauuu

SEQ ID NO: 1068061 - RNA, 19 nt, Homo sapiens
gguauuuguuguagagcuu

SEQ ID NO: 1068062 - RNA, 19 nt, Homo sapiens
ucacuagcuucaagaguag

SEQ ID NO: 1068063 - RNA, 19 nt, Homo sapiens
gagaaguaccaccacagaa

SEQ ID NO: 1068064 - RNA, 19 nt, Homo sapiens
ccugugaaauuucuuuaca

SEQ ID NO: 1068065 - RNA, 19 nt, Homo sapiens
ucagaugauuauuccaguu

SEQ ID NO: 1068066 - RNA, 19 nt, Homo sapiens
ucaaccguacaucaaauua

SEQ ID NO: 1068067 - RNA, 19 nt, Homo sapiens
aagaggauguaauugauag

SEQ ID NO: 1068068 - RNA, 19 nt, Homo sapiens
gcaaaacgcaggcaacaga

SEQ ID NO: 1068069 - RNA, 19 nt, Homo sapiens
uaaauuagugguacgauac

SEQ ID NO: 1068070 - RNA, 19 nt, Homo sapiens
agagacaaaccaguuauuu

SEQ ID NO: 1068071 - RNA, 19 nt, Homo sapiens
ccuagagacaaaccaguua

SEQ ID NO: 1068072 - RNA, 19 nt, Homo sapiens
gaccaaaguaguauagaag

SEQ ID NO: 1068073 - RNA, 19 nt, Homo sapiens
ccuuuaaccucacuagcuu

SEQ ID NO: 1068074 - RNA, 19 nt, Homo sapiens
agagguauaugaacauguc

SEQ ID NO: 1068075 - RNA, 19 nt, Homo sapiens
cacaaggaaagguuaaauu

SEQ ID NO: 1068076 - RNA, 19 nt, Homo sapiens
caaaauaaguaggaacuca

SEQ ID NO: 1068077 - RNA, 19 nt, Homo sapiens
caaccguacaucaaauuau

SEQ ID NO: 1068078 - RNA, 19 nt, Homo sapiens
uggaauugcugauagacau

SEQ ID NO: 1068079 - RNA, 19 nt, Homo sapiens
agugacaaauguuagaaga

SEQ ID NO: 1068080 - RNA, 19 nt, Homo sapiens
cagguggaauugcugauag

SEQ ID NO: 1068081 - RNA, 19 nt, Homo sapiens
caaucuauauaucccgaau

SEQ ID NO: 1068082 - RNA, 19 nt, Homo sapiens
gaaguaccaccacagaaac

SEQ ID NO: 1068083 - RNA, 19 nt, Homo sapiens
ccacagaacugcacauuua

SEQ ID NO: 1068084 - RNA, 19 nt, Homo sapiens
ggaauaagccuaucacaaa

SEQ ID NO: 1068085 - RNA, 19 nt, Homo sapiens
gcaaggauguggagauauu

SEQ ID NO: 1068086 - RNA, 19 nt, Homo sapiens
gaaggagacuguaacuuug

SEQ ID NO: 1068087 - RNA, 19 nt, Homo sapiens
ggaaggaaauucugacaug

SEQ ID NO: 1068088 - RNA, 19 nt, Homo sapiens
ggagauggaugaugguuau

SEQ ID NO: 1068089 - RNA, 19 nt, Homo sapiens
caauauggaugaagcuuaa

SEQ ID NO: 1068090 - RNA, 19 nt, Homo sapiens
ccucuaagcucgccuauug

SEQ ID NO: 1068091 - RNA, 19 nt, Homo sapiens
gaaagaaucaggugcagaa

SEQ ID NO: 1068092 - RNA, 19 nt, Homo sapiens
ucacaccacugucccauuu

SEQ ID NO: 1068093 - RNA, 19 nt, Homo sapiens
gacaucaccaccuuaauua

SEQ ID NO: 1068094 - RNA, 19 nt, Homo sapiens
gcaguuugaucuuauuguu

SEQ ID NO: 1068095 - RNA, 19 nt, Homo sapiens
gauaauaagaagcgcaaua

SEQ ID NO: 1068096 - RNA, 19 nt, Homo sapiens
ggcaguacaucaccaguaa

SEQ ID NO: 1068097 - RNA, 19 nt, Homo sapiens
ggaaguauccaaacaaaca

SEQ ID NO: 1068098 - RNA, 19 nt, Homo sapiens
gauauuggauucccuugug

SEQ ID NO: 1068099 - RNA, 19 nt, Homo sapiens
ccuaagagaugacaaaugg

SEQ ID NO: 1068100 - RNA, 19 nt, Homo sapiens
gcagucaguuucacagaga

SEQ ID NO: 1068101 - RNA, 19 nt, Homo sapiens
gcaauauggaugaagcuua

SEQ ID NO: 1068102 - RNA, 19 nt, Homo sapiens
guccauggauagaugaaua

SEQ ID NO: 1068103 - RNA, 19 nt, Homo sapiens
agaaggagacuguaacuuu

SEQ ID NO: 1068104 - RNA, 19 nt, Homo sapiens
ggacuugaacgaacauuug

SEQ ID NO: 1068105 - RNA, 19 nt, Homo sapiens
gcucaacagugugaaugua

SEQ ID NO: 1068106 - RNA, 19 nt, Homo sapiens
gaugauggcgauuggauuu

SEQ ID NO: 1068107 - RNA, 19 nt, Homo sapiens
ugauguagcuacuauggaa

SEQ ID NO: 1068108 - RNA, 19 nt, Homo sapiens
ugacaucaccaccuuaauu

SEQ ID NO: 1068109 - RNA, 19 nt, Homo sapiens
gaauaagccuaucacaaaa

SEQ ID NO: 1068110 - RNA, 19 nt, Homo sapiens
caauauagagucaucagaa

SEQ ID NO: 1068111 - RNA, 19 nt, Homo sapiens
gagcuacuccucucgauau

SEQ ID NO: 1068112 - RNA, 19 nt, Homo sapiens
gaugacaaaugggaaguau

SEQ ID NO: 1068113 - RNA, 19 nt, Homo sapiens
gauuggauuucccaucuga

SEQ ID NO: 1068114 - RNA, 19 nt, Homo sapiens
caauggagagugaguguuu

SEQ ID NO: 1068115 - RNA, 19 nt, Homo sapiens
gauaaauguuggcaaggau

SEQ ID NO: 1068116 - RNA, 19 nt, Homo sapiens
gaagcgcaauauagaguca

SEQ ID NO: 1068117 - RNA, 19 nt, Homo sapiens
ggagaagggcauuugcaaa

SEQ ID NO: 1068118 - RNA, 19 nt, Homo sapiens
caaaugggaaguauccaaa

SEQ ID NO: 1068119 - RNA, 19 nt, Homo sapiens
ugacacagaucaaccuaag

SEQ ID NO: 1068120 - RNA, 19 nt, Homo sapiens
gaugaaagaaggagacugu

SEQ ID NO: 1068121 - RNA, 19 nt, Homo sapiens
uggcaaggauguggagaua

SEQ ID NO: 1068122 - RNA, 19 nt, Homo sapiens
ccugagcaguuugaucuua

SEQ ID NO: 1068123 - RNA, 19 nt, Homo sapiens
cuucacagccuuuaggaua

SEQ ID NO: 1068124 - RNA, 19 nt, Homo sapiens
gcgauuggauuucccaucu

SEQ ID NO: 1068125 - RNA, 19 nt, Homo sapiens
ugaaagaaggagacuguaa

SEQ ID NO: 1068126 - RNA, 19 nt, Homo sapiens
gccaagggcugggagaaga

SEQ ID NO: 1068127 - RNA, 19 nt, Homo sapiens
guucacagcggcuuuauuc

SEQ ID NO: 1068128 - RNA, 19 nt, Homo sapiens
gaucugcaguuccacaucu

SEQ ID NO: 1068129 - RNA, 19 nt, Homo sapiens
caccugcacuccucauuau

SEQ ID NO: 1068130 - RNA, 19 nt, Homo sapiens
caaccuaagagaugacaaa

SEQ ID NO: 1068131 - RNA, 19 nt, Homo sapiens
gaaagaaggagacuguaac

SEQ ID NO: 1068132 - RNA, 19 nt, Homo sapiens
caaaguggaauaagccuau

SEQ ID NO: 1068133 - RNA, 19 nt, Homo sapiens
auucugacaugcugcaaua

SEQ ID NO: 1068134 - RNA, 19 nt, Homo sapiens
gaaggaauggugaugaaag

SEQ ID NO: 1068135 - RNA, 19 nt, Homo sapiens
auauagaauugccguauga

SEQ ID NO: 1068136 - RNA, 19 nt, Homo sapiens
ggccuucccucgugauuca

SEQ ID NO: 1068137 - RNA, 19 nt, Homo sapiens
guagggacuugaacgaaca

SEQ ID NO: 1068138 - RNA, 19 nt, Homo sapiens
ugacuugggugcucaguac

SEQ ID NO: 1068139 - RNA, 19 nt, Homo sapiens
gcauugaggaugugcaaga

SEQ ID NO: 1068140 - RNA, 19 nt, Homo sapiens
agaaucaggugcagaaguc

SEQ ID NO: 1068141 - RNA, 19 nt, Homo sapiens
ucaccugcacuccucauua

SEQ ID NO: 1068142 - RNA, 19 nt, Homo sapiens
cuacuuauaugaggaaucu

SEQ ID NO: 1068143 - RNA, 19 nt, Homo sapiens
auaagaagcgcaauauaga

SEQ ID NO: 1068144 - RNA, 19 nt, Homo sapiens
aauaagaagcgcaauauag

SEQ ID NO: 1068145 - RNA, 19 nt, Homo sapiens
ugggaaguauccaaacaaa

SEQ ID NO: 1068146 - RNA, 19 nt, Homo sapiens
caccaguaaucccugcaua

SEQ ID NO: 1068147 - RNA, 19 nt, Homo sapiens
gaugaacuguuagccuaug

SEQ ID NO: 1068148 - RNA, 19 nt, Homo sapiens
aaggaauggugaugaaaga

SEQ ID NO: 1068149 - RNA, 19 nt, Homo sapiens
ggagagugaguguuuagug

SEQ ID NO: 1068150 - RNA, 19 nt, Homo sapiens
auacggcaauuucuuuaga

SEQ ID NO: 1068151 - RNA, 19 nt, Homo sapiens
gcgaagagccccuggauga

SEQ ID NO: 1068152 - RNA, 19 nt, Homo sapiens
gauaugcucugggccucuu

SEQ ID NO: 1068153 - RNA, 19 nt, Homo sapiens
cagaucaaccuaagagaug

SEQ ID NO: 1068154 - RNA, 19 nt, Homo sapiens
agagggcaauggagaguga

SEQ ID NO: 1068155 - RNA, 19 nt, Homo sapiens
ggagcacacagucagguuu

SEQ ID NO: 1068156 - RNA, 19 nt, Homo sapiens
gggcaguacaucaccagua

SEQ ID NO: 1068157 - RNA, 19 nt, Homo sapiens
gaagcugguacgaagauug

SEQ ID NO: 1068158 - RNA, 19 nt, Homo sapiens
uguggcaccucaaggaauu

SEQ ID NO: 1068159 - RNA, 19 nt, Homo sapiens
gcaaaucaacaagaagugu

SEQ ID NO: 1068160 - RNA, 19 nt, Homo sapiens
gcaacccaguguccaugga

SEQ ID NO: 1068161 - RNA, 19 nt, Homo sapiens
gccaauugcuaccaaaugc

SEQ ID NO: 1068162 - RNA, 19 nt, Homo sapiens
cacagcggcuuuauucaca

SEQ ID NO: 1068163 - RNA, 19 nt, Homo sapiens
gccuuuaggauagcuauua

SEQ ID NO: 1068164 - RNA, 19 nt, Homo sapiens
ggaaauuggagcacacagu

SEQ ID NO: 1068165 - RNA, 19 nt, Homo sapiens
auggagacauucacaggua

SEQ ID NO: 1068166 - RNA, 19 nt, Homo sapiens
gcaauauagagucaucaga

SEQ ID NO: 1068167 - RNA, 19 nt, Homo sapiens
cguaugaucugcaguucca

SEQ ID NO: 1068168 - RNA, 19 nt, Homo sapiens
ugauacggcaauuucuuua

SEQ ID NO: 1068169 - RNA, 19 nt, Homo sapiens
cuucagacaucgugugaca

SEQ ID NO: 1068170 - RNA, 19 nt, Homo sapiens
uaugggugcucaacagugu

SEQ ID NO: 1068171 - RNA, 19 nt, Homo sapiens
ggaauggugaugaaagaag

SEQ ID NO: 1068172 - RNA, 19 nt, Homo sapiens
agauaaauguuggcaagga

SEQ ID NO: 1068173 - RNA, 19 nt, Homo sapiens
ggauuucccaucugacuuc

SEQ ID NO: 1068174 - RNA, 19 nt, Homo sapiens
cauuuggaguuacauacuu

SEQ ID NO: 1068175 - RNA, 19 nt, Homo sapiens
ugagcaguuugaucuuauu

SEQ ID NO: 1068176 - RNA, 19 nt, Homo sapiens
aaaaucguguucugccuua

SEQ ID NO: 1068177 - RNA, 19 nt, Homo sapiens
cagaacugcacauuuaaau

SEQ ID NO: 1068178 - RNA, 19 nt, Homo sapiens
aaacauacaaugggcuauu

SEQ ID NO: 1068179 - RNA, 19 nt, Homo sapiens
aauauagaauugccguaug

SEQ ID NO: 1068180 - RNA, 19 nt, Homo sapiens
gaagcaaaacagaagauaa

SEQ ID NO: 1068181 - RNA, 19 nt, Homo sapiens
ggguuugccucagccaauu

SEQ ID NO: 1068182 - RNA, 19 nt, Homo sapiens
uguucugccuuaugaguaa

SEQ ID NO: 1068183 - RNA, 19 nt, Homo sapiens
gaaacgugaugcugaaaua

SEQ ID NO: 1068184 - RNA, 19 nt, Homo sapiens
gaaaguauaucaacaaagg

SEQ ID NO: 1068185 - RNA, 19 nt, Homo sapiens
ggaagaacaagcugaaaua

SEQ ID NO: 1068186 - RNA, 19 nt, Homo sapiens
ugaaaggcaucagaaauua

SEQ ID NO: 1068187 - RNA, 19 nt, Homo sapiens
gaagaacacaagagaauaa

SEQ ID NO: 1068188 - RNA, 19 nt, Homo sapiens
gcauugagcuuagagaauu

SEQ ID NO: 1068189 - RNA, 19 nt, Homo sapiens
gaagguauauagaagaguu

SEQ ID NO: 1068190 - RNA, 19 nt, Homo sapiens
caagcaauuucucagauua

SEQ ID NO: 1068191 - RNA, 19 nt, Homo sapiens
gaaacaacuugaagaacaa

SEQ ID NO: 1068192 - RNA, 19 nt, Homo sapiens
caacaaaggagugaaauuu

SEQ ID NO: 1068193 - RNA, 19 nt, Homo sapiens
caaacaacgugaacuagaa

SEQ ID NO: 1068194 - RNA, 19 nt, Homo sapiens
ggaaucaaauggugcagaa

SEQ ID NO: 1068195 - RNA, 19 nt, Homo sapiens
gcaagcaauuucucagauu

SEQ ID NO: 1068196 - RNA, 19 nt, Homo sapiens
ggaagagaaugcugcagaa

SEQ ID NO: 1068197 - RNA, 19 nt, Homo sapiens
cagcuuacaugaauaaaga

SEQ ID NO: 1068198 - RNA, 19 nt, Homo sapiens
gacaguauauuuaccuuga

SEQ ID NO: 1068199 - RNA, 19 nt, Homo sapiens
aagagaaacucaugauuga

SEQ ID NO: 1068200 - RNA, 19 nt, Homo sapiens
acaguacuaucuugacuua

SEQ ID NO: 1068201 - RNA, 19 nt, Homo sapiens
ugaaagaacuccagcucaa

SEQ ID NO: 1068202 - RNA, 19 nt, Homo sapiens
cggcaaggauuuauuaaug

SEQ ID NO: 1068203 - RNA, 19 nt, Homo sapiens
gaacaagugcgacaagaau

SEQ ID NO: 1068204 - RNA, 19 nt, Homo sapiens
ggagugaaauuugugaaga

SEQ ID NO: 1068205 - RNA, 19 nt, Homo sapiens
gaagcaagauuuugaagaa

SEQ ID NO: 1068206 - RNA, 19 nt, Homo sapiens
gaacaaaugaaacgugaug

SEQ ID NO: 1068207 - RNA, 19 nt, Homo sapiens
uuaaagagcaugcuacaaa

SEQ ID NO: 1068208 - RNA, 19 nt, Homo sapiens
agaaacaacuugaagaaca

SEQ ID NO: 1068209 - RNA, 19 nt, Homo sapiens
gcaaaggcggcaaggauuu

SEQ ID NO: 1068210 - RNA, 19 nt, Homo sapiens
gcucagaaacaaagaauga

SEQ ID NO: 1068211 - RNA, 19 nt, Homo sapiens
gugaggagauggaagaaga

SEQ ID NO: 1068212 - RNA, 19 nt, Homo sapiens
ccucaagacaguauauuua

SEQ ID NO: 1068213 - RNA, 19 nt, Homo sapiens
aauuugagcuguagugaaa

SEQ ID NO: 1068214 - RNA, 19 nt, Homo sapiens
ugaagaagaucaguuggaa

SEQ ID NO: 1068215 - RNA, 19 nt, Homo sapiens
ggaagaacacaagagaaua

SEQ ID NO: 1068216 - RNA, 19 nt, Homo sapiens
gugaaaggcaucagaaauu

SEQ ID NO: 1068217 - RNA, 19 nt, Homo sapiens
gaagaguucaggaaaguau

SEQ ID NO: 1068218 - RNA, 19 nt, Homo sapiens
gaaaagaaauugagaaagc

SEQ ID NO: 1068219 - RNA, 19 nt, Homo sapiens
uuaggaagaucuaugaaga

SEQ ID NO: 1068220 - RNA, 19 nt, Homo sapiens
gaaaacagcauugagcuua

SEQ ID NO: 1068221 - RNA, 19 nt, Homo sapiens
ggagaaauuugagcuguag

SEQ ID NO: 1068222 - RNA, 19 nt, Homo sapiens
gcaaugcgaagguauauag

SEQ ID NO: 1068223 - RNA, 19 nt, Homo sapiens
gagaaacucaugauugaug

SEQ ID NO: 1068224 - RNA, 19 nt, Homo sapiens
aaagagaaacucaugauug

SEQ ID NO: 1068225 - RNA, 19 nt, Homo sapiens
gaugaaaacuacugcaaaa

SEQ ID NO: 1068226 - RNA, 19 nt, Homo sapiens
gaaagaacuccagcucaaa

SEQ ID NO: 1068227 - RNA, 19 nt, Homo sapiens
gcaaggauuuauuaaugca

SEQ ID NO: 1068228 - RNA, 19 nt, Homo sapiens
gaagaacaagcugaaauau

SEQ ID NO: 1068229 - RNA, 19 nt, Homo sapiens
gaagacaaacgaaacaaag

SEQ ID NO: 1068230 - RNA, 19 nt, Homo sapiens
gaaagggcagcucagauug

SEQ ID NO: 1068231 - RNA, 19 nt, Homo sapiens
gaaugaagcagcuggaaca

SEQ ID NO: 1068232 - RNA, 19 nt, Homo sapiens
cagaaugcguugacacaga

SEQ ID NO: 1068233 - RNA, 19 nt, Homo sapiens
uuagagaauuggagaagaa

SEQ ID NO: 1068234 - RNA, 19 nt, Homo sapiens
gaagaggagaacuuuagaa

SEQ ID NO: 1068235 - RNA, 19 nt, Homo sapiens
agagcaugcuacaaacuua

SEQ ID NO: 1068236 - RNA, 19 nt, Homo sapiens
caaaggcggcaaggauuua

SEQ ID NO: 1068237 - RNA, 19 nt, Homo sapiens
gaagagcgucgccaacaau

SEQ ID NO: 1068238 - RNA, 19 nt, Homo sapiens
gcugcuggcugcugcguuu

SEQ ID NO: 1068239 - RNA, 19 nt, Homo sapiens
gcacaguacuaucuugacu

SEQ ID NO: 1068240 - RNA, 19 nt, Homo sapiens
ggcauuagguauccauugu

SEQ ID NO: 1068241 - RNA, 19 nt, Homo sapiens
ugaggaugaucgaauagaa

SEQ ID NO: 1068242 - RNA, 19 nt, Homo sapiens
acaagugcgacaagaauua

SEQ ID NO: 1068243 - RNA, 19 nt, Homo sapiens
ggaacaagugcgacaagaa

SEQ ID NO: 1068244 - RNA, 19 nt, Homo sapiens
ugaaaaggaugccauuaaa

SEQ ID NO: 1068245 - RNA, 19 nt, Homo sapiens
aaagaaacgugaggagaug

SEQ ID NO: 1068246 - RNA, 19 nt, Homo sapiens
gaaagcacaguacuaucuu

SEQ ID NO: 1068247 - RNA, 19 nt, Homo sapiens
agacaaacaacgugaacua

SEQ ID NO: 1068248 - RNA, 19 nt, Homo sapiens
uaaauuugcugaggaugau

SEQ ID NO: 1068249 - RNA, 19 nt, Homo sapiens
ugaaugcaaugcgaaggua

SEQ ID NO: 1068250 - RNA, 19 nt, Homo sapiens
gaaauuugagcuguaguga

SEQ ID NO: 1068251 - RNA, 19 nt, Homo sapiens
agaaagggcagcucagauu

SEQ ID NO: 1068252 - RNA, 19 nt, Homo sapiens
gaacaauuugaguuggaua

SEQ ID NO: 1068253 - RNA, 19 nt, Homo sapiens
gcggcaacgugaagauuug

SEQ ID NO: 1068254 - RNA, 19 nt, Homo sapiens
gaagaagaucaguuggaaa

SEQ ID NO: 1068255 - RNA, 19 nt, Homo sapiens
caaauggugcagaaugaaa

SEQ ID NO: 1068256 - RNA, 19 nt, Homo sapiens
gauggaagaacacaagaga

SEQ ID NO: 1068257 - RNA, 19 nt, Homo sapiens
aggaugccauuaaauauga

SEQ ID NO: 1068258 - RNA, 19 nt, Homo sapiens
gaagaaaacaagagauuga

SEQ ID NO: 1068259 - RNA, 19 nt, Homo sapiens
acaauuccuugcagacaaa

SEQ ID NO: 1068260 - RNA, 19 nt, Homo sapiens
aagaacaaauggccuugaa

SEQ ID NO: 1068261 - RNA, 19 nt, Homo sapiens
gugaagauuuggaacaagu

SEQ ID NO: 1068262 - RNA, 19 nt, Homo sapiens
agaaugcguugacacagaa

SEQ ID NO: 1068263 - RNA, 19 nt, Homo sapiens
ucauagaguuugcuaacau

SEQ ID NO: 1068264 - RNA, 19 nt, Homo sapiens
aaagaugaggcaacaagua

SEQ ID NO: 1068265 - RNA, 19 nt, Homo sapiens
uaaagagcaugcuacaaac

SEQ ID NO: 1068266 - RNA, 19 nt, Homo sapiens
ugaagagcgucgccaacaa

SEQ ID NO: 1068267 - RNA, 19 nt, Homo sapiens
ggaagaggagaacuuuaga

SEQ ID NO: 1068268 - RNA, 19 nt, Homo sapiens
gaugaaauuguuaggaaga

SEQ ID NO: 1068269 - RNA, 19 nt, Homo sapiens
aguacuaucuugacuuaga

SEQ ID NO: 1068270 - RNA, 19 nt, Homo sapiens
gcagaagacaaacgaaaca

SEQ ID NO: 1068271 - RNA, 19 nt, Homo sapiens
gaaaggcuaaaacuucuua

SEQ ID NO: 1068272 - RNA, 19 nt, Homo sapiens
gaggaagaggagaacuuua

SEQ ID NO: 1068273 - RNA, 19 nt, Homo sapiens
gcgaagguauauagaagag

SEQ ID NO: 1068274 - RNA, 19 nt, Homo sapiens
cgaaagcacaguacuaucu

SEQ ID NO: 1068275 - RNA, 19 nt, Homo sapiens
uggcaaaacugaaacauga

SEQ ID NO: 1068276 - RNA, 19 nt, Homo sapiens
gaaaggcaucagaaauuag

SEQ ID NO: 1068277 - RNA, 19 nt, Homo sapiens
cauagaguuugcuaacaug

SEQ ID NO: 1068278 - RNA, 19 nt, Homo sapiens
aaugaaacgugaugcugaa

SEQ ID NO: 1068279 - RNA, 19 nt, Homo sapiens
gaugaggcaacaaguaaga

SEQ ID NO: 1068280 - RNA, 19 nt, Homo sapiens
aagaugaggcaacaaguaa

SEQ ID NO: 1068281 - RNA, 19 nt, Homo sapiens
uuacagcucaguggcauua

SEQ ID NO: 1068282 - RNA, 19 nt, Homo sapiens
ucaggaaaguauaucaaca

SEQ ID NO: 1068283 - RNA, 19 nt, Homo sapiens
caaaggaaaugguacaauu

SEQ ID NO: 1068284 - RNA, 19 nt, Homo sapiens
gugcuuaccuccaguauga

SEQ ID NO: 1068285 - RNA, 19 nt, Homo sapiens
gaacgugcccucgcucuuu

SEQ ID NO: 1068286 - RNA, 19 nt, Homo sapiens
gaaucaaacugaaugaacu

SEQ ID NO: 1068287 - RNA, 19 nt, Homo sapiens
caaacucuccguaguauau

SEQ ID NO: 1068288 - RNA, 19 nt, Homo sapiens
cguaguauauucaugauuc

SEQ ID NO: 1068289 - RNA, 19 nt, Homo sapiens
gaauugcaaauccugcuua

SEQ ID NO: 1068290 - RNA, 19 nt, Homo sapiens
gcacccagccugugucuuc

SEQ ID NO: 1068291 - RNA, 19 nt, Homo sapiens
gauuguagaccaaaggaaa

SEQ ID NO: 1068292 - RNA, 19 nt, Homo sapiens
cauuaaagccuuguuauuc

SEQ ID NO: 1068293 - RNA, 19 nt, Homo sapiens
gacagggucuugguauguu

SEQ ID NO: 1068294 - RNA, 19 nt, Homo sapiens
gugacuaauuccaaaguug

SEQ ID NO: 1068295 - RNA, 19 nt, Homo sapiens
gaagugaauugcaaauccu

SEQ ID NO: 1068296 - RNA, 19 nt, Homo sapiens
ccauuaaagccuuguuauu

SEQ ID NO: 1068297 - RNA, 19 nt, Homo sapiens
uacaaacucuccguaguau

SEQ ID NO: 1068298 - RNA, 19 nt, Homo sapiens
ggaaucaaacugaaugaac

SEQ ID NO: 1068299 - RNA, 19 nt, Homo sapiens
aacgugcccucgcucuuua

SEQ ID NO: 1068300 - RNA, 19 nt, Homo sapiens
ggaaacuccugggcucaag

SEQ ID NO: 1068301 - RNA, 19 nt, Homo sapiens
aguaugaagugaauugcaa

SEQ ID NO: 1068302 - RNA, 19 nt, Homo sapiens
ugaagugaauugcaaaucc

SEQ ID NO: 1068303 - RNA, 19 nt, Homo sapiens
ccuauagcguggauuguag

SEQ ID NO: 1068304 - RNA, 19 nt, Homo sapiens
gauguuggagugugggauu

SEQ ID NO: 1068305 - RNA, 19 nt, Homo sapiens
gaacuuuucucugcacugu

SEQ ID NO: 1068306 - RNA, 19 nt, Homo sapiens
aagacuacuucccuuguug

SEQ ID NO: 1068307 - RNA, 19 nt, Homo sapiens
gaaaauugagccauuaaag

SEQ ID NO: 1068308 - RNA, 19 nt, Homo sapiens
uaaauggcguuaccuuuuc

SEQ ID NO: 1068309 - RNA, 19 nt, Homo sapiens
caaacugaaugaacuuuuc

SEQ ID NO: 1068310 - RNA, 19 nt, Homo sapiens
uuccagcucuaaucagaaa

SEQ ID NO: 1068311 - RNA, 19 nt, Homo sapiens
acagcaagccggcuacgaa

SEQ ID NO: 1068312 - RNA, 19 nt, Homo sapiens
gacuaauuccaaaguugua

SEQ ID NO: 1068313 - RNA, 19 nt, Homo sapiens
ugacuaauuccaaaguugu

SEQ ID NO: 1068314 - RNA, 19 nt, Homo sapiens
gagccuagaggaccugcuu

SEQ ID NO: 1068315 - RNA, 19 nt, Homo sapiens
uugcaaauccugcuuaugg

SEQ ID NO: 1068316 - RNA, 19 nt, Homo sapiens
uuaccagaguggacgaguu

SEQ ID NO: 1068317 - RNA, 19 nt, Homo sapiens
gccauuaaagccuuguuau

SEQ ID NO: 1068318 - RNA, 19 nt, Homo sapiens
cuaaauggcguuaccuuuu

SEQ ID NO: 1068319 - RNA, 19 nt, Homo sapiens
ucuuccagcucuaaucaga

SEQ ID NO: 1068320 - RNA, 19 nt, Homo sapiens
ccuccaguaugaagugaau

SEQ ID NO: 1068321 - RNA, 19 nt, Homo sapiens
caauccuaauagucaguuu

SEQ ID NO: 1068322 - RNA, 19 nt, Homo sapiens
ggcguuaccuuuucaagau

SEQ ID NO: 1068323 - RNA, 19 nt, Homo sapiens
gggaaucaaacugaaugaa

SEQ ID NO: 1068324 - RNA, 19 nt, Homo sapiens
ugcaaauccugcuuaugga

SEQ ID NO: 1068325 - RNA, 19 nt, Homo sapiens
guaugaagugaauugcaaa

SEQ ID NO: 1068326 - RNA, 19 nt, Homo sapiens
ugugacuaauuccaaaguu

SEQ ID NO: 1068327 - RNA, 19 nt, Homo sapiens
ccaaaggaaaugguacaau

SEQ ID NO: 1068328 - RNA, 19 nt, Homo sapiens
acuaaauggcguuaccuuu

SEQ ID NO: 1068329 - RNA, 19 nt, Homo sapiens
cuccugggcucaagugauc

SEQ ID NO: 1068330 - RNA, 19 nt, Homo sapiens
gccuuguuauucaauccua

SEQ ID NO: 1068331 - RNA, 19 nt, Homo sapiens
ccagggcguucaagaagcu

SEQ ID NO: 1068332 - RNA, 19 nt, Homo sapiens
ugcccucgcucuuuagcaa

SEQ ID NO: 1068333 - RNA, 19 nt, Homo sapiens
uggaggagcaggucaccaa

SEQ ID NO: 1068334 - RNA, 19 nt, Homo sapiens
acagggucuugguauguug

SEQ ID NO: 1068335 - RNA, 19 nt, Homo sapiens
gaaacuccugggcucaagu

SEQ ID NO: 1068336 - RNA, 19 nt, Homo sapiens
ugcccagacuguucggaaa

SEQ ID NO: 1068337 - RNA, 19 nt, Homo sapiens
aauugcaaauccugcuuau

SEQ ID NO: 1068338 - RNA, 19 nt, Homo sapiens
gaacuuugauucugccuua

SEQ ID NO: 1068339 - RNA, 19 nt, Homo sapiens
ccauagaccuggcagaaua

SEQ ID NO: 1068340 - RNA, 19 nt, Homo sapiens
gcucauggcuuuaucuuau

SEQ ID NO: 1068341 - RNA, 19 nt, Homo sapiens
aaacagagaugaugugugu

SEQ ID NO: 1068342 - RNA, 19 nt, Homo sapiens
ggagugacuuucugacuaa

SEQ ID NO: 1068343 - RNA, 19 nt, Homo sapiens
gauuauaccuccaauguuc

SEQ ID NO: 1068344 - RNA, 19 nt, Homo sapiens
gaaaagugcucaucuguga

SEQ ID NO: 1068345 - RNA, 19 nt, Homo sapiens
ccacaugacucugaaauau

SEQ ID NO: 1068346 - RNA, 19 nt, Homo sapiens
ggaaauccuuaaagaucua

SEQ ID NO: 1068347 - RNA, 19 nt, Homo sapiens
guaacauacucaagacuuu

SEQ ID NO: 1068348 - RNA, 19 nt, Homo sapiens
ggucauguauggaauguug

SEQ ID NO: 1068349 - RNA, 19 nt, Homo sapiens
caaacaagcaccuaccaua

SEQ ID NO: 1068350 - RNA, 19 nt, Homo sapiens
gcaugugaauuauaccuuu

SEQ ID NO: 1068351 - RNA, 19 nt, Homo sapiens
auacagcuguugcauauuu

SEQ ID NO: 1068352 - RNA, 19 nt, Homo sapiens
gcucaucugugaacucuau

SEQ ID NO: 1068353 - RNA, 19 nt, Homo sapiens
caacaagccauuagacuga

SEQ ID NO: 1068354 - RNA, 19 nt, Homo sapiens
gcucauguuucaucauauu

SEQ ID NO: 1068355 - RNA, 19 nt, Homo sapiens
gcacagcccauaagacuau

SEQ ID NO: 1068356 - RNA, 19 nt, Homo sapiens
gcacucagcugugucagau

SEQ ID NO: 1068357 - RNA, 19 nt, Homo sapiens
guguuuagcucauggcuuu

SEQ ID NO: 1068358 - RNA, 19 nt, Homo sapiens
aagcacaccuugauacuga

SEQ ID NO: 1068359 - RNA, 19 nt, Homo sapiens
guacauggcaaugcuguua

SEQ ID NO: 1068360 - RNA, 19 nt, Homo sapiens
ggaugguucucaaagguaa

SEQ ID NO: 1068361 - RNA, 19 nt, Homo sapiens
uaaccacaguuuaccuuaa

SEQ ID NO: 1068362 - RNA, 19 nt, Homo sapiens
ugacgugacucaggauuaa

SEQ ID NO: 1068363 - RNA, 19 nt, Homo sapiens
acagugaaaucucaucgua

SEQ ID NO: 1068364 - RNA, 19 nt, Homo sapiens
ccuuaaagaucuacaaguu

SEQ ID NO: 1068365 - RNA, 19 nt, Homo sapiens
gaugaacucccaaugauau

SEQ ID NO: 1068366 - RNA, 19 nt, Homo sapiens
acacagagaauaaggagua

SEQ ID NO: 1068367 - RNA, 19 nt, Homo sapiens
ucaaauaugucaugaccau

SEQ ID NO: 1068368 - RNA, 19 nt, Homo sapiens
gauauacagcuguugcaua

SEQ ID NO: 1068369 - RNA, 19 nt, Homo sapiens
acaugacucugaaauauga

SEQ ID NO: 1068370 - RNA, 19 nt, Homo sapiens
ucagagaggucaugguugu

SEQ ID NO: 1068371 - RNA, 19 nt, Homo sapiens
uaacuggccuugguuccua

SEQ ID NO: 1068372 - RNA, 19 nt, Homo sapiens
aaaugcagcuauuggauga

SEQ ID NO: 1068373 - RNA, 19 nt, Homo sapiens
ugaguaaccugaucaugau

SEQ ID NO: 1068374 - RNA, 19 nt, Homo sapiens
uuaagaggguauagaacua

SEQ ID NO: 1068375 - RNA, 19 nt, Homo sapiens
ggaaguguguugcauuaac

SEQ ID NO: 1068376 - RNA, 19 nt, Homo sapiens
ggugaccuauaggauauua

SEQ ID NO: 1068377 - RNA, 19 nt, Homo sapiens
guggccaccuguucaauaa

SEQ ID NO: 1068378 - RNA, 19 nt, Homo sapiens
gugaguaaccugaucauga

SEQ ID NO: 1068379 - RNA, 19 nt, Homo sapiens
aaauaugacugguggucua

SEQ ID NO: 1068380 - RNA, 19 nt, Homo sapiens
ccaaugauauacagcuguu

SEQ ID NO: 1068381 - RNA, 19 nt, Homo sapiens
ggaugaacucccaaugaua

SEQ ID NO: 1068382 - RNA, 19 nt, Homo sapiens
aacgguacauugcuucuua

SEQ ID NO: 1068383 - RNA, 19 nt, Homo sapiens
gccaggcucuuuaauguuc

SEQ ID NO: 1068384 - RNA, 19 nt, Homo sapiens
uaaggcagcuaguucuaau

SEQ ID NO: 1068385 - RNA, 19 nt, Homo sapiens
agaccuggcagaauaaaua

SEQ ID NO: 1068386 - RNA, 19 nt, Homo sapiens
gagaugauguguguguaug

SEQ ID NO: 1068387 - RNA, 19 nt, Homo sapiens
uauggaauguuggucuuua

SEQ ID NO: 1068388 - RNA, 19 nt, Homo sapiens
gcaguuaccugggcuaucg

SEQ ID NO: 1068389 - RNA, 19 nt, Homo sapiens
auaaguagccuuuguacaa

SEQ ID NO: 1068390 - RNA, 19 nt, Homo sapiens
gaaguguguugcauuaacu

SEQ ID NO: 1068391 - RNA, 19 nt, Homo sapiens
agggaaguguguugcauua

SEQ ID NO: 1068392 - RNA, 19 nt, Homo sapiens
ggccagugauccuguuuga

SEQ ID NO: 1068393 - RNA, 19 nt, Homo sapiens
uaaauaaugcagucagcua

SEQ ID NO: 1068394 - RNA, 19 nt, Homo sapiens
gaacacuuuaccugagaua

SEQ ID NO: 1068395 - RNA, 19 nt, Homo sapiens
cugagguucugcaggauua

SEQ ID NO: 1068396 - RNA, 19 nt, Homo sapiens
ucaauaaguagccuuugua

SEQ ID NO: 1068397 - RNA, 19 nt, Homo sapiens
cugcucauguuucaucaua

SEQ ID NO: 1068398 - RNA, 19 nt, Homo sapiens
gcagcuaguucuaauuugc

SEQ ID NO: 1068399 - RNA, 19 nt, Homo sapiens
gaaggaaauagauguaagu

SEQ ID NO: 1068400 - RNA, 19 nt, Homo sapiens
acucagcugugucagauuu

SEQ ID NO: 1068401 - RNA, 19 nt, Homo sapiens
gaaggcacagcccauaaga

SEQ ID NO: 1068402 - RNA, 19 nt, Homo sapiens
guaaccugaucaugauuau

SEQ ID NO: 1068403 - RNA, 19 nt, Homo sapiens
uugcagaucuuuaaguugu

SEQ ID NO: 1068404 - RNA, 19 nt, Homo sapiens
gcuagucggaggaucauaa

SEQ ID NO: 1068405 - RNA, 19 nt, Homo sapiens
gggauucuguguaguucuu

SEQ ID NO: 1068406 - RNA, 19 nt, Homo sapiens
gcugugggauucuguguag

SEQ ID NO: 1068407 - RNA, 19 nt, Homo sapiens
acacuuuaccugagauaua

SEQ ID NO: 1068408 - RNA, 19 nt, Homo sapiens
ccacagccaaccagaauga

SEQ ID NO: 1068409 - RNA, 19 nt, Homo sapiens
gcagaaacaguugggcuuu

SEQ ID NO: 1068410 - RNA, 19 nt, Homo sapiens
ugaaguuucucuuuggaau

SEQ ID NO: 1068411 - RNA, 19 nt, Homo sapiens
gccauuagacugauucuuc

SEQ ID NO: 1068412 - RNA, 19 nt, Homo sapiens
ggacuggguuauacaucau

SEQ ID NO: 1068413 - RNA, 19 nt, Homo sapiens
cauguuaacuagaguguac

SEQ ID NO: 1068414 - RNA, 19 nt, Homo sapiens
agaguugaauuccucacua

SEQ ID NO: 1068415 - RNA, 19 nt, Homo sapiens
cagaaagcacaccuugaua

SEQ ID NO: 1068416 - RNA, 19 nt, Homo sapiens
ucaguuagauauacuucug

SEQ ID NO: 1068417 - RNA, 19 nt, Homo sapiens
ccauaagacuauacuugau

SEQ ID NO: 1068418 - RNA, 19 nt, Homo sapiens
uuaugaaccuccaggaaga

SEQ ID NO: 1068419 - RNA, 19 nt, Homo sapiens
caucuuauaaccuuucuga

SEQ ID NO: 1068420 - RNA, 19 nt, Homo sapiens
uaaagaaacagagaugaug

SEQ ID NO: 1068421 - RNA, 19 nt, Homo sapiens
gaucaagaacucaguaaac

SEQ ID NO: 1068422 - RNA, 19 nt, Homo sapiens
gcuguugcauauuugugua

SEQ ID NO: 1068423 - RNA, 19 nt, Homo sapiens
ucugugaacucuauagcaa

SEQ ID NO: 1068424 - RNA, 19 nt, Homo sapiens
gauucuagguggacauuac

SEQ ID NO: 1068425 - RNA, 19 nt, Homo sapiens
guaaggcagcuaguucuaa

SEQ ID NO: 1068426 - RNA, 19 nt, Homo sapiens
gcucugcucugaucuuugc

SEQ ID NO: 1068427 - RNA, 19 nt, Homo sapiens
gaggacauguauagaaugc

SEQ ID NO: 1068428 - RNA, 19 nt, Homo sapiens
caagaucaagaacucagua

SEQ ID NO: 1068429 - RNA, 19 nt, Homo sapiens
uggaugaacucccaaugau

SEQ ID NO: 1068430 - RNA, 19 nt, Homo sapiens
gaaagcacaccuugauacu

SEQ ID NO: 1068431 - RNA, 19 nt, Homo sapiens
gcccauaagacuauacuug

SEQ ID NO: 1068432 - RNA, 19 nt, Homo sapiens
gguauagaacuaaaccauu

SEQ ID NO: 1068433 - RNA, 19 nt, Homo sapiens
gauguaaguuucugcuacu

SEQ ID NO: 1068434 - RNA, 19 nt, Homo sapiens
gcagaucuuuaaguuguca

SEQ ID NO: 1068435 - RNA, 19 nt, Homo sapiens
cagcucugcucugaucuuu

SEQ ID NO: 1068436 - RNA, 19 nt, Homo sapiens
gauuuauggugucugucua

SEQ ID NO: 1068437 - RNA, 19 nt, Homo sapiens
ugccaaggguugcauguga

SEQ ID NO: 1068438 - RNA, 19 nt, Homo sapiens
guacgugccuuaaucuuua

SEQ ID NO: 1068439 - RNA, 19 nt, Homo sapiens
uguaggagcuuaagaaaua

SEQ ID NO: 1068440 - RNA, 19 nt, Homo sapiens
ggaauucucucuuucaaau

SEQ ID NO: 1068441 - RNA, 19 nt, Homo sapiens
gagcaggaauucucucuuu

SEQ ID NO: 1068442 - RNA, 19 nt, Homo sapiens
agagaaaucuggcaauaaa

SEQ ID NO: 1068443 - RNA, 19 nt, Homo sapiens
guagagaaaucuggcaaua

SEQ ID NO: 1068444 - RNA, 19 nt, Homo sapiens
caucaucucuuacaaauca

SEQ ID NO: 1068445 - RNA, 19 nt, Homo sapiens
uaaccaagcuggaguggaa

SEQ ID NO: 1068446 - RNA, 19 nt, Homo sapiens
uggcacaacuugauauaua

SEQ ID NO: 1068447 - RNA, 19 nt, Homo sapiens
ggagagcacuuauaaaauu

SEQ ID NO: 1068448 - RNA, 19 nt, Homo sapiens
ggaguuucaugcuucauuu

SEQ ID NO: 1068449 - RNA, 19 nt, Homo sapiens
ggaagaagcagcccuugaa

SEQ ID NO: 1068450 - RNA, 19 nt, Homo sapiens
ggugauauuugaagaaaga

SEQ ID NO: 1068451 - RNA, 19 nt, Homo sapiens
ugacagagauacaccuuug

SEQ ID NO: 1068452 - RNA, 19 nt, Homo sapiens
aaucaaaccugcuauuuca

SEQ ID NO: 1068453 - RNA, 19 nt, Homo sapiens
ggaaauacacuaaaugagu

SEQ ID NO: 1068454 - RNA, 19 nt, Homo sapiens
gaagaaagaagaauucagu

SEQ ID NO: 1068455 - RNA, 19 nt, Homo sapiens
ggaacagucucucgacaug

SEQ ID NO: 1068456 - RNA, 19 nt, Homo sapiens
cuaaggauauccacagaaa

SEQ ID NO: 1068457 - RNA, 19 nt, Homo sapiens
acacuaagauacucugauu

SEQ ID NO: 1068458 - RNA, 19 nt, Homo sapiens
uagagaauguacagccuua

SEQ ID NO: 1068459 - RNA, 19 nt, Homo sapiens
acaucucucugcacaauua

SEQ ID NO: 1068460 - RNA, 19 nt, Homo sapiens
gaaaggcagugaugaaagc

SEQ ID NO: 1068461 - RNA, 19 nt, Homo sapiens
gaagcucacaucucaaauu

SEQ ID NO: 1068462 - RNA, 19 nt, Homo sapiens
gaaauucugccaccuuguu

SEQ ID NO: 1068463 - RNA, 19 nt, Homo sapiens
gaggagaaaugccacauac

SEQ ID NO: 1068464 - RNA, 19 nt, Homo sapiens
ggacaguggccuuugguuu

SEQ ID NO: 1068465 - RNA, 19 nt, Homo sapiens
caaaugaaggaaugacuaa

SEQ ID NO: 1068466 - RNA, 19 nt, Homo sapiens
gcucacaucucaaauucau

SEQ ID NO: 1068467 - RNA, 19 nt, Homo sapiens
gaagaagcagcccuugaaa

SEQ ID NO: 1068468 - RNA, 19 nt, Homo sapiens
caaagugcuucuacugaga

SEQ ID NO: 1068469 - RNA, 19 nt, Homo sapiens
aaagaagaauucagucuca

SEQ ID NO: 1068470 - RNA, 19 nt, Homo sapiens
uacaguccaucaucucuua

SEQ ID NO: 1068471 - RNA, 19 nt, Homo sapiens
ggaaugguuucaacaaguc

SEQ ID NO: 1068472 - RNA, 19 nt, Homo sapiens
ugucugugcuucacuaauu

SEQ ID NO: 1068473 - RNA, 19 nt, Homo sapiens
aaaccauccuuuauuguug

SEQ ID NO: 1068474 - RNA, 19 nt, Homo sapiens
cuacugagaggccuuuaua

SEQ ID NO: 1068475 - RNA, 19 nt, Homo sapiens
ggucaucucugccguuucu

SEQ ID NO: 1068476 - RNA, 19 nt, Homo sapiens
gccuuaaucuuuaucuuug

SEQ ID NO: 1068477 - RNA, 19 nt, Homo sapiens
cagaguacgugccuuaauc

SEQ ID NO: 1068478 - RNA, 19 nt, Homo sapiens
ggaagaguuugacagagau

SEQ ID NO: 1068479 - RNA, 19 nt, Homo sapiens
cauuugggcccuuuaauaa

SEQ ID NO: 1068480 - RNA, 19 nt, Homo sapiens
gguagcuccucauuaacua

SEQ ID NO: 1068481 - RNA, 19 nt, Homo sapiens
ugucaagcauucauuauuc

SEQ ID NO: 1068482 - RNA, 19 nt, Homo sapiens
ccauuugggcccuuuaaua

SEQ ID NO: 1068483 - RNA, 19 nt, Homo sapiens
aagcagcccuugaaauguu

SEQ ID NO: 1068484 - RNA, 19 nt, Homo sapiens
ucacaucucucugcacaau

SEQ ID NO: 1068485 - RNA, 19 nt, Homo sapiens
uggaagaguuugacagaga

SEQ ID NO: 1068486 - RNA, 19 nt, Homo sapiens
uacaguaacucuaagugaa

SEQ ID NO: 1068487 - RNA, 19 nt, Homo sapiens
cuuaagaaauacucacuga

SEQ ID NO: 1068488 - RNA, 19 nt, Homo sapiens
ggugggauguuucggaaug

SEQ ID NO: 1068489 - RNA, 19 nt, Homo sapiens
ggaggagaaaugccacaua

SEQ ID NO: 1068490 - RNA, 19 nt, Homo sapiens
agucaagcccuuuguguua

SEQ ID NO: 1068491 - RNA, 19 nt, Homo sapiens
ugugugagauuuauggaaa

SEQ ID NO: 1068492 - RNA, 19 nt, Homo sapiens
guacaguaacucuaaguga

SEQ ID NO: 1068493 - RNA, 19 nt, Homo sapiens
gaucauauacccaaaucau

SEQ ID NO: 1068494 - RNA, 19 nt, Homo sapiens
uaagacgcaucauaaaugg

SEQ ID NO: 1068495 - RNA, 19 nt, Homo sapiens
agaagcagcccuugaaaug

SEQ ID NO: 1068496 - RNA, 19 nt, Homo sapiens
gauugucugugcuucacua

SEQ ID NO: 1068497 - RNA, 19 nt, Homo sapiens
aagaaauacucacugaaug

SEQ ID NO: 1068498 - RNA, 19 nt, Homo sapiens
aaagcuaugucaagcauuc

SEQ ID NO: 1068499 - RNA, 19 nt, Homo sapiens
gaacugaagcucacaucuc

SEQ ID NO: 1068500 - RNA, 19 nt, Homo sapiens
ugaaaaccauccuuuauug

SEQ ID NO: 1068501 - RNA, 19 nt, Homo sapiens
caguaacucuaagugaaua

SEQ ID NO: 1068502 - RNA, 19 nt, Homo sapiens
guaaauguggcaaagagaa

SEQ ID NO: 1068503 - RNA, 19 nt, Homo sapiens
gcacauccaggacuugaau

SEQ ID NO: 1068504 - RNA, 19 nt, Homo sapiens
cauccaagauuuccagagu

SEQ ID NO: 1068505 - RNA, 19 nt, Homo sapiens
ggauguuuguagugcuaua

SEQ ID NO: 1068506 - RNA, 19 nt, Homo sapiens
agaaaugccacauaccuuu

SEQ ID NO: 1068507 - RNA, 19 nt, Homo sapiens
uuaagugaauggaagaguu

SEQ ID NO: 1068508 - RNA, 19 nt, Homo sapiens
gucaagcccuuuguguuaa

SEQ ID NO: 1068509 - RNA, 19 nt, Homo sapiens
aaagauguguuuccuagag

SEQ ID NO: 1068510 - RNA, 19 nt, Homo sapiens
ugaaagcuaugucaagcau

SEQ ID NO: 1068511 - RNA, 19 nt, Homo sapiens
gcaggaauucucucuuuca

SEQ ID NO: 1068512 - RNA, 19 nt, Homo sapiens
gaacuacagacuccaucuu

SEQ ID NO: 1068513 - RNA, 19 nt, Homo sapiens
uaauucagguucaguacau

SEQ ID NO: 1068514 - RNA, 19 nt, Homo sapiens
gagugucacccuaaggaua

SEQ ID NO: 1068515 - RNA, 19 nt, Homo sapiens
gauuuacucugcuuuacca

SEQ ID NO: 1068516 - RNA, 19 nt, Homo sapiens
gaaugaauccauacuucug

SEQ ID NO: 1068517 - RNA, 19 nt, Homo sapiens
uaagugaauggaagaguuu

SEQ ID NO: 1068518 - RNA, 19 nt, Homo sapiens
uuaagacgcaucauaaaug

SEQ ID NO: 1068519 - RNA, 19 nt, Homo sapiens
aagcucacaucucaaauuc

SEQ ID NO: 1068520 - RNA, 19 nt, Homo sapiens
gaggccacccugauuauug

SEQ ID NO: 1068521 - RNA, 19 nt, Homo sapiens
gaccugugguggaaugaau

SEQ ID NO: 1068522 - RNA, 19 nt, Homo sapiens
gagaaaugccacauaccuu

SEQ ID NO: 1068523 - RNA, 19 nt, Homo sapiens
gcagugagccaugccaaug

SEQ ID NO: 1068524 - RNA, 19 nt, Homo sapiens
gaagaguuugacagagaua

SEQ ID NO: 1068525 - RNA, 19 nt, Homo sapiens
uaauaaagccaaguagaga

SEQ ID NO: 1068526 - RNA, 19 nt, Homo sapiens
caggaauucucucuuucaa

SEQ ID NO: 1068527 - RNA, 19 nt, Homo sapiens
ucacuaauuuccauaacca

SEQ ID NO: 1068528 - RNA, 19 nt, Homo sapiens
ugacuaaggauguuuguag

SEQ ID NO: 1068529 - RNA, 19 nt, Homo sapiens
ucacugaaugcaugaauga

SEQ ID NO: 1068530 - RNA, 19 nt, Homo sapiens
gcaauaaaaggcaaaugua

SEQ ID NO: 1068531 - RNA, 19 nt, Homo sapiens
ggcacaacuugauauauag

SEQ ID NO: 1068532 - RNA, 19 nt, Homo sapiens
caauggugauauuugaaga

SEQ ID NO: 1068533 - RNA, 19 nt, Homo sapiens
uuacucugcuuuaccaguu

SEQ ID NO: 1068534 - RNA, 19 nt, Homo sapiens
ugaaugaacaaaugaagga

SEQ ID NO: 1068535 - RNA, 19 nt, Homo sapiens
gaagcagcccuugaaaugu

SEQ ID NO: 1068536 - RNA, 19 nt, Homo sapiens
auaccaccauguacaguaa

SEQ ID NO: 1068537 - RNA, 19 nt, Homo sapiens
cagguucaguacauuuauu

SEQ ID NO: 1068538 - RNA, 19 nt, Homo sapiens
gaacaaaugaggaguuaua

SEQ ID NO: 1068539 - RNA, 19 nt, Homo sapiens
aaacagagcaaauguagua

SEQ ID NO: 1068540 - RNA, 19 nt, Homo sapiens
ggacagaucagcaguaugu

SEQ ID NO: 1068541 - RNA, 19 nt, Homo sapiens
gaaaagacuuggcuuagaa

SEQ ID NO: 1068542 - RNA, 19 nt, Homo sapiens
ggccagcuaugugauauua

SEQ ID NO: 1068543 - RNA, 19 nt, Homo sapiens
guagaccucuuucguaaug

SEQ ID NO: 1068544 - RNA, 19 nt, Homo sapiens
gggaugaucuuaacugaag

SEQ ID NO: 1068545 - RNA, 19 nt, Homo sapiens
guaaagguauuguuugaag

SEQ ID NO: 1068546 - RNA, 19 nt, Homo sapiens
caagugguauucccauauu

SEQ ID NO: 1068547 - RNA, 19 nt, Homo sapiens
uagaacaaaugaggaguua

SEQ ID NO: 1068548 - RNA, 19 nt, Homo sapiens
gaaauuauuguggccuuua

SEQ ID NO: 1068549 - RNA, 19 nt, Homo sapiens
ggagugagccuuauaagag

SEQ ID NO: 1068550 - RNA, 19 nt, Homo sapiens
gcaaauggccaagaccuaa

SEQ ID NO: 1068551 - RNA, 19 nt, Homo sapiens
agacuuggcuuagaacaaa

SEQ ID NO: 1068552 - RNA, 19 nt, Homo sapiens
cguucagucucauuuauua

SEQ ID NO: 1068553 - RNA, 19 nt, Homo sapiens
ccaaagagagaaagauuga

SEQ ID NO: 1068554 - RNA, 19 nt, Homo sapiens
ggacguucagucucauuua

SEQ ID NO: 1068555 - RNA, 19 nt, Homo sapiens
gaauggaccuauaggacau

SEQ ID NO: 1068556 - RNA, 19 nt, Homo sapiens
ggaaauuauuguggccuuu

SEQ ID NO: 1068557 - RNA, 19 nt, Homo sapiens
gauagaaauucagcuacaa

SEQ ID NO: 1068558 - RNA, 19 nt, Homo sapiens
gaagaaaagacuuggcuua

SEQ ID NO: 1068559 - RNA, 19 nt, Homo sapiens
ccagcuaugugauauuaga

SEQ ID NO: 1068560 - RNA, 19 nt, Homo sapiens
gugucuagguuucugauaa

SEQ ID NO: 1068561 - RNA, 19 nt, Homo sapiens
gugccuauaucgacaaaga

SEQ ID NO: 1068562 - RNA, 19 nt, Homo sapiens
gaacggaagaguggauuau

SEQ ID NO: 1068563 - RNA, 19 nt, Homo sapiens
gacguucagucucauuuau

SEQ ID NO: 1068564 - RNA, 19 nt, Homo sapiens
caacgacaguggcaucuac

SEQ ID NO: 1068565 - RNA, 19 nt, Homo sapiens
cagagcaaauguaguagga

SEQ ID NO: 1068566 - RNA, 19 nt, Homo sapiens
gcuauucugccaugucuuu

SEQ ID NO: 1068567 - RNA, 19 nt, Homo sapiens
acggaagaguggauuauuu

SEQ ID NO: 1068568 - RNA, 19 nt, Homo sapiens
gauauuagaggaagaaagg

SEQ ID NO: 1068569 - RNA, 19 nt, Homo sapiens
gauuugaagugacugauac

SEQ ID NO: 1068570 - RNA, 19 nt, Homo sapiens
cuguagaccucuuucguaa

SEQ ID NO: 1068571 - RNA, 19 nt, Homo sapiens
guaccugggugccuauauc

SEQ ID NO: 1068572 - RNA, 19 nt, Homo sapiens
gaagccagacgagcuguaa

SEQ ID NO: 1068573 - RNA, 19 nt, Homo sapiens
gaaggaaaacugaagaaaa

SEQ ID NO: 1068574 - RNA, 19 nt, Homo sapiens
ucaauacucccaaugaaga

SEQ ID NO: 1068575 - RNA, 19 nt, Homo sapiens
cgagauugauucaccuuca

SEQ ID NO: 1068576 - RNA, 19 nt, Homo sapiens
gcuguagaccucuuucgua

SEQ ID NO: 1068577 - RNA, 19 nt, Homo sapiens
ugaucccuauggagaauua

SEQ ID NO: 1068578 - RNA, 19 nt, Homo sapiens
ggaaaguaaagguauuguu

SEQ ID NO: 1068579 - RNA, 19 nt, Homo sapiens
gcaccaggaugcuguagac

SEQ ID NO: 1068580 - RNA, 19 nt, Homo sapiens
ccaggagggugauaagauc

SEQ ID NO: 1068581 - RNA, 19 nt, Homo sapiens
ugucuagguuucugauaaa

SEQ ID NO: 1068582 - RNA, 19 nt, Homo sapiens
cgacaaagagugagaagag

SEQ ID NO: 1068583 - RNA, 19 nt, Homo sapiens
uggauuauuuggucacuga

SEQ ID NO: 1068584 - RNA, 19 nt, Homo sapiens
uauaggacaucgaggugaa

SEQ ID NO: 1068585 - RNA, 19 nt, Homo sapiens
gguuacaggugcagaaugg

SEQ ID NO: 1068586 - RNA, 19 nt, Homo sapiens
gcacuuugguagccugaag

SEQ ID NO: 1068587 - RNA, 19 nt, Homo sapiens
gagaauuaaaggugagaaa

SEQ ID NO: 1068588 - RNA, 19 nt, Homo sapiens
ggugcagaauggaccuaua

SEQ ID NO: 1068589 - RNA, 19 nt, Homo sapiens
gaagugggagauugcuuga

SEQ ID NO: 1068590 - RNA, 19 nt, Homo sapiens
gcaaauguaguaggaacaa

SEQ ID NO: 1068591 - RNA, 19 nt, Homo sapiens
caccauaggcaauaccuuu

SEQ ID NO: 1068592 - RNA, 19 nt, Homo sapiens
caaaaccucaucucuauuu

SEQ ID NO: 1068593 - RNA, 19 nt, Homo sapiens
gagucuuccugucaccaua

SEQ ID NO: 1068594 - RNA, 19 nt, Homo sapiens
ugauagaaauucagcuaca

SEQ ID NO: 1068595 - RNA, 19 nt, Homo sapiens
aagaggacguucagucuca

SEQ ID NO: 1068596 - RNA, 19 nt, Homo sapiens
aacuugcucucuuucaaua

SEQ ID NO: 1068597 - RNA, 19 nt, Homo sapiens
guaaaucccagcacuuugg

SEQ ID NO: 1068598 - RNA, 19 nt, Homo sapiens
gggagugagccuuauaaga

SEQ ID NO: 1068599 - RNA, 19 nt, Homo sapiens
gcagaauggaccuauagga

SEQ ID NO: 1068600 - RNA, 19 nt, Homo sapiens
gauaaaagggaugaucuua

SEQ ID NO: 1068601 - RNA, 19 nt, Homo sapiens
caaauggccaagaccuaaa

SEQ ID NO: 1068602 - RNA, 19 nt, Homo sapiens
cugcauagccagauuugaa

SEQ ID NO: 1068603 - RNA, 19 nt, Homo sapiens
ccugggcuuucaugagaua

SEQ ID NO: 1068604 - RNA, 19 nt, Homo sapiens
gaaggggacccaaguggua

SEQ ID NO: 1068605 - RNA, 19 nt, Homo sapiens
cggaagaguggauuauuug

SEQ ID NO: 1068606 - RNA, 19 nt, Homo sapiens
auaagauccuuucggcaaa

SEQ ID NO: 1068607 - RNA, 19 nt, Homo sapiens
gaagaguggauuauuuggu

SEQ ID NO: 1068608 - RNA, 19 nt, Homo sapiens
aagggaugaucuuaacuga

SEQ ID NO: 1068609 - RNA, 19 nt, Homo sapiens
gcuacaacccaaagagaga

SEQ ID NO: 1068610 - RNA, 19 nt, Homo sapiens
ccucagggcugggcuucaa

SEQ ID NO: 1068611 - RNA, 19 nt, Homo sapiens
gccaagaccuaaagaaccu

SEQ ID NO: 1068612 - RNA, 19 nt, Homo sapiens
uaagauccuuucggcaaau

SEQ ID NO: 1068613 - RNA, 19 nt, Homo sapiens
uaaaagggaugaucuuaac

SEQ ID NO: 1068614 - RNA, 19 nt, Homo sapiens
uuaaacagagcaaauguag

SEQ ID NO: 1068615 - RNA, 19 nt, Homo sapiens
aaaggccagcuaugugaua

SEQ ID NO: 1068616 - RNA, 19 nt, Homo sapiens
auaaaggccagcuauguga

SEQ ID NO: 1068617 - RNA, 19 nt, Homo sapiens
ccaagugguauucccauau

SEQ ID NO: 1068618 - RNA, 19 nt, Homo sapiens
cccaagugguauucccaua

SEQ ID NO: 1068619 - RNA, 19 nt, Homo sapiens
gaauuaaaggugagaaagc

SEQ ID NO: 1068620 - RNA, 19 nt, Homo sapiens
gagauaccggcaacaacuu

SEQ ID NO: 1068621 - RNA, 19 nt, Homo sapiens
aaagagagaaagauugagu

SEQ ID NO: 1068622 - RNA, 19 nt, Homo sapiens
uaaugggaaaguaaaggua

SEQ ID NO: 1068623 - RNA, 19 nt, Homo sapiens
agugguauucccauauuua

SEQ ID NO: 1068624 - RNA, 19 nt, Homo sapiens
ggaagccagacgagcugua

SEQ ID NO: 1068625 - RNA, 19 nt, Homo sapiens
cuacgucagccgcaucaaa

SEQ ID NO: 1068626 - RNA, 19 nt, Homo sapiens
gguauuguuugaaggaaaa

SEQ ID NO: 1068627 - RNA, 19 nt, Homo sapiens
ggcaaauggccaagaccua

SEQ ID NO: 1068628 - RNA, 19 nt, Homo sapiens
ggagggugauaagauccuu

SEQ ID NO: 1068629 - RNA, 19 nt, Homo sapiens
cuauaucgacaaagaguga

SEQ ID NO: 1068630 - RNA, 19 nt, Homo sapiens
aaggaaaacugaagaaaag

SEQ ID NO: 1068631 - RNA, 19 nt, Homo sapiens
ugaacggaagaguggauua

SEQ ID NO: 1068632 - RNA, 19 nt, Homo sapiens
ugggacagaucagcaguau

SEQ ID NO: 1068633 - RNA, 19 nt, Homo sapiens
gcuacuuuguggugucuag

SEQ ID NO: 1068634 - RNA, 19 nt, Homo sapiens
cagacgagcuguaaaacau

SEQ ID NO: 1068635 - RNA, 19 nt, Homo sapiens
cagcuacaacccaaagaga

SEQ ID NO: 1068636 - RNA, 19 nt, Homo sapiens
aaacuugcucucuuucaau

SEQ ID NO: 1068637 - RNA, 19 nt, Homo sapiens
ggaagaguggauuauuugg

SEQ ID NO: 1068638 - RNA, 19 nt, Homo sapiens
gaggagaacuucauacuca

SEQ ID NO: 1068639 - RNA, 19 nt, Homo sapiens
guagcaagauggaucauaa

SEQ ID NO: 1068640 - RNA, 19 nt, Homo sapiens
gcaguuagcuauagacauc

SEQ ID NO: 1068641 - RNA, 19 nt, Homo sapiens
gcagcaaggucuagcaauu

SEQ ID NO: 1068642 - RNA, 19 nt, Homo sapiens
gagaaguguuugccuauug

SEQ ID NO: 1068643 - RNA, 19 nt, Homo sapiens
ggaaauuuguugucuagug

SEQ ID NO: 1068644 - RNA, 19 nt, Homo sapiens
cuaaagaggugacugguau

SEQ ID NO: 1068645 - RNA, 19 nt, Homo sapiens
cuaugucucuuucuucuua

SEQ ID NO: 1068646 - RNA, 19 nt, Homo sapiens
gagccaaguucuaguaguu

SEQ ID NO: 1068647 - RNA, 19 nt, Homo sapiens
gggaggagcuucuaaagag

SEQ ID NO: 1068648 - RNA, 19 nt, Homo sapiens
uaaagccacuggaaauuug

SEQ ID NO: 1068649 - RNA, 19 nt, Homo sapiens
gcacgugccucucugaauc

SEQ ID NO: 1068650 - RNA, 19 nt, Homo sapiens
gaauaccugucuccacauu

SEQ ID NO: 1068651 - RNA, 19 nt, Homo sapiens
caaaagagauauccauuga

SEQ ID NO: 1068652 - RNA, 19 nt, Homo sapiens
caucgugccugaaggagua

SEQ ID NO: 1068653 - RNA, 19 nt, Homo sapiens
caccacaccuguuuaaaga

SEQ ID NO: 1068654 - RNA, 19 nt, Homo sapiens
gcgcaucucuacauguauu

SEQ ID NO: 1068655 - RNA, 19 nt, Homo sapiens
ggacugguuuccuucuuga

SEQ ID NO: 1068656 - RNA, 19 nt, Homo sapiens
uuagauugcuguaagcuuu

SEQ ID NO: 1068657 - RNA, 19 nt, Homo sapiens
ucuaaugacuggcaucuga

SEQ ID NO: 1068658 - RNA, 19 nt, Homo sapiens
guucuaggcuuuccuucaa

SEQ ID NO: 1068659 - RNA, 19 nt, Homo sapiens
cuaaaggugauucuaguua

SEQ ID NO: 1068660 - RNA, 19 nt, Homo sapiens
uuacguccauggugacaua

SEQ ID NO: 1068661 - RNA, 19 nt, Homo sapiens
guguuugccuauugauuua

SEQ ID NO: 1068662 - RNA, 19 nt, Homo sapiens
acagaccaguguccaguua

SEQ ID NO: 1068663 - RNA, 19 nt, Homo sapiens
gacugaagcuggugacugu

SEQ ID NO: 1068664 - RNA, 19 nt, Homo sapiens
gaaccaccacaccuguuua

SEQ ID NO: 1068665 - RNA, 19 nt, Homo sapiens
cagggaagauggaauuuag

SEQ ID NO: 1068666 - RNA, 19 nt, Homo sapiens
gcaagugaaacacauaaug

SEQ ID NO: 1068667 - RNA, 19 nt, Homo sapiens
ggccauggcagcuguagua

SEQ ID NO: 1068668 - RNA, 19 nt, Homo sapiens
ggaaguggcagcccugguu

SEQ ID NO: 1068669 - RNA, 19 nt, Homo sapiens
ggaaccaccacaccuguuu

SEQ ID NO: 1068670 - RNA, 19 nt, Homo sapiens
ucuaguaguuucaguucua

SEQ ID NO: 1068671 - RNA, 19 nt, Homo sapiens
guacaugcccuuuaugaag

SEQ ID NO: 1068672 - RNA, 19 nt, Homo sapiens
gcaagauggaucauaaaug

SEQ ID NO: 1068673 - RNA, 19 nt, Homo sapiens
cauagcacccacucacuua

SEQ ID NO: 1068674 - RNA, 19 nt, Homo sapiens
ggaagauggaauuuaguuu

SEQ ID NO: 1068675 - RNA, 19 nt, Homo sapiens
gggaaggccuaaagaacug

SEQ ID NO: 1068676 - RNA, 19 nt, Homo sapiens
gaaggugccucgugaacac

SEQ ID NO: 1068677 - RNA, 19 nt, Homo sapiens
gaaacacauuuacguugca

SEQ ID NO: 1068678 - RNA, 19 nt, Homo sapiens
gaggagccaaguucuagua

SEQ ID NO: 1068679 - RNA, 19 nt, Homo sapiens
uaagcuaugucucuuucuu

SEQ ID NO: 1068680 - RNA, 19 nt, Homo sapiens
guagaaacacauuuacguu

SEQ ID NO: 1068681 - RNA, 19 nt, Homo sapiens
gauguuacguggccggaau

SEQ ID NO: 1068682 - RNA, 19 nt, Homo sapiens
cuacauguauuccuagagu

SEQ ID NO: 1068683 - RNA, 19 nt, Homo sapiens
gaguacaugcccuuuauga

SEQ ID NO: 1068684 - RNA, 19 nt, Homo sapiens
guaauuaagcuaugucucu

SEQ ID NO: 1068685 - RNA, 19 nt, Homo sapiens
gaacuucauacucacaaug

SEQ ID NO: 1068686 - RNA, 19 nt, Homo sapiens
agaaguguuugccuauuga

SEQ ID NO: 1068687 - RNA, 19 nt, Homo sapiens
acagucagaucacaaagug

SEQ ID NO: 1068688 - RNA, 19 nt, Homo sapiens
ggauuuaaacagcuccuuu

SEQ ID NO: 1068689 - RNA, 19 nt, Homo sapiens
gcauuggcagcaccaguua

SEQ ID NO: 1068690 - RNA, 19 nt, Homo sapiens
uggcaaucaugcuacauaa

SEQ ID NO: 1068691 - RNA, 19 nt, Homo sapiens
uacaugcccuuuaugaaga

SEQ ID NO: 1068692 - RNA, 19 nt, Homo sapiens
uaaauacuaggucagcuuu

SEQ ID NO: 1068693 - RNA, 19 nt, Homo sapiens
gcuacuuuauccauugauu

SEQ ID NO: 1068694 - RNA, 19 nt, Homo sapiens
gggaagauggaauuuaguu

SEQ ID NO: 1068695 - RNA, 19 nt, Homo sapiens
caagaacagucagaucaca

SEQ ID NO: 1068696 - RNA, 19 nt, Homo sapiens
cuugaugcaugcuggcuua

SEQ ID NO: 1068697 - RNA, 19 nt, Homo sapiens
gcaaucaugcuacauaagg

SEQ ID NO: 1068698 - RNA, 19 nt, Homo sapiens
uuacguggccggaaucauu

SEQ ID NO: 1068699 - RNA, 19 nt, Homo sapiens
gaauaaaggagggcagaau

SEQ ID NO: 1068700 - RNA, 19 nt, Homo sapiens
uugcgcaucucuacaugua

SEQ ID NO: 1068701 - RNA, 19 nt, Homo sapiens
gccgggacauuucuuuaug

SEQ ID NO: 1068702 - RNA, 19 nt, Homo sapiens
gagcggaaucgaaucagaa

SEQ ID NO: 1068703 - RNA, 19 nt, Homo sapiens
cauggcagcuguaguaucg

SEQ ID NO: 1068704 - RNA, 19 nt, Homo sapiens
guaggacaccagcauuaaa

SEQ ID NO: 1068705 - RNA, 19 nt, Homo sapiens
caguaggacaccagcauua

SEQ ID NO: 1068706 - RNA, 19 nt, Homo sapiens
gcacagccacgaccacaca

SEQ ID NO: 1068707 - RNA, 19 nt, Homo sapiens
ucccuuggcuguuaauuuc

SEQ ID NO: 1068708 - RNA, 19 nt, Homo sapiens
ggaugguuauugauaucuu

SEQ ID NO: 1068709 - RNA, 19 nt, Homo sapiens
gagaggagccaaguucuag

SEQ ID NO: 1068710 - RNA, 19 nt, Homo sapiens
gauuuaaacagcuccuuug

SEQ ID NO: 1068711 - RNA, 19 nt, Homo sapiens
ggaaucgaaucagaaagca

SEQ ID NO: 1068712 - RNA, 19 nt, Homo sapiens
caagcaagugaaacacaua

SEQ ID NO: 1068713 - RNA, 19 nt, Homo sapiens
ccaagcaagugaaacacau

SEQ ID NO: 1068714 - RNA, 19 nt, Homo sapiens
cuauagacaucccauugug

SEQ ID NO: 1068715 - RNA, 19 nt, Homo sapiens
uuaaagccacuggaaauuu

SEQ ID NO: 1068716 - RNA, 19 nt, Homo sapiens
gaaagcccacucucuugga

SEQ ID NO: 1068717 - RNA, 19 nt, Homo sapiens
ugagaaguguuugccuauu

SEQ ID NO: 1068718 - RNA, 19 nt, Homo sapiens
aggaguacaugcccuuuau

SEQ ID NO: 1068719 - RNA, 19 nt, Homo sapiens
ccacaccuguuuaaagaac

SEQ ID NO: 1068720 - RNA, 19 nt, Homo sapiens
ccacgagaaucuaaugacu

SEQ ID NO: 1068721 - RNA, 19 nt, Homo sapiens
cuuuggaaauuaagggaua

SEQ ID NO: 1068722 - RNA, 19 nt, Homo sapiens
gauagcaagacacauugaa

SEQ ID NO: 1068723 - RNA, 19 nt, Homo sapiens
auguaagacuggugcuuua

SEQ ID NO: 1068724 - RNA, 19 nt, Homo sapiens
ucagggaagauggaauuua

SEQ ID NO: 1068725 - RNA, 19 nt, Homo sapiens
ucucuuaacccuauucuca

SEQ ID NO: 1068726 - RNA, 19 nt, Homo sapiens
gaauagggcacagccacaa

SEQ ID NO: 1068727 - RNA, 19 nt, Homo sapiens
gaugcaugcuggcuuagag

SEQ ID NO: 1068728 - RNA, 19 nt, Homo sapiens
gggcagagacagcuuugug

SEQ ID NO: 1068729 - RNA, 19 nt, Homo sapiens
auaaccaccuguagcaaga

SEQ ID NO: 1068730 - RNA, 19 nt, Homo sapiens
guggcaaucaugcuacaua

SEQ ID NO: 1068731 - RNA, 19 nt, Homo sapiens
gagcagcagcaucuacuuc

SEQ ID NO: 1068732 - RNA, 19 nt, Homo sapiens
cuauguuggugggauguua

SEQ ID NO: 1068733 - RNA, 19 nt, Homo sapiens
gccaaguucuaguaguuuc

SEQ ID NO: 1068734 - RNA, 19 nt, Homo sapiens
ggagccaaguucuaguagu

SEQ ID NO: 1068735 - RNA, 19 nt, Homo sapiens
gcuaaaggugauucuaguu

SEQ ID NO: 1068736 - RNA, 19 nt, Homo sapiens
cagguucgcuugagucacu

SEQ ID NO: 1068737 - RNA, 19 nt, Homo sapiens
gaaaagaggagaacuucau

SEQ ID NO: 1068738 - RNA, 19 nt, Homo sapiens
ggaaauuacuuaccugaua

SEQ ID NO: 1068739 - RNA, 19 nt, Homo sapiens
ugaaggaggugguaaguua

SEQ ID NO: 1068740 - RNA, 19 nt, Homo sapiens
gaaggaagguuucuuuagu

SEQ ID NO: 1068741 - RNA, 19 nt, Homo sapiens
gaaaagacuuguugguuua

SEQ ID NO: 1068742 - RNA, 19 nt, Homo sapiens
ggaaacgcuugcccuaaua

SEQ ID NO: 1068743 - RNA, 19 nt, Homo sapiens
ggacucggcuggcugcuuu

SEQ ID NO: 1068744 - RNA, 19 nt, Homo sapiens
gcaauugggucacaguguu

SEQ ID NO: 1068745 - RNA, 19 nt, Homo sapiens
caagaacaaucuaucauuc

SEQ ID NO: 1068746 - RNA, 19 nt, Homo sapiens
gaucuugggacauuuauuu

SEQ ID NO: 1068747 - RNA, 19 nt, Homo sapiens
ggugguaaguuaauuaguu

SEQ ID NO: 1068748 - RNA, 19 nt, Homo sapiens
gaagguuucuuuaguacug

SEQ ID NO: 1068749 - RNA, 19 nt, Homo sapiens
cuaaagcucuugcuauguu

SEQ ID NO: 1068750 - RNA, 19 nt, Homo sapiens
caguaucuguuacacauua

SEQ ID NO: 1068751 - RNA, 19 nt, Homo sapiens
gaaauuacuuaccugauac

SEQ ID NO: 1068752 - RNA, 19 nt, Homo sapiens
gcaagaacaaucuaucauu

SEQ ID NO: 1068753 - RNA, 19 nt, Homo sapiens
gauggaacguucuaugaau

SEQ ID NO: 1068754 - RNA, 19 nt, Homo sapiens
ucuaagaugugucugcuaa

SEQ ID NO: 1068755 - RNA, 19 nt, Homo sapiens
ggaggugguaaguuaauua

SEQ ID NO: 1068756 - RNA, 19 nt, Homo sapiens
uaaugcccaugucaauuua

SEQ ID NO: 1068757 - RNA, 19 nt, Homo sapiens
ggaaugagagugcagauag

SEQ ID NO: 1068758 - RNA, 19 nt, Homo sapiens
gauaccaugguccaaauua

SEQ ID NO: 1068759 - RNA, 19 nt, Homo sapiens
aaggaagguuucuuuagua

SEQ ID NO: 1068760 - RNA, 19 nt, Homo sapiens
acagagaucuugggacauu

SEQ ID NO: 1068761 - RNA, 19 nt, Homo sapiens
cccaagagguucucgcuuu

SEQ ID NO: 1068762 - RNA, 19 nt, Homo sapiens
gaaggagucuaugaacuag

SEQ ID NO: 1068763 - RNA, 19 nt, Homo sapiens
gaacgaauaaaguguuuca

SEQ ID NO: 1068764 - RNA, 19 nt, Homo sapiens
ccuuaaaccuucaaauaug

SEQ ID NO: 1068765 - RNA, 19 nt, Homo sapiens
gaaacgcuugcccuaauaa

SEQ ID NO: 1068766 - RNA, 19 nt, Homo sapiens
aaacaagagacggaaauua

SEQ ID NO: 1068767 - RNA, 19 nt, Homo sapiens
cagaacgaauaaaguguuu

SEQ ID NO: 1068768 - RNA, 19 nt, Homo sapiens
uaaauucucccaagagguu

SEQ ID NO: 1068769 - RNA, 19 nt, Homo sapiens
uaagaugugucugcuaaug

SEQ ID NO: 1068770 - RNA, 19 nt, Homo sapiens
gaaggaggugguaaguuaa

SEQ ID NO: 1068771 - RNA, 19 nt, Homo sapiens
gaaugagagugcagauagu

SEQ ID NO: 1068772 - RNA, 19 nt, Homo sapiens
ccacugcuuuaagaaauaa

SEQ ID NO: 1068773 - RNA, 19 nt, Homo sapiens
cauauucuccacugcuuua

SEQ ID NO: 1068774 - RNA, 19 nt, Homo sapiens
ggagacauaagucccauga

SEQ ID NO: 1068775 - RNA, 19 nt, Homo sapiens
gcagaacgaauaaaguguu

SEQ ID NO: 1068776 - RNA, 19 nt, Homo sapiens
gcauuugaaagagcaauua

SEQ ID NO: 1068777 - RNA, 19 nt, Homo sapiens
agaaggagucuaugaacua

SEQ ID NO: 1068778 - RNA, 19 nt, Homo sapiens
ggaaagccuuagccaacug

SEQ ID NO: 1068779 - RNA, 19 nt, Homo sapiens
ccacacagaauauggagaa

SEQ ID NO: 1068780 - RNA, 19 nt, Homo sapiens
uuaaugcccaugucaauuu

SEQ ID NO: 1068781 - RNA, 19 nt, Homo sapiens
uggaaacgcuugcccuaau

SEQ ID NO: 1068782 - RNA, 19 nt, Homo sapiens
agaaaagacuuguugguuu

SEQ ID NO: 1068783 - RNA, 19 nt, Homo sapiens
aaauuuggcucgcauugau

SEQ ID NO: 1068784 - RNA, 19 nt, Homo sapiens
uaacugcucuaagaugugu

SEQ ID NO: 1068785 - RNA, 19 nt, Homo sapiens
uucauuaacugcucuaaga

SEQ ID NO: 1068786 - RNA, 19 nt, Homo sapiens
gcaauuaaugcccauguca

SEQ ID NO: 1068787 - RNA, 19 nt, Homo sapiens
gcuaauggugcuuaaauuc

SEQ ID NO: 1068788 - RNA, 19 nt, Homo sapiens
ggaaagugucaacuaccua

SEQ ID NO: 1068789 - RNA, 19 nt, Homo sapiens
agaaaagccuccaaaagaa

SEQ ID NO: 1068790 - RNA, 19 nt, Homo sapiens
caauugggucacaguguua

SEQ ID NO: 1068791 - RNA, 19 nt, Homo sapiens
gucuauaguuccugagauu

SEQ ID NO: 1068792 - RNA, 19 nt, Homo sapiens
ccaugaggaucccagaguu

SEQ ID NO: 1068793 - RNA, 19 nt, Homo sapiens
guucuuugguggaaugaga

SEQ ID NO: 1068794 - RNA, 19 nt, Homo sapiens
gcugggaaccugagaagga

SEQ ID NO: 1068795 - RNA, 19 nt, Homo sapiens
caagagacggaaauuacuu

SEQ ID NO: 1068796 - RNA, 19 nt, Homo sapiens
uagaaaagccuccaaaaga

SEQ ID NO: 1068797 - RNA, 19 nt, Homo sapiens
gaacaaucuaucauuccaa

SEQ ID NO: 1068798 - RNA, 19 nt, Homo sapiens
ggaacguucuaugaauuuc

SEQ ID NO: 1068799 - RNA, 19 nt, Homo sapiens
ggaauggcaagaacaaucu

SEQ ID NO: 1068800 - RNA, 19 nt, Homo sapiens
ggaggcagaacgaauaaag

SEQ ID NO: 1068801 - RNA, 19 nt, Homo sapiens
uaaagcucuugcuauguug

SEQ ID NO: 1068802 - RNA, 19 nt, Homo sapiens
gaauauggagaacucaaca

SEQ ID NO: 1068803 - RNA, 19 nt, Homo sapiens
gauaaacaagagacggaaa

SEQ ID NO: 1068804 - RNA, 19 nt, Homo sapiens
ccucagguguguucaucuu

SEQ ID NO: 1068805 - RNA, 19 nt, Homo sapiens
caaauuuggcucgcauuga

SEQ ID NO: 1068806 - RNA, 19 nt, Homo sapiens
uaaggaauggcaagaacaa

SEQ ID NO: 1068807 - RNA, 19 nt, Homo sapiens
cuugggacauuuauuuguu

SEQ ID NO: 1068808 - RNA, 19 nt, Homo sapiens
aagagacggaaauuacuua

SEQ ID NO: 1068809 - RNA, 19 nt, Homo sapiens
gagcugaaguucggaaagc

SEQ ID NO: 1068810 - RNA, 19 nt, Homo sapiens
gaauuuggaggcagaacga

SEQ ID NO: 1068811 - RNA, 19 nt, Homo sapiens
agagaucuugggacauuua

SEQ ID NO: 1068812 - RNA, 19 nt, Homo sapiens
uaaacaagagacggaaauu

SEQ ID NO: 1068813 - RNA, 19 nt, Homo sapiens
uaugaucucuaaagcucuu

SEQ ID NO: 1068814 - RNA, 19 nt, Homo sapiens
uaauggugcuuaaauucuc

SEQ ID NO: 1068815 - RNA, 19 nt, Homo sapiens
gggaaagugucaacuaccu

SEQ ID NO: 1068816 - RNA, 19 nt, Homo sapiens
cgauggaacguucuaugaa

SEQ ID NO: 1068817 - RNA, 19 nt, Homo sapiens
cacagaauauggagaacuc

SEQ ID NO: 1068818 - RNA, 19 nt, Homo sapiens
caaaagaaggagucuauga

SEQ ID NO: 1068819 - RNA, 19 nt, Homo sapiens
ggcauuucaguaucuguua

SEQ ID NO: 1068820 - RNA, 19 nt, Homo sapiens
caccuuggcauuucaguau

SEQ ID NO: 1068821 - RNA, 19 nt, Homo sapiens
uccacugcuuuaagaaaua

SEQ ID NO: 1068822 - RNA, 19 nt, Homo sapiens
cucuaaagcucuugcuaug

SEQ ID NO: 1068823 - RNA, 19 nt, Homo sapiens
ggaccucuuacucugaauu

SEQ ID NO: 1068824 - RNA, 19 nt, Homo sapiens
uuaauuugcugugcuucuu

SEQ ID NO: 1068825 - RNA, 19 nt, Homo sapiens
agacggaaauuacuuaccu

SEQ ID NO: 1068826 - RNA, 19 nt, Homo sapiens
gaauggcaagaacaaucua

SEQ ID NO: 1068827 - RNA, 19 nt, Homo sapiens
acucugaauugguuggauu

SEQ ID NO: 1068828 - RNA, 19 nt, Homo sapiens
gcauuucaguaucuguuac

SEQ ID NO: 1068829 - RNA, 19 nt, Homo sapiens
gagguucucgcuuuuauuu

SEQ ID NO: 1068830 - RNA, 19 nt, Homo sapiens
ccaagagguucucgcuuuu

SEQ ID NO: 1068831 - RNA, 19 nt, Homo sapiens
cauguucuuugguggaaug

SEQ ID NO: 1068832 - RNA, 19 nt, Homo sapiens
caauuuaggcuacacaaaa

SEQ ID NO: 1068833 - RNA, 19 nt, Homo sapiens
ggugaugcauuugaaagag

SEQ ID NO: 1068834 - RNA, 19 nt, Homo sapiens
uugcugugcuucuugcauu

SEQ ID NO: 1068835 - RNA, 19 nt, Homo sapiens
agaacaaucuaucauucca

SEQ ID NO: 1068836 - RNA, 19 nt, Homo sapiens
gacaauacgauggaacguu

SEQ ID NO: 1068837 - RNA, 19 nt, Homo sapiens
uaauuucuccuuaguuugg

SEQ ID NO: 1068838 - RNA, 19 nt, Homo sapiens
ggacaacaguacccuagug

SEQ ID NO: 1068839 - RNA, 19 nt, Homo sapiens
aaacaaauccugcagugaa

SEQ ID NO: 1068840 - RNA, 19 nt, Homo sapiens
ggacguaagcgcucugaga

SEQ ID NO: 1068841 - RNA, 19 nt, Homo sapiens
caagggugagugugaaaua

SEQ ID NO: 1068842 - RNA, 19 nt, Homo sapiens
aacaaauccugcagugaaa

SEQ ID NO: 1068843 - RNA, 19 nt, Homo sapiens
gagcaggccggagcuauug

SEQ ID NO: 1068844 - RNA, 19 nt, Homo sapiens
caaccuacggcuggaauuu

SEQ ID NO: 1068845 - RNA, 19 nt, Homo sapiens
cgaccacauucacaaccua

SEQ ID NO: 1068846 - RNA, 19 nt, Homo sapiens
aagggugagugugaaauaa

SEQ ID NO: 1068847 - RNA, 19 nt, Homo sapiens
gagugcuagugccuucuuu

SEQ ID NO: 1068848 - RNA, 19 nt, Homo sapiens
gccugcaccuagccaguuu

SEQ ID NO: 1068849 - RNA, 19 nt, Homo sapiens
ugcgcgaggugcauuguuu

SEQ ID NO: 1068850 - RNA, 19 nt, Homo sapiens
gcaccuauacccucaagcu

SEQ ID NO: 1068851 - RNA, 19 nt, Homo sapiens
uaaacaaauccugcaguga

SEQ ID NO: 1068852 - RNA, 19 nt, Homo sapiens
cgagcaggccggagcuauu

SEQ ID NO: 1068853 - RNA, 19 nt, Homo sapiens
gggugagugugaaauaaac

SEQ ID NO: 1068854 - RNA, 19 nt, Homo sapiens
gcgcaccuauacccucaag

SEQ ID NO: 1068855 - RNA, 19 nt, Homo sapiens
accuacggcuggaauuuga

SEQ ID NO: 1068856 - RNA, 19 nt, Homo sapiens
aauuugagccaucgaggaa

SEQ ID NO: 1068857 - RNA, 19 nt, Homo sapiens
gaacaggagucuugauucu

SEQ ID NO: 1068858 - RNA, 19 nt, Homo sapiens
guaauagccuuaauuccuu

SEQ ID NO: 1068859 - RNA, 19 nt, Homo sapiens
acaggagucuugauucuuu

SEQ ID NO: 1068860 - RNA, 19 nt, Homo sapiens
ccaacuuucuucagaguaa

SEQ ID NO: 1068861 - RNA, 19 nt, Homo sapiens
gaagguauccuccaagaag

SEQ ID NO: 1068862 - RNA, 19 nt, Homo sapiens
cuacuuccuuucuagaaua

SEQ ID NO: 1068863 - RNA, 19 nt, Homo sapiens
gaacacagagucacagcuu

SEQ ID NO: 1068864 - RNA, 19 nt, Homo sapiens
gcacugagccacaaagaag

SEQ ID NO: 1068865 - RNA, 19 nt, Homo sapiens
gaaguuucaugggaaggua

SEQ ID NO: 1068866 - RNA, 19 nt, Homo sapiens
gggaagguauccuccaaga

SEQ ID NO: 1068867 - RNA, 19 nt, Homo sapiens
ucacaucuuucccaccuuu

SEQ ID NO: 1068868 - RNA, 19 nt, Homo sapiens
ccucugcccuuuacuugaa

SEQ ID NO: 1068869 - RNA, 19 nt, Homo sapiens
gcucaaaccgagauaugaa

SEQ ID NO: 1068870 - RNA, 19 nt, Homo sapiens
aaagauggccaagaacuaa

SEQ ID NO: 1068871 - RNA, 19 nt, Homo sapiens
ggagagagagaguccaugu

SEQ ID NO: 1068872 - RNA, 19 nt, Homo sapiens
ggacagaggaacacagagu

SEQ ID NO: 1068873 - RNA, 19 nt, Homo sapiens
uggcuacuuuguguuauua

SEQ ID NO: 1068874 - RNA, 19 nt, Homo sapiens
gaagccaaccuacgcaugu

SEQ ID NO: 1068875 - RNA, 19 nt, Homo sapiens
aaguacaagucacaucuuu

SEQ ID NO: 1068876 - RNA, 19 nt, Homo sapiens
gaauacaagcccugaucuu

SEQ ID NO: 1068877 - RNA, 19 nt, Homo sapiens
gccaagaacuaaguaacga

SEQ ID NO: 1068878 - RNA, 19 nt, Homo sapiens
gaagguguggccagaacaa

SEQ ID NO: 1068879 - RNA, 19 nt, Homo sapiens
gagcucaaaccgagauaug

SEQ ID NO: 1068880 - RNA, 19 nt, Homo sapiens
cccagcaacccucacauua

SEQ ID NO: 1068881 - RNA, 19 nt, Homo sapiens
caaaguacaagucacaucu

SEQ ID NO: 1068882 - RNA, 19 nt, Homo sapiens
cagaguaauagccuuaauu

SEQ ID NO: 1068883 - RNA, 19 nt, Homo sapiens
gguagcggcuucgguagug

SEQ ID NO: 1068884 - RNA, 19 nt, Homo sapiens
guguggagcuggagaagag

SEQ ID NO: 1068885 - RNA, 19 nt, Homo sapiens
ggaagguauccuccaagaa

SEQ ID NO: 1068886 - RNA, 19 nt, Homo sapiens
cacggucuguggcuacuuu

SEQ ID NO: 1068887 - RNA, 19 nt, Homo sapiens
cagcaacccucacauuagc

SEQ ID NO: 1068888 - RNA, 19 nt, Homo sapiens
gggcucugaugaggaaauu

SEQ ID NO: 1068889 - RNA, 19 nt, Homo sapiens
ggauaaaaguccugaccuu

SEQ ID NO: 1068890 - RNA, 19 nt, Homo sapiens
gcugaccaauguccucuag

SEQ ID NO: 1068891 - RNA, 19 nt, Homo sapiens
agaaccaccugcccaaagu

SEQ ID NO: 1068892 - RNA, 19 nt, Homo sapiens
gcucagcugccgacugcua

SEQ ID NO: 1068893 - RNA, 19 nt, Homo sapiens
gaagcaggaccgggacauu

SEQ ID NO: 1068894 - RNA, 19 nt, Homo sapiens
guaucuacuuccuuucuag

SEQ ID NO: 1068895 - RNA, 19 nt, Homo sapiens
caaaccgagauaugaauga

SEQ ID NO: 1068896 - RNA, 19 nt, Homo sapiens
guggcuacuuuguguuauu

SEQ ID NO: 1068897 - RNA, 19 nt, Homo sapiens
cauguccucucaccagaau

SEQ ID NO: 1068898 - RNA, 19 nt, Homo sapiens
ccaagagccggaagcagaa

SEQ ID NO: 1068899 - RNA, 19 nt, Homo sapiens
cuuaauuccuucccuaucu

SEQ ID NO: 1068900 - RNA, 19 nt, Homo sapiens
gaaggaggaggaggaggaa

SEQ ID NO: 1068901 - RNA, 19 nt, Homo sapiens
agaguaauagccuuaauuc

SEQ ID NO: 1068902 - RNA, 19 nt, Homo sapiens
ccagcaacccucacauuag

SEQ ID NO: 1068903 - RNA, 19 nt, Homo sapiens
uuccuucccuaucuccuua

SEQ ID NO: 1068904 - RNA, 19 nt, Homo sapiens
ucagaguaauagccuuaau

SEQ ID NO: 1068905 - RNA, 19 nt, Homo sapiens
cuucagaguaauagccuua

SEQ ID NO: 1068906 - RNA, 19 nt, Homo sapiens
uggaagaccuggacaaccu

SEQ ID NO: 1068907 - RNA, 19 nt, Homo sapiens
aaacucagcccaguagaca

SEQ ID NO: 1068908 - RNA, 19 nt, Homo sapiens
gaaacucagcccaguagac

SEQ ID NO: 1068909 - RNA, 19 nt, Homo sapiens
caggauccaccagaagaua

SEQ ID NO: 1068910 - RNA, 19 nt, Homo sapiens
gaauaugccccaccacgaa

SEQ ID NO: 1068911 - RNA, 19 nt, Homo sapiens
guacaagucacaucuuucc

SEQ ID NO: 1068912 - RNA, 19 nt, Homo sapiens
caccaugucucaggaaggu

SEQ ID NO: 1068913 - RNA, 19 nt, Homo sapiens
gaguuccacugcccgaagu

SEQ ID NO: 1068914 - RNA, 19 nt, Homo sapiens
gcuguggaccggcaguuug

SEQ ID NO: 1068915 - RNA, 19 nt, Homo sapiens
guccugaccuuuguucucu

SEQ ID NO: 1068916 - RNA, 19 nt, Homo sapiens
caacuuucuucagaguaau

SEQ ID NO: 1068917 - RNA, 19 nt, Homo sapiens
uguccucucaccagaauaa

SEQ ID NO: 1068918 - RNA, 19 nt, Homo sapiens
cggccuuccugagagaaua

SEQ ID NO: 1068919 - RNA, 19 nt, Homo sapiens
gaaccaccugcccaaagug

SEQ ID NO: 1068920 - RNA, 19 nt, Homo sapiens
ccugaccuuuguucucuug

SEQ ID NO: 1068921 - RNA, 19 nt, Homo sapiens
gauggccaagaacuaagua

SEQ ID NO: 1068922 - RNA, 19 nt, Homo sapiens
ccuaucuccuuaccaaagu

SEQ ID NO: 1068923 - RNA, 19 nt, Homo sapiens
uacaagcccugaucuucca

SEQ ID NO: 1068924 - RNA, 19 nt, Homo sapiens
ggauccaccagaagauaug

SEQ ID NO: 1068925 - RNA, 19 nt, Homo sapiens
ucaaaccgagauaugaaug

SEQ ID NO: 1068926 - RNA, 19 nt, Homo sapiens
agaacuaaguaacgaucug

SEQ ID NO: 1068927 - RNA, 19 nt, Homo sapiens
ugaacaggagucuugauuc

SEQ ID NO: 1068928 - RNA, 19 nt, Homo sapiens
acacagagucacagcuuca

SEQ ID NO: 1068929 - RNA, 19 nt, Homo sapiens
gguguggccagaacaacuu

SEQ ID NO: 1068930 - RNA, 19 nt, Homo sapiens
agugccagcugacaagaug

SEQ ID NO: 1068931 - RNA, 19 nt, Homo sapiens
aauacaagcccugaucuuc

SEQ ID NO: 1068932 - RNA, 19 nt, Homo sapiens
ccucacagugcaaggcuuu

SEQ ID NO: 1068933 - RNA, 19 nt, Homo sapiens
cuuccuuucuagaauaaga

SEQ ID NO: 1068934 - RNA, 19 nt, Homo sapiens
gucuaccguucauuccuuu

SEQ ID NO: 1068935 - RNA, 19 nt, Homo sapiens
gcugguacagggcacaguu

SEQ ID NO: 1068936 - RNA, 19 nt, Homo sapiens
uugaacaggagucuugauu

SEQ ID NO: 1068937 - RNA, 19 nt, Homo sapiens
agucuaccguucauuccuu

SEQ ID NO: 1068938 - RNA, 19 nt, Homo sapiens
ccaaaguacaagucacauc

SEQ ID NO: 1068939 - RNA, 19 nt, Homo sapiens
cuaucuccuuaccaaagua

SEQ ID NO: 1068940 - RNA, 19 nt, Homo sapiens
caccagaagauaugaagca

SEQ ID NO: 1068941 - RNA, 19 nt, Homo sapiens
aagaagguguggccagaac

SEQ ID NO: 1068942 - RNA, 19 nt, Homo sapiens
gucuguggcuacuuugugu

SEQ ID NO: 1068943 - RNA, 19 nt, Homo sapiens
ggucuguggcuacuuugug

SEQ ID NO: 1068944 - RNA, 19 nt, Homo sapiens
cuaggagucuaccguucau

SEQ ID NO: 1068945 - RNA, 19 nt, Homo sapiens
aguaauagccuuaauuccu

SEQ ID NO: 1068946 - RNA, 19 nt, Homo sapiens
aggguggccuccuggaaga

SEQ ID NO: 1068947 - RNA, 19 nt, Homo sapiens
cagaaccaccugcccaaag

SEQ ID NO: 1068948 - RNA, 19 nt, Homo sapiens
gaacauaaaugaucugaug

SEQ ID NO: 1068949 - RNA, 19 nt, Homo sapiens
ggagauaauuucugcauuu

SEQ ID NO: 1068950 - RNA, 19 nt, Homo sapiens
gaaaggauaucagagauug

SEQ ID NO: 1068951 - RNA, 19 nt, Homo sapiens
gaagguggguaauaacaaa

SEQ ID NO: 1068952 - RNA, 19 nt, Homo sapiens
gaaugaguuugacgaauuu

SEQ ID NO: 1068953 - RNA, 19 nt, Homo sapiens
guagauaaauccaugaaga

SEQ ID NO: 1068954 - RNA, 19 nt, Homo sapiens
aaagauggcugaauaggaa

SEQ ID NO: 1068955 - RNA, 19 nt, Homo sapiens
gaagaaaggauaucagaga

SEQ ID NO: 1068956 - RNA, 19 nt, Homo sapiens
guacccagcucaucucauu

SEQ ID NO: 1068957 - RNA, 19 nt, Homo sapiens
uaucagagauugaagauca

SEQ ID NO: 1068958 - RNA, 19 nt, Homo sapiens
gaccaaagguagauaaauc

SEQ ID NO: 1068959 - RNA, 19 nt, Homo sapiens
agaaugaguuugacgaauu

SEQ ID NO: 1068960 - RNA, 19 nt, Homo sapiens
cagcaaauuucaaacugua

SEQ ID NO: 1068961 - RNA, 19 nt, Homo sapiens
ggaauagcgucaacaucaa

SEQ ID NO: 1068962 - RNA, 19 nt, Homo sapiens
gcacagauacuaugcuuuc

SEQ ID NO: 1068963 - RNA, 19 nt, Homo sapiens
cuggaaagauggcugaaua

SEQ ID NO: 1068964 - RNA, 19 nt, Homo sapiens
gagcagggcaucucugaaa

SEQ ID NO: 1068965 - RNA, 19 nt, Homo sapiens
gagaagaacauaaaugauc

SEQ ID NO: 1068966 - RNA, 19 nt, Homo sapiens
gggcaucucugaaacaaag

SEQ ID NO: 1068967 - RNA, 19 nt, Homo sapiens
gaagaucaacuuaaugaca

SEQ ID NO: 1068968 - RNA, 19 nt, Homo sapiens
caaagcugcugggaaguuu

SEQ ID NO: 1068969 - RNA, 19 nt, Homo sapiens
gaaagauggcugaauagga

SEQ ID NO: 1068970 - RNA, 19 nt, Homo sapiens
gaauaaccacuuuagagaa

SEQ ID NO: 1068971 - RNA, 19 nt, Homo sapiens
gaaggucaccagcaucaaa

SEQ ID NO: 1068972 - RNA, 19 nt, Homo sapiens
gauaaauccaugaagauga

SEQ ID NO: 1068973 - RNA, 19 nt, Homo sapiens
gcagcaaauuucaaacugu

SEQ ID NO: 1068974 - RNA, 19 nt, Homo sapiens
gagauaauuucugcauuuc

SEQ ID NO: 1068975 - RNA, 19 nt, Homo sapiens
gcaacagucugggagcaaa

SEQ ID NO: 1068976 - RNA, 19 nt, Homo sapiens
ggauggagaaugaguuuga

SEQ ID NO: 1068977 - RNA, 19 nt, Homo sapiens
cuagauuccuccucucuga

SEQ ID NO: 1068978 - RNA, 19 nt, Homo sapiens
ugaggugucuggaaagaug

SEQ ID NO: 1068979 - RNA, 19 nt, Homo sapiens
gagaaugaguuugacgaau

SEQ ID NO: 1068980 - RNA, 19 nt, Homo sapiens
ggaaggaacaggcagcaau

SEQ ID NO: 1068981 - RNA, 19 nt, Homo sapiens
gaucaacgcagaaggagau

SEQ ID NO: 1068982 - RNA, 19 nt, Homo sapiens
ggaauugcuaacuagaaua

SEQ ID NO: 1068983 - RNA, 19 nt, Homo sapiens
gcuaaaggagcauguucua

SEQ ID NO: 1068984 - RNA, 19 nt, Homo sapiens
cugaaucgaucaagcagaa

SEQ ID NO: 1068985 - RNA, 19 nt, Homo sapiens
cgugaagcauacagaagua

SEQ ID NO: 1068986 - RNA, 19 nt, Homo sapiens
ggacucuggcagcaaauuu

SEQ ID NO: 1068987 - RNA, 19 nt, Homo sapiens
cauaaagugugacgucaag

SEQ ID NO: 1068988 - RNA, 19 nt, Homo sapiens
ucaagcagaagaaaggaua

SEQ ID NO: 1068989 - RNA, 19 nt, Homo sapiens
ugacgaauuuacagaagga

SEQ ID NO: 1068990 - RNA, 19 nt, Homo sapiens
agaauaaccacuuuagaga

SEQ ID NO: 1068991 - RNA, 19 nt, Homo sapiens
ggagaaugaguuugacgaa

SEQ ID NO: 1068992 - RNA, 19 nt, Homo sapiens
ccacagaaggcaagcagaa

SEQ ID NO: 1068993 - RNA, 19 nt, Homo sapiens
cagaagaaaggauaucaga

SEQ ID NO: 1068994 - RNA, 19 nt, Homo sapiens
caccagaaguucgggauug

SEQ ID NO: 1068995 - RNA, 19 nt, Homo sapiens
aaacacagcacgagaccuu

SEQ ID NO: 1068996 - RNA, 19 nt, Homo sapiens
uaaccacuuuagagaagaa

SEQ ID NO: 1068997 - RNA, 19 nt, Homo sapiens
aaaaggacauccacacaaa

SEQ ID NO: 1068998 - RNA, 19 nt, Homo sapiens
gaaggaacaggcagcaauc

SEQ ID NO: 1068999 - RNA, 19 nt, Homo sapiens
gggcauuccggcacagaua

SEQ ID NO: 1069000 - RNA, 19 nt, Homo sapiens
gauaauuucugcauuuccu

SEQ ID NO: 1069001 - RNA, 19 nt, Homo sapiens
gaggaauugcuaacuagaa

SEQ ID NO: 1069002 - RNA, 19 nt, Homo sapiens
caacgcagaaggagauaau

SEQ ID NO: 1069003 - RNA, 19 nt, Homo sapiens
gcaaauuucaaacuguaug

SEQ ID NO: 1069004 - RNA, 19 nt, Homo sapiens
aauaaccacuuuagagaag

SEQ ID NO: 1069005 - RNA, 19 nt, Homo sapiens
uaaaggagcauguucuaac

SEQ ID NO: 1069006 - RNA, 19 nt, Homo sapiens
uucagaagguggguaauaa

SEQ ID NO: 1069007 - RNA, 19 nt, Homo sapiens
gggccugacuguuauaagg

SEQ ID NO: 1069008 - RNA, 19 nt, Homo sapiens
aaucugugcuguucuguag

SEQ ID NO: 1069009 - RNA, 19 nt, Homo sapiens
cagacugccuccucaagug

SEQ ID NO: 1069010 - RNA, 19 nt, Homo sapiens
gcccuggguuucaagcaaa

SEQ ID NO: 1069011 - RNA, 19 nt, Homo sapiens
ggauaucagagauugaaga

SEQ ID NO: 1069012 - RNA, 19 nt, Homo sapiens
cuggaggaauugcuaacua

SEQ ID NO: 1069013 - RNA, 19 nt, Homo sapiens
aaaacuggauggagaauga

SEQ ID NO: 1069014 - RNA, 19 nt, Homo sapiens
cagcacagcagucugaugu

SEQ ID NO: 1069015 - RNA, 19 nt, Homo sapiens
uaaaguacccagcucaucu

SEQ ID NO: 1069016 - RNA, 19 nt, Homo sapiens
aagaaaggauaucagagau

SEQ ID NO: 1069017 - RNA, 19 nt, Homo sapiens
gcaucaaagaccaaaggua

SEQ ID NO: 1069018 - RNA, 19 nt, Homo sapiens
ggcagcaaauuucaaacug

SEQ ID NO: 1069019 - RNA, 19 nt, Homo sapiens
ccacggagcccaacaagcu

SEQ ID NO: 1069020 - RNA, 19 nt, Homo sapiens
gauaucagagauugaagau

SEQ ID NO: 1069021 - RNA, 19 nt, Homo sapiens
gaaucgaucaagcagaaga

SEQ ID NO: 1069022 - RNA, 19 nt, Homo sapiens
uagaauaaccacuuuagag

SEQ ID NO: 1069023 - RNA, 19 nt, Homo sapiens
gaucuggaggccauccuuu

SEQ ID NO: 1069024 - RNA, 19 nt, Homo sapiens
aggaauagcgucaacauca

SEQ ID NO: 1069025 - RNA, 19 nt, Homo sapiens
cggcacagauacuaugcuu

SEQ ID NO: 1069026 - RNA, 19 nt, Homo sapiens
aaacuccucugagcuaaag

SEQ ID NO: 1069027 - RNA, 19 nt, Homo sapiens
acaaacuccucugagcuaa

SEQ ID NO: 1069028 - RNA, 19 nt, Homo sapiens
aggaauugcuaacuagaau

SEQ ID NO: 1069029 - RNA, 19 nt, Homo sapiens
uaauaacaaacuccucuga

SEQ ID NO: 1069030 - RNA, 19 nt, Homo sapiens
aaagaccaaagguagauaa

SEQ ID NO: 1069031 - RNA, 19 nt, Homo sapiens
gggcgucugccauuacuga

SEQ ID NO: 1069032 - RNA, 19 nt, Homo sapiens
caaagaccaaagguagaua

SEQ ID NO: 1069033 - RNA, 19 nt, Homo sapiens
cagaggggccugacuguua

SEQ ID NO: 1069034 - RNA, 19 nt, Homo sapiens
cagggcaucucugaaacaa

SEQ ID NO: 1069035 - RNA, 19 nt, Homo sapiens
ccacuggguugaaauucuc

SEQ ID NO: 1069036 - RNA, 19 nt, Homo sapiens
cgagaucaacgcagaagga

SEQ ID NO: 1069037 - RNA, 19 nt, Homo sapiens
ggaggaauugcuaacuaga

SEQ ID NO: 1069038 - RNA, 19 nt, Homo sapiens
gagcauguucuaacccaau

SEQ ID NO: 1069039 - RNA, 19 nt, Homo sapiens
gagcuaaaggagcauguuc

SEQ ID NO: 1069040 - RNA, 19 nt, Homo sapiens
ggacagacugccuccucaa

SEQ ID NO: 1069041 - RNA, 19 nt, Homo sapiens
ggaggggcgucugccauua

SEQ ID NO: 1069042 - RNA, 19 nt, Homo sapiens
uuucugcauuuccuacuaa

SEQ ID NO: 1069043 - RNA, 19 nt, Homo sapiens
cauaauuguuccagaucug

SEQ ID NO: 1069044 - RNA, 19 nt, Homo sapiens
aaagugugacgucaagauu

SEQ ID NO: 1069045 - RNA, 19 nt, Homo sapiens
gaaaggaauagcgucaaca

SEQ ID NO: 1069046 - RNA, 19 nt, Homo sapiens
gcagaucucccagcacagu

SEQ ID NO: 1069047 - RNA, 19 nt, Homo sapiens
uggaggaauugcuaacuag

SEQ ID NO: 1069048 - RNA, 19 nt, Homo sapiens
gaucaucucuguaaacuuu

SEQ ID NO: 1069049 - RNA, 19 nt, Homo sapiens
caaaugaggugcugaauga

SEQ ID NO: 1069050 - RNA, 19 nt, Homo sapiens
gaaacaaguugagcaaauu

SEQ ID NO: 1069051 - RNA, 19 nt, Homo sapiens
guucggacaucaacaaaua

SEQ ID NO: 1069052 - RNA, 19 nt, Homo sapiens
gaagaaaguuccuuaugca

SEQ ID NO: 1069053 - RNA, 19 nt, Homo sapiens
ggaauggacucacuuucaa

SEQ ID NO: 1069054 - RNA, 19 nt, Homo sapiens
ggaaagaugaaucaaauga

SEQ ID NO: 1069055 - RNA, 19 nt, Homo sapiens
ugaaagacuugcacagaaa

SEQ ID NO: 1069056 - RNA, 19 nt, Homo sapiens
caccauggcuacagaaauu

SEQ ID NO: 1069057 - RNA, 19 nt, Homo sapiens
gcauggugcugaugugaaa

SEQ ID NO: 1069058 - RNA, 19 nt, Homo sapiens
gaaaugacaauuccagguu

SEQ ID NO: 1069059 - RNA, 19 nt, Homo sapiens
gggaauaccagaacaacua

SEQ ID NO: 1069060 - RNA, 19 nt, Homo sapiens
caaagagaccagagagaua

SEQ ID NO: 1069061 - RNA, 19 nt, Homo sapiens
aaaguaaaguguccuguau

SEQ ID NO: 1069062 - RNA, 19 nt, Homo sapiens
acgcuucgcuggccauuua

SEQ ID NO: 1069063 - RNA, 19 nt, Homo sapiens
gaaaguuccuuaugcaaaa

SEQ ID NO: 1069064 - RNA, 19 nt, Homo sapiens
ccacagagaugaaccuuuu

SEQ ID NO: 1069065 - RNA, 19 nt, Homo sapiens
ggacacggcccucaggaaa

SEQ ID NO: 1069066 - RNA, 19 nt, Homo sapiens
gcacauaaggaggcgauua

SEQ ID NO: 1069067 - RNA, 19 nt, Homo sapiens
aguaaaguguccuguauuu

SEQ ID NO: 1069068 - RNA, 19 nt, Homo sapiens
gaaaagcugugaaccgaaa

SEQ ID NO: 1069069 - RNA, 19 nt, Homo sapiens
gaaugugauuuacgcaaga

SEQ ID NO: 1069070 - RNA, 19 nt, Homo sapiens
gacaguauguaagaacuuu

SEQ ID NO: 1069071 - RNA, 19 nt, Homo sapiens
gaacagaauauggcaaaga

SEQ ID NO: 1069072 - RNA, 19 nt, Homo sapiens
caaugaacauggcucaaau

SEQ ID NO: 1069073 - RNA, 19 nt, Homo sapiens
aagcagaaauugagcaaga

SEQ ID NO: 1069074 - RNA, 19 nt, Homo sapiens
gacauuaaauuggaagaga

SEQ ID NO: 1069075 - RNA, 19 nt, Homo sapiens
ccuaauagccuggcaguaa

SEQ ID NO: 1069076 - RNA, 19 nt, Homo sapiens
caaaugaccauacuagcaa

SEQ ID NO: 1069077 - RNA, 19 nt, Homo sapiens
gagaacagaauauggcaaa

SEQ ID NO: 1069078 - RNA, 19 nt, Homo sapiens
agaaacaaguugagcaaau

SEQ ID NO: 1069079 - RNA, 19 nt, Homo sapiens
gauccaagguccugugucu

SEQ ID NO: 1069080 - RNA, 19 nt, Homo sapiens
ggacaucaacaaauaaagu

SEQ ID NO: 1069081 - RNA, 19 nt, Homo sapiens
ugaaugcaguaacaacaaa

SEQ ID NO: 1069082 - RNA, 19 nt, Homo sapiens
gcaaagagaccagagagau

SEQ ID NO: 1069083 - RNA, 19 nt, Homo sapiens
aaaggaagccugcaccauu

SEQ ID NO: 1069084 - RNA, 19 nt, Homo sapiens
gauggcggcugcuccuuug

SEQ ID NO: 1069085 - RNA, 19 nt, Homo sapiens
caacuucuggagcaacuua

SEQ ID NO: 1069086 - RNA, 19 nt, Homo sapiens
ggaauaccagaacaacuaa

SEQ ID NO: 1069087 - RNA, 19 nt, Homo sapiens
ccacggaggauaugugaaa

SEQ ID NO: 1069088 - RNA, 19 nt, Homo sapiens
uaaaguguccuguauuugu

SEQ ID NO: 1069089 - RNA, 19 nt, Homo sapiens
gguccaaugucucagauuc

SEQ ID NO: 1069090 - RNA, 19 nt, Homo sapiens
ugacggcacuguuagaauc

SEQ ID NO: 1069091 - RNA, 19 nt, Homo sapiens
uaaaguaaaguguccugua

SEQ ID NO: 1069092 - RNA, 19 nt, Homo sapiens
gaucuggucccaccuauag

SEQ ID NO: 1069093 - RNA, 19 nt, Homo sapiens
gagagcaccacgauggaua

SEQ ID NO: 1069094 - RNA, 19 nt, Homo sapiens
gaagauggaguagaauaug

SEQ ID NO: 1069095 - RNA, 19 nt, Homo sapiens
gugcugaugugaaaugugu

SEQ ID NO: 1069096 - RNA, 19 nt, Homo sapiens
gaugaccucgaaccuaaua

SEQ ID NO: 1069097 - RNA, 19 nt, Homo sapiens
gaacaugaacaacgucaag

SEQ ID NO: 1069098 - RNA, 19 nt, Homo sapiens
aaugacaauuccagguuua

SEQ ID NO: 1069099 - RNA, 19 nt, Homo sapiens
caacacuucaugcccauaa

SEQ ID NO: 1069100 - RNA, 19 nt, Homo sapiens
ccaaaggguuaguuguuuc

SEQ ID NO: 1069101 - RNA, 19 nt, Homo sapiens
aaaguguccuguauuuguu

SEQ ID NO: 1069102 - RNA, 19 nt, Homo sapiens
ugaauaauccuaugaaugc

SEQ ID NO: 1069103 - RNA, 19 nt, Homo sapiens
uuaaguuccuguccauuug

SEQ ID NO: 1069104 - RNA, 19 nt, Homo sapiens
gcccggagaugaacguuuc

SEQ ID NO: 1069105 - RNA, 19 nt, Homo sapiens
ggacaaaugggaccacaag

SEQ ID NO: 1069106 - RNA, 19 nt, Homo sapiens
agaagaaaguuccuuaugc

SEQ ID NO: 1069107 - RNA, 19 nt, Homo sapiens
aaaugacaauuccagguuu

SEQ ID NO: 1069108 - RNA, 19 nt, Homo sapiens
aaggaagccugcaccauug

SEQ ID NO: 1069109 - RNA, 19 nt, Homo sapiens
gcagaaauugagcaagaaa

SEQ ID NO: 1069110 - RNA, 19 nt, Homo sapiens
cuaauagccuggcaguaau

SEQ ID NO: 1069111 - RNA, 19 nt, Homo sapiens
caaugcaacagcuuacuuu

SEQ ID NO: 1069112 - RNA, 19 nt, Homo sapiens
ggccaggucaugaacauuu

SEQ ID NO: 1069113 - RNA, 19 nt, Homo sapiens
agaauaugaugaccucgaa

SEQ ID NO: 1069114 - RNA, 19 nt, Homo sapiens
uggaaugucugaagaugga

SEQ ID NO: 1069115 - RNA, 19 nt, Homo sapiens
agacauuucuggcucugaa

SEQ ID NO: 1069116 - RNA, 19 nt, Homo sapiens
gcucagagagugcccaaau

SEQ ID NO: 1069117 - RNA, 19 nt, Homo sapiens
uugaaagacuugcacagaa

SEQ ID NO: 1069118 - RNA, 19 nt, Homo sapiens
aaacacaagcagaaauuga

SEQ ID NO: 1069119 - RNA, 19 nt, Homo sapiens
ggagcgggauugagaggau

SEQ ID NO: 1069120 - RNA, 19 nt, Homo sapiens
gaaugggaauaccagaaca

SEQ ID NO: 1069121 - RNA, 19 nt, Homo sapiens
augaugaccucgaaccuaa

SEQ ID NO: 1069122 - RNA, 19 nt, Homo sapiens
aagauggaguagaauauga

SEQ ID NO: 1069123 - RNA, 19 nt, Homo sapiens
cuuccgaggucauaagaaa

SEQ ID NO: 1069124 - RNA, 19 nt, Homo sapiens
guagagggaguaacaugaa

SEQ ID NO: 1069125 - RNA, 19 nt, Homo sapiens
ccaaugaacauggcucaaa

SEQ ID NO: 1069126 - RNA, 19 nt, Homo sapiens
gcucaaagccagacguauc

SEQ ID NO: 1069127 - RNA, 19 nt, Homo sapiens
guuagaaucugggacuuuc

SEQ ID NO: 1069128 - RNA, 19 nt, Homo sapiens
gaguuuacccuguggaaug

SEQ ID NO: 1069129 - RNA, 19 nt, Homo sapiens
ccuauaggaauguugaaua

SEQ ID NO: 1069130 - RNA, 19 nt, Homo sapiens
ugaugcagguuauuacaau

SEQ ID NO: 1069131 - RNA, 19 nt, Homo sapiens
caauccaucuguaauuaag

SEQ ID NO: 1069132 - RNA, 19 nt, Homo sapiens
cagcagaccagaugacuuc

SEQ ID NO: 1069133 - RNA, 19 nt, Homo sapiens
aaaaguaccucagaagaaa

SEQ ID NO: 1069134 - RNA, 19 nt, Homo sapiens
ggggaaagaugaaucaaau

SEQ ID NO: 1069135 - RNA, 19 nt, Homo sapiens
cgaaaccgaccaggugaua

SEQ ID NO: 1069136 - RNA, 19 nt, Homo sapiens
agacuggcauccaaccaaa

SEQ ID NO: 1069137 - RNA, 19 nt, Homo sapiens
ggacucacuuucaauuuug

SEQ ID NO: 1069138 - RNA, 19 nt, Homo sapiens
gcaaugcaacagcuuacuu

SEQ ID NO: 1069139 - RNA, 19 nt, Homo sapiens
ucaaugagguuuucaagau

SEQ ID NO: 1069140 - RNA, 19 nt, Homo sapiens
cagcaggcuuggaugcaaa

SEQ ID NO: 1069141 - RNA, 19 nt, Homo sapiens
gucugaagauggaguagaa

SEQ ID NO: 1069142 - RNA, 19 nt, Homo sapiens
aaaccgaccaggugauaaa

SEQ ID NO: 1069143 - RNA, 19 nt, Homo sapiens
gcucaaaugaccauacuag

SEQ ID NO: 1069144 - RNA, 19 nt, Homo sapiens
gcagagucuugcaacacuu

SEQ ID NO: 1069145 - RNA, 19 nt, Homo sapiens
ggacucaccaagagaaaca

SEQ ID NO: 1069146 - RNA, 19 nt, Homo sapiens
ugaguacccugaggccuuu

SEQ ID NO: 1069147 - RNA, 19 nt, Homo sapiens
gguagagggaguaacauga

SEQ ID NO: 1069148 - RNA, 19 nt, Homo sapiens
gcacauggcuccuccuuaa

SEQ ID NO: 1069149 - RNA, 19 nt, Homo sapiens
gaagauaacuugucugcaa

SEQ ID NO: 1069150 - RNA, 19 nt, Homo sapiens
gaagguagaucagaagaua

SEQ ID NO: 1069151 - RNA, 19 nt, Homo sapiens
gauggaagaucucuccuua

SEQ ID NO: 1069152 - RNA, 19 nt, Homo sapiens
gcaaugaccucuucuugga

SEQ ID NO: 1069153 - RNA, 19 nt, Homo sapiens
ccaauagauuuccuacuua

SEQ ID NO: 1069154 - RNA, 19 nt, Homo sapiens
ggaaaguccuggugguuga

SEQ ID NO: 1069155 - RNA, 19 nt, Homo sapiens
gccaauagauuuccuacuu

SEQ ID NO: 1069156 - RNA, 19 nt, Homo sapiens
cccaagagcuguacaagaa

SEQ ID NO: 1069157 - RNA, 19 nt, Homo sapiens
ccaccggcauugaggauua

SEQ ID NO: 1069158 - RNA, 19 nt, Homo sapiens
gggcaaauauggaacuaug

SEQ ID NO: 1069159 - RNA, 19 nt, Homo sapiens
uggaagaucucuccuuaga

SEQ ID NO: 1069160 - RNA, 19 nt, Homo sapiens
ccacagcaaugaccucuuc

SEQ ID NO: 1069161 - RNA, 19 nt, Homo sapiens
gagcacuucuaauguauca

SEQ ID NO: 1069162 - RNA, 19 nt, Homo sapiens
gagaguaacugggcauaca

SEQ ID NO: 1069163 - RNA, 19 nt, Homo sapiens
ggagucauuguucuaauaa

SEQ ID NO: 1069164 - RNA, 19 nt, Homo sapiens
uggagucauuguucuaaua

SEQ ID NO: 1069165 - RNA, 19 nt, Homo sapiens
ggacaacugcagccugaaa

SEQ ID NO: 1069166 - RNA, 19 nt, Homo sapiens
gaacauggaacgggaggaa

SEQ ID NO: 1069167 - RNA, 19 nt, Homo sapiens
cuggagcacuucuaaugua

SEQ ID NO: 1069168 - RNA, 19 nt, Homo sapiens
ggcccuggaugacuaugua

SEQ ID NO: 1069169 - RNA, 19 nt, Homo sapiens
caagagcuguacaagaaca

SEQ ID NO: 1069170 - RNA, 19 nt, Homo sapiens
ugacacgcccuccaucuuu

SEQ ID NO: 1069171 - RNA, 19 nt, Homo sapiens
gggacacacuccauaaucu

SEQ ID NO: 1069172 - RNA, 19 nt, Homo sapiens
gcagagcuccuggcuguga

SEQ ID NO: 1069173 - RNA, 19 nt, Homo sapiens
acaaggcgcuccucagagu

SEQ ID NO: 1069174 - RNA, 19 nt, Homo sapiens
caacaacugcuucaggaau

SEQ ID NO: 1069175 - RNA, 19 nt, Homo sapiens
ugagggagaacgagaguaa

SEQ ID NO: 1069176 - RNA, 19 nt, Homo sapiens
gacacgcccuccaucuuug

SEQ ID NO: 1069177 - RNA, 19 nt, Homo sapiens
ccacuucaccuuccugaga

SEQ ID NO: 1069178 - RNA, 19 nt, Homo sapiens
ucuucuaccugcauucuaa

SEQ ID NO: 1069179 - RNA, 19 nt, Homo sapiens
ccucagagcagcacagaga

SEQ ID NO: 1069180 - RNA, 19 nt, Homo sapiens
gaucagaagauaacuuguc

SEQ ID NO: 1069181 - RNA, 19 nt, Homo sapiens
ggaacuauggcugaaggua

SEQ ID NO: 1069182 - RNA, 19 nt, Homo sapiens
guaccaggccaaaguggaa

SEQ ID NO: 1069183 - RNA, 19 nt, Homo sapiens
cagcaaugaccucuucuug

SEQ ID NO: 1069184 - RNA, 19 nt, Homo sapiens
ggaugacuauguagcaaac

SEQ ID NO: 1069185 - RNA, 19 nt, Homo sapiens
agcaagagcugagggagaa

SEQ ID NO: 1069186 - RNA, 19 nt, Homo sapiens
aaucaccaauucagacuca

SEQ ID NO: 1069187 - RNA, 19 nt, Homo sapiens
uagaucagaagauaacuug

SEQ ID NO: 1069188 - RNA, 19 nt, Homo sapiens
cgcauuuccaguuguauua

SEQ ID NO: 1069189 - RNA, 19 nt, Homo sapiens
uuagauagaaccugucuuc

SEQ ID NO: 1069190 - RNA, 19 nt, Homo sapiens
gacccuggagcacuucuaa

SEQ ID NO: 1069191 - RNA, 19 nt, Homo sapiens
ccucagagucaaacacuug

SEQ ID NO: 1069192 - RNA, 19 nt, Homo sapiens
uggagaagcacaagcaaga

SEQ ID NO: 1069193 - RNA, 19 nt, Homo sapiens
gacauguggucauccucuu

SEQ ID NO: 1069194 - RNA, 19 nt, Homo sapiens
ggccagagccucagugacu

SEQ ID NO: 1069195 - RNA, 19 nt, Homo sapiens
gcccagcugcuccaaagaa

SEQ ID NO: 1069196 - RNA, 19 nt, Homo sapiens
ggucucuucuaccugcauu

SEQ ID NO: 1069197 - RNA, 19 nt, Homo sapiens
aacaacugcuucaggaaug

SEQ ID NO: 1069198 - RNA, 19 nt, Homo sapiens
guacugugccuucaacaac

SEQ ID NO: 1069199 - RNA, 19 nt, Homo sapiens
gcugccaaccugagauuga

SEQ ID NO: 1069200 - RNA, 19 nt, Homo sapiens
aaacacuauuccacucugu

SEQ ID NO: 1069201 - RNA, 19 nt, Homo sapiens
uggagcacuucuaauguau

SEQ ID NO: 1069202 - RNA, 19 nt, Homo sapiens
auacaaggcgcuccucaga

SEQ ID NO: 1069203 - RNA, 19 nt, Homo sapiens
gcugagucauggagcuuuc

SEQ ID NO: 1069204 - RNA, 19 nt, Homo sapiens
uagcaaacacggacaacug

SEQ ID NO: 1069205 - RNA, 19 nt, Homo sapiens
caacaccaccggcauugag

SEQ ID NO: 1069206 - RNA, 19 nt, Homo sapiens
ggaggacagggcacaacaa

SEQ ID NO: 1069207 - RNA, 19 nt, Homo sapiens
gagcuccgggucucuucua

SEQ ID NO: 1069208 - RNA, 19 nt, Homo sapiens
gcaguaccaggccaaagug

SEQ ID NO: 1069209 - RNA, 19 nt, Homo sapiens
ggacacacuccauaaucuc

SEQ ID NO: 1069210 - RNA, 19 nt, Homo sapiens
caaaacaggcugcgggaaa

SEQ ID NO: 1069211 - RNA, 19 nt, Homo sapiens
guagaucagaagauaacuu

SEQ ID NO: 1069212 - RNA, 19 nt, Homo sapiens
aacuauggcugaagguaga

SEQ ID NO: 1069213 - RNA, 19 nt, Homo sapiens
uggaauggcagguggagaa

SEQ ID NO: 1069214 - RNA, 19 nt, Homo sapiens
gcaacaccaccggcauuga

SEQ ID NO: 1069215 - RNA, 19 nt, Homo sapiens
ggauggaagaucucuccuu

SEQ ID NO: 1069216 - RNA, 19 nt, Homo sapiens
cauggagucauuguucuaa

SEQ ID NO: 1069217 - RNA, 19 nt, Homo sapiens
acacaguggccaucaggaa

SEQ ID NO: 1069218 - RNA, 19 nt, Homo sapiens
ggcaguaccaggccaaagu

SEQ ID NO: 1069219 - RNA, 19 nt, Homo sapiens
gcuccuggcugugauugag

SEQ ID NO: 1069220 - RNA, 19 nt, Homo sapiens
guaaacacuauuccacucu

SEQ ID NO: 1069221 - RNA, 19 nt, Homo sapiens
acuccauaaucucuacuuu

SEQ ID NO: 1069222 - RNA, 19 nt, Homo sapiens
ccauggagucauuguucua

SEQ ID NO: 1069223 - RNA, 19 nt, Homo sapiens
uaucuccgcauuuccaguu

SEQ ID NO: 1069224 - RNA, 19 nt, Homo sapiens
cugccaaccugagauugaa

SEQ ID NO: 1069225 - RNA, 19 nt, Homo sapiens
gguacugugccuucaacaa

SEQ ID NO: 1069226 - RNA, 19 nt, Homo sapiens
aaaacaggcugcgggaaaa

SEQ ID NO: 1069227 - RNA, 19 nt, Homo sapiens
cuaauaaucaccaauucag

SEQ ID NO: 1069228 - RNA, 19 nt, Homo sapiens
aauggcagguggagaagca

SEQ ID NO: 1069229 - RNA, 19 nt, Homo sapiens
gugcgggagugugagagaa

SEQ ID NO: 1069230 - RNA, 19 nt, Homo sapiens
ggacaggggccaugagaca

SEQ ID NO: 1069231 - RNA, 19 nt, Homo sapiens
cagagcagcacagagaguu

SEQ ID NO: 1069232 - RNA, 19 nt, Homo sapiens
ccaacaacugcuucaggaa

SEQ ID NO: 1069233 - RNA, 19 nt, Homo sapiens
ucuggacccuggagcacuu

SEQ ID NO: 1069234 - RNA, 19 nt, Homo sapiens
gggacucucagcagcuuug

SEQ ID NO: 1069235 - RNA, 19 nt, Homo sapiens
gaggacagggcacaacaac

SEQ ID NO: 1069236 - RNA, 19 nt, Homo sapiens
cuguucaucuuucauuaca

SEQ ID NO: 1069237 - RNA, 19 nt, Homo sapiens
gcuuuugcauuaugagauu

SEQ ID NO: 1069238 - RNA, 19 nt, Homo sapiens
uccauaaucucuacuuuuc

SEQ ID NO: 1069239 - RNA, 19 nt, Homo sapiens
ggacugcuaccugcucucu

SEQ ID NO: 1069240 - RNA, 19 nt, Homo sapiens
gaacagagcucccuugaug

SEQ ID NO: 1069241 - RNA, 19 nt, Homo sapiens
gaagagauccuguaacuuu

SEQ ID NO: 1069242 - RNA, 19 nt, Homo sapiens
gaacuggacuacugucuuu

SEQ ID NO: 1069243 - RNA, 19 nt, Homo sapiens
gaggagagccagagaauua

SEQ ID NO: 1069244 - RNA, 19 nt, Homo sapiens
ggacgaaggugaaagagaa

SEQ ID NO: 1069245 - RNA, 19 nt, Homo sapiens
gaacagaagcugauauuga

SEQ ID NO: 1069246 - RNA, 19 nt, Homo sapiens
gaagcuaccuauggcauua

SEQ ID NO: 1069247 - RNA, 19 nt, Homo sapiens
gguaagaguucaacaauca

SEQ ID NO: 1069248 - RNA, 19 nt, Homo sapiens
aaacagagaugauagacaa

SEQ ID NO: 1069249 - RNA, 19 nt, Homo sapiens
gauauugacuccauuugaa

SEQ ID NO: 1069250 - RNA, 19 nt, Homo sapiens
gcacacaagugaacucaau

SEQ ID NO: 1069251 - RNA, 19 nt, Homo sapiens
uuaagaagcuccaugaaga

SEQ ID NO: 1069252 - RNA, 19 nt, Homo sapiens
aaacauggcaacagaaaua

SEQ ID NO: 1069253 - RNA, 19 nt, Homo sapiens
gugaggauuuggaauguua

SEQ ID NO: 1069254 - RNA, 19 nt, Homo sapiens
aagcaaaucuccauauaga

SEQ ID NO: 1069255 - RNA, 19 nt, Homo sapiens
cagggaagcugcgguauuu

SEQ ID NO: 1069256 - RNA, 19 nt, Homo sapiens
ggaaagcucuacugcagau

SEQ ID NO: 1069257 - RNA, 19 nt, Homo sapiens
ggacuuggguucaguuagu

SEQ ID NO: 1069258 - RNA, 19 nt, Homo sapiens
gauaguagaugcucgaaac

SEQ ID NO: 1069259 - RNA, 19 nt, Homo sapiens
gaauuaagaagcuccauga

SEQ ID NO: 1069260 - RNA, 19 nt, Homo sapiens
gcuuaagaccauugaauua

SEQ ID NO: 1069261 - RNA, 19 nt, Homo sapiens
ucacuaguuugccagaaua

SEQ ID NO: 1069262 - RNA, 19 nt, Homo sapiens
aaacaguucuuguguauac

SEQ ID NO: 1069263 - RNA, 19 nt, Homo sapiens
gagacugcaucacaagaaa

SEQ ID NO: 1069264 - RNA, 19 nt, Homo sapiens
ccaagacacuagcacugua

SEQ ID NO: 1069265 - RNA, 19 nt, Homo sapiens
ggaauguuaugugaaagaa

SEQ ID NO: 1069266 - RNA, 19 nt, Homo sapiens
gauuuggaauguuauguga

SEQ ID NO: 1069267 - RNA, 19 nt, Homo sapiens
ucacacaacucugaauaug

SEQ ID NO: 1069268 - RNA, 19 nt, Homo sapiens
agaggcagauacacaauuu

SEQ ID NO: 1069269 - RNA, 19 nt, Homo sapiens
ugagagaagugauauugug

SEQ ID NO: 1069270 - RNA, 19 nt, Homo sapiens
agaccaaacuggaaccaaa

SEQ ID NO: 1069271 - RNA, 19 nt, Homo sapiens
ugaaagcacuauugaugug

SEQ ID NO: 1069272 - RNA, 19 nt, Homo sapiens
ggugaaagaugggcaacuu

SEQ ID NO: 1069273 - RNA, 19 nt, Homo sapiens
ugaacgaaauuuggacuuu

SEQ ID NO: 1069274 - RNA, 19 nt, Homo sapiens
gcggaauccucccaauuga

SEQ ID NO: 1069275 - RNA, 19 nt, Homo sapiens
aagaagaugugaagguuau

SEQ ID NO: 1069276 - RNA, 19 nt, Homo sapiens
guugacagcuuauggauac

SEQ ID NO: 1069277 - RNA, 19 nt, Homo sapiens
gaagaugugaagguuauuu

SEQ ID NO: 1069278 - RNA, 19 nt, Homo sapiens
agaaauggaugccaauaag

SEQ ID NO: 1069279 - RNA, 19 nt, Homo sapiens
caugaaagcacuauugaug

SEQ ID NO: 1069280 - RNA, 19 nt, Homo sapiens
gugguaagcugcuguacug

SEQ ID NO: 1069281 - RNA, 19 nt, Homo sapiens
gaauuacacacuuuacguu

SEQ ID NO: 1069282 - RNA, 19 nt, Homo sapiens
ggucacacaacucugaaua

SEQ ID NO: 1069283 - RNA, 19 nt, Homo sapiens
ggaggaaugggaagauuga

SEQ ID NO: 1069284 - RNA, 19 nt, Homo sapiens
ccacaacggaugaagauga

SEQ ID NO: 1069285 - RNA, 19 nt, Homo sapiens
gcagcuaggcagaaauaaa

SEQ ID NO: 1069286 - RNA, 19 nt, Homo sapiens
guuggugaauuguauggua

SEQ ID NO: 1069287 - RNA, 19 nt, Homo sapiens
ccauugaauuacacacuuu

SEQ ID NO: 1069288 - RNA, 19 nt, Homo sapiens
gaauaagcaaaucuccaua

SEQ ID NO: 1069289 - RNA, 19 nt, Homo sapiens
gaaauuucccacagugaau

SEQ ID NO: 1069290 - RNA, 19 nt, Homo sapiens
gaacgaaauuuggacuuuu

SEQ ID NO: 1069291 - RNA, 19 nt, Homo sapiens
gaagccaucgucacacuga

SEQ ID NO: 1069292 - RNA, 19 nt, Homo sapiens
agaagacggucccaaggaa

SEQ ID NO: 1069293 - RNA, 19 nt, Homo sapiens
gugcuguucuccugauauu

SEQ ID NO: 1069294 - RNA, 19 nt, Homo sapiens
ugaauaugcuuaagaccau

SEQ ID NO: 1069295 - RNA, 19 nt, Homo sapiens
gaugauagacaaagcaaca

SEQ ID NO: 1069296 - RNA, 19 nt, Homo sapiens
gaaagaaauggaugccaau

SEQ ID NO: 1069297 - RNA, 19 nt, Homo sapiens
ggagagucauugagagaag

SEQ ID NO: 1069298 - RNA, 19 nt, Homo sapiens
uggaagagauccuguaacu

SEQ ID NO: 1069299 - RNA, 19 nt, Homo sapiens
gccagaauauuccaagaca

SEQ ID NO: 1069300 - RNA, 19 nt, Homo sapiens
aaacaagcagagaaagaua

SEQ ID NO: 1069301 - RNA, 19 nt, Homo sapiens
gcuguucuccugauauuga

SEQ ID NO: 1069302 - RNA, 19 nt, Homo sapiens
caccgagucucauguugaa

SEQ ID NO: 1069303 - RNA, 19 nt, Homo sapiens
uuacguuggugaauuguau

SEQ ID NO: 1069304 - RNA, 19 nt, Homo sapiens
gaagcugcgguauuuacua

SEQ ID NO: 1069305 - RNA, 19 nt, Homo sapiens
acaagcaccuggauaugug

SEQ ID NO: 1069306 - RNA, 19 nt, Homo sapiens
gaucauguuccuccuguau

SEQ ID NO: 1069307 - RNA, 19 nt, Homo sapiens
gaugugaggauuuggaaug

SEQ ID NO: 1069308 - RNA, 19 nt, Homo sapiens
gcaggagaaucacuugaac

SEQ ID NO: 1069309 - RNA, 19 nt, Homo sapiens
caauugaucagaugagaga

SEQ ID NO: 1069310 - RNA, 19 nt, Homo sapiens
ggaauccucccaauugauc

SEQ ID NO: 1069311 - RNA, 19 nt, Homo sapiens
gcagacgugcucagaagaa

SEQ ID NO: 1069312 - RNA, 19 nt, Homo sapiens
gaauaugcuuaagaccauu

SEQ ID NO: 1069313 - RNA, 19 nt, Homo sapiens
uagaggaaguagauuagug

SEQ ID NO: 1069314 - RNA, 19 nt, Homo sapiens
gcaacaagaaaguaucugu

SEQ ID NO: 1069315 - RNA, 19 nt, Homo sapiens
uacuggagcucuuuaagga

SEQ ID NO: 1069316 - RNA, 19 nt, Homo sapiens
cuugaugacuuccuugcua

SEQ ID NO: 1069317 - RNA, 19 nt, Homo sapiens
agucucauguugaaaugua

SEQ ID NO: 1069318 - RNA, 19 nt, Homo sapiens
gauggucacacaacucuga

SEQ ID NO: 1069319 - RNA, 19 nt, Homo sapiens
cuaaggaacauguagaaug

SEQ ID NO: 1069320 - RNA, 19 nt, Homo sapiens
ggcuagaacuggacuacug

SEQ ID NO: 1069321 - RNA, 19 nt, Homo sapiens
gaaccagggaggcagaguu

SEQ ID NO: 1069322 - RNA, 19 nt, Homo sapiens
ccaacagucuccaugucaa

SEQ ID NO: 1069323 - RNA, 19 nt, Homo sapiens
ccuccuguaucacuaguuu

SEQ ID NO: 1069324 - RNA, 19 nt, Homo sapiens
caucaugggcaacaagaaa

SEQ ID NO: 1069325 - RNA, 19 nt, Homo sapiens
gaagaugacagugaguaug

SEQ ID NO: 1069326 - RNA, 19 nt, Homo sapiens
caaacaagcagagaaagau

SEQ ID NO: 1069327 - RNA, 19 nt, Homo sapiens
gaaaccccgucucuacuaa

SEQ ID NO: 1069328 - RNA, 19 nt, Homo sapiens
ggaagaggcaaacagagau

SEQ ID NO: 1069329 - RNA, 19 nt, Homo sapiens
acacaacucugaauaugcu

SEQ ID NO: 1069330 - RNA, 19 nt, Homo sapiens
ucacugguuauuccacuua

SEQ ID NO: 1069331 - RNA, 19 nt, Homo sapiens
gaacuugcaggaacagagu

SEQ ID NO: 1069332 - RNA, 19 nt, Homo sapiens
cagaauauuccaagacaug

SEQ ID NO: 1069333 - RNA, 19 nt, Homo sapiens
gacaaagcaacacaacuga

SEQ ID NO: 1069334 - RNA, 19 nt, Homo sapiens
gaggcaaacagagaugaua

SEQ ID NO: 1069335 - RNA, 19 nt, Homo sapiens
aaagaagaugugaagguua

SEQ ID NO: 1069336 - RNA, 19 nt, Homo sapiens
gaacgucauucugaucaac

SEQ ID NO: 1069337 - RNA, 19 nt, Homo sapiens
ugaacucaaugauggcuau

SEQ ID NO: 1069338 - RNA, 19 nt, Homo sapiens
uaagaagcuccaugaagaa

SEQ ID NO: 1069339 - RNA, 19 nt, Homo sapiens
cuccugcucuggccauaua

SEQ ID NO: 1069340 - RNA, 19 nt, Homo sapiens
gaagaggucucaaguauga

SEQ ID NO: 1069341 - RNA, 19 nt, Homo sapiens
gaacaagccuucagacauu

SEQ ID NO: 1069342 - RNA, 19 nt, Homo sapiens
uaagagacguaucagauua

SEQ ID NO: 1069343 - RNA, 19 nt, Homo sapiens
gaaagauccuccggacuua

SEQ ID NO: 1069344 - RNA, 19 nt, Homo sapiens
gaacaacaauacaguacaa

SEQ ID NO: 1069345 - RNA, 19 nt, Homo sapiens
gaagaugaaacgaaacuua

SEQ ID NO: 1069346 - RNA, 19 nt, Homo sapiens
ggccugggcuucaguauaa

SEQ ID NO: 1069347 - RNA, 19 nt, Homo sapiens
guaaaugaggcaucuauua

SEQ ID NO: 1069348 - RNA, 19 nt, Homo sapiens
gcaaagggcguugugaaua

SEQ ID NO: 1069349 - RNA, 19 nt, Homo sapiens
agaaguagauggacagaaa

SEQ ID NO: 1069350 - RNA, 19 nt, Homo sapiens
gacagaagcuaauuccuau

SEQ ID NO: 1069351 - RNA, 19 nt, Homo sapiens
agacagaagugaagaaaga

SEQ ID NO: 1069352 - RNA, 19 nt, Homo sapiens
auacuuaccucaccucuaa

SEQ ID NO: 1069353 - RNA, 19 nt, Homo sapiens
acaagaagaugaaacgaaa

SEQ ID NO: 1069354 - RNA, 19 nt, Homo sapiens
gaagcuaauuccuauugaa

SEQ ID NO: 1069355 - RNA, 19 nt, Homo sapiens
caauagaccuuaugaaugc

SEQ ID NO: 1069356 - RNA, 19 nt, Homo sapiens
ggaaaauucuggauaguaa

SEQ ID NO: 1069357 - RNA, 19 nt, Homo sapiens
gaacacauacuugaucaaa

SEQ ID NO: 1069358 - RNA, 19 nt, Homo sapiens
gaaacgaaacuuaaggaaa

SEQ ID NO: 1069359 - RNA, 19 nt, Homo sapiens
aagaagaggucucaaguau

SEQ ID NO: 1069360 - RNA, 19 nt, Homo sapiens
gcaauagaccuuaugaaug

SEQ ID NO: 1069361 - RNA, 19 nt, Homo sapiens
gaaaggauggccacuagaa

SEQ ID NO: 1069362 - RNA, 19 nt, Homo sapiens
gaagaaggauggagaaaau

SEQ ID NO: 1069363 - RNA, 19 nt, Homo sapiens
gaaacucacagaagagaaa

SEQ ID NO: 1069364 - RNA, 19 nt, Homo sapiens
cacuagaacuuauauguga

SEQ ID NO: 1069365 - RNA, 19 nt, Homo sapiens
gaacaucuuuccuacuuuu

SEQ ID NO: 1069366 - RNA, 19 nt, Homo sapiens
gcaauaauacuggaaauuc

SEQ ID NO: 1069367 - RNA, 19 nt, Homo sapiens
guaaagcaauagaccuuau

SEQ ID NO: 1069368 - RNA, 19 nt, Homo sapiens
agagaaauaucaaguggaa

SEQ ID NO: 1069369 - RNA, 19 nt, Homo sapiens
ccaaugcggcaaauaauaa

SEQ ID NO: 1069370 - RNA, 19 nt, Homo sapiens
gaaacagugucuucaaacu

SEQ ID NO: 1069371 - RNA, 19 nt, Homo sapiens
ggauuggccugguugcaaa

SEQ ID NO: 1069372 - RNA, 19 nt, Homo sapiens
uuaaacaugucucagauug

SEQ ID NO: 1069373 - RNA, 19 nt, Homo sapiens
ucagacauuugcuauauug

SEQ ID NO: 1069374 - RNA, 19 nt, Homo sapiens
gaucacaaauaaacugcuu

SEQ ID NO: 1069375 - RNA, 19 nt, Homo sapiens
caaagggcguugugaauac

SEQ ID NO: 1069376 - RNA, 19 nt, Homo sapiens
aguauaagcuccuaucuca

SEQ ID NO: 1069377 - RNA, 19 nt, Homo sapiens
ggaacaauguguaaaugag

SEQ ID NO: 1069378 - RNA, 19 nt, Homo sapiens
gcuaauuccuauugaacaa

SEQ ID NO: 1069379 - RNA, 19 nt, Homo sapiens
caaacacugaucacaaaua

SEQ ID NO: 1069380 - RNA, 19 nt, Homo sapiens
ugacagaagcuaauuccua

SEQ ID NO: 1069381 - RNA, 19 nt, Homo sapiens
gcagauauugaauguauga

SEQ ID NO: 1069382 - RNA, 19 nt, Homo sapiens
ucuagcaguucaaaguuua

SEQ ID NO: 1069383 - RNA, 19 nt, Homo sapiens
gcaaaugacagaagcuaau

SEQ ID NO: 1069384 - RNA, 19 nt, Homo sapiens
ggcaagggcaaauggauua

SEQ ID NO: 1069385 - RNA, 19 nt, Homo sapiens
ggaggaacuugaagcuguu

SEQ ID NO: 1069386 - RNA, 19 nt, Homo sapiens
cagagacccuguuaaauac

SEQ ID NO: 1069387 - RNA, 19 nt, Homo sapiens
gaggagguauuguuacaca

SEQ ID NO: 1069388 - RNA, 19 nt, Homo sapiens
agacguaucagauuaugua

SEQ ID NO: 1069389 - RNA, 19 nt, Homo sapiens
caaauaagaaaguggcaaa

SEQ ID NO: 1069390 - RNA, 19 nt, Homo sapiens
uaauggagcucaaugaaaa

SEQ ID NO: 1069391 - RNA, 19 nt, Homo sapiens
gcacuaaugaggcuaaauc

SEQ ID NO: 1069392 - RNA, 19 nt, Homo sapiens
uaaagaggccauuugaaga

SEQ ID NO: 1069393 - RNA, 19 nt, Homo sapiens
gacgaguaauggaguguuu

SEQ ID NO: 1069394 - RNA, 19 nt, Homo sapiens
guaauggagcucaaugaaa

SEQ ID NO: 1069395 - RNA, 19 nt, Homo sapiens
gcaaugggauauccaacag

SEQ ID NO: 1069396 - RNA, 19 nt, Homo sapiens
acaaagugcuggagaugga

SEQ ID NO: 1069397 - RNA, 19 nt, Homo sapiens
ucacagaagagaaauauca

SEQ ID NO: 1069398 - RNA, 19 nt, Homo sapiens
gacccaaugcggcaaauaa

SEQ ID NO: 1069399 - RNA, 19 nt, Homo sapiens
cuaaugaggcuaaaucaga

SEQ ID NO: 1069400 - RNA, 19 nt, Homo sapiens
aaguauuccuggucaguua

SEQ ID NO: 1069401 - RNA, 19 nt, Homo sapiens
guaauuguccuccgcauuc

SEQ ID NO: 1069402 - RNA, 19 nt, Homo sapiens
ugaaagauccuccggacuu

SEQ ID NO: 1069403 - RNA, 19 nt, Homo sapiens
gcaaagacaaacccacaga

SEQ ID NO: 1069404 - RNA, 19 nt, Homo sapiens
caaaaggcuugcugauuaa

SEQ ID NO: 1069405 - RNA, 19 nt, Homo sapiens
aaacagagggugagacaga

SEQ ID NO: 1069406 - RNA, 19 nt, Homo sapiens
uaccagcccuucuguucua

SEQ ID NO: 1069407 - RNA, 19 nt, Homo sapiens
gggacgaauuggagaagaa

SEQ ID NO: 1069408 - RNA, 19 nt, Homo sapiens
gauaaucuuccuauucaga

SEQ ID NO: 1069409 - RNA, 19 nt, Homo sapiens
gguaucuacuguugaaugu

SEQ ID NO: 1069410 - RNA, 19 nt, Homo sapiens
uaugguaucuacuguugaa

SEQ ID NO: 1069411 - RNA, 19 nt, Homo sapiens
gcaguucaaaguuuaaguu

SEQ ID NO: 1069412 - RNA, 19 nt, Homo sapiens
gcgcagguccaaauaagaa

SEQ ID NO: 1069413 - RNA, 19 nt, Homo sapiens
ugaaaccuccaguaccuua

SEQ ID NO: 1069414 - RNA, 19 nt, Homo sapiens
ucuucaaacucaagcaaua

SEQ ID NO: 1069415 - RNA, 19 nt, Homo sapiens
aauuugggcuguaguuauu

SEQ ID NO: 1069416 - RNA, 19 nt, Homo sapiens
ccagggcacuuuaauuugg

SEQ ID NO: 1069417 - RNA, 19 nt, Homo sapiens
cucaaacacugaucacaaa

SEQ ID NO: 1069418 - RNA, 19 nt, Homo sapiens
aauaugguaucuacuguug

SEQ ID NO: 1069419 - RNA, 19 nt, Homo sapiens
cuucagacauuugcuauau

SEQ ID NO: 1069420 - RNA, 19 nt, Homo sapiens
ggagguagaaguagaugga

SEQ ID NO: 1069421 - RNA, 19 nt, Homo sapiens
uaauggagguagaaguaga

SEQ ID NO: 1069422 - RNA, 19 nt, Homo sapiens
uaaugaggcuaaaucagau

SEQ ID NO: 1069423 - RNA, 19 nt, Homo sapiens
aaagaagaggucucaagua

SEQ ID NO: 1069424 - RNA, 19 nt, Homo sapiens
gagcgagacccaacagaug

SEQ ID NO: 1069425 - RNA, 19 nt, Homo sapiens
caaguggaacaauguguaa

SEQ ID NO: 1069426 - RNA, 19 nt, Homo sapiens
aaagguguguuccagagaa

SEQ ID NO: 1069427 - RNA, 19 nt, Homo sapiens
gaaagaugaggccggagaa

SEQ ID NO: 1069428 - RNA, 19 nt, Homo sapiens
ggaaauucuacaacugaaa

SEQ ID NO: 1069429 - RNA, 19 nt, Homo sapiens
cuaaagaggccauuugaag

SEQ ID NO: 1069430 - RNA, 19 nt, Homo sapiens
uaaagaugauauggacuug

SEQ ID NO: 1069431 - RNA, 19 nt, Homo sapiens
ugaaaacgguaccucauuu

SEQ ID NO: 1069432 - RNA, 19 nt, Homo sapiens
cagaagcuaauuccuauug

SEQ ID NO: 1069433 - RNA, 19 nt, Homo sapiens
ggagaagaaggauggagaa

SEQ ID NO: 1069434 - RNA, 19 nt, Homo sapiens
ucagauugguuggaugaaa

SEQ ID NO: 1069435 - RNA, 19 nt, Homo sapiens
aaacaugucucagauuggu

SEQ ID NO: 1069436 - RNA, 19 nt, Homo sapiens
caaaugacagaagcuaauu

SEQ ID NO: 1069437 - RNA, 19 nt, Homo sapiens
guagauggacagaaauuca

SEQ ID NO: 1069438 - RNA, 19 nt, Homo sapiens
uguaauggagguagaagua

SEQ ID NO: 1069439 - RNA, 19 nt, Homo sapiens
ggauggccacuagaacuua

SEQ ID NO: 1069440 - RNA, 19 nt, Homo sapiens
gaaccaguguuuacaagua

SEQ ID NO: 1069441 - RNA, 19 nt, Homo sapiens
gaaccaguguuuacaagua

SEQ ID NO: 1069442 - RNA, 19 nt, Homo sapiens
gaaccaugcuucucuuaga

SEQ ID NO: 1069443 - RNA, 19 nt, Homo sapiens
gguaagacaccaaccuuua

SEQ ID NO: 1069444 - RNA, 19 nt, Homo sapiens
gagcaaggguccagacuag

SEQ ID NO: 1069445 - RNA, 19 nt, Homo sapiens
ccacaaaggcuucacugua

SEQ ID NO: 1069446 - RNA, 19 nt, Homo sapiens
ggugagaauuccaauguga

SEQ ID NO: 1069447 - RNA, 19 nt, Homo sapiens
agaaagugcucaccaucua

SEQ ID NO: 1069448 - RNA, 19 nt, Homo sapiens
ugacaggacugcagaucaa

SEQ ID NO: 1069449 - RNA, 19 nt, Homo sapiens
ggacugggugcuacuuaua

SEQ ID NO: 1069450 - RNA, 19 nt, Homo sapiens
gagaaggaaccaguguuua

SEQ ID NO: 1069451 - RNA, 19 nt, Homo sapiens
agaauacggugguugagaa

SEQ ID NO: 1069452 - RNA, 19 nt, Homo sapiens
ggcaugaucaccuucaaua

SEQ ID NO: 1069453 - RNA, 19 nt, Homo sapiens
ggaaugggguggauuguga

SEQ ID NO: 1069454 - RNA, 19 nt, Homo sapiens
ucucuauccucucguauuu

SEQ ID NO: 1069455 - RNA, 19 nt, Homo sapiens
cacaaaggcuucacuguac

SEQ ID NO: 1069456 - RNA, 19 nt, Homo sapiens
gcagaccaccuccuucuau

SEQ ID NO: 1069457 - RNA, 19 nt, Homo sapiens
gguguggccuucuacaaug

SEQ ID NO: 1069458 - RNA, 19 nt, Homo sapiens
gguaacagccuucugaaag

SEQ ID NO: 1069459 - RNA, 19 nt, Homo sapiens
ccaugguguuccuuaauaa

SEQ ID NO: 1069460 - RNA, 19 nt, Homo sapiens
ccagauggguucuaaugca

SEQ ID NO: 1069461 - RNA, 19 nt, Homo sapiens
ggacugagggaggaaauga

SEQ ID NO: 1069462 - RNA, 19 nt, Homo sapiens
uccaugguguuccuuaaua

SEQ ID NO: 1069463 - RNA, 19 nt, Homo sapiens
ggacaggcaacaaccuuga

SEQ ID NO: 1069464 - RNA, 19 nt, Homo sapiens
gcaaggguccagacuagga

SEQ ID NO: 1069465 - RNA, 19 nt, Homo sapiens
caaguaauaccagaaaguu

SEQ ID NO: 1069466 - RNA, 19 nt, Homo sapiens
ucaacgugcugcucuccua

SEQ ID NO: 1069467 - RNA, 19 nt, Homo sapiens
gcaugaucaccuucaauaa

SEQ ID NO: 1069468 - RNA, 19 nt, Homo sapiens
ccggguggcuuacaaacaa

SEQ ID NO: 1069469 - RNA, 19 nt, Homo sapiens
acaccaaccuuuacauucu

SEQ ID NO: 1069470 - RNA, 19 nt, Homo sapiens
gaaagugcucaccaucuau

SEQ ID NO: 1069471 - RNA, 19 nt, Homo sapiens
ugaccacgcugcugugcaa

SEQ ID NO: 1069472 - RNA, 19 nt, Homo sapiens
ccagguaacagccuucuga

SEQ ID NO: 1069473 - RNA, 19 nt, Homo sapiens
gggaggaaaugagcgaguu

SEQ ID NO: 1069474 - RNA, 19 nt, Homo sapiens
ugagaaggaaccaguguuu

SEQ ID NO: 1069475 - RNA, 19 nt, Homo sapiens
ucaauaaccucugccucaa

SEQ ID NO: 1069476 - RNA, 19 nt, Homo sapiens
guaacagccuucugaaagc

SEQ ID NO: 1069477 - RNA, 19 nt, Homo sapiens
gaaggaaccaguguuuaca

SEQ ID NO: 1069478 - RNA, 19 nt, Homo sapiens
gaaggaaccaguguuuaca

SEQ ID NO: 1069479 - RNA, 19 nt, Homo sapiens
gcugggagaugaagaagac

SEQ ID NO: 1069480 - RNA, 19 nt, Homo sapiens
aaacaacagaaacguauug

SEQ ID NO: 1069481 - RNA, 19 nt, Homo sapiens
ggagcaaggguccagacua

SEQ ID NO: 1069482 - RNA, 19 nt, Homo sapiens
uaagcagggucauuaacau

SEQ ID NO: 1069483 - RNA, 19 nt, Homo sapiens
ccaguccgcugacccacaa

SEQ ID NO: 1069484 - RNA, 19 nt, Homo sapiens
gcaucuggcgccugacuuu

SEQ ID NO: 1069485 - RNA, 19 nt, Homo sapiens
aaagugcucaccaucuaua

SEQ ID NO: 1069486 - RNA, 19 nt, Homo sapiens
ccacagaccggccuuccuu

SEQ ID NO: 1069487 - RNA, 19 nt, Homo sapiens
gaaacguauugcucacagu

SEQ ID NO: 1069488 - RNA, 19 nt, Homo sapiens
acaaacaacagaaacguau

SEQ ID NO: 1069489 - RNA, 19 nt, Homo sapiens
gccaaacccuucucuaucc

SEQ ID NO: 1069490 - RNA, 19 nt, Homo sapiens
gggaaccaugcuucucuua

SEQ ID NO: 1069491 - RNA, 19 nt, Homo sapiens
ggacagggacaggcaacaa

SEQ ID NO: 1069492 - RNA, 19 nt, Homo sapiens
guugaaggaaccaguguuu

SEQ ID NO: 1069493 - RNA, 19 nt, Homo sapiens
gagaaagugcucaccaucu

SEQ ID NO: 1069494 - RNA, 19 nt, Homo sapiens
ggagcacccuagugagagu

SEQ ID NO: 1069495 - RNA, 19 nt, Homo sapiens
uauagacccaaucagaaua

SEQ ID NO: 1069496 - RNA, 19 nt, Homo sapiens
cugaugcccugaguuguuu

SEQ ID NO: 1069497 - RNA, 19 nt, Homo sapiens
ucaagaggccagcagauuc

SEQ ID NO: 1069498 - RNA, 19 nt, Homo sapiens
uaacagccuucugaaagca

SEQ ID NO: 1069499 - RNA, 19 nt, Homo sapiens
cagaccaccuccuucuaug

SEQ ID NO: 1069500 - RNA, 19 nt, Homo sapiens
gcccugaguuguuugugau

SEQ ID NO: 1069501 - RNA, 19 nt, Homo sapiens
gacaccaaccuuuacauuc

SEQ ID NO: 1069502 - RNA, 19 nt, Homo sapiens
caaacaacagaaacguauu

SEQ ID NO: 1069503 - RNA, 19 nt, Homo sapiens
aauaaccucugccucaagu

SEQ ID NO: 1069504 - RNA, 19 nt, Homo sapiens
ggacugcagaucaaguuca

SEQ ID NO: 1069505 - RNA, 19 nt, Homo sapiens
agacaccaaccuuuacauu

SEQ ID NO: 1069506 - RNA, 19 nt, Homo sapiens
ccaaagacagcgagaagag

SEQ ID NO: 1069507 - RNA, 19 nt, Homo sapiens
gcgccugacuuucuacaac

SEQ ID NO: 1069508 - RNA, 19 nt, Homo sapiens
caccaaccuuuacauucuu

SEQ ID NO: 1069509 - RNA, 19 nt, Homo sapiens
ugaaggaaccaguguuuac

SEQ ID NO: 1069510 - RNA, 19 nt, Homo sapiens
ggccugaugcccugaguug

SEQ ID NO: 1069511 - RNA, 19 nt, Homo sapiens
ggaaccaugcuucucuuag

SEQ ID NO: 1069512 - RNA, 19 nt, Homo sapiens
agaccggccuuccuuugga

SEQ ID NO: 1069513 - RNA, 19 nt, Homo sapiens
ccucucguauuucugaguu

SEQ ID NO: 1069514 - RNA, 19 nt, Homo sapiens
auacggugguugagaagga

SEQ ID NO: 1069515 - RNA, 19 nt, Homo sapiens
gaucaagaggccagcagau

SEQ ID NO: 1069516 - RNA, 19 nt, Homo sapiens
cuacuuauagacccaauca

SEQ ID NO: 1069517 - RNA, 19 nt, Homo sapiens
caaggccugugcccagaca

SEQ ID NO: 1069518 - RNA, 19 nt, Homo sapiens
ucaagcagaccaccuccuu

SEQ ID NO: 1069519 - RNA, 19 nt, Homo sapiens
gggugagaauuccaaugug

SEQ ID NO: 1069520 - RNA, 19 nt, Homo sapiens
uacaaacaacagaaacgua

SEQ ID NO: 1069521 - RNA, 19 nt, Homo sapiens
ucuccaugguguuccuuaa

SEQ ID NO: 1069522 - RNA, 19 nt, Homo sapiens
uaagacaccaaccuuuaca

SEQ ID NO: 1069523 - RNA, 19 nt, Homo sapiens
uauccucucguauuucuga

SEQ ID NO: 1069524 - RNA, 19 nt, Homo sapiens
ggaaccaguguuuacaagu

SEQ ID NO: 1069525 - RNA, 19 nt, Homo sapiens
ggaaccaguguuuacaagu

SEQ ID NO: 1069526 - RNA, 19 nt, Homo sapiens
agaaggaaccaguguuuac

SEQ ID NO: 1069527 - RNA, 19 nt, Homo sapiens
ccugaugcccugaguuguu

SEQ ID NO: 1069528 - RNA, 19 nt, Homo sapiens
ggcauuugguauguccuuu

SEQ ID NO: 1069529 - RNA, 19 nt, Homo sapiens
guagaagcacaaacaagca

SEQ ID NO: 1069530 - RNA, 19 nt, Homo sapiens
ccgcuugccuugugauggu

SEQ ID NO: 1069531 - RNA, 19 nt, Homo sapiens
gagguuaagcagggucauu

SEQ ID NO: 1069532 - RNA, 19 nt, Homo sapiens
caugaucaccuucaauaac

SEQ ID NO: 1069533 - RNA, 19 nt, Homo sapiens
cuuauagacccaaucagaa

SEQ ID NO: 1069534 - RNA, 19 nt, Homo sapiens
ucuccuaccugcugcucaa

SEQ ID NO: 1069535 - RNA, 19 nt, Homo sapiens
uggacugggugcuacuuau

SEQ ID NO: 1069536 - RNA, 19 nt, Homo sapiens
acuccaacccuguucauga

SEQ ID NO: 1069537 - RNA, 19 nt, Homo sapiens
caccugcgguaucaucauc

SEQ ID NO: 1069538 - RNA, 19 nt, Homo sapiens
ucuauccucucguauuucu

SEQ ID NO: 1069539 - RNA, 19 nt, Homo sapiens
uuauagacccaaucagaau

SEQ ID NO: 1069540 - RNA, 19 nt, Homo sapiens
gaaggcagcaggauuauua

SEQ ID NO: 1069541 - RNA, 19 nt, Homo sapiens
ccgcggagaugaagaauuu

SEQ ID NO: 1069542 - RNA, 19 nt, Homo sapiens
gcgaggaccugcacgagua

SEQ ID NO: 1069543 - RNA, 19 nt, Homo sapiens
gagaagaaccugcacuuug

SEQ ID NO: 1069544 - RNA, 19 nt, Homo sapiens
gcagcaggauuauuacaga

SEQ ID NO: 1069545 - RNA, 19 nt, Homo sapiens
agaagaaccugcacuuugu

SEQ ID NO: 1069546 - RNA, 19 nt, Homo sapiens
gcaucaaccucacggagaa

SEQ ID NO: 1069547 - RNA, 19 nt, Homo sapiens
agagaaggcagcaggauua

SEQ ID NO: 1069548 - RNA, 19 nt, Homo sapiens
ccacggcucugcaggauca

SEQ ID NO: 1069549 - RNA, 19 nt, Homo sapiens
ccaaguagcugggauugca

SEQ ID NO: 1069550 - RNA, 19 nt, Homo sapiens
gaccaggccuuucauucug

SEQ ID NO: 1069551 - RNA, 19 nt, Homo sapiens
ggagaagaaccugcacuuu

SEQ ID NO: 1069552 - RNA, 19 nt, Homo sapiens
uaacgagagacaucaguuu

SEQ ID NO: 1069553 - RNA, 19 nt, Homo sapiens
ucacggagaaccugcagua

SEQ ID NO: 1069554 - RNA, 19 nt, Homo sapiens
ccaaagugcugggaugaca

SEQ ID NO: 1069555 - RNA, 19 nt, Homo sapiens
cguacugccugaacaagaa

SEQ ID NO: 1069556 - RNA, 19 nt, Homo sapiens
gacaucaguuucucaggau

SEQ ID NO: 1069557 - RNA, 19 nt, Homo sapiens
ucaucgcgcucaaucagaa

SEQ ID NO: 1069558 - RNA, 19 nt, Homo sapiens
cagcaggauuauuacagaa

SEQ ID NO: 1069559 - RNA, 19 nt, Homo sapiens
ugcaauagguucucuuugg

SEQ ID NO: 1069560 - RNA, 19 nt, Homo sapiens
gaggacacacucacggaaa

SEQ ID NO: 1069561 - RNA, 19 nt, Homo sapiens
ucaccaaauucauacagau

SEQ ID NO: 1069562 - RNA, 19 nt, Homo sapiens
ccgagucccuggagaagau

SEQ ID NO: 1069563 - RNA, 19 nt, Homo sapiens
gagaccaggccuuucauuc

SEQ ID NO: 1069564 - RNA, 19 nt, Homo sapiens
ugacuuccgucggcuguga

SEQ ID NO: 1069565 - RNA, 19 nt, Homo sapiens
ggagaccaggccuuucauu

SEQ ID NO: 1069566 - RNA, 19 nt, Homo sapiens
cggagaaccugcaguacgu

SEQ ID NO: 1069567 - RNA, 19 nt, Homo sapiens
gaagagaaggcagcaggau

SEQ ID NO: 1069568 - RNA, 19 nt, Homo sapiens
ggaguguaguagugugauc

SEQ ID NO: 1069569 - RNA, 19 nt, Homo sapiens
aaccugcacuuuguccaua

SEQ ID NO: 1069570 - RNA, 19 nt, Homo sapiens
gccuauaccucauuuucua

SEQ ID NO: 1069571 - RNA, 19 nt, Homo sapiens
ugccucagccucccaagua

SEQ ID NO: 1069572 - RNA, 19 nt, Homo sapiens
gaaccugcacuuuguccau

SEQ ID NO: 1069573 - RNA, 19 nt, Homo sapiens
ugugaauccuugucuguca

SEQ ID NO: 1069574 - RNA, 19 nt, Homo sapiens
uguuggagcugcugguuca

SEQ ID NO: 1069575 - RNA, 19 nt, Homo sapiens
ccagggagaccaggccuuu

SEQ ID NO: 1069576 - RNA, 19 nt, Homo sapiens
gagcugcugguucaaguuc

SEQ ID NO: 1069577 - RNA, 19 nt, Homo sapiens
cuacaugucgcuuguugga

SEQ ID NO: 1069578 - RNA, 19 nt, Homo sapiens
guaccuggaccugcggaua

SEQ ID NO: 1069579 - RNA, 19 nt, Homo sapiens
gcccugucgugcugaaaug

SEQ ID NO: 1069580 - RNA, 19 nt, Homo sapiens
gagaaggcagcaggauuau

SEQ ID NO: 1069581 - RNA, 19 nt, Homo sapiens
ugccgaggcuggaguguag

SEQ ID NO: 1069582 - RNA, 19 nt, Homo sapiens
gaagaaccugcacuuuguc

SEQ ID NO: 1069583 - RNA, 19 nt, Homo sapiens
gaagagugucccgcagaga

SEQ ID NO: 1069584 - RNA, 19 nt, Homo sapiens
gccacgacacgaugacgua

SEQ ID NO: 1069585 - RNA, 19 nt, Homo sapiens
caggugagcgcuuccaaca

SEQ ID NO: 1069586 - RNA, 19 nt, Homo sapiens
guugcaauagguucucuuu

SEQ ID NO: 1069587 - RNA, 19 nt, Homo sapiens
uuugggaccuaaugacuca

SEQ ID NO: 1069588 - RNA, 19 nt, Homo sapiens
ucacggugcaccaacauca

SEQ ID NO: 1069589 - RNA, 19 nt, Homo sapiens
cuggagggcucggagaaga

SEQ ID NO: 1069590 - RNA, 19 nt, Homo sapiens
auucugggcucgagaccaa

SEQ ID NO: 1069591 - RNA, 19 nt, Homo sapiens
ccaaauucauacagaucgu

SEQ ID NO: 1069592 - RNA, 19 nt, Homo sapiens
gcugugaauccuugucugu

SEQ ID NO: 1069593 - RNA, 19 nt, Homo sapiens
gcugacgggacccuucuga

SEQ ID NO: 1069594 - RNA, 19 nt, Homo sapiens
ugggaagccuggccucagu

SEQ ID NO: 1069595 - RNA, 19 nt, Homo sapiens
ggacacacucacggaaauc

SEQ ID NO: 1069596 - RNA, 19 nt, Homo sapiens
aagagaaggcagcaggauu

SEQ ID NO: 1069597 - RNA, 19 nt, Homo sapiens
ugacguacugccugaacaa

SEQ ID NO: 1069598 - RNA, 19 nt, Homo sapiens
caaauucauacagaucguu

SEQ ID NO: 1069599 - RNA, 19 nt, Homo sapiens
ccagggcucaccucugaug

SEQ ID NO: 1069600 - RNA, 19 nt, Homo sapiens
uugcuacggugaaaugaag

SEQ ID NO: 1069601 - RNA, 19 nt, Homo sapiens
aggcuggaguguaguagug

SEQ ID NO: 1069602 - RNA, 19 nt, Homo sapiens
uccgauaccuggagaccau

SEQ ID NO: 1069603 - RNA, 19 nt, Homo sapiens
aggacacacucacggaaau

SEQ ID NO: 1069604 - RNA, 19 nt, Homo sapiens
ggaagccuggccucagugu

SEQ ID NO: 1069605 - RNA, 19 nt, Homo sapiens
gauuauuacagaaccuugu

SEQ ID NO: 1069606 - RNA, 19 nt, Homo sapiens
agaccaggccuuucauucu

SEQ ID NO: 1069607 - RNA, 19 nt, Homo sapiens
gggcguauccacaaaauca

SEQ ID NO: 1069608 - RNA, 19 nt, Homo sapiens
cuaacgagagacaucaguu

SEQ ID NO: 1069609 - RNA, 19 nt, Homo sapiens
ggagcugcugguucaaguu

SEQ ID NO: 1069610 - RNA, 19 nt, Homo sapiens
gguucacggugcaccaaca

SEQ ID NO: 1069611 - RNA, 19 nt, Homo sapiens
gacuggaugucggcacugu

SEQ ID NO: 1069612 - RNA, 19 nt, Homo sapiens
guccauaugguguacacaa

SEQ ID NO: 1069613 - RNA, 19 nt, Homo sapiens
gcacagaacugacuacuuu

SEQ ID NO: 1069614 - RNA, 19 nt, Homo sapiens
ggaaagaucuucagcuuau

SEQ ID NO: 1069615 - RNA, 19 nt, Homo sapiens
ggacccagcugguuuauaa

SEQ ID NO: 1069616 - RNA, 19 nt, Homo sapiens
gcaaguggcugaaauauca

SEQ ID NO: 1069617 - RNA, 19 nt, Homo sapiens
gaagaucacucacuuagga

SEQ ID NO: 1069618 - RNA, 19 nt, Homo sapiens
uaaagaagcaccagaguua

SEQ ID NO: 1069619 - RNA, 19 nt, Homo sapiens
ugaaacaucuccaaauuga

SEQ ID NO: 1069620 - RNA, 19 nt, Homo sapiens
gaucaguucucauuaaaga

SEQ ID NO: 1069621 - RNA, 19 nt, Homo sapiens
gaacuaaauucugagauga

SEQ ID NO: 1069622 - RNA, 19 nt, Homo sapiens
ggacgugacuccaggauau

SEQ ID NO: 1069623 - RNA, 19 nt, Homo sapiens
gaagugaggaaaccauuua

SEQ ID NO: 1069624 - RNA, 19 nt, Homo sapiens
ggaguauagugacacauua

SEQ ID NO: 1069625 - RNA, 19 nt, Homo sapiens
aaacagaguugauaagaga

SEQ ID NO: 1069626 - RNA, 19 nt, Homo sapiens
gaacucaacagacguauga

SEQ ID NO: 1069627 - RNA, 19 nt, Homo sapiens
uaaaguugcuggagccaua

SEQ ID NO: 1069628 - RNA, 19 nt, Homo sapiens
caaggauucucaacagaua

SEQ ID NO: 1069629 - RNA, 19 nt, Homo sapiens
gcacagauauuagcucuuc

SEQ ID NO: 1069630 - RNA, 19 nt, Homo sapiens
cagcaugccuccuuuguuu

SEQ ID NO: 1069631 - RNA, 19 nt, Homo sapiens
caacaguguccaacuauua

SEQ ID NO: 1069632 - RNA, 19 nt, Homo sapiens
gaaaagaaauagaggagua

SEQ ID NO: 1069633 - RNA, 19 nt, Homo sapiens
ggaacuaaauucugagaug

SEQ ID NO: 1069634 - RNA, 19 nt, Homo sapiens
ccgaauaaaucuaaaggua

SEQ ID NO: 1069635 - RNA, 19 nt, Homo sapiens
caaaguaccuaauucaaca

SEQ ID NO: 1069636 - RNA, 19 nt, Homo sapiens
ccaggaagaugauguaaau

SEQ ID NO: 1069637 - RNA, 19 nt, Homo sapiens
gaagauuugggaaagauua

SEQ ID NO: 1069638 - RNA, 19 nt, Homo sapiens
gugaggaaaccauuuauua

SEQ ID NO: 1069639 - RNA, 19 nt, Homo sapiens
gaacauuugccauucuuaa

SEQ ID NO: 1069640 - RNA, 19 nt, Homo sapiens
gagagucuguuucuuaaau

SEQ ID NO: 1069641 - RNA, 19 nt, Homo sapiens
gcacaaggauucucaacag

SEQ ID NO: 1069642 - RNA, 19 nt, Homo sapiens
aaacaauacuggaauccua

SEQ ID NO: 1069643 - RNA, 19 nt, Homo sapiens
caaguggacugaugcugua

SEQ ID NO: 1069644 - RNA, 19 nt, Homo sapiens
ggagagaaaugccauggau

SEQ ID NO: 1069645 - RNA, 19 nt, Homo sapiens
caaaagaggucugagaaua

SEQ ID NO: 1069646 - RNA, 19 nt, Homo sapiens
gaaagaucuucagcuuaua

SEQ ID NO: 1069647 - RNA, 19 nt, Homo sapiens
aaauaagggucgucucuuu

SEQ ID NO: 1069648 - RNA, 19 nt, Homo sapiens
gauaagagaauaacugaug

SEQ ID NO: 1069649 - RNA, 19 nt, Homo sapiens
aaaggaaguuuacugguuu

SEQ ID NO: 1069650 - RNA, 19 nt, Homo sapiens
ggaagagugugcugagaug

SEQ ID NO: 1069651 - RNA, 19 nt, Homo sapiens
aagcaaagcacagauauua

SEQ ID NO: 1069652 - RNA, 19 nt, Homo sapiens
gaacugaaacaucuccaaa

SEQ ID NO: 1069653 - RNA, 19 nt, Homo sapiens
gugaggaacuaaauucuga

SEQ ID NO: 1069654 - RNA, 19 nt, Homo sapiens
gaagugcugugugaagaaa

SEQ ID NO: 1069655 - RNA, 19 nt, Homo sapiens
cugagaacauugugacuua

SEQ ID NO: 1069656 - RNA, 19 nt, Homo sapiens
guaccauccugccaucaua

SEQ ID NO: 1069657 - RNA, 19 nt, Homo sapiens
gagcugugcuuuccaagug

SEQ ID NO: 1069658 - RNA, 19 nt, Homo sapiens
gaucaacucuaacacauac

SEQ ID NO: 1069659 - RNA, 19 nt, Homo sapiens
agcaguagcuuacagguua

SEQ ID NO: 1069660 - RNA, 19 nt, Homo sapiens
ucacagaguucaccuauac

SEQ ID NO: 1069661 - RNA, 19 nt, Homo sapiens
uaaaggaucaguucucauu

SEQ ID NO: 1069662 - RNA, 19 nt, Homo sapiens
ggaaagccaagaauuuauu

SEQ ID NO: 1069663 - RNA, 19 nt, Homo sapiens
ggaagaugauguaaauucu

SEQ ID NO: 1069664 - RNA, 19 nt, Homo sapiens
gaagagcacagaaaauuua

SEQ ID NO: 1069665 - RNA, 19 nt, Homo sapiens
gaagggagagaaacugaaa

SEQ ID NO: 1069666 - RNA, 19 nt, Homo sapiens
ugacaaaccuacagugaca

SEQ ID NO: 1069667 - RNA, 19 nt, Homo sapiens
uuucacaucuugccucaua

SEQ ID NO: 1069668 - RNA, 19 nt, Homo sapiens
uuagacagcuuggaaauau

SEQ ID NO: 1069669 - RNA, 19 nt, Homo sapiens
gaggaggaaucacaggaaa

SEQ ID NO: 1069670 - RNA, 19 nt, Homo sapiens
uaggaucucugaugacauu

SEQ ID NO: 1069671 - RNA, 19 nt, Homo sapiens
guauugcacuugauaaauc

SEQ ID NO: 1069672 - RNA, 19 nt, Homo sapiens
gaauguauugcacuugaua

SEQ ID NO: 1069673 - RNA, 19 nt, Homo sapiens
gauugagggugaacauuug

SEQ ID NO: 1069674 - RNA, 19 nt, Homo sapiens
cagaaucacuaugaaugua

SEQ ID NO: 1069675 - RNA, 19 nt, Homo sapiens
cgaaucaucuaguucaugu

SEQ ID NO: 1069676 - RNA, 19 nt, Homo sapiens
gcaccagaguuaaauucaa

SEQ ID NO: 1069677 - RNA, 19 nt, Homo sapiens
ggaaaccauuuauuacagu

SEQ ID NO: 1069678 - RNA, 19 nt, Homo sapiens
ccagagaaggcaaacaaua

SEQ ID NO: 1069679 - RNA, 19 nt, Homo sapiens
ggaaugauacagaaaggaa

SEQ ID NO: 1069680 - RNA, 19 nt, Homo sapiens
gaaaguggauuuugugcaa

SEQ ID NO: 1069681 - RNA, 19 nt, Homo sapiens
guaccuaauucaacaggaa

SEQ ID NO: 1069682 - RNA, 19 nt, Homo sapiens
caaagcugaucgauguaaa

SEQ ID NO: 1069683 - RNA, 19 nt, Homo sapiens
aaaggaagguccaaauaag

SEQ ID NO: 1069684 - RNA, 19 nt, Homo sapiens
gguugaaacugccagagaa

SEQ ID NO: 1069685 - RNA, 19 nt, Homo sapiens
acauauaucugaaccugaa

SEQ ID NO: 1069686 - RNA, 19 nt, Homo sapiens
ccaaucagaaucacuauga

SEQ ID NO: 1069687 - RNA, 19 nt, Homo sapiens
aaaggaguaugaacaauca

SEQ ID NO: 1069688 - RNA, 19 nt, Homo sapiens
uuaaaugccuugaggugaa

SEQ ID NO: 1069689 - RNA, 19 nt, Homo sapiens
acuuugagcuggauacuuu

SEQ ID NO: 1069690 - RNA, 19 nt, Homo sapiens
acugaaacaucuccaaauu

SEQ ID NO: 1069691 - RNA, 19 nt, Homo sapiens
aaaccaaaguaccuaauuc

SEQ ID NO: 1069692 - RNA, 19 nt, Homo sapiens
uagaaauacugccuuugaa

SEQ ID NO: 1069693 - RNA, 19 nt, Homo sapiens
gcugaucgauguaaauucu

SEQ ID NO: 1069694 - RNA, 19 nt, Homo sapiens
aaggaucaguucucauuaa

SEQ ID NO: 1069695 - RNA, 19 nt, Homo sapiens
ugaaucagcugcaucacau

SEQ ID NO: 1069696 - RNA, 19 nt, Homo sapiens
gaaaccuggagaugacuua

SEQ ID NO: 1069697 - RNA, 19 nt, Homo sapiens
uggagagucuguuucuuaa

SEQ ID NO: 1069698 - RNA, 19 nt, Homo sapiens
gagugaugcugucaaugaa

SEQ ID NO: 1069699 - RNA, 19 nt, Homo sapiens
caacguggcuacuccaaac

SEQ ID NO: 1069700 - RNA, 19 nt, Homo sapiens
ggaccaaaaugaaaccuuu

SEQ ID NO: 1069701 - RNA, 19 nt, Homo sapiens
gaggaaaccauuuauuaca

SEQ ID NO: 1069702 - RNA, 19 nt, Homo sapiens
gaacuuucuggauuaguaa

SEQ ID NO: 1069703 - RNA, 19 nt, Homo sapiens
agacacagaagcacauaua

SEQ ID NO: 1069704 - RNA, 19 nt, Homo sapiens
gaagucagaauuaacuaug

SEQ ID NO: 1069705 - RNA, 19 nt, Homo sapiens
gaaagccaagaauuuauug

SEQ ID NO: 1069706 - RNA, 19 nt, Homo sapiens
ugacauuuccuguuaaaga

SEQ ID NO: 1069707 - RNA, 19 nt, Homo sapiens
aaucugacauucaagaaga

SEQ ID NO: 1069708 - RNA, 19 nt, Homo sapiens
gagaugaagagcacagaaa

SEQ ID NO: 1069709 - RNA, 19 nt, Homo sapiens
gaagcaaagcacagauauu

SEQ ID NO: 1069710 - RNA, 19 nt, Homo sapiens
cagaagaaauaauggaaag

SEQ ID NO: 1069711 - RNA, 19 nt, Homo sapiens
ggagccauagguauuguua

SEQ ID NO: 1069712 - RNA, 19 nt, Homo sapiens
gcuauuucccuucuaauug

SEQ ID NO: 1069713 - RNA, 19 nt, Homo sapiens
ggaagaauauuguguauca

SEQ ID NO: 1069714 - RNA, 19 nt, Homo sapiens
gaaauccacugaauucuau

SEQ ID NO: 1069715 - RNA, 19 nt, Homo sapiens
ggaggaaguugcuauuaaa

SEQ ID NO: 1069716 - RNA, 19 nt, Homo sapiens
gaagaaguuucaagagauu

SEQ ID NO: 1069717 - RNA, 19 nt, Homo sapiens
gaaaacagcuugaagaaga

SEQ ID NO: 1069718 - RNA, 19 nt, Homo sapiens
ggaagaaguuucaagagau

SEQ ID NO: 1069719 - RNA, 19 nt, Homo sapiens
gaaaagacuuguugagaaa

SEQ ID NO: 1069720 - RNA, 19 nt, Homo sapiens
gaauuacgcuuaccugaag

SEQ ID NO: 1069721 - RNA, 19 nt, Homo sapiens
uaacagaagucuuggaucu

SEQ ID NO: 1069722 - RNA, 19 nt, Homo sapiens
aauggagacuuucagauua

SEQ ID NO: 1069723 - RNA, 19 nt, Homo sapiens
gcagucaguugaauacgaa

SEQ ID NO: 1069724 - RNA, 19 nt, Homo sapiens
gaaaauggcuauauaguac

SEQ ID NO: 1069725 - RNA, 19 nt, Homo sapiens
gcaggaaagugaauaaacu

SEQ ID NO: 1069726 - RNA, 19 nt, Homo sapiens
cagaggaccuuaugacuca

SEQ ID NO: 1069727 - RNA, 19 nt, Homo sapiens
gaaaccagauaacagaagu

SEQ ID NO: 1069728 - RNA, 19 nt, Homo sapiens
ggaccucucucuucugcaa

SEQ ID NO: 1069729 - RNA, 19 nt, Homo sapiens
uguaguaaauggagacuuu

SEQ ID NO: 1069730 - RNA, 19 nt, Homo sapiens
caucaggccucaucucaug

SEQ ID NO: 1069731 - RNA, 19 nt, Homo sapiens
uaacagcaccgauuccaaa

SEQ ID NO: 1069732 - RNA, 19 nt, Homo sapiens
guacaugucuauuuaacag

SEQ ID NO: 1069733 - RNA, 19 nt, Homo sapiens
ccaguugaauuaccagaaa

SEQ ID NO: 1069734 - RNA, 19 nt, Homo sapiens
uggaggaaguugcuauuaa

SEQ ID NO: 1069735 - RNA, 19 nt, Homo sapiens
agagagagcuggaggaagu

SEQ ID NO: 1069736 - RNA, 19 nt, Homo sapiens
ccagauaacagaagucuug

SEQ ID NO: 1069737 - RNA, 19 nt, Homo sapiens
gauuguacauaaagcguuu

SEQ ID NO: 1069738 - RNA, 19 nt, Homo sapiens
uaucaaacuuguaggagaa

SEQ ID NO: 1069739 - RNA, 19 nt, Homo sapiens
ggucaacuauaacaagaug

SEQ ID NO: 1069740 - RNA, 19 nt, Homo sapiens
caagaugauugugaagauu

SEQ ID NO: 1069741 - RNA, 19 nt, Homo sapiens
gaugcaauccugaguaaga

SEQ ID NO: 1069742 - RNA, 19 nt, Homo sapiens
gagaaacucaagaugauug

SEQ ID NO: 1069743 - RNA, 19 nt, Homo sapiens
gagaugaggaaguuaagaa

SEQ ID NO: 1069744 - RNA, 19 nt, Homo sapiens
caaguccaauguaaaugaa

SEQ ID NO: 1069745 - RNA, 19 nt, Homo sapiens
ccucgaagaugcuguggaa

SEQ ID NO: 1069746 - RNA, 19 nt, Homo sapiens
guugagaaauccacugaau

SEQ ID NO: 1069747 - RNA, 19 nt, Homo sapiens
guucuguacucuaauguug

SEQ ID NO: 1069748 - RNA, 19 nt, Homo sapiens
ugagaaauccacugaauuc

SEQ ID NO: 1069749 - RNA, 19 nt, Homo sapiens
ggaaaauggcuauauagua

SEQ ID NO: 1069750 - RNA, 19 nt, Homo sapiens
guaaaggagauuguacaua

SEQ ID NO: 1069751 - RNA, 19 nt, Homo sapiens
ucaagaugauugugaagau

SEQ ID NO: 1069752 - RNA, 19 nt, Homo sapiens
aggaagaaguuucaagaga

SEQ ID NO: 1069753 - RNA, 19 nt, Homo sapiens
gaaacuaaaggacauuaag

SEQ ID NO: 1069754 - RNA, 19 nt, Homo sapiens
ugacaaguccaauguaaau

SEQ ID NO: 1069755 - RNA, 19 nt, Homo sapiens
ugagaaaccagauaacaga

SEQ ID NO: 1069756 - RNA, 19 nt, Homo sapiens
gaagagaguaaaggagauu

SEQ ID NO: 1069757 - RNA, 19 nt, Homo sapiens
gagaaugucugaaaaccuu

SEQ ID NO: 1069758 - RNA, 19 nt, Homo sapiens
gagugcaaguuuacaaauc

SEQ ID NO: 1069759 - RNA, 19 nt, Homo sapiens
ugaaaagacuuguugagaa

SEQ ID NO: 1069760 - RNA, 19 nt, Homo sapiens
uaccuguucuguacucuaa

SEQ ID NO: 1069761 - RNA, 19 nt, Homo sapiens
gaauaccuguucuguacuc

SEQ ID NO: 1069762 - RNA, 19 nt, Homo sapiens
aaauggagacuuucagauu

SEQ ID NO: 1069763 - RNA, 19 nt, Homo sapiens
ccaaagggaagaauauugu

SEQ ID NO: 1069764 - RNA, 19 nt, Homo sapiens
guaaauggagacuuucaga

SEQ ID NO: 1069765 - RNA, 19 nt, Homo sapiens
cccaugaaauuguaguaaa

SEQ ID NO: 1069766 - RNA, 19 nt, Homo sapiens
uagaagggcuauauaacgu

SEQ ID NO: 1069767 - RNA, 19 nt, Homo sapiens
gaucauggaaucucgaauc

SEQ ID NO: 1069768 - RNA, 19 nt, Homo sapiens
ggacauuaaggaaauagug

SEQ ID NO: 1069769 - RNA, 19 nt, Homo sapiens
cuaaaggacauuaaggaaa

SEQ ID NO: 1069770 - RNA, 19 nt, Homo sapiens
gauaacagaagucuuggau

SEQ ID NO: 1069771 - RNA, 19 nt, Homo sapiens
gagaguaaaggagauugua

SEQ ID NO: 1069772 - RNA, 19 nt, Homo sapiens
aaaggaagaaguuucaaga

SEQ ID NO: 1069773 - RNA, 19 nt, Homo sapiens
agacugagaaaccagauaa

SEQ ID NO: 1069774 - RNA, 19 nt, Homo sapiens
ccacugaauucuauuuuga

SEQ ID NO: 1069775 - RNA, 19 nt, Homo sapiens
uguggaaggugcugaugaa

SEQ ID NO: 1069776 - RNA, 19 nt, Homo sapiens
acgaugcaauccugaguaa

SEQ ID NO: 1069777 - RNA, 19 nt, Homo sapiens
cuguugcuguccagaauua

SEQ ID NO: 1069778 - RNA, 19 nt, Homo sapiens
ugaccaugcuaucaaacuu

SEQ ID NO: 1069779 - RNA, 19 nt, Homo sapiens
gcugggaccucucucuucu

SEQ ID NO: 1069780 - RNA, 19 nt, Homo sapiens
ggacauggccaacuuugcu

SEQ ID NO: 1069781 - RNA, 19 nt, Homo sapiens
uaaaccaguugaauuacca

SEQ ID NO: 1069782 - RNA, 19 nt, Homo sapiens
cccuacagcagcaguauua

SEQ ID NO: 1069783 - RNA, 19 nt, Homo sapiens
ggucuucugucccuacuac

SEQ ID NO: 1069784 - RNA, 19 nt, Homo sapiens
aaacucaagaugauuguga

SEQ ID NO: 1069785 - RNA, 19 nt, Homo sapiens
gagaaaccagauaacagaa

SEQ ID NO: 1069786 - RNA, 19 nt, Homo sapiens
cgagaggcgucaccaacau

SEQ ID NO: 1069787 - RNA, 19 nt, Homo sapiens
caaagauacaguuauugga

SEQ ID NO: 1069788 - RNA, 19 nt, Homo sapiens
acaaguccaauguaaauga

SEQ ID NO: 1069789 - RNA, 19 nt, Homo sapiens
ggccgacuuugcugagaaa

SEQ ID NO: 1069790 - RNA, 19 nt, Homo sapiens
ggucauacuagacugagaa

SEQ ID NO: 1069791 - RNA, 19 nt, Homo sapiens
cauaugaccaugcuaucaa

SEQ ID NO: 1069792 - RNA, 19 nt, Homo sapiens
ugaagaagagaguaaagga

SEQ ID NO: 1069793 - RNA, 19 nt, Homo sapiens
agggcuauauaacgucuua

SEQ ID NO: 1069794 - RNA, 19 nt, Homo sapiens
aaagacuuguugagaaauc

SEQ ID NO: 1069795 - RNA, 19 nt, Homo sapiens
ucuagcccaugaaauugua

SEQ ID NO: 1069796 - RNA, 19 nt, Homo sapiens
gcuauauaguacaugucua

SEQ ID NO: 1069797 - RNA, 19 nt, Homo sapiens
ugacucagaaguauaaaca

SEQ ID NO: 1069798 - RNA, 19 nt, Homo sapiens
gcuggcagaauucauuauu

SEQ ID NO: 1069799 - RNA, 19 nt, Homo sapiens
auggagacuuucagauuaa

SEQ ID NO: 1069800 - RNA, 19 nt, Homo sapiens
cgaagaugcuguggaaggu

SEQ ID NO: 1069801 - RNA, 19 nt, Homo sapiens
gaauauuguguaucacugu

SEQ ID NO: 1069802 - RNA, 19 nt, Homo sapiens
gaggaaguugcuauuaaau

SEQ ID NO: 1069803 - RNA, 19 nt, Homo sapiens
gcugaugaagccuuacaaa

SEQ ID NO: 1069804 - RNA, 19 nt, Homo sapiens
cgacuuugcugagaaacuc

SEQ ID NO: 1069805 - RNA, 19 nt, Homo sapiens
uggcagaauucauuauugg

SEQ ID NO: 1069806 - RNA, 19 nt, Homo sapiens
agaauuacgcuuaccugaa

SEQ ID NO: 1069807 - RNA, 19 nt, Homo sapiens
ccuuaugacucagaaguau

SEQ ID NO: 1069808 - RNA, 19 nt, Homo sapiens
gcucuagcccaugaaauug

SEQ ID NO: 1069809 - RNA, 19 nt, Homo sapiens
uguuagaagggcuauauaa

SEQ ID NO: 1069810 - RNA, 19 nt, Homo sapiens
gcaaucuggguaguucuuu

SEQ ID NO: 1069811 - RNA, 19 nt, Homo sapiens
gugcaaguuuacaaaucaa

SEQ ID NO: 1069812 - RNA, 19 nt, Homo sapiens
gaguaaaggagauuguaca

SEQ ID NO: 1069813 - RNA, 19 nt, Homo sapiens
gauaagcucucaacuauag

SEQ ID NO: 1069814 - RNA, 19 nt, Homo sapiens
gaagagggauaagaaauga

SEQ ID NO: 1069815 - RNA, 19 nt, Homo sapiens
cuaaagcaaugauguagua

SEQ ID NO: 1069816 - RNA, 19 nt, Homo sapiens
gaaaugaaagauccugaua

SEQ ID NO: 1069817 - RNA, 19 nt, Homo sapiens
aaagugagguguagauuga

SEQ ID NO: 1069818 - RNA, 19 nt, Homo sapiens
caucacugcuuguuacaua

SEQ ID NO: 1069819 - RNA, 19 nt, Homo sapiens
gcagauaccuuagugacaa

SEQ ID NO: 1069820 - RNA, 19 nt, Homo sapiens
acaaggagcuauuucuaaa

SEQ ID NO: 1069821 - RNA, 19 nt, Homo sapiens
caugaaggaugacauugua

SEQ ID NO: 1069822 - RNA, 19 nt, Homo sapiens
aagccgaccugacuacuua

SEQ ID NO: 1069823 - RNA, 19 nt, Homo sapiens
caauauaguuucuccugaa

SEQ ID NO: 1069824 - RNA, 19 nt, Homo sapiens
gaaaccagcagauaguaaa

SEQ ID NO: 1069825 - RNA, 19 nt, Homo sapiens
gcucuuaauugcauccuuu

SEQ ID NO: 1069826 - RNA, 19 nt, Homo sapiens
uuagagaccugcuuuacaa

SEQ ID NO: 1069827 - RNA, 19 nt, Homo sapiens
gagcaugugucaaagacuu

SEQ ID NO: 1069828 - RNA, 19 nt, Homo sapiens
gauugagccuugauauuau

SEQ ID NO: 1069829 - RNA, 19 nt, Homo sapiens
uuaaucagcuuccuguuga

SEQ ID NO: 1069830 - RNA, 19 nt, Homo sapiens
uuccaaaccuggcuuauaa

SEQ ID NO: 1069831 - RNA, 19 nt, Homo sapiens
gaugguaacucagaggaaa

SEQ ID NO: 1069832 - RNA, 19 nt, Homo sapiens
ggaauuucaucuaaagcaa

SEQ ID NO: 1069833 - RNA, 19 nt, Homo sapiens
uaaagaagcugaacaucac

SEQ ID NO: 1069834 - RNA, 19 nt, Homo sapiens
agaaggaguuuauaacguu

SEQ ID NO: 1069835 - RNA, 19 nt, Homo sapiens
gaggguggcuuaugcuuca

SEQ ID NO: 1069836 - RNA, 19 nt, Homo sapiens
agauugagccuugauauua

SEQ ID NO: 1069837 - RNA, 19 nt, Homo sapiens
ggaagagggauaagaaaug

SEQ ID NO: 1069838 - RNA, 19 nt, Homo sapiens
gagaaggucguggcucuua

SEQ ID NO: 1069839 - RNA, 19 nt, Homo sapiens
agacuuauucgacucauua

SEQ ID NO: 1069840 - RNA, 19 nt, Homo sapiens
ggaaaccagcagauaguaa

SEQ ID NO: 1069841 - RNA, 19 nt, Homo sapiens
gcagguugccgaucgagua

SEQ ID NO: 1069842 - RNA, 19 nt, Homo sapiens
aaaccuggcuuauaagaag

SEQ ID NO: 1069843 - RNA, 19 nt, Homo sapiens
uaacuaaagugagguguag

SEQ ID NO: 1069844 - RNA, 19 nt, Homo sapiens
aagaaagugugaaaugcua

SEQ ID NO: 1069845 - RNA, 19 nt, Homo sapiens
gacauucaacuucuuguuu

SEQ ID NO: 1069846 - RNA, 19 nt, Homo sapiens
guucaguacaguuucauua

SEQ ID NO: 1069847 - RNA, 19 nt, Homo sapiens
gugaaaugcuaguauaaag

SEQ ID NO: 1069848 - RNA, 19 nt, Homo sapiens
ggucguggcucuuauuggu

SEQ ID NO: 1069849 - RNA, 19 nt, Homo sapiens
cauaagguuugauuacuca

SEQ ID NO: 1069850 - RNA, 19 nt, Homo sapiens
gcauaagguuugauuacuc

SEQ ID NO: 1069851 - RNA, 19 nt, Homo sapiens
gcagagacuaccuuuguga

SEQ ID NO: 1069852 - RNA, 19 nt, Homo sapiens
guaagaaagugugaaaugc

SEQ ID NO: 1069853 - RNA, 19 nt, Homo sapiens
gaagauuggaagagggaua

SEQ ID NO: 1069854 - RNA, 19 nt, Homo sapiens
gaaaugcuaguauaaaggu

SEQ ID NO: 1069855 - RNA, 19 nt, Homo sapiens
gaccagaccuuccaaaccu

SEQ ID NO: 1069856 - RNA, 19 nt, Homo sapiens
aaacuaauguauccagaag

SEQ ID NO: 1069857 - RNA, 19 nt, Homo sapiens
gcaauugcacgaccagaga

SEQ ID NO: 1069858 - RNA, 19 nt, Homo sapiens
gugaccagcucccaguaaa

SEQ ID NO: 1069859 - RNA, 19 nt, Homo sapiens
ucccagaacugaucaaagu

SEQ ID NO: 1069860 - RNA, 19 nt, Homo sapiens
guugguauguaaacuaaug

SEQ ID NO: 1069861 - RNA, 19 nt, Homo sapiens
gaaggucguggcucuuauu

SEQ ID NO: 1069862 - RNA, 19 nt, Homo sapiens
caaaagcguuggcgauuga

SEQ ID NO: 1069863 - RNA, 19 nt, Homo sapiens
ugacaguguuucacaagug

SEQ ID NO: 1069864 - RNA, 19 nt, Homo sapiens
aagaugagcaugugucaaa

SEQ ID NO: 1069865 - RNA, 19 nt, Homo sapiens
acacagugaucaccgaaug

SEQ ID NO: 1069866 - RNA, 19 nt, Homo sapiens
gaagaaggaguuuauaacg

SEQ ID NO: 1069867 - RNA, 19 nt, Homo sapiens
cuggcuaucuuucuuauau

SEQ ID NO: 1069868 - RNA, 19 nt, Homo sapiens
gaacugaucaaaguagcuu

SEQ ID NO: 1069869 - RNA, 19 nt, Homo sapiens
ggagaaauuucagaagcau

SEQ ID NO: 1069870 - RNA, 19 nt, Homo sapiens
uaauguauccagaagauug

SEQ ID NO: 1069871 - RNA, 19 nt, Homo sapiens
ggcuaucuuucuuauauga

SEQ ID NO: 1069872 - RNA, 19 nt, Homo sapiens
guacaauucaagaaacuga

SEQ ID NO: 1069873 - RNA, 19 nt, Homo sapiens
ugucaaaccuuuuaaguug

SEQ ID NO: 1069874 - RNA, 19 nt, Homo sapiens
guuauuaucugucaaaccu

SEQ ID NO: 1069875 - RNA, 19 nt, Homo sapiens
agugugaaaugcuaguaua

SEQ ID NO: 1069876 - RNA, 19 nt, Homo sapiens
gacauuguaccuuggcaua

SEQ ID NO: 1069877 - RNA, 19 nt, Homo sapiens
ggucacgccugcauaaggu

SEQ ID NO: 1069878 - RNA, 19 nt, Homo sapiens
uaaaauugcugugcagaaa

SEQ ID NO: 1069879 - RNA, 19 nt, Homo sapiens
uuaaagaagcugaacauca

SEQ ID NO: 1069880 - RNA, 19 nt, Homo sapiens
gaguuuauaacguucagua

SEQ ID NO: 1069881 - RNA, 19 nt, Homo sapiens
ucacauguuuaguugguau

SEQ ID NO: 1069882 - RNA, 19 nt, Homo sapiens
guuggaaguucagauggua

SEQ ID NO: 1069883 - RNA, 19 nt, Homo sapiens
ggaguuggaaguucagaug

SEQ ID NO: 1069884 - RNA, 19 nt, Homo sapiens
gaggaaaccagcagauagu

SEQ ID NO: 1069885 - RNA, 19 nt, Homo sapiens
gagccuugauauuauuuag

SEQ ID NO: 1069886 - RNA, 19 nt, Homo sapiens
uaaagugagguguagauug

SEQ ID NO: 1069887 - RNA, 19 nt, Homo sapiens
gcagacauucaacuucuug

SEQ ID NO: 1069888 - RNA, 19 nt, Homo sapiens
gcaugaaggaugacauugu

SEQ ID NO: 1069889 - RNA, 19 nt, Homo sapiens
gcacucagucucuaacaag

SEQ ID NO: 1069890 - RNA, 19 nt, Homo sapiens
uaaagucaguaagaaagug

SEQ ID NO: 1069891 - RNA, 19 nt, Homo sapiens
aaaauacucugaagaagga

SEQ ID NO: 1069892 - RNA, 19 nt, Homo sapiens
gacaaaguuuaaucagcuu

SEQ ID NO: 1069893 - RNA, 19 nt, Homo sapiens
ggaggauucuuggaagcuu

SEQ ID NO: 1069894 - RNA, 19 nt, Homo sapiens
cuaacaagcuuuucugguu

SEQ ID NO: 1069895 - RNA, 19 nt, Homo sapiens
uacaaggagcuauuucuaa

SEQ ID NO: 1069896 - RNA, 19 nt, Homo sapiens
gcuaugccagcucuuaauu

SEQ ID NO: 1069897 - RNA, 19 nt, Homo sapiens
aaugaaagauccugauacu

SEQ ID NO: 1069898 - RNA, 19 nt, Homo sapiens
aguaucacauguuuaguug

SEQ ID NO: 1069899 - RNA, 19 nt, Homo sapiens
caacuucuuguuuacacua

SEQ ID NO: 1069900 - RNA, 19 nt, Homo sapiens
gaucaccgaaugagggaaa

SEQ ID NO: 1069901 - RNA, 19 nt, Homo sapiens
caguacaguuucauuaaag

SEQ ID NO: 1069902 - RNA, 19 nt, Homo sapiens
cagauaccuuagugacaaa

SEQ ID NO: 1069903 - RNA, 19 nt, Homo sapiens
cuuggaagcuugcacuuag

SEQ ID NO: 1069904 - RNA, 19 nt, Homo sapiens
gaacaccugcuuuccuucu

SEQ ID NO: 1069905 - RNA, 19 nt, Homo sapiens
cugaacaccugcuuuccuu

SEQ ID NO: 1069906 - RNA, 19 nt, Homo sapiens
gaagccgaccugacuacuu

SEQ ID NO: 1069907 - RNA, 19 nt, Homo sapiens
guagauugagccuugauau

SEQ ID NO: 1069908 - RNA, 19 nt, Homo sapiens
gagaaauuucagaagcaua

SEQ ID NO: 1069909 - RNA, 19 nt, Homo sapiens
uaucacauguuuaguuggu

SEQ ID NO: 1069910 - RNA, 19 nt, Homo sapiens
gaguauuuaugggcauuga

SEQ ID NO: 1069911 - RNA, 19 nt, Homo sapiens
cuucaucccuggcuaucuu

SEQ ID NO: 1069912 - RNA, 19 nt, Homo sapiens
ucaguaagaaagugugaaa

SEQ ID NO: 1069913 - RNA, 19 nt, Homo sapiens
gaaacuaucuagcacacua

SEQ ID NO: 1069914 - RNA, 19 nt, Homo sapiens
gaaggcagcugacauuauc

SEQ ID NO: 1069915 - RNA, 19 nt, Homo sapiens
caacagaaacugauauuga

SEQ ID NO: 1069916 - RNA, 19 nt, Homo sapiens
gauaaagucuugggaaaug

SEQ ID NO: 1069917 - RNA, 19 nt, Homo sapiens
gcaagcggcucucguggaa

SEQ ID NO: 1069918 - RNA, 19 nt, Homo sapiens
ucagucagauaaagagaua

SEQ ID NO: 1069919 - RNA, 19 nt, Homo sapiens
ggaaacagguggguucauc

SEQ ID NO: 1069920 - RNA, 19 nt, Homo sapiens
gaucagaggacuuggacua

SEQ ID NO: 1069921 - RNA, 19 nt, Homo sapiens
gaagccacauucagucaga

SEQ ID NO: 1069922 - RNA, 19 nt, Homo sapiens
acaaagaugucccugucua

SEQ ID NO: 1069923 - RNA, 19 nt, Homo sapiens
gaccauccaugaaggcaaa

SEQ ID NO: 1069924 - RNA, 19 nt, Homo sapiens
agaauuggauaaagucuug

SEQ ID NO: 1069925 - RNA, 19 nt, Homo sapiens
agagauagaugccuuugug

SEQ ID NO: 1069926 - RNA, 19 nt, Homo sapiens
gaagcucaccagagaaauu

SEQ ID NO: 1069927 - RNA, 19 nt, Homo sapiens
ggacuuggacuagauagaa

SEQ ID NO: 1069928 - RNA, 19 nt, Homo sapiens
gcugagaauuggauaaagu

SEQ ID NO: 1069929 - RNA, 19 nt, Homo sapiens
gagaaggcagcugacauua

SEQ ID NO: 1069930 - RNA, 19 nt, Homo sapiens
gaguggcucuggaaauuca

SEQ ID NO: 1069931 - RNA, 19 nt, Homo sapiens
ccaacuacuugucaacaga

SEQ ID NO: 1069932 - RNA, 19 nt, Homo sapiens
ggacauccaguuccauuuc

SEQ ID NO: 1069933 - RNA, 19 nt, Homo sapiens
uggaguggcucuggaaauu

SEQ ID NO: 1069934 - RNA, 19 nt, Homo sapiens
uggauaaagucuugggaaa

SEQ ID NO: 1069935 - RNA, 19 nt, Homo sapiens
ccacccagcaggaggcuua

SEQ ID NO: 1069936 - RNA, 19 nt, Homo sapiens
cagaggacuuggacuagau

SEQ ID NO: 1069937 - RNA, 19 nt, Homo sapiens
agagaaggcagcugacauu

SEQ ID NO: 1069938 - RNA, 19 nt, Homo sapiens
ggauaaagucuugggaaau

SEQ ID NO: 1069939 - RNA, 19 nt, Homo sapiens
ucagaggacuuggacuaga

SEQ ID NO: 1069940 - RNA, 19 nt, Homo sapiens
gaguggaggugccaucaac

SEQ ID NO: 1069941 - RNA, 19 nt, Homo sapiens
aagcggcucucguggaaga

SEQ ID NO: 1069942 - RNA, 19 nt, Homo sapiens
ggacaaucacaaagagugu

SEQ ID NO: 1069943 - RNA, 19 nt, Homo sapiens
cugaugaccucaagaaacu

SEQ ID NO: 1069944 - RNA, 19 nt, Homo sapiens
gaaugcugaugaccucaag

SEQ ID NO: 1069945 - RNA, 19 nt, Homo sapiens
gcuccugccugaaacuauc

SEQ ID NO: 1069946 - RNA, 19 nt, Homo sapiens
caaucaugaucgcagagaa

SEQ ID NO: 1069947 - RNA, 19 nt, Homo sapiens
ccacauucagucagauaaa

SEQ ID NO: 1069948 - RNA, 19 nt, Homo sapiens
gauccagcccaacuacuug

SEQ ID NO: 1069949 - RNA, 19 nt, Homo sapiens
aagaccaccuggagaucua

SEQ ID NO: 1069950 - RNA, 19 nt, Homo sapiens
ccaggaagccacauucagu

SEQ ID NO: 1069951 - RNA, 19 nt, Homo sapiens
aacagaaacugauauugag

SEQ ID NO: 1069952 - RNA, 19 nt, Homo sapiens
caccguauccugucacuuc

SEQ ID NO: 1069953 - RNA, 19 nt, Homo sapiens
caacuacuugucaacagaa

SEQ ID NO: 1069954 - RNA, 19 nt, Homo sapiens
ggacuagauagaagcaugu

SEQ ID NO: 1069955 - RNA, 19 nt, Homo sapiens
gagaauuggauaaagucuu

SEQ ID NO: 1069956 - RNA, 19 nt, Homo sapiens
ucaaugccauggucuacgu

SEQ ID NO: 1069957 - RNA, 19 nt, Homo sapiens
ggacgaguacagcuaugug

SEQ ID NO: 1069958 - RNA, 19 nt, Homo sapiens
ucagauaaagagauagaug

SEQ ID NO: 1069959 - RNA, 19 nt, Homo sapiens
aaagagcuccagccaggaa

SEQ ID NO: 1069960 - RNA, 19 nt, Homo sapiens
ggaaugcugaugaccucaa

SEQ ID NO: 1069961 - RNA, 19 nt, Homo sapiens
agaaggcagcugacauuau

SEQ ID NO: 1069962 - RNA, 19 nt, Homo sapiens
cauguggugucuccuacga

SEQ ID NO: 1069963 - RNA, 19 nt, Homo sapiens
auaaagucuugggaaauga

SEQ ID NO: 1069964 - RNA, 19 nt, Homo sapiens
gcugaugaccucaagaaac

SEQ ID NO: 1069965 - RNA, 19 nt, Homo sapiens
aagcucaccagagaaauuu

SEQ ID NO: 1069966 - RNA, 19 nt, Homo sapiens
gaaacugauauugaggauu

SEQ ID NO: 1069967 - RNA, 19 nt, Homo sapiens
agaaacugauauugaggau

SEQ ID NO: 1069968 - RNA, 19 nt, Homo sapiens
gacuuggacuagauagaag

SEQ ID NO: 1069969 - RNA, 19 nt, Homo sapiens
agaugucccugucuacaag

SEQ ID NO: 1069970 - RNA, 19 nt, Homo sapiens
gcagagaaggcagcugaca

SEQ ID NO: 1069971 - RNA, 19 nt, Homo sapiens
gcagugggcguggaguaug

SEQ ID NO: 1069972 - RNA, 19 nt, Homo sapiens
gcucaccgaggacaugaau

SEQ ID NO: 1069973 - RNA, 19 nt, Homo sapiens
gcacugccugcccuacuuc

SEQ ID NO: 1069974 - RNA, 19 nt, Homo sapiens
gucaacagaaacugauauu

SEQ ID NO: 1069975 - RNA, 19 nt, Homo sapiens
gcaagaccaccuggagauc

SEQ ID NO: 1069976 - RNA, 19 nt, Homo sapiens
gggcuuaugccagcaagga

SEQ ID NO: 1069977 - RNA, 19 nt, Homo sapiens
cagugggcguggaguaugu

SEQ ID NO: 1069978 - RNA, 19 nt, Homo sapiens
cacauucagucagauaaag

SEQ ID NO: 1069979 - RNA, 19 nt, Homo sapiens
cagcccaacuacuugucaa

SEQ ID NO: 1069980 - RNA, 19 nt, Homo sapiens
ccaagaccacccugugauc

SEQ ID NO: 1069981 - RNA, 19 nt, Homo sapiens
aaacugagaagugccaauc

SEQ ID NO: 1069982 - RNA, 19 nt, Homo sapiens
ggaguggcucuggaaauuc

SEQ ID NO: 1069983 - RNA, 19 nt, Homo sapiens
ccaccuggagaucuacauu

SEQ ID NO: 1069984 - RNA, 19 nt, Homo sapiens
ucaccgaggacaugaaugg

SEQ ID NO: 1069985 - RNA, 19 nt, Homo sapiens
caaagaugucccugucuac

SEQ ID NO: 1069986 - RNA, 19 nt, Homo sapiens
ucacagagugcaccguauc

SEQ ID NO: 1069987 - RNA, 19 nt, Homo sapiens
gauuuccgucuguguguga

SEQ ID NO: 1069988 - RNA, 19 nt, Homo sapiens
gugcagugggcguggagua

SEQ ID NO: 1069989 - RNA, 19 nt, Homo sapiens
gccacauucagucagauaa

SEQ ID NO: 1069990 - RNA, 19 nt, Homo sapiens
ugauccagcccaacuacuu

SEQ ID NO: 1069991 - RNA, 19 nt, Homo sapiens
uggcugagaauuggauaaa

SEQ ID NO: 1069992 - RNA, 19 nt, Homo sapiens
gagugugggcuggcucaaa

SEQ ID NO: 1069993 - RNA, 19 nt, Homo sapiens
gaaggacccuccacgcuua

SEQ ID NO: 1069994 - RNA, 19 nt, Homo sapiens
ucaccaagcuuaagagaaa

SEQ ID NO: 1069995 - RNA, 19 nt, Homo sapiens
ucacuuaacuuacaagaug

SEQ ID NO: 1069996 - RNA, 19 nt, Homo sapiens
uuacacagcuugccagaaa

SEQ ID NO: 1069997 - RNA, 19 nt, Homo sapiens
guaagaaucugaguuuguu

SEQ ID NO: 1069998 - RNA, 19 nt, Homo sapiens
gcagggaucugggaaauuc

SEQ ID NO: 1069999 - RNA, 19 nt, Homo sapiens
gaagaguguuugagaagga

SEQ ID NO: 1070000 - RNA, 19 nt, Homo sapiens
guuagugucuguuuagaaa

SEQ ID NO: 1070001 - RNA, 19 nt, Homo sapiens
auucagaacuugugacuuu

SEQ ID NO: 1070002 - RNA, 19 nt, Homo sapiens
agaaagaucuguguuguca

SEQ ID NO: 1070003 - RNA, 19 nt, Homo sapiens
gaucuguguugucacuuaa

SEQ ID NO: 1070004 - RNA, 19 nt, Homo sapiens
ccagugaucuccuuuagca

SEQ ID NO: 1070005 - RNA, 19 nt, Homo sapiens
ccacagaucauucuaagug

SEQ ID NO: 1070006 - RNA, 19 nt, Homo sapiens
ucaaaccacugaccuggaa

SEQ ID NO: 1070007 - RNA, 19 nt, Homo sapiens
gaacagacgagaucuaugc

SEQ ID NO: 1070008 - RNA, 19 nt, Homo sapiens
gaagcagggugcacauauc

SEQ ID NO: 1070009 - RNA, 19 nt, Homo sapiens
cagaagcagucaaggugua

SEQ ID NO: 1070010 - RNA, 19 nt, Homo sapiens
uaacuuacaagaugucuga

SEQ ID NO: 1070011 - RNA, 19 nt, Homo sapiens
gcggugauauuaccaaaca

SEQ ID NO: 1070012 - RNA, 19 nt, Homo sapiens
caguagaaggccaauauua

SEQ ID NO: 1070013 - RNA, 19 nt, Homo sapiens
guaccacuaugacauggaa

SEQ ID NO: 1070014 - RNA, 19 nt, Homo sapiens
gcagagcccuuuuaggauu

SEQ ID NO: 1070015 - RNA, 19 nt, Homo sapiens
acagauaugugcauuacug

SEQ ID NO: 1070016 - RNA, 19 nt, Homo sapiens
gugcauuacugaaguguca

SEQ ID NO: 1070017 - RNA, 19 nt, Homo sapiens
gacaagaagccaugcaaug

SEQ ID NO: 1070018 - RNA, 19 nt, Homo sapiens
uaugagauuucaagagaug

SEQ ID NO: 1070019 - RNA, 19 nt, Homo sapiens
gcagggugcacauaucauu

SEQ ID NO: 1070020 - RNA, 19 nt, Homo sapiens
gcacauuuggaacgcguua

SEQ ID NO: 1070021 - RNA, 19 nt, Homo sapiens
agaaggccaauauuacuua

SEQ ID NO: 1070022 - RNA, 19 nt, Homo sapiens
aagaagccaugcaaugcua

SEQ ID NO: 1070023 - RNA, 19 nt, Homo sapiens
gauggaaucuaugguugga

SEQ ID NO: 1070024 - RNA, 19 nt, Homo sapiens
gggcagggaucugggaaau

SEQ ID NO: 1070025 - RNA, 19 nt, Homo sapiens
caaggacaacucuaucuau

SEQ ID NO: 1070026 - RNA, 19 nt, Homo sapiens
agaucuguguugucacuua

SEQ ID NO: 1070027 - RNA, 19 nt, Homo sapiens
gauauuaccaaacagaaca

SEQ ID NO: 1070028 - RNA, 19 nt, Homo sapiens
gaagcgaacagacgagauc

SEQ ID NO: 1070029 - RNA, 19 nt, Homo sapiens
ccaaggacaacucuaucua

SEQ ID NO: 1070030 - RNA, 19 nt, Homo sapiens
aagcuuugcuccugaugaa

SEQ ID NO: 1070031 - RNA, 19 nt, Homo sapiens
cgagaucuaugcccuaggu

SEQ ID NO: 1070032 - RNA, 19 nt, Homo sapiens
cuuacaagaugucugagaa

SEQ ID NO: 1070033 - RNA, 19 nt, Homo sapiens
gcaaugcuagugacucuca

SEQ ID NO: 1070034 - RNA, 19 nt, Homo sapiens
aaggacaacucuaucuaug

SEQ ID NO: 1070035 - RNA, 19 nt, Homo sapiens
acuaugacauggaaacaga

SEQ ID NO: 1070036 - RNA, 19 nt, Homo sapiens
ggacaagaagccaugcaau

SEQ ID NO: 1070037 - RNA, 19 nt, Homo sapiens
aaacugaagcagauuugaa

SEQ ID NO: 1070038 - RNA, 19 nt, Homo sapiens
cagucaagguguaccacua

SEQ ID NO: 1070039 - RNA, 19 nt, Homo sapiens
caacacaccagugcaacaa

SEQ ID NO: 1070040 - RNA, 19 nt, Homo sapiens
ggaaacguguggagaaccu

SEQ ID NO: 1070041 - RNA, 19 nt, Homo sapiens
uuacagauaugugcauuac

SEQ ID NO: 1070042 - RNA, 19 nt, Homo sapiens
gaaggccaauauuacuuac

SEQ ID NO: 1070043 - RNA, 19 nt, Homo sapiens
gcgaacagacgagaucuau

SEQ ID NO: 1070044 - RNA, 19 nt, Homo sapiens
gcacuggacacuuuuauug

SEQ ID NO: 1070045 - RNA, 19 nt, Homo sapiens
uuacugaagugucaaacca

SEQ ID NO: 1070046 - RNA, 19 nt, Homo sapiens
cacaguagaaggccaauau

SEQ ID NO: 1070047 - RNA, 19 nt, Homo sapiens
uguguugucacuuaacuua

SEQ ID NO: 1070048 - RNA, 19 nt, Homo sapiens
gagauccguuagugucugu

SEQ ID NO: 1070049 - RNA, 19 nt, Homo sapiens
aaagaucuguguugucacu

SEQ ID NO: 1070050 - RNA, 19 nt, Homo sapiens
gagaaauacaggaaauuac

SEQ ID NO: 1070051 - RNA, 19 nt, Homo sapiens
gacagggaguggaaucuac

SEQ ID NO: 1070052 - RNA, 19 nt, Homo sapiens
cuaucuaugucguggcuaa

SEQ ID NO: 1070053 - RNA, 19 nt, Homo sapiens
cgaagcagggugcacauau

SEQ ID NO: 1070054 - RNA, 19 nt, Homo sapiens
gaagcuuugcuccugauga

SEQ ID NO: 1070055 - RNA, 19 nt, Homo sapiens
gauaugugcauuacugaag

SEQ ID NO: 1070056 - RNA, 19 nt, Homo sapiens
guagaaggccaauauuacu

SEQ ID NO: 1070057 - RNA, 19 nt, Homo sapiens
guggucagcuguugcuauc

SEQ ID NO: 1070058 - RNA, 19 nt, Homo sapiens
uuaccaaacagaacagaaa

SEQ ID NO: 1070059 - RNA, 19 nt, Homo sapiens
uuggugcacuggacacuuu

SEQ ID NO: 1070060 - RNA, 19 nt, Homo sapiens
guuauggcccuguauggaa

SEQ ID NO: 1070061 - RNA, 19 nt, Homo sapiens
ccugaaagacauuaugaga

SEQ ID NO: 1070062 - RNA, 19 nt, Homo sapiens
ccagcagugucaagccauu

SEQ ID NO: 1070063 - RNA, 19 nt, Homo sapiens
caccuacccugcagcuguu

SEQ ID NO: 1070064 - RNA, 19 nt, Homo sapiens
ggucagcuguugcuaucag

SEQ ID NO: 1070065 - RNA, 19 nt, Homo sapiens
ucuaugucguggcuaauau

SEQ ID NO: 1070066 - RNA, 19 nt, Homo sapiens
ucagcugccuggccaagga

SEQ ID NO: 1070067 - RNA, 19 nt, Homo sapiens
ggugauauuaccaaacaga

SEQ ID NO: 1070068 - RNA, 19 nt, Homo sapiens
gaaacaaaacguaagaauc

SEQ ID NO: 1070069 - RNA, 19 nt, Homo sapiens
gacauuaugagauuucaag

SEQ ID NO: 1070070 - RNA, 19 nt, Homo sapiens
aaacguaagaaucugaguu

SEQ ID NO: 1070071 - RNA, 19 nt, Homo sapiens
ggccaugggagucaaucua

SEQ ID NO: 1070072 - RNA, 19 nt, Homo sapiens
caauugacagcauucucua

SEQ ID NO: 1070073 - RNA, 19 nt, Homo sapiens
gcaacacaccagugcaaca

SEQ ID NO: 1070074 - RNA, 19 nt, Homo sapiens
gagcaugcggugauauuac

SEQ ID NO: 1070075 - RNA, 19 nt, Homo sapiens
ggucagcuuuuaccaaguu

SEQ ID NO: 1070076 - RNA, 19 nt, Homo sapiens
ugagcaugcggugauauua

SEQ ID NO: 1070077 - RNA, 19 nt, Homo sapiens
acacaccagugcaacaaag

SEQ ID NO: 1070078 - RNA, 19 nt, Homo sapiens
gcgaagcagggugcacaua

SEQ ID NO: 1070079 - RNA, 19 nt, Homo sapiens
uauggaagaguguuugaga

SEQ ID NO: 1070080 - RNA, 19 nt, Homo sapiens
cguaagaaucugaguuugu

SEQ ID NO: 1070081 - RNA, 19 nt, Homo sapiens
agagaguggucagcuguug

SEQ ID NO: 1070082 - RNA, 19 nt, Homo sapiens
uagcagagcccuuuuagga

SEQ ID NO: 1070083 - RNA, 19 nt, Homo sapiens
gcuguucccuuccauucag

SEQ ID NO: 1070084 - RNA, 19 nt, Homo sapiens
ggagagcauuuaccccuau

SEQ ID NO: 1070085 - RNA, 19 nt, Homo sapiens
ucaccagggagagcauuua

SEQ ID NO: 1070086 - RNA, 19 nt, Homo sapiens
gaugaacaagaacauagau

SEQ ID NO: 1070087 - RNA, 19 nt, Homo sapiens
gauccguuagugucuguuu

SEQ ID NO: 1070088 - RNA, 19 nt, Homo sapiens
aacguaagaaucugaguuu

SEQ ID NO: 1070089 - RNA, 19 nt, Homo sapiens
gcauuacugaagugucaaa

SEQ ID NO: 1070090 - RNA, 19 nt, Homo sapiens
uagaaggccaauauuacuu

SEQ ID NO: 1070091 - RNA, 19 nt, Homo sapiens
ugacagggaguggaaucua

SEQ ID NO: 1070092 - RNA, 19 nt, Homo sapiens
cugauggccguuaccaaua

SEQ ID NO: 1070093 - RNA, 19 nt, Homo sapiens
gaggaaaugucuauugaau

SEQ ID NO: 1070094 - RNA, 19 nt, Homo sapiens
ccaccuagcugagugauaa

SEQ ID NO: 1070095 - RNA, 19 nt, Homo sapiens
gaaugagccuguuuccaaa

SEQ ID NO: 1070096 - RNA, 19 nt, Homo sapiens
guaagaaucugaguuuguu

SEQ ID NO: 1070097 - RNA, 19 nt, Homo sapiens
gaaauuguauaggacuuga

SEQ ID NO: 1070098 - RNA, 19 nt, Homo sapiens
gaagcagggugcacauauc

SEQ ID NO: 1070099 - RNA, 19 nt, Homo sapiens
ugaaugagccuguuuccaa

SEQ ID NO: 1070100 - RNA, 19 nt, Homo sapiens
gcggugauauuaccaaaca

SEQ ID NO: 1070101 - RNA, 19 nt, Homo sapiens
gacaagaagccaugcaaug

SEQ ID NO: 1070102 - RNA, 19 nt, Homo sapiens
gcagggugcacauaucauu

SEQ ID NO: 1070103 - RNA, 19 nt, Homo sapiens
caauauggccaauggaaau

SEQ ID NO: 1070104 - RNA, 19 nt, Homo sapiens
gauggaaucuaugguugga

SEQ ID NO: 1070105 - RNA, 19 nt, Homo sapiens
caaggacaacucuaucuau

SEQ ID NO: 1070106 - RNA, 19 nt, Homo sapiens
uugaggaaaugucuauuga

SEQ ID NO: 1070107 - RNA, 19 nt, Homo sapiens
caaucaauauggccaaugg

SEQ ID NO: 1070108 - RNA, 19 nt, Homo sapiens
gauauuaccaaacagaaca

SEQ ID NO: 1070109 - RNA, 19 nt, Homo sapiens
ccaaggacaacucuaucua

SEQ ID NO: 1070110 - RNA, 19 nt, Homo sapiens
aagcuuugcuccugaugaa

SEQ ID NO: 1070111 - RNA, 19 nt, Homo sapiens
aaggacaacucuaucuaug

SEQ ID NO: 1070112 - RNA, 19 nt, Homo sapiens
ggacaagaagccaugcaau

SEQ ID NO: 1070113 - RNA, 19 nt, Homo sapiens
caacacaccagugcaacaa

SEQ ID NO: 1070114 - RNA, 19 nt, Homo sapiens
gcaaugccagugacucuca

SEQ ID NO: 1070115 - RNA, 19 nt, Homo sapiens
gcacuggacacuuuuauug

SEQ ID NO: 1070116 - RNA, 19 nt, Homo sapiens
cuaucuaugucguggcuaa

SEQ ID NO: 1070117 - RNA, 19 nt, Homo sapiens
ggaaauuguauaggacuug

SEQ ID NO: 1070118 - RNA, 19 nt, Homo sapiens
cgaagcagggugcacauau

SEQ ID NO: 1070119 - RNA, 19 nt, Homo sapiens
gaagcuuugcuccugauga

SEQ ID NO: 1070120 - RNA, 19 nt, Homo sapiens
uuaccaaacagaacagaaa

SEQ ID NO: 1070121 - RNA, 19 nt, Homo sapiens
aaagaugaaugagccuguu

SEQ ID NO: 1070122 - RNA, 19 nt, Homo sapiens
uuggugcacuggacacuuu

SEQ ID NO: 1070123 - RNA, 19 nt, Homo sapiens
ucuaugucguggcuaauau

SEQ ID NO: 1070124 - RNA, 19 nt, Homo sapiens
ucagcugccuggccaagga

SEQ ID NO: 1070125 - RNA, 19 nt, Homo sapiens
ucaauauggccaauggaaa

SEQ ID NO: 1070126 - RNA, 19 nt, Homo sapiens
ggugauauuaccaaacaga

SEQ ID NO: 1070127 - RNA, 19 nt, Homo sapiens
gcaacacaccagugcaaca

SEQ ID NO: 1070128 - RNA, 19 nt, Homo sapiens
aaacguaagaaucugaguu

SEQ ID NO: 1070129 - RNA, 19 nt, Homo sapiens
gaaacaaaacguaagaauc

SEQ ID NO: 1070130 - RNA, 19 nt, Homo sapiens
acacaccagugcaacaaag

SEQ ID NO: 1070131 - RNA, 19 nt, Homo sapiens
gcgaagcagggugcacaua

SEQ ID NO: 1070132 - RNA, 19 nt, Homo sapiens
gagcaugcggugauauuac

SEQ ID NO: 1070133 - RNA, 19 nt, Homo sapiens
ugagcaugcggugauauua

SEQ ID NO: 1070134 - RNA, 19 nt, Homo sapiens
cguaagaaucugaguuugu

SEQ ID NO: 1070135 - RNA, 19 nt, Homo sapiens
cagaaugcaaucaauaugg

SEQ ID NO: 1070136 - RNA, 19 nt, Homo sapiens
ggagagcauuuaccccuau

SEQ ID NO: 1070137 - RNA, 19 nt, Homo sapiens
ucaccagggagagcauuua

SEQ ID NO: 1070138 - RNA, 19 nt, Homo sapiens
gaugaacaagaacauagau

SEQ ID NO: 1070139 - RNA, 19 nt, Homo sapiens
cugauggccguuaccaaua

SEQ ID NO: 1070140 - RNA, 19 nt, Homo sapiens
aacguaagaaucugaguuu

SEQ ID NO: 1070141 - RNA, 19 nt, Homo sapiens
cugaugugguguuugauuc

SEQ ID NO: 1070142 - RNA, 19 nt, Homo sapiens
ugauggccguuaccaauac

SEQ ID NO: 1070143 - RNA, 19 nt, Homo sapiens
ucagaaugcaaucaauaug

SEQ ID NO: 1070144 - RNA, 19 nt, Homo sapiens
uauaugagcaugcggugau

SEQ ID NO: 1070145 - RNA, 19 nt, Homo sapiens
ccugauggccguuaccaau

SEQ ID NO: 1070146 - RNA, 19 nt, Homo sapiens
gggacaagaagccaugcaa

SEQ ID NO: 1070147 - RNA, 19 nt, Homo sapiens
gauggccguuaccaauaca

SEQ ID NO: 1070148 - RNA, 19 nt, Homo sapiens
ugaggaaaugucuauugaa

SEQ ID NO: 1070149 - RNA, 19 nt, Homo sapiens
cuacuucugggaccacauu

SEQ ID NO: 1070150 - RNA, 19 nt, Homo sapiens
cuaucacugucauucagaa

SEQ ID NO: 1070151 - RNA, 19 nt, Homo sapiens
ccaauacaacacugaugug

SEQ ID NO: 1070152 - RNA, 19 nt, Homo sapiens
gcaaucaauauggccaaug

SEQ ID NO: 1070153 - RNA, 19 nt, Homo sapiens
gcauuuaccccuaucuaga

SEQ ID NO: 1070154 - RNA, 19 nt, Homo sapiens
aaucuaugguuggaucuuc

SEQ ID NO: 1070155 - RNA, 19 nt, Homo sapiens
ugaugaacaagaacauaga

SEQ ID NO: 1070156 - RNA, 19 nt, Homo sapiens
gaugugguguuugauucuc

SEQ ID NO: 1070157 - RNA, 19 nt, Homo sapiens
gugauauuaccaaacagaa

SEQ ID NO: 1070158 - RNA, 19 nt, Homo sapiens
uaguaaguuugaggaaaug

SEQ ID NO: 1070159 - RNA, 19 nt, Homo sapiens
gcuaucacugucauucaga

SEQ ID NO: 1070160 - RNA, 19 nt, Homo sapiens
acaagaagccaugcaaugc

SEQ ID NO: 1070161 - RNA, 19 nt, Homo sapiens
auaugagcaugcggugaua

SEQ ID NO: 1070162 - RNA, 19 nt, Homo sapiens
gaacugcgaucccacauuu

SEQ ID NO: 1070163 - RNA, 19 nt, Homo sapiens
gggcugaguucacgaauua

SEQ ID NO: 1070164 - RNA, 19 nt, Homo sapiens
cuacauggcuccagaagua

SEQ ID NO: 1070165 - RNA, 19 nt, Homo sapiens
gggagaagcuugccuuuga

SEQ ID NO: 1070166 - RNA, 19 nt, Homo sapiens
uaaauaagauccugugugu

SEQ ID NO: 1070167 - RNA, 19 nt, Homo sapiens
gaaaauggguucacacaaa

SEQ ID NO: 1070168 - RNA, 19 nt, Homo sapiens
ggaguuacaggguuaaaua

SEQ ID NO: 1070169 - RNA, 19 nt, Homo sapiens
gcaaugaaguacaugaaca

SEQ ID NO: 1070170 - RNA, 19 nt, Homo sapiens
cgucaugacuuugcaauuu

SEQ ID NO: 1070171 - RNA, 19 nt, Homo sapiens
auaaaggucugauauguug

SEQ ID NO: 1070172 - RNA, 19 nt, Homo sapiens
aauaagauccuguguguaa

SEQ ID NO: 1070173 - RNA, 19 nt, Homo sapiens
gaugaaauccucaacaugu

SEQ ID NO: 1070174 - RNA, 19 nt, Homo sapiens
uggaguaucuucagaggua

SEQ ID NO: 1070175 - RNA, 19 nt, Homo sapiens
gggaggaauucaucauauu

SEQ ID NO: 1070176 - RNA, 19 nt, Homo sapiens
ggagaagcuugccuuugaa

SEQ ID NO: 1070177 - RNA, 19 nt, Homo sapiens
guccugagcuuguaagaug

SEQ ID NO: 1070178 - RNA, 19 nt, Homo sapiens
gaagcgagacacuaagaaa

SEQ ID NO: 1070179 - RNA, 19 nt, Homo sapiens
aaacaacgcugccaaaucc

SEQ ID NO: 1070180 - RNA, 19 nt, Homo sapiens
acacagcccugacagcaaa

SEQ ID NO: 1070181 - RNA, 19 nt, Homo sapiens
gaaacaacgcugccaaauc

SEQ ID NO: 1070182 - RNA, 19 nt, Homo sapiens
ggaagucgcccuaggaaca

SEQ ID NO: 1070183 - RNA, 19 nt, Homo sapiens
cagcagaacucuccaacuc

SEQ ID NO: 1070184 - RNA, 19 nt, Homo sapiens
gggaugagguucggaaugu

SEQ ID NO: 1070185 - RNA, 19 nt, Homo sapiens
guuacaggguuaaauaaga

SEQ ID NO: 1070186 - RNA, 19 nt, Homo sapiens
ccaacucucuaucagcuuu

SEQ ID NO: 1070187 - RNA, 19 nt, Homo sapiens
ugaaguacaugaacaagca

SEQ ID NO: 1070188 - RNA, 19 nt, Homo sapiens
ccacaguccugagcuugua

SEQ ID NO: 1070189 - RNA, 19 nt, Homo sapiens
gggagaacccaauuaggua

SEQ ID NO: 1070190 - RNA, 19 nt, Homo sapiens
gaaaauguaugcaaugaag

SEQ ID NO: 1070191 - RNA, 19 nt, Homo sapiens
cauuugagcuugaagagau

SEQ ID NO: 1070192 - RNA, 19 nt, Homo sapiens
gagaguauccaaucgguau

SEQ ID NO: 1070193 - RNA, 19 nt, Homo sapiens
gggacgcgguguucaagaa

SEQ ID NO: 1070194 - RNA, 19 nt, Homo sapiens
gaugagcagggaaagcuua

SEQ ID NO: 1070195 - RNA, 19 nt, Homo sapiens
cauuacagacuucaacaua

SEQ ID NO: 1070196 - RNA, 19 nt, Homo sapiens
ggagucagguuuguguuca

SEQ ID NO: 1070197 - RNA, 19 nt, Homo sapiens
uugaagagaugauucuaga

SEQ ID NO: 1070198 - RNA, 19 nt, Homo sapiens
ggucuuugauauuuguuug

SEQ ID NO: 1070199 - RNA, 19 nt, Homo sapiens
gaugagguucggaauguuu

SEQ ID NO: 1070200 - RNA, 19 nt, Homo sapiens
cagcauaaucgucaucauu

SEQ ID NO: 1070201 - RNA, 19 nt, Homo sapiens
guccagccuucaugacaua

SEQ ID NO: 1070202 - RNA, 19 nt, Homo sapiens
caacauagcgacgguagug

SEQ ID NO: 1070203 - RNA, 19 nt, Homo sapiens
ccuggaggcucuuaagaug

SEQ ID NO: 1070204 - RNA, 19 nt, Homo sapiens
ggcacauccuagcuuguua

SEQ ID NO: 1070205 - RNA, 19 nt, Homo sapiens
ccaauuagguaggaaacau

SEQ ID NO: 1070206 - RNA, 19 nt, Homo sapiens
aagaagcgauuggcaaaga

SEQ ID NO: 1070207 - RNA, 19 nt, Homo sapiens
uggcauuucuuguuuggaa

SEQ ID NO: 1070208 - RNA, 19 nt, Homo sapiens
gaguuacaggguuaaauaa

SEQ ID NO: 1070209 - RNA, 19 nt, Homo sapiens
ggaaacaacgcugccaaau

SEQ ID NO: 1070210 - RNA, 19 nt, Homo sapiens
gucaugacuuugcaauuug

SEQ ID NO: 1070211 - RNA, 19 nt, Homo sapiens
ccugcuggcuacuaacuaa

SEQ ID NO: 1070212 - RNA, 19 nt, Homo sapiens
agacuauccuuaccuuuua

SEQ ID NO: 1070213 - RNA, 19 nt, Homo sapiens
cgggaggaauucaucauau

SEQ ID NO: 1070214 - RNA, 19 nt, Homo sapiens
gcauuucuuguuuggaaua

SEQ ID NO: 1070215 - RNA, 19 nt, Homo sapiens
gacuauuucuggauugugu

SEQ ID NO: 1070216 - RNA, 19 nt, Homo sapiens
gaagcuugccuuugaacug

SEQ ID NO: 1070217 - RNA, 19 nt, Homo sapiens
cuucagagguaccacauca

SEQ ID NO: 1070218 - RNA, 19 nt, Homo sapiens
gaagacuauccuuaccuuu

SEQ ID NO: 1070219 - RNA, 19 nt, Homo sapiens
agaagacuauccuuaccuu

SEQ ID NO: 1070220 - RNA, 19 nt, Homo sapiens
ccgagacuauuucuggauu

SEQ ID NO: 1070221 - RNA, 19 nt, Homo sapiens
uuaggauucuuccaaaugu

SEQ ID NO: 1070222 - RNA, 19 nt, Homo sapiens
ucacccagcaggucaguuu

SEQ ID NO: 1070223 - RNA, 19 nt, Homo sapiens
ccuuugaacuggaagaugu

SEQ ID NO: 1070224 - RNA, 19 nt, Homo sapiens
caugggugcuuagaaaguu

SEQ ID NO: 1070225 - RNA, 19 nt, Homo sapiens
cagcugagcccacacuugu

SEQ ID NO: 1070226 - RNA, 19 nt, Homo sapiens
gagacuauuucuggauugu

SEQ ID NO: 1070227 - RNA, 19 nt, Homo sapiens
guuacauccugcugaaguu

SEQ ID NO: 1070228 - RNA, 19 nt, Homo sapiens
gaacccaauuagguaggaa

SEQ ID NO: 1070229 - RNA, 19 nt, Homo sapiens
agaagaagcgauuggcaaa

SEQ ID NO: 1070230 - RNA, 19 nt, Homo sapiens
gaaauccucaacauguuca

SEQ ID NO: 1070231 - RNA, 19 nt, Homo sapiens
cagaaguauuccaggugua

SEQ ID NO: 1070232 - RNA, 19 nt, Homo sapiens
gcagggaaagcuuagacuu

SEQ ID NO: 1070233 - RNA, 19 nt, Homo sapiens
ccaaagggguuaaacacuu

SEQ ID NO: 1070234 - RNA, 19 nt, Homo sapiens
gucagauucuucuuacaga

SEQ ID NO: 1070235 - RNA, 19 nt, Homo sapiens
gacaucaagccagacaaua

SEQ ID NO: 1070236 - RNA, 19 nt, Homo sapiens
ggaugagguucggaauguu

SEQ ID NO: 1070237 - RNA, 19 nt, Homo sapiens
aaguuggcauuucuuguuu

SEQ ID NO: 1070238 - RNA, 19 nt, Homo sapiens
gcuccucucccuacuguga

SEQ ID NO: 1070239 - RNA, 19 nt, Homo sapiens
gauacuuucuuccuucacu

SEQ ID NO: 1070240 - RNA, 19 nt, Homo sapiens
aaaauggguucacacaaaa

SEQ ID NO: 1070241 - RNA, 19 nt, Homo sapiens
uuacagagaguauccaauc

SEQ ID NO: 1070242 - RNA, 19 nt, Homo sapiens
gcuugucagauucuucuua

SEQ ID NO: 1070243 - RNA, 19 nt, Homo sapiens
gcugagcccacacuuguug

SEQ ID NO: 1070244 - RNA, 19 nt, Homo sapiens
caaugaaguacaugaacaa

SEQ ID NO: 1070245 - RNA, 19 nt, Homo sapiens
gaacucuccaacucucuau

SEQ ID NO: 1070246 - RNA, 19 nt, Homo sapiens
ucgaugaaauccucaacau

SEQ ID NO: 1070247 - RNA, 19 nt, Homo sapiens
gcuggaggccguacgaaau

SEQ ID NO: 1070248 - RNA, 19 nt, Homo sapiens
cggcagcaacggcggaaua

SEQ ID NO: 1070249 - RNA, 19 nt, Homo sapiens
cgagacuauuucuggauug

SEQ ID NO: 1070250 - RNA, 19 nt, Homo sapiens
cagcaacggcggaauaugg

SEQ ID NO: 1070251 - RNA, 19 nt, Homo sapiens
ucucagcgcugcggucuca

SEQ ID NO: 1070252 - RNA, 19 nt, Homo sapiens
gcaaaauaaaggucugaua

SEQ ID NO: 1070253 - RNA, 19 nt, Homo sapiens
ucacgcccaucgaugaaau

SEQ ID NO: 1070254 - RNA, 19 nt, Homo sapiens
uggaggcucuuaagaugau

SEQ ID NO: 1070255 - RNA, 19 nt, Homo sapiens
ccauccaacuggcccgaaa

SEQ ID NO: 1070256 - RNA, 19 nt, Homo sapiens
aaucaaaccgucaugacuu

SEQ ID NO: 1070257 - RNA, 19 nt, Homo sapiens
agaagcgauuggcaaagaa

SEQ ID NO: 1070258 - RNA, 19 nt, Homo sapiens
cagaagcgagacacuaaga

SEQ ID NO: 1070259 - RNA, 19 nt, Homo sapiens
cuuaagaugaugaugguuu

SEQ ID NO: 1070260 - RNA, 19 nt, Homo sapiens
ccacuucaaauuacaagau

SEQ ID NO: 1070261 - RNA, 19 nt, Homo sapiens
uguuuaggauucuuccaaa

SEQ ID NO: 1070262 - RNA, 19 nt, Homo sapiens
ggaguuguguucuuuguaa

SEQ ID NO: 1070263 - RNA, 19 nt, Homo sapiens
gaaagcagaucaagggaau

SEQ ID NO: 1070264 - RNA, 19 nt, Homo sapiens
gaacacagagcauuccuaa

SEQ ID NO: 1070265 - RNA, 19 nt, Homo sapiens
ggaggacucugauggagaa

SEQ ID NO: 1070266 - RNA, 19 nt, Homo sapiens
ugacgaugcugaagauuga

SEQ ID NO: 1070267 - RNA, 19 nt, Homo sapiens
gagcauuucucaagagcuu

SEQ ID NO: 1070268 - RNA, 19 nt, Homo sapiens
aaggagacaugaucuauga

SEQ ID NO: 1070269 - RNA, 19 nt, Homo sapiens
uuaaugggcuccuccuuga

SEQ ID NO: 1070270 - RNA, 19 nt, Homo sapiens
ccacugauacccuauuauu

SEQ ID NO: 1070271 - RNA, 19 nt, Homo sapiens
ggaacagccuggcgaucuu

SEQ ID NO: 1070272 - RNA, 19 nt, Homo sapiens
gaccaguguuccuuauuga

SEQ ID NO: 1070273 - RNA, 19 nt, Homo sapiens
ugaaauguguguguguuug

SEQ ID NO: 1070274 - RNA, 19 nt, Homo sapiens
agaccaguguuccuuauug

SEQ ID NO: 1070275 - RNA, 19 nt, Homo sapiens
gagaaaauguuugcaguga

SEQ ID NO: 1070276 - RNA, 19 nt, Homo sapiens
ggaaggcuuugccauggau

SEQ ID NO: 1070277 - RNA, 19 nt, Homo sapiens
gaggaguuguguucuuugu

SEQ ID NO: 1070278 - RNA, 19 nt, Homo sapiens
ggacucugauggagaacug

SEQ ID NO: 1070279 - RNA, 19 nt, Homo sapiens
ggugaaaagucauaucuga

SEQ ID NO: 1070280 - RNA, 19 nt, Homo sapiens
gaacagccuggcgaucuuu

SEQ ID NO: 1070281 - RNA, 19 nt, Homo sapiens
ggagcuuucugccuuguag

SEQ ID NO: 1070282 - RNA, 19 nt, Homo sapiens
gaaaagucauaucugagaa

SEQ ID NO: 1070283 - RNA, 19 nt, Homo sapiens
ucaagggaauccauaugau

SEQ ID NO: 1070284 - RNA, 19 nt, Homo sapiens
gaaauguguguguguuugu

SEQ ID NO: 1070285 - RNA, 19 nt, Homo sapiens
gaucaagggaauccauaug

SEQ ID NO: 1070286 - RNA, 19 nt, Homo sapiens
caagggaauccauaugaug

SEQ ID NO: 1070287 - RNA, 19 nt, Homo sapiens
gaguuguguucuuuguaaa

SEQ ID NO: 1070288 - RNA, 19 nt, Homo sapiens
ggagagagagacugagaag

SEQ ID NO: 1070289 - RNA, 19 nt, Homo sapiens
ccauccgccuccacugaua

SEQ ID NO: 1070290 - RNA, 19 nt, Homo sapiens
gcauuucucaagagcuuaa

SEQ ID NO: 1070291 - RNA, 19 nt, Homo sapiens
gauugaguguggagcuuuc

SEQ ID NO: 1070292 - RNA, 19 nt, Homo sapiens
cuccacugauacccuauua

SEQ ID NO: 1070293 - RNA, 19 nt, Homo sapiens
gggcacccauucugaagag

SEQ ID NO: 1070294 - RNA, 19 nt, Homo sapiens
caaggagacaugaucuaug

SEQ ID NO: 1070295 - RNA, 19 nt, Homo sapiens
caaacuguccacccaagga

SEQ ID NO: 1070296 - RNA, 19 nt, Homo sapiens
cagaucaagggaauccaua

SEQ ID NO: 1070297 - RNA, 19 nt, Homo sapiens
acagaccaguguuccuuau

SEQ ID NO: 1070298 - RNA, 19 nt, Homo sapiens
ugagaaggcuauggaucga

SEQ ID NO: 1070299 - RNA, 19 nt, Homo sapiens
guuugacgaugcugaagau

SEQ ID NO: 1070300 - RNA, 19 nt, Homo sapiens
gucaagaggaguuguguuc

SEQ ID NO: 1070301 - RNA, 19 nt, Homo sapiens
gcuccuccuugaaaugugu

SEQ ID NO: 1070302 - RNA, 19 nt, Homo sapiens
ucgccagucuguuguuguu

SEQ ID NO: 1070303 - RNA, 19 nt, Homo sapiens
gagagacugagaaggcuau

SEQ ID NO: 1070304 - RNA, 19 nt, Homo sapiens
agucuguuguuguucuuaa

SEQ ID NO: 1070305 - RNA, 19 nt, Homo sapiens
gaucgacuagcccguggaa

SEQ ID NO: 1070306 - RNA, 19 nt, Homo sapiens
agacugagaaggcuaugga

SEQ ID NO: 1070307 - RNA, 19 nt, Homo sapiens
acaaggagacaugaucuau

SEQ ID NO: 1070308 - RNA, 19 nt, Homo sapiens
uggaugaggaggacucuga

SEQ ID NO: 1070309 - RNA, 19 nt, Homo sapiens
cacagaccaguguuccuua

SEQ ID NO: 1070310 - RNA, 19 nt, Homo sapiens
gcagaucaagggaauccau

SEQ ID NO: 1070311 - RNA, 19 nt, Homo sapiens
gaggcuggcuuugcuacag

SEQ ID NO: 1070312 - RNA, 19 nt, Homo sapiens
cacccauucugaagaggaa

SEQ ID NO: 1070313 - RNA, 19 nt, Homo sapiens
caggagagagagacugaga

SEQ ID NO: 1070314 - RNA, 19 nt, Homo sapiens
ucugauggagaacugaaua

SEQ ID NO: 1070315 - RNA, 19 nt, Homo sapiens
gugagggcacccauucuga

SEQ ID NO: 1070316 - RNA, 19 nt, Homo sapiens
agucauaucugagaaaaug

SEQ ID NO: 1070317 - RNA, 19 nt, Homo sapiens
aaugggcuccuccuugaaa

SEQ ID NO: 1070318 - RNA, 19 nt, Homo sapiens
gccagucuguuguuguucu

SEQ ID NO: 1070319 - RNA, 19 nt, Homo sapiens
ugagggcacccauucugaa

SEQ ID NO: 1070320 - RNA, 19 nt, Homo sapiens
caccauccgccuccacuga

SEQ ID NO: 1070321 - RNA, 19 nt, Homo sapiens
ccacaaggagacaugaucu

SEQ ID NO: 1070322 - RNA, 19 nt, Homo sapiens
ccaguguuccuuauugaca

SEQ ID NO: 1070323 - RNA, 19 nt, Homo sapiens
cauaugaugcugacgacau

SEQ ID NO: 1070324 - RNA, 19 nt, Homo sapiens
aaacuguccacccaaggaa

SEQ ID NO: 1070325 - RNA, 19 nt, Homo sapiens
cuugaaauguguguguguu

SEQ ID NO: 1070326 - RNA, 19 nt, Homo sapiens
ugaggaggacucugaugga

SEQ ID NO: 1070327 - RNA, 19 nt, Homo sapiens
cacaaggagacaugaucua

SEQ ID NO: 1070328 - RNA, 19 nt, Homo sapiens
gggcuccuccuugaaaugu

SEQ ID NO: 1070329 - RNA, 19 nt, Homo sapiens
gaugaggaggacucugaug

SEQ ID NO: 1070330 - RNA, 19 nt, Homo sapiens
ccagucuguuguuguucuu

SEQ ID NO: 1070331 - RNA, 19 nt, Homo sapiens
ugaaaagucauaucugaga

SEQ ID NO: 1070332 - RNA, 19 nt, Homo sapiens
cgacauccaggagagcauu

SEQ ID NO: 1070333 - RNA, 19 nt, Homo sapiens
ggaacacugugauagauua

SEQ ID NO: 1070334 - RNA, 19 nt, Homo sapiens
gaucaucaaugcuguggua

SEQ ID NO: 1070335 - RNA, 19 nt, Homo sapiens
gaaguucaaugacaguuug

SEQ ID NO: 1070336 - RNA, 19 nt, Homo sapiens
caacauccuuuaugacuga

SEQ ID NO: 1070337 - RNA, 19 nt, Homo sapiens
ucucugagcuuguuuguug

SEQ ID NO: 1070338 - RNA, 19 nt, Homo sapiens
gaaugucaauuguguaauc

SEQ ID NO: 1070339 - RNA, 19 nt, Homo sapiens
gaaacaggaaugucaauug

SEQ ID NO: 1070340 - RNA, 19 nt, Homo sapiens
gaacaaaaccuuauggaaa

SEQ ID NO: 1070341 - RNA, 19 nt, Homo sapiens
ggaauugggauauauuuga

SEQ ID NO: 1070342 - RNA, 19 nt, Homo sapiens
caaucacugugcuuauuua

SEQ ID NO: 1070343 - RNA, 19 nt, Homo sapiens
guaaauagaaguccuuaug

SEQ ID NO: 1070344 - RNA, 19 nt, Homo sapiens
ccucugauguccugguuua

SEQ ID NO: 1070345 - RNA, 19 nt, Homo sapiens
ggugcacgcugauggauuu

SEQ ID NO: 1070346 - RNA, 19 nt, Homo sapiens
aaacaggaaugucaauugu

SEQ ID NO: 1070347 - RNA, 19 nt, Homo sapiens
uaugugcuauggcuacuua

SEQ ID NO: 1070348 - RNA, 19 nt, Homo sapiens
gcaaucacugugcuuauuu

SEQ ID NO: 1070349 - RNA, 19 nt, Homo sapiens
ggaccuagaagucugcuuu

SEQ ID NO: 1070350 - RNA, 19 nt, Homo sapiens
uagaaguccuuauguaugu

SEQ ID NO: 1070351 - RNA, 19 nt, Homo sapiens
gcaacugccuccuaauuuu

SEQ ID NO: 1070352 - RNA, 19 nt, Homo sapiens
ugugauagauuaacuguag

SEQ ID NO: 1070353 - RNA, 19 nt, Homo sapiens
ucaaugacaguuuguguuu

SEQ ID NO: 1070354 - RNA, 19 nt, Homo sapiens
gauauaaugggcuucacua

SEQ ID NO: 1070355 - RNA, 19 nt, Homo sapiens
cgaguggaauugggauaua

SEQ ID NO: 1070356 - RNA, 19 nt, Homo sapiens
gaacugcuaccgauacauc

SEQ ID NO: 1070357 - RNA, 19 nt, Homo sapiens
gaucaucccauucuucugu

SEQ ID NO: 1070358 - RNA, 19 nt, Homo sapiens
gcauugccauugcgauuuc

SEQ ID NO: 1070359 - RNA, 19 nt, Homo sapiens
ggaggugacuuugaguuca

SEQ ID NO: 1070360 - RNA, 19 nt, Homo sapiens
gaacacugugauagauuaa

SEQ ID NO: 1070361 - RNA, 19 nt, Homo sapiens
uaccagaucuuugacuuug

SEQ ID NO: 1070362 - RNA, 19 nt, Homo sapiens
ucaaggaggucauccaacu

SEQ ID NO: 1070363 - RNA, 19 nt, Homo sapiens
gagcuuguuuguugcugaa

SEQ ID NO: 1070364 - RNA, 19 nt, Homo sapiens
ggacgcgguucuacuccaa

SEQ ID NO: 1070365 - RNA, 19 nt, Homo sapiens
acaggaaugucaauugugu

SEQ ID NO: 1070366 - RNA, 19 nt, Homo sapiens
ggaaacaggaaugucaauu

SEQ ID NO: 1070367 - RNA, 19 nt, Homo sapiens
caaaucugauggaccuaga

SEQ ID NO: 1070368 - RNA, 19 nt, Homo sapiens
uaaguguucugcccuagau

SEQ ID NO: 1070369 - RNA, 19 nt, Homo sapiens
gaacauguugguugcaauc

SEQ ID NO: 1070370 - RNA, 19 nt, Homo sapiens
cuucagccauuccagcaua

SEQ ID NO: 1070371 - RNA, 19 nt, Homo sapiens
gauguccugguuuauguua

SEQ ID NO: 1070372 - RNA, 19 nt, Homo sapiens
cagugaauccuaccuguuu

SEQ ID NO: 1070373 - RNA, 19 nt, Homo sapiens
caacaugugcauugccauu

SEQ ID NO: 1070374 - RNA, 19 nt, Homo sapiens
gaguggaauugggauauau

SEQ ID NO: 1070375 - RNA, 19 nt, Homo sapiens
cccacaacauccuuuauga

SEQ ID NO: 1070376 - RNA, 19 nt, Homo sapiens
ucaaugcugugguacuguu

SEQ ID NO: 1070377 - RNA, 19 nt, Homo sapiens
gauguuagauugaaaacug

SEQ ID NO: 1070378 - RNA, 19 nt, Homo sapiens
gagccucucugagcuuguu

SEQ ID NO: 1070379 - RNA, 19 nt, Homo sapiens
ucacugugcuuauuuaucc

SEQ ID NO: 1070380 - RNA, 19 nt, Homo sapiens
cgauuucucuucucaugau

SEQ ID NO: 1070381 - RNA, 19 nt, Homo sapiens
gaacugggaggugacuuug

SEQ ID NO: 1070382 - RNA, 19 nt, Homo sapiens
ccuguugguucauuauuga

SEQ ID NO: 1070383 - RNA, 19 nt, Homo sapiens
guucugcccuagauugguu

SEQ ID NO: 1070384 - RNA, 19 nt, Homo sapiens
uaccuugacuaccugaauu

SEQ ID NO: 1070385 - RNA, 19 nt, Homo sapiens
uccauggccugaauuaaga

SEQ ID NO: 1070386 - RNA, 19 nt, Homo sapiens
cuagaagucugcuuuugua

SEQ ID NO: 1070387 - RNA, 19 nt, Homo sapiens
guuuguugcugaaaugcua

SEQ ID NO: 1070388 - RNA, 19 nt, Homo sapiens
gcugugguacuguugauuu

SEQ ID NO: 1070389 - RNA, 19 nt, Homo sapiens
guuagaggguggaauggau

SEQ ID NO: 1070390 - RNA, 19 nt, Homo sapiens
caucaaugcugugguacug

SEQ ID NO: 1070391 - RNA, 19 nt, Homo sapiens
ggcagcagcuugacuuugc

SEQ ID NO: 1070392 - RNA, 19 nt, Homo sapiens
guuaccagaucuuugacuu

SEQ ID NO: 1070393 - RNA, 19 nt, Homo sapiens
ugacuguucuuguggaucu

SEQ ID NO: 1070394 - RNA, 19 nt, Homo sapiens
gaggugacuuugaguucau

SEQ ID NO: 1070395 - RNA, 19 nt, Homo sapiens
caaugacaguuuguguuug

SEQ ID NO: 1070396 - RNA, 19 nt, Homo sapiens
gcacgcugauggauuuacu

SEQ ID NO: 1070397 - RNA, 19 nt, Homo sapiens
ggauugccuuccuuguaug

SEQ ID NO: 1070398 - RNA, 19 nt, Homo sapiens
gauauacuucugccuaaca

SEQ ID NO: 1070399 - RNA, 19 nt, Homo sapiens
gaccaucugcugacuguuc

SEQ ID NO: 1070400 - RNA, 19 nt, Homo sapiens
gugaccaucugcugacugu

SEQ ID NO: 1070401 - RNA, 19 nt, Homo sapiens
gaauucuuccuguacgauu

SEQ ID NO: 1070402 - RNA, 19 nt, Homo sapiens
ugcaaucacugugcuuauu

SEQ ID NO: 1070403 - RNA, 19 nt, Homo sapiens
uugauauacuucugccuaa

SEQ ID NO: 1070404 - RNA, 19 nt, Homo sapiens
gcuggaacacugugauaga

SEQ ID NO: 1070405 - RNA, 19 nt, Homo sapiens
uugauuagcuguguuugga

SEQ ID NO: 1070406 - RNA, 19 nt, Homo sapiens
agacaucugagcaauaguu

SEQ ID NO: 1070407 - RNA, 19 nt, Homo sapiens
cagcuugacuuugcagaca

SEQ ID NO: 1070408 - RNA, 19 nt, Homo sapiens
ccuguuugguccuuauuau

SEQ ID NO: 1070409 - RNA, 19 nt, Homo sapiens
gaugucaugucagugaauc

SEQ ID NO: 1070410 - RNA, 19 nt, Homo sapiens
gaacggccagaugaaagaa

SEQ ID NO: 1070411 - RNA, 19 nt, Homo sapiens
cuagucaccuuuuaaaaug

SEQ ID NO: 1070412 - RNA, 19 nt, Homo sapiens
cgaacggccagaugaaaga

SEQ ID NO: 1070413 - RNA, 19 nt, Homo sapiens
ugaacugggaggugacuuu

SEQ ID NO: 1070414 - RNA, 19 nt, Homo sapiens
gcuacauccuacugcuuug

SEQ ID NO: 1070415 - RNA, 19 nt, Homo sapiens
cauaugcuuugcuggaaca

SEQ ID NO: 1070416 - RNA, 19 nt, Homo sapiens
gagggcagcagcuugacuu

SEQ ID NO: 1070417 - RNA, 19 nt, Homo sapiens
cugauguccugguuuaugu

SEQ ID NO: 1070418 - RNA, 19 nt, Homo sapiens
ucaucccauucuucuguua

SEQ ID NO: 1070419 - RNA, 19 nt, Homo sapiens
uugacuaccugaauugcaa

SEQ ID NO: 1070420 - RNA, 19 nt, Homo sapiens
guggaauugggauauauuu

SEQ ID NO: 1070421 - RNA, 19 nt, Homo sapiens
ccauugcgauuucucuucu

SEQ ID NO: 1070422 - RNA, 19 nt, Homo sapiens
ucauccaacugacuuuauc

SEQ ID NO: 1070423 - RNA, 19 nt, Homo sapiens
guuuggugguaaaggauuu

SEQ ID NO: 1070424 - RNA, 19 nt, Homo sapiens
gaugaugccacugugaaug

SEQ ID NO: 1070425 - RNA, 19 nt, Homo sapiens
gacuuuaucgaguggaauu

SEQ ID NO: 1070426 - RNA, 19 nt, Homo sapiens
gguaaaggauuuucuccau

SEQ ID NO: 1070427 - RNA, 19 nt, Homo sapiens
aaugacaguuuguguuugg

SEQ ID NO: 1070428 - RNA, 19 nt, Homo sapiens
aggaaugucaauuguguaa

SEQ ID NO: 1070429 - RNA, 19 nt, Homo sapiens
uauggaaacaggaauguca

SEQ ID NO: 1070430 - RNA, 19 nt, Homo sapiens
auaaugggcuucacuaacc

SEQ ID NO: 1070431 - RNA, 19 nt, Homo sapiens
gugcuuauuuauccaaacu

SEQ ID NO: 1070432 - RNA, 19 nt, Homo sapiens
gugcauugccauugcgauu

SEQ ID NO: 1070433 - RNA, 19 nt, Homo sapiens
ccacagggauugagaauuu

SEQ ID NO: 1070434 - RNA, 19 nt, Homo sapiens
ggaaauaguucuggaauau

SEQ ID NO: 1070435 - RNA, 19 nt, Homo sapiens
gagauaaccucgaguucuu

SEQ ID NO: 1070436 - RNA, 19 nt, Homo sapiens
gaggagagaacacgucuua

SEQ ID NO: 1070437 - RNA, 19 nt, Homo sapiens
gcaagaacguauuagaugu

SEQ ID NO: 1070438 - RNA, 19 nt, Homo sapiens
gggaaauaguucuggaaua

SEQ ID NO: 1070439 - RNA, 19 nt, Homo sapiens
ugacuucucugcccuuaaa

SEQ ID NO: 1070440 - RNA, 19 nt, Homo sapiens
gaguuuaccuuccagcaaa

SEQ ID NO: 1070441 - RNA, 19 nt, Homo sapiens
gacagugccuuuauguauu

SEQ ID NO: 1070442 - RNA, 19 nt, Homo sapiens
gcuacaaggugcagaguau

SEQ ID NO: 1070443 - RNA, 19 nt, Homo sapiens
gcacaaagccaucaagcau

SEQ ID NO: 1070444 - RNA, 19 nt, Homo sapiens
ccaaguggauauacugcua

SEQ ID NO: 1070445 - RNA, 19 nt, Homo sapiens
ugaaauugguuccaucaga

SEQ ID NO: 1070446 - RNA, 19 nt, Homo sapiens
ggaggaggcacagauauaa

SEQ ID NO: 1070447 - RNA, 19 nt, Homo sapiens
ccacagacauggccuuagu

SEQ ID NO: 1070448 - RNA, 19 nt, Homo sapiens
ggacuugguugacuucucu

SEQ ID NO: 1070449 - RNA, 19 nt, Homo sapiens
gaaguucgauaucaaacag

SEQ ID NO: 1070450 - RNA, 19 nt, Homo sapiens
caucugaccuucacguuca

SEQ ID NO: 1070451 - RNA, 19 nt, Homo sapiens
uuauuuaucuucccacuug

SEQ ID NO: 1070452 - RNA, 19 nt, Homo sapiens
gcagaugacagugccuuua

SEQ ID NO: 1070453 - RNA, 19 nt, Homo sapiens
gcaaugugaccaucaguga

SEQ ID NO: 1070454 - RNA, 19 nt, Homo sapiens
cuacugggcucaacugcaa

SEQ ID NO: 1070455 - RNA, 19 nt, Homo sapiens
guguguagcuagguuauuu

SEQ ID NO: 1070456 - RNA, 19 nt, Homo sapiens
ggagagaacacgucuuaca

SEQ ID NO: 1070457 - RNA, 19 nt, Homo sapiens
ugacagugccuuuauguau

SEQ ID NO: 1070458 - RNA, 19 nt, Homo sapiens
gaaagaaacaaaggagaga

SEQ ID NO: 1070459 - RNA, 19 nt, Homo sapiens
acaaagccaucaagcauca

SEQ ID NO: 1070460 - RNA, 19 nt, Homo sapiens
ggaagacuaauaaaggaaa

SEQ ID NO: 1070461 - RNA, 19 nt, Homo sapiens
caaaacauauugcaaagga

SEQ ID NO: 1070462 - RNA, 19 nt, Homo sapiens
gacauggccuuaguaccua

SEQ ID NO: 1070463 - RNA, 19 nt, Homo sapiens
gcagucguaucuccggaaa

SEQ ID NO: 1070464 - RNA, 19 nt, Homo sapiens
gaccaucaguucccugcaa

SEQ ID NO: 1070465 - RNA, 19 nt, Homo sapiens
guggaagacuaauaaagga

SEQ ID NO: 1070466 - RNA, 19 nt, Homo sapiens
gaagagagaggagagaaca

SEQ ID NO: 1070467 - RNA, 19 nt, Homo sapiens
guauggaaguucgauauca

SEQ ID NO: 1070468 - RNA, 19 nt, Homo sapiens
cgacuccagugcaacauau

SEQ ID NO: 1070469 - RNA, 19 nt, Homo sapiens
gcagccagcccuuugaaga

SEQ ID NO: 1070470 - RNA, 19 nt, Homo sapiens
ucucugcccuuaaaguaaa

SEQ ID NO: 1070471 - RNA, 19 nt, Homo sapiens
uaaagcaaguauggaaguu

SEQ ID NO: 1070472 - RNA, 19 nt, Homo sapiens
cgauucaucuucaucacuu

SEQ ID NO: 1070473 - RNA, 19 nt, Homo sapiens
gaacguauuagauguuucu

SEQ ID NO: 1070474 - RNA, 19 nt, Homo sapiens
aaagugauuucaugcuaga

SEQ ID NO: 1070475 - RNA, 19 nt, Homo sapiens
uauaagagcaggaugaaca

SEQ ID NO: 1070476 - RNA, 19 nt, Homo sapiens
gcacgagggaccaucaguu

SEQ ID NO: 1070477 - RNA, 19 nt, Homo sapiens
gaagacuaauaaaggaaag

SEQ ID NO: 1070478 - RNA, 19 nt, Homo sapiens
guauuggagugucuacaga

SEQ ID NO: 1070479 - RNA, 19 nt, Homo sapiens
agaagaauuugacaagcuu

SEQ ID NO: 1070480 - RNA, 19 nt, Homo sapiens
gaccaucagugaccuguac

SEQ ID NO: 1070481 - RNA, 19 nt, Homo sapiens
acagugccuuuauguauug

SEQ ID NO: 1070482 - RNA, 19 nt, Homo sapiens
gaaacccgcaggcugaguu

SEQ ID NO: 1070483 - RNA, 19 nt, Homo sapiens
gcaaagugacacccucgaa

SEQ ID NO: 1070484 - RNA, 19 nt, Homo sapiens
ccaaauccauaaguuagau

SEQ ID NO: 1070485 - RNA, 19 nt, Homo sapiens
gauauaagagcaggaugaa

SEQ ID NO: 1070486 - RNA, 19 nt, Homo sapiens
uggagugucuacagauaaa

SEQ ID NO: 1070487 - RNA, 19 nt, Homo sapiens
guaggugccugcccaagag

SEQ ID NO: 1070488 - RNA, 19 nt, Homo sapiens
caaaagaucucuggaagca

SEQ ID NO: 1070489 - RNA, 19 nt, Homo sapiens
caagaacguauuagauguu

SEQ ID NO: 1070490 - RNA, 19 nt, Homo sapiens
uauggaaguucgauaucaa

SEQ ID NO: 1070491 - RNA, 19 nt, Homo sapiens
ucaaaaguauugccucaaa

SEQ ID NO: 1070492 - RNA, 19 nt, Homo sapiens
caaaggagccagacguucu

SEQ ID NO: 1070493 - RNA, 19 nt, Homo sapiens
cuuugaagaugaugacauu

SEQ ID NO: 1070494 - RNA, 19 nt, Homo sapiens
gugacacccucgaaguauu

SEQ ID NO: 1070495 - RNA, 19 nt, Homo sapiens
gcauuaagagauugcaaga

SEQ ID NO: 1070496 - RNA, 19 nt, Homo sapiens
gucaguugcuugggccuua

SEQ ID NO: 1070497 - RNA, 19 nt, Homo sapiens
gaugacagugccuuuaugu

SEQ ID NO: 1070498 - RNA, 19 nt, Homo sapiens
ggaagggauguacguguga

SEQ ID NO: 1070499 - RNA, 19 nt, Homo sapiens
gcagguaacagagcuggaa

SEQ ID NO: 1070500 - RNA, 19 nt, Homo sapiens
caauugaggcuccuucauc

SEQ ID NO: 1070501 - RNA, 19 nt, Homo sapiens
gaaagggacaggggcauua

SEQ ID NO: 1070502 - RNA, 19 nt, Homo sapiens
agucguaucuccggaaaga

SEQ ID NO: 1070503 - RNA, 19 nt, Homo sapiens
gguggaagacuaauaaagg

SEQ ID NO: 1070504 - RNA, 19 nt, Homo sapiens
gagauugcaagaacguauu

SEQ ID NO: 1070505 - RNA, 19 nt, Homo sapiens
ggagccagacguucucaga

SEQ ID NO: 1070506 - RNA, 19 nt, Homo sapiens
agaaugggauccuuugcau

SEQ ID NO: 1070507 - RNA, 19 nt, Homo sapiens
cuacagauaaagcaaguau

SEQ ID NO: 1070508 - RNA, 19 nt, Homo sapiens
ugguuaauuucuccuguaa

SEQ ID NO: 1070509 - RNA, 19 nt, Homo sapiens
ccagagaaugggauccuuu

SEQ ID NO: 1070510 - RNA, 19 nt, Homo sapiens
gugaggacuugguugacuu

SEQ ID NO: 1070511 - RNA, 19 nt, Homo sapiens
gacagccucucccuacaag

SEQ ID NO: 1070512 - RNA, 19 nt, Homo sapiens
guugacuucucugcccuua

SEQ ID NO: 1070513 - RNA, 19 nt, Homo sapiens
gagagaacacgucuuacag

SEQ ID NO: 1070514 - RNA, 19 nt, Homo sapiens
ggaaguucgauaucaaaca

SEQ ID NO: 1070515 - RNA, 19 nt, Homo sapiens
agauaaagcaaguauggaa

SEQ ID NO: 1070516 - RNA, 19 nt, Homo sapiens
cgucagagggagauugaaa

SEQ ID NO: 1070517 - RNA, 19 nt, Homo sapiens
ugaagaugaugacauuugc

SEQ ID NO: 1070518 - RNA, 19 nt, Homo sapiens
gagaaugggauccuuugca

SEQ ID NO: 1070519 - RNA, 19 nt, Homo sapiens
ucagagauaaccucgaguu

SEQ ID NO: 1070520 - RNA, 19 nt, Homo sapiens
cuucacagcccaacucaga

SEQ ID NO: 1070521 - RNA, 19 nt, Homo sapiens
cagaugacagugccuuuau

SEQ ID NO: 1070522 - RNA, 19 nt, Homo sapiens
gagcgauucaucuucauca

SEQ ID NO: 1070523 - RNA, 19 nt, Homo sapiens
gguaggugccugcccaaga

SEQ ID NO: 1070524 - RNA, 19 nt, Homo sapiens
ugacuccgcugccuucacu

SEQ ID NO: 1070525 - RNA, 19 nt, Homo sapiens
gaauuugacaagcuucauc

SEQ ID NO: 1070526 - RNA, 19 nt, Homo sapiens
uacaaggugcagaguauuu

SEQ ID NO: 1070527 - RNA, 19 nt, Homo sapiens
cgacagggccauggagaga

SEQ ID NO: 1070528 - RNA, 19 nt, Homo sapiens
auuaagagauugcaagaac

SEQ ID NO: 1070529 - RNA, 19 nt, Homo sapiens
gcccaacucagaagagaga

SEQ ID NO: 1070530 - RNA, 19 nt, Homo sapiens
caaguauggaaguucgaua

SEQ ID NO: 1070531 - RNA, 19 nt, Homo sapiens
aagaagaauuugacaagcu

SEQ ID NO: 1070532 - RNA, 19 nt, Homo sapiens
cuucaucacuuccaaagac

SEQ ID NO: 1070533 - RNA, 19 nt, Homo sapiens
caacaucacugcauugaga

SEQ ID NO: 1070534 - RNA, 19 nt, Homo sapiens
gaacuuacaaagacacuua

SEQ ID NO: 1070535 - RNA, 19 nt, Homo sapiens
ugagaaagcuuuaaguaga

SEQ ID NO: 1070536 - RNA, 19 nt, Homo sapiens
ugaaucaccucguugguua

SEQ ID NO: 1070537 - RNA, 19 nt, Homo sapiens
gcacagaaguuggagaaga

SEQ ID NO: 1070538 - RNA, 19 nt, Homo sapiens
gacccaaacucccaaauug

SEQ ID NO: 1070539 - RNA, 19 nt, Homo sapiens
ggacuggcuugucuuauug

SEQ ID NO: 1070540 - RNA, 19 nt, Homo sapiens
ccaaagcgguuuacucaga

SEQ ID NO: 1070541 - RNA, 19 nt, Homo sapiens
gcagugagauccauaagca

SEQ ID NO: 1070542 - RNA, 19 nt, Homo sapiens
ggccaucaguugcuuauuu

SEQ ID NO: 1070543 - RNA, 19 nt, Homo sapiens
gagaauguguauaugugua

SEQ ID NO: 1070544 - RNA, 19 nt, Homo sapiens
guauguaccuuuguaauug

SEQ ID NO: 1070545 - RNA, 19 nt, Homo sapiens
ucagaugugucacuaaauu

SEQ ID NO: 1070546 - RNA, 19 nt, Homo sapiens
cuacuaaccucuuggagaa

SEQ ID NO: 1070547 - RNA, 19 nt, Homo sapiens
gugguaggcucauuuguuu

SEQ ID NO: 1070548 - RNA, 19 nt, Homo sapiens
caacagauccuacaaaguc

SEQ ID NO: 1070549 - RNA, 19 nt, Homo sapiens
ggacaaggagagcucuuua

SEQ ID NO: 1070550 - RNA, 19 nt, Homo sapiens
aauggaagguucaguaauu

SEQ ID NO: 1070551 - RNA, 19 nt, Homo sapiens
aaaccaguguuaugacuuu

SEQ ID NO: 1070552 - RNA, 19 nt, Homo sapiens
gaccaucagugcugccuuu

SEQ ID NO: 1070553 - RNA, 19 nt, Homo sapiens
gaacgguggucuuucucuu

SEQ ID NO: 1070554 - RNA, 19 nt, Homo sapiens
aauaugcccuguuaggaua

SEQ ID NO: 1070555 - RNA, 19 nt, Homo sapiens
ggaagaacuuacaaagaca

SEQ ID NO: 1070556 - RNA, 19 nt, Homo sapiens
gcugggagaagaagcauua

SEQ ID NO: 1070557 - RNA, 19 nt, Homo sapiens
gaaaauagaccccuucuca

SEQ ID NO: 1070558 - RNA, 19 nt, Homo sapiens
gaucuagguggaaguauuu

SEQ ID NO: 1070559 - RNA, 19 nt, Homo sapiens
gaaguuuccuggaucucuu

SEQ ID NO: 1070560 - RNA, 19 nt, Homo sapiens
gcagggagacuggaaguuu

SEQ ID NO: 1070561 - RNA, 19 nt, Homo sapiens
ugaggaagaggaagaauuu

SEQ ID NO: 1070562 - RNA, 19 nt, Homo sapiens
gaacauuggcguagacaca

SEQ ID NO: 1070563 - RNA, 19 nt, Homo sapiens
ugagggauuuggacaauau

SEQ ID NO: 1070564 - RNA, 19 nt, Homo sapiens
ccucaggaaucuucuggua

SEQ ID NO: 1070565 - RNA, 19 nt, Homo sapiens
ggaggacuggcuugucuua

SEQ ID NO: 1070566 - RNA, 19 nt, Homo sapiens
gagaaagcuuuaaguagag

SEQ ID NO: 1070567 - RNA, 19 nt, Homo sapiens
gcucauuuguuucuagaga

SEQ ID NO: 1070568 - RNA, 19 nt, Homo sapiens
gaggaagaacuuacaaaga

SEQ ID NO: 1070569 - RNA, 19 nt, Homo sapiens
agacucagaugaucaagug

SEQ ID NO: 1070570 - RNA, 19 nt, Homo sapiens
gauuauugcucccuucauc

SEQ ID NO: 1070571 - RNA, 19 nt, Homo sapiens
caaaucagagccacgguaa

SEQ ID NO: 1070572 - RNA, 19 nt, Homo sapiens
gcacacugacuucugguuu

SEQ ID NO: 1070573 - RNA, 19 nt, Homo sapiens
gggauuuggacaauauuua

SEQ ID NO: 1070574 - RNA, 19 nt, Homo sapiens
aguuggagcuuucuuugua

SEQ ID NO: 1070575 - RNA, 19 nt, Homo sapiens
ggaacuccucccaguauaa

SEQ ID NO: 1070576 - RNA, 19 nt, Homo sapiens
uaguugggcucuucauaaa

SEQ ID NO: 1070577 - RNA, 19 nt, Homo sapiens
guucuuccaugacuccuaa

SEQ ID NO: 1070578 - RNA, 19 nt, Homo sapiens
gaagagacucagaugauca

SEQ ID NO: 1070579 - RNA, 19 nt, Homo sapiens
ggagugagagugaggaaga

SEQ ID NO: 1070580 - RNA, 19 nt, Homo sapiens
gggaguccaucucucuauu

SEQ ID NO: 1070581 - RNA, 19 nt, Homo sapiens
guuaugacuuuguuccauu

SEQ ID NO: 1070582 - RNA, 19 nt, Homo sapiens
cccaaucuguuuaaucaaa

SEQ ID NO: 1070583 - RNA, 19 nt, Homo sapiens
caaagugguaggcucauuu

SEQ ID NO: 1070584 - RNA, 19 nt, Homo sapiens
uagagaauguguauaugug

SEQ ID NO: 1070585 - RNA, 19 nt, Homo sapiens
gaauauaaaccuggaguca

SEQ ID NO: 1070586 - RNA, 19 nt, Homo sapiens
gagggcaguuaaacaguga

SEQ ID NO: 1070587 - RNA, 19 nt, Homo sapiens
gccaacagauccuacaaag

SEQ ID NO: 1070588 - RNA, 19 nt, Homo sapiens
uccaaauacugucauguuu

SEQ ID NO: 1070589 - RNA, 19 nt, Homo sapiens
gagauucuaguacuucaaa

SEQ ID NO: 1070590 - RNA, 19 nt, Homo sapiens
cagguuaacaucagcauuu

SEQ ID NO: 1070591 - RNA, 19 nt, Homo sapiens
ucaggaaucuucugguaca

SEQ ID NO: 1070592 - RNA, 19 nt, Homo sapiens
gcagggaacgguggucuuu

SEQ ID NO: 1070593 - RNA, 19 nt, Homo sapiens
ggagcuuucuuuguauuau

SEQ ID NO: 1070594 - RNA, 19 nt, Homo sapiens
ucacugcauugagagaaua

SEQ ID NO: 1070595 - RNA, 19 nt, Homo sapiens
ggagaagagauuucaugaa

SEQ ID NO: 1070596 - RNA, 19 nt, Homo sapiens
cguccaacaucgaaagaaa

SEQ ID NO: 1070597 - RNA, 19 nt, Homo sapiens
gagcuuucuuuguauuaug

SEQ ID NO: 1070598 - RNA, 19 nt, Homo sapiens
aagcaaaucugacccaaac

SEQ ID NO: 1070599 - RNA, 19 nt, Homo sapiens
gaaguuggagaagagauuu

SEQ ID NO: 1070600 - RNA, 19 nt, Homo sapiens
uuucuucagugguguauuu

SEQ ID NO: 1070601 - RNA, 19 nt, Homo sapiens
gcacuugcaggaucgauug

SEQ ID NO: 1070602 - RNA, 19 nt, Homo sapiens
gcucuugacaucuuauuug

SEQ ID NO: 1070603 - RNA, 19 nt, Homo sapiens
uuucagaugugucacuaaa

SEQ ID NO: 1070604 - RNA, 19 nt, Homo sapiens
ggagaucuacaauuugaau

SEQ ID NO: 1070605 - RNA, 19 nt, Homo sapiens
ggaagagaggaagaacuua

SEQ ID NO: 1070606 - RNA, 19 nt, Homo sapiens
gcaguuaaacagugacaug

SEQ ID NO: 1070607 - RNA, 19 nt, Homo sapiens
ccacuaauaugcacaucca

SEQ ID NO: 1070608 - RNA, 19 nt, Homo sapiens
gcagcuugguguauuaugg

SEQ ID NO: 1070609 - RNA, 19 nt, Homo sapiens
gcugguggccuuugucuug

SEQ ID NO: 1070610 - RNA, 19 nt, Homo sapiens
uaugaguucuuugcaguaa

SEQ ID NO: 1070611 - RNA, 19 nt, Homo sapiens
guagagaauguguauaugu

SEQ ID NO: 1070612 - RNA, 19 nt, Homo sapiens
ugacuuuguuccauuugaa

SEQ ID NO: 1070613 - RNA, 19 nt, Homo sapiens
cgaaagaaaaccaguguua

SEQ ID NO: 1070614 - RNA, 19 nt, Homo sapiens
gagaggaagaacuuacaaa

SEQ ID NO: 1070615 - RNA, 19 nt, Homo sapiens
gaagagaggaagaacuuac

SEQ ID NO: 1070616 - RNA, 19 nt, Homo sapiens
guugggcucuucauaaaca

SEQ ID NO: 1070617 - RNA, 19 nt, Homo sapiens
guaaauagaagacgucacu

SEQ ID NO: 1070618 - RNA, 19 nt, Homo sapiens
ggaagguucaguaauuuca

SEQ ID NO: 1070619 - RNA, 19 nt, Homo sapiens
gggguaagauaagcuauua

SEQ ID NO: 1070620 - RNA, 19 nt, Homo sapiens
ggucggaagcgaacauuau

SEQ ID NO: 1070621 - RNA, 19 nt, Homo sapiens
gccaucaguugcuuauuuc

SEQ ID NO: 1070622 - RNA, 19 nt, Homo sapiens
gaacuccucccaguauaau

SEQ ID NO: 1070623 - RNA, 19 nt, Homo sapiens
ggccaucucuacuacuguu

SEQ ID NO: 1070624 - RNA, 19 nt, Homo sapiens
ugaucuagguggaaguauu

SEQ ID NO: 1070625 - RNA, 19 nt, Homo sapiens
acacuuugauccugauguu

SEQ ID NO: 1070626 - RNA, 19 nt, Homo sapiens
uccuggaucucuuucguua

SEQ ID NO: 1070627 - RNA, 19 nt, Homo sapiens
ggaggacccuagccauucu

SEQ ID NO: 1070628 - RNA, 19 nt, Homo sapiens
ugcccaauaugcccuguua

SEQ ID NO: 1070629 - RNA, 19 nt, Homo sapiens
gccuuugucuugcuuaaug

SEQ ID NO: 1070630 - RNA, 19 nt, Homo sapiens
ggggagaucuacaauuuga

SEQ ID NO: 1070631 - RNA, 19 nt, Homo sapiens
gaggccaucucuacuacug

SEQ ID NO: 1070632 - RNA, 19 nt, Homo sapiens
cuaaauaaaggcagauaug

SEQ ID NO: 1070633 - RNA, 19 nt, Homo sapiens
ggacuuaaauucagaccua

SEQ ID NO: 1070634 - RNA, 19 nt, Homo sapiens
ggagaaagguggcugagaa

SEQ ID NO: 1070635 - RNA, 19 nt, Homo sapiens
ggaaaaggauuaugaguaa

SEQ ID NO: 1070636 - RNA, 19 nt, Homo sapiens
gaacaucagccaggacuua

SEQ ID NO: 1070637 - RNA, 19 nt, Homo sapiens
ucacaaagaucuggagaaa

SEQ ID NO: 1070638 - RNA, 19 nt, Homo sapiens
caugugauguucuucauuu

SEQ ID NO: 1070639 - RNA, 19 nt, Homo sapiens
caugugauguucuucauuu

SEQ ID NO: 1070640 - RNA, 19 nt, Homo sapiens
caugugauguucuucauuu

SEQ ID NO: 1070641 - RNA, 19 nt, Homo sapiens
caugugauguucuucauuu

SEQ ID NO: 1070642 - RNA, 19 nt, Homo sapiens
caugugauguucuucauuu

SEQ ID NO: 1070643 - RNA, 19 nt, Homo sapiens
caugugauguucuucauuu

SEQ ID NO: 1070644 - RNA, 19 nt, Homo sapiens
cagcaucgcuugcacaugu

SEQ ID NO: 1070645 - RNA, 19 nt, Homo sapiens
cagcaucgcuugcacaugu

SEQ ID NO: 1070646 - RNA, 19 nt, Homo sapiens
cagcaucgcuugcacaugu

SEQ ID NO: 1070647 - RNA, 19 nt, Homo sapiens
cagcaucgcuugcacaugu

SEQ ID NO: 1070648 - RNA, 19 nt, Homo sapiens
cagcaucgcuugcacaugu

SEQ ID NO: 1070649 - RNA, 19 nt, Homo sapiens
uaaauacccuggaauugug

SEQ ID NO: 1070650 - RNA, 19 nt, Homo sapiens
acaaagaucuggagaaagg

SEQ ID NO: 1070651 - RNA, 19 nt, Homo sapiens
gaacaucgccuucaaugac

SEQ ID NO: 1070652 - RNA, 19 nt, Homo sapiens
ggaacauucucuagguuau

SEQ ID NO: 1070653 - RNA, 19 nt, Homo sapiens
caauguaaaugguggaaau

SEQ ID NO: 1070654 - RNA, 19 nt, Homo sapiens
agaauggccuggaaaucua

SEQ ID NO: 1070655 - RNA, 19 nt, Homo sapiens
gaagugcgccuaccuccaa

SEQ ID NO: 1070656 - RNA, 19 nt, Homo sapiens
gaacauucucuagguuaua

SEQ ID NO: 1070657 - RNA, 19 nt, Homo sapiens
guagcaacauugaaagguu

SEQ ID NO: 1070658 - RNA, 19 nt, Homo sapiens
guaaauacccuggaauugu

SEQ ID NO: 1070659 - RNA, 19 nt, Homo sapiens
guaaaugguggaaaucaaa

SEQ ID NO: 1070660 - RNA, 19 nt, Homo sapiens
gaagggugcuaugaguauu

SEQ ID NO: 1070661 - RNA, 19 nt, Homo sapiens
gaauugagagccacugcua

SEQ ID NO: 1070662 - RNA, 19 nt, Homo sapiens
aggaugacauggaagcuua

SEQ ID NO: 1070663 - RNA, 19 nt, Homo sapiens
cacauuaucucacuuaguc

SEQ ID NO: 1070664 - RNA, 19 nt, Homo sapiens
cuucauaggcacuuacuua

SEQ ID NO: 1070665 - RNA, 19 nt, Homo sapiens
gaaagguggcugagaagga

SEQ ID NO: 1070666 - RNA, 19 nt, Homo sapiens
gcagaggcccuucuagugu

SEQ ID NO: 1070667 - RNA, 19 nt, Homo sapiens
uagcaacauugaaagguuu

SEQ ID NO: 1070668 - RNA, 19 nt, Homo sapiens
ccagggagauguuuauguc

SEQ ID NO: 1070669 - RNA, 19 nt, Homo sapiens
gagaagggugcuaugagua

SEQ ID NO: 1070670 - RNA, 19 nt, Homo sapiens
ucacacauuaucucacuua

SEQ ID NO: 1070671 - RNA, 19 nt, Homo sapiens
guaaauucacccaauagaa

SEQ ID NO: 1070672 - RNA, 19 nt, Homo sapiens
gccggaagcugaugaacau

SEQ ID NO: 1070673 - RNA, 19 nt, Homo sapiens
cugaacggcuucuguaaug

SEQ ID NO: 1070674 - RNA, 19 nt, Homo sapiens
agguauagcucuaagaaug

SEQ ID NO: 1070675 - RNA, 19 nt, Homo sapiens
agauugagcuggaccugaa

SEQ ID NO: 1070676 - RNA, 19 nt, Homo sapiens
ggaaacagagggucagagu

SEQ ID NO: 1070677 - RNA, 19 nt, Homo sapiens
ugaguaaguucugguaaau

SEQ ID NO: 1070678 - RNA, 19 nt, Homo sapiens
agagaaagggccugaguuu

SEQ ID NO: 1070679 - RNA, 19 nt, Homo sapiens
aaacacuacuugagcacuu

SEQ ID NO: 1070680 - RNA, 19 nt, Homo sapiens
aguaaguucugguaaauuc

SEQ ID NO: 1070681 - RNA, 19 nt, Homo sapiens
ugacugaacggcuucugua

SEQ ID NO: 1070682 - RNA, 19 nt, Homo sapiens
gagcagaggcccuucuagu

SEQ ID NO: 1070683 - RNA, 19 nt, Homo sapiens
ugacggugcccgacuauga

SEQ ID NO: 1070684 - RNA, 19 nt, Homo sapiens
ggugaggggugaugugaua

SEQ ID NO: 1070685 - RNA, 19 nt, Homo sapiens
ggaccagggagauguuuau

SEQ ID NO: 1070686 - RNA, 19 nt, Homo sapiens
cccaguagguuaguuggua

SEQ ID NO: 1070687 - RNA, 19 nt, Homo sapiens
ggaagcuuauguagcaaca

SEQ ID NO: 1070688 - RNA, 19 nt, Homo sapiens
ucaguaaguaugaugagua

SEQ ID NO: 1070689 - RNA, 19 nt, Homo sapiens
guaccuggccggucugaga

SEQ ID NO: 1070690 - RNA, 19 nt, Homo sapiens
ccucuucuguugccauuau

SEQ ID NO: 1070691 - RNA, 19 nt, Homo sapiens
ucacugggaagcuuaugua

SEQ ID NO: 1070692 - RNA, 19 nt, Homo sapiens
cugguaaauucacccaaua

SEQ ID NO: 1070693 - RNA, 19 nt, Homo sapiens
agagaagggugcuaugagu

SEQ ID NO: 1070694 - RNA, 19 nt, Homo sapiens
gacauugugugcugcaaag

SEQ ID NO: 1070695 - RNA, 19 nt, Homo sapiens
ggacauugugugcugcaaa

SEQ ID NO: 1070696 - RNA, 19 nt, Homo sapiens
gcuacagaauggccuggaa

SEQ ID NO: 1070697 - RNA, 19 nt, Homo sapiens
gaaggugguguuucgcuau

SEQ ID NO: 1070698 - RNA, 19 nt, Homo sapiens
cugggaagcuuauguagca

SEQ ID NO: 1070699 - RNA, 19 nt, Homo sapiens
gagagaaagggccugaguu

SEQ ID NO: 1070700 - RNA, 19 nt, Homo sapiens
ugaagcugcuggccaagau

SEQ ID NO: 1070701 - RNA, 19 nt, Homo sapiens
gagagccacugcuauagcu

SEQ ID NO: 1070702 - RNA, 19 nt, Homo sapiens
gaaacugccagguggaaag

SEQ ID NO: 1070703 - RNA, 19 nt, Homo sapiens
caguaaauacccuggaauu

SEQ ID NO: 1070704 - RNA, 19 nt, Homo sapiens
gaguuucagccaguaaaua

SEQ ID NO: 1070705 - RNA, 19 nt, Homo sapiens
caaaucaaccuggccaugu

SEQ ID NO: 1070706 - RNA, 19 nt, Homo sapiens
uguaaaugguggaaaucaa

SEQ ID NO: 1070707 - RNA, 19 nt, Homo sapiens
aggguaaccuggaacauuc

SEQ ID NO: 1070708 - RNA, 19 nt, Homo sapiens
gggagauguuuauguccaa

SEQ ID NO: 1070709 - RNA, 19 nt, Homo sapiens
gccaggacuuaaauucaga

SEQ ID NO: 1070710 - RNA, 19 nt, Homo sapiens
guagguuaguugguauuug

SEQ ID NO: 1070711 - RNA, 19 nt, Homo sapiens
ccaguagguuaguugguau

SEQ ID NO: 1070712 - RNA, 19 nt, Homo sapiens
gguaaauucacccaauaga

SEQ ID NO: 1070713 - RNA, 19 nt, Homo sapiens
ggagagaaagggccugagu

SEQ ID NO: 1070714 - RNA, 19 nt, Homo sapiens
acagagcacuuuggcaugu

SEQ ID NO: 1070715 - RNA, 19 nt, Homo sapiens
gcugauuacuacugcaaca

SEQ ID NO: 1070716 - RNA, 19 nt, Homo sapiens
gaacggcuucuguaauguc

SEQ ID NO: 1070717 - RNA, 19 nt, Homo sapiens
ugagguauagcucuaagaa

SEQ ID NO: 1070718 - RNA, 19 nt, Homo sapiens
ccaagaccaucuccaacag

SEQ ID NO: 1070719 - RNA, 19 nt, Homo sapiens
aaucaucaccagagguuaa

SEQ ID NO: 1070720 - RNA, 19 nt, Homo sapiens
gauguuuaucacagcauua

SEQ ID NO: 1070721 - RNA, 19 nt, Homo sapiens
gcucagguccuugcuugaa

SEQ ID NO: 1070722 - RNA, 19 nt, Homo sapiens
guauagcucuaagaaugug

SEQ ID NO: 1070723 - RNA, 19 nt, Homo sapiens
uggaacauucucuagguua

SEQ ID NO: 1070724 - RNA, 19 nt, Homo sapiens
guugggcuacuucuucaua

SEQ ID NO: 1070725 - RNA, 19 nt, Homo sapiens
cagaauggccuggaaaucu

SEQ ID NO: 1070726 - RNA, 19 nt, Homo sapiens
ucaaguacaacgagaagga

SEQ ID NO: 1070727 - RNA, 19 nt, Homo sapiens
uuacagaugaggaaacaga

SEQ ID NO: 1070728 - RNA, 19 nt, Homo sapiens
gaaagguuuuacaaaguga

SEQ ID NO: 1070729 - RNA, 19 nt, Homo sapiens
gaauguguuacgugacuga

SEQ ID NO: 1070730 - RNA, 19 nt, Homo sapiens
ucuauaggguaaccuggaa

SEQ ID NO: 1070731 - RNA, 19 nt, Homo sapiens
caugcugacaucaagaaua

SEQ ID NO: 1070732 - RNA, 19 nt, Homo sapiens
gguauagcucuaagaaugu

SEQ ID NO: 1070733 - RNA, 19 nt, Homo sapiens
gaacaaacgucaugacaaa

SEQ ID NO: 1070734 - RNA, 19 nt, Homo sapiens
gaaaggcgauaauuuguau

SEQ ID NO: 1070735 - RNA, 19 nt, Homo sapiens
gaaaugccgucuucuagaa

SEQ ID NO: 1070736 - RNA, 19 nt, Homo sapiens
gcaaagagccagaauauuc

SEQ ID NO: 1070737 - RNA, 19 nt, Homo sapiens
gaacauuucuuuaccuuca

SEQ ID NO: 1070738 - RNA, 19 nt, Homo sapiens
gaaauaagcacccuaacuu

SEQ ID NO: 1070739 - RNA, 19 nt, Homo sapiens
gcagaaaggcgauaauuug

SEQ ID NO: 1070740 - RNA, 19 nt, Homo sapiens
ccucugagcuuuacuggua

SEQ ID NO: 1070741 - RNA, 19 nt, Homo sapiens
gaaaggaacaguaauuugu

SEQ ID NO: 1070742 - RNA, 19 nt, Homo sapiens
ugacaaagauucucugagu

SEQ ID NO: 1070743 - RNA, 19 nt, Homo sapiens
gaaaggaaccgaacuaaaa

SEQ ID NO: 1070744 - RNA, 19 nt, Homo sapiens
gaaguuaacaccacguauu

SEQ ID NO: 1070745 - RNA, 19 nt, Homo sapiens
gcacacacagugaauguuu

SEQ ID NO: 1070746 - RNA, 19 nt, Homo sapiens
gaggaauacucaagugcua

SEQ ID NO: 1070747 - RNA, 19 nt, Homo sapiens
ggauggaaauggaaaggaa

SEQ ID NO: 1070748 - RNA, 19 nt, Homo sapiens
uaagagagcuccgacugaa

SEQ ID NO: 1070749 - RNA, 19 nt, Homo sapiens
gcagaucauuccuuugaga

SEQ ID NO: 1070750 - RNA, 19 nt, Homo sapiens
gcucuuaggaauaguguua

SEQ ID NO: 1070751 - RNA, 19 nt, Homo sapiens
cgagagcauuuccuucuaa

SEQ ID NO: 1070752 - RNA, 19 nt, Homo sapiens
ggaaaggaaccgaacuaaa

SEQ ID NO: 1070753 - RNA, 19 nt, Homo sapiens
gcuccaggcugcaguaaug

SEQ ID NO: 1070754 - RNA, 19 nt, Homo sapiens
cauaucacauucuuucuug

SEQ ID NO: 1070755 - RNA, 19 nt, Homo sapiens
ugaaggcuuucuuguaauu

SEQ ID NO: 1070756 - RNA, 19 nt, Homo sapiens
ccaaguaaccauuugauau

SEQ ID NO: 1070757 - RNA, 19 nt, Homo sapiens
uagaagcugugauauauag

SEQ ID NO: 1070758 - RNA, 19 nt, Homo sapiens
guaggaacaagaguaauua

SEQ ID NO: 1070759 - RNA, 19 nt, Homo sapiens
gcaguaauguguugguagu

SEQ ID NO: 1070760 - RNA, 19 nt, Homo sapiens
cuaaagaggugaugaacag

SEQ ID NO: 1070761 - RNA, 19 nt, Homo sapiens
ucagagaguuugaauugug

SEQ ID NO: 1070762 - RNA, 19 nt, Homo sapiens
ggaaaugccgucuucuaga

SEQ ID NO: 1070763 - RNA, 19 nt, Homo sapiens
auugaaggcuuucuuguaa

SEQ ID NO: 1070764 - RNA, 19 nt, Homo sapiens
ccaccaaauugaaggcuuu

SEQ ID NO: 1070765 - RNA, 19 nt, Homo sapiens
caaguaaccauuugauaug

SEQ ID NO: 1070766 - RNA, 19 nt, Homo sapiens
auacucaagugcuagcuua

SEQ ID NO: 1070767 - RNA, 19 nt, Homo sapiens
uagaccaaauugaagcuua

SEQ ID NO: 1070768 - RNA, 19 nt, Homo sapiens
gaaacagccauuugauuca

SEQ ID NO: 1070769 - RNA, 19 nt, Homo sapiens
gcgagagcauuuccuucua

SEQ ID NO: 1070770 - RNA, 19 nt, Homo sapiens
uaagcuggcgguacuauaa

SEQ ID NO: 1070771 - RNA, 19 nt, Homo sapiens
gcaaggacagccuggguuu

SEQ ID NO: 1070772 - RNA, 19 nt, Homo sapiens
gcccaaggcucgauuaagg

SEQ ID NO: 1070773 - RNA, 19 nt, Homo sapiens
gaguacaagugaagaaaca

SEQ ID NO: 1070774 - RNA, 19 nt, Homo sapiens
caaacuaauuggcauugug

SEQ ID NO: 1070775 - RNA, 19 nt, Homo sapiens
aaucugagcucuagugucu

SEQ ID NO: 1070776 - RNA, 19 nt, Homo sapiens
agugguugcuuuccauuua

SEQ ID NO: 1070777 - RNA, 19 nt, Homo sapiens
ggacuggcucugugaauga

SEQ ID NO: 1070778 - RNA, 19 nt, Homo sapiens
uagcggagaauuuauauug

SEQ ID NO: 1070779 - RNA, 19 nt, Homo sapiens
aguaauguguugguaguua

SEQ ID NO: 1070780 - RNA, 19 nt, Homo sapiens
gagagaggaguacaaguga

SEQ ID NO: 1070781 - RNA, 19 nt, Homo sapiens
gggccaggguggaaucuga

SEQ ID NO: 1070782 - RNA, 19 nt, Homo sapiens
gagcguggcacaugaacaa

SEQ ID NO: 1070783 - RNA, 19 nt, Homo sapiens
caacagcgaggauggaaau

SEQ ID NO: 1070784 - RNA, 19 nt, Homo sapiens
caaauugaaggcuuucuug

SEQ ID NO: 1070785 - RNA, 19 nt, Homo sapiens
uggcgaaacugucggcauu

SEQ ID NO: 1070786 - RNA, 19 nt, Homo sapiens
guacacuagcggagaauuu

SEQ ID NO: 1070787 - RNA, 19 nt, Homo sapiens
caaagauucucugagugaa

SEQ ID NO: 1070788 - RNA, 19 nt, Homo sapiens
aagcuggugugcaucauuu

SEQ ID NO: 1070789 - RNA, 19 nt, Homo sapiens
ggcagaaaggcgauaauuu

SEQ ID NO: 1070790 - RNA, 19 nt, Homo sapiens
uaacacaucaucucugcaa

SEQ ID NO: 1070791 - RNA, 19 nt, Homo sapiens
ccagagcccugcagagagu

SEQ ID NO: 1070792 - RNA, 19 nt, Homo sapiens
caagaguaauuagaccaaa

SEQ ID NO: 1070793 - RNA, 19 nt, Homo sapiens
agaaacagccauuugauuc

SEQ ID NO: 1070794 - RNA, 19 nt, Homo sapiens
acaaagauucucugaguga

SEQ ID NO: 1070795 - RNA, 19 nt, Homo sapiens
ggacagccuggguuucaaa

SEQ ID NO: 1070796 - RNA, 19 nt, Homo sapiens
ggagagaauuuuggaguuu

SEQ ID NO: 1070797 - RNA, 19 nt, Homo sapiens
cagcagcucuccagcaucu

SEQ ID NO: 1070798 - RNA, 19 nt, Homo sapiens
cagaaacagccauuugauu

SEQ ID NO: 1070799 - RNA, 19 nt, Homo sapiens
ucacuguuguucaaguaaa

SEQ ID NO: 1070800 - RNA, 19 nt, Homo sapiens
gcggagaauuuauauuguc

SEQ ID NO: 1070801 - RNA, 19 nt, Homo sapiens
cagcgaggauggaaaugga

SEQ ID NO: 1070802 - RNA, 19 nt, Homo sapiens
guaagagagcuccgacuga

SEQ ID NO: 1070803 - RNA, 19 nt, Homo sapiens
gguggaaucugagcucuag

SEQ ID NO: 1070804 - RNA, 19 nt, Homo sapiens
gcagaaacagccauuugau

SEQ ID NO: 1070805 - RNA, 19 nt, Homo sapiens
gaaacugucggcauuagca

SEQ ID NO: 1070806 - RNA, 19 nt, Homo sapiens
ccaaucauuucaguucuau

SEQ ID NO: 1070807 - RNA, 19 nt, Homo sapiens
gaugcaaagagccagaaua

SEQ ID NO: 1070808 - RNA, 19 nt, Homo sapiens
gagagaguauauauaugca

SEQ ID NO: 1070809 - RNA, 19 nt, Homo sapiens
ucacuguggcucaaacuaa

SEQ ID NO: 1070810 - RNA, 19 nt, Homo sapiens
caaacgucaugacaaagau

SEQ ID NO: 1070811 - RNA, 19 nt, Homo sapiens
gaagcaaaacguuucauuu

SEQ ID NO: 1070812 - RNA, 19 nt, Homo sapiens
ugaaaggaacaguaauuug

SEQ ID NO: 1070813 - RNA, 19 nt, Homo sapiens
ucucuuauaucucaagcuu

SEQ ID NO: 1070814 - RNA, 19 nt, Homo sapiens
guccagaucagagcuguua

SEQ ID NO: 1070815 - RNA, 19 nt, Homo sapiens
ggggaagggucgaggaaua

SEQ ID NO: 1070816 - RNA, 19 nt, Homo sapiens
cacaucaucucugcaaaga

SEQ ID NO: 1070817 - RNA, 19 nt, Homo sapiens
gcugagcaguugagcacuu

SEQ ID NO: 1070818 - RNA, 19 nt, Homo sapiens
gagaaaaguugacaugucu

SEQ ID NO: 1070819 - RNA, 19 nt, Homo sapiens
gccaaguaaccauuugaua

SEQ ID NO: 1070820 - RNA, 19 nt, Homo sapiens
guaauagaaaucacgcaaa

SEQ ID NO: 1070821 - RNA, 19 nt, Homo sapiens
acaguaauuuguguggaua

SEQ ID NO: 1070822 - RNA, 19 nt, Homo sapiens
caucaccaccuaccagauu

SEQ ID NO: 1070823 - RNA, 19 nt, Homo sapiens
ccaccaaucauuucaguuc

SEQ ID NO: 1070824 - RNA, 19 nt, Homo sapiens
agaaaggcgauaauuugua

SEQ ID NO: 1070825 - RNA, 19 nt, Homo sapiens
gcuaacguuuccuuucuag

SEQ ID NO: 1070826 - RNA, 19 nt, Homo sapiens
uaagcacccuaacuucaau

SEQ ID NO: 1070827 - RNA, 19 nt, Homo sapiens
ggaacaagaguaauuagac

SEQ ID NO: 1070828 - RNA, 19 nt, Homo sapiens
uaaagccaaguaaccauuu

SEQ ID NO: 1070829 - RNA, 19 nt, Homo sapiens
gcugugauauauagaguac

SEQ ID NO: 1070830 - RNA, 19 nt, Homo sapiens
ucccaucggucgccauaaa

SEQ ID NO: 1070831 - RNA, 19 nt, Homo sapiens
ggauccauaucacauucuu

SEQ ID NO: 1070832 - RNA, 19 nt, Homo sapiens
gaguuuauaaagccaagua

SEQ ID NO: 1070833 - RNA, 19 nt, Homo sapiens
ggaaugaaaugaaggaaua

SEQ ID NO: 1070834 - RNA, 19 nt, Homo sapiens
gcacauaugcgcucaauaa

SEQ ID NO: 1070835 - RNA, 19 nt, Homo sapiens
caauaagccuugccucuuu

SEQ ID NO: 1070836 - RNA, 19 nt, Homo sapiens
ggacauggauucuugaucu

SEQ ID NO: 1070837 - RNA, 19 nt, Homo sapiens
uuagaacucugcaguauuu

SEQ ID NO: 1070838 - RNA, 19 nt, Homo sapiens
ccuagaagcugccauuaaa

SEQ ID NO: 1070839 - RNA, 19 nt, Homo sapiens
gaaaguuaaugccaauaga

SEQ ID NO: 1070840 - RNA, 19 nt, Homo sapiens
gauuaggccuggcuuauga

SEQ ID NO: 1070841 - RNA, 19 nt, Homo sapiens
gaucuuccuuuacacauuu

SEQ ID NO: 1070842 - RNA, 19 nt, Homo sapiens
gaaggcugcugcacugaaa

SEQ ID NO: 1070843 - RNA, 19 nt, Homo sapiens
gaagcaguaugaagugauu

SEQ ID NO: 1070844 - RNA, 19 nt, Homo sapiens
gauagcagcuucuaauuuu

SEQ ID NO: 1070845 - RNA, 19 nt, Homo sapiens
cccaguagcugcacacaua

SEQ ID NO: 1070846 - RNA, 19 nt, Homo sapiens
ucacugggcugcaagauau

SEQ ID NO: 1070847 - RNA, 19 nt, Homo sapiens
gagauaauguacaauguca

SEQ ID NO: 1070848 - RNA, 19 nt, Homo sapiens
ggugguaccugaacuguau

SEQ ID NO: 1070849 - RNA, 19 nt, Homo sapiens
ggauagcagcuucuaauuu

SEQ ID NO: 1070850 - RNA, 19 nt, Homo sapiens
ggacacgcauccaauuuca

SEQ ID NO: 1070851 - RNA, 19 nt, Homo sapiens
cuuaguagcucagucuuua

SEQ ID NO: 1070852 - RNA, 19 nt, Homo sapiens
ggaauauucugaugcaaag

SEQ ID NO: 1070853 - RNA, 19 nt, Homo sapiens
caacaccuccuucaagaaa

SEQ ID NO: 1070854 - RNA, 19 nt, Homo sapiens
aaucugauauggaaggaua

SEQ ID NO: 1070855 - RNA, 19 nt, Homo sapiens
cgggaaaucugaaaugaug

SEQ ID NO: 1070856 - RNA, 19 nt, Homo sapiens
gaacagagaauggucuuuc

SEQ ID NO: 1070857 - RNA, 19 nt, Homo sapiens
gaguauauguucuuggaau

SEQ ID NO: 1070858 - RNA, 19 nt, Homo sapiens
uggauggucuucucuauga

SEQ ID NO: 1070859 - RNA, 19 nt, Homo sapiens
ggacacaaagggagaaaug

SEQ ID NO: 1070860 - RNA, 19 nt, Homo sapiens
gauucuugaucuuccuuua

SEQ ID NO: 1070861 - RNA, 19 nt, Homo sapiens
gagaagcaguaugaaguga

SEQ ID NO: 1070862 - RNA, 19 nt, Homo sapiens
caagagauaauguacaaug

SEQ ID NO: 1070863 - RNA, 19 nt, Homo sapiens
uaaaagaguugaagggaaa

SEQ ID NO: 1070864 - RNA, 19 nt, Homo sapiens
aauaagccuugccucuuua

SEQ ID NO: 1070865 - RNA, 19 nt, Homo sapiens
ugacgaggcuguguuacaa

SEQ ID NO: 1070866 - RNA, 19 nt, Homo sapiens
uuacagauauggaccaaca

SEQ ID NO: 1070867 - RNA, 19 nt, Homo sapiens
gaacucugcaguauuuguu

SEQ ID NO: 1070868 - RNA, 19 nt, Homo sapiens
gcaagaaacauucaugcau

SEQ ID NO: 1070869 - RNA, 19 nt, Homo sapiens
cauauugcauccaaaggaa

SEQ ID NO: 1070870 - RNA, 19 nt, Homo sapiens
gcaagaaggcuuaguagcu

SEQ ID NO: 1070871 - RNA, 19 nt, Homo sapiens
gccuagagagucaauguua

SEQ ID NO: 1070872 - RNA, 19 nt, Homo sapiens
gaagguggaggagucauuu

SEQ ID NO: 1070873 - RNA, 19 nt, Homo sapiens
gagcaucuccaaagaagga

SEQ ID NO: 1070874 - RNA, 19 nt, Homo sapiens
gaaaagcugccacucuaua

SEQ ID NO: 1070875 - RNA, 19 nt, Homo sapiens
gggagcaacucucugaagu

SEQ ID NO: 1070876 - RNA, 19 nt, Homo sapiens
cauaugcgcucaauaaacg

SEQ ID NO: 1070877 - RNA, 19 nt, Homo sapiens
gauaauguacaaugucaga

SEQ ID NO: 1070878 - RNA, 19 nt, Homo sapiens
uacacuaucuggcacauau

SEQ ID NO: 1070879 - RNA, 19 nt, Homo sapiens
gguuggaggagaacuauaa

SEQ ID NO: 1070880 - RNA, 19 nt, Homo sapiens
uccaugagguacaagauuu

SEQ ID NO: 1070881 - RNA, 19 nt, Homo sapiens
ccaagaguguuauucucaa

SEQ ID NO: 1070882 - RNA, 19 nt, Homo sapiens
guagcucagucuuuaacaa

SEQ ID NO: 1070883 - RNA, 19 nt, Homo sapiens
gaaggaaaaucaugaagag

SEQ ID NO: 1070884 - RNA, 19 nt, Homo sapiens
gaauguaaucugauaugga

SEQ ID NO: 1070885 - RNA, 19 nt, Homo sapiens
gcaguagcaggccauauug

SEQ ID NO: 1070886 - RNA, 19 nt, Homo sapiens
ccaggaauauucugaugca

SEQ ID NO: 1070887 - RNA, 19 nt, Homo sapiens
ggacacaaaguucuucagu

SEQ ID NO: 1070888 - RNA, 19 nt, Homo sapiens
aaugggacauggauucuug

SEQ ID NO: 1070889 - RNA, 19 nt, Homo sapiens
ccuagagcaucuccaaaga

SEQ ID NO: 1070890 - RNA, 19 nt, Homo sapiens
ggcgggaugugaugacuau

SEQ ID NO: 1070891 - RNA, 19 nt, Homo sapiens
ggagaacuauaacggaaaa

SEQ ID NO: 1070892 - RNA, 19 nt, Homo sapiens
gcucaggauuacagauaug

SEQ ID NO: 1070893 - RNA, 19 nt, Homo sapiens
ggagaaaugggacauggau

SEQ ID NO: 1070894 - RNA, 19 nt, Homo sapiens
ugaagagucucgggcaaga

SEQ ID NO: 1070895 - RNA, 19 nt, Homo sapiens
gggaugugaugacuaugga

SEQ ID NO: 1070896 - RNA, 19 nt, Homo sapiens
ggagaagcaguaugaagug

SEQ ID NO: 1070897 - RNA, 19 nt, Homo sapiens
gaaggaauagaaauccaau

SEQ ID NO: 1070898 - RNA, 19 nt, Homo sapiens
cuagaaauccuggguagaa

SEQ ID NO: 1070899 - RNA, 19 nt, Homo sapiens
uagagcaucuccaaagaag

SEQ ID NO: 1070900 - RNA, 19 nt, Homo sapiens
cugcuaagcucuguggauu

SEQ ID NO: 1070901 - RNA, 19 nt, Homo sapiens
ggagaagcauuuguuccau

SEQ ID NO: 1070902 - RNA, 19 nt, Homo sapiens
uaggaaauguagaaaccaa

SEQ ID NO: 1070903 - RNA, 19 nt, Homo sapiens
guggaggagucauuucaug

SEQ ID NO: 1070904 - RNA, 19 nt, Homo sapiens
ggugguaggacacaaaguu

SEQ ID NO: 1070905 - RNA, 19 nt, Homo sapiens
ggaccaacaccuccuucaa

SEQ ID NO: 1070906 - RNA, 19 nt, Homo sapiens
gaaauccuggguagaagug

SEQ ID NO: 1070907 - RNA, 19 nt, Homo sapiens
gcaugaguauauguucuug

SEQ ID NO: 1070908 - RNA, 19 nt, Homo sapiens
cuacaacuauagcaugcuu

SEQ ID NO: 1070909 - RNA, 19 nt, Homo sapiens
ggucuucucuaugaucuca

SEQ ID NO: 1070910 - RNA, 19 nt, Homo sapiens
ucuaugagauggugacucu

SEQ ID NO: 1070911 - RNA, 19 nt, Homo sapiens
aggccuggcuuaugaaguu

SEQ ID NO: 1070912 - RNA, 19 nt, Homo sapiens
gagggacacgcauccaauu

SEQ ID NO: 1070913 - RNA, 19 nt, Homo sapiens
gcacaauaaauaggaaaug

SEQ ID NO: 1070914 - RNA, 19 nt, Homo sapiens
caaaggagguuuuagaacu

SEQ ID NO: 1070915 - RNA, 19 nt, Homo sapiens
gacauggauucuugaucuu

SEQ ID NO: 1070916 - RNA, 19 nt, Homo sapiens
ggaaggcugcugcacugaa

SEQ ID NO: 1070917 - RNA, 19 nt, Homo sapiens
gcugcaagauaucaauaag

SEQ ID NO: 1070918 - RNA, 19 nt, Homo sapiens
gccaucuccucuacucaaa

SEQ ID NO: 1070919 - RNA, 19 nt, Homo sapiens
ucuaagcccaagaguguua

SEQ ID NO: 1070920 - RNA, 19 nt, Homo sapiens
ccucugaguuucaccuuag

SEQ ID NO: 1070921 - RNA, 19 nt, Homo sapiens
gaccaacaccuccuucaag

SEQ ID NO: 1070922 - RNA, 19 nt, Homo sapiens
ccaacccugucauuauuuc

SEQ ID NO: 1070923 - RNA, 19 nt, Homo sapiens
ggagggacacgcauccaau

SEQ ID NO: 1070924 - RNA, 19 nt, Homo sapiens
ucuaugaucucacagaaaa

SEQ ID NO: 1070925 - RNA, 19 nt, Homo sapiens
caagaguguuauucucaag

SEQ ID NO: 1070926 - RNA, 19 nt, Homo sapiens
ugauuaucgucccaacuuu

SEQ ID NO: 1070927 - RNA, 19 nt, Homo sapiens
gugauuaucgucccaacuu

SEQ ID NO: 1070928 - RNA, 19 nt, Homo sapiens
aagggauucuuuaugugua

SEQ ID NO: 1070929 - RNA, 19 nt, Homo sapiens
cauccugagcuaagacaua

SEQ ID NO: 1070930 - RNA, 19 nt, Homo sapiens
gccuagaagcugccauuaa

SEQ ID NO: 1070931 - RNA, 19 nt, Homo sapiens
caauuucacugggcugcaa

SEQ ID NO: 1070932 - RNA, 19 nt, Homo sapiens
gagaccugcuagcaucaga

SEQ ID NO: 1070933 - RNA, 19 nt, Homo sapiens
caacgcaaauguaugaaua

SEQ ID NO: 1070934 - RNA, 19 nt, Homo sapiens
gaucauugcugucuucaaa

SEQ ID NO: 1070935 - RNA, 19 nt, Homo sapiens
gaaaguaacuaucuugaag

SEQ ID NO: 1070936 - RNA, 19 nt, Homo sapiens
guaacuaucuugaagguuu

SEQ ID NO: 1070937 - RNA, 19 nt, Homo sapiens
gcaauucccuauuauauuc

SEQ ID NO: 1070938 - RNA, 19 nt, Homo sapiens
gaaauuggguccaguguag

SEQ ID NO: 1070939 - RNA, 19 nt, Homo sapiens
acaacuggcugauuaaaua

SEQ ID NO: 1070940 - RNA, 19 nt, Homo sapiens
cuacaaagaugcagacuau

SEQ ID NO: 1070941 - RNA, 19 nt, Homo sapiens
gaggaaauauugucagaga

SEQ ID NO: 1070942 - RNA, 19 nt, Homo sapiens
gaacuuacacugauaggaa

SEQ ID NO: 1070943 - RNA, 19 nt, Homo sapiens
gugcauagcucucuguaga

SEQ ID NO: 1070944 - RNA, 19 nt, Homo sapiens
ggaccuauaugaacucuuc

SEQ ID NO: 1070945 - RNA, 19 nt, Homo sapiens
aaugacaacuggcugauua

SEQ ID NO: 1070946 - RNA, 19 nt, Homo sapiens
gaaggagccuguuaucaag

SEQ ID NO: 1070947 - RNA, 19 nt, Homo sapiens
gaaagggagugaggacuau

SEQ ID NO: 1070948 - RNA, 19 nt, Homo sapiens
cuauugcaauucccuauua

SEQ ID NO: 1070949 - RNA, 19 nt, Homo sapiens
cgaaacaguucuccuggaa

SEQ ID NO: 1070950 - RNA, 19 nt, Homo sapiens
gagccaagguggugucaga

SEQ ID NO: 1070951 - RNA, 19 nt, Homo sapiens
ggaagaggaccuauaugaa

SEQ ID NO: 1070952 - RNA, 19 nt, Homo sapiens
caaauacaguucugaccuu

SEQ ID NO: 1070953 - RNA, 19 nt, Homo sapiens
gaacauaucccaccuugcu

SEQ ID NO: 1070954 - RNA, 19 nt, Homo sapiens
agugagaccuucaacuaua

SEQ ID NO: 1070955 - RNA, 19 nt, Homo sapiens
caccagaucuccacauugu

SEQ ID NO: 1070956 - RNA, 19 nt, Homo sapiens
gaagguaggaacggaauuu

SEQ ID NO: 1070957 - RNA, 19 nt, Homo sapiens
gagagcagcaccuuuaaga

SEQ ID NO: 1070958 - RNA, 19 nt, Homo sapiens
cugaaacccugcucuauug

SEQ ID NO: 1070959 - RNA, 19 nt, Homo sapiens
gaccugaacuuacacugau

SEQ ID NO: 1070960 - RNA, 19 nt, Homo sapiens
guggagagcagcaccuuua

SEQ ID NO: 1070961 - RNA, 19 nt, Homo sapiens
gcaggcagaggaaauauug

SEQ ID NO: 1070962 - RNA, 19 nt, Homo sapiens
ccagugagaccuucaacua

SEQ ID NO: 1070963 - RNA, 19 nt, Homo sapiens
uaguauaccuggccaguga

SEQ ID NO: 1070964 - RNA, 19 nt, Homo sapiens
ggagcuaaguggucuaugg

SEQ ID NO: 1070965 - RNA, 19 nt, Homo sapiens
gaagaggaccuauaugaac

SEQ ID NO: 1070966 - RNA, 19 nt, Homo sapiens
ccuauuauauucugcauca

SEQ ID NO: 1070967 - RNA, 19 nt, Homo sapiens
ugaaggagccuguuaucaa

SEQ ID NO: 1070968 - RNA, 19 nt, Homo sapiens
cagaaccucuuccugagaa

SEQ ID NO: 1070969 - RNA, 19 nt, Homo sapiens
aggaagcuauggguaauua

SEQ ID NO: 1070970 - RNA, 19 nt, Homo sapiens
ggagagaggccuucaaacu

SEQ ID NO: 1070971 - RNA, 19 nt, Homo sapiens
aaauaugacuguccaaugg

SEQ ID NO: 1070972 - RNA, 19 nt, Homo sapiens
guugaaggcuacaaagaug

SEQ ID NO: 1070973 - RNA, 19 nt, Homo sapiens
ugacaugguucccuacuag

SEQ ID NO: 1070974 - RNA, 19 nt, Homo sapiens
gaaggaagacaaagaaggu

SEQ ID NO: 1070975 - RNA, 19 nt, Homo sapiens
ggucaucucaugucagaaa

SEQ ID NO: 1070976 - RNA, 19 nt, Homo sapiens
gagacgagcccacuagugu

SEQ ID NO: 1070977 - RNA, 19 nt, Homo sapiens
ggaaauuggguccagugua

SEQ ID NO: 1070978 - RNA, 19 nt, Homo sapiens
cagaggaaauauugucaga

SEQ ID NO: 1070979 - RNA, 19 nt, Homo sapiens
gguugguggugcuggauua

SEQ ID NO: 1070980 - RNA, 19 nt, Homo sapiens
gaauguggacucuggaaga

SEQ ID NO: 1070981 - RNA, 19 nt, Homo sapiens
gagagaggccuucaaacug

SEQ ID NO: 1070982 - RNA, 19 nt, Homo sapiens
ccaagaggacaggcuauua

SEQ ID NO: 1070983 - RNA, 19 nt, Homo sapiens
gucccaaucuucucauuug

SEQ ID NO: 1070984 - RNA, 19 nt, Homo sapiens
gaggaucauugcugucuuc

SEQ ID NO: 1070985 - RNA, 19 nt, Homo sapiens
agagaggccuucaaacugu

SEQ ID NO: 1070986 - RNA, 19 nt, Homo sapiens
gaggacaggcuauuagguu

SEQ ID NO: 1070987 - RNA, 19 nt, Homo sapiens
gauguaagaguucaguuug

SEQ ID NO: 1070988 - RNA, 19 nt, Homo sapiens
ccaaucuucucauuuguuc

SEQ ID NO: 1070989 - RNA, 19 nt, Homo sapiens
ccacgcagccggaguguau

SEQ ID NO: 1070990 - RNA, 19 nt, Homo sapiens
acaaagaugcagacuauug

SEQ ID NO: 1070991 - RNA, 19 nt, Homo sapiens
ccaaguggcugcagaagcu

SEQ ID NO: 1070992 - RNA, 19 nt, Homo sapiens
gcauagcucucuguagaca

SEQ ID NO: 1070993 - RNA, 19 nt, Homo sapiens
gugacugccuuguccuuaa

SEQ ID NO: 1070994 - RNA, 19 nt, Homo sapiens
gaagcuauggguaauuaug

SEQ ID NO: 1070995 - RNA, 19 nt, Homo sapiens
guagaaauuguacguaaug

SEQ ID NO: 1070996 - RNA, 19 nt, Homo sapiens
ccucauaaguggcaguuuc

SEQ ID NO: 1070997 - RNA, 19 nt, Homo sapiens
agacagaagccacaccuuu

SEQ ID NO: 1070998 - RNA, 19 nt, Homo sapiens
caacacugaucgaggcaau

SEQ ID NO: 1070999 - RNA, 19 nt, Homo sapiens
gugcucagguugccuugaa

SEQ ID NO: 1071000 - RNA, 19 nt, Homo sapiens
gcacaaucaggaacaguga

SEQ ID NO: 1071001 - RNA, 19 nt, Homo sapiens
gcaucgggcuaccaccaaa

SEQ ID NO: 1071002 - RNA, 19 nt, Homo sapiens
cagcuugucuguuucucaa

SEQ ID NO: 1071003 - RNA, 19 nt, Homo sapiens
uggaagaggaccuauauga

SEQ ID NO: 1071004 - RNA, 19 nt, Homo sapiens
aaucaacgcaaauguauga

SEQ ID NO: 1071005 - RNA, 19 nt, Homo sapiens
ccagggcuaucucucagaa

SEQ ID NO: 1071006 - RNA, 19 nt, Homo sapiens
uaacuaucuugaagguuug

SEQ ID NO: 1071007 - RNA, 19 nt, Homo sapiens
cagucaaccucagaaagua

SEQ ID NO: 1071008 - RNA, 19 nt, Homo sapiens
gugcuguccuugcugcuuu

SEQ ID NO: 1071009 - RNA, 19 nt, Homo sapiens
ucugauccuuccaaagaua

SEQ ID NO: 1071010 - RNA, 19 nt, Homo sapiens
aaacuggaacucaacauug

SEQ ID NO: 1071011 - RNA, 19 nt, Homo sapiens
cagaagcugugcuguccuu

SEQ ID NO: 1071012 - RNA, 19 nt, Homo sapiens
gaaguaacaggacguggau

SEQ ID NO: 1071013 - RNA, 19 nt, Homo sapiens
gcacuuccgcacacaauca

SEQ ID NO: 1071014 - RNA, 19 nt, Homo sapiens
ucaagaaagauccugguuu

SEQ ID NO: 1071015 - RNA, 19 nt, Homo sapiens
uaaauaugacuguccaaug

SEQ ID NO: 1071016 - RNA, 19 nt, Homo sapiens
uuagugugauucuuuguug

SEQ ID NO: 1071017 - RNA, 19 nt, Homo sapiens
aaauacaguucugaccuuu

SEQ ID NO: 1071018 - RNA, 19 nt, Homo sapiens
ccacuugccagguguuuga

SEQ ID NO: 1071019 - RNA, 19 nt, Homo sapiens
cguggauucugccucauaa

SEQ ID NO: 1071020 - RNA, 19 nt, Homo sapiens
caagaggacaggcuauuag

SEQ ID NO: 1071021 - RNA, 19 nt, Homo sapiens
ggagaagcacaaucaggaa

SEQ ID NO: 1071022 - RNA, 19 nt, Homo sapiens
ggaguggggugcaggaaaa

SEQ ID NO: 1071023 - RNA, 19 nt, Homo sapiens
aaaguuggacagcgguuua

SEQ ID NO: 1071024 - RNA, 19 nt, Homo sapiens
gcagaggcaggaagagcua

SEQ ID NO: 1071025 - RNA, 19 nt, Homo sapiens
gacagaagccacaccuuuc

SEQ ID NO: 1071026 - RNA, 19 nt, Homo sapiens
ccagaugccaccugugauu

SEQ ID NO: 1071027 - RNA, 19 nt, Homo sapiens
gaacacuaaccggcaacua

SEQ ID NO: 1071028 - RNA, 19 nt, Homo sapiens
cauuccagcucuuuguuga

SEQ ID NO: 1071029 - RNA, 19 nt, Homo sapiens
cacaccagaucuccacauu

SEQ ID NO: 1071030 - RNA, 19 nt, Homo sapiens
gaggcaggcagaggaaaua

SEQ ID NO: 1071031 - RNA, 19 nt, Homo sapiens
gauaucggacccuaacuuc

SEQ ID NO: 1071032 - RNA, 19 nt, Homo sapiens
gcagaaccucuuccugaga

SEQ ID NO: 1071033 - RNA, 19 nt, Homo sapiens
gagaagaucuggcuccuaa

SEQ ID NO: 1071034 - RNA, 19 nt, Homo sapiens
cuaaauaccuuccucauaa

SEQ ID NO: 1071035 - RNA, 19 nt, Homo sapiens
ugaaacagaucaaggaaua

SEQ ID NO: 1071036 - RNA, 19 nt, Homo sapiens
gaagacaacucuccuaaca

SEQ ID NO: 1071037 - RNA, 19 nt, Homo sapiens
gagcauaaccaaaguauuu

SEQ ID NO: 1071038 - RNA, 19 nt, Homo sapiens
gaccauaucugaaagaaau

SEQ ID NO: 1071039 - RNA, 19 nt, Homo sapiens
caaaguauuuccuucagua

SEQ ID NO: 1071040 - RNA, 19 nt, Homo sapiens
gaaaggaccaaucucauuu

SEQ ID NO: 1071041 - RNA, 19 nt, Homo sapiens
uaacacaugccaaguaaua

SEQ ID NO: 1071042 - RNA, 19 nt, Homo sapiens
caaagaagagccaggaaua

SEQ ID NO: 1071043 - RNA, 19 nt, Homo sapiens
caucccagcuugaagaaua

SEQ ID NO: 1071044 - RNA, 19 nt, Homo sapiens
gacuaagacugaacacaua

SEQ ID NO: 1071045 - RNA, 19 nt, Homo sapiens
gaaggaaccugaagacaac

SEQ ID NO: 1071046 - RNA, 19 nt, Homo sapiens
ggaccaaucucauuugaag

SEQ ID NO: 1071047 - RNA, 19 nt, Homo sapiens
agaaauagcugagccuaaa

SEQ ID NO: 1071048 - RNA, 19 nt, Homo sapiens
ggaauacaaugaaacagau

SEQ ID NO: 1071049 - RNA, 19 nt, Homo sapiens
acagagaacuacuuagaaa

SEQ ID NO: 1071050 - RNA, 19 nt, Homo sapiens
ggaaaggaccaaucucauu

SEQ ID NO: 1071051 - RNA, 19 nt, Homo sapiens
uaccugggcuugaagaaua

SEQ ID NO: 1071052 - RNA, 19 nt, Homo sapiens
agaaucagcugaaccuaaa

SEQ ID NO: 1071053 - RNA, 19 nt, Homo sapiens
ccuaaaggcuauauucuug

SEQ ID NO: 1071054 - RNA, 19 nt, Homo sapiens
caagaaauaucuguacuuc

SEQ ID NO: 1071055 - RNA, 19 nt, Homo sapiens
gaacauacagcuuaauagu

SEQ ID NO: 1071056 - RNA, 19 nt, Homo sapiens
gcagauaagugacuaagac

SEQ ID NO: 1071057 - RNA, 19 nt, Homo sapiens
ccaggaagaugcuaaagau

SEQ ID NO: 1071058 - RNA, 19 nt, Homo sapiens
gaagaccucucuccuaaaa

SEQ ID NO: 1071059 - RNA, 19 nt, Homo sapiens
cugaagaccucucuacuga

SEQ ID NO: 1071060 - RNA, 19 nt, Homo sapiens
cugaagaccucucuccuaa

SEQ ID NO: 1071061 - RNA, 19 nt, Homo sapiens
caauggaacauacagcuua

SEQ ID NO: 1071062 - RNA, 19 nt, Homo sapiens
cagcagaaccagaggaaua

SEQ ID NO: 1071063 - RNA, 19 nt, Homo sapiens
ccuaacacaugccaaguaa

SEQ ID NO: 1071064 - RNA, 19 nt, Homo sapiens
ucaagaccauccuuucaaa

SEQ ID NO: 1071065 - RNA, 19 nt, Homo sapiens
gauaagugacuaagacuga

SEQ ID NO: 1071066 - RNA, 19 nt, Homo sapiens
ggugggaacagacaaauaa

SEQ ID NO: 1071067 - RNA, 19 nt, Homo sapiens
agaaauaccugggcuugaa

SEQ ID NO: 1071068 - RNA, 19 nt, Homo sapiens
gaaccuggaguuugagaaa

SEQ ID NO: 1071069 - RNA, 19 nt, Homo sapiens
ccacauagacaauaucaug

SEQ ID NO: 1071070 - RNA, 19 nt, Homo sapiens
ccagaggaauacaaugaaa

SEQ ID NO: 1071071 - RNA, 19 nt, Homo sapiens
gcuauauucuugacacaga

SEQ ID NO: 1071072 - RNA, 19 nt, Homo sapiens
agaaagcacuggcaccuau

SEQ ID NO: 1071073 - RNA, 19 nt, Homo sapiens
aaacagagaacuacuuaga

SEQ ID NO: 1071074 - RNA, 19 nt, Homo sapiens
agacugaacacauacauuu

SEQ ID NO: 1071075 - RNA, 19 nt, Homo sapiens
gaaauuauugugccuaaag

SEQ ID NO: 1071076 - RNA, 19 nt, Homo sapiens
gcaggaugcucucuucaag

SEQ ID NO: 1071077 - RNA, 19 nt, Homo sapiens
gacaauaucaugcuagaau

SEQ ID NO: 1071078 - RNA, 19 nt, Homo sapiens
agacaacucuccuaacaca

SEQ ID NO: 1071079 - RNA, 19 nt, Homo sapiens
agaaacagagaacuacuua

SEQ ID NO: 1071080 - RNA, 19 nt, Homo sapiens
auaaggaugugccuaaaga

SEQ ID NO: 1071081 - RNA, 19 nt, Homo sapiens
ccugaaauauaccaagaaa

SEQ ID NO: 1071082 - RNA, 19 nt, Homo sapiens
ccugaaauauaccaagaaa

SEQ ID NO: 1071083 - RNA, 19 nt, Homo sapiens
aggaauagcugagacagaa

SEQ ID NO: 1071084 - RNA, 19 nt, Homo sapiens
gaaagcacuggcaccuaua

SEQ ID NO: 1071085 - RNA, 19 nt, Homo sapiens
caagauggauuugggaaag

SEQ ID NO: 1071086 - RNA, 19 nt, Homo sapiens
gaaauaaaccaagaaacuc

SEQ ID NO: 1071087 - RNA, 19 nt, Homo sapiens
ccugaaacguaucaagaaa

SEQ ID NO: 1071088 - RNA, 19 nt, Homo sapiens
guaccaagauauggcuaaa

SEQ ID NO: 1071089 - RNA, 19 nt, Homo sapiens
agauauggcuaaacgagaa

SEQ ID NO: 1071090 - RNA, 19 nt, Homo sapiens
gcacuggcaccuauagaga

SEQ ID NO: 1071091 - RNA, 19 nt, Homo sapiens
cauagacaauaucaugcua

SEQ ID NO: 1071092 - RNA, 19 nt, Homo sapiens
ccuaaauaccuuccucaua

SEQ ID NO: 1071093 - RNA, 19 nt, Homo sapiens
caagaaauagcaguacaaa

SEQ ID NO: 1071094 - RNA, 19 nt, Homo sapiens
ugaaggaaccugaagacaa

SEQ ID NO: 1071095 - RNA, 19 nt, Homo sapiens
guaccaagaaauagcagua

SEQ ID NO: 1071096 - RNA, 19 nt, Homo sapiens
aaaccauucuucugaaaca

SEQ ID NO: 1071097 - RNA, 19 nt, Homo sapiens
ggaaaucgaagaggcagaa

SEQ ID NO: 1071098 - RNA, 19 nt, Homo sapiens
caaaauagcaggaagguau

SEQ ID NO: 1071099 - RNA, 19 nt, Homo sapiens
ggaagaugcuaaagaugcu

SEQ ID NO: 1071100 - RNA, 19 nt, Homo sapiens
aaacaucccagcuugaaga

SEQ ID NO: 1071101 - RNA, 19 nt, Homo sapiens
caaugaaacagaucaagga

SEQ ID NO: 1071102 - RNA, 19 nt, Homo sapiens
gagaaacagagaacuacuu

SEQ ID NO: 1071103 - RNA, 19 nt, Homo sapiens
gggaacagacaaauaagga

SEQ ID NO: 1071104 - RNA, 19 nt, Homo sapiens
aaauaaggaugugccuaaa

SEQ ID NO: 1071105 - RNA, 19 nt, Homo sapiens
uagaaagauucacggcaaa

SEQ ID NO: 1071106 - RNA, 19 nt, Homo sapiens
ggggaggacuggauaauug

SEQ ID NO: 1071107 - RNA, 19 nt, Homo sapiens
ggaugugccuaaagaaugc

SEQ ID NO: 1071108 - RNA, 19 nt, Homo sapiens
gcaagauggauuugggaaa

SEQ ID NO: 1071109 - RNA, 19 nt, Homo sapiens
guaccaagaaauaucugua

SEQ ID NO: 1071110 - RNA, 19 nt, Homo sapiens
guguguguauguauguaua

SEQ ID NO: 1071111 - RNA, 19 nt, Homo sapiens
caccugaaauauaccaaga

SEQ ID NO: 1071112 - RNA, 19 nt, Homo sapiens
caccugaaauauaccaaga

SEQ ID NO: 1071113 - RNA, 19 nt, Homo sapiens
ggaaauaguggagaaagca

SEQ ID NO: 1071114 - RNA, 19 nt, Homo sapiens
gaagaggcagaaagaaaca

SEQ ID NO: 1071115 - RNA, 19 nt, Homo sapiens
ggauaguggugggaacaga

SEQ ID NO: 1071116 - RNA, 19 nt, Homo sapiens
uagacaauaucaugcuaga

SEQ ID NO: 1071117 - RNA, 19 nt, Homo sapiens
uggaacauacagcuuaaua

SEQ ID NO: 1071118 - RNA, 19 nt, Homo sapiens
ccaagaaacaucccagcuu

SEQ ID NO: 1071119 - RNA, 19 nt, Homo sapiens
agaagcugcuguacccaaa

SEQ ID NO: 1071120 - RNA, 19 nt, Homo sapiens
ggaacagacaaauaaggaa

SEQ ID NO: 1071121 - RNA, 19 nt, Homo sapiens
ggaacauacagcuuaauag

SEQ ID NO: 1071122 - RNA, 19 nt, Homo sapiens
aauggaacauacagcuuaa

SEQ ID NO: 1071123 - RNA, 19 nt, Homo sapiens
uaucuguacuucaagacaa

SEQ ID NO: 1071124 - RNA, 19 nt, Homo sapiens
ggagugaugaauguaguuu

SEQ ID NO: 1071125 - RNA, 19 nt, Homo sapiens
uaauguaacaguagcauca

SEQ ID NO: 1071126 - RNA, 19 nt, Homo sapiens
acaauaucaugcuagaaug

SEQ ID NO: 1071127 - RNA, 19 nt, Homo sapiens
gaaacuccugggucugaaa

SEQ ID NO: 1071128 - RNA, 19 nt, Homo sapiens
gaucaaggaauagcugaga

SEQ ID NO: 1071129 - RNA, 19 nt, Homo sapiens
guacuguggguguuagaaa

SEQ ID NO: 1071130 - RNA, 19 nt, Homo sapiens
uuaaggcucuaccacauag

SEQ ID NO: 1071131 - RNA, 19 nt, Homo sapiens
ccauaaaguugugguccaa

SEQ ID NO: 1071132 - RNA, 19 nt, Homo sapiens
aaacaccucauucugaaga

SEQ ID NO: 1071133 - RNA, 19 nt, Homo sapiens
ggaaguaccuuucuuguga

SEQ ID NO: 1071134 - RNA, 19 nt, Homo sapiens
ccagaucgcuuuaaacaua

SEQ ID NO: 1071135 - RNA, 19 nt, Homo sapiens
gaucauggcauuccuauua

SEQ ID NO: 1071136 - RNA, 19 nt, Homo sapiens
gaucuucacugaggaauua

SEQ ID NO: 1071137 - RNA, 19 nt, Homo sapiens
gcaagaacgugcggauuua

SEQ ID NO: 1071138 - RNA, 19 nt, Homo sapiens
caggauggauucugaaaua

SEQ ID NO: 1071139 - RNA, 19 nt, Homo sapiens
aauaggagcucauuuaaga

SEQ ID NO: 1071140 - RNA, 19 nt, Homo sapiens
gaaacuauaggaaagguua

SEQ ID NO: 1071141 - RNA, 19 nt, Homo sapiens
ugaauuaacuguccauuuc

SEQ ID NO: 1071142 - RNA, 19 nt, Homo sapiens
ggauagagguggcagaaug

SEQ ID NO: 1071143 - RNA, 19 nt, Homo sapiens
gaagaaaacugaagaggaa

SEQ ID NO: 1071144 - RNA, 19 nt, Homo sapiens
caaauagccuugaggaaau

SEQ ID NO: 1071145 - RNA, 19 nt, Homo sapiens
gcaaauuggugauugugaa

SEQ ID NO: 1071146 - RNA, 19 nt, Homo sapiens
caacaucuaugccuacaga

SEQ ID NO: 1071147 - RNA, 19 nt, Homo sapiens
ggacagaaguagaaguaga

SEQ ID NO: 1071148 - RNA, 19 nt, Homo sapiens
ccagagauagccauuauua

SEQ ID NO: 1071149 - RNA, 19 nt, Homo sapiens
ccagaaauguguuggugua

SEQ ID NO: 1071150 - RNA, 19 nt, Homo sapiens
gaaguuaggcuguggcaaa

SEQ ID NO: 1071151 - RNA, 19 nt, Homo sapiens
caauaaauauggaguguca

SEQ ID NO: 1071152 - RNA, 19 nt, Homo sapiens
ggaauaggagcucauuuaa

SEQ ID NO: 1071153 - RNA, 19 nt, Homo sapiens
guaacauucucguuucuuu

SEQ ID NO: 1071154 - RNA, 19 nt, Homo sapiens
agacaggcaugugcuauua

SEQ ID NO: 1071155 - RNA, 19 nt, Homo sapiens
caucaaaccuuuauguauc

SEQ ID NO: 1071156 - RNA, 19 nt, Homo sapiens
gaagggagauaggaaacaa

SEQ ID NO: 1071157 - RNA, 19 nt, Homo sapiens
ccaguuaccucuaggcauu

SEQ ID NO: 1071158 - RNA, 19 nt, Homo sapiens
agaaaugucucuagaggaa

SEQ ID NO: 1071159 - RNA, 19 nt, Homo sapiens
ggaguauguuguguaguua

SEQ ID NO: 1071160 - RNA, 19 nt, Homo sapiens
gaaccaggcccagauguaa

SEQ ID NO: 1071161 - RNA, 19 nt, Homo sapiens
ggaaacaaugagaaacuua

SEQ ID NO: 1071162 - RNA, 19 nt, Homo sapiens
gcacagagaauuggacaaa

SEQ ID NO: 1071163 - RNA, 19 nt, Homo sapiens
caacaugucaaaccuauga

SEQ ID NO: 1071164 - RNA, 19 nt, Homo sapiens
cgagauucuuguacuguua

SEQ ID NO: 1071165 - RNA, 19 nt, Homo sapiens
gaguauccaucugcaguua

SEQ ID NO: 1071166 - RNA, 19 nt, Homo sapiens
gcagagagaguauccuuga

SEQ ID NO: 1071167 - RNA, 19 nt, Homo sapiens
ggauaaacagaccuucuua

SEQ ID NO: 1071168 - RNA, 19 nt, Homo sapiens
ccaaguagcugggauuaca

SEQ ID NO: 1071169 - RNA, 19 nt, Homo sapiens
ccagacggcuuucucaguu

SEQ ID NO: 1071170 - RNA, 19 nt, Homo sapiens
gaguauccuugacugcuua

SEQ ID NO: 1071171 - RNA, 19 nt, Homo sapiens
caacugugccagaaacaua

SEQ ID NO: 1071172 - RNA, 19 nt, Homo sapiens
cagaauauauugugaggau

SEQ ID NO: 1071173 - RNA, 19 nt, Homo sapiens
agaggaagauguugaaugu

SEQ ID NO: 1071174 - RNA, 19 nt, Homo sapiens
gugcugaggugauaauuca

SEQ ID NO: 1071175 - RNA, 19 nt, Homo sapiens
gagaacuuaugaucuauuc

SEQ ID NO: 1071176 - RNA, 19 nt, Homo sapiens
cagcauggauaccaacauu

SEQ ID NO: 1071177 - RNA, 19 nt, Homo sapiens
aaaguucgguuaaagcauu

SEQ ID NO: 1071178 - RNA, 19 nt, Homo sapiens
gcccagauguaaagaagaa

SEQ ID NO: 1071179 - RNA, 19 nt, Homo sapiens
uaaagucaauuggcuggua

SEQ ID NO: 1071180 - RNA, 19 nt, Homo sapiens
gcuccuuuauacagaauua

SEQ ID NO: 1071181 - RNA, 19 nt, Homo sapiens
ggauggauucugaaauaua

SEQ ID NO: 1071182 - RNA, 19 nt, Homo sapiens
gcaggaguauguuguguag

SEQ ID NO: 1071183 - RNA, 19 nt, Homo sapiens
aaaugucucuagaggaaua

SEQ ID NO: 1071184 - RNA, 19 nt, Homo sapiens
uggaauaggagcucauuua

SEQ ID NO: 1071185 - RNA, 19 nt, Homo sapiens
ggaagauguugaaugugaa

SEQ ID NO: 1071186 - RNA, 19 nt, Homo sapiens
gauaggaaacaaugagaaa

SEQ ID NO: 1071187 - RNA, 19 nt, Homo sapiens
gauuaacuguucacuuuca

SEQ ID NO: 1071188 - RNA, 19 nt, Homo sapiens
caucuaugccuacagaaua

SEQ ID NO: 1071189 - RNA, 19 nt, Homo sapiens
gaagaauuaccuccgauug

SEQ ID NO: 1071190 - RNA, 19 nt, Homo sapiens
ccaccuaucuaccaguuga

SEQ ID NO: 1071191 - RNA, 19 nt, Homo sapiens
ggagcucauuuaagauuga

SEQ ID NO: 1071192 - RNA, 19 nt, Homo sapiens
ccauagucaucaaggaaua

SEQ ID NO: 1071193 - RNA, 19 nt, Homo sapiens
gaacauuaauaccugaaac

SEQ ID NO: 1071194 - RNA, 19 nt, Homo sapiens
aggaagauguugaauguga

SEQ ID NO: 1071195 - RNA, 19 nt, Homo sapiens
cagaauaucggugaaagua

SEQ ID NO: 1071196 - RNA, 19 nt, Homo sapiens
ggccugcuuugacauauuu

SEQ ID NO: 1071197 - RNA, 19 nt, Homo sapiens
guuaugugcugaggugaua

SEQ ID NO: 1071198 - RNA, 19 nt, Homo sapiens
caacaacugugccagaaac

SEQ ID NO: 1071199 - RNA, 19 nt, Homo sapiens
ggcaagaacgugcggauuu

SEQ ID NO: 1071200 - RNA, 19 nt, Homo sapiens
ggcaguaccugaauuaacu

SEQ ID NO: 1071201 - RNA, 19 nt, Homo sapiens
gaucuauucauguguguuu

SEQ ID NO: 1071202 - RNA, 19 nt, Homo sapiens
gaccagaucgcuuuaaaca

SEQ ID NO: 1071203 - RNA, 19 nt, Homo sapiens
gaauauaagagcaaguguu

SEQ ID NO: 1071204 - RNA, 19 nt, Homo sapiens
gagcaaaccuuuucauugg

SEQ ID NO: 1071205 - RNA, 19 nt, Homo sapiens
guacagcuccaccuaucua

SEQ ID NO: 1071206 - RNA, 19 nt, Homo sapiens
ggaguggugugucauugau

SEQ ID NO: 1071207 - RNA, 19 nt, Homo sapiens
ggugauaauucauccaaca

SEQ ID NO: 1071208 - RNA, 19 nt, Homo sapiens
ggagcuacuucacacucua

SEQ ID NO: 1071209 - RNA, 19 nt, Homo sapiens
gauguaauggcaaacaauu

SEQ ID NO: 1071210 - RNA, 19 nt, Homo sapiens
gaaguaccuuucuugugau

SEQ ID NO: 1071211 - RNA, 19 nt, Homo sapiens
gguguaacauucucguuuc

SEQ ID NO: 1071212 - RNA, 19 nt, Homo sapiens
guacaugucaagugccuuu

SEQ ID NO: 1071213 - RNA, 19 nt, Homo sapiens
ggagaacuaauuugaacuu

SEQ ID NO: 1071214 - RNA, 19 nt, Homo sapiens
ggagugcaguggcaugauc

SEQ ID NO: 1071215 - RNA, 19 nt, Homo sapiens
acaccaggauggauucuga

SEQ ID NO: 1071216 - RNA, 19 nt, Homo sapiens
caucuaaggcuuugggaaa

SEQ ID NO: 1071217 - RNA, 19 nt, Homo sapiens
ggagucaucuaaggcuuug

SEQ ID NO: 1071218 - RNA, 19 nt, Homo sapiens
gcuaggaccagaucgcuuu

SEQ ID NO: 1071219 - RNA, 19 nt, Homo sapiens
agaaguagaaguagaagaa

SEQ ID NO: 1071220 - RNA, 19 nt, Homo sapiens
aaauagccuugaggaaaua

SEQ ID NO: 1071221 - RNA, 19 nt, Homo sapiens
auaaguaugucaccuuuca

SEQ ID NO: 1071222 - RNA, 19 nt, Homo sapiens
gagaguuucuucuugugau

SEQ ID NO: 1071223 - RNA, 19 nt, Homo sapiens
gaacuuaaucaccacuuca

SEQ ID NO: 1071224 - RNA, 19 nt, Homo sapiens
aaagucaauuggcugguaa

SEQ ID NO: 1071225 - RNA, 19 nt, Homo sapiens
acagagaauuggacaaaca

SEQ ID NO: 1071226 - RNA, 19 nt, Homo sapiens
gauagagguggcagaauga

SEQ ID NO: 1071227 - RNA, 19 nt, Homo sapiens
gaggaguggugugucauug

SEQ ID NO: 1071228 - RNA, 19 nt, Homo sapiens
aggaguauguuguguaguu

SEQ ID NO: 1071229 - RNA, 19 nt, Homo sapiens
guaccuuucuugugaucuu

SEQ ID NO: 1071230 - RNA, 19 nt, Homo sapiens
caguuucuguugcaaauug

SEQ ID NO: 1071231 - RNA, 19 nt, Homo sapiens
gcagaaugaggaaauugaa

SEQ ID NO: 1071232 - RNA, 19 nt, Homo sapiens
cauguguguuucaggcuua

SEQ ID NO: 1071233 - RNA, 19 nt, Homo sapiens
gaaugaagauuuccgauau

SEQ ID NO: 1071234 - RNA, 19 nt, Homo sapiens
ggaagaagaaccagacuga

SEQ ID NO: 1071235 - RNA, 19 nt, Homo sapiens
ggaagugaguggaaucuag

SEQ ID NO: 1071236 - RNA, 19 nt, Homo sapiens
cgauauggcuacucuuauu

SEQ ID NO: 1071237 - RNA, 19 nt, Homo sapiens
gagcugcugccuucauuua

SEQ ID NO: 1071238 - RNA, 19 nt, Homo sapiens
gaucuugagugcaguccua

SEQ ID NO: 1071239 - RNA, 19 nt, Homo sapiens
gauauggcuacucuuauua

SEQ ID NO: 1071240 - RNA, 19 nt, Homo sapiens
gcucuuggguguuuggauu

SEQ ID NO: 1071241 - RNA, 19 nt, Homo sapiens
cagcagcacuugcccauuc

SEQ ID NO: 1071242 - RNA, 19 nt, Homo sapiens
gaguagucaugugauaaua

SEQ ID NO: 1071243 - RNA, 19 nt, Homo sapiens
ggagaauguucccaaccaa

SEQ ID NO: 1071244 - RNA, 19 nt, Homo sapiens
ucagaaggcuacaccuaug

SEQ ID NO: 1071245 - RNA, 19 nt, Homo sapiens
gccaugcucuuggguguuu

SEQ ID NO: 1071246 - RNA, 19 nt, Homo sapiens
gaacagccgacagugauga

SEQ ID NO: 1071247 - RNA, 19 nt, Homo sapiens
agaaggaaauguuggaagu

SEQ ID NO: 1071248 - RNA, 19 nt, Homo sapiens
gaaaagagaccagaaggaa

SEQ ID NO: 1071249 - RNA, 19 nt, Homo sapiens
ccugaguagucaugugaua

SEQ ID NO: 1071250 - RNA, 19 nt, Homo sapiens
aaagagaccagaaggaaau

SEQ ID NO: 1071251 - RNA, 19 nt, Homo sapiens
gagaauguucccaaccaaa

SEQ ID NO: 1071252 - RNA, 19 nt, Homo sapiens
agccaucgcugcccucaaa

SEQ ID NO: 1071253 - RNA, 19 nt, Homo sapiens
gaagaaccagacugaggaa

SEQ ID NO: 1071254 - RNA, 19 nt, Homo sapiens
aaggaaauguuggaaguga

SEQ ID NO: 1071255 - RNA, 19 nt, Homo sapiens
ccaugccucuccugauuau

SEQ ID NO: 1071256 - RNA, 19 nt, Homo sapiens
gggaacagccgacagugau

SEQ ID NO: 1071257 - RNA, 19 nt, Homo sapiens
agccaugccucuccugauu

SEQ ID NO: 1071258 - RNA, 19 nt, Homo sapiens
gccaugccucuccugauua

SEQ ID NO: 1071259 - RNA, 19 nt, Homo sapiens
ggaaauguuggaagugagu

SEQ ID NO: 1071260 - RNA, 19 nt, Homo sapiens
gaaacggggugguacauac

SEQ ID NO: 1071261 - RNA, 19 nt, Homo sapiens
gaaggaaauguuggaagug

SEQ ID NO: 1071262 - RNA, 19 nt, Homo sapiens
gagaccagaaggaaauguu

SEQ ID NO: 1071263 - RNA, 19 nt, Homo sapiens
gcacuugcccauuccuuac

SEQ ID NO: 1071264 - RNA, 19 nt, Homo sapiens
gaaccagacugaggaaaag

SEQ ID NO: 1071265 - RNA, 19 nt, Homo sapiens
augccucuccugauuauua

SEQ ID NO: 1071266 - RNA, 19 nt, Homo sapiens
uggagcugcugccuucauu

SEQ ID NO: 1071267 - RNA, 19 nt, Homo sapiens
aaugaagauuuccgauaug

SEQ ID NO: 1071268 - RNA, 19 nt, Homo sapiens
uggcuacucuuauuacaac

SEQ ID NO: 1071269 - RNA, 19 nt, Homo sapiens
uccgauauggcuacucuua

SEQ ID NO: 1071270 - RNA, 19 nt, Homo sapiens
ggaacagccgacagugaug

SEQ ID NO: 1071271 - RNA, 19 nt, Homo sapiens
gucagaaggcuacaccuau

SEQ ID NO: 1071272 - RNA, 19 nt, Homo sapiens
ugaguagucaugugauaau

SEQ ID NO: 1071273 - RNA, 19 nt, Homo sapiens
gcacauccaccaggagucu

SEQ ID NO: 1071274 - RNA, 19 nt, Homo sapiens
uggcuguacugcuggagaa

SEQ ID NO: 1071275 - RNA, 19 nt, Homo sapiens
ggagcugcugccuucauuu

SEQ ID NO: 1071276 - RNA, 19 nt, Homo sapiens
uggagaauguucccaacca

SEQ ID NO: 1071277 - RNA, 19 nt, Homo sapiens
guaccuccuucauggacau

SEQ ID NO: 1071278 - RNA, 19 nt, Homo sapiens
gugauaauaaacucucaug

SEQ ID NO: 1071279 - RNA, 19 nt, Homo sapiens
guacugcuggagaauguuc

SEQ ID NO: 1071280 - RNA, 19 nt, Homo sapiens
ggaaaagagaccagaagga

SEQ ID NO: 1071281 - RNA, 19 nt, Homo sapiens
cuacucuuauuacaacagu

SEQ ID NO: 1071282 - RNA, 19 nt, Homo sapiens
caucgcugcccucaaacuu

SEQ ID NO: 1071283 - RNA, 19 nt, Homo sapiens
gaauguucccaaccaaagg

SEQ ID NO: 1071284 - RNA, 19 nt, Homo sapiens
cagaaggcuacaccuaugu

SEQ ID NO: 1071285 - RNA, 19 nt, Homo sapiens
agucagaaggcuacaccua

SEQ ID NO: 1071286 - RNA, 19 nt, Homo sapiens
uauggcuacucuuauuaca

SEQ ID NO: 1071287 - RNA, 19 nt, Homo sapiens
gaaagaagcuuaucugcaa

SEQ ID NO: 1071288 - RNA, 19 nt, Homo sapiens
uaagagaccuuccaaguuu

SEQ ID NO: 1071289 - RNA, 19 nt, Homo sapiens
guagaaaccugauacauga

SEQ ID NO: 1071290 - RNA, 19 nt, Homo sapiens
gagcuaggauuucauagua

SEQ ID NO: 1071291 - RNA, 19 nt, Homo sapiens
gaagagcaaucaucucaaa

SEQ ID NO: 1071292 - RNA, 19 nt, Homo sapiens
gguaagaaacuccuaauua

SEQ ID NO: 1071293 - RNA, 19 nt, Homo sapiens
caaacccacugccauauua

SEQ ID NO: 1071294 - RNA, 19 nt, Homo sapiens
gcaaucaucucaaacaguu

SEQ ID NO: 1071295 - RNA, 19 nt, Homo sapiens
gaacacaaguugggaaaug

SEQ ID NO: 1071296 - RNA, 19 nt, Homo sapiens
gcaauagcuuggauuauau

SEQ ID NO: 1071297 - RNA, 19 nt, Homo sapiens
cagcauaccuaauaauuug

SEQ ID NO: 1071298 - RNA, 19 nt, Homo sapiens
ccagcuagauugcaguuua

SEQ ID NO: 1071299 - RNA, 19 nt, Homo sapiens
gaacaggugccuaaauuau

SEQ ID NO: 1071300 - RNA, 19 nt, Homo sapiens
uaaagaagacuggaaguua

SEQ ID NO: 1071301 - RNA, 19 nt, Homo sapiens
caaaguagcuggguuucuu

SEQ ID NO: 1071302 - RNA, 19 nt, Homo sapiens
gaauuaacuuccuuuccua

SEQ ID NO: 1071303 - RNA, 19 nt, Homo sapiens
gaacucugguuaaacaaga

SEQ ID NO: 1071304 - RNA, 19 nt, Homo sapiens
gaucuuagguguaguagag

SEQ ID NO: 1071305 - RNA, 19 nt, Homo sapiens
guagcagacuguuaaauug

SEQ ID NO: 1071306 - RNA, 19 nt, Homo sapiens
uaacaaagccaguaucaug

SEQ ID NO: 1071307 - RNA, 19 nt, Homo sapiens
uaacaacauuugcaucuug

SEQ ID NO: 1071308 - RNA, 19 nt, Homo sapiens
guacauacugugcauauaa

SEQ ID NO: 1071309 - RNA, 19 nt, Homo sapiens
gcuagcaacugucgaaaga

SEQ ID NO: 1071310 - RNA, 19 nt, Homo sapiens
aaagcuaccuccuaaacua

SEQ ID NO: 1071311 - RNA, 19 nt, Homo sapiens
gaacucagcaucucacaau

SEQ ID NO: 1071312 - RNA, 19 nt, Homo sapiens
aaggagagguggcaguuua

SEQ ID NO: 1071313 - RNA, 19 nt, Homo sapiens
gaagaugcauuuaagaacu

SEQ ID NO: 1071314 - RNA, 19 nt, Homo sapiens
guaauuaugacacgaagua

SEQ ID NO: 1071315 - RNA, 19 nt, Homo sapiens
aagaacaggugccuaaauu

SEQ ID NO: 1071316 - RNA, 19 nt, Homo sapiens
uaaccuagauguaaguuuc

SEQ ID NO: 1071317 - RNA, 19 nt, Homo sapiens
gcgcuaugcuuacaaucua

SEQ ID NO: 1071318 - RNA, 19 nt, Homo sapiens
ggacuuuggacuugucuua

SEQ ID NO: 1071319 - RNA, 19 nt, Homo sapiens
uggcuaaacuacuaacuaa

SEQ ID NO: 1071320 - RNA, 19 nt, Homo sapiens
acaggugccuaaauuauaa

SEQ ID NO: 1071321 - RNA, 19 nt, Homo sapiens
ccugauaucucuaaggauu

SEQ ID NO: 1071322 - RNA, 19 nt, Homo sapiens
agcaauagcuuggauuaua

SEQ ID NO: 1071323 - RNA, 19 nt, Homo sapiens
cgauuuggcuaaacuacua

SEQ ID NO: 1071324 - RNA, 19 nt, Homo sapiens
gaagaagauuccuuugucu

SEQ ID NO: 1071325 - RNA, 19 nt, Homo sapiens
uggcuaaucuucaccaauu

SEQ ID NO: 1071326 - RNA, 19 nt, Homo sapiens
gccaauaacuaaccuagau

SEQ ID NO: 1071327 - RNA, 19 nt, Homo sapiens
gaacuuuccuuuucuagaa

SEQ ID NO: 1071328 - RNA, 19 nt, Homo sapiens
gaaaguaaacuguggucaa

SEQ ID NO: 1071329 - RNA, 19 nt, Homo sapiens
ggaacaggauuucuacuac

SEQ ID NO: 1071330 - RNA, 19 nt, Homo sapiens
acacuaagcuauacugcaa

SEQ ID NO: 1071331 - RNA, 19 nt, Homo sapiens
ucauuaggauucacuguaa

SEQ ID NO: 1071332 - RNA, 19 nt, Homo sapiens
gaaagguacugcugaugca

SEQ ID NO: 1071333 - RNA, 19 nt, Homo sapiens
ggagaaagguacugcugau

SEQ ID NO: 1071334 - RNA, 19 nt, Homo sapiens
gaaccugugcuauuaaaug

SEQ ID NO: 1071335 - RNA, 19 nt, Homo sapiens
aauaguaucugagggauuu

SEQ ID NO: 1071336 - RNA, 19 nt, Homo sapiens
gaagucuguuacucugaua

SEQ ID NO: 1071337 - RNA, 19 nt, Homo sapiens
gaaacgccaucauuaggau

SEQ ID NO: 1071338 - RNA, 19 nt, Homo sapiens
ggaaggauuuauuuacagu

SEQ ID NO: 1071339 - RNA, 19 nt, Homo sapiens
ucaaagaacaggugccuaa

SEQ ID NO: 1071340 - RNA, 19 nt, Homo sapiens
uaagcccugugaauauuua

SEQ ID NO: 1071341 - RNA, 19 nt, Homo sapiens
gaaauucacaguagagcuu

SEQ ID NO: 1071342 - RNA, 19 nt, Homo sapiens
gcagcauaccuaauaauuu

SEQ ID NO: 1071343 - RNA, 19 nt, Homo sapiens
aauuaaagcuaccuccuaa

SEQ ID NO: 1071344 - RNA, 19 nt, Homo sapiens
uuagugagcuggauuaucu

SEQ ID NO: 1071345 - RNA, 19 nt, Homo sapiens
guuaaagacugaacuacug

SEQ ID NO: 1071346 - RNA, 19 nt, Homo sapiens
ugaagaagauuccuuuguc

SEQ ID NO: 1071347 - RNA, 19 nt, Homo sapiens
aggauucacuguaacguua

SEQ ID NO: 1071348 - RNA, 19 nt, Homo sapiens
uaacuaaccuagauguaag

SEQ ID NO: 1071349 - RNA, 19 nt, Homo sapiens
gcaacgaccuuucuuuuau

SEQ ID NO: 1071350 - RNA, 19 nt, Homo sapiens
acagugugcuaaaucaaua

SEQ ID NO: 1071351 - RNA, 19 nt, Homo sapiens
gaaauuuccauacaucuuc

SEQ ID NO: 1071352 - RNA, 19 nt, Homo sapiens
uuaaagagcuaggauuuca

SEQ ID NO: 1071353 - RNA, 19 nt, Homo sapiens
gguggagucuuaaaguuau

SEQ ID NO: 1071354 - RNA, 19 nt, Homo sapiens
ugaacaacauuacucaguu

SEQ ID NO: 1071355 - RNA, 19 nt, Homo sapiens
uaagcagcauaccuaauaa

SEQ ID NO: 1071356 - RNA, 19 nt, Homo sapiens
guugaacucugguuaaaca

SEQ ID NO: 1071357 - RNA, 19 nt, Homo sapiens
gcuaaacuacuaacuaaug

SEQ ID NO: 1071358 - RNA, 19 nt, Homo sapiens
gaacccuauucucaucuuu

SEQ ID NO: 1071359 - RNA, 19 nt, Homo sapiens
ucacacagcuguccugcau

SEQ ID NO: 1071360 - RNA, 19 nt, Homo sapiens
cucagcaucucacaauuua

SEQ ID NO: 1071361 - RNA, 19 nt, Homo sapiens
cagcuagauugcaguuuaa

SEQ ID NO: 1071362 - RNA, 19 nt, Homo sapiens
ucuugaaccugugcuauua

SEQ ID NO: 1071363 - RNA, 19 nt, Homo sapiens
uuacugaagcgacguguua

SEQ ID NO: 1071364 - RNA, 19 nt, Homo sapiens
auaagcagcauaccuaaua

SEQ ID NO: 1071365 - RNA, 19 nt, Homo sapiens
uagauaaccuggagaccuu

SEQ ID NO: 1071366 - RNA, 19 nt, Homo sapiens
gcaaacccacugccauauu

SEQ ID NO: 1071367 - RNA, 19 nt, Homo sapiens
aaaguaaacuguggucaau

SEQ ID NO: 1071368 - RNA, 19 nt, Homo sapiens
acacagcuguccugcauug

SEQ ID NO: 1071369 - RNA, 19 nt, Homo sapiens
gcaugucgcuuggcuaauc

SEQ ID NO: 1071370 - RNA, 19 nt, Homo sapiens
gguaauccacucuuaagaa

SEQ ID NO: 1071371 - RNA, 19 nt, Homo sapiens
gccagaagaugcauuuaag

SEQ ID NO: 1071372 - RNA, 19 nt, Homo sapiens
agacugaacuacugugugu

SEQ ID NO: 1071373 - RNA, 19 nt, Homo sapiens
ggccugauaucucuaagga

SEQ ID NO: 1071374 - RNA, 19 nt, Homo sapiens
gaucuucauucccuaguca

SEQ ID NO: 1071375 - RNA, 19 nt, Homo sapiens
ggguggagucuuaaaguua

SEQ ID NO: 1071376 - RNA, 19 nt, Homo sapiens
gaaagaauaaagcuuaguc

SEQ ID NO: 1071377 - RNA, 19 nt, Homo sapiens
ccuaauguuucauccuuaa

SEQ ID NO: 1071378 - RNA, 19 nt, Homo sapiens
aauccacucuuaagaacua

SEQ ID NO: 1071379 - RNA, 19 nt, Homo sapiens
gauggagcauuugauggua

SEQ ID NO: 1071380 - RNA, 19 nt, Homo sapiens
gaaauguggcuucuguuca

SEQ ID NO: 1071381 - RNA, 19 nt, Homo sapiens
ggaaauguggcuucuguuc

SEQ ID NO: 1071382 - RNA, 19 nt, Homo sapiens
ucagaaaacucacaaucua

SEQ ID NO: 1071383 - RNA, 19 nt, Homo sapiens
gggaagagcaaucaucuca

SEQ ID NO: 1071384 - RNA, 19 nt, Homo sapiens
cucagaaagugccauauuu

SEQ ID NO: 1071385 - RNA, 19 nt, Homo sapiens
guacaaagauaagcagcau

SEQ ID NO: 1071386 - RNA, 19 nt, Homo sapiens
gcuaggauuucauaguaau

SEQ ID NO: 1071387 - RNA, 19 nt, Homo sapiens
ggacaugucuggccuccaa

SEQ ID NO: 1071388 - RNA, 19 nt, Homo sapiens
ucaagucucuccagugugu

SEQ ID NO: 1071389 - RNA, 19 nt, Homo sapiens
ccucgaggcugcucaguga

SEQ ID NO: 1071390 - RNA, 19 nt, Homo sapiens
agaccuaccuggaggaaga

SEQ ID NO: 1071391 - RNA, 19 nt, Homo sapiens
gaaucugcuuugucuucua

SEQ ID NO: 1071392 - RNA, 19 nt, Homo sapiens
guggaauucuugcgucuga

SEQ ID NO: 1071393 - RNA, 19 nt, Homo sapiens
ggagaugcuucagaggauu

SEQ ID NO: 1071394 - RNA, 19 nt, Homo sapiens
cauauggccuggcucuaga

SEQ ID NO: 1071395 - RNA, 19 nt, Homo sapiens
ggcaggacguggcugaaga

SEQ ID NO: 1071396 - RNA, 19 nt, Homo sapiens
gcaaguaccaggacagcau

SEQ ID NO: 1071397 - RNA, 19 nt, Homo sapiens
cuucaagucucuccagugu

SEQ ID NO: 1071398 - RNA, 19 nt, Homo sapiens
cacgcuaccuccugagauu

SEQ ID NO: 1071399 - RNA, 19 nt, Homo sapiens
gcaaccggcugagcuugga

SEQ ID NO: 1071400 - RNA, 19 nt, Homo sapiens
ccagaaaugcccagacugu

SEQ ID NO: 1071401 - RNA, 19 nt, Homo sapiens
ccucagauuuggacagcuu

SEQ ID NO: 1071402 - RNA, 19 nt, Homo sapiens
acucgcaccugaagaaugu

SEQ ID NO: 1071403 - RNA, 19 nt, Homo sapiens
gcaaccuccuggccucugu

SEQ ID NO: 1071404 - RNA, 19 nt, Homo sapiens
gccucgaucucucucagaa

SEQ ID NO: 1071405 - RNA, 19 nt, Homo sapiens
ccaucaagcugccgagacu

SEQ ID NO: 1071406 - RNA, 19 nt, Homo sapiens
gcagccaccugggaugaca

SEQ ID NO: 1071407 - RNA, 19 nt, Homo sapiens
agaaaugcccagacuguuc

SEQ ID NO: 1071408 - RNA, 19 nt, Homo sapiens
ggggugaccuggagaccua

SEQ ID NO: 1071409 - RNA, 19 nt, Homo sapiens
gaagaaugugaaggaggua

SEQ ID NO: 1071410 - RNA, 19 nt, Homo sapiens
gaaccagaggcugcaguga

SEQ ID NO: 1071411 - RNA, 19 nt, Homo sapiens
gcagcccucauuccagaaa

SEQ ID NO: 1071412 - RNA, 19 nt, Homo sapiens
guuccgggaugaucuggau

SEQ ID NO: 1071413 - RNA, 19 nt, Homo sapiens
ggcacgaguuccgggauga

SEQ ID NO: 1071414 - RNA, 19 nt, Homo sapiens
agaaugugaaggagguaua

SEQ ID NO: 1071415 - RNA, 19 nt, Homo sapiens
ucaacagccuggagacacu

SEQ ID NO: 1071416 - RNA, 19 nt, Homo sapiens
gguucagggugaccacaau

SEQ ID NO: 1071417 - RNA, 19 nt, Homo sapiens
ggagcucacccaccuguac

SEQ ID NO: 1071418 - RNA, 19 nt, Homo sapiens
cauccagagucccuguuuc

SEQ ID NO: 1071419 - RNA, 19 nt, Homo sapiens
gaagaggugcgcgcagucu

SEQ ID NO: 1071420 - RNA, 19 nt, Homo sapiens
ccacuucuccugguuccuu

SEQ ID NO: 1071421 - RNA, 19 nt, Homo sapiens
ccauauggccuggcucuag

SEQ ID NO: 1071422 - RNA, 19 nt, Homo sapiens
guacaccaccaagaacugu

SEQ ID NO: 1071423 - RNA, 19 nt, Homo sapiens
gccugcaccuguuguacug

SEQ ID NO: 1071424 - RNA, 19 nt, Homo sapiens
ggagaccuaccuggaggaa

SEQ ID NO: 1071425 - RNA, 19 nt, Homo sapiens
gagaugcuucagaggauuc

SEQ ID NO: 1071426 - RNA, 19 nt, Homo sapiens
aggagaugcuucagaggau

SEQ ID NO: 1071427 - RNA, 19 nt, Homo sapiens
gaugagcagauccgucaca

SEQ ID NO: 1071428 - RNA, 19 nt, Homo sapiens
cugacacgguggagauguu

SEQ ID NO: 1071429 - RNA, 19 nt, Homo sapiens
cagaaaugcccagacuguu

SEQ ID NO: 1071430 - RNA, 19 nt, Homo sapiens
cucgaucucucucagaauc

SEQ ID NO: 1071431 - RNA, 19 nt, Homo sapiens
ccauccagagucccuguuu

SEQ ID NO: 1071432 - RNA, 19 nt, Homo sapiens
ucuacucgcaccugaagaa

SEQ ID NO: 1071433 - RNA, 19 nt, Homo sapiens
aaucugcuuugucuucuac

SEQ ID NO: 1071434 - RNA, 19 nt, Homo sapiens
ggacaugucuggccuccaa

SEQ ID NO: 1071435 - RNA, 19 nt, Homo sapiens
ucacacacuucuccuggua

SEQ ID NO: 1071436 - RNA, 19 nt, Homo sapiens
ucaagucucuccagugugu

SEQ ID NO: 1071437 - RNA, 19 nt, Homo sapiens
ccucgaggcugcucaguga

SEQ ID NO: 1071438 - RNA, 19 nt, Homo sapiens
agaccuaccuggaggaaga

SEQ ID NO: 1071439 - RNA, 19 nt, Homo sapiens
gaaucugcuuugucuucua

SEQ ID NO: 1071440 - RNA, 19 nt, Homo sapiens
guggaauucuugcgucuga

SEQ ID NO: 1071441 - RNA, 19 nt, Homo sapiens
ggagaugcuucagaggauu

SEQ ID NO: 1071442 - RNA, 19 nt, Homo sapiens
ggcaggacguggcugaaga

SEQ ID NO: 1071443 - RNA, 19 nt, Homo sapiens
gcaaguaccaggacagcau

SEQ ID NO: 1071444 - RNA, 19 nt, Homo sapiens
cuucaagucucuccagugu

SEQ ID NO: 1071445 - RNA, 19 nt, Homo sapiens
cacgcuaccuccugagauu

SEQ ID NO: 1071446 - RNA, 19 nt, Homo sapiens
gcaaccggcugagcuugga

SEQ ID NO: 1071447 - RNA, 19 nt, Homo sapiens
ccagaaaugcccagacugu

SEQ ID NO: 1071448 - RNA, 19 nt, Homo sapiens
ccucagauuuggacagcuu

SEQ ID NO: 1071449 - RNA, 19 nt, Homo sapiens
acucgcaccugaagaaugu

SEQ ID NO: 1071450 - RNA, 19 nt, Homo sapiens
gcaaccuccuggccucugu

SEQ ID NO: 1071451 - RNA, 19 nt, Homo sapiens
gccucgaucucucucagaa

SEQ ID NO: 1071452 - RNA, 19 nt, Homo sapiens
ccaucaagcugccgagacu

SEQ ID NO: 1071453 - RNA, 19 nt, Homo sapiens
gcagccaccugggaugaca

SEQ ID NO: 1071454 - RNA, 19 nt, Homo sapiens
agaaaugcccagacuguuc

SEQ ID NO: 1071455 - RNA, 19 nt, Homo sapiens
ggggugaccuggagaccua

SEQ ID NO: 1071456 - RNA, 19 nt, Homo sapiens
gaagaaugugaaggaggua

SEQ ID NO: 1071457 - RNA, 19 nt, Homo sapiens
gaaccagaggcugcaguga

SEQ ID NO: 1071458 - RNA, 19 nt, Homo sapiens
gcagcccucauuccagaaa

SEQ ID NO: 1071459 - RNA, 19 nt, Homo sapiens
guuccgggaugaucuggau

SEQ ID NO: 1071460 - RNA, 19 nt, Homo sapiens
ggcacgaguuccgggauga

SEQ ID NO: 1071461 - RNA, 19 nt, Homo sapiens
agaaugugaaggagguaua

SEQ ID NO: 1071462 - RNA, 19 nt, Homo sapiens
ucaacagccuggagacacu

SEQ ID NO: 1071463 - RNA, 19 nt, Homo sapiens
ggagcucacccaccuguac

SEQ ID NO: 1071464 - RNA, 19 nt, Homo sapiens
gaagaggugcgcgcagucu

SEQ ID NO: 1071465 - RNA, 19 nt, Homo sapiens
gcuuccaggucacacacuu

SEQ ID NO: 1071466 - RNA, 19 nt, Homo sapiens
ccacuucuccugguuccuu

SEQ ID NO: 1071467 - RNA, 19 nt, Homo sapiens
aggagaugcuucagaggau

SEQ ID NO: 1071468 - RNA, 19 nt, Homo sapiens
guacaccaccaagaacugu

SEQ ID NO: 1071469 - RNA, 19 nt, Homo sapiens
gccugcaccuguuguacug

SEQ ID NO: 1071470 - RNA, 19 nt, Homo sapiens
ggagaccuaccuggaggaa

SEQ ID NO: 1071471 - RNA, 19 nt, Homo sapiens
gagaugcuucagaggauuc

SEQ ID NO: 1071472 - RNA, 19 nt, Homo sapiens
gaugagcagauccgucaca

SEQ ID NO: 1071473 - RNA, 19 nt, Homo sapiens
cugacacgguggagauguu

SEQ ID NO: 1071474 - RNA, 19 nt, Homo sapiens
cagaaaugcccagacuguu

SEQ ID NO: 1071475 - RNA, 19 nt, Homo sapiens
cucgaucucucucagaauc

SEQ ID NO: 1071476 - RNA, 19 nt, Homo sapiens
ucuacucgcaccugaagaa

SEQ ID NO: 1071477 - RNA, 19 nt, Homo sapiens
aaucugcuuugucuucuac

SEQ ID NO: 1071478 - RNA, 19 nt, Homo sapiens
ggacaugucuggccuccaa

SEQ ID NO: 1071479 - RNA, 19 nt, Homo sapiens
ucacacacuucuccuggua

SEQ ID NO: 1071480 - RNA, 19 nt, Homo sapiens
ucaagucucuccagugugu

SEQ ID NO: 1071481 - RNA, 19 nt, Homo sapiens
ccucgaggcugcucaguga

SEQ ID NO: 1071482 - RNA, 19 nt, Homo sapiens
agaccuaccuggaggaaga

SEQ ID NO: 1071483 - RNA, 19 nt, Homo sapiens
gaaucugcuuugucuucua

SEQ ID NO: 1071484 - RNA, 19 nt, Homo sapiens
guggaauucuugcgucuga

SEQ ID NO: 1071485 - RNA, 19 nt, Homo sapiens
ggagaugcuucagaggauu

SEQ ID NO: 1071486 - RNA, 19 nt, Homo sapiens
ggcaggacguggcugaaga

SEQ ID NO: 1071487 - RNA, 19 nt, Homo sapiens
gcaaguaccaggacagcau

SEQ ID NO: 1071488 - RNA, 19 nt, Homo sapiens
cuucaagucucuccagugu

SEQ ID NO: 1071489 - RNA, 19 nt, Homo sapiens
cacgcuaccuccugagauu

SEQ ID NO: 1071490 - RNA, 19 nt, Homo sapiens
gcaaccggcugagcuugga

SEQ ID NO: 1071491 - RNA, 19 nt, Homo sapiens
ccagaaaugcccagacugu

SEQ ID NO: 1071492 - RNA, 19 nt, Homo sapiens
ccucagauuuggacagcuu

SEQ ID NO: 1071493 - RNA, 19 nt, Homo sapiens
acucgcaccugaagaaugu

SEQ ID NO: 1071494 - RNA, 19 nt, Homo sapiens
gcaaccuccuggccucugu

SEQ ID NO: 1071495 - RNA, 19 nt, Homo sapiens
gccucgaucucucucagaa

SEQ ID NO: 1071496 - RNA, 19 nt, Homo sapiens
ccaucaagcugccgagacu

SEQ ID NO: 1071497 - RNA, 19 nt, Homo sapiens
gcagccaccugggaugaca

SEQ ID NO: 1071498 - RNA, 19 nt, Homo sapiens
agaaaugcccagacuguuc

SEQ ID NO: 1071499 - RNA, 19 nt, Homo sapiens
ggggugaccuggagaccua

SEQ ID NO: 1071500 - RNA, 19 nt, Homo sapiens
gaaccagaggcugcaguga

SEQ ID NO: 1071501 - RNA, 19 nt, Homo sapiens
gcagcccucauuccagaaa

SEQ ID NO: 1071502 - RNA, 19 nt, Homo sapiens
guuccgggaugaucuggau

SEQ ID NO: 1071503 - RNA, 19 nt, Homo sapiens
ggcacgaguuccgggauga

SEQ ID NO: 1071504 - RNA, 19 nt, Homo sapiens
ucaacagccuggagacacu

SEQ ID NO: 1071505 - RNA, 19 nt, Homo sapiens
ggagcucacccaccuguac

SEQ ID NO: 1071506 - RNA, 19 nt, Homo sapiens
gaagaggugcgcgcagucu

SEQ ID NO: 1071507 - RNA, 19 nt, Homo sapiens
gcuuccaggucacacacuu

SEQ ID NO: 1071508 - RNA, 19 nt, Homo sapiens
ccacuucuccugguuccuu

SEQ ID NO: 1071509 - RNA, 19 nt, Homo sapiens
aggagaugcuucagaggau

SEQ ID NO: 1071510 - RNA, 19 nt, Homo sapiens
guacaccaccaagaacugu

SEQ ID NO: 1071511 - RNA, 19 nt, Homo sapiens
gccugcaccuguuguacug

SEQ ID NO: 1071512 - RNA, 19 nt, Homo sapiens
ggagaccuaccuggaggaa

SEQ ID NO: 1071513 - RNA, 19 nt, Homo sapiens
gagaugcuucagaggauuc

SEQ ID NO: 1071514 - RNA, 19 nt, Homo sapiens
gaugagcagauccgucaca

SEQ ID NO: 1071515 - RNA, 19 nt, Homo sapiens
cugacacgguggagauguu

SEQ ID NO: 1071516 - RNA, 19 nt, Homo sapiens
cagaaaugcccagacuguu

SEQ ID NO: 1071517 - RNA, 19 nt, Homo sapiens
cucgaucucucucagaauc

SEQ ID NO: 1071518 - RNA, 19 nt, Homo sapiens
ucuacucgcaccugaagaa

SEQ ID NO: 1071519 - RNA, 19 nt, Homo sapiens
aaucugcuuugucuucuac

SEQ ID NO: 1071520 - RNA, 19 nt, Homo sapiens
gaaacacucuucaacauua

SEQ ID NO: 1071521 - RNA, 19 nt, Homo sapiens
caacacaccuggcuaauuu

SEQ ID NO: 1071522 - RNA, 19 nt, Homo sapiens
ggaagcagauucagguuua

SEQ ID NO: 1071523 - RNA, 19 nt, Homo sapiens
ggauauauauucugccaua

SEQ ID NO: 1071524 - RNA, 19 nt, Homo sapiens
caaccauucugaucaguua

SEQ ID NO: 1071525 - RNA, 19 nt, Homo sapiens
ggucugaucuuuacguauu

SEQ ID NO: 1071526 - RNA, 19 nt, Homo sapiens
ggaaugaugguuugagaua

SEQ ID NO: 1071527 - RNA, 19 nt, Homo sapiens
gcucacaccuguaauccua

SEQ ID NO: 1071528 - RNA, 19 nt, Homo sapiens
gagaaacacucuucaacau

SEQ ID NO: 1071529 - RNA, 19 nt, Homo sapiens
caaccuagauguccaguuc

SEQ ID NO: 1071530 - RNA, 19 nt, Homo sapiens
caacaccucuuacguaaag

SEQ ID NO: 1071531 - RNA, 19 nt, Homo sapiens
gaaaccaggaguuauuuaa

SEQ ID NO: 1071532 - RNA, 19 nt, Homo sapiens
gggcuuugcucaccacuuu

SEQ ID NO: 1071533 - RNA, 19 nt, Homo sapiens
cagaguccgugucaucuua

SEQ ID NO: 1071534 - RNA, 19 nt, Homo sapiens
cuacugaccuaucuucaaa

SEQ ID NO: 1071535 - RNA, 19 nt, Homo sapiens
gcagauccaaagacuauua

SEQ ID NO: 1071536 - RNA, 19 nt, Homo sapiens
uaaagacucuacugaccua

SEQ ID NO: 1071537 - RNA, 19 nt, Homo sapiens
gcaauugaguacuacagaa

SEQ ID NO: 1071538 - RNA, 19 nt, Homo sapiens
gagcagauccaaagacuau

SEQ ID NO: 1071539 - RNA, 19 nt, Homo sapiens
gcaaacccauggaauaucu

SEQ ID NO: 1071540 - RNA, 19 nt, Homo sapiens
ggccaaagcaucaacuaua

SEQ ID NO: 1071541 - RNA, 19 nt, Homo sapiens
uaagaaaccaggaguuauu

SEQ ID NO: 1071542 - RNA, 19 nt, Homo sapiens
ucacguaacuacagagguu

SEQ ID NO: 1071543 - RNA, 19 nt, Homo sapiens
caaacacacuuagggaauu

SEQ ID NO: 1071544 - RNA, 19 nt, Homo sapiens
aaacgcaguacuucuauua

SEQ ID NO: 1071545 - RNA, 19 nt, Homo sapiens
guacaugaauugcagaucu

SEQ ID NO: 1071546 - RNA, 19 nt, Homo sapiens
cauaagaaaccaggaguua

SEQ ID NO: 1071547 - RNA, 19 nt, Homo sapiens
ggaacggucugaucuuuac

SEQ ID NO: 1071548 - RNA, 19 nt, Homo sapiens
caaccacucucuauuacau

SEQ ID NO: 1071549 - RNA, 19 nt, Homo sapiens
ccauagaaaugcuacaugu

SEQ ID NO: 1071550 - RNA, 19 nt, Homo sapiens
gaagagccaaccauucuga

SEQ ID NO: 1071551 - RNA, 19 nt, Homo sapiens
gacaagguuucccuacauu

SEQ ID NO: 1071552 - RNA, 19 nt, Homo sapiens
aggaauggcugggcaauaa

SEQ ID NO: 1071553 - RNA, 19 nt, Homo sapiens
ggucuucuauucagcuauu

SEQ ID NO: 1071554 - RNA, 19 nt, Homo sapiens
gaucuaagaaggaauguuc

SEQ ID NO: 1071555 - RNA, 19 nt, Homo sapiens
guucucaccuugaaacaga

SEQ ID NO: 1071556 - RNA, 19 nt, Homo sapiens
caaaucaugcuccagaauu

SEQ ID NO: 1071557 - RNA, 19 nt, Homo sapiens
gccaaagcaucaacuauag

SEQ ID NO: 1071558 - RNA, 19 nt, Homo sapiens
guaaugcccuuaggaaagu

SEQ ID NO: 1071559 - RNA, 19 nt, Homo sapiens
acacaaauccuuccucaau

SEQ ID NO: 1071560 - RNA, 19 nt, Homo sapiens
gagacaagguuucccuaca

SEQ ID NO: 1071561 - RNA, 19 nt, Homo sapiens
aaacacacuuagggaauuu

SEQ ID NO: 1071562 - RNA, 19 nt, Homo sapiens
uaauguggauuucuucugu

SEQ ID NO: 1071563 - RNA, 19 nt, Homo sapiens
gcagauucagguuuauuaa

SEQ ID NO: 1071564 - RNA, 19 nt, Homo sapiens
aaucacagcucacugaagu

SEQ ID NO: 1071565 - RNA, 19 nt, Homo sapiens
gcaaacacacuuagggaau

SEQ ID NO: 1071566 - RNA, 19 nt, Homo sapiens
acaaauccuuccucaauca

SEQ ID NO: 1071567 - RNA, 19 nt, Homo sapiens
cuacuugcccucaacauuu

SEQ ID NO: 1071568 - RNA, 19 nt, Homo sapiens
caaagcaucaacuauagaa

SEQ ID NO: 1071569 - RNA, 19 nt, Homo sapiens
ggaugggaaugaugguuug

SEQ ID NO: 1071570 - RNA, 19 nt, Homo sapiens
ggaguacaguggcacaauc

SEQ ID NO: 1071571 - RNA, 19 nt, Homo sapiens
gaaauuagacauggugagu

SEQ ID NO: 1071572 - RNA, 19 nt, Homo sapiens
uggcuuaaguaaccaauug

SEQ ID NO: 1071573 - RNA, 19 nt, Homo sapiens
gguacuuacuggacacuga

SEQ ID NO: 1071574 - RNA, 19 nt, Homo sapiens
uaggaacggucugaucuuu

SEQ ID NO: 1071575 - RNA, 19 nt, Homo sapiens
caaaggaacagguuagaag

SEQ ID NO: 1071576 - RNA, 19 nt, Homo sapiens
ugaguucguuccuguaaug

SEQ ID NO: 1071577 - RNA, 19 nt, Homo sapiens
gaacgaaugcuuccuucuc

SEQ ID NO: 1071578 - RNA, 19 nt, Homo sapiens
uauuagacauucuguagga

SEQ ID NO: 1071579 - RNA, 19 nt, Homo sapiens
gacaauggccaaagcauca

SEQ ID NO: 1071580 - RNA, 19 nt, Homo sapiens
aaaguuagauuaggaagca

SEQ ID NO: 1071581 - RNA, 19 nt, Homo sapiens
aaacucacguaacuacaga

SEQ ID NO: 1071582 - RNA, 19 nt, Homo sapiens
aaagcugacucuaggcaaa

SEQ ID NO: 1071583 - RNA, 19 nt, Homo sapiens
aauccuuccucaaucaaua

SEQ ID NO: 1071584 - RNA, 19 nt, Homo sapiens
ucaaaagggucuucuauuc

SEQ ID NO: 1071585 - RNA, 19 nt, Homo sapiens
cguuaaaccuauugguaaa

SEQ ID NO: 1071586 - RNA, 19 nt, Homo sapiens
gcugagaugcuccagguuu

SEQ ID NO: 1071587 - RNA, 19 nt, Homo sapiens
guaccugucaccagaaauu

SEQ ID NO: 1071588 - RNA, 19 nt, Homo sapiens
cucaacaccucuuacguaa

SEQ ID NO: 1071589 - RNA, 19 nt, Homo sapiens
guggagaguuuugaaauua

SEQ ID NO: 1071590 - RNA, 19 nt, Homo sapiens
gcuuguaaaugaaagaauc

SEQ ID NO: 1071591 - RNA, 19 nt, Homo sapiens
gcagaucuaagaaggaaug

SEQ ID NO: 1071592 - RNA, 19 nt, Homo sapiens
gaagcagauucagguuuau

SEQ ID NO: 1071593 - RNA, 19 nt, Homo sapiens
uuaaagcucucaaggugau

SEQ ID NO: 1071594 - RNA, 19 nt, Homo sapiens
ucucaacaccucuuacgua

SEQ ID NO: 1071595 - RNA, 19 nt, Homo sapiens
aauuagacauggugaguau

SEQ ID NO: 1071596 - RNA, 19 nt, Homo sapiens
ccacaucccaccaccugua

SEQ ID NO: 1071597 - RNA, 19 nt, Homo sapiens
guaggaaggcuuuauaaaa

SEQ ID NO: 1071598 - RNA, 19 nt, Homo sapiens
cacccaagcuccuguccaa

SEQ ID NO: 1071599 - RNA, 19 nt, Homo sapiens
acacugaauuccugcucua

SEQ ID NO: 1071600 - RNA, 19 nt, Homo sapiens
gaaugacaauggccaaagc

SEQ ID NO: 1071601 - RNA, 19 nt, Homo sapiens
gcaggagaauggugugaac

SEQ ID NO: 1071602 - RNA, 19 nt, Homo sapiens
gagccaaccauucugauca

SEQ ID NO: 1071603 - RNA, 19 nt, Homo sapiens
agacaagguuucccuacau

SEQ ID NO: 1071604 - RNA, 19 nt, Homo sapiens
ccaucuagauacaaauuag

SEQ ID NO: 1071605 - RNA, 19 nt, Homo sapiens
uacaugaauugcagaucua

SEQ ID NO: 1071606 - RNA, 19 nt, Homo sapiens
ccaacuccaucuagauaca

SEQ ID NO: 1071607 - RNA, 19 nt, Homo sapiens
gugcaaacccauggaauau

SEQ ID NO: 1071608 - RNA, 19 nt, Homo sapiens
gaaugaugguuugagauac

SEQ ID NO: 1071609 - RNA, 19 nt, Homo sapiens
gaauggcugggcaauaaug

SEQ ID NO: 1071610 - RNA, 19 nt, Homo sapiens
caagggcgugaaccucuua

SEQ ID NO: 1071611 - RNA, 19 nt, Homo sapiens
uaguagcccuccaucauca

SEQ ID NO: 1071612 - RNA, 19 nt, Homo sapiens
augcaaccacucucuauua

SEQ ID NO: 1071613 - RNA, 19 nt, Homo sapiens
cacaaauccuuccucaauc

SEQ ID NO: 1071614 - RNA, 19 nt, Homo sapiens
uagaauggauuaucaaccu

SEQ ID NO: 1071615 - RNA, 19 nt, Homo sapiens
uagaaaugcuacauguaca

SEQ ID NO: 1071616 - RNA, 19 nt, Homo sapiens
cauagaaaugcuacaugua

SEQ ID NO: 1071617 - RNA, 19 nt, Homo sapiens
caagguuguugcuuugaca

SEQ ID NO: 1071618 - RNA, 19 nt, Homo sapiens
ggugaguucguuccuguaa

SEQ ID NO: 1071619 - RNA, 19 nt, Homo sapiens
gaggaauggcugggcaaua

SEQ ID NO: 1071620 - RNA, 19 nt, Homo sapiens
gcaagaggcugcugagaaa

SEQ ID NO: 1071621 - RNA, 19 nt, Homo sapiens
gcuggaagcucucggauau

SEQ ID NO: 1071622 - RNA, 19 nt, Homo sapiens
ucaacaaccucacugcaaa

SEQ ID NO: 1071623 - RNA, 19 nt, Homo sapiens
ucauagagcugugucugua

SEQ ID NO: 1071624 - RNA, 19 nt, Homo sapiens
ucacagcucagacuucaua

SEQ ID NO: 1071625 - RNA, 19 nt, Homo sapiens
ugaggaagcuccagagaag

SEQ ID NO: 1071626 - RNA, 19 nt, Homo sapiens
aaaccgaggugcagcaguu

SEQ ID NO: 1071627 - RNA, 19 nt, Homo sapiens
ucaccuaccucuccaguca

SEQ ID NO: 1071628 - RNA, 19 nt, Homo sapiens
guagagccuuuggagauuu

SEQ ID NO: 1071629 - RNA, 19 nt, Homo sapiens
gcuccaggaucguguguau

SEQ ID NO: 1071630 - RNA, 19 nt, Homo sapiens
ggaaaggcaucaggaagag

SEQ ID NO: 1071631 - RNA, 19 nt, Homo sapiens
uuacagcuguugccaguau

SEQ ID NO: 1071632 - RNA, 19 nt, Homo sapiens
cuucuuaccuccucaccua

SEQ ID NO: 1071633 - RNA, 19 nt, Homo sapiens
aaaugcagcucagagauga

SEQ ID NO: 1071634 - RNA, 19 nt, Homo sapiens
gaugagacagaauaaaguu

SEQ ID NO: 1071635 - RNA, 19 nt, Homo sapiens
uagagccuuuggagauuua

SEQ ID NO: 1071636 - RNA, 19 nt, Homo sapiens
caagcuuguuuguccagua

SEQ ID NO: 1071637 - RNA, 19 nt, Homo sapiens
auagagcugugucuguaua

SEQ ID NO: 1071638 - RNA, 19 nt, Homo sapiens
caaaugcagcucagagaug

SEQ ID NO: 1071639 - RNA, 19 nt, Homo sapiens
gaucuuguuucucaauguc

SEQ ID NO: 1071640 - RNA, 19 nt, Homo sapiens
gaaguaguaggccagaguu

SEQ ID NO: 1071641 - RNA, 19 nt, Homo sapiens
gccuuuggcuccucaacaa

SEQ ID NO: 1071642 - RNA, 19 nt, Homo sapiens
gcaaaugcagcucagagau

SEQ ID NO: 1071643 - RNA, 19 nt, Homo sapiens
guaauggugcucacaguuc

SEQ ID NO: 1071644 - RNA, 19 nt, Homo sapiens
agggugaucuuguuucuca

SEQ ID NO: 1071645 - RNA, 19 nt, Homo sapiens
agauuuaggaccauaauga

SEQ ID NO: 1071646 - RNA, 19 nt, Homo sapiens
guuuggagcugcugcaucu

SEQ ID NO: 1071647 - RNA, 19 nt, Homo sapiens
ccauguggcugugcuggaa

SEQ ID NO: 1071648 - RNA, 19 nt, Homo sapiens
caguagagccuuuggagau

SEQ ID NO: 1071649 - RNA, 19 nt, Homo sapiens
gauugagccucucuuacag

SEQ ID NO: 1071650 - RNA, 19 nt, Homo sapiens
ugauugagccucucuuaca

SEQ ID NO: 1071651 - RNA, 19 nt, Homo sapiens
ggagagugaggcugugaga

SEQ ID NO: 1071652 - RNA, 19 nt, Homo sapiens
gaaacacagcaaaccuuca

SEQ ID NO: 1071653 - RNA, 19 nt, Homo sapiens
cagaaaaggguccugcuua

SEQ ID NO: 1071654 - RNA, 19 nt, Homo sapiens
ccgccacccuucauguuug

SEQ ID NO: 1071655 - RNA, 19 nt, Homo sapiens
ggagauuuaggaccauaau

SEQ ID NO: 1071656 - RNA, 19 nt, Homo sapiens
guuguggcagccuuauuua

SEQ ID NO: 1071657 - RNA, 19 nt, Homo sapiens
uggaaaggcaucaggaaga

SEQ ID NO: 1071658 - RNA, 19 nt, Homo sapiens
caucugcuguuccuguauc

SEQ ID NO: 1071659 - RNA, 19 nt, Homo sapiens
aguagagccuuuggagauu

SEQ ID NO: 1071660 - RNA, 19 nt, Homo sapiens
uaauggugcucacaguucu

SEQ ID NO: 1071661 - RNA, 19 nt, Homo sapiens
caccuaagccaagaccuuu

SEQ ID NO: 1071662 - RNA, 19 nt, Homo sapiens
guaguaggccagaguuugg

SEQ ID NO: 1071663 - RNA, 19 nt, Homo sapiens
ccuggugccuucauuacau

SEQ ID NO: 1071664 - RNA, 19 nt, Homo sapiens
cagaggcuguucaggucuu

SEQ ID NO: 1071665 - RNA, 19 nt, Homo sapiens
aaacacagcaaaccuucau

SEQ ID NO: 1071666 - RNA, 19 nt, Homo sapiens
uauuuauccuucugcaguu

SEQ ID NO: 1071667 - RNA, 19 nt, Homo sapiens
ggcaaaugcagcucagaga

SEQ ID NO: 1071668 - RNA, 19 nt, Homo sapiens
guugcaaccuggcccaaag

SEQ ID NO: 1071669 - RNA, 19 nt, Homo sapiens
gcugguagcuuuugaugag

SEQ ID NO: 1071670 - RNA, 19 nt, Homo sapiens
ucucugcucccacaccuaa

SEQ ID NO: 1071671 - RNA, 19 nt, Homo sapiens
ucugauugagccucucuua

SEQ ID NO: 1071672 - RNA, 19 nt, Homo sapiens
gcguaauggugcucacagu

SEQ ID NO: 1071673 - RNA, 19 nt, Homo sapiens
uguuguggcagccuuauuu

SEQ ID NO: 1071674 - RNA, 19 nt, Homo sapiens
gugaucuuguuucucaaug

SEQ ID NO: 1071675 - RNA, 19 nt, Homo sapiens
uucugacacugaaguagua

SEQ ID NO: 1071676 - RNA, 19 nt, Homo sapiens
uaacguggugagcguaaug

SEQ ID NO: 1071677 - RNA, 19 nt, Homo sapiens
cagcucagacuucauagag

SEQ ID NO: 1071678 - RNA, 19 nt, Homo sapiens
gagauuuaggaccauaaug

SEQ ID NO: 1071679 - RNA, 19 nt, Homo sapiens
aagcuuguuuguccaguag

SEQ ID NO: 1071680 - RNA, 19 nt, Homo sapiens
cagcagacagcucuucaag

SEQ ID NO: 1071681 - RNA, 19 nt, Homo sapiens
ugcaucugcuguuccugua

SEQ ID NO: 1071682 - RNA, 19 nt, Homo sapiens
gguugcugcuguuggacuu

SEQ ID NO: 1071683 - RNA, 19 nt, Homo sapiens
gaagcuccagagaagauca

SEQ ID NO: 1071684 - RNA, 19 nt, Homo sapiens
uggaagcucucggauaugc

SEQ ID NO: 1071685 - RNA, 19 nt, Homo sapiens
gacucaguguggucuacuu

SEQ ID NO: 1071686 - RNA, 19 nt, Homo sapiens
gauuuaggaccauaaugag

SEQ ID NO: 1071687 - RNA, 19 nt, Homo sapiens
gcugcacacacuagccuuu

SEQ ID NO: 1071688 - RNA, 19 nt, Homo sapiens
agagugaggcugugagaag

SEQ ID NO: 1071689 - RNA, 19 nt, Homo sapiens
ucaguguggucuacuuacu

SEQ ID NO: 1071690 - RNA, 19 nt, Homo sapiens
acucaguguggucuacuua

SEQ ID NO: 1071691 - RNA, 19 nt, Homo sapiens
ugaucuuguuucucaaugu

SEQ ID NO: 1071692 - RNA, 19 nt, Homo sapiens
ugaaguaguaggccagagu

SEQ ID NO: 1071693 - RNA, 19 nt, Homo sapiens
gcugaggaagcuccagaga

SEQ ID NO: 1071694 - RNA, 19 nt, Homo sapiens
gcagccaggucagcaaucc

SEQ ID NO: 1071695 - RNA, 19 nt, Homo sapiens
ggagacaaaugccuagaua

SEQ ID NO: 1071696 - RNA, 19 nt, Homo sapiens
caaguaagaugagaacuaa

SEQ ID NO: 1071697 - RNA, 19 nt, Homo sapiens
ggacagaggagucaaguaa

SEQ ID NO: 1071698 - RNA, 19 nt, Homo sapiens
gggaagaaaugcagcagua

SEQ ID NO: 1071699 - RNA, 19 nt, Homo sapiens
gauggaagcuuacuuugga

SEQ ID NO: 1071700 - RNA, 19 nt, Homo sapiens
gaauguacuucaacacaaa

SEQ ID NO: 1071701 - RNA, 19 nt, Homo sapiens
gaggugaacauucuucuua

SEQ ID NO: 1071702 - RNA, 19 nt, Homo sapiens
ggaauugacugaaaaguaa

SEQ ID NO: 1071703 - RNA, 19 nt, Homo sapiens
ggacagagucuuaaauaau

SEQ ID NO: 1071704 - RNA, 19 nt, Homo sapiens
ggaaagauacacagaguga

SEQ ID NO: 1071705 - RNA, 19 nt, Homo sapiens
cauuugagauggaagcuua

SEQ ID NO: 1071706 - RNA, 19 nt, Homo sapiens
gcugcuaguuguucuauuu

SEQ ID NO: 1071707 - RNA, 19 nt, Homo sapiens
ggaauguacuucaacacaa

SEQ ID NO: 1071708 - RNA, 19 nt, Homo sapiens
ggagaugucuuuggcuuug

SEQ ID NO: 1071709 - RNA, 19 nt, Homo sapiens
gaagcuuacuuuggaauug

SEQ ID NO: 1071710 - RNA, 19 nt, Homo sapiens
gaacuaaaaugccguugaa

SEQ ID NO: 1071711 - RNA, 19 nt, Homo sapiens
ggagguaucagccaauaaa

SEQ ID NO: 1071712 - RNA, 19 nt, Homo sapiens
gaagcuaaauuuggaagug

SEQ ID NO: 1071713 - RNA, 19 nt, Homo sapiens
cagcauggcaguaggaaua

SEQ ID NO: 1071714 - RNA, 19 nt, Homo sapiens
ggacaccagguauaaagua

SEQ ID NO: 1071715 - RNA, 19 nt, Homo sapiens
gaggagaugcuauucauug

SEQ ID NO: 1071716 - RNA, 19 nt, Homo sapiens
ugagaacacuuaaagaaca

SEQ ID NO: 1071717 - RNA, 19 nt, Homo sapiens
gcacuauugagaacacuua

SEQ ID NO: 1071718 - RNA, 19 nt, Homo sapiens
gaagagggccuaggacaga

SEQ ID NO: 1071719 - RNA, 19 nt, Homo sapiens
gagaacacuuaaagaacaa

SEQ ID NO: 1071720 - RNA, 19 nt, Homo sapiens
ggcaaaggauaaaguguau

SEQ ID NO: 1071721 - RNA, 19 nt, Homo sapiens
ggugaacauucuucuuauu

SEQ ID NO: 1071722 - RNA, 19 nt, Homo sapiens
ggcuauggcuuaagcugua

SEQ ID NO: 1071723 - RNA, 19 nt, Homo sapiens
gaagaaaugcagcaguaug

SEQ ID NO: 1071724 - RNA, 19 nt, Homo sapiens
gagaugcuauucauugucu

SEQ ID NO: 1071725 - RNA, 19 nt, Homo sapiens
cagaugaggugaacauucu

SEQ ID NO: 1071726 - RNA, 19 nt, Homo sapiens
agugagagcuguucuagug

SEQ ID NO: 1071727 - RNA, 19 nt, Homo sapiens
uuaaagugcucuccugugu

SEQ ID NO: 1071728 - RNA, 19 nt, Homo sapiens
auaaugggcuccuggcaaa

SEQ ID NO: 1071729 - RNA, 19 nt, Homo sapiens
uaggacagagucuuaaaua

SEQ ID NO: 1071730 - RNA, 19 nt, Homo sapiens
acagaggagucaaguaaga

SEQ ID NO: 1071731 - RNA, 19 nt, Homo sapiens
aaagugcucuccuguguag

SEQ ID NO: 1071732 - RNA, 19 nt, Homo sapiens
gcagcaguauggaggcaaa

SEQ ID NO: 1071733 - RNA, 19 nt, Homo sapiens
ucaaguaagaugagaacua

SEQ ID NO: 1071734 - RNA, 19 nt, Homo sapiens
uuaaacgucuagguaagua

SEQ ID NO: 1071735 - RNA, 19 nt, Homo sapiens
ugagauggaagcuuacuuu

SEQ ID NO: 1071736 - RNA, 19 nt, Homo sapiens
gaauagaauaggaguggaa

SEQ ID NO: 1071737 - RNA, 19 nt, Homo sapiens
uuacagaggacaccaggua

SEQ ID NO: 1071738 - RNA, 19 nt, Homo sapiens
augaucaucuggcuacaua

SEQ ID NO: 1071739 - RNA, 19 nt, Homo sapiens
ugaacacaaugauuacaug

SEQ ID NO: 1071740 - RNA, 19 nt, Homo sapiens
ggaucagggugccacagaa

SEQ ID NO: 1071741 - RNA, 19 nt, Homo sapiens
caccagguauaaaguagaa

SEQ ID NO: 1071742 - RNA, 19 nt, Homo sapiens
uaaagaaacaugucagucu

SEQ ID NO: 1071743 - RNA, 19 nt, Homo sapiens
guggcucucucuauuuauu

SEQ ID NO: 1071744 - RNA, 19 nt, Homo sapiens
cuguggcucucucuauuua

SEQ ID NO: 1071745 - RNA, 19 nt, Homo sapiens
agacaaaugccuagauaau

SEQ ID NO: 1071746 - RNA, 19 nt, Homo sapiens
gacuaucuuuggaagcuaa

SEQ ID NO: 1071747 - RNA, 19 nt, Homo sapiens
cuagguaaguaaauagguu

SEQ ID NO: 1071748 - RNA, 19 nt, Homo sapiens
augcacauuugaucacuua

SEQ ID NO: 1071749 - RNA, 19 nt, Homo sapiens
gguauaaaguagaaacaac

SEQ ID NO: 1071750 - RNA, 19 nt, Homo sapiens
gagacaaaugccuagauaa

SEQ ID NO: 1071751 - RNA, 19 nt, Homo sapiens
gaucaucuggcuacauaga

SEQ ID NO: 1071752 - RNA, 19 nt, Homo sapiens
aaauaauacuggccuuuag

SEQ ID NO: 1071753 - RNA, 19 nt, Homo sapiens
ggauacagauaaaugucau

SEQ ID NO: 1071754 - RNA, 19 nt, Homo sapiens
acagaacccuucgugugua

SEQ ID NO: 1071755 - RNA, 19 nt, Homo sapiens
ggccuaggacagagucuua

SEQ ID NO: 1071756 - RNA, 19 nt, Homo sapiens
uuaaggugcuugaugaaca

SEQ ID NO: 1071757 - RNA, 19 nt, Homo sapiens
uaaugggaauccaacauca

SEQ ID NO: 1071758 - RNA, 19 nt, Homo sapiens
gcagaugaggugaacauuc

SEQ ID NO: 1071759 - RNA, 19 nt, Homo sapiens
ccacagugauuggagaugu

SEQ ID NO: 1071760 - RNA, 19 nt, Homo sapiens
aggacagagucuuaaauaa

SEQ ID NO: 1071761 - RNA, 19 nt, Homo sapiens
gcacaacagcauggcagua

SEQ ID NO: 1071762 - RNA, 19 nt, Homo sapiens
cagaggacaccagguauaa

SEQ ID NO: 1071763 - RNA, 19 nt, Homo sapiens
gauuuggguuucuggcuau

SEQ ID NO: 1071764 - RNA, 19 nt, Homo sapiens
ggacuaucuuuggaagcua

SEQ ID NO: 1071765 - RNA, 19 nt, Homo sapiens
ggagucaaguaagaugaga

SEQ ID NO: 1071766 - RNA, 19 nt, Homo sapiens
gagaguagaccgggacaga

SEQ ID NO: 1071767 - RNA, 19 nt, Homo sapiens
cacauuugaucacuuacaa

SEQ ID NO: 1071768 - RNA, 19 nt, Homo sapiens
ggaagcuuacuuuggaauu

SEQ ID NO: 1071769 - RNA, 19 nt, Homo sapiens
gggacaaauuccacagugu

SEQ ID NO: 1071770 - RNA, 19 nt, Homo sapiens
gaagcuggacuaucuuugg

SEQ ID NO: 1071771 - RNA, 19 nt, Homo sapiens
gggaauccaacaucaguga

SEQ ID NO: 1071772 - RNA, 19 nt, Homo sapiens
gcacucgguuccaggucuu

SEQ ID NO: 1071773 - RNA, 19 nt, Homo sapiens
acacagagugaauaucaaa

SEQ ID NO: 1071774 - RNA, 19 nt, Homo sapiens
gacaccagguauaaaguag

SEQ ID NO: 1071775 - RNA, 19 nt, Homo sapiens
gaggacaccagguauaaag

SEQ ID NO: 1071776 - RNA, 19 nt, Homo sapiens
uggcaaaggauaaagugua

SEQ ID NO: 1071777 - RNA, 19 nt, Homo sapiens
cuacauagauaaguauugc

SEQ ID NO: 1071778 - RNA, 19 nt, Homo sapiens
cugggaagcuggacuaucu

SEQ ID NO: 1071779 - RNA, 19 nt, Homo sapiens
aguuuaaggugcuugauga

SEQ ID NO: 1071780 - RNA, 19 nt, Homo sapiens
gagcagaugaggugaacau

SEQ ID NO: 1071781 - RNA, 19 nt, Homo sapiens
aaaccggaauguacuucaa

SEQ ID NO: 1071782 - RNA, 19 nt, Homo sapiens
ccuaggagauuccagaaac

SEQ ID NO: 1071783 - RNA, 19 nt, Homo sapiens
gacaaaugccuagauaauc

SEQ ID NO: 1071784 - RNA, 19 nt, Homo sapiens
ggaagugggagacaaaugc

SEQ ID NO: 1071785 - RNA, 19 nt, Homo sapiens
cagaacccuucguguguau

SEQ ID NO: 1071786 - RNA, 19 nt, Homo sapiens
caaauuccacagugucaug

SEQ ID NO: 1071787 - RNA, 19 nt, Homo sapiens
cuauuuaaacgucuaggua

SEQ ID NO: 1071788 - RNA, 19 nt, Homo sapiens
gaacacuuaaagaacaaga

SEQ ID NO: 1071789 - RNA, 19 nt, Homo sapiens
aaagauacacagagugaau

SEQ ID NO: 1071790 - RNA, 19 nt, Homo sapiens
cauaaaagcuaagggaaga

SEQ ID NO: 1071791 - RNA, 19 nt, Homo sapiens
gcuauggcuuaagcuguaa

SEQ ID NO: 1071792 - RNA, 19 nt, Homo sapiens
aagcuaaauuuggaaguga

SEQ ID NO: 1071793 - RNA, 19 nt, Homo sapiens
gggaagcuggacuaucuuu

SEQ ID NO: 1071794 - RNA, 19 nt, Homo sapiens
gugaacauucuucuuauuc

SEQ ID NO: 1071795 - RNA, 19 nt, Homo sapiens
ggaaagggcuaguggauaa

SEQ ID NO: 1071796 - RNA, 19 nt, Homo sapiens
gcagaaagaugucagaaug

SEQ ID NO: 1071797 - RNA, 19 nt, Homo sapiens
gcagguaucuucccguuaa

SEQ ID NO: 1071798 - RNA, 19 nt, Homo sapiens
gaacgcaucuguaguguca

SEQ ID NO: 1071799 - RNA, 19 nt, Homo sapiens
gaaauggaguuacuaggaa

SEQ ID NO: 1071800 - RNA, 19 nt, Homo sapiens
gaauucacauggcuuauga

SEQ ID NO: 1071801 - RNA, 19 nt, Homo sapiens
gaaaaucacuuaugccauu

SEQ ID NO: 1071802 - RNA, 19 nt, Homo sapiens
ucacauggcuuaugaugga

SEQ ID NO: 1071803 - RNA, 19 nt, Homo sapiens
gauuuggccuguaacauuu

SEQ ID NO: 1071804 - RNA, 19 nt, Homo sapiens
gaucagugccuuuaugaaa

SEQ ID NO: 1071805 - RNA, 19 nt, Homo sapiens
gacuugaccugguuucuuu

SEQ ID NO: 1071806 - RNA, 19 nt, Homo sapiens
uaucaucggucuaauguga

SEQ ID NO: 1071807 - RNA, 19 nt, Homo sapiens
ggauaaagcccucccauag

SEQ ID NO: 1071808 - RNA, 19 nt, Homo sapiens
gauaggaacagacuaguug

SEQ ID NO: 1071809 - RNA, 19 nt, Homo sapiens
guaauugaauggcaaaugg

SEQ ID NO: 1071810 - RNA, 19 nt, Homo sapiens
gauaaagcccucccauaga

SEQ ID NO: 1071811 - RNA, 19 nt, Homo sapiens
gaagagcugcuugcuguaa

SEQ ID NO: 1071812 - RNA, 19 nt, Homo sapiens
augcauggguagauuauua

SEQ ID NO: 1071813 - RNA, 19 nt, Homo sapiens
gcagaacucauugccuuua

SEQ ID NO: 1071814 - RNA, 19 nt, Homo sapiens
cagaaugggauuuaaguaa

SEQ ID NO: 1071815 - RNA, 19 nt, Homo sapiens
agagucacauuaucuguaa

SEQ ID NO: 1071816 - RNA, 19 nt, Homo sapiens
gauuugugcuucuuugguu

SEQ ID NO: 1071817 - RNA, 19 nt, Homo sapiens
ggaaauaaggagagguuga

SEQ ID NO: 1071818 - RNA, 19 nt, Homo sapiens
ugacagaucagugccuuua

SEQ ID NO: 1071819 - RNA, 19 nt, Homo sapiens
caucacaagagucacauua

SEQ ID NO: 1071820 - RNA, 19 nt, Homo sapiens
ucacaagagucacauuauc

SEQ ID NO: 1071821 - RNA, 19 nt, Homo sapiens
caacugggacucuuaaaca

SEQ ID NO: 1071822 - RNA, 19 nt, Homo sapiens
uaacguggguaauauuugg

SEQ ID NO: 1071823 - RNA, 19 nt, Homo sapiens
ggaguuccuuauauauuuc

SEQ ID NO: 1071824 - RNA, 19 nt, Homo sapiens
cagaacucauugccuuuaa

SEQ ID NO: 1071825 - RNA, 19 nt, Homo sapiens
uaggauauaugacucacuu

SEQ ID NO: 1071826 - RNA, 19 nt, Homo sapiens
ugacaguuauggguaauug

SEQ ID NO: 1071827 - RNA, 19 nt, Homo sapiens
ggacuugcacgaucgaaga

SEQ ID NO: 1071828 - RNA, 19 nt, Homo sapiens
gaguguaacguggguaaua

SEQ ID NO: 1071829 - RNA, 19 nt, Homo sapiens
gaaaugguccacagucucu

SEQ ID NO: 1071830 - RNA, 19 nt, Homo sapiens
gaugucagaaugggauuua

SEQ ID NO: 1071831 - RNA, 19 nt, Homo sapiens
gaacucauugccuuuaauc

SEQ ID NO: 1071832 - RNA, 19 nt, Homo sapiens
ccacuuuguucaaggaaug

SEQ ID NO: 1071833 - RNA, 19 nt, Homo sapiens
ugaaauggaguuacuagga

SEQ ID NO: 1071834 - RNA, 19 nt, Homo sapiens
caacacuauugacaguuau

SEQ ID NO: 1071835 - RNA, 19 nt, Homo sapiens
cccaguaaauguuggugua

SEQ ID NO: 1071836 - RNA, 19 nt, Homo sapiens
gcagugauuugugcuucuu

SEQ ID NO: 1071837 - RNA, 19 nt, Homo sapiens
acagaucagugccuuuaug

SEQ ID NO: 1071838 - RNA, 19 nt, Homo sapiens
gaaaacaucacaagaguca

SEQ ID NO: 1071839 - RNA, 19 nt, Homo sapiens
ucagugccuuuaugaaaug

SEQ ID NO: 1071840 - RNA, 19 nt, Homo sapiens
cuagggaauuggcuuguau

SEQ ID NO: 1071841 - RNA, 19 nt, Homo sapiens
ugacgugccuccuuaucug

SEQ ID NO: 1071842 - RNA, 19 nt, Homo sapiens
ugccugacgugccuccuua

SEQ ID NO: 1071843 - RNA, 19 nt, Homo sapiens
uaugauggagucuuuguuu

SEQ ID NO: 1071844 - RNA, 19 nt, Homo sapiens
gaaauaaggagagguugag

SEQ ID NO: 1071845 - RNA, 19 nt, Homo sapiens
ggaauucacauggcuuaug

SEQ ID NO: 1071846 - RNA, 19 nt, Homo sapiens
gagaguguaacguggguaa

SEQ ID NO: 1071847 - RNA, 19 nt, Homo sapiens
auaaagcccucccauagag

SEQ ID NO: 1071848 - RNA, 19 nt, Homo sapiens
uaagugacaggcagugauu

SEQ ID NO: 1071849 - RNA, 19 nt, Homo sapiens
ugucaggugucauaaaaua

SEQ ID NO: 1071850 - RNA, 19 nt, Homo sapiens
uaagauaggaacagacuag

SEQ ID NO: 1071851 - RNA, 19 nt, Homo sapiens
gaggaaagggcuaguggau

SEQ ID NO: 1071852 - RNA, 19 nt, Homo sapiens
ccugguuucuuuagucuga

SEQ ID NO: 1071853 - RNA, 19 nt, Homo sapiens
ccuuauauauuuccugcuu

SEQ ID NO: 1071854 - RNA, 19 nt, Homo sapiens
ucacugaaucuuuaaguuc

SEQ ID NO: 1071855 - RNA, 19 nt, Homo sapiens
cagaaaugguccacagucu

SEQ ID NO: 1071856 - RNA, 19 nt, Homo sapiens
gccauucccuguauuacca

SEQ ID NO: 1071857 - RNA, 19 nt, Homo sapiens
gcuccaacugggacucuua

SEQ ID NO: 1071858 - RNA, 19 nt, Homo sapiens
acucaaagcagaaagaugu

SEQ ID NO: 1071859 - RNA, 19 nt, Homo sapiens
uauugacaguuauggguaa

SEQ ID NO: 1071860 - RNA, 19 nt, Homo sapiens
agauuuggccuguaacauu

SEQ ID NO: 1071861 - RNA, 19 nt, Homo sapiens
ggcuuaugauggagucuuu

SEQ ID NO: 1071862 - RNA, 19 nt, Homo sapiens
gagcugcuugcuguaaaua

SEQ ID NO: 1071863 - RNA, 19 nt, Homo sapiens
gaaagggcuaguggauaaa

SEQ ID NO: 1071864 - RNA, 19 nt, Homo sapiens
auaaggagagguugagaaa

SEQ ID NO: 1071865 - RNA, 19 nt, Homo sapiens
gagcacagugucccuagga

SEQ ID NO: 1071866 - RNA, 19 nt, Homo sapiens
uaaguaauuucugccuuca

SEQ ID NO: 1071867 - RNA, 19 nt, Homo sapiens
ggaagagcugcuugcugua

SEQ ID NO: 1071868 - RNA, 19 nt, Homo sapiens
caaaugggguuuccaacug

SEQ ID NO: 1071869 - RNA, 19 nt, Homo sapiens
cagaucagugccuuuauga

SEQ ID NO: 1071870 - RNA, 19 nt, Homo sapiens
uuaggaaacacgacacaaa

SEQ ID NO: 1071871 - RNA, 19 nt, Homo sapiens
gcugcuugcuguaaauagu

SEQ ID NO: 1071872 - RNA, 19 nt, Homo sapiens
ugaccugguuucuuuaguc

SEQ ID NO: 1071873 - RNA, 19 nt, Homo sapiens
ucagaaugggauuuaagua

SEQ ID NO: 1071874 - RNA, 19 nt, Homo sapiens
ccaccacccaacauaaauu

SEQ ID NO: 1071875 - RNA, 19 nt, Homo sapiens
aagagcugcuugcuguaaa

SEQ ID NO: 1071876 - RNA, 19 nt, Homo sapiens
gguuaggucccacuuuguu

SEQ ID NO: 1071877 - RNA, 19 nt, Homo sapiens
ccuagggaauuggcuugua

SEQ ID NO: 1071878 - RNA, 19 nt, Homo sapiens
uaggaauucacauggcuua

SEQ ID NO: 1071879 - RNA, 19 nt, Homo sapiens
caucccaccacccaacaua

SEQ ID NO: 1071880 - RNA, 19 nt, Homo sapiens
aguaaauguugguguaugu

SEQ ID NO: 1071881 - RNA, 19 nt, Homo sapiens
aggguuaggucccacuuug

SEQ ID NO: 1071882 - RNA, 19 nt, Homo sapiens
uggauaaagcccucccaua

SEQ ID NO: 1071883 - RNA, 19 nt, Homo sapiens
cugagaaauuggacguauu

SEQ ID NO: 1071884 - RNA, 19 nt, Homo sapiens
gaccugguuucuuuagucu

SEQ ID NO: 1071885 - RNA, 19 nt, Homo sapiens
uauauuuccugcuugucuu

SEQ ID NO: 1071886 - RNA, 19 nt, Homo sapiens
cuuaugccauucccuguau

SEQ ID NO: 1071887 - RNA, 19 nt, Homo sapiens
ugaguaccuuguccuagga

SEQ ID NO: 1071888 - RNA, 19 nt, Homo sapiens
cagauaucaucacugaauc

SEQ ID NO: 1071889 - RNA, 19 nt, Homo sapiens
acacaaacgcuaagacucu

SEQ ID NO: 1071890 - RNA, 19 nt, Homo sapiens
guaacguggguaauauuug

SEQ ID NO: 1071891 - RNA, 19 nt, Homo sapiens
ucuuuagucugagaaauug

SEQ ID NO: 1071892 - RNA, 19 nt, Homo sapiens
aaauggaguuacuaggaau

SEQ ID NO: 1071893 - RNA, 19 nt, Homo sapiens
ucaccugaaucuugguugu

SEQ ID NO: 1071894 - RNA, 19 nt, Homo sapiens
aagcugcuaucaccugaau

SEQ ID NO: 1071895 - RNA, 19 nt, Homo sapiens
aagaaaggcucccaauuua

SEQ ID NO: 1071896 - RNA, 19 nt, Homo sapiens
uaagaaaggcucccaauuu

SEQ ID NO: 1071897 - RNA, 19 nt, Homo sapiens
gaaauaaccauucaugugu

SEQ ID NO: 1071898 - RNA, 19 nt, Homo sapiens
gagaagggcuugcaaacca

SEQ ID NO: 1071899 - RNA, 19 nt, Homo sapiens
ggaaauaaccauucaugug

SEQ ID NO: 1071900 - RNA, 19 nt, Homo sapiens
ccaagaccauccauuauuc

SEQ ID NO: 1071901 - RNA, 19 nt, Homo sapiens
accaggaccuuguuaaaua

SEQ ID NO: 1071902 - RNA, 19 nt, Homo sapiens
gaaggagaguagacaugaa

SEQ ID NO: 1071903 - RNA, 19 nt, Homo sapiens
cauccaagaccauccauua

SEQ ID NO: 1071904 - RNA, 19 nt, Homo sapiens
aagcagcgauucuuccuuu

SEQ ID NO: 1071905 - RNA, 19 nt, Homo sapiens
ccaucaagguuguaagaaa

SEQ ID NO: 1071906 - RNA, 19 nt, Homo sapiens
gaaaccaggaccuuguuaa

SEQ ID NO: 1071907 - RNA, 19 nt, Homo sapiens
aaaggacaguguuuagaaa

SEQ ID NO: 1071908 - RNA, 19 nt, Homo sapiens
gaccauccauuauucuaga

SEQ ID NO: 1071909 - RNA, 19 nt, Homo sapiens
aaaccaagaucaagguguu

SEQ ID NO: 1071910 - RNA, 19 nt, Homo sapiens
ggaaggagaguagacauga

SEQ ID NO: 1071911 - RNA, 19 nt, Homo sapiens
gaaaggcucccaauuuaac

SEQ ID NO: 1071912 - RNA, 19 nt, Homo sapiens
caagguguuucuccgcuaa

SEQ ID NO: 1071913 - RNA, 19 nt, Homo sapiens
uaaauucacuugguacaca

SEQ ID NO: 1071914 - RNA, 19 nt, Homo sapiens
gaaaccgauuugcuugaga

SEQ ID NO: 1071915 - RNA, 19 nt, Homo sapiens
gcauuucaguggagaagga

SEQ ID NO: 1071916 - RNA, 19 nt, Homo sapiens
gcauuaguguggcauuuca

SEQ ID NO: 1071917 - RNA, 19 nt, Homo sapiens
guaagaaaggcucccaauu

SEQ ID NO: 1071918 - RNA, 19 nt, Homo sapiens
ggccaauccacaccaauua

SEQ ID NO: 1071919 - RNA, 19 nt, Homo sapiens
gcaugaagaacuuaagaug

SEQ ID NO: 1071920 - RNA, 19 nt, Homo sapiens
ucaagaaaccgauuugcuu

SEQ ID NO: 1071921 - RNA, 19 nt, Homo sapiens
caucaagguuguaagaaag

SEQ ID NO: 1071922 - RNA, 19 nt, Homo sapiens
ccaagcugaucccuacaaa

SEQ ID NO: 1071923 - RNA, 19 nt, Homo sapiens
gaagaacuuaagaugauga

SEQ ID NO: 1071924 - RNA, 19 nt, Homo sapiens
aaaccgauuugcuugagaa

SEQ ID NO: 1071925 - RNA, 19 nt, Homo sapiens
aaguuuagcuacuguguug

SEQ ID NO: 1071926 - RNA, 19 nt, Homo sapiens
gagguuaagaguagcauga

SEQ ID NO: 1071927 - RNA, 19 nt, Homo sapiens
ucauguaugugacuuagau

SEQ ID NO: 1071928 - RNA, 19 nt, Homo sapiens
ggaccuuguuaaauaguuc

SEQ ID NO: 1071929 - RNA, 19 nt, Homo sapiens
ccaggaccuuguuaaauag

SEQ ID NO: 1071930 - RNA, 19 nt, Homo sapiens
caauccacaccaauuauuu

SEQ ID NO: 1071931 - RNA, 19 nt, Homo sapiens
caugaagaacuuaagauga

SEQ ID NO: 1071932 - RNA, 19 nt, Homo sapiens
gcuacuguguugcaagaga

SEQ ID NO: 1071933 - RNA, 19 nt, Homo sapiens
ugacuuagauacugcuuuu

SEQ ID NO: 1071934 - RNA, 19 nt, Homo sapiens
aaaccaggaccuuguuaaa

SEQ ID NO: 1071935 - RNA, 19 nt, Homo sapiens
uagcuacuguguugcaaga

SEQ ID NO: 1071936 - RNA, 19 nt, Homo sapiens
guuucaagguuucaauaga

SEQ ID NO: 1071937 - RNA, 19 nt, Homo sapiens
agaaaggcucccaauuuaa

SEQ ID NO: 1071938 - RNA, 19 nt, Homo sapiens
uuuaaaagcccacuucuua

SEQ ID NO: 1071939 - RNA, 19 nt, Homo sapiens
gagaaaccaggaccuuguu

SEQ ID NO: 1071940 - RNA, 19 nt, Homo sapiens
uauaaaagcaggcaaguuu

SEQ ID NO: 1071941 - RNA, 19 nt, Homo sapiens
aaagcccacuucuuagcua

SEQ ID NO: 1071942 - RNA, 19 nt, Homo sapiens
agaguagcaugaagaacuu

SEQ ID NO: 1071943 - RNA, 19 nt, Homo sapiens
ccaauccacaccaauuauu

SEQ ID NO: 1071944 - RNA, 19 nt, Homo sapiens
ccuauuaccuggugcaaaa

SEQ ID NO: 1071945 - RNA, 19 nt, Homo sapiens
acacaauuuuccccuauua

SEQ ID NO: 1071946 - RNA, 19 nt, Homo sapiens
guuaagaguagcaugaaga

SEQ ID NO: 1071947 - RNA, 19 nt, Homo sapiens
gauucuuccuuucagaguu

SEQ ID NO: 1071948 - RNA, 19 nt, Homo sapiens
aaauaguucucuccauuac

SEQ ID NO: 1071949 - RNA, 19 nt, Homo sapiens
cagaaaacacugggaauua

SEQ ID NO: 1071950 - RNA, 19 nt, Homo sapiens
gaugaugauaagagucuaa

SEQ ID NO: 1071951 - RNA, 19 nt, Homo sapiens
cuacuguguugcaagagaa

SEQ ID NO: 1071952 - RNA, 19 nt, Homo sapiens
gcaggcaaguuuagcuacu

SEQ ID NO: 1071953 - RNA, 19 nt, Homo sapiens
ugacucaucacuucccaaa

SEQ ID NO: 1071954 - RNA, 19 nt, Homo sapiens
caucauguaugugacuuag

SEQ ID NO: 1071955 - RNA, 19 nt, Homo sapiens
gcuggaggucacacaauuu

SEQ ID NO: 1071956 - RNA, 19 nt, Homo sapiens
ugaagaacuuaagaugaug

SEQ ID NO: 1071957 - RNA, 19 nt, Homo sapiens
ccauuaccauuuauucucu

SEQ ID NO: 1071958 - RNA, 19 nt, Homo sapiens
caggaaauaaccauucaug

SEQ ID NO: 1071959 - RNA, 19 nt, Homo sapiens
uaacugucccugucccuau

SEQ ID NO: 1071960 - RNA, 19 nt, Homo sapiens
aagcauuaguguggcauuu

SEQ ID NO: 1071961 - RNA, 19 nt, Homo sapiens
caagagaaaccaggaccuu

SEQ ID NO: 1071962 - RNA, 19 nt, Homo sapiens
aaucaaucccuguuucuau

SEQ ID NO: 1071963 - RNA, 19 nt, Homo sapiens
gcagcgauucuuccuuuca

SEQ ID NO: 1071964 - RNA, 19 nt, Homo sapiens
uccaagaccauccauuauu

SEQ ID NO: 1071965 - RNA, 19 nt, Homo sapiens
gacaucaagaaaccgauuu

SEQ ID NO: 1071966 - RNA, 19 nt, Homo sapiens
caaaagacaucaagaaacc

SEQ ID NO: 1071967 - RNA, 19 nt, Homo sapiens
gcaaguuuagcuacugugu

SEQ ID NO: 1071968 - RNA, 19 nt, Homo sapiens
ccacuggguaaauuauauu

SEQ ID NO: 1071969 - RNA, 19 nt, Homo sapiens
uuugggagguuaagaguag

SEQ ID NO: 1071970 - RNA, 19 nt, Homo sapiens
aucaaucccuguuucuauu

SEQ ID NO: 1071971 - RNA, 19 nt, Homo sapiens
ucacuugguacacaccuuu

SEQ ID NO: 1071972 - RNA, 19 nt, Homo sapiens
ucaaucccuguuucuauuu

SEQ ID NO: 1071973 - RNA, 19 nt, Homo sapiens
agaaaccaggaccuuguua

SEQ ID NO: 1071974 - RNA, 19 nt, Homo sapiens
gcacucugaucaauaaaag

SEQ ID NO: 1071975 - RNA, 19 nt, Homo sapiens
ggucuggccaccucaugaa

SEQ ID NO: 1071976 - RNA, 19 nt, Homo sapiens
guuaaauaguucucuccau

SEQ ID NO: 1071977 - RNA, 19 nt, Homo sapiens
caagguuucaauagaaugu

SEQ ID NO: 1071978 - RNA, 19 nt, Homo sapiens
uaaucaaucccuguuucua

SEQ ID NO: 1071979 - RNA, 19 nt, Homo sapiens
ugcuggaggucacacaauu

SEQ ID NO: 1071980 - RNA, 19 nt, Homo sapiens
uccacuggguaaauuauau

SEQ ID NO: 1071981 - RNA, 19 nt, Homo sapiens
agaagggcuugcaaaccaa

SEQ ID NO: 1071982 - RNA, 19 nt, Homo sapiens
gccaauccacaccaauuau

SEQ ID NO: 1071983 - RNA, 19 nt, Homo sapiens
uuaagaguagcaugaagaa

SEQ ID NO: 1071984 - RNA, 19 nt, Homo sapiens
gaaaaugcccaagacauca

SEQ ID NO: 1071985 - RNA, 19 nt, Homo sapiens
augaauccaacaagcauua

SEQ ID NO: 1071986 - RNA, 19 nt, Homo sapiens
uuuauggccuauagucuca

SEQ ID NO: 1071987 - RNA, 19 nt, Homo sapiens
aaaccacgauuuucccauu

SEQ ID NO: 1071988 - RNA, 19 nt, Homo sapiens
uagcaugaagaacuuaaga

SEQ ID NO: 1071989 - RNA, 19 nt, Homo sapiens
ugaacagggccuaaucuag

SEQ ID NO: 1071990 - RNA, 19 nt, Homo sapiens
gguuaagaguagcaugaag

SEQ ID NO: 1071991 - RNA, 19 nt, Homo sapiens
caguggagaaggaaacuug

SEQ ID NO: 1071992 - RNA, 19 nt, Homo sapiens
auaguucucuccauuacca

SEQ ID NO: 1071993 - RNA, 19 nt, Homo sapiens
cagcacgcauaaaccaaca

SEQ ID NO: 1071994 - RNA, 19 nt, Homo sapiens
agagaaaccaggaccuugu

SEQ ID NO: 1071995 - RNA, 19 nt, Homo sapiens
gcaagaaucucauaguuca

SEQ ID NO: 1071996 - RNA, 19 nt, Homo sapiens
gaagaaaccuaagaaggaa

SEQ ID NO: 1071997 - RNA, 19 nt, Homo sapiens
gagcaagaaucucauaguu

SEQ ID NO: 1071998 - RNA, 19 nt, Homo sapiens
ucucuugucugcuaaauua

SEQ ID NO: 1071999 - RNA, 19 nt, Homo sapiens
acacugagguuuagaauug

SEQ ID NO: 1072000 - RNA, 19 nt, Homo sapiens
aaacugaggucuuccauga

SEQ ID NO: 1072001 - RNA, 19 nt, Homo sapiens
uaugacagcucuaguugua

SEQ ID NO: 1072002 - RNA, 19 nt, Homo sapiens
cauagacucuuucauggua

SEQ ID NO: 1072003 - RNA, 19 nt, Homo sapiens
ggaaacaaguagcaucaug

SEQ ID NO: 1072004 - RNA, 19 nt, Homo sapiens
ggagguggaucucugcaaa

SEQ ID NO: 1072005 - RNA, 19 nt, Homo sapiens
cauaagacacugagguuua

SEQ ID NO: 1072006 - RNA, 19 nt, Homo sapiens
ccucagagauguaagcauu

SEQ ID NO: 1072007 - RNA, 19 nt, Homo sapiens
ggucagcugucacuacauu

SEQ ID NO: 1072008 - RNA, 19 nt, Homo sapiens
ucaaauggcugcagauugg

SEQ ID NO: 1072009 - RNA, 19 nt, Homo sapiens
ggaguaugaugcccucaaa

SEQ ID NO: 1072010 - RNA, 19 nt, Homo sapiens
gcaaggcucguuucuacua

SEQ ID NO: 1072011 - RNA, 19 nt, Homo sapiens
caugagaccuccucuuugu

SEQ ID NO: 1072012 - RNA, 19 nt, Homo sapiens
caauauagaaguccgcaua

SEQ ID NO: 1072013 - RNA, 19 nt, Homo sapiens
gaaggaaugaggagaaaug

SEQ ID NO: 1072014 - RNA, 19 nt, Homo sapiens
gaacaccacgcucaguaaa

SEQ ID NO: 1072015 - RNA, 19 nt, Homo sapiens
caacuuauguggcuuccau

SEQ ID NO: 1072016 - RNA, 19 nt, Homo sapiens
ggugaagcauagacucuuu

SEQ ID NO: 1072017 - RNA, 19 nt, Homo sapiens
caaaaucucuggcuaugaa

SEQ ID NO: 1072018 - RNA, 19 nt, Homo sapiens
guggaucucugcaaaccua

SEQ ID NO: 1072019 - RNA, 19 nt, Homo sapiens
gguauucuuucuucccuuu

SEQ ID NO: 1072020 - RNA, 19 nt, Homo sapiens
acacauuccuuuagucuuc

SEQ ID NO: 1072021 - RNA, 19 nt, Homo sapiens
ggacugcaacucaugacua

SEQ ID NO: 1072022 - RNA, 19 nt, Homo sapiens
cagcuucacucacgacuuc

SEQ ID NO: 1072023 - RNA, 19 nt, Homo sapiens
agacagauuucacgacuca

SEQ ID NO: 1072024 - RNA, 19 nt, Homo sapiens
agaagaagcgugaggcuaa

SEQ ID NO: 1072025 - RNA, 19 nt, Homo sapiens
acucacgacuucaagauuu

SEQ ID NO: 1072026 - RNA, 19 nt, Homo sapiens
agaaaucucuugcuaucau

SEQ ID NO: 1072027 - RNA, 19 nt, Homo sapiens
cagagaaacugaggucuuc

SEQ ID NO: 1072028 - RNA, 19 nt, Homo sapiens
gagaugaagacaauauaga

SEQ ID NO: 1072029 - RNA, 19 nt, Homo sapiens
uaacugaagggcauaaaug

SEQ ID NO: 1072030 - RNA, 19 nt, Homo sapiens
aaaccuacacugucuauga

SEQ ID NO: 1072031 - RNA, 19 nt, Homo sapiens
agaagaaaccuaagaagga

SEQ ID NO: 1072032 - RNA, 19 nt, Homo sapiens
ggagggagcaagaaucuca

SEQ ID NO: 1072033 - RNA, 19 nt, Homo sapiens
gauagagggaucagaaaug

SEQ ID NO: 1072034 - RNA, 19 nt, Homo sapiens
gaccauccaguccaauaua

SEQ ID NO: 1072035 - RNA, 19 nt, Homo sapiens
caaggcucguuucuacuaa

SEQ ID NO: 1072036 - RNA, 19 nt, Homo sapiens
gaacaccaucuaugacaau

SEQ ID NO: 1072037 - RNA, 19 nt, Homo sapiens
gacugcaacucaugacuau

SEQ ID NO: 1072038 - RNA, 19 nt, Homo sapiens
gaccgacucucagcaguga

SEQ ID NO: 1072039 - RNA, 19 nt, Homo sapiens
ccagagccauugguacaaa

SEQ ID NO: 1072040 - RNA, 19 nt, Homo sapiens
gaguuuggauuccuaugga

SEQ ID NO: 1072041 - RNA, 19 nt, Homo sapiens
gggagaaggcggaagagaa

SEQ ID NO: 1072042 - RNA, 19 nt, Homo sapiens
ggagaaggcggaagagaag

SEQ ID NO: 1072043 - RNA, 19 nt, Homo sapiens
auagagggaucagaaauga

SEQ ID NO: 1072044 - RNA, 19 nt, Homo sapiens
gaaaucucuugcuaucauc

SEQ ID NO: 1072045 - RNA, 19 nt, Homo sapiens
aagcauagacucuuucaug

SEQ ID NO: 1072046 - RNA, 19 nt, Homo sapiens
cucaguaaauccagucuaa

SEQ ID NO: 1072047 - RNA, 19 nt, Homo sapiens
guaaaggcaaggcucguuu

SEQ ID NO: 1072048 - RNA, 19 nt, Homo sapiens
cugcaugccuaaaggagua

SEQ ID NO: 1072049 - RNA, 19 nt, Homo sapiens
ugaagggcauaaauggaaa

SEQ ID NO: 1072050 - RNA, 19 nt, Homo sapiens
gcaaaccuacacugucuau

SEQ ID NO: 1072051 - RNA, 19 nt, Homo sapiens
gaagaagcgugaggcuaag

SEQ ID NO: 1072052 - RNA, 19 nt, Homo sapiens
uauaacacuugcagacaga

SEQ ID NO: 1072053 - RNA, 19 nt, Homo sapiens
uacaugagaccuccucuuu

SEQ ID NO: 1072054 - RNA, 19 nt, Homo sapiens
agaccuaccugccaucauc

SEQ ID NO: 1072055 - RNA, 19 nt, Homo sapiens
ugguacaaaugcuuuauug

SEQ ID NO: 1072056 - RNA, 19 nt, Homo sapiens
uacuuggugugacuaaaua

SEQ ID NO: 1072057 - RNA, 19 nt, Homo sapiens
ucagcugucacuacauuua

SEQ ID NO: 1072058 - RNA, 19 nt, Homo sapiens
ggauagagggaucagaaau

SEQ ID NO: 1072059 - RNA, 19 nt, Homo sapiens
gcucguuucuacuaaaugg

SEQ ID NO: 1072060 - RNA, 19 nt, Homo sapiens
ugaagacaauauagaaguc

SEQ ID NO: 1072061 - RNA, 19 nt, Homo sapiens
ggaucacacuguccauucu

SEQ ID NO: 1072062 - RNA, 19 nt, Homo sapiens
guacuuggugugacuaaau

SEQ ID NO: 1072063 - RNA, 19 nt, Homo sapiens
uagaacaccacgcucagua

SEQ ID NO: 1072064 - RNA, 19 nt, Homo sapiens
caggguagaucaggaggaa

SEQ ID NO: 1072065 - RNA, 19 nt, Homo sapiens
gucuacaucuuacucagaa

SEQ ID NO: 1072066 - RNA, 19 nt, Homo sapiens
gauaugaagggaaacaagu

SEQ ID NO: 1072067 - RNA, 19 nt, Homo sapiens
aacaggauaugaagggaaa

SEQ ID NO: 1072068 - RNA, 19 nt, Homo sapiens
uuuauaauguccugagaga

SEQ ID NO: 1072069 - RNA, 19 nt, Homo sapiens
ccacaaacccuuucauucc

SEQ ID NO: 1072070 - RNA, 19 nt, Homo sapiens
aggcaaggcucguuucuac

SEQ ID NO: 1072071 - RNA, 19 nt, Homo sapiens
gcgugaacaccaucuauga

SEQ ID NO: 1072072 - RNA, 19 nt, Homo sapiens
caagauuugaugcuaauuc

SEQ ID NO: 1072073 - RNA, 19 nt, Homo sapiens
uccauucucuugucugcua

SEQ ID NO: 1072074 - RNA, 19 nt, Homo sapiens
ugaacaccaucuaugacaa

SEQ ID NO: 1072075 - RNA, 19 nt, Homo sapiens
gaaguccgcauagucauca

SEQ ID NO: 1072076 - RNA, 19 nt, Homo sapiens
cauuuucccuccuuuauaa

SEQ ID NO: 1072077 - RNA, 19 nt, Homo sapiens
acaccacgcucaguaaauc

SEQ ID NO: 1072078 - RNA, 19 nt, Homo sapiens
uaccugccaucaucaaaug

SEQ ID NO: 1072079 - RNA, 19 nt, Homo sapiens
gcaccagcgugaacaccau

SEQ ID NO: 1072080 - RNA, 19 nt, Homo sapiens
ggaugggacugcaacucau

SEQ ID NO: 1072081 - RNA, 19 nt, Homo sapiens
cuaagaaggaagcaaauca

SEQ ID NO: 1072082 - RNA, 19 nt, Homo sapiens
auauaaagcuguguaaagg

SEQ ID NO: 1072083 - RNA, 19 nt, Homo sapiens
guaagcagugugcaaacaa

SEQ ID NO: 1072084 - RNA, 19 nt, Homo sapiens
ggagcaagaaucucauagu

SEQ ID NO: 1072085 - RNA, 19 nt, Homo sapiens
gaacgugaggcagagaaga

SEQ ID NO: 1072086 - RNA, 19 nt, Homo sapiens
ggagaagaaaccuaagaag

SEQ ID NO: 1072087 - RNA, 19 nt, Homo sapiens
ugacagcucuaguuguacu

SEQ ID NO: 1072088 - RNA, 19 nt, Homo sapiens
ccagaacucacaccagaau

SEQ ID NO: 1072089 - RNA, 19 nt, Homo sapiens
gccacaaacccuuucauuc

SEQ ID NO: 1072090 - RNA, 19 nt, Homo sapiens
gagcaggagaagaaaccua

SEQ ID NO: 1072091 - RNA, 19 nt, Homo sapiens
ucacuacacauuccuuuag

SEQ ID NO: 1072092 - RNA, 19 nt, Homo sapiens
ggacuuuguuaaucuucuc

SEQ ID NO: 1072093 - RNA, 19 nt, Homo sapiens
cugcaaaccuacacugucu

SEQ ID NO: 1072094 - RNA, 19 nt, Homo sapiens
guggaguccugcccaacuu

SEQ ID NO: 1072095 - RNA, 19 nt, Homo sapiens
gaagagaccugacagauua

SEQ ID NO: 1072096 - RNA, 19 nt, Homo sapiens
gaaauagacugugaaguaa

SEQ ID NO: 1072097 - RNA, 19 nt, Homo sapiens
caaauuggcuacugauaaa

SEQ ID NO: 1072098 - RNA, 19 nt, Homo sapiens
ugaaauagacugugaagua

SEQ ID NO: 1072099 - RNA, 19 nt, Homo sapiens
ggaagguacuauauaugua

SEQ ID NO: 1072100 - RNA, 19 nt, Homo sapiens
gaauaagucucacaagauc

SEQ ID NO: 1072101 - RNA, 19 nt, Homo sapiens
gcaaauuggcuacugauaa

SEQ ID NO: 1072102 - RNA, 19 nt, Homo sapiens
gcaaaucucaucuugaauu

SEQ ID NO: 1072103 - RNA, 19 nt, Homo sapiens
gaguuuggcuccacuauug

SEQ ID NO: 1072104 - RNA, 19 nt, Homo sapiens
gggaaagaauagucuguuu

SEQ ID NO: 1072105 - RNA, 19 nt, Homo sapiens
gaacuggaagguacuauau

SEQ ID NO: 1072106 - RNA, 19 nt, Homo sapiens
gaggauaagggaaagaaua

SEQ ID NO: 1072107 - RNA, 19 nt, Homo sapiens
caacagauaccucucaaug

SEQ ID NO: 1072108 - RNA, 19 nt, Homo sapiens
ccucugaucucaucugcua

SEQ ID NO: 1072109 - RNA, 19 nt, Homo sapiens
gccaugcccuguccuguuu

SEQ ID NO: 1072110 - RNA, 19 nt, Homo sapiens
ucucaaguguggcuuuaua

SEQ ID NO: 1072111 - RNA, 19 nt, Homo sapiens
gcaccagacuccauguaau

SEQ ID NO: 1072112 - RNA, 19 nt, Homo sapiens
acagauaccucucaaugug

SEQ ID NO: 1072113 - RNA, 19 nt, Homo sapiens
ccucaugugugaaauuauu

SEQ ID NO: 1072114 - RNA, 19 nt, Homo sapiens
cuccauagcugcugaauca

SEQ ID NO: 1072115 - RNA, 19 nt, Homo sapiens
aaacugaccuagugcacaa

SEQ ID NO: 1072116 - RNA, 19 nt, Homo sapiens
gcauguauauucuguuucu

SEQ ID NO: 1072117 - RNA, 19 nt, Homo sapiens
guucucacauccagucuuu

SEQ ID NO: 1072118 - RNA, 19 nt, Homo sapiens
ucauuucaaucucuccuua

SEQ ID NO: 1072119 - RNA, 19 nt, Homo sapiens
caaaucucaucuugaauuc

SEQ ID NO: 1072120 - RNA, 19 nt, Homo sapiens
gcacacuugguacacauua

SEQ ID NO: 1072121 - RNA, 19 nt, Homo sapiens
guacaagcucucucucuuu

SEQ ID NO: 1072122 - RNA, 19 nt, Homo sapiens
cugaguaacuuauugucua

SEQ ID NO: 1072123 - RNA, 19 nt, Homo sapiens
guauuucccuuuacuuaca

SEQ ID NO: 1072124 - RNA, 19 nt, Homo sapiens
augcaaaucucaucuugaa

SEQ ID NO: 1072125 - RNA, 19 nt, Homo sapiens
aaucuaagguuucccuaug

SEQ ID NO: 1072126 - RNA, 19 nt, Homo sapiens
uacaagcucucucucuuug

SEQ ID NO: 1072127 - RNA, 19 nt, Homo sapiens
ucacaagaucugauaguuu

SEQ ID NO: 1072128 - RNA, 19 nt, Homo sapiens
uuaggccucuguucaagua

SEQ ID NO: 1072129 - RNA, 19 nt, Homo sapiens
cacaagaucugauaguuuu

SEQ ID NO: 1072130 - RNA, 19 nt, Homo sapiens
guuacugacuuacaugaug

SEQ ID NO: 1072131 - RNA, 19 nt, Homo sapiens
ggaaggaaucuaagguuuc

SEQ ID NO: 1072132 - RNA, 19 nt, Homo sapiens
gaaccauuguagccucaga

SEQ ID NO: 1072133 - RNA, 19 nt, Homo sapiens
ccagccaaguggaauugua

SEQ ID NO: 1072134 - RNA, 19 nt, Homo sapiens
ccaugcaaaucucaucuug

SEQ ID NO: 1072135 - RNA, 19 nt, Homo sapiens
caaguggucuuuccugacu

SEQ ID NO: 1072136 - RNA, 19 nt, Homo sapiens
auuaaagccucauguguga

SEQ ID NO: 1072137 - RNA, 19 nt, Homo sapiens
caaguguggcuuuauaaga

SEQ ID NO: 1072138 - RNA, 19 nt, Homo sapiens
ucccuucugucaccauuua

SEQ ID NO: 1072139 - RNA, 19 nt, Homo sapiens
gaucucaucugcuaaaauc

SEQ ID NO: 1072140 - RNA, 19 nt, Homo sapiens
aggaaggaaucuaagguuu

SEQ ID NO: 1072141 - RNA, 19 nt, Homo sapiens
uuagcuguauuucccuuua

SEQ ID NO: 1072142 - RNA, 19 nt, Homo sapiens
guucaaguaucaccuccuu

SEQ ID NO: 1072143 - RNA, 19 nt, Homo sapiens
gagaagagaccugacagau

SEQ ID NO: 1072144 - RNA, 19 nt, Homo sapiens
ggacuaacacauuuuauga

SEQ ID NO: 1072145 - RNA, 19 nt, Homo sapiens
ugaauaagucucacaagau

SEQ ID NO: 1072146 - RNA, 19 nt, Homo sapiens
caucuugaauuccuaugug

SEQ ID NO: 1072147 - RNA, 19 nt, Homo sapiens
cauguaaucuagucuuugg

SEQ ID NO: 1072148 - RNA, 19 nt, Homo sapiens
gaucuggguuaaucugagu

SEQ ID NO: 1072149 - RNA, 19 nt, Homo sapiens
aaaagaccauuuccuguaa

SEQ ID NO: 1072150 - RNA, 19 nt, Homo sapiens
agaagagaccugacagauu

SEQ ID NO: 1072151 - RNA, 19 nt, Homo sapiens
acuggaagguacuauauau

SEQ ID NO: 1072152 - RNA, 19 nt, Homo sapiens
ggugcaaauuggcuacuga

SEQ ID NO: 1072153 - RNA, 19 nt, Homo sapiens
ccaccaugcuugugagauc

SEQ ID NO: 1072154 - RNA, 19 nt, Homo sapiens
gaucaacagauaccucuca

SEQ ID NO: 1072155 - RNA, 19 nt, Homo sapiens
uaaagccucaugugugaaa

SEQ ID NO: 1072156 - RNA, 19 nt, Homo sapiens
gagcacacuugguacacau

SEQ ID NO: 1072157 - RNA, 19 nt, Homo sapiens
gcaggggaacuauuauuua

SEQ ID NO: 1072158 - RNA, 19 nt, Homo sapiens
ggagagaagagaccugaca

SEQ ID NO: 1072159 - RNA, 19 nt, Homo sapiens
aaagaccauuuccuguaaa

SEQ ID NO: 1072160 - RNA, 19 nt, Homo sapiens
uaaaagaccauuuccugua

SEQ ID NO: 1072161 - RNA, 19 nt, Homo sapiens
gaauaacagaucaacagau

SEQ ID NO: 1072162 - RNA, 19 nt, Homo sapiens
uguacaagcucucucucuu

SEQ ID NO: 1072163 - RNA, 19 nt, Homo sapiens
aaguguggcuuuauaagau

SEQ ID NO: 1072164 - RNA, 19 nt, Homo sapiens
ucagcugucugucccuuga

SEQ ID NO: 1072165 - RNA, 19 nt, Homo sapiens
cuauugaucuggguuaauc

SEQ ID NO: 1072166 - RNA, 19 nt, Homo sapiens
gcacacaggaaggaaucua

SEQ ID NO: 1072167 - RNA, 19 nt, Homo sapiens
ggccaccucugaucucauc

SEQ ID NO: 1072168 - RNA, 19 nt, Homo sapiens
gcccuguccuguuuacuuc

SEQ ID NO: 1072169 - RNA, 19 nt, Homo sapiens
gauaagggaaagaauaguc

SEQ ID NO: 1072170 - RNA, 19 nt, Homo sapiens
ggagcacacuugguacaca

SEQ ID NO: 1072171 - RNA, 19 nt, Homo sapiens
ugaguaacuuauugucuag

SEQ ID NO: 1072172 - RNA, 19 nt, Homo sapiens
agccaucccuggaagguuu

SEQ ID NO: 1072173 - RNA, 19 nt, Homo sapiens
agccucaugugugaaauua

SEQ ID NO: 1072174 - RNA, 19 nt, Homo sapiens
aagggaugcuuuagguuga

SEQ ID NO: 1072175 - RNA, 19 nt, Homo sapiens
gaaucuaagguuucccuau

SEQ ID NO: 1072176 - RNA, 19 nt, Homo sapiens
ucaaguaucaccuccuuca

SEQ ID NO: 1072177 - RNA, 19 nt, Homo sapiens
cagacuccauguaaucuag

SEQ ID NO: 1072178 - RNA, 19 nt, Homo sapiens
cagccaaguggaauuguaa

SEQ ID NO: 1072179 - RNA, 19 nt, Homo sapiens
ugagugaggauaagggaaa

SEQ ID NO: 1072180 - RNA, 19 nt, Homo sapiens
gaagguuucaucccaacug

SEQ ID NO: 1072181 - RNA, 19 nt, Homo sapiens
ugugggaggucauugaauc

SEQ ID NO: 1072182 - RNA, 19 nt, Homo sapiens
uucaaucucuccuuacuca

SEQ ID NO: 1072183 - RNA, 19 nt, Homo sapiens
ggcaccagacuccauguaa

SEQ ID NO: 1072184 - RNA, 19 nt, Homo sapiens
agauaccucucaauguguu

SEQ ID NO: 1072185 - RNA, 19 nt, Homo sapiens
cuucucaaguguggcuuua

SEQ ID NO: 1072186 - RNA, 19 nt, Homo sapiens
cauccagucuuugcacuuc

SEQ ID NO: 1072187 - RNA, 19 nt, Homo sapiens
caugguuacugacuuacau

SEQ ID NO: 1072188 - RNA, 19 nt, Homo sapiens
uguccaucuuugugauuua

SEQ ID NO: 1072189 - RNA, 19 nt, Homo sapiens
uggaagguacuauauaugu

SEQ ID NO: 1072190 - RNA, 19 nt, Homo sapiens
cucaauguguuugcuaauu

SEQ ID NO: 1072191 - RNA, 19 nt, Homo sapiens
uaugauuggugcaaauugg

SEQ ID NO: 1072192 - RNA, 19 nt, Homo sapiens
aauagacugugaaguaaac

SEQ ID NO: 1072193 - RNA, 19 nt, Homo sapiens
gguacuauauauguaugug

SEQ ID NO: 1072194 - RNA, 19 nt, Homo sapiens
uccauguaaucuagucuuu

SEQ ID NO: 1072195 - RNA, 19 nt, Homo sapiens
gagcuggguuggaaacuua

SEQ ID NO: 1072196 - RNA, 19 nt, Homo sapiens
gcuaagggcuacucuauug

SEQ ID NO: 1072197 - RNA, 19 nt, Homo sapiens
caccauaccuggccaauuu

SEQ ID NO: 1072198 - RNA, 19 nt, Homo sapiens
uagacgauguguaauguua

SEQ ID NO: 1072199 - RNA, 19 nt, Homo sapiens
gaaggaaacaccaagaaga

SEQ ID NO: 1072200 - RNA, 19 nt, Homo sapiens
ccaguuagacgauguguaa

SEQ ID NO: 1072201 - RNA, 19 nt, Homo sapiens
uaacaaauauucccugacu

SEQ ID NO: 1072202 - RNA, 19 nt, Homo sapiens
gguaggagcuggguuggaa

SEQ ID NO: 1072203 - RNA, 19 nt, Homo sapiens
agagaggccucgugucuuu

SEQ ID NO: 1072204 - RNA, 19 nt, Homo sapiens
caaauagaacagaagcuua

SEQ ID NO: 1072205 - RNA, 19 nt, Homo sapiens
gaagagaggccucgugucu

SEQ ID NO: 1072206 - RNA, 19 nt, Homo sapiens
gcaagaggcagaagacaga

SEQ ID NO: 1072207 - RNA, 19 nt, Homo sapiens
gcauuuccauucauuacuu

SEQ ID NO: 1072208 - RNA, 19 nt, Homo sapiens
acccugagcucaucaaauu

SEQ ID NO: 1072209 - RNA, 19 nt, Homo sapiens
gggauaggagggacacuua

SEQ ID NO: 1072210 - RNA, 19 nt, Homo sapiens
ggaaagcuagcgagaguug

SEQ ID NO: 1072211 - RNA, 19 nt, Homo sapiens
gacgauguguaauguuaaa

SEQ ID NO: 1072212 - RNA, 19 nt, Homo sapiens
caccguaacuacacagauu

SEQ ID NO: 1072213 - RNA, 19 nt, Homo sapiens
ggacacacagggacaaaug

SEQ ID NO: 1072214 - RNA, 19 nt, Homo sapiens
gaagaggucacugaacuug

SEQ ID NO: 1072215 - RNA, 19 nt, Homo sapiens
gcacaggacaggagcauca

SEQ ID NO: 1072216 - RNA, 19 nt, Homo sapiens
gcaaagggguguauccuau

SEQ ID NO: 1072217 - RNA, 19 nt, Homo sapiens
cagaagaggucacugaacu

SEQ ID NO: 1072218 - RNA, 19 nt, Homo sapiens
ggguguauccuauccauaa

SEQ ID NO: 1072219 - RNA, 19 nt, Homo sapiens
gguaagagcaucuggaagu

SEQ ID NO: 1072220 - RNA, 19 nt, Homo sapiens
ggacaaauggacagacaga

SEQ ID NO: 1072221 - RNA, 19 nt, Homo sapiens
cauagaagcgugaaggaaa

SEQ ID NO: 1072222 - RNA, 19 nt, Homo sapiens
ggacacuuagcaauguuua

SEQ ID NO: 1072223 - RNA, 19 nt, Homo sapiens
gagggacacuuagcaaugu

SEQ ID NO: 1072224 - RNA, 19 nt, Homo sapiens
gggcaggguuggagaagug

SEQ ID NO: 1072225 - RNA, 19 nt, Homo sapiens
ggagggacacuuagcaaug

SEQ ID NO: 1072226 - RNA, 19 nt, Homo sapiens
gagcaucaggagccuauuu

SEQ ID NO: 1072227 - RNA, 19 nt, Homo sapiens
cuacacagauuaacaacag

SEQ ID NO: 1072228 - RNA, 19 nt, Homo sapiens
gugcucagcuugcuauuac

SEQ ID NO: 1072229 - RNA, 19 nt, Homo sapiens
ggaccaacacaauauucua

SEQ ID NO: 1072230 - RNA, 19 nt, Homo sapiens
aaacuuaaacagaggguaa

SEQ ID NO: 1072231 - RNA, 19 nt, Homo sapiens
agacagauacaaaccagua

SEQ ID NO: 1072232 - RNA, 19 nt, Homo sapiens
gaaauggaccugggcacaa

SEQ ID NO: 1072233 - RNA, 19 nt, Homo sapiens
gcacuugaggccaguaguu

SEQ ID NO: 1072234 - RNA, 19 nt, Homo sapiens
uauacagccugcagcauug

SEQ ID NO: 1072235 - RNA, 19 nt, Homo sapiens
aaauggaccugggcacaaa

SEQ ID NO: 1072236 - RNA, 19 nt, Homo sapiens
guaagagcaucuggaagug

SEQ ID NO: 1072237 - RNA, 19 nt, Homo sapiens
gagguaagagcaucuggaa

SEQ ID NO: 1072238 - RNA, 19 nt, Homo sapiens
ucacugaacuuggcaaugc

SEQ ID NO: 1072239 - RNA, 19 nt, Homo sapiens
gguguauccuauccauaaa

SEQ ID NO: 1072240 - RNA, 19 nt, Homo sapiens
guuagacgauguguaaugu

SEQ ID NO: 1072241 - RNA, 19 nt, Homo sapiens
ggagcuggguuggaaacuu

SEQ ID NO: 1072242 - RNA, 19 nt, Homo sapiens
gcgaagagugaacauagaa

SEQ ID NO: 1072243 - RNA, 19 nt, Homo sapiens
gaccaacacaauauucuau

SEQ ID NO: 1072244 - RNA, 19 nt, Homo sapiens
uagaacagaagcuuagaaa

SEQ ID NO: 1072245 - RNA, 19 nt, Homo sapiens
gcaggagaaucgcuugaac

SEQ ID NO: 1072246 - RNA, 19 nt, Homo sapiens
gaaaccccgucucuacuaa

SEQ ID NO: 1072247 - RNA, 19 nt, Homo sapiens
aggagaggcugacuacaga

SEQ ID NO: 1072248 - RNA, 19 nt, Homo sapiens
ggcgaagagugaacauaga

SEQ ID NO: 1072249 - RNA, 19 nt, Homo sapiens
agaaggaaauggcgaagag

SEQ ID NO: 1072250 - RNA, 19 nt, Homo sapiens
ggaaauggcgaagagugaa

SEQ ID NO: 1072251 - RNA, 19 nt, Homo sapiens
gagaugggcagagcacuug

SEQ ID NO: 1072252 - RNA, 19 nt, Homo sapiens
aggcagaggccaaauagaa

SEQ ID NO: 1072253 - RNA, 19 nt, Homo sapiens
gaugugacagggaaagcua

SEQ ID NO: 1072254 - RNA, 19 nt, Homo sapiens
ccaaauagaacagaagcuu

SEQ ID NO: 1072255 - RNA, 19 nt, Homo sapiens
caucugaauucuugaacuc

SEQ ID NO: 1072256 - RNA, 19 nt, Homo sapiens
gaggagaggcugacuacag

SEQ ID NO: 1072257 - RNA, 19 nt, Homo sapiens
gcccugcgagugagauaua

SEQ ID NO: 1072258 - RNA, 19 nt, Homo sapiens
caaugcagguauagagagu

SEQ ID NO: 1072259 - RNA, 19 nt, Homo sapiens
guaacuacacagauuaaca

SEQ ID NO: 1072260 - RNA, 19 nt, Homo sapiens
acuccaaguuuguguaaga

SEQ ID NO: 1072261 - RNA, 19 nt, Homo sapiens
gaggccaaauagaacagaa

SEQ ID NO: 1072262 - RNA, 19 nt, Homo sapiens
gcagaagacagaaggaaac

SEQ ID NO: 1072263 - RNA, 19 nt, Homo sapiens
gcagaggccaaauagaaca

SEQ ID NO: 1072264 - RNA, 19 nt, Homo sapiens
cagaaggaaacaccaagaa

SEQ ID NO: 1072265 - RNA, 19 nt, Homo sapiens
gaacccugagcucaucaaa

SEQ ID NO: 1072266 - RNA, 19 nt, Homo sapiens
ggacuuuucucaggacaaa

SEQ ID NO: 1072267 - RNA, 19 nt, Homo sapiens
gacaaugcagguauagaga

SEQ ID NO: 1072268 - RNA, 19 nt, Homo sapiens
ucagcuugcuauuacagaa

SEQ ID NO: 1072269 - RNA, 19 nt, Homo sapiens
gcaccuguaguuccagcua

SEQ ID NO: 1072270 - RNA, 19 nt, Homo sapiens
acaaaccaguaccauggaa

SEQ ID NO: 1072271 - RNA, 19 nt, Homo sapiens
ggcagaagacagaaggaaa

SEQ ID NO: 1072272 - RNA, 19 nt, Homo sapiens
uacccucccuccucucaaa

SEQ ID NO: 1072273 - RNA, 19 nt, Homo sapiens
aaacccgaauuccucaguu

SEQ ID NO: 1072274 - RNA, 19 nt, Homo sapiens
ccacugacaccguaacuac

SEQ ID NO: 1072275 - RNA, 19 nt, Homo sapiens
uuacagaaauguguuagac

SEQ ID NO: 1072276 - RNA, 19 nt, Homo sapiens
gguuggaaacuuaaacaga

SEQ ID NO: 1072277 - RNA, 19 nt, Homo sapiens
gagaggccucgugucuuua

SEQ ID NO: 1072278 - RNA, 19 nt, Homo sapiens
aaauagaacagaagcuuag

SEQ ID NO: 1072279 - RNA, 19 nt, Homo sapiens
ccuaggaccaacacaauau

SEQ ID NO: 1072280 - RNA, 19 nt, Homo sapiens
gggaaaaggugagaaaugg

SEQ ID NO: 1072281 - RNA, 19 nt, Homo sapiens
uacagacaguggcuuuaga

SEQ ID NO: 1072282 - RNA, 19 nt, Homo sapiens
cuuguugguugguuucaaa

SEQ ID NO: 1072283 - RNA, 19 nt, Homo sapiens
agggaaagcuagcgagagu

SEQ ID NO: 1072284 - RNA, 19 nt, Homo sapiens
gccuaggaccaacacaaua

SEQ ID NO: 1072285 - RNA, 19 nt, Homo sapiens
caaacaggccuaggaccaa

SEQ ID NO: 1072286 - RNA, 19 nt, Homo sapiens
gaaggacacacagggacaa

SEQ ID NO: 1072287 - RNA, 19 nt, Homo sapiens
gaggcugacuacagacagu

SEQ ID NO: 1072288 - RNA, 19 nt, Homo sapiens
guaaaccccucuagugaca

SEQ ID NO: 1072289 - RNA, 19 nt, Homo sapiens
guuucucacugccuaauag

SEQ ID NO: 1072290 - RNA, 19 nt, Homo sapiens
gcaggcaagaggcagaaga

SEQ ID NO: 1072291 - RNA, 19 nt, Homo sapiens
ugacaaugcagguauagag

SEQ ID NO: 1072292 - RNA, 19 nt, Homo sapiens
caaaccaguaccauggaaa

SEQ ID NO: 1072293 - RNA, 19 nt, Homo sapiens
aaaacagccugcaggauug

SEQ ID NO: 1072294 - RNA, 19 nt, Homo sapiens
ccaguaccauggaaacacu

SEQ ID NO: 1072295 - RNA, 19 nt, Homo sapiens
gcagcauacuugaauauua

SEQ ID NO: 1072296 - RNA, 19 nt, Homo sapiens
gaaccuagcgcaauuguaa

SEQ ID NO: 1072297 - RNA, 19 nt, Homo sapiens
gcaguugacuuuacuaugu

SEQ ID NO: 1072298 - RNA, 19 nt, Homo sapiens
cauaugaguugaugugaua

SEQ ID NO: 1072299 - RNA, 19 nt, Homo sapiens
gagaaggaaugaggaguua

SEQ ID NO: 1072300 - RNA, 19 nt, Homo sapiens
ggaauuggauugaagacuu

SEQ ID NO: 1072301 - RNA, 19 nt, Homo sapiens
gaauuggauugaagacuuu

SEQ ID NO: 1072302 - RNA, 19 nt, Homo sapiens
gaagcagcauacuugaaua

SEQ ID NO: 1072303 - RNA, 19 nt, Homo sapiens
caacaaacauaacuucuac

SEQ ID NO: 1072304 - RNA, 19 nt, Homo sapiens
caacccauccauagaaaua

SEQ ID NO: 1072305 - RNA, 19 nt, Homo sapiens
caugauaccucaauugaca

SEQ ID NO: 1072306 - RNA, 19 nt, Homo sapiens
uuacaagccugauaauguu

SEQ ID NO: 1072307 - RNA, 19 nt, Homo sapiens
gaaaaugguuagacugaaa

SEQ ID NO: 1072308 - RNA, 19 nt, Homo sapiens
caacuuugcugagaauaug

SEQ ID NO: 1072309 - RNA, 19 nt, Homo sapiens
ggaacucacugauggagau

SEQ ID NO: 1072310 - RNA, 19 nt, Homo sapiens
ggaagcagcauacuugaau

SEQ ID NO: 1072311 - RNA, 19 nt, Homo sapiens
guuagaaccuagcgcaauu

SEQ ID NO: 1072312 - RNA, 19 nt, Homo sapiens
uaagcuuucuccuagguua

SEQ ID NO: 1072313 - RNA, 19 nt, Homo sapiens
caaagacggaagccaaaua

SEQ ID NO: 1072314 - RNA, 19 nt, Homo sapiens
ggaaauuuauagcaaccaa

SEQ ID NO: 1072315 - RNA, 19 nt, Homo sapiens
cagcauacuugaauauuag

SEQ ID NO: 1072316 - RNA, 19 nt, Homo sapiens
cuaccaugguuaagaauuu

SEQ ID NO: 1072317 - RNA, 19 nt, Homo sapiens
ucagauuuaugccaacuuu

SEQ ID NO: 1072318 - RNA, 19 nt, Homo sapiens
gaauaccuccuuuauaaca

SEQ ID NO: 1072319 - RNA, 19 nt, Homo sapiens
auaaacaggucacuaaauc

SEQ ID NO: 1072320 - RNA, 19 nt, Homo sapiens
uaaaugcugcuuccuauug

SEQ ID NO: 1072321 - RNA, 19 nt, Homo sapiens
gagaagcaggaaauuuaua

SEQ ID NO: 1072322 - RNA, 19 nt, Homo sapiens
gagugaacaucaacaaaca

SEQ ID NO: 1072323 - RNA, 19 nt, Homo sapiens
gaaauggcaguaaggaaga

SEQ ID NO: 1072324 - RNA, 19 nt, Homo sapiens
uaaauuggagggaaacaaa

SEQ ID NO: 1072325 - RNA, 19 nt, Homo sapiens
gacggaagccaaauaggua

SEQ ID NO: 1072326 - RNA, 19 nt, Homo sapiens
gguaaucuauggccaacga

SEQ ID NO: 1072327 - RNA, 19 nt, Homo sapiens
ucaccuagaucauaugagu

SEQ ID NO: 1072328 - RNA, 19 nt, Homo sapiens
gcagggaauuggauugaag

SEQ ID NO: 1072329 - RNA, 19 nt, Homo sapiens
ccaaagaaauagggcaaga

SEQ ID NO: 1072330 - RNA, 19 nt, Homo sapiens
uugagaagcaggaaauuua

SEQ ID NO: 1072331 - RNA, 19 nt, Homo sapiens
agacagauauaaacaccaa

SEQ ID NO: 1072332 - RNA, 19 nt, Homo sapiens
guucaaauccagauaguau

SEQ ID NO: 1072333 - RNA, 19 nt, Homo sapiens
gauaaacaggucacuaaau

SEQ ID NO: 1072334 - RNA, 19 nt, Homo sapiens
uaacugaugcauugauuug

SEQ ID NO: 1072335 - RNA, 19 nt, Homo sapiens
ccagauaguauuacauuug

SEQ ID NO: 1072336 - RNA, 19 nt, Homo sapiens
gaauauggaggguauagau

SEQ ID NO: 1072337 - RNA, 19 nt, Homo sapiens
ggagaaggaaugaggaguu

SEQ ID NO: 1072338 - RNA, 19 nt, Homo sapiens
gcgcaauuguaaagugaaa

SEQ ID NO: 1072339 - RNA, 19 nt, Homo sapiens
uguuagaucuuguaggaaa

SEQ ID NO: 1072340 - RNA, 19 nt, Homo sapiens
uacagacacuaccauaauu

SEQ ID NO: 1072341 - RNA, 19 nt, Homo sapiens
caggugaacacacaugaua

SEQ ID NO: 1072342 - RNA, 19 nt, Homo sapiens
gucaggagcuuuuauauau

SEQ ID NO: 1072343 - RNA, 19 nt, Homo sapiens
uguaaaugcugcuuccuau

SEQ ID NO: 1072344 - RNA, 19 nt, Homo sapiens
cagacacuaccauaauuua

SEQ ID NO: 1072345 - RNA, 19 nt, Homo sapiens
acaggucacuaaaucauug

SEQ ID NO: 1072346 - RNA, 19 nt, Homo sapiens
gaugugaaauggcaguaag

SEQ ID NO: 1072347 - RNA, 19 nt, Homo sapiens
ccaacgauguuagaaccua

SEQ ID NO: 1072348 - RNA, 19 nt, Homo sapiens
gaacaucaacaaacauaac

SEQ ID NO: 1072349 - RNA, 19 nt, Homo sapiens
gugaacaucaacaaacaua

SEQ ID NO: 1072350 - RNA, 19 nt, Homo sapiens
caguugacuuuacuaugua

SEQ ID NO: 1072351 - RNA, 19 nt, Homo sapiens
gaaaccaagauuagaaaca

SEQ ID NO: 1072352 - RNA, 19 nt, Homo sapiens
ucauuggcguuuauaaaga

SEQ ID NO: 1072353 - RNA, 19 nt, Homo sapiens
ccagacacguuguaaaugc

SEQ ID NO: 1072354 - RNA, 19 nt, Homo sapiens
gaaguucaaauccagauag

SEQ ID NO: 1072355 - RNA, 19 nt, Homo sapiens
gaaauucaaggagaaggaa

SEQ ID NO: 1072356 - RNA, 19 nt, Homo sapiens
gaagaaaacagaauaacug

SEQ ID NO: 1072357 - RNA, 19 nt, Homo sapiens
guuguaacauaaaggcaaa

SEQ ID NO: 1072358 - RNA, 19 nt, Homo sapiens
cugaugcauugauuugaua

SEQ ID NO: 1072359 - RNA, 19 nt, Homo sapiens
uagcgcaauuguaaaguga

SEQ ID NO: 1072360 - RNA, 19 nt, Homo sapiens
ucuagggccacuuaauuua

SEQ ID NO: 1072361 - RNA, 19 nt, Homo sapiens
ggguauagaugagugaaca

SEQ ID NO: 1072362 - RNA, 19 nt, Homo sapiens
ggaagcagggaauuggauu

SEQ ID NO: 1072363 - RNA, 19 nt, Homo sapiens
aguguuagaucuuguagga

SEQ ID NO: 1072364 - RNA, 19 nt, Homo sapiens
uauguaaauuggagggaaa

SEQ ID NO: 1072365 - RNA, 19 nt, Homo sapiens
ggguucaccuagaucauau

SEQ ID NO: 1072366 - RNA, 19 nt, Homo sapiens
ugugauacuucuagaacaa

SEQ ID NO: 1072367 - RNA, 19 nt, Homo sapiens
uuacagacacuaccauaau

SEQ ID NO: 1072368 - RNA, 19 nt, Homo sapiens
ccaccaagccagacacguu

SEQ ID NO: 1072369 - RNA, 19 nt, Homo sapiens
aaagaaauagggcaagaga

SEQ ID NO: 1072370 - RNA, 19 nt, Homo sapiens
gaguugaugugauacuucu

SEQ ID NO: 1072371 - RNA, 19 nt, Homo sapiens
cacaugauaccucaauuga

SEQ ID NO: 1072372 - RNA, 19 nt, Homo sapiens
uagggaagcagcauacuug

SEQ ID NO: 1072373 - RNA, 19 nt, Homo sapiens
gaagcagggaauuggauug

SEQ ID NO: 1072374 - RNA, 19 nt, Homo sapiens
cauaacuucuaccaugguu

SEQ ID NO: 1072375 - RNA, 19 nt, Homo sapiens
uagggccacuuaauuuaga

SEQ ID NO: 1072376 - RNA, 19 nt, Homo sapiens
gaagacuuucauaguugua

SEQ ID NO: 1072377 - RNA, 19 nt, Homo sapiens
uaggaaaccaagauuagaa

SEQ ID NO: 1072378 - RNA, 19 nt, Homo sapiens
caucagguuuccccuauaa

SEQ ID NO: 1072379 - RNA, 19 nt, Homo sapiens
aaucaacccauccauagaa

SEQ ID NO: 1072380 - RNA, 19 nt, Homo sapiens
guaaaugcugcuuccuauu

SEQ ID NO: 1072381 - RNA, 19 nt, Homo sapiens
cugagaauauggaggguau

SEQ ID NO: 1072382 - RNA, 19 nt, Homo sapiens
ugcuuuaacugaugcauug

SEQ ID NO: 1072383 - RNA, 19 nt, Homo sapiens
ggauaacacaagcuuagug

SEQ ID NO: 1072384 - RNA, 19 nt, Homo sapiens
guaaucaggauaacacaag

SEQ ID NO: 1072385 - RNA, 19 nt, Homo sapiens
uugauaaacaggucacuaa

SEQ ID NO: 1072386 - RNA, 19 nt, Homo sapiens
ugauggagaugugaaaugg

SEQ ID NO: 1072387 - RNA, 19 nt, Homo sapiens
gaaggaaugaggaguuagg

SEQ ID NO: 1072388 - RNA, 19 nt, Homo sapiens
guaggaaaccaagauuaga

SEQ ID NO: 1072389 - RNA, 19 nt, Homo sapiens
caucaacaaacauaacuuc

SEQ ID NO: 1072390 - RNA, 19 nt, Homo sapiens
gucuagggccacuuaauuu

SEQ ID NO: 1072391 - RNA, 19 nt, Homo sapiens
aaacuuacacauggaaaga

SEQ ID NO: 1072392 - RNA, 19 nt, Homo sapiens
acagacacuaccauaauuu

SEQ ID NO: 1072393 - RNA, 19 nt, Homo sapiens
aaucagagagaccugcuaa

SEQ ID NO: 1072394 - RNA, 19 nt, Homo sapiens
uauaagcuuucuccuaggu

SEQ ID NO: 1072395 - RNA, 19 nt, Homo sapiens
caaacaagcuucuuuaaag

SEQ ID NO: 1072396 - RNA, 19 nt, Homo sapiens
ugagugagauuaugcaaua

SEQ ID NO: 1072397 - RNA, 19 nt, Homo sapiens
gcagauaucuucacaaggu

SEQ ID NO: 1072398 - RNA, 19 nt, Homo sapiens
ugacuucccuaauuucuua

SEQ ID NO: 1072399 - RNA, 19 nt, Homo sapiens
gaaauguggcuuuagguua

SEQ ID NO: 1072400 - RNA, 19 nt, Homo sapiens
caacugagguuuacaacau

SEQ ID NO: 1072401 - RNA, 19 nt, Homo sapiens
guuaacaccuauacucaua

SEQ ID NO: 1072402 - RNA, 19 nt, Homo sapiens
gcaaacaagcuucuuuaaa

SEQ ID NO: 1072403 - RNA, 19 nt, Homo sapiens
gaaaguaaucugaagagaa

SEQ ID NO: 1072404 - RNA, 19 nt, Homo sapiens
gugaugacuucccuaauuu

SEQ ID NO: 1072405 - RNA, 19 nt, Homo sapiens
gguauacugugaacucgua

SEQ ID NO: 1072406 - RNA, 19 nt, Homo sapiens
gguauaggcugaaggugaa

SEQ ID NO: 1072407 - RNA, 19 nt, Homo sapiens
guuaguagcacuuauguaa

SEQ ID NO: 1072408 - RNA, 19 nt, Homo sapiens
gaauaaugcugcaaugaac

SEQ ID NO: 1072409 - RNA, 19 nt, Homo sapiens
gaaaauugcuucaaguuca

SEQ ID NO: 1072410 - RNA, 19 nt, Homo sapiens
gaccauagguuaggauaau

SEQ ID NO: 1072411 - RNA, 19 nt, Homo sapiens
caauauagacguuauggaa

SEQ ID NO: 1072412 - RNA, 19 nt, Homo sapiens
gacauuaacagcacucuuu

SEQ ID NO: 1072413 - RNA, 19 nt, Homo sapiens
acacacacauaaacguaua

SEQ ID NO: 1072414 - RNA, 19 nt, Homo sapiens
ugugaugacuucccuaauu

SEQ ID NO: 1072415 - RNA, 19 nt, Homo sapiens
ucaagucaccaguuaauaa

SEQ ID NO: 1072416 - RNA, 19 nt, Homo sapiens
uggcuuaucucauuuaaca

SEQ ID NO: 1072417 - RNA, 19 nt, Homo sapiens
cuacauaucugcuauuuug

SEQ ID NO: 1072418 - RNA, 19 nt, Homo sapiens
ggaaaaguguggucugaaa

SEQ ID NO: 1072419 - RNA, 19 nt, Homo sapiens
ucacauacuuuaacaagag

SEQ ID NO: 1072420 - RNA, 19 nt, Homo sapiens
acaccuauacucauacuua

SEQ ID NO: 1072421 - RNA, 19 nt, Homo sapiens
ucugggaacuucugguaua

SEQ ID NO: 1072422 - RNA, 19 nt, Homo sapiens
gaaguucucuacuaaucuc

SEQ ID NO: 1072423 - RNA, 19 nt, Homo sapiens
ucuacugucucagauauua

SEQ ID NO: 1072424 - RNA, 19 nt, Homo sapiens
gaacgaaaauugcuucaag

SEQ ID NO: 1072425 - RNA, 19 nt, Homo sapiens
guccaucuauguuguggua

SEQ ID NO: 1072426 - RNA, 19 nt, Homo sapiens
cuacauaugagugagauua

SEQ ID NO: 1072427 - RNA, 19 nt, Homo sapiens
gcaaaugauccuucuguuc

SEQ ID NO: 1072428 - RNA, 19 nt, Homo sapiens
gugcagauaucuucacaag

SEQ ID NO: 1072429 - RNA, 19 nt, Homo sapiens
aacaucaagucaccaguua

SEQ ID NO: 1072430 - RNA, 19 nt, Homo sapiens
gauacaugaccauagguua

SEQ ID NO: 1072431 - RNA, 19 nt, Homo sapiens
uuucgaaguucucuacuaa

SEQ ID NO: 1072432 - RNA, 19 nt, Homo sapiens
caaaugauccuucuguucu

SEQ ID NO: 1072433 - RNA, 19 nt, Homo sapiens
gaaacacuacuguccaaug

SEQ ID NO: 1072434 - RNA, 19 nt, Homo sapiens
gcuaucauuucacauacuu

SEQ ID NO: 1072435 - RNA, 19 nt, Homo sapiens
uaucuuggcuacugugaau

SEQ ID NO: 1072436 - RNA, 19 nt, Homo sapiens
cugauacgauuucaaaguu

SEQ ID NO: 1072437 - RNA, 19 nt, Homo sapiens
aaagauacaugaccauagg

SEQ ID NO: 1072438 - RNA, 19 nt, Homo sapiens
ugaauaaugcugcaaugaa

SEQ ID NO: 1072439 - RNA, 19 nt, Homo sapiens
aaauguggcuuuagguuag

SEQ ID NO: 1072440 - RNA, 19 nt, Homo sapiens
acaagcuucuuuaaaguga

SEQ ID NO: 1072441 - RNA, 19 nt, Homo sapiens
ucaagaaaguaaucugaag

SEQ ID NO: 1072442 - RNA, 19 nt, Homo sapiens
cccagaaucuucaaaauaa

SEQ ID NO: 1072443 - RNA, 19 nt, Homo sapiens
gugaaacacuacuguccaa

SEQ ID NO: 1072444 - RNA, 19 nt, Homo sapiens
ucccagacaucaauuucua

SEQ ID NO: 1072445 - RNA, 19 nt, Homo sapiens
caagaaaguaaucugaaga

SEQ ID NO: 1072446 - RNA, 19 nt, Homo sapiens
aauaugcuccguagaaauu

SEQ ID NO: 1072447 - RNA, 19 nt, Homo sapiens
gaagugagaggaagcaaac

SEQ ID NO: 1072448 - RNA, 19 nt, Homo sapiens
ccaucuauguugugguaaa

SEQ ID NO: 1072449 - RNA, 19 nt, Homo sapiens
gcagauuaauauagcuauc

SEQ ID NO: 1072450 - RNA, 19 nt, Homo sapiens
gaauauagacagcaaaaug

SEQ ID NO: 1072451 - RNA, 19 nt, Homo sapiens
ggaagugagaggaagcaaa

SEQ ID NO: 1072452 - RNA, 19 nt, Homo sapiens
gauauuaguguuccuccaa

SEQ ID NO: 1072453 - RNA, 19 nt, Homo sapiens
acacauaaacguauacaca

SEQ ID NO: 1072454 - RNA, 19 nt, Homo sapiens
cauuguacauugucuauac

SEQ ID NO: 1072455 - RNA, 19 nt, Homo sapiens
gugucuggcuuaucucauu

SEQ ID NO: 1072456 - RNA, 19 nt, Homo sapiens
ugaagcagauuaauauagc

SEQ ID NO: 1072457 - RNA, 19 nt, Homo sapiens
caagucaccaguuaauaau

SEQ ID NO: 1072458 - RNA, 19 nt, Homo sapiens
ucgaaguucucuacuaauc

SEQ ID NO: 1072459 - RNA, 19 nt, Homo sapiens
uaaaauaugcuccguagaa

SEQ ID NO: 1072460 - RNA, 19 nt, Homo sapiens
gaacgcgagagugcagaua

SEQ ID NO: 1072461 - RNA, 19 nt, Homo sapiens
cuucuuuacucaugucauu

SEQ ID NO: 1072462 - RNA, 19 nt, Homo sapiens
cguauacacacacacauaa

SEQ ID NO: 1072463 - RNA, 19 nt, Homo sapiens
cccuguaucucuaaacuug

SEQ ID NO: 1072464 - RNA, 19 nt, Homo sapiens
ggugaagcagauuaauaua

SEQ ID NO: 1072465 - RNA, 19 nt, Homo sapiens
aaacacuacuguccaaugc

SEQ ID NO: 1072466 - RNA, 19 nt, Homo sapiens
aacaugaugcuauggaaua

SEQ ID NO: 1072467 - RNA, 19 nt, Homo sapiens
caccuauacucauacuuau

SEQ ID NO: 1072468 - RNA, 19 nt, Homo sapiens
acacuacuguccaaugcaa

SEQ ID NO: 1072469 - RNA, 19 nt, Homo sapiens
cauccuacauaucugcuau

SEQ ID NO: 1072470 - RNA, 19 nt, Homo sapiens
gcaaaauggugaagcagau

SEQ ID NO: 1072471 - RNA, 19 nt, Homo sapiens
ggucugaaauagggacaug

SEQ ID NO: 1072472 - RNA, 19 nt, Homo sapiens
caucaagucaccaguuaau

SEQ ID NO: 1072473 - RNA, 19 nt, Homo sapiens
aaacaucaagucaccaguu

SEQ ID NO: 1072474 - RNA, 19 nt, Homo sapiens
ccauagguuaggauaauaa

SEQ ID NO: 1072475 - RNA, 19 nt, Homo sapiens
aagcagcccuucuuuacuc

SEQ ID NO: 1072476 - RNA, 19 nt, Homo sapiens
gagugcagauaucuucaca

SEQ ID NO: 1072477 - RNA, 19 nt, Homo sapiens
uuacucaugucauuucuac

SEQ ID NO: 1072478 - RNA, 19 nt, Homo sapiens
acaacaugaugcuauggaa

SEQ ID NO: 1072479 - RNA, 19 nt, Homo sapiens
ccagacaucaauuucuauu

SEQ ID NO: 1072480 - RNA, 19 nt, Homo sapiens
cgagagugcagauaucuuc

SEQ ID NO: 1072481 - RNA, 19 nt, Homo sapiens
uaaccacuguuucguucug

SEQ ID NO: 1072482 - RNA, 19 nt, Homo sapiens
aacaagagcugcuaaaauc

SEQ ID NO: 1072483 - RNA, 19 nt, Homo sapiens
ugaaauguggcuuuagguu

SEQ ID NO: 1072484 - RNA, 19 nt, Homo sapiens
agaaaguaaucugaagaga

SEQ ID NO: 1072485 - RNA, 19 nt, Homo sapiens
aaaguguggucugaaauag

SEQ ID NO: 1072486 - RNA, 19 nt, Homo sapiens
acauaaacguauacacaca

SEQ ID NO: 1072487 - RNA, 19 nt, Homo sapiens
ucagguccaucuauguugu

SEQ ID NO: 1072488 - RNA, 19 nt, Homo sapiens
gugaagcagauuaauauag

SEQ ID NO: 1072489 - RNA, 19 nt, Homo sapiens
uauggaauauagacagcaa

SEQ ID NO: 1072490 - RNA, 19 nt, Homo sapiens
uaacaccuauacucauacu

SEQ ID NO: 1072491 - RNA, 19 nt, Homo sapiens
ccaacuccaucaugcaucu

SEQ ID NO: 1072492 - RNA, 19 nt, Homo sapiens
acugugaacucguauuuac

SEQ ID NO: 1072493 - RNA, 19 nt, Homo sapiens
uggugaagcagauuaauau

SEQ ID NO: 1072494 - RNA, 19 nt, Homo sapiens
uaugcuccguagaaauuaa

SEQ ID NO: 1072495 - RNA, 19 nt, Homo sapiens
gaacaaaccuagugggaua

SEQ ID NO: 1072496 - RNA, 19 nt, Homo sapiens
gagagaagcuggaagaaau

SEQ ID NO: 1072497 - RNA, 19 nt, Homo sapiens
ccacagaaaugaacaagaa

SEQ ID NO: 1072498 - RNA, 19 nt, Homo sapiens
ggaaccaucuccuauuaaa

SEQ ID NO: 1072499 - RNA, 19 nt, Homo sapiens
ugaaauaggucacaacaga

SEQ ID NO: 1072500 - RNA, 19 nt, Homo sapiens
gagaagaacaugcuaaauu

SEQ ID NO: 1072501 - RNA, 19 nt, Homo sapiens
gcacgcagacugugaauuu

SEQ ID NO: 1072502 - RNA, 19 nt, Homo sapiens
ugaguaaucugguuguuaa

SEQ ID NO: 1072503 - RNA, 19 nt, Homo sapiens
gagaacaacuugccuaucu

SEQ ID NO: 1072504 - RNA, 19 nt, Homo sapiens
ggacuuaacagaugaagaa

SEQ ID NO: 1072505 - RNA, 19 nt, Homo sapiens
agaaagcacuugaaacuga

SEQ ID NO: 1072506 - RNA, 19 nt, Homo sapiens
guggaaccaucuccuauua

SEQ ID NO: 1072507 - RNA, 19 nt, Homo sapiens
gcaaaggauuggcugugua

SEQ ID NO: 1072508 - RNA, 19 nt, Homo sapiens
gaacggcugugccaagaug

SEQ ID NO: 1072509 - RNA, 19 nt, Homo sapiens
uaacuuguguuccuccuaa

SEQ ID NO: 1072510 - RNA, 19 nt, Homo sapiens
gcugucugcucuuacauua

SEQ ID NO: 1072511 - RNA, 19 nt, Homo sapiens
uaagugauccugaaaugua

SEQ ID NO: 1072512 - RNA, 19 nt, Homo sapiens
caaacagcauuaagaagaa

SEQ ID NO: 1072513 - RNA, 19 nt, Homo sapiens
gaacgggacggaaugcuaa

SEQ ID NO: 1072514 - RNA, 19 nt, Homo sapiens
cagaaggucuuaauuaugg

SEQ ID NO: 1072515 - RNA, 19 nt, Homo sapiens
gauacuagcuaaagauugg

SEQ ID NO: 1072516 - RNA, 19 nt, Homo sapiens
gauaccacauuuaacauug

SEQ ID NO: 1072517 - RNA, 19 nt, Homo sapiens
gaggagguguguuuaucua

SEQ ID NO: 1072518 - RNA, 19 nt, Homo sapiens
gaggagaguucagagaauu

SEQ ID NO: 1072519 - RNA, 19 nt, Homo sapiens
cuaagguuauguccuaaua

SEQ ID NO: 1072520 - RNA, 19 nt, Homo sapiens
gaauguugauacuagcuaa

SEQ ID NO: 1072521 - RNA, 19 nt, Homo sapiens
ccucagaaggucuuaauua

SEQ ID NO: 1072522 - RNA, 19 nt, Homo sapiens
ggagaugguugauuuaggu

SEQ ID NO: 1072523 - RNA, 19 nt, Homo sapiens
ucagugagcagcaugaaua

SEQ ID NO: 1072524 - RNA, 19 nt, Homo sapiens
ccaaacagcauuaagaaga

SEQ ID NO: 1072525 - RNA, 19 nt, Homo sapiens
acaagaagcucagugcaaa

SEQ ID NO: 1072526 - RNA, 19 nt, Homo sapiens
gaacagaggguaucauugc

SEQ ID NO: 1072527 - RNA, 19 nt, Homo sapiens
aaagacugguccaaagaua

SEQ ID NO: 1072528 - RNA, 19 nt, Homo sapiens
gcacaaacuugaucaucca

SEQ ID NO: 1072529 - RNA, 19 nt, Homo sapiens
gaggacgaauuccaaagaa

SEQ ID NO: 1072530 - RNA, 19 nt, Homo sapiens
gaccaagcccagcuaauuu

SEQ ID NO: 1072531 - RNA, 19 nt, Homo sapiens
ccagauuucuucauucaau

SEQ ID NO: 1072532 - RNA, 19 nt, Homo sapiens
gaaaacgaaugaagaguug

SEQ ID NO: 1072533 - RNA, 19 nt, Homo sapiens
cuuaacagaugaagaagaa

SEQ ID NO: 1072534 - RNA, 19 nt, Homo sapiens
gaaagcacuugaaacugau

SEQ ID NO: 1072535 - RNA, 19 nt, Homo sapiens
gcuaaagauuggguaaauu

SEQ ID NO: 1072536 - RNA, 19 nt, Homo sapiens
gaagguaaacagagagcua

SEQ ID NO: 1072537 - RNA, 19 nt, Homo sapiens
ugugggagaugguugauuu

SEQ ID NO: 1072538 - RNA, 19 nt, Homo sapiens
ccaaauagcuaggacuaca

SEQ ID NO: 1072539 - RNA, 19 nt, Homo sapiens
ccauuggguugguuugaua

SEQ ID NO: 1072540 - RNA, 19 nt, Homo sapiens
caacuugccuaucuggaau

SEQ ID NO: 1072541 - RNA, 19 nt, Homo sapiens
gaaauaggucacaacagaa

SEQ ID NO: 1072542 - RNA, 19 nt, Homo sapiens
aaagccagauuucuucauu

SEQ ID NO: 1072543 - RNA, 19 nt, Homo sapiens
gaacaugcuaaauuucuga

SEQ ID NO: 1072544 - RNA, 19 nt, Homo sapiens
ugucacaacuguccucuug

SEQ ID NO: 1072545 - RNA, 19 nt, Homo sapiens
agaagaggcugaugaugga

SEQ ID NO: 1072546 - RNA, 19 nt, Homo sapiens
ggauuguaauucagaagaa

SEQ ID NO: 1072547 - RNA, 19 nt, Homo sapiens
ugaccuaagugaauguuga

SEQ ID NO: 1072548 - RNA, 19 nt, Homo sapiens
ugucugcucuuacauuauu

SEQ ID NO: 1072549 - RNA, 19 nt, Homo sapiens
ggacggaaugcuaaaggua

SEQ ID NO: 1072550 - RNA, 19 nt, Homo sapiens
ggaaggugcuguaucuaac

SEQ ID NO: 1072551 - RNA, 19 nt, Homo sapiens
gguggaaggugcuguaucu

SEQ ID NO: 1072552 - RNA, 19 nt, Homo sapiens
ucaauucuguuaucucugu

SEQ ID NO: 1072553 - RNA, 19 nt, Homo sapiens
caucugagccuccuucgaa

SEQ ID NO: 1072554 - RNA, 19 nt, Homo sapiens
ucuggaaucugaggaauuu

SEQ ID NO: 1072555 - RNA, 19 nt, Homo sapiens
agaaggaaaucagaagaaa

SEQ ID NO: 1072556 - RNA, 19 nt, Homo sapiens
gcaaaugaaggccuuacaa

SEQ ID NO: 1072557 - RNA, 19 nt, Homo sapiens
aaacagcuauguguaugaa

SEQ ID NO: 1072558 - RNA, 19 nt, Homo sapiens
ggacuaagugauccugaaa

SEQ ID NO: 1072559 - RNA, 19 nt, Homo sapiens
gagaaggaaaucagaagaa

SEQ ID NO: 1072560 - RNA, 19 nt, Homo sapiens
guucagaggagguguguuu

SEQ ID NO: 1072561 - RNA, 19 nt, Homo sapiens
agaaauagauugggugaca

SEQ ID NO: 1072562 - RNA, 19 nt, Homo sapiens
cgaguauccuccacagaaa

SEQ ID NO: 1072563 - RNA, 19 nt, Homo sapiens
gagaggagaguucagagaa

SEQ ID NO: 1072564 - RNA, 19 nt, Homo sapiens
cggccaagauucuacauug

SEQ ID NO: 1072565 - RNA, 19 nt, Homo sapiens
agaaggcugucugcucuua

SEQ ID NO: 1072566 - RNA, 19 nt, Homo sapiens
agagagcuauguuucugua

SEQ ID NO: 1072567 - RNA, 19 nt, Homo sapiens
guaaagccaagaagaagaa

SEQ ID NO: 1072568 - RNA, 19 nt, Homo sapiens
cagcaaagguuucauucag

SEQ ID NO: 1072569 - RNA, 19 nt, Homo sapiens
cugcagagcucaagugaag

SEQ ID NO: 1072570 - RNA, 19 nt, Homo sapiens
gaaaucagaagaaauacag

SEQ ID NO: 1072571 - RNA, 19 nt, Homo sapiens
ggagguguguuuaucuauc

SEQ ID NO: 1072572 - RNA, 19 nt, Homo sapiens
gcauauggaaacugaauga

SEQ ID NO: 1072573 - RNA, 19 nt, Homo sapiens
agaagaaguucccgcauca

SEQ ID NO: 1072574 - RNA, 19 nt, Homo sapiens
gagcaaucccuuucuuaug

SEQ ID NO: 1072575 - RNA, 19 nt, Homo sapiens
ucacuuugcauuucaguuu

SEQ ID NO: 1072576 - RNA, 19 nt, Homo sapiens
gaagaacaugcuaaauuuc

SEQ ID NO: 1072577 - RNA, 19 nt, Homo sapiens
gagaugaggagaaggaaau

SEQ ID NO: 1072578 - RNA, 19 nt, Homo sapiens
ggaggacgaauuccaaaga

SEQ ID NO: 1072579 - RNA, 19 nt, Homo sapiens
gaaacugaaugaucuucgu

SEQ ID NO: 1072580 - RNA, 19 nt, Homo sapiens
uuacaugccuuagauuuca

SEQ ID NO: 1072581 - RNA, 19 nt, Homo sapiens
ggagaaacucuguuaccaa

SEQ ID NO: 1072582 - RNA, 19 nt, Homo sapiens
ggaaaagacugguccaaag

SEQ ID NO: 1072583 - RNA, 19 nt, Homo sapiens
gcagagcucaagugaaguu

SEQ ID NO: 1072584 - RNA, 19 nt, Homo sapiens
cuaaagauuggguaaauug

SEQ ID NO: 1072585 - RNA, 19 nt, Homo sapiens
gagcuauguuucuguaucu

SEQ ID NO: 1072586 - RNA, 19 nt, Homo sapiens
uuaaauaacccgaacuuca

SEQ ID NO: 1072587 - RNA, 19 nt, Homo sapiens
gccauuugcguacuaauuu

SEQ ID NO: 1072588 - RNA, 19 nt, Homo sapiens
ggaacgggacggaaugcua

SEQ ID NO: 1072589 - RNA, 19 nt, Homo sapiens
uauggaaacugaaugaucu

SEQ ID NO: 1072590 - RNA, 19 nt, Homo sapiens
ccagaaagcacuugaaacu

SEQ ID NO: 1072591 - RNA, 19 nt, Homo sapiens
ugaccaagcccagcuaauu

SEQ ID NO: 1072592 - RNA, 19 nt, Homo sapiens
gguuugauaccacauuuaa

SEQ ID NO: 1072593 - RNA, 19 nt, Homo sapiens
cgaacaagcacugcaguaa

SEQ ID NO: 1072594 - RNA, 19 nt, Homo sapiens
gaaggaaaucagaagaaau

SEQ ID NO: 1072595 - RNA, 19 nt, Homo sapiens
uaagagacauugccuaaau

SEQ ID NO: 1072596 - RNA, 19 nt, Homo sapiens
gaaacuccgucucugcuaa

SEQ ID NO: 1072597 - RNA, 19 nt, Homo sapiens
gaggaggacuugaaugcua

SEQ ID NO: 1072598 - RNA, 19 nt, Homo sapiens
ggacuugaaugcuaccaaa

SEQ ID NO: 1072599 - RNA, 19 nt, Homo sapiens
caaacaggauuagacuuua

SEQ ID NO: 1072600 - RNA, 19 nt, Homo sapiens
ggagugaguuaaaugugua

SEQ ID NO: 1072601 - RNA, 19 nt, Homo sapiens
gaggguaaauguacuaugu

SEQ ID NO: 1072602 - RNA, 19 nt, Homo sapiens
caaagacuaucauggcauu

SEQ ID NO: 1072603 - RNA, 19 nt, Homo sapiens
agagagagcacgauaauuu

SEQ ID NO: 1072604 - RNA, 19 nt, Homo sapiens
uagcagaaaucaacuguau

SEQ ID NO: 1072605 - RNA, 19 nt, Homo sapiens
ggacagagaguuccaaaca

SEQ ID NO: 1072606 - RNA, 19 nt, Homo sapiens
ggauuagacuuuauuacug

SEQ ID NO: 1072607 - RNA, 19 nt, Homo sapiens
gagcagaauugacagaaca

SEQ ID NO: 1072608 - RNA, 19 nt, Homo sapiens
auacuaggauacugacuua

SEQ ID NO: 1072609 - RNA, 19 nt, Homo sapiens
ccaaacaggauuagacuuu

SEQ ID NO: 1072610 - RNA, 19 nt, Homo sapiens
gcaguugccuucuagaucu

SEQ ID NO: 1072611 - RNA, 19 nt, Homo sapiens
gcagaugggagcagaauug

SEQ ID NO: 1072612 - RNA, 19 nt, Homo sapiens
ugacauaaccuacguaagu

SEQ ID NO: 1072613 - RNA, 19 nt, Homo sapiens
guucuggguugucucauaa

SEQ ID NO: 1072614 - RNA, 19 nt, Homo sapiens
ccaaccagaucuaaauaau

SEQ ID NO: 1072615 - RNA, 19 nt, Homo sapiens
cuaaggcugugcuaauaaa

SEQ ID NO: 1072616 - RNA, 19 nt, Homo sapiens
caacuguauuuguuugcua

SEQ ID NO: 1072617 - RNA, 19 nt, Homo sapiens
ugaguacucuccugagcua

SEQ ID NO: 1072618 - RNA, 19 nt, Homo sapiens
ggguaaauguacuauguug

SEQ ID NO: 1072619 - RNA, 19 nt, Homo sapiens
ugacaguguuggcuuagaa

SEQ ID NO: 1072620 - RNA, 19 nt, Homo sapiens
cuaacagaauggagaguaa

SEQ ID NO: 1072621 - RNA, 19 nt, Homo sapiens
cuaauaaagugcuguaaac

SEQ ID NO: 1072622 - RNA, 19 nt, Homo sapiens
gcuaauaaagugcuguaaa

SEQ ID NO: 1072623 - RNA, 19 nt, Homo sapiens
gccaugauccucaguggua

SEQ ID NO: 1072624 - RNA, 19 nt, Homo sapiens
uugccuaaauugcugauua

SEQ ID NO: 1072625 - RNA, 19 nt, Homo sapiens
caucagaggcuaacagaau

SEQ ID NO: 1072626 - RNA, 19 nt, Homo sapiens
ccaaacaucugacauaacc

SEQ ID NO: 1072627 - RNA, 19 nt, Homo sapiens
ggucauuugugcuucuuug

SEQ ID NO: 1072628 - RNA, 19 nt, Homo sapiens
auaaagugcuguaaaccaa

SEQ ID NO: 1072629 - RNA, 19 nt, Homo sapiens
guaaguagcagaaaucaac

SEQ ID NO: 1072630 - RNA, 19 nt, Homo sapiens
cuacguaagugacaguguu

SEQ ID NO: 1072631 - RNA, 19 nt, Homo sapiens
gacauaaccuacguaagug

SEQ ID NO: 1072632 - RNA, 19 nt, Homo sapiens
aauuagagcugguaagaca

SEQ ID NO: 1072633 - RNA, 19 nt, Homo sapiens
cuaggauacugacuuagaa

SEQ ID NO: 1072634 - RNA, 19 nt, Homo sapiens
gcuaaggcugugcuaauaa

SEQ ID NO: 1072635 - RNA, 19 nt, Homo sapiens
gauccucagugguaaguag

SEQ ID NO: 1072636 - RNA, 19 nt, Homo sapiens
gaugggagcagaauugaca

SEQ ID NO: 1072637 - RNA, 19 nt, Homo sapiens
ucacagagcaagccaaaca

SEQ ID NO: 1072638 - RNA, 19 nt, Homo sapiens
gagagagagagcacgauaa

SEQ ID NO: 1072639 - RNA, 19 nt, Homo sapiens
uaaggaaccuacugagcau

SEQ ID NO: 1072640 - RNA, 19 nt, Homo sapiens
uggguugucucauaauuau

SEQ ID NO: 1072641 - RNA, 19 nt, Homo sapiens
aagagacauugccuaaauu

SEQ ID NO: 1072642 - RNA, 19 nt, Homo sapiens
aaaccaacguacucacaga

SEQ ID NO: 1072643 - RNA, 19 nt, Homo sapiens
aaacaucugacauaaccua

SEQ ID NO: 1072644 - RNA, 19 nt, Homo sapiens
ccaauuagagcugguaaga

SEQ ID NO: 1072645 - RNA, 19 nt, Homo sapiens
ugccuaaauugcugauuaa

SEQ ID NO: 1072646 - RNA, 19 nt, Homo sapiens
ggauaucccuccccgcuaa

SEQ ID NO: 1072647 - RNA, 19 nt, Homo sapiens
ugcuaaggcugugcuaaua

SEQ ID NO: 1072648 - RNA, 19 nt, Homo sapiens
ugucagauuugccaaguuc

SEQ ID NO: 1072649 - RNA, 19 nt, Homo sapiens
uaaagagccauaugacugu

SEQ ID NO: 1072650 - RNA, 19 nt, Homo sapiens
gcuaacagaauggagagua

SEQ ID NO: 1072651 - RNA, 19 nt, Homo sapiens
gagcaagccaaacaggauu

SEQ ID NO: 1072652 - RNA, 19 nt, Homo sapiens
augccgaccugucauuuaa

SEQ ID NO: 1072653 - RNA, 19 nt, Homo sapiens
gagcaucgaaccacuccaa

SEQ ID NO: 1072654 - RNA, 19 nt, Homo sapiens
ccaaugaggguaaauguac

SEQ ID NO: 1072655 - RNA, 19 nt, Homo sapiens
gcagguacagccucaggaa

SEQ ID NO: 1072656 - RNA, 19 nt, Homo sapiens
gagggucagggaaaucuaa

SEQ ID NO: 1072657 - RNA, 19 nt, Homo sapiens
gaggaggcgcagugucuuu

SEQ ID NO: 1072658 - RNA, 19 nt, Homo sapiens
caucgaaccacuccaacuu

SEQ ID NO: 1072659 - RNA, 19 nt, Homo sapiens
uaaccacuuugaagaccaa

SEQ ID NO: 1072660 - RNA, 19 nt, Homo sapiens
aguguuggcuuagaauaaa

SEQ ID NO: 1072661 - RNA, 19 nt, Homo sapiens
gaucuagccacaggagaaa

SEQ ID NO: 1072662 - RNA, 19 nt, Homo sapiens
gccaaugaggguaaaugua

SEQ ID NO: 1072663 - RNA, 19 nt, Homo sapiens
gaguuggagugaguuaaau

SEQ ID NO: 1072664 - RNA, 19 nt, Homo sapiens
caucucuacauccaaauaa

SEQ ID NO: 1072665 - RNA, 19 nt, Homo sapiens
agagagagagagcacgaua

SEQ ID NO: 1072666 - RNA, 19 nt, Homo sapiens
aagugacaguguuggcuua

SEQ ID NO: 1072667 - RNA, 19 nt, Homo sapiens
ggagcagaauugacagaac

SEQ ID NO: 1072668 - RNA, 19 nt, Homo sapiens
ugaguuggagugaguuaaa

SEQ ID NO: 1072669 - RNA, 19 nt, Homo sapiens
uuuaagagacauugccuaa

SEQ ID NO: 1072670 - RNA, 19 nt, Homo sapiens
ggacuacuuuugugagaau

SEQ ID NO: 1072671 - RNA, 19 nt, Homo sapiens
gaaccuacugagcaucgaa

SEQ ID NO: 1072672 - RNA, 19 nt, Homo sapiens
gcaagaugggucauuugug

SEQ ID NO: 1072673 - RNA, 19 nt, Homo sapiens
uggagugaguuaaaugugu

SEQ ID NO: 1072674 - RNA, 19 nt, Homo sapiens
aggaauacuuauaggcaaa

SEQ ID NO: 1072675 - RNA, 19 nt, Homo sapiens
uaacagaauggagaguaaa

SEQ ID NO: 1072676 - RNA, 19 nt, Homo sapiens
aauaauaccagccaugauc

SEQ ID NO: 1072677 - RNA, 19 nt, Homo sapiens
gagagagagcacgauaauu

SEQ ID NO: 1072678 - RNA, 19 nt, Homo sapiens
caugccgaccugucauuua

SEQ ID NO: 1072679 - RNA, 19 nt, Homo sapiens
agagagagagcacgauaau

SEQ ID NO: 1072680 - RNA, 19 nt, Homo sapiens
gguacagccucaggaauac

SEQ ID NO: 1072681 - RNA, 19 nt, Homo sapiens
agguacagccucaggaaua

SEQ ID NO: 1072682 - RNA, 19 nt, Homo sapiens
gugagaauuugaagaccau

SEQ ID NO: 1072683 - RNA, 19 nt, Homo sapiens
caguguuggcuuagaauaa

SEQ ID NO: 1072684 - RNA, 19 nt, Homo sapiens
caucugacauaaccuacgu

SEQ ID NO: 1072685 - RNA, 19 nt, Homo sapiens
guaaauguacuauguugcu

SEQ ID NO: 1072686 - RNA, 19 nt, Homo sapiens
uaaagugcuguaaaccaaa

SEQ ID NO: 1072687 - RNA, 19 nt, Homo sapiens
gggaggcccaguuacuuga

SEQ ID NO: 1072688 - RNA, 19 nt, Homo sapiens
ccaugauccucagugguaa

SEQ ID NO: 1072689 - RNA, 19 nt, Homo sapiens
ccauugacuuuggguucua

SEQ ID NO: 1072690 - RNA, 19 nt, Homo sapiens
ucucugaguuggagugagu

SEQ ID NO: 1072691 - RNA, 19 nt, Homo sapiens
aagcagagggucagggaaa

SEQ ID NO: 1072692 - RNA, 19 nt, Homo sapiens
gcacauggccaggauaucc

SEQ ID NO: 1072693 - RNA, 19 nt, Homo sapiens
gcugucagauuugccaagu

SEQ ID NO: 1072694 - RNA, 19 nt, Homo sapiens
gaccaacagccaagacauc

SEQ ID NO: 1072695 - RNA, 19 nt, Homo sapiens
gcaauuaguucuacaaaga

SEQ ID NO: 1072696 - RNA, 19 nt, Homo sapiens
uaaaguagcugaauucuuc

SEQ ID NO: 1072697 - RNA, 19 nt, Homo sapiens
aaagaaaucugucaccauu

SEQ ID NO: 1072698 - RNA, 19 nt, Homo sapiens
caacaggaguaacuaauug

SEQ ID NO: 1072699 - RNA, 19 nt, Homo sapiens
acuaagagcucaaaugauu

SEQ ID NO: 1072700 - RNA, 19 nt, Homo sapiens
gagauuaccuauaugcuau

SEQ ID NO: 1072701 - RNA, 19 nt, Homo sapiens
acacguaagugcuaaagua

SEQ ID NO: 1072702 - RNA, 19 nt, Homo sapiens
gaaaagggauggaugugua

SEQ ID NO: 1072703 - RNA, 19 nt, Homo sapiens
agaauacuguccaaguuua

SEQ ID NO: 1072704 - RNA, 19 nt, Homo sapiens
aaagaauacuguccaaguu

SEQ ID NO: 1072705 - RNA, 19 nt, Homo sapiens
ccagaaacauauacacaga

SEQ ID NO: 1072706 - RNA, 19 nt, Homo sapiens
acagaaaguuuauguggaa

SEQ ID NO: 1072707 - RNA, 19 nt, Homo sapiens
ccaaauaugugugaaaucu

SEQ ID NO: 1072708 - RNA, 19 nt, Homo sapiens
ucaaagugcugugccagua

SEQ ID NO: 1072709 - RNA, 19 nt, Homo sapiens
gcaauugcagcauuaauau

SEQ ID NO: 1072710 - RNA, 19 nt, Homo sapiens
gaaagaacucuaugagcaa

SEQ ID NO: 1072711 - RNA, 19 nt, Homo sapiens
uuucuacccuguuccauua

SEQ ID NO: 1072712 - RNA, 19 nt, Homo sapiens
gagcucaaaugauuacaca

SEQ ID NO: 1072713 - RNA, 19 nt, Homo sapiens
caaagaaagaacucuauga

SEQ ID NO: 1072714 - RNA, 19 nt, Homo sapiens
uauuagaguuggaguacua

SEQ ID NO: 1072715 - RNA, 19 nt, Homo sapiens
gcccaucucaggaaacuua

SEQ ID NO: 1072716 - RNA, 19 nt, Homo sapiens
uaucagcuguguccaaaga

SEQ ID NO: 1072717 - RNA, 19 nt, Homo sapiens
uuacuaagagcucaaauga

SEQ ID NO: 1072718 - RNA, 19 nt, Homo sapiens
gaaaccauucuuaggauau

SEQ ID NO: 1072719 - RNA, 19 nt, Homo sapiens
cguaagugcuaaaguauag

SEQ ID NO: 1072720 - RNA, 19 nt, Homo sapiens
caggaaacuuaaauucuug

SEQ ID NO: 1072721 - RNA, 19 nt, Homo sapiens
auaaagggauggugaagga

SEQ ID NO: 1072722 - RNA, 19 nt, Homo sapiens
uacaguaucucuggguaua

SEQ ID NO: 1072723 - RNA, 19 nt, Homo sapiens
caaagaauacuguccaagu

SEQ ID NO: 1072724 - RNA, 19 nt, Homo sapiens
agacaaacuucacaaacug

SEQ ID NO: 1072725 - RNA, 19 nt, Homo sapiens
cuacacaggauuauuagaa

SEQ ID NO: 1072726 - RNA, 19 nt, Homo sapiens
gaaacuacacaggauuauu

SEQ ID NO: 1072727 - RNA, 19 nt, Homo sapiens
ucacagagacuaguucaga

SEQ ID NO: 1072728 - RNA, 19 nt, Homo sapiens
aaagugcugugccaguaaa

SEQ ID NO: 1072729 - RNA, 19 nt, Homo sapiens
acuagcaauugcagcauua

SEQ ID NO: 1072730 - RNA, 19 nt, Homo sapiens
uccaaggauucuuaaagua

SEQ ID NO: 1072731 - RNA, 19 nt, Homo sapiens
caagagaauaugaguacaa

SEQ ID NO: 1072732 - RNA, 19 nt, Homo sapiens
ccaacaggaguaacuaauu

SEQ ID NO: 1072733 - RNA, 19 nt, Homo sapiens
uagacaaacuucacaaacu

SEQ ID NO: 1072734 - RNA, 19 nt, Homo sapiens
gagcaauuaguucuacaaa

SEQ ID NO: 1072735 - RNA, 19 nt, Homo sapiens
gcugugccaguaaauauaa

SEQ ID NO: 1072736 - RNA, 19 nt, Homo sapiens
caguucacauuuacuaaga

SEQ ID NO: 1072737 - RNA, 19 nt, Homo sapiens
gcacauuuggaauugauga

SEQ ID NO: 1072738 - RNA, 19 nt, Homo sapiens
uuuaugaacuuccacugaa

SEQ ID NO: 1072739 - RNA, 19 nt, Homo sapiens
gauauaaagggauggugaa

SEQ ID NO: 1072740 - RNA, 19 nt, Homo sapiens
caaagugcugugccaguaa

SEQ ID NO: 1072741 - RNA, 19 nt, Homo sapiens
gcucaaaugauuacacauc

SEQ ID NO: 1072742 - RNA, 19 nt, Homo sapiens
ugagauuaccuauaugcua

SEQ ID NO: 1072743 - RNA, 19 nt, Homo sapiens
ccaaggauucuuaaaguag

SEQ ID NO: 1072744 - RNA, 19 nt, Homo sapiens
ggaaccacaauuuauaauc

SEQ ID NO: 1072745 - RNA, 19 nt, Homo sapiens
ucuaucagcuguguccaaa

SEQ ID NO: 1072746 - RNA, 19 nt, Homo sapiens
aauccaaagccaaagaaua

SEQ ID NO: 1072747 - RNA, 19 nt, Homo sapiens
cuaagagcucaaaugauua

SEQ ID NO: 1072748 - RNA, 19 nt, Homo sapiens
gcacauuuccucugcuucu

SEQ ID NO: 1072749 - RNA, 19 nt, Homo sapiens
cuacaaagaaagaacucua

SEQ ID NO: 1072750 - RNA, 19 nt, Homo sapiens
gagacuaguucagagcaau

SEQ ID NO: 1072751 - RNA, 19 nt, Homo sapiens
gaauacuguccaaguuuau

SEQ ID NO: 1072752 - RNA, 19 nt, Homo sapiens
ugacagagagggauauugg

SEQ ID NO: 1072753 - RNA, 19 nt, Homo sapiens
gagggauauuggaggcuuu

SEQ ID NO: 1072754 - RNA, 19 nt, Homo sapiens
gccaaagaauacuguccaa

SEQ ID NO: 1072755 - RNA, 19 nt, Homo sapiens
aagaauacuguccaaguuu

SEQ ID NO: 1072756 - RNA, 19 nt, Homo sapiens
uguccaaguuuaucaaagu

SEQ ID NO: 1072757 - RNA, 19 nt, Homo sapiens
cuccaaggauucuuaaagu

SEQ ID NO: 1072758 - RNA, 19 nt, Homo sapiens
ccacuuugcagcuucuuug

SEQ ID NO: 1072759 - RNA, 19 nt, Homo sapiens
agcaauugcagcauuaaua

SEQ ID NO: 1072760 - RNA, 19 nt, Homo sapiens
gaacuuggagcacauuucc

SEQ ID NO: 1072761 - RNA, 19 nt, Homo sapiens
gcuauuuccuacccuugug

SEQ ID NO: 1072762 - RNA, 19 nt, Homo sapiens
gcucaugcaugcuauuucc

SEQ ID NO: 1072763 - RNA, 19 nt, Homo sapiens
acacaaccacaguaagaaa

SEQ ID NO: 1072764 - RNA, 19 nt, Homo sapiens
auacacaaccacaguaaga

SEQ ID NO: 1072765 - RNA, 19 nt, Homo sapiens
ggaacugauucguguacag

SEQ ID NO: 1072766 - RNA, 19 nt, Homo sapiens
gcucgaagcauguauuuug

SEQ ID NO: 1072767 - RNA, 19 nt, Homo sapiens
cuuaggauauggguuaaau

SEQ ID NO: 1072768 - RNA, 19 nt, Homo sapiens
aaaccauucuuaggauaug

SEQ ID NO: 1072769 - RNA, 19 nt, Homo sapiens
aaagaaagaacucuaugag

SEQ ID NO: 1072770 - RNA, 19 nt, Homo sapiens
gacuaguucagagcaauua

SEQ ID NO: 1072771 - RNA, 19 nt, Homo sapiens
gugcugugccaguaaauau

SEQ ID NO: 1072772 - RNA, 19 nt, Homo sapiens
ugucaccauuucugucaaa

SEQ ID NO: 1072773 - RNA, 19 nt, Homo sapiens
cuuugcagcuucuuugaga

SEQ ID NO: 1072774 - RNA, 19 nt, Homo sapiens
cagauacacaaccacagua

SEQ ID NO: 1072775 - RNA, 19 nt, Homo sapiens
acaugaaacuacacaggau

SEQ ID NO: 1072776 - RNA, 19 nt, Homo sapiens
guccaaagacugugcuuca

SEQ ID NO: 1072777 - RNA, 19 nt, Homo sapiens
auucuuaggauauggguua

SEQ ID NO: 1072778 - RNA, 19 nt, Homo sapiens
cauauacacagauacacaa

SEQ ID NO: 1072779 - RNA, 19 nt, Homo sapiens
uaacuaauugucccagcaa

SEQ ID NO: 1072780 - RNA, 19 nt, Homo sapiens
ccaaagacugugcuucauc

SEQ ID NO: 1072781 - RNA, 19 nt, Homo sapiens
uggaauugaugaaucuauc

SEQ ID NO: 1072782 - RNA, 19 nt, Homo sapiens
cagaaaguuuauguggaaa

SEQ ID NO: 1072783 - RNA, 19 nt, Homo sapiens
ucagagcaauuaguucuac

SEQ ID NO: 1072784 - RNA, 19 nt, Homo sapiens
aaacuccaaggauucuuaa

SEQ ID NO: 1072785 - RNA, 19 nt, Homo sapiens
cacaucuaauuacacauug

SEQ ID NO: 1072786 - RNA, 19 nt, Homo sapiens
cauuuggaauugaugaauc

SEQ ID NO: 1072787 - RNA, 19 nt, Homo sapiens
auacacagauacacaacca

SEQ ID NO: 1072788 - RNA, 19 nt, Homo sapiens
caaagccaaagaauacugu

SEQ ID NO: 1072789 - RNA, 19 nt, Homo sapiens
guucagagcaauuaguucu

SEQ ID NO: 1072790 - RNA, 19 nt, Homo sapiens
uaagagcucaaaugauuac

SEQ ID NO: 1072791 - RNA, 19 nt, Homo sapiens
caguaucucuggguauauc

SEQ ID NO: 1072792 - RNA, 19 nt, Homo sapiens
gaaaguuuauguggaaaag

SEQ ID NO: 1072793 - RNA, 19 nt, Homo sapiens
caucucaggaaacuuaaau

SEQ ID NO: 1072794 - RNA, 19 nt, Homo sapiens
guccaaguuuaucaaagug

SEQ ID NO: 1072795 - RNA, 19 nt, Homo sapiens
gagaagagauugaagcuuu

SEQ ID NO: 1072796 - RNA, 19 nt, Homo sapiens
gagaaagacugcaaacaug

SEQ ID NO: 1072797 - RNA, 19 nt, Homo sapiens
caacugaggugguucugaa

SEQ ID NO: 1072798 - RNA, 19 nt, Homo sapiens
caucgaaucuccuggguuu

SEQ ID NO: 1072799 - RNA, 19 nt, Homo sapiens
gagagcggcugguucauug

SEQ ID NO: 1072800 - RNA, 19 nt, Homo sapiens
caaagaugcuggcuauauc

SEQ ID NO: 1072801 - RNA, 19 nt, Homo sapiens
ccaacaaacccaacucuaa

SEQ ID NO: 1072802 - RNA, 19 nt, Homo sapiens
gagacugguucgcuuguuu

SEQ ID NO: 1072803 - RNA, 19 nt, Homo sapiens
gagcccacccuaaccauua

SEQ ID NO: 1072804 - RNA, 19 nt, Homo sapiens
ccauuaagcuagagcaaga

SEQ ID NO: 1072805 - RNA, 19 nt, Homo sapiens
ccggagagauugccauuga

SEQ ID NO: 1072806 - RNA, 19 nt, Homo sapiens
caacuuggacugcaccuuu

SEQ ID NO: 1072807 - RNA, 19 nt, Homo sapiens
caacuucaacccucacuuu

SEQ ID NO: 1072808 - RNA, 19 nt, Homo sapiens
gcuacuacgucaaauccua

SEQ ID NO: 1072809 - RNA, 19 nt, Homo sapiens
caacaaacccaacucuaau

SEQ ID NO: 1072810 - RNA, 19 nt, Homo sapiens
gaacagcacccaaaacaaa

SEQ ID NO: 1072811 - RNA, 19 nt, Homo sapiens
gaacccaaccagaagauug

SEQ ID NO: 1072812 - RNA, 19 nt, Homo sapiens
gaagggaacaugcacuaug

SEQ ID NO: 1072813 - RNA, 19 nt, Homo sapiens
gggauucaauugcaacuuc

SEQ ID NO: 1072814 - RNA, 19 nt, Homo sapiens
gaaagacugcaaacauguu

SEQ ID NO: 1072815 - RNA, 19 nt, Homo sapiens
gaccggacguuuccagaug

SEQ ID NO: 1072816 - RNA, 19 nt, Homo sapiens
gaagcacgacugcaaguau

SEQ ID NO: 1072817 - RNA, 19 nt, Homo sapiens
gugcggaggucguuugaau

SEQ ID NO: 1072818 - RNA, 19 nt, Homo sapiens
ccaaagaugcuggcuauau

SEQ ID NO: 1072819 - RNA, 19 nt, Homo sapiens
cgacauggaguaccagauu

SEQ ID NO: 1072820 - RNA, 19 nt, Homo sapiens
aagggaacaugcacuauga

SEQ ID NO: 1072821 - RNA, 19 nt, Homo sapiens
gaauggcuacuacgucaaa

SEQ ID NO: 1072822 - RNA, 19 nt, Homo sapiens
gaacugcagcuuugaggau

SEQ ID NO: 1072823 - RNA, 19 nt, Homo sapiens
caagacaggcucugaagau

SEQ ID NO: 1072824 - RNA, 19 nt, Homo sapiens
uuucuuagcccucuacuuu

SEQ ID NO: 1072825 - RNA, 19 nt, Homo sapiens
gagcauuugugcgcaaguu

SEQ ID NO: 1072826 - RNA, 19 nt, Homo sapiens
ccugagcacucuuaucaau

SEQ ID NO: 1072827 - RNA, 19 nt, Homo sapiens
cgagaaagacugcaaacau

SEQ ID NO: 1072828 - RNA, 19 nt, Homo sapiens
gacauggaguaccagauug

SEQ ID NO: 1072829 - RNA, 19 nt, Homo sapiens
gggauggcauuccacaugu

SEQ ID NO: 1072830 - RNA, 19 nt, Homo sapiens
gcugagggccgaagcaaga

SEQ ID NO: 1072831 - RNA, 19 nt, Homo sapiens
gaacugcgaguggauuguu

SEQ ID NO: 1072832 - RNA, 19 nt, Homo sapiens
caaacauguugccucgauu

SEQ ID NO: 1072833 - RNA, 19 nt, Homo sapiens
ggagagauugccauugaug

SEQ ID NO: 1072834 - RNA, 19 nt, Homo sapiens
ccagagagagggccaguau

SEQ ID NO: 1072835 - RNA, 19 nt, Homo sapiens
gaacuuucagugcaauguu

SEQ ID NO: 1072836 - RNA, 19 nt, Homo sapiens
gcuccaugcucuacaucaa

SEQ ID NO: 1072837 - RNA, 19 nt, Homo sapiens
gaggagcccugugguugga

SEQ ID NO: 1072838 - RNA, 19 nt, Homo sapiens
ucaauugcaacuucgauuu

SEQ ID NO: 1072839 - RNA, 19 nt, Homo sapiens
gaacacccaagacagugaa

SEQ ID NO: 1072840 - RNA, 19 nt, Homo sapiens
cauggagucuggccggauu

SEQ ID NO: 1072841 - RNA, 19 nt, Homo sapiens
caaguacugugggaccaaa

SEQ ID NO: 1072842 - RNA, 19 nt, Homo sapiens
ggauggcauuccacauguu

SEQ ID NO: 1072843 - RNA, 19 nt, Homo sapiens
aaacauguugccucgauuu

SEQ ID NO: 1072844 - RNA, 19 nt, Homo sapiens
guuagaauccgcccucaga

SEQ ID NO: 1072845 - RNA, 19 nt, Homo sapiens
aaacacagaauggcuacua

SEQ ID NO: 1072846 - RNA, 19 nt, Homo sapiens
gaacagaucagugccucau

SEQ ID NO: 1072847 - RNA, 19 nt, Homo sapiens
ucuuugaccuggagcauga

SEQ ID NO: 1072848 - RNA, 19 nt, Homo sapiens
gacaggcucugaagauugc

SEQ ID NO: 1072849 - RNA, 19 nt, Homo sapiens
gagagauugccauugauga

SEQ ID NO: 1072850 - RNA, 19 nt, Homo sapiens
ggaggucguuugaauucca

SEQ ID NO: 1072851 - RNA, 19 nt, Homo sapiens
gcggaggucguuugaauuc

SEQ ID NO: 1072852 - RNA, 19 nt, Homo sapiens
agugaaaggugucaucauc

SEQ ID NO: 1072853 - RNA, 19 nt, Homo sapiens
gaugcucccugcuccaaca

SEQ ID NO: 1072854 - RNA, 19 nt, Homo sapiens
caacacagggagcgauuuc

SEQ ID NO: 1072855 - RNA, 19 nt, Homo sapiens
uagagaacuuucagugcaa

SEQ ID NO: 1072856 - RNA, 19 nt, Homo sapiens
ucgccuaguuucuguguga

SEQ ID NO: 1072857 - RNA, 19 nt, Homo sapiens
gaacccaucucggcuuuug

SEQ ID NO: 1072858 - RNA, 19 nt, Homo sapiens
ggaacacccaagacaguga

SEQ ID NO: 1072859 - RNA, 19 nt, Homo sapiens
ugagagagcggcugguuca

SEQ ID NO: 1072860 - RNA, 19 nt, Homo sapiens
ggggagaacugcagcuuug

SEQ ID NO: 1072861 - RNA, 19 nt, Homo sapiens
caaggacugggaauacauu

SEQ ID NO: 1072862 - RNA, 19 nt, Homo sapiens
ugaaaggugucaucaucca

SEQ ID NO: 1072863 - RNA, 19 nt, Homo sapiens
ucagguagaucugggaaca

SEQ ID NO: 1072864 - RNA, 19 nt, Homo sapiens
aagacaggcucugaagauu

SEQ ID NO: 1072865 - RNA, 19 nt, Homo sapiens
guaugacuuuaucgagauu

SEQ ID NO: 1072866 - RNA, 19 nt, Homo sapiens
ucccauaccuccucucagu

SEQ ID NO: 1072867 - RNA, 19 nt, Homo sapiens
uguggaagccagagcauuu

SEQ ID NO: 1072868 - RNA, 19 nt, Homo sapiens
uuccaaagaugcuggcuau

SEQ ID NO: 1072869 - RNA, 19 nt, Homo sapiens
caacgggaccaucgaaucu

SEQ ID NO: 1072870 - RNA, 19 nt, Homo sapiens
ggcaaacacugugggaaca

SEQ ID NO: 1072871 - RNA, 19 nt, Homo sapiens
acucaaggcucagcugguu

SEQ ID NO: 1072872 - RNA, 19 nt, Homo sapiens
gauugccauugaugacauu

SEQ ID NO: 1072873 - RNA, 19 nt, Homo sapiens
agaagauuguccucaacuu

SEQ ID NO: 1072874 - RNA, 19 nt, Homo sapiens
gaagaggaggccacagagu

SEQ ID NO: 1072875 - RNA, 19 nt, Homo sapiens
ggcaaggacugggaauaca

SEQ ID NO: 1072876 - RNA, 19 nt, Homo sapiens
aggaguggcuucagguaga

SEQ ID NO: 1072877 - RNA, 19 nt, Homo sapiens
ccaacaacgaugcaacuga

SEQ ID NO: 1072878 - RNA, 19 nt, Homo sapiens
gagaggacuggauggugua

SEQ ID NO: 1072879 - RNA, 19 nt, Homo sapiens
ggaagucagcacuaaugga

SEQ ID NO: 1072880 - RNA, 19 nt, Homo sapiens
gcuccauggugaugacaau

SEQ ID NO: 1072881 - RNA, 19 nt, Homo sapiens
caaaacacccucugaacuu

SEQ ID NO: 1072882 - RNA, 19 nt, Homo sapiens
aacuuggacugcaccuuua

SEQ ID NO: 1072883 - RNA, 19 nt, Homo sapiens
gcuacgacauggaguacca

SEQ ID NO: 1072884 - RNA, 19 nt, Homo sapiens
aagcacgacugcaaguaug

SEQ ID NO: 1072885 - RNA, 19 nt, Homo sapiens
ucacggccaucgcaacaca

SEQ ID NO: 1072886 - RNA, 19 nt, Homo sapiens
ccucaucuaccuacucuga

SEQ ID NO: 1072887 - RNA, 19 nt, Homo sapiens
ugagaaguauccacacaac

SEQ ID NO: 1072888 - RNA, 19 nt, Homo sapiens
caaguucaccuccgacuac

SEQ ID NO: 1072889 - RNA, 19 nt, Homo sapiens
acaugugugugugugaaua

SEQ ID NO: 1072890 - RNA, 19 nt, Homo sapiens
agacaugugugugugugaa

SEQ ID NO: 1072891 - RNA, 19 nt, Homo sapiens
gcagagugacagccagaga

SEQ ID NO: 1072892 - RNA, 19 nt, Homo sapiens
gcaaggacugggaauacau

SEQ ID NO: 1072893 - RNA, 19 nt, Homo sapiens
uggaacccaucucggcuuu

SEQ ID NO: 1072894 - RNA, 19 nt, Homo sapiens
aaagucuccuacagccuaa

SEQ ID NO: 1072895 - RNA, 19 nt, Homo sapiens
gaaguaggacucaguauua

SEQ ID NO: 1072896 - RNA, 19 nt, Homo sapiens
ccaaagacaucuagaguuu

SEQ ID NO: 1072897 - RNA, 19 nt, Homo sapiens
cauagcaacugacauauuu

SEQ ID NO: 1072898 - RNA, 19 nt, Homo sapiens
uaagguuucugacacauua

SEQ ID NO: 1072899 - RNA, 19 nt, Homo sapiens
ccaaagagucagucacuua

SEQ ID NO: 1072900 - RNA, 19 nt, Homo sapiens
gguuuccucuucucuauua

SEQ ID NO: 1072901 - RNA, 19 nt, Homo sapiens
caucauagcaacugacaua

SEQ ID NO: 1072902 - RNA, 19 nt, Homo sapiens
acacacaaauucaugguaa

SEQ ID NO: 1072903 - RNA, 19 nt, Homo sapiens
gugacagccuuguguguua

SEQ ID NO: 1072904 - RNA, 19 nt, Homo sapiens
gcauuaaacucccuacaag

SEQ ID NO: 1072905 - RNA, 19 nt, Homo sapiens
ggaaguaggacucaguauu

SEQ ID NO: 1072906 - RNA, 19 nt, Homo sapiens
ucaauuacccucauaguau

SEQ ID NO: 1072907 - RNA, 19 nt, Homo sapiens
uaaguggguuuaugaccua

SEQ ID NO: 1072908 - RNA, 19 nt, Homo sapiens
gaaagcaagcggugaaagu

SEQ ID NO: 1072909 - RNA, 19 nt, Homo sapiens
caucugcacuugcucaaau

SEQ ID NO: 1072910 - RNA, 19 nt, Homo sapiens
gacaauauauuagccaaag

SEQ ID NO: 1072911 - RNA, 19 nt, Homo sapiens
ccaaagcagaauucuauuu

SEQ ID NO: 1072912 - RNA, 19 nt, Homo sapiens
agacugaucuacaaaugga

SEQ ID NO: 1072913 - RNA, 19 nt, Homo sapiens
gaccuacccuagacuuguu

SEQ ID NO: 1072914 - RNA, 19 nt, Homo sapiens
gguagauaauuacucuuga

SEQ ID NO: 1072915 - RNA, 19 nt, Homo sapiens
guauaagcauguuuaaggu

SEQ ID NO: 1072916 - RNA, 19 nt, Homo sapiens
guacacaaggacaauauau

SEQ ID NO: 1072917 - RNA, 19 nt, Homo sapiens
caaagagucagucacuuau

SEQ ID NO: 1072918 - RNA, 19 nt, Homo sapiens
uccaucuucuuccauauua

SEQ ID NO: 1072919 - RNA, 19 nt, Homo sapiens
caaccucagccacacauaa

SEQ ID NO: 1072920 - RNA, 19 nt, Homo sapiens
cagaauggaguuagacaaa

SEQ ID NO: 1072921 - RNA, 19 nt, Homo sapiens
ucacaagguuaagaugaaa

SEQ ID NO: 1072922 - RNA, 19 nt, Homo sapiens
aagaagggguagauaauua

SEQ ID NO: 1072923 - RNA, 19 nt, Homo sapiens
caaagacaucuagaguuua

SEQ ID NO: 1072924 - RNA, 19 nt, Homo sapiens
gaugaaagcaagcggugaa

SEQ ID NO: 1072925 - RNA, 19 nt, Homo sapiens
guuaauucgugguacuaaa

SEQ ID NO: 1072926 - RNA, 19 nt, Homo sapiens
caaacaucauagcaacuga

SEQ ID NO: 1072927 - RNA, 19 nt, Homo sapiens
ggcaugagguggugacucu

SEQ ID NO: 1072928 - RNA, 19 nt, Homo sapiens
agacacacaucugcacuug

SEQ ID NO: 1072929 - RNA, 19 nt, Homo sapiens
gugcaaccauccaaguaug

SEQ ID NO: 1072930 - RNA, 19 nt, Homo sapiens
uaacagcuaacacagaguu

SEQ ID NO: 1072931 - RNA, 19 nt, Homo sapiens
ucacuuauggguagacuga

SEQ ID NO: 1072932 - RNA, 19 nt, Homo sapiens
aaguaggacucaguauuaa

SEQ ID NO: 1072933 - RNA, 19 nt, Homo sapiens
uauauuagccaaagacauc

SEQ ID NO: 1072934 - RNA, 19 nt, Homo sapiens
gugcuaaguggguuuauga

SEQ ID NO: 1072935 - RNA, 19 nt, Homo sapiens
caccaaguuucaagaccua

SEQ ID NO: 1072936 - RNA, 19 nt, Homo sapiens
ggacaauauauuagccaaa

SEQ ID NO: 1072937 - RNA, 19 nt, Homo sapiens
ggaguuagacaaaacagua

SEQ ID NO: 1072938 - RNA, 19 nt, Homo sapiens
ucccaaagcagaauucuau

SEQ ID NO: 1072939 - RNA, 19 nt, Homo sapiens
uauauucuguacacaagga

SEQ ID NO: 1072940 - RNA, 19 nt, Homo sapiens
uagguuuccucuucucuau

SEQ ID NO: 1072941 - RNA, 19 nt, Homo sapiens
gacacauuaucaggaagua

SEQ ID NO: 1072942 - RNA, 19 nt, Homo sapiens
gcauacaaucugaaacuca

SEQ ID NO: 1072943 - RNA, 19 nt, Homo sapiens
uaugguugcuggucuuuag

SEQ ID NO: 1072944 - RNA, 19 nt, Homo sapiens
ggguagauaauuacucuug

SEQ ID NO: 1072945 - RNA, 19 nt, Homo sapiens
agacaucuagaguuuauga

SEQ ID NO: 1072946 - RNA, 19 nt, Homo sapiens
gccaaagacaucuagaguu

SEQ ID NO: 1072947 - RNA, 19 nt, Homo sapiens
guggguuuaugaccuauau

SEQ ID NO: 1072948 - RNA, 19 nt, Homo sapiens
caaauggaaguauuaaagg

SEQ ID NO: 1072949 - RNA, 19 nt, Homo sapiens
acacacaucugcacuugcu

SEQ ID NO: 1072950 - RNA, 19 nt, Homo sapiens
gaaaguucagaauggaguu

SEQ ID NO: 1072951 - RNA, 19 nt, Homo sapiens
guagauaauuacucuugac

SEQ ID NO: 1072952 - RNA, 19 nt, Homo sapiens
aagcacuucugcauuuguu

SEQ ID NO: 1072953 - RNA, 19 nt, Homo sapiens
agccuuguguguuaucuuu

SEQ ID NO: 1072954 - RNA, 19 nt, Homo sapiens
ucauagcaacugacauauu

SEQ ID NO: 1072955 - RNA, 19 nt, Homo sapiens
uugguuagguuuccucuuc

SEQ ID NO: 1072956 - RNA, 19 nt, Homo sapiens
ugacagccuuguguguuau

SEQ ID NO: 1072957 - RNA, 19 nt, Homo sapiens
gggacaaacaucauagcaa

SEQ ID NO: 1072958 - RNA, 19 nt, Homo sapiens
gcauuuguuuuaggucuua

SEQ ID NO: 1072959 - RNA, 19 nt, Homo sapiens
aagagucagucacuuaugg

SEQ ID NO: 1072960 - RNA, 19 nt, Homo sapiens
gaucaauuacccucauagu

SEQ ID NO: 1072961 - RNA, 19 nt, Homo sapiens
uaaguuaauucgugguacu

SEQ ID NO: 1072962 - RNA, 19 nt, Homo sapiens
cccuagacuuguuucagua

SEQ ID NO: 1072963 - RNA, 19 nt, Homo sapiens
gcaaccauccaaguaugaa

SEQ ID NO: 1072964 - RNA, 19 nt, Homo sapiens
uguauaagcauguuuaagg

SEQ ID NO: 1072965 - RNA, 19 nt, Homo sapiens
gguuuaugaccuauaugua

SEQ ID NO: 1072966 - RNA, 19 nt, Homo sapiens
caugagguggugacucuuu

SEQ ID NO: 1072967 - RNA, 19 nt, Homo sapiens
gucuuuaggucccauuuua

SEQ ID NO: 1072968 - RNA, 19 nt, Homo sapiens
gaucuacaaauggaaguau

SEQ ID NO: 1072969 - RNA, 19 nt, Homo sapiens
cagcuaagaguaaccaaag

SEQ ID NO: 1072970 - RNA, 19 nt, Homo sapiens
cugaucaauuacccucaua

SEQ ID NO: 1072971 - RNA, 19 nt, Homo sapiens
aaagcaagcggugaaaguu

SEQ ID NO: 1072972 - RNA, 19 nt, Homo sapiens
uaucuuaccaccaaguuuc

SEQ ID NO: 1072973 - RNA, 19 nt, Homo sapiens
gacucaguauuaagcuuga

SEQ ID NO: 1072974 - RNA, 19 nt, Homo sapiens
caggaaguaggacucagua

SEQ ID NO: 1072975 - RNA, 19 nt, Homo sapiens
guuuaagguuucugacaca

SEQ ID NO: 1072976 - RNA, 19 nt, Homo sapiens
aagaguaaccaaagaguca

SEQ ID NO: 1072977 - RNA, 19 nt, Homo sapiens
cacagucauugguuagguu

SEQ ID NO: 1072978 - RNA, 19 nt, Homo sapiens
ccauauuauuccacaguca

SEQ ID NO: 1072979 - RNA, 19 nt, Homo sapiens
ugaagugacagccuugugu

SEQ ID NO: 1072980 - RNA, 19 nt, Homo sapiens
ucucuauugugucauccua

SEQ ID NO: 1072981 - RNA, 19 nt, Homo sapiens
uaagcauguuuaagguuuc

SEQ ID NO: 1072982 - RNA, 19 nt, Homo sapiens
aaagcgguauauauucugu

SEQ ID NO: 1072983 - RNA, 19 nt, Homo sapiens
gcggcaugcuucuuuaaaa

SEQ ID NO: 1072984 - RNA, 19 nt, Homo sapiens
gacaggucaugacagauac

SEQ ID NO: 1072985 - RNA, 19 nt, Homo sapiens
aagauugggcuaauacaug

SEQ ID NO: 1072986 - RNA, 19 nt, Homo sapiens
aaagguuuacuuccugaaa

SEQ ID NO: 1072987 - RNA, 19 nt, Homo sapiens
caagaccuacccuagacuu

SEQ ID NO: 1072988 - RNA, 19 nt, Homo sapiens
ccacagucauugguuaggu

SEQ ID NO: 1072989 - RNA, 19 nt, Homo sapiens
auuccacagucauugguua

SEQ ID NO: 1072990 - RNA, 19 nt, Homo sapiens
cagccacacauaauacuau

SEQ ID NO: 1072991 - RNA, 19 nt, Homo sapiens
acugacauauuuggagaaa

SEQ ID NO: 1072992 - RNA, 19 nt, Homo sapiens
gcauguuuaagguuucuga

SEQ ID NO: 1072993 - RNA, 19 nt, Homo sapiens
gaucuuucuuuucagcuaa

SEQ ID NO: 1072994 - RNA, 19 nt, Homo sapiens
caagugggaaacaaucugu

SEQ ID NO: 1072995 - RNA, 19 nt, Homo sapiens
gaaagaacauguugggaau

SEQ ID NO: 1072996 - RNA, 19 nt, Homo sapiens
ggaauuaucgcaucucuaa

SEQ ID NO: 1072997 - RNA, 19 nt, Homo sapiens
ggaaggcucugucuaugaa

SEQ ID NO: 1072998 - RNA, 19 nt, Homo sapiens
ggaaguggaggguuaaaua

SEQ ID NO: 1072999 - RNA, 19 nt, Homo sapiens
acagaaagauccaugaauu

SEQ ID NO: 1073000 - RNA, 19 nt, Homo sapiens
gaaguggaggguuaaauaa

SEQ ID NO: 1073001 - RNA, 19 nt, Homo sapiens
caacccaaauggacuaaga

SEQ ID NO: 1073002 - RNA, 19 nt, Homo sapiens
cauauaugcuuaucagguu

SEQ ID NO: 1073003 - RNA, 19 nt, Homo sapiens
ccagaggccauaccuaaua

SEQ ID NO: 1073004 - RNA, 19 nt, Homo sapiens
ccagaacugugggcaauaa

SEQ ID NO: 1073005 - RNA, 19 nt, Homo sapiens
uaacucccauugcuaaaga

SEQ ID NO: 1073006 - RNA, 19 nt, Homo sapiens
ccacuguacugcagacuga

SEQ ID NO: 1073007 - RNA, 19 nt, Homo sapiens
cagaggccauaccuaauaa

SEQ ID NO: 1073008 - RNA, 19 nt, Homo sapiens
gauauuuguucacaggaaa

SEQ ID NO: 1073009 - RNA, 19 nt, Homo sapiens
gaacugugggcaauaaaug

SEQ ID NO: 1073010 - RNA, 19 nt, Homo sapiens
gaaaauaacucccauugcu

SEQ ID NO: 1073011 - RNA, 19 nt, Homo sapiens
ggcaauaaaugucuguugu

SEQ ID NO: 1073012 - RNA, 19 nt, Homo sapiens
caacaucuuucaucacucu

SEQ ID NO: 1073013 - RNA, 19 nt, Homo sapiens
uccaguaucuuugguauuu

SEQ ID NO: 1073014 - RNA, 19 nt, Homo sapiens
ggauauuuguucacaggaa

SEQ ID NO: 1073015 - RNA, 19 nt, Homo sapiens
uaacuucccacgaguguuu

SEQ ID NO: 1073016 - RNA, 19 nt, Homo sapiens
gguacuggcuagaaauuuc

SEQ ID NO: 1073017 - RNA, 19 nt, Homo sapiens
uccaugaauuccagaaaua

SEQ ID NO: 1073018 - RNA, 19 nt, Homo sapiens
gacauugugugcaucuuug

SEQ ID NO: 1073019 - RNA, 19 nt, Homo sapiens
uuuauuaccuguccaguau

SEQ ID NO: 1073020 - RNA, 19 nt, Homo sapiens
gcaauaaaugucuguuguu

SEQ ID NO: 1073021 - RNA, 19 nt, Homo sapiens
gagggaaggcucugucuau

SEQ ID NO: 1073022 - RNA, 19 nt, Homo sapiens
agauggaaguggaggguua

SEQ ID NO: 1073023 - RNA, 19 nt, Homo sapiens
gaugagcacuccuacaaaa

SEQ ID NO: 1073024 - RNA, 19 nt, Homo sapiens
gggaugagcacuccuacaa

SEQ ID NO: 1073025 - RNA, 19 nt, Homo sapiens
guggaggguuaaauaauga

SEQ ID NO: 1073026 - RNA, 19 nt, Homo sapiens
ccagaaauaucacugaaaa

SEQ ID NO: 1073027 - RNA, 19 nt, Homo sapiens
gaguggagccucaugaaug

SEQ ID NO: 1073028 - RNA, 19 nt, Homo sapiens
ucccauugcuaaagacaua

SEQ ID NO: 1073029 - RNA, 19 nt, Homo sapiens
aaauaacucccauugcuaa

SEQ ID NO: 1073030 - RNA, 19 nt, Homo sapiens
uuacuaugguucacaauuc

SEQ ID NO: 1073031 - RNA, 19 nt, Homo sapiens
aauaaggcaugcaguucua

SEQ ID NO: 1073032 - RNA, 19 nt, Homo sapiens
gaacuuuauugcuuuagac

SEQ ID NO: 1073033 - RNA, 19 nt, Homo sapiens
caccagaggccauaccuaa

SEQ ID NO: 1073034 - RNA, 19 nt, Homo sapiens
gaagagaugauuggaagau

SEQ ID NO: 1073035 - RNA, 19 nt, Homo sapiens
gagguaggcagaucacuug

SEQ ID NO: 1073036 - RNA, 19 nt, Homo sapiens
caaccuugcuaaauugagu

SEQ ID NO: 1073037 - RNA, 19 nt, Homo sapiens
uaacagaaagauccaugaa

SEQ ID NO: 1073038 - RNA, 19 nt, Homo sapiens
aagaacauguugggaauug

SEQ ID NO: 1073039 - RNA, 19 nt, Homo sapiens
agacauauaugcuuaucag

SEQ ID NO: 1073040 - RNA, 19 nt, Homo sapiens
gcuaaagacauauaugcuu

SEQ ID NO: 1073041 - RNA, 19 nt, Homo sapiens
gccaacaucuuucaucacu

SEQ ID NO: 1073042 - RNA, 19 nt, Homo sapiens
ccugaugucuauaugaaga

SEQ ID NO: 1073043 - RNA, 19 nt, Homo sapiens
cuacagcuacucuuuaaau

SEQ ID NO: 1073044 - RNA, 19 nt, Homo sapiens
uggcaaacucccaccauua

SEQ ID NO: 1073045 - RNA, 19 nt, Homo sapiens
gaauaaggcaugcaguucu

SEQ ID NO: 1073046 - RNA, 19 nt, Homo sapiens
gggaaggcucugucuauga

SEQ ID NO: 1073047 - RNA, 19 nt, Homo sapiens
cccuacagcuacucuuuaa

SEQ ID NO: 1073048 - RNA, 19 nt, Homo sapiens
ggcaugcaguucuaacaga

SEQ ID NO: 1073049 - RNA, 19 nt, Homo sapiens
ccaaaucaaaugaguuuca

SEQ ID NO: 1073050 - RNA, 19 nt, Homo sapiens
ugacauuucaggauauuug

SEQ ID NO: 1073051 - RNA, 19 nt, Homo sapiens
cagcuacucuuuaaaucuc

SEQ ID NO: 1073052 - RNA, 19 nt, Homo sapiens
ggaugagcacuccuacaaa

SEQ ID NO: 1073053 - RNA, 19 nt, Homo sapiens
gcccuacagcuacucuuua

SEQ ID NO: 1073054 - RNA, 19 nt, Homo sapiens
gaggcugucugccaacauc

SEQ ID NO: 1073055 - RNA, 19 nt, Homo sapiens
gagaguggagccucaugaa

SEQ ID NO: 1073056 - RNA, 19 nt, Homo sapiens
caaacucccaccauuacaa

SEQ ID NO: 1073057 - RNA, 19 nt, Homo sapiens
cagaauaaggcaugcaguu

SEQ ID NO: 1073058 - RNA, 19 nt, Homo sapiens
ccacgaguguuuaugaaaa

SEQ ID NO: 1073059 - RNA, 19 nt, Homo sapiens
aguggaggguuaaauaaug

SEQ ID NO: 1073060 - RNA, 19 nt, Homo sapiens
gaauugguacuggcuagaa

SEQ ID NO: 1073061 - RNA, 19 nt, Homo sapiens
cagaaagauccaugaauuc

SEQ ID NO: 1073062 - RNA, 19 nt, Homo sapiens
cuugcuaaauugaguacua

SEQ ID NO: 1073063 - RNA, 19 nt, Homo sapiens
gaaaacaccagaggccaua

SEQ ID NO: 1073064 - RNA, 19 nt, Homo sapiens
cauugaaucugccgcaucu

SEQ ID NO: 1073065 - RNA, 19 nt, Homo sapiens
ccacaguuuagaaagauuu

SEQ ID NO: 1073066 - RNA, 19 nt, Homo sapiens
gaacauguugggaauuggu

SEQ ID NO: 1073067 - RNA, 19 nt, Homo sapiens
uuuauucacuuccugaugu

SEQ ID NO: 1073068 - RNA, 19 nt, Homo sapiens
ugacauugugugcaucuuu

SEQ ID NO: 1073069 - RNA, 19 nt, Homo sapiens
gggaugggaggaucucuug

SEQ ID NO: 1073070 - RNA, 19 nt, Homo sapiens
caaaucaaaugaguuucag

SEQ ID NO: 1073071 - RNA, 19 nt, Homo sapiens
aaacucccaccauuacaaa

SEQ ID NO: 1073072 - RNA, 19 nt, Homo sapiens
cuuuauugcuuuagacaga

SEQ ID NO: 1073073 - RNA, 19 nt, Homo sapiens
ucacaggaaagaacauguu

SEQ ID NO: 1073074 - RNA, 19 nt, Homo sapiens
uaucaauucaugcugguuu

SEQ ID NO: 1073075 - RNA, 19 nt, Homo sapiens
gaaagauccaugaauucca

SEQ ID NO: 1073076 - RNA, 19 nt, Homo sapiens
gauccaugaauuccagaaa

SEQ ID NO: 1073077 - RNA, 19 nt, Homo sapiens
gagaugauuggaagaugga

SEQ ID NO: 1073078 - RNA, 19 nt, Homo sapiens
gggcaauaaaugucuguug

SEQ ID NO: 1073079 - RNA, 19 nt, Homo sapiens
ucacucugccugcaacuau

SEQ ID NO: 1073080 - RNA, 19 nt, Homo sapiens
ccuguaaucccagcacuuu

SEQ ID NO: 1073081 - RNA, 19 nt, Homo sapiens
cuccaaaucaaaugaguuu

SEQ ID NO: 1073082 - RNA, 19 nt, Homo sapiens
gcaaacucccaccauuaca

SEQ ID NO: 1073083 - RNA, 19 nt, Homo sapiens
guuacuaugguucacaauu

SEQ ID NO: 1073084 - RNA, 19 nt, Homo sapiens
cugccaacaucuuucauca

SEQ ID NO: 1073085 - RNA, 19 nt, Homo sapiens
uuaccuguccaguaucuuu

SEQ ID NO: 1073086 - RNA, 19 nt, Homo sapiens
guuuauuaccuguccagua

SEQ ID NO: 1073087 - RNA, 19 nt, Homo sapiens
ugaaucugccgcaucuuga

SEQ ID NO: 1073088 - RNA, 19 nt, Homo sapiens
ggaggguuaaauaaugaaa

SEQ ID NO: 1073089 - RNA, 19 nt, Homo sapiens
gauggaaguggaggguuaa

SEQ ID NO: 1073090 - RNA, 19 nt, Homo sapiens
ggcaaacucccaccauuac

SEQ ID NO: 1073091 - RNA, 19 nt, Homo sapiens
uuccugaugucuauaugaa

SEQ ID NO: 1073092 - RNA, 19 nt, Homo sapiens
caaauggacuaagaaaaca

SEQ ID NO: 1073093 - RNA, 19 nt, Homo sapiens
aauucaugcugguuuauuc

SEQ ID NO: 1073094 - RNA, 19 nt, Homo sapiens
ucuguuccauauugacauu

SEQ ID NO: 1073095 - RNA, 19 nt, Homo sapiens
caaauggagugaucuguua

SEQ ID NO: 1073096 - RNA, 19 nt, Homo sapiens
gaagucccgucucuacuaa

SEQ ID NO: 1073097 - RNA, 19 nt, Homo sapiens
ccacagaauugauggugua

SEQ ID NO: 1073098 - RNA, 19 nt, Homo sapiens
cacaagagcaacaauaaua

SEQ ID NO: 1073099 - RNA, 19 nt, Homo sapiens
aauaugaacucaccaaugu

SEQ ID NO: 1073100 - RNA, 19 nt, Homo sapiens
guuaauugcuuggaaguuu

SEQ ID NO: 1073101 - RNA, 19 nt, Homo sapiens
ggaauuauuuaccucugaa

SEQ ID NO: 1073102 - RNA, 19 nt, Homo sapiens
gcucagaaguugaauuugg

SEQ ID NO: 1073103 - RNA, 19 nt, Homo sapiens
uaacacaagagcaacaaua

SEQ ID NO: 1073104 - RNA, 19 nt, Homo sapiens
guucauaucagccucauuu

SEQ ID NO: 1073105 - RNA, 19 nt, Homo sapiens
caaauucgagucuuucaaa

SEQ ID NO: 1073106 - RNA, 19 nt, Homo sapiens
acacuguucugguuacuuu

SEQ ID NO: 1073107 - RNA, 19 nt, Homo sapiens
cagaauugaugguguaugu

SEQ ID NO: 1073108 - RNA, 19 nt, Homo sapiens
gacgcugccuuucuauuaa

SEQ ID NO: 1073109 - RNA, 19 nt, Homo sapiens
ugaagcggauaccauuaua

SEQ ID NO: 1073110 - RNA, 19 nt, Homo sapiens
gaauuucauccuugguuua

SEQ ID NO: 1073111 - RNA, 19 nt, Homo sapiens
uacaggagaucuugaguga

SEQ ID NO: 1073112 - RNA, 19 nt, Homo sapiens
uauguuggccugugaguua

SEQ ID NO: 1073113 - RNA, 19 nt, Homo sapiens
gcggauaccauuauagaaa

SEQ ID NO: 1073114 - RNA, 19 nt, Homo sapiens
gguauuuccuaauugauug

SEQ ID NO: 1073115 - RNA, 19 nt, Homo sapiens
gaacuaaaaucccuaaguc

SEQ ID NO: 1073116 - RNA, 19 nt, Homo sapiens
caggagaucuugagugagu

SEQ ID NO: 1073117 - RNA, 19 nt, Homo sapiens
agaaagcucaagauaguua

SEQ ID NO: 1073118 - RNA, 19 nt, Homo sapiens
ccacauggacauuauauuc

SEQ ID NO: 1073119 - RNA, 19 nt, Homo sapiens
gaauugaugguguauguau

SEQ ID NO: 1073120 - RNA, 19 nt, Homo sapiens
gcuuggaaguuucauuuau

SEQ ID NO: 1073121 - RNA, 19 nt, Homo sapiens
agacgcugccuuucuauua

SEQ ID NO: 1073122 - RNA, 19 nt, Homo sapiens
ccacuaggaauucgucuaa

SEQ ID NO: 1073123 - RNA, 19 nt, Homo sapiens
cuuaaggucugccagguuu

SEQ ID NO: 1073124 - RNA, 19 nt, Homo sapiens
ggaauucgucuaacagugu

SEQ ID NO: 1073125 - RNA, 19 nt, Homo sapiens
gggcaaggccuuccuaagu

SEQ ID NO: 1073126 - RNA, 19 nt, Homo sapiens
gaaguugaauuuggugucu

SEQ ID NO: 1073127 - RNA, 19 nt, Homo sapiens
ucaccaauguggaacaaau

SEQ ID NO: 1073128 - RNA, 19 nt, Homo sapiens
cgauauugcucagaaguug

SEQ ID NO: 1073129 - RNA, 19 nt, Homo sapiens
cuacugagaucuuuugaaa

SEQ ID NO: 1073130 - RNA, 19 nt, Homo sapiens
gcucacaggagacagagua

SEQ ID NO: 1073131 - RNA, 19 nt, Homo sapiens
gguuaauacugaugacaga

SEQ ID NO: 1073132 - RNA, 19 nt, Homo sapiens
ggcaaggccuuccuaaguc

SEQ ID NO: 1073133 - RNA, 19 nt, Homo sapiens
gaacaaauggagugaucug

SEQ ID NO: 1073134 - RNA, 19 nt, Homo sapiens
gcauuugcccugaacuaaa

SEQ ID NO: 1073135 - RNA, 19 nt, Homo sapiens
gaacucaggaggcagaagu

SEQ ID NO: 1073136 - RNA, 19 nt, Homo sapiens
ccgacucccuguccucuaa

SEQ ID NO: 1073137 - RNA, 19 nt, Homo sapiens
gaacuuucuucgucuucug

SEQ ID NO: 1073138 - RNA, 19 nt, Homo sapiens
gcaggagaaucacuugaac

SEQ ID NO: 1073139 - RNA, 19 nt, Homo sapiens
cauccuugguuuaaaguug

SEQ ID NO: 1073140 - RNA, 19 nt, Homo sapiens
uaauauaugccagccauuu

SEQ ID NO: 1073141 - RNA, 19 nt, Homo sapiens
gcacuuguagucccagcua

SEQ ID NO: 1073142 - RNA, 19 nt, Homo sapiens
ggauaugaaacugaaagua

SEQ ID NO: 1073143 - RNA, 19 nt, Homo sapiens
gauuaaacuucugguggaa

SEQ ID NO: 1073144 - RNA, 19 nt, Homo sapiens
gacauuauauuccuuaacc

SEQ ID NO: 1073145 - RNA, 19 nt, Homo sapiens
ugauaugucccaggaguua

SEQ ID NO: 1073146 - RNA, 19 nt, Homo sapiens
ugaucaaauucgagucuuu

SEQ ID NO: 1073147 - RNA, 19 nt, Homo sapiens
auaguuauaucuccaggaa

SEQ ID NO: 1073148 - RNA, 19 nt, Homo sapiens
agagcgagauucuguguca

SEQ ID NO: 1073149 - RNA, 19 nt, Homo sapiens
ugaagucccgucucuacua

SEQ ID NO: 1073150 - RNA, 19 nt, Homo sapiens
uguauuccaugccuucauu

SEQ ID NO: 1073151 - RNA, 19 nt, Homo sapiens
gaucuugagugaguguguu

SEQ ID NO: 1073152 - RNA, 19 nt, Homo sapiens
guaaauaugaacucaccaa

SEQ ID NO: 1073153 - RNA, 19 nt, Homo sapiens
guuaaacacgguauguaaa

SEQ ID NO: 1073154 - RNA, 19 nt, Homo sapiens
gcuguucacuuugggcauu

SEQ ID NO: 1073155 - RNA, 19 nt, Homo sapiens
gaagcaggagaaucacuug

SEQ ID NO: 1073156 - RNA, 19 nt, Homo sapiens
uuaaacuucugguggaaau

SEQ ID NO: 1073157 - RNA, 19 nt, Homo sapiens
accauucucuuccucgaua

SEQ ID NO: 1073158 - RNA, 19 nt, Homo sapiens
gaauaacacaagagcaaca

SEQ ID NO: 1073159 - RNA, 19 nt, Homo sapiens
aaacauucgucccuugaag

SEQ ID NO: 1073160 - RNA, 19 nt, Homo sapiens
ggguuuagacgcugccuuu

SEQ ID NO: 1073161 - RNA, 19 nt, Homo sapiens
gcagacacacacacuguuc

SEQ ID NO: 1073162 - RNA, 19 nt, Homo sapiens
ccaaggugaaacuaagaua

SEQ ID NO: 1073163 - RNA, 19 nt, Homo sapiens
gaguuaaacacgguaugua

SEQ ID NO: 1073164 - RNA, 19 nt, Homo sapiens
ggagacagagcgagauucu

SEQ ID NO: 1073165 - RNA, 19 nt, Homo sapiens
ucaguauguuggccuguga

SEQ ID NO: 1073166 - RNA, 19 nt, Homo sapiens
gauggcuauuuaucugauu

SEQ ID NO: 1073167 - RNA, 19 nt, Homo sapiens
gggaagguuacguuaugua

SEQ ID NO: 1073168 - RNA, 19 nt, Homo sapiens
cugggaagguuacguuaug

SEQ ID NO: 1073169 - RNA, 19 nt, Homo sapiens
cacgguauguaaauaugaa

SEQ ID NO: 1073170 - RNA, 19 nt, Homo sapiens
cacacacacuguucugguu

SEQ ID NO: 1073171 - RNA, 19 nt, Homo sapiens
uuucugagguugccuguag

SEQ ID NO: 1073172 - RNA, 19 nt, Homo sapiens
cggaauaacacaagagcaa

SEQ ID NO: 1073173 - RNA, 19 nt, Homo sapiens
ggaguuaaacacgguaugu

SEQ ID NO: 1073174 - RNA, 19 nt, Homo sapiens
gaucaaauucgagucuuuc

SEQ ID NO: 1073175 - RNA, 19 nt, Homo sapiens
acacacacuguucugguua

SEQ ID NO: 1073176 - RNA, 19 nt, Homo sapiens
auguuaggcuguucacuuu

SEQ ID NO: 1073177 - RNA, 19 nt, Homo sapiens
uggaacaaauggagugauc

SEQ ID NO: 1073178 - RNA, 19 nt, Homo sapiens
guagcuauguuaggcuguu

SEQ ID NO: 1073179 - RNA, 19 nt, Homo sapiens
aacacaagagcaacaauaa

SEQ ID NO: 1073180 - RNA, 19 nt, Homo sapiens
gaaagcucaagauaguuau

SEQ ID NO: 1073181 - RNA, 19 nt, Homo sapiens
ccugugaguuacggucaua

SEQ ID NO: 1073182 - RNA, 19 nt, Homo sapiens
ucaccggaauaacacaaga

SEQ ID NO: 1073183 - RNA, 19 nt, Homo sapiens
guuaggcuguucacuuugg

SEQ ID NO: 1073184 - RNA, 19 nt, Homo sapiens
acaaauggagugaucuguu

SEQ ID NO: 1073185 - RNA, 19 nt, Homo sapiens
ccuguaaucccagcacuuu

SEQ ID NO: 1073186 - RNA, 19 nt, Homo sapiens
caaggugaaacuaagauag

SEQ ID NO: 1073187 - RNA, 19 nt, Homo sapiens
uuaauugcuuggaaguuuc

SEQ ID NO: 1073188 - RNA, 19 nt, Homo sapiens
aaauaugaacucaccaaug

SEQ ID NO: 1073189 - RNA, 19 nt, Homo sapiens
aggcagaaguugcgguuag

SEQ ID NO: 1073190 - RNA, 19 nt, Homo sapiens
aagcggauaccauuauaga

SEQ ID NO: 1073191 - RNA, 19 nt, Homo sapiens
acuaggaauucgucuaaca

SEQ ID NO: 1073192 - RNA, 19 nt, Homo sapiens
ugucucagcccacuaggaa

SEQ ID NO: 1073193 - RNA, 19 nt, Homo sapiens
gauauugcucagaaguuga

SEQ ID NO: 1073194 - RNA, 19 nt, Homo sapiens
uauguuaggcuguucacuu

SEQ ID NO: 1073195 - RNA, 19 nt, Homo sapiens
gaacuagaccucaagaaua

SEQ ID NO: 1073196 - RNA, 19 nt, Homo sapiens
gaagcaagauauagaguaa

SEQ ID NO: 1073197 - RNA, 19 nt, Homo sapiens
gaccagaacuuacacauca

SEQ ID NO: 1073198 - RNA, 19 nt, Homo sapiens
ggaaagcuauggaugauuc

SEQ ID NO: 1073199 - RNA, 19 nt, Homo sapiens
gaagacagauugugguaca

SEQ ID NO: 1073200 - RNA, 19 nt, Homo sapiens
caaaauaccugaucgauau

SEQ ID NO: 1073201 - RNA, 19 nt, Homo sapiens
ucagaaagguccuaguuga

SEQ ID NO: 1073202 - RNA, 19 nt, Homo sapiens
gauaaagcauggauucuag

SEQ ID NO: 1073203 - RNA, 19 nt, Homo sapiens
gaaugaaacuagucaaacu

SEQ ID NO: 1073204 - RNA, 19 nt, Homo sapiens
cagcagacauagauaaaga

SEQ ID NO: 1073205 - RNA, 19 nt, Homo sapiens
gauaagggcucagcauaca

SEQ ID NO: 1073206 - RNA, 19 nt, Homo sapiens
aagcauggauucuaguuaa

SEQ ID NO: 1073207 - RNA, 19 nt, Homo sapiens
gagcaacuuucucauaaca

SEQ ID NO: 1073208 - RNA, 19 nt, Homo sapiens
gagaagaggcagacaguga

SEQ ID NO: 1073209 - RNA, 19 nt, Homo sapiens
ugacaaguguaccauacua

SEQ ID NO: 1073210 - RNA, 19 nt, Homo sapiens
gaaaauguccugcaaagaa

SEQ ID NO: 1073211 - RNA, 19 nt, Homo sapiens
gaacagccagcccagauga

SEQ ID NO: 1073212 - RNA, 19 nt, Homo sapiens
gcaacgaucucucucuuuu

SEQ ID NO: 1073213 - RNA, 19 nt, Homo sapiens
aaacagagucagagaaauu

SEQ ID NO: 1073214 - RNA, 19 nt, Homo sapiens
ggaacuagaccucaagaau

SEQ ID NO: 1073215 - RNA, 19 nt, Homo sapiens
ggaguaaagaagcaagaua

SEQ ID NO: 1073216 - RNA, 19 nt, Homo sapiens
guaggcauaacaauucuua

SEQ ID NO: 1073217 - RNA, 19 nt, Homo sapiens
guaacacguucuuaguuga

SEQ ID NO: 1073218 - RNA, 19 nt, Homo sapiens
caacagaggccauucuaca

SEQ ID NO: 1073219 - RNA, 19 nt, Homo sapiens
cuaguaagauaaugcagaa

SEQ ID NO: 1073220 - RNA, 19 nt, Homo sapiens
gaaagcuggugcugugauc

SEQ ID NO: 1073221 - RNA, 19 nt, Homo sapiens
uaaggacaguggaaagcua

SEQ ID NO: 1073222 - RNA, 19 nt, Homo sapiens
ggacacaugaccacuaaau

SEQ ID NO: 1073223 - RNA, 19 nt, Homo sapiens
guaccauacuaauguaaga

SEQ ID NO: 1073224 - RNA, 19 nt, Homo sapiens
gagguaggcauaacaauuc

SEQ ID NO: 1073225 - RNA, 19 nt, Homo sapiens
aagggaggcucaaucaauu

SEQ ID NO: 1073226 - RNA, 19 nt, Homo sapiens
gaguaaagaagcaagauau

SEQ ID NO: 1073227 - RNA, 19 nt, Homo sapiens
gaugaugguuuagaggaaa

SEQ ID NO: 1073228 - RNA, 19 nt, Homo sapiens
gaggucaucagcauaaauu

SEQ ID NO: 1073229 - RNA, 19 nt, Homo sapiens
gcauggauucuaguuaaua

SEQ ID NO: 1073230 - RNA, 19 nt, Homo sapiens
uguaacacguucuuaguug

SEQ ID NO: 1073231 - RNA, 19 nt, Homo sapiens
caagggaggcucaaucaau

SEQ ID NO: 1073232 - RNA, 19 nt, Homo sapiens
aacuagaccucaagaauau

SEQ ID NO: 1073233 - RNA, 19 nt, Homo sapiens
uaacgugaaccacaacaaa

SEQ ID NO: 1073234 - RNA, 19 nt, Homo sapiens
guucuuaguugacaaagca

SEQ ID NO: 1073235 - RNA, 19 nt, Homo sapiens
caaaauagcuaagaacauc

SEQ ID NO: 1073236 - RNA, 19 nt, Homo sapiens
aaggacacaugaccacuaa

SEQ ID NO: 1073237 - RNA, 19 nt, Homo sapiens
ggauggaaaucauacaaaa

SEQ ID NO: 1073238 - RNA, 19 nt, Homo sapiens
gaucuagagucagagaaau

SEQ ID NO: 1073239 - RNA, 19 nt, Homo sapiens
cagauaagggcucagcaua

SEQ ID NO: 1073240 - RNA, 19 nt, Homo sapiens
gcaacuuucucauaacaac

SEQ ID NO: 1073241 - RNA, 19 nt, Homo sapiens
uaaauggccuucgauggau

SEQ ID NO: 1073242 - RNA, 19 nt, Homo sapiens
cauaugagagaguggauuu

SEQ ID NO: 1073243 - RNA, 19 nt, Homo sapiens
guaaagaagcaagauauag

SEQ ID NO: 1073244 - RNA, 19 nt, Homo sapiens
cuagaccucaagaauauua

SEQ ID NO: 1073245 - RNA, 19 nt, Homo sapiens
acccgaagcuuauaauuag

SEQ ID NO: 1073246 - RNA, 19 nt, Homo sapiens
ccagauucauuauucuaug

SEQ ID NO: 1073247 - RNA, 19 nt, Homo sapiens
ggaucuagagucagagaaa

SEQ ID NO: 1073248 - RNA, 19 nt, Homo sapiens
gaggcucaaucaauucaau

SEQ ID NO: 1073249 - RNA, 19 nt, Homo sapiens
caagauauagaguaaguca

SEQ ID NO: 1073250 - RNA, 19 nt, Homo sapiens
uuaaauggccuucgaugga

SEQ ID NO: 1073251 - RNA, 19 nt, Homo sapiens
gagaguggauuuucagaga

SEQ ID NO: 1073252 - RNA, 19 nt, Homo sapiens
caaagcauuuucacaugua

SEQ ID NO: 1073253 - RNA, 19 nt, Homo sapiens
caaagaaugaaacuaguca

SEQ ID NO: 1073254 - RNA, 19 nt, Homo sapiens
aaacacgcuuucuccuuga

SEQ ID NO: 1073255 - RNA, 19 nt, Homo sapiens
ugagguaggcauaacaauu

SEQ ID NO: 1073256 - RNA, 19 nt, Homo sapiens
gcugugaucgacccagaua

SEQ ID NO: 1073257 - RNA, 19 nt, Homo sapiens
aacccgaagcuuauaauua

SEQ ID NO: 1073258 - RNA, 19 nt, Homo sapiens
gcaaagaaugaaacuaguc

SEQ ID NO: 1073259 - RNA, 19 nt, Homo sapiens
guugaggucaucagcauaa

SEQ ID NO: 1073260 - RNA, 19 nt, Homo sapiens
ucaauauacccugagaaua

SEQ ID NO: 1073261 - RNA, 19 nt, Homo sapiens
gcuucauacuaguaagaua

SEQ ID NO: 1073262 - RNA, 19 nt, Homo sapiens
ggcauaacaauucuuaaug

SEQ ID NO: 1073263 - RNA, 19 nt, Homo sapiens
ccacaacccgaagcuuaua

SEQ ID NO: 1073264 - RNA, 19 nt, Homo sapiens
guggaaagcuauggaugau

SEQ ID NO: 1073265 - RNA, 19 nt, Homo sapiens
auaggagugucuuguacua

SEQ ID NO: 1073266 - RNA, 19 nt, Homo sapiens
gaaaccccaucucuacaaa

SEQ ID NO: 1073267 - RNA, 19 nt, Homo sapiens
uaauguccuucauaaagug

SEQ ID NO: 1073268 - RNA, 19 nt, Homo sapiens
caaaagacacacauacaaa

SEQ ID NO: 1073269 - RNA, 19 nt, Homo sapiens
aaaaggaucuagagucaga

SEQ ID NO: 1073270 - RNA, 19 nt, Homo sapiens
gugcucaccguaugucuuu

SEQ ID NO: 1073271 - RNA, 19 nt, Homo sapiens
gaaagaaaaggaagacaga

SEQ ID NO: 1073272 - RNA, 19 nt, Homo sapiens
ggagugucuuguacuaucu

SEQ ID NO: 1073273 - RNA, 19 nt, Homo sapiens
gacaaguguaccauacuaa

SEQ ID NO: 1073274 - RNA, 19 nt, Homo sapiens
ugauaaagcauggauucua

SEQ ID NO: 1073275 - RNA, 19 nt, Homo sapiens
uaaggacacaugaccacua

SEQ ID NO: 1073276 - RNA, 19 nt, Homo sapiens
gaucaccacaggcaaaaua

SEQ ID NO: 1073277 - RNA, 19 nt, Homo sapiens
acauucugaugaugguuua

SEQ ID NO: 1073278 - RNA, 19 nt, Homo sapiens
guacauaggagugucuugu

SEQ ID NO: 1073279 - RNA, 19 nt, Homo sapiens
caaguguaccauacuaaug

SEQ ID NO: 1073280 - RNA, 19 nt, Homo sapiens
aaacugucauggucaucaa

SEQ ID NO: 1073281 - RNA, 19 nt, Homo sapiens
gagaucauccuggcuaaca

SEQ ID NO: 1073282 - RNA, 19 nt, Homo sapiens
gugaaggauggaaaucaua

SEQ ID NO: 1073283 - RNA, 19 nt, Homo sapiens
acaaucagcagacauagau

SEQ ID NO: 1073284 - RNA, 19 nt, Homo sapiens
cauaucuugucuuugugua

SEQ ID NO: 1073285 - RNA, 19 nt, Homo sapiens
uaacaaccaggccaagaau

SEQ ID NO: 1073286 - RNA, 19 nt, Homo sapiens
aaauggaacuagaccucaa

SEQ ID NO: 1073287 - RNA, 19 nt, Homo sapiens
aaucagcagacauagauaa

SEQ ID NO: 1073288 - RNA, 19 nt, Homo sapiens
acagaggccauucuacaaa

SEQ ID NO: 1073289 - RNA, 19 nt, Homo sapiens
uaaagugaaggauggaaau

SEQ ID NO: 1073290 - RNA, 19 nt, Homo sapiens
uacacaaucagcagacaua

SEQ ID NO: 1073291 - RNA, 19 nt, Homo sapiens
ggaccagaacuuacacauc

SEQ ID NO: 1073292 - RNA, 19 nt, Homo sapiens
gacaaagcauuuucacaug

SEQ ID NO: 1073293 - RNA, 19 nt, Homo sapiens
agaagcaagauauagagua

SEQ ID NO: 1073294 - RNA, 19 nt, Homo sapiens
caacccgaagcuuauaauu

SEQ ID NO: 1073295 - RNA, 19 nt, Homo sapiens
uagcaaagguguuagauua

SEQ ID NO: 1073296 - RNA, 19 nt, Homo sapiens
ggaaguagcucacccauuc

SEQ ID NO: 1073297 - RNA, 19 nt, Homo sapiens
uaggagagaugacaaauua

SEQ ID NO: 1073298 - RNA, 19 nt, Homo sapiens
caaaggagguuaucaucua

SEQ ID NO: 1073299 - RNA, 19 nt, Homo sapiens
uaacuaaucugccugcaaa

SEQ ID NO: 1073300 - RNA, 19 nt, Homo sapiens
ccacagagcacacauuuaa

SEQ ID NO: 1073301 - RNA, 19 nt, Homo sapiens
gagcuuaucugauuuacau

SEQ ID NO: 1073302 - RNA, 19 nt, Homo sapiens
ggagagaugacaaauuaua

SEQ ID NO: 1073303 - RNA, 19 nt, Homo sapiens
gaacauggcacccuugaug

SEQ ID NO: 1073304 - RNA, 19 nt, Homo sapiens
caaaaugggugauuaguaa

SEQ ID NO: 1073305 - RNA, 19 nt, Homo sapiens
gcaaagguguuagauuaga

SEQ ID NO: 1073306 - RNA, 19 nt, Homo sapiens
gaagcuagcaggaaucuga

SEQ ID NO: 1073307 - RNA, 19 nt, Homo sapiens
gcagcaauguaguaucaaa

SEQ ID NO: 1073308 - RNA, 19 nt, Homo sapiens
gaauauggcagcaauguag

SEQ ID NO: 1073309 - RNA, 19 nt, Homo sapiens
gaucugaaagguauugaaa

SEQ ID NO: 1073310 - RNA, 19 nt, Homo sapiens
ggcuacagaugccaguuua

SEQ ID NO: 1073311 - RNA, 19 nt, Homo sapiens
gguguuagauuagauuaga

SEQ ID NO: 1073312 - RNA, 19 nt, Homo sapiens
gagcacacauuuaauuugc

SEQ ID NO: 1073313 - RNA, 19 nt, Homo sapiens
gauaaggccaacauaacua

SEQ ID NO: 1073314 - RNA, 19 nt, Homo sapiens
uaagaggagucugaggaua

SEQ ID NO: 1073315 - RNA, 19 nt, Homo sapiens
gaguuccacuugcuauaaa

SEQ ID NO: 1073316 - RNA, 19 nt, Homo sapiens
aaaggagguuaucaucuaa

SEQ ID NO: 1073317 - RNA, 19 nt, Homo sapiens
caaguaagcagcaggguau

SEQ ID NO: 1073318 - RNA, 19 nt, Homo sapiens
gcaaaaggauggauuacug

SEQ ID NO: 1073319 - RNA, 19 nt, Homo sapiens
gaaagagggagggaagaaa

SEQ ID NO: 1073320 - RNA, 19 nt, Homo sapiens
gagagaauaacaauaggaa

SEQ ID NO: 1073321 - RNA, 19 nt, Homo sapiens
gcucacccauucuccacua

SEQ ID NO: 1073322 - RNA, 19 nt, Homo sapiens
cuagauacacuauaccuuu

SEQ ID NO: 1073323 - RNA, 19 nt, Homo sapiens
uaaguacacucugaagaug

SEQ ID NO: 1073324 - RNA, 19 nt, Homo sapiens
ugagauaaggccaacauaa

SEQ ID NO: 1073325 - RNA, 19 nt, Homo sapiens
gcagcaggguauacaaauc

SEQ ID NO: 1073326 - RNA, 19 nt, Homo sapiens
ggaaagagggagggaagaa

SEQ ID NO: 1073327 - RNA, 19 nt, Homo sapiens
gaauaacaauaggaacugu

SEQ ID NO: 1073328 - RNA, 19 nt, Homo sapiens
uaccacagaugcuagaguu

SEQ ID NO: 1073329 - RNA, 19 nt, Homo sapiens
gaguagguauugaaauuac

SEQ ID NO: 1073330 - RNA, 19 nt, Homo sapiens
gauucugucaucauucuua

SEQ ID NO: 1073331 - RNA, 19 nt, Homo sapiens
gagcugaugcccaaagaug

SEQ ID NO: 1073332 - RNA, 19 nt, Homo sapiens
gggaacugauuaaguaucu

SEQ ID NO: 1073333 - RNA, 19 nt, Homo sapiens
uggcagcaauguaguauca

SEQ ID NO: 1073334 - RNA, 19 nt, Homo sapiens
acagagcacacauuuaauu

SEQ ID NO: 1073335 - RNA, 19 nt, Homo sapiens
caaagguguuagauuagau

SEQ ID NO: 1073336 - RNA, 19 nt, Homo sapiens
gauucuaaguacacucuga

SEQ ID NO: 1073337 - RNA, 19 nt, Homo sapiens
guuaagcauuugauucugu

SEQ ID NO: 1073338 - RNA, 19 nt, Homo sapiens
guaaaaccauucccaauag

SEQ ID NO: 1073339 - RNA, 19 nt, Homo sapiens
gguaaaaccauucccaaua

SEQ ID NO: 1073340 - RNA, 19 nt, Homo sapiens
ugaaggcuauccuacugaa

SEQ ID NO: 1073341 - RNA, 19 nt, Homo sapiens
uagaaaggguuagggaaga

SEQ ID NO: 1073342 - RNA, 19 nt, Homo sapiens
gaagaaaggaagaaaagaa

SEQ ID NO: 1073343 - RNA, 19 nt, Homo sapiens
gagauaaggccaacauaac

SEQ ID NO: 1073344 - RNA, 19 nt, Homo sapiens
gagguuaucaucuaauaca

SEQ ID NO: 1073345 - RNA, 19 nt, Homo sapiens
cccaugucaucuauaauaa

SEQ ID NO: 1073346 - RNA, 19 nt, Homo sapiens
cuaguaacaccuaugagua

SEQ ID NO: 1073347 - RNA, 19 nt, Homo sapiens
cagagcacacauuuaauuu

SEQ ID NO: 1073348 - RNA, 19 nt, Homo sapiens
gaggagaacugggcuacag

SEQ ID NO: 1073349 - RNA, 19 nt, Homo sapiens
aggagguuaucaucuaaua

SEQ ID NO: 1073350 - RNA, 19 nt, Homo sapiens
uaggggaacugauuaagua

SEQ ID NO: 1073351 - RNA, 19 nt, Homo sapiens
ucccaugucaucuauaaua

SEQ ID NO: 1073352 - RNA, 19 nt, Homo sapiens
cugaggcaaucaagucuaa

SEQ ID NO: 1073353 - RNA, 19 nt, Homo sapiens
gaaagauucuaaguacacu

SEQ ID NO: 1073354 - RNA, 19 nt, Homo sapiens
cugauuaaguaucugcuaa

SEQ ID NO: 1073355 - RNA, 19 nt, Homo sapiens
guugugaaguuuaacagau

SEQ ID NO: 1073356 - RNA, 19 nt, Homo sapiens
gcaaaggagguuaucaucu

SEQ ID NO: 1073357 - RNA, 19 nt, Homo sapiens
gaugcuagaguuccacuug

SEQ ID NO: 1073358 - RNA, 19 nt, Homo sapiens
gcaaaaugggugauuagua

SEQ ID NO: 1073359 - RNA, 19 nt, Homo sapiens
uagauacacuauaccuuuc

SEQ ID NO: 1073360 - RNA, 19 nt, Homo sapiens
guaggagagaugacaaauu

SEQ ID NO: 1073361 - RNA, 19 nt, Homo sapiens
gaaggaagaaggugcaaaa

SEQ ID NO: 1073362 - RNA, 19 nt, Homo sapiens
gagaauaacaauaggaacu

SEQ ID NO: 1073363 - RNA, 19 nt, Homo sapiens
acucccaugucaucuauaa

SEQ ID NO: 1073364 - RNA, 19 nt, Homo sapiens
caaacuaccacagaugcua

SEQ ID NO: 1073365 - RNA, 19 nt, Homo sapiens
cuugggaucugaaagguau

SEQ ID NO: 1073366 - RNA, 19 nt, Homo sapiens
augagaagcuaucagaguu

SEQ ID NO: 1073367 - RNA, 19 nt, Homo sapiens
guaucaaacuaccacagau

SEQ ID NO: 1073368 - RNA, 19 nt, Homo sapiens
gagaaggagaggcaaggaa

SEQ ID NO: 1073369 - RNA, 19 nt, Homo sapiens
ccugaaggcuauccuacug

SEQ ID NO: 1073370 - RNA, 19 nt, Homo sapiens
gaaaggguuagggaagaaa

SEQ ID NO: 1073371 - RNA, 19 nt, Homo sapiens
ggcaaucaagucuaaggua

SEQ ID NO: 1073372 - RNA, 19 nt, Homo sapiens
cuaaguacacucugaagau

SEQ ID NO: 1073373 - RNA, 19 nt, Homo sapiens
gauuacugcuauggaagaa

SEQ ID NO: 1073374 - RNA, 19 nt, Homo sapiens
cccauucuccacuaaguua

SEQ ID NO: 1073375 - RNA, 19 nt, Homo sapiens
uaccuuuccuccacugauu

SEQ ID NO: 1073376 - RNA, 19 nt, Homo sapiens
gagaagcuaucagaguuuu

SEQ ID NO: 1073377 - RNA, 19 nt, Homo sapiens
agaaaggguuagggaagaa

SEQ ID NO: 1073378 - RNA, 19 nt, Homo sapiens
gcaauaauuuucagguauc

SEQ ID NO: 1073379 - RNA, 19 nt, Homo sapiens
guagcaaagguguuagauu

SEQ ID NO: 1073380 - RNA, 19 nt, Homo sapiens
aaaccauucccaauagaaa

SEQ ID NO: 1073381 - RNA, 19 nt, Homo sapiens
aaaagaagcuagcaggaau

SEQ ID NO: 1073382 - RNA, 19 nt, Homo sapiens
agaaggagaggcaaggaaa

SEQ ID NO: 1073383 - RNA, 19 nt, Homo sapiens
cugauucucuguaacuaau

SEQ ID NO: 1073384 - RNA, 19 nt, Homo sapiens
ugagaucagucugcagaga

SEQ ID NO: 1073385 - RNA, 19 nt, Homo sapiens
gggcuacagaugccaguuu

SEQ ID NO: 1073386 - RNA, 19 nt, Homo sapiens
gcaagaaaaugagcuuauc

SEQ ID NO: 1073387 - RNA, 19 nt, Homo sapiens
gagagaugacaaauuauac

SEQ ID NO: 1073388 - RNA, 19 nt, Homo sapiens
ggagagagggaggaaggaa

SEQ ID NO: 1073389 - RNA, 19 nt, Homo sapiens
gaagugcagaggagaacug

SEQ ID NO: 1073390 - RNA, 19 nt, Homo sapiens
uagagcugaugcccaaaga

SEQ ID NO: 1073391 - RNA, 19 nt, Homo sapiens
ggagucugaggauaugaaa

SEQ ID NO: 1073392 - RNA, 19 nt, Homo sapiens
cagcaauaauuuucaggua

SEQ ID NO: 1073393 - RNA, 19 nt, Homo sapiens
auacucccaugucaucuau

SEQ ID NO: 1073394 - RNA, 19 nt, Homo sapiens
uuaauuugcuccuaguaac

SEQ ID NO: 1073395 - RNA, 19 nt, Homo sapiens
gcaagucgcuucaacagua

SEQ ID NO: 1073396 - RNA, 19 nt, Homo sapiens
gcaaacagguacuacagaa

SEQ ID NO: 1073397 - RNA, 19 nt, Homo sapiens
gaucaaaugguuuagguua

SEQ ID NO: 1073398 - RNA, 19 nt, Homo sapiens
gaagagaaacuaacacaau

SEQ ID NO: 1073399 - RNA, 19 nt, Homo sapiens
gaauuuggcccugaauaua

SEQ ID NO: 1073400 - RNA, 19 nt, Homo sapiens
ugauagagauccuagauau

SEQ ID NO: 1073401 - RNA, 19 nt, Homo sapiens
caacaguacuaucucaguu

SEQ ID NO: 1073402 - RNA, 19 nt, Homo sapiens
aaacagguacuacagaaua

SEQ ID NO: 1073403 - RNA, 19 nt, Homo sapiens
gaaaccucgucucuacuaa

SEQ ID NO: 1073404 - RNA, 19 nt, Homo sapiens
gauccuagauauuugacuu

SEQ ID NO: 1073405 - RNA, 19 nt, Homo sapiens
gagaacccauggauaugaa

SEQ ID NO: 1073406 - RNA, 19 nt, Homo sapiens
ggugaaaccucgucucuac

SEQ ID NO: 1073407 - RNA, 19 nt, Homo sapiens
ggaaaguaaccuaaguaaa

SEQ ID NO: 1073408 - RNA, 19 nt, Homo sapiens
guaaaugaauagccuacau

SEQ ID NO: 1073409 - RNA, 19 nt, Homo sapiens
gaaugagaacccauggaua

SEQ ID NO: 1073410 - RNA, 19 nt, Homo sapiens
guccuacuauguauuguaa

SEQ ID NO: 1073411 - RNA, 19 nt, Homo sapiens
gaacuaagcaagguaugga

SEQ ID NO: 1073412 - RNA, 19 nt, Homo sapiens
gcaguacaccauagauuau

SEQ ID NO: 1073413 - RNA, 19 nt, Homo sapiens
gauaugaagguccuacuau

SEQ ID NO: 1073414 - RNA, 19 nt, Homo sapiens
ucaauggucaggaaaguaa

SEQ ID NO: 1073415 - RNA, 19 nt, Homo sapiens
ggucaucccugaaauucuc

SEQ ID NO: 1073416 - RNA, 19 nt, Homo sapiens
acucugaaaucccuguaua

SEQ ID NO: 1073417 - RNA, 19 nt, Homo sapiens
acaguacuaucucaguuaa

SEQ ID NO: 1073418 - RNA, 19 nt, Homo sapiens
ugaauagccuacauagcaa

SEQ ID NO: 1073419 - RNA, 19 nt, Homo sapiens
gaaauucucgcugaucugu

SEQ ID NO: 1073420 - RNA, 19 nt, Homo sapiens
cauuucaacccaaguauuu

SEQ ID NO: 1073421 - RNA, 19 nt, Homo sapiens
gauagagauccuagauauu

SEQ ID NO: 1073422 - RNA, 19 nt, Homo sapiens
ugaagguccuacuauguau

SEQ ID NO: 1073423 - RNA, 19 nt, Homo sapiens
ggauaugaagguccuacua

SEQ ID NO: 1073424 - RNA, 19 nt, Homo sapiens
uaaauggacacgauaggaa

SEQ ID NO: 1073425 - RNA, 19 nt, Homo sapiens
ucaguuaaauggacacgau

SEQ ID NO: 1073426 - RNA, 19 nt, Homo sapiens
ugaaaccucgucucuacua

SEQ ID NO: 1073427 - RNA, 19 nt, Homo sapiens
aaugagaacccauggauau

SEQ ID NO: 1073428 - RNA, 19 nt, Homo sapiens
ggucaggaaaguaaccuaa

SEQ ID NO: 1073429 - RNA, 19 nt, Homo sapiens
ucaggaaaguaaccuaagu

SEQ ID NO: 1073430 - RNA, 19 nt, Homo sapiens
uagagauccuagauauuug

SEQ ID NO: 1073431 - RNA, 19 nt, Homo sapiens
ggaagagaaacuaacacaa

SEQ ID NO: 1073432 - RNA, 19 nt, Homo sapiens
ucucagauacaguagauaa

SEQ ID NO: 1073433 - RNA, 19 nt, Homo sapiens
ugaauuuggcccugaauau

SEQ ID NO: 1073434 - RNA, 19 nt, Homo sapiens
ugcaguacaccauagauua

SEQ ID NO: 1073435 - RNA, 19 nt, Homo sapiens
cagaucaaaugguuuaggu

SEQ ID NO: 1073436 - RNA, 19 nt, Homo sapiens
caggaaaguaaccuaagua

SEQ ID NO: 1073437 - RNA, 19 nt, Homo sapiens
aacagguacuacagaauaa

SEQ ID NO: 1073438 - RNA, 19 nt, Homo sapiens
cuauuucaaugccauauca

SEQ ID NO: 1073439 - RNA, 19 nt, Homo sapiens
gcaggagaauggcgugaac

SEQ ID NO: 1073440 - RNA, 19 nt, Homo sapiens
ccuguaaucccagcaauuu

SEQ ID NO: 1073441 - RNA, 19 nt, Homo sapiens
ggauuacucaaacuccuaa

SEQ ID NO: 1073442 - RNA, 19 nt, Homo sapiens
gaagguccuacuauguauu

SEQ ID NO: 1073443 - RNA, 19 nt, Homo sapiens
uugaauccaugaaugagaa

SEQ ID NO: 1073444 - RNA, 19 nt, Homo sapiens
aaacaccaguagccuaagu

SEQ ID NO: 1073445 - RNA, 19 nt, Homo sapiens
gugguugaauccaugaaug

SEQ ID NO: 1073446 - RNA, 19 nt, Homo sapiens
ucgagaccauccuggcuaa

SEQ ID NO: 1073447 - RNA, 19 nt, Homo sapiens
aauuuggcccugaauauaa

SEQ ID NO: 1073448 - RNA, 19 nt, Homo sapiens
ugagaacccauggauauga

SEQ ID NO: 1073449 - RNA, 19 nt, Homo sapiens
ccuacuauguauuguaaca

SEQ ID NO: 1073450 - RNA, 19 nt, Homo sapiens
aauucucgcugaucuguau

SEQ ID NO: 1073451 - RNA, 19 nt, Homo sapiens
ugaaugagaacccauggau

SEQ ID NO: 1073452 - RNA, 19 nt, Homo sapiens
uccauuaaccucuagacua

SEQ ID NO: 1073453 - RNA, 19 nt, Homo sapiens
aaaacacugugcacauuaa

SEQ ID NO: 1073454 - RNA, 19 nt, Homo sapiens
uagccuacauagcaacaga

SEQ ID NO: 1073455 - RNA, 19 nt, Homo sapiens
ucugaaaucccuguauauu

SEQ ID NO: 1073456 - RNA, 19 nt, Homo sapiens
gcaccuguagucccagcua

SEQ ID NO: 1073457 - RNA, 19 nt, Homo sapiens
gaucaugaggucaggagau

SEQ ID NO: 1073458 - RNA, 19 nt, Homo sapiens
uaaaacacugugcacauua

SEQ ID NO: 1073459 - RNA, 19 nt, Homo sapiens
auaugaagguccuacuaug

SEQ ID NO: 1073460 - RNA, 19 nt, Homo sapiens
gguccuacuauguauugua

SEQ ID NO: 1073461 - RNA, 19 nt, Homo sapiens
ccauagauuauaacugcua

SEQ ID NO: 1073462 - RNA, 19 nt, Homo sapiens
gucaggagaucgagaccau

SEQ ID NO: 1073463 - RNA, 19 nt, Homo sapiens
gacuaggucaucccugaaa

SEQ ID NO: 1073464 - RNA, 19 nt, Homo sapiens
augaauagccuacauagca

SEQ ID NO: 1073465 - RNA, 19 nt, Homo sapiens
gcaagguauggaacacuga

SEQ ID NO: 1073466 - RNA, 19 nt, Homo sapiens
ugccauaucauuacuacaa

SEQ ID NO: 1073467 - RNA, 19 nt, Homo sapiens
aaauggacacgauaggaaa

SEQ ID NO: 1073468 - RNA, 19 nt, Homo sapiens
caguacaccauagauuaua

SEQ ID NO: 1073469 - RNA, 19 nt, Homo sapiens
augaagguccuacuaugua

SEQ ID NO: 1073470 - RNA, 19 nt, Homo sapiens
gauauuugacuuggagaau

SEQ ID NO: 1073471 - RNA, 19 nt, Homo sapiens
cuucaacaguacuaucuca

SEQ ID NO: 1073472 - RNA, 19 nt, Homo sapiens
uaugaagguccuacuaugu

SEQ ID NO: 1073473 - RNA, 19 nt, Homo sapiens
caacagaauguagcguaga

SEQ ID NO: 1073474 - RNA, 19 nt, Homo sapiens
aacaguacuaucucaguua

SEQ ID NO: 1073475 - RNA, 19 nt, Homo sapiens
aaaccucgucucuacuaaa

SEQ ID NO: 1073476 - RNA, 19 nt, Homo sapiens
gcugaucuguauuuucauu

SEQ ID NO: 1073477 - RNA, 19 nt, Homo sapiens
uuaaaacacugugcacauu

SEQ ID NO: 1073478 - RNA, 19 nt, Homo sapiens
aggaaaguaaccuaaguaa

SEQ ID NO: 1073479 - RNA, 19 nt, Homo sapiens
caaacagguacuacagaau

SEQ ID NO: 1073480 - RNA, 19 nt, Homo sapiens
caagcaauauguggcaaac

SEQ ID NO: 1073481 - RNA, 19 nt, Homo sapiens
acacugugcacauuaaaca

SEQ ID NO: 1073482 - RNA, 19 nt, Homo sapiens
caagucgcuucaacaguac

SEQ ID NO: 1073483 - RNA, 19 nt, Homo sapiens
gccauaucauuacuacaag

SEQ ID NO: 1073484 - RNA, 19 nt, Homo sapiens
ucgcugaucuguauuuuca

SEQ ID NO: 1073485 - RNA, 19 nt, Homo sapiens
caagguauggaacacugaa

SEQ ID NO: 1073486 - RNA, 19 nt, Homo sapiens
uaugauagagauccuagau

SEQ ID NO: 1073487 - RNA, 19 nt, Homo sapiens
ccauaucauuacuacaagu

SEQ ID NO: 1073488 - RNA, 19 nt, Homo sapiens
cugaaauucucgcugaucu

SEQ ID NO: 1073489 - RNA, 19 nt, Homo sapiens
aaacacugugcacauuaaa

SEQ ID NO: 1073490 - RNA, 19 nt, Homo sapiens
ggcaaacagguacuacaga

SEQ ID NO: 1073491 - RNA, 19 nt, Homo sapiens
gacuuggagaauacuguua

SEQ ID NO: 1073492 - RNA, 19 nt, Homo sapiens
guacuaucucaguuaaaug

SEQ ID NO: 1073493 - RNA, 19 nt, Homo sapiens
uuucucagauacaguagau

SEQ ID NO: 1073494 - RNA, 19 nt, Homo sapiens
gagaccauccuggcuaaca

SEQ ID NO: 1073495 - RNA, 19 nt, Homo sapiens
gaacugaacuucucacuau

SEQ ID NO: 1073496 - RNA, 19 nt, Homo sapiens
gauaagagcugcagcauug

SEQ ID NO: 1073497 - RNA, 19 nt, Homo sapiens
guaaagggcugcaagauuu

SEQ ID NO: 1073498 - RNA, 19 nt, Homo sapiens
gagaagaaaucagguaauu

SEQ ID NO: 1073499 - RNA, 19 nt, Homo sapiens
gagaggagucuuauuauuu

SEQ ID NO: 1073500 - RNA, 19 nt, Homo sapiens
gaaaggaauucuuagcaau

SEQ ID NO: 1073501 - RNA, 19 nt, Homo sapiens
cagaugaaauggacuauga

SEQ ID NO: 1073502 - RNA, 19 nt, Homo sapiens
uaacaaacuugcuaaagga

SEQ ID NO: 1073503 - RNA, 19 nt, Homo sapiens
gaaguggaaucucaguuga

SEQ ID NO: 1073504 - RNA, 19 nt, Homo sapiens
aagaagagccgguuagaua

SEQ ID NO: 1073505 - RNA, 19 nt, Homo sapiens
agagagaggagucuuauua

SEQ ID NO: 1073506 - RNA, 19 nt, Homo sapiens
caaauuaccaccugagaaa

SEQ ID NO: 1073507 - RNA, 19 nt, Homo sapiens
gaaauggacuaugaucuag

SEQ ID NO: 1073508 - RNA, 19 nt, Homo sapiens
gaacaugggcguuagagau

SEQ ID NO: 1073509 - RNA, 19 nt, Homo sapiens
ccagaagaagucaguauua

SEQ ID NO: 1073510 - RNA, 19 nt, Homo sapiens
ggacuaugaucuagaacug

SEQ ID NO: 1073511 - RNA, 19 nt, Homo sapiens
ggacugaguguaugacaaa

SEQ ID NO: 1073512 - RNA, 19 nt, Homo sapiens
cguuagagaugguaauaaa

SEQ ID NO: 1073513 - RNA, 19 nt, Homo sapiens
ggacauggaugcagaugac

SEQ ID NO: 1073514 - RNA, 19 nt, Homo sapiens
ccaaagagcagagaacuga

SEQ ID NO: 1073515 - RNA, 19 nt, Homo sapiens
ugaaaggaauucuuagcaa

SEQ ID NO: 1073516 - RNA, 19 nt, Homo sapiens
gaagaagucaguauuacau

SEQ ID NO: 1073517 - RNA, 19 nt, Homo sapiens
ugaaauggacuaugaucua

SEQ ID NO: 1073518 - RNA, 19 nt, Homo sapiens
gaaagcagcucugguucag

SEQ ID NO: 1073519 - RNA, 19 nt, Homo sapiens
aaaccgaauugguaacaaa

SEQ ID NO: 1073520 - RNA, 19 nt, Homo sapiens
agagaggagucuuauuauu

SEQ ID NO: 1073521 - RNA, 19 nt, Homo sapiens
guucagugcugugggauuu

SEQ ID NO: 1073522 - RNA, 19 nt, Homo sapiens
caaacuugcuaaaggaaau

SEQ ID NO: 1073523 - RNA, 19 nt, Homo sapiens
guauaaacaucgacauucu

SEQ ID NO: 1073524 - RNA, 19 nt, Homo sapiens
ggcaugaaaggaauucuua

SEQ ID NO: 1073525 - RNA, 19 nt, Homo sapiens
gaaguaaagggcugcaaga

SEQ ID NO: 1073526 - RNA, 19 nt, Homo sapiens
ggaggaagaggaagaggaa

SEQ ID NO: 1073527 - RNA, 19 nt, Homo sapiens
ccacaggcuuuacccuuug

SEQ ID NO: 1073528 - RNA, 19 nt, Homo sapiens
ccuaaagccugacauucuu

SEQ ID NO: 1073529 - RNA, 19 nt, Homo sapiens
aaagagcagucucgccaaa

SEQ ID NO: 1073530 - RNA, 19 nt, Homo sapiens
gcaugaaaaugacuaugua

SEQ ID NO: 1073531 - RNA, 19 nt, Homo sapiens
gaagucaguauuacaugaa

SEQ ID NO: 1073532 - RNA, 19 nt, Homo sapiens
cuaacaaacuugcuaaagg

SEQ ID NO: 1073533 - RNA, 19 nt, Homo sapiens
gagagaggagucuuauuau

SEQ ID NO: 1073534 - RNA, 19 nt, Homo sapiens
acagaguggugguagagua

SEQ ID NO: 1073535 - RNA, 19 nt, Homo sapiens
aggaggagguagauuguuu

SEQ ID NO: 1073536 - RNA, 19 nt, Homo sapiens
ugaaauaugggaauccaaa

SEQ ID NO: 1073537 - RNA, 19 nt, Homo sapiens
agaagucaguauuacauga

SEQ ID NO: 1073538 - RNA, 19 nt, Homo sapiens
ugacugugcuuccguucuu

SEQ ID NO: 1073539 - RNA, 19 nt, Homo sapiens
ggaaagcagcucugguuca

SEQ ID NO: 1073540 - RNA, 19 nt, Homo sapiens
uaaaugcuccuaguuguau

SEQ ID NO: 1073541 - RNA, 19 nt, Homo sapiens
aaaggcagcccuccagauu

SEQ ID NO: 1073542 - RNA, 19 nt, Homo sapiens
gagcagagaacugaacuuc

SEQ ID NO: 1073543 - RNA, 19 nt, Homo sapiens
gcagagagaggagucuuau

SEQ ID NO: 1073544 - RNA, 19 nt, Homo sapiens
gaacuuggagcagccagaa

SEQ ID NO: 1073545 - RNA, 19 nt, Homo sapiens
gggagaagaaaucagguaa

SEQ ID NO: 1073546 - RNA, 19 nt, Homo sapiens
ccagucagcaguacuaaau

SEQ ID NO: 1073547 - RNA, 19 nt, Homo sapiens
gacuauguaugcugacgaa

SEQ ID NO: 1073548 - RNA, 19 nt, Homo sapiens
ggaagaggaagaggaagaa

SEQ ID NO: 1073549 - RNA, 19 nt, Homo sapiens
cagaagaagucaguauuac

SEQ ID NO: 1073550 - RNA, 19 nt, Homo sapiens
guaauaaaccgugguccuu

SEQ ID NO: 1073551 - RNA, 19 nt, Homo sapiens
gguagauuguuucgucuuc

SEQ ID NO: 1073552 - RNA, 19 nt, Homo sapiens
gcuccuaguuguauagucu

SEQ ID NO: 1073553 - RNA, 19 nt, Homo sapiens
caagggcaucucuaucuuu

SEQ ID NO: 1073554 - RNA, 19 nt, Homo sapiens
ucaagggcaucucuaucuu

SEQ ID NO: 1073555 - RNA, 19 nt, Homo sapiens
agaagagccgguuagauaa

SEQ ID NO: 1073556 - RNA, 19 nt, Homo sapiens
gaucugcacccaagaccaa

SEQ ID NO: 1073557 - RNA, 19 nt, Homo sapiens
cgaaguggaaucucaguug

SEQ ID NO: 1073558 - RNA, 19 nt, Homo sapiens
gaaauaugggaauccaaau

SEQ ID NO: 1073559 - RNA, 19 nt, Homo sapiens
guauuccucugcaguuuua

SEQ ID NO: 1073560 - RNA, 19 nt, Homo sapiens
uuacacaguucauccaaag

SEQ ID NO: 1073561 - RNA, 19 nt, Homo sapiens
cccacaggcuuuacccuuu

SEQ ID NO: 1073562 - RNA, 19 nt, Homo sapiens
ugagaaauuugcagauguc

SEQ ID NO: 1073563 - RNA, 19 nt, Homo sapiens
caugagggcagauagugua

SEQ ID NO: 1073564 - RNA, 19 nt, Homo sapiens
uauguaugcugacgaagug

SEQ ID NO: 1073565 - RNA, 19 nt, Homo sapiens
caagaagagagcccugauu

SEQ ID NO: 1073566 - RNA, 19 nt, Homo sapiens
gggcucugauuaaggagaa

SEQ ID NO: 1073567 - RNA, 19 nt, Homo sapiens
uaguguaucuucaagcaau

SEQ ID NO: 1073568 - RNA, 19 nt, Homo sapiens
aauggacuaugaucuagaa

SEQ ID NO: 1073569 - RNA, 19 nt, Homo sapiens
uaauaaaccgugguccuuu

SEQ ID NO: 1073570 - RNA, 19 nt, Homo sapiens
gaaguuagucgggaaagca

SEQ ID NO: 1073571 - RNA, 19 nt, Homo sapiens
gcacccaagaccaaagaaa

SEQ ID NO: 1073572 - RNA, 19 nt, Homo sapiens
ggaggaggaggaagaggaa

SEQ ID NO: 1073573 - RNA, 19 nt, Homo sapiens
aagaagagagcccugauug

SEQ ID NO: 1073574 - RNA, 19 nt, Homo sapiens
gauauacgccagcgguuag

SEQ ID NO: 1073575 - RNA, 19 nt, Homo sapiens
cagcaguacuaaaucagau

SEQ ID NO: 1073576 - RNA, 19 nt, Homo sapiens
acuaugaucuagaacugaa

SEQ ID NO: 1073577 - RNA, 19 nt, Homo sapiens
gggguccuguuguuuauua

SEQ ID NO: 1073578 - RNA, 19 nt, Homo sapiens
uguauagucugucuguugu

SEQ ID NO: 1073579 - RNA, 19 nt, Homo sapiens
gggauuaugggucaauguu

SEQ ID NO: 1073580 - RNA, 19 nt, Homo sapiens
ggagaagaaaucagguaau

SEQ ID NO: 1073581 - RNA, 19 nt, Homo sapiens
ccgaggaacccauugaaga

SEQ ID NO: 1073582 - RNA, 19 nt, Homo sapiens
agauaucauucccgucgua

SEQ ID NO: 1073583 - RNA, 19 nt, Homo sapiens
uuaaaugcuccuaguugua

SEQ ID NO: 1073584 - RNA, 19 nt, Homo sapiens
ggcuuuacccuuugagaaa

SEQ ID NO: 1073585 - RNA, 19 nt, Homo sapiens
cuucugaugugcauaguag

SEQ ID NO: 1073586 - RNA, 19 nt, Homo sapiens
gcaguacuaaaucagauau

SEQ ID NO: 1073587 - RNA, 19 nt, Homo sapiens
ccugagaaauuugcagaug

SEQ ID NO: 1073588 - RNA, 19 nt, Homo sapiens
gcuaaaggaaauagguuau

SEQ ID NO: 1073589 - RNA, 19 nt, Homo sapiens
aguggaaucucaguugaaa

SEQ ID NO: 1073590 - RNA, 19 nt, Homo sapiens
agaggaagaggaagaagaa

SEQ ID NO: 1073591 - RNA, 19 nt, Homo sapiens
gagaugggguccuguuguu

SEQ ID NO: 1073592 - RNA, 19 nt, Homo sapiens
ggcagagagaggagucuua

SEQ ID NO: 1073593 - RNA, 19 nt, Homo sapiens
gccagaagaagucaguauu

SEQ ID NO: 1073594 - RNA, 19 nt, Homo sapiens
ccaccagucagcaguacua

SEQ ID NO: 1073595 - RNA, 19 nt, Homo sapiens
gaaguaaccucaagaauag

SEQ ID NO: 1073596 - RNA, 19 nt, Homo sapiens
ggaaguaaccucaagaaua

SEQ ID NO: 1073597 - RNA, 19 nt, Homo sapiens
gcaaucagcuuacucaaca

SEQ ID NO: 1073598 - RNA, 19 nt, Homo sapiens
ggaggaagaagaaguguua

SEQ ID NO: 1073599 - RNA, 19 nt, Homo sapiens
gaucaguucuucaguucua

SEQ ID NO: 1073600 - RNA, 19 nt, Homo sapiens
ggagaagccuuacgagugu

SEQ ID NO: 1073601 - RNA, 19 nt, Homo sapiens
guaaaucccuuggccguaa

SEQ ID NO: 1073602 - RNA, 19 nt, Homo sapiens
gcuguacgcuguugugaaa

SEQ ID NO: 1073603 - RNA, 19 nt, Homo sapiens
gcucaagccucguuauuca

SEQ ID NO: 1073604 - RNA, 19 nt, Homo sapiens
cgacguagccauagacuuu

SEQ ID NO: 1073605 - RNA, 19 nt, Homo sapiens
gaaagacuacgaaugcaaa

SEQ ID NO: 1073606 - RNA, 19 nt, Homo sapiens
gcucuagccucucggaauu

SEQ ID NO: 1073607 - RNA, 19 nt, Homo sapiens
gagaagcccuacgaaugua

SEQ ID NO: 1073608 - RNA, 19 nt, Homo sapiens
ggagguaugucaaucagau

SEQ ID NO: 1073609 - RNA, 19 nt, Homo sapiens
gaaggcauguaaccaccua

SEQ ID NO: 1073610 - RNA, 19 nt, Homo sapiens
ggagaagcccuacgaaugu

SEQ ID NO: 1073611 - RNA, 19 nt, Homo sapiens
ggaaggcuuucauuuaugg

SEQ ID NO: 1073612 - RNA, 19 nt, Homo sapiens
agucguggcuaucaacuua

SEQ ID NO: 1073613 - RNA, 19 nt, Homo sapiens
ggagaaagacuacgaaugc

SEQ ID NO: 1073614 - RNA, 19 nt, Homo sapiens
gugggaaggcuuucauuua

SEQ ID NO: 1073615 - RNA, 19 nt, Homo sapiens
ugagaaacccuaugaaugu

SEQ ID NO: 1073616 - RNA, 19 nt, Homo sapiens
gagcaguggucccaaagug

SEQ ID NO: 1073617 - RNA, 19 nt, Homo sapiens
ugggaaggcuuucauuuau

SEQ ID NO: 1073618 - RNA, 19 nt, Homo sapiens
gaauucagauagaagaagu

SEQ ID NO: 1073619 - RNA, 19 nt, Homo sapiens
gcgagaagccguacaagug

SEQ ID NO: 1073620 - RNA, 19 nt, Homo sapiens
gggagaagcccuacgaaug

SEQ ID NO: 1073621 - RNA, 19 nt, Homo sapiens
gaacacaucagagacauca

SEQ ID NO: 1073622 - RNA, 19 nt, Homo sapiens
uguuauacguccuaaagua

SEQ ID NO: 1073623 - RNA, 19 nt, Homo sapiens
gccaucagcuuacacaaca

SEQ ID NO: 1073624 - RNA, 19 nt, Homo sapiens
gagaaaccuuaugaaugua

SEQ ID NO: 1073625 - RNA, 19 nt, Homo sapiens
gggaaggcuuucauuuaug

SEQ ID NO: 1073626 - RNA, 19 nt, Homo sapiens
ggccguaacuggauaugug

SEQ ID NO: 1073627 - RNA, 19 nt, Homo sapiens
gaaauaagggcuuccaaaa

SEQ ID NO: 1073628 - RNA, 19 nt, Homo sapiens
agaaagagcuggccuucag

SEQ ID NO: 1073629 - RNA, 19 nt, Homo sapiens
guagcccgcucguaucuau

SEQ ID NO: 1073630 - RNA, 19 nt, Homo sapiens
gaaugugggaagagcuuua

SEQ ID NO: 1073631 - RNA, 19 nt, Homo sapiens
gaaacccuaugaaugucaa

SEQ ID NO: 1073632 - RNA, 19 nt, Homo sapiens
caacuuagucaacaucaga

SEQ ID NO: 1073633 - RNA, 19 nt, Homo sapiens
ggagaacuacaguaacuug

SEQ ID NO: 1073634 - RNA, 19 nt, Homo sapiens
caacugcgccugagaccuu

SEQ ID NO: 1073635 - RNA, 19 nt, Homo sapiens
caaaaggaauucagauaga

SEQ ID NO: 1073636 - RNA, 19 nt, Homo sapiens
gaggaaaccgacacuguga

SEQ ID NO: 1073637 - RNA, 19 nt, Homo sapiens
ggaagaagaaguguuauac

SEQ ID NO: 1073638 - RNA, 19 nt, Homo sapiens
gcgaaauccuacgaaugua

SEQ ID NO: 1073639 - RNA, 19 nt, Homo sapiens
cuaugaaugucaagaaugu

SEQ ID NO: 1073640 - RNA, 19 nt, Homo sapiens
cagcacaagagaauucaua

SEQ ID NO: 1073641 - RNA, 19 nt, Homo sapiens
gaaguguuauacguccuaa

SEQ ID NO: 1073642 - RNA, 19 nt, Homo sapiens
ggcgaaauccuacgaaugu

SEQ ID NO: 1073643 - RNA, 19 nt, Homo sapiens
cuacgaauguaaagacugu

SEQ ID NO: 1073644 - RNA, 19 nt, Homo sapiens
gcuaucaacuuagucaaca

SEQ ID NO: 1073645 - RNA, 19 nt, Homo sapiens
cgaaauccuacgaauguaa

SEQ ID NO: 1073646 - RNA, 19 nt, Homo sapiens
gugagaaacccuaugaaug

SEQ ID NO: 1073647 - RNA, 19 nt, Homo sapiens
ucacucagcaccagagauu

SEQ ID NO: 1073648 - RNA, 19 nt, Homo sapiens
caaaaggccugcuacuaga

SEQ ID NO: 1073649 - RNA, 19 nt, Homo sapiens
ugaaauaagggcuuccaaa

SEQ ID NO: 1073650 - RNA, 19 nt, Homo sapiens
cgugaaacaugagagaauu

SEQ ID NO: 1073651 - RNA, 19 nt, Homo sapiens
ucaagccucguuauucaua

SEQ ID NO: 1073652 - RNA, 19 nt, Homo sapiens
acacaucagagacaucaua

SEQ ID NO: 1073653 - RNA, 19 nt, Homo sapiens
guuauacguccuaaaguaa

SEQ ID NO: 1073654 - RNA, 19 nt, Homo sapiens
gagcuggccuucaggaaaa

SEQ ID NO: 1073655 - RNA, 19 nt, Homo sapiens
guacaagugcacagaaugu

SEQ ID NO: 1073656 - RNA, 19 nt, Homo sapiens
gagaaacccuaugaauguc

SEQ ID NO: 1073657 - RNA, 19 nt, Homo sapiens
gagaaagacuacgaaugca

SEQ ID NO: 1073658 - RNA, 19 nt, Homo sapiens
cauaagaggauucauacug

SEQ ID NO: 1073659 - RNA, 19 nt, Homo sapiens
ggugagaaacccuaugaau

SEQ ID NO: 1073660 - RNA, 19 nt, Homo sapiens
caucuuaggucagcuuuac

SEQ ID NO: 1073661 - RNA, 19 nt, Homo sapiens
aagaagaaguguuauacgu

SEQ ID NO: 1073662 - RNA, 19 nt, Homo sapiens
guaaccaccuaaaccaucu

SEQ ID NO: 1073663 - RNA, 19 nt, Homo sapiens
guauaaauguaaggagugu

SEQ ID NO: 1073664 - RNA, 19 nt, Homo sapiens
caagccucauucagcauaa

SEQ ID NO: 1073665 - RNA, 19 nt, Homo sapiens
cacaagagaauucauagug

SEQ ID NO: 1073666 - RNA, 19 nt, Homo sapiens
gaauguaaagacuguggaa

SEQ ID NO: 1073667 - RNA, 19 nt, Homo sapiens
ggauuuggagucagcauau

SEQ ID NO: 1073668 - RNA, 19 nt, Homo sapiens
ggaggaggaagaagaagug

SEQ ID NO: 1073669 - RNA, 19 nt, Homo sapiens
ggccuucaauuguggcuau

SEQ ID NO: 1073670 - RNA, 19 nt, Homo sapiens
gagaagccuuacgagugua

SEQ ID NO: 1073671 - RNA, 19 nt, Homo sapiens
gaaauccuacgaauguaag

SEQ ID NO: 1073672 - RNA, 19 nt, Homo sapiens
cagaggauccacaacaguu

SEQ ID NO: 1073673 - RNA, 19 nt, Homo sapiens
cacacuaccuggaggacaa

SEQ ID NO: 1073674 - RNA, 19 nt, Homo sapiens
ggccuuuacucgagucaau

SEQ ID NO: 1073675 - RNA, 19 nt, Homo sapiens
ggagugggccugucugaac

SEQ ID NO: 1073676 - RNA, 19 nt, Homo sapiens
gagaggcuguacgcuguug

SEQ ID NO: 1073677 - RNA, 19 nt, Homo sapiens
caucagaggauccacaaca

SEQ ID NO: 1073678 - RNA, 19 nt, Homo sapiens
ucacucagcacgagagaau

SEQ ID NO: 1073679 - RNA, 19 nt, Homo sapiens
caucagagacaucauaagg

SEQ ID NO: 1073680 - RNA, 19 nt, Homo sapiens
ucaagccucauucagcaua

SEQ ID NO: 1073681 - RNA, 19 nt, Homo sapiens
gcacaagagaauucauagu

SEQ ID NO: 1073682 - RNA, 19 nt, Homo sapiens
ggaauuugucuucuucagu

SEQ ID NO: 1073683 - RNA, 19 nt, Homo sapiens
uaucuaugguuucgcuuuc

SEQ ID NO: 1073684 - RNA, 19 nt, Homo sapiens
ccgcucguaucuaugguuu

SEQ ID NO: 1073685 - RNA, 19 nt, Homo sapiens
gaaaccccguauaaaugua

SEQ ID NO: 1073686 - RNA, 19 nt, Homo sapiens
ucacgaauguaaggagugu

SEQ ID NO: 1073687 - RNA, 19 nt, Homo sapiens
gaaugugggaaggccuuua

SEQ ID NO: 1073688 - RNA, 19 nt, Homo sapiens
cuucacaagucacgagaug

SEQ ID NO: 1073689 - RNA, 19 nt, Homo sapiens
agccguguguauaaacuua

SEQ ID NO: 1073690 - RNA, 19 nt, Homo sapiens
gggagaaagacuacgaaug

SEQ ID NO: 1073691 - RNA, 19 nt, Homo sapiens
gaagcccuacgaauguaaa

SEQ ID NO: 1073692 - RNA, 19 nt, Homo sapiens
gacaucauaaggagaauuc

SEQ ID NO: 1073693 - RNA, 19 nt, Homo sapiens
gggacgugaugcuggagaa

SEQ ID NO: 1073694 - RNA, 19 nt, Homo sapiens
gaaggcaccccuccuagaa

SEQ ID NO: 1073695 - RNA, 19 nt, Homo sapiens
gaacauaucugaccaaagg

SEQ ID NO: 1073696 - RNA, 19 nt, Homo sapiens
gaaacagccucgacccuua

SEQ ID NO: 1073697 - RNA, 19 nt, Homo sapiens
gaccagagcucagaugcua

SEQ ID NO: 1073698 - RNA, 19 nt, Homo sapiens
cgagaaacaugccaaaucu

SEQ ID NO: 1073699 - RNA, 19 nt, Homo sapiens
ggaccaggccgagaauuaa

SEQ ID NO: 1073700 - RNA, 19 nt, Homo sapiens
gaaacaugccaaaucuaaa

SEQ ID NO: 1073701 - RNA, 19 nt, Homo sapiens
ccagagacaucacccugaa

SEQ ID NO: 1073702 - RNA, 19 nt, Homo sapiens
agaaacaugccaaaucuaa

SEQ ID NO: 1073703 - RNA, 19 nt, Homo sapiens
uaacggcaccucccuagaa

SEQ ID NO: 1073704 - RNA, 19 nt, Homo sapiens
gagcauacagugaguuuca

SEQ ID NO: 1073705 - RNA, 19 nt, Homo sapiens
cugagaacguggaguuuaa

SEQ ID NO: 1073706 - RNA, 19 nt, Homo sapiens
ggucacaguuggaaagaca

SEQ ID NO: 1073707 - RNA, 19 nt, Homo sapiens
gaacguggaguuuaagucu

SEQ ID NO: 1073708 - RNA, 19 nt, Homo sapiens
cacagacgcucuccagguu

SEQ ID NO: 1073709 - RNA, 19 nt, Homo sapiens
ggacugccaacuugucuga

SEQ ID NO: 1073710 - RNA, 19 nt, Homo sapiens
ccaaagugguuuuaagaaa

SEQ ID NO: 1073711 - RNA, 19 nt, Homo sapiens
uccagguucucaagaguua

SEQ ID NO: 1073712 - RNA, 19 nt, Homo sapiens
ccucgacccuuacagagaa

SEQ ID NO: 1073713 - RNA, 19 nt, Homo sapiens
gccuacagcugaccugguu

SEQ ID NO: 1073714 - RNA, 19 nt, Homo sapiens
gaggaggagcuacagauga

SEQ ID NO: 1073715 - RNA, 19 nt, Homo sapiens
gcgagaaacaugccaaauc

SEQ ID NO: 1073716 - RNA, 19 nt, Homo sapiens
agagcaaggucuucauuca

SEQ ID NO: 1073717 - RNA, 19 nt, Homo sapiens
gagaaacaacauggacuuu

SEQ ID NO: 1073718 - RNA, 19 nt, Homo sapiens
gaccacaccugagcauaca

SEQ ID NO: 1073719 - RNA, 19 nt, Homo sapiens
gugaacauaucugaccaaa

SEQ ID NO: 1073720 - RNA, 19 nt, Homo sapiens
gagaaacaugccaaaucua

SEQ ID NO: 1073721 - RNA, 19 nt, Homo sapiens
uuguugagguucucuauug

SEQ ID NO: 1073722 - RNA, 19 nt, Homo sapiens
uauccugccuuccagauuc

SEQ ID NO: 1073723 - RNA, 19 nt, Homo sapiens
auacuacugugugaaguuu

SEQ ID NO: 1073724 - RNA, 19 nt, Homo sapiens
gccgagaauuaaucuacaa

SEQ ID NO: 1073725 - RNA, 19 nt, Homo sapiens
uggaccaggccgagaauua

SEQ ID NO: 1073726 - RNA, 19 nt, Homo sapiens
agcaaggucuucauucaug

SEQ ID NO: 1073727 - RNA, 19 nt, Homo sapiens
gagaaugagccagugagaa

SEQ ID NO: 1073728 - RNA, 19 nt, Homo sapiens
caagcugguuccuggugaa

SEQ ID NO: 1073729 - RNA, 19 nt, Homo sapiens
ggaccacaccugagcauac

SEQ ID NO: 1073730 - RNA, 19 nt, Homo sapiens
ucacaaagagaaacaacau

SEQ ID NO: 1073731 - RNA, 19 nt, Homo sapiens
cugagaagcuccuguuggu

SEQ ID NO: 1073732 - RNA, 19 nt, Homo sapiens
caaagagaaacaacaugga

SEQ ID NO: 1073733 - RNA, 19 nt, Homo sapiens
gcucugggcacugacuuaa

SEQ ID NO: 1073734 - RNA, 19 nt, Homo sapiens
gagcaaggucuucauucau

SEQ ID NO: 1073735 - RNA, 19 nt, Homo sapiens
ccagagcaaggucuucauu

SEQ ID NO: 1073736 - RNA, 19 nt, Homo sapiens
ccugagaacguggaguuua

SEQ ID NO: 1073737 - RNA, 19 nt, Homo sapiens
agaaugagccagugagaag

SEQ ID NO: 1073738 - RNA, 19 nt, Homo sapiens
ucucagacuuccagaccaa

SEQ ID NO: 1073739 - RNA, 19 nt, Homo sapiens
aggaggagcuacagaugau

SEQ ID NO: 1073740 - RNA, 19 nt, Homo sapiens
ugaccugguuggagaaugg

SEQ ID NO: 1073741 - RNA, 19 nt, Homo sapiens
cagcacagccaggguggua

SEQ ID NO: 1073742 - RNA, 19 nt, Homo sapiens
gguucucuauugccucuug

SEQ ID NO: 1073743 - RNA, 19 nt, Homo sapiens
caccaggacucccauccau

SEQ ID NO: 1073744 - RNA, 19 nt, Homo sapiens
gaggagcuacagaugauuc

SEQ ID NO: 1073745 - RNA, 19 nt, Homo sapiens
acaaaugcacucccaaagu

SEQ ID NO: 1073746 - RNA, 19 nt, Homo sapiens
ccuugagacugaccguaaa

SEQ ID NO: 1073747 - RNA, 19 nt, Homo sapiens
uuacugcgcugcuccucau

SEQ ID NO: 1073748 - RNA, 19 nt, Homo sapiens
ccuuggagguuacucaaca

SEQ ID NO: 1073749 - RNA, 19 nt, Homo sapiens
ggccgagaauuaaucuaca

SEQ ID NO: 1073750 - RNA, 19 nt, Homo sapiens
gccuugagacugaccguaa

SEQ ID NO: 1073751 - RNA, 19 nt, Homo sapiens
aaacaugccaaaucuaaac

SEQ ID NO: 1073752 - RNA, 19 nt, Homo sapiens
ggaagcagaagaccugacu

SEQ ID NO: 1073753 - RNA, 19 nt, Homo sapiens
acaaggaugguaccuacaa

SEQ ID NO: 1073754 - RNA, 19 nt, Homo sapiens
acaucacccugaaaugguu

SEQ ID NO: 1073755 - RNA, 19 nt, Homo sapiens
gguccuuuccugcuucuga

SEQ ID NO: 1073756 - RNA, 19 nt, Homo sapiens
auacaaaugcacucccaaa

SEQ ID NO: 1073757 - RNA, 19 nt, Homo sapiens
cuagaaggcgagaaacaug

SEQ ID NO: 1073758 - RNA, 19 nt, Homo sapiens
ucugcugccuccuuccuuu

SEQ ID NO: 1073759 - RNA, 19 nt, Homo sapiens
gaccaggccgagaauuaau

SEQ ID NO: 1073760 - RNA, 19 nt, Homo sapiens
gaaacgugugccagagaga

SEQ ID NO: 1073761 - RNA, 19 nt, Homo sapiens
gacagaguguggccuacag

SEQ ID NO: 1073762 - RNA, 19 nt, Homo sapiens
gcccugagaacguggaguu

SEQ ID NO: 1073763 - RNA, 19 nt, Homo sapiens
uccaucgccuugagacuga

SEQ ID NO: 1073764 - RNA, 19 nt, Homo sapiens
ggacagaguguggccuaca

SEQ ID NO: 1073765 - RNA, 19 nt, Homo sapiens
caugccaaaucuaaacaca

SEQ ID NO: 1073766 - RNA, 19 nt, Homo sapiens
ucacaguccaccagaagga

SEQ ID NO: 1073767 - RNA, 19 nt, Homo sapiens
ggucacaguccaccagaag

SEQ ID NO: 1073768 - RNA, 19 nt, Homo sapiens
caaggaugguaccuacaac

SEQ ID NO: 1073769 - RNA, 19 nt, Homo sapiens
acagagaacaaggauggua

SEQ ID NO: 1073770 - RNA, 19 nt, Homo sapiens
gacaucacccugaaauggu

SEQ ID NO: 1073771 - RNA, 19 nt, Homo sapiens
agacaucacccugaaaugg

SEQ ID NO: 1073772 - RNA, 19 nt, Homo sapiens
gagacaucacccugaaaug

SEQ ID NO: 1073773 - RNA, 19 nt, Homo sapiens
ccuccuuccuuuccugaga

SEQ ID NO: 1073774 - RNA, 19 nt, Homo sapiens
ucgugggacugccaacuug

SEQ ID NO: 1073775 - RNA, 19 nt, Homo sapiens
agagacaucacccugaaau

SEQ ID NO: 1073776 - RNA, 19 nt, Homo sapiens
agagaaacaacauggacuu

SEQ ID NO: 1073777 - RNA, 19 nt, Homo sapiens
gaccugacucuccuuccuu

SEQ ID NO: 1073778 - RNA, 19 nt, Homo sapiens
cagacgcucuccagguucu

SEQ ID NO: 1073779 - RNA, 19 nt, Homo sapiens
caggguaacaacaguuuca

SEQ ID NO: 1073780 - RNA, 19 nt, Homo sapiens
cauacuacugugugaaguu

SEQ ID NO: 1073781 - RNA, 19 nt, Homo sapiens
cuucugaggucuccaaaau

SEQ ID NO: 1073782 - RNA, 19 nt, Homo sapiens
ugagagaaugagccaguga

SEQ ID NO: 1073783 - RNA, 19 nt, Homo sapiens
gaaggaccagagcucagau

SEQ ID NO: 1073784 - RNA, 19 nt, Homo sapiens
cagccucgacccuuacaga

SEQ ID NO: 1073785 - RNA, 19 nt, Homo sapiens
gagaacguggaguuuaagu

SEQ ID NO: 1073786 - RNA, 19 nt, Homo sapiens
gagcaggggccaugggauu

SEQ ID NO: 1073787 - RNA, 19 nt, Homo sapiens
ugaggaggagcuacagaug

SEQ ID NO: 1073788 - RNA, 19 nt, Homo sapiens
agaaggaccagagcucaga

SEQ ID NO: 1073789 - RNA, 19 nt, Homo sapiens
ucugcgagguggcccaugu

SEQ ID NO: 1073790 - RNA, 19 nt, Homo sapiens
gugaggaggagcuacagau

SEQ ID NO: 1073791 - RNA, 19 nt, Homo sapiens
cgagaaacaugccaaaucu

SEQ ID NO: 1073792 - RNA, 19 nt, Homo sapiens
ggaccaggccgagaauuaa

SEQ ID NO: 1073793 - RNA, 19 nt, Homo sapiens
gaaacaugccaaaucuaaa

SEQ ID NO: 1073794 - RNA, 19 nt, Homo sapiens
agaaacaugccaaaucuaa

SEQ ID NO: 1073795 - RNA, 19 nt, Homo sapiens
uaacggcaccucccuagaa

SEQ ID NO: 1073796 - RNA, 19 nt, Homo sapiens
cugagaacguggaguuuaa

SEQ ID NO: 1073797 - RNA, 19 nt, Homo sapiens
ggucacaguuggaaagaca

SEQ ID NO: 1073798 - RNA, 19 nt, Homo sapiens
gaacguggaguuuaagucu

SEQ ID NO: 1073799 - RNA, 19 nt, Homo sapiens
cacagacgcucuccagguu

SEQ ID NO: 1073800 - RNA, 19 nt, Homo sapiens
ccaaagugguuuuaagaaa

SEQ ID NO: 1073801 - RNA, 19 nt, Homo sapiens
uccagguucucaagaguua

SEQ ID NO: 1073802 - RNA, 19 nt, Homo sapiens
gaggaggagcuacagauga

SEQ ID NO: 1073803 - RNA, 19 nt, Homo sapiens
gcgagaaacaugccaaauc

SEQ ID NO: 1073804 - RNA, 19 nt, Homo sapiens
agagcaaggucuucauuca

SEQ ID NO: 1073805 - RNA, 19 nt, Homo sapiens
gagaaacaacauggacuuu

SEQ ID NO: 1073806 - RNA, 19 nt, Homo sapiens
gagaaacaugccaaaucua

SEQ ID NO: 1073807 - RNA, 19 nt, Homo sapiens
uuguugagguucucuauug

SEQ ID NO: 1073808 - RNA, 19 nt, Homo sapiens
uauccugccuuccagauuc

SEQ ID NO: 1073809 - RNA, 19 nt, Homo sapiens
auacuacugugugaaguuu

SEQ ID NO: 1073810 - RNA, 19 nt, Homo sapiens
gccgagaauuaaucuacaa

SEQ ID NO: 1073811 - RNA, 19 nt, Homo sapiens
uggaccaggccgagaauua

SEQ ID NO: 1073812 - RNA, 19 nt, Homo sapiens
agcaaggucuucauucaug

SEQ ID NO: 1073813 - RNA, 19 nt, Homo sapiens
gagaaugagccagugagaa

SEQ ID NO: 1073814 - RNA, 19 nt, Homo sapiens
ucacaaagagaaacaacau

SEQ ID NO: 1073815 - RNA, 19 nt, Homo sapiens
cugagaagcuccuguuggu

SEQ ID NO: 1073816 - RNA, 19 nt, Homo sapiens
caaagagaaacaacaugga

SEQ ID NO: 1073817 - RNA, 19 nt, Homo sapiens
gcucugggcacugacuuaa

SEQ ID NO: 1073818 - RNA, 19 nt, Homo sapiens
gagcaaggucuucauucau

SEQ ID NO: 1073819 - RNA, 19 nt, Homo sapiens
ccagagcaaggucuucauu

SEQ ID NO: 1073820 - RNA, 19 nt, Homo sapiens
ccugagaacguggaguuua

SEQ ID NO: 1073821 - RNA, 19 nt, Homo sapiens
agaaugagccagugagaag

SEQ ID NO: 1073822 - RNA, 19 nt, Homo sapiens
aggaggagcuacagaugau

SEQ ID NO: 1073823 - RNA, 19 nt, Homo sapiens
gguucucuauugccucuug

SEQ ID NO: 1073824 - RNA, 19 nt, Homo sapiens
caccaggacucccauccau

SEQ ID NO: 1073825 - RNA, 19 nt, Homo sapiens
gaggagcuacagaugauuc

SEQ ID NO: 1073826 - RNA, 19 nt, Homo sapiens
acaaaugcacucccaaagu

SEQ ID NO: 1073827 - RNA, 19 nt, Homo sapiens
ccuugagacugaccguaaa

SEQ ID NO: 1073828 - RNA, 19 nt, Homo sapiens
uuacugcgcugcuccucau

SEQ ID NO: 1073829 - RNA, 19 nt, Homo sapiens
ggccgagaauuaaucuaca

SEQ ID NO: 1073830 - RNA, 19 nt, Homo sapiens
gccuugagacugaccguaa

SEQ ID NO: 1073831 - RNA, 19 nt, Homo sapiens
aaacaugccaaaucuaaac

SEQ ID NO: 1073832 - RNA, 19 nt, Homo sapiens
ggaagcagaagaccugacu

SEQ ID NO: 1073833 - RNA, 19 nt, Homo sapiens
auacaaaugcacucccaaa

SEQ ID NO: 1073834 - RNA, 19 nt, Homo sapiens
gguccuuuccugcuucuga

SEQ ID NO: 1073835 - RNA, 19 nt, Homo sapiens
cuagaaggcgagaaacaug

SEQ ID NO: 1073836 - RNA, 19 nt, Homo sapiens
ucugcugccuccuuccuuu

SEQ ID NO: 1073837 - RNA, 19 nt, Homo sapiens
gcccugagaacguggaguu

SEQ ID NO: 1073838 - RNA, 19 nt, Homo sapiens
gaccaggccgagaauuaau

SEQ ID NO: 1073839 - RNA, 19 nt, Homo sapiens
uccaucgccuugagacuga

SEQ ID NO: 1073840 - RNA, 19 nt, Homo sapiens
caugccaaaucuaaacaca

SEQ ID NO: 1073841 - RNA, 19 nt, Homo sapiens
ccuccuuccuuuccugaga

SEQ ID NO: 1073842 - RNA, 19 nt, Homo sapiens
agagaaacaacauggacuu

SEQ ID NO: 1073843 - RNA, 19 nt, Homo sapiens
gaccugacucuccuuccuu

SEQ ID NO: 1073844 - RNA, 19 nt, Homo sapiens
cagacgcucuccagguucu

SEQ ID NO: 1073845 - RNA, 19 nt, Homo sapiens
cauacuacugugugaaguu

SEQ ID NO: 1073846 - RNA, 19 nt, Homo sapiens
caggguaacaacaguuuca

SEQ ID NO: 1073847 - RNA, 19 nt, Homo sapiens
cuucugaggucuccaaaau

SEQ ID NO: 1073848 - RNA, 19 nt, Homo sapiens
ugagagaaugagccaguga

SEQ ID NO: 1073849 - RNA, 19 nt, Homo sapiens
gagaacguggaguuuaagu

SEQ ID NO: 1073850 - RNA, 19 nt, Homo sapiens
ugaggaggagcuacagaug

SEQ ID NO: 1073851 - RNA, 19 nt, Homo sapiens
gugaggaggagcuacagau

SEQ ID NO: 1073852 - RNA, 19 nt, Homo sapiens
gagcaggggccaugggauu

SEQ ID NO: 1073853 - RNA, 19 nt, Homo sapiens
caaaggagaugaugauuca

SEQ ID NO: 1073854 - RNA, 19 nt, Homo sapiens
cauaauagguccugcauug

SEQ ID NO: 1073855 - RNA, 19 nt, Homo sapiens
gagaggagcugaugacaca

SEQ ID NO: 1073856 - RNA, 19 nt, Homo sapiens
gcaagggagucauccagua

SEQ ID NO: 1073857 - RNA, 19 nt, Homo sapiens
gaaaggaaagcuaaggaaa

SEQ ID NO: 1073858 - RNA, 19 nt, Homo sapiens
gauaaagaucucaagguua

SEQ ID NO: 1073859 - RNA, 19 nt, Homo sapiens
ugauaaagaucucaagguu

SEQ ID NO: 1073860 - RNA, 19 nt, Homo sapiens
caagagagaauaccauuug

SEQ ID NO: 1073861 - RNA, 19 nt, Homo sapiens
gaagaugaggauauuauug

SEQ ID NO: 1073862 - RNA, 19 nt, Homo sapiens
gaacuaaacaccagauuuu

SEQ ID NO: 1073863 - RNA, 19 nt, Homo sapiens
gagacuggcugagcaggua

SEQ ID NO: 1073864 - RNA, 19 nt, Homo sapiens
guucguggauagacucaua

SEQ ID NO: 1073865 - RNA, 19 nt, Homo sapiens
aaauaagccucaagagaga

SEQ ID NO: 1073866 - RNA, 19 nt, Homo sapiens
uaaacuuccuccagaaaug

SEQ ID NO: 1073867 - RNA, 19 nt, Homo sapiens
uaaggcugcugaagacaaa

SEQ ID NO: 1073868 - RNA, 19 nt, Homo sapiens
agaaggaaaucaagaaucu

SEQ ID NO: 1073869 - RNA, 19 nt, Homo sapiens
ggagucauccaguaagaaa

SEQ ID NO: 1073870 - RNA, 19 nt, Homo sapiens
ggaaaggaaagcuaaggaa

SEQ ID NO: 1073871 - RNA, 19 nt, Homo sapiens
gaagaaggaaaucaagaau

SEQ ID NO: 1073872 - RNA, 19 nt, Homo sapiens
cagaaucucuuauggacau

SEQ ID NO: 1073873 - RNA, 19 nt, Homo sapiens
ccaccugguuucauuaaau

SEQ ID NO: 1073874 - RNA, 19 nt, Homo sapiens
ggaaacagacagcagugaa

SEQ ID NO: 1073875 - RNA, 19 nt, Homo sapiens
gaacagcgaggacgaagag

SEQ ID NO: 1073876 - RNA, 19 nt, Homo sapiens
cggcaaaggcaauauguuu

SEQ ID NO: 1073877 - RNA, 19 nt, Homo sapiens
gcccagagaaugaaagaaa

SEQ ID NO: 1073878 - RNA, 19 nt, Homo sapiens
aaggaccaguuaacuauaa

SEQ ID NO: 1073879 - RNA, 19 nt, Homo sapiens
gaguaaggcugcugaagac

SEQ ID NO: 1073880 - RNA, 19 nt, Homo sapiens
gaucagaaucucuuaugga

SEQ ID NO: 1073881 - RNA, 19 nt, Homo sapiens
caagggagucauccaguaa

SEQ ID NO: 1073882 - RNA, 19 nt, Homo sapiens
gcagugaagaugaggauau

SEQ ID NO: 1073883 - RNA, 19 nt, Homo sapiens
gaaaucaagaaucugaaga

SEQ ID NO: 1073884 - RNA, 19 nt, Homo sapiens
cuaaacccauuguaagaga

SEQ ID NO: 1073885 - RNA, 19 nt, Homo sapiens
cgaagaaggaaaucaagaa

SEQ ID NO: 1073886 - RNA, 19 nt, Homo sapiens
guacgaagaaggaaaucaa

SEQ ID NO: 1073887 - RNA, 19 nt, Homo sapiens
agacagcgaugaagacagu

SEQ ID NO: 1073888 - RNA, 19 nt, Homo sapiens
cugagcagguaucuucaua

SEQ ID NO: 1073889 - RNA, 19 nt, Homo sapiens
ggaaagcuaaggaaacaca

SEQ ID NO: 1073890 - RNA, 19 nt, Homo sapiens
gacuaaacuuccuccagaa

SEQ ID NO: 1073891 - RNA, 19 nt, Homo sapiens
cagugaagaugaggauauu

SEQ ID NO: 1073892 - RNA, 19 nt, Homo sapiens
guaagaaagaugaagaaca

SEQ ID NO: 1073893 - RNA, 19 nt, Homo sapiens
aaggaaagcuaaggaaaca

SEQ ID NO: 1073894 - RNA, 19 nt, Homo sapiens
gugaagaugaggauauuau

SEQ ID NO: 1073895 - RNA, 19 nt, Homo sapiens
ucucaagguuaaucgguuu

SEQ ID NO: 1073896 - RNA, 19 nt, Homo sapiens
gaccaaaggagaugaugau

SEQ ID NO: 1073897 - RNA, 19 nt, Homo sapiens
gaaacagacagcagugaag

SEQ ID NO: 1073898 - RNA, 19 nt, Homo sapiens
gaagaugacagugguccaa

SEQ ID NO: 1073899 - RNA, 19 nt, Homo sapiens
guuaaucgguuugaugaag

SEQ ID NO: 1073900 - RNA, 19 nt, Homo sapiens
ugauucaucuaaacccauu

SEQ ID NO: 1073901 - RNA, 19 nt, Homo sapiens
ugacgaugaugaugaugau

SEQ ID NO: 1073902 - RNA, 19 nt, Homo sapiens
uaaggaaacacaagaagca

SEQ ID NO: 1073903 - RNA, 19 nt, Homo sapiens
gauagggaaaggaaagcua

SEQ ID NO: 1073904 - RNA, 19 nt, Homo sapiens
caaaaggaccaguuaacua

SEQ ID NO: 1073905 - RNA, 19 nt, Homo sapiens
aagagagaauaccauuuga

SEQ ID NO: 1073906 - RNA, 19 nt, Homo sapiens
ucauaucugugaccagugu

SEQ ID NO: 1073907 - RNA, 19 nt, Homo sapiens
ccaaaggagaugaugauuc

SEQ ID NO: 1073908 - RNA, 19 nt, Homo sapiens
ggguugacguucguggaua

SEQ ID NO: 1073909 - RNA, 19 nt, Homo sapiens
ggaaaucaagaaucugaag

SEQ ID NO: 1073910 - RNA, 19 nt, Homo sapiens
caucuaaacccauuguaag

SEQ ID NO: 1073911 - RNA, 19 nt, Homo sapiens
cagagaugauccaggacaa

SEQ ID NO: 1073912 - RNA, 19 nt, Homo sapiens
agaacuaaacaccagauuu

SEQ ID NO: 1073913 - RNA, 19 nt, Homo sapiens
agaguaaggcugcugaaga

SEQ ID NO: 1073914 - RNA, 19 nt, Homo sapiens
ccaguaagaaagaugaaga

SEQ ID NO: 1073915 - RNA, 19 nt, Homo sapiens
gccaaggacuuuuaagaga

SEQ ID NO: 1073916 - RNA, 19 nt, Homo sapiens
cauuugaccgugauaaaga

SEQ ID NO: 1073917 - RNA, 19 nt, Homo sapiens
guaaggcugcugaagacaa

SEQ ID NO: 1073918 - RNA, 19 nt, Homo sapiens
agacaguaguucuuuguac

SEQ ID NO: 1073919 - RNA, 19 nt, Homo sapiens
ucaucuaaacccauuguaa

SEQ ID NO: 1073920 - RNA, 19 nt, Homo sapiens
aaaggaccaguuaacuaua

SEQ ID NO: 1073921 - RNA, 19 nt, Homo sapiens
ugaugacgaugaugaugau

SEQ ID NO: 1073922 - RNA, 19 nt, Homo sapiens
gcaagaaaacagaggaaaa

SEQ ID NO: 1073923 - RNA, 19 nt, Homo sapiens
cuccagaaaugaaagacuu

SEQ ID NO: 1073924 - RNA, 19 nt, Homo sapiens
agacagcagugaagaugag

SEQ ID NO: 1073925 - RNA, 19 nt, Homo sapiens
ggacaacaggaaacagaca

SEQ ID NO: 1073926 - RNA, 19 nt, Homo sapiens
acugaucaaugugaacuuu

SEQ ID NO: 1073927 - RNA, 19 nt, Homo sapiens
ucaagagagaauaccauuu

SEQ ID NO: 1073928 - RNA, 19 nt, Homo sapiens
gggaaaggaaagcuaagga

SEQ ID NO: 1073929 - RNA, 19 nt, Homo sapiens
gacagauacuccagcugau

SEQ ID NO: 1073930 - RNA, 19 nt, Homo sapiens
aagcaguaguucagauuca

SEQ ID NO: 1073931 - RNA, 19 nt, Homo sapiens
aaggaaaucaagaaucuga

SEQ ID NO: 1073932 - RNA, 19 nt, Homo sapiens
ucacacggcaaaggcaaua

SEQ ID NO: 1073933 - RNA, 19 nt, Homo sapiens
aaacagacagcagugaaga

SEQ ID NO: 1073934 - RNA, 19 nt, Homo sapiens
gauccaggacaacaggaaa

SEQ ID NO: 1073935 - RNA, 19 nt, Homo sapiens
caccugguuucauuaaauc

SEQ ID NO: 1073936 - RNA, 19 nt, Homo sapiens
gagaacuaaacaccagauu

SEQ ID NO: 1073937 - RNA, 19 nt, Homo sapiens
acagauacuccagcugaua

SEQ ID NO: 1073938 - RNA, 19 nt, Homo sapiens
gaccaguuaacuauaaugu

SEQ ID NO: 1073939 - RNA, 19 nt, Homo sapiens
guaguucagauucaucaga

SEQ ID NO: 1073940 - RNA, 19 nt, Homo sapiens
gagaugauccaggacaaca

SEQ ID NO: 1073941 - RNA, 19 nt, Homo sapiens
ucaggaugaugacgaugau

SEQ ID NO: 1073942 - RNA, 19 nt, Homo sapiens
uggcugagcagguaucuuc

SEQ ID NO: 1073943 - RNA, 19 nt, Homo sapiens
gaaagcuaaggaaacacaa

SEQ ID NO: 1073944 - RNA, 19 nt, Homo sapiens
cagcugauagggaaaggaa

SEQ ID NO: 1073945 - RNA, 19 nt, Homo sapiens
caggacaacaggaaacaga

SEQ ID NO: 1073946 - RNA, 19 nt, Homo sapiens
gguugacguucguggauag

SEQ ID NO: 1073947 - RNA, 19 nt, Homo sapiens
aaacuuccuccagaaauga

SEQ ID NO: 1073948 - RNA, 19 nt, Homo sapiens
gccaccugguuucauuaaa

SEQ ID NO: 1073949 - RNA, 19 nt, Homo sapiens
caguaguucuuuguacgaa

SEQ ID NO: 1073950 - RNA, 19 nt, Homo sapiens
ggaacagcgaggacgaaga

SEQ ID NO: 1073951 - RNA, 19 nt, Homo sapiens
ccuccaaggcccauaauag

SEQ ID NO: 1073952 - RNA, 19 nt, Homo sapiens
agaugaggauauuauugga

SEQ ID NO: 1073953 - RNA, 19 nt, Homo sapiens
uaacuaggcuucuuaauug

SEQ ID NO: 1073954 - RNA, 19 nt, Homo sapiens
gcacaccacugagaaauua

SEQ ID NO: 1073955 - RNA, 19 nt, Homo sapiens
gaacauacuuugagaaaca

SEQ ID NO: 1073956 - RNA, 19 nt, Homo sapiens
gguccaaacucuucauuua

SEQ ID NO: 1073957 - RNA, 19 nt, Homo sapiens
ccacaugguucuauagaua

SEQ ID NO: 1073958 - RNA, 19 nt, Homo sapiens
guaaauaucuuaggcuuug

SEQ ID NO: 1073959 - RNA, 19 nt, Homo sapiens
gaacaaaggaagaauauuc

SEQ ID NO: 1073960 - RNA, 19 nt, Homo sapiens
ugagaaacauugacuauag

SEQ ID NO: 1073961 - RNA, 19 nt, Homo sapiens
gaacaacccauguauaucu

SEQ ID NO: 1073962 - RNA, 19 nt, Homo sapiens
aaccagagcaggauaauua

SEQ ID NO: 1073963 - RNA, 19 nt, Homo sapiens
gagaaacauugacuauaga

SEQ ID NO: 1073964 - RNA, 19 nt, Homo sapiens
uaaagcagcuacagacaau

SEQ ID NO: 1073965 - RNA, 19 nt, Homo sapiens
cagauaagcuuaggaaaca

SEQ ID NO: 1073966 - RNA, 19 nt, Homo sapiens
uagcaaaccuuucuguaau

SEQ ID NO: 1073967 - RNA, 19 nt, Homo sapiens
ggagacagggugagaauga

SEQ ID NO: 1073968 - RNA, 19 nt, Homo sapiens
gcccaucaguucccaaauu

SEQ ID NO: 1073969 - RNA, 19 nt, Homo sapiens
guaaagcaccaucuaauca

SEQ ID NO: 1073970 - RNA, 19 nt, Homo sapiens
cagaugaacaugacauuaa

SEQ ID NO: 1073971 - RNA, 19 nt, Homo sapiens
ccauguauaucuucuucua

SEQ ID NO: 1073972 - RNA, 19 nt, Homo sapiens
gcagaugaacaugacauua

SEQ ID NO: 1073973 - RNA, 19 nt, Homo sapiens
gaacauuacacacucugaa

SEQ ID NO: 1073974 - RNA, 19 nt, Homo sapiens
guaaugggcagauaguaaa

SEQ ID NO: 1073975 - RNA, 19 nt, Homo sapiens
aaacuaacuaggcuucuua

SEQ ID NO: 1073976 - RNA, 19 nt, Homo sapiens
uaacaagcacccuaaguga

SEQ ID NO: 1073977 - RNA, 19 nt, Homo sapiens
uagaacaacccauguauau

SEQ ID NO: 1073978 - RNA, 19 nt, Homo sapiens
ggcaaaaucuucagcagua

SEQ ID NO: 1073979 - RNA, 19 nt, Homo sapiens
cuaacuaggcuucuuaauu

SEQ ID NO: 1073980 - RNA, 19 nt, Homo sapiens
gaggaacaaaggaagaaua

SEQ ID NO: 1073981 - RNA, 19 nt, Homo sapiens
uuacagggcuccuuuaaaa

SEQ ID NO: 1073982 - RNA, 19 nt, Homo sapiens
gcacacagaacauuacaca

SEQ ID NO: 1073983 - RNA, 19 nt, Homo sapiens
cccaguggcucccaaauau

SEQ ID NO: 1073984 - RNA, 19 nt, Homo sapiens
ucaagcacaucagaaguuu

SEQ ID NO: 1073985 - RNA, 19 nt, Homo sapiens
agacuucccucaucagaau

SEQ ID NO: 1073986 - RNA, 19 nt, Homo sapiens
cuauuaacauccugaagaa

SEQ ID NO: 1073987 - RNA, 19 nt, Homo sapiens
cuacuucuuugcaugaauu

SEQ ID NO: 1073988 - RNA, 19 nt, Homo sapiens
caacuacuucuuugcauga

SEQ ID NO: 1073989 - RNA, 19 nt, Homo sapiens
cccaucaguucccaaauuu

SEQ ID NO: 1073990 - RNA, 19 nt, Homo sapiens
gagauucacugagcacaca

SEQ ID NO: 1073991 - RNA, 19 nt, Homo sapiens
caagcacccuaagugauuu

SEQ ID NO: 1073992 - RNA, 19 nt, Homo sapiens
aaagcaccaucuaaucaaa

SEQ ID NO: 1073993 - RNA, 19 nt, Homo sapiens
cuaggcuucuuaauuguuu

SEQ ID NO: 1073994 - RNA, 19 nt, Homo sapiens
caauuuaccucugcaacau

SEQ ID NO: 1073995 - RNA, 19 nt, Homo sapiens
caaagccuauggcacacaa

SEQ ID NO: 1073996 - RNA, 19 nt, Homo sapiens
acaacuguguuccaauaaa

SEQ ID NO: 1073997 - RNA, 19 nt, Homo sapiens
caacuguguuccaauaaac

SEQ ID NO: 1073998 - RNA, 19 nt, Homo sapiens
gcaccaguuccaugaauug

SEQ ID NO: 1073999 - RNA, 19 nt, Homo sapiens
ucuaguagcaucucugaaa

SEQ ID NO: 1074000 - RNA, 19 nt, Homo sapiens
gcccaguggcucccaaaua

SEQ ID NO: 1074001 - RNA, 19 nt, Homo sapiens
cagguacucgucacacuua

SEQ ID NO: 1074002 - RNA, 19 nt, Homo sapiens
uuaacauccugaagaacua

SEQ ID NO: 1074003 - RNA, 19 nt, Homo sapiens
gcaaaccuuucuguaaugg

SEQ ID NO: 1074004 - RNA, 19 nt, Homo sapiens
gcaguauggaaacagaaua

SEQ ID NO: 1074005 - RNA, 19 nt, Homo sapiens
caucaguucccaaauuuau

SEQ ID NO: 1074006 - RNA, 19 nt, Homo sapiens
uuagcaaaccuuucuguaa

SEQ ID NO: 1074007 - RNA, 19 nt, Homo sapiens
guccaaacucuucauuuaa

SEQ ID NO: 1074008 - RNA, 19 nt, Homo sapiens
acaagcacccuaagugauu

SEQ ID NO: 1074009 - RNA, 19 nt, Homo sapiens
gguaaagcaccaucuaauc

SEQ ID NO: 1074010 - RNA, 19 nt, Homo sapiens
ccacaggugcucuugcaaa

SEQ ID NO: 1074011 - RNA, 19 nt, Homo sapiens
caguggcucccaaauauaa

SEQ ID NO: 1074012 - RNA, 19 nt, Homo sapiens
ucacugagcacacagaaca

SEQ ID NO: 1074013 - RNA, 19 nt, Homo sapiens
ucucauccauucaucauag

SEQ ID NO: 1074014 - RNA, 19 nt, Homo sapiens
caacugggaaccacugaug

SEQ ID NO: 1074015 - RNA, 19 nt, Homo sapiens
uaaagcaccaucuaaucaa

SEQ ID NO: 1074016 - RNA, 19 nt, Homo sapiens
cuagaacaacccauguaua

SEQ ID NO: 1074017 - RNA, 19 nt, Homo sapiens
cuacagauaagcuuaggaa

SEQ ID NO: 1074018 - RNA, 19 nt, Homo sapiens
guacucgucacacuuauca

SEQ ID NO: 1074019 - RNA, 19 nt, Homo sapiens
cuacagacaauacgaugaa

SEQ ID NO: 1074020 - RNA, 19 nt, Homo sapiens
gcuagaacaacccauguau

SEQ ID NO: 1074021 - RNA, 19 nt, Homo sapiens
cucccuaacuuaauuaugu

SEQ ID NO: 1074022 - RNA, 19 nt, Homo sapiens
gaaauuaaucugguaaagc

SEQ ID NO: 1074023 - RNA, 19 nt, Homo sapiens
aacaguaugucucagauuc

SEQ ID NO: 1074024 - RNA, 19 nt, Homo sapiens
uguaaugggcagauaguaa

SEQ ID NO: 1074025 - RNA, 19 nt, Homo sapiens
gguuucaucuccuuauucu

SEQ ID NO: 1074026 - RNA, 19 nt, Homo sapiens
gaaacacugccuggucuau

SEQ ID NO: 1074027 - RNA, 19 nt, Homo sapiens
ccaguuccaugaauugucu

SEQ ID NO: 1074028 - RNA, 19 nt, Homo sapiens
uccaaacucuucauuuaag

SEQ ID NO: 1074029 - RNA, 19 nt, Homo sapiens
uagaugcuauuccagacuu

SEQ ID NO: 1074030 - RNA, 19 nt, Homo sapiens
cacaaucccucagccaguu

SEQ ID NO: 1074031 - RNA, 19 nt, Homo sapiens
cugagaaauuaaucuggua

SEQ ID NO: 1074032 - RNA, 19 nt, Homo sapiens
uaaaaccucuuggacaaaa

SEQ ID NO: 1074033 - RNA, 19 nt, Homo sapiens
gaggugcauucuccacugu

SEQ ID NO: 1074034 - RNA, 19 nt, Homo sapiens
cauuacacacucugaaauu

SEQ ID NO: 1074035 - RNA, 19 nt, Homo sapiens
uaugccacaugguucuaua

SEQ ID NO: 1074036 - RNA, 19 nt, Homo sapiens
ggaaacacugccuggucua

SEQ ID NO: 1074037 - RNA, 19 nt, Homo sapiens
gggaagaagaaucuacaga

SEQ ID NO: 1074038 - RNA, 19 nt, Homo sapiens
ggccacaggugcucuugca

SEQ ID NO: 1074039 - RNA, 19 nt, Homo sapiens
caguauggaaacagaauaa

SEQ ID NO: 1074040 - RNA, 19 nt, Homo sapiens
ccaguggcucccaaauaua

SEQ ID NO: 1074041 - RNA, 19 nt, Homo sapiens
guuucucccuaacuuaauu

SEQ ID NO: 1074042 - RNA, 19 nt, Homo sapiens
gcugccaacuacuucuuug

SEQ ID NO: 1074043 - RNA, 19 nt, Homo sapiens
uggaacauacuuugagaaa

SEQ ID NO: 1074044 - RNA, 19 nt, Homo sapiens
gggauuagcaaaccuuucu

SEQ ID NO: 1074045 - RNA, 19 nt, Homo sapiens
uuaguucgcccauauggaa

SEQ ID NO: 1074046 - RNA, 19 nt, Homo sapiens
gagcagggauuagcaaacc

SEQ ID NO: 1074047 - RNA, 19 nt, Homo sapiens
ggaacauacuuugagaaac

SEQ ID NO: 1074048 - RNA, 19 nt, Homo sapiens
gcaaaaucuucagcaguaa

SEQ ID NO: 1074049 - RNA, 19 nt, Homo sapiens
ggguauaugccacaugguu

SEQ ID NO: 1074050 - RNA, 19 nt, Homo sapiens
ggaacaaaggaagaauauu

SEQ ID NO: 1074051 - RNA, 19 nt, Homo sapiens
ucuauuaacauccugaaga

SEQ ID NO: 1074052 - RNA, 19 nt, Homo sapiens
gaagcaccaguuccaugaa

SEQ ID NO: 1074053 - RNA, 19 nt, Homo sapiens
gcaggaauaucaaauguua

SEQ ID NO: 1074054 - RNA, 19 nt, Homo sapiens
gaacugaauuucugacuga

SEQ ID NO: 1074055 - RNA, 19 nt, Homo sapiens
gugcaaagauuggcuauua

SEQ ID NO: 1074056 - RNA, 19 nt, Homo sapiens
ggaaauauguacaugagaa

SEQ ID NO: 1074057 - RNA, 19 nt, Homo sapiens
gcuauuaggauguucauua

SEQ ID NO: 1074058 - RNA, 19 nt, Homo sapiens
gaaacccugucucuacuaa

SEQ ID NO: 1074059 - RNA, 19 nt, Homo sapiens
gcacaaagaucagcaggau

SEQ ID NO: 1074060 - RNA, 19 nt, Homo sapiens
cuaaugagcuaaugaguca

SEQ ID NO: 1074061 - RNA, 19 nt, Homo sapiens
caacuggcauauuaaagaa

SEQ ID NO: 1074062 - RNA, 19 nt, Homo sapiens
caacuccacugguuaacuu

SEQ ID NO: 1074063 - RNA, 19 nt, Homo sapiens
ucccucaacuggcauauua

SEQ ID NO: 1074064 - RNA, 19 nt, Homo sapiens
gagguagacuggaucaaug

SEQ ID NO: 1074065 - RNA, 19 nt, Homo sapiens
gcuaaugagucaacaguuc

SEQ ID NO: 1074066 - RNA, 19 nt, Homo sapiens
uaaccaaggugaaaugaca

SEQ ID NO: 1074067 - RNA, 19 nt, Homo sapiens
agaaagagcugugauacug

SEQ ID NO: 1074068 - RNA, 19 nt, Homo sapiens
gugaaaccuuuaucucuuu

SEQ ID NO: 1074069 - RNA, 19 nt, Homo sapiens
caaagcacacauuuacaua

SEQ ID NO: 1074070 - RNA, 19 nt, Homo sapiens
ccaggcaccuugaccauga

SEQ ID NO: 1074071 - RNA, 19 nt, Homo sapiens
aaagaaauauggcacaaag

SEQ ID NO: 1074072 - RNA, 19 nt, Homo sapiens
gauuguauuucuucccuuu

SEQ ID NO: 1074073 - RNA, 19 nt, Homo sapiens
aaagauaggaagaaccuua

SEQ ID NO: 1074074 - RNA, 19 nt, Homo sapiens
gcacacauuuacauaccuu

SEQ ID NO: 1074075 - RNA, 19 nt, Homo sapiens
aaucacaacuguaugucua

SEQ ID NO: 1074076 - RNA, 19 nt, Homo sapiens
caaauguuauggauuguag

SEQ ID NO: 1074077 - RNA, 19 nt, Homo sapiens
aggaauaugugcaaagauu

SEQ ID NO: 1074078 - RNA, 19 nt, Homo sapiens
ccucuaaucucuaguucuu

SEQ ID NO: 1074079 - RNA, 19 nt, Homo sapiens
caucuauguucucucauuu

SEQ ID NO: 1074080 - RNA, 19 nt, Homo sapiens
ggcagugucugggauuaua

SEQ ID NO: 1074081 - RNA, 19 nt, Homo sapiens
aaagcaauguggacucaaa

SEQ ID NO: 1074082 - RNA, 19 nt, Homo sapiens
gggaaaaugugauaacuga

SEQ ID NO: 1074083 - RNA, 19 nt, Homo sapiens
ugaaggacauacagguaaa

SEQ ID NO: 1074084 - RNA, 19 nt, Homo sapiens
gaaagagcugugauacuga

SEQ ID NO: 1074085 - RNA, 19 nt, Homo sapiens
gaagggaugcaagucauuu

SEQ ID NO: 1074086 - RNA, 19 nt, Homo sapiens
ucacccacccucuuuauuu

SEQ ID NO: 1074087 - RNA, 19 nt, Homo sapiens
ucacaacuguaugucuaua

SEQ ID NO: 1074088 - RNA, 19 nt, Homo sapiens
ggacauacagguaaaauga

SEQ ID NO: 1074089 - RNA, 19 nt, Homo sapiens
gagaaucacaacuguaugu

SEQ ID NO: 1074090 - RNA, 19 nt, Homo sapiens
ucacacuucuucuuucuca

SEQ ID NO: 1074091 - RNA, 19 nt, Homo sapiens
agagcuaccuauuggcaua

SEQ ID NO: 1074092 - RNA, 19 nt, Homo sapiens
caacagugcuuuucagugu

SEQ ID NO: 1074093 - RNA, 19 nt, Homo sapiens
ggacagcaaagcuccaaga

SEQ ID NO: 1074094 - RNA, 19 nt, Homo sapiens
ucaacuggcauauuaaaga

SEQ ID NO: 1074095 - RNA, 19 nt, Homo sapiens
ugugaaaccuuuaucucuu

SEQ ID NO: 1074096 - RNA, 19 nt, Homo sapiens
gauguucauuacaguguug

SEQ ID NO: 1074097 - RNA, 19 nt, Homo sapiens
gagccagacuccaucucaa

SEQ ID NO: 1074098 - RNA, 19 nt, Homo sapiens
gacaguuuguguuuggaaa

SEQ ID NO: 1074099 - RNA, 19 nt, Homo sapiens
gaaauauggcacaaagauc

SEQ ID NO: 1074100 - RNA, 19 nt, Homo sapiens
caugguggcucaagcuugu

SEQ ID NO: 1074101 - RNA, 19 nt, Homo sapiens
cuaaugcaauaaugggaaa

SEQ ID NO: 1074102 - RNA, 19 nt, Homo sapiens
ggaauaugugcaaagauug

SEQ ID NO: 1074103 - RNA, 19 nt, Homo sapiens
ggacauccuaaugcaauaa

SEQ ID NO: 1074104 - RNA, 19 nt, Homo sapiens
ugaauuaaccaaggugaaa

SEQ ID NO: 1074105 - RNA, 19 nt, Homo sapiens
ccaaagacggagagaaguu

SEQ ID NO: 1074106 - RNA, 19 nt, Homo sapiens
gauuguagaucgugaaaau

SEQ ID NO: 1074107 - RNA, 19 nt, Homo sapiens
agacucacacuucuucuuu

SEQ ID NO: 1074108 - RNA, 19 nt, Homo sapiens
gaaauaugacccugagcau

SEQ ID NO: 1074109 - RNA, 19 nt, Homo sapiens
ggugaaacccugucucuac

SEQ ID NO: 1074110 - RNA, 19 nt, Homo sapiens
uuaggaauaugugcaaaga

SEQ ID NO: 1074111 - RNA, 19 nt, Homo sapiens
gaucacaaggucaggaaau

SEQ ID NO: 1074112 - RNA, 19 nt, Homo sapiens
ccaaggagggaacauguau

SEQ ID NO: 1074113 - RNA, 19 nt, Homo sapiens
aaucaaagcacacauuuac

SEQ ID NO: 1074114 - RNA, 19 nt, Homo sapiens
aaauauggcacaaagauca

SEQ ID NO: 1074115 - RNA, 19 nt, Homo sapiens
gcaagucauuuuauccauu

SEQ ID NO: 1074116 - RNA, 19 nt, Homo sapiens
gaugaagggaugcaaguca

SEQ ID NO: 1074117 - RNA, 19 nt, Homo sapiens
uaagcgauacuccagauga

SEQ ID NO: 1074118 - RNA, 19 nt, Homo sapiens
ggauguucauuacaguguu

SEQ ID NO: 1074119 - RNA, 19 nt, Homo sapiens
gcaggagaauggcgugaac

SEQ ID NO: 1074120 - RNA, 19 nt, Homo sapiens
gcugugauacugagagcua

SEQ ID NO: 1074121 - RNA, 19 nt, Homo sapiens
gcacuugcaggaauaucaa

SEQ ID NO: 1074122 - RNA, 19 nt, Homo sapiens
agaaagcaauguggacuca

SEQ ID NO: 1074123 - RNA, 19 nt, Homo sapiens
gcaaagauuggcuauuagg

SEQ ID NO: 1074124 - RNA, 19 nt, Homo sapiens
agaaauauggcacaaagau

SEQ ID NO: 1074125 - RNA, 19 nt, Homo sapiens
ugacagagccagacuccau

SEQ ID NO: 1074126 - RNA, 19 nt, Homo sapiens
aagagaaagagcugugaua

SEQ ID NO: 1074127 - RNA, 19 nt, Homo sapiens
ucaaagcacacauuuacau

SEQ ID NO: 1074128 - RNA, 19 nt, Homo sapiens
gggauuauaggugauugua

SEQ ID NO: 1074129 - RNA, 19 nt, Homo sapiens
ugaaaccuuuaucucuuug

SEQ ID NO: 1074130 - RNA, 19 nt, Homo sapiens
gugacagagucguggguaa

SEQ ID NO: 1074131 - RNA, 19 nt, Homo sapiens
ucgagaccauccuggcuaa

SEQ ID NO: 1074132 - RNA, 19 nt, Homo sapiens
uggaauaccuguuuucuuc

SEQ ID NO: 1074133 - RNA, 19 nt, Homo sapiens
gagcuaaugagucaacagu

SEQ ID NO: 1074134 - RNA, 19 nt, Homo sapiens
cacccacccucuuuauuuc

SEQ ID NO: 1074135 - RNA, 19 nt, Homo sapiens
gaauaugugcaaagauugg

SEQ ID NO: 1074136 - RNA, 19 nt, Homo sapiens
uauguuaucccucuaaucu

SEQ ID NO: 1074137 - RNA, 19 nt, Homo sapiens
gugggaggauggacacuca

SEQ ID NO: 1074138 - RNA, 19 nt, Homo sapiens
gugaaacccugucucuacu

SEQ ID NO: 1074139 - RNA, 19 nt, Homo sapiens
acugagagcuaccuauugg

SEQ ID NO: 1074140 - RNA, 19 nt, Homo sapiens
gaauuaaccaaggugaaau

SEQ ID NO: 1074141 - RNA, 19 nt, Homo sapiens
ucuauguucucucauuugu

SEQ ID NO: 1074142 - RNA, 19 nt, Homo sapiens
gauuggcuauuaggauguu

SEQ ID NO: 1074143 - RNA, 19 nt, Homo sapiens
gaucaaugugggucagcua

SEQ ID NO: 1074144 - RNA, 19 nt, Homo sapiens
auacuguggugauuauuag

SEQ ID NO: 1074145 - RNA, 19 nt, Homo sapiens
cuauuaggauguucauuac

SEQ ID NO: 1074146 - RNA, 19 nt, Homo sapiens
gagaaagagcugugauacu

SEQ ID NO: 1074147 - RNA, 19 nt, Homo sapiens
caagucauuuuauccauug

SEQ ID NO: 1074148 - RNA, 19 nt, Homo sapiens
caaagauuggcuauuagga

SEQ ID NO: 1074149 - RNA, 19 nt, Homo sapiens
cgugaaaauuacacacuua

SEQ ID NO: 1074150 - RNA, 19 nt, Homo sapiens
gccaaggagggaacaugua

SEQ ID NO: 1074151 - RNA, 19 nt, Homo sapiens
guggcagugucugggauua

SEQ ID NO: 1074152 - RNA, 19 nt, Homo sapiens
gagcauggaaauauguaca

SEQ ID NO: 1074153 - RNA, 19 nt, Homo sapiens
ggaacgugcucuucacauu

SEQ ID NO: 1074154 - RNA, 19 nt, Homo sapiens
ggcuauagaugaaucagua

SEQ ID NO: 1074155 - RNA, 19 nt, Homo sapiens
aauaguaccuuccucauug

SEQ ID NO: 1074156 - RNA, 19 nt, Homo sapiens
ggucagcccuauccaguau

SEQ ID NO: 1074157 - RNA, 19 nt, Homo sapiens
gcucuucacauucaauaua

SEQ ID NO: 1074158 - RNA, 19 nt, Homo sapiens
gcaaguaguaaguuauuug

SEQ ID NO: 1074159 - RNA, 19 nt, Homo sapiens
gaagggcuauagaugaauc

SEQ ID NO: 1074160 - RNA, 19 nt, Homo sapiens
gaugacaaccuccacugua

SEQ ID NO: 1074161 - RNA, 19 nt, Homo sapiens
caguaucccugguaaguau

SEQ ID NO: 1074162 - RNA, 19 nt, Homo sapiens
guaccuuccucauuggauu

SEQ ID NO: 1074163 - RNA, 19 nt, Homo sapiens
gaacgugcucuucacauuc

SEQ ID NO: 1074164 - RNA, 19 nt, Homo sapiens
ucacagcccuuuccugcau

SEQ ID NO: 1074165 - RNA, 19 nt, Homo sapiens
gaugaaucaguauguguaa

SEQ ID NO: 1074166 - RNA, 19 nt, Homo sapiens
guaucugucugucuauuag

SEQ ID NO: 1074167 - RNA, 19 nt, Homo sapiens
uugaagggcuauagaugaa

SEQ ID NO: 1074168 - RNA, 19 nt, Homo sapiens
ggcaaguaguaaguuauuu

SEQ ID NO: 1074169 - RNA, 19 nt, Homo sapiens
guugaagggcuauagauga

SEQ ID NO: 1074170 - RNA, 19 nt, Homo sapiens
ccuguuuccuccucaguaa

SEQ ID NO: 1074171 - RNA, 19 nt, Homo sapiens
uccauuuccuugucuguaa

SEQ ID NO: 1074172 - RNA, 19 nt, Homo sapiens
ccacuuacuagcuauguga

SEQ ID NO: 1074173 - RNA, 19 nt, Homo sapiens
gagccaggauaccaaacug

SEQ ID NO: 1074174 - RNA, 19 nt, Homo sapiens
gacugaagcaggaggauug

SEQ ID NO: 1074175 - RNA, 19 nt, Homo sapiens
gcacccucuucaucaggua

SEQ ID NO: 1074176 - RNA, 19 nt, Homo sapiens
gaggugggaggaucucuug

SEQ ID NO: 1074177 - RNA, 19 nt, Homo sapiens
aaauaguaccuuccucauu

SEQ ID NO: 1074178 - RNA, 19 nt, Homo sapiens
cauugccacuuacuagcua

SEQ ID NO: 1074179 - RNA, 19 nt, Homo sapiens
ggggaaggaucgugauuga

SEQ ID NO: 1074180 - RNA, 19 nt, Homo sapiens
ccauuuccuugucuguaaa

SEQ ID NO: 1074181 - RNA, 19 nt, Homo sapiens
aguaggugcuuauccaugu

SEQ ID NO: 1074182 - RNA, 19 nt, Homo sapiens
cauagagguucuuuucaaa

SEQ ID NO: 1074183 - RNA, 19 nt, Homo sapiens
agaugaaucaguaugugua

SEQ ID NO: 1074184 - RNA, 19 nt, Homo sapiens
gcucccaucuccagaacag

SEQ ID NO: 1074185 - RNA, 19 nt, Homo sapiens
cagccugggcaacauagua

SEQ ID NO: 1074186 - RNA, 19 nt, Homo sapiens
caucuuaguaggugcuuau

SEQ ID NO: 1074187 - RNA, 19 nt, Homo sapiens
cuguguaucugucugucua

SEQ ID NO: 1074188 - RNA, 19 nt, Homo sapiens
uguaucugucugucuauua

SEQ ID NO: 1074189 - RNA, 19 nt, Homo sapiens
gcaucuuaguaggugcuua

SEQ ID NO: 1074190 - RNA, 19 nt, Homo sapiens
ggaugacaaccuccacugu

SEQ ID NO: 1074191 - RNA, 19 nt, Homo sapiens
ccucguuccugggucagua

SEQ ID NO: 1074192 - RNA, 19 nt, Homo sapiens
cuuaguaggugcuuaucca

SEQ ID NO: 1074193 - RNA, 19 nt, Homo sapiens
ucaaaggggcaucuuagua

SEQ ID NO: 1074194 - RNA, 19 nt, Homo sapiens
aacgugcucuucacauuca

SEQ ID NO: 1074195 - RNA, 19 nt, Homo sapiens
gcaacaugguguccccaaa

SEQ ID NO: 1074196 - RNA, 19 nt, Homo sapiens
uggcaaguaguaaguuauu

SEQ ID NO: 1074197 - RNA, 19 nt, Homo sapiens
guaggugcuuauccaugug

SEQ ID NO: 1074198 - RNA, 19 nt, Homo sapiens
gugcucuucacauucaaua

SEQ ID NO: 1074199 - RNA, 19 nt, Homo sapiens
cacagcccuuuccugcaua

SEQ ID NO: 1074200 - RNA, 19 nt, Homo sapiens
gcauuugagccuggcauug

SEQ ID NO: 1074201 - RNA, 19 nt, Homo sapiens
acauagagguucuuuucaa

SEQ ID NO: 1074202 - RNA, 19 nt, Homo sapiens
ucacauagagguucuuuuc

SEQ ID NO: 1074203 - RNA, 19 nt, Homo sapiens
uuucugagcuccuguuucc

SEQ ID NO: 1074204 - RNA, 19 nt, Homo sapiens
uugagugguuggcugugua

SEQ ID NO: 1074205 - RNA, 19 nt, Homo sapiens
acacuuagaaaggaacuug

SEQ ID NO: 1074206 - RNA, 19 nt, Homo sapiens
gggccuccauuuccuuguc

SEQ ID NO: 1074207 - RNA, 19 nt, Homo sapiens
caaaggggcaucuuaguag

SEQ ID NO: 1074208 - RNA, 19 nt, Homo sapiens
auauccaggucuugcauug

SEQ ID NO: 1074209 - RNA, 19 nt, Homo sapiens
uucaauauauccaggucuu

SEQ ID NO: 1074210 - RNA, 19 nt, Homo sapiens
guguaucugucugucuauu

SEQ ID NO: 1074211 - RNA, 19 nt, Homo sapiens
gugguuggcuguguaucug

SEQ ID NO: 1074212 - RNA, 19 nt, Homo sapiens
caacaugguguccccaaaa

SEQ ID NO: 1074213 - RNA, 19 nt, Homo sapiens
cugcaggccucggucauca

SEQ ID NO: 1074214 - RNA, 19 nt, Homo sapiens
augacaaccuccacuguag

SEQ ID NO: 1074215 - RNA, 19 nt, Homo sapiens
ggcaugagugggcaacaga

SEQ ID NO: 1074216 - RNA, 19 nt, Homo sapiens
caaacuggaacgugcucuu

SEQ ID NO: 1074217 - RNA, 19 nt, Homo sapiens
gcuccagcccauucugaga

SEQ ID NO: 1074218 - RNA, 19 nt, Homo sapiens
auagaugaaucaguaugug

SEQ ID NO: 1074219 - RNA, 19 nt, Homo sapiens
ucaguccucccaugagaug

SEQ ID NO: 1074220 - RNA, 19 nt, Homo sapiens
guuccugaguugucucucu

SEQ ID NO: 1074221 - RNA, 19 nt, Homo sapiens
acaaauaacugcagacauu

SEQ ID NO: 1074222 - RNA, 19 nt, Homo sapiens
agaagaaucugauggcuaa

SEQ ID NO: 1074223 - RNA, 19 nt, Homo sapiens
caaccaauuucuccaauga

SEQ ID NO: 1074224 - RNA, 19 nt, Homo sapiens
acaggaagguaguaacuua

SEQ ID NO: 1074225 - RNA, 19 nt, Homo sapiens
ggacaagucauuauaccua

SEQ ID NO: 1074226 - RNA, 19 nt, Homo sapiens
ugacauauaggcacaaaua

SEQ ID NO: 1074227 - RNA, 19 nt, Homo sapiens
uagcaucuaucucagguua

SEQ ID NO: 1074228 - RNA, 19 nt, Homo sapiens
ggccucagcuuccagagua

SEQ ID NO: 1074229 - RNA, 19 nt, Homo sapiens
gaacggaaagcauucagaa

SEQ ID NO: 1074230 - RNA, 19 nt, Homo sapiens
gaauucaguuuaccaaagu

SEQ ID NO: 1074231 - RNA, 19 nt, Homo sapiens
guaaacuugugaacuacua

SEQ ID NO: 1074232 - RNA, 19 nt, Homo sapiens
guaccggauuuaaagcuua

SEQ ID NO: 1074233 - RNA, 19 nt, Homo sapiens
gacaagucauuauaccuaa

SEQ ID NO: 1074234 - RNA, 19 nt, Homo sapiens
ggaagguaguaacuuagaa

SEQ ID NO: 1074235 - RNA, 19 nt, Homo sapiens
gcaucuaucucagguuauu

SEQ ID NO: 1074236 - RNA, 19 nt, Homo sapiens
gaggauaaggcacggguua

SEQ ID NO: 1074237 - RNA, 19 nt, Homo sapiens
gaagguaguaacuuagaaa

SEQ ID NO: 1074238 - RNA, 19 nt, Homo sapiens
gcaaacaggcugaaagagu

SEQ ID NO: 1074239 - RNA, 19 nt, Homo sapiens
gcccugaaauucuaguaaa

SEQ ID NO: 1074240 - RNA, 19 nt, Homo sapiens
gguggaaagucuuaucaug

SEQ ID NO: 1074241 - RNA, 19 nt, Homo sapiens
ccacguugcuuucucugaa

SEQ ID NO: 1074242 - RNA, 19 nt, Homo sapiens
cagaguaguuaaauggaaa

SEQ ID NO: 1074243 - RNA, 19 nt, Homo sapiens
gugcagguauuagucauuu

SEQ ID NO: 1074244 - RNA, 19 nt, Homo sapiens
aaacaguaccggauuuaaa

SEQ ID NO: 1074245 - RNA, 19 nt, Homo sapiens
ggauuacuuucccauucua

SEQ ID NO: 1074246 - RNA, 19 nt, Homo sapiens
ccaacaaccuaaucuacau

SEQ ID NO: 1074247 - RNA, 19 nt, Homo sapiens
auaaggcccugaaauucua

SEQ ID NO: 1074248 - RNA, 19 nt, Homo sapiens
gaaccaaagcacagacgaa

SEQ ID NO: 1074249 - RNA, 19 nt, Homo sapiens
caacaaccuaaucuacaua

SEQ ID NO: 1074250 - RNA, 19 nt, Homo sapiens
ccagaguaguuaaauggaa

SEQ ID NO: 1074251 - RNA, 19 nt, Homo sapiens
gcacaaugaugaaaacaau

SEQ ID NO: 1074252 - RNA, 19 nt, Homo sapiens
ccgagaacauaaugaaaug

SEQ ID NO: 1074253 - RNA, 19 nt, Homo sapiens
ccaaagcacagacgaaugu

SEQ ID NO: 1074254 - RNA, 19 nt, Homo sapiens
gguaguaacuuagaaagac

SEQ ID NO: 1074255 - RNA, 19 nt, Homo sapiens
aagcuuagcacaaugauga

SEQ ID NO: 1074256 - RNA, 19 nt, Homo sapiens
guggaaagucuuaucauga

SEQ ID NO: 1074257 - RNA, 19 nt, Homo sapiens
gcaaucagacuuagagaac

SEQ ID NO: 1074258 - RNA, 19 nt, Homo sapiens
uaagcuagaguucaguuaa

SEQ ID NO: 1074259 - RNA, 19 nt, Homo sapiens
gauaaggcacggguuacua

SEQ ID NO: 1074260 - RNA, 19 nt, Homo sapiens
caguuaagcuuagcacaau

SEQ ID NO: 1074261 - RNA, 19 nt, Homo sapiens
ggauauguaauaacagcua

SEQ ID NO: 1074262 - RNA, 19 nt, Homo sapiens
ugacuacuccauauucauu

SEQ ID NO: 1074263 - RNA, 19 nt, Homo sapiens
ccaggcaggugaugugaca

SEQ ID NO: 1074264 - RNA, 19 nt, Homo sapiens
gccugggucuuuaagcuuu

SEQ ID NO: 1074265 - RNA, 19 nt, Homo sapiens
agaaucugauggcuaaaug

SEQ ID NO: 1074266 - RNA, 19 nt, Homo sapiens
agaauucaguuuaccaaag

SEQ ID NO: 1074267 - RNA, 19 nt, Homo sapiens
gcacaaauaacugcagaca

SEQ ID NO: 1074268 - RNA, 19 nt, Homo sapiens
gacauauaggcacaaauaa

SEQ ID NO: 1074269 - RNA, 19 nt, Homo sapiens
guaagcuagaguucaguua

SEQ ID NO: 1074270 - RNA, 19 nt, Homo sapiens
ccaaugacuacuccauauu

SEQ ID NO: 1074271 - RNA, 19 nt, Homo sapiens
ccucggacaagucauuaua

SEQ ID NO: 1074272 - RNA, 19 nt, Homo sapiens
cuugugaacuacuacuaaa

SEQ ID NO: 1074273 - RNA, 19 nt, Homo sapiens
ggauuuaaagcuuacacaa

SEQ ID NO: 1074274 - RNA, 19 nt, Homo sapiens
uccaaugacuacuccauau

SEQ ID NO: 1074275 - RNA, 19 nt, Homo sapiens
caaugacuacuccauauuc

SEQ ID NO: 1074276 - RNA, 19 nt, Homo sapiens
gcagguauuagucauuuag

SEQ ID NO: 1074277 - RNA, 19 nt, Homo sapiens
ucucuguagucacucauuu

SEQ ID NO: 1074278 - RNA, 19 nt, Homo sapiens
ggaggcauuuggcauucug

SEQ ID NO: 1074279 - RNA, 19 nt, Homo sapiens
ucaaccaauuucuccaaug

SEQ ID NO: 1074280 - RNA, 19 nt, Homo sapiens
cauaaggcccugaaauucu

SEQ ID NO: 1074281 - RNA, 19 nt, Homo sapiens
caucauaaggcccugaaau

SEQ ID NO: 1074282 - RNA, 19 nt, Homo sapiens
gcagugcagguauuaguca

SEQ ID NO: 1074283 - RNA, 19 nt, Homo sapiens
ucauaaggcccugaaauuc

SEQ ID NO: 1074284 - RNA, 19 nt, Homo sapiens
acacacacguuagggucua

SEQ ID NO: 1074285 - RNA, 19 nt, Homo sapiens
gcucaucccagucugaauc

SEQ ID NO: 1074286 - RNA, 19 nt, Homo sapiens
cauauaggcacaaauaacu

SEQ ID NO: 1074287 - RNA, 19 nt, Homo sapiens
uuacuggacccuaaacaug

SEQ ID NO: 1074288 - RNA, 19 nt, Homo sapiens
guaguaacuuagaaagacu

SEQ ID NO: 1074289 - RNA, 19 nt, Homo sapiens
guuaagcuuagcacaauga

SEQ ID NO: 1074290 - RNA, 19 nt, Homo sapiens
uggaaagucuuaucaugac

SEQ ID NO: 1074291 - RNA, 19 nt, Homo sapiens
gaacuguggacgguggaaa

SEQ ID NO: 1074292 - RNA, 19 nt, Homo sapiens
gcacggguuacuacaggaa

SEQ ID NO: 1074293 - RNA, 19 nt, Homo sapiens
ucaguuaagcuuagcacaa

SEQ ID NO: 1074294 - RNA, 19 nt, Homo sapiens
cauuuggcauucuguggaa

SEQ ID NO: 1074295 - RNA, 19 nt, Homo sapiens
aaucagacuuagagaacug

SEQ ID NO: 1074296 - RNA, 19 nt, Homo sapiens
gguccaacaaccuaaucua

SEQ ID NO: 1074297 - RNA, 19 nt, Homo sapiens
aaacugccugggucuuuaa

SEQ ID NO: 1074298 - RNA, 19 nt, Homo sapiens
agaguucaguuaagcuuag

SEQ ID NO: 1074299 - RNA, 19 nt, Homo sapiens
caaauaacugcagacauuc

SEQ ID NO: 1074300 - RNA, 19 nt, Homo sapiens
aaugacuacuccauauuca

SEQ ID NO: 1074301 - RNA, 19 nt, Homo sapiens
gcugcaauuggauauguaa

SEQ ID NO: 1074302 - RNA, 19 nt, Homo sapiens
ggcugcaauuggauaugua

SEQ ID NO: 1074303 - RNA, 19 nt, Homo sapiens
gugcgcagugcagguauua

SEQ ID NO: 1074304 - RNA, 19 nt, Homo sapiens
ggugcgcagugcagguauu

SEQ ID NO: 1074305 - RNA, 19 nt, Homo sapiens
aaaacugccugggucuuua

SEQ ID NO: 1074306 - RNA, 19 nt, Homo sapiens
ugcaaagaauucaaccaau

SEQ ID NO: 1074307 - RNA, 19 nt, Homo sapiens
aagcuagaguucaguuaag

SEQ ID NO: 1074308 - RNA, 19 nt, Homo sapiens
cccauucuaucaccacguu

SEQ ID NO: 1074309 - RNA, 19 nt, Homo sapiens
ccagaggagcgcacaguca

SEQ ID NO: 1074310 - RNA, 19 nt, Homo sapiens
gcgcagugcagguauuagu

SEQ ID NO: 1074311 - RNA, 19 nt, Homo sapiens
uagaguucaguuaagcuua

SEQ ID NO: 1074312 - RNA, 19 nt, Homo sapiens
ucaccacguugcuuucucu

SEQ ID NO: 1074313 - RNA, 19 nt, Homo sapiens
gauuuaaagcuuacacaac

SEQ ID NO: 1074314 - RNA, 19 nt, Homo sapiens
cugcaaagaauucaaccaa

SEQ ID NO: 1074315 - RNA, 19 nt, Homo sapiens
ccaauuucuccaaugacua

SEQ ID NO: 1074316 - RNA, 19 nt, Homo sapiens
ucaccucggacaagucauu

SEQ ID NO: 1074317 - RNA, 19 nt, Homo sapiens
agauggaaaugaucaacca

SEQ ID NO: 1074318 - RNA, 19 nt, Homo sapiens
gacgauuccuccgagaaca

SEQ ID NO: 1074319 - RNA, 19 nt, Homo sapiens
cagaauucaguuuaccaaa

SEQ ID NO: 1074320 - RNA, 19 nt, Homo sapiens
uaggaggcauuuggcauuc

SEQ ID NO: 1074321 - RNA, 19 nt, Homo sapiens
gauaggaucugaauugaua

SEQ ID NO: 1074322 - RNA, 19 nt, Homo sapiens
gaagagaaguuaagacuag

SEQ ID NO: 1074323 - RNA, 19 nt, Homo sapiens
gaaagcaguugugauuuaa

SEQ ID NO: 1074324 - RNA, 19 nt, Homo sapiens
gcaaugacaucuguaguuu

SEQ ID NO: 1074325 - RNA, 19 nt, Homo sapiens
gaacauauucucugcauga

SEQ ID NO: 1074326 - RNA, 19 nt, Homo sapiens
agaaagcaguugugauuua

SEQ ID NO: 1074327 - RNA, 19 nt, Homo sapiens
ggaagaaauuguugaccua

SEQ ID NO: 1074328 - RNA, 19 nt, Homo sapiens
cauauucucugcaugauuu

SEQ ID NO: 1074329 - RNA, 19 nt, Homo sapiens
gaagaaggaaugaauagaa

SEQ ID NO: 1074330 - RNA, 19 nt, Homo sapiens
ucuaagaaaugcugaagua

SEQ ID NO: 1074331 - RNA, 19 nt, Homo sapiens
gggcagcacuuaaguauag

SEQ ID NO: 1074332 - RNA, 19 nt, Homo sapiens
ucauguggcucuuucaaua

SEQ ID NO: 1074333 - RNA, 19 nt, Homo sapiens
aaauaacccuucagaguuu

SEQ ID NO: 1074334 - RNA, 19 nt, Homo sapiens
caacuagaauguauaagug

SEQ ID NO: 1074335 - RNA, 19 nt, Homo sapiens
cgaaauggaugauaaugga

SEQ ID NO: 1074336 - RNA, 19 nt, Homo sapiens
uaugguagauuuccacuuu

SEQ ID NO: 1074337 - RNA, 19 nt, Homo sapiens
gaugauaggaucugaauug

SEQ ID NO: 1074338 - RNA, 19 nt, Homo sapiens
caagaagacuggaaguaau

SEQ ID NO: 1074339 - RNA, 19 nt, Homo sapiens
caagaaaggcagagaauug

SEQ ID NO: 1074340 - RNA, 19 nt, Homo sapiens
gcacuuaaguauagcaaca

SEQ ID NO: 1074341 - RNA, 19 nt, Homo sapiens
gaaguuaagacuagaagaa

SEQ ID NO: 1074342 - RNA, 19 nt, Homo sapiens
uaaugguccugucauguua

SEQ ID NO: 1074343 - RNA, 19 nt, Homo sapiens
gaaauaugaagucacagua

SEQ ID NO: 1074344 - RNA, 19 nt, Homo sapiens
uaagggagauguguaagaa

SEQ ID NO: 1074345 - RNA, 19 nt, Homo sapiens
guaguagacucucaucaga

SEQ ID NO: 1074346 - RNA, 19 nt, Homo sapiens
gagaaaggcauuaugauuc

SEQ ID NO: 1074347 - RNA, 19 nt, Homo sapiens
caauagaguuugagaaucu

SEQ ID NO: 1074348 - RNA, 19 nt, Homo sapiens
ggugagcacuugacaauag

SEQ ID NO: 1074349 - RNA, 19 nt, Homo sapiens
gaaggaaugguaacaaaug

SEQ ID NO: 1074350 - RNA, 19 nt, Homo sapiens
gaagguccagauauaaaua

SEQ ID NO: 1074351 - RNA, 19 nt, Homo sapiens
auaggaagguccagauaua

SEQ ID NO: 1074352 - RNA, 19 nt, Homo sapiens
gccacuauauugacuuuaa

SEQ ID NO: 1074353 - RNA, 19 nt, Homo sapiens
agacucagauuuagaauag

SEQ ID NO: 1074354 - RNA, 19 nt, Homo sapiens
cgaguauucuggauuugua

SEQ ID NO: 1074355 - RNA, 19 nt, Homo sapiens
uaagagaaaggcauuauga

SEQ ID NO: 1074356 - RNA, 19 nt, Homo sapiens
gcacuugacaauagaguuu

SEQ ID NO: 1074357 - RNA, 19 nt, Homo sapiens
ggcauaagcuacgauugua

SEQ ID NO: 1074358 - RNA, 19 nt, Homo sapiens
gacggugcauguucuuaua

SEQ ID NO: 1074359 - RNA, 19 nt, Homo sapiens
gcuaagcaaugacaucugu

SEQ ID NO: 1074360 - RNA, 19 nt, Homo sapiens
ggaaugguaacaaauggua

SEQ ID NO: 1074361 - RNA, 19 nt, Homo sapiens
cauaauugcuuuccuugau

SEQ ID NO: 1074362 - RNA, 19 nt, Homo sapiens
ccugucauguuacugauua

SEQ ID NO: 1074363 - RNA, 19 nt, Homo sapiens
ugaccuuguuuaucaguua

SEQ ID NO: 1074364 - RNA, 19 nt, Homo sapiens
gaugaagaaggaaugaaua

SEQ ID NO: 1074365 - RNA, 19 nt, Homo sapiens
ugagaaauaugaagucaca

SEQ ID NO: 1074366 - RNA, 19 nt, Homo sapiens
uaagaaaccaugcuguaaa

SEQ ID NO: 1074367 - RNA, 19 nt, Homo sapiens
uauuagaacugucugauuc

SEQ ID NO: 1074368 - RNA, 19 nt, Homo sapiens
gugccgaaauggaugauaa

SEQ ID NO: 1074369 - RNA, 19 nt, Homo sapiens
agaguuagccuuacaagaa

SEQ ID NO: 1074370 - RNA, 19 nt, Homo sapiens
guaagaaaccaugcuguaa

SEQ ID NO: 1074371 - RNA, 19 nt, Homo sapiens
gcacauccuuagaucuaga

SEQ ID NO: 1074372 - RNA, 19 nt, Homo sapiens
acagaaagcaguugugauu

SEQ ID NO: 1074373 - RNA, 19 nt, Homo sapiens
gcauuucuguuuacuaugg

SEQ ID NO: 1074374 - RNA, 19 nt, Homo sapiens
gacaauagaguuugagaau

SEQ ID NO: 1074375 - RNA, 19 nt, Homo sapiens
gaagucacaguaugaaguu

SEQ ID NO: 1074376 - RNA, 19 nt, Homo sapiens
gaagaaauuguugaccuaa

SEQ ID NO: 1074377 - RNA, 19 nt, Homo sapiens
ugugugaccuuguuuauca

SEQ ID NO: 1074378 - RNA, 19 nt, Homo sapiens
cuucgaaucuuguuugaga

SEQ ID NO: 1074379 - RNA, 19 nt, Homo sapiens
agaaauuguugaccuaaga

SEQ ID NO: 1074380 - RNA, 19 nt, Homo sapiens
agaaaacacuccauaauug

SEQ ID NO: 1074381 - RNA, 19 nt, Homo sapiens
augaaaggcuccauugauu

SEQ ID NO: 1074382 - RNA, 19 nt, Homo sapiens
ggacauuucaaguugguaa

SEQ ID NO: 1074383 - RNA, 19 nt, Homo sapiens
gauacagaauuaagugcaa

SEQ ID NO: 1074384 - RNA, 19 nt, Homo sapiens
gugggaagaugaagaagga

SEQ ID NO: 1074385 - RNA, 19 nt, Homo sapiens
ggcauuacauguguuuauu

SEQ ID NO: 1074386 - RNA, 19 nt, Homo sapiens
caaaggaguagggaugaua

SEQ ID NO: 1074387 - RNA, 19 nt, Homo sapiens
aagaaaccaugcuguaaau

SEQ ID NO: 1074388 - RNA, 19 nt, Homo sapiens
cagcacauccuuagaucua

SEQ ID NO: 1074389 - RNA, 19 nt, Homo sapiens
gcagagaauugugcagcaa

SEQ ID NO: 1074390 - RNA, 19 nt, Homo sapiens
gaggugagcacuugacaau

SEQ ID NO: 1074391 - RNA, 19 nt, Homo sapiens
uaagugcaauuucaucauc

SEQ ID NO: 1074392 - RNA, 19 nt, Homo sapiens
ggaagguccagauauaaau

SEQ ID NO: 1074393 - RNA, 19 nt, Homo sapiens
cuucagaguuuggacauuu

SEQ ID NO: 1074394 - RNA, 19 nt, Homo sapiens
ggagggaucgucagacuca

SEQ ID NO: 1074395 - RNA, 19 nt, Homo sapiens
uaucaguuaugaccaaaug

SEQ ID NO: 1074396 - RNA, 19 nt, Homo sapiens
ugacacagaucaacagacu

SEQ ID NO: 1074397 - RNA, 19 nt, Homo sapiens
gaaaggcuccauugauuuu

SEQ ID NO: 1074398 - RNA, 19 nt, Homo sapiens
gaucgucagacucagauuu

SEQ ID NO: 1074399 - RNA, 19 nt, Homo sapiens
cauaaggcauucugacaca

SEQ ID NO: 1074400 - RNA, 19 nt, Homo sapiens
acaagaagacuggaaguaa

SEQ ID NO: 1074401 - RNA, 19 nt, Homo sapiens
gaauagaaugcuuccaaug

SEQ ID NO: 1074402 - RNA, 19 nt, Homo sapiens
gcaagaaaggcagagaauu

SEQ ID NO: 1074403 - RNA, 19 nt, Homo sapiens
ugaaaggcuccauugauuu

SEQ ID NO: 1074404 - RNA, 19 nt, Homo sapiens
ugaauagaaugcuuccaau

SEQ ID NO: 1074405 - RNA, 19 nt, Homo sapiens
gaagaugaagaaggaauga

SEQ ID NO: 1074406 - RNA, 19 nt, Homo sapiens
agagaaaggcauuaugauu

SEQ ID NO: 1074407 - RNA, 19 nt, Homo sapiens
caacaaugacggugcaugu

SEQ ID NO: 1074408 - RNA, 19 nt, Homo sapiens
guuuggacauuucaaguug

SEQ ID NO: 1074409 - RNA, 19 nt, Homo sapiens
aauagaaugcuuccaauga

SEQ ID NO: 1074410 - RNA, 19 nt, Homo sapiens
gaguuagccuuacaagaag

SEQ ID NO: 1074411 - RNA, 19 nt, Homo sapiens
aguacaaggugcuuuaaug

SEQ ID NO: 1074412 - RNA, 19 nt, Homo sapiens
uuacaugccacuauauuga

SEQ ID NO: 1074413 - RNA, 19 nt, Homo sapiens
gaggagggaucgucagacu

SEQ ID NO: 1074414 - RNA, 19 nt, Homo sapiens
uagaaugcuuccaaugaga

SEQ ID NO: 1074415 - RNA, 19 nt, Homo sapiens
aauaugaagucacaguaug

SEQ ID NO: 1074416 - RNA, 19 nt, Homo sapiens
uugaaggaaugguaacaaa

SEQ ID NO: 1074417 - RNA, 19 nt, Homo sapiens
gcauaagcuacgauuguaa

SEQ ID NO: 1074418 - RNA, 19 nt, Homo sapiens
uacauguccuaguuugaua

SEQ ID NO: 1074419 - RNA, 19 nt, Homo sapiens
gcggaggauccaaguauuu

SEQ ID NO: 1074420 - RNA, 19 nt, Homo sapiens
gacagcacauccuuagauc

SEQ ID NO: 1074421 - RNA, 19 nt, Homo sapiens
gaacuaaagugauucaaug

SEQ ID NO: 1074422 - RNA, 19 nt, Homo sapiens
gcaacaagauccugagaaa

SEQ ID NO: 1074423 - RNA, 19 nt, Homo sapiens
ggauauaucugcaucuuga

SEQ ID NO: 1074424 - RNA, 19 nt, Homo sapiens
caaggaaacaucagaauua

SEQ ID NO: 1074425 - RNA, 19 nt, Homo sapiens
gaacucagaugcuguuaca

SEQ ID NO: 1074426 - RNA, 19 nt, Homo sapiens
gauuacagcaugugaauua

SEQ ID NO: 1074427 - RNA, 19 nt, Homo sapiens
ggaaacaucagaauuacua

SEQ ID NO: 1074428 - RNA, 19 nt, Homo sapiens
ccugaaagcuuuacagaaa

SEQ ID NO: 1074429 - RNA, 19 nt, Homo sapiens
gaacacugguaacuauaaa

SEQ ID NO: 1074430 - RNA, 19 nt, Homo sapiens
ggacugagccagaauguga

SEQ ID NO: 1074431 - RNA, 19 nt, Homo sapiens
ucaaacagaugaaagaaga

SEQ ID NO: 1074432 - RNA, 19 nt, Homo sapiens
gaagaggauuugacaacuu

SEQ ID NO: 1074433 - RNA, 19 nt, Homo sapiens
ggacagugcuuccaaguac

SEQ ID NO: 1074434 - RNA, 19 nt, Homo sapiens
gaacacaaguugaaucacu

SEQ ID NO: 1074435 - RNA, 19 nt, Homo sapiens
gaagaacgccugaaagcuu

SEQ ID NO: 1074436 - RNA, 19 nt, Homo sapiens
gagccucacucacauuaaa

SEQ ID NO: 1074437 - RNA, 19 nt, Homo sapiens
gguauaaugugaagucaga

SEQ ID NO: 1074438 - RNA, 19 nt, Homo sapiens
gaagucagauauuuacagu

SEQ ID NO: 1074439 - RNA, 19 nt, Homo sapiens
aaaccaguauccaucaaua

SEQ ID NO: 1074440 - RNA, 19 nt, Homo sapiens
ggaaugagugaaacuuuaa

SEQ ID NO: 1074441 - RNA, 19 nt, Homo sapiens
uaaucuagcuagugucauu

SEQ ID NO: 1074442 - RNA, 19 nt, Homo sapiens
caggaacacugguaacuau

SEQ ID NO: 1074443 - RNA, 19 nt, Homo sapiens
uaacaagccaucaauauca

SEQ ID NO: 1074444 - RNA, 19 nt, Homo sapiens
gaagaaagccaggauucaa

SEQ ID NO: 1074445 - RNA, 19 nt, Homo sapiens
caacuugacuucuguccau

SEQ ID NO: 1074446 - RNA, 19 nt, Homo sapiens
caguggaacucacacagua

SEQ ID NO: 1074447 - RNA, 19 nt, Homo sapiens
caaaauggcuguauucaca

SEQ ID NO: 1074448 - RNA, 19 nt, Homo sapiens
ggaacacugguaacuauaa

SEQ ID NO: 1074449 - RNA, 19 nt, Homo sapiens
ccaccaacguuucucacua

SEQ ID NO: 1074450 - RNA, 19 nt, Homo sapiens
ccuauauacuugacacuuu

SEQ ID NO: 1074451 - RNA, 19 nt, Homo sapiens
gaacucacacaguaaauag

SEQ ID NO: 1074452 - RNA, 19 nt, Homo sapiens
ggaacucacacaguaaaua

SEQ ID NO: 1074453 - RNA, 19 nt, Homo sapiens
aggaaugagugaaacuuua

SEQ ID NO: 1074454 - RNA, 19 nt, Homo sapiens
gcacagaguacuaugacaa

SEQ ID NO: 1074455 - RNA, 19 nt, Homo sapiens
caaucagaauccagaauga

SEQ ID NO: 1074456 - RNA, 19 nt, Homo sapiens
ucagauauuuacaguguug

SEQ ID NO: 1074457 - RNA, 19 nt, Homo sapiens
uggguuauuucuccauuua

SEQ ID NO: 1074458 - RNA, 19 nt, Homo sapiens
uagcuagugucauuuauuc

SEQ ID NO: 1074459 - RNA, 19 nt, Homo sapiens
aguaaauagugaccgauua

SEQ ID NO: 1074460 - RNA, 19 nt, Homo sapiens
gaacuacugagacaggauu

SEQ ID NO: 1074461 - RNA, 19 nt, Homo sapiens
ccaacaggcuaguuuaucu

SEQ ID NO: 1074462 - RNA, 19 nt, Homo sapiens
gaaagaagaaagccaggau

SEQ ID NO: 1074463 - RNA, 19 nt, Homo sapiens
ccuuauagcccauuggaua

SEQ ID NO: 1074464 - RNA, 19 nt, Homo sapiens
ggauuuacauggguauaau

SEQ ID NO: 1074465 - RNA, 19 nt, Homo sapiens
uguauucacaggaguauua

SEQ ID NO: 1074466 - RNA, 19 nt, Homo sapiens
gcagcuggcuuuggguuau

SEQ ID NO: 1074467 - RNA, 19 nt, Homo sapiens
aagaacgccugaaagcuuu

SEQ ID NO: 1074468 - RNA, 19 nt, Homo sapiens
acuaugagcuccaaguaga

SEQ ID NO: 1074469 - RNA, 19 nt, Homo sapiens
ccagugaaguacuauguuc

SEQ ID NO: 1074470 - RNA, 19 nt, Homo sapiens
gguuauuucuccauuuaug

SEQ ID NO: 1074471 - RNA, 19 nt, Homo sapiens
ggaagaggauuugacaacu

SEQ ID NO: 1074472 - RNA, 19 nt, Homo sapiens
caccaacguuucucacuau

SEQ ID NO: 1074473 - RNA, 19 nt, Homo sapiens
gcuaguuuaucuuacauca

SEQ ID NO: 1074474 - RNA, 19 nt, Homo sapiens
ugugugaacuaaagugauu

SEQ ID NO: 1074475 - RNA, 19 nt, Homo sapiens
agucagauauuuacagugu

SEQ ID NO: 1074476 - RNA, 19 nt, Homo sapiens
agaaagccaggauucaaua

SEQ ID NO: 1074477 - RNA, 19 nt, Homo sapiens
cuaaagugauucaaugucu

SEQ ID NO: 1074478 - RNA, 19 nt, Homo sapiens
caaugaagaacgccugaaa

SEQ ID NO: 1074479 - RNA, 19 nt, Homo sapiens
aagaggauuugacaacuug

SEQ ID NO: 1074480 - RNA, 19 nt, Homo sapiens
gguguagacucugggauug

SEQ ID NO: 1074481 - RNA, 19 nt, Homo sapiens
ugagaggguugaacuaucu

SEQ ID NO: 1074482 - RNA, 19 nt, Homo sapiens
aaaccacucuguucaaagg

SEQ ID NO: 1074483 - RNA, 19 nt, Homo sapiens
gaaggaaugagugaaacuu

SEQ ID NO: 1074484 - RNA, 19 nt, Homo sapiens
ccaaguagaaauaggaaga

SEQ ID NO: 1074485 - RNA, 19 nt, Homo sapiens
guccagaacuacugagaca

SEQ ID NO: 1074486 - RNA, 19 nt, Homo sapiens
gcaccaaaauggcuguauu

SEQ ID NO: 1074487 - RNA, 19 nt, Homo sapiens
ugaacuaucugcaccaaaa

SEQ ID NO: 1074488 - RNA, 19 nt, Homo sapiens
gaaaccaguauccaucaau

SEQ ID NO: 1074489 - RNA, 19 nt, Homo sapiens
agaguacuaugacaaggaa

SEQ ID NO: 1074490 - RNA, 19 nt, Homo sapiens
aucauugccuccaguguua

SEQ ID NO: 1074491 - RNA, 19 nt, Homo sapiens
gcaguuuauugucccaugu

SEQ ID NO: 1074492 - RNA, 19 nt, Homo sapiens
gccaucagcaagcaguuua

SEQ ID NO: 1074493 - RNA, 19 nt, Homo sapiens
ggagaaagugugcuugucu

SEQ ID NO: 1074494 - RNA, 19 nt, Homo sapiens
uagagccagugaaguacua

SEQ ID NO: 1074495 - RNA, 19 nt, Homo sapiens
gcacuggagaaucuauuau

SEQ ID NO: 1074496 - RNA, 19 nt, Homo sapiens
gggaaaauguuugugcuuu

SEQ ID NO: 1074497 - RNA, 19 nt, Homo sapiens
acaaggaaacaucagaauu

SEQ ID NO: 1074498 - RNA, 19 nt, Homo sapiens
uuacaaaucuggaaaacug

SEQ ID NO: 1074499 - RNA, 19 nt, Homo sapiens
guagaaauaggaagaggau

SEQ ID NO: 1074500 - RNA, 19 nt, Homo sapiens
ucacuaugagcuccaagua

SEQ ID NO: 1074501 - RNA, 19 nt, Homo sapiens
uaugguaacaccuaacuga

SEQ ID NO: 1074502 - RNA, 19 nt, Homo sapiens
uaaaaccacucuguucaaa

SEQ ID NO: 1074503 - RNA, 19 nt, Homo sapiens
cuauauacuugacacuuuc

SEQ ID NO: 1074504 - RNA, 19 nt, Homo sapiens
aagccaggauucaauacuu

SEQ ID NO: 1074505 - RNA, 19 nt, Homo sapiens
ccagccauauccucauuuc

SEQ ID NO: 1074506 - RNA, 19 nt, Homo sapiens
gugagaggguugaacuauc

SEQ ID NO: 1074507 - RNA, 19 nt, Homo sapiens
caagaacacaaguugaauc

SEQ ID NO: 1074508 - RNA, 19 nt, Homo sapiens
ugaaaccaguauccaucaa

SEQ ID NO: 1074509 - RNA, 19 nt, Homo sapiens
ucaaucagaauccagaaug

SEQ ID NO: 1074510 - RNA, 19 nt, Homo sapiens
uaggauauaucugcaucuu

SEQ ID NO: 1074511 - RNA, 19 nt, Homo sapiens
ucacguccauccacuagag

SEQ ID NO: 1074512 - RNA, 19 nt, Homo sapiens
caggcuaguuuaucuuaca

SEQ ID NO: 1074513 - RNA, 19 nt, Homo sapiens
ugacaaggaaacaucagaa

SEQ ID NO: 1074514 - RNA, 19 nt, Homo sapiens
uucaauacuuucacuguug

SEQ ID NO: 1074515 - RNA, 19 nt, Homo sapiens
ucagcaagcaguuuauugu

SEQ ID NO: 1074516 - RNA, 19 nt, Homo sapiens
gggauuacagcaugugaau

SEQ ID NO: 1074517 - RNA, 19 nt, Homo sapiens
caacaggcuaguuuaucuu

SEQ ID NO: 1074518 - RNA, 19 nt, Homo sapiens
gacaaggaaacaucagaau

SEQ ID NO: 1074519 - RNA, 19 nt, Homo sapiens
agccaggauucaauacuuu

SEQ ID NO: 1074520 - RNA, 19 nt, Homo sapiens
gagaaaaggccaucagcaa

SEQ ID NO: 1074521 - RNA, 19 nt, Homo sapiens
gggauuauguuucugauuu

SEQ ID NO: 1074522 - RNA, 19 nt, Homo sapiens
gcucuuggcuuaacuguug

SEQ ID NO: 1074523 - RNA, 19 nt, Homo sapiens
gauaaagccuacuugauca

SEQ ID NO: 1074524 - RNA, 19 nt, Homo sapiens
ggccagggcuuccaauauu

SEQ ID NO: 1074525 - RNA, 19 nt, Homo sapiens
ggaggcacuuuauuucuuu

SEQ ID NO: 1074526 - RNA, 19 nt, Homo sapiens
ugauuuggcucuuggcuua

SEQ ID NO: 1074527 - RNA, 19 nt, Homo sapiens
ugucaucucugauuucuuu

SEQ ID NO: 1074528 - RNA, 19 nt, Homo sapiens
gaauaggaguggugagaga

SEQ ID NO: 1074529 - RNA, 19 nt, Homo sapiens
ggauaaagccuacuugauc

SEQ ID NO: 1074530 - RNA, 19 nt, Homo sapiens
agacuucgcugaauuuaug

SEQ ID NO: 1074531 - RNA, 19 nt, Homo sapiens
uggcuuaacuguugguaua

SEQ ID NO: 1074532 - RNA, 19 nt, Homo sapiens
gagguauguucauucaaua

SEQ ID NO: 1074533 - RNA, 19 nt, Homo sapiens
gaauuuggauuuggcugua

SEQ ID NO: 1074534 - RNA, 19 nt, Homo sapiens
gcacagaggccaugcuaau

SEQ ID NO: 1074535 - RNA, 19 nt, Homo sapiens
gccagggcuuccaauauua

SEQ ID NO: 1074536 - RNA, 19 nt, Homo sapiens
gaagcaguguugaauuuua

SEQ ID NO: 1074537 - RNA, 19 nt, Homo sapiens
uaaauggaaugcuucacaa

SEQ ID NO: 1074538 - RNA, 19 nt, Homo sapiens
ugucaucgauggcucuuaa

SEQ ID NO: 1074539 - RNA, 19 nt, Homo sapiens
gugaagcauuccauuuaaa

SEQ ID NO: 1074540 - RNA, 19 nt, Homo sapiens
ugagguauguucauucaau

SEQ ID NO: 1074541 - RNA, 19 nt, Homo sapiens
gaagaauguuguugguagu

SEQ ID NO: 1074542 - RNA, 19 nt, Homo sapiens
gauauagaaucauguuguc

SEQ ID NO: 1074543 - RNA, 19 nt, Homo sapiens
ggauuauguuucugauuug

SEQ ID NO: 1074544 - RNA, 19 nt, Homo sapiens
gcuaauuugugaagcauuc

SEQ ID NO: 1074545 - RNA, 19 nt, Homo sapiens
gaauguuguugguaguuug

SEQ ID NO: 1074546 - RNA, 19 nt, Homo sapiens
auggaaugcuucacaaaua

SEQ ID NO: 1074547 - RNA, 19 nt, Homo sapiens
ugaaugggauuauguuucu

SEQ ID NO: 1074548 - RNA, 19 nt, Homo sapiens
ugugaagcauuccauuuaa

SEQ ID NO: 1074549 - RNA, 19 nt, Homo sapiens
guugguaggcuauuuauug

SEQ ID NO: 1074550 - RNA, 19 nt, Homo sapiens
gaugcuagccucauagaau

SEQ ID NO: 1074551 - RNA, 19 nt, Homo sapiens
cagaggccaugcuaauuug

SEQ ID NO: 1074552 - RNA, 19 nt, Homo sapiens
guugguaguuugauaggaa

SEQ ID NO: 1074553 - RNA, 19 nt, Homo sapiens
ggaaugguaccagcucuuu

SEQ ID NO: 1074554 - RNA, 19 nt, Homo sapiens
augaagcaguguugaauuu

SEQ ID NO: 1074555 - RNA, 19 nt, Homo sapiens
acagaggccaugcuaauuu

SEQ ID NO: 1074556 - RNA, 19 nt, Homo sapiens
uggaaugcuucacaaauau

SEQ ID NO: 1074557 - RNA, 19 nt, Homo sapiens
gcacuuuauuucuuucucu

SEQ ID NO: 1074558 - RNA, 19 nt, Homo sapiens
guccaggaauuuauccauu

SEQ ID NO: 1074559 - RNA, 19 nt, Homo sapiens
uauguuggcuguggauuug

SEQ ID NO: 1074560 - RNA, 19 nt, Homo sapiens
gaaucauguugucugcaaa

SEQ ID NO: 1074561 - RNA, 19 nt, Homo sapiens
ucgcugaauuuauguauca

SEQ ID NO: 1074562 - RNA, 19 nt, Homo sapiens
agagaucuuucuagaguau

SEQ ID NO: 1074563 - RNA, 19 nt, Homo sapiens
ggauugccuuugcuauuca

SEQ ID NO: 1074564 - RNA, 19 nt, Homo sapiens
ccugagacuucgcugaauu

SEQ ID NO: 1074565 - RNA, 19 nt, Homo sapiens
ccaggaauuuauccauuuc

SEQ ID NO: 1074566 - RNA, 19 nt, Homo sapiens
uccaggaauuuauccauuu

SEQ ID NO: 1074567 - RNA, 19 nt, Homo sapiens
gagagggcauccuugucuu

SEQ ID NO: 1074568 - RNA, 19 nt, Homo sapiens
ggguguauguguccaggaa

SEQ ID NO: 1074569 - RNA, 19 nt, Homo sapiens
agaaucauguugucugcaa

SEQ ID NO: 1074570 - RNA, 19 nt, Homo sapiens
gggauucuguuucuuucug

SEQ ID NO: 1074571 - RNA, 19 nt, Homo sapiens
ucagggauucuguuucuuu

SEQ ID NO: 1074572 - RNA, 19 nt, Homo sapiens
caucucugauuucuuugaa

SEQ ID NO: 1074573 - RNA, 19 nt, Homo sapiens
guguauguguccaggaauu

SEQ ID NO: 1074574 - RNA, 19 nt, Homo sapiens
cgauggcucuuaauauuuu

SEQ ID NO: 1074575 - RNA, 19 nt, Homo sapiens
uggaggcacuuuauuucuu

SEQ ID NO: 1074576 - RNA, 19 nt, Homo sapiens
guauguguccaggaauuua

SEQ ID NO: 1074577 - RNA, 19 nt, Homo sapiens
gcuauuuauugcugauuca

SEQ ID NO: 1074578 - RNA, 19 nt, Homo sapiens
gaaucccuccuccucaauu

SEQ ID NO: 1074579 - RNA, 19 nt, Homo sapiens
aagaaucccuccuccucaa

SEQ ID NO: 1074580 - RNA, 19 nt, Homo sapiens
agaauguuguugguaguuu

SEQ ID NO: 1074581 - RNA, 19 nt, Homo sapiens
caucgauggcucuuaauau

SEQ ID NO: 1074582 - RNA, 19 nt, Homo sapiens
ggaaugcuucacaaauaug

SEQ ID NO: 1074583 - RNA, 19 nt, Homo sapiens
cuauugagauaaucaugug

SEQ ID NO: 1074584 - RNA, 19 nt, Homo sapiens
aucgauggcucuuaauauu

SEQ ID NO: 1074585 - RNA, 19 nt, Homo sapiens
gcaguugugaaugggauua

SEQ ID NO: 1074586 - RNA, 19 nt, Homo sapiens
uuucagaguucauuauugg

SEQ ID NO: 1074587 - RNA, 19 nt, Homo sapiens
uugugaagcauuccauuua

SEQ ID NO: 1074588 - RNA, 19 nt, Homo sapiens
ucugguagaauuuggauuu

SEQ ID NO: 1074589 - RNA, 19 nt, Homo sapiens
aaagccuacuugaucauga

SEQ ID NO: 1074590 - RNA, 19 nt, Homo sapiens
gggauaaagccuacuugau

SEQ ID NO: 1074591 - RNA, 19 nt, Homo sapiens
guucauuauuggucucuuc

SEQ ID NO: 1074592 - RNA, 19 nt, Homo sapiens
cuucagggauucuguuucu

SEQ ID NO: 1074593 - RNA, 19 nt, Homo sapiens
aaucccuccuccucaauuu

SEQ ID NO: 1074594 - RNA, 19 nt, Homo sapiens
gcuuaacuguugguauaug

SEQ ID NO: 1074595 - RNA, 19 nt, Homo sapiens
cagggauucuguuucuuuc

SEQ ID NO: 1074596 - RNA, 19 nt, Homo sapiens
uaggauugccuuugcuauu

SEQ ID NO: 1074597 - RNA, 19 nt, Homo sapiens
ucaucgauggcucuuaaua

SEQ ID NO: 1074598 - RNA, 19 nt, Homo sapiens
cccuuucaguggacuauuu

SEQ ID NO: 1074599 - RNA, 19 nt, Homo sapiens
ucugccagguuucgguaua

SEQ ID NO: 1074600 - RNA, 19 nt, Homo sapiens
gguauguucauucaauaug

SEQ ID NO: 1074601 - RNA, 19 nt, Homo sapiens
ggugagagagggcauccuu

SEQ ID NO: 1074602 - RNA, 19 nt, Homo sapiens
ugauucaauuucagaguuc

SEQ ID NO: 1074603 - RNA, 19 nt, Homo sapiens
gaaugguaccagcucuuug

SEQ ID NO: 1074604 - RNA, 19 nt, Homo sapiens
caugaagcaguguugaauu

SEQ ID NO: 1074605 - RNA, 19 nt, Homo sapiens
ucgauggcucuuaauauuu

SEQ ID NO: 1074606 - RNA, 19 nt, Homo sapiens
cccauucaguauuauguug

SEQ ID NO: 1074607 - RNA, 19 nt, Homo sapiens
aggauugccuuugcuauuc

SEQ ID NO: 1074608 - RNA, 19 nt, Homo sapiens
gggcuuccaauauuauguu

SEQ ID NO: 1074609 - RNA, 19 nt, Homo sapiens
gaggguaguuugacuuccu

SEQ ID NO: 1074610 - RNA, 19 nt, Homo sapiens
gugaaugggauuauguuuc

SEQ ID NO: 1074611 - RNA, 19 nt, Homo sapiens
gaucaugauggguaagcuu

SEQ ID NO: 1074612 - RNA, 19 nt, Homo sapiens
gguaguuugauaggaauaa

SEQ ID NO: 1074613 - RNA, 19 nt, Homo sapiens
uuaaauggaaugcuucaca

SEQ ID NO: 1074614 - RNA, 19 nt, Homo sapiens
guacgucugguagaauuug

SEQ ID NO: 1074615 - RNA, 19 nt, Homo sapiens
augcuagccucauagaaug

SEQ ID NO: 1074616 - RNA, 19 nt, Homo sapiens
uugaugugcuaguggguuu

SEQ ID NO: 1074617 - RNA, 19 nt, Homo sapiens
ugagagagggcauccuugu

SEQ ID NO: 1074618 - RNA, 19 nt, Homo sapiens
gagacuucgcugaauuuau

SEQ ID NO: 1074619 - RNA, 19 nt, Homo sapiens
gugaagaauguuguuggua

SEQ ID NO: 1074620 - RNA, 19 nt, Homo sapiens
ggcuauuuauugcugauuc

SEQ ID NO: 1074621 - RNA, 19 nt, Homo sapiens
gcaaagcacuaacaaauuu

SEQ ID NO: 1074622 - RNA, 19 nt, Homo sapiens
caaaggaugugaauugaua

SEQ ID NO: 1074623 - RNA, 19 nt, Homo sapiens
gaucuuguauccaaaguua

SEQ ID NO: 1074624 - RNA, 19 nt, Homo sapiens
ggaguaguauggaggauua

SEQ ID NO: 1074625 - RNA, 19 nt, Homo sapiens
gaagcaagauuaauuguca

SEQ ID NO: 1074626 - RNA, 19 nt, Homo sapiens
aaagauaacucucguucua

SEQ ID NO: 1074627 - RNA, 19 nt, Homo sapiens
gagcaauacugauaugaau

SEQ ID NO: 1074628 - RNA, 19 nt, Homo sapiens
ugcgaaagaugacuauuua

SEQ ID NO: 1074629 - RNA, 19 nt, Homo sapiens
acacagcaaucacagauaa

SEQ ID NO: 1074630 - RNA, 19 nt, Homo sapiens
cuacugaacguucuaaaua

SEQ ID NO: 1074631 - RNA, 19 nt, Homo sapiens
ccauaggacuguauuauca

SEQ ID NO: 1074632 - RNA, 19 nt, Homo sapiens
cugcaaaguugaaugauaa

SEQ ID NO: 1074633 - RNA, 19 nt, Homo sapiens
gaacacauaggauugcaaa

SEQ ID NO: 1074634 - RNA, 19 nt, Homo sapiens
gauggacaauugcuaggua

SEQ ID NO: 1074635 - RNA, 19 nt, Homo sapiens
uaaauaagccugggaagaa

SEQ ID NO: 1074636 - RNA, 19 nt, Homo sapiens
gagaagaugguucagagua

SEQ ID NO: 1074637 - RNA, 19 nt, Homo sapiens
ggaagguuaugccaaucua

SEQ ID NO: 1074638 - RNA, 19 nt, Homo sapiens
gaauggaaagucugaguaa

SEQ ID NO: 1074639 - RNA, 19 nt, Homo sapiens
agucaaagguuuccagauu

SEQ ID NO: 1074640 - RNA, 19 nt, Homo sapiens
gcauugccauccauucaaa

SEQ ID NO: 1074641 - RNA, 19 nt, Homo sapiens
gcagagcaauacugauaug

SEQ ID NO: 1074642 - RNA, 19 nt, Homo sapiens
uaauauacauugccucugu

SEQ ID NO: 1074643 - RNA, 19 nt, Homo sapiens
caaccaggaagcaagauua

SEQ ID NO: 1074644 - RNA, 19 nt, Homo sapiens
gaagaugguucagaguaug

SEQ ID NO: 1074645 - RNA, 19 nt, Homo sapiens
caaaccagauuagguaaau

SEQ ID NO: 1074646 - RNA, 19 nt, Homo sapiens
gaaaucaagaguaagcauu

SEQ ID NO: 1074647 - RNA, 19 nt, Homo sapiens
gaaauacacagcaaucaca

SEQ ID NO: 1074648 - RNA, 19 nt, Homo sapiens
gaaucaggaaguaguauuu

SEQ ID NO: 1074649 - RNA, 19 nt, Homo sapiens
gaguuugaguuguguacua

SEQ ID NO: 1074650 - RNA, 19 nt, Homo sapiens
gaacaaguagaaacaugaa

SEQ ID NO: 1074651 - RNA, 19 nt, Homo sapiens
uaagacuacugcaaaguug

SEQ ID NO: 1074652 - RNA, 19 nt, Homo sapiens
ccaggaagcaagauuaauu

SEQ ID NO: 1074653 - RNA, 19 nt, Homo sapiens
gaaagucugaguaacaaga

SEQ ID NO: 1074654 - RNA, 19 nt, Homo sapiens
gaacucaccgguccagaug

SEQ ID NO: 1074655 - RNA, 19 nt, Homo sapiens
cagauuagguaaauugaca

SEQ ID NO: 1074656 - RNA, 19 nt, Homo sapiens
ggauauaaaucagucuugu

SEQ ID NO: 1074657 - RNA, 19 nt, Homo sapiens
guauggaggauuauucuaa

SEQ ID NO: 1074658 - RNA, 19 nt, Homo sapiens
caggauaaauacagaaauc

SEQ ID NO: 1074659 - RNA, 19 nt, Homo sapiens
gcacaggagaauauagaaa

SEQ ID NO: 1074660 - RNA, 19 nt, Homo sapiens
acauaucucugugguuuaa

SEQ ID NO: 1074661 - RNA, 19 nt, Homo sapiens
ucacacagacucagcuaaa

SEQ ID NO: 1074662 - RNA, 19 nt, Homo sapiens
ggcaaagcacuaacaaauu

SEQ ID NO: 1074663 - RNA, 19 nt, Homo sapiens
gucaaagguuuccagauug

SEQ ID NO: 1074664 - RNA, 19 nt, Homo sapiens
aaacagugcacacacauga

SEQ ID NO: 1074665 - RNA, 19 nt, Homo sapiens
gaacaggauauaaaucagu

SEQ ID NO: 1074666 - RNA, 19 nt, Homo sapiens
ggaaaccacagacuuguag

SEQ ID NO: 1074667 - RNA, 19 nt, Homo sapiens
gagagaggaagcagucaaa

SEQ ID NO: 1074668 - RNA, 19 nt, Homo sapiens
agaagaugguucagaguau

SEQ ID NO: 1074669 - RNA, 19 nt, Homo sapiens
gguauucuggaaaugauua

SEQ ID NO: 1074670 - RNA, 19 nt, Homo sapiens
gugaugaguuugaguugug

SEQ ID NO: 1074671 - RNA, 19 nt, Homo sapiens
auacauugccucugucuuu

SEQ ID NO: 1074672 - RNA, 19 nt, Homo sapiens
gaaaugauuauggagaaga

SEQ ID NO: 1074673 - RNA, 19 nt, Homo sapiens
gaguaagcauuuagaaacu

SEQ ID NO: 1074674 - RNA, 19 nt, Homo sapiens
cugcagagcaauacugaua

SEQ ID NO: 1074675 - RNA, 19 nt, Homo sapiens
cuaaugcaguguuauucaa

SEQ ID NO: 1074676 - RNA, 19 nt, Homo sapiens
gcaaauaccaauaucucau

SEQ ID NO: 1074677 - RNA, 19 nt, Homo sapiens
uaagguagaacacauagga

SEQ ID NO: 1074678 - RNA, 19 nt, Homo sapiens
ccagaagggugagauuugu

SEQ ID NO: 1074679 - RNA, 19 nt, Homo sapiens
acaggaagguuaugccaau

SEQ ID NO: 1074680 - RNA, 19 nt, Homo sapiens
gagcauugccauccauuca

SEQ ID NO: 1074681 - RNA, 19 nt, Homo sapiens
ccacagacuuguagagacu

SEQ ID NO: 1074682 - RNA, 19 nt, Homo sapiens
guuuguuacuagucuguua

SEQ ID NO: 1074683 - RNA, 19 nt, Homo sapiens
gcaauacugauaugaaugg

SEQ ID NO: 1074684 - RNA, 19 nt, Homo sapiens
gugaacaaguagaaacaug

SEQ ID NO: 1074685 - RNA, 19 nt, Homo sapiens
agagggagcugggaaggaa

SEQ ID NO: 1074686 - RNA, 19 nt, Homo sapiens
uggaaaugauuauggagaa

SEQ ID NO: 1074687 - RNA, 19 nt, Homo sapiens
uaauuucaguggcaagguu

SEQ ID NO: 1074688 - RNA, 19 nt, Homo sapiens
ugaacuggcuacggauaaa

SEQ ID NO: 1074689 - RNA, 19 nt, Homo sapiens
cuaaaaugcuugcgaaaga

SEQ ID NO: 1074690 - RNA, 19 nt, Homo sapiens
ggaugugaauugauaucau

SEQ ID NO: 1074691 - RNA, 19 nt, Homo sapiens
gguagaacacauaggauug

SEQ ID NO: 1074692 - RNA, 19 nt, Homo sapiens
guaaauugacaaccaggaa

SEQ ID NO: 1074693 - RNA, 19 nt, Homo sapiens
caacauguuccuguacaaa

SEQ ID NO: 1074694 - RNA, 19 nt, Homo sapiens
guaagcauguggacaccau

SEQ ID NO: 1074695 - RNA, 19 nt, Homo sapiens
gaauaucuaaugcaguguu

SEQ ID NO: 1074696 - RNA, 19 nt, Homo sapiens
acugcaaaguugaaugaua

SEQ ID NO: 1074697 - RNA, 19 nt, Homo sapiens
uggcaaagcacuaacaaau

SEQ ID NO: 1074698 - RNA, 19 nt, Homo sapiens
aggaagcagucaaagguuu

SEQ ID NO: 1074699 - RNA, 19 nt, Homo sapiens
ccaggagccuaauacacaa

SEQ ID NO: 1074700 - RNA, 19 nt, Homo sapiens
gccaggagccuaauacaca

SEQ ID NO: 1074701 - RNA, 19 nt, Homo sapiens
gccaagcacaggagaauau

SEQ ID NO: 1074702 - RNA, 19 nt, Homo sapiens
caaagagcauugccaucca

SEQ ID NO: 1074703 - RNA, 19 nt, Homo sapiens
cugcaaaggaugugaauug

SEQ ID NO: 1074704 - RNA, 19 nt, Homo sapiens
uggaaagucugaguaacaa

SEQ ID NO: 1074705 - RNA, 19 nt, Homo sapiens
ggaaaugauuauggagaag

SEQ ID NO: 1074706 - RNA, 19 nt, Homo sapiens
gagccuccuuucucuacuu

SEQ ID NO: 1074707 - RNA, 19 nt, Homo sapiens
caagaguaagcauuuagaa

SEQ ID NO: 1074708 - RNA, 19 nt, Homo sapiens
guuacaggauaaauacaga

SEQ ID NO: 1074709 - RNA, 19 nt, Homo sapiens
cauugcaugcucauaaaua

SEQ ID NO: 1074710 - RNA, 19 nt, Homo sapiens
ucaaagguuuccagauugg

SEQ ID NO: 1074711 - RNA, 19 nt, Homo sapiens
gaguaugaaggaucuugua

SEQ ID NO: 1074712 - RNA, 19 nt, Homo sapiens
gaaugauggacaauugcua

SEQ ID NO: 1074713 - RNA, 19 nt, Homo sapiens
uuugaaugauggacaauug

SEQ ID NO: 1074714 - RNA, 19 nt, Homo sapiens
gauaaaagacugaagauac

SEQ ID NO: 1074715 - RNA, 19 nt, Homo sapiens
gacuggcucugccuucuuc

SEQ ID NO: 1074716 - RNA, 19 nt, Homo sapiens
gcaaaggaugugaauugau

SEQ ID NO: 1074717 - RNA, 19 nt, Homo sapiens
ugaacaaguagaaacauga

SEQ ID NO: 1074718 - RNA, 19 nt, Homo sapiens
auacacaaauccacuugau

SEQ ID NO: 1074719 - RNA, 19 nt, Homo sapiens
caggaagcaagauuaauug

SEQ ID NO: 1074720 - RNA, 19 nt, Homo sapiens
ccuccuuucucuacuuuga

SEQ ID NO: 1074721 - RNA, 19 nt, Homo sapiens
gaacagcaguuucaaguga

SEQ ID NO: 1074722 - RNA, 19 nt, Homo sapiens
guacaugccuuaugcagaa

SEQ ID NO: 1074723 - RNA, 19 nt, Homo sapiens
gaagccaaguugcaacaua

SEQ ID NO: 1074724 - RNA, 19 nt, Homo sapiens
gaagaagaaugaaucaauc

SEQ ID NO: 1074725 - RNA, 19 nt, Homo sapiens
gagaagaucccaacauuau

SEQ ID NO: 1074726 - RNA, 19 nt, Homo sapiens
gaauaagaaugcuagaaga

SEQ ID NO: 1074727 - RNA, 19 nt, Homo sapiens
gauguaaggccuauuagua

SEQ ID NO: 1074728 - RNA, 19 nt, Homo sapiens
gaaguaaucaccacuguau

SEQ ID NO: 1074729 - RNA, 19 nt, Homo sapiens
uagagaaggugaauauuug

SEQ ID NO: 1074730 - RNA, 19 nt, Homo sapiens
gaagaucccaacauuauga

SEQ ID NO: 1074731 - RNA, 19 nt, Homo sapiens
gagaauggaggcaaucaua

SEQ ID NO: 1074732 - RNA, 19 nt, Homo sapiens
caaccgagccuuaggauga

SEQ ID NO: 1074733 - RNA, 19 nt, Homo sapiens
ccacaucccugauuucauc

SEQ ID NO: 1074734 - RNA, 19 nt, Homo sapiens
uaagaaugcuagaagaaga

SEQ ID NO: 1074735 - RNA, 19 nt, Homo sapiens
acacagugguuguaagaaa

SEQ ID NO: 1074736 - RNA, 19 nt, Homo sapiens
uaaauggucagaaacgaua

SEQ ID NO: 1074737 - RNA, 19 nt, Homo sapiens
gaagagagacucaggaacu

SEQ ID NO: 1074738 - RNA, 19 nt, Homo sapiens
cacaguaaauggucagaaa

SEQ ID NO: 1074739 - RNA, 19 nt, Homo sapiens
gaauuuacuucacuucucu

SEQ ID NO: 1074740 - RNA, 19 nt, Homo sapiens
aacgauagcuguugguauu

SEQ ID NO: 1074741 - RNA, 19 nt, Homo sapiens
gagaggagucaauaggaua

SEQ ID NO: 1074742 - RNA, 19 nt, Homo sapiens
uauccucccuuaacaacua

SEQ ID NO: 1074743 - RNA, 19 nt, Homo sapiens
ggaauuuacuucacuucuc

SEQ ID NO: 1074744 - RNA, 19 nt, Homo sapiens
gggagaacuuccuuagaga

SEQ ID NO: 1074745 - RNA, 19 nt, Homo sapiens
gaaacgauagcuguuggua

SEQ ID NO: 1074746 - RNA, 19 nt, Homo sapiens
gaauggaggcaaucauaau

SEQ ID NO: 1074747 - RNA, 19 nt, Homo sapiens
acagauguaaggccuauua

SEQ ID NO: 1074748 - RNA, 19 nt, Homo sapiens
ugagaagaucccaacauua

SEQ ID NO: 1074749 - RNA, 19 nt, Homo sapiens
uugagaagaucccaacauu

SEQ ID NO: 1074750 - RNA, 19 nt, Homo sapiens
cuuauuguauccucccuua

SEQ ID NO: 1074751 - RNA, 19 nt, Homo sapiens
cagugaugcugcacaguaa

SEQ ID NO: 1074752 - RNA, 19 nt, Homo sapiens
caacauaugcuuugucacu

SEQ ID NO: 1074753 - RNA, 19 nt, Homo sapiens
uuaaagcaaucaugaccuu

SEQ ID NO: 1074754 - RNA, 19 nt, Homo sapiens
gaagaaugaaucaaucuac

SEQ ID NO: 1074755 - RNA, 19 nt, Homo sapiens
ggagaacuuccuuagagaa

SEQ ID NO: 1074756 - RNA, 19 nt, Homo sapiens
guaaagagcccaaaauaca

SEQ ID NO: 1074757 - RNA, 19 nt, Homo sapiens
ggauuucauuccuauucaa

SEQ ID NO: 1074758 - RNA, 19 nt, Homo sapiens
ggugggauuucauuccuau

SEQ ID NO: 1074759 - RNA, 19 nt, Homo sapiens
ccaauuccuugcaaaucuu

SEQ ID NO: 1074760 - RNA, 19 nt, Homo sapiens
gggauuucauuccuauuca

SEQ ID NO: 1074761 - RNA, 19 nt, Homo sapiens
gaccugaguguguaaagaa

SEQ ID NO: 1074762 - RNA, 19 nt, Homo sapiens
gauuacugcauaugacuuu

SEQ ID NO: 1074763 - RNA, 19 nt, Homo sapiens
cagauucgguuuucuauau

SEQ ID NO: 1074764 - RNA, 19 nt, Homo sapiens
ucacagauguaaggccuau

SEQ ID NO: 1074765 - RNA, 19 nt, Homo sapiens
gggaacagcaguuucaagu

SEQ ID NO: 1074766 - RNA, 19 nt, Homo sapiens
uaagggaacagcaguuuca

SEQ ID NO: 1074767 - RNA, 19 nt, Homo sapiens
gcuagaagaagaaugaauc

SEQ ID NO: 1074768 - RNA, 19 nt, Homo sapiens
aagagagacucaggaacua

SEQ ID NO: 1074769 - RNA, 19 nt, Homo sapiens
aagcaaucaugaccuuauu

SEQ ID NO: 1074770 - RNA, 19 nt, Homo sapiens
cagaaguaaucaccacugu

SEQ ID NO: 1074771 - RNA, 19 nt, Homo sapiens
ggagucaauaggauaugua

SEQ ID NO: 1074772 - RNA, 19 nt, Homo sapiens
ugagaggagucaauaggau

SEQ ID NO: 1074773 - RNA, 19 nt, Homo sapiens
aagccaaguugcaacauau

SEQ ID NO: 1074774 - RNA, 19 nt, Homo sapiens
guagaaagagcugaaguuc

SEQ ID NO: 1074775 - RNA, 19 nt, Homo sapiens
aaaauggacuucugauaga

SEQ ID NO: 1074776 - RNA, 19 nt, Homo sapiens
ugacuaagguuacauuccu

SEQ ID NO: 1074777 - RNA, 19 nt, Homo sapiens
caggaacuaugaggugauu

SEQ ID NO: 1074778 - RNA, 19 nt, Homo sapiens
gagaaggugaauauuugaa

SEQ ID NO: 1074779 - RNA, 19 nt, Homo sapiens
guaccuaucaaauggagaa

SEQ ID NO: 1074780 - RNA, 19 nt, Homo sapiens
caaacaaagcacugaagga

SEQ ID NO: 1074781 - RNA, 19 nt, Homo sapiens
ugaauaagaaugcuagaag

SEQ ID NO: 1074782 - RNA, 19 nt, Homo sapiens
acaacuaguacaugccuua

SEQ ID NO: 1074783 - RNA, 19 nt, Homo sapiens
ccuaucaaauggagaaugg

SEQ ID NO: 1074784 - RNA, 19 nt, Homo sapiens
agggccagcugacagauaa

SEQ ID NO: 1074785 - RNA, 19 nt, Homo sapiens
gucaguuucuuaucuuuca

SEQ ID NO: 1074786 - RNA, 19 nt, Homo sapiens
cacagugguuguaagaaau

SEQ ID NO: 1074787 - RNA, 19 nt, Homo sapiens
ccuauucaacgggcaauua

SEQ ID NO: 1074788 - RNA, 19 nt, Homo sapiens
acagugaugcugcacagua

SEQ ID NO: 1074789 - RNA, 19 nt, Homo sapiens
ccauuucaaccgagccuua

SEQ ID NO: 1074790 - RNA, 19 nt, Homo sapiens
ccagcugacagauaaguuu

SEQ ID NO: 1074791 - RNA, 19 nt, Homo sapiens
gcucagacucauuucagaa

SEQ ID NO: 1074792 - RNA, 19 nt, Homo sapiens
acauaugcuuugucacuug

SEQ ID NO: 1074793 - RNA, 19 nt, Homo sapiens
gaggugauugggacaugua

SEQ ID NO: 1074794 - RNA, 19 nt, Homo sapiens
gagagacucaggaacuaug

SEQ ID NO: 1074795 - RNA, 19 nt, Homo sapiens
cagaagagagacucaggaa

SEQ ID NO: 1074796 - RNA, 19 nt, Homo sapiens
agaauggaggcaaucauaa

SEQ ID NO: 1074797 - RNA, 19 nt, Homo sapiens
cauuuagaaucaagucuca

SEQ ID NO: 1074798 - RNA, 19 nt, Homo sapiens
guaaauggucagaaacgau

SEQ ID NO: 1074799 - RNA, 19 nt, Homo sapiens
ugaccugaguguguaaaga

SEQ ID NO: 1074800 - RNA, 19 nt, Homo sapiens
gggucaguuucuuaucuuu

SEQ ID NO: 1074801 - RNA, 19 nt, Homo sapiens
agacucauuucagaacauu

SEQ ID NO: 1074802 - RNA, 19 nt, Homo sapiens
gauuucaauuucacacaca

SEQ ID NO: 1074803 - RNA, 19 nt, Homo sapiens
uagcaguguuaagcucaua

SEQ ID NO: 1074804 - RNA, 19 nt, Homo sapiens
ugaguucuuagcaguguua

SEQ ID NO: 1074805 - RNA, 19 nt, Homo sapiens
ucccugauuucaucugauu

SEQ ID NO: 1074806 - RNA, 19 nt, Homo sapiens
caucccugauuucaucuga

SEQ ID NO: 1074807 - RNA, 19 nt, Homo sapiens
ugcaacauaugcuuuguca

SEQ ID NO: 1074808 - RNA, 19 nt, Homo sapiens
ggaacagcaguuucaagug

SEQ ID NO: 1074809 - RNA, 19 nt, Homo sapiens
acacacagugguuguaaga

SEQ ID NO: 1074810 - RNA, 19 nt, Homo sapiens
ggaaggggccugagaagug

SEQ ID NO: 1074811 - RNA, 19 nt, Homo sapiens
ucacacacagugguuguaa

SEQ ID NO: 1074812 - RNA, 19 nt, Homo sapiens
acagauaaguuuucacaga

SEQ ID NO: 1074813 - RNA, 19 nt, Homo sapiens
cauaugcuuugucacuugu

SEQ ID NO: 1074814 - RNA, 19 nt, Homo sapiens
ucaagugacuaagguuaca

SEQ ID NO: 1074815 - RNA, 19 nt, Homo sapiens
gaccccagauggaucauuu

SEQ ID NO: 1074816 - RNA, 19 nt, Homo sapiens
caauuccuugcaaaucuua

SEQ ID NO: 1074817 - RNA, 19 nt, Homo sapiens
ggaacuaugaggugauugg

SEQ ID NO: 1074818 - RNA, 19 nt, Homo sapiens
cccaauuccuugcaaaucu

SEQ ID NO: 1074819 - RNA, 19 nt, Homo sapiens
uaaagcaaucaugaccuua

SEQ ID NO: 1074820 - RNA, 19 nt, Homo sapiens
uccaacaacuuucaaacca

SEQ ID NO: 1074821 - RNA, 19 nt, Homo sapiens
gcaagcggguuguuauuga

SEQ ID NO: 1074822 - RNA, 19 nt, Homo sapiens
gcucugggcuccucugcaa

SEQ ID NO: 1074823 - RNA, 19 nt, Homo sapiens
gaguuaagggagagaauaa

SEQ ID NO: 1074824 - RNA, 19 nt, Homo sapiens
caacaaccuguaucuggua

SEQ ID NO: 1074825 - RNA, 19 nt, Homo sapiens
caagcggguuguuauugaa

SEQ ID NO: 1074826 - RNA, 19 nt, Homo sapiens
ggagcaagcggguuguuau

SEQ ID NO: 1074827 - RNA, 19 nt, Homo sapiens
caaccuguaucugguauca

SEQ ID NO: 1074828 - RNA, 19 nt, Homo sapiens
gaagaugauaggauugaug

SEQ ID NO: 1074829 - RNA, 19 nt, Homo sapiens
gagcaagcggguuguuauu

SEQ ID NO: 1074830 - RNA, 19 nt, Homo sapiens
caaagacaaugaguuaagg

SEQ ID NO: 1074831 - RNA, 19 nt, Homo sapiens
gaaaucaacaaccuguauc

SEQ ID NO: 1074832 - RNA, 19 nt, Homo sapiens
gcaggacaccaacaacuuc

SEQ ID NO: 1074833 - RNA, 19 nt, Homo sapiens
ccaaagacaaugaguuaag

SEQ ID NO: 1074834 - RNA, 19 nt, Homo sapiens
ugaaaucaacaaccuguau

SEQ ID NO: 1074835 - RNA, 19 nt, Homo sapiens
ggacaccaacaacuucuuc

SEQ ID NO: 1074836 - RNA, 19 nt, Homo sapiens
uaagaacggcgguaacagu

SEQ ID NO: 1074837 - RNA, 19 nt, Homo sapiens
ggguuguuauugaagauga

SEQ ID NO: 1074838 - RNA, 19 nt, Homo sapiens
guuaagggagagaauaaga

SEQ ID NO: 1074839 - RNA, 19 nt, Homo sapiens
ugaguuaagggagagaaua

SEQ ID NO: 1074840 - RNA, 19 nt, Homo sapiens
aagaugauaggauugauga

SEQ ID NO: 1074841 - RNA, 19 nt, Homo sapiens
agaauaagaacggcgguaa

SEQ ID NO: 1074842 - RNA, 19 nt, Homo sapiens
ggauugaugacgugcugaa

SEQ ID NO: 1074843 - RNA, 19 nt, Homo sapiens
gaauaagaacggcgguaac

SEQ ID NO: 1074844 - RNA, 19 nt, Homo sapiens
uuaagggagagaauaagaa

SEQ ID NO: 1074845 - RNA, 19 nt, Homo sapiens
aagaacggcgguaacaguu

SEQ ID NO: 1074846 - RNA, 19 nt, Homo sapiens
cgacgugggccagaucuuc

SEQ ID NO: 1074847 - RNA, 19 nt, Homo sapiens
ccccaaagacaaugaguua

SEQ ID NO: 1074848 - RNA, 19 nt, Homo sapiens
cggagcaagcggguuguua

SEQ ID NO: 1074849 - RNA, 19 nt, Homo sapiens
gcggguuguuauugaagau

SEQ ID NO: 1074850 - RNA, 19 nt, Homo sapiens
aauaagaacggcgguaaca

SEQ ID NO: 1074851 - RNA, 19 nt, Homo sapiens
uaagggagagaauaagaac

SEQ ID NO: 1074852 - RNA, 19 nt, Homo sapiens
ugaagaugauaggauugau

SEQ ID NO: 1074853 - RNA, 19 nt, Homo sapiens
caauugagauguuggcaua

SEQ ID NO: 1074854 - RNA, 19 nt, Homo sapiens
gggcauuguuucuaaauaa

SEQ ID NO: 1074855 - RNA, 19 nt, Homo sapiens
gauagggacucuuugcaaa

SEQ ID NO: 1074856 - RNA, 19 nt, Homo sapiens
gcaaguuaccacuauaaua

SEQ ID NO: 1074857 - RNA, 19 nt, Homo sapiens
gaucaaaugcugucaaguu

SEQ ID NO: 1074858 - RNA, 19 nt, Homo sapiens
gcagcaaguuaccacuaua

SEQ ID NO: 1074859 - RNA, 19 nt, Homo sapiens
caguuacacuuaagucuaa

SEQ ID NO: 1074860 - RNA, 19 nt, Homo sapiens
caacuuucaccaucaauuu

SEQ ID NO: 1074861 - RNA, 19 nt, Homo sapiens
guaaacugcuacugauuuc

SEQ ID NO: 1074862 - RNA, 19 nt, Homo sapiens
aaacuuugcuucgucuuaa

SEQ ID NO: 1074863 - RNA, 19 nt, Homo sapiens
aaacugauguccuauccuu

SEQ ID NO: 1074864 - RNA, 19 nt, Homo sapiens
ugauaccacuucaacagua

SEQ ID NO: 1074865 - RNA, 19 nt, Homo sapiens
gcugcaggcuucaucuaaa

SEQ ID NO: 1074866 - RNA, 19 nt, Homo sapiens
gagaucaaaugcugucaag

SEQ ID NO: 1074867 - RNA, 19 nt, Homo sapiens
agggaaaucuguauggaaa

SEQ ID NO: 1074868 - RNA, 19 nt, Homo sapiens
uaucuugucucccuacuuc

SEQ ID NO: 1074869 - RNA, 19 nt, Homo sapiens
caaacuagauccuguucag

SEQ ID NO: 1074870 - RNA, 19 nt, Homo sapiens
gcucuaacuagcauguuua

SEQ ID NO: 1074871 - RNA, 19 nt, Homo sapiens
ugugucauuucuucaguua

SEQ ID NO: 1074872 - RNA, 19 nt, Homo sapiens
gcaaacugauguccuaucc

SEQ ID NO: 1074873 - RNA, 19 nt, Homo sapiens
ucacaacuuucaccaucaa

SEQ ID NO: 1074874 - RNA, 19 nt, Homo sapiens
aaauaugugcagcaaguua

SEQ ID NO: 1074875 - RNA, 19 nt, Homo sapiens
cagcaaguuaccacuauaa

SEQ ID NO: 1074876 - RNA, 19 nt, Homo sapiens
aucaaaugcugucaaguuu

SEQ ID NO: 1074877 - RNA, 19 nt, Homo sapiens
gggacucuuugcaaacuga

SEQ ID NO: 1074878 - RNA, 19 nt, Homo sapiens
uguaaacugcuacugauuu

SEQ ID NO: 1074879 - RNA, 19 nt, Homo sapiens
acaauuccuugcucaccua

SEQ ID NO: 1074880 - RNA, 19 nt, Homo sapiens
gaagaauaaaugcuuacug

SEQ ID NO: 1074881 - RNA, 19 nt, Homo sapiens
ucaccauucuuccacauca

SEQ ID NO: 1074882 - RNA, 19 nt, Homo sapiens
aaagggaaaucuguaugga

SEQ ID NO: 1074883 - RNA, 19 nt, Homo sapiens
caaaugcugucaaguuuuc

SEQ ID NO: 1074884 - RNA, 19 nt, Homo sapiens
uagggaacccgcaaagauu

SEQ ID NO: 1074885 - RNA, 19 nt, Homo sapiens
ugucauuucuucaguuaca

SEQ ID NO: 1074886 - RNA, 19 nt, Homo sapiens
ucaguuacacuuaagucua

SEQ ID NO: 1074887 - RNA, 19 nt, Homo sapiens
ccacuucaacaguaucuug

SEQ ID NO: 1074888 - RNA, 19 nt, Homo sapiens
uuucuugacuugccaaauc

SEQ ID NO: 1074889 - RNA, 19 nt, Homo sapiens
gauguccuauccuucuuag

SEQ ID NO: 1074890 - RNA, 19 nt, Homo sapiens
guuaugcauuuguaaacug

SEQ ID NO: 1074891 - RNA, 19 nt, Homo sapiens
ugggcauuguuucuaaaua

SEQ ID NO: 1074892 - RNA, 19 nt, Homo sapiens
uccaauuccugugucauuu

SEQ ID NO: 1074893 - RNA, 19 nt, Homo sapiens
cuucaccucuauaaucaga

SEQ ID NO: 1074894 - RNA, 19 nt, Homo sapiens
ugacuugccaaaucaguga

SEQ ID NO: 1074895 - RNA, 19 nt, Homo sapiens
caaugccuugucccaauua

SEQ ID NO: 1074896 - RNA, 19 nt, Homo sapiens
caauguagaaacaauguag

SEQ ID NO: 1074897 - RNA, 19 nt, Homo sapiens
uuugcaaacugauguccua

SEQ ID NO: 1074898 - RNA, 19 nt, Homo sapiens
aaacugcuacugauuucuu

SEQ ID NO: 1074899 - RNA, 19 nt, Homo sapiens
ggaauuaaaagucacaaug

SEQ ID NO: 1074900 - RNA, 19 nt, Homo sapiens
uagauccuguucagacaug

SEQ ID NO: 1074901 - RNA, 19 nt, Homo sapiens
gcucaccuauuccuuucuc

SEQ ID NO: 1074902 - RNA, 19 nt, Homo sapiens
cugaaccaauugagauguu

SEQ ID NO: 1074903 - RNA, 19 nt, Homo sapiens
gaauugauuuugccuugau

SEQ ID NO: 1074904 - RNA, 19 nt, Homo sapiens
ugaaccaauugagauguug

SEQ ID NO: 1074905 - RNA, 19 nt, Homo sapiens
caauuccugugucauuucu

SEQ ID NO: 1074906 - RNA, 19 nt, Homo sapiens
gcugauaccacuucaacag

SEQ ID NO: 1074907 - RNA, 19 nt, Homo sapiens
guuggcauaaacaagauua

SEQ ID NO: 1074908 - RNA, 19 nt, Homo sapiens
cuacucuaguuucaucuca

SEQ ID NO: 1074909 - RNA, 19 nt, Homo sapiens
uuagggaacccgcaaagau

SEQ ID NO: 1074910 - RNA, 19 nt, Homo sapiens
ugcagcaaguuaccacuau

SEQ ID NO: 1074911 - RNA, 19 nt, Homo sapiens
gugcagcaaguuaccacua

SEQ ID NO: 1074912 - RNA, 19 nt, Homo sapiens
ccaguuccuacucuaguuu

SEQ ID NO: 1074913 - RNA, 19 nt, Homo sapiens
gucacaauguagaaacaau

SEQ ID NO: 1074914 - RNA, 19 nt, Homo sapiens
ucacaauguagaaacaaug

SEQ ID NO: 1074915 - RNA, 19 nt, Homo sapiens
uguccuauccuucuuagug

SEQ ID NO: 1074916 - RNA, 19 nt, Homo sapiens
ugauagggacucuuugcaa

SEQ ID NO: 1074917 - RNA, 19 nt, Homo sapiens
uuuguaaacugcuacugau

SEQ ID NO: 1074918 - RNA, 19 nt, Homo sapiens
auugagauguuggcauaaa

SEQ ID NO: 1074919 - RNA, 19 nt, Homo sapiens
cuucuucaccucuauaauc

SEQ ID NO: 1074920 - RNA, 19 nt, Homo sapiens
ccuguucagacauguuaua

SEQ ID NO: 1074921 - RNA, 19 nt, Homo sapiens
ugauguccuauccuucuua

SEQ ID NO: 1074922 - RNA, 19 nt, Homo sapiens
gccuuucugugccuauuca

SEQ ID NO: 1074923 - RNA, 19 nt, Homo sapiens
uuuaugacaugccuuucug

SEQ ID NO: 1074924 - RNA, 19 nt, Homo sapiens
ccaauuccugugucauuuc

SEQ ID NO: 1074925 - RNA, 19 nt, Homo sapiens
acucuaguuucaucucaug

SEQ ID NO: 1074926 - RNA, 19 nt, Homo sapiens
agggaacccgcaaagauuu

SEQ ID NO: 1074927 - RNA, 19 nt, Homo sapiens
ggcauaaacaagauuaacu

SEQ ID NO: 1074928 - RNA, 19 nt, Homo sapiens
ucuuccacaucacaacuuu

SEQ ID NO: 1074929 - RNA, 19 nt, Homo sapiens
auuccuugcucaccuauuc

SEQ ID NO: 1074930 - RNA, 19 nt, Homo sapiens
gccuugauagggacucuuu

SEQ ID NO: 1074931 - RNA, 19 nt, Homo sapiens
uguccuugcuacaauuuua

SEQ ID NO: 1074932 - RNA, 19 nt, Homo sapiens
aaaacucucagcaaaagua

SEQ ID NO: 1074933 - RNA, 19 nt, Homo sapiens
ccccauaaacuauuuguaa

SEQ ID NO: 1074934 - RNA, 19 nt, Homo sapiens
gcacugugaucuaauuuaa

SEQ ID NO: 1074935 - RNA, 19 nt, Homo sapiens
guaaucauauugccaaaga

SEQ ID NO: 1074936 - RNA, 19 nt, Homo sapiens
gcauugaaaucgagacuau

SEQ ID NO: 1074937 - RNA, 19 nt, Homo sapiens
cauauuggauucucaaaga

SEQ ID NO: 1074938 - RNA, 19 nt, Homo sapiens
ccaagagguuuacuauuga

SEQ ID NO: 1074939 - RNA, 19 nt, Homo sapiens
gcaccuugcuguuguacuu

SEQ ID NO: 1074940 - RNA, 19 nt, Homo sapiens
gcagcacugugaucuaauu

SEQ ID NO: 1074941 - RNA, 19 nt, Homo sapiens
guauagaucugccuaccuu

SEQ ID NO: 1074942 - RNA, 19 nt, Homo sapiens
gaacugcuuucucuaccuu

SEQ ID NO: 1074943 - RNA, 19 nt, Homo sapiens
gaacgaucauuucugacuu

SEQ ID NO: 1074944 - RNA, 19 nt, Homo sapiens
ggaguuucaugaggauuua

SEQ ID NO: 1074945 - RNA, 19 nt, Homo sapiens
ggagaaccauaaaggagaa

SEQ ID NO: 1074946 - RNA, 19 nt, Homo sapiens
gaccuacacggccaaauua

SEQ ID NO: 1074947 - RNA, 19 nt, Homo sapiens
ggagaaagaacgugauguu

SEQ ID NO: 1074948 - RNA, 19 nt, Homo sapiens
ccauaaaguuucugugaug

SEQ ID NO: 1074949 - RNA, 19 nt, Homo sapiens
gguuuacuauugaugcuua

SEQ ID NO: 1074950 - RNA, 19 nt, Homo sapiens
ggacuugguuuauauugca

SEQ ID NO: 1074951 - RNA, 19 nt, Homo sapiens
guaugaaacugccaauauc

SEQ ID NO: 1074952 - RNA, 19 nt, Homo sapiens
accaagagguuuacuauug

SEQ ID NO: 1074953 - RNA, 19 nt, Homo sapiens
gccaauaucaugaauagaa

SEQ ID NO: 1074954 - RNA, 19 nt, Homo sapiens
cauucacacucacuacuua

SEQ ID NO: 1074955 - RNA, 19 nt, Homo sapiens
cagaagaccaagagguuua

SEQ ID NO: 1074956 - RNA, 19 nt, Homo sapiens
gaaacugccaauaucauga

SEQ ID NO: 1074957 - RNA, 19 nt, Homo sapiens
gaggccaucugagcucaua

SEQ ID NO: 1074958 - RNA, 19 nt, Homo sapiens
ugugaacgaucauuucuga

SEQ ID NO: 1074959 - RNA, 19 nt, Homo sapiens
caucaacacuuuugcuaua

SEQ ID NO: 1074960 - RNA, 19 nt, Homo sapiens
cuacacggccaaauuaauu

SEQ ID NO: 1074961 - RNA, 19 nt, Homo sapiens
gaaaucagacgugugugaa

SEQ ID NO: 1074962 - RNA, 19 nt, Homo sapiens
gugguuaacuccuuguguu

SEQ ID NO: 1074963 - RNA, 19 nt, Homo sapiens
guucuguuauguucaugua

SEQ ID NO: 1074964 - RNA, 19 nt, Homo sapiens
ggcauucaguguucuguau

SEQ ID NO: 1074965 - RNA, 19 nt, Homo sapiens
uagaaagggagaaccauaa

SEQ ID NO: 1074966 - RNA, 19 nt, Homo sapiens
ucacacucacuacuuaaua

SEQ ID NO: 1074967 - RNA, 19 nt, Homo sapiens
gcacacucucaguuauuua

SEQ ID NO: 1074968 - RNA, 19 nt, Homo sapiens
gaaccuauuaaaccuagaa

SEQ ID NO: 1074969 - RNA, 19 nt, Homo sapiens
gaucauuucugacuuaacc

SEQ ID NO: 1074970 - RNA, 19 nt, Homo sapiens
gauguauugucuuccaguu

SEQ ID NO: 1074971 - RNA, 19 nt, Homo sapiens
ugccaaagacaaacuauuu

SEQ ID NO: 1074972 - RNA, 19 nt, Homo sapiens
gugauguucuguuauguuc

SEQ ID NO: 1074973 - RNA, 19 nt, Homo sapiens
aaacaugcaacauuucuug

SEQ ID NO: 1074974 - RNA, 19 nt, Homo sapiens
ucaaagacuucgauauggu

SEQ ID NO: 1074975 - RNA, 19 nt, Homo sapiens
aacgaucauuucugacuua

SEQ ID NO: 1074976 - RNA, 19 nt, Homo sapiens
cgaguacccuuccuguugu

SEQ ID NO: 1074977 - RNA, 19 nt, Homo sapiens
gauauggugaaccuauuaa

SEQ ID NO: 1074978 - RNA, 19 nt, Homo sapiens
cgauauggugaaccuauua

SEQ ID NO: 1074979 - RNA, 19 nt, Homo sapiens
uaacggaauguguaaauca

SEQ ID NO: 1074980 - RNA, 19 nt, Homo sapiens
acucuggacuugguuuaua

SEQ ID NO: 1074981 - RNA, 19 nt, Homo sapiens
gauguucuguuauguucau

SEQ ID NO: 1074982 - RNA, 19 nt, Homo sapiens
ucucaaagacuucgauaug

SEQ ID NO: 1074983 - RNA, 19 nt, Homo sapiens
cgucagcucgguugcuuua

SEQ ID NO: 1074984 - RNA, 19 nt, Homo sapiens
ccaaagacaaacuauuuca

SEQ ID NO: 1074985 - RNA, 19 nt, Homo sapiens
caagagguuuacuauugau

SEQ ID NO: 1074986 - RNA, 19 nt, Homo sapiens
gugaaaauguggaggaaaa

SEQ ID NO: 1074987 - RNA, 19 nt, Homo sapiens
gaaccauaaaggagaaaga

SEQ ID NO: 1074988 - RNA, 19 nt, Homo sapiens
gcaaucagaagaccaagag

SEQ ID NO: 1074989 - RNA, 19 nt, Homo sapiens
ucuguaacauuucugaguu

SEQ ID NO: 1074990 - RNA, 19 nt, Homo sapiens
agacgugugugaacgauca

SEQ ID NO: 1074991 - RNA, 19 nt, Homo sapiens
cgaaaccgaugugucuaug

SEQ ID NO: 1074992 - RNA, 19 nt, Homo sapiens
gcauucaguguucuguaua

SEQ ID NO: 1074993 - RNA, 19 nt, Homo sapiens
ccuagaaauuguauucauc

SEQ ID NO: 1074994 - RNA, 19 nt, Homo sapiens
guaacggaauguguaaauc

SEQ ID NO: 1074995 - RNA, 19 nt, Homo sapiens
cagcucgguugcuuuauca

SEQ ID NO: 1074996 - RNA, 19 nt, Homo sapiens
gaaagggagaaccauaaag

SEQ ID NO: 1074997 - RNA, 19 nt, Homo sapiens
gaauagaaagggagaacca

SEQ ID NO: 1074998 - RNA, 19 nt, Homo sapiens
uguaugaaacugccaauau

SEQ ID NO: 1074999 - RNA, 19 nt, Homo sapiens
aagcuguaauggugucuuu

SEQ ID NO: 1075000 - RNA, 19 nt, Homo sapiens
ugaaaucagacguguguga

SEQ ID NO: 1075001 - RNA, 19 nt, Homo sapiens
ucaguguucuguauagauc

SEQ ID NO: 1075002 - RNA, 19 nt, Homo sapiens
aaguuucugugauguauug

SEQ ID NO: 1075003 - RNA, 19 nt, Homo sapiens
cauaaaguuucugugaugu

SEQ ID NO: 1075004 - RNA, 19 nt, Homo sapiens
uaccauaaaguuucuguga

SEQ ID NO: 1075005 - RNA, 19 nt, Homo sapiens
gaccaagagguuuacuauu

SEQ ID NO: 1075006 - RNA, 19 nt, Homo sapiens
aaaccgaugugucuauggu

SEQ ID NO: 1075007 - RNA, 19 nt, Homo sapiens
ccagaccuaccauaaaguu

SEQ ID NO: 1075008 - RNA, 19 nt, Homo sapiens
gcacauaaugcagcacugu

SEQ ID NO: 1075009 - RNA, 19 nt, Homo sapiens
cugccaauaucaugaauag

SEQ ID NO: 1075010 - RNA, 19 nt, Homo sapiens
agaccuacacggccaaauu

SEQ ID NO: 1075011 - RNA, 19 nt, Homo sapiens
augcagcacugugaucuaa

SEQ ID NO: 1075012 - RNA, 19 nt, Homo sapiens
cacauggcauucaguguuc

SEQ ID NO: 1075013 - RNA, 19 nt, Homo sapiens
ugauaacccucuuuuaguu

SEQ ID NO: 1075014 - RNA, 19 nt, Homo sapiens
agaaagggagaaccauaaa

SEQ ID NO: 1075015 - RNA, 19 nt, Homo sapiens
ccaguuucaugcuguguca

SEQ ID NO: 1075016 - RNA, 19 nt, Homo sapiens
cgagacuauuuauuuggaa

SEQ ID NO: 1075017 - RNA, 19 nt, Homo sapiens
uuacugaguugcaucaaaa

SEQ ID NO: 1075018 - RNA, 19 nt, Homo sapiens
gaccuaccauaaaguuucu

SEQ ID NO: 1075019 - RNA, 19 nt, Homo sapiens
ucauauugccaaagacaaa

SEQ ID NO: 1075020 - RNA, 19 nt, Homo sapiens
gacuugguguugcuuggaa

SEQ ID NO: 1075021 - RNA, 19 nt, Homo sapiens
agaccaagagguuuacuau

SEQ ID NO: 1075022 - RNA, 19 nt, Homo sapiens
caugcaacauuucuugagu

SEQ ID NO: 1075023 - RNA, 19 nt, Homo sapiens
ucgagacuauuuauuugga

SEQ ID NO: 1075024 - RNA, 19 nt, Homo sapiens
augcaacauuucuugagua

SEQ ID NO: 1075025 - RNA, 19 nt, Homo sapiens
uuagcacacucucaguuau

SEQ ID NO: 1075026 - RNA, 19 nt, Homo sapiens
ucgauauggugaaccuauu

SEQ ID NO: 1075027 - RNA, 19 nt, Homo sapiens
gcugcaccuugcuguugua

SEQ ID NO: 1075028 - RNA, 19 nt, Homo sapiens
cugccuaccuuugugaauu

SEQ ID NO: 1075029 - RNA, 19 nt, Homo sapiens
cauguaaaccuaaagaaac

SEQ ID NO: 1075030 - RNA, 19 nt, Homo sapiens
aaacugccaauaucaugaa

SEQ ID NO: 1075031 - RNA, 19 nt, Homo sapiens
ugaaacugccaauaucaug

SEQ ID NO: 1075032 - RNA, 19 nt, Homo sapiens
ugcaacauuucuugaguau

SEQ ID NO: 1075033 - RNA, 19 nt, Homo sapiens
cggaauguguaaaucaaag

SEQ ID NO: 1075034 - RNA, 19 nt, Homo sapiens
ugaaagaacugaagcauuu

SEQ ID NO: 1075035 - RNA, 19 nt, Homo sapiens
ggacugcacuacauuauuu

SEQ ID NO: 1075036 - RNA, 19 nt, Homo sapiens
ggagagaaacugauauuua

SEQ ID NO: 1075037 - RNA, 19 nt, Homo sapiens
ggagaagacauguuuauuu

SEQ ID NO: 1075038 - RNA, 19 nt, Homo sapiens
aagcagaccuuacggaaua

SEQ ID NO: 1075039 - RNA, 19 nt, Homo sapiens
cagaggagauggagcguua

SEQ ID NO: 1075040 - RNA, 19 nt, Homo sapiens
gcuuggaggucauuaauaa

SEQ ID NO: 1075041 - RNA, 19 nt, Homo sapiens
gcaaauggguaauaguaga

SEQ ID NO: 1075042 - RNA, 19 nt, Homo sapiens
gaagauagucugaauggaa

SEQ ID NO: 1075043 - RNA, 19 nt, Homo sapiens
ccacugaaauagaggauaa

SEQ ID NO: 1075044 - RNA, 19 nt, Homo sapiens
ugacaucacuagaucaauu

SEQ ID NO: 1075045 - RNA, 19 nt, Homo sapiens
gcucugcaguuugguauua

SEQ ID NO: 1075046 - RNA, 19 nt, Homo sapiens
guuuaaagauggaagcuaa

SEQ ID NO: 1075047 - RNA, 19 nt, Homo sapiens
caaaugguaugccacaaga

SEQ ID NO: 1075048 - RNA, 19 nt, Homo sapiens
gcuguugguugaaaucaua

SEQ ID NO: 1075049 - RNA, 19 nt, Homo sapiens
gcaugugcauccagucuaa

SEQ ID NO: 1075050 - RNA, 19 nt, Homo sapiens
gagagaaucaaaugaguuu

SEQ ID NO: 1075051 - RNA, 19 nt, Homo sapiens
gaagaccagugaauuacga

SEQ ID NO: 1075052 - RNA, 19 nt, Homo sapiens
ggagagcagcacauucuua

SEQ ID NO: 1075053 - RNA, 19 nt, Homo sapiens
ugacaaagcugaaguuagc

SEQ ID NO: 1075054 - RNA, 19 nt, Homo sapiens
aaagagaccuauguugaaa

SEQ ID NO: 1075055 - RNA, 19 nt, Homo sapiens
gagauaagggcacacagua

SEQ ID NO: 1075056 - RNA, 19 nt, Homo sapiens
gcaagcaccuagugaucuu

SEQ ID NO: 1075057 - RNA, 19 nt, Homo sapiens
caagagaaagguagaacua

SEQ ID NO: 1075058 - RNA, 19 nt, Homo sapiens
ggaacaagaagaacauuau

SEQ ID NO: 1075059 - RNA, 19 nt, Homo sapiens
gaauggaaaucugaaauac

SEQ ID NO: 1075060 - RNA, 19 nt, Homo sapiens
ugaagaugaugaacaagaa

SEQ ID NO: 1075061 - RNA, 19 nt, Homo sapiens
agagaaagguagaacuaaa

SEQ ID NO: 1075062 - RNA, 19 nt, Homo sapiens
ggagaggucuugauguuuu

SEQ ID NO: 1075063 - RNA, 19 nt, Homo sapiens
guaaagaaggacugucuaa

SEQ ID NO: 1075064 - RNA, 19 nt, Homo sapiens
uaugaagaccagugaauua

SEQ ID NO: 1075065 - RNA, 19 nt, Homo sapiens
aaagaugugugaaauguuc

SEQ ID NO: 1075066 - RNA, 19 nt, Homo sapiens
gaaaagcgcugugcugaug

SEQ ID NO: 1075067 - RNA, 19 nt, Homo sapiens
cagugaagcuguugguuga

SEQ ID NO: 1075068 - RNA, 19 nt, Homo sapiens
ugaugaagaugaugaacaa

SEQ ID NO: 1075069 - RNA, 19 nt, Homo sapiens
agacgcaucuucauaaaca

SEQ ID NO: 1075070 - RNA, 19 nt, Homo sapiens
caagaaagaaggaauguag

SEQ ID NO: 1075071 - RNA, 19 nt, Homo sapiens
aaagaacacggaaacauuu

SEQ ID NO: 1075072 - RNA, 19 nt, Homo sapiens
gauggaagcuaagcaaugg

SEQ ID NO: 1075073 - RNA, 19 nt, Homo sapiens
cuugauagcuugaagaauc

SEQ ID NO: 1075074 - RNA, 19 nt, Homo sapiens
gggccaaacuacccaguga

SEQ ID NO: 1075075 - RNA, 19 nt, Homo sapiens
ucaugaaagugaagaguga

SEQ ID NO: 1075076 - RNA, 19 nt, Homo sapiens
gagaugaauugguggaagu

SEQ ID NO: 1075077 - RNA, 19 nt, Homo sapiens
uaaagcuacggcagaauua

SEQ ID NO: 1075078 - RNA, 19 nt, Homo sapiens
aagauagucugaauggaaa

SEQ ID NO: 1075079 - RNA, 19 nt, Homo sapiens
caugacugcugaagaaaga

SEQ ID NO: 1075080 - RNA, 19 nt, Homo sapiens
gaaauagagacgcaucuuc

SEQ ID NO: 1075081 - RNA, 19 nt, Homo sapiens
aagaaggacugucuaaagu

SEQ ID NO: 1075082 - RNA, 19 nt, Homo sapiens
gauaagggcacacaguaug

SEQ ID NO: 1075083 - RNA, 19 nt, Homo sapiens
ccagugaauuacgauauuu

SEQ ID NO: 1075084 - RNA, 19 nt, Homo sapiens
agaaauaugucacuugcau

SEQ ID NO: 1075085 - RNA, 19 nt, Homo sapiens
ggauuaggauuaguaguca

SEQ ID NO: 1075086 - RNA, 19 nt, Homo sapiens
gacauuacuuuagcaauuc

SEQ ID NO: 1075087 - RNA, 19 nt, Homo sapiens
gauuugacauggaagugaa

SEQ ID NO: 1075088 - RNA, 19 nt, Homo sapiens
ugucuaaagucaagucuau

SEQ ID NO: 1075089 - RNA, 19 nt, Homo sapiens
gacaucacuagaucaauua

SEQ ID NO: 1075090 - RNA, 19 nt, Homo sapiens
ccacaaaacagcacuauuu

SEQ ID NO: 1075091 - RNA, 19 nt, Homo sapiens
ggaccucucaugaaaguga

SEQ ID NO: 1075092 - RNA, 19 nt, Homo sapiens
agacaaacgagaugaauug

SEQ ID NO: 1075093 - RNA, 19 nt, Homo sapiens
caaacuacccagugaguau

SEQ ID NO: 1075094 - RNA, 19 nt, Homo sapiens
ggauaucaugguaacaaua

SEQ ID NO: 1075095 - RNA, 19 nt, Homo sapiens
ucacuugcauauagaaugu

SEQ ID NO: 1075096 - RNA, 19 nt, Homo sapiens
uuaaugcguuacuguauga

SEQ ID NO: 1075097 - RNA, 19 nt, Homo sapiens
uagagacgcaucuucauaa

SEQ ID NO: 1075098 - RNA, 19 nt, Homo sapiens
gaacuucagggauguuugu

SEQ ID NO: 1075099 - RNA, 19 nt, Homo sapiens
gaacugaagcauuuguaca

SEQ ID NO: 1075100 - RNA, 19 nt, Homo sapiens
gaacacacaaagagcuuau

SEQ ID NO: 1075101 - RNA, 19 nt, Homo sapiens
cuaaagguaugaacacaca

SEQ ID NO: 1075102 - RNA, 19 nt, Homo sapiens
gaacaagaagaacauuauc

SEQ ID NO: 1075103 - RNA, 19 nt, Homo sapiens
ucaggucaauuccuaguau

SEQ ID NO: 1075104 - RNA, 19 nt, Homo sapiens
aagcaaauggguaauagua

SEQ ID NO: 1075105 - RNA, 19 nt, Homo sapiens
gguaaagaguauuaucaag

SEQ ID NO: 1075106 - RNA, 19 nt, Homo sapiens
cuucagggauguuuguauu

SEQ ID NO: 1075107 - RNA, 19 nt, Homo sapiens
auacugcacuauggaauaa

SEQ ID NO: 1075108 - RNA, 19 nt, Homo sapiens
ugagaauacugcacuaugg

SEQ ID NO: 1075109 - RNA, 19 nt, Homo sapiens
gguguucagucuuuacaau

SEQ ID NO: 1075110 - RNA, 19 nt, Homo sapiens
guuaggcaaauacacauua

SEQ ID NO: 1075111 - RNA, 19 nt, Homo sapiens
ucaggccacugucuccuuu

SEQ ID NO: 1075112 - RNA, 19 nt, Homo sapiens
uaauaagaaugccuagaag

SEQ ID NO: 1075113 - RNA, 19 nt, Homo sapiens
gugaagcuguugguugaaa

SEQ ID NO: 1075114 - RNA, 19 nt, Homo sapiens
aaacaggcauacaggacaa

SEQ ID NO: 1075115 - RNA, 19 nt, Homo sapiens
caauggaaaugcuauacgu

SEQ ID NO: 1075116 - RNA, 19 nt, Homo sapiens
gaaauguucucugcaaaau

SEQ ID NO: 1075117 - RNA, 19 nt, Homo sapiens
gugaaauguucucugcaaa

SEQ ID NO: 1075118 - RNA, 19 nt, Homo sapiens
uaaaagagaccuauguuga

SEQ ID NO: 1075119 - RNA, 19 nt, Homo sapiens
agagacgcaucuucauaaa

SEQ ID NO: 1075120 - RNA, 19 nt, Homo sapiens
gucaguaucguucagauuu

SEQ ID NO: 1075121 - RNA, 19 nt, Homo sapiens
ucugugauguugauaucua

SEQ ID NO: 1075122 - RNA, 19 nt, Homo sapiens
gaaagugaagagugagaug

SEQ ID NO: 1075123 - RNA, 19 nt, Homo sapiens
cacacaguaugaacucuuu

SEQ ID NO: 1075124 - RNA, 19 nt, Homo sapiens
gcuaucagagcaacaaaga

SEQ ID NO: 1075125 - RNA, 19 nt, Homo sapiens
gcaagaaagaaggaaugua

SEQ ID NO: 1075126 - RNA, 19 nt, Homo sapiens
caagaagaacauuaucaga

SEQ ID NO: 1075127 - RNA, 19 nt, Homo sapiens
gaagcuaagcaauggaaau

SEQ ID NO: 1075128 - RNA, 19 nt, Homo sapiens
gauaggacugcacuacauu

SEQ ID NO: 1075129 - RNA, 19 nt, Homo sapiens
ucugaaauacggaauguuu

SEQ ID NO: 1075130 - RNA, 19 nt, Homo sapiens
guagucaguugcuguaaac

SEQ ID NO: 1075131 - RNA, 19 nt, Homo sapiens
cagccuccuugacuugaua

SEQ ID NO: 1075132 - RNA, 19 nt, Homo sapiens
uuauguaccuccuggaaug

SEQ ID NO: 1075133 - RNA, 19 nt, Homo sapiens
cccaaucaaucaaucaaga

SEQ ID NO: 1075134 - RNA, 19 nt, Homo sapiens
gaaauuggcccuccagaaa

SEQ ID NO: 1075135 - RNA, 19 nt, Homo sapiens
ugugcaagcugacuuauua

SEQ ID NO: 1075136 - RNA, 19 nt, Homo sapiens
gaucagagaugagaccaaa

SEQ ID NO: 1075137 - RNA, 19 nt, Homo sapiens
gaagaagauuaucgaggua

SEQ ID NO: 1075138 - RNA, 19 nt, Homo sapiens
caagcugacuuauuagaaa

SEQ ID NO: 1075139 - RNA, 19 nt, Homo sapiens
cauaagggcuuguguaagu

SEQ ID NO: 1075140 - RNA, 19 nt, Homo sapiens
gcggagagcaggcaauuaa

SEQ ID NO: 1075141 - RNA, 19 nt, Homo sapiens
gagacuugaugaauaaaga

SEQ ID NO: 1075142 - RNA, 19 nt, Homo sapiens
caacugaaacuucucuaaa

SEQ ID NO: 1075143 - RNA, 19 nt, Homo sapiens
gaucacagacagccucuuu

SEQ ID NO: 1075144 - RNA, 19 nt, Homo sapiens
acagacagccucuuuauga

SEQ ID NO: 1075145 - RNA, 19 nt, Homo sapiens
ugggagacuugaugaauaa

SEQ ID NO: 1075146 - RNA, 19 nt, Homo sapiens
ugagaaaugugaagguguu

SEQ ID NO: 1075147 - RNA, 19 nt, Homo sapiens
gaauaaagaaucccugaag

SEQ ID NO: 1075148 - RNA, 19 nt, Homo sapiens
gagguuuacuuccuugaga

SEQ ID NO: 1075149 - RNA, 19 nt, Homo sapiens
gugguuagaugcucacaga

SEQ ID NO: 1075150 - RNA, 19 nt, Homo sapiens
gcaagucagauuccaggua

SEQ ID NO: 1075151 - RNA, 19 nt, Homo sapiens
gagagaagaggcaagaaug

SEQ ID NO: 1075152 - RNA, 19 nt, Homo sapiens
uaccaccagucccuuaaua

SEQ ID NO: 1075153 - RNA, 19 nt, Homo sapiens
gcaagcugacuuauuagaa

SEQ ID NO: 1075154 - RNA, 19 nt, Homo sapiens
ggcagggagugcuguguaa

SEQ ID NO: 1075155 - RNA, 19 nt, Homo sapiens
gagaugagaccaaaaguaa

SEQ ID NO: 1075156 - RNA, 19 nt, Homo sapiens
gaauguuguacaccaguua

SEQ ID NO: 1075157 - RNA, 19 nt, Homo sapiens
gagagcaggcaauuaaaga

SEQ ID NO: 1075158 - RNA, 19 nt, Homo sapiens
gccauaagggcuuguguaa

SEQ ID NO: 1075159 - RNA, 19 nt, Homo sapiens
ggacggauggcuagagaga

SEQ ID NO: 1075160 - RNA, 19 nt, Homo sapiens
uauccuagaucagagauga

SEQ ID NO: 1075161 - RNA, 19 nt, Homo sapiens
gcaggcaauuaaagaagga

SEQ ID NO: 1075162 - RNA, 19 nt, Homo sapiens
gaaaagggauguuuaugac

SEQ ID NO: 1075163 - RNA, 19 nt, Homo sapiens
uggcuucucucccuuauuc

SEQ ID NO: 1075164 - RNA, 19 nt, Homo sapiens
gagauacacagacuagaug

SEQ ID NO: 1075165 - RNA, 19 nt, Homo sapiens
gagaagaggcaagaauguu

SEQ ID NO: 1075166 - RNA, 19 nt, Homo sapiens
uugggagacuugaugaaua

SEQ ID NO: 1075167 - RNA, 19 nt, Homo sapiens
caugucaccugccaaagug

SEQ ID NO: 1075168 - RNA, 19 nt, Homo sapiens
gccaugaauuccucuuguu

SEQ ID NO: 1075169 - RNA, 19 nt, Homo sapiens
gguagaggauguauagacu

SEQ ID NO: 1075170 - RNA, 19 nt, Homo sapiens
ucacagacagccucuuuau

SEQ ID NO: 1075171 - RNA, 19 nt, Homo sapiens
auaauggagucacgaagaa

SEQ ID NO: 1075172 - RNA, 19 nt, Homo sapiens
gaagugcuuucagauccaa

SEQ ID NO: 1075173 - RNA, 19 nt, Homo sapiens
uguauagacuggcuaguuc

SEQ ID NO: 1075174 - RNA, 19 nt, Homo sapiens
gaagaggcaagaauguugu

SEQ ID NO: 1075175 - RNA, 19 nt, Homo sapiens
caaagaaaagggauguuua

SEQ ID NO: 1075176 - RNA, 19 nt, Homo sapiens
caaaacaacugaaacuucu

SEQ ID NO: 1075177 - RNA, 19 nt, Homo sapiens
ccagguagaggauguauag

SEQ ID NO: 1075178 - RNA, 19 nt, Homo sapiens
ggacucuguuccuucuuca

SEQ ID NO: 1075179 - RNA, 19 nt, Homo sapiens
ccuaaacccugugccuuga

SEQ ID NO: 1075180 - RNA, 19 nt, Homo sapiens
ccaaguauuccgaugauuc

SEQ ID NO: 1075181 - RNA, 19 nt, Homo sapiens
guugccaucuccugacauu

SEQ ID NO: 1075182 - RNA, 19 nt, Homo sapiens
ccaggcauaugaagugcuu

SEQ ID NO: 1075183 - RNA, 19 nt, Homo sapiens
gcccuguguuucccacuuu

SEQ ID NO: 1075184 - RNA, 19 nt, Homo sapiens
uaauauguuugcccugugu

SEQ ID NO: 1075185 - RNA, 19 nt, Homo sapiens
gaggugagccagugguaau

SEQ ID NO: 1075186 - RNA, 19 nt, Homo sapiens
uagcuguccuccaaguauu

SEQ ID NO: 1075187 - RNA, 19 nt, Homo sapiens
ucaagccauuccucuagaa

SEQ ID NO: 1075188 - RNA, 19 nt, Homo sapiens
ucagggaagugagcuguau

SEQ ID NO: 1075189 - RNA, 19 nt, Homo sapiens
ggagagcaggcaauuaaag

SEQ ID NO: 1075190 - RNA, 19 nt, Homo sapiens
gagugugcaagcugacuua

SEQ ID NO: 1075191 - RNA, 19 nt, Homo sapiens
ccaugaauuccucuuguuu

SEQ ID NO: 1075192 - RNA, 19 nt, Homo sapiens
gggcagggagugcugugua

SEQ ID NO: 1075193 - RNA, 19 nt, Homo sapiens
gauuaucgagguacauguu

SEQ ID NO: 1075194 - RNA, 19 nt, Homo sapiens
ccagucccuuaauauguuu

SEQ ID NO: 1075195 - RNA, 19 nt, Homo sapiens
ccaauccaguaaauauauc

SEQ ID NO: 1075196 - RNA, 19 nt, Homo sapiens
ccaaggugauccgugagaa

SEQ ID NO: 1075197 - RNA, 19 nt, Homo sapiens
ccaccagucccuuaauaug

SEQ ID NO: 1075198 - RNA, 19 nt, Homo sapiens
guguaaaccugggauguag

SEQ ID NO: 1075199 - RNA, 19 nt, Homo sapiens
gaugagaccaaaaguaaaa

SEQ ID NO: 1075200 - RNA, 19 nt, Homo sapiens
gcagccggauuagugagaa

SEQ ID NO: 1075201 - RNA, 19 nt, Homo sapiens
uauaauggagucacgaaga

SEQ ID NO: 1075202 - RNA, 19 nt, Homo sapiens
guggacggauggcuagaga

SEQ ID NO: 1075203 - RNA, 19 nt, Homo sapiens
uauauggcagguuugcuua

SEQ ID NO: 1075204 - RNA, 19 nt, Homo sapiens
ggccauaagggcuugugua

SEQ ID NO: 1075205 - RNA, 19 nt, Homo sapiens
cuaacgcucugaaagucuu

SEQ ID NO: 1075206 - RNA, 19 nt, Homo sapiens
gaagggaucgguggagaag

SEQ ID NO: 1075207 - RNA, 19 nt, Homo sapiens
agaagaggcaagaauguug

SEQ ID NO: 1075208 - RNA, 19 nt, Homo sapiens
gguuagaugcucacagaug

SEQ ID NO: 1075209 - RNA, 19 nt, Homo sapiens
uguauugggugugccauga

SEQ ID NO: 1075210 - RNA, 19 nt, Homo sapiens
ugagcuguaucacaacaug

SEQ ID NO: 1075211 - RNA, 19 nt, Homo sapiens
gaaaugugaagguguuggu

SEQ ID NO: 1075212 - RNA, 19 nt, Homo sapiens
ccauggacaucuuugacau

SEQ ID NO: 1075213 - RNA, 19 nt, Homo sapiens
gagcaggcaauuaaagaag

SEQ ID NO: 1075214 - RNA, 19 nt, Homo sapiens
gcuuuccaauccaguaaau

SEQ ID NO: 1075215 - RNA, 19 nt, Homo sapiens
gugaaaugauucccaugag

SEQ ID NO: 1075216 - RNA, 19 nt, Homo sapiens
acggauggcuagagagaga

SEQ ID NO: 1075217 - RNA, 19 nt, Homo sapiens
uggcagguuugcuuaacaa

SEQ ID NO: 1075218 - RNA, 19 nt, Homo sapiens
uggcugaccugucccuauc

SEQ ID NO: 1075219 - RNA, 19 nt, Homo sapiens
ggaggugagccagugguaa

SEQ ID NO: 1075220 - RNA, 19 nt, Homo sapiens
ugagauacacagacuagau

SEQ ID NO: 1075221 - RNA, 19 nt, Homo sapiens
ccaaaggaguagguagaca

SEQ ID NO: 1075222 - RNA, 19 nt, Homo sapiens
gagguugggagacuugaug

SEQ ID NO: 1075223 - RNA, 19 nt, Homo sapiens
gaccaaaaguaaaagaauc

SEQ ID NO: 1075224 - RNA, 19 nt, Homo sapiens
accagucccuuaauauguu

SEQ ID NO: 1075225 - RNA, 19 nt, Homo sapiens
cggauuagugagaaacuuu

SEQ ID NO: 1075226 - RNA, 19 nt, Homo sapiens
cagacagccucuuuaugag

SEQ ID NO: 1075227 - RNA, 19 nt, Homo sapiens
ggccuuauuuccauuccau

SEQ ID NO: 1075228 - RNA, 19 nt, Homo sapiens
gugcuaaucgugagauaca

SEQ ID NO: 1075229 - RNA, 19 nt, Homo sapiens
gggugcuaaucgugagaua

SEQ ID NO: 1075230 - RNA, 19 nt, Homo sapiens
agaaauuggcccuccagaa

SEQ ID NO: 1075231 - RNA, 19 nt, Homo sapiens
caccagucccuuaauaugu

SEQ ID NO: 1075232 - RNA, 19 nt, Homo sapiens
auaaagaaucccugaagga

SEQ ID NO: 1075233 - RNA, 19 nt, Homo sapiens
gcaugagguugggagacuu

SEQ ID NO: 1075234 - RNA, 19 nt, Homo sapiens
gaaagaaacauucgguaaa

SEQ ID NO: 1075235 - RNA, 19 nt, Homo sapiens
gagcagacaucagagagua

SEQ ID NO: 1075236 - RNA, 19 nt, Homo sapiens
gcacagaaagguuaagaaa

SEQ ID NO: 1075237 - RNA, 19 nt, Homo sapiens
gcaagcagcugcccagaca

SEQ ID NO: 1075238 - RNA, 19 nt, Homo sapiens
gagagaaagugauggcaau

SEQ ID NO: 1075239 - RNA, 19 nt, Homo sapiens
gauguaagggagcuuguua

SEQ ID NO: 1075240 - RNA, 19 nt, Homo sapiens
gaagguugagggaacuuua

SEQ ID NO: 1075241 - RNA, 19 nt, Homo sapiens
caaguaaggacaugaagaa

SEQ ID NO: 1075242 - RNA, 19 nt, Homo sapiens
ccacaaggcccacuggaaa

SEQ ID NO: 1075243 - RNA, 19 nt, Homo sapiens
gaagauggguuugauugag

SEQ ID NO: 1075244 - RNA, 19 nt, Homo sapiens
ggaaauagcacagaaaggu

SEQ ID NO: 1075245 - RNA, 19 nt, Homo sapiens
acagaaagguuaagaaacu

SEQ ID NO: 1075246 - RNA, 19 nt, Homo sapiens
gaaauagcacagaaagguu

SEQ ID NO: 1075247 - RNA, 19 nt, Homo sapiens
ggaaugagagaaagugaug

SEQ ID NO: 1075248 - RNA, 19 nt, Homo sapiens
gaaagagaaagcaggaaga

SEQ ID NO: 1075249 - RNA, 19 nt, Homo sapiens
ugagagaagugggaaagaa

SEQ ID NO: 1075250 - RNA, 19 nt, Homo sapiens
ugaaagaaacauucgguaa

SEQ ID NO: 1075251 - RNA, 19 nt, Homo sapiens
gguccaggcuauaauaauc

SEQ ID NO: 1075252 - RNA, 19 nt, Homo sapiens
guaaggacaugaagaagcu

SEQ ID NO: 1075253 - RNA, 19 nt, Homo sapiens
gguccugguuucccuauga

SEQ ID NO: 1075254 - RNA, 19 nt, Homo sapiens
gaacuugagggaagguuga

SEQ ID NO: 1075255 - RNA, 19 nt, Homo sapiens
ggaaagaagcaauggaaag

SEQ ID NO: 1075256 - RNA, 19 nt, Homo sapiens
caacuguucugugcgugua

SEQ ID NO: 1075257 - RNA, 19 nt, Homo sapiens
aaagaaacauucgguaaag

SEQ ID NO: 1075258 - RNA, 19 nt, Homo sapiens
aaauagcacagaaagguua

SEQ ID NO: 1075259 - RNA, 19 nt, Homo sapiens
ggaagauggguuugauuga

SEQ ID NO: 1075260 - RNA, 19 nt, Homo sapiens
uguaaggaauggagugauu

SEQ ID NO: 1075261 - RNA, 19 nt, Homo sapiens
ggaaagcugggucaggaaa

SEQ ID NO: 1075262 - RNA, 19 nt, Homo sapiens
gaagugcagcgagggcuua

SEQ ID NO: 1075263 - RNA, 19 nt, Homo sapiens
ugaaggccauugacucaga

SEQ ID NO: 1075264 - RNA, 19 nt, Homo sapiens
ggaagugaaagaaacauuc

SEQ ID NO: 1075265 - RNA, 19 nt, Homo sapiens
gguaccaucucuucuucuu

SEQ ID NO: 1075266 - RNA, 19 nt, Homo sapiens
cagagaguaucaacuguuc

SEQ ID NO: 1075267 - RNA, 19 nt, Homo sapiens
ggaagauucugaguuaggu

SEQ ID NO: 1075268 - RNA, 19 nt, Homo sapiens
ccagggagcaugcgcauug

SEQ ID NO: 1075269 - RNA, 19 nt, Homo sapiens
caacaggacccucgugaag

SEQ ID NO: 1075270 - RNA, 19 nt, Homo sapiens
ggagugauuuggacuugag

SEQ ID NO: 1075271 - RNA, 19 nt, Homo sapiens
gaaauccaucucaguagga

SEQ ID NO: 1075272 - RNA, 19 nt, Homo sapiens
acucagagguguaaggaau

SEQ ID NO: 1075273 - RNA, 19 nt, Homo sapiens
ccaaaggcagagaaacuaa

SEQ ID NO: 1075274 - RNA, 19 nt, Homo sapiens
gaaagaagcaauggaaagc

SEQ ID NO: 1075275 - RNA, 19 nt, Homo sapiens
ugauugagguccugguuuc

SEQ ID NO: 1075276 - RNA, 19 nt, Homo sapiens
guaaagaggggaagaugua

SEQ ID NO: 1075277 - RNA, 19 nt, Homo sapiens
ucacaccacuacucuccaa

SEQ ID NO: 1075278 - RNA, 19 nt, Homo sapiens
caucagagaguaucaacug

SEQ ID NO: 1075279 - RNA, 19 nt, Homo sapiens
ggauuuaagaucucaggaa

SEQ ID NO: 1075280 - RNA, 19 nt, Homo sapiens
caaaggcagagaaacuaaa

SEQ ID NO: 1075281 - RNA, 19 nt, Homo sapiens
acaggacccucgugaagga

SEQ ID NO: 1075282 - RNA, 19 nt, Homo sapiens
gggcuuaacccuccucaca

SEQ ID NO: 1075283 - RNA, 19 nt, Homo sapiens
gcaaucacaccacuacucu

SEQ ID NO: 1075284 - RNA, 19 nt, Homo sapiens
ggugaaggccauugacuca

SEQ ID NO: 1075285 - RNA, 19 nt, Homo sapiens
guaccaggcaugugaagug

SEQ ID NO: 1075286 - RNA, 19 nt, Homo sapiens
guaaggaauggagugauuu

SEQ ID NO: 1075287 - RNA, 19 nt, Homo sapiens
gcaacaggacccucgugaa

SEQ ID NO: 1075288 - RNA, 19 nt, Homo sapiens
gggaaagaagcaauggaaa

SEQ ID NO: 1075289 - RNA, 19 nt, Homo sapiens
cagaaagguuaagaaacuu

SEQ ID NO: 1075290 - RNA, 19 nt, Homo sapiens
ggcugaggcugacaacaau

SEQ ID NO: 1075291 - RNA, 19 nt, Homo sapiens
ugggaaauccaucucagua

SEQ ID NO: 1075292 - RNA, 19 nt, Homo sapiens
ccaagauaguucucuaagg

SEQ ID NO: 1075293 - RNA, 19 nt, Homo sapiens
acaccuaacugggaaaugg

SEQ ID NO: 1075294 - RNA, 19 nt, Homo sapiens
gagcugggaggaucacuca

SEQ ID NO: 1075295 - RNA, 19 nt, Homo sapiens
gaagguuuccaguucaaca

SEQ ID NO: 1075296 - RNA, 19 nt, Homo sapiens
gaacuuuagggaagguuuc

SEQ ID NO: 1075297 - RNA, 19 nt, Homo sapiens
ccagggauuuggacucaag

SEQ ID NO: 1075298 - RNA, 19 nt, Homo sapiens
gaauuugaaccccaagaua

SEQ ID NO: 1075299 - RNA, 19 nt, Homo sapiens
ugacaaguaaggacaugaa

SEQ ID NO: 1075300 - RNA, 19 nt, Homo sapiens
aaagcugggucaggaaaga

SEQ ID NO: 1075301 - RNA, 19 nt, Homo sapiens
gaagugggaaagaagcaau

SEQ ID NO: 1075302 - RNA, 19 nt, Homo sapiens
gcaagaggagcuggauuuc

SEQ ID NO: 1075303 - RNA, 19 nt, Homo sapiens
ccagaguccucagggaaug

SEQ ID NO: 1075304 - RNA, 19 nt, Homo sapiens
gagagaagugggaaagaag

SEQ ID NO: 1075305 - RNA, 19 nt, Homo sapiens
aagaaacauucgguaaaga

SEQ ID NO: 1075306 - RNA, 19 nt, Homo sapiens
gcuuaacccuccucacaac

SEQ ID NO: 1075307 - RNA, 19 nt, Homo sapiens
uaaggaauggagugauuug

SEQ ID NO: 1075308 - RNA, 19 nt, Homo sapiens
aaagagaaagcaggaagaa

SEQ ID NO: 1075309 - RNA, 19 nt, Homo sapiens
uaccaucucuucuucuuuu

SEQ ID NO: 1075310 - RNA, 19 nt, Homo sapiens
gagaguaucaacuguucug

SEQ ID NO: 1075311 - RNA, 19 nt, Homo sapiens
gaugaugaagauaaagaug

SEQ ID NO: 1075312 - RNA, 19 nt, Homo sapiens
ggaacuuuagggaagguuu

SEQ ID NO: 1075313 - RNA, 19 nt, Homo sapiens
gggaagugaaagaaacauu

SEQ ID NO: 1075314 - RNA, 19 nt, Homo sapiens
acaggaagauggguuugau

SEQ ID NO: 1075315 - RNA, 19 nt, Homo sapiens
ugaugaagauaaagaugag

SEQ ID NO: 1075316 - RNA, 19 nt, Homo sapiens
cugaugaugaugaagauaa

SEQ ID NO: 1075317 - RNA, 19 nt, Homo sapiens
ccuguaaucccagcacuuu

SEQ ID NO: 1075318 - RNA, 19 nt, Homo sapiens
gcccaaccaguaagucaaa

SEQ ID NO: 1075319 - RNA, 19 nt, Homo sapiens
gaaagcaggaagaaaauca

SEQ ID NO: 1075320 - RNA, 19 nt, Homo sapiens
gaagugaaagaaacauucg

SEQ ID NO: 1075321 - RNA, 19 nt, Homo sapiens
auagggaaauagcacagaa

SEQ ID NO: 1075322 - RNA, 19 nt, Homo sapiens
ggaagguugagggaacuuu

SEQ ID NO: 1075323 - RNA, 19 nt, Homo sapiens
uaaguguccugcccaacca

SEQ ID NO: 1075324 - RNA, 19 nt, Homo sapiens
gcguguaccaggcauguga

SEQ ID NO: 1075325 - RNA, 19 nt, Homo sapiens
ucagagaguaucaacuguu

SEQ ID NO: 1075326 - RNA, 19 nt, Homo sapiens
gggaaauccaucucaguag

SEQ ID NO: 1075327 - RNA, 19 nt, Homo sapiens
gcaagccaggguuggaaga

SEQ ID NO: 1075328 - RNA, 19 nt, Homo sapiens
guaccaucucuucuucuuu

SEQ ID NO: 1075329 - RNA, 19 nt, Homo sapiens
agagaaagcaggaagaaaa

SEQ ID NO: 1075330 - RNA, 19 nt, Homo sapiens
guaagggagcuuguuaaca

SEQ ID NO: 1075331 - RNA, 19 nt, Homo sapiens
uccaugcucccaacccuua

SEQ ID NO: 1075332 - RNA, 19 nt, Homo sapiens
gaagaaccaaaggcagaga

SEQ ID NO: 1075333 - RNA, 19 nt, Homo sapiens
aaauccaucucaguaggaa

SEQ ID NO: 1075334 - RNA, 19 nt, Homo sapiens
gaacagauauuaagacucu

SEQ ID NO: 1075335 - RNA, 19 nt, Homo sapiens
cuaaggagcuugccuaauu

SEQ ID NO: 1075336 - RNA, 19 nt, Homo sapiens
gagagaagguuguaaaaua

SEQ ID NO: 1075337 - RNA, 19 nt, Homo sapiens
guagguaacucuuuguauu

SEQ ID NO: 1075338 - RNA, 19 nt, Homo sapiens
gauaaggaaugguucacua

SEQ ID NO: 1075339 - RNA, 19 nt, Homo sapiens
gaaauaagccagggccaua

SEQ ID NO: 1075340 - RNA, 19 nt, Homo sapiens
gaagagagaagguuguaaa

SEQ ID NO: 1075341 - RNA, 19 nt, Homo sapiens
ggagguagguaacucuuug

SEQ ID NO: 1075342 - RNA, 19 nt, Homo sapiens
gcaaacagaccaauuguca

SEQ ID NO: 1075343 - RNA, 19 nt, Homo sapiens
gaagucauauccacugucu

SEQ ID NO: 1075344 - RNA, 19 nt, Homo sapiens
gaaacaauauggucuacac

SEQ ID NO: 1075345 - RNA, 19 nt, Homo sapiens
cauaaugccuuuaacucuu

SEQ ID NO: 1075346 - RNA, 19 nt, Homo sapiens
gugcaacucugaggacuuu

SEQ ID NO: 1075347 - RNA, 19 nt, Homo sapiens
cauauccacugucuuguga

SEQ ID NO: 1075348 - RNA, 19 nt, Homo sapiens
gguauuaacacaaaucguu

SEQ ID NO: 1075349 - RNA, 19 nt, Homo sapiens
acaauauggucuacacuga

SEQ ID NO: 1075350 - RNA, 19 nt, Homo sapiens
acaaauaucugugucucuu

SEQ ID NO: 1075351 - RNA, 19 nt, Homo sapiens
uuugggaccucuugaagua

SEQ ID NO: 1075352 - RNA, 19 nt, Homo sapiens
ccaaagccagaacauauuu

SEQ ID NO: 1075353 - RNA, 19 nt, Homo sapiens
ggacuccaacacaaagaua

SEQ ID NO: 1075354 - RNA, 19 nt, Homo sapiens
uaagauauugugcagagua

SEQ ID NO: 1075355 - RNA, 19 nt, Homo sapiens
agaaauacauccagcugau

SEQ ID NO: 1075356 - RNA, 19 nt, Homo sapiens
ggucuacacugaacaucug

SEQ ID NO: 1075357 - RNA, 19 nt, Homo sapiens
uaaggagcuugccuaauuc

SEQ ID NO: 1075358 - RNA, 19 nt, Homo sapiens
cagaugggcucgagagucu

SEQ ID NO: 1075359 - RNA, 19 nt, Homo sapiens
uaauucccauguguuguua

SEQ ID NO: 1075360 - RNA, 19 nt, Homo sapiens
uaccaaagccagaacauau

SEQ ID NO: 1075361 - RNA, 19 nt, Homo sapiens
ugugaccaguuccaaauaa

SEQ ID NO: 1075362 - RNA, 19 nt, Homo sapiens
uugcugacuuugcuuuaua

SEQ ID NO: 1075363 - RNA, 19 nt, Homo sapiens
cguuaccucuuccuucuuu

SEQ ID NO: 1075364 - RNA, 19 nt, Homo sapiens
gguuauuccucuuaugugu

SEQ ID NO: 1075365 - RNA, 19 nt, Homo sapiens
aaagcaaacagaccaauug

SEQ ID NO: 1075366 - RNA, 19 nt, Homo sapiens
aagauauugugcagaguaa

SEQ ID NO: 1075367 - RNA, 19 nt, Homo sapiens
aaauaucugugucucuuuc

SEQ ID NO: 1075368 - RNA, 19 nt, Homo sapiens
gcucacccuggccaaauua

SEQ ID NO: 1075369 - RNA, 19 nt, Homo sapiens
guaacucuuuguauucaca

SEQ ID NO: 1075370 - RNA, 19 nt, Homo sapiens
ucauacaccuuuuccauuu

SEQ ID NO: 1075371 - RNA, 19 nt, Homo sapiens
gaccaguuccaaauaagaa

SEQ ID NO: 1075372 - RNA, 19 nt, Homo sapiens
gaccaauugucaaccuaau

SEQ ID NO: 1075373 - RNA, 19 nt, Homo sapiens
cacccuggccaaauuauaa

SEQ ID NO: 1075374 - RNA, 19 nt, Homo sapiens
ccugaggacuccaacacaa

SEQ ID NO: 1075375 - RNA, 19 nt, Homo sapiens
gcugaucaauacauaaugc

SEQ ID NO: 1075376 - RNA, 19 nt, Homo sapiens
gugccuaugugaccaguuc

SEQ ID NO: 1075377 - RNA, 19 nt, Homo sapiens
gcaggccugacaauacuaa

SEQ ID NO: 1075378 - RNA, 19 nt, Homo sapiens
caaauaucugugucucuuu

SEQ ID NO: 1075379 - RNA, 19 nt, Homo sapiens
acacaaaucguuaccucuu

SEQ ID NO: 1075380 - RNA, 19 nt, Homo sapiens
ccuguaagguauuaacaca

SEQ ID NO: 1075381 - RNA, 19 nt, Homo sapiens
gccagggccauaagcauaa

SEQ ID NO: 1075382 - RNA, 19 nt, Homo sapiens
caacucugaggacuuugua

SEQ ID NO: 1075383 - RNA, 19 nt, Homo sapiens
ccuaugaguccuccuagaa

SEQ ID NO: 1075384 - RNA, 19 nt, Homo sapiens
cacaaaucguuaccucuuc

SEQ ID NO: 1075385 - RNA, 19 nt, Homo sapiens
caauauggucuacacugaa

SEQ ID NO: 1075386 - RNA, 19 nt, Homo sapiens
agucauauccacugucuug

SEQ ID NO: 1075387 - RNA, 19 nt, Homo sapiens
acauccagcugaucaauac

SEQ ID NO: 1075388 - RNA, 19 nt, Homo sapiens
caacacaaagauauagaag

SEQ ID NO: 1075389 - RNA, 19 nt, Homo sapiens
ccaacacaaagauauagaa

SEQ ID NO: 1075390 - RNA, 19 nt, Homo sapiens
gaacgcagggcagaguuuc

SEQ ID NO: 1075391 - RNA, 19 nt, Homo sapiens
cagaccaauugucaaccua

SEQ ID NO: 1075392 - RNA, 19 nt, Homo sapiens
cagcugaucaauacauaau

SEQ ID NO: 1075393 - RNA, 19 nt, Homo sapiens
gaaauacauccagcugauc

SEQ ID NO: 1075394 - RNA, 19 nt, Homo sapiens
ugacuuugcuuuauauccu

SEQ ID NO: 1075395 - RNA, 19 nt, Homo sapiens
cacuggacuuggccucaua

SEQ ID NO: 1075396 - RNA, 19 nt, Homo sapiens
cuaauucccauguguuguu

SEQ ID NO: 1075397 - RNA, 19 nt, Homo sapiens
aagcaggccugacaauacu

SEQ ID NO: 1075398 - RNA, 19 nt, Homo sapiens
uccagcugaucaauacaua

SEQ ID NO: 1075399 - RNA, 19 nt, Homo sapiens
gguagguaacucuuuguau

SEQ ID NO: 1075400 - RNA, 19 nt, Homo sapiens
uauaugcagaguccuauga

SEQ ID NO: 1075401 - RNA, 19 nt, Homo sapiens
uaaggaaugguucacuaug

SEQ ID NO: 1075402 - RNA, 19 nt, Homo sapiens
gugaagagagaagguugua

SEQ ID NO: 1075403 - RNA, 19 nt, Homo sapiens
aaacagaccaauugucaac

SEQ ID NO: 1075404 - RNA, 19 nt, Homo sapiens
aaagcaggccugacaauac

SEQ ID NO: 1075405 - RNA, 19 nt, Homo sapiens
cuaugaguccuccuagaaa

SEQ ID NO: 1075406 - RNA, 19 nt, Homo sapiens
gcaacucugaggacuuugu

SEQ ID NO: 1075407 - RNA, 19 nt, Homo sapiens
caaacagaccaauugucaa

SEQ ID NO: 1075408 - RNA, 19 nt, Homo sapiens
gaugggcucgagagucuug

SEQ ID NO: 1075409 - RNA, 19 nt, Homo sapiens
uuaccaaagccagaacaua

SEQ ID NO: 1075410 - RNA, 19 nt, Homo sapiens
aaauacauccagcugauca

SEQ ID NO: 1075411 - RNA, 19 nt, Homo sapiens
uagguaacucuuuguauuc

SEQ ID NO: 1075412 - RNA, 19 nt, Homo sapiens
ccucuuccuucuuuauauc

SEQ ID NO: 1075413 - RNA, 19 nt, Homo sapiens
aaauaagccagggccauaa

SEQ ID NO: 1075414 - RNA, 19 nt, Homo sapiens
ucacccuggccaaauuaua

SEQ ID NO: 1075415 - RNA, 19 nt, Homo sapiens
aacuaagggugaagagaga

SEQ ID NO: 1075416 - RNA, 19 nt, Homo sapiens
gacuuugcuuuauauccuu

SEQ ID NO: 1075417 - RNA, 19 nt, Homo sapiens
gggaccucuugaaguauga

SEQ ID NO: 1075418 - RNA, 19 nt, Homo sapiens
uaugugaccaguuccaaau

SEQ ID NO: 1075419 - RNA, 19 nt, Homo sapiens
ucucgaggguucccauuac

SEQ ID NO: 1075420 - RNA, 19 nt, Homo sapiens
gcuccugggcacuuugauu

SEQ ID NO: 1075421 - RNA, 19 nt, Homo sapiens
ugggaccucuugaaguaug

SEQ ID NO: 1075422 - RNA, 19 nt, Homo sapiens
ccugacaauacuaaccuua

SEQ ID NO: 1075423 - RNA, 19 nt, Homo sapiens
uaccucuuccuucuuuaua

SEQ ID NO: 1075424 - RNA, 19 nt, Homo sapiens
guuaccucuuccuucuuua

SEQ ID NO: 1075425 - RNA, 19 nt, Homo sapiens
cugaggacuuuguaagcuu

SEQ ID NO: 1075426 - RNA, 19 nt, Homo sapiens
cauguguuguuacaguuca

SEQ ID NO: 1075427 - RNA, 19 nt, Homo sapiens
ugaccaguuccaaauaaga

SEQ ID NO: 1075428 - RNA, 19 nt, Homo sapiens
gugaccaguuccaaauaag

SEQ ID NO: 1075429 - RNA, 19 nt, Homo sapiens
gaauuuugguacauacuag

SEQ ID NO: 1075430 - RNA, 19 nt, Homo sapiens
gcuggcuccugggcacuuu

SEQ ID NO: 1075431 - RNA, 19 nt, Homo sapiens
gauauugugcagaguaaaa

SEQ ID NO: 1075432 - RNA, 19 nt, Homo sapiens
gccagaacauauuuugcua

SEQ ID NO: 1075433 - RNA, 19 nt, Homo sapiens
uacauccagcugaucaaua

SEQ ID NO: 1075434 - RNA, 19 nt, Homo sapiens
ggucauaucucgcaaagga

SEQ ID NO: 1075435 - RNA, 19 nt, Homo sapiens
gagcagagcaucuuuaaug

SEQ ID NO: 1075436 - RNA, 19 nt, Homo sapiens
ucacaagggucaagcaauu

SEQ ID NO: 1075437 - RNA, 19 nt, Homo sapiens
aggaagagcuauuaacaaa

SEQ ID NO: 1075438 - RNA, 19 nt, Homo sapiens
gcaggaagcauacaauaau

SEQ ID NO: 1075439 - RNA, 19 nt, Homo sapiens
uuaaggagcucaauauucu

SEQ ID NO: 1075440 - RNA, 19 nt, Homo sapiens
ccaaagaccucaagcucau

SEQ ID NO: 1075441 - RNA, 19 nt, Homo sapiens
gcaaaggaagagcuauuaa

SEQ ID NO: 1075442 - RNA, 19 nt, Homo sapiens
ucucucagcucaaauaugu

SEQ ID NO: 1075443 - RNA, 19 nt, Homo sapiens
gagugcagguuguuauuau

SEQ ID NO: 1075444 - RNA, 19 nt, Homo sapiens
gcauuaaggagcucaauau

SEQ ID NO: 1075445 - RNA, 19 nt, Homo sapiens
caaguucagaucacaauuu

SEQ ID NO: 1075446 - RNA, 19 nt, Homo sapiens
gggcaagagccaaaucuaa

SEQ ID NO: 1075447 - RNA, 19 nt, Homo sapiens
gcaggucccaucuccauuu

SEQ ID NO: 1075448 - RNA, 19 nt, Homo sapiens
ggcaagagccaaaucuaaa

SEQ ID NO: 1075449 - RNA, 19 nt, Homo sapiens
ccagggagcucacggucuu

SEQ ID NO: 1075450 - RNA, 19 nt, Homo sapiens
ggagcucaauauucuucua

SEQ ID NO: 1075451 - RNA, 19 nt, Homo sapiens
ucaaauauguaugcucuca

SEQ ID NO: 1075452 - RNA, 19 nt, Homo sapiens
caagucaucuaggcucuga

SEQ ID NO: 1075453 - RNA, 19 nt, Homo sapiens
uaaagaccauucccuaggu

SEQ ID NO: 1075454 - RNA, 19 nt, Homo sapiens
caggaagcauacaauaaug

SEQ ID NO: 1075455 - RNA, 19 nt, Homo sapiens
ggaagggaaagaaagaaga

SEQ ID NO: 1075456 - RNA, 19 nt, Homo sapiens
gggaaagaaagaagacaaa

SEQ ID NO: 1075457 - RNA, 19 nt, Homo sapiens
ugaaccaaaucuugaagga

SEQ ID NO: 1075458 - RNA, 19 nt, Homo sapiens
gcucaauauucuucuagau

SEQ ID NO: 1075459 - RNA, 19 nt, Homo sapiens
guucagaucacaauuuaca

SEQ ID NO: 1075460 - RNA, 19 nt, Homo sapiens
ggaagcauacaauaaugga

SEQ ID NO: 1075461 - RNA, 19 nt, Homo sapiens
aaaggaagagcuauuaaca

SEQ ID NO: 1075462 - RNA, 19 nt, Homo sapiens
ggaggucuuggcagguuua

SEQ ID NO: 1075463 - RNA, 19 nt, Homo sapiens
gcagguuguuauuaugcaa

SEQ ID NO: 1075464 - RNA, 19 nt, Homo sapiens
guuccuacaugcaaaauuu

SEQ ID NO: 1075465 - RNA, 19 nt, Homo sapiens
uaugcuagccucucuauca

SEQ ID NO: 1075466 - RNA, 19 nt, Homo sapiens
ugacuccucucacgcuuuc

SEQ ID NO: 1075467 - RNA, 19 nt, Homo sapiens
caaaaugaaccaaaucuug

SEQ ID NO: 1075468 - RNA, 19 nt, Homo sapiens
ggaagagcuauuaacaaau

SEQ ID NO: 1075469 - RNA, 19 nt, Homo sapiens
gcaaagccacagcauuaag

SEQ ID NO: 1075470 - RNA, 19 nt, Homo sapiens
ggaaugguagcaagucauc

SEQ ID NO: 1075471 - RNA, 19 nt, Homo sapiens
gggcuggcacggaauggua

SEQ ID NO: 1075472 - RNA, 19 nt, Homo sapiens
cgcaaaggaagagcuauua

SEQ ID NO: 1075473 - RNA, 19 nt, Homo sapiens
ccaaacaaaucugacaaaa

SEQ ID NO: 1075474 - RNA, 19 nt, Homo sapiens
gaagcccauuugacuccaa

SEQ ID NO: 1075475 - RNA, 19 nt, Homo sapiens
gaaccauucgacaaccaaa

SEQ ID NO: 1075476 - RNA, 19 nt, Homo sapiens
caaaggaagagcuauuaac

SEQ ID NO: 1075477 - RNA, 19 nt, Homo sapiens
gcaagagccaaaucuaaaa

SEQ ID NO: 1075478 - RNA, 19 nt, Homo sapiens
aaagagugcagguuguuau

SEQ ID NO: 1075479 - RNA, 19 nt, Homo sapiens
gaagcauacaauaauggaa

SEQ ID NO: 1075480 - RNA, 19 nt, Homo sapiens
gcacggaaugguagcaagu

SEQ ID NO: 1075481 - RNA, 19 nt, Homo sapiens
ggucuuggcagguuuaugc

SEQ ID NO: 1075482 - RNA, 19 nt, Homo sapiens
cauuaaggagcucaauauu

SEQ ID NO: 1075483 - RNA, 19 nt, Homo sapiens
aaauauguaugcucucacu

SEQ ID NO: 1075484 - RNA, 19 nt, Homo sapiens
caggucccaucuccauuug

SEQ ID NO: 1075485 - RNA, 19 nt, Homo sapiens
gaagggaaagaaagaagac

SEQ ID NO: 1075486 - RNA, 19 nt, Homo sapiens
ggagcucacggucuucuca

SEQ ID NO: 1075487 - RNA, 19 nt, Homo sapiens
agagugcagguuguuauua

SEQ ID NO: 1075488 - RNA, 19 nt, Homo sapiens
cucaugagcuccaacacau

SEQ ID NO: 1075489 - RNA, 19 nt, Homo sapiens
ugcaggaagcauacaauaa

SEQ ID NO: 1075490 - RNA, 19 nt, Homo sapiens
auucgacaaccaaauguua

SEQ ID NO: 1075491 - RNA, 19 nt, Homo sapiens
caugagcuccaacacauuc

SEQ ID NO: 1075492 - RNA, 19 nt, Homo sapiens
gcucuguuccuacaugcaa

SEQ ID NO: 1075493 - RNA, 19 nt, Homo sapiens
agguguagcucuguuccua

SEQ ID NO: 1075494 - RNA, 19 nt, Homo sapiens
ggaaccauucgacaaccaa

SEQ ID NO: 1075495 - RNA, 19 nt, Homo sapiens
aaggaggucuuggcagguu

SEQ ID NO: 1075496 - RNA, 19 nt, Homo sapiens
cuacagugcuucccaucac

SEQ ID NO: 1075497 - RNA, 19 nt, Homo sapiens
gagcucaauauucuucuag

SEQ ID NO: 1075498 - RNA, 19 nt, Homo sapiens
caaagccacagcauuaagg

SEQ ID NO: 1075499 - RNA, 19 nt, Homo sapiens
aaugguagcaagucaucua

SEQ ID NO: 1075500 - RNA, 19 nt, Homo sapiens
ucuuuuaucuggcaacuuu

SEQ ID NO: 1075501 - RNA, 19 nt, Homo sapiens
ggaaagaaagaagacaaaa

SEQ ID NO: 1075502 - RNA, 19 nt, Homo sapiens
aauaauggaagggaaagaa

SEQ ID NO: 1075503 - RNA, 19 nt, Homo sapiens
ucucagcucaaauauguau

SEQ ID NO: 1075504 - RNA, 19 nt, Homo sapiens
ggucuucucagguucaucu

SEQ ID NO: 1075505 - RNA, 19 nt, Homo sapiens
ggaugguggugguggaaaa

SEQ ID NO: 1075506 - RNA, 19 nt, Homo sapiens
aaggaagagcuauuaacaa

SEQ ID NO: 1075507 - RNA, 19 nt, Homo sapiens
cucauucugcccaggauua

SEQ ID NO: 1075508 - RNA, 19 nt, Homo sapiens
gagcuccaacacauucuuc

SEQ ID NO: 1075509 - RNA, 19 nt, Homo sapiens
cacugucucucagcucaaa

SEQ ID NO: 1075510 - RNA, 19 nt, Homo sapiens
ucgcaaaggaagagcuauu

SEQ ID NO: 1075511 - RNA, 19 nt, Homo sapiens
acuuaggacuuuucgaaua

SEQ ID NO: 1075512 - RNA, 19 nt, Homo sapiens
auaauggaagggaaagaaa

SEQ ID NO: 1075513 - RNA, 19 nt, Homo sapiens
uacaauaauggaagggaaa

SEQ ID NO: 1075514 - RNA, 19 nt, Homo sapiens
cccaaacaaaucugacaaa

SEQ ID NO: 1075515 - RNA, 19 nt, Homo sapiens
caaagaccucaagcucauu

SEQ ID NO: 1075516 - RNA, 19 nt, Homo sapiens
gacaaaaguuaaagaccau

SEQ ID NO: 1075517 - RNA, 19 nt, Homo sapiens
gguuuaugcuagccucucu

SEQ ID NO: 1075518 - RNA, 19 nt, Homo sapiens
ccacuuaggacuuuucgaa

SEQ ID NO: 1075519 - RNA, 19 nt, Homo sapiens
aauggaagggaaagaaaga

SEQ ID NO: 1075520 - RNA, 19 nt, Homo sapiens
gcuacagugcuucccauca

SEQ ID NO: 1075521 - RNA, 19 nt, Homo sapiens
gaacaaagacagauaccuu

SEQ ID NO: 1075522 - RNA, 19 nt, Homo sapiens
ggagagagauuuaacuuuu

SEQ ID NO: 1075523 - RNA, 19 nt, Homo sapiens
gauguggacuucaguuauu

SEQ ID NO: 1075524 - RNA, 19 nt, Homo sapiens
gcaguuacuucaaggauau

SEQ ID NO: 1075525 - RNA, 19 nt, Homo sapiens
aaagcuaguugccauauuu

SEQ ID NO: 1075526 - RNA, 19 nt, Homo sapiens
caagcuucaugaugucuua

SEQ ID NO: 1075527 - RNA, 19 nt, Homo sapiens
ggaacuuucucaacgcauu

SEQ ID NO: 1075528 - RNA, 19 nt, Homo sapiens
ggaaugcacgucagucaaa

SEQ ID NO: 1075529 - RNA, 19 nt, Homo sapiens
gaagaugggagagagauuu

SEQ ID NO: 1075530 - RNA, 19 nt, Homo sapiens
gcaaaugugugcucaagcu

SEQ ID NO: 1075531 - RNA, 19 nt, Homo sapiens
aaagacagauaccuucaga

SEQ ID NO: 1075532 - RNA, 19 nt, Homo sapiens
ugacauugauccacagguu

SEQ ID NO: 1075533 - RNA, 19 nt, Homo sapiens
caaccaacauuauagaacu

SEQ ID NO: 1075534 - RNA, 19 nt, Homo sapiens
ccacagggauggcgagaag

SEQ ID NO: 1075535 - RNA, 19 nt, Homo sapiens
caaagcuaguugccauauu

SEQ ID NO: 1075536 - RNA, 19 nt, Homo sapiens
gaacuugcuuggcagugau

SEQ ID NO: 1075537 - RNA, 19 nt, Homo sapiens
gaagauaucagaggaaugc

SEQ ID NO: 1075538 - RNA, 19 nt, Homo sapiens
uaaaucaaaugagccauca

SEQ ID NO: 1075539 - RNA, 19 nt, Homo sapiens
cauacaacaugacgaaaca

SEQ ID NO: 1075540 - RNA, 19 nt, Homo sapiens
uauuucagcuuggacauuu

SEQ ID NO: 1075541 - RNA, 19 nt, Homo sapiens
guuaaugaauccaaagaag

SEQ ID NO: 1075542 - RNA, 19 nt, Homo sapiens
ucaaaugagccaucaguga

SEQ ID NO: 1075543 - RNA, 19 nt, Homo sapiens
gaagaauggcacagggaaa

SEQ ID NO: 1075544 - RNA, 19 nt, Homo sapiens
gauggaacaaagacagaua

SEQ ID NO: 1075545 - RNA, 19 nt, Homo sapiens
caguccauguuguauauaa

SEQ ID NO: 1075546 - RNA, 19 nt, Homo sapiens
ggcgagaaguauuuguuga

SEQ ID NO: 1075547 - RNA, 19 nt, Homo sapiens
gaaaccccaucucuacuaa

SEQ ID NO: 1075548 - RNA, 19 nt, Homo sapiens
ugcucaagcuaauaaguua

SEQ ID NO: 1075549 - RNA, 19 nt, Homo sapiens
ucacucaacuuggaucugu

SEQ ID NO: 1075550 - RNA, 19 nt, Homo sapiens
cugcacugguugcugauua

SEQ ID NO: 1075551 - RNA, 19 nt, Homo sapiens
gggagagagauuuaacuuu

SEQ ID NO: 1075552 - RNA, 19 nt, Homo sapiens
gauccacagguuucugaua

SEQ ID NO: 1075553 - RNA, 19 nt, Homo sapiens
gggauggcgagaaguauuu

SEQ ID NO: 1075554 - RNA, 19 nt, Homo sapiens
gcuucaugaugucuuaauu

SEQ ID NO: 1075555 - RNA, 19 nt, Homo sapiens
ggguacagcuuuuaucuug

SEQ ID NO: 1075556 - RNA, 19 nt, Homo sapiens
guugaaguguguccugaug

SEQ ID NO: 1075557 - RNA, 19 nt, Homo sapiens
caagggaucauguugaagu

SEQ ID NO: 1075558 - RNA, 19 nt, Homo sapiens
gcuaguugccauauuucua

SEQ ID NO: 1075559 - RNA, 19 nt, Homo sapiens
ugaacuugcuuggcaguga

SEQ ID NO: 1075560 - RNA, 19 nt, Homo sapiens
caagguggaagauaucaga

SEQ ID NO: 1075561 - RNA, 19 nt, Homo sapiens
ccacaagcuucaugauguc

SEQ ID NO: 1075562 - RNA, 19 nt, Homo sapiens
auccacagguuucugauaa

SEQ ID NO: 1075563 - RNA, 19 nt, Homo sapiens
gaccacaagcuucaugaug

SEQ ID NO: 1075564 - RNA, 19 nt, Homo sapiens
gcuuuuaucuugcacauga

SEQ ID NO: 1075565 - RNA, 19 nt, Homo sapiens
gagaaguauuuguugacau

SEQ ID NO: 1075566 - RNA, 19 nt, Homo sapiens
cgagaaguauuuguugaca

SEQ ID NO: 1075567 - RNA, 19 nt, Homo sapiens
gaacuuucucaacgcauug

SEQ ID NO: 1075568 - RNA, 19 nt, Homo sapiens
gaggaaugcacgucaguca

SEQ ID NO: 1075569 - RNA, 19 nt, Homo sapiens
gugcaaaugugugcucaag

SEQ ID NO: 1075570 - RNA, 19 nt, Homo sapiens
uuucauauacugcagguaa

SEQ ID NO: 1075571 - RNA, 19 nt, Homo sapiens
gcuuggcagugauauuuca

SEQ ID NO: 1075572 - RNA, 19 nt, Homo sapiens
ucucaacgcauugcauuaa

SEQ ID NO: 1075573 - RNA, 19 nt, Homo sapiens
gugcucaagcuaauaaguu

SEQ ID NO: 1075574 - RNA, 19 nt, Homo sapiens
accacaagcuucaugaugu

SEQ ID NO: 1075575 - RNA, 19 nt, Homo sapiens
ggucaugauggaacaaaga

SEQ ID NO: 1075576 - RNA, 19 nt, Homo sapiens
guagcuggguuuagugaac

SEQ ID NO: 1075577 - RNA, 19 nt, Homo sapiens
aagaugggagagagauuua

SEQ ID NO: 1075578 - RNA, 19 nt, Homo sapiens
ccaaagaagaugggagaga

SEQ ID NO: 1075579 - RNA, 19 nt, Homo sapiens
ucaguuauuugcgaagaau

SEQ ID NO: 1075580 - RNA, 19 nt, Homo sapiens
uaacagcugauguggacuu

SEQ ID NO: 1075581 - RNA, 19 nt, Homo sapiens
gacauugauccacagguuu

SEQ ID NO: 1075582 - RNA, 19 nt, Homo sapiens
cuaguugccauauuucuau

SEQ ID NO: 1075583 - RNA, 19 nt, Homo sapiens
caaaugugugcucaagcua

SEQ ID NO: 1075584 - RNA, 19 nt, Homo sapiens
guauugauguccggcugaa

SEQ ID NO: 1075585 - RNA, 19 nt, Homo sapiens
acagggauggcgagaagua

SEQ ID NO: 1075586 - RNA, 19 nt, Homo sapiens
ccuguaaucccagcacuuu

SEQ ID NO: 1075587 - RNA, 19 nt, Homo sapiens
uggaagauaucagaggaau

SEQ ID NO: 1075588 - RNA, 19 nt, Homo sapiens
cuugcuaccucaucagaga

SEQ ID NO: 1075589 - RNA, 19 nt, Homo sapiens
agcaguuacuucaaggaua

SEQ ID NO: 1075590 - RNA, 19 nt, Homo sapiens
ccaggaacagcagaucuaa

SEQ ID NO: 1075591 - RNA, 19 nt, Homo sapiens
ggaucauguugaagugugu

SEQ ID NO: 1075592 - RNA, 19 nt, Homo sapiens
gugacuggcuuuggugcaa

SEQ ID NO: 1075593 - RNA, 19 nt, Homo sapiens
gguaacaaaagucaaagua

SEQ ID NO: 1075594 - RNA, 19 nt, Homo sapiens
gcagguaacaaaagucaaa

SEQ ID NO: 1075595 - RNA, 19 nt, Homo sapiens
gcagaucuaacagcugaug

SEQ ID NO: 1075596 - RNA, 19 nt, Homo sapiens
gaggucagcaguuaaagac

SEQ ID NO: 1075597 - RNA, 19 nt, Homo sapiens
aaugugugcucaagcuaau

SEQ ID NO: 1075598 - RNA, 19 nt, Homo sapiens
aaaugugugcucaagcuaa

SEQ ID NO: 1075599 - RNA, 19 nt, Homo sapiens
ucagucggcccaagaaauc

SEQ ID NO: 1075600 - RNA, 19 nt, Homo sapiens
gguagaggguacagcuuuu

SEQ ID NO: 1075601 - RNA, 19 nt, Homo sapiens
ugauuauggucaugaugga

SEQ ID NO: 1075602 - RNA, 19 nt, Homo sapiens
gaaugcacgucagucaaaa

SEQ ID NO: 1075603 - RNA, 19 nt, Homo sapiens
gguugugacuggcuuuggu

SEQ ID NO: 1075604 - RNA, 19 nt, Homo sapiens
aggaacagcagaucuaaca

SEQ ID NO: 1075605 - RNA, 19 nt, Homo sapiens
gauguucuuccugugcaua

SEQ ID NO: 1075606 - RNA, 19 nt, Homo sapiens
cguuguagcuggguuuagu

SEQ ID NO: 1075607 - RNA, 19 nt, Homo sapiens
ugaggcagcaguuacuuca

SEQ ID NO: 1075608 - RNA, 19 nt, Homo sapiens
gcugaagguucuuuuagau

SEQ ID NO: 1075609 - RNA, 19 nt, Homo sapiens
gaaguauuuguugacauug

SEQ ID NO: 1075610 - RNA, 19 nt, Homo sapiens
uaaagaccagccugaccaa

SEQ ID NO: 1075611 - RNA, 19 nt, Homo sapiens
acuuggaucugugcugaaa

SEQ ID NO: 1075612 - RNA, 19 nt, Homo sapiens
ggaagauaucagaggaaug

SEQ ID NO: 1075613 - RNA, 19 nt, Homo sapiens
caacgcauugcauuaacug

SEQ ID NO: 1075614 - RNA, 19 nt, Homo sapiens
uugcuuggcagugauauuu

SEQ ID NO: 1075615 - RNA, 19 nt, Homo sapiens
uccacagguuucugauaaa

SEQ ID NO: 1075616 - RNA, 19 nt, Homo sapiens
aggcagcaguuacuucaag

SEQ ID NO: 1075617 - RNA, 19 nt, Homo sapiens
ugaaguguguccugaugcu

SEQ ID NO: 1075618 - RNA, 19 nt, Homo sapiens
ugauguggacuucaguuau

SEQ ID NO: 1075619 - RNA, 19 nt, Homo sapiens
ucaacgcauugcauuaacu

SEQ ID NO: 1075620 - RNA, 19 nt, Homo sapiens
ugaggucagcaguuaaaga

SEQ ID NO: 1075621 - RNA, 19 nt, Homo sapiens
ugaaggagguguugacuaa

SEQ ID NO: 1075622 - RNA, 19 nt, Homo sapiens
cuagguauaugguucauua

SEQ ID NO: 1075623 - RNA, 19 nt, Homo sapiens
uaagugagauucaagcauu

SEQ ID NO: 1075624 - RNA, 19 nt, Homo sapiens
gaacaaagacagauaccuu

SEQ ID NO: 1075625 - RNA, 19 nt, Homo sapiens
ggagagagauuuaacuuuu

SEQ ID NO: 1075626 - RNA, 19 nt, Homo sapiens
gauguggacuucaguuauu

SEQ ID NO: 1075627 - RNA, 19 nt, Homo sapiens
gcaguuacuucaaggauau

SEQ ID NO: 1075628 - RNA, 19 nt, Homo sapiens
guauaugguucauuaguga

SEQ ID NO: 1075629 - RNA, 19 nt, Homo sapiens
cgagcuagccugcgaauuu

SEQ ID NO: 1075630 - RNA, 19 nt, Homo sapiens
caagcuucaugaugucuua

SEQ ID NO: 1075631 - RNA, 19 nt, Homo sapiens
ggaacuuucucaacgcauu

SEQ ID NO: 1075632 - RNA, 19 nt, Homo sapiens
ggaaugcacgucagucaaa

SEQ ID NO: 1075633 - RNA, 19 nt, Homo sapiens
gaagaugggagagagauuu

SEQ ID NO: 1075634 - RNA, 19 nt, Homo sapiens
ggaaugagccugcagaaaa

SEQ ID NO: 1075635 - RNA, 19 nt, Homo sapiens
aaagacagauaccuucaga

SEQ ID NO: 1075636 - RNA, 19 nt, Homo sapiens
ugacauugauccacagguu

SEQ ID NO: 1075637 - RNA, 19 nt, Homo sapiens
ggauuccaauuuccuggua

SEQ ID NO: 1075638 - RNA, 19 nt, Homo sapiens
gguauaugguucauuagug

SEQ ID NO: 1075639 - RNA, 19 nt, Homo sapiens
gagcuagccugcgaauuuc

SEQ ID NO: 1075640 - RNA, 19 nt, Homo sapiens
ccacagggauggcgagaag

SEQ ID NO: 1075641 - RNA, 19 nt, Homo sapiens
gaacuugcuuggcagugau

SEQ ID NO: 1075642 - RNA, 19 nt, Homo sapiens
ugaaaggugucacuaaguc

SEQ ID NO: 1075643 - RNA, 19 nt, Homo sapiens
aagagaaggucccguuaga

SEQ ID NO: 1075644 - RNA, 19 nt, Homo sapiens
cauugacacugacuaaaga

SEQ ID NO: 1075645 - RNA, 19 nt, Homo sapiens
gaagauaucagaggaaugc

SEQ ID NO: 1075646 - RNA, 19 nt, Homo sapiens
uaaaucaaaugagccauca

SEQ ID NO: 1075647 - RNA, 19 nt, Homo sapiens
uaaagagaaggucccguua

SEQ ID NO: 1075648 - RNA, 19 nt, Homo sapiens
cauacaacaugacgaaaca

SEQ ID NO: 1075649 - RNA, 19 nt, Homo sapiens
gguguucacucaacuugga

SEQ ID NO: 1075650 - RNA, 19 nt, Homo sapiens
uauuucagcuuggacauuu

SEQ ID NO: 1075651 - RNA, 19 nt, Homo sapiens
guuaaugaauccaaagaag

SEQ ID NO: 1075652 - RNA, 19 nt, Homo sapiens
ucaaaugagccaucaguga

SEQ ID NO: 1075653 - RNA, 19 nt, Homo sapiens
gaagaauggcacagggaaa

SEQ ID NO: 1075654 - RNA, 19 nt, Homo sapiens
gauggaacaaagacagaua

SEQ ID NO: 1075655 - RNA, 19 nt, Homo sapiens
ggcgagaaguauuuguuga

SEQ ID NO: 1075656 - RNA, 19 nt, Homo sapiens
uaugaaaggugucacuaag

SEQ ID NO: 1075657 - RNA, 19 nt, Homo sapiens
cugcacugguugcugauua

SEQ ID NO: 1075658 - RNA, 19 nt, Homo sapiens
ucacucaacuuggaucugu

SEQ ID NO: 1075659 - RNA, 19 nt, Homo sapiens
gggagagagauuuaacuuu

SEQ ID NO: 1075660 - RNA, 19 nt, Homo sapiens
gauccacagguuucugaua

SEQ ID NO: 1075661 - RNA, 19 nt, Homo sapiens
gggauggcgagaaguauuu

SEQ ID NO: 1075662 - RNA, 19 nt, Homo sapiens
gcuucaugaugucuuaauu

SEQ ID NO: 1075663 - RNA, 19 nt, Homo sapiens
ggguacagcuuuuaucuug

SEQ ID NO: 1075664 - RNA, 19 nt, Homo sapiens
gcauugacacugacuaaag

SEQ ID NO: 1075665 - RNA, 19 nt, Homo sapiens
aaggagauuucauuacuuc

SEQ ID NO: 1075666 - RNA, 19 nt, Homo sapiens
guugaaguguguccugaug

SEQ ID NO: 1075667 - RNA, 19 nt, Homo sapiens
caagggaucauguugaagu

SEQ ID NO: 1075668 - RNA, 19 nt, Homo sapiens
guaccgagaucugcacgau

SEQ ID NO: 1075669 - RNA, 19 nt, Homo sapiens
gaauggauggccacuggaa

SEQ ID NO: 1075670 - RNA, 19 nt, Homo sapiens
ugaacuugcuuggcaguga

SEQ ID NO: 1075671 - RNA, 19 nt, Homo sapiens
caagguggaagauaucaga

SEQ ID NO: 1075672 - RNA, 19 nt, Homo sapiens
ccacaagcuucaugauguc

SEQ ID NO: 1075673 - RNA, 19 nt, Homo sapiens
auccacagguuucugauaa

SEQ ID NO: 1075674 - RNA, 19 nt, Homo sapiens
gccaaggguuauuaugugu

SEQ ID NO: 1075675 - RNA, 19 nt, Homo sapiens
gaccacaagcuucaugaug

SEQ ID NO: 1075676 - RNA, 19 nt, Homo sapiens
gagaaguauuuguugacau

SEQ ID NO: 1075677 - RNA, 19 nt, Homo sapiens
cgagaaguauuuguugaca

SEQ ID NO: 1075678 - RNA, 19 nt, Homo sapiens
gcuuuuaucuugcacauga

SEQ ID NO: 1075679 - RNA, 19 nt, Homo sapiens
caaggguuauuauguguac

SEQ ID NO: 1075680 - RNA, 19 nt, Homo sapiens
gaacuuucucaacgcauug

SEQ ID NO: 1075681 - RNA, 19 nt, Homo sapiens
guacaucugguagagguaa

SEQ ID NO: 1075682 - RNA, 19 nt, Homo sapiens
gaggaaugcacgucaguca

SEQ ID NO: 1075683 - RNA, 19 nt, Homo sapiens
gcuuggcagugauauuuca

SEQ ID NO: 1075684 - RNA, 19 nt, Homo sapiens
ucucaacgcauugcauuaa

SEQ ID NO: 1075685 - RNA, 19 nt, Homo sapiens
agucugggauuccaauuuc

SEQ ID NO: 1075686 - RNA, 19 nt, Homo sapiens
accacaagcuucaugaugu

SEQ ID NO: 1075687 - RNA, 19 nt, Homo sapiens
aaggagguguugacuaauc

SEQ ID NO: 1075688 - RNA, 19 nt, Homo sapiens
ggucaugauggaacaaaga

SEQ ID NO: 1075689 - RNA, 19 nt, Homo sapiens
gacacugacuaaagagaag

SEQ ID NO: 1075690 - RNA, 19 nt, Homo sapiens
guagcuggguuuagugaac

SEQ ID NO: 1075691 - RNA, 19 nt, Homo sapiens
aagaugggagagagauuua

SEQ ID NO: 1075692 - RNA, 19 nt, Homo sapiens
cuaauccagccaaggguua

SEQ ID NO: 1075693 - RNA, 19 nt, Homo sapiens
guacaugaaggagguguug

SEQ ID NO: 1075694 - RNA, 19 nt, Homo sapiens
cagccaaggguuauuaugu

SEQ ID NO: 1075695 - RNA, 19 nt, Homo sapiens
ccaaagaagaugggagaga

SEQ ID NO: 1075696 - RNA, 19 nt, Homo sapiens
ucaguuauuugcgaagaau

SEQ ID NO: 1075697 - RNA, 19 nt, Homo sapiens
uaacagcugauguggacuu

SEQ ID NO: 1075698 - RNA, 19 nt, Homo sapiens
gacauugauccacagguuu

SEQ ID NO: 1075699 - RNA, 19 nt, Homo sapiens
gaacccucgugggagauau

SEQ ID NO: 1075700 - RNA, 19 nt, Homo sapiens
ccaucacuguggccgagua

SEQ ID NO: 1075701 - RNA, 19 nt, Homo sapiens
gcgcagccauuccuuuuau

SEQ ID NO: 1075702 - RNA, 19 nt, Homo sapiens
guauugauguccggcugaa

SEQ ID NO: 1075703 - RNA, 19 nt, Homo sapiens
gggaaugagccugcagaaa

SEQ ID NO: 1075704 - RNA, 19 nt, Homo sapiens
acagggauggcgagaagua

SEQ ID NO: 1075705 - RNA, 19 nt, Homo sapiens
ugacacugacuaaagagaa

SEQ ID NO: 1075706 - RNA, 19 nt, Homo sapiens
ggaacccucgugggagaua

SEQ ID NO: 1075707 - RNA, 19 nt, Homo sapiens
uggaagauaucagaggaau

SEQ ID NO: 1075708 - RNA, 19 nt, Homo sapiens
cuugcuaccucaucagaga

SEQ ID NO: 1075709 - RNA, 19 nt, Homo sapiens
agcaguuacuucaaggaua

SEQ ID NO: 1075710 - RNA, 19 nt, Homo sapiens
ccaggaacagcagaucuaa

SEQ ID NO: 1075711 - RNA, 19 nt, Homo sapiens
ggaucauguugaagugugu

SEQ ID NO: 1075712 - RNA, 19 nt, Homo sapiens
cuacuggucccaucacugu

SEQ ID NO: 1075713 - RNA, 19 nt, Homo sapiens
gaaugagccugcagaaaac

SEQ ID NO: 1075714 - RNA, 19 nt, Homo sapiens
accgagaucugcacgaugu

SEQ ID NO: 1075715 - RNA, 19 nt, Homo sapiens
gcagaucuaacagcugaug

SEQ ID NO: 1075716 - RNA, 19 nt, Homo sapiens
ccaaggguuauuaugugua

SEQ ID NO: 1075717 - RNA, 19 nt, Homo sapiens
gaaaggugucacuaagucu

SEQ ID NO: 1075718 - RNA, 19 nt, Homo sapiens
aagcauugacacugacuaa

SEQ ID NO: 1075719 - RNA, 19 nt, Homo sapiens
ccugcgaauuucagcauga

SEQ ID NO: 1075720 - RNA, 19 nt, Homo sapiens
ucagucggcccaagaaauc

SEQ ID NO: 1075721 - RNA, 19 nt, Homo sapiens
ggucagagcuuccuucuuu

SEQ ID NO: 1075722 - RNA, 19 nt, Homo sapiens
ccaaaggaaugaccaauga

SEQ ID NO: 1075723 - RNA, 19 nt, Homo sapiens
gaagaacuguaaaugaaga

SEQ ID NO: 1075724 - RNA, 19 nt, Homo sapiens
gcacauacaccaccacaug

SEQ ID NO: 1075725 - RNA, 19 nt, Homo sapiens
cauggaagcugacgggaaa

SEQ ID NO: 1075726 - RNA, 19 nt, Homo sapiens
aggaagaacuguaaaugaa

SEQ ID NO: 1075727 - RNA, 19 nt, Homo sapiens
cuacaccaacccauaauua

SEQ ID NO: 1075728 - RNA, 19 nt, Homo sapiens
gaaaggaagagucgguguu

SEQ ID NO: 1075729 - RNA, 19 nt, Homo sapiens
ugacuacgaugacauagca

SEQ ID NO: 1075730 - RNA, 19 nt, Homo sapiens
ggcaaacauuccacccuaa

SEQ ID NO: 1075731 - RNA, 19 nt, Homo sapiens
gauguugucgccagacuuu

SEQ ID NO: 1075732 - RNA, 19 nt, Homo sapiens
ugaaauccuucgagaucuu

SEQ ID NO: 1075733 - RNA, 19 nt, Homo sapiens
gagccacagucccuaggaa

SEQ ID NO: 1075734 - RNA, 19 nt, Homo sapiens
caaaaucagccuucaaauu

SEQ ID NO: 1075735 - RNA, 19 nt, Homo sapiens
gaagcugacgggaaaggaa

SEQ ID NO: 1075736 - RNA, 19 nt, Homo sapiens
uaggaagaacuguaaauga

SEQ ID NO: 1075737 - RNA, 19 nt, Homo sapiens
gaugauccaccuuuuauaa

SEQ ID NO: 1075738 - RNA, 19 nt, Homo sapiens
ggaagaacuguaaaugaag

SEQ ID NO: 1075739 - RNA, 19 nt, Homo sapiens
gcaggagcuacgcuagaua

SEQ ID NO: 1075740 - RNA, 19 nt, Homo sapiens
uaugaaauccuucgagauc

SEQ ID NO: 1075741 - RNA, 19 nt, Homo sapiens
ggcaggagcuacgcuagau

SEQ ID NO: 1075742 - RNA, 19 nt, Homo sapiens
caccaacccauaauuauuc

SEQ ID NO: 1075743 - RNA, 19 nt, Homo sapiens
acaccaacccauaauuauu

SEQ ID NO: 1075744 - RNA, 19 nt, Homo sapiens
caggauuucucccaacauc

SEQ ID NO: 1075745 - RNA, 19 nt, Homo sapiens
ccacauggcacaggauuuc

SEQ ID NO: 1075746 - RNA, 19 nt, Homo sapiens
aaaggaagagucgguguuu

SEQ ID NO: 1075747 - RNA, 19 nt, Homo sapiens
cgccagacuuucagccaaa

SEQ ID NO: 1075748 - RNA, 19 nt, Homo sapiens
ccacagucccuaggaagaa

SEQ ID NO: 1075749 - RNA, 19 nt, Homo sapiens
ccgaaggcaucgauucuac

SEQ ID NO: 1075750 - RNA, 19 nt, Homo sapiens
aaaggaaugaccaaugaga

SEQ ID NO: 1075751 - RNA, 19 nt, Homo sapiens
gaaauccuucgagaucuuc

SEQ ID NO: 1075752 - RNA, 19 nt, Homo sapiens
ccuccgugccuuuccguua

SEQ ID NO: 1075753 - RNA, 19 nt, Homo sapiens
cacaggauuucucccaaca

SEQ ID NO: 1075754 - RNA, 19 nt, Homo sapiens
gaaggcaucgauucuacag

SEQ ID NO: 1075755 - RNA, 19 nt, Homo sapiens
gaaaacacuugcccuucuc

SEQ ID NO: 1075756 - RNA, 19 nt, Homo sapiens
gcaaacauuccacccuaac

SEQ ID NO: 1075757 - RNA, 19 nt, Homo sapiens
cuaggaagaacuguaaaug

SEQ ID NO: 1075758 - RNA, 19 nt, Homo sapiens
aacuguaaaugaagacgaa

SEQ ID NO: 1075759 - RNA, 19 nt, Homo sapiens
gauccaccuuuuauaaugu

SEQ ID NO: 1075760 - RNA, 19 nt, Homo sapiens
gccaaaaucagccuucaaa

SEQ ID NO: 1075761 - RNA, 19 nt, Homo sapiens
ccaccacugacuacgauga

SEQ ID NO: 1075762 - RNA, 19 nt, Homo sapiens
aaucagccuucaaauuaac

SEQ ID NO: 1075763 - RNA, 19 nt, Homo sapiens
ugaaaacacuugcccuucu

SEQ ID NO: 1075764 - RNA, 19 nt, Homo sapiens
uacaccaacccauaauuau

SEQ ID NO: 1075765 - RNA, 19 nt, Homo sapiens
cuacgugggauccgauguu

SEQ ID NO: 1075766 - RNA, 19 nt, Homo sapiens
gcccaaccuccgugccuuu

SEQ ID NO: 1075767 - RNA, 19 nt, Homo sapiens
ggagcuacgcuagauacug

SEQ ID NO: 1075768 - RNA, 19 nt, Homo sapiens
aggaagagucgguguuuua

SEQ ID NO: 1075769 - RNA, 19 nt, Homo sapiens
ggaagcugacgggaaagga

SEQ ID NO: 1075770 - RNA, 19 nt, Homo sapiens
uacgugggauccgauguug

SEQ ID NO: 1075771 - RNA, 19 nt, Homo sapiens
gccacagucccuaggaaga

SEQ ID NO: 1075772 - RNA, 19 nt, Homo sapiens
caaaugaaaugacauaugg

SEQ ID NO: 1075773 - RNA, 19 nt, Homo sapiens
aaacacugcugguuccuua

SEQ ID NO: 1075774 - RNA, 19 nt, Homo sapiens
aagcauaccuguacuagaa

SEQ ID NO: 1075775 - RNA, 19 nt, Homo sapiens
gaucuugacuaaguucaua

SEQ ID NO: 1075776 - RNA, 19 nt, Homo sapiens
uaaaugaacucuucucaac

SEQ ID NO: 1075777 - RNA, 19 nt, Homo sapiens
gagagugaaucaacuacuu

SEQ ID NO: 1075778 - RNA, 19 nt, Homo sapiens
gcauaccuguacuagaaua

SEQ ID NO: 1075779 - RNA, 19 nt, Homo sapiens
aaaccuuugucacauguua

SEQ ID NO: 1075780 - RNA, 19 nt, Homo sapiens
uaaagggaaugaggaguuu

SEQ ID NO: 1075781 - RNA, 19 nt, Homo sapiens
gacggcaacuacagcuuua

SEQ ID NO: 1075782 - RNA, 19 nt, Homo sapiens
ccacugugcuguacgaaau

SEQ ID NO: 1075783 - RNA, 19 nt, Homo sapiens
ugaaucaacuacuuucguu

SEQ ID NO: 1075784 - RNA, 19 nt, Homo sapiens
gcaacuacagcuuuaggua

SEQ ID NO: 1075785 - RNA, 19 nt, Homo sapiens
aaacccagcuucugaucuu

SEQ ID NO: 1075786 - RNA, 19 nt, Homo sapiens
ugucacauguuacacaauu

SEQ ID NO: 1075787 - RNA, 19 nt, Homo sapiens
gaaaugacauaugggaaaa

SEQ ID NO: 1075788 - RNA, 19 nt, Homo sapiens
gaaucaacuacuuucguua

SEQ ID NO: 1075789 - RNA, 19 nt, Homo sapiens
cuucugaucuugacuaagu

SEQ ID NO: 1075790 - RNA, 19 nt, Homo sapiens
ugaaaugacauaugggaaa

SEQ ID NO: 1075791 - RNA, 19 nt, Homo sapiens
guacgaaaucaauucauga

SEQ ID NO: 1075792 - RNA, 19 nt, Homo sapiens
ggacuucgagagugaauca

SEQ ID NO: 1075793 - RNA, 19 nt, Homo sapiens
caacuacuuucguuaacuc

SEQ ID NO: 1075794 - RNA, 19 nt, Homo sapiens
ucagggacuucgagaguga

SEQ ID NO: 1075795 - RNA, 19 nt, Homo sapiens
ucagugaagcuuuguuaaa

SEQ ID NO: 1075796 - RNA, 19 nt, Homo sapiens
cuuaauacccuuacuggaa

SEQ ID NO: 1075797 - RNA, 19 nt, Homo sapiens
ggaaaaccuuugucacaug

SEQ ID NO: 1075798 - RNA, 19 nt, Homo sapiens
gaaaaccuuugucacaugu

SEQ ID NO: 1075799 - RNA, 19 nt, Homo sapiens
gaugaagagcucacacuca

SEQ ID NO: 1075800 - RNA, 19 nt, Homo sapiens
uguacgaaaucaauucaug

SEQ ID NO: 1075801 - RNA, 19 nt, Homo sapiens
uagguagaauuucaacuuc

SEQ ID NO: 1075802 - RNA, 19 nt, Homo sapiens
gugagaaucaaaugaaaug

SEQ ID NO: 1075803 - RNA, 19 nt, Homo sapiens
cuccugaauuuaaguauug

SEQ ID NO: 1075804 - RNA, 19 nt, Homo sapiens
caacagaaagagaccuugu

SEQ ID NO: 1075805 - RNA, 19 nt, Homo sapiens
cuacuuucguuaacucaau

SEQ ID NO: 1075806 - RNA, 19 nt, Homo sapiens
aaaaggaaacgcccuauuu

SEQ ID NO: 1075807 - RNA, 19 nt, Homo sapiens
ugacggcaacuacagcuuu

SEQ ID NO: 1075808 - RNA, 19 nt, Homo sapiens
ggaugguuguggugagaau

SEQ ID NO: 1075809 - RNA, 19 nt, Homo sapiens
ucacauguuacacaauuga

SEQ ID NO: 1075810 - RNA, 19 nt, Homo sapiens
uauaagccacugugcugua

SEQ ID NO: 1075811 - RNA, 19 nt, Homo sapiens
acacugcugguuccuuaua

SEQ ID NO: 1075812 - RNA, 19 nt, Homo sapiens
uuaaagggaaugaggaguu

SEQ ID NO: 1075813 - RNA, 19 nt, Homo sapiens
gcaggcaaaccacuucaca

SEQ ID NO: 1075814 - RNA, 19 nt, Homo sapiens
cuuccuaaccuguuugaaa

SEQ ID NO: 1075815 - RNA, 19 nt, Homo sapiens
acucagugaagcuuuguua

SEQ ID NO: 1075816 - RNA, 19 nt, Homo sapiens
gaaaaggaaacgcccuauu

SEQ ID NO: 1075817 - RNA, 19 nt, Homo sapiens
ucacagugcuaggaugaag

SEQ ID NO: 1075818 - RNA, 19 nt, Homo sapiens
guggugagaaucaaaugaa

SEQ ID NO: 1075819 - RNA, 19 nt, Homo sapiens
gaauaacaucaaccuugga

SEQ ID NO: 1075820 - RNA, 19 nt, Homo sapiens
cgcccuauuuccaagcaua

SEQ ID NO: 1075821 - RNA, 19 nt, Homo sapiens
ggugagaaucaaaugaaau

SEQ ID NO: 1075822 - RNA, 19 nt, Homo sapiens
uggugagaaucaaaugaaa

SEQ ID NO: 1075823 - RNA, 19 nt, Homo sapiens
agagugaaucaacuacuuu

SEQ ID NO: 1075824 - RNA, 19 nt, Homo sapiens
cacugcugguuccuuauaa

SEQ ID NO: 1075825 - RNA, 19 nt, Homo sapiens
uacccuuacuggaacauau

SEQ ID NO: 1075826 - RNA, 19 nt, Homo sapiens
gacaacagaaagagaccuu

SEQ ID NO: 1075827 - RNA, 19 nt, Homo sapiens
gagaaucaaaugaaaugac

SEQ ID NO: 1075828 - RNA, 19 nt, Homo sapiens
cauaauuacucagggaaaa

SEQ ID NO: 1075829 - RNA, 19 nt, Homo sapiens
cagcuucugaucuugacua

SEQ ID NO: 1075830 - RNA, 19 nt, Homo sapiens
gagugaaucaacuacuuuc

SEQ ID NO: 1075831 - RNA, 19 nt, Homo sapiens
gggaaaaccuuugucacau

SEQ ID NO: 1075832 - RNA, 19 nt, Homo sapiens
caagcauaccuguacuaga

SEQ ID NO: 1075833 - RNA, 19 nt, Homo sapiens
auugauggcuaugggaauu

SEQ ID NO: 1075834 - RNA, 19 nt, Homo sapiens
ucaacuacuuucguuaacu

SEQ ID NO: 1075835 - RNA, 19 nt, Homo sapiens
ccaagcauaccuguacuag

SEQ ID NO: 1075836 - RNA, 19 nt, Homo sapiens
gcuguacgaaaucaauuca

SEQ ID NO: 1075837 - RNA, 19 nt, Homo sapiens
acacauaucuguaggaaua

SEQ ID NO: 1075838 - RNA, 19 nt, Homo sapiens
gcauauagcuagcaaagaa

SEQ ID NO: 1075839 - RNA, 19 nt, Homo sapiens
gcacuacuauguaucauuu

SEQ ID NO: 1075840 - RNA, 19 nt, Homo sapiens
ccaaacagauccaugcaua

SEQ ID NO: 1075841 - RNA, 19 nt, Homo sapiens
gcaggagaauggauaagua

SEQ ID NO: 1075842 - RNA, 19 nt, Homo sapiens
gaacacauaucuguaggaa

SEQ ID NO: 1075843 - RNA, 19 nt, Homo sapiens
gauaaguaguugugguaua

SEQ ID NO: 1075844 - RNA, 19 nt, Homo sapiens
caaacaaacucuguacauu

SEQ ID NO: 1075845 - RNA, 19 nt, Homo sapiens
gcaaagaauuaguaucuag

SEQ ID NO: 1075846 - RNA, 19 nt, Homo sapiens
gaacaacaaaggacacaaa

SEQ ID NO: 1075847 - RNA, 19 nt, Homo sapiens
gaggauguuucaacuguuu

SEQ ID NO: 1075848 - RNA, 19 nt, Homo sapiens
gcacaucagcuucaggaua

SEQ ID NO: 1075849 - RNA, 19 nt, Homo sapiens
gcauagagaagaacuguuu

SEQ ID NO: 1075850 - RNA, 19 nt, Homo sapiens
gaaauagccauuacaaauc

SEQ ID NO: 1075851 - RNA, 19 nt, Homo sapiens
gagaauggauaaguaguug

SEQ ID NO: 1075852 - RNA, 19 nt, Homo sapiens
gaaacaaccuaaauaucca

SEQ ID NO: 1075853 - RNA, 19 nt, Homo sapiens
aagcagaagucauaaagaa

SEQ ID NO: 1075854 - RNA, 19 nt, Homo sapiens
ccacaguuauaaugaauga

SEQ ID NO: 1075855 - RNA, 19 nt, Homo sapiens
cacaucagcuucaggauau

SEQ ID NO: 1075856 - RNA, 19 nt, Homo sapiens
gcauauaacauacaacuca

SEQ ID NO: 1075857 - RNA, 19 nt, Homo sapiens
aaacagauccaugcauaua

SEQ ID NO: 1075858 - RNA, 19 nt, Homo sapiens
ggaaaagaauugagaguau

SEQ ID NO: 1075859 - RNA, 19 nt, Homo sapiens
agaagcccauuucccauua

SEQ ID NO: 1075860 - RNA, 19 nt, Homo sapiens
gcagaaauagccauuacaa

SEQ ID NO: 1075861 - RNA, 19 nt, Homo sapiens
ugauuaagguccuaaacaa

SEQ ID NO: 1075862 - RNA, 19 nt, Homo sapiens
ggaaacaaccuaaauaucc

SEQ ID NO: 1075863 - RNA, 19 nt, Homo sapiens
caucaauggucaauaaaca

SEQ ID NO: 1075864 - RNA, 19 nt, Homo sapiens
acagauccaugcauauaaa

SEQ ID NO: 1075865 - RNA, 19 nt, Homo sapiens
gaaggauacagguaauauu

SEQ ID NO: 1075866 - RNA, 19 nt, Homo sapiens
ggauacaaaugaaaugaac

SEQ ID NO: 1075867 - RNA, 19 nt, Homo sapiens
caaccuaaauauccaacug

SEQ ID NO: 1075868 - RNA, 19 nt, Homo sapiens
uuaagguccuaaacaagua

SEQ ID NO: 1075869 - RNA, 19 nt, Homo sapiens
ggagaauggauaaguaguu

SEQ ID NO: 1075870 - RNA, 19 nt, Homo sapiens
ccagguaucaggaauuauu

SEQ ID NO: 1075871 - RNA, 19 nt, Homo sapiens
gcuucaggauauuuagaua

SEQ ID NO: 1075872 - RNA, 19 nt, Homo sapiens
ucaguaauuccacuaagua

SEQ ID NO: 1075873 - RNA, 19 nt, Homo sapiens
gagaguauccaaacagauc

SEQ ID NO: 1075874 - RNA, 19 nt, Homo sapiens
caacaaaggacacaaacag

SEQ ID NO: 1075875 - RNA, 19 nt, Homo sapiens
ccauuucccauuauacaua

SEQ ID NO: 1075876 - RNA, 19 nt, Homo sapiens
gaagcccauuucccauuau

SEQ ID NO: 1075877 - RNA, 19 nt, Homo sapiens
guaauuccacuaaguauac

SEQ ID NO: 1075878 - RNA, 19 nt, Homo sapiens
acauacaacucaguaauuc

SEQ ID NO: 1075879 - RNA, 19 nt, Homo sapiens
gacauuagaagcccauuuc

SEQ ID NO: 1075880 - RNA, 19 nt, Homo sapiens
agauaugucugggaaagaa

SEQ ID NO: 1075881 - RNA, 19 nt, Homo sapiens
gaauggauaaguaguugug

SEQ ID NO: 1075882 - RNA, 19 nt, Homo sapiens
gaauugagaguauccaaac

SEQ ID NO: 1075883 - RNA, 19 nt, Homo sapiens
aaguauacaugccaaacaa

SEQ ID NO: 1075884 - RNA, 19 nt, Homo sapiens
gcauauaaagcagaaauag

SEQ ID NO: 1075885 - RNA, 19 nt, Homo sapiens
ggaaaacaauuuggcaaga

SEQ ID NO: 1075886 - RNA, 19 nt, Homo sapiens
gacacaaacaggcaaauca

SEQ ID NO: 1075887 - RNA, 19 nt, Homo sapiens
ggaauaaaccugaaaagca

SEQ ID NO: 1075888 - RNA, 19 nt, Homo sapiens
gauauuuacauggguguuu

SEQ ID NO: 1075889 - RNA, 19 nt, Homo sapiens
cagcacugauaauaaugaa

SEQ ID NO: 1075890 - RNA, 19 nt, Homo sapiens
ccaaacaaacucuguacau

SEQ ID NO: 1075891 - RNA, 19 nt, Homo sapiens
gcagaagucauaaagaaaa

SEQ ID NO: 1075892 - RNA, 19 nt, Homo sapiens
gaaaacaauuuggcaagau

SEQ ID NO: 1075893 - RNA, 19 nt, Homo sapiens
cagaaauagccauuacaaa

SEQ ID NO: 1075894 - RNA, 19 nt, Homo sapiens
gaaaagaauugagaguauc

SEQ ID NO: 1075895 - RNA, 19 nt, Homo sapiens
aaauagccauuacaaaucg

SEQ ID NO: 1075896 - RNA, 19 nt, Homo sapiens
ucucugaaugcuugaaaua

SEQ ID NO: 1075897 - RNA, 19 nt, Homo sapiens
uaaagcagaaauagccauu

SEQ ID NO: 1075898 - RNA, 19 nt, Homo sapiens
cacauaauaagcacuacua

SEQ ID NO: 1075899 - RNA, 19 nt, Homo sapiens
acagaaggauacagguaau

SEQ ID NO: 1075900 - RNA, 19 nt, Homo sapiens
acacgaggauguuucaacu

SEQ ID NO: 1075901 - RNA, 19 nt, Homo sapiens
uuacagaaggauacaggua

SEQ ID NO: 1075902 - RNA, 19 nt, Homo sapiens
aagcagaaauagccauuac

SEQ ID NO: 1075903 - RNA, 19 nt, Homo sapiens
caacucaguaauuccacua

SEQ ID NO: 1075904 - RNA, 19 nt, Homo sapiens
acaaacaggcaaaucauca

SEQ ID NO: 1075905 - RNA, 19 nt, Homo sapiens
caaugcauauagcuagcaa

SEQ ID NO: 1075906 - RNA, 19 nt, Homo sapiens
aagcccauuucccauuaua

SEQ ID NO: 1075907 - RNA, 19 nt, Homo sapiens
aaucugugggugauauuua

SEQ ID NO: 1075908 - RNA, 19 nt, Homo sapiens
acgaggauguuucaacugu

SEQ ID NO: 1075909 - RNA, 19 nt, Homo sapiens
gaacaucuaaaaccaagaa

SEQ ID NO: 1075910 - RNA, 19 nt, Homo sapiens
ccaugcauauaaagcagaa

SEQ ID NO: 1075911 - RNA, 19 nt, Homo sapiens
caaacagauccaugcauau

SEQ ID NO: 1075912 - RNA, 19 nt, Homo sapiens
ggcaaaaguuaauguguga

SEQ ID NO: 1075913 - RNA, 19 nt, Homo sapiens
acaggcaaaucaucaaugg

SEQ ID NO: 1075914 - RNA, 19 nt, Homo sapiens
caaacaggcaaaucaucaa

SEQ ID NO: 1075915 - RNA, 19 nt, Homo sapiens
ggacacaaacaggcaaauc

SEQ ID NO: 1075916 - RNA, 19 nt, Homo sapiens
gcaaaauuuucguaucugu

SEQ ID NO: 1075917 - RNA, 19 nt, Homo sapiens
uaagcacuacuauguauca

SEQ ID NO: 1075918 - RNA, 19 nt, Homo sapiens
uacagaaggauacagguaa

SEQ ID NO: 1075919 - RNA, 19 nt, Homo sapiens
gcaaaucaucaauggucaa

SEQ ID NO: 1075920 - RNA, 19 nt, Homo sapiens
gagaaaauauuugcaaugc

SEQ ID NO: 1075921 - RNA, 19 nt, Homo sapiens
uagaagcccauuucccauu

SEQ ID NO: 1075922 - RNA, 19 nt, Homo sapiens
acaauuuacugccaaugca

SEQ ID NO: 1075923 - RNA, 19 nt, Homo sapiens
uuggcaagauccaguuaaa

SEQ ID NO: 1075924 - RNA, 19 nt, Homo sapiens
gaugcugaauaacacuaga

SEQ ID NO: 1075925 - RNA, 19 nt, Homo sapiens
cgaggauguuucaacuguu

SEQ ID NO: 1075926 - RNA, 19 nt, Homo sapiens
cagaaggauacagguaaua

SEQ ID NO: 1075927 - RNA, 19 nt, Homo sapiens
cagggucacuuguucacau

SEQ ID NO: 1075928 - RNA, 19 nt, Homo sapiens
gaauaacacuagaaaacag

SEQ ID NO: 1075929 - RNA, 19 nt, Homo sapiens
uuagauaugucugggaaag

SEQ ID NO: 1075930 - RNA, 19 nt, Homo sapiens
uggauaaguaguuguggua

SEQ ID NO: 1075931 - RNA, 19 nt, Homo sapiens
ucaauagaacaacaaagga

SEQ ID NO: 1075932 - RNA, 19 nt, Homo sapiens
gguauacacgaggauguuu

SEQ ID NO: 1075933 - RNA, 19 nt, Homo sapiens
gauccaugcauauaaagca

SEQ ID NO: 1075934 - RNA, 19 nt, Homo sapiens
gauuaagguccuaaacaag

SEQ ID NO: 1075935 - RNA, 19 nt, Homo sapiens
agaaggauacagguaauau

SEQ ID NO: 1075936 - RNA, 19 nt, Homo sapiens
caaaucaucaauggucaau

SEQ ID NO: 1075937 - RNA, 19 nt, Homo sapiens
gaagaucaaccaaguauuu

SEQ ID NO: 1075938 - RNA, 19 nt, Homo sapiens
gcuauuaccuugaagauca

SEQ ID NO: 1075939 - RNA, 19 nt, Homo sapiens
uagcagcacuagcuucuua

SEQ ID NO: 1075940 - RNA, 19 nt, Homo sapiens
guaaaugacaugacaguaa

SEQ ID NO: 1075941 - RNA, 19 nt, Homo sapiens
agaauuaucuguuggaaug

SEQ ID NO: 1075942 - RNA, 19 nt, Homo sapiens
cuacaaagucucucuuaua

SEQ ID NO: 1075943 - RNA, 19 nt, Homo sapiens
gauaguauguacaguaaca

SEQ ID NO: 1075944 - RNA, 19 nt, Homo sapiens
auacagaucuccucaccua

SEQ ID NO: 1075945 - RNA, 19 nt, Homo sapiens
gcacuagcuucuuagaguu

SEQ ID NO: 1075946 - RNA, 19 nt, Homo sapiens
gaagugaaacauacccuuu

SEQ ID NO: 1075947 - RNA, 19 nt, Homo sapiens
gugcuugucucuuugguaa

SEQ ID NO: 1075948 - RNA, 19 nt, Homo sapiens
gaaacaggauaguauguac

SEQ ID NO: 1075949 - RNA, 19 nt, Homo sapiens
ggaaacaggauaguaugua

SEQ ID NO: 1075950 - RNA, 19 nt, Homo sapiens
ggaggaaacaggauaguau

SEQ ID NO: 1075951 - RNA, 19 nt, Homo sapiens
ugacuaaacucaaacuuac

SEQ ID NO: 1075952 - RNA, 19 nt, Homo sapiens
gcucauaccgugcaaaguu

SEQ ID NO: 1075953 - RNA, 19 nt, Homo sapiens
gcaaaacaguaauggauuu

SEQ ID NO: 1075954 - RNA, 19 nt, Homo sapiens
uuacaacccuuuaauccaa

SEQ ID NO: 1075955 - RNA, 19 nt, Homo sapiens
uaaacuggcuggacuuucu

SEQ ID NO: 1075956 - RNA, 19 nt, Homo sapiens
gaaccugcccuuggaauau

SEQ ID NO: 1075957 - RNA, 19 nt, Homo sapiens
gugacuaaacucaaacuua

SEQ ID NO: 1075958 - RNA, 19 nt, Homo sapiens
aauuagagcuagaaucgaa

SEQ ID NO: 1075959 - RNA, 19 nt, Homo sapiens
aaaccaaacaccacacuuu

SEQ ID NO: 1075960 - RNA, 19 nt, Homo sapiens
gcaugggccucucaaucuu

SEQ ID NO: 1075961 - RNA, 19 nt, Homo sapiens
gcaagacgcugggguuaaa

SEQ ID NO: 1075962 - RNA, 19 nt, Homo sapiens
ugacaugacaguaauuaga

SEQ ID NO: 1075963 - RNA, 19 nt, Homo sapiens
aggauaguauguacaguaa

SEQ ID NO: 1075964 - RNA, 19 nt, Homo sapiens
gauuaaagucacagucaaa

SEQ ID NO: 1075965 - RNA, 19 nt, Homo sapiens
agaccgcgcugguaccauu

SEQ ID NO: 1075966 - RNA, 19 nt, Homo sapiens
cagcuggucucagguaguu

SEQ ID NO: 1075967 - RNA, 19 nt, Homo sapiens
guaauuagagcuagaaucg

SEQ ID NO: 1075968 - RNA, 19 nt, Homo sapiens
gucaagaagugaaacauac

SEQ ID NO: 1075969 - RNA, 19 nt, Homo sapiens
caggauaguauguacagua

SEQ ID NO: 1075970 - RNA, 19 nt, Homo sapiens
aaucgaaccugcccuugga

SEQ ID NO: 1075971 - RNA, 19 nt, Homo sapiens
aaacauacccuuugaucca

SEQ ID NO: 1075972 - RNA, 19 nt, Homo sapiens
caucagcuauaguuaugga

SEQ ID NO: 1075973 - RNA, 19 nt, Homo sapiens
gaugaagucuggcaaaauc

SEQ ID NO: 1075974 - RNA, 19 nt, Homo sapiens
cagcuuccuuguuugacua

SEQ ID NO: 1075975 - RNA, 19 nt, Homo sapiens
gcaugcaguuuguggcaau

SEQ ID NO: 1075976 - RNA, 19 nt, Homo sapiens
gaaucgaaaugaguaaacu

SEQ ID NO: 1075977 - RNA, 19 nt, Homo sapiens
gacaguaauuagagcuaga

SEQ ID NO: 1075978 - RNA, 19 nt, Homo sapiens
uacuucaccucucaucuuu

SEQ ID NO: 1075979 - RNA, 19 nt, Homo sapiens
accuacagcuuccuuguuu

SEQ ID NO: 1075980 - RNA, 19 nt, Homo sapiens
gaggaaacaggauaguaug

SEQ ID NO: 1075981 - RNA, 19 nt, Homo sapiens
gcaggacagguaucgguuu

SEQ ID NO: 1075982 - RNA, 19 nt, Homo sapiens
cgaaccugcccuuggaaua

SEQ ID NO: 1075983 - RNA, 19 nt, Homo sapiens
guggguaaaugacaugaca

SEQ ID NO: 1075984 - RNA, 19 nt, Homo sapiens
caaauuugcagugacuaaa

SEQ ID NO: 1075985 - RNA, 19 nt, Homo sapiens
ucaaauuugcagugacuaa

SEQ ID NO: 1075986 - RNA, 19 nt, Homo sapiens
gcgcugguaccauugcuuu

SEQ ID NO: 1075987 - RNA, 19 nt, Homo sapiens
uccaugcuguagucaguua

SEQ ID NO: 1075988 - RNA, 19 nt, Homo sapiens
guaucgcuauuaccuugaa

SEQ ID NO: 1075989 - RNA, 19 nt, Homo sapiens
uuaacuaucuuagguugga

SEQ ID NO: 1075990 - RNA, 19 nt, Homo sapiens
ucacagcuggucucaggua

SEQ ID NO: 1075991 - RNA, 19 nt, Homo sapiens
agugaaacauacccuuuga

SEQ ID NO: 1075992 - RNA, 19 nt, Homo sapiens
ugucaagaagugaaacaua

SEQ ID NO: 1075993 - RNA, 19 nt, Homo sapiens
ucucuuagauuagacuguu

SEQ ID NO: 1075994 - RNA, 19 nt, Homo sapiens
guauguacaguaacaaugu

SEQ ID NO: 1075995 - RNA, 19 nt, Homo sapiens
ugaaacauacccuuugauc

SEQ ID NO: 1075996 - RNA, 19 nt, Homo sapiens
gcugcagcauuuauauugu

SEQ ID NO: 1075997 - RNA, 19 nt, Homo sapiens
gaaauauuugguacgauag

SEQ ID NO: 1075998 - RNA, 19 nt, Homo sapiens
guuaaagaccgcgcuggua

SEQ ID NO: 1075999 - RNA, 19 nt, Homo sapiens
caauauuccuaggacagaa

SEQ ID NO: 1076000 - RNA, 19 nt, Homo sapiens
ugcaucagcuauaguuaug

SEQ ID NO: 1076001 - RNA, 19 nt, Homo sapiens
cguggcaucuccaggcaaa

SEQ ID NO: 1076002 - RNA, 19 nt, Homo sapiens
ucuacaaagucucucuuau

SEQ ID NO: 1076003 - RNA, 19 nt, Homo sapiens
acagucaaauuugcaguga

SEQ ID NO: 1076004 - RNA, 19 nt, Homo sapiens
gcuggucucagguaguuaa

SEQ ID NO: 1076005 - RNA, 19 nt, Homo sapiens
aaacaccacacuuugaugu

SEQ ID NO: 1076006 - RNA, 19 nt, Homo sapiens
ugcagugacuaaacucaaa

SEQ ID NO: 1076007 - RNA, 19 nt, Homo sapiens
ucuaggcacuucuacaaag

SEQ ID NO: 1076008 - RNA, 19 nt, Homo sapiens
cuacagcuuccuuguuuga

SEQ ID NO: 1076009 - RNA, 19 nt, Homo sapiens
gauagcagcacuagcuucu

SEQ ID NO: 1076010 - RNA, 19 nt, Homo sapiens
ggagauaagacaauauucc

SEQ ID NO: 1076011 - RNA, 19 nt, Homo sapiens
cucauaccgugcaaaguuu

SEQ ID NO: 1076012 - RNA, 19 nt, Homo sapiens
ggauggugaguuugaaaga

SEQ ID NO: 1076013 - RNA, 19 nt, Homo sapiens
ugagauagcagcacuagcu

SEQ ID NO: 1076014 - RNA, 19 nt, Homo sapiens
gguaaaugacaugacagua

SEQ ID NO: 1076015 - RNA, 19 nt, Homo sapiens
guacuugugcuugaauuuc

SEQ ID NO: 1076016 - RNA, 19 nt, Homo sapiens
ggcaugggccucucaaucu

SEQ ID NO: 1076017 - RNA, 19 nt, Homo sapiens
uuauuuagcaugcaguuug

SEQ ID NO: 1076018 - RNA, 19 nt, Homo sapiens
agauuaaagucacagucaa

SEQ ID NO: 1076019 - RNA, 19 nt, Homo sapiens
aaagucacagucaaauuug

SEQ ID NO: 1076020 - RNA, 19 nt, Homo sapiens
cagcauuuauauugucaag

SEQ ID NO: 1076021 - RNA, 19 nt, Homo sapiens
aaucuaggcacuucuacaa

SEQ ID NO: 1076022 - RNA, 19 nt, Homo sapiens
gugagagccugcugguagu

SEQ ID NO: 1076023 - RNA, 19 nt, Homo sapiens
ggcauuccauuccguuucu

SEQ ID NO: 1076024 - RNA, 19 nt, Homo sapiens
uagauuaaagucacaguca

SEQ ID NO: 1076025 - RNA, 19 nt, Homo sapiens
gcaguuuguggcaauucua

SEQ ID NO: 1076026 - RNA, 19 nt, Homo sapiens
uaagacaauauuccuagga

SEQ ID NO: 1076027 - RNA, 19 nt, Homo sapiens
cagcuauaguuauggagau

SEQ ID NO: 1076028 - RNA, 19 nt, Homo sapiens
gacaugacaguaauuagag

SEQ ID NO: 1076029 - RNA, 19 nt, Homo sapiens
guacgauagugcuuaaaau

SEQ ID NO: 1076030 - RNA, 19 nt, Homo sapiens
uggaauauacuaagcauac

SEQ ID NO: 1076031 - RNA, 19 nt, Homo sapiens
gcagauucuuggcauucca

SEQ ID NO: 1076032 - RNA, 19 nt, Homo sapiens
agcacuagcuucuuagagu

SEQ ID NO: 1076033 - RNA, 19 nt, Homo sapiens
uuacuucaccucucaucuu

SEQ ID NO: 1076034 - RNA, 19 nt, Homo sapiens
gagauagcagcacuagcuu

SEQ ID NO: 1076035 - RNA, 19 nt, Homo sapiens
gagauaagacaauauuccu

SEQ ID NO: 1076036 - RNA, 19 nt, Homo sapiens
ggacuuucugcaucagcua

SEQ ID NO: 1076037 - RNA, 19 nt, Homo sapiens
guacaaaccucucauuuua

SEQ ID NO: 1076038 - RNA, 19 nt, Homo sapiens
uagaagagcuguagaaauc

SEQ ID NO: 1076039 - RNA, 19 nt, Homo sapiens
gagcauaguuuauauaguc

SEQ ID NO: 1076040 - RNA, 19 nt, Homo sapiens
caugaaauccugcuaaauu

SEQ ID NO: 1076041 - RNA, 19 nt, Homo sapiens
agaaaucagucauguaguu

SEQ ID NO: 1076042 - RNA, 19 nt, Homo sapiens
ggugggaauuuaagcauaa

SEQ ID NO: 1076043 - RNA, 19 nt, Homo sapiens
cuaaauucccugugaaaua

SEQ ID NO: 1076044 - RNA, 19 nt, Homo sapiens
caaaugcuguuuaugauac

SEQ ID NO: 1076045 - RNA, 19 nt, Homo sapiens
gaagcaaucuaguacaaac

SEQ ID NO: 1076046 - RNA, 19 nt, Homo sapiens
gaucugaggauagucuuua

SEQ ID NO: 1076047 - RNA, 19 nt, Homo sapiens
cauaaucucuucugugagu

SEQ ID NO: 1076048 - RNA, 19 nt, Homo sapiens
gaggauagucuuuacuuug

SEQ ID NO: 1076049 - RNA, 19 nt, Homo sapiens
gaaaucagucauguaguuu

SEQ ID NO: 1076050 - RNA, 19 nt, Homo sapiens
guaauaauacccagcuuga

SEQ ID NO: 1076051 - RNA, 19 nt, Homo sapiens
gcuuaucucugcuucaguu

SEQ ID NO: 1076052 - RNA, 19 nt, Homo sapiens
ucagucauguaguuucaua

SEQ ID NO: 1076053 - RNA, 19 nt, Homo sapiens
ggagaaagugauuguaguu

SEQ ID NO: 1076054 - RNA, 19 nt, Homo sapiens
guagaaaucagucauguag

SEQ ID NO: 1076055 - RNA, 19 nt, Homo sapiens
ugaggaagcagauaauuug

SEQ ID NO: 1076056 - RNA, 19 nt, Homo sapiens
gauagucuuuacuuugcua

SEQ ID NO: 1076057 - RNA, 19 nt, Homo sapiens
uuacgugauuucagaagua

SEQ ID NO: 1076058 - RNA, 19 nt, Homo sapiens
gcacagaauuuuagaauac

SEQ ID NO: 1076059 - RNA, 19 nt, Homo sapiens
ucauguacuuguugcauuu

SEQ ID NO: 1076060 - RNA, 19 nt, Homo sapiens
ccaaaugcuguuuaugaua

SEQ ID NO: 1076061 - RNA, 19 nt, Homo sapiens
gagaaccaaaugcuguuua

SEQ ID NO: 1076062 - RNA, 19 nt, Homo sapiens
gaucagucuucaugaaauc

SEQ ID NO: 1076063 - RNA, 19 nt, Homo sapiens
ugaggauagucuuuacuuu

SEQ ID NO: 1076064 - RNA, 19 nt, Homo sapiens
gauuguaguugggaucuga

SEQ ID NO: 1076065 - RNA, 19 nt, Homo sapiens
gggagaaagugauuguagu

SEQ ID NO: 1076066 - RNA, 19 nt, Homo sapiens
guagaagcaguaugguaua

SEQ ID NO: 1076067 - RNA, 19 nt, Homo sapiens
gaagaggcaguauaaccuu

SEQ ID NO: 1076068 - RNA, 19 nt, Homo sapiens
ugaaguaguagaagcagua

SEQ ID NO: 1076069 - RNA, 19 nt, Homo sapiens
gaagagcuguagaaaucag

SEQ ID NO: 1076070 - RNA, 19 nt, Homo sapiens
gcucauuuccuauagaaga

SEQ ID NO: 1076071 - RNA, 19 nt, Homo sapiens
ccuucaugcuuguuaauaa

SEQ ID NO: 1076072 - RNA, 19 nt, Homo sapiens
uaaagcucauuuccuauag

SEQ ID NO: 1076073 - RNA, 19 nt, Homo sapiens
gaccaaggcaagaggauug

SEQ ID NO: 1076074 - RNA, 19 nt, Homo sapiens
aaccaaaugcuguuuauga

SEQ ID NO: 1076075 - RNA, 19 nt, Homo sapiens
uggaagcaaucuaguacaa

SEQ ID NO: 1076076 - RNA, 19 nt, Homo sapiens
cauaaacuccuucaugcuu

SEQ ID NO: 1076077 - RNA, 19 nt, Homo sapiens
aaagagggaagaagaaaga

SEQ ID NO: 1076078 - RNA, 19 nt, Homo sapiens
cagaugaggaagcagauaa

SEQ ID NO: 1076079 - RNA, 19 nt, Homo sapiens
agaaccaaaugcuguuuau

SEQ ID NO: 1076080 - RNA, 19 nt, Homo sapiens
ggaagcaaucuaguacaaa

SEQ ID NO: 1076081 - RNA, 19 nt, Homo sapiens
gaucuuggaagcaaucuag

SEQ ID NO: 1076082 - RNA, 19 nt, Homo sapiens
gauaauuugcacaggcuuu

SEQ ID NO: 1076083 - RNA, 19 nt, Homo sapiens
gauacaguuuaguagaguu

SEQ ID NO: 1076084 - RNA, 19 nt, Homo sapiens
cgugauuucagaaguaaua

SEQ ID NO: 1076085 - RNA, 19 nt, Homo sapiens
gagaaagugauuguaguug

SEQ ID NO: 1076086 - RNA, 19 nt, Homo sapiens
aagcucauuuccuauagaa

SEQ ID NO: 1076087 - RNA, 19 nt, Homo sapiens
aauaauacccagcuugaga

SEQ ID NO: 1076088 - RNA, 19 nt, Homo sapiens
ccugcuaaauucccuguga

SEQ ID NO: 1076089 - RNA, 19 nt, Homo sapiens
gaugaggaagcagauaauu

SEQ ID NO: 1076090 - RNA, 19 nt, Homo sapiens
gaaaagagggaagaagaaa

SEQ ID NO: 1076091 - RNA, 19 nt, Homo sapiens
ccugugacauuagucguaa

SEQ ID NO: 1076092 - RNA, 19 nt, Homo sapiens
cuuguugcauuuggauuua

SEQ ID NO: 1076093 - RNA, 19 nt, Homo sapiens
aagaggcaguauaaccuuu

SEQ ID NO: 1076094 - RNA, 19 nt, Homo sapiens
augaaauccugcuaaauuc

SEQ ID NO: 1076095 - RNA, 19 nt, Homo sapiens
aaucagucauguaguuuca

SEQ ID NO: 1076096 - RNA, 19 nt, Homo sapiens
gggcugauuuucaauuuug

SEQ ID NO: 1076097 - RNA, 19 nt, Homo sapiens
ggccuguaaucccagcuuu

SEQ ID NO: 1076098 - RNA, 19 nt, Homo sapiens
uaaacuccuucaugcuugu

SEQ ID NO: 1076099 - RNA, 19 nt, Homo sapiens
gaaccaaaugcuguuuaug

SEQ ID NO: 1076100 - RNA, 19 nt, Homo sapiens
aauauugucauuccuguga

SEQ ID NO: 1076101 - RNA, 19 nt, Homo sapiens
ugagagcauuggauuagag

SEQ ID NO: 1076102 - RNA, 19 nt, Homo sapiens
uauagaagagcuguagaaa

SEQ ID NO: 1076103 - RNA, 19 nt, Homo sapiens
aaagcucauuuccuauaga

SEQ ID NO: 1076104 - RNA, 19 nt, Homo sapiens
acaguuuaguagaguugua

SEQ ID NO: 1076105 - RNA, 19 nt, Homo sapiens
uaguacaaaccucucauuu

SEQ ID NO: 1076106 - RNA, 19 nt, Homo sapiens
uagaagcaguaugguauag

SEQ ID NO: 1076107 - RNA, 19 nt, Homo sapiens
uuuagguggugggaauuua

SEQ ID NO: 1076108 - RNA, 19 nt, Homo sapiens
agaucagucuucaugaaau

SEQ ID NO: 1076109 - RNA, 19 nt, Homo sapiens
uacgugauuucagaaguaa

SEQ ID NO: 1076110 - RNA, 19 nt, Homo sapiens
gagaccucauguacuuguu

SEQ ID NO: 1076111 - RNA, 19 nt, Homo sapiens
cauggcacauaaucucuuc

SEQ ID NO: 1076112 - RNA, 19 nt, Homo sapiens
guccaggaguuugagacua

SEQ ID NO: 1076113 - RNA, 19 nt, Homo sapiens
guugggaucugaggauagu

SEQ ID NO: 1076114 - RNA, 19 nt, Homo sapiens
uaguugggaucugaggaua

SEQ ID NO: 1076115 - RNA, 19 nt, Homo sapiens
aguagaagcaguaugguau

SEQ ID NO: 1076116 - RNA, 19 nt, Homo sapiens
cuauagaagagcuguagaa

SEQ ID NO: 1076117 - RNA, 19 nt, Homo sapiens
uggugggaauuuaagcaua

SEQ ID NO: 1076118 - RNA, 19 nt, Homo sapiens
accaaaugcuguuuaugau

SEQ ID NO: 1076119 - RNA, 19 nt, Homo sapiens
caggcgaggugcuaugucu

SEQ ID NO: 1076120 - RNA, 19 nt, Homo sapiens
gcuaaauucccugugaaau

SEQ ID NO: 1076121 - RNA, 19 nt, Homo sapiens
gaaguaguagaagcaguau

SEQ ID NO: 1076122 - RNA, 19 nt, Homo sapiens
uucaugaaauccugcuaaa

SEQ ID NO: 1076123 - RNA, 19 nt, Homo sapiens
uccaggaguuugagacuag

SEQ ID NO: 1076124 - RNA, 19 nt, Homo sapiens
uuucauaaacuccuucaug

SEQ ID NO: 1076125 - RNA, 19 nt, Homo sapiens
aaagcuagagagucugaaa

SEQ ID NO: 1076126 - RNA, 19 nt, Homo sapiens
ggaagaagaaagaaaagug

SEQ ID NO: 1076127 - RNA, 19 nt, Homo sapiens
uaguagaagcaguauggua

SEQ ID NO: 1076128 - RNA, 19 nt, Homo sapiens
gagggaagaagaaagaaaa

SEQ ID NO: 1076129 - RNA, 19 nt, Homo sapiens
gaagaagaaagaaaagugu

SEQ ID NO: 1076130 - RNA, 19 nt, Homo sapiens
cugcuaaauucccugugaa

SEQ ID NO: 1076131 - RNA, 19 nt, Homo sapiens
aggauagucuuuacuuugc

SEQ ID NO: 1076132 - RNA, 19 nt, Homo sapiens
gcauggcacauaaucucuu

SEQ ID NO: 1076133 - RNA, 19 nt, Homo sapiens
cuaugucucaggccuguaa

SEQ ID NO: 1076134 - RNA, 19 nt, Homo sapiens
ugauacaguuuaguagagu

SEQ ID NO: 1076135 - RNA, 19 nt, Homo sapiens
aaccggaucuuggaagcaa

SEQ ID NO: 1076136 - RNA, 19 nt, Homo sapiens
caggaauauuguuaugaag

SEQ ID NO: 1076137 - RNA, 19 nt, Homo sapiens
acgcaaaucugacacauua

SEQ ID NO: 1076138 - RNA, 19 nt, Homo sapiens
guuaaauccuuccaaguua

SEQ ID NO: 1076139 - RNA, 19 nt, Homo sapiens
gaaggagucugaaucaaca

SEQ ID NO: 1076140 - RNA, 19 nt, Homo sapiens
gaucaaggguaguuaaauc

SEQ ID NO: 1076141 - RNA, 19 nt, Homo sapiens
uuaaguggcuguauagauu

SEQ ID NO: 1076142 - RNA, 19 nt, Homo sapiens
gauguuauuucucguggua

SEQ ID NO: 1076143 - RNA, 19 nt, Homo sapiens
ccacuucgguagaggauuu

SEQ ID NO: 1076144 - RNA, 19 nt, Homo sapiens
cgaccuaucugggcuuuaa

SEQ ID NO: 1076145 - RNA, 19 nt, Homo sapiens
gcuuuaaccuucucuucua

SEQ ID NO: 1076146 - RNA, 19 nt, Homo sapiens
gaggauuucuaguuucuug

SEQ ID NO: 1076147 - RNA, 19 nt, Homo sapiens
cuugugggcuaauuaaaua

SEQ ID NO: 1076148 - RNA, 19 nt, Homo sapiens
guuccaguguucucucuua

SEQ ID NO: 1076149 - RNA, 19 nt, Homo sapiens
accauuaacugacuuguaa

SEQ ID NO: 1076150 - RNA, 19 nt, Homo sapiens
aagcgaaacuucuguggaa

SEQ ID NO: 1076151 - RNA, 19 nt, Homo sapiens
guauagauuuccacuuuca

SEQ ID NO: 1076152 - RNA, 19 nt, Homo sapiens
cuguauagauuuccacuuu

SEQ ID NO: 1076153 - RNA, 19 nt, Homo sapiens
gcacagucuuuccauuuua

SEQ ID NO: 1076154 - RNA, 19 nt, Homo sapiens
ccaguguucucucuuauuc

SEQ ID NO: 1076155 - RNA, 19 nt, Homo sapiens
gaggugggaggaucacuua

SEQ ID NO: 1076156 - RNA, 19 nt, Homo sapiens
caacaucugagcaaacauu

SEQ ID NO: 1076157 - RNA, 19 nt, Homo sapiens
ucuaagagcuccgagaguu

SEQ ID NO: 1076158 - RNA, 19 nt, Homo sapiens
gcacagaucaaggguaguu

SEQ ID NO: 1076159 - RNA, 19 nt, Homo sapiens
aaacaaugccaacaucuga

SEQ ID NO: 1076160 - RNA, 19 nt, Homo sapiens
gaugauaaagcgaaacuuc

SEQ ID NO: 1076161 - RNA, 19 nt, Homo sapiens
gcacugcuacuauuugcaa

SEQ ID NO: 1076162 - RNA, 19 nt, Homo sapiens
gccaacaucugagcaaaca

SEQ ID NO: 1076163 - RNA, 19 nt, Homo sapiens
gauccaagaccucuguaga

SEQ ID NO: 1076164 - RNA, 19 nt, Homo sapiens
gcgauccuguuucagagaa

SEQ ID NO: 1076165 - RNA, 19 nt, Homo sapiens
aaacaaaugcacagaucaa

SEQ ID NO: 1076166 - RNA, 19 nt, Homo sapiens
ccguugcacuccucaguaa

SEQ ID NO: 1076167 - RNA, 19 nt, Homo sapiens
gagucugaaucaacaucua

SEQ ID NO: 1076168 - RNA, 19 nt, Homo sapiens
gauuuccacuuucacaaca

SEQ ID NO: 1076169 - RNA, 19 nt, Homo sapiens
ggguauaucucuauuuuca

SEQ ID NO: 1076170 - RNA, 19 nt, Homo sapiens
caucagggaguaaacaaug

SEQ ID NO: 1076171 - RNA, 19 nt, Homo sapiens
ccuauuauacuaugaagga

SEQ ID NO: 1076172 - RNA, 19 nt, Homo sapiens
caaguuaguucaaaaugug

SEQ ID NO: 1076173 - RNA, 19 nt, Homo sapiens
uaaaacaaaugcacagauc

SEQ ID NO: 1076174 - RNA, 19 nt, Homo sapiens
ggauuugaacuacgugaug

SEQ ID NO: 1076175 - RNA, 19 nt, Homo sapiens
gcaaaucugacacauuacu

SEQ ID NO: 1076176 - RNA, 19 nt, Homo sapiens
uuaaauccuuccaaguuag

SEQ ID NO: 1076177 - RNA, 19 nt, Homo sapiens
ucaaacgacauuagcaguu

SEQ ID NO: 1076178 - RNA, 19 nt, Homo sapiens
uaaguggcuguauagauuu

SEQ ID NO: 1076179 - RNA, 19 nt, Homo sapiens
gauaaagcgaaacuucugu

SEQ ID NO: 1076180 - RNA, 19 nt, Homo sapiens
acaacagaauuagcagauu

SEQ ID NO: 1076181 - RNA, 19 nt, Homo sapiens
caccuacgauacuguuuua

SEQ ID NO: 1076182 - RNA, 19 nt, Homo sapiens
ccaucauacucuucaccua

SEQ ID NO: 1076183 - RNA, 19 nt, Homo sapiens
aguaaacaaugccaacauc

SEQ ID NO: 1076184 - RNA, 19 nt, Homo sapiens
aguuaaauccuuccaaguu

SEQ ID NO: 1076185 - RNA, 19 nt, Homo sapiens
gaacuacgugaugcuccua

SEQ ID NO: 1076186 - RNA, 19 nt, Homo sapiens
uaugaaggagucugaauca

SEQ ID NO: 1076187 - RNA, 19 nt, Homo sapiens
cagaucaaggguaguuaaa

SEQ ID NO: 1076188 - RNA, 19 nt, Homo sapiens
uaaacaaugccaacaucug

SEQ ID NO: 1076189 - RNA, 19 nt, Homo sapiens
acgcacagucuuuccauuu

SEQ ID NO: 1076190 - RNA, 19 nt, Homo sapiens
ucugacacauuacuuccuu

SEQ ID NO: 1076191 - RNA, 19 nt, Homo sapiens
cuguauaccguuaccauuu

SEQ ID NO: 1076192 - RNA, 19 nt, Homo sapiens
caaaucugacacauuacuu

SEQ ID NO: 1076193 - RNA, 19 nt, Homo sapiens
cacuuucacaacagaauua

SEQ ID NO: 1076194 - RNA, 19 nt, Homo sapiens
uguuauuucucgugguaaa

SEQ ID NO: 1076195 - RNA, 19 nt, Homo sapiens
acagaucaaggguaguuaa

SEQ ID NO: 1076196 - RNA, 19 nt, Homo sapiens
agagcgauccuguuucaga

SEQ ID NO: 1076197 - RNA, 19 nt, Homo sapiens
gaguaaacaaugccaacau

SEQ ID NO: 1076198 - RNA, 19 nt, Homo sapiens
uaagagcuccgagaguuca

SEQ ID NO: 1076199 - RNA, 19 nt, Homo sapiens
ccacuuucacaacagaauu

SEQ ID NO: 1076200 - RNA, 19 nt, Homo sapiens
ggaguaaacaaugccaaca

SEQ ID NO: 1076201 - RNA, 19 nt, Homo sapiens
acauuuuccuuuccaguua

SEQ ID NO: 1076202 - RNA, 19 nt, Homo sapiens
ccaaguuaguucaaaaugu

SEQ ID NO: 1076203 - RNA, 19 nt, Homo sapiens
guaaacaaugccaacaucu

SEQ ID NO: 1076204 - RNA, 19 nt, Homo sapiens
ugaaggagucugaaucaac

SEQ ID NO: 1076205 - RNA, 19 nt, Homo sapiens
ggauuucuaguuucuugug

SEQ ID NO: 1076206 - RNA, 19 nt, Homo sapiens
ugauaaagcgaaacuucug

SEQ ID NO: 1076207 - RNA, 19 nt, Homo sapiens
ugggguauaucucuauuuu

SEQ ID NO: 1076208 - RNA, 19 nt, Homo sapiens
uguauagauuuccacuuuc

SEQ ID NO: 1076209 - RNA, 19 nt, Homo sapiens
aaagauccaagaccucugu

SEQ ID NO: 1076210 - RNA, 19 nt, Homo sapiens
gugggaggaucacuuaagc

SEQ ID NO: 1076211 - RNA, 19 nt, Homo sapiens
aaacaucagggaguaaaca

SEQ ID NO: 1076212 - RNA, 19 nt, Homo sapiens
gggcuuuaaccuucucuuc

SEQ ID NO: 1076213 - RNA, 19 nt, Homo sapiens
ggugggaggaucacuuaag

SEQ ID NO: 1076214 - RNA, 19 nt, Homo sapiens
cugacacauuacuuccuua

SEQ ID NO: 1076215 - RNA, 19 nt, Homo sapiens
uguauaccguuaccauuuu

SEQ ID NO: 1076216 - RNA, 19 nt, Homo sapiens
uauauacgcaaaucugaca

SEQ ID NO: 1076217 - RNA, 19 nt, Homo sapiens
cacaacagaauuagcagau

SEQ ID NO: 1076218 - RNA, 19 nt, Homo sapiens
uuagggauuugaacuacgu

SEQ ID NO: 1076219 - RNA, 19 nt, Homo sapiens
cuuuaaccuucucuucuau

SEQ ID NO: 1076220 - RNA, 19 nt, Homo sapiens
agucugaaucaacaucuaa

SEQ ID NO: 1076221 - RNA, 19 nt, Homo sapiens
gaaacgcugugucuacuaa

SEQ ID NO: 1076222 - RNA, 19 nt, Homo sapiens
gcagugagcuuagaucaug

SEQ ID NO: 1076223 - RNA, 19 nt, Homo sapiens
gcuauaauccuacuaguaa

SEQ ID NO: 1076224 - RNA, 19 nt, Homo sapiens
uacgagagcuccacaaaug

SEQ ID NO: 1076225 - RNA, 19 nt, Homo sapiens
gagggaagauauaccacaa

SEQ ID NO: 1076226 - RNA, 19 nt, Homo sapiens
aaugugagcuauaauccua

SEQ ID NO: 1076227 - RNA, 19 nt, Homo sapiens
caagguggguggaucacuu

SEQ ID NO: 1076228 - RNA, 19 nt, Homo sapiens
ugacagauauggaagaaaa

SEQ ID NO: 1076229 - RNA, 19 nt, Homo sapiens
gcuaguagaauuuguaauc

SEQ ID NO: 1076230 - RNA, 19 nt, Homo sapiens
ugagagggcugaguucuuc

SEQ ID NO: 1076231 - RNA, 19 nt, Homo sapiens
gaaaauauuugcagcacau

SEQ ID NO: 1076232 - RNA, 19 nt, Homo sapiens
cugccaagcugccaccuaa

SEQ ID NO: 1076233 - RNA, 19 nt, Homo sapiens
gaaccccauuuauaucaua

SEQ ID NO: 1076234 - RNA, 19 nt, Homo sapiens
gcaggagaaucacaucaac

SEQ ID NO: 1076235 - RNA, 19 nt, Homo sapiens
gucauuugcuaguagaauu

SEQ ID NO: 1076236 - RNA, 19 nt, Homo sapiens
cauggugccugguauauac

SEQ ID NO: 1076237 - RNA, 19 nt, Homo sapiens
acaguguccauacaaauua

SEQ ID NO: 1076238 - RNA, 19 nt, Homo sapiens
gcauggugccugguauaua

SEQ ID NO: 1076239 - RNA, 19 nt, Homo sapiens
acaaaugacagauauggaa

SEQ ID NO: 1076240 - RNA, 19 nt, Homo sapiens
gggaagauauaccacaaaa

SEQ ID NO: 1076241 - RNA, 19 nt, Homo sapiens
ggagguugcagugagcuua

SEQ ID NO: 1076242 - RNA, 19 nt, Homo sapiens
uggcaggugucauuugcua

SEQ ID NO: 1076243 - RNA, 19 nt, Homo sapiens
cagaagaaauaggauuauc

SEQ ID NO: 1076244 - RNA, 19 nt, Homo sapiens
uuagacaacuagcuaucaa

SEQ ID NO: 1076245 - RNA, 19 nt, Homo sapiens
gcagaagaaauaggauuau

SEQ ID NO: 1076246 - RNA, 19 nt, Homo sapiens
aagcagauuucgcaaccaa

SEQ ID NO: 1076247 - RNA, 19 nt, Homo sapiens
gagcuauaauccuacuagu

SEQ ID NO: 1076248 - RNA, 19 nt, Homo sapiens
gggaaaagauaagcagauu

SEQ ID NO: 1076249 - RNA, 19 nt, Homo sapiens
gcgaaacgcugugucuacu

SEQ ID NO: 1076250 - RNA, 19 nt, Homo sapiens
cacaguguccauacaaauu

SEQ ID NO: 1076251 - RNA, 19 nt, Homo sapiens
gcgccuguaaucccaguua

SEQ ID NO: 1076252 - RNA, 19 nt, Homo sapiens
uggaaaacaucaagguuaa

SEQ ID NO: 1076253 - RNA, 19 nt, Homo sapiens
cauagcagaagaaauagga

SEQ ID NO: 1076254 - RNA, 19 nt, Homo sapiens
aaugacagauauggaagaa

SEQ ID NO: 1076255 - RNA, 19 nt, Homo sapiens
ugagcagaauaaaggauau

SEQ ID NO: 1076256 - RNA, 19 nt, Homo sapiens
gaaaaugagcagaauaaag

SEQ ID NO: 1076257 - RNA, 19 nt, Homo sapiens
ggugucauuugcuaguaga

SEQ ID NO: 1076258 - RNA, 19 nt, Homo sapiens
caggugucauuugcuagua

SEQ ID NO: 1076259 - RNA, 19 nt, Homo sapiens
gcuucaggguccuuagaga

SEQ ID NO: 1076260 - RNA, 19 nt, Homo sapiens
acaaaugugagcuauaauc

SEQ ID NO: 1076261 - RNA, 19 nt, Homo sapiens
uauacgagagcuccacaaa

SEQ ID NO: 1076262 - RNA, 19 nt, Homo sapiens
uagcauggugccugguaua

SEQ ID NO: 1076263 - RNA, 19 nt, Homo sapiens
gcaggugucauuugcuagu

SEQ ID NO: 1076264 - RNA, 19 nt, Homo sapiens
agcagaagaaauaggauua

SEQ ID NO: 1076265 - RNA, 19 nt, Homo sapiens
caccuaaagacaagaguga

SEQ ID NO: 1076266 - RNA, 19 nt, Homo sapiens
ccaagcugccaccuaaaga

SEQ ID NO: 1076267 - RNA, 19 nt, Homo sapiens
cgauggcucacgccuguaa

SEQ ID NO: 1076268 - RNA, 19 nt, Homo sapiens
cgaaacgcugugucuacua

SEQ ID NO: 1076269 - RNA, 19 nt, Homo sapiens
gugaacgccuagaaaauga

SEQ ID NO: 1076270 - RNA, 19 nt, Homo sapiens
auacaaaacuagccaggaa

SEQ ID NO: 1076271 - RNA, 19 nt, Homo sapiens
uagcagaagaaauaggauu

SEQ ID NO: 1076272 - RNA, 19 nt, Homo sapiens
guuguugcugcccguauua

SEQ ID NO: 1076273 - RNA, 19 nt, Homo sapiens
ccuguaaucccggcacuuu

SEQ ID NO: 1076274 - RNA, 19 nt, Homo sapiens
ucacaguguccauacaaau

SEQ ID NO: 1076275 - RNA, 19 nt, Homo sapiens
gaucucuaccucacagugu

SEQ ID NO: 1076276 - RNA, 19 nt, Homo sapiens
gugggacggucuuuucuaa

SEQ ID NO: 1076277 - RNA, 19 nt, Homo sapiens
ggcaggagaaucacaucaa

SEQ ID NO: 1076278 - RNA, 19 nt, Homo sapiens
uaaucccaguuacuuagga

SEQ ID NO: 1076279 - RNA, 19 nt, Homo sapiens
uaucaaugugaacugcuua

SEQ ID NO: 1076280 - RNA, 19 nt, Homo sapiens
agagugagagggcugaguu

SEQ ID NO: 1076281 - RNA, 19 nt, Homo sapiens
cgaaagucucugugugaug

SEQ ID NO: 1076282 - RNA, 19 nt, Homo sapiens
ggaaaagauaagcagauuu

SEQ ID NO: 1076283 - RNA, 19 nt, Homo sapiens
ccuaaagacaagagugaga

SEQ ID NO: 1076284 - RNA, 19 nt, Homo sapiens
gcugccaccuaaagacaag

SEQ ID NO: 1076285 - RNA, 19 nt, Homo sapiens
gcagauuucgcaaccaaaa

SEQ ID NO: 1076286 - RNA, 19 nt, Homo sapiens
aaaaugagcagaauaaagg

SEQ ID NO: 1076287 - RNA, 19 nt, Homo sapiens
uuaucaaugugaacugcuu

SEQ ID NO: 1076288 - RNA, 19 nt, Homo sapiens
gccaagcugccaccuaaag

SEQ ID NO: 1076289 - RNA, 19 nt, Homo sapiens
acacaaaugacagauaugg

SEQ ID NO: 1076290 - RNA, 19 nt, Homo sapiens
ucgaaagucucugugugau

SEQ ID NO: 1076291 - RNA, 19 nt, Homo sapiens
ucacuugaggucaggaguu

SEQ ID NO: 1076292 - RNA, 19 nt, Homo sapiens
ccagagggaagauauacca

SEQ ID NO: 1076293 - RNA, 19 nt, Homo sapiens
caaaugugagcuauaaucc

SEQ ID NO: 1076294 - RNA, 19 nt, Homo sapiens
gugagagggcugaguucuu

SEQ ID NO: 1076295 - RNA, 19 nt, Homo sapiens
aaucaacgaguacaauuac

SEQ ID NO: 1076296 - RNA, 19 nt, Homo sapiens
cacuugaggucaggaguuc

SEQ ID NO: 1076297 - RNA, 19 nt, Homo sapiens
agacaacuagcuaucaaag

SEQ ID NO: 1076298 - RNA, 19 nt, Homo sapiens
caguguccauacaaauuag

SEQ ID NO: 1076299 - RNA, 19 nt, Homo sapiens
gaaaggagauuaacaagug

SEQ ID NO: 1076300 - RNA, 19 nt, Homo sapiens
ggacaaugaucagauauuu

SEQ ID NO: 1076301 - RNA, 19 nt, Homo sapiens
caagagaagugcuuugauu

SEQ ID NO: 1076302 - RNA, 19 nt, Homo sapiens
ggagguggcucuaaguaaa

SEQ ID NO: 1076303 - RNA, 19 nt, Homo sapiens
gagcuucucuuccagcaua

SEQ ID NO: 1076304 - RNA, 19 nt, Homo sapiens
gaacugauuuggaagaaca

SEQ ID NO: 1076305 - RNA, 19 nt, Homo sapiens
gaagggaggcuugccauua

SEQ ID NO: 1076306 - RNA, 19 nt, Homo sapiens
ggacaaguggugaagcaua

SEQ ID NO: 1076307 - RNA, 19 nt, Homo sapiens
gaaaaucuggcaugaaaua

SEQ ID NO: 1076308 - RNA, 19 nt, Homo sapiens
ggacgcagguuuaacuucu

SEQ ID NO: 1076309 - RNA, 19 nt, Homo sapiens
gucaugaacugauuuggaa

SEQ ID NO: 1076310 - RNA, 19 nt, Homo sapiens
ucagauauuucacaucgaa

SEQ ID NO: 1076311 - RNA, 19 nt, Homo sapiens
gggcagagguugggaagau

SEQ ID NO: 1076312 - RNA, 19 nt, Homo sapiens
aauccaggguccagaguua

SEQ ID NO: 1076313 - RNA, 19 nt, Homo sapiens
gcaauaugaaucacugaaa

SEQ ID NO: 1076314 - RNA, 19 nt, Homo sapiens
caaauguccuuguauucug

SEQ ID NO: 1076315 - RNA, 19 nt, Homo sapiens
gugaaaaucuggcaugaaa

SEQ ID NO: 1076316 - RNA, 19 nt, Homo sapiens
cagguguuauuuccaauuu

SEQ ID NO: 1076317 - RNA, 19 nt, Homo sapiens
uauuauagcugcaaauguc

SEQ ID NO: 1076318 - RNA, 19 nt, Homo sapiens
ggacaguaguggugcaucu

SEQ ID NO: 1076319 - RNA, 19 nt, Homo sapiens
ggaauaugguauguuacuu

SEQ ID NO: 1076320 - RNA, 19 nt, Homo sapiens
gcauuuggaucagcugcua

SEQ ID NO: 1076321 - RNA, 19 nt, Homo sapiens
gaaacagucuuuuauccuu

SEQ ID NO: 1076322 - RNA, 19 nt, Homo sapiens
ucacauggcagcaaauaug

SEQ ID NO: 1076323 - RNA, 19 nt, Homo sapiens
gaaugaugauaaaguugug

SEQ ID NO: 1076324 - RNA, 19 nt, Homo sapiens
gcaaauguccuuguauucu

SEQ ID NO: 1076325 - RNA, 19 nt, Homo sapiens
cugcaaauguccuuguauu

SEQ ID NO: 1076326 - RNA, 19 nt, Homo sapiens
ggcaugaaauaaggacuaa

SEQ ID NO: 1076327 - RNA, 19 nt, Homo sapiens
ucagaaaggagauuaacaa

SEQ ID NO: 1076328 - RNA, 19 nt, Homo sapiens
ccuauaaggagucucauaa

SEQ ID NO: 1076329 - RNA, 19 nt, Homo sapiens
gcagcaaauauguauguuu

SEQ ID NO: 1076330 - RNA, 19 nt, Homo sapiens
auuaacaagugguggaaua

SEQ ID NO: 1076331 - RNA, 19 nt, Homo sapiens
aagggaggcuugccauuau

SEQ ID NO: 1076332 - RNA, 19 nt, Homo sapiens
uggaauaaccuaagugaug

SEQ ID NO: 1076333 - RNA, 19 nt, Homo sapiens
ggugaagcauacaagagaa

SEQ ID NO: 1076334 - RNA, 19 nt, Homo sapiens
gaacagggagccgcuagug

SEQ ID NO: 1076335 - RNA, 19 nt, Homo sapiens
gaucaugcggcacaucuug

SEQ ID NO: 1076336 - RNA, 19 nt, Homo sapiens
ggauacagcaggaaugauc

SEQ ID NO: 1076337 - RNA, 19 nt, Homo sapiens
gauagcauaagaccacaaa

SEQ ID NO: 1076338 - RNA, 19 nt, Homo sapiens
gacaaguggugaagcauac

SEQ ID NO: 1076339 - RNA, 19 nt, Homo sapiens
ggagcucacugcgguccua

SEQ ID NO: 1076340 - RNA, 19 nt, Homo sapiens
caucgaauccagccucaaa

SEQ ID NO: 1076341 - RNA, 19 nt, Homo sapiens
caucuggccucccacuguu

SEQ ID NO: 1076342 - RNA, 19 nt, Homo sapiens
caugaaauaaggacuaaug

SEQ ID NO: 1076343 - RNA, 19 nt, Homo sapiens
guccuuguauucuguuuau

SEQ ID NO: 1076344 - RNA, 19 nt, Homo sapiens
aaagcugauugguuggaua

SEQ ID NO: 1076345 - RNA, 19 nt, Homo sapiens
uggaucagcugcuauuugg

SEQ ID NO: 1076346 - RNA, 19 nt, Homo sapiens
gcuaugcucccgucuggaa

SEQ ID NO: 1076347 - RNA, 19 nt, Homo sapiens
uaaaguugccacaggaaga

SEQ ID NO: 1076348 - RNA, 19 nt, Homo sapiens
ggucaugaacugauuugga

SEQ ID NO: 1076349 - RNA, 19 nt, Homo sapiens
uuacggucaugaacugauu

SEQ ID NO: 1076350 - RNA, 19 nt, Homo sapiens
gcagguguuauuuccaauu

SEQ ID NO: 1076351 - RNA, 19 nt, Homo sapiens
gguggaauaaccuaaguga

SEQ ID NO: 1076352 - RNA, 19 nt, Homo sapiens
gggaggcuugccauuauuu

SEQ ID NO: 1076353 - RNA, 19 nt, Homo sapiens
gcagguuuaacuucuuuau

SEQ ID NO: 1076354 - RNA, 19 nt, Homo sapiens
acagggagccgcuagugaa

SEQ ID NO: 1076355 - RNA, 19 nt, Homo sapiens
gguauuauagcugcaaaug

SEQ ID NO: 1076356 - RNA, 19 nt, Homo sapiens
ccuucucccuauccuauaa

SEQ ID NO: 1076357 - RNA, 19 nt, Homo sapiens
acgcagguuuaacuucuuu

SEQ ID NO: 1076358 - RNA, 19 nt, Homo sapiens
gagaagugcuuugauuccu

SEQ ID NO: 1076359 - RNA, 19 nt, Homo sapiens
gcaucuggccucccacugu

SEQ ID NO: 1076360 - RNA, 19 nt, Homo sapiens
cugcagguguuauuuccaa

SEQ ID NO: 1076361 - RNA, 19 nt, Homo sapiens
guucauggcaguguaccua

SEQ ID NO: 1076362 - RNA, 19 nt, Homo sapiens
cuauaaggagucucauaaa

SEQ ID NO: 1076363 - RNA, 19 nt, Homo sapiens
gguguuauuuccaauuuug

SEQ ID NO: 1076364 - RNA, 19 nt, Homo sapiens
gguccuuuguucuccaaug

SEQ ID NO: 1076365 - RNA, 19 nt, Homo sapiens
gaucagacccagggacaag

SEQ ID NO: 1076366 - RNA, 19 nt, Homo sapiens
aaauguccuuguauucugu

SEQ ID NO: 1076367 - RNA, 19 nt, Homo sapiens
aaucuggcaugaaauaagg

SEQ ID NO: 1076368 - RNA, 19 nt, Homo sapiens
gaacauucugggucaagag

SEQ ID NO: 1076369 - RNA, 19 nt, Homo sapiens
cauggcagcaaauauguau

SEQ ID NO: 1076370 - RNA, 19 nt, Homo sapiens
ccuuuguucuccaauguug

SEQ ID NO: 1076371 - RNA, 19 nt, Homo sapiens
gacaaugaucagauauuuc

SEQ ID NO: 1076372 - RNA, 19 nt, Homo sapiens
gcauacaagagaagugcuu

SEQ ID NO: 1076373 - RNA, 19 nt, Homo sapiens
gaaauccaggguccagagu

SEQ ID NO: 1076374 - RNA, 19 nt, Homo sapiens
gacgcagguuuaacuucuu

SEQ ID NO: 1076375 - RNA, 19 nt, Homo sapiens
ugaacauucugggucaaga

SEQ ID NO: 1076376 - RNA, 19 nt, Homo sapiens
uauuucacauggcagcaaa

SEQ ID NO: 1076377 - RNA, 19 nt, Homo sapiens
gcugauugguuggauagca

SEQ ID NO: 1076378 - RNA, 19 nt, Homo sapiens
uacaagagaagugcuuuga

SEQ ID NO: 1076379 - RNA, 19 nt, Homo sapiens
agcggacaaugaucagaua

SEQ ID NO: 1076380 - RNA, 19 nt, Homo sapiens
caggagacaucggcuagag

SEQ ID NO: 1076381 - RNA, 19 nt, Homo sapiens
gguaaaguugccacaggaa

SEQ ID NO: 1076382 - RNA, 19 nt, Homo sapiens
guccuuuguucuccaaugu

SEQ ID NO: 1076383 - RNA, 19 nt, Homo sapiens
caagugguggaauaaccua

SEQ ID NO: 1076384 - RNA, 19 nt, Homo sapiens
uuaacaagugguggaauaa

SEQ ID NO: 1076385 - RNA, 19 nt, Homo sapiens
caugaacugauuuggaaga

SEQ ID NO: 1076386 - RNA, 19 nt, Homo sapiens
gaagcauacaagagaagug

SEQ ID NO: 1076387 - RNA, 19 nt, Homo sapiens
ggcagcaaauauguauguu

SEQ ID NO: 1076388 - RNA, 19 nt, Homo sapiens
aaggagacuucagaaagga

SEQ ID NO: 1076389 - RNA, 19 nt, Homo sapiens
uugguuggauagcauaaga

SEQ ID NO: 1076390 - RNA, 19 nt, Homo sapiens
ccaggguccagaguuauuu

SEQ ID NO: 1076391 - RNA, 19 nt, Homo sapiens
aaggagguggcucuaagua

SEQ ID NO: 1076392 - RNA, 19 nt, Homo sapiens
aaaaggagguggcucuaag

SEQ ID NO: 1076393 - RNA, 19 nt, Homo sapiens
cagggagccgcuagugaaa

SEQ ID NO: 1076394 - RNA, 19 nt, Homo sapiens
guauguuacuuacggucau

SEQ ID NO: 1076395 - RNA, 19 nt, Homo sapiens
ucucugcagcggacaauga

SEQ ID NO: 1076396 - RNA, 19 nt, Homo sapiens
ggcaauaugaaucacugaa

SEQ ID NO: 1076397 - RNA, 19 nt, Homo sapiens
guauuauagcugcaaaugu

SEQ ID NO: 1076398 - RNA, 19 nt, Homo sapiens
cagguauuauagcugcaaa

SEQ ID NO: 1076399 - RNA, 19 nt, Homo sapiens
cgaaagaacuuccguacga

SEQ ID NO: 1076400 - RNA, 19 nt, Homo sapiens
gaaacuggaugauauaugc

SEQ ID NO: 1076401 - RNA, 19 nt, Homo sapiens
ggaaagggaucuaugugau

SEQ ID NO: 1076402 - RNA, 19 nt, Homo sapiens
gaugauauaugcuuaaagg

SEQ ID NO: 1076403 - RNA, 19 nt, Homo sapiens
gagagcaccuuucugauag

SEQ ID NO: 1076404 - RNA, 19 nt, Homo sapiens
cgagagcaccuuucugaua

SEQ ID NO: 1076405 - RNA, 19 nt, Homo sapiens
ugagagagauaacagagaa

SEQ ID NO: 1076406 - RNA, 19 nt, Homo sapiens
ugauggugcugcucucuua

SEQ ID NO: 1076407 - RNA, 19 nt, Homo sapiens
gaaaguccagcucaucaaa

SEQ ID NO: 1076408 - RNA, 19 nt, Homo sapiens
gaugaaacuggaugauaua

SEQ ID NO: 1076409 - RNA, 19 nt, Homo sapiens
uaaaggagguaacgucgau

SEQ ID NO: 1076410 - RNA, 19 nt, Homo sapiens
agaugaaacuggaugauau

SEQ ID NO: 1076411 - RNA, 19 nt, Homo sapiens
gacgagagcaccuuucuga

SEQ ID NO: 1076412 - RNA, 19 nt, Homo sapiens
cagagacccuuucuacguu

SEQ ID NO: 1076413 - RNA, 19 nt, Homo sapiens
gauaacagagaaagaaguu

SEQ ID NO: 1076414 - RNA, 19 nt, Homo sapiens
gaagccgaauguuaugguu

SEQ ID NO: 1076415 - RNA, 19 nt, Homo sapiens
gaaagggaucuaugugaug

SEQ ID NO: 1076416 - RNA, 19 nt, Homo sapiens
gagaaugucaagccagauu

SEQ ID NO: 1076417 - RNA, 19 nt, Homo sapiens
uauaauauucggcuucuga

SEQ ID NO: 1076418 - RNA, 19 nt, Homo sapiens
cagaugaaacuggaugaua

SEQ ID NO: 1076419 - RNA, 19 nt, Homo sapiens
caacaguuauuggaaaguc

SEQ ID NO: 1076420 - RNA, 19 nt, Homo sapiens
gaauaccucgggaaaggaa

SEQ ID NO: 1076421 - RNA, 19 nt, Homo sapiens
ggaaaguccagcucaucaa

SEQ ID NO: 1076422 - RNA, 19 nt, Homo sapiens
gaucaacaagguaaaucuu

SEQ ID NO: 1076423 - RNA, 19 nt, Homo sapiens
guguugaagccgaauguua

SEQ ID NO: 1076424 - RNA, 19 nt, Homo sapiens
uggaagauaugcuguaugc

SEQ ID NO: 1076425 - RNA, 19 nt, Homo sapiens
gagcuguacugccgugucu

SEQ ID NO: 1076426 - RNA, 19 nt, Homo sapiens
gaugagagacggcagugau

SEQ ID NO: 1076427 - RNA, 19 nt, Homo sapiens
gucaagcgcuucucaacgu

SEQ ID NO: 1076428 - RNA, 19 nt, Homo sapiens
gccaugguguucuggauca

SEQ ID NO: 1076429 - RNA, 19 nt, Homo sapiens
ucuaugugauggagaguga

SEQ ID NO: 1076430 - RNA, 19 nt, Homo sapiens
agagauaacagagaaagaa

SEQ ID NO: 1076431 - RNA, 19 nt, Homo sapiens
gcccagagcagaugaaacu

SEQ ID NO: 1076432 - RNA, 19 nt, Homo sapiens
gcugcucucuuagcuguga

SEQ ID NO: 1076433 - RNA, 19 nt, Homo sapiens
uggaggauuugaugagaga

SEQ ID NO: 1076434 - RNA, 19 nt, Homo sapiens
cggaaagggaucuauguga

SEQ ID NO: 1076435 - RNA, 19 nt, Homo sapiens
uaugcuguaugcgccauua

SEQ ID NO: 1076436 - RNA, 19 nt, Homo sapiens
ucagagacccuuucuacgu

SEQ ID NO: 1076437 - RNA, 19 nt, Homo sapiens
ggccuacacuguggagaug

SEQ ID NO: 1076438 - RNA, 19 nt, Homo sapiens
ccucagagacccuuucuac

SEQ ID NO: 1076439 - RNA, 19 nt, Homo sapiens
guuggaggauuugaugaga

SEQ ID NO: 1076440 - RNA, 19 nt, Homo sapiens
gagagauaacagagaaaga

SEQ ID NO: 1076441 - RNA, 19 nt, Homo sapiens
gagacccuuucuacguuga

SEQ ID NO: 1076442 - RNA, 19 nt, Homo sapiens
guucagugccucgaaagaa

SEQ ID NO: 1076443 - RNA, 19 nt, Homo sapiens
acuggaugauauaugcuua

SEQ ID NO: 1076444 - RNA, 19 nt, Homo sapiens
agaaggugguggccagugu

SEQ ID NO: 1076445 - RNA, 19 nt, Homo sapiens
aaugguggaugcccugaug

SEQ ID NO: 1076446 - RNA, 19 nt, Homo sapiens
ccgccaaccugcaguggau

SEQ ID NO: 1076447 - RNA, 19 nt, Homo sapiens
gagauaacagagaaagaag

SEQ ID NO: 1076448 - RNA, 19 nt, Homo sapiens
ucaagcgcuucucaacguu

SEQ ID NO: 1076449 - RNA, 19 nt, Homo sapiens
cugaauaccucgggaaagg

SEQ ID NO: 1076450 - RNA, 19 nt, Homo sapiens
uaugagcaggagcacauua

SEQ ID NO: 1076451 - RNA, 19 nt, Homo sapiens
uuucuacguugaccaguau

SEQ ID NO: 1076452 - RNA, 19 nt, Homo sapiens
auauucggcuucugagaga

SEQ ID NO: 1076453 - RNA, 19 nt, Homo sapiens
gacagaguccgaccucagu

SEQ ID NO: 1076454 - RNA, 19 nt, Homo sapiens
gagagagauaacagagaaa

SEQ ID NO: 1076455 - RNA, 19 nt, Homo sapiens
uguugaagccgaauguuau

SEQ ID NO: 1076456 - RNA, 19 nt, Homo sapiens
ggaucaacaagguaaaucu

SEQ ID NO: 1076457 - RNA, 19 nt, Homo sapiens
ugaaacuggaugauauaug

SEQ ID NO: 1076458 - RNA, 19 nt, Homo sapiens
ggagcugaaagacgcgaaa

SEQ ID NO: 1076459 - RNA, 19 nt, Homo sapiens
gcuguaugcgccauuagug

SEQ ID NO: 1076460 - RNA, 19 nt, Homo sapiens
cuuggaagauaugcuguau

SEQ ID NO: 1076461 - RNA, 19 nt, Homo sapiens
cuuucuacguugaccagua

SEQ ID NO: 1076462 - RNA, 19 nt, Homo sapiens
cacccuacuucccguuguu

SEQ ID NO: 1076463 - RNA, 19 nt, Homo sapiens
caacguucagugccucgaa

SEQ ID NO: 1076464 - RNA, 19 nt, Homo sapiens
cggaagaaccugaauaccu

SEQ ID NO: 1076465 - RNA, 19 nt, Homo sapiens
gaaugucaagccagauuuu

SEQ ID NO: 1076466 - RNA, 19 nt, Homo sapiens
agaaugucaagccagauuu

SEQ ID NO: 1076467 - RNA, 19 nt, Homo sapiens
guaugcgccauuaguguug

SEQ ID NO: 1076468 - RNA, 19 nt, Homo sapiens
ucccguuguuggaggauuu

SEQ ID NO: 1076469 - RNA, 19 nt, Homo sapiens
gcagaugaaacuggaugau

SEQ ID NO: 1076470 - RNA, 19 nt, Homo sapiens
gcacccggaagaaccugaa

SEQ ID NO: 1076471 - RNA, 19 nt, Homo sapiens
ggaccucagagacccuuuc

SEQ ID NO: 1076472 - RNA, 19 nt, Homo sapiens
aacaacaguuauuggaaag

SEQ ID NO: 1076473 - RNA, 19 nt, Homo sapiens
gagcaggagcacauuaagc

SEQ ID NO: 1076474 - RNA, 19 nt, Homo sapiens
gaacauagauuagcaguuu

SEQ ID NO: 1076475 - RNA, 19 nt, Homo sapiens
gauuguaacuuucacagua

SEQ ID NO: 1076476 - RNA, 19 nt, Homo sapiens
acaaaucacuucaacagua

SEQ ID NO: 1076477 - RNA, 19 nt, Homo sapiens
ccacaaagcuucucauaac

SEQ ID NO: 1076478 - RNA, 19 nt, Homo sapiens
gaucauccauuauaucuuc

SEQ ID NO: 1076479 - RNA, 19 nt, Homo sapiens
gagaaugcccuaacaguaa

SEQ ID NO: 1076480 - RNA, 19 nt, Homo sapiens
agaauaaggugucacaauu

SEQ ID NO: 1076481 - RNA, 19 nt, Homo sapiens
gaaauuaggcagucacuuc

SEQ ID NO: 1076482 - RNA, 19 nt, Homo sapiens
caucgucucuugaauuauu

SEQ ID NO: 1076483 - RNA, 19 nt, Homo sapiens
caaauugcuuuaucaguug

SEQ ID NO: 1076484 - RNA, 19 nt, Homo sapiens
caacagcuggaguaaauua

SEQ ID NO: 1076485 - RNA, 19 nt, Homo sapiens
uaccaccacuucaauaaua

SEQ ID NO: 1076486 - RNA, 19 nt, Homo sapiens
uucaguagaugcagaauua

SEQ ID NO: 1076487 - RNA, 19 nt, Homo sapiens
caaaucacuucaacaguau

SEQ ID NO: 1076488 - RNA, 19 nt, Homo sapiens
ugacuacucuuaugcuuau

SEQ ID NO: 1076489 - RNA, 19 nt, Homo sapiens
gauaaucucaucuugcaaa

SEQ ID NO: 1076490 - RNA, 19 nt, Homo sapiens
uagcaguuauugagcuuua

SEQ ID NO: 1076491 - RNA, 19 nt, Homo sapiens
gcucuugcauuugcuuuaa

SEQ ID NO: 1076492 - RNA, 19 nt, Homo sapiens
caaagcuucucauaacuca

SEQ ID NO: 1076493 - RNA, 19 nt, Homo sapiens
gaaucugacuacucuuaug

SEQ ID NO: 1076494 - RNA, 19 nt, Homo sapiens
gaccaucuuugucgacuug

SEQ ID NO: 1076495 - RNA, 19 nt, Homo sapiens
uaauaucugucaggaauga

SEQ ID NO: 1076496 - RNA, 19 nt, Homo sapiens
uggcaagauuuguaagaua

SEQ ID NO: 1076497 - RNA, 19 nt, Homo sapiens
cuauggagcuguuguuuua

SEQ ID NO: 1076498 - RNA, 19 nt, Homo sapiens
cucaucgucucuugaauua

SEQ ID NO: 1076499 - RNA, 19 nt, Homo sapiens
ugcaacagcuggaguaaau

SEQ ID NO: 1076500 - RNA, 19 nt, Homo sapiens
ccacuucaauaauaucugu

SEQ ID NO: 1076501 - RNA, 19 nt, Homo sapiens
gacaguaagugacccaaag

SEQ ID NO: 1076502 - RNA, 19 nt, Homo sapiens
agaaugcccuaacaguaaa

SEQ ID NO: 1076503 - RNA, 19 nt, Homo sapiens
gaauguuuccugaucuauu

SEQ ID NO: 1076504 - RNA, 19 nt, Homo sapiens
gaaaacaaaucacuucaac

SEQ ID NO: 1076505 - RNA, 19 nt, Homo sapiens
cagcuggaguaaauuagaa

SEQ ID NO: 1076506 - RNA, 19 nt, Homo sapiens
caugguaccuggauucuac

SEQ ID NO: 1076507 - RNA, 19 nt, Homo sapiens
ggcaagauuuguaagauac

SEQ ID NO: 1076508 - RNA, 19 nt, Homo sapiens
caauuuggcaagauuugua

SEQ ID NO: 1076509 - RNA, 19 nt, Homo sapiens
gcacaaaaucguuucaaaa

SEQ ID NO: 1076510 - RNA, 19 nt, Homo sapiens
agagaaugcccuaacagua

SEQ ID NO: 1076511 - RNA, 19 nt, Homo sapiens
guuccguacugauaauaaa

SEQ ID NO: 1076512 - RNA, 19 nt, Homo sapiens
ccaccuggguucacaaugg

SEQ ID NO: 1076513 - RNA, 19 nt, Homo sapiens
aaaugaauguuuccugauc

SEQ ID NO: 1076514 - RNA, 19 nt, Homo sapiens
guaaguaaaugugcaacag

SEQ ID NO: 1076515 - RNA, 19 nt, Homo sapiens
gcuguguggucaguaagua

SEQ ID NO: 1076516 - RNA, 19 nt, Homo sapiens
uaagugacccaaaggaaga

SEQ ID NO: 1076517 - RNA, 19 nt, Homo sapiens
gaucccagauuuagugacu

SEQ ID NO: 1076518 - RNA, 19 nt, Homo sapiens
gcuagcuacuccuuauuuc

SEQ ID NO: 1076519 - RNA, 19 nt, Homo sapiens
aaacaaaucacuucaacag

SEQ ID NO: 1076520 - RNA, 19 nt, Homo sapiens
aguauuagccuuugggaaa

SEQ ID NO: 1076521 - RNA, 19 nt, Homo sapiens
uaugcuagcuacuccuuau

SEQ ID NO: 1076522 - RNA, 19 nt, Homo sapiens
gaagauagacuagcaugcu

SEQ ID NO: 1076523 - RNA, 19 nt, Homo sapiens
aauauugacuagaggauca

SEQ ID NO: 1076524 - RNA, 19 nt, Homo sapiens
ugacuuuaaaccaguguua

SEQ ID NO: 1076525 - RNA, 19 nt, Homo sapiens
caucacgaucccagauuua

SEQ ID NO: 1076526 - RNA, 19 nt, Homo sapiens
aaaauucccucuccucuug

SEQ ID NO: 1076527 - RNA, 19 nt, Homo sapiens
cuacugcauucuauugguu

SEQ ID NO: 1076528 - RNA, 19 nt, Homo sapiens
aaacucaucgucucuugaa

SEQ ID NO: 1076529 - RNA, 19 nt, Homo sapiens
cuaaacucaucgucucuug

SEQ ID NO: 1076530 - RNA, 19 nt, Homo sapiens
ucgaaucugacuacucuua

SEQ ID NO: 1076531 - RNA, 19 nt, Homo sapiens
acaucacgaucccagauuu

SEQ ID NO: 1076532 - RNA, 19 nt, Homo sapiens
ucacuuagcaguuauugag

SEQ ID NO: 1076533 - RNA, 19 nt, Homo sapiens
auaaagcucuugcauuugc

SEQ ID NO: 1076534 - RNA, 19 nt, Homo sapiens
ccagauuuagugacuuuaa

SEQ ID NO: 1076535 - RNA, 19 nt, Homo sapiens
ucccagauuuagugacuuu

SEQ ID NO: 1076536 - RNA, 19 nt, Homo sapiens
cagaauaaggugucacaau

SEQ ID NO: 1076537 - RNA, 19 nt, Homo sapiens
ccucuccucuuggcucaua

SEQ ID NO: 1076538 - RNA, 19 nt, Homo sapiens
ucacuucuacugcauucua

SEQ ID NO: 1076539 - RNA, 19 nt, Homo sapiens
uauccaauauugacuagag

SEQ ID NO: 1076540 - RNA, 19 nt, Homo sapiens
cauuuaauuuguccaguuc

SEQ ID NO: 1076541 - RNA, 19 nt, Homo sapiens
uaaggugucacaauucuuc

SEQ ID NO: 1076542 - RNA, 19 nt, Homo sapiens
cauaacuucagcaggaaua

SEQ ID NO: 1076543 - RNA, 19 nt, Homo sapiens
gcauucuauugguuacaaa

SEQ ID NO: 1076544 - RNA, 19 nt, Homo sapiens
aggauaaucucaucuugca

SEQ ID NO: 1076545 - RNA, 19 nt, Homo sapiens
aauaaggugucacaauucu

SEQ ID NO: 1076546 - RNA, 19 nt, Homo sapiens
gucacaauuuggcaagauu

SEQ ID NO: 1076547 - RNA, 19 nt, Homo sapiens
guggcuguguggucaguaa

SEQ ID NO: 1076548 - RNA, 19 nt, Homo sapiens
ugggaggcaugguucauug

SEQ ID NO: 1076549 - RNA, 19 nt, Homo sapiens
guaucugaaucacccaaau

SEQ ID NO: 1076550 - RNA, 19 nt, Homo sapiens
cagccaagacaguaaguga

SEQ ID NO: 1076551 - RNA, 19 nt, Homo sapiens
caaaagagaguauucagau

SEQ ID NO: 1076552 - RNA, 19 nt, Homo sapiens
uaacuuucacaguaucuga

SEQ ID NO: 1076553 - RNA, 19 nt, Homo sapiens
ggaccaucuuugucgacuu

SEQ ID NO: 1076554 - RNA, 19 nt, Homo sapiens
ucaggaaugaaaccacuuu

SEQ ID NO: 1076555 - RNA, 19 nt, Homo sapiens
cagugaagauagacuagca

SEQ ID NO: 1076556 - RNA, 19 nt, Homo sapiens
uuaaacaggcagaaacuuc

SEQ ID NO: 1076557 - RNA, 19 nt, Homo sapiens
uuuguccaguucucacuua

SEQ ID NO: 1076558 - RNA, 19 nt, Homo sapiens
uaucugaaucacccaaauu

SEQ ID NO: 1076559 - RNA, 19 nt, Homo sapiens
cauuaccaccacuucaaua

SEQ ID NO: 1076560 - RNA, 19 nt, Homo sapiens
caguagaugcagaauuauu

SEQ ID NO: 1076561 - RNA, 19 nt, Homo sapiens
guccaguucucacuuagca

SEQ ID NO: 1076562 - RNA, 19 nt, Homo sapiens
ucacaauuuggcaagauuu

SEQ ID NO: 1076563 - RNA, 19 nt, Homo sapiens
guucacaaugguaugagua

SEQ ID NO: 1076564 - RNA, 19 nt, Homo sapiens
gcuacuccuuauuucagaa

SEQ ID NO: 1076565 - RNA, 19 nt, Homo sapiens
cuucaacaguauuaacuag

SEQ ID NO: 1076566 - RNA, 19 nt, Homo sapiens
caaaugaauguuuccugau

SEQ ID NO: 1076567 - RNA, 19 nt, Homo sapiens
uacagagaaugcccuaaca

SEQ ID NO: 1076568 - RNA, 19 nt, Homo sapiens
uuuaucaguuguagucgaa

SEQ ID NO: 1076569 - RNA, 19 nt, Homo sapiens
guauucagauuuugaguca

SEQ ID NO: 1076570 - RNA, 19 nt, Homo sapiens
cugaaucacccaaauuuua

SEQ ID NO: 1076571 - RNA, 19 nt, Homo sapiens
uaacuucagcaggaauaaa

SEQ ID NO: 1076572 - RNA, 19 nt, Homo sapiens
guuauccaauauugacuag

SEQ ID NO: 1076573 - RNA, 19 nt, Homo sapiens
auaggauaaucucaucuug

SEQ ID NO: 1076574 - RNA, 19 nt, Homo sapiens
ugaaauggcuuuagaauca

SEQ ID NO: 1076575 - RNA, 19 nt, Homo sapiens
ggaauaacaugauuuaagg

SEQ ID NO: 1076576 - RNA, 19 nt, Homo sapiens
uggcagaacuguagcaaua

SEQ ID NO: 1076577 - RNA, 19 nt, Homo sapiens
caacaaucauauucacgua

SEQ ID NO: 1076578 - RNA, 19 nt, Homo sapiens
gauauguguucauugagua

SEQ ID NO: 1076579 - RNA, 19 nt, Homo sapiens
aaucagaccagcuuaaaua

SEQ ID NO: 1076580 - RNA, 19 nt, Homo sapiens
ggccacagauugguauuaa

SEQ ID NO: 1076581 - RNA, 19 nt, Homo sapiens
gaaacauugugcucuaaca

SEQ ID NO: 1076582 - RNA, 19 nt, Homo sapiens
gaccugacauccguuguaa

SEQ ID NO: 1076583 - RNA, 19 nt, Homo sapiens
guaguggaguugcagcuaa

SEQ ID NO: 1076584 - RNA, 19 nt, Homo sapiens
gggcauugauuccauuuca

SEQ ID NO: 1076585 - RNA, 19 nt, Homo sapiens
gcucauaaccaaauaaagu

SEQ ID NO: 1076586 - RNA, 19 nt, Homo sapiens
gcuaagugaucaagacugu

SEQ ID NO: 1076587 - RNA, 19 nt, Homo sapiens
ggauauguguucauugagu

SEQ ID NO: 1076588 - RNA, 19 nt, Homo sapiens
caggaaacauugugcucua

SEQ ID NO: 1076589 - RNA, 19 nt, Homo sapiens
gaagacaagcagcggauga

SEQ ID NO: 1076590 - RNA, 19 nt, Homo sapiens
gaauguacaagcucuguga

SEQ ID NO: 1076591 - RNA, 19 nt, Homo sapiens
guaguuggguugcuuugug

SEQ ID NO: 1076592 - RNA, 19 nt, Homo sapiens
gggaauaacaugauuuaag

SEQ ID NO: 1076593 - RNA, 19 nt, Homo sapiens
aagcacaucuaagggaaua

SEQ ID NO: 1076594 - RNA, 19 nt, Homo sapiens
uaaacagugugaugugugu

SEQ ID NO: 1076595 - RNA, 19 nt, Homo sapiens
acauugugcucuaacagua

SEQ ID NO: 1076596 - RNA, 19 nt, Homo sapiens
cuaagggaauaacaugauu

SEQ ID NO: 1076597 - RNA, 19 nt, Homo sapiens
cuggauauguguucauuga

SEQ ID NO: 1076598 - RNA, 19 nt, Homo sapiens
ccacagauugguauuaaug

SEQ ID NO: 1076599 - RNA, 19 nt, Homo sapiens
guacaagcucugugaauca

SEQ ID NO: 1076600 - RNA, 19 nt, Homo sapiens
ccucauacgcuauuuaaau

SEQ ID NO: 1076601 - RNA, 19 nt, Homo sapiens
gaaauggcuuuagaaucau

SEQ ID NO: 1076602 - RNA, 19 nt, Homo sapiens
ggucacaacaaucauauuc

SEQ ID NO: 1076603 - RNA, 19 nt, Homo sapiens
gcucuaacaguaugacuau

SEQ ID NO: 1076604 - RNA, 19 nt, Homo sapiens
guuugaggguguguuauuu

SEQ ID NO: 1076605 - RNA, 19 nt, Homo sapiens
gcagaacuguagcaauagg

SEQ ID NO: 1076606 - RNA, 19 nt, Homo sapiens
gcuccucucugcacguaga

SEQ ID NO: 1076607 - RNA, 19 nt, Homo sapiens
cucauacgcuauuuaaaug

SEQ ID NO: 1076608 - RNA, 19 nt, Homo sapiens
ucaagacuguaguggaguu

SEQ ID NO: 1076609 - RNA, 19 nt, Homo sapiens
gaaucagaccagcuuaaau

SEQ ID NO: 1076610 - RNA, 19 nt, Homo sapiens
uuguguagcuggaguaguu

SEQ ID NO: 1076611 - RNA, 19 nt, Homo sapiens
uagaaucauuuggguuuga

SEQ ID NO: 1076612 - RNA, 19 nt, Homo sapiens
cagcuccucucugcacgua

SEQ ID NO: 1076613 - RNA, 19 nt, Homo sapiens
guuaggagcaguauugagu

SEQ ID NO: 1076614 - RNA, 19 nt, Homo sapiens
ugaaucagaccagcuuaaa

SEQ ID NO: 1076615 - RNA, 19 nt, Homo sapiens
gagaggcuccugggcauug

SEQ ID NO: 1076616 - RNA, 19 nt, Homo sapiens
ccuuugcguuucauaugua

SEQ ID NO: 1076617 - RNA, 19 nt, Homo sapiens
ucagugagggccacagauu

SEQ ID NO: 1076618 - RNA, 19 nt, Homo sapiens
cgaccugacauccguugua

SEQ ID NO: 1076619 - RNA, 19 nt, Homo sapiens
gguuugaggguguguuauu

SEQ ID NO: 1076620 - RNA, 19 nt, Homo sapiens
ucacaacaaucauauucac

SEQ ID NO: 1076621 - RNA, 19 nt, Homo sapiens
uaagugaucaagacuguag

SEQ ID NO: 1076622 - RNA, 19 nt, Homo sapiens
caucuaagggaauaacaug

SEQ ID NO: 1076623 - RNA, 19 nt, Homo sapiens
ggaguaguuggguugcuuu

SEQ ID NO: 1076624 - RNA, 19 nt, Homo sapiens
uguacaagcucugugaauc

SEQ ID NO: 1076625 - RNA, 19 nt, Homo sapiens
gugaaucagaccagcuuaa

SEQ ID NO: 1076626 - RNA, 19 nt, Homo sapiens
cuaacaguaugacuauucu

SEQ ID NO: 1076627 - RNA, 19 nt, Homo sapiens
cauacgcuauuuaaauguc

SEQ ID NO: 1076628 - RNA, 19 nt, Homo sapiens
gggccacagauugguauua

SEQ ID NO: 1076629 - RNA, 19 nt, Homo sapiens
aggaaacauugugcucuaa

SEQ ID NO: 1076630 - RNA, 19 nt, Homo sapiens
ggccauggcuuuucacaca

SEQ ID NO: 1076631 - RNA, 19 nt, Homo sapiens
gcuuaaauacccacaccuu

SEQ ID NO: 1076632 - RNA, 19 nt, Homo sapiens
guugaaauggcuuuagaau

SEQ ID NO: 1076633 - RNA, 19 nt, Homo sapiens
gacccucauacgcuauuua

SEQ ID NO: 1076634 - RNA, 19 nt, Homo sapiens
guuggguugcuuuguguua

SEQ ID NO: 1076635 - RNA, 19 nt, Homo sapiens
uguaaccguuugccacuuc

SEQ ID NO: 1076636 - RNA, 19 nt, Homo sapiens
ugccacuucuucagauauu

SEQ ID NO: 1076637 - RNA, 19 nt, Homo sapiens
cuuaaauacccacaccuuu

SEQ ID NO: 1076638 - RNA, 19 nt, Homo sapiens
cagauugguauuaaugaga

SEQ ID NO: 1076639 - RNA, 19 nt, Homo sapiens
ugagcuaagugaucaagac

SEQ ID NO: 1076640 - RNA, 19 nt, Homo sapiens
ucuaacaguaugacuauuc

SEQ ID NO: 1076641 - RNA, 19 nt, Homo sapiens
guugcuggguguuuguuuc

SEQ ID NO: 1076642 - RNA, 19 nt, Homo sapiens
gguuguugcuggguguuug

SEQ ID NO: 1076643 - RNA, 19 nt, Homo sapiens
uuucucagcuuuuggaauu

SEQ ID NO: 1076644 - RNA, 19 nt, Homo sapiens
gccacagauugguauuaau

SEQ ID NO: 1076645 - RNA, 19 nt, Homo sapiens
gaauugcuucgaccugaca

SEQ ID NO: 1076646 - RNA, 19 nt, Homo sapiens
cuuaaacagugugaugugu

SEQ ID NO: 1076647 - RNA, 19 nt, Homo sapiens
ugagauacgaggguuguug

SEQ ID NO: 1076648 - RNA, 19 nt, Homo sapiens
gccacuucuucagauauuu

SEQ ID NO: 1076649 - RNA, 19 nt, Homo sapiens
uuaaauacccacaccuuuu

SEQ ID NO: 1076650 - RNA, 19 nt, Homo sapiens
agguugaaauggcuuuaga

SEQ ID NO: 1076651 - RNA, 19 nt, Homo sapiens
gagacccucauacgcuauu

SEQ ID NO: 1076652 - RNA, 19 nt, Homo sapiens
ggaaacauugugcucuaac

SEQ ID NO: 1076653 - RNA, 19 nt, Homo sapiens
gguugaaauggcuuuagaa

SEQ ID NO: 1076654 - RNA, 19 nt, Homo sapiens
gcacaucuaagggaauaac

SEQ ID NO: 1076655 - RNA, 19 nt, Homo sapiens
guguuuguuuccugagcua

SEQ ID NO: 1076656 - RNA, 19 nt, Homo sapiens
acagauugguauuaaugag

SEQ ID NO: 1076657 - RNA, 19 nt, Homo sapiens
uuagaaucauuuggguuug

SEQ ID NO: 1076658 - RNA, 19 nt, Homo sapiens
ccugggcauugauuccauu

SEQ ID NO: 1076659 - RNA, 19 nt, Homo sapiens
uaguuggguugcuuugugu

SEQ ID NO: 1076660 - RNA, 19 nt, Homo sapiens
acagugugauguguguuau

SEQ ID NO: 1076661 - RNA, 19 nt, Homo sapiens
ugagggccacagauuggua

SEQ ID NO: 1076662 - RNA, 19 nt, Homo sapiens
gagggccacagauugguau

SEQ ID NO: 1076663 - RNA, 19 nt, Homo sapiens
agucaugaauguacaagcu

SEQ ID NO: 1076664 - RNA, 19 nt, Homo sapiens
uaagguugaaauggcuuua

SEQ ID NO: 1076665 - RNA, 19 nt, Homo sapiens
uggaguaguuggguugcuu

SEQ ID NO: 1076666 - RNA, 19 nt, Homo sapiens
cacagauugguauuaauga

SEQ ID NO: 1076667 - RNA, 19 nt, Homo sapiens
gaaauagacugaaugaugu

SEQ ID NO: 1076668 - RNA, 19 nt, Homo sapiens
gaaauacucuucauucaag

SEQ ID NO: 1076669 - RNA, 19 nt, Homo sapiens
ggacuaugcuaugaauuua

SEQ ID NO: 1076670 - RNA, 19 nt, Homo sapiens
gagaagcacuggauccaaa

SEQ ID NO: 1076671 - RNA, 19 nt, Homo sapiens
cagauggaaucacaaauaa

SEQ ID NO: 1076672 - RNA, 19 nt, Homo sapiens
uaaccuauguuguauguga

SEQ ID NO: 1076673 - RNA, 19 nt, Homo sapiens
gaaacaaggugauguacag

SEQ ID NO: 1076674 - RNA, 19 nt, Homo sapiens
gaagagaugacuuggauga

SEQ ID NO: 1076675 - RNA, 19 nt, Homo sapiens
acaacuaccuggcauauga

SEQ ID NO: 1076676 - RNA, 19 nt, Homo sapiens
gauguacaguucauugauu

SEQ ID NO: 1076677 - RNA, 19 nt, Homo sapiens
ugaaggagauucuuuccaa

SEQ ID NO: 1076678 - RNA, 19 nt, Homo sapiens
ugaaauagacugaaugaug

SEQ ID NO: 1076679 - RNA, 19 nt, Homo sapiens
gguaugcaauuguucguuu

SEQ ID NO: 1076680 - RNA, 19 nt, Homo sapiens
gcagaugaagacauuaaua

SEQ ID NO: 1076681 - RNA, 19 nt, Homo sapiens
gaaacaccauggaggaugu

SEQ ID NO: 1076682 - RNA, 19 nt, Homo sapiens
gaaauauaccuacugcuau

SEQ ID NO: 1076683 - RNA, 19 nt, Homo sapiens
ggacugaaguuacugaaaa

SEQ ID NO: 1076684 - RNA, 19 nt, Homo sapiens
uuaaaucccuguuucucua

SEQ ID NO: 1076685 - RNA, 19 nt, Homo sapiens
ccacaggauuugcagauga

SEQ ID NO: 1076686 - RNA, 19 nt, Homo sapiens
guagaaauacucuucauuc

SEQ ID NO: 1076687 - RNA, 19 nt, Homo sapiens
cauaaugaccuauugugua

SEQ ID NO: 1076688 - RNA, 19 nt, Homo sapiens
uauguagucuggcaguaua

SEQ ID NO: 1076689 - RNA, 19 nt, Homo sapiens
ggugguacaucuuguugaa

SEQ ID NO: 1076690 - RNA, 19 nt, Homo sapiens
ggcuaaagaugggaaagua

SEQ ID NO: 1076691 - RNA, 19 nt, Homo sapiens
gguauaaagaugucaguuu

SEQ ID NO: 1076692 - RNA, 19 nt, Homo sapiens
aaacuuagcacgauucugu

SEQ ID NO: 1076693 - RNA, 19 nt, Homo sapiens
acagauggaaucacaaaua

SEQ ID NO: 1076694 - RNA, 19 nt, Homo sapiens
agaauuaaaucccuguuuc

SEQ ID NO: 1076695 - RNA, 19 nt, Homo sapiens
agaaauauaccuacugcua

SEQ ID NO: 1076696 - RNA, 19 nt, Homo sapiens
gaaaaugucccaaauaagu

SEQ ID NO: 1076697 - RNA, 19 nt, Homo sapiens
ucacguucguugaguguaa

SEQ ID NO: 1076698 - RNA, 19 nt, Homo sapiens
gcaaugcuugugaaucuuu

SEQ ID NO: 1076699 - RNA, 19 nt, Homo sapiens
gggcucaccuguugugcuu

SEQ ID NO: 1076700 - RNA, 19 nt, Homo sapiens
ugacuuggaugaaggagau

SEQ ID NO: 1076701 - RNA, 19 nt, Homo sapiens
guaaagaguuuucgagugu

SEQ ID NO: 1076702 - RNA, 19 nt, Homo sapiens
cuugaugcauuguaaguaa

SEQ ID NO: 1076703 - RNA, 19 nt, Homo sapiens
ucaguaaacauucuaguug

SEQ ID NO: 1076704 - RNA, 19 nt, Homo sapiens
gucaguggcugcgugcuua

SEQ ID NO: 1076705 - RNA, 19 nt, Homo sapiens
ugagugauguagacuauag

SEQ ID NO: 1076706 - RNA, 19 nt, Homo sapiens
cgaucgagaugaggaagua

SEQ ID NO: 1076707 - RNA, 19 nt, Homo sapiens
ggugagaauuuauggcaau

SEQ ID NO: 1076708 - RNA, 19 nt, Homo sapiens
gcacgauucugugacuguu

SEQ ID NO: 1076709 - RNA, 19 nt, Homo sapiens
auagagaacuacagaguca

SEQ ID NO: 1076710 - RNA, 19 nt, Homo sapiens
gcucaccuguugugcuuug

SEQ ID NO: 1076711 - RNA, 19 nt, Homo sapiens
caacucuacuguaccuuca

SEQ ID NO: 1076712 - RNA, 19 nt, Homo sapiens
ugguacaucuuguugaauu

SEQ ID NO: 1076713 - RNA, 19 nt, Homo sapiens
uuaggaaggugaaauacau

SEQ ID NO: 1076714 - RNA, 19 nt, Homo sapiens
guuguucaguguaaccuuu

SEQ ID NO: 1076715 - RNA, 19 nt, Homo sapiens
aaauauaccuacugcuauc

SEQ ID NO: 1076716 - RNA, 19 nt, Homo sapiens
ggagguagaaauacucuuc

SEQ ID NO: 1076717 - RNA, 19 nt, Homo sapiens
ugagaaacaaggugaugua

SEQ ID NO: 1076718 - RNA, 19 nt, Homo sapiens
uacuguaccuucaauaaug

SEQ ID NO: 1076719 - RNA, 19 nt, Homo sapiens
gcaccacaacucuacugua

SEQ ID NO: 1076720 - RNA, 19 nt, Homo sapiens
caguaaacauucuaguugu

SEQ ID NO: 1076721 - RNA, 19 nt, Homo sapiens
cguaugugguggauuagaa

SEQ ID NO: 1076722 - RNA, 19 nt, Homo sapiens
aggaagagaugacuuggau

SEQ ID NO: 1076723 - RNA, 19 nt, Homo sapiens
caccacaacucuacuguac

SEQ ID NO: 1076724 - RNA, 19 nt, Homo sapiens
gugagaauuuauggcaaua

SEQ ID NO: 1076725 - RNA, 19 nt, Homo sapiens
gauggaaucacaaauaaac

SEQ ID NO: 1076726 - RNA, 19 nt, Homo sapiens
aaccugggcucaccuguug

SEQ ID NO: 1076727 - RNA, 19 nt, Homo sapiens
cuaaagaugggaaaguauu

SEQ ID NO: 1076728 - RNA, 19 nt, Homo sapiens
ucacagauggaaucacaaa

SEQ ID NO: 1076729 - RNA, 19 nt, Homo sapiens
caagccaaauacuccacua

SEQ ID NO: 1076730 - RNA, 19 nt, Homo sapiens
ugcauuggcuucucauuuc

SEQ ID NO: 1076731 - RNA, 19 nt, Homo sapiens
cugcagcucuucacagaug

SEQ ID NO: 1076732 - RNA, 19 nt, Homo sapiens
acaaggugauguacaguuc

SEQ ID NO: 1076733 - RNA, 19 nt, Homo sapiens
ccagauagagaacuacaga

SEQ ID NO: 1076734 - RNA, 19 nt, Homo sapiens
auaauggacuaugcuauga

SEQ ID NO: 1076735 - RNA, 19 nt, Homo sapiens
gguagaaauacucuucauu

SEQ ID NO: 1076736 - RNA, 19 nt, Homo sapiens
ugaaaaggagguagaaaua

SEQ ID NO: 1076737 - RNA, 19 nt, Homo sapiens
ccuugaagccuacaaagaa

SEQ ID NO: 1076738 - RNA, 19 nt, Homo sapiens
ucauucaagucaaucaguu

SEQ ID NO: 1076739 - RNA, 19 nt, Homo sapiens
gcugcgugcuuaccuugaa

SEQ ID NO: 1076740 - RNA, 19 nt, Homo sapiens
ugaauauucuggauacaac

SEQ ID NO: 1076741 - RNA, 19 nt, Homo sapiens
ggaugaaggagauucuuuc

SEQ ID NO: 1076742 - RNA, 19 nt, Homo sapiens
cacaggauuugcagaugaa

SEQ ID NO: 1076743 - RNA, 19 nt, Homo sapiens
uggacuaugcuaugaauuu

SEQ ID NO: 1076744 - RNA, 19 nt, Homo sapiens
gaugaggaaguaaagaguu

SEQ ID NO: 1076745 - RNA, 19 nt, Homo sapiens
gaauuaaaucccuguuucu

SEQ ID NO: 1076746 - RNA, 19 nt, Homo sapiens
uacauucacugucucuguu

SEQ ID NO: 1076747 - RNA, 19 nt, Homo sapiens
gccugagguuacugcauua

SEQ ID NO: 1076748 - RNA, 19 nt, Homo sapiens
aaugaccuauuguguaaga

SEQ ID NO: 1076749 - RNA, 19 nt, Homo sapiens
aauaaaagguuccuaagug

SEQ ID NO: 1076750 - RNA, 19 nt, Homo sapiens
cuucacagauggaaucaca

SEQ ID NO: 1076751 - RNA, 19 nt, Homo sapiens
ccacaacucuacuguaccu

SEQ ID NO: 1076752 - RNA, 19 nt, Homo sapiens
acugaaugaugucaagaaa

SEQ ID NO: 1076753 - RNA, 19 nt, Homo sapiens
gcuugugaaucuuuucuua

SEQ ID NO: 1076754 - RNA, 19 nt, Homo sapiens
ccacuauugaguuugauuu

SEQ ID NO: 1076755 - RNA, 19 nt, Homo sapiens
ugaagccuacaaagaauuu

SEQ ID NO: 1076756 - RNA, 19 nt, Homo sapiens
gauacaacuaccuggcaua

SEQ ID NO: 1076757 - RNA, 19 nt, Homo sapiens
guaguccuggugagaauuu

SEQ ID NO: 1076758 - RNA, 19 nt, Homo sapiens
ugugagugauguagacuau

SEQ ID NO: 1076759 - RNA, 19 nt, Homo sapiens
gaaggauccaccagucugu

SEQ ID NO: 1076760 - RNA, 19 nt, Homo sapiens
augaggaaguaaagaguuu

SEQ ID NO: 1076761 - RNA, 19 nt, Homo sapiens
uagucuggcaguauaaaua

SEQ ID NO: 1076762 - RNA, 19 nt, Homo sapiens
gagaugaggaaguaaagag

SEQ ID NO: 1076763 - RNA, 19 nt, Homo sapiens
ucaauaauggacuaugcua

SEQ ID NO: 1076764 - RNA, 19 nt, Homo sapiens
gguacaucuuguugaauuc

SEQ ID NO: 1076765 - RNA, 19 nt, Homo sapiens
agccugagguuacugcauu

SEQ ID NO: 1076766 - RNA, 19 nt, Homo sapiens
gauugugggcuuugauuca

SEQ ID NO: 1076767 - RNA, 19 nt, Homo sapiens
gcaggaagcugaagugaga

SEQ ID NO: 1076768 - RNA, 19 nt, Homo sapiens
gagguaaaccggucaguua

SEQ ID NO: 1076769 - RNA, 19 nt, Homo sapiens
ggaagggaaugcuggagua

SEQ ID NO: 1076770 - RNA, 19 nt, Homo sapiens
gaaacccugucucuacuaa

SEQ ID NO: 1076771 - RNA, 19 nt, Homo sapiens
gaagucaagucagagguaa

SEQ ID NO: 1076772 - RNA, 19 nt, Homo sapiens
agagcgaccuucccagaaa

SEQ ID NO: 1076773 - RNA, 19 nt, Homo sapiens
aaucugggcuucuuguuca

SEQ ID NO: 1076774 - RNA, 19 nt, Homo sapiens
gcgcgcaccugaccuucaa

SEQ ID NO: 1076775 - RNA, 19 nt, Homo sapiens
cccauacugucuaguuuaa

SEQ ID NO: 1076776 - RNA, 19 nt, Homo sapiens
aggucaagcucaagaagua

SEQ ID NO: 1076777 - RNA, 19 nt, Homo sapiens
caccugaccuucaacaagu

SEQ ID NO: 1076778 - RNA, 19 nt, Homo sapiens
guucuuuguuuaaguguug

SEQ ID NO: 1076779 - RNA, 19 nt, Homo sapiens
gaagggaaugcuggaguaa

SEQ ID NO: 1076780 - RNA, 19 nt, Homo sapiens
ugaguacuguaucgauauu

SEQ ID NO: 1076781 - RNA, 19 nt, Homo sapiens
gcagguaaucccagaacuu

SEQ ID NO: 1076782 - RNA, 19 nt, Homo sapiens
ccagaucgacuacgacuuc

SEQ ID NO: 1076783 - RNA, 19 nt, Homo sapiens
ucaagaaguacaccaaguu

SEQ ID NO: 1076784 - RNA, 19 nt, Homo sapiens
ggugaaacccugucucuac

SEQ ID NO: 1076785 - RNA, 19 nt, Homo sapiens
cagguaaucccagaacuuu

SEQ ID NO: 1076786 - RNA, 19 nt, Homo sapiens
cuacgaggccgacuuuguu

SEQ ID NO: 1076787 - RNA, 19 nt, Homo sapiens
ggaguucuaccgcaaguuc

SEQ ID NO: 1076788 - RNA, 19 nt, Homo sapiens
ucaugaaggucaagcucaa

SEQ ID NO: 1076789 - RNA, 19 nt, Homo sapiens
gcaccugaccuucaacaag

SEQ ID NO: 1076790 - RNA, 19 nt, Homo sapiens
caagaaguacaccaaguuc

SEQ ID NO: 1076791 - RNA, 19 nt, Homo sapiens
gaggaguucuaccgcaagu

SEQ ID NO: 1076792 - RNA, 19 nt, Homo sapiens
ccaaggagcgcgcauucga

SEQ ID NO: 1076793 - RNA, 19 nt, Homo sapiens
ugaagucaagucagaggua

SEQ ID NO: 1076794 - RNA, 19 nt, Homo sapiens
gaaggguagccgacaaauc

SEQ ID NO: 1076795 - RNA, 19 nt, Homo sapiens
gcagcuguauaaacucuac

SEQ ID NO: 1076796 - RNA, 19 nt, Homo sapiens
gagcgaccuucccagaaag

SEQ ID NO: 1076797 - RNA, 19 nt, Homo sapiens
gugaaacccugucucuacu

SEQ ID NO: 1076798 - RNA, 19 nt, Homo sapiens
cuccgagacugaaagcuuu

SEQ ID NO: 1076799 - RNA, 19 nt, Homo sapiens
cgcuugaggucaggaauuu

SEQ ID NO: 1076800 - RNA, 19 nt, Homo sapiens
gguaaucccagaacuuugg

SEQ ID NO: 1076801 - RNA, 19 nt, Homo sapiens
gaaggucaagcucaagaag

SEQ ID NO: 1076802 - RNA, 19 nt, Homo sapiens
ggaaugcuggaguaaaaua

SEQ ID NO: 1076803 - RNA, 19 nt, Homo sapiens
auugaguacuguaucgaua

SEQ ID NO: 1076804 - RNA, 19 nt, Homo sapiens
ucacuccacugccucuauc

SEQ ID NO: 1076805 - RNA, 19 nt, Homo sapiens
ucgccaacuucauccagua

SEQ ID NO: 1076806 - RNA, 19 nt, Homo sapiens
acgaguuucuggacaaguu

SEQ ID NO: 1076807 - RNA, 19 nt, Homo sapiens
ccacugccucuauccauug

SEQ ID NO: 1076808 - RNA, 19 nt, Homo sapiens
ggccgacuuuguucucuuc

SEQ ID NO: 1076809 - RNA, 19 nt, Homo sapiens
guacaccaaguuccucuuc

SEQ ID NO: 1076810 - RNA, 19 nt, Homo sapiens
ucucagugcuggcgugaag

SEQ ID NO: 1076811 - RNA, 19 nt, Homo sapiens
ggaagcgcgugaugaucgu

SEQ ID NO: 1076812 - RNA, 19 nt, Homo sapiens
caacuggaagcgcgugaug

SEQ ID NO: 1076813 - RNA, 19 nt, Homo sapiens
uuugagaccuggccaacau

SEQ ID NO: 1076814 - RNA, 19 nt, Homo sapiens
gcaaucugggcuucuuguu

SEQ ID NO: 1076815 - RNA, 19 nt, Homo sapiens
ggacugguucgccaagauc

SEQ ID NO: 1076816 - RNA, 19 nt, Homo sapiens
gaggacugguucgccaaga

SEQ ID NO: 1076817 - RNA, 19 nt, Homo sapiens
gcaaguucgagcuggagaa

SEQ ID NO: 1076818 - RNA, 19 nt, Homo sapiens
aaaccggucaguuacagaa

SEQ ID NO: 1076819 - RNA, 19 nt, Homo sapiens
guacuguaucgauauuguu

SEQ ID NO: 1076820 - RNA, 19 nt, Homo sapiens
gcugggaggaggacugguu

SEQ ID NO: 1076821 - RNA, 19 nt, Homo sapiens
ucccauacugucuaguuua

SEQ ID NO: 1076822 - RNA, 19 nt, Homo sapiens
aacuccagcuguucccaua

SEQ ID NO: 1076823 - RNA, 19 nt, Homo sapiens
caaucugggcuucuuguuc

SEQ ID NO: 1076824 - RNA, 19 nt, Homo sapiens
agacagaaggaucgcuuga

SEQ ID NO: 1076825 - RNA, 19 nt, Homo sapiens
uaaauuauggcuguuaagg

SEQ ID NO: 1076826 - RNA, 19 nt, Homo sapiens
gcuguucccauacugucua

SEQ ID NO: 1076827 - RNA, 19 nt, Homo sapiens
uugcacacguccuucucua

SEQ ID NO: 1076828 - RNA, 19 nt, Homo sapiens
ucgacgaguuucuggacaa

SEQ ID NO: 1076829 - RNA, 19 nt, Homo sapiens
ugaaacccugucucuacua

SEQ ID NO: 1076830 - RNA, 19 nt, Homo sapiens
ggccgcaccugucuguuuu

SEQ ID NO: 1076831 - RNA, 19 nt, Homo sapiens
ggaaggguagccgacaaau

SEQ ID NO: 1076832 - RNA, 19 nt, Homo sapiens
cagagcgaccuucccagaa

SEQ ID NO: 1076833 - RNA, 19 nt, Homo sapiens
guucccauacugucuaguu

SEQ ID NO: 1076834 - RNA, 19 nt, Homo sapiens
uccacugccucuauccauu

SEQ ID NO: 1076835 - RNA, 19 nt, Homo sapiens
cuugaggucaggaauuuga

SEQ ID NO: 1076836 - RNA, 19 nt, Homo sapiens
cgacgaguuucuggacaag

SEQ ID NO: 1076837 - RNA, 19 nt, Homo sapiens
gggugacucaggcagguaa

SEQ ID NO: 1076838 - RNA, 19 nt, Homo sapiens
aguacuguaucgauauugu

SEQ ID NO: 1076839 - RNA, 19 nt, Homo sapiens
ggaguuaguuacccuugaa

SEQ ID NO: 1076840 - RNA, 19 nt, Homo sapiens
gggcagagguggcaggaau

SEQ ID NO: 1076841 - RNA, 19 nt, Homo sapiens
guagcacacuugaguuugu

SEQ ID NO: 1076842 - RNA, 19 nt, Homo sapiens
gaguuuguguauuccauug

SEQ ID NO: 1076843 - RNA, 19 nt, Homo sapiens
caaauugcccggagugucu

SEQ ID NO: 1076844 - RNA, 19 nt, Homo sapiens
cacuugaguuuguguauuc

SEQ ID NO: 1076845 - RNA, 19 nt, Homo sapiens
gcacugcccagagcuguga

SEQ ID NO: 1076846 - RNA, 19 nt, Homo sapiens
ggaagccccugguggagaa

SEQ ID NO: 1076847 - RNA, 19 nt, Homo sapiens
gcucuguacaucuuguuug

SEQ ID NO: 1076848 - RNA, 19 nt, Homo sapiens
gaggaagaauuuuguagag

SEQ ID NO: 1076849 - RNA, 19 nt, Homo sapiens
gcuacgggcaggaggaaga

SEQ ID NO: 1076850 - RNA, 19 nt, Homo sapiens
gcagcagcuuccaggaucu

SEQ ID NO: 1076851 - RNA, 19 nt, Homo sapiens
gcugugaugcucuguacau

SEQ ID NO: 1076852 - RNA, 19 nt, Homo sapiens
ggaggaagaauuuuguaga

SEQ ID NO: 1076853 - RNA, 19 nt, Homo sapiens
uggaguuaguuacccuuga

SEQ ID NO: 1076854 - RNA, 19 nt, Homo sapiens
gggcagcagcuuccaggau

SEQ ID NO: 1076855 - RNA, 19 nt, Homo sapiens
cugccgagcuccugaacca

SEQ ID NO: 1076856 - RNA, 19 nt, Homo sapiens
aaacaaaagcuugaacuug

SEQ ID NO: 1076857 - RNA, 19 nt, Homo sapiens
gaccaaugccagccagagu

SEQ ID NO: 1076858 - RNA, 19 nt, Homo sapiens
gagcuacgggcaggaggaa

SEQ ID NO: 1076859 - RNA, 19 nt, Homo sapiens
ccugaccacagcccaaauu

SEQ ID NO: 1076860 - RNA, 19 nt, Homo sapiens
gaauguacguugagaauca

SEQ ID NO: 1076861 - RNA, 19 nt, Homo sapiens
ggacaaagacucaguggaa

SEQ ID NO: 1076862 - RNA, 19 nt, Homo sapiens
ccaacuccaucuucaauaa

SEQ ID NO: 1076863 - RNA, 19 nt, Homo sapiens
gugcagagcuuguggaaag

SEQ ID NO: 1076864 - RNA, 19 nt, Homo sapiens
gagcugggcugucccuuca

SEQ ID NO: 1076865 - RNA, 19 nt, Homo sapiens
ccagacaucuucagaaugg

SEQ ID NO: 1076866 - RNA, 19 nt, Homo sapiens
ccauauaucugcuguacau

SEQ ID NO: 1076867 - RNA, 19 nt, Homo sapiens
gcagggaagugcagagcuu

SEQ ID NO: 1076868 - RNA, 19 nt, Homo sapiens
gacaaagacucaguggaaa

SEQ ID NO: 1076869 - RNA, 19 nt, Homo sapiens
ccacugaccucgacucucu

SEQ ID NO: 1076870 - RNA, 19 nt, Homo sapiens
guacuucgcccgaggauuc

SEQ ID NO: 1076871 - RNA, 19 nt, Homo sapiens
cuaauucucugccuaugga

SEQ ID NO: 1076872 - RNA, 19 nt, Homo sapiens
gccaaggaauguacguuga

SEQ ID NO: 1076873 - RNA, 19 nt, Homo sapiens
caucaccuaugcugccuuu

SEQ ID NO: 1076874 - RNA, 19 nt, Homo sapiens
ggacaacacccucuuacag

SEQ ID NO: 1076875 - RNA, 19 nt, Homo sapiens
guggaaagcgugugaguga

SEQ ID NO: 1076876 - RNA, 19 nt, Homo sapiens
caaggaauguacguugaga

SEQ ID NO: 1076877 - RNA, 19 nt, Homo sapiens
ccacacugcucaugcucaa

SEQ ID NO: 1076878 - RNA, 19 nt, Homo sapiens
caugcugggugccauauau

SEQ ID NO: 1076879 - RNA, 19 nt, Homo sapiens
ggagcaaguucugcagaug

SEQ ID NO: 1076880 - RNA, 19 nt, Homo sapiens
caucuucaauaaagucguu

SEQ ID NO: 1076881 - RNA, 19 nt, Homo sapiens
ucuaugaccucacagagau

SEQ ID NO: 1076882 - RNA, 19 nt, Homo sapiens
gaagacaggcaagaucuca

SEQ ID NO: 1076883 - RNA, 19 nt, Homo sapiens
gaccugcccuucauguaca

SEQ ID NO: 1076884 - RNA, 19 nt, Homo sapiens
gcuucagccuucuauauca

SEQ ID NO: 1076885 - RNA, 19 nt, Homo sapiens
ggugcaacgucauguacuu

SEQ ID NO: 1076886 - RNA, 19 nt, Homo sapiens
caucaccuaugccuucaug

SEQ ID NO: 1076887 - RNA, 19 nt, Homo sapiens
gguagagguuccagacauc

SEQ ID NO: 1076888 - RNA, 19 nt, Homo sapiens
ugaccucgacucucuauga

SEQ ID NO: 1076889 - RNA, 19 nt, Homo sapiens
caacuccaucuucaauaaa

SEQ ID NO: 1076890 - RNA, 19 nt, Homo sapiens
gcaugucagagcacuuuaa

SEQ ID NO: 1076891 - RNA, 19 nt, Homo sapiens
ggaacuugcucucauuuuc

SEQ ID NO: 1076892 - RNA, 19 nt, Homo sapiens
gagcuguuccuuaccauca

SEQ ID NO: 1076893 - RNA, 19 nt, Homo sapiens
gcucugaggauuuggacaa

SEQ ID NO: 1076894 - RNA, 19 nt, Homo sapiens
ccuggaacuugcucucauu

SEQ ID NO: 1076895 - RNA, 19 nt, Homo sapiens
ggaccugcccuucauguac

SEQ ID NO: 1076896 - RNA, 19 nt, Homo sapiens
ggagcuaggccacuucuac

SEQ ID NO: 1076897 - RNA, 19 nt, Homo sapiens
gagcugggaauaucagauc

SEQ ID NO: 1076898 - RNA, 19 nt, Homo sapiens
ucaccaucaugauucagaa

SEQ ID NO: 1076899 - RNA, 19 nt, Homo sapiens
guuugucacugcccaagga

SEQ ID NO: 1076900 - RNA, 19 nt, Homo sapiens
uggcuggaguggaggguaa

SEQ ID NO: 1076901 - RNA, 19 nt, Homo sapiens
gccaacuccaucuucaaua

SEQ ID NO: 1076902 - RNA, 19 nt, Homo sapiens
gggcuaauucucugccuau

SEQ ID NO: 1076903 - RNA, 19 nt, Homo sapiens
caugucagagcacuuuaaa

SEQ ID NO: 1076904 - RNA, 19 nt, Homo sapiens
ggagaaagaggaguagcau

SEQ ID NO: 1076905 - RNA, 19 nt, Homo sapiens
ucaagcccaggaccaauaa

SEQ ID NO: 1076906 - RNA, 19 nt, Homo sapiens
gagagaccugcgugggaua

SEQ ID NO: 1076907 - RNA, 19 nt, Homo sapiens
uuccagacaucuucagaau

SEQ ID NO: 1076908 - RNA, 19 nt, Homo sapiens
caaggagaaagggcuaauu

SEQ ID NO: 1076909 - RNA, 19 nt, Homo sapiens
gaggguaacacugugaugu

SEQ ID NO: 1076910 - RNA, 19 nt, Homo sapiens
ccgaggagcuaggccacuu

SEQ ID NO: 1076911 - RNA, 19 nt, Homo sapiens
uauaucugcuguacaucau

SEQ ID NO: 1076912 - RNA, 19 nt, Homo sapiens
ccaucaugauucagaagau

SEQ ID NO: 1076913 - RNA, 19 nt, Homo sapiens
ggugguacccauguccuuu

SEQ ID NO: 1076914 - RNA, 19 nt, Homo sapiens
cgacaggagcacugcaugu

SEQ ID NO: 1076915 - RNA, 19 nt, Homo sapiens
gaccugcgugggauaauca

SEQ ID NO: 1076916 - RNA, 19 nt, Homo sapiens
gcaugcugggugccauaua

SEQ ID NO: 1076917 - RNA, 19 nt, Homo sapiens
ggucauaaguggggagaga

SEQ ID NO: 1076918 - RNA, 19 nt, Homo sapiens
ggaauguacguugagaauc

SEQ ID NO: 1076919 - RNA, 19 nt, Homo sapiens
ggggagagcugggaauauc

SEQ ID NO: 1076920 - RNA, 19 nt, Homo sapiens
gaucugcggacgggaguau

SEQ ID NO: 1076921 - RNA, 19 nt, Homo sapiens
aaggagaaagggcuaauuc

SEQ ID NO: 1076922 - RNA, 19 nt, Homo sapiens
gaccucgacucucuaugac

SEQ ID NO: 1076923 - RNA, 19 nt, Homo sapiens
ggcuaggucuugccaacuc

SEQ ID NO: 1076924 - RNA, 19 nt, Homo sapiens
gggagaaagaggaguagca

SEQ ID NO: 1076925 - RNA, 19 nt, Homo sapiens
gcuggugcaacgucaugua

SEQ ID NO: 1076926 - RNA, 19 nt, Homo sapiens
ugguagagguuccagacau

SEQ ID NO: 1076927 - RNA, 19 nt, Homo sapiens
uaucugcuguacaucaucu

SEQ ID NO: 1076928 - RNA, 19 nt, Homo sapiens
gggacaacacccucuuaca

SEQ ID NO: 1076929 - RNA, 19 nt, Homo sapiens
cucaagcccaggaccaaua

SEQ ID NO: 1076930 - RNA, 19 nt, Homo sapiens
uaucaucaccaccaagaag

SEQ ID NO: 1076931 - RNA, 19 nt, Homo sapiens
ugagugagggagacaggaa

SEQ ID NO: 1076932 - RNA, 19 nt, Homo sapiens
ucauguacagcaucaccua

SEQ ID NO: 1076933 - RNA, 19 nt, Homo sapiens
uggagcaaguucugcagau

SEQ ID NO: 1076934 - RNA, 19 nt, Homo sapiens
gacugcguguucucacuuc

SEQ ID NO: 1076935 - RNA, 19 nt, Homo sapiens
ggaagacaggcaagaucuc

SEQ ID NO: 1076936 - RNA, 19 nt, Homo sapiens
ccuucgagcuguuccuuac

SEQ ID NO: 1076937 - RNA, 19 nt, Homo sapiens
uuggcgaccugaugcgauu

SEQ ID NO: 1076938 - RNA, 19 nt, Homo sapiens
ggaaacagcgcuacacaua

SEQ ID NO: 1076939 - RNA, 19 nt, Homo sapiens
gaauguacguugagaauca

SEQ ID NO: 1076940 - RNA, 19 nt, Homo sapiens
ggacaaagacucaguggaa

SEQ ID NO: 1076941 - RNA, 19 nt, Homo sapiens
ccaaggaacucgucaggaa

SEQ ID NO: 1076942 - RNA, 19 nt, Homo sapiens
ccaacuccaucuucaauaa

SEQ ID NO: 1076943 - RNA, 19 nt, Homo sapiens
ugaacaaguugcucaagua

SEQ ID NO: 1076944 - RNA, 19 nt, Homo sapiens
acaaguugcucaaguauga

SEQ ID NO: 1076945 - RNA, 19 nt, Homo sapiens
gugcagagcuuguggaaag

SEQ ID NO: 1076946 - RNA, 19 nt, Homo sapiens
gagcugggcugucccuuca

SEQ ID NO: 1076947 - RNA, 19 nt, Homo sapiens
ccagacaucuucagaaugg

SEQ ID NO: 1076948 - RNA, 19 nt, Homo sapiens
ccauauaucugcuguacau

SEQ ID NO: 1076949 - RNA, 19 nt, Homo sapiens
gcagggaagugcagagcuu

SEQ ID NO: 1076950 - RNA, 19 nt, Homo sapiens
gacaaagacucaguggaaa

SEQ ID NO: 1076951 - RNA, 19 nt, Homo sapiens
gaacaaguugcucaaguau

SEQ ID NO: 1076952 - RNA, 19 nt, Homo sapiens
ccacugaccucgacucucu

SEQ ID NO: 1076953 - RNA, 19 nt, Homo sapiens
guacuucgcccgaggauuc

SEQ ID NO: 1076954 - RNA, 19 nt, Homo sapiens
ggagcacccuuuguccuuu

SEQ ID NO: 1076955 - RNA, 19 nt, Homo sapiens
cuaauucucugccuaugga

SEQ ID NO: 1076956 - RNA, 19 nt, Homo sapiens
gccaaggaauguacguuga

SEQ ID NO: 1076957 - RNA, 19 nt, Homo sapiens
ucacagcccucuccaaacu

SEQ ID NO: 1076958 - RNA, 19 nt, Homo sapiens
uagcagcccucuaugacaa

SEQ ID NO: 1076959 - RNA, 19 nt, Homo sapiens
caucaccuaugcugccuuu

SEQ ID NO: 1076960 - RNA, 19 nt, Homo sapiens
ggacaacacccucuuacag

SEQ ID NO: 1076961 - RNA, 19 nt, Homo sapiens
guggaaagcgugugaguga

SEQ ID NO: 1076962 - RNA, 19 nt, Homo sapiens
caugacaucugagcucuau

SEQ ID NO: 1076963 - RNA, 19 nt, Homo sapiens
gagcacccuuuguccuuug

SEQ ID NO: 1076964 - RNA, 19 nt, Homo sapiens
gaaacagcgcuacacauag

SEQ ID NO: 1076965 - RNA, 19 nt, Homo sapiens
caaggaauguacguugaga

SEQ ID NO: 1076966 - RNA, 19 nt, Homo sapiens
ccacacugcucaugcucaa

SEQ ID NO: 1076967 - RNA, 19 nt, Homo sapiens
caugcugggugccauauau

SEQ ID NO: 1076968 - RNA, 19 nt, Homo sapiens
ugacaucugagcucuauga

SEQ ID NO: 1076969 - RNA, 19 nt, Homo sapiens
ggagcaaguucugcagaug

SEQ ID NO: 1076970 - RNA, 19 nt, Homo sapiens
caucuucaauaaagucguu

SEQ ID NO: 1076971 - RNA, 19 nt, Homo sapiens
ucuaugaccucacagagau

SEQ ID NO: 1076972 - RNA, 19 nt, Homo sapiens
gaagacaggcaagaucuca

SEQ ID NO: 1076973 - RNA, 19 nt, Homo sapiens
gaccugcccuucauguaca

SEQ ID NO: 1076974 - RNA, 19 nt, Homo sapiens
gcuucagccuucuauauca

SEQ ID NO: 1076975 - RNA, 19 nt, Homo sapiens
ggugcaacgucauguacuu

SEQ ID NO: 1076976 - RNA, 19 nt, Homo sapiens
caucaccuaugccuucaug

SEQ ID NO: 1076977 - RNA, 19 nt, Homo sapiens
gguagagguuccagacauc

SEQ ID NO: 1076978 - RNA, 19 nt, Homo sapiens
ugaccucgacucucuauga

SEQ ID NO: 1076979 - RNA, 19 nt, Homo sapiens
caacuccaucuucaauaaa

SEQ ID NO: 1076980 - RNA, 19 nt, Homo sapiens
gcaugucagagcacuuuaa

SEQ ID NO: 1076981 - RNA, 19 nt, Homo sapiens
ggaacuugcucucauuuuc

SEQ ID NO: 1076982 - RNA, 19 nt, Homo sapiens
gcacugcacaucgcuguug

SEQ ID NO: 1076983 - RNA, 19 nt, Homo sapiens
gagcuguuccuuaccauca

SEQ ID NO: 1076984 - RNA, 19 nt, Homo sapiens
ccugcaaccucaucuacuu

SEQ ID NO: 1076985 - RNA, 19 nt, Homo sapiens
gcucugaggauuuggacaa

SEQ ID NO: 1076986 - RNA, 19 nt, Homo sapiens
ccuggaacuugcucucauu

SEQ ID NO: 1076987 - RNA, 19 nt, Homo sapiens
ggaccugcccuucauguac

SEQ ID NO: 1076988 - RNA, 19 nt, Homo sapiens
ggagcuaggccacuucuac

SEQ ID NO: 1076989 - RNA, 19 nt, Homo sapiens
guugugaaccagaacauga

SEQ ID NO: 1076990 - RNA, 19 nt, Homo sapiens
ccuucuagcugccaaagau

SEQ ID NO: 1076991 - RNA, 19 nt, Homo sapiens
gagcugggaauaucagauc

SEQ ID NO: 1076992 - RNA, 19 nt, Homo sapiens
ucaccaucaugauucagaa

SEQ ID NO: 1076993 - RNA, 19 nt, Homo sapiens
gagccgagaugagcagaac

SEQ ID NO: 1076994 - RNA, 19 nt, Homo sapiens
guuugucacugcccaagga

SEQ ID NO: 1076995 - RNA, 19 nt, Homo sapiens
uggcuggaguggaggguaa

SEQ ID NO: 1076996 - RNA, 19 nt, Homo sapiens
gccaacuccaucuucaaua

SEQ ID NO: 1076997 - RNA, 19 nt, Homo sapiens
caugucagagcacuuuaaa

SEQ ID NO: 1076998 - RNA, 19 nt, Homo sapiens
ggagaaagaggaguagcau

SEQ ID NO: 1076999 - RNA, 19 nt, Homo sapiens
ucaagcccaggaccaauaa

SEQ ID NO: 1077000 - RNA, 19 nt, Homo sapiens
gggagcacccuuuguccuu

SEQ ID NO: 1077001 - RNA, 19 nt, Homo sapiens
gggcuaauucucugccuau

SEQ ID NO: 1077002 - RNA, 19 nt, Homo sapiens
acucacagcccucuccaaa

SEQ ID NO: 1077003 - RNA, 19 nt, Homo sapiens
ucaaguaugaggauugcaa

SEQ ID NO: 1077004 - RNA, 19 nt, Homo sapiens
ugccaaagauaaugauguc

SEQ ID NO: 1077005 - RNA, 19 nt, Homo sapiens
gagagaccugcgugggaua

SEQ ID NO: 1077006 - RNA, 19 nt, Homo sapiens
uuccagacaucuucagaau

SEQ ID NO: 1077007 - RNA, 19 nt, Homo sapiens
gaggguaacacugugaugu

SEQ ID NO: 1077008 - RNA, 19 nt, Homo sapiens
gcaaccucaucuacuuugg

SEQ ID NO: 1077009 - RNA, 19 nt, Homo sapiens
caaggagaaagggcuaauu

SEQ ID NO: 1077010 - RNA, 19 nt, Homo sapiens
ccgaggagcuaggccacuu

SEQ ID NO: 1077011 - RNA, 19 nt, Homo sapiens
cugaacaaguugcucaagu

SEQ ID NO: 1077012 - RNA, 19 nt, Homo sapiens
uauaucugcuguacaucau

SEQ ID NO: 1077013 - RNA, 19 nt, Homo sapiens
ccaucaugauucagaagau

SEQ ID NO: 1077014 - RNA, 19 nt, Homo sapiens
ggugguacccauguccuuu

SEQ ID NO: 1077015 - RNA, 19 nt, Homo sapiens
cgacaggagcacugcaugu

SEQ ID NO: 1077016 - RNA, 19 nt, Homo sapiens
gaccugcgugggauaauca

SEQ ID NO: 1077017 - RNA, 19 nt, Homo sapiens
gcaugcugggugccauaua

SEQ ID NO: 1077018 - RNA, 19 nt, Homo sapiens
ccccggagcuggucuuuga

SEQ ID NO: 1077019 - RNA, 19 nt, Homo sapiens
ggucauaaguggggagaga

SEQ ID NO: 1077020 - RNA, 19 nt, Homo sapiens
ggaauguacguugagaauc

SEQ ID NO: 1077021 - RNA, 19 nt, Homo sapiens
ggggagagcugggaauauc

SEQ ID NO: 1077022 - RNA, 19 nt, Homo sapiens
gaucugcggacgggaguau

SEQ ID NO: 1077023 - RNA, 19 nt, Homo sapiens
gaccucgacucucuaugac

SEQ ID NO: 1077024 - RNA, 19 nt, Homo sapiens
aaggagaaagggcuaauuc

SEQ ID NO: 1077025 - RNA, 19 nt, Homo sapiens
ggcuaggucuugccaacuc

SEQ ID NO: 1077026 - RNA, 19 nt, Homo sapiens
gggagaaagaggaguagca

SEQ ID NO: 1077027 - RNA, 19 nt, Homo sapiens
gcuggugcaacgucaugua

SEQ ID NO: 1077028 - RNA, 19 nt, Homo sapiens
ucgugcggcugcucauuga

SEQ ID NO: 1077029 - RNA, 19 nt, Homo sapiens
ugguagagguuccagacau

SEQ ID NO: 1077030 - RNA, 19 nt, Homo sapiens
uaucugcuguacaucaucu

SEQ ID NO: 1077031 - RNA, 19 nt, Homo sapiens
gaagaggaucugggagucu

SEQ ID NO: 1077032 - RNA, 19 nt, Homo sapiens
gggaaacagcgcuacacau

SEQ ID NO: 1077033 - RNA, 19 nt, Homo sapiens
gggacaacacccucuuaca

SEQ ID NO: 1077034 - RNA, 19 nt, Homo sapiens
cucaagcccaggaccaaua

SEQ ID NO: 1077035 - RNA, 19 nt, Homo sapiens
uaucaucaccaccaagaag

SEQ ID NO: 1077036 - RNA, 19 nt, Homo sapiens
ugagugagggagacaggaa

SEQ ID NO: 1077037 - RNA, 19 nt, Homo sapiens
ucauguacagcaucaccua

SEQ ID NO: 1077038 - RNA, 19 nt, Homo sapiens
gaagaacucuccaacaaua

SEQ ID NO: 1077039 - RNA, 19 nt, Homo sapiens
gaccucagcuccacgaaua

SEQ ID NO: 1077040 - RNA, 19 nt, Homo sapiens
gggaagaacucuccaacaa

SEQ ID NO: 1077041 - RNA, 19 nt, Homo sapiens
ucaaauagcagucaagauu

SEQ ID NO: 1077042 - RNA, 19 nt, Homo sapiens
uacagcagcuacugauuua

SEQ ID NO: 1077043 - RNA, 19 nt, Homo sapiens
ccacgaauaugcccacaga

SEQ ID NO: 1077044 - RNA, 19 nt, Homo sapiens
gcauggaguugucuaagga

SEQ ID NO: 1077045 - RNA, 19 nt, Homo sapiens
gaaacuguguucccugcaa

SEQ ID NO: 1077046 - RNA, 19 nt, Homo sapiens
gacgaaacuugucggcuuu

SEQ ID NO: 1077047 - RNA, 19 nt, Homo sapiens
gggagauggugccgacuuu

SEQ ID NO: 1077048 - RNA, 19 nt, Homo sapiens
gaauguggcuucggcuaug

SEQ ID NO: 1077049 - RNA, 19 nt, Homo sapiens
ggaguugucuaaggaaugu

SEQ ID NO: 1077050 - RNA, 19 nt, Homo sapiens
ggagaguggugcugucauc

SEQ ID NO: 1077051 - RNA, 19 nt, Homo sapiens
ggucacaggacauucagua

SEQ ID NO: 1077052 - RNA, 19 nt, Homo sapiens
gacaguuuauggagaagaa

SEQ ID NO: 1077053 - RNA, 19 nt, Homo sapiens
ggaagaacucuccaacaau

SEQ ID NO: 1077054 - RNA, 19 nt, Homo sapiens
gcgacuggguucccuguga

SEQ ID NO: 1077055 - RNA, 19 nt, Homo sapiens
guccaucuguggcgaguuu

SEQ ID NO: 1077056 - RNA, 19 nt, Homo sapiens
agagacaguuuauggagaa

SEQ ID NO: 1077057 - RNA, 19 nt, Homo sapiens
cacaggacauucaguacaa

SEQ ID NO: 1077058 - RNA, 19 nt, Homo sapiens
ugucaucuauuguaagaga

SEQ ID NO: 1077059 - RNA, 19 nt, Homo sapiens
gaacacagcacugacuuac

SEQ ID NO: 1077060 - RNA, 19 nt, Homo sapiens
ggaucggucuggaaacugu

SEQ ID NO: 1077061 - RNA, 19 nt, Homo sapiens
gcuacuagaacaagagaaa

SEQ ID NO: 1077062 - RNA, 19 nt, Homo sapiens
uaacaacacacugguagaa

SEQ ID NO: 1077063 - RNA, 19 nt, Homo sapiens
uuacagcagcuacugauuu

SEQ ID NO: 1077064 - RNA, 19 nt, Homo sapiens
gaagacauucauucucuca

SEQ ID NO: 1077065 - RNA, 19 nt, Homo sapiens
acacagcacugacuuacag

SEQ ID NO: 1077066 - RNA, 19 nt, Homo sapiens
gagacccuccuccuccuua

SEQ ID NO: 1077067 - RNA, 19 nt, Homo sapiens
ggacugcuugccaggauuu

SEQ ID NO: 1077068 - RNA, 19 nt, Homo sapiens
uaggcuauuugucauguaa

SEQ ID NO: 1077069 - RNA, 19 nt, Homo sapiens
cgacuggguucccugugaa

SEQ ID NO: 1077070 - RNA, 19 nt, Homo sapiens
caggaugcacuaacuauga

SEQ ID NO: 1077071 - RNA, 19 nt, Homo sapiens
caacacacugguagaauca

SEQ ID NO: 1077072 - RNA, 19 nt, Homo sapiens
agacauucauucucucaau

SEQ ID NO: 1077073 - RNA, 19 nt, Homo sapiens
ucuuguauguuguagagua

SEQ ID NO: 1077074 - RNA, 19 nt, Homo sapiens
guaagagacaguuuaugga

SEQ ID NO: 1077075 - RNA, 19 nt, Homo sapiens
ggaauguggcuucggcuau

SEQ ID NO: 1077076 - RNA, 19 nt, Homo sapiens
gcucaacgucuuuggauuc

SEQ ID NO: 1077077 - RNA, 19 nt, Homo sapiens
cauccucugugucaucuau

SEQ ID NO: 1077078 - RNA, 19 nt, Homo sapiens
gacauucauucucucaauc

SEQ ID NO: 1077079 - RNA, 19 nt, Homo sapiens
gaacucuccaacaauaaau

SEQ ID NO: 1077080 - RNA, 19 nt, Homo sapiens
acaacacacugguagaauc

SEQ ID NO: 1077081 - RNA, 19 nt, Homo sapiens
ugugucaucuauuguaaga

SEQ ID NO: 1077082 - RNA, 19 nt, Homo sapiens
gcuacugauuuaucuagau

SEQ ID NO: 1077083 - RNA, 19 nt, Homo sapiens
ugaacacagcacugacuua

SEQ ID NO: 1077084 - RNA, 19 nt, Homo sapiens
ucagacgucccuccaggua

SEQ ID NO: 1077085 - RNA, 19 nt, Homo sapiens
ggauucaaauagcagucaa

SEQ ID NO: 1077086 - RNA, 19 nt, Homo sapiens
uaaaagugcuacuagaaca

SEQ ID NO: 1077087 - RNA, 19 nt, Homo sapiens
ucugugucaucuauuguaa

SEQ ID NO: 1077088 - RNA, 19 nt, Homo sapiens
uauaggaagacgaaacuug

SEQ ID NO: 1077089 - RNA, 19 nt, Homo sapiens
guucccagcauaagauuug

SEQ ID NO: 1077090 - RNA, 19 nt, Homo sapiens
uuacuaggcuauuugucau

SEQ ID NO: 1077091 - RNA, 19 nt, Homo sapiens
ugaacucacuggagaagac

SEQ ID NO: 1077092 - RNA, 19 nt, Homo sapiens
ucagggaucggucuggaaa

SEQ ID NO: 1077093 - RNA, 19 nt, Homo sapiens
guggugacaacaucucuuu

SEQ ID NO: 1077094 - RNA, 19 nt, Homo sapiens
uguaagagacaguuuaugg

SEQ ID NO: 1077095 - RNA, 19 nt, Homo sapiens
gcuuucagaaggcaaauug

SEQ ID NO: 1077096 - RNA, 19 nt, Homo sapiens
agacgucccuccagguaag

SEQ ID NO: 1077097 - RNA, 19 nt, Homo sapiens
ugagaagccagcuagauca

SEQ ID NO: 1077098 - RNA, 19 nt, Homo sapiens
gacuuacaguagaucagaa

SEQ ID NO: 1077099 - RNA, 19 nt, Homo sapiens
ccagcuagaucaggagagu

SEQ ID NO: 1077100 - RNA, 19 nt, Homo sapiens
gguagaaucagcaucaacu

SEQ ID NO: 1077101 - RNA, 19 nt, Homo sapiens
cagcagcuacugauuuauc

SEQ ID NO: 1077102 - RNA, 19 nt, Homo sapiens
agaacucuccaacaauaaa

SEQ ID NO: 1077103 - RNA, 19 nt, Homo sapiens
ggcauggaguugucuaagg

SEQ ID NO: 1077104 - RNA, 19 nt, Homo sapiens
ucagaaggcaaauuguuca

SEQ ID NO: 1077105 - RNA, 19 nt, Homo sapiens
uacaguagaucagaacucu

SEQ ID NO: 1077106 - RNA, 19 nt, Homo sapiens
ucacaggacauucaguaca

SEQ ID NO: 1077107 - RNA, 19 nt, Homo sapiens
uucaagacauggagugugu

SEQ ID NO: 1077108 - RNA, 19 nt, Homo sapiens
gggacugcuugccaggauu

SEQ ID NO: 1077109 - RNA, 19 nt, Homo sapiens
ggccaggcauggaguuguc

SEQ ID NO: 1077110 - RNA, 19 nt, Homo sapiens
ugaaucaggagacuguaga

SEQ ID NO: 1077111 - RNA, 19 nt, Homo sapiens
gcagcuacugauuuaucua

SEQ ID NO: 1077112 - RNA, 19 nt, Homo sapiens
gagauggugccgacuuucu

SEQ ID NO: 1077113 - RNA, 19 nt, Homo sapiens
ugacuuacaguagaucaga

SEQ ID NO: 1077114 - RNA, 19 nt, Homo sapiens
cauggguggugacaacauc

SEQ ID NO: 1077115 - RNA, 19 nt, Homo sapiens
gcuggucucugcggucaca

SEQ ID NO: 1077116 - RNA, 19 nt, Homo sapiens
gauggugccgacuuucuuc

SEQ ID NO: 1077117 - RNA, 19 nt, Homo sapiens
uagaaucagcaucaacuca

SEQ ID NO: 1077118 - RNA, 19 nt, Homo sapiens
aguccagucucauucugaa

SEQ ID NO: 1077119 - RNA, 19 nt, Homo sapiens
ggcuauuugucauguaaag

SEQ ID NO: 1077120 - RNA, 19 nt, Homo sapiens
gcucauccucugugucauc

SEQ ID NO: 1077121 - RNA, 19 nt, Homo sapiens
gaugcacuaacuaugagaa

SEQ ID NO: 1077122 - RNA, 19 nt, Homo sapiens
cuaggcuauuugucaugua

SEQ ID NO: 1077123 - RNA, 19 nt, Homo sapiens
uguauguuguagaguaugu

SEQ ID NO: 1077124 - RNA, 19 nt, Homo sapiens
caacucaggaugcacuaac

SEQ ID NO: 1077125 - RNA, 19 nt, Homo sapiens
cagcuacugauuuaucuag

SEQ ID NO: 1077126 - RNA, 19 nt, Homo sapiens
ccaguccagucucauucug

SEQ ID NO: 1077127 - RNA, 19 nt, Homo sapiens
gaacucacuggagaagaca

SEQ ID NO: 1077128 - RNA, 19 nt, Homo sapiens
guagacagcaagaauucag

SEQ ID NO: 1077129 - RNA, 19 nt, Homo sapiens
guuccaguccagucucauu

SEQ ID NO: 1077130 - RNA, 19 nt, Homo sapiens
ucccauccaugugcuguga

SEQ ID NO: 1077131 - RNA, 19 nt, Homo sapiens
guauuacuaggcuauuugu

SEQ ID NO: 1077132 - RNA, 19 nt, Homo sapiens
aagaacucuccaacaauaa

SEQ ID NO: 1077133 - RNA, 19 nt, Homo sapiens
auaggaagacgaaacuugu

SEQ ID NO: 1077134 - RNA, 19 nt, Homo sapiens
gaacggaacucuccaacaa

SEQ ID NO: 1077135 - RNA, 19 nt, Homo sapiens
gcugaaaccucaaugaaua

SEQ ID NO: 1077136 - RNA, 19 nt, Homo sapiens
gaaccaaacugacggcauu

SEQ ID NO: 1077137 - RNA, 19 nt, Homo sapiens
gaaaugcccucaugcuuau

SEQ ID NO: 1077138 - RNA, 19 nt, Homo sapiens
gaccucagcuccacgaaua

SEQ ID NO: 1077139 - RNA, 19 nt, Homo sapiens
ggacggugcuucuuucuau

SEQ ID NO: 1077140 - RNA, 19 nt, Homo sapiens
gagaagaccuacuugaaca

SEQ ID NO: 1077141 - RNA, 19 nt, Homo sapiens
ucaaauagcagucaagauu

SEQ ID NO: 1077142 - RNA, 19 nt, Homo sapiens
guagagcccugauuaacuu

SEQ ID NO: 1077143 - RNA, 19 nt, Homo sapiens
gagcuaagacagaaauuaa

SEQ ID NO: 1077144 - RNA, 19 nt, Homo sapiens
gcacuucacuuuguuggaa

SEQ ID NO: 1077145 - RNA, 19 nt, Homo sapiens
gcaaagguuggcauauuua

SEQ ID NO: 1077146 - RNA, 19 nt, Homo sapiens
aaacagaaaugcccucaug

SEQ ID NO: 1077147 - RNA, 19 nt, Homo sapiens
ggauagcucuuuccagaau

SEQ ID NO: 1077148 - RNA, 19 nt, Homo sapiens
ucaauucccucaccugaaa

SEQ ID NO: 1077149 - RNA, 19 nt, Homo sapiens
cacaucaucuccuacuuua

SEQ ID NO: 1077150 - RNA, 19 nt, Homo sapiens
guaacuaccugcugaaagu

SEQ ID NO: 1077151 - RNA, 19 nt, Homo sapiens
ggagaaagccagacugaug

SEQ ID NO: 1077152 - RNA, 19 nt, Homo sapiens
caucauugcuuuauaguag

SEQ ID NO: 1077153 - RNA, 19 nt, Homo sapiens
guagagacuuguaugcaaa

SEQ ID NO: 1077154 - RNA, 19 nt, Homo sapiens
ggacauauaacaagaaaca

SEQ ID NO: 1077155 - RNA, 19 nt, Homo sapiens
uacagcagcuacugauuua

SEQ ID NO: 1077156 - RNA, 19 nt, Homo sapiens
gcacaucaucuccuacuuu

SEQ ID NO: 1077157 - RNA, 19 nt, Homo sapiens
ucaauaaacucagcugcua

SEQ ID NO: 1077158 - RNA, 19 nt, Homo sapiens
gauguuugcauuucuguua

SEQ ID NO: 1077159 - RNA, 19 nt, Homo sapiens
guaucugucuuuccuagua

SEQ ID NO: 1077160 - RNA, 19 nt, Homo sapiens
gagaagugcuuaggguuga

SEQ ID NO: 1077161 - RNA, 19 nt, Homo sapiens
acagagagaugaugaaagu

SEQ ID NO: 1077162 - RNA, 19 nt, Homo sapiens
gagagaugauguuugcauu

SEQ ID NO: 1077163 - RNA, 19 nt, Homo sapiens
uagaauggcccucauauug

SEQ ID NO: 1077164 - RNA, 19 nt, Homo sapiens
agaaaugcccucaugcuua

SEQ ID NO: 1077165 - RNA, 19 nt, Homo sapiens
ccacgaauaugcccacaga

SEQ ID NO: 1077166 - RNA, 19 nt, Homo sapiens
gcauggaguugucuaagga

SEQ ID NO: 1077167 - RNA, 19 nt, Homo sapiens
uuugaaaucuggucuguuu

SEQ ID NO: 1077168 - RNA, 19 nt, Homo sapiens
gaaacuguguucccugcaa

SEQ ID NO: 1077169 - RNA, 19 nt, Homo sapiens
ggaaaaccaucauugcuuu

SEQ ID NO: 1077170 - RNA, 19 nt, Homo sapiens
ggagggcugugucggguaa

SEQ ID NO: 1077171 - RNA, 19 nt, Homo sapiens
gagaugauguuugcauuuc

SEQ ID NO: 1077172 - RNA, 19 nt, Homo sapiens
ccuuugaucugcaugguua

SEQ ID NO: 1077173 - RNA, 19 nt, Homo sapiens
guucgaggguacuaugaua

SEQ ID NO: 1077174 - RNA, 19 nt, Homo sapiens
ucacauacgugccacuguu

SEQ ID NO: 1077175 - RNA, 19 nt, Homo sapiens
gaauugcccugcccaaguc

SEQ ID NO: 1077176 - RNA, 19 nt, Homo sapiens
cauauugccugccuaaauc

SEQ ID NO: 1077177 - RNA, 19 nt, Homo sapiens
gacgaaacuugucggcuuu

SEQ ID NO: 1077178 - RNA, 19 nt, Homo sapiens
gagcuuagaagguuauaga

SEQ ID NO: 1077179 - RNA, 19 nt, Homo sapiens
uuaccuagguuaagcacua

SEQ ID NO: 1077180 - RNA, 19 nt, Homo sapiens
gcagggcuguguuccuuug

SEQ ID NO: 1077181 - RNA, 19 nt, Homo sapiens
ucgcauaggugguuagaau

SEQ ID NO: 1077182 - RNA, 19 nt, Homo sapiens
gggagauggugccgacuuu

SEQ ID NO: 1077183 - RNA, 19 nt, Homo sapiens
gaauguggcuucggcuaug

SEQ ID NO: 1077184 - RNA, 19 nt, Homo sapiens
ccaagucacugucuuuuaa

SEQ ID NO: 1077185 - RNA, 19 nt, Homo sapiens
gaugaaguuuacugaauca

SEQ ID NO: 1077186 - RNA, 19 nt, Homo sapiens
ggaguugucuaaggaaugu

SEQ ID NO: 1077187 - RNA, 19 nt, Homo sapiens
acggaacucuccaacaaua

SEQ ID NO: 1077188 - RNA, 19 nt, Homo sapiens
ggccguuucuccauaguuu

SEQ ID NO: 1077189 - RNA, 19 nt, Homo sapiens
ggaauguggucgagaaagg

SEQ ID NO: 1077190 - RNA, 19 nt, Homo sapiens
ggagaguggugcugucauc

SEQ ID NO: 1077191 - RNA, 19 nt, Homo sapiens
ggaacucuccaacaauaaa

SEQ ID NO: 1077192 - RNA, 19 nt, Homo sapiens
guuaagcacuauugucugu

SEQ ID NO: 1077193 - RNA, 19 nt, Homo sapiens
ccaaguaaagucaugaauu

SEQ ID NO: 1077194 - RNA, 19 nt, Homo sapiens
gcaaccaaguaaagucaug

SEQ ID NO: 1077195 - RNA, 19 nt, Homo sapiens
ugcaaagguuggcauauuu

SEQ ID NO: 1077196 - RNA, 19 nt, Homo sapiens
ggucacaggacauucagua

SEQ ID NO: 1077197 - RNA, 19 nt, Homo sapiens
gacaguuuauggagaagaa

SEQ ID NO: 1077198 - RNA, 19 nt, Homo sapiens
guaaauccuggguaacuuu

SEQ ID NO: 1077199 - RNA, 19 nt, Homo sapiens
gauauguguuuacuagcuu

SEQ ID NO: 1077200 - RNA, 19 nt, Homo sapiens
gcccagaauuaacacauau

SEQ ID NO: 1077201 - RNA, 19 nt, Homo sapiens
ccauagcacucaauaaacu

SEQ ID NO: 1077202 - RNA, 19 nt, Homo sapiens
aaucuggucuguuugcauu

SEQ ID NO: 1077203 - RNA, 19 nt, Homo sapiens
guccaucuguggcgaguuu

SEQ ID NO: 1077204 - RNA, 19 nt, Homo sapiens
agagacaguuuauggagaa

SEQ ID NO: 1077205 - RNA, 19 nt, Homo sapiens
guuagcacaucaucuccua

SEQ ID NO: 1077206 - RNA, 19 nt, Homo sapiens
agacuuguaugcaaagguu

SEQ ID NO: 1077207 - RNA, 19 nt, Homo sapiens
cacaggacauucaguacaa

SEQ ID NO: 1077208 - RNA, 19 nt, Homo sapiens
ugucaucuauuguaagaga

SEQ ID NO: 1077209 - RNA, 19 nt, Homo sapiens
ugaucugcaugguuaauuu

SEQ ID NO: 1077210 - RNA, 19 nt, Homo sapiens
gaaugggcauaaccacugu

SEQ ID NO: 1077211 - RNA, 19 nt, Homo sapiens
gguaaauccuggguaacuu

SEQ ID NO: 1077212 - RNA, 19 nt, Homo sapiens
uguguagccuguauauauu

SEQ ID NO: 1077213 - RNA, 19 nt, Homo sapiens
acagagagaugauguuugc

SEQ ID NO: 1077214 - RNA, 19 nt, Homo sapiens
cgaggguacuaugauauuu

SEQ ID NO: 1077215 - RNA, 19 nt, Homo sapiens
guggacauauaacaagaaa

SEQ ID NO: 1077216 - RNA, 19 nt, Homo sapiens
ggaucggucuggaaacugu

SEQ ID NO: 1077217 - RNA, 19 nt, Homo sapiens
uuaaugagcccucuuucuu

SEQ ID NO: 1077218 - RNA, 19 nt, Homo sapiens
ggaauugcccugcccaagu

SEQ ID NO: 1077219 - RNA, 19 nt, Homo sapiens
caugauacucugcaucuuu

SEQ ID NO: 1077220 - RNA, 19 nt, Homo sapiens
uaacaacacacugguagaa

SEQ ID NO: 1077221 - RNA, 19 nt, Homo sapiens
gaucagauuacaggcauuu

SEQ ID NO: 1077222 - RNA, 19 nt, Homo sapiens
gcuacuagaacaagagaaa

SEQ ID NO: 1077223 - RNA, 19 nt, Homo sapiens
ccuaccuacucuagaaaua

SEQ ID NO: 1077224 - RNA, 19 nt, Homo sapiens
ggagaagaccuacuugaac

SEQ ID NO: 1077225 - RNA, 19 nt, Homo sapiens
uuacagcagcuacugauuu

SEQ ID NO: 1077226 - RNA, 19 nt, Homo sapiens
gaagacauucauucucuca

SEQ ID NO: 1077227 - RNA, 19 nt, Homo sapiens
ugcagaagcucguugacaa

SEQ ID NO: 1077228 - RNA, 19 nt, Homo sapiens
gaacuuucuuugauaucca

SEQ ID NO: 1077229 - RNA, 19 nt, Homo sapiens
gaaauaggaaaugagaaug

SEQ ID NO: 1077230 - RNA, 19 nt, Homo sapiens
gagacccuccuccuccuua

SEQ ID NO: 1077231 - RNA, 19 nt, Homo sapiens
ggacugcuugccaggauuu

SEQ ID NO: 1077232 - RNA, 19 nt, Homo sapiens
uaggcuauuugucauguaa

SEQ ID NO: 1077233 - RNA, 19 nt, Homo sapiens
gaaaggaaaaccaucauug

SEQ ID NO: 1077234 - RNA, 19 nt, Homo sapiens
gcagggagaucgagucuau

SEQ ID NO: 1077235 - RNA, 19 nt, Homo sapiens
ucuauacgcugaagaaauu

SEQ ID NO: 1077236 - RNA, 19 nt, Homo sapiens
ucauguuucuccaguauua

SEQ ID NO: 1077237 - RNA, 19 nt, Homo sapiens
gaucauguuucuccaguau

SEQ ID NO: 1077238 - RNA, 19 nt, Homo sapiens
ugggaccgcuggcuuauaa

SEQ ID NO: 1077239 - RNA, 19 nt, Homo sapiens
gcggaccacugcagacuga

SEQ ID NO: 1077240 - RNA, 19 nt, Homo sapiens
uauaagcgaucauguuucu

SEQ ID NO: 1077241 - RNA, 19 nt, Homo sapiens
cccuuaaacugaugucuuu

SEQ ID NO: 1077242 - RNA, 19 nt, Homo sapiens
ccauaaagggaacacauuu

SEQ ID NO: 1077243 - RNA, 19 nt, Homo sapiens
ugugagcccugaugccuuu

SEQ ID NO: 1077244 - RNA, 19 nt, Homo sapiens
cuuauaagcgaucauguuu

SEQ ID NO: 1077245 - RNA, 19 nt, Homo sapiens
ccgaaucaccaucaagaaa

SEQ ID NO: 1077246 - RNA, 19 nt, Homo sapiens
auaaagggaacacauuuga

SEQ ID NO: 1077247 - RNA, 19 nt, Homo sapiens
cauaaagggaacacauuug

SEQ ID NO: 1077248 - RNA, 19 nt, Homo sapiens
ucaagaaacgcuucaaggu

SEQ ID NO: 1077249 - RNA, 19 nt, Homo sapiens
gaaucaccaucaagaaacg

SEQ ID NO: 1077250 - RNA, 19 nt, Homo sapiens
caaacucuucggacuguga

SEQ ID NO: 1077251 - RNA, 19 nt, Homo sapiens
gagucuauacgcugaagaa

SEQ ID NO: 1077252 - RNA, 19 nt, Homo sapiens
ggcgauugauuaugcuugu

SEQ ID NO: 1077253 - RNA, 19 nt, Homo sapiens
cgacaccgaaucaccauca

SEQ ID NO: 1077254 - RNA, 19 nt, Homo sapiens
cgaucauguuucuccagua

SEQ ID NO: 1077255 - RNA, 19 nt, Homo sapiens
caccgaaucaccaucaaga

SEQ ID NO: 1077256 - RNA, 19 nt, Homo sapiens
gggaacacauuugacuuuu

SEQ ID NO: 1077257 - RNA, 19 nt, Homo sapiens
agggaacacauuugacuuu

SEQ ID NO: 1077258 - RNA, 19 nt, Homo sapiens
cgaaucaccaucaagaaac

SEQ ID NO: 1077259 - RNA, 19 nt, Homo sapiens
gaggggaaauugacgaaca

SEQ ID NO: 1077260 - RNA, 19 nt, Homo sapiens
gacaccgaaucaccaucaa

SEQ ID NO: 1077261 - RNA, 19 nt, Homo sapiens
aaagggaacacauuugacu

SEQ ID NO: 1077262 - RNA, 19 nt, Homo sapiens
gagcagggagaucgagucu

SEQ ID NO: 1077263 - RNA, 19 nt, Homo sapiens
aauugggaccgcuggcuua

SEQ ID NO: 1077264 - RNA, 19 nt, Homo sapiens
cccauaaagggaacacauu

SEQ ID NO: 1077265 - RNA, 19 nt, Homo sapiens
ggacagcgauaaagaagga

SEQ ID NO: 1077266 - RNA, 19 nt, Homo sapiens
uaaaggagcuucgcaaauc

SEQ ID NO: 1077267 - RNA, 19 nt, Homo sapiens
gagggaaacugaagcaaga

SEQ ID NO: 1077268 - RNA, 19 nt, Homo sapiens
agaaagggacguucaagua

SEQ ID NO: 1077269 - RNA, 19 nt, Homo sapiens
cgacaaaugugaagaacag

SEQ ID NO: 1077270 - RNA, 19 nt, Homo sapiens
ucaccauucugucuucuaa

SEQ ID NO: 1077271 - RNA, 19 nt, Homo sapiens
caaaggacagcgauaaaga

SEQ ID NO: 1077272 - RNA, 19 nt, Homo sapiens
gaaagggacguucaaguac

SEQ ID NO: 1077273 - RNA, 19 nt, Homo sapiens
uagggcaggugucaucuuu

SEQ ID NO: 1077274 - RNA, 19 nt, Homo sapiens
caaaagagccuccaucugu

SEQ ID NO: 1077275 - RNA, 19 nt, Homo sapiens
gaagaacagcuugaagaga

SEQ ID NO: 1077276 - RNA, 19 nt, Homo sapiens
gcaccagcauuguguuagu

SEQ ID NO: 1077277 - RNA, 19 nt, Homo sapiens
caaauuccaccucugaaga

SEQ ID NO: 1077278 - RNA, 19 nt, Homo sapiens
cuacauggcggcagucauu

SEQ ID NO: 1077279 - RNA, 19 nt, Homo sapiens
guaaaggagcuucgcaaau

SEQ ID NO: 1077280 - RNA, 19 nt, Homo sapiens
acagauagaacccaaagaa

SEQ ID NO: 1077281 - RNA, 19 nt, Homo sapiens
gugaagaacagcuugaaga

SEQ ID NO: 1077282 - RNA, 19 nt, Homo sapiens
aaucuucuguuccuccuuu

SEQ ID NO: 1077283 - RNA, 19 nt, Homo sapiens
gauagaacccaaagaaagg

SEQ ID NO: 1077284 - RNA, 19 nt, Homo sapiens
ccauugacacgcacagaua

SEQ ID NO: 1077285 - RNA, 19 nt, Homo sapiens
gguaaaggagcuucgcaaa

SEQ ID NO: 1077286 - RNA, 19 nt, Homo sapiens
gaaauccaaggcugccaaa

SEQ ID NO: 1077287 - RNA, 19 nt, Homo sapiens
gcugaugcguuaucugaag

SEQ ID NO: 1077288 - RNA, 19 nt, Homo sapiens
uuacacacauucacacaag

SEQ ID NO: 1077289 - RNA, 19 nt, Homo sapiens
caaccacagccgaaauuga

SEQ ID NO: 1077290 - RNA, 19 nt, Homo sapiens
gcacagauagaacccaaag

SEQ ID NO: 1077291 - RNA, 19 nt, Homo sapiens
aaagagccuccaucuguaa

SEQ ID NO: 1077292 - RNA, 19 nt, Homo sapiens
cagagugacaucagccaua

SEQ ID NO: 1077293 - RNA, 19 nt, Homo sapiens
ccaaagaaaggcaaagagu

SEQ ID NO: 1077294 - RNA, 19 nt, Homo sapiens
cagauagaacccaaagaaa

SEQ ID NO: 1077295 - RNA, 19 nt, Homo sapiens
cagcaccagcauuguguua

SEQ ID NO: 1077296 - RNA, 19 nt, Homo sapiens
aaaagagccuccaucugua

SEQ ID NO: 1077297 - RNA, 19 nt, Homo sapiens
uggcggcagucauugagua

SEQ ID NO: 1077298 - RNA, 19 nt, Homo sapiens
ggaaacugaagcaagaugu

SEQ ID NO: 1077299 - RNA, 19 nt, Homo sapiens
ggacucgcagccaaauuug

SEQ ID NO: 1077300 - RNA, 19 nt, Homo sapiens
agagugacaucagccauau

SEQ ID NO: 1077301 - RNA, 19 nt, Homo sapiens
aaaggacagcgauaaagaa

SEQ ID NO: 1077302 - RNA, 19 nt, Homo sapiens
guaccuggcagcggaaauu

SEQ ID NO: 1077303 - RNA, 19 nt, Homo sapiens
gaagaaagggacguucaag

SEQ ID NO: 1077304 - RNA, 19 nt, Homo sapiens
gcgagagcaucggcaucua

SEQ ID NO: 1077305 - RNA, 19 nt, Homo sapiens
caucucagcccacuuugau

SEQ ID NO: 1077306 - RNA, 19 nt, Homo sapiens
gaacccaaagaaaggcaaa

SEQ ID NO: 1077307 - RNA, 19 nt, Homo sapiens
ugaccucaaagaagauaua

SEQ ID NO: 1077308 - RNA, 19 nt, Homo sapiens
gauucaccauucugucuuc

SEQ ID NO: 1077309 - RNA, 19 nt, Homo sapiens
agaccucguuuuagauuua

SEQ ID NO: 1077310 - RNA, 19 nt, Homo sapiens
gagccuccaucuguaagga

SEQ ID NO: 1077311 - RNA, 19 nt, Homo sapiens
gugcuuuucucuuuuguuu

SEQ ID NO: 1077312 - RNA, 19 nt, Homo sapiens
ccucaaagaagauauaggu

SEQ ID NO: 1077313 - RNA, 19 nt, Homo sapiens
aagcugagagggaaacuga

SEQ ID NO: 1077314 - RNA, 19 nt, Homo sapiens
caaaugugaagaacagcuu

SEQ ID NO: 1077315 - RNA, 19 nt, Homo sapiens
uggacucgcagccaaauuu

SEQ ID NO: 1077316 - RNA, 19 nt, Homo sapiens
aaaguggccugggcucugu

SEQ ID NO: 1077317 - RNA, 19 nt, Homo sapiens
ccucugcccuucacacucu

SEQ ID NO: 1077318 - RNA, 19 nt, Homo sapiens
gcggaggacaagaagcuaa

SEQ ID NO: 1077319 - RNA, 19 nt, Homo sapiens
gaaacugaagcaagauguc

SEQ ID NO: 1077320 - RNA, 19 nt, Homo sapiens
agauagaacccaaagaaag

SEQ ID NO: 1077321 - RNA, 19 nt, Homo sapiens
ucucagcccacuuugauga

SEQ ID NO: 1077322 - RNA, 19 nt, Homo sapiens
gaugcguuaucugaagaaa

SEQ ID NO: 1077323 - RNA, 19 nt, Homo sapiens
ccaaaggacagcgauaaag

SEQ ID NO: 1077324 - RNA, 19 nt, Homo sapiens
gaggcguccugcccagaau

SEQ ID NO: 1077325 - RNA, 19 nt, Homo sapiens
gggcaggugucaucuuucc

SEQ ID NO: 1077326 - RNA, 19 nt, Homo sapiens
aaacugcuuucccaaacag

SEQ ID NO: 1077327 - RNA, 19 nt, Homo sapiens
cuucaaauuccaccucuga

SEQ ID NO: 1077328 - RNA, 19 nt, Homo sapiens
aaaccaaaggacagcgaua

SEQ ID NO: 1077329 - RNA, 19 nt, Homo sapiens
caagcucgacgccaaguag

SEQ ID NO: 1077330 - RNA, 19 nt, Homo sapiens
gcgcagcaccagcauugug

SEQ ID NO: 1077331 - RNA, 19 nt, Homo sapiens
ugcguuaucugaagaaagg

SEQ ID NO: 1077332 - RNA, 19 nt, Homo sapiens
ggaggcugaugcguuaucu

SEQ ID NO: 1077333 - RNA, 19 nt, Homo sapiens
acacacauucacacaagaa

SEQ ID NO: 1077334 - RNA, 19 nt, Homo sapiens
caaauuugucauccacugu

SEQ ID NO: 1077335 - RNA, 19 nt, Homo sapiens
ccaaaccacggacguccaa

SEQ ID NO: 1077336 - RNA, 19 nt, Homo sapiens
uaucuguaacuacuccuaa

SEQ ID NO: 1077337 - RNA, 19 nt, Homo sapiens
cguccucgcugaagaacgu

SEQ ID NO: 1077338 - RNA, 19 nt, Homo sapiens
ugaagaacagcuugaagag

SEQ ID NO: 1077339 - RNA, 19 nt, Homo sapiens
uggggaggcugaugcguua

SEQ ID NO: 1077340 - RNA, 19 nt, Homo sapiens
ccauauuggcuccaugaga

SEQ ID NO: 1077341 - RNA, 19 nt, Homo sapiens
ggauucaccauucugucuu

SEQ ID NO: 1077342 - RNA, 19 nt, Homo sapiens
aaccaaaggacagcgauaa

SEQ ID NO: 1077343 - RNA, 19 nt, Homo sapiens
agugacaucagccauauug

SEQ ID NO: 1077344 - RNA, 19 nt, Homo sapiens
aggcugaugcguuaucuga

SEQ ID NO: 1077345 - RNA, 19 nt, Homo sapiens
agagugggguuuugcuuuu

SEQ ID NO: 1077346 - RNA, 19 nt, Homo sapiens
gggaaacugaagcaagaug

SEQ ID NO: 1077347 - RNA, 19 nt, Homo sapiens
gcgcguccucgcugaagaa

SEQ ID NO: 1077348 - RNA, 19 nt, Homo sapiens
gagaguggagggcauuguc

SEQ ID NO: 1077349 - RNA, 19 nt, Homo sapiens
aaaggcaagucggaaacga

SEQ ID NO: 1077350 - RNA, 19 nt, Homo sapiens
gcaaugccgcgagggacaa

SEQ ID NO: 1077351 - RNA, 19 nt, Homo sapiens
ccuggcagcggaaauucua

SEQ ID NO: 1077352 - RNA, 19 nt, Homo sapiens
gcauugacuuuuacacaca

SEQ ID NO: 1077353 - RNA, 19 nt, Homo sapiens
ggguuucuuuccauguguu

SEQ ID NO: 1077354 - RNA, 19 nt, Homo sapiens
gaggacaagaagcuaaagu

SEQ ID NO: 1077355 - RNA, 19 nt, Homo sapiens
gcugagagggaaacugaag

SEQ ID NO: 1077356 - RNA, 19 nt, Homo sapiens
ggaagaagaaaauguccaa

SEQ ID NO: 1077357 - RNA, 19 nt, Homo sapiens
ccaaugacgaggagcucaa

SEQ ID NO: 1077358 - RNA, 19 nt, Homo sapiens
gaagaaaaugggaaagaca

SEQ ID NO: 1077359 - RNA, 19 nt, Homo sapiens
caccagcauuguguuagug

SEQ ID NO: 1077360 - RNA, 19 nt, Homo sapiens
cugaugcguuaucugaaga

SEQ ID NO: 1077361 - RNA, 19 nt, Homo sapiens
ucaaauuccaccucugaag

SEQ ID NO: 1077362 - RNA, 19 nt, Homo sapiens
gagaagaaaaugggaaaga

SEQ ID NO: 1077363 - RNA, 19 nt, Homo sapiens
cggaggacaagaagcuaaa

SEQ ID NO: 1077364 - RNA, 19 nt, Homo sapiens
ccgcgagggacaacaagaa

SEQ ID NO: 1077365 - RNA, 19 nt, Homo sapiens
ugaggaggauguagcauua

SEQ ID NO: 1077366 - RNA, 19 nt, Homo sapiens
gguaugauguuugugaaua

SEQ ID NO: 1077367 - RNA, 19 nt, Homo sapiens
gcauuaacuucauauggua

SEQ ID NO: 1077368 - RNA, 19 nt, Homo sapiens
gaccagagguaugauguuu

SEQ ID NO: 1077369 - RNA, 19 nt, Homo sapiens
gcucaugccuccaaucuag

SEQ ID NO: 1077370 - RNA, 19 nt, Homo sapiens
ggaaggcucaucuuuauca

SEQ ID NO: 1077371 - RNA, 19 nt, Homo sapiens
gcaagaugcaggaggagua

SEQ ID NO: 1077372 - RNA, 19 nt, Homo sapiens
cauggaaggcucaucuuua

SEQ ID NO: 1077373 - RNA, 19 nt, Homo sapiens
guaugugacucucaucaug

SEQ ID NO: 1077374 - RNA, 19 nt, Homo sapiens
ccagagguaugauguuugu

SEQ ID NO: 1077375 - RNA, 19 nt, Homo sapiens
ggacgacaauucugugcau

SEQ ID NO: 1077376 - RNA, 19 nt, Homo sapiens
ggauguagcauuaacuuca

SEQ ID NO: 1077377 - RNA, 19 nt, Homo sapiens
caauguggacuuuguugua

SEQ ID NO: 1077378 - RNA, 19 nt, Homo sapiens
guacgcuacuuucucuuug

SEQ ID NO: 1077379 - RNA, 19 nt, Homo sapiens
gagguaugauguuugugaa

SEQ ID NO: 1077380 - RNA, 19 nt, Homo sapiens
gcuauugguugcagucugu

SEQ ID NO: 1077381 - RNA, 19 nt, Homo sapiens
gcauggaaggcucaucuuu

SEQ ID NO: 1077382 - RNA, 19 nt, Homo sapiens
ucacaauucugcuacucuu

SEQ ID NO: 1077383 - RNA, 19 nt, Homo sapiens
ucaucgagcucaaucaaca

SEQ ID NO: 1077384 - RNA, 19 nt, Homo sapiens
gauguagcauuaacuucau

SEQ ID NO: 1077385 - RNA, 19 nt, Homo sapiens
auggaaggcucaucuuuau

SEQ ID NO: 1077386 - RNA, 19 nt, Homo sapiens
ucacugugcucuucuccau

SEQ ID NO: 1077387 - RNA, 19 nt, Homo sapiens
gaggauguagcauuaacuu

SEQ ID NO: 1077388 - RNA, 19 nt, Homo sapiens
agacaggagugcccuuuac

SEQ ID NO: 1077389 - RNA, 19 nt, Homo sapiens
ccagcucaauguggacuuu

SEQ ID NO: 1077390 - RNA, 19 nt, Homo sapiens
ucucuuugcucucuguuuc

SEQ ID NO: 1077391 - RNA, 19 nt, Homo sapiens
ugauggagcugaggaggau

SEQ ID NO: 1077392 - RNA, 19 nt, Homo sapiens
ccugagcucugcauucucu

SEQ ID NO: 1077393 - RNA, 19 nt, Homo sapiens
ugauggcccucacauucuu

SEQ ID NO: 1077394 - RNA, 19 nt, Homo sapiens
ucacauucuucgucuccaa

SEQ ID NO: 1077395 - RNA, 19 nt, Homo sapiens
ccugauggcccucacauuc

SEQ ID NO: 1077396 - RNA, 19 nt, Homo sapiens
acucuuagcauuucucuuc

SEQ ID NO: 1077397 - RNA, 19 nt, Homo sapiens
caucaucgagcucaaucaa

SEQ ID NO: 1077398 - RNA, 19 nt, Homo sapiens
guagacaggagugcccuuu

SEQ ID NO: 1077399 - RNA, 19 nt, Homo sapiens
agagguaugauguuuguga

SEQ ID NO: 1077400 - RNA, 19 nt, Homo sapiens
gacgacaauucugugcauu

SEQ ID NO: 1077401 - RNA, 19 nt, Homo sapiens
ccauucagccgcagacugu

SEQ ID NO: 1077402 - RNA, 19 nt, Homo sapiens
gugcucuucuccaucauca

SEQ ID NO: 1077403 - RNA, 19 nt, Homo sapiens
agaugcaggaggaguauaa

SEQ ID NO: 1077404 - RNA, 19 nt, Homo sapiens
ccagagcccgagacaguga

SEQ ID NO: 1077405 - RNA, 19 nt, Homo sapiens
gaacuggaagcagcaugga

SEQ ID NO: 1077406 - RNA, 19 nt, Homo sapiens
caucaugaccagagguaug

SEQ ID NO: 1077407 - RNA, 19 nt, Homo sapiens
agcauuaacuucauauggu

SEQ ID NO: 1077408 - RNA, 19 nt, Homo sapiens
uagacaggagugcccuuua

SEQ ID NO: 1077409 - RNA, 19 nt, Homo sapiens
gcucuucuccaucaucauc

SEQ ID NO: 1077410 - RNA, 19 nt, Homo sapiens
uagcauuucucuuccucau

SEQ ID NO: 1077411 - RNA, 19 nt, Homo sapiens
aaaucauuauugccacuga

SEQ ID NO: 1077412 - RNA, 19 nt, Homo sapiens
cgagcucaaucaacaaacu

SEQ ID NO: 1077413 - RNA, 19 nt, Homo sapiens
gaggaggauguagcauuaa

SEQ ID NO: 1077414 - RNA, 19 nt, Homo sapiens
acugugcucuucuccauca

SEQ ID NO: 1077415 - RNA, 19 nt, Homo sapiens
gcaucguggucacaauucu

SEQ ID NO: 1077416 - RNA, 19 nt, Homo sapiens
ccuggucuauguccucuuc

SEQ ID NO: 1077417 - RNA, 19 nt, Homo sapiens
caagaugcaggaggaguau

SEQ ID NO: 1077418 - RNA, 19 nt, Homo sapiens
cacaauucugcuacucuua

SEQ ID NO: 1077419 - RNA, 19 nt, Homo sapiens
gcagucuguugcaaaucau

SEQ ID NO: 1077420 - RNA, 19 nt, Homo sapiens
cguacgcuacuuucucuuu

SEQ ID NO: 1077421 - RNA, 19 nt, Homo sapiens
gacuguugaucccacacaa

SEQ ID NO: 1077422 - RNA, 19 nt, Homo sapiens
ccaacacagcuuccaagug

SEQ ID NO: 1077423 - RNA, 19 nt, Homo sapiens
gcucaauguggacuuuguu

SEQ ID NO: 1077424 - RNA, 19 nt, Homo sapiens
cauuauugccacugaguau

SEQ ID NO: 1077425 - RNA, 19 nt, Homo sapiens
ccacccagcuccucuuccu

SEQ ID NO: 1077426 - RNA, 19 nt, Homo sapiens
ggucacaauucugcuacuc

SEQ ID NO: 1077427 - RNA, 19 nt, Homo sapiens
uagcauuaacuucauaugg

SEQ ID NO: 1077428 - RNA, 19 nt, Homo sapiens
caggagugcccuuuacaag

SEQ ID NO: 1077429 - RNA, 19 nt, Homo sapiens
gacaggagugcccuuuaca

SEQ ID NO: 1077430 - RNA, 19 nt, Homo sapiens
ucccugagcucugcauucu

SEQ ID NO: 1077431 - RNA, 19 nt, Homo sapiens
gaaggcucaucuuuaucac

SEQ ID NO: 1077432 - RNA, 19 nt, Homo sapiens
cagcauggaaggcucaucu

SEQ ID NO: 1077433 - RNA, 19 nt, Homo sapiens
cuccaaagccaccuucugu

SEQ ID NO: 1077434 - RNA, 19 nt, Homo sapiens
acaauucugcuacucuuag

SEQ ID NO: 1077435 - RNA, 19 nt, Homo sapiens
ccuccaaucuagugaagcu

SEQ ID NO: 1077436 - RNA, 19 nt, Homo sapiens
ggaaugauuugucggaauu

SEQ ID NO: 1077437 - RNA, 19 nt, Homo sapiens
gcugcuaucuggaguaaua

SEQ ID NO: 1077438 - RNA, 19 nt, Homo sapiens
gaaacccugucucaacuaa

SEQ ID NO: 1077439 - RNA, 19 nt, Homo sapiens
uaguuuagcuuccugauuu

SEQ ID NO: 1077440 - RNA, 19 nt, Homo sapiens
gcacugagccgagaucgua

SEQ ID NO: 1077441 - RNA, 19 nt, Homo sapiens
gcaaugagccaagaucgua

SEQ ID NO: 1077442 - RNA, 19 nt, Homo sapiens
cagcaugaauuacaaguga

SEQ ID NO: 1077443 - RNA, 19 nt, Homo sapiens
gcugauuccuauaacuuua

SEQ ID NO: 1077444 - RNA, 19 nt, Homo sapiens
gagccgagaucguaccauu

SEQ ID NO: 1077445 - RNA, 19 nt, Homo sapiens
aaagaugacuguaagacaa

SEQ ID NO: 1077446 - RNA, 19 nt, Homo sapiens
gaucagaguauucaaauca

SEQ ID NO: 1077447 - RNA, 19 nt, Homo sapiens
caaacagcaugaauuacaa

SEQ ID NO: 1077448 - RNA, 19 nt, Homo sapiens
ccacauauauacacacaca

SEQ ID NO: 1077449 - RNA, 19 nt, Homo sapiens
ggagaaggaggaauauuug

SEQ ID NO: 1077450 - RNA, 19 nt, Homo sapiens
gaaguuuaauuuccuugga

SEQ ID NO: 1077451 - RNA, 19 nt, Homo sapiens
gaacaggaaggaaguagga

SEQ ID NO: 1077452 - RNA, 19 nt, Homo sapiens
uaagugugccaguuauuua

SEQ ID NO: 1077453 - RNA, 19 nt, Homo sapiens
ggaaggaaguaggaguaaa

SEQ ID NO: 1077454 - RNA, 19 nt, Homo sapiens
gacaaaggaauugcuguua

SEQ ID NO: 1077455 - RNA, 19 nt, Homo sapiens
ggguguguguccucuguua

SEQ ID NO: 1077456 - RNA, 19 nt, Homo sapiens
uuacaucccuuuaucaagu

SEQ ID NO: 1077457 - RNA, 19 nt, Homo sapiens
uaaggaaggacacacagua

SEQ ID NO: 1077458 - RNA, 19 nt, Homo sapiens
uauaugggaugguuugguu

SEQ ID NO: 1077459 - RNA, 19 nt, Homo sapiens
aacccugucucaacuaaua

SEQ ID NO: 1077460 - RNA, 19 nt, Homo sapiens
ggcacaacgucccuaauug

SEQ ID NO: 1077461 - RNA, 19 nt, Homo sapiens
gauccacuguccauuaauc

SEQ ID NO: 1077462 - RNA, 19 nt, Homo sapiens
ccaaacagcaugaauuaca

SEQ ID NO: 1077463 - RNA, 19 nt, Homo sapiens
gagccaaacagcaugaauu

SEQ ID NO: 1077464 - RNA, 19 nt, Homo sapiens
aggaauugcuguuacugua

SEQ ID NO: 1077465 - RNA, 19 nt, Homo sapiens
caaaggaauugcuguuacu

SEQ ID NO: 1077466 - RNA, 19 nt, Homo sapiens
caagagcgaaacuccauuu

SEQ ID NO: 1077467 - RNA, 19 nt, Homo sapiens
gauaaugacaaaggaauug

SEQ ID NO: 1077468 - RNA, 19 nt, Homo sapiens
caaguucugcauugcuuua

SEQ ID NO: 1077469 - RNA, 19 nt, Homo sapiens
guguguguguguauauaua

SEQ ID NO: 1077470 - RNA, 19 nt, Homo sapiens
gcuuuguggucuucacuaa

SEQ ID NO: 1077471 - RNA, 19 nt, Homo sapiens
ucaccuggcugggcuugua

SEQ ID NO: 1077472 - RNA, 19 nt, Homo sapiens
cgaaaugguucaugcuucu

SEQ ID NO: 1077473 - RNA, 19 nt, Homo sapiens
cuucaccugucaccuauaa

SEQ ID NO: 1077474 - RNA, 19 nt, Homo sapiens
gggaacacuucaccuguca

SEQ ID NO: 1077475 - RNA, 19 nt, Homo sapiens
gguguaauccuaaauucuu

SEQ ID NO: 1077476 - RNA, 19 nt, Homo sapiens
acacacacacauacauaua

SEQ ID NO: 1077477 - RNA, 19 nt, Homo sapiens
gagcgcagguugcaaugag

SEQ ID NO: 1077478 - RNA, 19 nt, Homo sapiens
gcacaacgucccuaauugg

SEQ ID NO: 1077479 - RNA, 19 nt, Homo sapiens
uggagaaggaggaauauuu

SEQ ID NO: 1077480 - RNA, 19 nt, Homo sapiens
gcaggagaaucacuugaac

SEQ ID NO: 1077481 - RNA, 19 nt, Homo sapiens
cggaggauauguuuuauuu

SEQ ID NO: 1077482 - RNA, 19 nt, Homo sapiens
gaugugaaguuuaauuucc

SEQ ID NO: 1077483 - RNA, 19 nt, Homo sapiens
gcucucugcuugcugauag

SEQ ID NO: 1077484 - RNA, 19 nt, Homo sapiens
uuacuguacugcaaauaug

SEQ ID NO: 1077485 - RNA, 19 nt, Homo sapiens
guucugugauaaugacaaa

SEQ ID NO: 1077486 - RNA, 19 nt, Homo sapiens
uggcugggcuuguauaucu

SEQ ID NO: 1077487 - RNA, 19 nt, Homo sapiens
acucaaugauggaaugauu

SEQ ID NO: 1077488 - RNA, 19 nt, Homo sapiens
gaaggaaguaggaguaaac

SEQ ID NO: 1077489 - RNA, 19 nt, Homo sapiens
guucugcauugcuuuauuc

SEQ ID NO: 1077490 - RNA, 19 nt, Homo sapiens
uaucuggaguaauagcuuu

SEQ ID NO: 1077491 - RNA, 19 nt, Homo sapiens
ggucuucacuaaccuuucu

SEQ ID NO: 1077492 - RNA, 19 nt, Homo sapiens
ggugacagacucaaugaug

SEQ ID NO: 1077493 - RNA, 19 nt, Homo sapiens
uaagcucagugaacaggaa

SEQ ID NO: 1077494 - RNA, 19 nt, Homo sapiens
caaauaugcuguggguucu

SEQ ID NO: 1077495 - RNA, 19 nt, Homo sapiens
aggauccacuguccauuaa

SEQ ID NO: 1077496 - RNA, 19 nt, Homo sapiens
gugcugcuaucuggaguaa

SEQ ID NO: 1077497 - RNA, 19 nt, Homo sapiens
agccaaacagcaugaauua

SEQ ID NO: 1077498 - RNA, 19 nt, Homo sapiens
gaauugcuguuacuguacu

SEQ ID NO: 1077499 - RNA, 19 nt, Homo sapiens
acacacacauacauauaca

SEQ ID NO: 1077500 - RNA, 19 nt, Homo sapiens
gaauuaacacaaagcagau

SEQ ID NO: 1077501 - RNA, 19 nt, Homo sapiens
aaggauccacuguccauua

SEQ ID NO: 1077502 - RNA, 19 nt, Homo sapiens
uuaguuacaucccuuuauc

SEQ ID NO: 1077503 - RNA, 19 nt, Homo sapiens
acaaaggaauugcuguuac

SEQ ID NO: 1077504 - RNA, 19 nt, Homo sapiens
uaacauguucggacacuuc

SEQ ID NO: 1077505 - RNA, 19 nt, Homo sapiens
uucaaacucuucuaaggaa

SEQ ID NO: 1077506 - RNA, 19 nt, Homo sapiens
guucaaacucuucuaagga

SEQ ID NO: 1077507 - RNA, 19 nt, Homo sapiens
cagacucaaugauggaaug

SEQ ID NO: 1077508 - RNA, 19 nt, Homo sapiens
uaaucaggcccuugacauu

SEQ ID NO: 1077509 - RNA, 19 nt, Homo sapiens
acacuucaccugucaccua

SEQ ID NO: 1077510 - RNA, 19 nt, Homo sapiens
ucagaguauucaaaucaga

SEQ ID NO: 1077511 - RNA, 19 nt, Homo sapiens
gaaugauuugucggaauua

SEQ ID NO: 1077512 - RNA, 19 nt, Homo sapiens
gagaccagccugaccaaca

SEQ ID NO: 1077513 - RNA, 19 nt, Homo sapiens
caggaaggaaguaggagua

SEQ ID NO: 1077514 - RNA, 19 nt, Homo sapiens
gguguucaaacucuucuaa

SEQ ID NO: 1077515 - RNA, 19 nt, Homo sapiens
ugacaaaggaauugcuguu

SEQ ID NO: 1077516 - RNA, 19 nt, Homo sapiens
auacacacacacauacaua

SEQ ID NO: 1077517 - RNA, 19 nt, Homo sapiens
ucaaugauggaaugauuug

SEQ ID NO: 1077518 - RNA, 19 nt, Homo sapiens
ccuggucaguuucugcuuu

SEQ ID NO: 1077519 - RNA, 19 nt, Homo sapiens
uaaagaugacuguaagaca

SEQ ID NO: 1077520 - RNA, 19 nt, Homo sapiens
cagcuucuguggcuuugug

SEQ ID NO: 1077521 - RNA, 19 nt, Homo sapiens
uuuggucccuggucaguuu

SEQ ID NO: 1077522 - RNA, 19 nt, Homo sapiens
uggcacaacgucccuaauu

SEQ ID NO: 1077523 - RNA, 19 nt, Homo sapiens
aaucaggcccuugacauuu

SEQ ID NO: 1077524 - RNA, 19 nt, Homo sapiens
guuuggagaaggaggaaua

SEQ ID NO: 1077525 - RNA, 19 nt, Homo sapiens
ggcaggagaaucacuugaa

SEQ ID NO: 1077526 - RNA, 19 nt, Homo sapiens
cauggugaacuuaucaauu

SEQ ID NO: 1077527 - RNA, 19 nt, Homo sapiens
cuaccaggcuccgauguca

SEQ ID NO: 1077528 - RNA, 19 nt, Homo sapiens
gguaggagccaaacagcau

SEQ ID NO: 1077529 - RNA, 19 nt, Homo sapiens
uuaagugugccaguuauuu

SEQ ID NO: 1077530 - RNA, 19 nt, Homo sapiens
gguguuugcugcucuuggu

SEQ ID NO: 1077531 - RNA, 19 nt, Homo sapiens
auagaugguuucccagugu

SEQ ID NO: 1077532 - RNA, 19 nt, Homo sapiens
gcuguggguucucgguguu

SEQ ID NO: 1077533 - RNA, 19 nt, Homo sapiens
guguguguguguguauaua

SEQ ID NO: 1077534 - RNA, 19 nt, Homo sapiens
ucauagccauccagaccuu

SEQ ID NO: 1077535 - RNA, 19 nt, Homo sapiens
ccauuaaucaggcccuuga

SEQ ID NO: 1077536 - RNA, 19 nt, Homo sapiens
ggaagaagcagacccagaa

SEQ ID NO: 1077537 - RNA, 19 nt, Homo sapiens
gccauuuccucuagaauuu

SEQ ID NO: 1077538 - RNA, 19 nt, Homo sapiens
ggaauuuacaggcacaaua

SEQ ID NO: 1077539 - RNA, 19 nt, Homo sapiens
gcuaguagguucugcuguu

SEQ ID NO: 1077540 - RNA, 19 nt, Homo sapiens
gcucugcccuaugaacuuu

SEQ ID NO: 1077541 - RNA, 19 nt, Homo sapiens
gcagagcccugaggaugau

SEQ ID NO: 1077542 - RNA, 19 nt, Homo sapiens
ggagagagaucgggaagcu

SEQ ID NO: 1077543 - RNA, 19 nt, Homo sapiens
cuaguagguucugcuguua

SEQ ID NO: 1077544 - RNA, 19 nt, Homo sapiens
gcucagagaagucggaaga

SEQ ID NO: 1077545 - RNA, 19 nt, Homo sapiens
ugaaggagcacgagaagau

SEQ ID NO: 1077546 - RNA, 19 nt, Homo sapiens
gaauuuacaggcacaauac

SEQ ID NO: 1077547 - RNA, 19 nt, Homo sapiens
cugcugcucugcccuauga

SEQ ID NO: 1077548 - RNA, 19 nt, Homo sapiens
ugacagaggcacugaagga

SEQ ID NO: 1077549 - RNA, 19 nt, Homo sapiens
caagcuccaugaggaauau

SEQ ID NO: 1077550 - RNA, 19 nt, Homo sapiens
ccucaggagugacuucuca

SEQ ID NO: 1077551 - RNA, 19 nt, Homo sapiens
acagagcccuugugcagau

SEQ ID NO: 1077552 - RNA, 19 nt, Homo sapiens
ccgaguugcugcucagaga

SEQ ID NO: 1077553 - RNA, 19 nt, Homo sapiens
ugacagaggagcugaagca

SEQ ID NO: 1077554 - RNA, 19 nt, Homo sapiens
gaaggagcacgagaagaug

SEQ ID NO: 1077555 - RNA, 19 nt, Homo sapiens
ucagagaagucggaagaag

SEQ ID NO: 1077556 - RNA, 19 nt, Homo sapiens
gcacaauacacuuccuuuu

SEQ ID NO: 1077557 - RNA, 19 nt, Homo sapiens
ccaacaggcgccaaacuca

SEQ ID NO: 1077558 - RNA, 19 nt, Homo sapiens
acacuccucugcccagcaa

SEQ ID NO: 1077559 - RNA, 19 nt, Homo sapiens
ugacaagcuccaugaggaa

SEQ ID NO: 1077560 - RNA, 19 nt, Homo sapiens
aaagaugcuuauugucucu

SEQ ID NO: 1077561 - RNA, 19 nt, Homo sapiens
gacaggaagguccgaagga

SEQ ID NO: 1077562 - RNA, 19 nt, Homo sapiens
gaagaagcagacccagaag

SEQ ID NO: 1077563 - RNA, 19 nt, Homo sapiens
ccucuagaauuuggauaau

SEQ ID NO: 1077564 - RNA, 19 nt, Homo sapiens
gcuguuaugcagagccauu

SEQ ID NO: 1077565 - RNA, 19 nt, Homo sapiens
aguagguucugcuguuaug

SEQ ID NO: 1077566 - RNA, 19 nt, Homo sapiens
ggcacaauacacuuccuuu

SEQ ID NO: 1077567 - RNA, 19 nt, Homo sapiens
acaagcuccaugaggaaua

SEQ ID NO: 1077568 - RNA, 19 nt, Homo sapiens
augagagccuggagcaaga

SEQ ID NO: 1077569 - RNA, 19 nt, Homo sapiens
cuuauugucucucccuucu

SEQ ID NO: 1077570 - RNA, 19 nt, Homo sapiens
acaccaugcugcggagaga

SEQ ID NO: 1077571 - RNA, 19 nt, Homo sapiens
ggaaagacauuguguuauu

SEQ ID NO: 1077572 - RNA, 19 nt, Homo sapiens
gaauagacccggcauguua

SEQ ID NO: 1077573 - RNA, 19 nt, Homo sapiens
gaagagaccggacugauuu

SEQ ID NO: 1077574 - RNA, 19 nt, Homo sapiens
gaagagaaauggagucaca

SEQ ID NO: 1077575 - RNA, 19 nt, Homo sapiens
ccaagaaguuucauuaaug

SEQ ID NO: 1077576 - RNA, 19 nt, Homo sapiens
ggagucacaugcaaacuuu

SEQ ID NO: 1077577 - RNA, 19 nt, Homo sapiens
gaaauggagucacaugcaa

SEQ ID NO: 1077578 - RNA, 19 nt, Homo sapiens
gcagauuuaccaccaauua

SEQ ID NO: 1077579 - RNA, 19 nt, Homo sapiens
ggacugauuugacugauuc

SEQ ID NO: 1077580 - RNA, 19 nt, Homo sapiens
gguagagaauucaagauuu

SEQ ID NO: 1077581 - RNA, 19 nt, Homo sapiens
cagaggagcuuguaucaau

SEQ ID NO: 1077582 - RNA, 19 nt, Homo sapiens
ggaaauauaucaguagagu

SEQ ID NO: 1077583 - RNA, 19 nt, Homo sapiens
gaacaaauagaagagcuua

SEQ ID NO: 1077584 - RNA, 19 nt, Homo sapiens
ggagaauguugcaaauauu

SEQ ID NO: 1077585 - RNA, 19 nt, Homo sapiens
gaaggagaauguugcaaau

SEQ ID NO: 1077586 - RNA, 19 nt, Homo sapiens
gcaaggcaaugcaaacgaa

SEQ ID NO: 1077587 - RNA, 19 nt, Homo sapiens
gcagauaguuggaggaaag

SEQ ID NO: 1077588 - RNA, 19 nt, Homo sapiens
ccagauaggcagacaguua

SEQ ID NO: 1077589 - RNA, 19 nt, Homo sapiens
gaucggccauugauagauu

SEQ ID NO: 1077590 - RNA, 19 nt, Homo sapiens
aaagggaaauggaaagaaa

SEQ ID NO: 1077591 - RNA, 19 nt, Homo sapiens
gcaaggaauagaucuuaua

SEQ ID NO: 1077592 - RNA, 19 nt, Homo sapiens
caggaaagacauuguguua

SEQ ID NO: 1077593 - RNA, 19 nt, Homo sapiens
ggaaagagcaaaucagagu

SEQ ID NO: 1077594 - RNA, 19 nt, Homo sapiens
gaauacuaauugcaacuga

SEQ ID NO: 1077595 - RNA, 19 nt, Homo sapiens
gaugacgccuuucaauguu

SEQ ID NO: 1077596 - RNA, 19 nt, Homo sapiens
ggaaauagagaugaacaaa

SEQ ID NO: 1077597 - RNA, 19 nt, Homo sapiens
aggaauagaucuuauagga

SEQ ID NO: 1077598 - RNA, 19 nt, Homo sapiens
caaagucauugucuucguu

SEQ ID NO: 1077599 - RNA, 19 nt, Homo sapiens
aaacaaagugggcagauuu

SEQ ID NO: 1077600 - RNA, 19 nt, Homo sapiens
ggacugguguuuccauuac

SEQ ID NO: 1077601 - RNA, 19 nt, Homo sapiens
gaccuaauacuuggaaaua

SEQ ID NO: 1077602 - RNA, 19 nt, Homo sapiens
ggagaaagcauuagagaac

SEQ ID NO: 1077603 - RNA, 19 nt, Homo sapiens
cuuaucaagugaccuaaua

SEQ ID NO: 1077604 - RNA, 19 nt, Homo sapiens
ugaaugaucugcaaaugag

SEQ ID NO: 1077605 - RNA, 19 nt, Homo sapiens
caaccagaaucauuaguca

SEQ ID NO: 1077606 - RNA, 19 nt, Homo sapiens
agaacaaccagaaucauua

SEQ ID NO: 1077607 - RNA, 19 nt, Homo sapiens
gaaagagcaaaucagagua

SEQ ID NO: 1077608 - RNA, 19 nt, Homo sapiens
ggacauguuggcaguauga

SEQ ID NO: 1077609 - RNA, 19 nt, Homo sapiens
caacaccuauucagucaca

SEQ ID NO: 1077610 - RNA, 19 nt, Homo sapiens
gaaaagcuguugcggauca

SEQ ID NO: 1077611 - RNA, 19 nt, Homo sapiens
cggcgaagcucgacagugu

SEQ ID NO: 1077612 - RNA, 19 nt, Homo sapiens
aagcagugauagacaauuu

SEQ ID NO: 1077613 - RNA, 19 nt, Homo sapiens
acagagagaucgggagaaa

SEQ ID NO: 1077614 - RNA, 19 nt, Homo sapiens
cgcacaaucuuauuugaaa

SEQ ID NO: 1077615 - RNA, 19 nt, Homo sapiens
gaacaggaaagacauugug

SEQ ID NO: 1077616 - RNA, 19 nt, Homo sapiens
ggagaucggccauugauag

SEQ ID NO: 1077617 - RNA, 19 nt, Homo sapiens
aaagauggaagcacagaua

SEQ ID NO: 1077618 - RNA, 19 nt, Homo sapiens
gagaugaacaaauagaaga

SEQ ID NO: 1077619 - RNA, 19 nt, Homo sapiens
aaacaccacaauccaaaua

SEQ ID NO: 1077620 - RNA, 19 nt, Homo sapiens
aggagaauguugcaaauau

SEQ ID NO: 1077621 - RNA, 19 nt, Homo sapiens
aauccuaccugcacauuug

SEQ ID NO: 1077622 - RNA, 19 nt, Homo sapiens
gagaggaagguuugaaaug

SEQ ID NO: 1077623 - RNA, 19 nt, Homo sapiens
ucagaaugcggaauugaua

SEQ ID NO: 1077624 - RNA, 19 nt, Homo sapiens
ggaucuaguugcuguaagu

SEQ ID NO: 1077625 - RNA, 19 nt, Homo sapiens
ccacaagugccaugucaaa

SEQ ID NO: 1077626 - RNA, 19 nt, Homo sapiens
gaacaaccagaaucauuag

SEQ ID NO: 1077627 - RNA, 19 nt, Homo sapiens
ggcccaagaaguuucauua

SEQ ID NO: 1077628 - RNA, 19 nt, Homo sapiens
caacuuugacuagaaauga

SEQ ID NO: 1077629 - RNA, 19 nt, Homo sapiens
cgugcgggcuccuuaagua

SEQ ID NO: 1077630 - RNA, 19 nt, Homo sapiens
gccaacaccuauucaguca

SEQ ID NO: 1077631 - RNA, 19 nt, Homo sapiens
gcggaggaguugaaucgaa

SEQ ID NO: 1077632 - RNA, 19 nt, Homo sapiens
cccaagaaguuucauuaau

SEQ ID NO: 1077633 - RNA, 19 nt, Homo sapiens
gcaacucccggaagauuga

SEQ ID NO: 1077634 - RNA, 19 nt, Homo sapiens
ucaaguagaaggagaaugu

SEQ ID NO: 1077635 - RNA, 19 nt, Homo sapiens
gaggacugguguuuccauu

SEQ ID NO: 1077636 - RNA, 19 nt, Homo sapiens
caccacaauccaaauaaua

SEQ ID NO: 1077637 - RNA, 19 nt, Homo sapiens
ugaagagaccggacugauu

SEQ ID NO: 1077638 - RNA, 19 nt, Homo sapiens
gccucugaauugauuaaua

SEQ ID NO: 1077639 - RNA, 19 nt, Homo sapiens
gcagggaggacugguguuu

SEQ ID NO: 1077640 - RNA, 19 nt, Homo sapiens
gcacaaucuuauuugaaag

SEQ ID NO: 1077641 - RNA, 19 nt, Homo sapiens
gauacugcauuccaaccuu

SEQ ID NO: 1077642 - RNA, 19 nt, Homo sapiens
ggguagagaauucaagauu

SEQ ID NO: 1077643 - RNA, 19 nt, Homo sapiens
guguuuccauuacaacuuu

SEQ ID NO: 1077644 - RNA, 19 nt, Homo sapiens
gguugccucugaauugauu

SEQ ID NO: 1077645 - RNA, 19 nt, Homo sapiens
gcauggagauagagaacag

SEQ ID NO: 1077646 - RNA, 19 nt, Homo sapiens
ggaauagacccggcauguu

SEQ ID NO: 1077647 - RNA, 19 nt, Homo sapiens
caacaaacaccacaaucca

SEQ ID NO: 1077648 - RNA, 19 nt, Homo sapiens
cuacauggccucauucagu

SEQ ID NO: 1077649 - RNA, 19 nt, Homo sapiens
gaaagcaaaagcagugaua

SEQ ID NO: 1077650 - RNA, 19 nt, Homo sapiens
gcccaagaaguuucauuaa

SEQ ID NO: 1077651 - RNA, 19 nt, Homo sapiens
caaggaaggcccaagaagu

SEQ ID NO: 1077652 - RNA, 19 nt, Homo sapiens
ggcaaagugagaauacuaa

SEQ ID NO: 1077653 - RNA, 19 nt, Homo sapiens
uacauggccucauucaguu

SEQ ID NO: 1077654 - RNA, 19 nt, Homo sapiens
auaaagggcuucggagugu

SEQ ID NO: 1077655 - RNA, 19 nt, Homo sapiens
ucaauguuauccugagguu

SEQ ID NO: 1077656 - RNA, 19 nt, Homo sapiens
cacauuugaugacgccuuu

SEQ ID NO: 1077657 - RNA, 19 nt, Homo sapiens
gauaguuggaggaaagaaa

SEQ ID NO: 1077658 - RNA, 19 nt, Homo sapiens
agauugggaucaaauuaga

SEQ ID NO: 1077659 - RNA, 19 nt, Homo sapiens
gauagauugggaucaaauu

SEQ ID NO: 1077660 - RNA, 19 nt, Homo sapiens
ugaggcacaucaacggaaa

SEQ ID NO: 1077661 - RNA, 19 nt, Homo sapiens
gagaaagcauuagagaacu

SEQ ID NO: 1077662 - RNA, 19 nt, Homo sapiens
ucgucaaucugaagaauau

SEQ ID NO: 1077663 - RNA, 19 nt, Homo sapiens
ugaguaacuucgucaaucu

SEQ ID NO: 1077664 - RNA, 19 nt, Homo sapiens
guacaacaaacaccacaau

SEQ ID NO: 1077665 - RNA, 19 nt, Homo sapiens
gggcagauuuaccaccaau

SEQ ID NO: 1077666 - RNA, 19 nt, Homo sapiens
gagaucggccauugauaga

SEQ ID NO: 1077667 - RNA, 19 nt, Homo sapiens
gaagcacagauaacaaugu

SEQ ID NO: 1077668 - RNA, 19 nt, Homo sapiens
gauggaagcacagauaaca

SEQ ID NO: 1077669 - RNA, 19 nt, Homo sapiens
caaaagcagugauagacaa

SEQ ID NO: 1077670 - RNA, 19 nt, Homo sapiens
acaaacaccacaauccaaa

SEQ ID NO: 1077671 - RNA, 19 nt, Homo sapiens
gaaagaaguucgaagguuu

SEQ ID NO: 1077672 - RNA, 19 nt, Homo sapiens
caacagggcuuauuaaugu

SEQ ID NO: 1077673 - RNA, 19 nt, Homo sapiens
ccacagggcuuauuaauau

SEQ ID NO: 1077674 - RNA, 19 nt, Homo sapiens
aaagggagcuguuuaaauu

SEQ ID NO: 1077675 - RNA, 19 nt, Homo sapiens
caccagagcugauaaauau

SEQ ID NO: 1077676 - RNA, 19 nt, Homo sapiens
ggaauuucauccacgauua

SEQ ID NO: 1077677 - RNA, 19 nt, Homo sapiens
gaagagagagugguaaaua

SEQ ID NO: 1077678 - RNA, 19 nt, Homo sapiens
gauaacgucuugucaaaug

SEQ ID NO: 1077679 - RNA, 19 nt, Homo sapiens
caccagagcuuauuaacuu

SEQ ID NO: 1077680 - RNA, 19 nt, Homo sapiens
uaccagggcuugcuuauuu

SEQ ID NO: 1077681 - RNA, 19 nt, Homo sapiens
gauaacaucuugucaacug

SEQ ID NO: 1077682 - RNA, 19 nt, Homo sapiens
gauaaugucuugucaacug

SEQ ID NO: 1077683 - RNA, 19 nt, Homo sapiens
ccaccagcauuuauuaaua

SEQ ID NO: 1077684 - RNA, 19 nt, Homo sapiens
uaccaggacuuacuuauuu

SEQ ID NO: 1077685 - RNA, 19 nt, Homo sapiens
guacaaggaucuaugaaag

SEQ ID NO: 1077686 - RNA, 19 nt, Homo sapiens
ccaaauacaccacaaauau

SEQ ID NO: 1077687 - RNA, 19 nt, Homo sapiens
gaaggcgcuuaaagaaaua

SEQ ID NO: 1077688 - RNA, 19 nt, Homo sapiens
gugaagagaggauaaauaa

SEQ ID NO: 1077689 - RNA, 19 nt, Homo sapiens
gaaagucaagagacaauuu

SEQ ID NO: 1077690 - RNA, 19 nt, Homo sapiens
caccacagcuuguucauau

SEQ ID NO: 1077691 - RNA, 19 nt, Homo sapiens
aagaugagcugcuuuacaa

SEQ ID NO: 1077692 - RNA, 19 nt, Homo sapiens
gguaacaucuugucaacug

SEQ ID NO: 1077693 - RNA, 19 nt, Homo sapiens
gguauuccauccaugagua

SEQ ID NO: 1077694 - RNA, 19 nt, Homo sapiens
uauccgggcuuauuaauau

SEQ ID NO: 1077695 - RNA, 19 nt, Homo sapiens
gguauuccauccaugagua

SEQ ID NO: 1077696 - RNA, 19 nt, Homo sapiens
gauaacgucuugucaacug

SEQ ID NO: 1077697 - RNA, 19 nt, Homo sapiens
gaggagugaugaaguaaau

SEQ ID NO: 1077698 - RNA, 19 nt, Homo sapiens
agaaggcgcuuaaagaaau

SEQ ID NO: 1077699 - RNA, 19 nt, Homo sapiens
caaggaagcagcaagguuu

SEQ ID NO: 1077700 - RNA, 19 nt, Homo sapiens
ucacaagucucagcaaaga

SEQ ID NO: 1077701 - RNA, 19 nt, Homo sapiens
gguauuucaugcagaagua

SEQ ID NO: 1077702 - RNA, 19 nt, Homo sapiens
gugaagagaagaaagauaa

SEQ ID NO: 1077703 - RNA, 19 nt, Homo sapiens
gacagacacugguauuuca

SEQ ID NO: 1077704 - RNA, 19 nt, Homo sapiens
caacauccgugaagagaag

SEQ ID NO: 1077705 - RNA, 19 nt, Homo sapiens
aagagagagugguaaauaa

SEQ ID NO: 1077706 - RNA, 19 nt, Homo sapiens
gagaaggcgcuuaaagaaa

SEQ ID NO: 1077707 - RNA, 19 nt, Homo sapiens
gucaggagcugguauuuca

SEQ ID NO: 1077708 - RNA, 19 nt, Homo sapiens
cauaugcuaccauuacuua

SEQ ID NO: 1077709 - RNA, 19 nt, Homo sapiens
ugaaagaaguucgaagguu

SEQ ID NO: 1077710 - RNA, 19 nt, Homo sapiens
cgaccacggcguauuaaua

SEQ ID NO: 1077711 - RNA, 19 nt, Homo sapiens
caauauccgugaagagaga

SEQ ID NO: 1077712 - RNA, 19 nt, Homo sapiens
caacagggcaucaaagcaa

SEQ ID NO: 1077713 - RNA, 19 nt, Homo sapiens
agggagcuguuuaaauuua

SEQ ID NO: 1077714 - RNA, 19 nt, Homo sapiens
gaagagaggauaaauaacg

SEQ ID NO: 1077715 - RNA, 19 nt, Homo sapiens
ggaagaugcugcagucacu

SEQ ID NO: 1077716 - RNA, 19 nt, Homo sapiens
cgagaaggcgcuuaaagaa

SEQ ID NO: 1077717 - RNA, 19 nt, Homo sapiens
guaaauaaccaaccacuac

SEQ ID NO: 1077718 - RNA, 19 nt, Homo sapiens
ccagggaucugcauucuac

SEQ ID NO: 1077719 - RNA, 19 nt, Homo sapiens
aaugaggagugaugaagua

SEQ ID NO: 1077720 - RNA, 19 nt, Homo sapiens
ggagaaacaaggacauaug

SEQ ID NO: 1077721 - RNA, 19 nt, Homo sapiens
gaagagaggauggaaaaua

SEQ ID NO: 1077722 - RNA, 19 nt, Homo sapiens
gaagauggaaaguggcaaa

SEQ ID NO: 1077723 - RNA, 19 nt, Homo sapiens
gagcuaguauuccagcaau

SEQ ID NO: 1077724 - RNA, 19 nt, Homo sapiens
gaccacggcguauuaauau

SEQ ID NO: 1077725 - RNA, 19 nt, Homo sapiens
gaugcaggcuucuccacuu

SEQ ID NO: 1077726 - RNA, 19 nt, Homo sapiens
gaccaaccgcaaccuaaua

SEQ ID NO: 1077727 - RNA, 19 nt, Homo sapiens
gaggagaagaugacaaaug

SEQ ID NO: 1077728 - RNA, 19 nt, Homo sapiens
gaaaauggccaaucucgaa

SEQ ID NO: 1077729 - RNA, 19 nt, Homo sapiens
uaccaucgcucacaauauc

SEQ ID NO: 1077730 - RNA, 19 nt, Homo sapiens
gugcaaagaccaaggagaa

SEQ ID NO: 1077731 - RNA, 19 nt, Homo sapiens
cagguggccuucacuauca

SEQ ID NO: 1077732 - RNA, 19 nt, Homo sapiens
gccaaauacaccacaaaua

SEQ ID NO: 1077733 - RNA, 19 nt, Homo sapiens
guucaaccagugauuauuu

SEQ ID NO: 1077734 - RNA, 19 nt, Homo sapiens
gcugguauuucaugcagaa

SEQ ID NO: 1077735 - RNA, 19 nt, Homo sapiens
caacugguguuucauccau

SEQ ID NO: 1077736 - RNA, 19 nt, Homo sapiens
gaagagaagauggaaagug

SEQ ID NO: 1077737 - RNA, 19 nt, Homo sapiens
caaugucugugaagagaga

SEQ ID NO: 1077738 - RNA, 19 nt, Homo sapiens
ccuauaauccugaaaugaa

SEQ ID NO: 1077739 - RNA, 19 nt, Homo sapiens
ucaccagagcugauaaaua

SEQ ID NO: 1077740 - RNA, 19 nt, Homo sapiens
ccugauaacuccuugucaa

SEQ ID NO: 1077741 - RNA, 19 nt, Homo sapiens
ggcagcaacugguguuuca

SEQ ID NO: 1077742 - RNA, 19 nt, Homo sapiens
ccuauguguuuacaaauga

SEQ ID NO: 1077743 - RNA, 19 nt, Homo sapiens
ggaacagguuauugcugaa

SEQ ID NO: 1077744 - RNA, 19 nt, Homo sapiens
ggaagcagcaagguuuaaa

SEQ ID NO: 1077745 - RNA, 19 nt, Homo sapiens
gguggaaacugugccaaau

SEQ ID NO: 1077746 - RNA, 19 nt, Homo sapiens
ccagagcugauaaauauga

SEQ ID NO: 1077747 - RNA, 19 nt, Homo sapiens
gaaguaccagggaucugua

SEQ ID NO: 1077748 - RNA, 19 nt, Homo sapiens
ccaccugguuguauuaauc

SEQ ID NO: 1077749 - RNA, 19 nt, Homo sapiens
aggauaacgucuugucaaa

SEQ ID NO: 1077750 - RNA, 19 nt, Homo sapiens
gagacacucuucaucuaag

SEQ ID NO: 1077751 - RNA, 19 nt, Homo sapiens
gguacaaggaucuaugaaa

SEQ ID NO: 1077752 - RNA, 19 nt, Homo sapiens
caaauacaccacaaauauc

SEQ ID NO: 1077753 - RNA, 19 nt, Homo sapiens
guucuauccgggcuuauua

SEQ ID NO: 1077754 - RNA, 19 nt, Homo sapiens
gcaccaauggccuguauuc

SEQ ID NO: 1077755 - RNA, 19 nt, Homo sapiens
gaguauguccucgugguua

SEQ ID NO: 1077756 - RNA, 19 nt, Homo sapiens
ucuaagagaaggaagagua

SEQ ID NO: 1077757 - RNA, 19 nt, Homo sapiens
ggaucuguaugcuaccauu

SEQ ID NO: 1077758 - RNA, 19 nt, Homo sapiens
ggauccauaugcuaccauu

SEQ ID NO: 1077759 - RNA, 19 nt, Homo sapiens
caaaugaugggcagcaaau

SEQ ID NO: 1077760 - RNA, 19 nt, Homo sapiens
gguauuccacccaugagua

SEQ ID NO: 1077761 - RNA, 19 nt, Homo sapiens
ggcaggagcugguauucca

SEQ ID NO: 1077762 - RNA, 19 nt, Homo sapiens
gauaugccagccaugagua

SEQ ID NO: 1077763 - RNA, 19 nt, Homo sapiens
aagagaagauggaaaauga

SEQ ID NO: 1077764 - RNA, 19 nt, Homo sapiens
gccuauguguuuacaaaug

SEQ ID NO: 1077765 - RNA, 19 nt, Homo sapiens
ccacggcguauuaauauga

SEQ ID NO: 1077766 - RNA, 19 nt, Homo sapiens
gccaaccaguagcugauaa

SEQ ID NO: 1077767 - RNA, 19 nt, Homo sapiens
gcaaaugaggagugaugaa

SEQ ID NO: 1077768 - RNA, 19 nt, Homo sapiens
aaauaacggccaaccagua

SEQ ID NO: 1077769 - RNA, 19 nt, Homo sapiens
ucaaccaacuccaccugaa

SEQ ID NO: 1077770 - RNA, 19 nt, Homo sapiens
gaugacaaauggccaacag

SEQ ID NO: 1077771 - RNA, 19 nt, Homo sapiens
caacagcggccuccucuuu

SEQ ID NO: 1077772 - RNA, 19 nt, Homo sapiens
ggacguggccuaucacugu

SEQ ID NO: 1077773 - RNA, 19 nt, Homo sapiens
cgaacggccuguacgauga

SEQ ID NO: 1077774 - RNA, 19 nt, Homo sapiens
ccgaggagcugguggcauu

SEQ ID NO: 1077775 - RNA, 19 nt, Homo sapiens
guacucugcuggacacgaa

SEQ ID NO: 1077776 - RNA, 19 nt, Homo sapiens
caacaaguguaacgacgau

SEQ ID NO: 1077777 - RNA, 19 nt, Homo sapiens
gcucugcacugcccucuuc

SEQ ID NO: 1077778 - RNA, 19 nt, Homo sapiens
gccagacgcccaaccauaa

SEQ ID NO: 1077779 - RNA, 19 nt, Homo sapiens
gcgagcagccaccaaauug

SEQ ID NO: 1077780 - RNA, 19 nt, Homo sapiens
gagcagccaccaaauugaa

SEQ ID NO: 1077781 - RNA, 19 nt, Homo sapiens
agaagguccuggagaguga

SEQ ID NO: 1077782 - RNA, 19 nt, Homo sapiens
cuguggagauuucaacuuu

SEQ ID NO: 1077783 - RNA, 19 nt, Homo sapiens
gggcagagaauccgcaaug

SEQ ID NO: 1077784 - RNA, 19 nt, Homo sapiens
aggacuggcuggcugauuu

SEQ ID NO: 1077785 - RNA, 19 nt, Homo sapiens
guggaagaauucaguuuua

SEQ ID NO: 1077786 - RNA, 19 nt, Homo sapiens
uaagggagcucuguuucuc

SEQ ID NO: 1077787 - RNA, 19 nt, Homo sapiens
acgaugcccuggccucuaa

SEQ ID NO: 1077788 - RNA, 19 nt, Homo sapiens
ggccagacgcccaaccaua

SEQ ID NO: 1077789 - RNA, 19 nt, Homo sapiens
ucauggacguggccuauca

SEQ ID NO: 1077790 - RNA, 19 nt, Homo sapiens
guccugggcccuuaucuuu

SEQ ID NO: 1077791 - RNA, 19 nt, Homo sapiens
gcucgcugccuccuucaua

SEQ ID NO: 1077792 - RNA, 19 nt, Homo sapiens
caagcgagcagccaccaaa

SEQ ID NO: 1077793 - RNA, 19 nt, Homo sapiens
gggaguaccuggcguuucc

SEQ ID NO: 1077794 - RNA, 19 nt, Homo sapiens
gcccuuaucuuuccaugcu

SEQ ID NO: 1077795 - RNA, 19 nt, Homo sapiens
ggccccagaucaaaauuua

SEQ ID NO: 1077796 - RNA, 19 nt, Homo sapiens
aggccgagguggaagaauu

SEQ ID NO: 1077797 - RNA, 19 nt, Homo sapiens
gcacaccucaggaccaaag

SEQ ID NO: 1077798 - RNA, 19 nt, Homo sapiens
ggaaggccgagguggaaga

SEQ ID NO: 1077799 - RNA, 19 nt, Homo sapiens
cgucgucuguggagauuuc

SEQ ID NO: 1077800 - RNA, 19 nt, Homo sapiens
gacguggccuaucacuguu

SEQ ID NO: 1077801 - RNA, 19 nt, Homo sapiens
ugcaggagguguuugacaa

SEQ ID NO: 1077802 - RNA, 19 nt, Homo sapiens
cagccucuguggaguacaa

SEQ ID NO: 1077803 - RNA, 19 nt, Homo sapiens
ggacacgaacggccuguac

SEQ ID NO: 1077804 - RNA, 19 nt, Homo sapiens
cgacgaggccuucgaccau

SEQ ID NO: 1077805 - RNA, 19 nt, Homo sapiens
gaaggccgagguggaagaa

SEQ ID NO: 1077806 - RNA, 19 nt, Homo sapiens
caagagcucgggccagaag

SEQ ID NO: 1077807 - RNA, 19 nt, Homo sapiens
caaagaaucgucggguaca

SEQ ID NO: 1077808 - RNA, 19 nt, Homo sapiens
aagcacaccucaggaccaa

SEQ ID NO: 1077809 - RNA, 19 nt, Homo sapiens
gagcucuguuucucaaggu

SEQ ID NO: 1077810 - RNA, 19 nt, Homo sapiens
ggacuggcuggcugauuuc

SEQ ID NO: 1077811 - RNA, 19 nt, Homo sapiens
ugaggucuccgccuucuuc

SEQ ID NO: 1077812 - RNA, 19 nt, Homo sapiens
ggagaucgggcagagaauc

SEQ ID NO: 1077813 - RNA, 19 nt, Homo sapiens
auucacggcuggaagacaa

SEQ ID NO: 1077814 - RNA, 19 nt, Homo sapiens
gcagcugcacggcuacuuc

SEQ ID NO: 1077815 - RNA, 19 nt, Homo sapiens
cgagcagccaccaaauuga

SEQ ID NO: 1077816 - RNA, 19 nt, Homo sapiens
aggccucgguggugaagaa

SEQ ID NO: 1077817 - RNA, 19 nt, Homo sapiens
aaggagaucgggcagagaa

SEQ ID NO: 1077818 - RNA, 19 nt, Homo sapiens
caucauggacguggccuau

SEQ ID NO: 1077819 - RNA, 19 nt, Homo sapiens
agggagcucuguuucucaa

SEQ ID NO: 1077820 - RNA, 19 nt, Homo sapiens
gcaggagguguuugacaag

SEQ ID NO: 1077821 - RNA, 19 nt, Homo sapiens
gcagaagguccuggagagu

SEQ ID NO: 1077822 - RNA, 19 nt, Homo sapiens
gcaagagcucgggccagaa

SEQ ID NO: 1077823 - RNA, 19 nt, Homo sapiens
gaacggccuguacgaugag

SEQ ID NO: 1077824 - RNA, 19 nt, Homo sapiens
uguccgcccugcacugugu

SEQ ID NO: 1077825 - RNA, 19 nt, Homo sapiens
uguguguccugggcccuua

SEQ ID NO: 1077826 - RNA, 19 nt, Homo sapiens
uguggagauuucaacuuug

SEQ ID NO: 1077827 - RNA, 19 nt, Homo sapiens
gaggagcugguggcauuug

SEQ ID NO: 1077828 - RNA, 19 nt, Homo sapiens
ccagacgcccaaccauaau

SEQ ID NO: 1077829 - RNA, 19 nt, Homo sapiens
ggcagagaauccgcaaugg

SEQ ID NO: 1077830 - RNA, 19 nt, Homo sapiens
gccagggucaacaaccuuu

SEQ ID NO: 1077831 - RNA, 19 nt, Homo sapiens
ggaaagagaucuccauggu

SEQ ID NO: 1077832 - RNA, 19 nt, Homo sapiens
ugaaaugacuucucucuug

SEQ ID NO: 1077833 - RNA, 19 nt, Homo sapiens
gguccuagaugucuucuuu

SEQ ID NO: 1077834 - RNA, 19 nt, Homo sapiens
ccaaugagcucacccacuu

SEQ ID NO: 1077835 - RNA, 19 nt, Homo sapiens
cugaauacauccauuguuu

SEQ ID NO: 1077836 - RNA, 19 nt, Homo sapiens
caacuucucuguggucuau

SEQ ID NO: 1077837 - RNA, 19 nt, Homo sapiens
ggaguuugcuguggcagua

SEQ ID NO: 1077838 - RNA, 19 nt, Homo sapiens
gagcuggccuggcuggaaa

SEQ ID NO: 1077839 - RNA, 19 nt, Homo sapiens
ggucugggcuucucaucuu

SEQ ID NO: 1077840 - RNA, 19 nt, Homo sapiens
cuuaagagcugcaacuuca

SEQ ID NO: 1077841 - RNA, 19 nt, Homo sapiens
caggagaccuuccagacuu

SEQ ID NO: 1077842 - RNA, 19 nt, Homo sapiens
ggagcccucuguacauuug

SEQ ID NO: 1077843 - RNA, 19 nt, Homo sapiens
auacauccauuguuucuga

SEQ ID NO: 1077844 - RNA, 19 nt, Homo sapiens
ggacugaauacauccauug

SEQ ID NO: 1077845 - RNA, 19 nt, Homo sapiens
ggacggugcugugacugaa

SEQ ID NO: 1077846 - RNA, 19 nt, Homo sapiens
cagaugggccuguucauug

SEQ ID NO: 1077847 - RNA, 19 nt, Homo sapiens
gcugucacccucugcaaua

SEQ ID NO: 1077848 - RNA, 19 nt, Homo sapiens
caaauuugcugaggaggau

SEQ ID NO: 1077849 - RNA, 19 nt, Homo sapiens
gagaccaucugcccaccaa

SEQ ID NO: 1077850 - RNA, 19 nt, Homo sapiens
gcaguggccuggagaucau

SEQ ID NO: 1077851 - RNA, 19 nt, Homo sapiens
gaauacauccauuguuucu

SEQ ID NO: 1077852 - RNA, 19 nt, Homo sapiens
gauccucgacuacaucuau

SEQ ID NO: 1077853 - RNA, 19 nt, Homo sapiens
caccaaauaucuacaucga

SEQ ID NO: 1077854 - RNA, 19 nt, Homo sapiens
cccaggaggucucuuugaa

SEQ ID NO: 1077855 - RNA, 19 nt, Homo sapiens
cccagagccugacauggua

SEQ ID NO: 1077856 - RNA, 19 nt, Homo sapiens
gaucgagauugugugcaaa

SEQ ID NO: 1077857 - RNA, 19 nt, Homo sapiens
cgaucgagauugugugcaa

SEQ ID NO: 1077858 - RNA, 19 nt, Homo sapiens
gguugagccuuagcccaua

SEQ ID NO: 1077859 - RNA, 19 nt, Homo sapiens
gaacuuccugguccuagau

SEQ ID NO: 1077860 - RNA, 19 nt, Homo sapiens
ccacucuucuccucacugu

SEQ ID NO: 1077861 - RNA, 19 nt, Homo sapiens
gaacaggugaggacaagcu

SEQ ID NO: 1077862 - RNA, 19 nt, Homo sapiens
guauggaggcgucccaaga

SEQ ID NO: 1077863 - RNA, 19 nt, Homo sapiens
agacaaaugagacgucguu

SEQ ID NO: 1077864 - RNA, 19 nt, Homo sapiens
uggccuggcuggaaaguca

SEQ ID NO: 1077865 - RNA, 19 nt, Homo sapiens
gggccagcauccucacguu

SEQ ID NO: 1077866 - RNA, 19 nt, Homo sapiens
uccuagaugucuucuuuga

SEQ ID NO: 1077867 - RNA, 19 nt, Homo sapiens
gguacagacacuuggguaa

SEQ ID NO: 1077868 - RNA, 19 nt, Homo sapiens
gggcagcugggcaugguaa

SEQ ID NO: 1077869 - RNA, 19 nt, Homo sapiens
ggagauccucgacuacauc

SEQ ID NO: 1077870 - RNA, 19 nt, Homo sapiens
gaccaucugcccaccaaau

SEQ ID NO: 1077871 - RNA, 19 nt, Homo sapiens
gaggacaagcucuaaaugc

SEQ ID NO: 1077872 - RNA, 19 nt, Homo sapiens
gcaacgagaccuacauacg

SEQ ID NO: 1077873 - RNA, 19 nt, Homo sapiens
ccgcaacgagaccuacaua

SEQ ID NO: 1077874 - RNA, 19 nt, Homo sapiens
ccuccagucugauuuuaua

SEQ ID NO: 1077875 - RNA, 19 nt, Homo sapiens
gcaggagaccuuccagacu

SEQ ID NO: 1077876 - RNA, 19 nt, Homo sapiens
gggcucagagucaggagaa

SEQ ID NO: 1077877 - RNA, 19 nt, Homo sapiens
ggagaacuuccugguccua

SEQ ID NO: 1077878 - RNA, 19 nt, Homo sapiens
ggaaguacaaccgcaacga

SEQ ID NO: 1077879 - RNA, 19 nt, Homo sapiens
ucaugucucuguccacucu

SEQ ID NO: 1077880 - RNA, 19 nt, Homo sapiens
gugaggacaagcucuaaau

SEQ ID NO: 1077881 - RNA, 19 nt, Homo sapiens
gcugugcuggugcugauaa

SEQ ID NO: 1077882 - RNA, 19 nt, Homo sapiens
cuacaggggugggugauuu

SEQ ID NO: 1077883 - RNA, 19 nt, Homo sapiens
ggaaaggcuggcgguguga

SEQ ID NO: 1077884 - RNA, 19 nt, Homo sapiens
guacagacacuuggguaag

SEQ ID NO: 1077885 - RNA, 19 nt, Homo sapiens
gucacccucugcaauauca

SEQ ID NO: 1077886 - RNA, 19 nt, Homo sapiens
gugcugggcugguccuacu

SEQ ID NO: 1077887 - RNA, 19 nt, Homo sapiens
ggagggccaggacucaguu

SEQ ID NO: 1077888 - RNA, 19 nt, Homo sapiens
gacagaugccgaucgagau

SEQ ID NO: 1077889 - RNA, 19 nt, Homo sapiens
cgcauucuccagaccuuua

SEQ ID NO: 1077890 - RNA, 19 nt, Homo sapiens
ggugaggacaagcucuaaa

SEQ ID NO: 1077891 - RNA, 19 nt, Homo sapiens
agaacuuccugguccuaga

SEQ ID NO: 1077892 - RNA, 19 nt, Homo sapiens
aggaguaccugcccaucug

SEQ ID NO: 1077893 - RNA, 19 nt, Homo sapiens
gggagcccucuguacauuu

SEQ ID NO: 1077894 - RNA, 19 nt, Homo sapiens
ugcccgaggugacaaggaa

SEQ ID NO: 1077895 - RNA, 19 nt, Homo sapiens
guccugggaucgacugaag

SEQ ID NO: 1077896 - RNA, 19 nt, Homo sapiens
cgaaacccaaggagaagga

SEQ ID NO: 1077897 - RNA, 19 nt, Homo sapiens
ugccugaucugcaguucau

SEQ ID NO: 1077898 - RNA, 19 nt, Homo sapiens
gcuacucggccuacagugu

SEQ ID NO: 1077899 - RNA, 19 nt, Homo sapiens
gcuuaagagcugcaacuuc

SEQ ID NO: 1077900 - RNA, 19 nt, Homo sapiens
ugaauacauccauuguuuc

SEQ ID NO: 1077901 - RNA, 19 nt, Homo sapiens
ugaggacaagcucuaaaug

SEQ ID NO: 1077902 - RNA, 19 nt, Homo sapiens
caggugaggacaagcucua

SEQ ID NO: 1077903 - RNA, 19 nt, Homo sapiens
acagaugccgaucgagauu

SEQ ID NO: 1077904 - RNA, 19 nt, Homo sapiens
ugcuggagauccucgacua

SEQ ID NO: 1077905 - RNA, 19 nt, Homo sapiens
agaugggccuguucauugg

SEQ ID NO: 1077906 - RNA, 19 nt, Homo sapiens
gaggaguaccugcccaucu

SEQ ID NO: 1077907 - RNA, 19 nt, Homo sapiens
ccagcucgccgacaugcuu

SEQ ID NO: 1077908 - RNA, 19 nt, Homo sapiens
ccaccuggccaaucugaca

SEQ ID NO: 1077909 - RNA, 19 nt, Homo sapiens
cuacauacgggagaacuuc

SEQ ID NO: 1077910 - RNA, 19 nt, Homo sapiens
ucuccucacugucuuggau

SEQ ID NO: 1077911 - RNA, 19 nt, Homo sapiens
ccaucagccucuucauguc

SEQ ID NO: 1077912 - RNA, 19 nt, Homo sapiens
cagcucgccgacaugcuua

SEQ ID NO: 1077913 - RNA, 19 nt, Homo sapiens
cuaggacggugcugugacu

SEQ ID NO: 1077914 - RNA, 19 nt, Homo sapiens
cgacugaagcggguaugga

SEQ ID NO: 1077915 - RNA, 19 nt, Homo sapiens
ucacguugcuggagauccu

SEQ ID NO: 1077916 - RNA, 19 nt, Homo sapiens
gagcagcgagcagccuaug

SEQ ID NO: 1077917 - RNA, 19 nt, Homo sapiens
ccaucuauccauccauuca

SEQ ID NO: 1077918 - RNA, 19 nt, Homo sapiens
caaugagcucacccacuuu

SEQ ID NO: 1077919 - RNA, 19 nt, Homo sapiens
caucugcccaccaaauauc

SEQ ID NO: 1077920 - RNA, 19 nt, Homo sapiens
uaagagcugcaacuucagu

SEQ ID NO: 1077921 - RNA, 19 nt, Homo sapiens
ggggagcccucuguacauu

SEQ ID NO: 1077922 - RNA, 19 nt, Homo sapiens
ugaaaggacccaggagucu

SEQ ID NO: 1077923 - RNA, 19 nt, Homo sapiens
gaucgaggagagagacaag

SEQ ID NO: 1077924 - RNA, 19 nt, Homo sapiens
ccgcuugcccugaguuuag

SEQ ID NO: 1077925 - RNA, 19 nt, Homo sapiens
ucacgcuucuccucaacca

SEQ ID NO: 1077926 - RNA, 19 nt, Homo sapiens
agaugccgaucgagauugu

SEQ ID NO: 1077927 - RNA, 19 nt, Homo sapiens
agaccuacauacgggagaa

SEQ ID NO: 1077928 - RNA, 19 nt, Homo sapiens
cuccagaccuuuacaaccu

SEQ ID NO: 1077929 - RNA, 19 nt, Homo sapiens
auucaucgauucgcgcauu

SEQ ID NO: 1077930 - RNA, 19 nt, Homo sapiens
gugaaaugacuucucucuu

SEQ ID NO: 1077931 - RNA, 19 nt, Homo sapiens
gcagagagguaccaucuug

SEQ ID NO: 1077932 - RNA, 19 nt, Homo sapiens
ucaaggagcuacugaauau

SEQ ID NO: 1077933 - RNA, 19 nt, Homo sapiens
gaaagcaccauuaaggaua

SEQ ID NO: 1077934 - RNA, 19 nt, Homo sapiens
gaaacccugucucuacuaa

SEQ ID NO: 1077935 - RNA, 19 nt, Homo sapiens
caucugcccucuaaacuuu

SEQ ID NO: 1077936 - RNA, 19 nt, Homo sapiens
gcaggucacuugccacaau

SEQ ID NO: 1077937 - RNA, 19 nt, Homo sapiens
uuagaaagcuggagguguu

SEQ ID NO: 1077938 - RNA, 19 nt, Homo sapiens
ggagaaagcaccauuaagg

SEQ ID NO: 1077939 - RNA, 19 nt, Homo sapiens
guauguaccuuagcuguga

SEQ ID NO: 1077940 - RNA, 19 nt, Homo sapiens
ggagauggauauggugaga

SEQ ID NO: 1077941 - RNA, 19 nt, Homo sapiens
gaagaguagaaucacuuua

SEQ ID NO: 1077942 - RNA, 19 nt, Homo sapiens
ucuggucucuguaagcuua

SEQ ID NO: 1077943 - RNA, 19 nt, Homo sapiens
gagaaagcaccauuaagga

SEQ ID NO: 1077944 - RNA, 19 nt, Homo sapiens
guuuaucacuucucaagga

SEQ ID NO: 1077945 - RNA, 19 nt, Homo sapiens
uacagugucuggcgggaua

SEQ ID NO: 1077946 - RNA, 19 nt, Homo sapiens
agagguaccaucuugauuu

SEQ ID NO: 1077947 - RNA, 19 nt, Homo sapiens
gggauaaugcagagaggua

SEQ ID NO: 1077948 - RNA, 19 nt, Homo sapiens
aaagcaccauuaaggauau

SEQ ID NO: 1077949 - RNA, 19 nt, Homo sapiens
gcauggaggacaguaauga

SEQ ID NO: 1077950 - RNA, 19 nt, Homo sapiens
gcugggagauggauauggu

SEQ ID NO: 1077951 - RNA, 19 nt, Homo sapiens
gcgaaacccugucucuacu

SEQ ID NO: 1077952 - RNA, 19 nt, Homo sapiens
aauugcaucugcccucuaa

SEQ ID NO: 1077953 - RNA, 19 nt, Homo sapiens
guggagaccucagaaaugg

SEQ ID NO: 1077954 - RNA, 19 nt, Homo sapiens
gaaagcuggagguguuuau

SEQ ID NO: 1077955 - RNA, 19 nt, Homo sapiens
gagguaccaucuugauuuu

SEQ ID NO: 1077956 - RNA, 19 nt, Homo sapiens
gguggugugugccuauaau

SEQ ID NO: 1077957 - RNA, 19 nt, Homo sapiens
gagagguaccaucuugauu

SEQ ID NO: 1077958 - RNA, 19 nt, Homo sapiens
gguggagaccucagaaaug

SEQ ID NO: 1077959 - RNA, 19 nt, Homo sapiens
uagcugcaccugcuuuauu

SEQ ID NO: 1077960 - RNA, 19 nt, Homo sapiens
ugaggcaggagaauucuuu

SEQ ID NO: 1077961 - RNA, 19 nt, Homo sapiens
caccuggucuggucucugu

SEQ ID NO: 1077962 - RNA, 19 nt, Homo sapiens
uccuagacaugaaugcaua

SEQ ID NO: 1077963 - RNA, 19 nt, Homo sapiens
agauggauauggugagaug

SEQ ID NO: 1077964 - RNA, 19 nt, Homo sapiens
cauuaaggauauaccuaug

SEQ ID NO: 1077965 - RNA, 19 nt, Homo sapiens
gcuuagaagaguagaauca

SEQ ID NO: 1077966 - RNA, 19 nt, Homo sapiens
ucuguaagcuuagaagagu

SEQ ID NO: 1077967 - RNA, 19 nt, Homo sapiens
caggucacuugccacaauu

SEQ ID NO: 1077968 - RNA, 19 nt, Homo sapiens
ccauuaaggauauaccuau

SEQ ID NO: 1077969 - RNA, 19 nt, Homo sapiens
gcaucugcccucuaaacuu

SEQ ID NO: 1077970 - RNA, 19 nt, Homo sapiens
cagggagaaagcaccauua

SEQ ID NO: 1077971 - RNA, 19 nt, Homo sapiens
uagaagaguagaaucacuu

SEQ ID NO: 1077972 - RNA, 19 nt, Homo sapiens
gggaggauguuagaaagcu

SEQ ID NO: 1077973 - RNA, 19 nt, Homo sapiens
ggcgaaacccugucucuac

SEQ ID NO: 1077974 - RNA, 19 nt, Homo sapiens
uauagcugcaccugcuuua

SEQ ID NO: 1077975 - RNA, 19 nt, Homo sapiens
agaaagcaccauuaaggau

SEQ ID NO: 1077976 - RNA, 19 nt, Homo sapiens
gaaggcauggaggacagua

SEQ ID NO: 1077977 - RNA, 19 nt, Homo sapiens
cgaaacccugucucuacua

SEQ ID NO: 1077978 - RNA, 19 nt, Homo sapiens
agaagaguagaaucacuuu

SEQ ID NO: 1077979 - RNA, 19 nt, Homo sapiens
ggucuggucucuguaagcu

SEQ ID NO: 1077980 - RNA, 19 nt, Homo sapiens
ggagguguuuaucacuucu

SEQ ID NO: 1077981 - RNA, 19 nt, Homo sapiens
gugguggugugugccuaua

SEQ ID NO: 1077982 - RNA, 19 nt, Homo sapiens
agaaauggucugcuacaca

SEQ ID NO: 1077983 - RNA, 19 nt, Homo sapiens
gaugcugggagauggauau

SEQ ID NO: 1077984 - RNA, 19 nt, Homo sapiens
caaggagcuacugaauaua

SEQ ID NO: 1077985 - RNA, 19 nt, Homo sapiens
ccagggagaaagcaccauu

SEQ ID NO: 1077986 - RNA, 19 nt, Homo sapiens
cucaaggagcuacugaaua

SEQ ID NO: 1077987 - RNA, 19 nt, Homo sapiens
agggagaaagcaccauuaa

SEQ ID NO: 1077988 - RNA, 19 nt, Homo sapiens
ggcaggagaauucuuuuaa

SEQ ID NO: 1077989 - RNA, 19 nt, Homo sapiens
gaugguggagaccucagaa

SEQ ID NO: 1077990 - RNA, 19 nt, Homo sapiens
aagcaccauuaaggauaua

SEQ ID NO: 1077991 - RNA, 19 nt, Homo sapiens
gggagaaagcaccauuaag

SEQ ID NO: 1077992 - RNA, 19 nt, Homo sapiens
agacaagcccagggagaaa

SEQ ID NO: 1077993 - RNA, 19 nt, Homo sapiens
aaggagcuacugaauauag

SEQ ID NO: 1077994 - RNA, 19 nt, Homo sapiens
cuggagguguuuaucacuu

SEQ ID NO: 1077995 - RNA, 19 nt, Homo sapiens
uuuauuggcaggucacuug

SEQ ID NO: 1077996 - RNA, 19 nt, Homo sapiens
uggagguguuuaucacuuc

SEQ ID NO: 1077997 - RNA, 19 nt, Homo sapiens
gcaggagaauucuuuuaac

SEQ ID NO: 1077998 - RNA, 19 nt, Homo sapiens
gugguucacgccuguaaug

SEQ ID NO: 1077999 - RNA, 19 nt, Homo sapiens
agcugcaccugcuuuauug

SEQ ID NO: 1078000 - RNA, 19 nt, Homo sapiens
cacaggcacuaggucaguu

SEQ ID NO: 1078001 - RNA, 19 nt, Homo sapiens
ccuguaaugccagcacuuu

SEQ ID NO: 1078002 - RNA, 19 nt, Homo sapiens
gauauaccuaugccagcuu

SEQ ID NO: 1078003 - RNA, 19 nt, Homo sapiens
agaaagcuggagguguuua

SEQ ID NO: 1078004 - RNA, 19 nt, Homo sapiens
ucucaaggagcuacugaau

SEQ ID NO: 1078005 - RNA, 19 nt, Homo sapiens
gcaaggugcugauauuauu

SEQ ID NO: 1078006 - RNA, 19 nt, Homo sapiens
gaauggagcucgacuggaa

SEQ ID NO: 1078007 - RNA, 19 nt, Homo sapiens
gaaaggaacagucuucaga

SEQ ID NO: 1078008 - RNA, 19 nt, Homo sapiens
gaauagcggcucaaaugua

SEQ ID NO: 1078009 - RNA, 19 nt, Homo sapiens
gggaggagaucaauacaau

SEQ ID NO: 1078010 - RNA, 19 nt, Homo sapiens
ucagauggguuaagauuga

SEQ ID NO: 1078011 - RNA, 19 nt, Homo sapiens
gggaauagcggcucaaaug

SEQ ID NO: 1078012 - RNA, 19 nt, Homo sapiens
ugagauggcagucgaaaua

SEQ ID NO: 1078013 - RNA, 19 nt, Homo sapiens
ggccaaaguuacauaauuc

SEQ ID NO: 1078014 - RNA, 19 nt, Homo sapiens
ugaggucugucuuugcuua

SEQ ID NO: 1078015 - RNA, 19 nt, Homo sapiens
gagcucgacuggaaaggaa

SEQ ID NO: 1078016 - RNA, 19 nt, Homo sapiens
gaggagaucaauacaauuc

SEQ ID NO: 1078017 - RNA, 19 nt, Homo sapiens
uaaaucauccugcuuucaa

SEQ ID NO: 1078018 - RNA, 19 nt, Homo sapiens
uaaagugaauugagaacag

SEQ ID NO: 1078019 - RNA, 19 nt, Homo sapiens
gcacucauccaucaaucaa

SEQ ID NO: 1078020 - RNA, 19 nt, Homo sapiens
ugucuuugcuuaaccuauu

SEQ ID NO: 1078021 - RNA, 19 nt, Homo sapiens
ggaauagcggcucaaaugu

SEQ ID NO: 1078022 - RNA, 19 nt, Homo sapiens
aggccaaaguuacauaauu

SEQ ID NO: 1078023 - RNA, 19 nt, Homo sapiens
gaucauaaagugaauugag

SEQ ID NO: 1078024 - RNA, 19 nt, Homo sapiens
ggaggaucauaaagugaau

SEQ ID NO: 1078025 - RNA, 19 nt, Homo sapiens
gggaggaucauaaagugaa

SEQ ID NO: 1078026 - RNA, 19 nt, Homo sapiens
gaugggaggaucauaaagu

SEQ ID NO: 1078027 - RNA, 19 nt, Homo sapiens
aauagcggcucaaauguag

SEQ ID NO: 1078028 - RNA, 19 nt, Homo sapiens
aaugaggcauggacagaaa

SEQ ID NO: 1078029 - RNA, 19 nt, Homo sapiens
caaggugcugauauuauuu

SEQ ID NO: 1078030 - RNA, 19 nt, Homo sapiens
uuuaugggauuuacucaug

SEQ ID NO: 1078031 - RNA, 19 nt, Homo sapiens
gaaaauauaccccucacau

SEQ ID NO: 1078032 - RNA, 19 nt, Homo sapiens
ggaggagaucaauacaauu

SEQ ID NO: 1078033 - RNA, 19 nt, Homo sapiens
gagcaccguccuucaacaa

SEQ ID NO: 1078034 - RNA, 19 nt, Homo sapiens
guaaugaggcauggacaga

SEQ ID NO: 1078035 - RNA, 19 nt, Homo sapiens
aaggaacagucuucagaug

SEQ ID NO: 1078036 - RNA, 19 nt, Homo sapiens
ugccagcacucauccauca

SEQ ID NO: 1078037 - RNA, 19 nt, Homo sapiens
uaaccuauucaaccagaaa

SEQ ID NO: 1078038 - RNA, 19 nt, Homo sapiens
ucaaucacccacaaggaaa

SEQ ID NO: 1078039 - RNA, 19 nt, Homo sapiens
gguuauuaggccaaaguua

SEQ ID NO: 1078040 - RNA, 19 nt, Homo sapiens
ucacaucaucggauugaga

SEQ ID NO: 1078041 - RNA, 19 nt, Homo sapiens
cugcuccaauccaggguua

SEQ ID NO: 1078042 - RNA, 19 nt, Homo sapiens
acucauccaucaaucaauc

SEQ ID NO: 1078043 - RNA, 19 nt, Homo sapiens
aauaaaucauccugcuuuc

SEQ ID NO: 1078044 - RNA, 19 nt, Homo sapiens
guuauuaggccaaaguuac

SEQ ID NO: 1078045 - RNA, 19 nt, Homo sapiens
cuucagauggguuaagauu

SEQ ID NO: 1078046 - RNA, 19 nt, Homo sapiens
cagucgaaauagcuucauu

SEQ ID NO: 1078047 - RNA, 19 nt, Homo sapiens
aaagugaauugagaacagu

SEQ ID NO: 1078048 - RNA, 19 nt, Homo sapiens
gucgaaauagcuucauuga

SEQ ID NO: 1078049 - RNA, 19 nt, Homo sapiens
cagauggguuaagauugaa

SEQ ID NO: 1078050 - RNA, 19 nt, Homo sapiens
gcuccaauccaggguuauu

SEQ ID NO: 1078051 - RNA, 19 nt, Homo sapiens
ggaaaggaacagucuucag

SEQ ID NO: 1078052 - RNA, 19 nt, Homo sapiens
cagcacucauccaucaauc

SEQ ID NO: 1078053 - RNA, 19 nt, Homo sapiens
ccuauucaaccagaaauga

SEQ ID NO: 1078054 - RNA, 19 nt, Homo sapiens
ggauuuacucaugggcaua

SEQ ID NO: 1078055 - RNA, 19 nt, Homo sapiens
ggagcucgacuggaaagga

SEQ ID NO: 1078056 - RNA, 19 nt, Homo sapiens
cggcucaaauguaguucug

SEQ ID NO: 1078057 - RNA, 19 nt, Homo sapiens
gagauggcagucgaaauag

SEQ ID NO: 1078058 - RNA, 19 nt, Homo sapiens
ccaggguuauuaggccaaa

SEQ ID NO: 1078059 - RNA, 19 nt, Homo sapiens
aaaggaacagucuucagau

SEQ ID NO: 1078060 - RNA, 19 nt, Homo sapiens
gaggucugucuuugcuuaa

SEQ ID NO: 1078061 - RNA, 19 nt, Homo sapiens
ccucacaucaucggauuga

SEQ ID NO: 1078062 - RNA, 19 nt, Homo sapiens
guucugacaugaaaagcaa

SEQ ID NO: 1078063 - RNA, 19 nt, Homo sapiens
gccaaaguuacauaauuca

SEQ ID NO: 1078064 - RNA, 19 nt, Homo sapiens
uaaugaggcauggacagaa

SEQ ID NO: 1078065 - RNA, 19 nt, Homo sapiens
uagcggcucaaauguaguu

SEQ ID NO: 1078066 - RNA, 19 nt, Homo sapiens
cuucaacaaggaaauucua

SEQ ID NO: 1078067 - RNA, 19 nt, Homo sapiens
ugagcaccguccuucaaca

SEQ ID NO: 1078068 - RNA, 19 nt, Homo sapiens
gaaaugagccaucaaguga

SEQ ID NO: 1078069 - RNA, 19 nt, Homo sapiens
ugaauuggcucaguauuua

SEQ ID NO: 1078070 - RNA, 19 nt, Homo sapiens
gaagaacuauccuguuaga

SEQ ID NO: 1078071 - RNA, 19 nt, Homo sapiens
gauguuagcuguccugcaa

SEQ ID NO: 1078072 - RNA, 19 nt, Homo sapiens
agaagcagguuugaaauua

SEQ ID NO: 1078073 - RNA, 19 nt, Homo sapiens
ucacagaauucccucauuu

SEQ ID NO: 1078074 - RNA, 19 nt, Homo sapiens
gaccauagcuuugcuggaa

SEQ ID NO: 1078075 - RNA, 19 nt, Homo sapiens
gaagcagguuugaaauuau

SEQ ID NO: 1078076 - RNA, 19 nt, Homo sapiens
gagcuggucuuccauuaug

SEQ ID NO: 1078077 - RNA, 19 nt, Homo sapiens
ugacgugucccuauuaaua

SEQ ID NO: 1078078 - RNA, 19 nt, Homo sapiens
gcaaagaggcugguucuga

SEQ ID NO: 1078079 - RNA, 19 nt, Homo sapiens
gagugaauguguuagaauu

SEQ ID NO: 1078080 - RNA, 19 nt, Homo sapiens
ggucagucauauacaauaa

SEQ ID NO: 1078081 - RNA, 19 nt, Homo sapiens
gagcugcauugaugaauug

SEQ ID NO: 1078082 - RNA, 19 nt, Homo sapiens
gcagugucauaccaaauaa

SEQ ID NO: 1078083 - RNA, 19 nt, Homo sapiens
acucauaccuucuguuuga

SEQ ID NO: 1078084 - RNA, 19 nt, Homo sapiens
ccaaacagccuauugaaau

SEQ ID NO: 1078085 - RNA, 19 nt, Homo sapiens
gaacacagacacagcuuau

SEQ ID NO: 1078086 - RNA, 19 nt, Homo sapiens
ugaaaucuauggcccugua

SEQ ID NO: 1078087 - RNA, 19 nt, Homo sapiens
gaugauagcaugaccauag

SEQ ID NO: 1078088 - RNA, 19 nt, Homo sapiens
gcaaagagcacaggacuca

SEQ ID NO: 1078089 - RNA, 19 nt, Homo sapiens
uaaacucaaugcacagaaa

SEQ ID NO: 1078090 - RNA, 19 nt, Homo sapiens
gaagaugucuauggaugug

SEQ ID NO: 1078091 - RNA, 19 nt, Homo sapiens
ggagcugcauugaugaauu

SEQ ID NO: 1078092 - RNA, 19 nt, Homo sapiens
ugagauacacagcaaguua

SEQ ID NO: 1078093 - RNA, 19 nt, Homo sapiens
caaacagccuauugaaauc

SEQ ID NO: 1078094 - RNA, 19 nt, Homo sapiens
cuaaagagugaauguguua

SEQ ID NO: 1078095 - RNA, 19 nt, Homo sapiens
ugacaugucugugaauaug

SEQ ID NO: 1078096 - RNA, 19 nt, Homo sapiens
gaaaagaaacgcccaggua

SEQ ID NO: 1078097 - RNA, 19 nt, Homo sapiens
gguggaagaugucuaugga

SEQ ID NO: 1078098 - RNA, 19 nt, Homo sapiens
ugaguggaauuacuaggua

SEQ ID NO: 1078099 - RNA, 19 nt, Homo sapiens
agaagugacucuagcagaa

SEQ ID NO: 1078100 - RNA, 19 nt, Homo sapiens
gcaaaguugugccgugcaa

SEQ ID NO: 1078101 - RNA, 19 nt, Homo sapiens
ucaauguccugcagaagaa

SEQ ID NO: 1078102 - RNA, 19 nt, Homo sapiens
ccauagcuuugcuggaaua

SEQ ID NO: 1078103 - RNA, 19 nt, Homo sapiens
ggacaggcaggauugauga

SEQ ID NO: 1078104 - RNA, 19 nt, Homo sapiens
gcaaguuaguuuauacucu

SEQ ID NO: 1078105 - RNA, 19 nt, Homo sapiens
ccacagauagccaauauuc

SEQ ID NO: 1078106 - RNA, 19 nt, Homo sapiens
gauaagcauuccaaucaag

SEQ ID NO: 1078107 - RNA, 19 nt, Homo sapiens
ggucuuccauuaugugguu

SEQ ID NO: 1078108 - RNA, 19 nt, Homo sapiens
gcagggauaagggauguua

SEQ ID NO: 1078109 - RNA, 19 nt, Homo sapiens
gcagggagaauuaccaaga

SEQ ID NO: 1078110 - RNA, 19 nt, Homo sapiens
uagcuguccugcaaaguuu

SEQ ID NO: 1078111 - RNA, 19 nt, Homo sapiens
uuggcuagguguuuauuua

SEQ ID NO: 1078112 - RNA, 19 nt, Homo sapiens
gggcuccucugcacaauca

SEQ ID NO: 1078113 - RNA, 19 nt, Homo sapiens
gaacaaggaagaacuaucc

SEQ ID NO: 1078114 - RNA, 19 nt, Homo sapiens
gguuugaaauuauggguau

SEQ ID NO: 1078115 - RNA, 19 nt, Homo sapiens
uaccacagauagccaauau

SEQ ID NO: 1078116 - RNA, 19 nt, Homo sapiens
ggaacacagacacagcuua

SEQ ID NO: 1078117 - RNA, 19 nt, Homo sapiens
acagauggcagcaacauuu

SEQ ID NO: 1078118 - RNA, 19 nt, Homo sapiens
acacugacaugucugugaa

SEQ ID NO: 1078119 - RNA, 19 nt, Homo sapiens
gacgugucccuauuaauaa

SEQ ID NO: 1078120 - RNA, 19 nt, Homo sapiens
gaauugcagugucauacca

SEQ ID NO: 1078121 - RNA, 19 nt, Homo sapiens
acacagacacagcuuauga

SEQ ID NO: 1078122 - RNA, 19 nt, Homo sapiens
aguguuagaucuccaagaa

SEQ ID NO: 1078123 - RNA, 19 nt, Homo sapiens
caaagaggaacaaggaaga

SEQ ID NO: 1078124 - RNA, 19 nt, Homo sapiens
uaagucaaauccuaaagag

SEQ ID NO: 1078125 - RNA, 19 nt, Homo sapiens
guaagucaaauccuaaaga

SEQ ID NO: 1078126 - RNA, 19 nt, Homo sapiens
ggguuuggcuagguguuua

SEQ ID NO: 1078127 - RNA, 19 nt, Homo sapiens
agaaacagauggcauugca

SEQ ID NO: 1078128 - RNA, 19 nt, Homo sapiens
ucaaugcacagaaacuuaa

SEQ ID NO: 1078129 - RNA, 19 nt, Homo sapiens
cacagcaaguuaguuuaua

SEQ ID NO: 1078130 - RNA, 19 nt, Homo sapiens
gaggaacaaggaagaacua

SEQ ID NO: 1078131 - RNA, 19 nt, Homo sapiens
ucuagaagcagguuugaaa

SEQ ID NO: 1078132 - RNA, 19 nt, Homo sapiens
gaagcaacccuggaugaug

SEQ ID NO: 1078133 - RNA, 19 nt, Homo sapiens
gcauuucgccucuuucaca

SEQ ID NO: 1078134 - RNA, 19 nt, Homo sapiens
cggagcuggucuuccauua

SEQ ID NO: 1078135 - RNA, 19 nt, Homo sapiens
ccuaaagagugaauguguu

SEQ ID NO: 1078136 - RNA, 19 nt, Homo sapiens
ugacacugcucucuagaag

SEQ ID NO: 1078137 - RNA, 19 nt, Homo sapiens
gaauuggcucaguauuuaa

SEQ ID NO: 1078138 - RNA, 19 nt, Homo sapiens
aaagaaacgcccagguaaa

SEQ ID NO: 1078139 - RNA, 19 nt, Homo sapiens
uccauuaugugguucauga

SEQ ID NO: 1078140 - RNA, 19 nt, Homo sapiens
acacggagcuggucuucca

SEQ ID NO: 1078141 - RNA, 19 nt, Homo sapiens
auacacagcaaguuaguuu

SEQ ID NO: 1078142 - RNA, 19 nt, Homo sapiens
ccauugagauacacagcaa

SEQ ID NO: 1078143 - RNA, 19 nt, Homo sapiens
caaauugcaggcccauuga

SEQ ID NO: 1078144 - RNA, 19 nt, Homo sapiens
cuacuacuacugguauuua

SEQ ID NO: 1078145 - RNA, 19 nt, Homo sapiens
guacuacuacuacugguau

SEQ ID NO: 1078146 - RNA, 19 nt, Homo sapiens
cuuaaagcagggagaauua

SEQ ID NO: 1078147 - RNA, 19 nt, Homo sapiens
ucauugacgugucccuauu

SEQ ID NO: 1078148 - RNA, 19 nt, Homo sapiens
caaaagaaaugagccauca

SEQ ID NO: 1078149 - RNA, 19 nt, Homo sapiens
gucaaauccuaaagaguga

SEQ ID NO: 1078150 - RNA, 19 nt, Homo sapiens
uagcuuugcuggaauacug

SEQ ID NO: 1078151 - RNA, 19 nt, Homo sapiens
agacacagcuuaugaaaag

SEQ ID NO: 1078152 - RNA, 19 nt, Homo sapiens
gccaucaagugaagcuuau

SEQ ID NO: 1078153 - RNA, 19 nt, Homo sapiens
ggcgagugcuggcucuuug

SEQ ID NO: 1078154 - RNA, 19 nt, Homo sapiens
uaaaagaauuugcgcaugu

SEQ ID NO: 1078155 - RNA, 19 nt, Homo sapiens
gcaggcccauugagauaca

SEQ ID NO: 1078156 - RNA, 19 nt, Homo sapiens
uagaagcagguuugaaauu

SEQ ID NO: 1078157 - RNA, 19 nt, Homo sapiens
ccacagcacaccacagaug

SEQ ID NO: 1078158 - RNA, 19 nt, Homo sapiens
gaguaaaacugugcuuuga

SEQ ID NO: 1078159 - RNA, 19 nt, Homo sapiens
ggagagggguggaagaugu

SEQ ID NO: 1078160 - RNA, 19 nt, Homo sapiens
gaauuugcgcaugugaaua

SEQ ID NO: 1078161 - RNA, 19 nt, Homo sapiens
ggaagaugucuauggaugu

SEQ ID NO: 1078162 - RNA, 19 nt, Homo sapiens
aagcagguuugaaauuaug

SEQ ID NO: 1078163 - RNA, 19 nt, Homo sapiens
agaaaugucaugagacguu

SEQ ID NO: 1078164 - RNA, 19 nt, Homo sapiens
ggacaaagcaaaggagcau

SEQ ID NO: 1078165 - RNA, 19 nt, Homo sapiens
aagcagaccuguugaucca

SEQ ID NO: 1078166 - RNA, 19 nt, Homo sapiens
ccuguuagacucagaagaa

SEQ ID NO: 1078167 - RNA, 19 nt, Homo sapiens
agggagaaaugucaugaga

SEQ ID NO: 1078168 - RNA, 19 nt, Homo sapiens
gaauaaacauguacuguga

SEQ ID NO: 1078169 - RNA, 19 nt, Homo sapiens
gcaauugacuccucuaaga

SEQ ID NO: 1078170 - RNA, 19 nt, Homo sapiens
gaacagagcaaaguuuaua

SEQ ID NO: 1078171 - RNA, 19 nt, Homo sapiens
gagaggaaaucaucuguuu

SEQ ID NO: 1078172 - RNA, 19 nt, Homo sapiens
caauagagaugaugaaaug

SEQ ID NO: 1078173 - RNA, 19 nt, Homo sapiens
caaguggacuguucacaua

SEQ ID NO: 1078174 - RNA, 19 nt, Homo sapiens
gaauagcacuuuaugaugu

SEQ ID NO: 1078175 - RNA, 19 nt, Homo sapiens
ggaaagauaucgucaagca

SEQ ID NO: 1078176 - RNA, 19 nt, Homo sapiens
caauaaagcugcuaaaguc

SEQ ID NO: 1078177 - RNA, 19 nt, Homo sapiens
guucucagcuaacacauua

SEQ ID NO: 1078178 - RNA, 19 nt, Homo sapiens
gaguagagcuggauuuaau

SEQ ID NO: 1078179 - RNA, 19 nt, Homo sapiens
caacauaguaucugucaua

SEQ ID NO: 1078180 - RNA, 19 nt, Homo sapiens
acacaaaguucucagcuaa

SEQ ID NO: 1078181 - RNA, 19 nt, Homo sapiens
gaagugaggaugccuguuu

SEQ ID NO: 1078182 - RNA, 19 nt, Homo sapiens
ucagacaacuccaaucaaa

SEQ ID NO: 1078183 - RNA, 19 nt, Homo sapiens
caacucaaguagcaaauau

SEQ ID NO: 1078184 - RNA, 19 nt, Homo sapiens
gcaaguuacugcaaugaau

SEQ ID NO: 1078185 - RNA, 19 nt, Homo sapiens
gcgauaaacuacaagaaug

SEQ ID NO: 1078186 - RNA, 19 nt, Homo sapiens
gcugauagcuauguucuug

SEQ ID NO: 1078187 - RNA, 19 nt, Homo sapiens
uagcaaauaucauggagaa

SEQ ID NO: 1078188 - RNA, 19 nt, Homo sapiens
ucaauggucuguuucgaaa

SEQ ID NO: 1078189 - RNA, 19 nt, Homo sapiens
gcaguaaucauuuauggaa

SEQ ID NO: 1078190 - RNA, 19 nt, Homo sapiens
gaagagagaccguguagag

SEQ ID NO: 1078191 - RNA, 19 nt, Homo sapiens
gaagaagcaauuacacauu

SEQ ID NO: 1078192 - RNA, 19 nt, Homo sapiens
ggaguugcuucuagcgaua

SEQ ID NO: 1078193 - RNA, 19 nt, Homo sapiens
gagaguagagcuggauuua

SEQ ID NO: 1078194 - RNA, 19 nt, Homo sapiens
uuucaaaccuugugcaauu

SEQ ID NO: 1078195 - RNA, 19 nt, Homo sapiens
gcaauaaagcugcuaaagu

SEQ ID NO: 1078196 - RNA, 19 nt, Homo sapiens
ccauaacacucauuuaaca

SEQ ID NO: 1078197 - RNA, 19 nt, Homo sapiens
ugguaaagauggacugaua

SEQ ID NO: 1078198 - RNA, 19 nt, Homo sapiens
uuaaaugccuuauggauag

SEQ ID NO: 1078199 - RNA, 19 nt, Homo sapiens
agagagggcuaaagaagaa

SEQ ID NO: 1078200 - RNA, 19 nt, Homo sapiens
gcauccaaguggguuauua

SEQ ID NO: 1078201 - RNA, 19 nt, Homo sapiens
uaacuaagaucacaaugac

SEQ ID NO: 1078202 - RNA, 19 nt, Homo sapiens
caaacuguauugcuaagga

SEQ ID NO: 1078203 - RNA, 19 nt, Homo sapiens
aaacaaaguucuagauagg

SEQ ID NO: 1078204 - RNA, 19 nt, Homo sapiens
uaaacagccuugugucuuc

SEQ ID NO: 1078205 - RNA, 19 nt, Homo sapiens
gaugaaaugccuuuaugaa

SEQ ID NO: 1078206 - RNA, 19 nt, Homo sapiens
cagaugaaaugccuuuaug

SEQ ID NO: 1078207 - RNA, 19 nt, Homo sapiens
gggauaugcucaagaagug

SEQ ID NO: 1078208 - RNA, 19 nt, Homo sapiens
ugaaagaaacagaguguaa

SEQ ID NO: 1078209 - RNA, 19 nt, Homo sapiens
caaauaucauggagaacuu

SEQ ID NO: 1078210 - RNA, 19 nt, Homo sapiens
gauguucuuuccaaguuaa

SEQ ID NO: 1078211 - RNA, 19 nt, Homo sapiens
ccaaguggguuauuacaca

SEQ ID NO: 1078212 - RNA, 19 nt, Homo sapiens
gaucagacaacuccaauca

SEQ ID NO: 1078213 - RNA, 19 nt, Homo sapiens
uuacaaggguucaaucugu

SEQ ID NO: 1078214 - RNA, 19 nt, Homo sapiens
gcauagacgugccagagau

SEQ ID NO: 1078215 - RNA, 19 nt, Homo sapiens
caaaggauauugauuaccu

SEQ ID NO: 1078216 - RNA, 19 nt, Homo sapiens
caaugacuguguacccuuu

SEQ ID NO: 1078217 - RNA, 19 nt, Homo sapiens
gaagaacccaucacagcaa

SEQ ID NO: 1078218 - RNA, 19 nt, Homo sapiens
gcaguuaguccaagauaug

SEQ ID NO: 1078219 - RNA, 19 nt, Homo sapiens
gaaagaaacagaguguaau

SEQ ID NO: 1078220 - RNA, 19 nt, Homo sapiens
gcuguuaauuucccaucua

SEQ ID NO: 1078221 - RNA, 19 nt, Homo sapiens
guaaagauggacugauauu

SEQ ID NO: 1078222 - RNA, 19 nt, Homo sapiens
gaaaagaaaggacaaauuc

SEQ ID NO: 1078223 - RNA, 19 nt, Homo sapiens
uaaacaaagcaaugccuua

SEQ ID NO: 1078224 - RNA, 19 nt, Homo sapiens
cagagagaauaaacaugua

SEQ ID NO: 1078225 - RNA, 19 nt, Homo sapiens
aggcuaaacuaagcaaaua

SEQ ID NO: 1078226 - RNA, 19 nt, Homo sapiens
auggagaacuucaguguuu

SEQ ID NO: 1078227 - RNA, 19 nt, Homo sapiens
guauccagcauuugcauua

SEQ ID NO: 1078228 - RNA, 19 nt, Homo sapiens
gaucagaugaaaugccuuu

SEQ ID NO: 1078229 - RNA, 19 nt, Homo sapiens
uaccuaugcuuucagagua

SEQ ID NO: 1078230 - RNA, 19 nt, Homo sapiens
gcuggaagcgcaauucauu

SEQ ID NO: 1078231 - RNA, 19 nt, Homo sapiens
guuaauuucccaucuauga

SEQ ID NO: 1078232 - RNA, 19 nt, Homo sapiens
gcccaauuauuacauauca

SEQ ID NO: 1078233 - RNA, 19 nt, Homo sapiens
guuaagaccacaaacugua

SEQ ID NO: 1078234 - RNA, 19 nt, Homo sapiens
cuauaggcaugcagaaauu

SEQ ID NO: 1078235 - RNA, 19 nt, Homo sapiens
ucacaaccauuuaccuuag

SEQ ID NO: 1078236 - RNA, 19 nt, Homo sapiens
ggugaagagucaaauaucu

SEQ ID NO: 1078237 - RNA, 19 nt, Homo sapiens
ggagaacgaggaaucaaug

SEQ ID NO: 1078238 - RNA, 19 nt, Homo sapiens
gcaagguuaccauuaagaa

SEQ ID NO: 1078239 - RNA, 19 nt, Homo sapiens
aaggcaagguuaccauuaa

SEQ ID NO: 1078240 - RNA, 19 nt, Homo sapiens
ccacaaacuguauugcuaa

SEQ ID NO: 1078241 - RNA, 19 nt, Homo sapiens
ucaccuacuucuucuaaug

SEQ ID NO: 1078242 - RNA, 19 nt, Homo sapiens
gaaguguguggaacaagua

SEQ ID NO: 1078243 - RNA, 19 nt, Homo sapiens
gagagagggcuaaagaaga

SEQ ID NO: 1078244 - RNA, 19 nt, Homo sapiens
gaacaugaaacagagagaa

SEQ ID NO: 1078245 - RNA, 19 nt, Homo sapiens
aggaaucaauggucuguuu

SEQ ID NO: 1078246 - RNA, 19 nt, Homo sapiens
gcuaacacauuaaacuucu

SEQ ID NO: 1078247 - RNA, 19 nt, Homo sapiens
gaguaugauucuucuugaa

SEQ ID NO: 1078248 - RNA, 19 nt, Homo sapiens
aagcaaugccuuagcguua

SEQ ID NO: 1078249 - RNA, 19 nt, Homo sapiens
gaggaugccuguuuugauu

SEQ ID NO: 1078250 - RNA, 19 nt, Homo sapiens
ucaaguagcaaauaucaug

SEQ ID NO: 1078251 - RNA, 19 nt, Homo sapiens
ggagagagggcuaaagaag

SEQ ID NO: 1078252 - RNA, 19 nt, Homo sapiens
cauguacugugaauuaugu

SEQ ID NO: 1078253 - RNA, 19 nt, Homo sapiens
gauguaggcuaaacuaagc

SEQ ID NO: 1078254 - RNA, 19 nt, Homo sapiens
gcugguagcauuaaauuag

SEQ ID NO: 1078255 - RNA, 19 nt, Homo sapiens
gaaaaggaauacuacuguu

SEQ ID NO: 1078256 - RNA, 19 nt, Homo sapiens
acaaaguucuagauagguu

SEQ ID NO: 1078257 - RNA, 19 nt, Homo sapiens
ugaugaaagugaagauguu

SEQ ID NO: 1078258 - RNA, 19 nt, Homo sapiens
aagaggacauguaguugaa

SEQ ID NO: 1078259 - RNA, 19 nt, Homo sapiens
caacaaguauugggauuuu

SEQ ID NO: 1078260 - RNA, 19 nt, Homo sapiens
gaggaacagagcaaaguuu

SEQ ID NO: 1078261 - RNA, 19 nt, Homo sapiens
gaagagaggaaaucaucug

SEQ ID NO: 1078262 - RNA, 19 nt, Homo sapiens
gcuaaagaagaagcaauua

SEQ ID NO: 1078263 - RNA, 19 nt, Homo sapiens
uaugagcagugccuacaaa

SEQ ID NO: 1078264 - RNA, 19 nt, Homo sapiens
gccauuaugugugaccuuu

SEQ ID NO: 1078265 - RNA, 19 nt, Homo sapiens
ucauggaauugauagcuaa

SEQ ID NO: 1078266 - RNA, 19 nt, Homo sapiens
caaaccuugugcaauugua

SEQ ID NO: 1078267 - RNA, 19 nt, Homo sapiens
gguuguccuuguuguuaua

SEQ ID NO: 1078268 - RNA, 19 nt, Homo sapiens
ggacaacccuuuauuauua

SEQ ID NO: 1078269 - RNA, 19 nt, Homo sapiens
gaacaaaggcaguuaauua

SEQ ID NO: 1078270 - RNA, 19 nt, Homo sapiens
ggaagugaauuugggauua

SEQ ID NO: 1078271 - RNA, 19 nt, Homo sapiens
gcaaauaauacccaacuua

SEQ ID NO: 1078272 - RNA, 19 nt, Homo sapiens
gaagaaacagcucagauuu

SEQ ID NO: 1078273 - RNA, 19 nt, Homo sapiens
cuaauaggcugaagauaaa

SEQ ID NO: 1078274 - RNA, 19 nt, Homo sapiens
caaaggcaguuaauuauuc

SEQ ID NO: 1078275 - RNA, 19 nt, Homo sapiens
ucaggcaggugaacuaaua

SEQ ID NO: 1078276 - RNA, 19 nt, Homo sapiens
gguagggacuguaucuuaa

SEQ ID NO: 1078277 - RNA, 19 nt, Homo sapiens
aaacacaggucauuaguca

SEQ ID NO: 1078278 - RNA, 19 nt, Homo sapiens
auaaauaccugacuuagga

SEQ ID NO: 1078279 - RNA, 19 nt, Homo sapiens
agaaacagcucagauuuga

SEQ ID NO: 1078280 - RNA, 19 nt, Homo sapiens
cauguuuacugcucaaaua

SEQ ID NO: 1078281 - RNA, 19 nt, Homo sapiens
gaguugagaucgcgcaauu

SEQ ID NO: 1078282 - RNA, 19 nt, Homo sapiens
gagaagggcuuaguaacug

SEQ ID NO: 1078283 - RNA, 19 nt, Homo sapiens
gaggagaaauaagcgguua

SEQ ID NO: 1078284 - RNA, 19 nt, Homo sapiens
cuacaacccuauugcuuaa

SEQ ID NO: 1078285 - RNA, 19 nt, Homo sapiens
gcucacgccuguaauucua

SEQ ID NO: 1078286 - RNA, 19 nt, Homo sapiens
gaacuaauaggcugaagau

SEQ ID NO: 1078287 - RNA, 19 nt, Homo sapiens
gaucacuuaucccauugua

SEQ ID NO: 1078288 - RNA, 19 nt, Homo sapiens
cgguuaauauucucucuua

SEQ ID NO: 1078289 - RNA, 19 nt, Homo sapiens
uaauaucucugccuuguca

SEQ ID NO: 1078290 - RNA, 19 nt, Homo sapiens
gcucaaauauuucuacaac

SEQ ID NO: 1078291 - RNA, 19 nt, Homo sapiens
cgagaauccuuucacugua

SEQ ID NO: 1078292 - RNA, 19 nt, Homo sapiens
gcucagauuugaccaagau

SEQ ID NO: 1078293 - RNA, 19 nt, Homo sapiens
gaagugaauuugggauuag

SEQ ID NO: 1078294 - RNA, 19 nt, Homo sapiens
uuaauugccugaggauaua

SEQ ID NO: 1078295 - RNA, 19 nt, Homo sapiens
gagaauccuuucacuguag

SEQ ID NO: 1078296 - RNA, 19 nt, Homo sapiens
guuuauagccacuuacaua

SEQ ID NO: 1078297 - RNA, 19 nt, Homo sapiens
gaauuggaacccacuauga

SEQ ID NO: 1078298 - RNA, 19 nt, Homo sapiens
ucacuuaucccauuguauu

SEQ ID NO: 1078299 - RNA, 19 nt, Homo sapiens
uuagaucacuuaucccauu

SEQ ID NO: 1078300 - RNA, 19 nt, Homo sapiens
ucaggacaacccuuuauua

SEQ ID NO: 1078301 - RNA, 19 nt, Homo sapiens
ccgcuacucucuugaggua

SEQ ID NO: 1078302 - RNA, 19 nt, Homo sapiens
ccaggcauuuaucgaguua

SEQ ID NO: 1078303 - RNA, 19 nt, Homo sapiens
acuaauaggcugaagauaa

SEQ ID NO: 1078304 - RNA, 19 nt, Homo sapiens
gcaagaacaaaggcaguua

SEQ ID NO: 1078305 - RNA, 19 nt, Homo sapiens
gcacgugacaaauccuuaa

SEQ ID NO: 1078306 - RNA, 19 nt, Homo sapiens
ugaagaaacagcucagauu

SEQ ID NO: 1078307 - RNA, 19 nt, Homo sapiens
caaacagaauucaggacaa

SEQ ID NO: 1078308 - RNA, 19 nt, Homo sapiens
ggaaauucuucugauccua

SEQ ID NO: 1078309 - RNA, 19 nt, Homo sapiens
uuaucaaccuugugacuuu

SEQ ID NO: 1078310 - RNA, 19 nt, Homo sapiens
caacauaaaugaguuugac

SEQ ID NO: 1078311 - RNA, 19 nt, Homo sapiens
ggaacaaagggaucaauca

SEQ ID NO: 1078312 - RNA, 19 nt, Homo sapiens
gaauucaggacaacccuuu

SEQ ID NO: 1078313 - RNA, 19 nt, Homo sapiens
gaggauauacugcuagugu

SEQ ID NO: 1078314 - RNA, 19 nt, Homo sapiens
caagaucacacaaguagga

SEQ ID NO: 1078315 - RNA, 19 nt, Homo sapiens
ugaccaagaucacacaagu

SEQ ID NO: 1078316 - RNA, 19 nt, Homo sapiens
caguuucugugauaaauga

SEQ ID NO: 1078317 - RNA, 19 nt, Homo sapiens
gcaauugcuuaucaaccuu

SEQ ID NO: 1078318 - RNA, 19 nt, Homo sapiens
uaucaaccuugugacuuua

SEQ ID NO: 1078319 - RNA, 19 nt, Homo sapiens
ggagaggccaaacagaauu

SEQ ID NO: 1078320 - RNA, 19 nt, Homo sapiens
caagaacaaaggcaguuaa

SEQ ID NO: 1078321 - RNA, 19 nt, Homo sapiens
gaggaaacagaaacaggua

SEQ ID NO: 1078322 - RNA, 19 nt, Homo sapiens
ggaaggauuagaagaggaa

SEQ ID NO: 1078323 - RNA, 19 nt, Homo sapiens
ugagacagcacgugacaaa

SEQ ID NO: 1078324 - RNA, 19 nt, Homo sapiens
ccacuuacauaauaauggu

SEQ ID NO: 1078325 - RNA, 19 nt, Homo sapiens
gagaaauaagcgguuaaua

SEQ ID NO: 1078326 - RNA, 19 nt, Homo sapiens
guuaauugccugaggauau

SEQ ID NO: 1078327 - RNA, 19 nt, Homo sapiens
gacugacuccaaauuaaua

SEQ ID NO: 1078328 - RNA, 19 nt, Homo sapiens
gagcaaaacuccaccucaa

SEQ ID NO: 1078329 - RNA, 19 nt, Homo sapiens
guugaugaguuaacuguca

SEQ ID NO: 1078330 - RNA, 19 nt, Homo sapiens
uggguggguugaugaguua

SEQ ID NO: 1078331 - RNA, 19 nt, Homo sapiens
gaagguagggacuguaucu

SEQ ID NO: 1078332 - RNA, 19 nt, Homo sapiens
ucuacaacccuauugcuua

SEQ ID NO: 1078333 - RNA, 19 nt, Homo sapiens
acacaggucauuagucaaa

SEQ ID NO: 1078334 - RNA, 19 nt, Homo sapiens
cacaugacaggaaggauua

SEQ ID NO: 1078335 - RNA, 19 nt, Homo sapiens
uaugacugacuccaaauua

SEQ ID NO: 1078336 - RNA, 19 nt, Homo sapiens
ccaaauccgagaauccuuu

SEQ ID NO: 1078337 - RNA, 19 nt, Homo sapiens
auacccaacuuaaucugua

SEQ ID NO: 1078338 - RNA, 19 nt, Homo sapiens
aaacuccaccucaaagaaa

SEQ ID NO: 1078339 - RNA, 19 nt, Homo sapiens
gcaggagaaucacuugaac

SEQ ID NO: 1078340 - RNA, 19 nt, Homo sapiens
gaaaccccaucucuacuaa

SEQ ID NO: 1078341 - RNA, 19 nt, Homo sapiens
ccucaaagucucugaauuc

SEQ ID NO: 1078342 - RNA, 19 nt, Homo sapiens
cauucuaccucuaaggaaa

SEQ ID NO: 1078343 - RNA, 19 nt, Homo sapiens
caggacaacccuuuauuau

SEQ ID NO: 1078344 - RNA, 19 nt, Homo sapiens
guaaauugucuuugacuuc

SEQ ID NO: 1078345 - RNA, 19 nt, Homo sapiens
ggaauuggaacccacuaug

SEQ ID NO: 1078346 - RNA, 19 nt, Homo sapiens
ggauauacugcuaguguug

SEQ ID NO: 1078347 - RNA, 19 nt, Homo sapiens
uaaguauuccucuuccuuu

SEQ ID NO: 1078348 - RNA, 19 nt, Homo sapiens
gaucacacaaguaggaguu

SEQ ID NO: 1078349 - RNA, 19 nt, Homo sapiens
gcauuuaucgaguuauuca

SEQ ID NO: 1078350 - RNA, 19 nt, Homo sapiens
gacuuaggauuccaaaaua

SEQ ID NO: 1078351 - RNA, 19 nt, Homo sapiens
gugcguagaggagaaauaa

SEQ ID NO: 1078352 - RNA, 19 nt, Homo sapiens
cacuaugacugacuccaaa

SEQ ID NO: 1078353 - RNA, 19 nt, Homo sapiens
gaccaagaucacacaagua

SEQ ID NO: 1078354 - RNA, 19 nt, Homo sapiens
gagcggaucaccugaaguc

SEQ ID NO: 1078355 - RNA, 19 nt, Homo sapiens
gaauuugggauuagucauc

SEQ ID NO: 1078356 - RNA, 19 nt, Homo sapiens
gaacaaagggaucaaucac

SEQ ID NO: 1078357 - RNA, 19 nt, Homo sapiens
gcauuguacuaagugcuuu

SEQ ID NO: 1078358 - RNA, 19 nt, Homo sapiens
gauuagaagaggaaacaga

SEQ ID NO: 1078359 - RNA, 19 nt, Homo sapiens
cuuaaaggauacacacaug

SEQ ID NO: 1078360 - RNA, 19 nt, Homo sapiens
guggguggguugaugaguu

SEQ ID NO: 1078361 - RNA, 19 nt, Homo sapiens
uaaaggacccugagcuucu

SEQ ID NO: 1078362 - RNA, 19 nt, Homo sapiens
ggagaaauaagcgguuaau

SEQ ID NO: 1078363 - RNA, 19 nt, Homo sapiens
gcuacucucuugagguaca

SEQ ID NO: 1078364 - RNA, 19 nt, Homo sapiens
gauacacacaugacaggaa

SEQ ID NO: 1078365 - RNA, 19 nt, Homo sapiens
acaaguaggaguugaggaa

SEQ ID NO: 1078366 - RNA, 19 nt, Homo sapiens
uggcauuucugaugucuag

SEQ ID NO: 1078367 - RNA, 19 nt, Homo sapiens
guagggacuguaucuuaaa

SEQ ID NO: 1078368 - RNA, 19 nt, Homo sapiens
gcaaggaugugauuauuga

SEQ ID NO: 1078369 - RNA, 19 nt, Homo sapiens
aaacaucugucgaaacuaa

SEQ ID NO: 1078370 - RNA, 19 nt, Homo sapiens
gagggaggcugaauuuauu

SEQ ID NO: 1078371 - RNA, 19 nt, Homo sapiens
gaccuucgcuugaugauga

SEQ ID NO: 1078372 - RNA, 19 nt, Homo sapiens
uaaauaacauggcccacua

SEQ ID NO: 1078373 - RNA, 19 nt, Homo sapiens
caacaacuccugcacagua

SEQ ID NO: 1078374 - RNA, 19 nt, Homo sapiens
gaggaggugucugaaauaa

SEQ ID NO: 1078375 - RNA, 19 nt, Homo sapiens
gaaugugccugaaauccaa

SEQ ID NO: 1078376 - RNA, 19 nt, Homo sapiens
gaagauauccucgccaaga

SEQ ID NO: 1078377 - RNA, 19 nt, Homo sapiens
gcaccaggaacaacauuua

SEQ ID NO: 1078378 - RNA, 19 nt, Homo sapiens
ggacagggucauuugcuua

SEQ ID NO: 1078379 - RNA, 19 nt, Homo sapiens
gaucaucuuugacacauuc

SEQ ID NO: 1078380 - RNA, 19 nt, Homo sapiens
ccacucauccugucgaaua

SEQ ID NO: 1078381 - RNA, 19 nt, Homo sapiens
ugacaggccuucugcaguu

SEQ ID NO: 1078382 - RNA, 19 nt, Homo sapiens
gcuggaaucucaggaguuu

SEQ ID NO: 1078383 - RNA, 19 nt, Homo sapiens
gacaagcccugcuggagaa

SEQ ID NO: 1078384 - RNA, 19 nt, Homo sapiens
ccaaguggcuccuacaaag

SEQ ID NO: 1078385 - RNA, 19 nt, Homo sapiens
ggaggugucugaaauaaaa

SEQ ID NO: 1078386 - RNA, 19 nt, Homo sapiens
ggccaaggcugguggauca

SEQ ID NO: 1078387 - RNA, 19 nt, Homo sapiens
gaaaacaucugucgaaacu

SEQ ID NO: 1078388 - RNA, 19 nt, Homo sapiens
gaauaugggaugagcauug

SEQ ID NO: 1078389 - RNA, 19 nt, Homo sapiens
uaagugaauuuccagagaa

SEQ ID NO: 1078390 - RNA, 19 nt, Homo sapiens
gagcaagacugcguuucaa

SEQ ID NO: 1078391 - RNA, 19 nt, Homo sapiens
gaacauggccucugcuacu

SEQ ID NO: 1078392 - RNA, 19 nt, Homo sapiens
ggaggaggugucugaaaua

SEQ ID NO: 1078393 - RNA, 19 nt, Homo sapiens
gaugaugacuuuugaagaa

SEQ ID NO: 1078394 - RNA, 19 nt, Homo sapiens
gagcaaauacaaacauguu

SEQ ID NO: 1078395 - RNA, 19 nt, Homo sapiens
caaaucaccaccuggagua

SEQ ID NO: 1078396 - RNA, 19 nt, Homo sapiens
cgaaagagcauuccagaca

SEQ ID NO: 1078397 - RNA, 19 nt, Homo sapiens
uguccaaucucccacauuu

SEQ ID NO: 1078398 - RNA, 19 nt, Homo sapiens
gagccaggaucacaccauu

SEQ ID NO: 1078399 - RNA, 19 nt, Homo sapiens
agcaagagaugagcaaaua

SEQ ID NO: 1078400 - RNA, 19 nt, Homo sapiens
gagcugauguuccguaaaa

SEQ ID NO: 1078401 - RNA, 19 nt, Homo sapiens
ccacacggcaggauuauug

SEQ ID NO: 1078402 - RNA, 19 nt, Homo sapiens
ccagguuggugacaguaua

SEQ ID NO: 1078403 - RNA, 19 nt, Homo sapiens
ucacugaugucauuauugg

SEQ ID NO: 1078404 - RNA, 19 nt, Homo sapiens
uuauugaucuguugugcua

SEQ ID NO: 1078405 - RNA, 19 nt, Homo sapiens
gcaccagcaugaagauauc

SEQ ID NO: 1078406 - RNA, 19 nt, Homo sapiens
gagacacugugaacauguu

SEQ ID NO: 1078407 - RNA, 19 nt, Homo sapiens
gugggcagauuucuauuga

SEQ ID NO: 1078408 - RNA, 19 nt, Homo sapiens
gaaggaagaggccucacuu

SEQ ID NO: 1078409 - RNA, 19 nt, Homo sapiens
gcauugagagcccaaaguu

SEQ ID NO: 1078410 - RNA, 19 nt, Homo sapiens
gguccguggucguuuguuu

SEQ ID NO: 1078411 - RNA, 19 nt, Homo sapiens
gacaguauauugugagcau

SEQ ID NO: 1078412 - RNA, 19 nt, Homo sapiens
ggucauuggugauucaucu

SEQ ID NO: 1078413 - RNA, 19 nt, Homo sapiens
gaauggagaagaugaugga

SEQ ID NO: 1078414 - RNA, 19 nt, Homo sapiens
ccgcaaggaugugauuauu

SEQ ID NO: 1078415 - RNA, 19 nt, Homo sapiens
caagaaauggcaccaggaa

SEQ ID NO: 1078416 - RNA, 19 nt, Homo sapiens
uuaagugaauuuccagaga

SEQ ID NO: 1078417 - RNA, 19 nt, Homo sapiens
ucaggaguuugaccacuuu

SEQ ID NO: 1078418 - RNA, 19 nt, Homo sapiens
caacuccugcacaguauuu

SEQ ID NO: 1078419 - RNA, 19 nt, Homo sapiens
gaaauggcaccaggaacaa

SEQ ID NO: 1078420 - RNA, 19 nt, Homo sapiens
gagcauuccagacacauau

SEQ ID NO: 1078421 - RNA, 19 nt, Homo sapiens
ucauaaagcugccaaaauc

SEQ ID NO: 1078422 - RNA, 19 nt, Homo sapiens
guuagucuaucucaaucaa

SEQ ID NO: 1078423 - RNA, 19 nt, Homo sapiens
caagagaugagcaaauaca

SEQ ID NO: 1078424 - RNA, 19 nt, Homo sapiens
ugaaccauauggacccaaa

SEQ ID NO: 1078425 - RNA, 19 nt, Homo sapiens
ccaccaaguucucgacagu

SEQ ID NO: 1078426 - RNA, 19 nt, Homo sapiens
ggagacguuuaccacagaa

SEQ ID NO: 1078427 - RNA, 19 nt, Homo sapiens
gagaugagcaaauacaaac

SEQ ID NO: 1078428 - RNA, 19 nt, Homo sapiens
cauauggacccaaaucaga

SEQ ID NO: 1078429 - RNA, 19 nt, Homo sapiens
gaaauaaaauccuccuacu

SEQ ID NO: 1078430 - RNA, 19 nt, Homo sapiens
ggagugugcauuugauugu

SEQ ID NO: 1078431 - RNA, 19 nt, Homo sapiens
gggacagggucauuugcuu

SEQ ID NO: 1078432 - RNA, 19 nt, Homo sapiens
ucucgacagugaagcgaua

SEQ ID NO: 1078433 - RNA, 19 nt, Homo sapiens
ccaagaagcaugacuuugc

SEQ ID NO: 1078434 - RNA, 19 nt, Homo sapiens
aauaugggaugagcauuga

SEQ ID NO: 1078435 - RNA, 19 nt, Homo sapiens
uuacaccacuccagcugaa

SEQ ID NO: 1078436 - RNA, 19 nt, Homo sapiens
agugugcauuugauuguua

SEQ ID NO: 1078437 - RNA, 19 nt, Homo sapiens
cagagcugauguuccguaa

SEQ ID NO: 1078438 - RNA, 19 nt, Homo sapiens
gaggcugaauuuauugaca

SEQ ID NO: 1078439 - RNA, 19 nt, Homo sapiens
aagcaugacuuugccauca

SEQ ID NO: 1078440 - RNA, 19 nt, Homo sapiens
uggagaaugugccugaaau

SEQ ID NO: 1078441 - RNA, 19 nt, Homo sapiens
ggcaugcaauggugguuug

SEQ ID NO: 1078442 - RNA, 19 nt, Homo sapiens
aggaggaggugucugaaau

SEQ ID NO: 1078443 - RNA, 19 nt, Homo sapiens
gcagugauauugggaagcu

SEQ ID NO: 1078444 - RNA, 19 nt, Homo sapiens
caagggauuguuccugaaa

SEQ ID NO: 1078445 - RNA, 19 nt, Homo sapiens
agagggaggcugaauuuau

SEQ ID NO: 1078446 - RNA, 19 nt, Homo sapiens
gcucuugccuuggguucuu

SEQ ID NO: 1078447 - RNA, 19 nt, Homo sapiens
ccacacgacuggcuuuuga

SEQ ID NO: 1078448 - RNA, 19 nt, Homo sapiens
gcugugccaucauccaugu

SEQ ID NO: 1078449 - RNA, 19 nt, Homo sapiens
ggacggagacacugugaac

SEQ ID NO: 1078450 - RNA, 19 nt, Homo sapiens
ucuuuauacugcagugaua

SEQ ID NO: 1078451 - RNA, 19 nt, Homo sapiens
cgaaacuaaugcuggaauc

SEQ ID NO: 1078452 - RNA, 19 nt, Homo sapiens
auugaaaccucccaacuuc

SEQ ID NO: 1078453 - RNA, 19 nt, Homo sapiens
gccaguacccgcuguagga

SEQ ID NO: 1078454 - RNA, 19 nt, Homo sapiens
ggccaagaagcaugacuuu

SEQ ID NO: 1078455 - RNA, 19 nt, Homo sapiens
gcagccgugucaacucuuc

SEQ ID NO: 1078456 - RNA, 19 nt, Homo sapiens
gcucaagguuuuaauguuc

SEQ ID NO: 1078457 - RNA, 19 nt, Homo sapiens
aaagagcauuccagacaca

SEQ ID NO: 1078458 - RNA, 19 nt, Homo sapiens
ucaagggauuguuccugaa

SEQ ID NO: 1078459 - RNA, 19 nt, Homo sapiens
gaaguguuagucuaucuca

SEQ ID NO: 1078460 - RNA, 19 nt, Homo sapiens
gaugagaaagacugguuug

SEQ ID NO: 1078461 - RNA, 19 nt, Homo sapiens
guuuguuucuccaagguuu

SEQ ID NO: 1078462 - RNA, 19 nt, Homo sapiens
cauugagagcccaaaguua

SEQ ID NO: 1078463 - RNA, 19 nt, Homo sapiens
gaagaugauggacggaauc

SEQ ID NO: 1078464 - RNA, 19 nt, Homo sapiens
gaggaaguguuagucuauc

SEQ ID NO: 1078465 - RNA, 19 nt, Homo sapiens
auagagggaggcugaauuu

SEQ ID NO: 1078466 - RNA, 19 nt, Homo sapiens
cgggacaucuggugaacau

SEQ ID NO: 1078467 - RNA, 19 nt, Homo sapiens
uguaggaauuggcacaguu

SEQ ID NO: 1078468 - RNA, 19 nt, Homo sapiens
gcaaagaacuggcacaauu

SEQ ID NO: 1078469 - RNA, 19 nt, Homo sapiens
gcacagagcacagaaauga

SEQ ID NO: 1078470 - RNA, 19 nt, Homo sapiens
gaugagaguuugagauuca

SEQ ID NO: 1078471 - RNA, 19 nt, Homo sapiens
gaaaugaggccguuuacau

SEQ ID NO: 1078472 - RNA, 19 nt, Homo sapiens
aaacagaaaucaggaguga

SEQ ID NO: 1078473 - RNA, 19 nt, Homo sapiens
cuacguauguggauaagaa

SEQ ID NO: 1078474 - RNA, 19 nt, Homo sapiens
uuacaggccuuuccaaguu

SEQ ID NO: 1078475 - RNA, 19 nt, Homo sapiens
gcacugaccugcccagaac

SEQ ID NO: 1078476 - RNA, 19 nt, Homo sapiens
gagaugagaguuugagauu

SEQ ID NO: 1078477 - RNA, 19 nt, Homo sapiens
gaaauccggcugcggcaua

SEQ ID NO: 1078478 - RNA, 19 nt, Homo sapiens
gaacuggcacaauugguuu

SEQ ID NO: 1078479 - RNA, 19 nt, Homo sapiens
gaccaccucucauuucuuc

SEQ ID NO: 1078480 - RNA, 19 nt, Homo sapiens
agaacaagaucccuuacaa

SEQ ID NO: 1078481 - RNA, 19 nt, Homo sapiens
ggcccgagcuguucuuuca

SEQ ID NO: 1078482 - RNA, 19 nt, Homo sapiens
guacagucuuaaugcgaua

SEQ ID NO: 1078483 - RNA, 19 nt, Homo sapiens
caaagaacuggcacaauug

SEQ ID NO: 1078484 - RNA, 19 nt, Homo sapiens
acaccaacaucguggagua

SEQ ID NO: 1078485 - RNA, 19 nt, Homo sapiens
aaacaugggugaccguaca

SEQ ID NO: 1078486 - RNA, 19 nt, Homo sapiens
ucgcggaacucuucuccua

SEQ ID NO: 1078487 - RNA, 19 nt, Homo sapiens
cgauaaauccacuagcuaa

SEQ ID NO: 1078488 - RNA, 19 nt, Homo sapiens
gaacaagaucccuuacaag

SEQ ID NO: 1078489 - RNA, 19 nt, Homo sapiens
gaaguacgcccuggacaug

SEQ ID NO: 1078490 - RNA, 19 nt, Homo sapiens
aaucaggagugaccacaaa

SEQ ID NO: 1078491 - RNA, 19 nt, Homo sapiens
caaguuuccauucuccuua

SEQ ID NO: 1078492 - RNA, 19 nt, Homo sapiens
ggccacacgugccucauga

SEQ ID NO: 1078493 - RNA, 19 nt, Homo sapiens
gcaacacggcccugcauga

SEQ ID NO: 1078494 - RNA, 19 nt, Homo sapiens
gagcuacguauguggauaa

SEQ ID NO: 1078495 - RNA, 19 nt, Homo sapiens
ggagcuacguauguggaua

SEQ ID NO: 1078496 - RNA, 19 nt, Homo sapiens
uuuacaggcuuuccgauuu

SEQ ID NO: 1078497 - RNA, 19 nt, Homo sapiens
ccaaggcgcuggccaucau

SEQ ID NO: 1078498 - RNA, 19 nt, Homo sapiens
caagacagguuuuaacuca

SEQ ID NO: 1078499 - RNA, 19 nt, Homo sapiens
agagaacugugcuuccaaa

SEQ ID NO: 1078500 - RNA, 19 nt, Homo sapiens
ucacguggccucugauuuc

SEQ ID NO: 1078501 - RNA, 19 nt, Homo sapiens
ccaugcagcccuucaacua

SEQ ID NO: 1078502 - RNA, 19 nt, Homo sapiens
acagaaaugaggccguuua

SEQ ID NO: 1078503 - RNA, 19 nt, Homo sapiens
cccuuuaccuggccagaua

SEQ ID NO: 1078504 - RNA, 19 nt, Homo sapiens
ggacacuuccuauuacauc

SEQ ID NO: 1078505 - RNA, 19 nt, Homo sapiens
gaauuuggugagcgagaua

SEQ ID NO: 1078506 - RNA, 19 nt, Homo sapiens
ggaauuuggugagcgagau

SEQ ID NO: 1078507 - RNA, 19 nt, Homo sapiens
ccaccaaugccuucaagaa

SEQ ID NO: 1078508 - RNA, 19 nt, Homo sapiens
gguccuggccuaugacuau

SEQ ID NO: 1078509 - RNA, 19 nt, Homo sapiens
gguuugguguucuguuuau

SEQ ID NO: 1078510 - RNA, 19 nt, Homo sapiens
cggagggacugaagccauu

SEQ ID NO: 1078511 - RNA, 19 nt, Homo sapiens
gcugguguuuaagucauua

SEQ ID NO: 1078512 - RNA, 19 nt, Homo sapiens
ucuccgugcugguguuuaa

SEQ ID NO: 1078513 - RNA, 19 nt, Homo sapiens
gcgauaaauccacuagcua

SEQ ID NO: 1078514 - RNA, 19 nt, Homo sapiens
gcuagaaacacaggaagaa

SEQ ID NO: 1078515 - RNA, 19 nt, Homo sapiens
ccauagugcccgaguuaaa

SEQ ID NO: 1078516 - RNA, 19 nt, Homo sapiens
ggucugcauugccauagug

SEQ ID NO: 1078517 - RNA, 19 nt, Homo sapiens
gccuuugccuuguuaccua

SEQ ID NO: 1078518 - RNA, 19 nt, Homo sapiens
ucaagaagacggccuacga

SEQ ID NO: 1078519 - RNA, 19 nt, Homo sapiens
ggacuccauaagugaauuu

SEQ ID NO: 1078520 - RNA, 19 nt, Homo sapiens
gccgcugaauacaguguua

SEQ ID NO: 1078521 - RNA, 19 nt, Homo sapiens
gacagggucggagguguua

SEQ ID NO: 1078522 - RNA, 19 nt, Homo sapiens
ggacaaggacaccacaaac

SEQ ID NO: 1078523 - RNA, 19 nt, Homo sapiens
ggaaguacgcccuggacau

SEQ ID NO: 1078524 - RNA, 19 nt, Homo sapiens
gcgaguaccugcccaaacc

SEQ ID NO: 1078525 - RNA, 19 nt, Homo sapiens
gcauagcuuucgguugguu

SEQ ID NO: 1078526 - RNA, 19 nt, Homo sapiens
ccacauggacgccaccaau

SEQ ID NO: 1078527 - RNA, 19 nt, Homo sapiens
uaagaaacgagaucugcuu

SEQ ID NO: 1078528 - RNA, 19 nt, Homo sapiens
gcugggagcuacguaugug

SEQ ID NO: 1078529 - RNA, 19 nt, Homo sapiens
aaaugaggccguuuacaug

SEQ ID NO: 1078530 - RNA, 19 nt, Homo sapiens
cuaggucucguuuggauuu

SEQ ID NO: 1078531 - RNA, 19 nt, Homo sapiens
uaaauccacuagcuaagac

SEQ ID NO: 1078532 - RNA, 19 nt, Homo sapiens
cguggccucugauuucauu

SEQ ID NO: 1078533 - RNA, 19 nt, Homo sapiens
aaacacaggaagaaguuga

SEQ ID NO: 1078534 - RNA, 19 nt, Homo sapiens
cguggaagccuuggaauug

SEQ ID NO: 1078535 - RNA, 19 nt, Homo sapiens
gcagggauuuugacaacaa

SEQ ID NO: 1078536 - RNA, 19 nt, Homo sapiens
uacaggccuuuccaaguuu

SEQ ID NO: 1078537 - RNA, 19 nt, Homo sapiens
agaaacacaggaagaaguu

SEQ ID NO: 1078538 - RNA, 19 nt, Homo sapiens
acccggacacuuccuauua

SEQ ID NO: 1078539 - RNA, 19 nt, Homo sapiens
uuauacaucuccacucuac

SEQ ID NO: 1078540 - RNA, 19 nt, Homo sapiens
cagcguagacagcagcaaa

SEQ ID NO: 1078541 - RNA, 19 nt, Homo sapiens
ugccauagugcccgaguua

SEQ ID NO: 1078542 - RNA, 19 nt, Homo sapiens
ugccuucccucgucccuuu

SEQ ID NO: 1078543 - RNA, 19 nt, Homo sapiens
acacauagcagcccagaac

SEQ ID NO: 1078544 - RNA, 19 nt, Homo sapiens
caagagcgagacuccauca

SEQ ID NO: 1078545 - RNA, 19 nt, Homo sapiens
ccaaguacagucuuaaugc

SEQ ID NO: 1078546 - RNA, 19 nt, Homo sapiens
ccaaagcacagagcacaga

SEQ ID NO: 1078547 - RNA, 19 nt, Homo sapiens
gaacggggaaucuuacgaa

SEQ ID NO: 1078548 - RNA, 19 nt, Homo sapiens
acacgugccucaugaucuc

SEQ ID NO: 1078549 - RNA, 19 nt, Homo sapiens
uuuaauaagugggcagguu

SEQ ID NO: 1078550 - RNA, 19 nt, Homo sapiens
caacaccccgcuacacaua

SEQ ID NO: 1078551 - RNA, 19 nt, Homo sapiens
gcacccagaucggcuuugc

SEQ ID NO: 1078552 - RNA, 19 nt, Homo sapiens
cagccgaggugggaaaugg

SEQ ID NO: 1078553 - RNA, 19 nt, Homo sapiens
gauaaauccacuagcuaag

SEQ ID NO: 1078554 - RNA, 19 nt, Homo sapiens
aggcccaaguacagucuua

SEQ ID NO: 1078555 - RNA, 19 nt, Homo sapiens
ggauugagacccaagucau

SEQ ID NO: 1078556 - RNA, 19 nt, Homo sapiens
gagagaacugugcuuccaa

SEQ ID NO: 1078557 - RNA, 19 nt, Homo sapiens
caugggugaccguacauuu

SEQ ID NO: 1078558 - RNA, 19 nt, Homo sapiens
gcuaucccgugggcagauu

SEQ ID NO: 1078559 - RNA, 19 nt, Homo sapiens
caaagcacagagcacagaa

SEQ ID NO: 1078560 - RNA, 19 nt, Homo sapiens
gauugagacccaagucauc

SEQ ID NO: 1078561 - RNA, 19 nt, Homo sapiens
agaacuggcacaauugguu

SEQ ID NO: 1078562 - RNA, 19 nt, Homo sapiens
agagagaacugugcuucca

SEQ ID NO: 1078563 - RNA, 19 nt, Homo sapiens
cuguaugugugaggaauuu

SEQ ID NO: 1078564 - RNA, 19 nt, Homo sapiens
gggagugagcuguaugugu

SEQ ID NO: 1078565 - RNA, 19 nt, Homo sapiens
uugguuugguguucuguuu

SEQ ID NO: 1078566 - RNA, 19 nt, Homo sapiens
gcuccugagaugagaguuu

SEQ ID NO: 1078567 - RNA, 19 nt, Homo sapiens
gaaacacaggaagaaguug

SEQ ID NO: 1078568 - RNA, 19 nt, Homo sapiens
gaaggaagcuuaugacauu

SEQ ID NO: 1078569 - RNA, 19 nt, Homo sapiens
aaagguaacugaucagaua

SEQ ID NO: 1078570 - RNA, 19 nt, Homo sapiens
ggacacaucucggcgaaua

SEQ ID NO: 1078571 - RNA, 19 nt, Homo sapiens
guaauugucuucucauuug

SEQ ID NO: 1078572 - RNA, 19 nt, Homo sapiens
gaggaaguauuucacauaa

SEQ ID NO: 1078573 - RNA, 19 nt, Homo sapiens
guaauaaacugccgugugu

SEQ ID NO: 1078574 - RNA, 19 nt, Homo sapiens
gccaaucacuaaucaauuu

SEQ ID NO: 1078575 - RNA, 19 nt, Homo sapiens
ggaaguauuucacauaaca

SEQ ID NO: 1078576 - RNA, 19 nt, Homo sapiens
caaauguucuacagucuuu

SEQ ID NO: 1078577 - RNA, 19 nt, Homo sapiens
gcaaggcgauuucgagcaa

SEQ ID NO: 1078578 - RNA, 19 nt, Homo sapiens
gaucuggucuggauuaugg

SEQ ID NO: 1078579 - RNA, 19 nt, Homo sapiens
ggcaauugcuuaucuccua

SEQ ID NO: 1078580 - RNA, 19 nt, Homo sapiens
uauguuagaugcccuugua

SEQ ID NO: 1078581 - RNA, 19 nt, Homo sapiens
caaaauacauguacacuuc

SEQ ID NO: 1078582 - RNA, 19 nt, Homo sapiens
gaucagauaauuacccaaa

SEQ ID NO: 1078583 - RNA, 19 nt, Homo sapiens
caguaaugcuuauuucuga

SEQ ID NO: 1078584 - RNA, 19 nt, Homo sapiens
guaaauugauuggugauuc

SEQ ID NO: 1078585 - RNA, 19 nt, Homo sapiens
gugguuaagugcacaguuu

SEQ ID NO: 1078586 - RNA, 19 nt, Homo sapiens
gaucaucugaguaaauuga

SEQ ID NO: 1078587 - RNA, 19 nt, Homo sapiens
guucuacagucuuuaaaug

SEQ ID NO: 1078588 - RNA, 19 nt, Homo sapiens
ucacaggacuuuugucuuu

SEQ ID NO: 1078589 - RNA, 19 nt, Homo sapiens
ccagagauaagacuaauau

SEQ ID NO: 1078590 - RNA, 19 nt, Homo sapiens
gugcauauauuaccauugg

SEQ ID NO: 1078591 - RNA, 19 nt, Homo sapiens
gguaacugaucagauaauu

SEQ ID NO: 1078592 - RNA, 19 nt, Homo sapiens
gagauuagagguacuuuua

SEQ ID NO: 1078593 - RNA, 19 nt, Homo sapiens
aaagaucuggucuggauua

SEQ ID NO: 1078594 - RNA, 19 nt, Homo sapiens
ucucaaagguaacugauca

SEQ ID NO: 1078595 - RNA, 19 nt, Homo sapiens
cgaagacgcugcugugcau

SEQ ID NO: 1078596 - RNA, 19 nt, Homo sapiens
gcaagaaauauguuagaug

SEQ ID NO: 1078597 - RNA, 19 nt, Homo sapiens
caacaggcaagaaauaugu

SEQ ID NO: 1078598 - RNA, 19 nt, Homo sapiens
uauagaggcuugaggaagu

SEQ ID NO: 1078599 - RNA, 19 nt, Homo sapiens
uaaaagaucuggucuggau

SEQ ID NO: 1078600 - RNA, 19 nt, Homo sapiens
gaguauuccuaaguguuua

SEQ ID NO: 1078601 - RNA, 19 nt, Homo sapiens
gcucauugcacuauauuau

SEQ ID NO: 1078602 - RNA, 19 nt, Homo sapiens
uauccgagcuuguuauugg

SEQ ID NO: 1078603 - RNA, 19 nt, Homo sapiens
uagaugcccuuguaauugu

SEQ ID NO: 1078604 - RNA, 19 nt, Homo sapiens
ccaccguacuugcaagaaa

SEQ ID NO: 1078605 - RNA, 19 nt, Homo sapiens
gcaaugaagcuacgccaau

SEQ ID NO: 1078606 - RNA, 19 nt, Homo sapiens
ggaagcuuaugacauuuua

SEQ ID NO: 1078607 - RNA, 19 nt, Homo sapiens
ggacuuuugucuuucauuu

SEQ ID NO: 1078608 - RNA, 19 nt, Homo sapiens
caauuuggauggcaagcuu

SEQ ID NO: 1078609 - RNA, 19 nt, Homo sapiens
gcgaauaggaugcccaaga

SEQ ID NO: 1078610 - RNA, 19 nt, Homo sapiens
ugaggaaguauuucacaua

SEQ ID NO: 1078611 - RNA, 19 nt, Homo sapiens
ggauaaaugucuuuucuca

SEQ ID NO: 1078612 - RNA, 19 nt, Homo sapiens
guuagaugcccuuguaauu

SEQ ID NO: 1078613 - RNA, 19 nt, Homo sapiens
gauguuggauaaaugucuu

SEQ ID NO: 1078614 - RNA, 19 nt, Homo sapiens
uugcuuaucuccuaggauu

SEQ ID NO: 1078615 - RNA, 19 nt, Homo sapiens
ucccuuagaucaugguaaa

SEQ ID NO: 1078616 - RNA, 19 nt, Homo sapiens
aguuggagauguuggauaa

SEQ ID NO: 1078617 - RNA, 19 nt, Homo sapiens
cauguacacuucaaagagu

SEQ ID NO: 1078618 - RNA, 19 nt, Homo sapiens
gagcucccaccuccauaua

SEQ ID NO: 1078619 - RNA, 19 nt, Homo sapiens
ggucuggauuauggaauuu

SEQ ID NO: 1078620 - RNA, 19 nt, Homo sapiens
cgaauaggaugcccaagac

SEQ ID NO: 1078621 - RNA, 19 nt, Homo sapiens
caaugaagcuacgccaauc

SEQ ID NO: 1078622 - RNA, 19 nt, Homo sapiens
ggagauguuggauaaaugu

SEQ ID NO: 1078623 - RNA, 19 nt, Homo sapiens
ccauucugguuuauguaua

SEQ ID NO: 1078624 - RNA, 19 nt, Homo sapiens
gcauauauuaccauuggaa

SEQ ID NO: 1078625 - RNA, 19 nt, Homo sapiens
aacuguagacggauaauua

SEQ ID NO: 1078626 - RNA, 19 nt, Homo sapiens
ugaguauuccuaaguguuu

SEQ ID NO: 1078627 - RNA, 19 nt, Homo sapiens
gagagugucuagcaguucu

SEQ ID NO: 1078628 - RNA, 19 nt, Homo sapiens
gcuuguuuaugauucagua

SEQ ID NO: 1078629 - RNA, 19 nt, Homo sapiens
agacgcugcugugcauaua

SEQ ID NO: 1078630 - RNA, 19 nt, Homo sapiens
gcucccaccuccauauaca

SEQ ID NO: 1078631 - RNA, 19 nt, Homo sapiens
gugagagugucuagcaguu

SEQ ID NO: 1078632 - RNA, 19 nt, Homo sapiens
gagcaaccuauguuucuug

SEQ ID NO: 1078633 - RNA, 19 nt, Homo sapiens
ggcaagaaauauguuagau

SEQ ID NO: 1078634 - RNA, 19 nt, Homo sapiens
guacucaucacagaauuug

SEQ ID NO: 1078635 - RNA, 19 nt, Homo sapiens
gcccaguaaugcuuauuuc

SEQ ID NO: 1078636 - RNA, 19 nt, Homo sapiens
ccagugguauuccaguaau

SEQ ID NO: 1078637 - RNA, 19 nt, Homo sapiens
aagagucaguuauccagaa

SEQ ID NO: 1078638 - RNA, 19 nt, Homo sapiens
uagcucaggauuauaugua

SEQ ID NO: 1078639 - RNA, 19 nt, Homo sapiens
gauuauagugaccuuauuc

SEQ ID NO: 1078640 - RNA, 19 nt, Homo sapiens
aagcuacucuggacaucuu

SEQ ID NO: 1078641 - RNA, 19 nt, Homo sapiens
gaacacaguuuugcauaag

SEQ ID NO: 1078642 - RNA, 19 nt, Homo sapiens
uaguagaauuagacaguga

SEQ ID NO: 1078643 - RNA, 19 nt, Homo sapiens
uuacuauucuucucaaagg

SEQ ID NO: 1078644 - RNA, 19 nt, Homo sapiens
gaauuagacagugagauca

SEQ ID NO: 1078645 - RNA, 19 nt, Homo sapiens
uacaguagcuaaaauguug

SEQ ID NO: 1078646 - RNA, 19 nt, Homo sapiens
gaggcuugaggaaguauuu

SEQ ID NO: 1078647 - RNA, 19 nt, Homo sapiens
uuagaugcccuuguaauug

SEQ ID NO: 1078648 - RNA, 19 nt, Homo sapiens
caucugaguaaauugauug

SEQ ID NO: 1078649 - RNA, 19 nt, Homo sapiens
caauaugcauuuugcuuga

SEQ ID NO: 1078650 - RNA, 19 nt, Homo sapiens
gcccaagacccaacuguag

SEQ ID NO: 1078651 - RNA, 19 nt, Homo sapiens
caucacagaauuugaagca

SEQ ID NO: 1078652 - RNA, 19 nt, Homo sapiens
gauuggugauuccagagau

SEQ ID NO: 1078653 - RNA, 19 nt, Homo sapiens
aaucacaaauguucuacag

SEQ ID NO: 1078654 - RNA, 19 nt, Homo sapiens
cuauucuucucaaagguaa

SEQ ID NO: 1078655 - RNA, 19 nt, Homo sapiens
agauacuguuugcuuguuu

SEQ ID NO: 1078656 - RNA, 19 nt, Homo sapiens
uagauacuguuugcuuguu

SEQ ID NO: 1078657 - RNA, 19 nt, Homo sapiens
gucuagcaguucuugguaa

SEQ ID NO: 1078658 - RNA, 19 nt, Homo sapiens
acgcugcugugcauauauu

SEQ ID NO: 1078659 - RNA, 19 nt, Homo sapiens
gaagcuacgccaaucaaaa

SEQ ID NO: 1078660 - RNA, 19 nt, Homo sapiens
agaauuagacagugagauc

SEQ ID NO: 1078661 - RNA, 19 nt, Homo sapiens
uaguguaacuucaaagacu

SEQ ID NO: 1078662 - RNA, 19 nt, Homo sapiens
gguagugcacuuccacgaa

SEQ ID NO: 1078663 - RNA, 19 nt, Homo sapiens
cagcaucccacuccggaaa

SEQ ID NO: 1078664 - RNA, 19 nt, Homo sapiens
cgccagugguauuccagua

SEQ ID NO: 1078665 - RNA, 19 nt, Homo sapiens
uaaauugauuggugauucc

SEQ ID NO: 1078666 - RNA, 19 nt, Homo sapiens
uggagauguuggauaaaug

SEQ ID NO: 1078667 - RNA, 19 nt, Homo sapiens
acaugaguauuccuaagug

SEQ ID NO: 1078668 - RNA, 19 nt, Homo sapiens
ggacugagcuggucuuuga

SEQ ID NO: 1078669 - RNA, 19 nt, Homo sapiens
caacaucacuucugggauu

SEQ ID NO: 1078670 - RNA, 19 nt, Homo sapiens
gaaaugugcucacucuguu

SEQ ID NO: 1078671 - RNA, 19 nt, Homo sapiens
gaagaaaugugcucacucu

SEQ ID NO: 1078672 - RNA, 19 nt, Homo sapiens
caacuuugcugcugugguu

SEQ ID NO: 1078673 - RNA, 19 nt, Homo sapiens
uaaagaggauagcaacuga

SEQ ID NO: 1078674 - RNA, 19 nt, Homo sapiens
ggacauggaggaggacuua

SEQ ID NO: 1078675 - RNA, 19 nt, Homo sapiens
gggaagacuacccauauua

SEQ ID NO: 1078676 - RNA, 19 nt, Homo sapiens
gugcguucaucucuuauua

SEQ ID NO: 1078677 - RNA, 19 nt, Homo sapiens
caaaauaucucucuguaga

SEQ ID NO: 1078678 - RNA, 19 nt, Homo sapiens
ggaccacccucucugaguu

SEQ ID NO: 1078679 - RNA, 19 nt, Homo sapiens
caaagugaaucaagcugaa

SEQ ID NO: 1078680 - RNA, 19 nt, Homo sapiens
agacagaccuacugcuuga

SEQ ID NO: 1078681 - RNA, 19 nt, Homo sapiens
ccaaguagcugggauuaca

SEQ ID NO: 1078682 - RNA, 19 nt, Homo sapiens
ccaaugcauucucuuacua

SEQ ID NO: 1078683 - RNA, 19 nt, Homo sapiens
ggacucaggugugugaaau

SEQ ID NO: 1078684 - RNA, 19 nt, Homo sapiens
ggacugaggccaaagugaa

SEQ ID NO: 1078685 - RNA, 19 nt, Homo sapiens
gguggaagaugcaguggaa

SEQ ID NO: 1078686 - RNA, 19 nt, Homo sapiens
gcguucaucucuuauuaaa

SEQ ID NO: 1078687 - RNA, 19 nt, Homo sapiens
gcaagagcguuuauuucug

SEQ ID NO: 1078688 - RNA, 19 nt, Homo sapiens
gcuggcagaucccaucaaa

SEQ ID NO: 1078689 - RNA, 19 nt, Homo sapiens
gaaguaaacauugcaagga

SEQ ID NO: 1078690 - RNA, 19 nt, Homo sapiens
gcaaggaagccaauuugug

SEQ ID NO: 1078691 - RNA, 19 nt, Homo sapiens
gaaagugcaagguaugaug

SEQ ID NO: 1078692 - RNA, 19 nt, Homo sapiens
agggacgucuugaucauua

SEQ ID NO: 1078693 - RNA, 19 nt, Homo sapiens
gaagcugucuguucucacu

SEQ ID NO: 1078694 - RNA, 19 nt, Homo sapiens
uauauguggugaaagcuuu

SEQ ID NO: 1078695 - RNA, 19 nt, Homo sapiens
ggaagacuacccauauuag

SEQ ID NO: 1078696 - RNA, 19 nt, Homo sapiens
gcaaucgccaccuuaaaga

SEQ ID NO: 1078697 - RNA, 19 nt, Homo sapiens
gaggacuuauuccagcuaa

SEQ ID NO: 1078698 - RNA, 19 nt, Homo sapiens
ucaggugugugaaauguau

SEQ ID NO: 1078699 - RNA, 19 nt, Homo sapiens
caugaaagccagagcuaaa

SEQ ID NO: 1078700 - RNA, 19 nt, Homo sapiens
ccacagugcugagauuaca

SEQ ID NO: 1078701 - RNA, 19 nt, Homo sapiens
gagcaugaaguccagauug

SEQ ID NO: 1078702 - RNA, 19 nt, Homo sapiens
ggaggacucagguguguga

SEQ ID NO: 1078703 - RNA, 19 nt, Homo sapiens
agacaggguuucaccaugu

SEQ ID NO: 1078704 - RNA, 19 nt, Homo sapiens
caccggaccuguucaguag

SEQ ID NO: 1078705 - RNA, 19 nt, Homo sapiens
gugacucuguggauuauug

SEQ ID NO: 1078706 - RNA, 19 nt, Homo sapiens
agccagagcuaaauguauu

SEQ ID NO: 1078707 - RNA, 19 nt, Homo sapiens
uuacucagguuugcaggua

SEQ ID NO: 1078708 - RNA, 19 nt, Homo sapiens
gaccauggcccugugcuuu

SEQ ID NO: 1078709 - RNA, 19 nt, Homo sapiens
gaaagccagagcuaaaugu

SEQ ID NO: 1078710 - RNA, 19 nt, Homo sapiens
ugucucagccucccaagua

SEQ ID NO: 1078711 - RNA, 19 nt, Homo sapiens
ccacgguuccgacuucuuu

SEQ ID NO: 1078712 - RNA, 19 nt, Homo sapiens
cgaguuccuucccaugaaa

SEQ ID NO: 1078713 - RNA, 19 nt, Homo sapiens
gaaauaucucagaccagua

SEQ ID NO: 1078714 - RNA, 19 nt, Homo sapiens
gaacucuggcucucaggaa

SEQ ID NO: 1078715 - RNA, 19 nt, Homo sapiens
gcuguggacucuguacuau

SEQ ID NO: 1078716 - RNA, 19 nt, Homo sapiens
guaccugacucuggcaguu

SEQ ID NO: 1078717 - RNA, 19 nt, Homo sapiens
guuuauuucuggaggcuuu

SEQ ID NO: 1078718 - RNA, 19 nt, Homo sapiens
ccaaggaguuugccaaucc

SEQ ID NO: 1078719 - RNA, 19 nt, Homo sapiens
aaguaaacauugcaaggaa

SEQ ID NO: 1078720 - RNA, 19 nt, Homo sapiens
ugaaauugcaggcgaucua

SEQ ID NO: 1078721 - RNA, 19 nt, Homo sapiens
ccaccggaccuguucagua

SEQ ID NO: 1078722 - RNA, 19 nt, Homo sapiens
guucauaaccuguggaucu

SEQ ID NO: 1078723 - RNA, 19 nt, Homo sapiens
uuugugcguucaucucuua

SEQ ID NO: 1078724 - RNA, 19 nt, Homo sapiens
aagcaauucuccugucuca

SEQ ID NO: 1078725 - RNA, 19 nt, Homo sapiens
gacaggguuucaccauguu

SEQ ID NO: 1078726 - RNA, 19 nt, Homo sapiens
caggcugaauggugacuuu

SEQ ID NO: 1078727 - RNA, 19 nt, Homo sapiens
ggagugcaguagcgugauc

SEQ ID NO: 1078728 - RNA, 19 nt, Homo sapiens
gcaccaagagauccagaug

SEQ ID NO: 1078729 - RNA, 19 nt, Homo sapiens
gguguggucugagcagcua

SEQ ID NO: 1078730 - RNA, 19 nt, Homo sapiens
ugacucaguuugcucaucu

SEQ ID NO: 1078731 - RNA, 19 nt, Homo sapiens
ccugaaugaugacucuuga

SEQ ID NO: 1078732 - RNA, 19 nt, Homo sapiens
ccugggaacugaggacuga

SEQ ID NO: 1078733 - RNA, 19 nt, Homo sapiens
guuuaucuguguuggaaga

SEQ ID NO: 1078734 - RNA, 19 nt, Homo sapiens
gcugugguuuauaugguuu

SEQ ID NO: 1078735 - RNA, 19 nt, Homo sapiens
gcagagaaaccagaaggau

SEQ ID NO: 1078736 - RNA, 19 nt, Homo sapiens
gaacuccugaccucaagug

SEQ ID NO: 1078737 - RNA, 19 nt, Homo sapiens
cgaucuagguguggucuga

SEQ ID NO: 1078738 - RNA, 19 nt, Homo sapiens
aguaugaccuggaccaaca

SEQ ID NO: 1078739 - RNA, 19 nt, Homo sapiens
gcagcugccgguugugaaa

SEQ ID NO: 1078740 - RNA, 19 nt, Homo sapiens
ccagggacgucuugaucau

SEQ ID NO: 1078741 - RNA, 19 nt, Homo sapiens
gccaaucccacugaugaua

SEQ ID NO: 1078742 - RNA, 19 nt, Homo sapiens
gccaaacccucagugaaca

SEQ ID NO: 1078743 - RNA, 19 nt, Homo sapiens
ucaguuugcucaucuucau

SEQ ID NO: 1078744 - RNA, 19 nt, Homo sapiens
aucaagaacucacccaaga

SEQ ID NO: 1078745 - RNA, 19 nt, Homo sapiens
gagauggucggccgaggaa

SEQ ID NO: 1078746 - RNA, 19 nt, Homo sapiens
caucaucuccagacaggaa

SEQ ID NO: 1078747 - RNA, 19 nt, Homo sapiens
uggcauccuuagugcauuu

SEQ ID NO: 1078748 - RNA, 19 nt, Homo sapiens
accaagagauccagaugug

SEQ ID NO: 1078749 - RNA, 19 nt, Homo sapiens
ggacauggugcauucaaac

SEQ ID NO: 1078750 - RNA, 19 nt, Homo sapiens
agauggacauggugcauuc

SEQ ID NO: 1078751 - RNA, 19 nt, Homo sapiens
gaaauugcaggcgaucuag

SEQ ID NO: 1078752 - RNA, 19 nt, Homo sapiens
gaagacuacccauauuagg

SEQ ID NO: 1078753 - RNA, 19 nt, Homo sapiens
agcaugaaguccagauuga

SEQ ID NO: 1078754 - RNA, 19 nt, Homo sapiens
uugcugcugugguuuauau

SEQ ID NO: 1078755 - RNA, 19 nt, Homo sapiens
gaagaccgaggcaaaauga

SEQ ID NO: 1078756 - RNA, 19 nt, Homo sapiens
ggcaaucgccaccuuaaag

SEQ ID NO: 1078757 - RNA, 19 nt, Homo sapiens
gguaaugccagcaaccaau

SEQ ID NO: 1078758 - RNA, 19 nt, Homo sapiens
gauggucggccgaggaaug

SEQ ID NO: 1078759 - RNA, 19 nt, Homo sapiens
gcuggaauccucuguguac

SEQ ID NO: 1078760 - RNA, 19 nt, Homo sapiens
gcagcggcauggcaagagu

SEQ ID NO: 1078761 - RNA, 19 nt, Homo sapiens
agaaggcuguagaggcaaa

SEQ ID NO: 1078762 - RNA, 19 nt, Homo sapiens
ccgaguuccuucccaugaa

SEQ ID NO: 1078763 - RNA, 19 nt, Homo sapiens
gccccaggcuuucuucuuu

SEQ ID NO: 1078764 - RNA, 19 nt, Homo sapiens
acaggaagaccgaggcaaa

SEQ ID NO: 1078765 - RNA, 19 nt, Homo sapiens
gcaugaaguccagauugaa

SEQ ID NO: 1078766 - RNA, 19 nt, Homo sapiens
gaucuacaugggaagacua

SEQ ID NO: 1078767 - RNA, 19 nt, Homo sapiens
cauaaccuguggaucuaca

SEQ ID NO: 1078768 - RNA, 19 nt, Homo sapiens
gaacugaacugcagcuaua

SEQ ID NO: 1078769 - RNA, 19 nt, Homo sapiens
caaaguagguaaaugcuua

SEQ ID NO: 1078770 - RNA, 19 nt, Homo sapiens
uggaagagcugaugaguaa

SEQ ID NO: 1078771 - RNA, 19 nt, Homo sapiens
gaaaguggaucaagguaga

SEQ ID NO: 1078772 - RNA, 19 nt, Homo sapiens
caagagaaguggcuauuga

SEQ ID NO: 1078773 - RNA, 19 nt, Homo sapiens
ucacguggcuuccagauuu

SEQ ID NO: 1078774 - RNA, 19 nt, Homo sapiens
caggugagaucauagcuua

SEQ ID NO: 1078775 - RNA, 19 nt, Homo sapiens
aaacugcacuaguguauau

SEQ ID NO: 1078776 - RNA, 19 nt, Homo sapiens
gcagaaggacuuacuguug

SEQ ID NO: 1078777 - RNA, 19 nt, Homo sapiens
agaaguaguugccauuauu

SEQ ID NO: 1078778 - RNA, 19 nt, Homo sapiens
gaacugcagcuauagaaug

SEQ ID NO: 1078779 - RNA, 19 nt, Homo sapiens
agaggcaaguuaaguauuu

SEQ ID NO: 1078780 - RNA, 19 nt, Homo sapiens
gaaguaguugccauuauuu

SEQ ID NO: 1078781 - RNA, 19 nt, Homo sapiens
gcagaaugcauaacacuga

SEQ ID NO: 1078782 - RNA, 19 nt, Homo sapiens
gagggaauauuucaguuuc

SEQ ID NO: 1078783 - RNA, 19 nt, Homo sapiens
guauauaucagggacauua

SEQ ID NO: 1078784 - RNA, 19 nt, Homo sapiens
gaacaugcauuuucuaaag

SEQ ID NO: 1078785 - RNA, 19 nt, Homo sapiens
gcacaucugggaacuugua

SEQ ID NO: 1078786 - RNA, 19 nt, Homo sapiens
ggaauuagcaguguacaug

SEQ ID NO: 1078787 - RNA, 19 nt, Homo sapiens
guaacuaacuccuuuccau

SEQ ID NO: 1078788 - RNA, 19 nt, Homo sapiens
uagacugccuucucuuuaa

SEQ ID NO: 1078789 - RNA, 19 nt, Homo sapiens
ggucaucacggccaucaua

SEQ ID NO: 1078790 - RNA, 19 nt, Homo sapiens
ggagaccgcugccauucug

SEQ ID NO: 1078791 - RNA, 19 nt, Homo sapiens
caacguaaagcacagauga

SEQ ID NO: 1078792 - RNA, 19 nt, Homo sapiens
ucaugucgcugauccauau

SEQ ID NO: 1078793 - RNA, 19 nt, Homo sapiens
gaagugagggaauauuuca

SEQ ID NO: 1078794 - RNA, 19 nt, Homo sapiens
aaagcaaacugcacuagug

SEQ ID NO: 1078795 - RNA, 19 nt, Homo sapiens
ggaccaauguuaugucaac

SEQ ID NO: 1078796 - RNA, 19 nt, Homo sapiens
ggagcugucuucauuuagu

SEQ ID NO: 1078797 - RNA, 19 nt, Homo sapiens
ggacaaagucuuaacaaaa

SEQ ID NO: 1078798 - RNA, 19 nt, Homo sapiens
agaaguggcuauugaagug

SEQ ID NO: 1078799 - RNA, 19 nt, Homo sapiens
gcaaacugcacuaguguau

SEQ ID NO: 1078800 - RNA, 19 nt, Homo sapiens
gaccacagacuaaauacaa

SEQ ID NO: 1078801 - RNA, 19 nt, Homo sapiens
ucacggccaucauauucua

SEQ ID NO: 1078802 - RNA, 19 nt, Homo sapiens
cacauaaucagaccauaua

SEQ ID NO: 1078803 - RNA, 19 nt, Homo sapiens
uagcuuaauugcugccuuu

SEQ ID NO: 1078804 - RNA, 19 nt, Homo sapiens
gaggaccaauguuauguca

SEQ ID NO: 1078805 - RNA, 19 nt, Homo sapiens
gaccacggacaaagucuua

SEQ ID NO: 1078806 - RNA, 19 nt, Homo sapiens
guaaguggaaagauuauug

SEQ ID NO: 1078807 - RNA, 19 nt, Homo sapiens
guaaagcacagaugauugu

SEQ ID NO: 1078808 - RNA, 19 nt, Homo sapiens
ccauggaagugagggaaua

SEQ ID NO: 1078809 - RNA, 19 nt, Homo sapiens
cggacaaagucuuaacaaa

SEQ ID NO: 1078810 - RNA, 19 nt, Homo sapiens
uagaagagacgcaagagaa

SEQ ID NO: 1078811 - RNA, 19 nt, Homo sapiens
gugcacaucugggaacuug

SEQ ID NO: 1078812 - RNA, 19 nt, Homo sapiens
uuaaaugaccacagacuaa

SEQ ID NO: 1078813 - RNA, 19 nt, Homo sapiens
uuggagcugucuucauuua

SEQ ID NO: 1078814 - RNA, 19 nt, Homo sapiens
uaagaaguaguugccauua

SEQ ID NO: 1078815 - RNA, 19 nt, Homo sapiens
cggauacaguguucaaaga

SEQ ID NO: 1078816 - RNA, 19 nt, Homo sapiens
uaacuaacuccuuuccauu

SEQ ID NO: 1078817 - RNA, 19 nt, Homo sapiens
gaagugauggccucaguag

SEQ ID NO: 1078818 - RNA, 19 nt, Homo sapiens
ggcccucucuagacacaua

SEQ ID NO: 1078819 - RNA, 19 nt, Homo sapiens
gaauuagcaguguacauga

SEQ ID NO: 1078820 - RNA, 19 nt, Homo sapiens
gcuagacugccuucucuuu

SEQ ID NO: 1078821 - RNA, 19 nt, Homo sapiens
ugggauagcagaaugcaua

SEQ ID NO: 1078822 - RNA, 19 nt, Homo sapiens
aaagaguauuccugggaua

SEQ ID NO: 1078823 - RNA, 19 nt, Homo sapiens
gauacaguguucaaagaag

SEQ ID NO: 1078824 - RNA, 19 nt, Homo sapiens
ggauacaguguucaaagaa

SEQ ID NO: 1078825 - RNA, 19 nt, Homo sapiens
ucaucugccuucccgcuua

SEQ ID NO: 1078826 - RNA, 19 nt, Homo sapiens
gauagcagaaugcauaaca

SEQ ID NO: 1078827 - RNA, 19 nt, Homo sapiens
aguuggagcugucuucauu

SEQ ID NO: 1078828 - RNA, 19 nt, Homo sapiens
ggaagugagggaauauuuc

SEQ ID NO: 1078829 - RNA, 19 nt, Homo sapiens
gaugauugucugaaagaaa

SEQ ID NO: 1078830 - RNA, 19 nt, Homo sapiens
ccacaagcuuggcucacaa

SEQ ID NO: 1078831 - RNA, 19 nt, Homo sapiens
caacuaguaacucaaugaa

SEQ ID NO: 1078832 - RNA, 19 nt, Homo sapiens
cacaaauacucauauacug

SEQ ID NO: 1078833 - RNA, 19 nt, Homo sapiens
uaaaugaccacagacuaaa

SEQ ID NO: 1078834 - RNA, 19 nt, Homo sapiens
cuagacugccuucucuuua

SEQ ID NO: 1078835 - RNA, 19 nt, Homo sapiens
cugcagcuauagaauguuu

SEQ ID NO: 1078836 - RNA, 19 nt, Homo sapiens
ggugagaucauagcuuaaa

SEQ ID NO: 1078837 - RNA, 19 nt, Homo sapiens
uaaacgugucugugaauuu

SEQ ID NO: 1078838 - RNA, 19 nt, Homo sapiens
caaugugaccauccaguuu

SEQ ID NO: 1078839 - RNA, 19 nt, Homo sapiens
caucugugcugcaguaguc

SEQ ID NO: 1078840 - RNA, 19 nt, Homo sapiens
gagcugucuucauuuagug

SEQ ID NO: 1078841 - RNA, 19 nt, Homo sapiens
gcacuaguguauauaucag

SEQ ID NO: 1078842 - RNA, 19 nt, Homo sapiens
gcaagagaaguggcuauug

SEQ ID NO: 1078843 - RNA, 19 nt, Homo sapiens
ggaagugauggccucagua

SEQ ID NO: 1078844 - RNA, 19 nt, Homo sapiens
gaagagcugaugaguaaac

SEQ ID NO: 1078845 - RNA, 19 nt, Homo sapiens
caaggagaccgcugccauu

SEQ ID NO: 1078846 - RNA, 19 nt, Homo sapiens
cagacuaaauacaaaguag

SEQ ID NO: 1078847 - RNA, 19 nt, Homo sapiens
ugccuucucuuuaauuaga

SEQ ID NO: 1078848 - RNA, 19 nt, Homo sapiens
uagaggagguaaagguuag

SEQ ID NO: 1078849 - RNA, 19 nt, Homo sapiens
ucacauaaucagaccauau

SEQ ID NO: 1078850 - RNA, 19 nt, Homo sapiens
uuaaucugguacucacaua

SEQ ID NO: 1078851 - RNA, 19 nt, Homo sapiens
cagccugacuguccucaug

SEQ ID NO: 1078852 - RNA, 19 nt, Homo sapiens
caucacggccaucauauuc

SEQ ID NO: 1078853 - RNA, 19 nt, Homo sapiens
ggagaaaugagaauuagcu

SEQ ID NO: 1078854 - RNA, 19 nt, Homo sapiens
ccugaaguaugacacaaau

SEQ ID NO: 1078855 - RNA, 19 nt, Homo sapiens
gagguaaagguuaguagga

SEQ ID NO: 1078856 - RNA, 19 nt, Homo sapiens
gagaaguggcuauugaagu

SEQ ID NO: 1078857 - RNA, 19 nt, Homo sapiens
ccaaaugguaacagauauu

SEQ ID NO: 1078858 - RNA, 19 nt, Homo sapiens
aagaaguaguugccauuau

SEQ ID NO: 1078859 - RNA, 19 nt, Homo sapiens
cuagaggagguaaagguua

SEQ ID NO: 1078860 - RNA, 19 nt, Homo sapiens
gagaucauagcuuaaauac

SEQ ID NO: 1078861 - RNA, 19 nt, Homo sapiens
aaacgugucugugaauuuu

SEQ ID NO: 1078862 - RNA, 19 nt, Homo sapiens
ggugggcccucucuagaca

SEQ ID NO: 1078863 - RNA, 19 nt, Homo sapiens
gagcagaaggacuuacugu

SEQ ID NO: 1078864 - RNA, 19 nt, Homo sapiens
caacauggaagagcugaug

SEQ ID NO: 1078865 - RNA, 19 nt, Homo sapiens
caaaaggagucaacaugga

SEQ ID NO: 1078866 - RNA, 19 nt, Homo sapiens
gugagggaauauuucaguu

SEQ ID NO: 1078867 - RNA, 19 nt, Homo sapiens
gaacauucuagaggaggua

SEQ ID NO: 1078868 - RNA, 19 nt, Homo sapiens
ccaagaagcuggccaacaa

SEQ ID NO: 1078869 - RNA, 19 nt, Homo sapiens
gaggagagcugcgauaguu

SEQ ID NO: 1078870 - RNA, 19 nt, Homo sapiens
gaagagcuaagaagaauuu

SEQ ID NO: 1078871 - RNA, 19 nt, Homo sapiens
agaaguggcugacaucuuu

SEQ ID NO: 1078872 - RNA, 19 nt, Homo sapiens
caaguuguuugaugcaaua

SEQ ID NO: 1078873 - RNA, 19 nt, Homo sapiens
gaaugccaguguuaccuua

SEQ ID NO: 1078874 - RNA, 19 nt, Homo sapiens
gagcagaggaaucuauaua

SEQ ID NO: 1078875 - RNA, 19 nt, Homo sapiens
gagacgggcuucaacaaug

SEQ ID NO: 1078876 - RNA, 19 nt, Homo sapiens
agaggaagaugaagaagaa

SEQ ID NO: 1078877 - RNA, 19 nt, Homo sapiens
gaacaaagugcaauuaacu

SEQ ID NO: 1078878 - RNA, 19 nt, Homo sapiens
guaaguaaguuagagagaa

SEQ ID NO: 1078879 - RNA, 19 nt, Homo sapiens
gaaguuugcucuagagaac

SEQ ID NO: 1078880 - RNA, 19 nt, Homo sapiens
gagaugauguucccaugga

SEQ ID NO: 1078881 - RNA, 19 nt, Homo sapiens
ugaacucgaugccagauuu

SEQ ID NO: 1078882 - RNA, 19 nt, Homo sapiens
agagugaucugaauggaaa

SEQ ID NO: 1078883 - RNA, 19 nt, Homo sapiens
guagacaggugauacaaag

SEQ ID NO: 1078884 - RNA, 19 nt, Homo sapiens
agaagcaggucuagaagaa

SEQ ID NO: 1078885 - RNA, 19 nt, Homo sapiens
ggaagaggaagaugaagaa

SEQ ID NO: 1078886 - RNA, 19 nt, Homo sapiens
cagaagagcuaagaagaau

SEQ ID NO: 1078887 - RNA, 19 nt, Homo sapiens
aaacacagcgguugcaauu

SEQ ID NO: 1078888 - RNA, 19 nt, Homo sapiens
gacuuucacucuaaggaua

SEQ ID NO: 1078889 - RNA, 19 nt, Homo sapiens
gauggagucuuguucuguu

SEQ ID NO: 1078890 - RNA, 19 nt, Homo sapiens
gaaagaguuuaagggcuaa

SEQ ID NO: 1078891 - RNA, 19 nt, Homo sapiens
uaaauuugcggaagaguuu

SEQ ID NO: 1078892 - RNA, 19 nt, Homo sapiens
gaucagcuccugcacuuga

SEQ ID NO: 1078893 - RNA, 19 nt, Homo sapiens
gaacaucaaggagaacaaa

SEQ ID NO: 1078894 - RNA, 19 nt, Homo sapiens
gcuaccagaucccuaaaga

SEQ ID NO: 1078895 - RNA, 19 nt, Homo sapiens
gaagaggacuuagaaaaug

SEQ ID NO: 1078896 - RNA, 19 nt, Homo sapiens
uguggcagcuugcuacuaa

SEQ ID NO: 1078897 - RNA, 19 nt, Homo sapiens
ccagaucccuaaagaagug

SEQ ID NO: 1078898 - RNA, 19 nt, Homo sapiens
cuagagaacuucacugucu

SEQ ID NO: 1078899 - RNA, 19 nt, Homo sapiens
acacagcgguugcaauugu

SEQ ID NO: 1078900 - RNA, 19 nt, Homo sapiens
ucuccuaccuccugaguaa

SEQ ID NO: 1078901 - RNA, 19 nt, Homo sapiens
gaagacaauuaagaggaaa

SEQ ID NO: 1078902 - RNA, 19 nt, Homo sapiens
cauuggaaauuuacacuga

SEQ ID NO: 1078903 - RNA, 19 nt, Homo sapiens
gcugguagaagacaauuaa

SEQ ID NO: 1078904 - RNA, 19 nt, Homo sapiens
aaaaggagcugguagaaga

SEQ ID NO: 1078905 - RNA, 19 nt, Homo sapiens
agaagaagcaggucuagaa

SEQ ID NO: 1078906 - RNA, 19 nt, Homo sapiens
agaaugcacgugugaguua

SEQ ID NO: 1078907 - RNA, 19 nt, Homo sapiens
ugucucagccgcuaaauuu

SEQ ID NO: 1078908 - RNA, 19 nt, Homo sapiens
gaagaugaagaagaagaua

SEQ ID NO: 1078909 - RNA, 19 nt, Homo sapiens
gcacgagugaccacaguuu

SEQ ID NO: 1078910 - RNA, 19 nt, Homo sapiens
agaagacaauuaagaggaa

SEQ ID NO: 1078911 - RNA, 19 nt, Homo sapiens
gaagaaggaagacaauugg

SEQ ID NO: 1078912 - RNA, 19 nt, Homo sapiens
cgaagaaggaagacaauug

SEQ ID NO: 1078913 - RNA, 19 nt, Homo sapiens
ccauaacuguucgagauaa

SEQ ID NO: 1078914 - RNA, 19 nt, Homo sapiens
ccaugaacaucaaggagaa

SEQ ID NO: 1078915 - RNA, 19 nt, Homo sapiens
gccugaagguccagaugua

SEQ ID NO: 1078916 - RNA, 19 nt, Homo sapiens
gagaaaacauuguaugauc

SEQ ID NO: 1078917 - RNA, 19 nt, Homo sapiens
ucauucaucuggccaaguu

SEQ ID NO: 1078918 - RNA, 19 nt, Homo sapiens
gggaagauucuaccucuga

SEQ ID NO: 1078919 - RNA, 19 nt, Homo sapiens
gaugugcgcuuucauucca

SEQ ID NO: 1078920 - RNA, 19 nt, Homo sapiens
gaaauggggugggguuaaa

SEQ ID NO: 1078921 - RNA, 19 nt, Homo sapiens
aggaauaucuggagagcuu

SEQ ID NO: 1078922 - RNA, 19 nt, Homo sapiens
gaaagaaagaaagacugua

SEQ ID NO: 1078923 - RNA, 19 nt, Homo sapiens
cuaaagaaguggcugacau

SEQ ID NO: 1078924 - RNA, 19 nt, Homo sapiens
aaagugcaauuaacuguag

SEQ ID NO: 1078925 - RNA, 19 nt, Homo sapiens
caaagugcaauuaacugua

SEQ ID NO: 1078926 - RNA, 19 nt, Homo sapiens
uggaaacccucucgucaga

SEQ ID NO: 1078927 - RNA, 19 nt, Homo sapiens
gguaacacgugccaucagu

SEQ ID NO: 1078928 - RNA, 19 nt, Homo sapiens
gagauggagucuuguucug

SEQ ID NO: 1078929 - RNA, 19 nt, Homo sapiens
ggaaauuuacacugaacaa

SEQ ID NO: 1078930 - RNA, 19 nt, Homo sapiens
cauaacuguucgagauaaa

SEQ ID NO: 1078931 - RNA, 19 nt, Homo sapiens
gcacgugugaguuacuaaa

SEQ ID NO: 1078932 - RNA, 19 nt, Homo sapiens
gaccacacacaucguuuaa

SEQ ID NO: 1078933 - RNA, 19 nt, Homo sapiens
gcagagcagaggaaucuau

SEQ ID NO: 1078934 - RNA, 19 nt, Homo sapiens
caagacaugcauaccauug

SEQ ID NO: 1078935 - RNA, 19 nt, Homo sapiens
ccagauuucuucccaguac

SEQ ID NO: 1078936 - RNA, 19 nt, Homo sapiens
gaugagagccaggagaguu

SEQ ID NO: 1078937 - RNA, 19 nt, Homo sapiens
gaaagaaagacuguagaca

SEQ ID NO: 1078938 - RNA, 19 nt, Homo sapiens
gaaguggcugacaucuuua

SEQ ID NO: 1078939 - RNA, 19 nt, Homo sapiens
gaucugaauggaaagacua

SEQ ID NO: 1078940 - RNA, 19 nt, Homo sapiens
uuucugacuuucacucuaa

SEQ ID NO: 1078941 - RNA, 19 nt, Homo sapiens
cagugaugaugaagaguuu

SEQ ID NO: 1078942 - RNA, 19 nt, Homo sapiens
ucuagaagaaguaguauug

SEQ ID NO: 1078943 - RNA, 19 nt, Homo sapiens
ggagucagauuugagugau

SEQ ID NO: 1078944 - RNA, 19 nt, Homo sapiens
gaaagacuaacccagaagu

SEQ ID NO: 1078945 - RNA, 19 nt, Homo sapiens
uggaaagacuaacccagaa

SEQ ID NO: 1078946 - RNA, 19 nt, Homo sapiens
gcagcuugcuacuaaugau

SEQ ID NO: 1078947 - RNA, 19 nt, Homo sapiens
gagugaccacaguuuaaua

SEQ ID NO: 1078948 - RNA, 19 nt, Homo sapiens
caacaagacaugcauacca

SEQ ID NO: 1078949 - RNA, 19 nt, Homo sapiens
ccagccaccucaccauaga

SEQ ID NO: 1078950 - RNA, 19 nt, Homo sapiens
ugccauaacuguucgagau

SEQ ID NO: 1078951 - RNA, 19 nt, Homo sapiens
gcgcacgcuuacagaauga

SEQ ID NO: 1078952 - RNA, 19 nt, Homo sapiens
uaguauuggucuucgagua

SEQ ID NO: 1078953 - RNA, 19 nt, Homo sapiens
ucguaggucuguuugguuu

SEQ ID NO: 1078954 - RNA, 19 nt, Homo sapiens
gugcuagccucuuccuuca

SEQ ID NO: 1078955 - RNA, 19 nt, Homo sapiens
cuuggucauuggaaauuua

SEQ ID NO: 1078956 - RNA, 19 nt, Homo sapiens
uggaggauaucaccgaaga

SEQ ID NO: 1078957 - RNA, 19 nt, Homo sapiens
aaaggaccaugaacaucaa

SEQ ID NO: 1078958 - RNA, 19 nt, Homo sapiens
ggagaguucagaugcuuug

SEQ ID NO: 1078959 - RNA, 19 nt, Homo sapiens
ucgaguagccuuucaguuc

SEQ ID NO: 1078960 - RNA, 19 nt, Homo sapiens
gaagaagcaggucuagaag

SEQ ID NO: 1078961 - RNA, 19 nt, Homo sapiens
ggaagaugaagaagaagau

SEQ ID NO: 1078962 - RNA, 19 nt, Homo sapiens
gcaaagaugaccggcauag

SEQ ID NO: 1078963 - RNA, 19 nt, Homo sapiens
gguuaaaguucagguaagu

SEQ ID NO: 1078964 - RNA, 19 nt, Homo sapiens
cagagcagaggaaucuaua

SEQ ID NO: 1078965 - RNA, 19 nt, Homo sapiens
augauaaaguucuggguaa

SEQ ID NO: 1078966 - RNA, 19 nt, Homo sapiens
uagaggaaugccaguguua

SEQ ID NO: 1078967 - RNA, 19 nt, Homo sapiens
gcccugaguuaguuucuag

SEQ ID NO: 1078968 - RNA, 19 nt, Homo sapiens
ggauguugcugcuguuugu

SEQ ID NO: 1078969 - RNA, 19 nt, Homo sapiens
caucaaaggcuucccaaga

SEQ ID NO: 1078970 - RNA, 19 nt, Homo sapiens
ggaccagauucuugaacuu

SEQ ID NO: 1078971 - RNA, 19 nt, Homo sapiens
gugagccacuggaaagaaa

SEQ ID NO: 1078972 - RNA, 19 nt, Homo sapiens
caaagaagcagauggaaaa

SEQ ID NO: 1078973 - RNA, 19 nt, Homo sapiens
ccaaagaagcagauggaaa

SEQ ID NO: 1078974 - RNA, 19 nt, Homo sapiens
gaacccagcagagguguga

SEQ ID NO: 1078975 - RNA, 19 nt, Homo sapiens
gaccagauucuugaacuuu

SEQ ID NO: 1078976 - RNA, 19 nt, Homo sapiens
ggucggcccuguucacucu

SEQ ID NO: 1078977 - RNA, 19 nt, Homo sapiens
gaaagaaagcaaaacaaga

SEQ ID NO: 1078978 - RNA, 19 nt, Homo sapiens
ggcccuggauucccgcuuu

SEQ ID NO: 1078979 - RNA, 19 nt, Homo sapiens
gaaagcaaaacaagagaaa

SEQ ID NO: 1078980 - RNA, 19 nt, Homo sapiens
caaggauguugcugcuguu

SEQ ID NO: 1078981 - RNA, 19 nt, Homo sapiens
aaagcaaucccuccucaga

SEQ ID NO: 1078982 - RNA, 19 nt, Homo sapiens
ccgaagcccagcacaguuu

SEQ ID NO: 1078983 - RNA, 19 nt, Homo sapiens
caagaggcaaggagaagug

SEQ ID NO: 1078984 - RNA, 19 nt, Homo sapiens
ccacuggaaagaaagcaaa

SEQ ID NO: 1078985 - RNA, 19 nt, Homo sapiens
ccagcucgcccuucugaga

SEQ ID NO: 1078986 - RNA, 19 nt, Homo sapiens
ggaaagaaagcaaaacaag

SEQ ID NO: 1078987 - RNA, 19 nt, Homo sapiens
caccagcucgcccuucuga

SEQ ID NO: 1078988 - RNA, 19 nt, Homo sapiens
aaagaaaaccccucaagug

SEQ ID NO: 1078989 - RNA, 19 nt, Homo sapiens
gcaagaggcaaggagaagu

SEQ ID NO: 1078990 - RNA, 19 nt, Homo sapiens
gcagauggaaaacugaaaa

SEQ ID NO: 1078991 - RNA, 19 nt, Homo sapiens
gcgccuggacuccuggaaa

SEQ ID NO: 1078992 - RNA, 19 nt, Homo sapiens
aagaaaaccccucaaguga

SEQ ID NO: 1078993 - RNA, 19 nt, Homo sapiens
ccaggaggagcccaacaga

SEQ ID NO: 1078994 - RNA, 19 nt, Homo sapiens
aucaaaggcuucccaagag

SEQ ID NO: 1078995 - RNA, 19 nt, Homo sapiens
cccaucugcuucccuuuca

SEQ ID NO: 1078996 - RNA, 19 nt, Homo sapiens
cgccuggacuccuggaaag

SEQ ID NO: 1078997 - RNA, 19 nt, Homo sapiens
gaagugaggucauccuuga

SEQ ID NO: 1078998 - RNA, 19 nt, Homo sapiens
caaacagccuuaguaauua

SEQ ID NO: 1078999 - RNA, 19 nt, Homo sapiens
gaacaucacugcuuguaag

SEQ ID NO: 1079000 - RNA, 19 nt, Homo sapiens
gaacacagucuauuucauu

SEQ ID NO: 1079001 - RNA, 19 nt, Homo sapiens
gcagggaucuaucuaaugu

SEQ ID NO: 1079002 - RNA, 19 nt, Homo sapiens
uaaagcaucuucagccaaa

SEQ ID NO: 1079003 - RNA, 19 nt, Homo sapiens
acaaacagccuuaguaauu

SEQ ID NO: 1079004 - RNA, 19 nt, Homo sapiens
ucaauagcaucuuaaguga

SEQ ID NO: 1079005 - RNA, 19 nt, Homo sapiens
gugaugauccugaagcuua

SEQ ID NO: 1079006 - RNA, 19 nt, Homo sapiens
ccaaugacgucaacagugu

SEQ ID NO: 1079007 - RNA, 19 nt, Homo sapiens
uuaagguucuugugguuua

SEQ ID NO: 1079008 - RNA, 19 nt, Homo sapiens
acaaauacgugguggucua

SEQ ID NO: 1079009 - RNA, 19 nt, Homo sapiens
gaaaggaucaagaagacuu

SEQ ID NO: 1079010 - RNA, 19 nt, Homo sapiens
auacauggcucuuauccaa

SEQ ID NO: 1079011 - RNA, 19 nt, Homo sapiens
gaugguaccuguggcaaga

SEQ ID NO: 1079012 - RNA, 19 nt, Homo sapiens
gcuacaacaugaucuaauc

SEQ ID NO: 1079013 - RNA, 19 nt, Homo sapiens
cgacauaaaggaacaguug

SEQ ID NO: 1079014 - RNA, 19 nt, Homo sapiens
cuacaaacagccuuaguaa

SEQ ID NO: 1079015 - RNA, 19 nt, Homo sapiens
gaaacaaacgcgagcuuca

SEQ ID NO: 1079016 - RNA, 19 nt, Homo sapiens
acagauacauggcucuuau

SEQ ID NO: 1079017 - RNA, 19 nt, Homo sapiens
gaaggcagcagacaaaguc

SEQ ID NO: 1079018 - RNA, 19 nt, Homo sapiens
aaagaaggcagcagacaaa

SEQ ID NO: 1079019 - RNA, 19 nt, Homo sapiens
aaacaucuagucuuccaua

SEQ ID NO: 1079020 - RNA, 19 nt, Homo sapiens
ccagaacuguuuagcuaau

SEQ ID NO: 1079021 - RNA, 19 nt, Homo sapiens
acccagaacuguuuagcua

SEQ ID NO: 1079022 - RNA, 19 nt, Homo sapiens
uuacccaucugaaauaugu

SEQ ID NO: 1079023 - RNA, 19 nt, Homo sapiens
cagaacuguuuagcuaaua

SEQ ID NO: 1079024 - RNA, 19 nt, Homo sapiens
ccaaguaccaccucaugaa

SEQ ID NO: 1079025 - RNA, 19 nt, Homo sapiens
gcagcugacuccauauuuu

SEQ ID NO: 1079026 - RNA, 19 nt, Homo sapiens
gaagaaugaggagacagua

SEQ ID NO: 1079027 - RNA, 19 nt, Homo sapiens
ggaugccacugcuuucugu

SEQ ID NO: 1079028 - RNA, 19 nt, Homo sapiens
ugaaggaugccacugcuuu

SEQ ID NO: 1079029 - RNA, 19 nt, Homo sapiens
cagaguggaugcuacaaca

SEQ ID NO: 1079030 - RNA, 19 nt, Homo sapiens
gguuuacccaucugaaaua

SEQ ID NO: 1079031 - RNA, 19 nt, Homo sapiens
ccaaacaucuagucuucca

SEQ ID NO: 1079032 - RNA, 19 nt, Homo sapiens
gcaaauaugaaugaagaug

SEQ ID NO: 1079033 - RNA, 19 nt, Homo sapiens
caauguggcucugaaacug

SEQ ID NO: 1079034 - RNA, 19 nt, Homo sapiens
cggugcagcugacuccaua

SEQ ID NO: 1079035 - RNA, 19 nt, Homo sapiens
caucacugcuuguaagaag

SEQ ID NO: 1079036 - RNA, 19 nt, Homo sapiens
gaaugaggagacaguagaa

SEQ ID NO: 1079037 - RNA, 19 nt, Homo sapiens
cgauuggaaacuacauuua

SEQ ID NO: 1079038 - RNA, 19 nt, Homo sapiens
gaagcaagagaccuuaaag

SEQ ID NO: 1079039 - RNA, 19 nt, Homo sapiens
gagaagcaagagaccuuaa

SEQ ID NO: 1079040 - RNA, 19 nt, Homo sapiens
cuaagaagccagauucauc

SEQ ID NO: 1079041 - RNA, 19 nt, Homo sapiens
cauuaagguucuugugguu

SEQ ID NO: 1079042 - RNA, 19 nt, Homo sapiens
gagcugaacacagucuauu

SEQ ID NO: 1079043 - RNA, 19 nt, Homo sapiens
ccuacaaacagccuuagua

SEQ ID NO: 1079044 - RNA, 19 nt, Homo sapiens
uaagaagaaugaggagaca

SEQ ID NO: 1079045 - RNA, 19 nt, Homo sapiens
aaagcaacuuccaguccua

SEQ ID NO: 1079046 - RNA, 19 nt, Homo sapiens
cuucaaagcuguuuuauac

SEQ ID NO: 1079047 - RNA, 19 nt, Homo sapiens
guagaaccuguuacaacua

SEQ ID NO: 1079048 - RNA, 19 nt, Homo sapiens
uagaaccuguuacaacuag

SEQ ID NO: 1079049 - RNA, 19 nt, Homo sapiens
gaaggaugccacugcuuuc

SEQ ID NO: 1079050 - RNA, 19 nt, Homo sapiens
caaagucgucuuccuucuu

SEQ ID NO: 1079051 - RNA, 19 nt, Homo sapiens
uggcagggaucuaucuaau

SEQ ID NO: 1079052 - RNA, 19 nt, Homo sapiens
gcgacugcauccgacauaa

SEQ ID NO: 1079053 - RNA, 19 nt, Homo sapiens
gaguagaaccuguuacaac

SEQ ID NO: 1079054 - RNA, 19 nt, Homo sapiens
guugaaggccaccaagauu

SEQ ID NO: 1079055 - RNA, 19 nt, Homo sapiens
caacuucaaagcuguuuua

SEQ ID NO: 1079056 - RNA, 19 nt, Homo sapiens
gaggagacaguagaaguga

SEQ ID NO: 1079057 - RNA, 19 nt, Homo sapiens
gcugaacacagucuauuuc

SEQ ID NO: 1079058 - RNA, 19 nt, Homo sapiens
gauccgaacaucacugcuu

SEQ ID NO: 1079059 - RNA, 19 nt, Homo sapiens
agccaaacaucuagucuuc

SEQ ID NO: 1079060 - RNA, 19 nt, Homo sapiens
gcccauaauauuccuaaug

SEQ ID NO: 1079061 - RNA, 19 nt, Homo sapiens
ugugugaggugcaauuaca

SEQ ID NO: 1079062 - RNA, 19 nt, Homo sapiens
ugaaggccaccaagauuug

SEQ ID NO: 1079063 - RNA, 19 nt, Homo sapiens
gagagccgaccguucaaug

SEQ ID NO: 1079064 - RNA, 19 nt, Homo sapiens
gauggcugcugcuccuugu

SEQ ID NO: 1079065 - RNA, 19 nt, Homo sapiens
gaaccuguuacaacuagug

SEQ ID NO: 1079066 - RNA, 19 nt, Homo sapiens
gaugcuacaacaugaucua

SEQ ID NO: 1079067 - RNA, 19 nt, Homo sapiens
gaguggaugcuacaacaug

SEQ ID NO: 1079068 - RNA, 19 nt, Homo sapiens
gcacgaaaggaucaagaag

SEQ ID NO: 1079069 - RNA, 19 nt, Homo sapiens
cgacugcauccgacauaaa

SEQ ID NO: 1079070 - RNA, 19 nt, Homo sapiens
gcccuuccaugucugugaa

SEQ ID NO: 1079071 - RNA, 19 nt, Homo sapiens
cccauaauauuccuaaugc

SEQ ID NO: 1079072 - RNA, 19 nt, Homo sapiens
cucaauagcaucuuaagug

SEQ ID NO: 1079073 - RNA, 19 nt, Homo sapiens
aguagaaccuguuacaacu

SEQ ID NO: 1079074 - RNA, 19 nt, Homo sapiens
ccuuguagcccacccauga

SEQ ID NO: 1079075 - RNA, 19 nt, Homo sapiens
uuucugcagugaucuaaga

SEQ ID NO: 1079076 - RNA, 19 nt, Homo sapiens
ccucacugauucacucaau

SEQ ID NO: 1079077 - RNA, 19 nt, Homo sapiens
gauuggaaacuacauuuac

SEQ ID NO: 1079078 - RNA, 19 nt, Homo sapiens
uagcauuaacuaacgauug

SEQ ID NO: 1079079 - RNA, 19 nt, Homo sapiens
gagccgaccguucaaugug

SEQ ID NO: 1079080 - RNA, 19 nt, Homo sapiens
gagcuucaguggugauucc

SEQ ID NO: 1079081 - RNA, 19 nt, Homo sapiens
cgaacaucacugcuuguaa

SEQ ID NO: 1079082 - RNA, 19 nt, Homo sapiens
uuacuaugcagccuacaaa

SEQ ID NO: 1079083 - RNA, 19 nt, Homo sapiens
acaggggacuauucaauuu

SEQ ID NO: 1079084 - RNA, 19 nt, Homo sapiens
cacgaaaggaucaagaaga

SEQ ID NO: 1079085 - RNA, 19 nt, Homo sapiens
acaaacaggcgucccuuuc

SEQ ID NO: 1079086 - RNA, 19 nt, Homo sapiens
cauccgacauaaaggaaca

SEQ ID NO: 1079087 - RNA, 19 nt, Homo sapiens
gcugugugaggugcaauua

SEQ ID NO: 1079088 - RNA, 19 nt, Homo sapiens
acauggcucuuauccaaca

SEQ ID NO: 1079089 - RNA, 19 nt, Homo sapiens
agaaugaggagacaguaga

SEQ ID NO: 1079090 - RNA, 19 nt, Homo sapiens
ucacugauucacucaauag

SEQ ID NO: 1079091 - RNA, 19 nt, Homo sapiens
ggaaacuacauuuacaacu

SEQ ID NO: 1079092 - RNA, 19 nt, Homo sapiens
gccagcauccgcuuguuga

SEQ ID NO: 1079093 - RNA, 19 nt, Homo sapiens
cagaggccuuccagacuca

SEQ ID NO: 1079094 - RNA, 19 nt, Homo sapiens
aacacagucuauuucauug

SEQ ID NO: 1079095 - RNA, 19 nt, Homo sapiens
caauagcaucuuaagugaa

SEQ ID NO: 1079096 - RNA, 19 nt, Homo sapiens
gccuagaccacauaaugaa

SEQ ID NO: 1079097 - RNA, 19 nt, Homo sapiens
gaagugaggucauccuuga

SEQ ID NO: 1079098 - RNA, 19 nt, Homo sapiens
caaacagccuuaguaauua

SEQ ID NO: 1079099 - RNA, 19 nt, Homo sapiens
uaagcgaacugguauguua

SEQ ID NO: 1079100 - RNA, 19 nt, Homo sapiens
gaacaucacugcuuguaag

SEQ ID NO: 1079101 - RNA, 19 nt, Homo sapiens
guaaggagcuuccaugcuu

SEQ ID NO: 1079102 - RNA, 19 nt, Homo sapiens
gaacacagucuauuucauu

SEQ ID NO: 1079103 - RNA, 19 nt, Homo sapiens
gcagggaucuaucuaaugu

SEQ ID NO: 1079104 - RNA, 19 nt, Homo sapiens
uaaagcaucuucagccaaa

SEQ ID NO: 1079105 - RNA, 19 nt, Homo sapiens
acaaacagccuuaguaauu

SEQ ID NO: 1079106 - RNA, 19 nt, Homo sapiens
ucaauagcaucuuaaguga

SEQ ID NO: 1079107 - RNA, 19 nt, Homo sapiens
gugaugauccugaagcuua

SEQ ID NO: 1079108 - RNA, 19 nt, Homo sapiens
ugaguucucucuugucaaa

SEQ ID NO: 1079109 - RNA, 19 nt, Homo sapiens
ccaaugacgucaacagugu

SEQ ID NO: 1079110 - RNA, 19 nt, Homo sapiens
uuaagguucuugugguuua

SEQ ID NO: 1079111 - RNA, 19 nt, Homo sapiens
gaugaguucucucuuguca

SEQ ID NO: 1079112 - RNA, 19 nt, Homo sapiens
acaaauacgugguggucua

SEQ ID NO: 1079113 - RNA, 19 nt, Homo sapiens
gaaaggaucaagaagacuu

SEQ ID NO: 1079114 - RNA, 19 nt, Homo sapiens
gagcuuccaugcuucauuc

SEQ ID NO: 1079115 - RNA, 19 nt, Homo sapiens
ccauagacuucccuuacua

SEQ ID NO: 1079116 - RNA, 19 nt, Homo sapiens
gaagacuguuccaucauuc

SEQ ID NO: 1079117 - RNA, 19 nt, Homo sapiens
auacauggcucuuauccaa

SEQ ID NO: 1079118 - RNA, 19 nt, Homo sapiens
ucacagacacucagggaua

SEQ ID NO: 1079119 - RNA, 19 nt, Homo sapiens
gaugguaccuguggcaaga

SEQ ID NO: 1079120 - RNA, 19 nt, Homo sapiens
gcuacaacaugaucuaauc

SEQ ID NO: 1079121 - RNA, 19 nt, Homo sapiens
cgacauaaaggaacaguug

SEQ ID NO: 1079122 - RNA, 19 nt, Homo sapiens
gccuuuaacugcaagauga

SEQ ID NO: 1079123 - RNA, 19 nt, Homo sapiens
cuacaaacagccuuaguaa

SEQ ID NO: 1079124 - RNA, 19 nt, Homo sapiens
acaggaaguuggagcagua

SEQ ID NO: 1079125 - RNA, 19 nt, Homo sapiens
agaagacuguuccaucauu

SEQ ID NO: 1079126 - RNA, 19 nt, Homo sapiens
gaaacaaacgcgagcuuca

SEQ ID NO: 1079127 - RNA, 19 nt, Homo sapiens
acagauacauggcucuuau

SEQ ID NO: 1079128 - RNA, 19 nt, Homo sapiens
ugacaacacuagagguaug

SEQ ID NO: 1079129 - RNA, 19 nt, Homo sapiens
gaaggcagcagacaaaguc

SEQ ID NO: 1079130 - RNA, 19 nt, Homo sapiens
aaagaaggcagcagacaaa

SEQ ID NO: 1079131 - RNA, 19 nt, Homo sapiens
ggucucgggucacugguuu

SEQ ID NO: 1079132 - RNA, 19 nt, Homo sapiens
gaaaugggaagguuugagu

SEQ ID NO: 1079133 - RNA, 19 nt, Homo sapiens
aaacaucuagucuuccaua

SEQ ID NO: 1079134 - RNA, 19 nt, Homo sapiens
ccagaacuguuuagcuaau

SEQ ID NO: 1079135 - RNA, 19 nt, Homo sapiens
acccagaacuguuuagcua

SEQ ID NO: 1079136 - RNA, 19 nt, Homo sapiens
uuacccaucugaaauaugu

SEQ ID NO: 1079137 - RNA, 19 nt, Homo sapiens
gauaugaccuagcccuuuu

SEQ ID NO: 1079138 - RNA, 19 nt, Homo sapiens
cagaacuguuuagcuaaua

SEQ ID NO: 1079139 - RNA, 19 nt, Homo sapiens
gaaccauagacuucccuua

SEQ ID NO: 1079140 - RNA, 19 nt, Homo sapiens
ggauagcaguaccauuuua

SEQ ID NO: 1079141 - RNA, 19 nt, Homo sapiens
ggagggaagggacauagaa

SEQ ID NO: 1079142 - RNA, 19 nt, Homo sapiens
ccaaguaccaccucaugaa

SEQ ID NO: 1079143 - RNA, 19 nt, Homo sapiens
ccagaaagaagggaaguuu

SEQ ID NO: 1079144 - RNA, 19 nt, Homo sapiens
gaagaaugaggagacagua

SEQ ID NO: 1079145 - RNA, 19 nt, Homo sapiens
ggaugccacugcuuucugu

SEQ ID NO: 1079146 - RNA, 19 nt, Homo sapiens
auagaagacuguuccauca

SEQ ID NO: 1079147 - RNA, 19 nt, Homo sapiens
gugcuacggugcagguaaa

SEQ ID NO: 1079148 - RNA, 19 nt, Homo sapiens
ugaaggaugccacugcuuu

SEQ ID NO: 1079149 - RNA, 19 nt, Homo sapiens
cagaguggaugcuacaaca

SEQ ID NO: 1079150 - RNA, 19 nt, Homo sapiens
gguuuacccaucugaaaua

SEQ ID NO: 1079151 - RNA, 19 nt, Homo sapiens
guaugucucuuucaacucu

SEQ ID NO: 1079152 - RNA, 19 nt, Homo sapiens
ccaaacaucuagucuucca

SEQ ID NO: 1079153 - RNA, 19 nt, Homo sapiens
guacaaaguuuagguucag

SEQ ID NO: 1079154 - RNA, 19 nt, Homo sapiens
gcaaauaugaaugaagaug

SEQ ID NO: 1079155 - RNA, 19 nt, Homo sapiens
uuaguaacguguacaaagu

SEQ ID NO: 1079156 - RNA, 19 nt, Homo sapiens
caauguggcucugaaacug

SEQ ID NO: 1079157 - RNA, 19 nt, Homo sapiens
caucacugcuuguaagaag

SEQ ID NO: 1079158 - RNA, 19 nt, Homo sapiens
gcgaacugguauguuagua

SEQ ID NO: 1079159 - RNA, 19 nt, Homo sapiens
caugacaacacuagaggua

SEQ ID NO: 1079160 - RNA, 19 nt, Homo sapiens
gaucacugcugcuccuuuu

SEQ ID NO: 1079161 - RNA, 19 nt, Homo sapiens
agggauagcaguaccauuu

SEQ ID NO: 1079162 - RNA, 19 nt, Homo sapiens
aaggaugaguucucucuug

SEQ ID NO: 1079163 - RNA, 19 nt, Homo sapiens
gaaugaggagacaguagaa

SEQ ID NO: 1079164 - RNA, 19 nt, Homo sapiens
cgauuggaaacuacauuua

SEQ ID NO: 1079165 - RNA, 19 nt, Homo sapiens
gaagcaagagaccuuaaag

SEQ ID NO: 1079166 - RNA, 19 nt, Homo sapiens
gagaagcaagagaccuuaa

SEQ ID NO: 1079167 - RNA, 19 nt, Homo sapiens
cuaagaagccagauucauc

SEQ ID NO: 1079168 - RNA, 19 nt, Homo sapiens
cauuaagguucuugugguu

SEQ ID NO: 1079169 - RNA, 19 nt, Homo sapiens
gagcugaacacagucuauu

SEQ ID NO: 1079170 - RNA, 19 nt, Homo sapiens
ccuacaaacagccuuagua

SEQ ID NO: 1079171 - RNA, 19 nt, Homo sapiens
uuccucagcugacuccaua

SEQ ID NO: 1079172 - RNA, 19 nt, Homo sapiens
uaagaagaaugaggagaca

SEQ ID NO: 1079173 - RNA, 19 nt, Homo sapiens
aaagcaacuuccaguccua

SEQ ID NO: 1079174 - RNA, 19 nt, Homo sapiens
guagaaccuguuacaacua

SEQ ID NO: 1079175 - RNA, 19 nt, Homo sapiens
cuucaaagcuguuuuauac

SEQ ID NO: 1079176 - RNA, 19 nt, Homo sapiens
gaaggaugccacugcuuuc

SEQ ID NO: 1079177 - RNA, 19 nt, Homo sapiens
caaagucgucuuccuucuu

SEQ ID NO: 1079178 - RNA, 19 nt, Homo sapiens
uggcagggaucuaucuaau

SEQ ID NO: 1079179 - RNA, 19 nt, Homo sapiens
gcgacugcauccgacauaa

SEQ ID NO: 1079180 - RNA, 19 nt, Homo sapiens
ugacuuuagggcuuuguua

SEQ ID NO: 1079181 - RNA, 19 nt, Homo sapiens
uagaaccuguuacaacuag

SEQ ID NO: 1079182 - RNA, 19 nt, Homo sapiens
ccaguuaaguggcguucau

SEQ ID NO: 1079183 - RNA, 19 nt, Homo sapiens
guugaaggccaccaagauu

SEQ ID NO: 1079184 - RNA, 19 nt, Homo sapiens
gaguagaaccuguuacaac

SEQ ID NO: 1079185 - RNA, 19 nt, Homo sapiens
guaggagucuuggugagau

SEQ ID NO: 1079186 - RNA, 19 nt, Homo sapiens
caacuucaaagcuguuuua

SEQ ID NO: 1079187 - RNA, 19 nt, Homo sapiens
gggcgaagccagaaagaag

SEQ ID NO: 1079188 - RNA, 19 nt, Homo sapiens
gggaaaaugugcaugacaa

SEQ ID NO: 1079189 - RNA, 19 nt, Homo sapiens
cgaacugguauguuaguaa

SEQ ID NO: 1079190 - RNA, 19 nt, Homo sapiens
auuaauggcugcugaccuu

SEQ ID NO: 1079191 - RNA, 19 nt, Homo sapiens
gaggagacaguagaaguga

SEQ ID NO: 1079192 - RNA, 19 nt, Homo sapiens
gcugaacacagucuauuuc

SEQ ID NO: 1079193 - RNA, 19 nt, Homo sapiens
gauccgaacaucacugcuu

SEQ ID NO: 1079194 - RNA, 19 nt, Homo sapiens
agccaaacaucuagucuuc

SEQ ID NO: 1079195 - RNA, 19 nt, Homo sapiens
ugaaggccaccaagauuug

SEQ ID NO: 1079196 - RNA, 19 nt, Homo sapiens
ugugugaggugcaauuaca

SEQ ID NO: 1079197 - RNA, 19 nt, Homo sapiens
ggacuggaauuauagauua

SEQ ID NO: 1079198 - RNA, 19 nt, Homo sapiens
ggaaucaaaugcuccauaa

SEQ ID NO: 1079199 - RNA, 19 nt, Homo sapiens
gaaaguacccugaccuuaa

SEQ ID NO: 1079200 - RNA, 19 nt, Homo sapiens
gaaauacguuaccuaauag

SEQ ID NO: 1079201 - RNA, 19 nt, Homo sapiens
gcaagaaauucauuccauu

SEQ ID NO: 1079202 - RNA, 19 nt, Homo sapiens
ccacaaaguucuagcuauu

SEQ ID NO: 1079203 - RNA, 19 nt, Homo sapiens
gauccucauucccuuauua

SEQ ID NO: 1079204 - RNA, 19 nt, Homo sapiens
gacugaagguaaaugaaua

SEQ ID NO: 1079205 - RNA, 19 nt, Homo sapiens
gaaagaaauacguuaccua

SEQ ID NO: 1079206 - RNA, 19 nt, Homo sapiens
uuguugagcuuaaccauua

SEQ ID NO: 1079207 - RNA, 19 nt, Homo sapiens
ggaaaguacccugaccuua

SEQ ID NO: 1079208 - RNA, 19 nt, Homo sapiens
ggauuuacaucacucuuuc

SEQ ID NO: 1079209 - RNA, 19 nt, Homo sapiens
gcccugaacucaauaacug

SEQ ID NO: 1079210 - RNA, 19 nt, Homo sapiens
ggauucugguugucacuuu

SEQ ID NO: 1079211 - RNA, 19 nt, Homo sapiens
uagcuuuggugcuuaguuu

SEQ ID NO: 1079212 - RNA, 19 nt, Homo sapiens
aaaguacccugaccuuaau

SEQ ID NO: 1079213 - RNA, 19 nt, Homo sapiens
guuaagagaauguugugua

SEQ ID NO: 1079214 - RNA, 19 nt, Homo sapiens
gagauuaccagcaaugugu

SEQ ID NO: 1079215 - RNA, 19 nt, Homo sapiens
gcaguaugcuaaaguaagg

SEQ ID NO: 1079216 - RNA, 19 nt, Homo sapiens
uggcaagacugaagguaaa

SEQ ID NO: 1079217 - RNA, 19 nt, Homo sapiens
auacagcccugaacucaau

SEQ ID NO: 1079218 - RNA, 19 nt, Homo sapiens
gagaagggauuuacaucac

SEQ ID NO: 1079219 - RNA, 19 nt, Homo sapiens
cgauggcgcugcugauuca

SEQ ID NO: 1079220 - RNA, 19 nt, Homo sapiens
gcaggaggugguagacuaa

SEQ ID NO: 1079221 - RNA, 19 nt, Homo sapiens
ucccagagguuaagagaau

SEQ ID NO: 1079222 - RNA, 19 nt, Homo sapiens
cagugugguuugucuaauu

SEQ ID NO: 1079223 - RNA, 19 nt, Homo sapiens
aucaaaugcuccauaagua

SEQ ID NO: 1079224 - RNA, 19 nt, Homo sapiens
uuccuuagcuuauuuguag

SEQ ID NO: 1079225 - RNA, 19 nt, Homo sapiens
cucauucccuuauuagaaa

SEQ ID NO: 1079226 - RNA, 19 nt, Homo sapiens
gccacaaaguucuagcuau

SEQ ID NO: 1079227 - RNA, 19 nt, Homo sapiens
gaaaagcaggauauuauga

SEQ ID NO: 1079228 - RNA, 19 nt, Homo sapiens
caagacugaagguaaauga

SEQ ID NO: 1079229 - RNA, 19 nt, Homo sapiens
gggauuuacaucacucuuu

SEQ ID NO: 1079230 - RNA, 19 nt, Homo sapiens
gguuaugucuagcugugaa

SEQ ID NO: 1079231 - RNA, 19 nt, Homo sapiens
ucaaaugcuccauaaguau

SEQ ID NO: 1079232 - RNA, 19 nt, Homo sapiens
ccaucgagauuaccagcaa

SEQ ID NO: 1079233 - RNA, 19 nt, Homo sapiens
gaacuuuugcugucacaua

SEQ ID NO: 1079234 - RNA, 19 nt, Homo sapiens
ucaguggucguuugaguuu

SEQ ID NO: 1079235 - RNA, 19 nt, Homo sapiens
caucaguggucguuugagu

SEQ ID NO: 1079236 - RNA, 19 nt, Homo sapiens
ggaagcaggaggugguaga

SEQ ID NO: 1079237 - RNA, 19 nt, Homo sapiens
uaaggcagccacaaaguuc

SEQ ID NO: 1079238 - RNA, 19 nt, Homo sapiens
ucucuuccuuagcuuauuu

SEQ ID NO: 1079239 - RNA, 19 nt, Homo sapiens
gcagauggcaagacugaag

SEQ ID NO: 1079240 - RNA, 19 nt, Homo sapiens
ccucauucccuuauuagaa

SEQ ID NO: 1079241 - RNA, 19 nt, Homo sapiens
ugaacucaauaacuguuug

SEQ ID NO: 1079242 - RNA, 19 nt, Homo sapiens
guuaugaguuuucgguuaa

SEQ ID NO: 1079243 - RNA, 19 nt, Homo sapiens
caaaugcuccauaaguauc

SEQ ID NO: 1079244 - RNA, 19 nt, Homo sapiens
uagaaaagcuuccuaacca

SEQ ID NO: 1079245 - RNA, 19 nt, Homo sapiens
ucuuauaggacuggaauua

SEQ ID NO: 1079246 - RNA, 19 nt, Homo sapiens
aaucaaaugcuccauaagu

SEQ ID NO: 1079247 - RNA, 19 nt, Homo sapiens
gucuagcugugaauauauu

SEQ ID NO: 1079248 - RNA, 19 nt, Homo sapiens
gagccagugugguuugucu

SEQ ID NO: 1079249 - RNA, 19 nt, Homo sapiens
agcaggaggugguagacua

SEQ ID NO: 1079250 - RNA, 19 nt, Homo sapiens
cuaauagugugaggaagga

SEQ ID NO: 1079251 - RNA, 19 nt, Homo sapiens
cgcaagaaauucauuccau

SEQ ID NO: 1079252 - RNA, 19 nt, Homo sapiens
ugagaagggauuuacauca

SEQ ID NO: 1079253 - RNA, 19 nt, Homo sapiens
augaagguauuguggguuu

SEQ ID NO: 1079254 - RNA, 19 nt, Homo sapiens
gcaggauauuaugaaggua

SEQ ID NO: 1079255 - RNA, 19 nt, Homo sapiens
gcuccauaaguauccauua

SEQ ID NO: 1079256 - RNA, 19 nt, Homo sapiens
aaaggcagauggcaagacu

SEQ ID NO: 1079257 - RNA, 19 nt, Homo sapiens
guguugcaauuuaucauca

SEQ ID NO: 1079258 - RNA, 19 nt, Homo sapiens
ugugaggaaggaauuauuu

SEQ ID NO: 1079259 - RNA, 19 nt, Homo sapiens
caauguguaguaccugaaa

SEQ ID NO: 1079260 - RNA, 19 nt, Homo sapiens
gcaugcaguaccugagaaa

SEQ ID NO: 1079261 - RNA, 19 nt, Homo sapiens
uuuccaugcucugauauuu

SEQ ID NO: 1079262 - RNA, 19 nt, Homo sapiens
gagguuaagagaauguugu

SEQ ID NO: 1079263 - RNA, 19 nt, Homo sapiens
aaagcaggauauuaugaag

SEQ ID NO: 1079264 - RNA, 19 nt, Homo sapiens
agacugaagguaaaugaau

SEQ ID NO: 1079265 - RNA, 19 nt, Homo sapiens
cuuaguuuguugagcuuaa

SEQ ID NO: 1079266 - RNA, 19 nt, Homo sapiens
cuuguuagcuuuggugcuu

SEQ ID NO: 1079267 - RNA, 19 nt, Homo sapiens
cacaaaguucuagcuauuu

SEQ ID NO: 1079268 - RNA, 19 nt, Homo sapiens
gccagugugguuugucuaa

SEQ ID NO: 1079269 - RNA, 19 nt, Homo sapiens
gacuggaauuauagauuag

SEQ ID NO: 1079270 - RNA, 19 nt, Homo sapiens
ggauccucauucccuuauu

SEQ ID NO: 1079271 - RNA, 19 nt, Homo sapiens
acccugaccuuaaucuugu

SEQ ID NO: 1079272 - RNA, 19 nt, Homo sapiens
uuaaggcagccacaaaguu

SEQ ID NO: 1079273 - RNA, 19 nt, Homo sapiens
aguuugagcgcaagaaauu

SEQ ID NO: 1079274 - RNA, 19 nt, Homo sapiens
gcaauguguaguaccugaa

SEQ ID NO: 1079275 - RNA, 19 nt, Homo sapiens
gcaagacugaagguaaaug

SEQ ID NO: 1079276 - RNA, 19 nt, Homo sapiens
augccagacuuuagugaaa

SEQ ID NO: 1079277 - RNA, 19 nt, Homo sapiens
augucuagcugugaauaua

SEQ ID NO: 1079278 - RNA, 19 nt, Homo sapiens
agugugguuugucuaauug

SEQ ID NO: 1079279 - RNA, 19 nt, Homo sapiens
ugcaguaccugagaaagau

SEQ ID NO: 1079280 - RNA, 19 nt, Homo sapiens
caagagugagaagggauuu

SEQ ID NO: 1079281 - RNA, 19 nt, Homo sapiens
cauuaacuaugauguuucg

SEQ ID NO: 1079282 - RNA, 19 nt, Homo sapiens
gagcgcaagaaauucauuc

SEQ ID NO: 1079283 - RNA, 19 nt, Homo sapiens
uagcaacuccuaauucacu

SEQ ID NO: 1079284 - RNA, 19 nt, Homo sapiens
uaugugauucucucuguug

SEQ ID NO: 1079285 - RNA, 19 nt, Homo sapiens
caucuuauaggacuggaau

SEQ ID NO: 1079286 - RNA, 19 nt, Homo sapiens
auucaucaguggucguuug

SEQ ID NO: 1079287 - RNA, 19 nt, Homo sapiens
agagaauguuguguauuuc

SEQ ID NO: 1079288 - RNA, 19 nt, Homo sapiens
cuaauucacuagggauucu

SEQ ID NO: 1079289 - RNA, 19 nt, Homo sapiens
cccuuucucuuucucuuga

SEQ ID NO: 1079290 - RNA, 19 nt, Homo sapiens
caggauauuaugaagguau

SEQ ID NO: 1079291 - RNA, 19 nt, Homo sapiens
cacuagggauucugguugu

SEQ ID NO: 1079292 - RNA, 19 nt, Homo sapiens
gugguagacuaaaauacua

SEQ ID NO: 1079293 - RNA, 19 nt, Homo sapiens
ucaagagugagaagggauu

SEQ ID NO: 1079294 - RNA, 19 nt, Homo sapiens
uaauacucaugccagacuu

SEQ ID NO: 1079295 - RNA, 19 nt, Homo sapiens
uuuaugugauucucucugu

SEQ ID NO: 1079296 - RNA, 19 nt, Homo sapiens
uuauuaaggcagccacaaa

SEQ ID NO: 1079297 - RNA, 19 nt, Homo sapiens
gaauaaagguagcuaaucu

SEQ ID NO: 1079298 - RNA, 19 nt, Homo sapiens
gaaguuaauggacuguuua

SEQ ID NO: 1079299 - RNA, 19 nt, Homo sapiens
gggaggacuuuaagaauga

SEQ ID NO: 1079300 - RNA, 19 nt, Homo sapiens
gaagaccgcucgggcauuc

SEQ ID NO: 1079301 - RNA, 19 nt, Homo sapiens
gaagugauccacagcauuc

SEQ ID NO: 1079302 - RNA, 19 nt, Homo sapiens
aaagguagcuaaucucauc

SEQ ID NO: 1079303 - RNA, 19 nt, Homo sapiens
guuaauggacuguuuauug

SEQ ID NO: 1079304 - RNA, 19 nt, Homo sapiens
gaaugacugagaacuauuu

SEQ ID NO: 1079305 - RNA, 19 nt, Homo sapiens
ggacaugaggugagaggua

SEQ ID NO: 1079306 - RNA, 19 nt, Homo sapiens
agucaaggcucagagaaua

SEQ ID NO: 1079307 - RNA, 19 nt, Homo sapiens
gguagcuaaucucaucaua

SEQ ID NO: 1079308 - RNA, 19 nt, Homo sapiens
uaagaaugacugagaacua

SEQ ID NO: 1079309 - RNA, 19 nt, Homo sapiens
gacaugaggugagagguau

SEQ ID NO: 1079310 - RNA, 19 nt, Homo sapiens
agaaguuaauggacuguuu

SEQ ID NO: 1079311 - RNA, 19 nt, Homo sapiens
gagaauaaagguagcuaau

SEQ ID NO: 1079312 - RNA, 19 nt, Homo sapiens
uuucagaaguucagucuau

SEQ ID NO: 1079313 - RNA, 19 nt, Homo sapiens
aagaaugacugagaacuau

SEQ ID NO: 1079314 - RNA, 19 nt, Homo sapiens
ugagagggcuugcaaagac

SEQ ID NO: 1079315 - RNA, 19 nt, Homo sapiens
guagcuaaucucaucauaa

SEQ ID NO: 1079316 - RNA, 19 nt, Homo sapiens
ggagacgacgacaguguuu

SEQ ID NO: 1079317 - RNA, 19 nt, Homo sapiens
uggcuucucuuuaaucuag

SEQ ID NO: 1079318 - RNA, 19 nt, Homo sapiens
ggagagacuugcuuuuguu

SEQ ID NO: 1079319 - RNA, 19 nt, Homo sapiens
gaaagcaagaaguuaaugg

SEQ ID NO: 1079320 - RNA, 19 nt, Homo sapiens
uaaucuaggucccauugug

SEQ ID NO: 1079321 - RNA, 19 nt, Homo sapiens
gcagaagggugcgccucuu

SEQ ID NO: 1079322 - RNA, 19 nt, Homo sapiens
ggaagugauccacagcauu

SEQ ID NO: 1079323 - RNA, 19 nt, Homo sapiens
ccugaaagcaagaaguuaa

SEQ ID NO: 1079324 - RNA, 19 nt, Homo sapiens
cagacgggcuuugccauug

SEQ ID NO: 1079325 - RNA, 19 nt, Homo sapiens
gagggaggacuuuaagaau

SEQ ID NO: 1079326 - RNA, 19 nt, Homo sapiens
ugagggaggacuuuaagaa

SEQ ID NO: 1079327 - RNA, 19 nt, Homo sapiens
gauggcuucucuuuaaucu

SEQ ID NO: 1079328 - RNA, 19 nt, Homo sapiens
ucagaaguucagucuauuu

SEQ ID NO: 1079329 - RNA, 19 nt, Homo sapiens
gacaccacguucaccaaga

SEQ ID NO: 1079330 - RNA, 19 nt, Homo sapiens
agggaggacuuuaagaaug

SEQ ID NO: 1079331 - RNA, 19 nt, Homo sapiens
ucauagcacugaaguugca

SEQ ID NO: 1079332 - RNA, 19 nt, Homo sapiens
gaagggaagaaggaaguga

SEQ ID NO: 1079333 - RNA, 19 nt, Homo sapiens
gacacggccuccuguugga

SEQ ID NO: 1079334 - RNA, 19 nt, Homo sapiens
gacuguuuauuguaacuug

SEQ ID NO: 1079335 - RNA, 19 nt, Homo sapiens
ggacuuuaagaaugacuga

SEQ ID NO: 1079336 - RNA, 19 nt, Homo sapiens
caacgugaaccuggcauau

SEQ ID NO: 1079337 - RNA, 19 nt, Homo sapiens
gcccuggacugugcagaga

SEQ ID NO: 1079338 - RNA, 19 nt, Homo sapiens
acgccucgcucaggaagua

SEQ ID NO: 1079339 - RNA, 19 nt, Homo sapiens
agucauagcacugaaguug

SEQ ID NO: 1079340 - RNA, 19 nt, Homo sapiens
ucaaggcucagagaauaaa

SEQ ID NO: 1079341 - RNA, 19 nt, Homo sapiens
ggaagaaggaagugaucca

SEQ ID NO: 1079342 - RNA, 19 nt, Homo sapiens
gauacugccgccaccaaga

SEQ ID NO: 1079343 - RNA, 19 nt, Homo sapiens
ccagacgggcuuugccauu

SEQ ID NO: 1079344 - RNA, 19 nt, Homo sapiens
gagucaaggcucagagaau

SEQ ID NO: 1079345 - RNA, 19 nt, Homo sapiens
acaccacguucaccaagau

SEQ ID NO: 1079346 - RNA, 19 nt, Homo sapiens
gcugagagggcuugcaaag

SEQ ID NO: 1079347 - RNA, 19 nt, Homo sapiens
ggccugccguaccacacua

SEQ ID NO: 1079348 - RNA, 19 nt, Homo sapiens
gggaugggcaccacagaca

SEQ ID NO: 1079349 - RNA, 19 nt, Homo sapiens
uaggucccauugugucuug

SEQ ID NO: 1079350 - RNA, 19 nt, Homo sapiens
cgaggacuguggcauuguc

SEQ ID NO: 1079351 - RNA, 19 nt, Homo sapiens
aaagcaagaaguuaaugga

SEQ ID NO: 1079352 - RNA, 19 nt, Homo sapiens
ggaaaccugaaagcaagaa

SEQ ID NO: 1079353 - RNA, 19 nt, Homo sapiens
cuuuaagaaugacugagaa

SEQ ID NO: 1079354 - RNA, 19 nt, Homo sapiens
cagaaggacaccacguuca

SEQ ID NO: 1079355 - RNA, 19 nt, Homo sapiens
cagcugagagggcuugcaa

SEQ ID NO: 1079356 - RNA, 19 nt, Homo sapiens
ccacuuucgugcaguacca

SEQ ID NO: 1079357 - RNA, 19 nt, Homo sapiens
uguccucgcccuacauuga

SEQ ID NO: 1079358 - RNA, 19 nt, Homo sapiens
gucaaggcucagagaauaa

SEQ ID NO: 1079359 - RNA, 19 nt, Homo sapiens
gauaauuucagaaguucag

SEQ ID NO: 1079360 - RNA, 19 nt, Homo sapiens
gagcugccaggccaugaug

SEQ ID NO: 1079361 - RNA, 19 nt, Homo sapiens
ggccaccuaugaccaguac

SEQ ID NO: 1079362 - RNA, 19 nt, Homo sapiens
gugcgccucuucccucuac

SEQ ID NO: 1079363 - RNA, 19 nt, Homo sapiens
ccuggacugugcagagaug

SEQ ID NO: 1079364 - RNA, 19 nt, Homo sapiens
ccaacgugaaccuggcaua

SEQ ID NO: 1079365 - RNA, 19 nt, Homo sapiens
cccgaggacuguggcauug

SEQ ID NO: 1079366 - RNA, 19 nt, Homo sapiens
gacgguuccugccugucuu

SEQ ID NO: 1079367 - RNA, 19 nt, Homo sapiens
acgugaaccuggcauaucu

SEQ ID NO: 1079368 - RNA, 19 nt, Homo sapiens
guacccaccggccaccuau

SEQ ID NO: 1079369 - RNA, 19 nt, Homo sapiens
auaaagguagcuaaucuca

SEQ ID NO: 1079370 - RNA, 19 nt, Homo sapiens
gaggaggccguggucauca

SEQ ID NO: 1079371 - RNA, 19 nt, Homo sapiens
ccaagaauccaaaaccuau

SEQ ID NO: 1079372 - RNA, 19 nt, Homo sapiens
ugaaagcaagaaguuaaug

SEQ ID NO: 1079373 - RNA, 19 nt, Homo sapiens
agaauaaagguagcuaauc

SEQ ID NO: 1079374 - RNA, 19 nt, Homo sapiens
agagaauaaagguagcuaa

SEQ ID NO: 1079375 - RNA, 19 nt, Homo sapiens
ccauggcagccucuucuug

SEQ ID NO: 1079376 - RNA, 19 nt, Homo sapiens
gaaaugaaaugaucaaugg

SEQ ID NO: 1079377 - RNA, 19 nt, Homo sapiens
ggaaauguaugaugacuau

SEQ ID NO: 1079378 - RNA, 19 nt, Homo sapiens
gaagcaaccuuauuaugaa

SEQ ID NO: 1079379 - RNA, 19 nt, Homo sapiens
caccaggacuugaaacuua

SEQ ID NO: 1079380 - RNA, 19 nt, Homo sapiens
gaacgcgcuuugagaauuu

SEQ ID NO: 1079381 - RNA, 19 nt, Homo sapiens
aaacuguccuccauaaaua

SEQ ID NO: 1079382 - RNA, 19 nt, Homo sapiens
gacaaucuuuggcaucuua

SEQ ID NO: 1079383 - RNA, 19 nt, Homo sapiens
augcauaacuccaacauua

SEQ ID NO: 1079384 - RNA, 19 nt, Homo sapiens
gggaaacuguccuccauaa

SEQ ID NO: 1079385 - RNA, 19 nt, Homo sapiens
agaagaagcuugaggaaau

SEQ ID NO: 1079386 - RNA, 19 nt, Homo sapiens
caaauuaaccaaaggcuaa

SEQ ID NO: 1079387 - RNA, 19 nt, Homo sapiens
gagauaaugaccaguguua

SEQ ID NO: 1079388 - RNA, 19 nt, Homo sapiens
ggucuuaauuguuucguaa

SEQ ID NO: 1079389 - RNA, 19 nt, Homo sapiens
gagaugaggcaguucuuua

SEQ ID NO: 1079390 - RNA, 19 nt, Homo sapiens
gauuuaaccucaagggaaa

SEQ ID NO: 1079391 - RNA, 19 nt, Homo sapiens
gcagaauggucuuaauugu

SEQ ID NO: 1079392 - RNA, 19 nt, Homo sapiens
ggaaaugacucggacugaa

SEQ ID NO: 1079393 - RNA, 19 nt, Homo sapiens
caacugaggauuucauauu

SEQ ID NO: 1079394 - RNA, 19 nt, Homo sapiens
aaacgcaccugcauuguug

SEQ ID NO: 1079395 - RNA, 19 nt, Homo sapiens
gaaacuguccuccauaaau

SEQ ID NO: 1079396 - RNA, 19 nt, Homo sapiens
ggaaaucaauguccaacca

SEQ ID NO: 1079397 - RNA, 19 nt, Homo sapiens
cuacauccauuaucccuuu

SEQ ID NO: 1079398 - RNA, 19 nt, Homo sapiens
guagaugucuuacaagucu

SEQ ID NO: 1079399 - RNA, 19 nt, Homo sapiens
gagaaguacccaaacuaua

SEQ ID NO: 1079400 - RNA, 19 nt, Homo sapiens
gaagaagcuugaggaaaug

SEQ ID NO: 1079401 - RNA, 19 nt, Homo sapiens
gcaaugacccaggauuuaa

SEQ ID NO: 1079402 - RNA, 19 nt, Homo sapiens
agaaguacccaaacuauaa

SEQ ID NO: 1079403 - RNA, 19 nt, Homo sapiens
gcagcgagccacacauuaa

SEQ ID NO: 1079404 - RNA, 19 nt, Homo sapiens
uuacccagcugaucaguuu

SEQ ID NO: 1079405 - RNA, 19 nt, Homo sapiens
gcaagccaccucuccauuu

SEQ ID NO: 1079406 - RNA, 19 nt, Homo sapiens
uaaagugugagacagauua

SEQ ID NO: 1079407 - RNA, 19 nt, Homo sapiens
gaauuaaaguacucugaca

SEQ ID NO: 1079408 - RNA, 19 nt, Homo sapiens
ggucucaccuacugggaua

SEQ ID NO: 1079409 - RNA, 19 nt, Homo sapiens
gaauggaaucagagaauaa

SEQ ID NO: 1079410 - RNA, 19 nt, Homo sapiens
aaaguacucugacauuuca

SEQ ID NO: 1079411 - RNA, 19 nt, Homo sapiens
caagccaccucuccauuug

SEQ ID NO: 1079412 - RNA, 19 nt, Homo sapiens
gaaauggaaauguaugaug

SEQ ID NO: 1079413 - RNA, 19 nt, Homo sapiens
ggaaaugaaaugaucaaug

SEQ ID NO: 1079414 - RNA, 19 nt, Homo sapiens
ccagagcacuuaugguaug

SEQ ID NO: 1079415 - RNA, 19 nt, Homo sapiens
gaaacgcaccugcauuguu

SEQ ID NO: 1079416 - RNA, 19 nt, Homo sapiens
gaaguacccaaacuauaaa

SEQ ID NO: 1079417 - RNA, 19 nt, Homo sapiens
gguuaaacauucucacuca

SEQ ID NO: 1079418 - RNA, 19 nt, Homo sapiens
agaagcaaccuuauuauga

SEQ ID NO: 1079419 - RNA, 19 nt, Homo sapiens
gcaggaauuuggacaccuu

SEQ ID NO: 1079420 - RNA, 19 nt, Homo sapiens
cauuaucccuuugccuuua

SEQ ID NO: 1079421 - RNA, 19 nt, Homo sapiens
aagccuagcuggaaaugaa

SEQ ID NO: 1079422 - RNA, 19 nt, Homo sapiens
ggaucucgcuggaaaucaa

SEQ ID NO: 1079423 - RNA, 19 nt, Homo sapiens
caaaccaggugauaacuac

SEQ ID NO: 1079424 - RNA, 19 nt, Homo sapiens
cggcagcucuccaccauga

SEQ ID NO: 1079425 - RNA, 19 nt, Homo sapiens
gagaagcaaccuuauuaug

SEQ ID NO: 1079426 - RNA, 19 nt, Homo sapiens
cagcagagccuguaaaguc

SEQ ID NO: 1079427 - RNA, 19 nt, Homo sapiens
agaauggaaucagagaaua

SEQ ID NO: 1079428 - RNA, 19 nt, Homo sapiens
aggaugaaauggaaaugua

SEQ ID NO: 1079429 - RNA, 19 nt, Homo sapiens
gaccagcccuguaacucaa

SEQ ID NO: 1079430 - RNA, 19 nt, Homo sapiens
ggacugaacaagaggauuc

SEQ ID NO: 1079431 - RNA, 19 nt, Homo sapiens
gacaggagaugaggcaguu

SEQ ID NO: 1079432 - RNA, 19 nt, Homo sapiens
aggagaagcaaccuuauua

SEQ ID NO: 1079433 - RNA, 19 nt, Homo sapiens
cgaacaagguugccacagu

SEQ ID NO: 1079434 - RNA, 19 nt, Homo sapiens
ucaggaaucuggagacaag

SEQ ID NO: 1079435 - RNA, 19 nt, Homo sapiens
cugaacagcugcaggaaug

SEQ ID NO: 1079436 - RNA, 19 nt, Homo sapiens
ggagaagcaaccuuauuau

SEQ ID NO: 1079437 - RNA, 19 nt, Homo sapiens
caacgucucccacccagaa

SEQ ID NO: 1079438 - RNA, 19 nt, Homo sapiens
gagaaacaacggcagcaaa

SEQ ID NO: 1079439 - RNA, 19 nt, Homo sapiens
gaccaccucucacuacauc

SEQ ID NO: 1079440 - RNA, 19 nt, Homo sapiens
ggaauuuggacaccuuuga

SEQ ID NO: 1079441 - RNA, 19 nt, Homo sapiens
cgucacaaauugagaaaca

SEQ ID NO: 1079442 - RNA, 19 nt, Homo sapiens
gacauucagucuuaacaca

SEQ ID NO: 1079443 - RNA, 19 nt, Homo sapiens
uaaagagcccgcaugcauu

SEQ ID NO: 1079444 - RNA, 19 nt, Homo sapiens
gcggaagccuagcuggaaa

SEQ ID NO: 1079445 - RNA, 19 nt, Homo sapiens
cuuaggaucucgcuggaaa

SEQ ID NO: 1079446 - RNA, 19 nt, Homo sapiens
uaacgggaaagucaaauga

SEQ ID NO: 1079447 - RNA, 19 nt, Homo sapiens
caacagcagcacaaaauua

SEQ ID NO: 1079448 - RNA, 19 nt, Homo sapiens
ggacuugaaacuuaucuca

SEQ ID NO: 1079449 - RNA, 19 nt, Homo sapiens
aaagagcccgcaugcauuu

SEQ ID NO: 1079450 - RNA, 19 nt, Homo sapiens
gggcagugaucaacaugug

SEQ ID NO: 1079451 - RNA, 19 nt, Homo sapiens
agaacgcgcuuugagaauu

SEQ ID NO: 1079452 - RNA, 19 nt, Homo sapiens
ucaguaccauucaacaaga

SEQ ID NO: 1079453 - RNA, 19 nt, Homo sapiens
guaaggaacgaacaagguu

SEQ ID NO: 1079454 - RNA, 19 nt, Homo sapiens
uaaaguacucugacauuuc

SEQ ID NO: 1079455 - RNA, 19 nt, Homo sapiens
caauggagaggaugaaaug

SEQ ID NO: 1079456 - RNA, 19 nt, Homo sapiens
ggaaacuguccuccauaaa

SEQ ID NO: 1079457 - RNA, 19 nt, Homo sapiens
gaauuuggacaccuuugaa

SEQ ID NO: 1079458 - RNA, 19 nt, Homo sapiens
acaacaaaccucacucuga

SEQ ID NO: 1079459 - RNA, 19 nt, Homo sapiens
cagcagaauggucuuaauu

SEQ ID NO: 1079460 - RNA, 19 nt, Homo sapiens
gaggagcuaccaacacuug

SEQ ID NO: 1079461 - RNA, 19 nt, Homo sapiens
gaguauaagcaacugauga

SEQ ID NO: 1079462 - RNA, 19 nt, Homo sapiens
gcaagauccacuuagagaa

SEQ ID NO: 1079463 - RNA, 19 nt, Homo sapiens
gcaauuuaccagugauuuc

SEQ ID NO: 1079464 - RNA, 19 nt, Homo sapiens
aaagucaaaugaagaugga

SEQ ID NO: 1079465 - RNA, 19 nt, Homo sapiens
cagcacagccucugaaucu

SEQ ID NO: 1079466 - RNA, 19 nt, Homo sapiens
ggaccagcccuguaacuca

SEQ ID NO: 1079467 - RNA, 19 nt, Homo sapiens
gcaaccgccacaccagaua

SEQ ID NO: 1079468 - RNA, 19 nt, Homo sapiens
gccuacagguugugaaugu

SEQ ID NO: 1079469 - RNA, 19 nt, Homo sapiens
aagaacagauugcgagaca

SEQ ID NO: 1079470 - RNA, 19 nt, Homo sapiens
caacagcaagaacagauug

SEQ ID NO: 1079471 - RNA, 19 nt, Homo sapiens
ugaaacagaagaagcuuga

SEQ ID NO: 1079472 - RNA, 19 nt, Homo sapiens
aggguccacuugcuauuua

SEQ ID NO: 1079473 - RNA, 19 nt, Homo sapiens
cauucagucuuaacacauu

SEQ ID NO: 1079474 - RNA, 19 nt, Homo sapiens
caccagauaucgacagagu

SEQ ID NO: 1079475 - RNA, 19 nt, Homo sapiens
caauuguguuugccuguug

SEQ ID NO: 1079476 - RNA, 19 nt, Homo sapiens
ggacaaagcuggcgcucaa

SEQ ID NO: 1079477 - RNA, 19 nt, Homo sapiens
gaagaggaacugacuauuc

SEQ ID NO: 1079478 - RNA, 19 nt, Homo sapiens
aagcagggcuccauucauu

SEQ ID NO: 1079479 - RNA, 19 nt, Homo sapiens
caagugagucucccagaua

SEQ ID NO: 1079480 - RNA, 19 nt, Homo sapiens
gggaaaccaugaagaggaa

SEQ ID NO: 1079481 - RNA, 19 nt, Homo sapiens
acaaagcgcugauccaagu

SEQ ID NO: 1079482 - RNA, 19 nt, Homo sapiens
ccagauacguugcauugug

SEQ ID NO: 1079483 - RNA, 19 nt, Homo sapiens
gauccaaguugcucuguag

SEQ ID NO: 1079484 - RNA, 19 nt, Homo sapiens
gcuggaaggugacgagugu

SEQ ID NO: 1079485 - RNA, 19 nt, Homo sapiens
ccaaguugcucuguaggaa

SEQ ID NO: 1079486 - RNA, 19 nt, Homo sapiens
uaacaaagcgcugauccaa

SEQ ID NO: 1079487 - RNA, 19 nt, Homo sapiens
ccaggauggugacaaguug

SEQ ID NO: 1079488 - RNA, 19 nt, Homo sapiens
guccaaggcccagauguua

SEQ ID NO: 1079489 - RNA, 19 nt, Homo sapiens
aagaggaacugacuauucu

SEQ ID NO: 1079490 - RNA, 19 nt, Homo sapiens
gaugauucgucugaacuga

SEQ ID NO: 1079491 - RNA, 19 nt, Homo sapiens
ucuuauugcugacuucaaa

SEQ ID NO: 1079492 - RNA, 19 nt, Homo sapiens
ugauucgucugaacugauu

SEQ ID NO: 1079493 - RNA, 19 nt, Homo sapiens
ccuguuuaaugccaagaua

SEQ ID NO: 1079494 - RNA, 19 nt, Homo sapiens
cgucugaacugauuaaaau

SEQ ID NO: 1079495 - RNA, 19 nt, Homo sapiens
gggcuguugugaggauuaa

SEQ ID NO: 1079496 - RNA, 19 nt, Homo sapiens
gcagggcuccauucauuca

SEQ ID NO: 1079497 - RNA, 19 nt, Homo sapiens
guaggaauuucugugacuu

SEQ ID NO: 1079498 - RNA, 19 nt, Homo sapiens
aaguugcucuguaggaauu

SEQ ID NO: 1079499 - RNA, 19 nt, Homo sapiens
ugacuauucuagccuaucu

SEQ ID NO: 1079500 - RNA, 19 nt, Homo sapiens
aaaugagaccaucuuauug

SEQ ID NO: 1079501 - RNA, 19 nt, Homo sapiens
gaacaagaggcccaaucuc

SEQ ID NO: 1079502 - RNA, 19 nt, Homo sapiens
gaccacccgugugaucuug

SEQ ID NO: 1079503 - RNA, 19 nt, Homo sapiens
cgccugacauggaacagaa

SEQ ID NO: 1079504 - RNA, 19 nt, Homo sapiens
uugguuuccuuaucuguaa

SEQ ID NO: 1079505 - RNA, 19 nt, Homo sapiens
aaagggcuguugugaggau

SEQ ID NO: 1079506 - RNA, 19 nt, Homo sapiens
ccacccgugugaucuugaa

SEQ ID NO: 1079507 - RNA, 19 nt, Homo sapiens
gaggaacugacuauucuag

SEQ ID NO: 1079508 - RNA, 19 nt, Homo sapiens
gugccaacaucagcauuau

SEQ ID NO: 1079509 - RNA, 19 nt, Homo sapiens
acaagugagucucccagau

SEQ ID NO: 1079510 - RNA, 19 nt, Homo sapiens
cauggcaaguggcucucua

SEQ ID NO: 1079511 - RNA, 19 nt, Homo sapiens
guaaaaugagaccaucuua

SEQ ID NO: 1079512 - RNA, 19 nt, Homo sapiens
gccaacaucagcauuaucu

SEQ ID NO: 1079513 - RNA, 19 nt, Homo sapiens
aacaagaggcccaaucuca

SEQ ID NO: 1079514 - RNA, 19 nt, Homo sapiens
gaagcagggcuccauucau

SEQ ID NO: 1079515 - RNA, 19 nt, Homo sapiens
gaucagggaaaccaugaag

SEQ ID NO: 1079516 - RNA, 19 nt, Homo sapiens
aaugagaugauucgucuga

SEQ ID NO: 1079517 - RNA, 19 nt, Homo sapiens
ggucccuccuccacaaugu

SEQ ID NO: 1079518 - RNA, 19 nt, Homo sapiens
ugauccaaguugcucugua

SEQ ID NO: 1079519 - RNA, 19 nt, Homo sapiens
gagaugauucgucugaacu

SEQ ID NO: 1079520 - RNA, 19 nt, Homo sapiens
ucccagauacguugcauug

SEQ ID NO: 1079521 - RNA, 19 nt, Homo sapiens
ugagaugauucgucugaac

SEQ ID NO: 1079522 - RNA, 19 nt, Homo sapiens
ggauuaaaugagaugauuc

SEQ ID NO: 1079523 - RNA, 19 nt, Homo sapiens
gggcuccauucauucaaca

SEQ ID NO: 1079524 - RNA, 19 nt, Homo sapiens
ccuggucccuccuccacaa

SEQ ID NO: 1079525 - RNA, 19 nt, Homo sapiens
gcuguugugaggauuaaau

SEQ ID NO: 1079526 - RNA, 19 nt, Homo sapiens
ugaacaagaggcccaaucu

SEQ ID NO: 1079527 - RNA, 19 nt, Homo sapiens
auaccaaagucugccacua

SEQ ID NO: 1079528 - RNA, 19 nt, Homo sapiens
caagaggcccaaucucacu

SEQ ID NO: 1079529 - RNA, 19 nt, Homo sapiens
ggggugacgucccuuguga

SEQ ID NO: 1079530 - RNA, 19 nt, Homo sapiens
gauuaaaugagaugauucg

SEQ ID NO: 1079531 - RNA, 19 nt, Homo sapiens
ugugccaacaucagcauua

SEQ ID NO: 1079532 - RNA, 19 nt, Homo sapiens
cgccuugguuuccuuaucu

SEQ ID NO: 1079533 - RNA, 19 nt, Homo sapiens
ucagggaaaccaugaagag

SEQ ID NO: 1079534 - RNA, 19 nt, Homo sapiens
uugugaggauuaaaugaga

SEQ ID NO: 1079535 - RNA, 19 nt, Homo sapiens
ccaccgcaacgacaucaug

SEQ ID NO: 1079536 - RNA, 19 nt, Homo sapiens
cuucaaagggcuguuguga

SEQ ID NO: 1079537 - RNA, 19 nt, Homo sapiens
uaggaauuucugugacuuu

SEQ ID NO: 1079538 - RNA, 19 nt, Homo sapiens
caaguugcucuguaggaau

SEQ ID NO: 1079539 - RNA, 19 nt, Homo sapiens
ugaagaggaacugacuauu

SEQ ID NO: 1079540 - RNA, 19 nt, Homo sapiens
ggugacgucccuugugaca

SEQ ID NO: 1079541 - RNA, 19 nt, Homo sapiens
ggacaaagcuggcgcucaa

SEQ ID NO: 1079542 - RNA, 19 nt, Homo sapiens
gaagaggaacugacuauuc

SEQ ID NO: 1079543 - RNA, 19 nt, Homo sapiens
aagcagggcuccauucauu

SEQ ID NO: 1079544 - RNA, 19 nt, Homo sapiens
gggaaaccaugaagaggaa

SEQ ID NO: 1079545 - RNA, 19 nt, Homo sapiens
acaaagcgcugauccaagu

SEQ ID NO: 1079546 - RNA, 19 nt, Homo sapiens
ccagauacguugcauugug

SEQ ID NO: 1079547 - RNA, 19 nt, Homo sapiens
gauccaaguugcucuguag

SEQ ID NO: 1079548 - RNA, 19 nt, Homo sapiens
gcuggaaggugacgagugu

SEQ ID NO: 1079549 - RNA, 19 nt, Homo sapiens
ccagugagucucccagaua

SEQ ID NO: 1079550 - RNA, 19 nt, Homo sapiens
ccaaguugcucuguaggaa

SEQ ID NO: 1079551 - RNA, 19 nt, Homo sapiens
uaacaaagcgcugauccaa

SEQ ID NO: 1079552 - RNA, 19 nt, Homo sapiens
ccaggauggugacaaguug

SEQ ID NO: 1079553 - RNA, 19 nt, Homo sapiens
guccaaggcccagauguua

SEQ ID NO: 1079554 - RNA, 19 nt, Homo sapiens
aagaggaacugacuauucu

SEQ ID NO: 1079555 - RNA, 19 nt, Homo sapiens
gaugauucgucugaacuga

SEQ ID NO: 1079556 - RNA, 19 nt, Homo sapiens
ucuuauugcugacuucaaa

SEQ ID NO: 1079557 - RNA, 19 nt, Homo sapiens
ugauucgucugaacugauu

SEQ ID NO: 1079558 - RNA, 19 nt, Homo sapiens
ccuguuuaaugccaagaua

SEQ ID NO: 1079559 - RNA, 19 nt, Homo sapiens
cgucugaacugauuaaaau

SEQ ID NO: 1079560 - RNA, 19 nt, Homo sapiens
gggcuguugugaggauuaa

SEQ ID NO: 1079561 - RNA, 19 nt, Homo sapiens
gcagggcuccauucauuca

SEQ ID NO: 1079562 - RNA, 19 nt, Homo sapiens
guaggaauuucugugacuu

SEQ ID NO: 1079563 - RNA, 19 nt, Homo sapiens
aaguugcucuguaggaauu

SEQ ID NO: 1079564 - RNA, 19 nt, Homo sapiens
ugacuauucuagccuaucu

SEQ ID NO: 1079565 - RNA, 19 nt, Homo sapiens
aaaugagaccaucuuauug

SEQ ID NO: 1079566 - RNA, 19 nt, Homo sapiens
gaacaagaggcccaaucuc

SEQ ID NO: 1079567 - RNA, 19 nt, Homo sapiens
gaccacccgugugaucuug

SEQ ID NO: 1079568 - RNA, 19 nt, Homo sapiens
cgccugacauggaacagaa

SEQ ID NO: 1079569 - RNA, 19 nt, Homo sapiens
uugguuuccuuaucuguaa

SEQ ID NO: 1079570 - RNA, 19 nt, Homo sapiens
aaagggcuguugugaggau

SEQ ID NO: 1079571 - RNA, 19 nt, Homo sapiens
ccacccgugugaucuugaa

SEQ ID NO: 1079572 - RNA, 19 nt, Homo sapiens
gaggaacugacuauucuag

SEQ ID NO: 1079573 - RNA, 19 nt, Homo sapiens
gugccaacaucagcauuau

SEQ ID NO: 1079574 - RNA, 19 nt, Homo sapiens
cauggcaaguggcucucua

SEQ ID NO: 1079575 - RNA, 19 nt, Homo sapiens
guaaaaugagaccaucuua

SEQ ID NO: 1079576 - RNA, 19 nt, Homo sapiens
gccaacaucagcauuaucu

SEQ ID NO: 1079577 - RNA, 19 nt, Homo sapiens
aacaagaggcccaaucuca

SEQ ID NO: 1079578 - RNA, 19 nt, Homo sapiens
gaagcagggcuccauucau

SEQ ID NO: 1079579 - RNA, 19 nt, Homo sapiens
gaucagggaaaccaugaag

SEQ ID NO: 1079580 - RNA, 19 nt, Homo sapiens
aaugagaugauucgucuga

SEQ ID NO: 1079581 - RNA, 19 nt, Homo sapiens
ggucccuccuccacaaugu

SEQ ID NO: 1079582 - RNA, 19 nt, Homo sapiens
ugauccaaguugcucugua

SEQ ID NO: 1079583 - RNA, 19 nt, Homo sapiens
gagaugauucgucugaacu

SEQ ID NO: 1079584 - RNA, 19 nt, Homo sapiens
ucccagauacguugcauug

SEQ ID NO: 1079585 - RNA, 19 nt, Homo sapiens
ugagaugauucgucugaac

SEQ ID NO: 1079586 - RNA, 19 nt, Homo sapiens
ggauuaaaugagaugauuc

SEQ ID NO: 1079587 - RNA, 19 nt, Homo sapiens
gggcuccauucauucaaca

SEQ ID NO: 1079588 - RNA, 19 nt, Homo sapiens
ccuggucccuccuccacaa

SEQ ID NO: 1079589 - RNA, 19 nt, Homo sapiens
cagugagucucccagauac

SEQ ID NO: 1079590 - RNA, 19 nt, Homo sapiens
gcuguugugaggauuaaau

SEQ ID NO: 1079591 - RNA, 19 nt, Homo sapiens
ugaacaagaggcccaaucu

SEQ ID NO: 1079592 - RNA, 19 nt, Homo sapiens
auaccaaagucugccacua

SEQ ID NO: 1079593 - RNA, 19 nt, Homo sapiens
caagaggcccaaucucacu

SEQ ID NO: 1079594 - RNA, 19 nt, Homo sapiens
ggggugacgucccuuguga

SEQ ID NO: 1079595 - RNA, 19 nt, Homo sapiens
gauuaaaugagaugauucg

SEQ ID NO: 1079596 - RNA, 19 nt, Homo sapiens
ugugccaacaucagcauua

SEQ ID NO: 1079597 - RNA, 19 nt, Homo sapiens
cgccuugguuuccuuaucu

SEQ ID NO: 1079598 - RNA, 19 nt, Homo sapiens
ucagggaaaccaugaagag

SEQ ID NO: 1079599 - RNA, 19 nt, Homo sapiens
ccaccgcaacgacaucaug

SEQ ID NO: 1079600 - RNA, 19 nt, Homo sapiens
uugugaggauuaaaugaga

SEQ ID NO: 1079601 - RNA, 19 nt, Homo sapiens
cuucaaagggcuguuguga

SEQ ID NO: 1079602 - RNA, 19 nt, Homo sapiens
uaggaauuucugugacuuu

SEQ ID NO: 1079603 - RNA, 19 nt, Homo sapiens
caaguugcucuguaggaau

SEQ ID NO: 1079604 - RNA, 19 nt, Homo sapiens
ugaagaggaacugacuauu

SEQ ID NO: 1079605 - RNA, 19 nt, Homo sapiens
ggugacgucccuugugaca

SEQ ID NO: 1079606 - RNA, 19 nt, Homo sapiens
ggacaaagcuggcgcucaa

SEQ ID NO: 1079607 - RNA, 19 nt, Homo sapiens
gaagaggaacugacuauuc

SEQ ID NO: 1079608 - RNA, 19 nt, Homo sapiens
aagcagggcuccauucauu

SEQ ID NO: 1079609 - RNA, 19 nt, Homo sapiens
gggaaaccaugaagaggaa

SEQ ID NO: 1079610 - RNA, 19 nt, Homo sapiens
acaaagcgcugauccaagu

SEQ ID NO: 1079611 - RNA, 19 nt, Homo sapiens
gauccaaguugcucuguag

SEQ ID NO: 1079612 - RNA, 19 nt, Homo sapiens
gcuggaaggugacgagugu

SEQ ID NO: 1079613 - RNA, 19 nt, Homo sapiens
ccaaguugcucuguaggaa

SEQ ID NO: 1079614 - RNA, 19 nt, Homo sapiens
uaacaaagcgcugauccaa

SEQ ID NO: 1079615 - RNA, 19 nt, Homo sapiens
ccaggauggugacaaguug

SEQ ID NO: 1079616 - RNA, 19 nt, Homo sapiens
guccaaggcccagauguua

SEQ ID NO: 1079617 - RNA, 19 nt, Homo sapiens
aagaggaacugacuauucu

SEQ ID NO: 1079618 - RNA, 19 nt, Homo sapiens
gaugauucgucugaacuga

SEQ ID NO: 1079619 - RNA, 19 nt, Homo sapiens
ucuuauugcugacuucaaa

SEQ ID NO: 1079620 - RNA, 19 nt, Homo sapiens
ugauucgucugaacugauu

SEQ ID NO: 1079621 - RNA, 19 nt, Homo sapiens
ccuguuuaaugccaagaua

SEQ ID NO: 1079622 - RNA, 19 nt, Homo sapiens
cgucugaacugauuaaaau

SEQ ID NO: 1079623 - RNA, 19 nt, Homo sapiens
gggcuguugugaggauuaa

SEQ ID NO: 1079624 - RNA, 19 nt, Homo sapiens
gcagggcuccauucauuca

SEQ ID NO: 1079625 - RNA, 19 nt, Homo sapiens
guaggaauuucugugacuu

SEQ ID NO: 1079626 - RNA, 19 nt, Homo sapiens
aaguugcucuguaggaauu

SEQ ID NO: 1079627 - RNA, 19 nt, Homo sapiens
ugacuauucuagccuaucu

SEQ ID NO: 1079628 - RNA, 19 nt, Homo sapiens
aaaugagaccaucuuauug

SEQ ID NO: 1079629 - RNA, 19 nt, Homo sapiens
gaacaagaggcccaaucuc

SEQ ID NO: 1079630 - RNA, 19 nt, Homo sapiens
gaccacccgugugaucuug

SEQ ID NO: 1079631 - RNA, 19 nt, Homo sapiens
cgccugacauggaacagaa

SEQ ID NO: 1079632 - RNA, 19 nt, Homo sapiens
uugguuuccuuaucuguaa

SEQ ID NO: 1079633 - RNA, 19 nt, Homo sapiens
aaagggcuguugugaggau

SEQ ID NO: 1079634 - RNA, 19 nt, Homo sapiens
ccacccgugugaucuugaa

SEQ ID NO: 1079635 - RNA, 19 nt, Homo sapiens
gaggaacugacuauucuag

SEQ ID NO: 1079636 - RNA, 19 nt, Homo sapiens
cauggcaaguggcucucua

SEQ ID NO: 1079637 - RNA, 19 nt, Homo sapiens
guaaaaugagaccaucuua

SEQ ID NO: 1079638 - RNA, 19 nt, Homo sapiens
aacaagaggcccaaucuca

SEQ ID NO: 1079639 - RNA, 19 nt, Homo sapiens
gaagcagggcuccauucau

SEQ ID NO: 1079640 - RNA, 19 nt, Homo sapiens
gaucagggaaaccaugaag

SEQ ID NO: 1079641 - RNA, 19 nt, Homo sapiens
aaugagaugauucgucuga

SEQ ID NO: 1079642 - RNA, 19 nt, Homo sapiens
ggucccuccuccacaaugu

SEQ ID NO: 1079643 - RNA, 19 nt, Homo sapiens
ugauccaaguugcucugua

SEQ ID NO: 1079644 - RNA, 19 nt, Homo sapiens
gagaugauucgucugaacu

SEQ ID NO: 1079645 - RNA, 19 nt, Homo sapiens
ugagaugauucgucugaac

SEQ ID NO: 1079646 - RNA, 19 nt, Homo sapiens
ggauuaaaugagaugauuc

SEQ ID NO: 1079647 - RNA, 19 nt, Homo sapiens
gggcuccauucauucaaca

SEQ ID NO: 1079648 - RNA, 19 nt, Homo sapiens
ccuggucccuccuccacaa

SEQ ID NO: 1079649 - RNA, 19 nt, Homo sapiens
gcuguugugaggauuaaau

SEQ ID NO: 1079650 - RNA, 19 nt, Homo sapiens
ugaacaagaggcccaaucu

SEQ ID NO: 1079651 - RNA, 19 nt, Homo sapiens
auaccaaagucugccacua

SEQ ID NO: 1079652 - RNA, 19 nt, Homo sapiens
caagaggcccaaucucacu

SEQ ID NO: 1079653 - RNA, 19 nt, Homo sapiens
ggggugacgucccuuguga

SEQ ID NO: 1079654 - RNA, 19 nt, Homo sapiens
gauuaaaugagaugauucg

SEQ ID NO: 1079655 - RNA, 19 nt, Homo sapiens
cgccuugguuuccuuaucu

SEQ ID NO: 1079656 - RNA, 19 nt, Homo sapiens
ucagggaaaccaugaagag

SEQ ID NO: 1079657 - RNA, 19 nt, Homo sapiens
uugugaggauuaaaugaga

SEQ ID NO: 1079658 - RNA, 19 nt, Homo sapiens
cuucaaagggcuguuguga

SEQ ID NO: 1079659 - RNA, 19 nt, Homo sapiens
ccaccgcaacgacaucaug

SEQ ID NO: 1079660 - RNA, 19 nt, Homo sapiens
uaggaauuucugugacuuu

SEQ ID NO: 1079661 - RNA, 19 nt, Homo sapiens
caaguugcucuguaggaau

SEQ ID NO: 1079662 - RNA, 19 nt, Homo sapiens
ugaagaggaacugacuauu

SEQ ID NO: 1079663 - RNA, 19 nt, Homo sapiens
ggugacgucccuugugaca

SEQ ID NO: 1079664 - RNA, 19 nt, Homo sapiens
ggacaaagcuggcgcucaa

SEQ ID NO: 1079665 - RNA, 19 nt, Homo sapiens
gaagaggaacugacuauuc

SEQ ID NO: 1079666 - RNA, 19 nt, Homo sapiens
aagcagggcuccauucauu

SEQ ID NO: 1079667 - RNA, 19 nt, Homo sapiens
gggaaaccaugaagaggaa

SEQ ID NO: 1079668 - RNA, 19 nt, Homo sapiens
acaaagcgcugauccaagu

SEQ ID NO: 1079669 - RNA, 19 nt, Homo sapiens
gauccaaguugcucuguag

SEQ ID NO: 1079670 - RNA, 19 nt, Homo sapiens
gcuggaaggugacgagugu

SEQ ID NO: 1079671 - RNA, 19 nt, Homo sapiens
ccaaguugcucuguaggaa

SEQ ID NO: 1079672 - RNA, 19 nt, Homo sapiens
uaacaaagcgcugauccaa

SEQ ID NO: 1079673 - RNA, 19 nt, Homo sapiens
ccaggauggugacaaguug

SEQ ID NO: 1079674 - RNA, 19 nt, Homo sapiens
guccaaggcccagauguua

SEQ ID NO: 1079675 - RNA, 19 nt, Homo sapiens
aagaggaacugacuauucu

SEQ ID NO: 1079676 - RNA, 19 nt, Homo sapiens
gaugauucgucugaacuga

SEQ ID NO: 1079677 - RNA, 19 nt, Homo sapiens
ucuuauugcugacuucaaa

SEQ ID NO: 1079678 - RNA, 19 nt, Homo sapiens
ugauucgucugaacugauu

SEQ ID NO: 1079679 - RNA, 19 nt, Homo sapiens
ccuguuuaaugccaagaua

SEQ ID NO: 1079680 - RNA, 19 nt, Homo sapiens
cgucugaacugauuaaaau

SEQ ID NO: 1079681 - RNA, 19 nt, Homo sapiens
gggcuguugugaggauuaa

SEQ ID NO: 1079682 - RNA, 19 nt, Homo sapiens
gcagggcuccauucauuca

SEQ ID NO: 1079683 - RNA, 19 nt, Homo sapiens
guaggaauuucugugacuu

SEQ ID NO: 1079684 - RNA, 19 nt, Homo sapiens
aaguugcucuguaggaauu

SEQ ID NO: 1079685 - RNA, 19 nt, Homo sapiens
ugacuauucuagccuaucu

SEQ ID NO: 1079686 - RNA, 19 nt, Homo sapiens
aaaugagaccaucuuauug

SEQ ID NO: 1079687 - RNA, 19 nt, Homo sapiens
gaacaagaggcccaaucuc

SEQ ID NO: 1079688 - RNA, 19 nt, Homo sapiens
gaccacccgugugaucuug

SEQ ID NO: 1079689 - RNA, 19 nt, Homo sapiens
cgccugacauggaacagaa

SEQ ID NO: 1079690 - RNA, 19 nt, Homo sapiens
uugguuuccuuaucuguaa

SEQ ID NO: 1079691 - RNA, 19 nt, Homo sapiens
aaagggcuguugugaggau

SEQ ID NO: 1079692 - RNA, 19 nt, Homo sapiens
ccacccgugugaucuugaa

SEQ ID NO: 1079693 - RNA, 19 nt, Homo sapiens
gaggaacugacuauucuag

SEQ ID NO: 1079694 - RNA, 19 nt, Homo sapiens
cauggcaaguggcucucua

SEQ ID NO: 1079695 - RNA, 19 nt, Homo sapiens
guaaaaugagaccaucuua

SEQ ID NO: 1079696 - RNA, 19 nt, Homo sapiens
aacaagaggcccaaucuca

SEQ ID NO: 1079697 - RNA, 19 nt, Homo sapiens
gaagcagggcuccauucau

SEQ ID NO: 1079698 - RNA, 19 nt, Homo sapiens
gaucagggaaaccaugaag

SEQ ID NO: 1079699 - RNA, 19 nt, Homo sapiens
aaugagaugauucgucuga

SEQ ID NO: 1079700 - RNA, 19 nt, Homo sapiens
ggucccuccuccacaaugu

SEQ ID NO: 1079701 - RNA, 19 nt, Homo sapiens
ugauccaaguugcucugua

SEQ ID NO: 1079702 - RNA, 19 nt, Homo sapiens
gagaugauucgucugaacu

SEQ ID NO: 1079703 - RNA, 19 nt, Homo sapiens
ugagaugauucgucugaac

SEQ ID NO: 1079704 - RNA, 19 nt, Homo sapiens
ggauuaaaugagaugauuc

SEQ ID NO: 1079705 - RNA, 19 nt, Homo sapiens
gggcuccauucauucaaca

SEQ ID NO: 1079706 - RNA, 19 nt, Homo sapiens
ccuggucccuccuccacaa

SEQ ID NO: 1079707 - RNA, 19 nt, Homo sapiens
gcuguugugaggauuaaau

SEQ ID NO: 1079708 - RNA, 19 nt, Homo sapiens
ugaacaagaggcccaaucu

SEQ ID NO: 1079709 - RNA, 19 nt, Homo sapiens
auaccaaagucugccacua

SEQ ID NO: 1079710 - RNA, 19 nt, Homo sapiens
caagaggcccaaucucacu

SEQ ID NO: 1079711 - RNA, 19 nt, Homo sapiens
ggggugacgucccuuguga

SEQ ID NO: 1079712 - RNA, 19 nt, Homo sapiens
gauuaaaugagaugauucg

SEQ ID NO: 1079713 - RNA, 19 nt, Homo sapiens
cgccuugguuuccuuaucu

SEQ ID NO: 1079714 - RNA, 19 nt, Homo sapiens
ucagggaaaccaugaagag

SEQ ID NO: 1079715 - RNA, 19 nt, Homo sapiens
uugugaggauuaaaugaga

SEQ ID NO: 1079716 - RNA, 19 nt, Homo sapiens
cuucaaagggcuguuguga

SEQ ID NO: 1079717 - RNA, 19 nt, Homo sapiens
ccaccgcaacgacaucaug

SEQ ID NO: 1079718 - RNA, 19 nt, Homo sapiens
uaggaauuucugugacuuu

SEQ ID NO: 1079719 - RNA, 19 nt, Homo sapiens
caaguugcucuguaggaau

SEQ ID NO: 1079720 - RNA, 19 nt, Homo sapiens
ggugacgucccuugugaca

SEQ ID NO: 1079721 - RNA, 19 nt, Homo sapiens
ugaagaggaacugacuauu

SEQ ID NO: 1079722 - RNA, 19 nt, Homo sapiens
ggaaucagcuaaguaauua

SEQ ID NO: 1079723 - RNA, 19 nt, Homo sapiens
ggaggaaucuguaaagaaa

SEQ ID NO: 1079724 - RNA, 19 nt, Homo sapiens
ggagaacagugccacaaua

SEQ ID NO: 1079725 - RNA, 19 nt, Homo sapiens
gcaaaucaaugcacguuau

SEQ ID NO: 1079726 - RNA, 19 nt, Homo sapiens
gcagaaaggucaaauuggu

SEQ ID NO: 1079727 - RNA, 19 nt, Homo sapiens
ggaggaugcccuagaaaua

SEQ ID NO: 1079728 - RNA, 19 nt, Homo sapiens
cauagaaacugaugcagaa

SEQ ID NO: 1079729 - RNA, 19 nt, Homo sapiens
gugcugaucuccaggauga

SEQ ID NO: 1079730 - RNA, 19 nt, Homo sapiens
gcacaaggauacccugcuu

SEQ ID NO: 1079731 - RNA, 19 nt, Homo sapiens
ucacugauguccugacuga

SEQ ID NO: 1079732 - RNA, 19 nt, Homo sapiens
ggacauuguuggugacuuc

SEQ ID NO: 1079733 - RNA, 19 nt, Homo sapiens
gcaugagcauuucaaguau

SEQ ID NO: 1079734 - RNA, 19 nt, Homo sapiens
caagaugaguucagcuaga

SEQ ID NO: 1079735 - RNA, 19 nt, Homo sapiens
gcacuggucccauuaggaa

SEQ ID NO: 1079736 - RNA, 19 nt, Homo sapiens
ccaaggcacuggucccauu

SEQ ID NO: 1079737 - RNA, 19 nt, Homo sapiens
gaaagccugucuggaaguu

SEQ ID NO: 1079738 - RNA, 19 nt, Homo sapiens
gcuggcaccuagacauuaa

SEQ ID NO: 1079739 - RNA, 19 nt, Homo sapiens
gaacagugccacaauagag

SEQ ID NO: 1079740 - RNA, 19 nt, Homo sapiens
ucaggaaucagcuaaguaa

SEQ ID NO: 1079741 - RNA, 19 nt, Homo sapiens
uguccaagcuggccaaguu

SEQ ID NO: 1079742 - RNA, 19 nt, Homo sapiens
ugaggaggaugcccuagaa

SEQ ID NO: 1079743 - RNA, 19 nt, Homo sapiens
gacauuaaacuguacuuug

SEQ ID NO: 1079744 - RNA, 19 nt, Homo sapiens
gaaggaggaaucuguaaag

SEQ ID NO: 1079745 - RNA, 19 nt, Homo sapiens
cuacaugccucccaaggau

SEQ ID NO: 1079746 - RNA, 19 nt, Homo sapiens
guauccagauggugaaguu

SEQ ID NO: 1079747 - RNA, 19 nt, Homo sapiens
uggaccagguuuaaaguaa

SEQ ID NO: 1079748 - RNA, 19 nt, Homo sapiens
ccagcgggcuuccuacaug

SEQ ID NO: 1079749 - RNA, 19 nt, Homo sapiens
aggaggauguucuuacaaa

SEQ ID NO: 1079750 - RNA, 19 nt, Homo sapiens
ccaggaggauguucuuaca

SEQ ID NO: 1079751 - RNA, 19 nt, Homo sapiens
gcaccuagacauuaaacug

SEQ ID NO: 1079752 - RNA, 19 nt, Homo sapiens
acaaggaccucaaggacau

SEQ ID NO: 1079753 - RNA, 19 nt, Homo sapiens
ugcaugagcauuucaagua

SEQ ID NO: 1079754 - RNA, 19 nt, Homo sapiens
gagaacagugccacaauag

SEQ ID NO: 1079755 - RNA, 19 nt, Homo sapiens
gggcagcucagauggauug

SEQ ID NO: 1079756 - RNA, 19 nt, Homo sapiens
gaagugaaagggcuuaaaa

SEQ ID NO: 1079757 - RNA, 19 nt, Homo sapiens
ucaaguaucccgugaugau

SEQ ID NO: 1079758 - RNA, 19 nt, Homo sapiens
ugcagcaccugauuauauu

SEQ ID NO: 1079759 - RNA, 19 nt, Homo sapiens
aaagaaagagagaagcaaa

SEQ ID NO: 1079760 - RNA, 19 nt, Homo sapiens
gcauagauuucagguacau

SEQ ID NO: 1079761 - RNA, 19 nt, Homo sapiens
gcugguauccugcauagau

SEQ ID NO: 1079762 - RNA, 19 nt, Homo sapiens
aagaugaguucagcuagaa

SEQ ID NO: 1079763 - RNA, 19 nt, Homo sapiens
aaacaccaguauccagaug

SEQ ID NO: 1079764 - RNA, 19 nt, Homo sapiens
gaaaauagggugugugagu

SEQ ID NO: 1079765 - RNA, 19 nt, Homo sapiens
gugccacaauagagugaua

SEQ ID NO: 1079766 - RNA, 19 nt, Homo sapiens
cagaaaggucaaauuggua

SEQ ID NO: 1079767 - RNA, 19 nt, Homo sapiens
uagaaauacugcagaaagg

SEQ ID NO: 1079768 - RNA, 19 nt, Homo sapiens
guaaagaaacaccaguauc

SEQ ID NO: 1079769 - RNA, 19 nt, Homo sapiens
ggaguuggccucugugaac

SEQ ID NO: 1079770 - RNA, 19 nt, Homo sapiens
caaggcacuggucccauua

SEQ ID NO: 1079771 - RNA, 19 nt, Homo sapiens
augcgaagaugccaaauca

SEQ ID NO: 1079772 - RNA, 19 nt, Homo sapiens
gcaaaugcuggcacaagga

SEQ ID NO: 1079773 - RNA, 19 nt, Homo sapiens
agaaaggucaaauugguaa

SEQ ID NO: 1079774 - RNA, 19 nt, Homo sapiens
agaaacugaugcagaagau

SEQ ID NO: 1079775 - RNA, 19 nt, Homo sapiens
gcacacggacccugacuac

SEQ ID NO: 1079776 - RNA, 19 nt, Homo sapiens
guuguugucugugcuguga

SEQ ID NO: 1079777 - RNA, 19 nt, Homo sapiens
gugaaagggcuuaaaauuu

SEQ ID NO: 1079778 - RNA, 19 nt, Homo sapiens
gaaaggucaaauugguaaa

SEQ ID NO: 1079779 - RNA, 19 nt, Homo sapiens
uaaagaaacaccaguaucc

SEQ ID NO: 1079780 - RNA, 19 nt, Homo sapiens
aaaaggcacugaaguuguu

SEQ ID NO: 1079781 - RNA, 19 nt, Homo sapiens
gggccaagcaggagggaaa

SEQ ID NO: 1079782 - RNA, 19 nt, Homo sapiens
ugaaggaggaaucuguaaa

SEQ ID NO: 1079783 - RNA, 19 nt, Homo sapiens
ccaaaucauccgagacaug

SEQ ID NO: 1079784 - RNA, 19 nt, Homo sapiens
agauuuaacuaacccaaag

SEQ ID NO: 1079785 - RNA, 19 nt, Homo sapiens
cacguuauccuacuuaauc

SEQ ID NO: 1079786 - RNA, 19 nt, Homo sapiens
aggaaucagcuaaguaauu

SEQ ID NO: 1079787 - RNA, 19 nt, Homo sapiens
gaaacaccaguauccagau

SEQ ID NO: 1079788 - RNA, 19 nt, Homo sapiens
gauauuuaagcaacuccua

SEQ ID NO: 1079789 - RNA, 19 nt, Homo sapiens
cuacucggcugccuauguc

SEQ ID NO: 1079790 - RNA, 19 nt, Homo sapiens
gaggaugcccuagaaauac

SEQ ID NO: 1079791 - RNA, 19 nt, Homo sapiens
gggcuggcaccuagacauu

SEQ ID NO: 1079792 - RNA, 19 nt, Homo sapiens
ggaggauguucuuacaaaa

SEQ ID NO: 1079793 - RNA, 19 nt, Homo sapiens
ggaaaaggcacugaaguug

SEQ ID NO: 1079794 - RNA, 19 nt, Homo sapiens
gaaagagagaagcaaaugc

SEQ ID NO: 1079795 - RNA, 19 nt, Homo sapiens
cugcagaaaggucaaauug

SEQ ID NO: 1079796 - RNA, 19 nt, Homo sapiens
agggaaagccugucuggaa

SEQ ID NO: 1079797 - RNA, 19 nt, Homo sapiens
aaaauagggugugugagua

SEQ ID NO: 1079798 - RNA, 19 nt, Homo sapiens
gagccaaccuccccugaug

SEQ ID NO: 1079799 - RNA, 19 nt, Homo sapiens
gacaugcgaagaugccaaa

SEQ ID NO: 1079800 - RNA, 19 nt, Homo sapiens
ugcagaagauggaaucaag

SEQ ID NO: 1079801 - RNA, 19 nt, Homo sapiens
ggaccucaaggacauuguu

SEQ ID NO: 1079802 - RNA, 19 nt, Homo sapiens
gcacguuauccuacuuaau

SEQ ID NO: 1079803 - RNA, 19 nt, Homo sapiens
gaguucagcuagaagucau

SEQ ID NO: 1079804 - RNA, 19 nt, Homo sapiens
aaggaggaaucuguaaaga

SEQ ID NO: 1079805 - RNA, 19 nt, Homo sapiens
gcagcaccugauuauauuu

SEQ ID NO: 1079806 - RNA, 19 nt, Homo sapiens
cuagaaauacugcagaaag

SEQ ID NO: 1079807 - RNA, 19 nt, Homo sapiens
uaaacgcggugugggacuu

SEQ ID NO: 1079808 - RNA, 19 nt, Homo sapiens
ucaacaaggaccucaagga

SEQ ID NO: 1079809 - RNA, 19 nt, Homo sapiens
uuucaaguaucccgugaug

SEQ ID NO: 1079810 - RNA, 19 nt, Homo sapiens
gaaaaggcacugaaguugu

SEQ ID NO: 1079811 - RNA, 19 nt, Homo sapiens
agaaagagagaagcaaaug

SEQ ID NO: 1079812 - RNA, 19 nt, Homo sapiens
gauggugaaguuuggaaga

SEQ ID NO: 1079813 - RNA, 19 nt, Homo sapiens
aggaaucuguaaagaaaca

SEQ ID NO: 1079814 - RNA, 19 nt, Homo sapiens
ggaaagccugucuggaagu

SEQ ID NO: 1079815 - RNA, 19 nt, Homo sapiens
ccaaaguccaggaggaugu

SEQ ID NO: 1079816 - RNA, 19 nt, Homo sapiens
cauuguuggugacuucaga

SEQ ID NO: 1079817 - RNA, 19 nt, Homo sapiens
caaggaucccggcuacuca

SEQ ID NO: 1079818 - RNA, 19 nt, Homo sapiens
caugagcauuucaaguauc

SEQ ID NO: 1079819 - RNA, 19 nt, Homo sapiens
cagaugacacguugaagca

SEQ ID NO: 1079820 - RNA, 19 nt, Homo sapiens
gaggaggaugcccuagaaa

SEQ ID NO: 1079821 - RNA, 19 nt, Homo sapiens
accuagacauuaaacugua

SEQ ID NO: 1079822 - RNA, 19 nt, Homo sapiens
guaaagauguggcugaauu

SEQ ID NO: 1079823 - RNA, 19 nt, Homo sapiens
gcaccgaaguuugacauua

SEQ ID NO: 1079824 - RNA, 19 nt, Homo sapiens
guggugaggugaaaucuua

SEQ ID NO: 1079825 - RNA, 19 nt, Homo sapiens
uaagagcgcguuauuauuu

SEQ ID NO: 1079826 - RNA, 19 nt, Homo sapiens
cgauaaggaugaucacuuu

SEQ ID NO: 1079827 - RNA, 19 nt, Homo sapiens
gaaccuaaguugacugaag

SEQ ID NO: 1079828 - RNA, 19 nt, Homo sapiens
uaaagaagguagcaugaau

SEQ ID NO: 1079829 - RNA, 19 nt, Homo sapiens
guauagcccugaaacguuu

SEQ ID NO: 1079830 - RNA, 19 nt, Homo sapiens
gaggugaaaucuuaucuca

SEQ ID NO: 1079831 - RNA, 19 nt, Homo sapiens
caccgaaguuugacauuaa

SEQ ID NO: 1079832 - RNA, 19 nt, Homo sapiens
gcaaaugccagaagauguu

SEQ ID NO: 1079833 - RNA, 19 nt, Homo sapiens
gcaagauauuaguggcuua

SEQ ID NO: 1079834 - RNA, 19 nt, Homo sapiens
ugauaaacauagccaguaa

SEQ ID NO: 1079835 - RNA, 19 nt, Homo sapiens
caacaauucuugguuaaag

SEQ ID NO: 1079836 - RNA, 19 nt, Homo sapiens
uagcaugaaugaacgcuuu

SEQ ID NO: 1079837 - RNA, 19 nt, Homo sapiens
uaaaagauguggucaguga

SEQ ID NO: 1079838 - RNA, 19 nt, Homo sapiens
gaagguagcaugaaugaac

SEQ ID NO: 1079839 - RNA, 19 nt, Homo sapiens
gacagggacugcugguauu

SEQ ID NO: 1079840 - RNA, 19 nt, Homo sapiens
gcacaagcaccgaaguuug

SEQ ID NO: 1079841 - RNA, 19 nt, Homo sapiens
ggauaaccuugauggcauu

SEQ ID NO: 1079842 - RNA, 19 nt, Homo sapiens
aagagcgcguuauuauuua

SEQ ID NO: 1079843 - RNA, 19 nt, Homo sapiens
gcagaacgugccuuauaaa

SEQ ID NO: 1079844 - RNA, 19 nt, Homo sapiens
gcugagacguuuagaggau

SEQ ID NO: 1079845 - RNA, 19 nt, Homo sapiens
ccauguugauucugauaaa

SEQ ID NO: 1079846 - RNA, 19 nt, Homo sapiens
gaaauagcgauuguccuuu

SEQ ID NO: 1079847 - RNA, 19 nt, Homo sapiens
gauauuaguggcuuaagug

SEQ ID NO: 1079848 - RNA, 19 nt, Homo sapiens
gaacucgaauuugcugaca

SEQ ID NO: 1079849 - RNA, 19 nt, Homo sapiens
ugaaauagcgauuguccuu

SEQ ID NO: 1079850 - RNA, 19 nt, Homo sapiens
guauugaucgcuacauuga

SEQ ID NO: 1079851 - RNA, 19 nt, Homo sapiens
ucaagcgacacaugacuua

SEQ ID NO: 1079852 - RNA, 19 nt, Homo sapiens
caaggcggcuucuguaaaa

SEQ ID NO: 1079853 - RNA, 19 nt, Homo sapiens
gauaaggaugaucacuuua

SEQ ID NO: 1079854 - RNA, 19 nt, Homo sapiens
augcaacaauucuugguua

SEQ ID NO: 1079855 - RNA, 19 nt, Homo sapiens
ggucagugauaacgugguu

SEQ ID NO: 1079856 - RNA, 19 nt, Homo sapiens
agauguggcugaauugaug

SEQ ID NO: 1079857 - RNA, 19 nt, Homo sapiens
gauaguagugacacauuga

SEQ ID NO: 1079858 - RNA, 19 nt, Homo sapiens
aaagauguggucagugaua

SEQ ID NO: 1079859 - RNA, 19 nt, Homo sapiens
gagcaaaugccagaagaug

SEQ ID NO: 1079860 - RNA, 19 nt, Homo sapiens
ccaaagaugaagcccuuaa

SEQ ID NO: 1079861 - RNA, 19 nt, Homo sapiens
gaauaucaagcgacacaug

SEQ ID NO: 1079862 - RNA, 19 nt, Homo sapiens
caaagaugaagcccuuaaa

SEQ ID NO: 1079863 - RNA, 19 nt, Homo sapiens
gcaacaauucuugguuaaa

SEQ ID NO: 1079864 - RNA, 19 nt, Homo sapiens
gauuggcguuacuuuguga

SEQ ID NO: 1079865 - RNA, 19 nt, Homo sapiens
cacaagcaccgaaguuuga

SEQ ID NO: 1079866 - RNA, 19 nt, Homo sapiens
uuuaagagcgcguuauuau

SEQ ID NO: 1079867 - RNA, 19 nt, Homo sapiens
ugacaugcaacaauucuug

SEQ ID NO: 1079868 - RNA, 19 nt, Homo sapiens
gcgauuggcguuacuuugu

SEQ ID NO: 1079869 - RNA, 19 nt, Homo sapiens
gauaaacauagccaguaaa

SEQ ID NO: 1079870 - RNA, 19 nt, Homo sapiens
ugacagggacugcugguau

SEQ ID NO: 1079871 - RNA, 19 nt, Homo sapiens
gauuggcgacugaauauca

SEQ ID NO: 1079872 - RNA, 19 nt, Homo sapiens
gggauuggauuaaaauuuc

SEQ ID NO: 1079873 - RNA, 19 nt, Homo sapiens
uggcuuaagugaauuugug

SEQ ID NO: 1079874 - RNA, 19 nt, Homo sapiens
aagcugaacucgaauuugc

SEQ ID NO: 1079875 - RNA, 19 nt, Homo sapiens
gcagguggacgauaaggau

SEQ ID NO: 1079876 - RNA, 19 nt, Homo sapiens
auuaguggcuuaagugaau

SEQ ID NO: 1079877 - RNA, 19 nt, Homo sapiens
caagauauuaguggcuuaa

SEQ ID NO: 1079878 - RNA, 19 nt, Homo sapiens
ucaaggcggcuucuguaaa

SEQ ID NO: 1079879 - RNA, 19 nt, Homo sapiens
uaacuucuggcgcaugauu

SEQ ID NO: 1079880 - RNA, 19 nt, Homo sapiens
ugauggcgauuaacuucuu

SEQ ID NO: 1079881 - RNA, 19 nt, Homo sapiens
uuacguggguuccaugaag

SEQ ID NO: 1079882 - RNA, 19 nt, Homo sapiens
agagcgcguuauuauuuaa

SEQ ID NO: 1079883 - RNA, 19 nt, Homo sapiens
agucauugcugagacguuu

SEQ ID NO: 1079884 - RNA, 19 nt, Homo sapiens
uaaggaugaucacuuuaac

SEQ ID NO: 1079885 - RNA, 19 nt, Homo sapiens
uaaagauguggcugaauug

SEQ ID NO: 1079886 - RNA, 19 nt, Homo sapiens
guuaaagaagguagcauga

SEQ ID NO: 1079887 - RNA, 19 nt, Homo sapiens
aagauguggucagugauaa

SEQ ID NO: 1079888 - RNA, 19 nt, Homo sapiens
cguuugaaguggccucauu

SEQ ID NO: 1079889 - RNA, 19 nt, Homo sapiens
uuagaggauugucaccaaa

SEQ ID NO: 1079890 - RNA, 19 nt, Homo sapiens
ucuugcagguggacgauaa

SEQ ID NO: 1079891 - RNA, 19 nt, Homo sapiens
ggugauggcgauuaacuuc

SEQ ID NO: 1079892 - RNA, 19 nt, Homo sapiens
ugcaacaauucuugguuaa

SEQ ID NO: 1079893 - RNA, 19 nt, Homo sapiens
aaauagcgauuguccuuuu

SEQ ID NO: 1079894 - RNA, 19 nt, Homo sapiens
gguauugaucgcuacauug

SEQ ID NO: 1079895 - RNA, 19 nt, Homo sapiens
ggucaccggcuugggauaa

SEQ ID NO: 1079896 - RNA, 19 nt, Homo sapiens
caaccagcgauguuuaaug

SEQ ID NO: 1079897 - RNA, 19 nt, Homo sapiens
ggcaaccagcgauguuuaa

SEQ ID NO: 1079898 - RNA, 19 nt, Homo sapiens
gcgcuugaaccuaaguuga

SEQ ID NO: 1079899 - RNA, 19 nt, Homo sapiens
agauaguagugacacauug

SEQ ID NO: 1079900 - RNA, 19 nt, Homo sapiens
ucgaugauuugcaauucaa

SEQ ID NO: 1079901 - RNA, 19 nt, Homo sapiens
aagaagguagcaugaauga

SEQ ID NO: 1079902 - RNA, 19 nt, Homo sapiens
gccagugcuuuaugacaug

SEQ ID NO: 1079903 - RNA, 19 nt, Homo sapiens
uuaagagcgcguuauuauu

SEQ ID NO: 1079904 - RNA, 19 nt, Homo sapiens
aaccagcgauguuuaaugc

SEQ ID NO: 1079905 - RNA, 19 nt, Homo sapiens
ucaagcugaacucgaauuu

SEQ ID NO: 1079906 - RNA, 19 nt, Homo sapiens
uuguugcgcuugaaccuaa

SEQ ID NO: 1079907 - RNA, 19 nt, Homo sapiens
ggauugucaccaaagauga

SEQ ID NO: 1079908 - RNA, 19 nt, Homo sapiens
agaggauugucaccaaaga

SEQ ID NO: 1079909 - RNA, 19 nt, Homo sapiens
gauuugcaauucaaguucu

SEQ ID NO: 1079910 - RNA, 19 nt, Homo sapiens
gacaucuucugcaaucgau

SEQ ID NO: 1079911 - RNA, 19 nt, Homo sapiens
uaaaauucgucacuucuuc

SEQ ID NO: 1079912 - RNA, 19 nt, Homo sapiens
aauguaauaugacgaaucg

SEQ ID NO: 1079913 - RNA, 19 nt, Homo sapiens
caaaugccagaagauguuu

SEQ ID NO: 1079914 - RNA, 19 nt, Homo sapiens
ggaugaucacuuuaaccua

SEQ ID NO: 1079915 - RNA, 19 nt, Homo sapiens
cagauaguagugacacauu

SEQ ID NO: 1079916 - RNA, 19 nt, Homo sapiens
aaggauuggcgacugaaua

SEQ ID NO: 1079917 - RNA, 19 nt, Homo sapiens
gauugucaccaaagaugaa

SEQ ID NO: 1079918 - RNA, 19 nt, Homo sapiens
ggcacaagcaccgaaguuu

SEQ ID NO: 1079919 - RNA, 19 nt, Homo sapiens
cgauuggcguuacuuugug

SEQ ID NO: 1079920 - RNA, 19 nt, Homo sapiens
gaaucaucuucuugagcaa

SEQ ID NO: 1079921 - RNA, 19 nt, Homo sapiens
auugaucgcuacauugaug

SEQ ID NO: 1079922 - RNA, 19 nt, Homo sapiens
caacuacacugugcugaua

SEQ ID NO: 1079923 - RNA, 19 nt, Homo sapiens
ucaacgagcuguauuucua

SEQ ID NO: 1079924 - RNA, 19 nt, Homo sapiens
ccaccaagaucgaguguga

SEQ ID NO: 1079925 - RNA, 19 nt, Homo sapiens
ggaagaggcucaacucacu

SEQ ID NO: 1079926 - RNA, 19 nt, Homo sapiens
gcacaucuaucuccugagu

SEQ ID NO: 1079927 - RNA, 19 nt, Homo sapiens
ggacagcgagugccaguuu

SEQ ID NO: 1079928 - RNA, 19 nt, Homo sapiens
gcagugaaccgagucuuua

SEQ ID NO: 1079929 - RNA, 19 nt, Homo sapiens
ucaaugagcugacuaacca

SEQ ID NO: 1079930 - RNA, 19 nt, Homo sapiens
gagcaggucuacagcuuug

SEQ ID NO: 1079931 - RNA, 19 nt, Homo sapiens
gagccucucuuccugcuuu

SEQ ID NO: 1079932 - RNA, 19 nt, Homo sapiens
caacaucaaugcccacauc

SEQ ID NO: 1079933 - RNA, 19 nt, Homo sapiens
ggaccgagaugccucuugu

SEQ ID NO: 1079934 - RNA, 19 nt, Homo sapiens
guucguggaugaccucuuu

SEQ ID NO: 1079935 - RNA, 19 nt, Homo sapiens
ucacguuccugcugcauaa

SEQ ID NO: 1079936 - RNA, 19 nt, Homo sapiens
gcacacggcuuaccaucuc

SEQ ID NO: 1079937 - RNA, 19 nt, Homo sapiens
ggagacaggcaccaaauug

SEQ ID NO: 1079938 - RNA, 19 nt, Homo sapiens
aaacaagugucugccuaua

SEQ ID NO: 1079939 - RNA, 19 nt, Homo sapiens
ugaagguucucaacuguga

SEQ ID NO: 1079940 - RNA, 19 nt, Homo sapiens
cgagcacccugaugaguuu

SEQ ID NO: 1079941 - RNA, 19 nt, Homo sapiens
agaagaaccucgagagcaa

SEQ ID NO: 1079942 - RNA, 19 nt, Homo sapiens
gagcugcccugcaucaaca

SEQ ID NO: 1079943 - RNA, 19 nt, Homo sapiens
cagcuaaggugguggaauc

SEQ ID NO: 1079944 - RNA, 19 nt, Homo sapiens
gggugaaugugaucaagaa

SEQ ID NO: 1079945 - RNA, 19 nt, Homo sapiens
ggcagaaacuggaacagau

SEQ ID NO: 1079946 - RNA, 19 nt, Homo sapiens
ggacucgcccuccaacaaa

SEQ ID NO: 1079947 - RNA, 19 nt, Homo sapiens
gagguauuaucgagacauu

SEQ ID NO: 1079948 - RNA, 19 nt, Homo sapiens
gcagaucgacuacaagaca

SEQ ID NO: 1079949 - RNA, 19 nt, Homo sapiens
gagaggaucgugugugaga

SEQ ID NO: 1079950 - RNA, 19 nt, Homo sapiens
gagcccaccuggagcauca

SEQ ID NO: 1079951 - RNA, 19 nt, Homo sapiens
ucacgggcacccaugauua

SEQ ID NO: 1079952 - RNA, 19 nt, Homo sapiens
ucaacucacuggcccacua

SEQ ID NO: 1079953 - RNA, 19 nt, Homo sapiens
acaaggagcugcccugcau

SEQ ID NO: 1079954 - RNA, 19 nt, Homo sapiens
cucaaccgcuccuccuuua

SEQ ID NO: 1079955 - RNA, 19 nt, Homo sapiens
gugcugacuuugucuucua

SEQ ID NO: 1079956 - RNA, 19 nt, Homo sapiens
gaagacagcgcggacaugu

SEQ ID NO: 1079957 - RNA, 19 nt, Homo sapiens
ggagacaggcgugagguuu

SEQ ID NO: 1079958 - RNA, 19 nt, Homo sapiens
cuccauggcuggugucauu

SEQ ID NO: 1079959 - RNA, 19 nt, Homo sapiens
agaagaugcuuaccaacug

SEQ ID NO: 1079960 - RNA, 19 nt, Homo sapiens
gaacgccucguacuccuau

SEQ ID NO: 1079961 - RNA, 19 nt, Homo sapiens
acaucuaucuccugaguga

SEQ ID NO: 1079962 - RNA, 19 nt, Homo sapiens
acaagacacugacccuuca

SEQ ID NO: 1079963 - RNA, 19 nt, Homo sapiens
ggacaucaaugagcugacu

SEQ ID NO: 1079964 - RNA, 19 nt, Homo sapiens
ccaucacacuugccauuga

SEQ ID NO: 1079965 - RNA, 19 nt, Homo sapiens
gaucaacggcaacuucugu

SEQ ID NO: 1079966 - RNA, 19 nt, Homo sapiens
gagcuguauuucuauguca

SEQ ID NO: 1079967 - RNA, 19 nt, Homo sapiens
ucaacaagcugcugcucau

SEQ ID NO: 1079968 - RNA, 19 nt, Homo sapiens
ggaugcaccugagccagaa

SEQ ID NO: 1079969 - RNA, 19 nt, Homo sapiens
gcgcggacauguucagucu

SEQ ID NO: 1079970 - RNA, 19 nt, Homo sapiens
gagaagaugcuuaccaacu

SEQ ID NO: 1079971 - RNA, 19 nt, Homo sapiens
gcuccuccuuuaccuacua

SEQ ID NO: 1079972 - RNA, 19 nt, Homo sapiens
accaauacaugccaaguga

SEQ ID NO: 1079973 - RNA, 19 nt, Homo sapiens
ccaaggacauccccaacua

SEQ ID NO: 1079974 - RNA, 19 nt, Homo sapiens
ucacccaggccaaagauaa

SEQ ID NO: 1079975 - RNA, 19 nt, Homo sapiens
cugagaagaugcuuaccaa

SEQ ID NO: 1079976 - RNA, 19 nt, Homo sapiens
gaggaugucaccaccaaga

SEQ ID NO: 1079977 - RNA, 19 nt, Homo sapiens
ucccaaagcugaggacaug

SEQ ID NO: 1079978 - RNA, 19 nt, Homo sapiens
ucaagcagcagauggagaa

SEQ ID NO: 1079979 - RNA, 19 nt, Homo sapiens
ccaaggcgaucgugugcau

SEQ ID NO: 1079980 - RNA, 19 nt, Homo sapiens
cccgcaagcucaucaguga

SEQ ID NO: 1079981 - RNA, 19 nt, Homo sapiens
gucagcagaucgacuacaa

SEQ ID NO: 1079982 - RNA, 19 nt, Homo sapiens
acaagcugcugcucauaga

SEQ ID NO: 1079983 - RNA, 19 nt, Homo sapiens
cugagaggaucguguguga

SEQ ID NO: 1079984 - RNA, 19 nt, Homo sapiens
gaagggcaagaaccugauu

SEQ ID NO: 1079985 - RNA, 19 nt, Homo sapiens
ucugugggcugguguugaa

SEQ ID NO: 1079986 - RNA, 19 nt, Homo sapiens
agagcuggguggagaggua

SEQ ID NO: 1079987 - RNA, 19 nt, Homo sapiens
ugcagaaguucguggauga

SEQ ID NO: 1079988 - RNA, 19 nt, Homo sapiens
gagacaggcaccaaauugu

SEQ ID NO: 1079989 - RNA, 19 nt, Homo sapiens
acaagugucugccuauaac

SEQ ID NO: 1079990 - RNA, 19 nt, Homo sapiens
caacaagcugcugcucaua

SEQ ID NO: 1079991 - RNA, 19 nt, Homo sapiens
cagcagaucgacuacaaga

SEQ ID NO: 1079992 - RNA, 19 nt, Homo sapiens
gcgagcacccugaugaguu

SEQ ID NO: 1079993 - RNA, 19 nt, Homo sapiens
gcagaaacuggaacagauc

SEQ ID NO: 1079994 - RNA, 19 nt, Homo sapiens
ggaaggacucgcccuccaa

SEQ ID NO: 1079995 - RNA, 19 nt, Homo sapiens
ugcauaaguuucugaagga

SEQ ID NO: 1079996 - RNA, 19 nt, Homo sapiens
gcagcucccgccucaacua

SEQ ID NO: 1079997 - RNA, 19 nt, Homo sapiens
ggagcaggucuacagcuuu

SEQ ID NO: 1079998 - RNA, 19 nt, Homo sapiens
gagacaggcgugagguuug

SEQ ID NO: 1079999 - RNA, 19 nt, Homo sapiens
agacagcgcggacauguuc

SEQ ID NO: 1080000 - RNA, 19 nt, Homo sapiens
guaccaggaugaguuugug

SEQ ID NO: 1080001 - RNA, 19 nt, Homo sapiens
caacgagcuguauuucuau

SEQ ID NO: 1080002 - RNA, 19 nt, Homo sapiens
caaacaagugucugccuau

SEQ ID NO: 1080003 - RNA, 19 nt, Homo sapiens
uggccgaccucaucgagaa

SEQ ID NO: 1080004 - RNA, 19 nt, Homo sapiens
cugaggagcugagcaagug

SEQ ID NO: 1080005 - RNA, 19 nt, Homo sapiens
ccucuugucggaagcauaa

SEQ ID NO: 1080006 - RNA, 19 nt, Homo sapiens
gaagcacugccaucacugu

SEQ ID NO: 1080007 - RNA, 19 nt, Homo sapiens
gggcucaucuacaccuaca

SEQ ID NO: 1080008 - RNA, 19 nt, Homo sapiens
acaccgagcuggacuucuc

SEQ ID NO: 1080009 - RNA, 19 nt, Homo sapiens
guacuccuaugaaggugau

SEQ ID NO: 1080010 - RNA, 19 nt, Homo sapiens
guggaugaccucuuugaga

SEQ ID NO: 1080011 - RNA, 19 nt, Homo sapiens
gacagcgagugccaguuug

SEQ ID NO: 1080012 - RNA, 19 nt, Homo sapiens
ccaaguaccgccaggagau

SEQ ID NO: 1080013 - RNA, 19 nt, Homo sapiens
ccuauaacauggccaacuc

SEQ ID NO: 1080014 - RNA, 19 nt, Homo sapiens
gcucauccgucagcagauc

SEQ ID NO: 1080015 - RNA, 19 nt, Homo sapiens
cggagcaggucuacagcuu

SEQ ID NO: 1080016 - RNA, 19 nt, Homo sapiens
gagcccuccuguacaagug

SEQ ID NO: 1080017 - RNA, 19 nt, Homo sapiens
ugacaucuacuacaucuac

SEQ ID NO: 1080018 - RNA, 19 nt, Homo sapiens
guuugccggugcugacuuu

SEQ ID NO: 1080019 - RNA, 19 nt, Homo sapiens
ggcugcagcuucucuccaa

SEQ ID NO: 1080020 - RNA, 19 nt, Homo sapiens
gaaacuggaacagaucauc

SEQ ID NO: 1080021 - RNA, 19 nt, Homo sapiens
ugagcugacuaaccacaug

SEQ ID NO: 1080022 - RNA, 19 nt, Homo sapiens
gcaaggagguaguaacaua

SEQ ID NO: 1080023 - RNA, 19 nt, Homo sapiens
gaccagagcucuugcauca

SEQ ID NO: 1080024 - RNA, 19 nt, Homo sapiens
gaaugagccuuuggaagua

SEQ ID NO: 1080025 - RNA, 19 nt, Homo sapiens
gagcagcccuugcauaugg

SEQ ID NO: 1080026 - RNA, 19 nt, Homo sapiens
gaauuuaccugggcucaug

SEQ ID NO: 1080027 - RNA, 19 nt, Homo sapiens
caaaguggagaaagaguua

SEQ ID NO: 1080028 - RNA, 19 nt, Homo sapiens
ggaaacagacaaauccaaa

SEQ ID NO: 1080029 - RNA, 19 nt, Homo sapiens
gaaguugugaagucaaaua

SEQ ID NO: 1080030 - RNA, 19 nt, Homo sapiens
uaacauauccagucgugaa

SEQ ID NO: 1080031 - RNA, 19 nt, Homo sapiens
gaauucugcuugugugcaa

SEQ ID NO: 1080032 - RNA, 19 nt, Homo sapiens
caagauggccuuugaagag

SEQ ID NO: 1080033 - RNA, 19 nt, Homo sapiens
cagcugaaaugaacuucuu

SEQ ID NO: 1080034 - RNA, 19 nt, Homo sapiens
gagauuguguugucuaagg

SEQ ID NO: 1080035 - RNA, 19 nt, Homo sapiens
aaacaugucccgucggaaa

SEQ ID NO: 1080036 - RNA, 19 nt, Homo sapiens
uaagugaccagcuuucuug

SEQ ID NO: 1080037 - RNA, 19 nt, Homo sapiens
gacacaagaugaagucucu

SEQ ID NO: 1080038 - RNA, 19 nt, Homo sapiens
gucaggcucuugucuggua

SEQ ID NO: 1080039 - RNA, 19 nt, Homo sapiens
gcaagauggccuuugaaga

SEQ ID NO: 1080040 - RNA, 19 nt, Homo sapiens
cuacauguguccugucugu

SEQ ID NO: 1080041 - RNA, 19 nt, Homo sapiens
caucucggcugauuagaca

SEQ ID NO: 1080042 - RNA, 19 nt, Homo sapiens
agaaugagccuuuggaagu

SEQ ID NO: 1080043 - RNA, 19 nt, Homo sapiens
gaaacagacaaauccaaau

SEQ ID NO: 1080044 - RNA, 19 nt, Homo sapiens
uaccugggcucaugcuuga

SEQ ID NO: 1080045 - RNA, 19 nt, Homo sapiens
ggagaaagaguuagaaaau

SEQ ID NO: 1080046 - RNA, 19 nt, Homo sapiens
ggagacgacacaagaugaa

SEQ ID NO: 1080047 - RNA, 19 nt, Homo sapiens
cggagauuguguugucuaa

SEQ ID NO: 1080048 - RNA, 19 nt, Homo sapiens
ggaccaucucggcugauua

SEQ ID NO: 1080049 - RNA, 19 nt, Homo sapiens
gcauaugggaacaggauga

SEQ ID NO: 1080050 - RNA, 19 nt, Homo sapiens
guugauugcucacguguac

SEQ ID NO: 1080051 - RNA, 19 nt, Homo sapiens
gaggagacgacacaagaug

SEQ ID NO: 1080052 - RNA, 19 nt, Homo sapiens
gggaccaucucggcugauu

SEQ ID NO: 1080053 - RNA, 19 nt, Homo sapiens
gcuggagguuagcaucuug

SEQ ID NO: 1080054 - RNA, 19 nt, Homo sapiens
auacagaucacuuggauuc

SEQ ID NO: 1080055 - RNA, 19 nt, Homo sapiens
gauguugcgagcucaguuu

SEQ ID NO: 1080056 - RNA, 19 nt, Homo sapiens
gaagaggagacgacacaag

SEQ ID NO: 1080057 - RNA, 19 nt, Homo sapiens
gcucuugucugguaauucc

SEQ ID NO: 1080058 - RNA, 19 nt, Homo sapiens
agauacagaucacuuggau

SEQ ID NO: 1080059 - RNA, 19 nt, Homo sapiens
gagcaggcaguccagagaa

SEQ ID NO: 1080060 - RNA, 19 nt, Homo sapiens
ggagcaggcaguccagaga

SEQ ID NO: 1080061 - RNA, 19 nt, Homo sapiens
caaggagguaguaacauau

SEQ ID NO: 1080062 - RNA, 19 nt, Homo sapiens
ccaugaaguugugaaguca

SEQ ID NO: 1080063 - RNA, 19 nt, Homo sapiens
gaccaucucggcugauuag

SEQ ID NO: 1080064 - RNA, 19 nt, Homo sapiens
aguguacccugcuggaauu

SEQ ID NO: 1080065 - RNA, 19 nt, Homo sapiens
ugucuaaggguuugucuga

SEQ ID NO: 1080066 - RNA, 19 nt, Homo sapiens
aagaggagacgacacaaga

SEQ ID NO: 1080067 - RNA, 19 nt, Homo sapiens
cuuagcagcugaaaugaac

SEQ ID NO: 1080068 - RNA, 19 nt, Homo sapiens
uacccacaguccacaauga

SEQ ID NO: 1080069 - RNA, 19 nt, Homo sapiens
gaggucacagggaauuuga

SEQ ID NO: 1080070 - RNA, 19 nt, Homo sapiens
ucaccagccaugccacuuu

SEQ ID NO: 1080071 - RNA, 19 nt, Homo sapiens
cgaucuaacugugcugugu

SEQ ID NO: 1080072 - RNA, 19 nt, Homo sapiens
ggucacagggaauuugaau

SEQ ID NO: 1080073 - RNA, 19 nt, Homo sapiens
ucaaaguggagaaagaguu

SEQ ID NO: 1080074 - RNA, 19 nt, Homo sapiens
gcggcuaagugaccagcuu

SEQ ID NO: 1080075 - RNA, 19 nt, Homo sapiens
cccaugaaguugugaaguc

SEQ ID NO: 1080076 - RNA, 19 nt, Homo sapiens
gcucuacgucgacagaaug

SEQ ID NO: 1080077 - RNA, 19 nt, Homo sapiens
guacccugcuggaauucug

SEQ ID NO: 1080078 - RNA, 19 nt, Homo sapiens
ggaguuggacagccagcuu

SEQ ID NO: 1080079 - RNA, 19 nt, Homo sapiens
gagagcgcacggccaagaa

SEQ ID NO: 1080080 - RNA, 19 nt, Homo sapiens
guacgcaagugggcucuac

SEQ ID NO: 1080081 - RNA, 19 nt, Homo sapiens
cagaucacuuggauucagu

SEQ ID NO: 1080082 - RNA, 19 nt, Homo sapiens
gaccugagcagcccuugca

SEQ ID NO: 1080083 - RNA, 19 nt, Homo sapiens
ucaagaggaggcuggagaa

SEQ ID NO: 1080084 - RNA, 19 nt, Homo sapiens
ccacacaucagaggaagau

SEQ ID NO: 1080085 - RNA, 19 nt, Homo sapiens
uuucggagauuguguuguc

SEQ ID NO: 1080086 - RNA, 19 nt, Homo sapiens
cugagcagcccuugcauau

SEQ ID NO: 1080087 - RNA, 19 nt, Homo sapiens
uuggcaagauggccuuuga

SEQ ID NO: 1080088 - RNA, 19 nt, Homo sapiens
guggagaaagaguuagaaa

SEQ ID NO: 1080089 - RNA, 19 nt, Homo sapiens
acagugagggugaugaaga

SEQ ID NO: 1080090 - RNA, 19 nt, Homo sapiens
agaggaggcuggagaaaau

SEQ ID NO: 1080091 - RNA, 19 nt, Homo sapiens
caagaggaggcuggagaaa

SEQ ID NO: 1080092 - RNA, 19 nt, Homo sapiens
gacagaaugagccuuugga

SEQ ID NO: 1080093 - RNA, 19 nt, Homo sapiens
uggaaucccuacccacagu

SEQ ID NO: 1080094 - RNA, 19 nt, Homo sapiens
cugaaguacuaaauaugga

SEQ ID NO: 1080095 - RNA, 19 nt, Homo sapiens
ggaccagcgaucuaacugu

SEQ ID NO: 1080096 - RNA, 19 nt, Homo sapiens
ugacagugagggugaugaa

SEQ ID NO: 1080097 - RNA, 19 nt, Homo sapiens
augaaguugugaagucaaa

SEQ ID NO: 1080098 - RNA, 19 nt, Homo sapiens
gagcgcacggccaagaaga

SEQ ID NO: 1080099 - RNA, 19 nt, Homo sapiens
gcacgaggucacagggaau

SEQ ID NO: 1080100 - RNA, 19 nt, Homo sapiens
cauauccagucgugaaacu

SEQ ID NO: 1080101 - RNA, 19 nt, Homo sapiens
cggaggaccagcgaucuaa

SEQ ID NO: 1080102 - RNA, 19 nt, Homo sapiens
ccugagcagcccuugcaua

SEQ ID NO: 1080103 - RNA, 19 nt, Homo sapiens
ccaaugaaaccccggaaaa

SEQ ID NO: 1080104 - RNA, 19 nt, Homo sapiens
gggaggccaugaggcugaa

SEQ ID NO: 1080105 - RNA, 19 nt, Homo sapiens
gcuggaauucugcuugugu

SEQ ID NO: 1080106 - RNA, 19 nt, Homo sapiens
cagugagggugaugaagag

SEQ ID NO: 1080107 - RNA, 19 nt, Homo sapiens
agccuuagcagcugaaaug

SEQ ID NO: 1080108 - RNA, 19 nt, Homo sapiens
gcucuugucaggcucuugu

SEQ ID NO: 1080109 - RNA, 19 nt, Homo sapiens
uggucaaaguggagaaaga

SEQ ID NO: 1080110 - RNA, 19 nt, Homo sapiens
cagacaaauccaaauaaag

SEQ ID NO: 1080111 - RNA, 19 nt, Homo sapiens
ccugaaguacuaaauaugg

SEQ ID NO: 1080112 - RNA, 19 nt, Homo sapiens
gcgccaagagcuacaugug

SEQ ID NO: 1080113 - RNA, 19 nt, Homo sapiens
cuaagugaccagcuuucuu

SEQ ID NO: 1080114 - RNA, 19 nt, Homo sapiens
ggcaagauggccuuugaag

SEQ ID NO: 1080115 - RNA, 19 nt, Homo sapiens
ggcagauacagaucacuug

SEQ ID NO: 1080116 - RNA, 19 nt, Homo sapiens
gucgacagaaugagccuuu

SEQ ID NO: 1080117 - RNA, 19 nt, Homo sapiens
cgaggucacagggaauuug

SEQ ID NO: 1080118 - RNA, 19 nt, Homo sapiens
ggucaaaguggagaaagag

SEQ ID NO: 1080119 - RNA, 19 nt, Homo sapiens
aaagggacauuuagagaua

SEQ ID NO: 1080120 - RNA, 19 nt, Homo sapiens
gaaugaaucuacaccuuug

SEQ ID NO: 1080121 - RNA, 19 nt, Homo sapiens
ggaaauacguggagacacu

SEQ ID NO: 1080122 - RNA, 19 nt, Homo sapiens
cggguaaacuugucccuua

SEQ ID NO: 1080123 - RNA, 19 nt, Homo sapiens
ccacaccucuuuaaguuug

SEQ ID NO: 1080124 - RNA, 19 nt, Homo sapiens
gagauaaggacaaauuuga

SEQ ID NO: 1080125 - RNA, 19 nt, Homo sapiens
gcuagaacaugcuauaaca

SEQ ID NO: 1080126 - RNA, 19 nt, Homo sapiens
ugcaacaucucuaagaaua

SEQ ID NO: 1080127 - RNA, 19 nt, Homo sapiens
ccagauaacuacggcgaua

SEQ ID NO: 1080128 - RNA, 19 nt, Homo sapiens
uggcguaccuucucauuga

SEQ ID NO: 1080129 - RNA, 19 nt, Homo sapiens
cgaugcagcacuuuaaaua

SEQ ID NO: 1080130 - RNA, 19 nt, Homo sapiens
gaccacacaugacagaaau

SEQ ID NO: 1080131 - RNA, 19 nt, Homo sapiens
gaaagggacauuuagagau

SEQ ID NO: 1080132 - RNA, 19 nt, Homo sapiens
gcaucaagcuguacaugag

SEQ ID NO: 1080133 - RNA, 19 nt, Homo sapiens
gauccagccuguuucacaa

SEQ ID NO: 1080134 - RNA, 19 nt, Homo sapiens
gguguaugaugaugacgua

SEQ ID NO: 1080135 - RNA, 19 nt, Homo sapiens
ccuggaagguugagaaguu

SEQ ID NO: 1080136 - RNA, 19 nt, Homo sapiens
gggaucggcugaaugaauc

SEQ ID NO: 1080137 - RNA, 19 nt, Homo sapiens
gaggaaagauggcguaccu

SEQ ID NO: 1080138 - RNA, 19 nt, Homo sapiens
gaaagugcgagacaacguu

SEQ ID NO: 1080139 - RNA, 19 nt, Homo sapiens
gaagucaaaguuucacaga

SEQ ID NO: 1080140 - RNA, 19 nt, Homo sapiens
gguucuguuucuaaaguua

SEQ ID NO: 1080141 - RNA, 19 nt, Homo sapiens
cacaaacgauugcaacauc

SEQ ID NO: 1080142 - RNA, 19 nt, Homo sapiens
gagacaacguuggugaaga

SEQ ID NO: 1080143 - RNA, 19 nt, Homo sapiens
caacaucucuaagaauagg

SEQ ID NO: 1080144 - RNA, 19 nt, Homo sapiens
cgaaagggacauuuagaga

SEQ ID NO: 1080145 - RNA, 19 nt, Homo sapiens
guuaugcuucucaagauua

SEQ ID NO: 1080146 - RNA, 19 nt, Homo sapiens
ugaaugaaucuacaccuuu

SEQ ID NO: 1080147 - RNA, 19 nt, Homo sapiens
ggugggaucggcugaauga

SEQ ID NO: 1080148 - RNA, 19 nt, Homo sapiens
guaaacuugucccuuaugg

SEQ ID NO: 1080149 - RNA, 19 nt, Homo sapiens
gaaauacguggagacacua

SEQ ID NO: 1080150 - RNA, 19 nt, Homo sapiens
ggccagggguucccaguua

SEQ ID NO: 1080151 - RNA, 19 nt, Homo sapiens
gugaagagguggauaugac

SEQ ID NO: 1080152 - RNA, 19 nt, Homo sapiens
gcgauacccuugaugaaaa

SEQ ID NO: 1080153 - RNA, 19 nt, Homo sapiens
ccaguuaugcuucucaaga

SEQ ID NO: 1080154 - RNA, 19 nt, Homo sapiens
acccacaccucuuuaaguu

SEQ ID NO: 1080155 - RNA, 19 nt, Homo sapiens
ggguaaacuugucccuuau

SEQ ID NO: 1080156 - RNA, 19 nt, Homo sapiens
uaaaccaauucgccgagaa

SEQ ID NO: 1080157 - RNA, 19 nt, Homo sapiens
gcauuaaugagauccgaaa

SEQ ID NO: 1080158 - RNA, 19 nt, Homo sapiens
agucaaaguuucacagauc

SEQ ID NO: 1080159 - RNA, 19 nt, Homo sapiens
agacaacguuggugaagag

SEQ ID NO: 1080160 - RNA, 19 nt, Homo sapiens
gauaaggacaaauuugaag

SEQ ID NO: 1080161 - RNA, 19 nt, Homo sapiens
ggaccugccugaagcuacu

SEQ ID NO: 1080162 - RNA, 19 nt, Homo sapiens
gagacacuacggacagaaa

SEQ ID NO: 1080163 - RNA, 19 nt, Homo sapiens
caagcacccacaccucuuu

SEQ ID NO: 1080164 - RNA, 19 nt, Homo sapiens
gauugcaacaucucuaaga

SEQ ID NO: 1080165 - RNA, 19 nt, Homo sapiens
ggacuaugccagcuguuca

SEQ ID NO: 1080166 - RNA, 19 nt, Homo sapiens
ggagguguaugaugaugac

SEQ ID NO: 1080167 - RNA, 19 nt, Homo sapiens
caguuaugcuucucaagau

SEQ ID NO: 1080168 - RNA, 19 nt, Homo sapiens
gaaagauggcguaccuucu

SEQ ID NO: 1080169 - RNA, 19 nt, Homo sapiens
ggcgauacccuugaugaaa

SEQ ID NO: 1080170 - RNA, 19 nt, Homo sapiens
caaauuugaagggcuguuu

SEQ ID NO: 1080171 - RNA, 19 nt, Homo sapiens
aaaagaacguggaggugua

SEQ ID NO: 1080172 - RNA, 19 nt, Homo sapiens
ggaucgagcaggauuucaa

SEQ ID NO: 1080173 - RNA, 19 nt, Homo sapiens
cucaagauuagccauauua

SEQ ID NO: 1080174 - RNA, 19 nt, Homo sapiens
agaauaggucuaagucuug

SEQ ID NO: 1080175 - RNA, 19 nt, Homo sapiens
ggacauuuagagauaagga

SEQ ID NO: 1080176 - RNA, 19 nt, Homo sapiens
gugguucuguuucuaaagu

SEQ ID NO: 1080177 - RNA, 19 nt, Homo sapiens
gagcuaguuuguagugacu

SEQ ID NO: 1080178 - RNA, 19 nt, Homo sapiens
acacaugacagaaauucaa

SEQ ID NO: 1080179 - RNA, 19 nt, Homo sapiens
gaacguggagguguaugau

SEQ ID NO: 1080180 - RNA, 19 nt, Homo sapiens
gccugugccugguguguga

SEQ ID NO: 1080181 - RNA, 19 nt, Homo sapiens
ugaaauccucuacaagguu

SEQ ID NO: 1080182 - RNA, 19 nt, Homo sapiens
cagacuggcuugugguucu

SEQ ID NO: 1080183 - RNA, 19 nt, Homo sapiens
ucucaagauuagccauauu

SEQ ID NO: 1080184 - RNA, 19 nt, Homo sapiens
cugaaugaaucuacaccuu

SEQ ID NO: 1080185 - RNA, 19 nt, Homo sapiens
ugccugcacccuagcauua

SEQ ID NO: 1080186 - RNA, 19 nt, Homo sapiens
acguggagguguaugauga

SEQ ID NO: 1080187 - RNA, 19 nt, Homo sapiens
gcuaguuuguagugacuca

SEQ ID NO: 1080188 - RNA, 19 nt, Homo sapiens
gaugcagcacuuuaaauag

SEQ ID NO: 1080189 - RNA, 19 nt, Homo sapiens
gauaugaccgguccuagcu

SEQ ID NO: 1080190 - RNA, 19 nt, Homo sapiens
guuaaggcaggaucugaaa

SEQ ID NO: 1080191 - RNA, 19 nt, Homo sapiens
ugaaucuacaccuuuguuu

SEQ ID NO: 1080192 - RNA, 19 nt, Homo sapiens
cacccuagcauuaaugaga

SEQ ID NO: 1080193 - RNA, 19 nt, Homo sapiens
ugaccacacaugacagaaa

SEQ ID NO: 1080194 - RNA, 19 nt, Homo sapiens
uugaagggcuguuuaagcu

SEQ ID NO: 1080195 - RNA, 19 nt, Homo sapiens
aaauuugaagggcuguuua

SEQ ID NO: 1080196 - RNA, 19 nt, Homo sapiens
guugcuagaacaugcuaua

SEQ ID NO: 1080197 - RNA, 19 nt, Homo sapiens
ucucuaagaauaggucuaa

SEQ ID NO: 1080198 - RNA, 19 nt, Homo sapiens
augcagcacuuuaaauagu

SEQ ID NO: 1080199 - RNA, 19 nt, Homo sapiens
ccacacaugacagaaauuc

SEQ ID NO: 1080200 - RNA, 19 nt, Homo sapiens
agagauaaggacaaauuug

SEQ ID NO: 1080201 - RNA, 19 nt, Homo sapiens
gcggucuaguuggcucuua

SEQ ID NO: 1080202 - RNA, 19 nt, Homo sapiens
gauggcguaccuucucauu

SEQ ID NO: 1080203 - RNA, 19 nt, Homo sapiens
gcaacaucucuaagaauag

SEQ ID NO: 1080204 - RNA, 19 nt, Homo sapiens
gagauuaaaaccuuuguga

SEQ ID NO: 1080205 - RNA, 19 nt, Homo sapiens
ccgaggaagccaacacuug

SEQ ID NO: 1080206 - RNA, 19 nt, Homo sapiens
cuacggcgauacccuugau

SEQ ID NO: 1080207 - RNA, 19 nt, Homo sapiens
ggcaacaggaggaaagaug

SEQ ID NO: 1080208 - RNA, 19 nt, Homo sapiens
agaccgcgaugcagcacuu

SEQ ID NO: 1080209 - RNA, 19 nt, Homo sapiens
uuaaugagauccgaaaaga

SEQ ID NO: 1080210 - RNA, 19 nt, Homo sapiens
gguuaaggcaggaucugaa

SEQ ID NO: 1080211 - RNA, 19 nt, Homo sapiens
gcgaugcagcacuuuaaau

SEQ ID NO: 1080212 - RNA, 19 nt, Homo sapiens
ccgcgaugcagcacuuuaa

SEQ ID NO: 1080213 - RNA, 19 nt, Homo sapiens
gcacccacaccucuuuaag

SEQ ID NO: 1080214 - RNA, 19 nt, Homo sapiens
gcagcacuuuaaauagucu

SEQ ID NO: 1080215 - RNA, 19 nt, Homo sapiens
ccuacaaggucuucuuucg

SEQ ID NO: 1080216 - RNA, 19 nt, Homo sapiens
gggagaguguguguguuca

SEQ ID NO: 1080217 - RNA, 19 nt, Homo sapiens
gcuugugguucuguuucua

SEQ ID NO: 1080218 - RNA, 19 nt, Homo sapiens
gcuuguacgacaugaaaga

SEQ ID NO: 1080219 - RNA, 19 nt, Homo sapiens
agaaagggcugaaugauua

SEQ ID NO: 1080220 - RNA, 19 nt, Homo sapiens
gcaaguggauuauauuuga

SEQ ID NO: 1080221 - RNA, 19 nt, Homo sapiens
gaaguucucucaaggauug

SEQ ID NO: 1080222 - RNA, 19 nt, Homo sapiens
ggacugagcucucucugaa

SEQ ID NO: 1080223 - RNA, 19 nt, Homo sapiens
gaaagauagucgaugauaa

SEQ ID NO: 1080224 - RNA, 19 nt, Homo sapiens
gaagucacauuacgucuuu

SEQ ID NO: 1080225 - RNA, 19 nt, Homo sapiens
ugaaagugcugaaugauaa

SEQ ID NO: 1080226 - RNA, 19 nt, Homo sapiens
gaaaauaccuuacuggauu

SEQ ID NO: 1080227 - RNA, 19 nt, Homo sapiens
gcagcucgaugucauguua

SEQ ID NO: 1080228 - RNA, 19 nt, Homo sapiens
aaacagugauggagaauaa

SEQ ID NO: 1080229 - RNA, 19 nt, Homo sapiens
gauagucgaugauaacauu

SEQ ID NO: 1080230 - RNA, 19 nt, Homo sapiens
gaagaaagcagugguguuu

SEQ ID NO: 1080231 - RNA, 19 nt, Homo sapiens
gagaaugacuauuacugua

SEQ ID NO: 1080232 - RNA, 19 nt, Homo sapiens
gaucaacaaugccaucaaa

SEQ ID NO: 1080233 - RNA, 19 nt, Homo sapiens
gaaaguugcuuccaugaca

SEQ ID NO: 1080234 - RNA, 19 nt, Homo sapiens
gaacaucaccgugccuuua

SEQ ID NO: 1080235 - RNA, 19 nt, Homo sapiens
gagagaagcugauggaaag

SEQ ID NO: 1080236 - RNA, 19 nt, Homo sapiens
gaaaugaaauugcauccau

SEQ ID NO: 1080237 - RNA, 19 nt, Homo sapiens
gaagaucaaugccauaaag

SEQ ID NO: 1080238 - RNA, 19 nt, Homo sapiens
ucaaagggcucuucuuaga

SEQ ID NO: 1080239 - RNA, 19 nt, Homo sapiens
gagagcaucugcaucauga

SEQ ID NO: 1080240 - RNA, 19 nt, Homo sapiens
gaggaagcaucuaugauuu

SEQ ID NO: 1080241 - RNA, 19 nt, Homo sapiens
uggcagagcugaaaggaua

SEQ ID NO: 1080242 - RNA, 19 nt, Homo sapiens
gaaaacggcucuuuauuga

SEQ ID NO: 1080243 - RNA, 19 nt, Homo sapiens
cagaugaacuccaagauga

SEQ ID NO: 1080244 - RNA, 19 nt, Homo sapiens
gaaguuugcugaugaucuu

SEQ ID NO: 1080245 - RNA, 19 nt, Homo sapiens
gccaauaaauggauuaaga

SEQ ID NO: 1080246 - RNA, 19 nt, Homo sapiens
caagaccucugcuuauaaa

SEQ ID NO: 1080247 - RNA, 19 nt, Homo sapiens
gaaauugcauccaugaaca

SEQ ID NO: 1080248 - RNA, 19 nt, Homo sapiens
ggcaggagcucaucagauu

SEQ ID NO: 1080249 - RNA, 19 nt, Homo sapiens
gaucgcaaguggauuauau

SEQ ID NO: 1080250 - RNA, 19 nt, Homo sapiens
uuagggagcuggucauuaa

SEQ ID NO: 1080251 - RNA, 19 nt, Homo sapiens
aauggaagcugaucuauga

SEQ ID NO: 1080252 - RNA, 19 nt, Homo sapiens
gaagcuggcugcacagaug

SEQ ID NO: 1080253 - RNA, 19 nt, Homo sapiens
gcaaaggucucagaacuca

SEQ ID NO: 1080254 - RNA, 19 nt, Homo sapiens
ggcaagaccucugcuuaua

SEQ ID NO: 1080255 - RNA, 19 nt, Homo sapiens
agacauggcuauaugauug

SEQ ID NO: 1080256 - RNA, 19 nt, Homo sapiens
gaagugcuuugaaggaauu

SEQ ID NO: 1080257 - RNA, 19 nt, Homo sapiens
gaaacgaccugccucucaa

SEQ ID NO: 1080258 - RNA, 19 nt, Homo sapiens
gaauuugaguugagacuug

SEQ ID NO: 1080259 - RNA, 19 nt, Homo sapiens
gauucaaacuuucaaggua

SEQ ID NO: 1080260 - RNA, 19 nt, Homo sapiens
ggagagauacuauuacuau

SEQ ID NO: 1080261 - RNA, 19 nt, Homo sapiens
caucaaagggcucuucuua

SEQ ID NO: 1080262 - RNA, 19 nt, Homo sapiens
gaaaggguuugaugugaug

SEQ ID NO: 1080263 - RNA, 19 nt, Homo sapiens
gaaaugaagcacaauguug

SEQ ID NO: 1080264 - RNA, 19 nt, Homo sapiens
agaaggagaaugacuauua

SEQ ID NO: 1080265 - RNA, 19 nt, Homo sapiens
gggaaagguuuaucaauca

SEQ ID NO: 1080266 - RNA, 19 nt, Homo sapiens
ucaagacgcuccugaauag

SEQ ID NO: 1080267 - RNA, 19 nt, Homo sapiens
gaaccuaaaucgggcguuu

SEQ ID NO: 1080268 - RNA, 19 nt, Homo sapiens
gaacagaaccugggugaau

SEQ ID NO: 1080269 - RNA, 19 nt, Homo sapiens
ggaccuagcugaggcaaug

SEQ ID NO: 1080270 - RNA, 19 nt, Homo sapiens
ggaaagauagucgaugaua

SEQ ID NO: 1080271 - RNA, 19 nt, Homo sapiens
aaucggaccuggagagaua

SEQ ID NO: 1080272 - RNA, 19 nt, Homo sapiens
ugaaagaucugcugaaggu

SEQ ID NO: 1080273 - RNA, 19 nt, Homo sapiens
ugagaucacugaccugaaa

SEQ ID NO: 1080274 - RNA, 19 nt, Homo sapiens
gaugaucgcaaguggauua

SEQ ID NO: 1080275 - RNA, 19 nt, Homo sapiens
gaagugaugguucggauuu

SEQ ID NO: 1080276 - RNA, 19 nt, Homo sapiens
ccauugagcuuccaacaga

SEQ ID NO: 1080277 - RNA, 19 nt, Homo sapiens
guucauaaaucucuacaug

SEQ ID NO: 1080278 - RNA, 19 nt, Homo sapiens
guugguggcuaacaaauuu

SEQ ID NO: 1080279 - RNA, 19 nt, Homo sapiens
gccaguaccuugguuuaua

SEQ ID NO: 1080280 - RNA, 19 nt, Homo sapiens
aaacggcucuuuauugaga

SEQ ID NO: 1080281 - RNA, 19 nt, Homo sapiens
caagaagcaucucaaggaa

SEQ ID NO: 1080282 - RNA, 19 nt, Homo sapiens
gagcacaucucuaggaucu

SEQ ID NO: 1080283 - RNA, 19 nt, Homo sapiens
ggugaaagauaacaggauu

SEQ ID NO: 1080284 - RNA, 19 nt, Homo sapiens
uggaagaggucaugaaguu

SEQ ID NO: 1080285 - RNA, 19 nt, Homo sapiens
cagagugacugaugacaaa

SEQ ID NO: 1080286 - RNA, 19 nt, Homo sapiens
gcaaggaguugaguacaug

SEQ ID NO: 1080287 - RNA, 19 nt, Homo sapiens
ccaaggagcacaaagaauu

SEQ ID NO: 1080288 - RNA, 19 nt, Homo sapiens
gaggaaauuuggcauuguu

SEQ ID NO: 1080289 - RNA, 19 nt, Homo sapiens
ccaaagugcuaucugaaga

SEQ ID NO: 1080290 - RNA, 19 nt, Homo sapiens
cgaggaaacugccaagaug

SEQ ID NO: 1080291 - RNA, 19 nt, Homo sapiens
ucacuccucuuucuaugua

SEQ ID NO: 1080292 - RNA, 19 nt, Homo sapiens
ccacauucaugaacgcaua

SEQ ID NO: 1080293 - RNA, 19 nt, Homo sapiens
gcaagaccucugcuuauaa

SEQ ID NO: 1080294 - RNA, 19 nt, Homo sapiens
aaagagcaaugaucagauu

SEQ ID NO: 1080295 - RNA, 19 nt, Homo sapiens
cgaccugccucucaaauau

SEQ ID NO: 1080296 - RNA, 19 nt, Homo sapiens
gaaggagaaugacuauuac

SEQ ID NO: 1080297 - RNA, 19 nt, Homo sapiens
ggaaauggaaaguaaagaa

SEQ ID NO: 1080298 - RNA, 19 nt, Homo sapiens
gcgagaagaucuuaagaag

SEQ ID NO: 1080299 - RNA, 19 nt, Homo sapiens
ggaaaggguuugaugugau

SEQ ID NO: 1080300 - RNA, 19 nt, Homo sapiens
ccaaucagauggaggaguu

SEQ ID NO: 1080301 - RNA, 19 nt, Homo sapiens
gggaauauguggaggacaa

SEQ ID NO: 1080302 - RNA, 19 nt, Homo sapiens
gagcugguaucccucauug

SEQ ID NO: 1080303 - RNA, 19 nt, Homo sapiens
gucgaaacauugaggaaua

SEQ ID NO: 1080304 - RNA, 19 nt, Homo sapiens
guacaucauugaccauuuc

SEQ ID NO: 1080305 - RNA, 19 nt, Homo sapiens
gggaaaggguuugauguga

SEQ ID NO: 1080306 - RNA, 19 nt, Homo sapiens
gaagaagugcuuugaagga

SEQ ID NO: 1080307 - RNA, 19 nt, Homo sapiens
ucucaaauaugcucgaauu

SEQ ID NO: 1080308 - RNA, 19 nt, Homo sapiens
cagaagaaaugaagcacaa

SEQ ID NO: 1080309 - RNA, 19 nt, Homo sapiens
gaucaaugccauaaagaaa

SEQ ID NO: 1080310 - RNA, 19 nt, Homo sapiens
aaauugaggaggacuauua

SEQ ID NO: 1080311 - RNA, 19 nt, Homo sapiens
ggaacuugcuccuucacaa

SEQ ID NO: 1080312 - RNA, 19 nt, Homo sapiens
caucagagcccaugaggaa

SEQ ID NO: 1080313 - RNA, 19 nt, Homo sapiens
gcagacagcagaaagaaau

SEQ ID NO: 1080314 - RNA, 19 nt, Homo sapiens
ggugagacauggcuauaug

SEQ ID NO: 1080315 - RNA, 19 nt, Homo sapiens
ccagaagucucgcccagaa

SEQ ID NO: 1080316 - RNA, 19 nt, Homo sapiens
ggaaccgucuggacucuau

SEQ ID NO: 1080317 - RNA, 19 nt, Homo sapiens
gagcaacuaugacucaagu

SEQ ID NO: 1080318 - RNA, 19 nt, Homo sapiens
ggaguuggcacaagacauu

SEQ ID NO: 1080319 - RNA, 19 nt, Homo sapiens
gaaaucagcauuccaauua

SEQ ID NO: 1080320 - RNA, 19 nt, Homo sapiens
gcaaccagcuguggaaaua

SEQ ID NO: 1080321 - RNA, 19 nt, Homo sapiens
auacagaacuccagaauuu

SEQ ID NO: 1080322 - RNA, 19 nt, Homo sapiens
gcaaaucccuaaacuugaa

SEQ ID NO: 1080323 - RNA, 19 nt, Homo sapiens
gagcaaaucccuaaacuug

SEQ ID NO: 1080324 - RNA, 19 nt, Homo sapiens
ggaaguaugugcccuacaa

SEQ ID NO: 1080325 - RNA, 19 nt, Homo sapiens
gaaaucacauuccacaauc

SEQ ID NO: 1080326 - RNA, 19 nt, Homo sapiens
ggacaaacacucccaauca

SEQ ID NO: 1080327 - RNA, 19 nt, Homo sapiens
ggaacaacaugcagguauu

SEQ ID NO: 1080328 - RNA, 19 nt, Homo sapiens
gaaguggcccucuauagaa

SEQ ID NO: 1080329 - RNA, 19 nt, Homo sapiens
gcaaagugccugccucuga

SEQ ID NO: 1080330 - RNA, 19 nt, Homo sapiens
ggaaauaccgcaaagacaa

SEQ ID NO: 1080331 - RNA, 19 nt, Homo sapiens
caaacuaggaugcuacaua

SEQ ID NO: 1080332 - RNA, 19 nt, Homo sapiens
cauaggaucuucaugaaca

SEQ ID NO: 1080333 - RNA, 19 nt, Homo sapiens
gcaaagacaagacccugua

SEQ ID NO: 1080334 - RNA, 19 nt, Homo sapiens
gcaagaguuucaagugguu

SEQ ID NO: 1080335 - RNA, 19 nt, Homo sapiens
aaugagugcuguagcuuua

SEQ ID NO: 1080336 - RNA, 19 nt, Homo sapiens
cuaagaguguucaguauug

SEQ ID NO: 1080337 - RNA, 19 nt, Homo sapiens
aaacuaggaugcuacauag

SEQ ID NO: 1080338 - RNA, 19 nt, Homo sapiens
acaagaguguugacaguuu

SEQ ID NO: 1080339 - RNA, 19 nt, Homo sapiens
gaccauaggaucuucauga

SEQ ID NO: 1080340 - RNA, 19 nt, Homo sapiens
ucacaacuguagucucauu

SEQ ID NO: 1080341 - RNA, 19 nt, Homo sapiens
gacaaucugugaaauccaa

SEQ ID NO: 1080342 - RNA, 19 nt, Homo sapiens
gcaaugcagcgucguuaaa

SEQ ID NO: 1080343 - RNA, 19 nt, Homo sapiens
ucagauggcucuccuacau

SEQ ID NO: 1080344 - RNA, 19 nt, Homo sapiens
ccacgaaucugccuuugag

SEQ ID NO: 1080345 - RNA, 19 nt, Homo sapiens
ugccagcccuucauguuua

SEQ ID NO: 1080346 - RNA, 19 nt, Homo sapiens
ggcaauuacuggccucaaa

SEQ ID NO: 1080347 - RNA, 19 nt, Homo sapiens
ucaagugguuuaugacgaa

SEQ ID NO: 1080348 - RNA, 19 nt, Homo sapiens
caagaguguugacaguuug

SEQ ID NO: 1080349 - RNA, 19 nt, Homo sapiens
gacaaacacucccaaucau

SEQ ID NO: 1080350 - RNA, 19 nt, Homo sapiens
ccagcuagcccaggaaaua

SEQ ID NO: 1080351 - RNA, 19 nt, Homo sapiens
guuacuaccuacuuuauag

SEQ ID NO: 1080352 - RNA, 19 nt, Homo sapiens
gagccagccagguguaaua

SEQ ID NO: 1080353 - RNA, 19 nt, Homo sapiens
cuagaaugcugugauuaaa

SEQ ID NO: 1080354 - RNA, 19 nt, Homo sapiens
ugagauucaucaucaaaga

SEQ ID NO: 1080355 - RNA, 19 nt, Homo sapiens
gaaagugaccauaggaucu

SEQ ID NO: 1080356 - RNA, 19 nt, Homo sapiens
ggccauaucuacaggaagu

SEQ ID NO: 1080357 - RNA, 19 nt, Homo sapiens
gaucaacugugggcaaagu

SEQ ID NO: 1080358 - RNA, 19 nt, Homo sapiens
caacucaacagucuuggaa

SEQ ID NO: 1080359 - RNA, 19 nt, Homo sapiens
gagcaaugcagcgucguua

SEQ ID NO: 1080360 - RNA, 19 nt, Homo sapiens
auaggaagcauuucuguaa

SEQ ID NO: 1080361 - RNA, 19 nt, Homo sapiens
ggaugucgcaguccagaaa

SEQ ID NO: 1080362 - RNA, 19 nt, Homo sapiens
agacuaauaggaagcauuu

SEQ ID NO: 1080363 - RNA, 19 nt, Homo sapiens
gaaagaagucaaaagauga

SEQ ID NO: 1080364 - RNA, 19 nt, Homo sapiens
caacaugguccuuggugaa

SEQ ID NO: 1080365 - RNA, 19 nt, Homo sapiens
cuacauaggauucugguau

SEQ ID NO: 1080366 - RNA, 19 nt, Homo sapiens
uaagaguguucaguauuga

SEQ ID NO: 1080367 - RNA, 19 nt, Homo sapiens
cagcaucuguaaaauguua

SEQ ID NO: 1080368 - RNA, 19 nt, Homo sapiens
ucugugaaauccaaaguug

SEQ ID NO: 1080369 - RNA, 19 nt, Homo sapiens
uacauaggauucugguauu

SEQ ID NO: 1080370 - RNA, 19 nt, Homo sapiens
uaagugugguugugcaugu

SEQ ID NO: 1080371 - RNA, 19 nt, Homo sapiens
agacauuucuuugcagcua

SEQ ID NO: 1080372 - RNA, 19 nt, Homo sapiens
gcccuaagaguguucagua

SEQ ID NO: 1080373 - RNA, 19 nt, Homo sapiens
gaacaacaugcagguauuc

SEQ ID NO: 1080374 - RNA, 19 nt, Homo sapiens
ccaaaugagugcuguagcu

SEQ ID NO: 1080375 - RNA, 19 nt, Homo sapiens
cagcuucuguucucuguca

SEQ ID NO: 1080376 - RNA, 19 nt, Homo sapiens
ccuacaugauggugcuuua

SEQ ID NO: 1080377 - RNA, 19 nt, Homo sapiens
gaaacgucauccucucucu

SEQ ID NO: 1080378 - RNA, 19 nt, Homo sapiens
agaaguggcccucuauaga

SEQ ID NO: 1080379 - RNA, 19 nt, Homo sapiens
ucuagaaugcugugauuaa

SEQ ID NO: 1080380 - RNA, 19 nt, Homo sapiens
gcuauggacaugcgggaua

SEQ ID NO: 1080381 - RNA, 19 nt, Homo sapiens
agauggcucuccuacauga

SEQ ID NO: 1080382 - RNA, 19 nt, Homo sapiens
gaucucaaggccaucaauu

SEQ ID NO: 1080383 - RNA, 19 nt, Homo sapiens
ugaaaucagcauuccaauu

SEQ ID NO: 1080384 - RNA, 19 nt, Homo sapiens
ugauggugcuuuagaaaca

SEQ ID NO: 1080385 - RNA, 19 nt, Homo sapiens
gaacacaccaacucaacag

SEQ ID NO: 1080386 - RNA, 19 nt, Homo sapiens
gcagugaaagugaccauag

SEQ ID NO: 1080387 - RNA, 19 nt, Homo sapiens
gaaauaccgcaaagacaag

SEQ ID NO: 1080388 - RNA, 19 nt, Homo sapiens
gagacaaucugugaaaucc

SEQ ID NO: 1080389 - RNA, 19 nt, Homo sapiens
guagaccuccaaacuagaa

SEQ ID NO: 1080390 - RNA, 19 nt, Homo sapiens
ccaauauggauuucuagaa

SEQ ID NO: 1080391 - RNA, 19 nt, Homo sapiens
agaaagaagucaaaagaug

SEQ ID NO: 1080392 - RNA, 19 nt, Homo sapiens
caauuaguguugagucucu

SEQ ID NO: 1080393 - RNA, 19 nt, Homo sapiens
cuagagacaaucugugaaa

SEQ ID NO: 1080394 - RNA, 19 nt, Homo sapiens
ucucugagccuccauuuca

SEQ ID NO: 1080395 - RNA, 19 nt, Homo sapiens
gcaaauauagagcaaaucc

SEQ ID NO: 1080396 - RNA, 19 nt, Homo sapiens
agaaugcugugauuaaagg

SEQ ID NO: 1080397 - RNA, 19 nt, Homo sapiens
ccucugaccucaucauggu

SEQ ID NO: 1080398 - RNA, 19 nt, Homo sapiens
gaaucuaggauaacaagag

SEQ ID NO: 1080399 - RNA, 19 nt, Homo sapiens
ucucaaggccaucaauuau

SEQ ID NO: 1080400 - RNA, 19 nt, Homo sapiens
caacuguagucucauuugc

SEQ ID NO: 1080401 - RNA, 19 nt, Homo sapiens
ccugauccaugcuuccauu

SEQ ID NO: 1080402 - RNA, 19 nt, Homo sapiens
gguaaaauuugccuguuug

SEQ ID NO: 1080403 - RNA, 19 nt, Homo sapiens
ggcacucacugcagacuuc

SEQ ID NO: 1080404 - RNA, 19 nt, Homo sapiens
aaguguggauggaugagua

SEQ ID NO: 1080405 - RNA, 19 nt, Homo sapiens
caggaaauacuugaaauca

SEQ ID NO: 1080406 - RNA, 19 nt, Homo sapiens
caacagagccuuuucaacu

SEQ ID NO: 1080407 - RNA, 19 nt, Homo sapiens
aagagcauaucccacaaga

SEQ ID NO: 1080408 - RNA, 19 nt, Homo sapiens
gcgggauggugaacuggaa

SEQ ID NO: 1080409 - RNA, 19 nt, Homo sapiens
aaguggcccucuauagaaa

SEQ ID NO: 1080410 - RNA, 19 nt, Homo sapiens
ugcuguagcuuuagaagug

SEQ ID NO: 1080411 - RNA, 19 nt, Homo sapiens
gagccacgaaucugccuuu

SEQ ID NO: 1080412 - RNA, 19 nt, Homo sapiens
gcauuccaauuaguguuga

SEQ ID NO: 1080413 - RNA, 19 nt, Homo sapiens
ggaagcauuucuguaacca

SEQ ID NO: 1080414 - RNA, 19 nt, Homo sapiens
uaauuggauugcaaacuag

SEQ ID NO: 1080415 - RNA, 19 nt, Homo sapiens
caucaugguucuaguucuc

SEQ ID NO: 1080416 - RNA, 19 nt, Homo sapiens
gauggugcuuuagaaacaa

SEQ ID NO: 1080417 - RNA, 19 nt, Homo sapiens
ugaagagcauaucccacaa

SEQ ID NO: 1080418 - RNA, 19 nt, Homo sapiens
guucugcuuugaugccauu

SEQ ID NO: 1080419 - RNA, 19 nt, Homo sapiens
gugaacagauuaaggauaa

SEQ ID NO: 1080420 - RNA, 19 nt, Homo sapiens
caaauugcaucucuacuug

SEQ ID NO: 1080421 - RNA, 19 nt, Homo sapiens
aaacuugucuaccauauug

SEQ ID NO: 1080422 - RNA, 19 nt, Homo sapiens
guacaggauuuguuuauag

SEQ ID NO: 1080423 - RNA, 19 nt, Homo sapiens
ugaucuaccuccugaauuu

SEQ ID NO: 1080424 - RNA, 19 nt, Homo sapiens
gaccaaagccaccuauuga

SEQ ID NO: 1080425 - RNA, 19 nt, Homo sapiens
caagccagaucacugagua

SEQ ID NO: 1080426 - RNA, 19 nt, Homo sapiens
gugcaggcauucuguauug

SEQ ID NO: 1080427 - RNA, 19 nt, Homo sapiens
caacaaacacagcuacuug

SEQ ID NO: 1080428 - RNA, 19 nt, Homo sapiens
gauaaaucgauguguguua

SEQ ID NO: 1080429 - RNA, 19 nt, Homo sapiens
ggaccaaagccaccuauug

SEQ ID NO: 1080430 - RNA, 19 nt, Homo sapiens
gcacugguguggagaucaa

SEQ ID NO: 1080431 - RNA, 19 nt, Homo sapiens
gcuguacugugauuuaguu

SEQ ID NO: 1080432 - RNA, 19 nt, Homo sapiens
gaaguuguaaaucgacuaa

SEQ ID NO: 1080433 - RNA, 19 nt, Homo sapiens
ccagaucacugaguauuuc

SEQ ID NO: 1080434 - RNA, 19 nt, Homo sapiens
ggagaucaaacgaauaaug

SEQ ID NO: 1080435 - RNA, 19 nt, Homo sapiens
ccaaagccaccuauugaaa

SEQ ID NO: 1080436 - RNA, 19 nt, Homo sapiens
ucagaucacagaagcuuua

SEQ ID NO: 1080437 - RNA, 19 nt, Homo sapiens
aaagacgccucgccagauu

SEQ ID NO: 1080438 - RNA, 19 nt, Homo sapiens
aauaauaccucaucagaac

SEQ ID NO: 1080439 - RNA, 19 nt, Homo sapiens
gauggacguuggaaacaug

SEQ ID NO: 1080440 - RNA, 19 nt, Homo sapiens
ccaaacuugucuaccauau

SEQ ID NO: 1080441 - RNA, 19 nt, Homo sapiens
guggagaucaaacgaauaa

SEQ ID NO: 1080442 - RNA, 19 nt, Homo sapiens
ucaguugccucucagauca

SEQ ID NO: 1080443 - RNA, 19 nt, Homo sapiens
caauggaaguuguaaaucg

SEQ ID NO: 1080444 - RNA, 19 nt, Homo sapiens
guucagcuguacugugauu

SEQ ID NO: 1080445 - RNA, 19 nt, Homo sapiens
gaagugcaggcauucugua

SEQ ID NO: 1080446 - RNA, 19 nt, Homo sapiens
gaucuaccuccugaauuua

SEQ ID NO: 1080447 - RNA, 19 nt, Homo sapiens
cuauagaaauguugcugaa

SEQ ID NO: 1080448 - RNA, 19 nt, Homo sapiens
guaaaucgacuaacuacag

SEQ ID NO: 1080449 - RNA, 19 nt, Homo sapiens
cgauguguguuaagaauag

SEQ ID NO: 1080450 - RNA, 19 nt, Homo sapiens
gacccggauucuucuaauu

SEQ ID NO: 1080451 - RNA, 19 nt, Homo sapiens
caauauggacaugucuuua

SEQ ID NO: 1080452 - RNA, 19 nt, Homo sapiens
caaacuuccugaccuugug

SEQ ID NO: 1080453 - RNA, 19 nt, Homo sapiens
cagcaaggccgaccacuuc

SEQ ID NO: 1080454 - RNA, 19 nt, Homo sapiens
gaucacagaagcuuuaguc

SEQ ID NO: 1080455 - RNA, 19 nt, Homo sapiens
ucaaauugcaucucuacuu

SEQ ID NO: 1080456 - RNA, 19 nt, Homo sapiens
uuuagucgcuauagaaaug

SEQ ID NO: 1080457 - RNA, 19 nt, Homo sapiens
gagaucaaacgaauaaugg

SEQ ID NO: 1080458 - RNA, 19 nt, Homo sapiens
gcccuccgcucucaggauu

SEQ ID NO: 1080459 - RNA, 19 nt, Homo sapiens
uuauagaagugcaggcauu

SEQ ID NO: 1080460 - RNA, 19 nt, Homo sapiens
ugaaauuaaugcagucaag

SEQ ID NO: 1080461 - RNA, 19 nt, Homo sapiens
gaacuugcuuggcuaaacc

SEQ ID NO: 1080462 - RNA, 19 nt, Homo sapiens
ggauuuguuuauagaagug

SEQ ID NO: 1080463 - RNA, 19 nt, Homo sapiens
ggauuugacagcucaguug

SEQ ID NO: 1080464 - RNA, 19 nt, Homo sapiens
ugaguggauugcuugguuu

SEQ ID NO: 1080465 - RNA, 19 nt, Homo sapiens
aacuacagcuguugaucua

SEQ ID NO: 1080466 - RNA, 19 nt, Homo sapiens
ucucuguccuggucaauau

SEQ ID NO: 1080467 - RNA, 19 nt, Homo sapiens
ucagcuguacugugauuua

SEQ ID NO: 1080468 - RNA, 19 nt, Homo sapiens
uguauugaauucaguagga

SEQ ID NO: 1080469 - RNA, 19 nt, Homo sapiens
uugcuugguuuaaugcaua

SEQ ID NO: 1080470 - RNA, 19 nt, Homo sapiens
ucaauauggacaugucuuu

SEQ ID NO: 1080471 - RNA, 19 nt, Homo sapiens
gggccagucuguggacauu

SEQ ID NO: 1080472 - RNA, 19 nt, Homo sapiens
caaagccaccuauugaaag

SEQ ID NO: 1080473 - RNA, 19 nt, Homo sapiens
acgagaagcugcuggucuu

SEQ ID NO: 1080474 - RNA, 19 nt, Homo sapiens
gcaggcauucuguauugaa

SEQ ID NO: 1080475 - RNA, 19 nt, Homo sapiens
guggauugcuugguuuaau

SEQ ID NO: 1080476 - RNA, 19 nt, Homo sapiens
gaguggauugcuugguuua

SEQ ID NO: 1080477 - RNA, 19 nt, Homo sapiens
cuguucagcuguacuguga

SEQ ID NO: 1080478 - RNA, 19 nt, Homo sapiens
gaaccaucccauccauuca

SEQ ID NO: 1080479 - RNA, 19 nt, Homo sapiens
caaacuugucuaccauauu

SEQ ID NO: 1080480 - RNA, 19 nt, Homo sapiens
cugaguggauugcuugguu

SEQ ID NO: 1080481 - RNA, 19 nt, Homo sapiens
uccuauaacuccaccagaa

SEQ ID NO: 1080482 - RNA, 19 nt, Homo sapiens
gccagucuguggacauuag

SEQ ID NO: 1080483 - RNA, 19 nt, Homo sapiens
guguggagaucaaacgaau

SEQ ID NO: 1080484 - RNA, 19 nt, Homo sapiens
gaugaacuugcuuggcuaa

SEQ ID NO: 1080485 - RNA, 19 nt, Homo sapiens
guuguaaaucgacuaacua

SEQ ID NO: 1080486 - RNA, 19 nt, Homo sapiens
aaaucgauguguguuaaga

SEQ ID NO: 1080487 - RNA, 19 nt, Homo sapiens
gggauaaaucgaugugugu

SEQ ID NO: 1080488 - RNA, 19 nt, Homo sapiens
uggauugcuugguuuaaug

SEQ ID NO: 1080489 - RNA, 19 nt, Homo sapiens
ucacugaguauuucucugu

SEQ ID NO: 1080490 - RNA, 19 nt, Homo sapiens
gccagaucacugaguauuu

SEQ ID NO: 1080491 - RNA, 19 nt, Homo sapiens
gaaacaugggccagucugu

SEQ ID NO: 1080492 - RNA, 19 nt, Homo sapiens
caggauuuguuuauagaag

SEQ ID NO: 1080493 - RNA, 19 nt, Homo sapiens
acagcuacuuggugaguug

SEQ ID NO: 1080494 - RNA, 19 nt, Homo sapiens
cauuagugggcuucaguua

SEQ ID NO: 1080495 - RNA, 19 nt, Homo sapiens
ucagaaccaucccauccau

SEQ ID NO: 1080496 - RNA, 19 nt, Homo sapiens
uaacuacagcuguugaucu

SEQ ID NO: 1080497 - RNA, 19 nt, Homo sapiens
ccaccgccuuccaccacua

SEQ ID NO: 1080498 - RNA, 19 nt, Homo sapiens
uccaauccuugauccguaa

SEQ ID NO: 1080499 - RNA, 19 nt, Homo sapiens
ggaaguuguaaaucgacua

SEQ ID NO: 1080500 - RNA, 19 nt, Homo sapiens
aauggaaguuguaaaucga

SEQ ID NO: 1080501 - RNA, 19 nt, Homo sapiens
cagcuguacugugauuuag

SEQ ID NO: 1080502 - RNA, 19 nt, Homo sapiens
ccuauaacuccaccagaaa

SEQ ID NO: 1080503 - RNA, 19 nt, Homo sapiens
ggauaaaucgauguguguu

SEQ ID NO: 1080504 - RNA, 19 nt, Homo sapiens
ucccauccauucacuguuc

SEQ ID NO: 1080505 - RNA, 19 nt, Homo sapiens
cuacuugugaacagauuaa

SEQ ID NO: 1080506 - RNA, 19 nt, Homo sapiens
uugcaucucuacuugugaa

SEQ ID NO: 1080507 - RNA, 19 nt, Homo sapiens
cgccuccacuccacauuug

SEQ ID NO: 1080508 - RNA, 19 nt, Homo sapiens
guauugaauucaguaggau

SEQ ID NO: 1080509 - RNA, 19 nt, Homo sapiens
gcacugauggacguuggaa

SEQ ID NO: 1080510 - RNA, 19 nt, Homo sapiens
guuggugcgucuugugugu

SEQ ID NO: 1080511 - RNA, 19 nt, Homo sapiens
ucgacuaacuacagcuguu

SEQ ID NO: 1080512 - RNA, 19 nt, Homo sapiens
gccgaacgccaaucugaau

SEQ ID NO: 1080513 - RNA, 19 nt, Homo sapiens
gcuacuuggugaguuggaa

SEQ ID NO: 1080514 - RNA, 19 nt, Homo sapiens
ccaacaaacacagcuacuu

SEQ ID NO: 1080515 - RNA, 19 nt, Homo sapiens
uuagugggcuucaguuagc

SEQ ID NO: 1080516 - RNA, 19 nt, Homo sapiens
ggaaaacaacccuuuaguc

SEQ ID NO: 1080517 - RNA, 19 nt, Homo sapiens
ggacauuagugggcuucag

SEQ ID NO: 1080518 - RNA, 19 nt, Homo sapiens
gcucggugcucgucaugcu

SEQ ID NO: 1080519 - RNA, 19 nt, Homo sapiens
gaacaaguuucccuggaua

SEQ ID NO: 1080520 - RNA, 19 nt, Homo sapiens
ggaaaggugucugagauua

SEQ ID NO: 1080521 - RNA, 19 nt, Homo sapiens
gagagaagauccaggagaa

SEQ ID NO: 1080522 - RNA, 19 nt, Homo sapiens
gaaaggugucugagauuaa

SEQ ID NO: 1080523 - RNA, 19 nt, Homo sapiens
ugucugagauuaagaagaa

SEQ ID NO: 1080524 - RNA, 19 nt, Homo sapiens
uagcagagaugguacugaa

SEQ ID NO: 1080525 - RNA, 19 nt, Homo sapiens
ggaaguggaccaugauuuc

SEQ ID NO: 1080526 - RNA, 19 nt, Homo sapiens
acaaagcgguggucuugaa

SEQ ID NO: 1080527 - RNA, 19 nt, Homo sapiens
agaagaagaucaagucgau

SEQ ID NO: 1080528 - RNA, 19 nt, Homo sapiens
gaacgggaccacacguauu

SEQ ID NO: 1080529 - RNA, 19 nt, Homo sapiens
gaguggcuuuggcgucuua

SEQ ID NO: 1080530 - RNA, 19 nt, Homo sapiens
ggagaacaacaucaucuga

SEQ ID NO: 1080531 - RNA, 19 nt, Homo sapiens
uggcucagguuuauugauu

SEQ ID NO: 1080532 - RNA, 19 nt, Homo sapiens
caacaccuuugaccagaau

SEQ ID NO: 1080533 - RNA, 19 nt, Homo sapiens
caggaaagacugccucuga

SEQ ID NO: 1080534 - RNA, 19 nt, Homo sapiens
ugacaaagcgguggucuug

SEQ ID NO: 1080535 - RNA, 19 nt, Homo sapiens
gcaggccauugcacccaua

SEQ ID NO: 1080536 - RNA, 19 nt, Homo sapiens
ggacgaagguugguuugac

SEQ ID NO: 1080537 - RNA, 19 nt, Homo sapiens
agggagaggugacacguuu

SEQ ID NO: 1080538 - RNA, 19 nt, Homo sapiens
ggaggacgaagguugguuu

SEQ ID NO: 1080539 - RNA, 19 nt, Homo sapiens
ggagggagccaaaguuucu

SEQ ID NO: 1080540 - RNA, 19 nt, Homo sapiens
uacggaacaucaaugagua

SEQ ID NO: 1080541 - RNA, 19 nt, Homo sapiens
gagccaaaguuucucugau

SEQ ID NO: 1080542 - RNA, 19 nt, Homo sapiens
gcuugucuguggccuauug

SEQ ID NO: 1080543 - RNA, 19 nt, Homo sapiens
cccuauccauuaaucaaua

SEQ ID NO: 1080544 - RNA, 19 nt, Homo sapiens
gcaggagggagccaaaguu

SEQ ID NO: 1080545 - RNA, 19 nt, Homo sapiens
caaaguuucucugaugucu

SEQ ID NO: 1080546 - RNA, 19 nt, Homo sapiens
gcacucggauguggugauc

SEQ ID NO: 1080547 - RNA, 19 nt, Homo sapiens
ggaagguccugugaucuac

SEQ ID NO: 1080548 - RNA, 19 nt, Homo sapiens
gcacugaccaggaaagacu

SEQ ID NO: 1080549 - RNA, 19 nt, Homo sapiens
gaaaagguauguguaugug

SEQ ID NO: 1080550 - RNA, 19 nt, Homo sapiens
gccaaaguuucucugaugu

SEQ ID NO: 1080551 - RNA, 19 nt, Homo sapiens
ggaacgggaccacacguau

SEQ ID NO: 1080552 - RNA, 19 nt, Homo sapiens
ccugugaucuacugcaaga

SEQ ID NO: 1080553 - RNA, 19 nt, Homo sapiens
cuguuuacccuauccauua

SEQ ID NO: 1080554 - RNA, 19 nt, Homo sapiens
gagauuaagaagaagauca

SEQ ID NO: 1080555 - RNA, 19 nt, Homo sapiens
ccaguguccucuccucuca

SEQ ID NO: 1080556 - RNA, 19 nt, Homo sapiens
gucaacauguacuuugcua

SEQ ID NO: 1080557 - RNA, 19 nt, Homo sapiens
gagaagauccaggagaaca

SEQ ID NO: 1080558 - RNA, 19 nt, Homo sapiens
gcauguugaccacagauga

SEQ ID NO: 1080559 - RNA, 19 nt, Homo sapiens
cagacgaggugcuauucga

SEQ ID NO: 1080560 - RNA, 19 nt, Homo sapiens
ccuauuggcugaagaagcu

SEQ ID NO: 1080561 - RNA, 19 nt, Homo sapiens
ugaaguccaugugaagaug

SEQ ID NO: 1080562 - RNA, 19 nt, Homo sapiens
caggagggagccaaaguuu

SEQ ID NO: 1080563 - RNA, 19 nt, Homo sapiens
gauggaaaggugucugaga

SEQ ID NO: 1080564 - RNA, 19 nt, Homo sapiens
acacagagggaguggcuuu

SEQ ID NO: 1080565 - RNA, 19 nt, Homo sapiens
uguuuacccuauccauuaa

SEQ ID NO: 1080566 - RNA, 19 nt, Homo sapiens
agccaaaguuucucugaug

SEQ ID NO: 1080567 - RNA, 19 nt, Homo sapiens
ccuggaagguccugugauc

SEQ ID NO: 1080568 - RNA, 19 nt, Homo sapiens
aaaggugucugagauuaag

SEQ ID NO: 1080569 - RNA, 19 nt, Homo sapiens
agacaccaguggagccuau

SEQ ID NO: 1080570 - RNA, 19 nt, Homo sapiens
gaugucuccugaucagcuu

SEQ ID NO: 1080571 - RNA, 19 nt, Homo sapiens
ggagagcaacgugaaagug

SEQ ID NO: 1080572 - RNA, 19 nt, Homo sapiens
guaccuggccguagucgau

SEQ ID NO: 1080573 - RNA, 19 nt, Homo sapiens
ggcucagguuuauugauuu

SEQ ID NO: 1080574 - RNA, 19 nt, Homo sapiens
uggaagguccugugaucua

SEQ ID NO: 1080575 - RNA, 19 nt, Homo sapiens
caaagcgguggucuugaaa

SEQ ID NO: 1080576 - RNA, 19 nt, Homo sapiens
ucucugaugucuccugauc

SEQ ID NO: 1080577 - RNA, 19 nt, Homo sapiens
ggagccaaaguuucucuga

SEQ ID NO: 1080578 - RNA, 19 nt, Homo sapiens
gcucagguuuauugauuuu

SEQ ID NO: 1080579 - RNA, 19 nt, Homo sapiens
caacauguacuuugcuacu

SEQ ID NO: 1080580 - RNA, 19 nt, Homo sapiens
cugaucagcuucggaacaa

SEQ ID NO: 1080581 - RNA, 19 nt, Homo sapiens
cagcagugcagcuuucaga

SEQ ID NO: 1080582 - RNA, 19 nt, Homo sapiens
ugaaaaggauccaugaagu

SEQ ID NO: 1080583 - RNA, 19 nt, Homo sapiens
uuaagaagaagaucaaguc

SEQ ID NO: 1080584 - RNA, 19 nt, Homo sapiens
cuagagacuccgcuuguug

SEQ ID NO: 1080585 - RNA, 19 nt, Homo sapiens
ccuagagacuccgcuuguu

SEQ ID NO: 1080586 - RNA, 19 nt, Homo sapiens
guaccagccuguggaaugc

SEQ ID NO: 1080587 - RNA, 19 nt, Homo sapiens
ggaguaccagccuguggaa

SEQ ID NO: 1080588 - RNA, 19 nt, Homo sapiens
gaucagcuucggaacaagu

SEQ ID NO: 1080589 - RNA, 19 nt, Homo sapiens
cuacggaacaucaaugagu

SEQ ID NO: 1080590 - RNA, 19 nt, Homo sapiens
gggauggaaaggugucuga

SEQ ID NO: 1080591 - RNA, 19 nt, Homo sapiens
cgaggccaauagcgaguga

SEQ ID NO: 1080592 - RNA, 19 nt, Homo sapiens
ggaaaagguauguguaugu

SEQ ID NO: 1080593 - RNA, 19 nt, Homo sapiens
gcucagagggguuaugauu

SEQ ID NO: 1080594 - RNA, 19 nt, Homo sapiens
gaaguggaccaugauuucu

SEQ ID NO: 1080595 - RNA, 19 nt, Homo sapiens
gaugagcgggauccuagga

SEQ ID NO: 1080596 - RNA, 19 nt, Homo sapiens
acaacaccuuugaccagaa

SEQ ID NO: 1080597 - RNA, 19 nt, Homo sapiens
auggaaaggugucugagau

SEQ ID NO: 1080598 - RNA, 19 nt, Homo sapiens
ucucuggacugggauggaa

SEQ ID NO: 1080599 - RNA, 19 nt, Homo sapiens
gaaaaggauccaugaaguc

SEQ ID NO: 1080600 - RNA, 19 nt, Homo sapiens
guugaccacagaugacaaa

SEQ ID NO: 1080601 - RNA, 19 nt, Homo sapiens
gccaauagcgagugaugag

SEQ ID NO: 1080602 - RNA, 19 nt, Homo sapiens
uggaaguggaccaugauuu

SEQ ID NO: 1080603 - RNA, 19 nt, Homo sapiens
gcgguggucuugaaaagga

SEQ ID NO: 1080604 - RNA, 19 nt, Homo sapiens
uuaacuccuucccuccaaa

SEQ ID NO: 1080605 - RNA, 19 nt, Homo sapiens
uuucgucuguuuacccuau

SEQ ID NO: 1080606 - RNA, 19 nt, Homo sapiens
gacaagguguggccccauu

SEQ ID NO: 1080607 - RNA, 19 nt, Homo sapiens
gaggaaaagguauguguau

SEQ ID NO: 1080608 - RNA, 19 nt, Homo sapiens
guccugugaucuacugcaa

SEQ ID NO: 1080609 - RNA, 19 nt, Homo sapiens
cugcagccauggagagcaa

SEQ ID NO: 1080610 - RNA, 19 nt, Homo sapiens
guuugcugcuuccaucuuc

SEQ ID NO: 1080611 - RNA, 19 nt, Homo sapiens
uuacgacuacaacaccuuu

SEQ ID NO: 1080612 - RNA, 19 nt, Homo sapiens
gcucucaguaggugggauu

SEQ ID NO: 1080613 - RNA, 19 nt, Homo sapiens
gggaaggauuagguagcaa

SEQ ID NO: 1080614 - RNA, 19 nt, Homo sapiens
cgggaaggauuagguagca

SEQ ID NO: 1080615 - RNA, 19 nt, Homo sapiens
gagccuggucugcgcaaau

SEQ ID NO: 1080616 - RNA, 19 nt, Homo sapiens
uggcuugucuguggccuau

SEQ ID NO: 1080617 - RNA, 19 nt, Homo sapiens
ugucagcaguucucauugc

SEQ ID NO: 1080618 - RNA, 19 nt, Homo sapiens
gaagauccaggagaacaac

SEQ ID NO: 1080619 - RNA, 19 nt, Homo sapiens
gaaaugggauucuugguaa

SEQ ID NO: 1080620 - RNA, 19 nt, Homo sapiens
gaucacaacuucuggauaa

SEQ ID NO: 1080621 - RNA, 19 nt, Homo sapiens
guaguaggcuguuguuaua

SEQ ID NO: 1080622 - RNA, 19 nt, Homo sapiens
ggacgaagaugaauggaaa

SEQ ID NO: 1080623 - RNA, 19 nt, Homo sapiens
gaagagcuuugaaguagua

SEQ ID NO: 1080624 - RNA, 19 nt, Homo sapiens
ccagaaaucuacagugaua

SEQ ID NO: 1080625 - RNA, 19 nt, Homo sapiens
gauaagaauuccucaugua

SEQ ID NO: 1080626 - RNA, 19 nt, Homo sapiens
gagaagagcuuugaaguag

SEQ ID NO: 1080627 - RNA, 19 nt, Homo sapiens
gaagaugaauggaaagaau

SEQ ID NO: 1080628 - RNA, 19 nt, Homo sapiens
guagaaagccggaaggaua

SEQ ID NO: 1080629 - RNA, 19 nt, Homo sapiens
uaucagaaauccugcauaa

SEQ ID NO: 1080630 - RNA, 19 nt, Homo sapiens
gguauuggcuguucuauag

SEQ ID NO: 1080631 - RNA, 19 nt, Homo sapiens
ugaaaugucucgugaguau

SEQ ID NO: 1080632 - RNA, 19 nt, Homo sapiens
ggaagaagacgauaaugaa

SEQ ID NO: 1080633 - RNA, 19 nt, Homo sapiens
gcauauugcuugguuaauu

SEQ ID NO: 1080634 - RNA, 19 nt, Homo sapiens
ucacugaucuguccuuaga

SEQ ID NO: 1080635 - RNA, 19 nt, Homo sapiens
gaacuaguuucaacagugu

SEQ ID NO: 1080636 - RNA, 19 nt, Homo sapiens
ggagaagagcuuugaagua

SEQ ID NO: 1080637 - RNA, 19 nt, Homo sapiens
gcccuacccuuaaggaaua

SEQ ID NO: 1080638 - RNA, 19 nt, Homo sapiens
guagggcugugauuuguaa

SEQ ID NO: 1080639 - RNA, 19 nt, Homo sapiens
guaggcuguuguuauauua

SEQ ID NO: 1080640 - RNA, 19 nt, Homo sapiens
gaagaagacgauaaugaaa

SEQ ID NO: 1080641 - RNA, 19 nt, Homo sapiens
gcaagaauucuguaacauu

SEQ ID NO: 1080642 - RNA, 19 nt, Homo sapiens
gaaauucagaguaacauga

SEQ ID NO: 1080643 - RNA, 19 nt, Homo sapiens
ggaugaggcuguccauugu

SEQ ID NO: 1080644 - RNA, 19 nt, Homo sapiens
uauaaugccucaucuaauc

SEQ ID NO: 1080645 - RNA, 19 nt, Homo sapiens
ggacuaaauuguguaggaa

SEQ ID NO: 1080646 - RNA, 19 nt, Homo sapiens
cuaauuguauucugaggua

SEQ ID NO: 1080647 - RNA, 19 nt, Homo sapiens
caccagaaaucuacaguga

SEQ ID NO: 1080648 - RNA, 19 nt, Homo sapiens
gauaggaguuuagucuuga

SEQ ID NO: 1080649 - RNA, 19 nt, Homo sapiens
gcuauaaugccucaucuaa

SEQ ID NO: 1080650 - RNA, 19 nt, Homo sapiens
cagauuugcugcacucauu

SEQ ID NO: 1080651 - RNA, 19 nt, Homo sapiens
caacagccauucaucaucu

SEQ ID NO: 1080652 - RNA, 19 nt, Homo sapiens
ggaaagaauuggagcaaaa

SEQ ID NO: 1080653 - RNA, 19 nt, Homo sapiens
cagcucuacuggauucuua

SEQ ID NO: 1080654 - RNA, 19 nt, Homo sapiens
ccuuagaaauucagaguaa

SEQ ID NO: 1080655 - RNA, 19 nt, Homo sapiens
gggcugugauuuguaauuu

SEQ ID NO: 1080656 - RNA, 19 nt, Homo sapiens
guaacuagacugcagcuaa

SEQ ID NO: 1080657 - RNA, 19 nt, Homo sapiens
uaaaacagcuccaguacaa

SEQ ID NO: 1080658 - RNA, 19 nt, Homo sapiens
caaccaauaugcugugcuu

SEQ ID NO: 1080659 - RNA, 19 nt, Homo sapiens
agaaugaacagaugaguaa

SEQ ID NO: 1080660 - RNA, 19 nt, Homo sapiens
uaaguaaccuaaaguaugc

SEQ ID NO: 1080661 - RNA, 19 nt, Homo sapiens
gaagcaagugggugaguaa

SEQ ID NO: 1080662 - RNA, 19 nt, Homo sapiens
gaucuguccuuagaaauuc

SEQ ID NO: 1080663 - RNA, 19 nt, Homo sapiens
ccacaaggaccaccagaaa

SEQ ID NO: 1080664 - RNA, 19 nt, Homo sapiens
aagggaagguugaaugauu

SEQ ID NO: 1080665 - RNA, 19 nt, Homo sapiens
gauugugcaugaucuuuga

SEQ ID NO: 1080666 - RNA, 19 nt, Homo sapiens
uugguaaacugaagacuuu

SEQ ID NO: 1080667 - RNA, 19 nt, Homo sapiens
agggaagguugaaugauua

SEQ ID NO: 1080668 - RNA, 19 nt, Homo sapiens
gaaaguguccgugcaggaa

SEQ ID NO: 1080669 - RNA, 19 nt, Homo sapiens
ggaguuuagucuugacgaa

SEQ ID NO: 1080670 - RNA, 19 nt, Homo sapiens
ccggguuucucuauaauaa

SEQ ID NO: 1080671 - RNA, 19 nt, Homo sapiens
aaagacaggugauguagca

SEQ ID NO: 1080672 - RNA, 19 nt, Homo sapiens
gugcaagaauucuguaaca

SEQ ID NO: 1080673 - RNA, 19 nt, Homo sapiens
aaguggagguguuauguaa

SEQ ID NO: 1080674 - RNA, 19 nt, Homo sapiens
gcgaaagacaggugaugua

SEQ ID NO: 1080675 - RNA, 19 nt, Homo sapiens
gcagaccacucgauuucau

SEQ ID NO: 1080676 - RNA, 19 nt, Homo sapiens
gacaagauccaggugauaa

SEQ ID NO: 1080677 - RNA, 19 nt, Homo sapiens
ccaauaugcugugcuugaa

SEQ ID NO: 1080678 - RNA, 19 nt, Homo sapiens
gagacaagauccaggugau

SEQ ID NO: 1080679 - RNA, 19 nt, Homo sapiens
ugauguagcacuucuguuu

SEQ ID NO: 1080680 - RNA, 19 nt, Homo sapiens
ggucacugaucuguccuua

SEQ ID NO: 1080681 - RNA, 19 nt, Homo sapiens
guucugaucugcuguaaaa

SEQ ID NO: 1080682 - RNA, 19 nt, Homo sapiens
ccaaggcugugacgaagga

SEQ ID NO: 1080683 - RNA, 19 nt, Homo sapiens
gaagggagagaauaaucuu

SEQ ID NO: 1080684 - RNA, 19 nt, Homo sapiens
cgacugcucuaugcauauu

SEQ ID NO: 1080685 - RNA, 19 nt, Homo sapiens
guaaaggcauauuguacuc

SEQ ID NO: 1080686 - RNA, 19 nt, Homo sapiens
gaaauaugugaaaguggua

SEQ ID NO: 1080687 - RNA, 19 nt, Homo sapiens
caucuaaucaggacuaaau

SEQ ID NO: 1080688 - RNA, 19 nt, Homo sapiens
ccacucacaauacaauuaa

SEQ ID NO: 1080689 - RNA, 19 nt, Homo sapiens
ggugauaacugggaagaag

SEQ ID NO: 1080690 - RNA, 19 nt, Homo sapiens
gaaggacgaagaugaaugg

SEQ ID NO: 1080691 - RNA, 19 nt, Homo sapiens
auaaagaaauggagaagag

SEQ ID NO: 1080692 - RNA, 19 nt, Homo sapiens
gaauaaaacagcuccagua

SEQ ID NO: 1080693 - RNA, 19 nt, Homo sapiens
guaucugguucaauagaaa

SEQ ID NO: 1080694 - RNA, 19 nt, Homo sapiens
ugaggaagcuacccaggau

SEQ ID NO: 1080695 - RNA, 19 nt, Homo sapiens
aagaauuccucauguacuu

SEQ ID NO: 1080696 - RNA, 19 nt, Homo sapiens
aaucaggacuaaauugugu

SEQ ID NO: 1080697 - RNA, 19 nt, Homo sapiens
guucaggcaaugcaaauaa

SEQ ID NO: 1080698 - RNA, 19 nt, Homo sapiens
ggcugugauuuguaauuua

SEQ ID NO: 1080699 - RNA, 19 nt, Homo sapiens
ggaaugggcuuugcuaacc

SEQ ID NO: 1080700 - RNA, 19 nt, Homo sapiens
uagaaagccggaaggauaa

SEQ ID NO: 1080701 - RNA, 19 nt, Homo sapiens
ugacgaaggacgaagauga

SEQ ID NO: 1080702 - RNA, 19 nt, Homo sapiens
ggaugccugccuucuaaua

SEQ ID NO: 1080703 - RNA, 19 nt, Homo sapiens
acagaagaguguccaccua

SEQ ID NO: 1080704 - RNA, 19 nt, Homo sapiens
uaacuagacugcagcuaac

SEQ ID NO: 1080705 - RNA, 19 nt, Homo sapiens
agauaggaguuuagucuug

SEQ ID NO: 1080706 - RNA, 19 nt, Homo sapiens
ugaagcaagugggugagua

SEQ ID NO: 1080707 - RNA, 19 nt, Homo sapiens
gaagaguguccaccuaaca

SEQ ID NO: 1080708 - RNA, 19 nt, Homo sapiens
ccggaaggauaaagaaaug

SEQ ID NO: 1080709 - RNA, 19 nt, Homo sapiens
gaggaggguuacaguaucu

SEQ ID NO: 1080710 - RNA, 19 nt, Homo sapiens
cagaagaguguccaccuaa

SEQ ID NO: 1080711 - RNA, 19 nt, Homo sapiens
ugauaagaauuccucaugu

SEQ ID NO: 1080712 - RNA, 19 nt, Homo sapiens
cacgacugcucuaugcaua

SEQ ID NO: 1080713 - RNA, 19 nt, Homo sapiens
gaugacuagugguguguau

SEQ ID NO: 1080714 - RNA, 19 nt, Homo sapiens
ccaagagggacaagaagaa

SEQ ID NO: 1080715 - RNA, 19 nt, Homo sapiens
gcagcagauuuaaauuaca

SEQ ID NO: 1080716 - RNA, 19 nt, Homo sapiens
caagauggucuggcaguuu

SEQ ID NO: 1080717 - RNA, 19 nt, Homo sapiens
gagcaaaaccucagcuaaa

SEQ ID NO: 1080718 - RNA, 19 nt, Homo sapiens
gagccuggacaacuucuuu

SEQ ID NO: 1080719 - RNA, 19 nt, Homo sapiens
gaaagucccuugacauuua

SEQ ID NO: 1080720 - RNA, 19 nt, Homo sapiens
gaagaaauauccucaauga

SEQ ID NO: 1080721 - RNA, 19 nt, Homo sapiens
gaacacagauccacgguuu

SEQ ID NO: 1080722 - RNA, 19 nt, Homo sapiens
gaaguaaaccgaaugcuua

SEQ ID NO: 1080723 - RNA, 19 nt, Homo sapiens
ggacgagacugaugaguuu

SEQ ID NO: 1080724 - RNA, 19 nt, Homo sapiens
gaagacuuaucguguguua

SEQ ID NO: 1080725 - RNA, 19 nt, Homo sapiens
gaaaucaccguguacuuua

SEQ ID NO: 1080726 - RNA, 19 nt, Homo sapiens
gaacuacacucccugugaa

SEQ ID NO: 1080727 - RNA, 19 nt, Homo sapiens
ggaaggauaugguuucuca

SEQ ID NO: 1080728 - RNA, 19 nt, Homo sapiens
ggacaucccuguuccuuuc

SEQ ID NO: 1080729 - RNA, 19 nt, Homo sapiens
ggaccuaccuuccauuuua

SEQ ID NO: 1080730 - RNA, 19 nt, Homo sapiens
gcaagcuguucuucaauaa

SEQ ID NO: 1080731 - RNA, 19 nt, Homo sapiens
ccacuuguccugucaaaua

SEQ ID NO: 1080732 - RNA, 19 nt, Homo sapiens
caaagcaaauucuccuauu

SEQ ID NO: 1080733 - RNA, 19 nt, Homo sapiens
ccaacacugugcagaaaua

SEQ ID NO: 1080734 - RNA, 19 nt, Homo sapiens
gugcauuacugauccuuua

SEQ ID NO: 1080735 - RNA, 19 nt, Homo sapiens
gaagaaaguucgccuuacu

SEQ ID NO: 1080736 - RNA, 19 nt, Homo sapiens
gaaauauccucaaugaaac

SEQ ID NO: 1080737 - RNA, 19 nt, Homo sapiens
guaauaucauugcccauuu

SEQ ID NO: 1080738 - RNA, 19 nt, Homo sapiens
gggaauaucuacguccuaa

SEQ ID NO: 1080739 - RNA, 19 nt, Homo sapiens
gaucacaguggaagacuua

SEQ ID NO: 1080740 - RNA, 19 nt, Homo sapiens
caacucacauuucgaaaca

SEQ ID NO: 1080741 - RNA, 19 nt, Homo sapiens
ccacuauuguuucagauaa

SEQ ID NO: 1080742 - RNA, 19 nt, Homo sapiens
gggaauggagguagaauaa

SEQ ID NO: 1080743 - RNA, 19 nt, Homo sapiens
ggauaugguuucucaagga

SEQ ID NO: 1080744 - RNA, 19 nt, Homo sapiens
gaaguacccguaugagaaa

SEQ ID NO: 1080745 - RNA, 19 nt, Homo sapiens
gaugcucucuucaacauga

SEQ ID NO: 1080746 - RNA, 19 nt, Homo sapiens
gaauggagguagaauaaac

SEQ ID NO: 1080747 - RNA, 19 nt, Homo sapiens
caaaggugguuacagaaga

SEQ ID NO: 1080748 - RNA, 19 nt, Homo sapiens
gcaagaagaggacagagaa

SEQ ID NO: 1080749 - RNA, 19 nt, Homo sapiens
cagaggagaacaaggauua

SEQ ID NO: 1080750 - RNA, 19 nt, Homo sapiens
gcaagucucugguagaaaa

SEQ ID NO: 1080751 - RNA, 19 nt, Homo sapiens
ggaaagucccuugacauuu

SEQ ID NO: 1080752 - RNA, 19 nt, Homo sapiens
cagcugaaaucaccgugua

SEQ ID NO: 1080753 - RNA, 19 nt, Homo sapiens
guccaaaggugguuacaga

SEQ ID NO: 1080754 - RNA, 19 nt, Homo sapiens
ccaggcaauugaugugaua

SEQ ID NO: 1080755 - RNA, 19 nt, Homo sapiens
ggugaaaguuguggaagaa

SEQ ID NO: 1080756 - RNA, 19 nt, Homo sapiens
cagcaagucucugguagaa

SEQ ID NO: 1080757 - RNA, 19 nt, Homo sapiens
acacuuagcaggaugaauu

SEQ ID NO: 1080758 - RNA, 19 nt, Homo sapiens
aaacaacacaucagaaguu

SEQ ID NO: 1080759 - RNA, 19 nt, Homo sapiens
gaccuacgauucacuucaa

SEQ ID NO: 1080760 - RNA, 19 nt, Homo sapiens
caaagauauuggccacaaa

SEQ ID NO: 1080761 - RNA, 19 nt, Homo sapiens
ugaaguacccguaugagaa

SEQ ID NO: 1080762 - RNA, 19 nt, Homo sapiens
gaagagugcauuacugauc

SEQ ID NO: 1080763 - RNA, 19 nt, Homo sapiens
gccaaucagcgaacuauaa

SEQ ID NO: 1080764 - RNA, 19 nt, Homo sapiens
gccauagacaugaauauaa

SEQ ID NO: 1080765 - RNA, 19 nt, Homo sapiens
ggaaacaacacaucagaag

SEQ ID NO: 1080766 - RNA, 19 nt, Homo sapiens
gagaaggcccaguuaucua

SEQ ID NO: 1080767 - RNA, 19 nt, Homo sapiens
aagaugaccucccaggauu

SEQ ID NO: 1080768 - RNA, 19 nt, Homo sapiens
ugaaaucaccguguacuuu

SEQ ID NO: 1080769 - RNA, 19 nt, Homo sapiens
ccauagacaugaauauaag

SEQ ID NO: 1080770 - RNA, 19 nt, Homo sapiens
ucaucgaacucuuagauau

SEQ ID NO: 1080771 - RNA, 19 nt, Homo sapiens
uguguacaauccugaguua

SEQ ID NO: 1080772 - RNA, 19 nt, Homo sapiens
gugcuggcgcucuuaauua

SEQ ID NO: 1080773 - RNA, 19 nt, Homo sapiens
gccaagcucuaucaacaga

SEQ ID NO: 1080774 - RNA, 19 nt, Homo sapiens
cuacauaucucuggccaau

SEQ ID NO: 1080775 - RNA, 19 nt, Homo sapiens
guuuacaucucaaucuuug

SEQ ID NO: 1080776 - RNA, 19 nt, Homo sapiens
gugaggaggugccuacugu

SEQ ID NO: 1080777 - RNA, 19 nt, Homo sapiens
caacaaaggcagcaucgau

SEQ ID NO: 1080778 - RNA, 19 nt, Homo sapiens
acauaucucuggccaauca

SEQ ID NO: 1080779 - RNA, 19 nt, Homo sapiens
gaggaacaaugacaaaauu

SEQ ID NO: 1080780 - RNA, 19 nt, Homo sapiens
gaucaucgaacucuuagau

SEQ ID NO: 1080781 - RNA, 19 nt, Homo sapiens
ucaaaggauuucaaagcaa

SEQ ID NO: 1080782 - RNA, 19 nt, Homo sapiens
gcucuaccauccugggaaa

SEQ ID NO: 1080783 - RNA, 19 nt, Homo sapiens
gaacuauaaccauucacaa

SEQ ID NO: 1080784 - RNA, 19 nt, Homo sapiens
gagcugccauagacaugaa

SEQ ID NO: 1080785 - RNA, 19 nt, Homo sapiens
guaaucagccccaaagaua

SEQ ID NO: 1080786 - RNA, 19 nt, Homo sapiens
ggaagaaauauccucaaug

SEQ ID NO: 1080787 - RNA, 19 nt, Homo sapiens
gaucugcacauuguuauga

SEQ ID NO: 1080788 - RNA, 19 nt, Homo sapiens
ggaagaaaguucgccuuac

SEQ ID NO: 1080789 - RNA, 19 nt, Homo sapiens
ggagaaggcccaguuaucu

SEQ ID NO: 1080790 - RNA, 19 nt, Homo sapiens
auacagagguggacuuugg

SEQ ID NO: 1080791 - RNA, 19 nt, Homo sapiens
gaccacagaucaucgaacu

SEQ ID NO: 1080792 - RNA, 19 nt, Homo sapiens
caccaucucuccugacugu

SEQ ID NO: 1080793 - RNA, 19 nt, Homo sapiens
caaggaaggcaucauugaa

SEQ ID NO: 1080794 - RNA, 19 nt, Homo sapiens
guuaugaggcgauacugua

SEQ ID NO: 1080795 - RNA, 19 nt, Homo sapiens
caacucaucagcugaaauc

SEQ ID NO: 1080796 - RNA, 19 nt, Homo sapiens
gucaauauguucaaaggau

SEQ ID NO: 1080797 - RNA, 19 nt, Homo sapiens
cuaugaaguuccacugauu

SEQ ID NO: 1080798 - RNA, 19 nt, Homo sapiens
gauaugguuucucaaggau

SEQ ID NO: 1080799 - RNA, 19 nt, Homo sapiens
ccugugaaacugaccauua

SEQ ID NO: 1080800 - RNA, 19 nt, Homo sapiens
aagccaagcucuaucaaca

SEQ ID NO: 1080801 - RNA, 19 nt, Homo sapiens
ucagcgaacuauaaccauu

SEQ ID NO: 1080802 - RNA, 19 nt, Homo sapiens
uauguucccucaauaauac

SEQ ID NO: 1080803 - RNA, 19 nt, Homo sapiens
gcucugcacuuuggugaug

SEQ ID NO: 1080804 - RNA, 19 nt, Homo sapiens
cacaaucgcaguaauauca

SEQ ID NO: 1080805 - RNA, 19 nt, Homo sapiens
gguuacagaagaagaagua

SEQ ID NO: 1080806 - RNA, 19 nt, Homo sapiens
gcaaauucuccuauuaaca

SEQ ID NO: 1080807 - RNA, 19 nt, Homo sapiens
gccuggauacccacuauua

SEQ ID NO: 1080808 - RNA, 19 nt, Homo sapiens
ccaaggaaggcaucauuga

SEQ ID NO: 1080809 - RNA, 19 nt, Homo sapiens
ucuaucaacagaccauuua

SEQ ID NO: 1080810 - RNA, 19 nt, Homo sapiens
agcaagcuguucuucaaua

SEQ ID NO: 1080811 - RNA, 19 nt, Homo sapiens
uaauaucauugcccauuuc

SEQ ID NO: 1080812 - RNA, 19 nt, Homo sapiens
aaaggugguuacagaagaa

SEQ ID NO: 1080813 - RNA, 19 nt, Homo sapiens
gaaacaacacaucagaagu

SEQ ID NO: 1080814 - RNA, 19 nt, Homo sapiens
gcuauuggaacucuuaaug

SEQ ID NO: 1080815 - RNA, 19 nt, Homo sapiens
caagguuggugaaaguugu

SEQ ID NO: 1080816 - RNA, 19 nt, Homo sapiens
gcucagucuucaauuuguu

SEQ ID NO: 1080817 - RNA, 19 nt, Homo sapiens
guaaggggauagcacauuu

SEQ ID NO: 1080818 - RNA, 19 nt, Homo sapiens
gauauguucccucaauaau

SEQ ID NO: 1080819 - RNA, 19 nt, Homo sapiens
gcaaaugccuucccaauua

SEQ ID NO: 1080820 - RNA, 19 nt, Homo sapiens
gaaaugggauugacuguga

SEQ ID NO: 1080821 - RNA, 19 nt, Homo sapiens
ggacaucggugaccucuuu

SEQ ID NO: 1080822 - RNA, 19 nt, Homo sapiens
ggaacuaaaucucuaggua

SEQ ID NO: 1080823 - RNA, 19 nt, Homo sapiens
gagaugggcugaacuguga

SEQ ID NO: 1080824 - RNA, 19 nt, Homo sapiens
ggaaaggucugcacacuca

SEQ ID NO: 1080825 - RNA, 19 nt, Homo sapiens
gagcaaauauuuccucaug

SEQ ID NO: 1080826 - RNA, 19 nt, Homo sapiens
gcucugaucccaauaaaua

SEQ ID NO: 1080827 - RNA, 19 nt, Homo sapiens
ggccaaaccugcagaauug

SEQ ID NO: 1080828 - RNA, 19 nt, Homo sapiens
ggacaaauacgguuuaaug

SEQ ID NO: 1080829 - RNA, 19 nt, Homo sapiens
uaauaaagcugcucaauac

SEQ ID NO: 1080830 - RNA, 19 nt, Homo sapiens
gcaagaagaugugauagga

SEQ ID NO: 1080831 - RNA, 19 nt, Homo sapiens
gaaggaguauuugaaguuu

SEQ ID NO: 1080832 - RNA, 19 nt, Homo sapiens
acaaugccaucgagaauua

SEQ ID NO: 1080833 - RNA, 19 nt, Homo sapiens
ggaaucacaugcacaguug

SEQ ID NO: 1080834 - RNA, 19 nt, Homo sapiens
gaacuaaaucucuagguaa

SEQ ID NO: 1080835 - RNA, 19 nt, Homo sapiens
gcaaauauuuccucaugau

SEQ ID NO: 1080836 - RNA, 19 nt, Homo sapiens
agacaacucuggaagaauu

SEQ ID NO: 1080837 - RNA, 19 nt, Homo sapiens
gggcacagcugcacagaga

SEQ ID NO: 1080838 - RNA, 19 nt, Homo sapiens
ccaauaaacuacaccaaug

SEQ ID NO: 1080839 - RNA, 19 nt, Homo sapiens
uaaaugaggcuccaauaaa

SEQ ID NO: 1080840 - RNA, 19 nt, Homo sapiens
caaaugauguggcaaugga

SEQ ID NO: 1080841 - RNA, 19 nt, Homo sapiens
ucagauaacccgugucaua

SEQ ID NO: 1080842 - RNA, 19 nt, Homo sapiens
gauacgagaugccaagguu

SEQ ID NO: 1080843 - RNA, 19 nt, Homo sapiens
cagaagaacagaugugaua

SEQ ID NO: 1080844 - RNA, 19 nt, Homo sapiens
caggaacugugcacaauaa

SEQ ID NO: 1080845 - RNA, 19 nt, Homo sapiens
ggaagacgaacccuguuua

SEQ ID NO: 1080846 - RNA, 19 nt, Homo sapiens
caaguuagaacacacauuu

SEQ ID NO: 1080847 - RNA, 19 nt, Homo sapiens
aguauaagcugaccuuuga

SEQ ID NO: 1080848 - RNA, 19 nt, Homo sapiens
gaaaggacuuguacuugca

SEQ ID NO: 1080849 - RNA, 19 nt, Homo sapiens
guaaaugaggcuccaauaa

SEQ ID NO: 1080850 - RNA, 19 nt, Homo sapiens
gaacaaaccgggaaauguc

SEQ ID NO: 1080851 - RNA, 19 nt, Homo sapiens
cuaaugggauuguucauau

SEQ ID NO: 1080852 - RNA, 19 nt, Homo sapiens
ccaaccagcucauacaguu

SEQ ID NO: 1080853 - RNA, 19 nt, Homo sapiens
aaggaaggcugaccucuuu

SEQ ID NO: 1080854 - RNA, 19 nt, Homo sapiens
ggugauggcuuaacguguu

SEQ ID NO: 1080855 - RNA, 19 nt, Homo sapiens
gcacagagaaggagcaaau

SEQ ID NO: 1080856 - RNA, 19 nt, Homo sapiens
caaagggugugaagcagaa

SEQ ID NO: 1080857 - RNA, 19 nt, Homo sapiens
caaccacacugggcaagua

SEQ ID NO: 1080858 - RNA, 19 nt, Homo sapiens
gcaguggaauugucauuuc

SEQ ID NO: 1080859 - RNA, 19 nt, Homo sapiens
ggacggcacucucgauuac

SEQ ID NO: 1080860 - RNA, 19 nt, Homo sapiens
cauaauugcuggucagaug

SEQ ID NO: 1080861 - RNA, 19 nt, Homo sapiens
uuacgugggugauggcuua

SEQ ID NO: 1080862 - RNA, 19 nt, Homo sapiens
guacguaccugggaccaaa

SEQ ID NO: 1080863 - RNA, 19 nt, Homo sapiens
gcacagcugcacagagaua

SEQ ID NO: 1080864 - RNA, 19 nt, Homo sapiens
gagaaacuccugaagaaug

SEQ ID NO: 1080865 - RNA, 19 nt, Homo sapiens
ggaaaggaagggauuuaaa

SEQ ID NO: 1080866 - RNA, 19 nt, Homo sapiens
ccaggaggcuucucaaauc

SEQ ID NO: 1080867 - RNA, 19 nt, Homo sapiens
ccacagcacucuucacaca

SEQ ID NO: 1080868 - RNA, 19 nt, Homo sapiens
gugcaaagguggccagaug

SEQ ID NO: 1080869 - RNA, 19 nt, Homo sapiens
ugaggaagcucggguuaaa

SEQ ID NO: 1080870 - RNA, 19 nt, Homo sapiens
cuaaaucucuagguaauga

SEQ ID NO: 1080871 - RNA, 19 nt, Homo sapiens
gaaaaguucuggaaauuca

SEQ ID NO: 1080872 - RNA, 19 nt, Homo sapiens
agaauucacugggaguuua

SEQ ID NO: 1080873 - RNA, 19 nt, Homo sapiens
gauaauaaugccacuacua

SEQ ID NO: 1080874 - RNA, 19 nt, Homo sapiens
caacgcauccuguuuguau

SEQ ID NO: 1080875 - RNA, 19 nt, Homo sapiens
gcucggagaucaacaacug

SEQ ID NO: 1080876 - RNA, 19 nt, Homo sapiens
gagcaaaccauaaugacaa

SEQ ID NO: 1080877 - RNA, 19 nt, Homo sapiens
aaagacaacucuggaagaa

SEQ ID NO: 1080878 - RNA, 19 nt, Homo sapiens
gaaaucaacccguguuugg

SEQ ID NO: 1080879 - RNA, 19 nt, Homo sapiens
agacgaacccuguuuauug

SEQ ID NO: 1080880 - RNA, 19 nt, Homo sapiens
agaaugaccugcacaaugg

SEQ ID NO: 1080881 - RNA, 19 nt, Homo sapiens
ucaaauccaugcucaggaa

SEQ ID NO: 1080882 - RNA, 19 nt, Homo sapiens
caaguucagaucuuuguua

SEQ ID NO: 1080883 - RNA, 19 nt, Homo sapiens
ggacaucuuugccuccaau

SEQ ID NO: 1080884 - RNA, 19 nt, Homo sapiens
gaccuccacuuccaggaua

SEQ ID NO: 1080885 - RNA, 19 nt, Homo sapiens
gcacgguguauauaaauaa

SEQ ID NO: 1080886 - RNA, 19 nt, Homo sapiens
agaaacuccugaagaauga

SEQ ID NO: 1080887 - RNA, 19 nt, Homo sapiens
cgacucagagaauuaaaua

SEQ ID NO: 1080888 - RNA, 19 nt, Homo sapiens
gauaacccgugucauagga

SEQ ID NO: 1080889 - RNA, 19 nt, Homo sapiens
caagaaggguuugguggaa

SEQ ID NO: 1080890 - RNA, 19 nt, Homo sapiens
gaacauacucucugucucu

SEQ ID NO: 1080891 - RNA, 19 nt, Homo sapiens
caucaacugugaauucuca

SEQ ID NO: 1080892 - RNA, 19 nt, Homo sapiens
ggaccuagacccaacaaga

SEQ ID NO: 1080893 - RNA, 19 nt, Homo sapiens
gauaucaucaguacuaaug

SEQ ID NO: 1080894 - RNA, 19 nt, Homo sapiens
gcaucuauaccuccuauuu

SEQ ID NO: 1080895 - RNA, 19 nt, Homo sapiens
caacaaugagcaaaccaua

SEQ ID NO: 1080896 - RNA, 19 nt, Homo sapiens
gauguucgccuuccacuga

SEQ ID NO: 1080897 - RNA, 19 nt, Homo sapiens
gcaagcagcagccugagaa

SEQ ID NO: 1080898 - RNA, 19 nt, Homo sapiens
gagcagggaucuucuuugc

SEQ ID NO: 1080899 - RNA, 19 nt, Homo sapiens
aguguaaccuggauuauga

SEQ ID NO: 1080900 - RNA, 19 nt, Homo sapiens
gaaccgucauuacgagaga

SEQ ID NO: 1080901 - RNA, 19 nt, Homo sapiens
cgauaaggacaaucaaaua

SEQ ID NO: 1080902 - RNA, 19 nt, Homo sapiens
acucaucaaugucugcuua

SEQ ID NO: 1080903 - RNA, 19 nt, Homo sapiens
ccacaaagacgucuaacug

SEQ ID NO: 1080904 - RNA, 19 nt, Homo sapiens
acaagggacugaaaggauu

SEQ ID NO: 1080905 - RNA, 19 nt, Homo sapiens
gcauuugccagaaagguua

SEQ ID NO: 1080906 - RNA, 19 nt, Homo sapiens
gaccaaaucggcacaguug

SEQ ID NO: 1080907 - RNA, 19 nt, Homo sapiens
cggagcagcugcccauuga

SEQ ID NO: 1080908 - RNA, 19 nt, Homo sapiens
ugugggagcugugucaaua

SEQ ID NO: 1080909 - RNA, 19 nt, Homo sapiens
aggacaagcugaaggagua

SEQ ID NO: 1080910 - RNA, 19 nt, Homo sapiens
guagaaaggacuuguacuu

SEQ ID NO: 1080911 - RNA, 19 nt, Homo sapiens
gagauggcuuucugugcua

SEQ ID NO: 1080912 - RNA, 19 nt, Homo sapiens
ccaaugggcuucugcacau

SEQ ID NO: 1080913 - RNA, 19 nt, Homo sapiens
caacagcgauaaggacaau

SEQ ID NO: 1080914 - RNA, 19 nt, Homo sapiens
gcuuaugccuggccacuga

SEQ ID NO: 1080915 - RNA, 19 nt, Homo sapiens
ucaagugcccggaugguua

SEQ ID NO: 1080916 - RNA, 19 nt, Homo sapiens
ggaagggauuuaaaaguaa

SEQ ID NO: 1080917 - RNA, 19 nt, Homo sapiens
guaacuguuugccagcaua

SEQ ID NO: 1080918 - RNA, 19 nt, Homo sapiens
gaagacgaacccuguuuau

SEQ ID NO: 1080919 - RNA, 19 nt, Homo sapiens
gaacagggccaaacggaaa

SEQ ID NO: 1080920 - RNA, 19 nt, Homo sapiens
gaaggaagguuuucuuuug

SEQ ID NO: 1080921 - RNA, 19 nt, Homo sapiens
gcugggagcugcugaagga

SEQ ID NO: 1080922 - RNA, 19 nt, Homo sapiens
agugaaagcuacuuaauca

SEQ ID NO: 1080923 - RNA, 19 nt, Homo sapiens
guauagggacuuugauaaa

SEQ ID NO: 1080924 - RNA, 19 nt, Homo sapiens
gauccaggcucagaacuuc

SEQ ID NO: 1080925 - RNA, 19 nt, Homo sapiens
ucaaugagauggugaacag

SEQ ID NO: 1080926 - RNA, 19 nt, Homo sapiens
gcagauggacugagcacaa

SEQ ID NO: 1080927 - RNA, 19 nt, Homo sapiens
cagauggacugagcacaaa

SEQ ID NO: 1080928 - RNA, 19 nt, Homo sapiens
auagggacuuugauaaaug

SEQ ID NO: 1080929 - RNA, 19 nt, Homo sapiens
uuugauaaaugcagguuug

SEQ ID NO: 1080930 - RNA, 19 nt, Homo sapiens
ugauaucggcuacgucaaa

SEQ ID NO: 1080931 - RNA, 19 nt, Homo sapiens
gagugaaagcuacuuaauc

SEQ ID NO: 1080932 - RNA, 19 nt, Homo sapiens
gaucgggacagacaagugu

SEQ ID NO: 1080933 - RNA, 19 nt, Homo sapiens
gcacaaaccacuggcugau

SEQ ID NO: 1080934 - RNA, 19 nt, Homo sapiens
ugacuccauugacaaccua

SEQ ID NO: 1080935 - RNA, 19 nt, Homo sapiens
ccauugccuucuauuccua

SEQ ID NO: 1080936 - RNA, 19 nt, Homo sapiens
gagcugagggaccgauuuc

SEQ ID NO: 1080937 - RNA, 19 nt, Homo sapiens
uguauagggacuuugauaa

SEQ ID NO: 1080938 - RNA, 19 nt, Homo sapiens
gacacugggucugaaagga

SEQ ID NO: 1080939 - RNA, 19 nt, Homo sapiens
guggagaggaucaaugaga

SEQ ID NO: 1080940 - RNA, 19 nt, Homo sapiens
gggaagauccuggcagaag

SEQ ID NO: 1080941 - RNA, 19 nt, Homo sapiens
aauaguguuugacuccauu

SEQ ID NO: 1080942 - RNA, 19 nt, Homo sapiens
ggagcugagggaccgauuu

SEQ ID NO: 1080943 - RNA, 19 nt, Homo sapiens
ggagaggaucaaugagaug

SEQ ID NO: 1080944 - RNA, 19 nt, Homo sapiens
uggagaggaucaaugagau

SEQ ID NO: 1080945 - RNA, 19 nt, Homo sapiens
acaaguguguggagaggau

SEQ ID NO: 1080946 - RNA, 19 nt, Homo sapiens
gaagauccuggcagaagca

SEQ ID NO: 1080947 - RNA, 19 nt, Homo sapiens
ucaccuguauagggacuuu

SEQ ID NO: 1080948 - RNA, 19 nt, Homo sapiens
gagagauccaggcucagaa

SEQ ID NO: 1080949 - RNA, 19 nt, Homo sapiens
gggagaugcugggcagaca

SEQ ID NO: 1080950 - RNA, 19 nt, Homo sapiens
gaucggcuagggauacuca

SEQ ID NO: 1080951 - RNA, 19 nt, Homo sapiens
gauaucggcuacgucaaac

SEQ ID NO: 1080952 - RNA, 19 nt, Homo sapiens
guguuugacuccauugaca

SEQ ID NO: 1080953 - RNA, 19 nt, Homo sapiens
gauccuggcagaagcagau

SEQ ID NO: 1080954 - RNA, 19 nt, Homo sapiens
guguggagaggaucaauga

SEQ ID NO: 1080955 - RNA, 19 nt, Homo sapiens
gauccgagguccuuuuagu

SEQ ID NO: 1080956 - RNA, 19 nt, Homo sapiens
gggcagacacaucguagca

SEQ ID NO: 1080957 - RNA, 19 nt, Homo sapiens
ggcuagggauacucacuca

SEQ ID NO: 1080958 - RNA, 19 nt, Homo sapiens
ugagugaaagcuacuuaau

SEQ ID NO: 1080959 - RNA, 19 nt, Homo sapiens
caggccauguuccacuauu

SEQ ID NO: 1080960 - RNA, 19 nt, Homo sapiens
acacugggucugaaaggaa

SEQ ID NO: 1080961 - RNA, 19 nt, Homo sapiens
aggccauguuccacuauuu

SEQ ID NO: 1080962 - RNA, 19 nt, Homo sapiens
gaugggugaugaggguuca

SEQ ID NO: 1080963 - RNA, 19 nt, Homo sapiens
gcagaagcagauggacuga

SEQ ID NO: 1080964 - RNA, 19 nt, Homo sapiens
ggauacucacucaccugua

SEQ ID NO: 1080965 - RNA, 19 nt, Homo sapiens
ccugagugaaagcuacuua

SEQ ID NO: 1080966 - RNA, 19 nt, Homo sapiens
ggacacugggucugaaagg

SEQ ID NO: 1080967 - RNA, 19 nt, Homo sapiens
ggaucaaugagauggugaa

SEQ ID NO: 1080968 - RNA, 19 nt, Homo sapiens
uagcaguguugcccgagau

SEQ ID NO: 1080969 - RNA, 19 nt, Homo sapiens
gcugggcagacacaucgua

SEQ ID NO: 1080970 - RNA, 19 nt, Homo sapiens
cuguauagggacuuugaua

SEQ ID NO: 1080971 - RNA, 19 nt, Homo sapiens
ggccauguuccacuauuuc

SEQ ID NO: 1080972 - RNA, 19 nt, Homo sapiens
ggugggauugugcucauau

SEQ ID NO: 1080973 - RNA, 19 nt, Homo sapiens
gccauugccuucuauuccu

SEQ ID NO: 1080974 - RNA, 19 nt, Homo sapiens
caguguugcccgagauuga

SEQ ID NO: 1080975 - RNA, 19 nt, Homo sapiens
cccgcuauaucuucaggaa

SEQ ID NO: 1080976 - RNA, 19 nt, Homo sapiens
aaauaguguuugacuccau

SEQ ID NO: 1080977 - RNA, 19 nt, Homo sapiens
cuucuauuccuacaccuuu

SEQ ID NO: 1080978 - RNA, 19 nt, Homo sapiens
gagaugcugggcagacaca

SEQ ID NO: 1080979 - RNA, 19 nt, Homo sapiens
augcagguuugcuggguuu

SEQ ID NO: 1080980 - RNA, 19 nt, Homo sapiens
acaccaagcagugaaaaua

SEQ ID NO: 1080981 - RNA, 19 nt, Homo sapiens
gggauugugcucauaucug

SEQ ID NO: 1080982 - RNA, 19 nt, Homo sapiens
gcaacaagcuuuagaacua

SEQ ID NO: 1080983 - RNA, 19 nt, Homo sapiens
ggacuuaacuucaucaaug

SEQ ID NO: 1080984 - RNA, 19 nt, Homo sapiens
gagaguugcuugaauauuu

SEQ ID NO: 1080985 - RNA, 19 nt, Homo sapiens
gaagaaaugugaacuuguu

SEQ ID NO: 1080986 - RNA, 19 nt, Homo sapiens
caaacagacugcucuauaa

SEQ ID NO: 1080987 - RNA, 19 nt, Homo sapiens
aaacaaagcugaccaucuu

SEQ ID NO: 1080988 - RNA, 19 nt, Homo sapiens
gaaauaugcuaaaguggaa

SEQ ID NO: 1080989 - RNA, 19 nt, Homo sapiens
ggagaaauaugcuaaagug

SEQ ID NO: 1080990 - RNA, 19 nt, Homo sapiens
gagguuacuugauuucuua

SEQ ID NO: 1080991 - RNA, 19 nt, Homo sapiens
gcaaacagacugcucuaua

SEQ ID NO: 1080992 - RNA, 19 nt, Homo sapiens
cagcagcucucccaguuua

SEQ ID NO: 1080993 - RNA, 19 nt, Homo sapiens
gcagaagaauuaccuccua

SEQ ID NO: 1080994 - RNA, 19 nt, Homo sapiens
gaagaauuaccuccuauuu

SEQ ID NO: 1080995 - RNA, 19 nt, Homo sapiens
ucaagcagguguuccauuu

SEQ ID NO: 1080996 - RNA, 19 nt, Homo sapiens
cagcugagguuacuugauu

SEQ ID NO: 1080997 - RNA, 19 nt, Homo sapiens
gcaggaaauuguguagaua

SEQ ID NO: 1080998 - RNA, 19 nt, Homo sapiens
gaaccacucugucuugauc

SEQ ID NO: 1080999 - RNA, 19 nt, Homo sapiens
uaaagcagaugaagaaagu

SEQ ID NO: 1081000 - RNA, 19 nt, Homo sapiens
gaaauuguguagauaugug

SEQ ID NO: 1081001 - RNA, 19 nt, Homo sapiens
ccaggugguucacuuauuu

SEQ ID NO: 1081002 - RNA, 19 nt, Homo sapiens
gaaggagaguugcuugaau

SEQ ID NO: 1081003 - RNA, 19 nt, Homo sapiens
caagagacuuugucauguu

SEQ ID NO: 1081004 - RNA, 19 nt, Homo sapiens
gaugaacacucgcccaaug

SEQ ID NO: 1081005 - RNA, 19 nt, Homo sapiens
gaaagaaacagaucaaacu

SEQ ID NO: 1081006 - RNA, 19 nt, Homo sapiens
gcaagagacuuugucaugu

SEQ ID NO: 1081007 - RNA, 19 nt, Homo sapiens
ugaaguagauguggagaaa

SEQ ID NO: 1081008 - RNA, 19 nt, Homo sapiens
aaggagaguugcuugaaua

SEQ ID NO: 1081009 - RNA, 19 nt, Homo sapiens
gaaauaguuccucagguaa

SEQ ID NO: 1081010 - RNA, 19 nt, Homo sapiens
aaguagauguggagaaaua

SEQ ID NO: 1081011 - RNA, 19 nt, Homo sapiens
agaaacagaucaaacugaa

SEQ ID NO: 1081012 - RNA, 19 nt, Homo sapiens
caaauugguucauuauugg

SEQ ID NO: 1081013 - RNA, 19 nt, Homo sapiens
gagauccacuuuacuaugg

SEQ ID NO: 1081014 - RNA, 19 nt, Homo sapiens
ggaaacggagucccuguaa

SEQ ID NO: 1081015 - RNA, 19 nt, Homo sapiens
cagaugaucauucaaauug

SEQ ID NO: 1081016 - RNA, 19 nt, Homo sapiens
uagagaagcuuguuaugca

SEQ ID NO: 1081017 - RNA, 19 nt, Homo sapiens
ccacagaugaucauucaaa

SEQ ID NO: 1081018 - RNA, 19 nt, Homo sapiens
gaaagugacagccagaugu

SEQ ID NO: 1081019 - RNA, 19 nt, Homo sapiens
caagagcacugaaucaaaa

SEQ ID NO: 1081020 - RNA, 19 nt, Homo sapiens
gaaaucaucuguggaucuc

SEQ ID NO: 1081021 - RNA, 19 nt, Homo sapiens
gaaacggagucccuguaau

SEQ ID NO: 1081022 - RNA, 19 nt, Homo sapiens
aaacggagucccuguaauu

SEQ ID NO: 1081023 - RNA, 19 nt, Homo sapiens
gaaaagcaggucagcauua

SEQ ID NO: 1081024 - RNA, 19 nt, Homo sapiens
gaaaugugaacuuguuaga

SEQ ID NO: 1081025 - RNA, 19 nt, Homo sapiens
caaucaguaccaagaauua

SEQ ID NO: 1081026 - RNA, 19 nt, Homo sapiens
caacaaugcagacuuuaau

SEQ ID NO: 1081027 - RNA, 19 nt, Homo sapiens
guccaacaaugcagacuuu

SEQ ID NO: 1081028 - RNA, 19 nt, Homo sapiens
caucagcguacauaaguua

SEQ ID NO: 1081029 - RNA, 19 nt, Homo sapiens
aaugugaacuuguuagaga

SEQ ID NO: 1081030 - RNA, 19 nt, Homo sapiens
aagcacaaccuuaucauuu

SEQ ID NO: 1081031 - RNA, 19 nt, Homo sapiens
caggaggucugcuaccaaa

SEQ ID NO: 1081032 - RNA, 19 nt, Homo sapiens
gaaaugagggauauucucu

SEQ ID NO: 1081033 - RNA, 19 nt, Homo sapiens
gaagcacaaccuuaucauu

SEQ ID NO: 1081034 - RNA, 19 nt, Homo sapiens
ugagggauauucucugaug

SEQ ID NO: 1081035 - RNA, 19 nt, Homo sapiens
ggaaaagucuaucaaaucu

SEQ ID NO: 1081036 - RNA, 19 nt, Homo sapiens
gaacacucgcccaaugaaa

SEQ ID NO: 1081037 - RNA, 19 nt, Homo sapiens
caugaaaucuccugguuac

SEQ ID NO: 1081038 - RNA, 19 nt, Homo sapiens
gcaguccaguaacaugaaa

SEQ ID NO: 1081039 - RNA, 19 nt, Homo sapiens
aagaagaaaugugaacuug

SEQ ID NO: 1081040 - RNA, 19 nt, Homo sapiens
ggcaaacucugcuggacuu

SEQ ID NO: 1081041 - RNA, 19 nt, Homo sapiens
ccaaauguccggucaagau

SEQ ID NO: 1081042 - RNA, 19 nt, Homo sapiens
cagaguaugucauugaaag

SEQ ID NO: 1081043 - RNA, 19 nt, Homo sapiens
aagaauuaguccagaauga

SEQ ID NO: 1081044 - RNA, 19 nt, Homo sapiens
ggcaggaaauuguguagau

SEQ ID NO: 1081045 - RNA, 19 nt, Homo sapiens
caacaagcuuuagaacuag

SEQ ID NO: 1081046 - RNA, 19 nt, Homo sapiens
cauaaugcaacaagcuuua

SEQ ID NO: 1081047 - RNA, 19 nt, Homo sapiens
ucuaagccaucaaguauuc

SEQ ID NO: 1081048 - RNA, 19 nt, Homo sapiens
caaugcagacuuuaauuug

SEQ ID NO: 1081049 - RNA, 19 nt, Homo sapiens
ggagcaggguucugagcaa

SEQ ID NO: 1081050 - RNA, 19 nt, Homo sapiens
gguguuccauuugguuuaa

SEQ ID NO: 1081051 - RNA, 19 nt, Homo sapiens
ccacccaggucauggcaaa

SEQ ID NO: 1081052 - RNA, 19 nt, Homo sapiens
caaucaaacuucccucaag

SEQ ID NO: 1081053 - RNA, 19 nt, Homo sapiens
guccacagaugaucauuca

SEQ ID NO: 1081054 - RNA, 19 nt, Homo sapiens
caagugauaaccacaaaug

SEQ ID NO: 1081055 - RNA, 19 nt, Homo sapiens
ccauucgacugcccuauga

SEQ ID NO: 1081056 - RNA, 19 nt, Homo sapiens
acagggaaaugguuuaaca

SEQ ID NO: 1081057 - RNA, 19 nt, Homo sapiens
ggaaagaaacagaucaaac

SEQ ID NO: 1081058 - RNA, 19 nt, Homo sapiens
gauccacuuuacuauggua

SEQ ID NO: 1081059 - RNA, 19 nt, Homo sapiens
agaauuaccuccuauuuug

SEQ ID NO: 1081060 - RNA, 19 nt, Homo sapiens
guagugggcucuguuugug

SEQ ID NO: 1081061 - RNA, 19 nt, Homo sapiens
ggagauccacuuuacuaug

SEQ ID NO: 1081062 - RNA, 19 nt, Homo sapiens
cagaagaauuaccuccuau

SEQ ID NO: 1081063 - RNA, 19 nt, Homo sapiens
guuuaguggucaaucuaua

SEQ ID NO: 1081064 - RNA, 19 nt, Homo sapiens
cgacagagaccuccuaaaa

SEQ ID NO: 1081065 - RNA, 19 nt, Homo sapiens
ggaggucugcuaccaaaug

SEQ ID NO: 1081066 - RNA, 19 nt, Homo sapiens
gaaacagaucaaacugaaa

SEQ ID NO: 1081067 - RNA, 19 nt, Homo sapiens
acagacugcucuauaacaa

SEQ ID NO: 1081068 - RNA, 19 nt, Homo sapiens
gacuuaacuucaucaaugu

SEQ ID NO: 1081069 - RNA, 19 nt, Homo sapiens
ccaacaaugcagacuuuaa

SEQ ID NO: 1081070 - RNA, 19 nt, Homo sapiens
aaugagggauauucucuga

SEQ ID NO: 1081071 - RNA, 19 nt, Homo sapiens
aagagacuuugucauguuu

SEQ ID NO: 1081072 - RNA, 19 nt, Homo sapiens
auacagaagcacaaccuua

SEQ ID NO: 1081073 - RNA, 19 nt, Homo sapiens
guggaucucaaucaaguua

SEQ ID NO: 1081074 - RNA, 19 nt, Homo sapiens
gccaaccacuccaaaauuu

SEQ ID NO: 1081075 - RNA, 19 nt, Homo sapiens
ccugccagcucaucacaaa

SEQ ID NO: 1081076 - RNA, 19 nt, Homo sapiens
gaugaucauucaaauuggu

SEQ ID NO: 1081077 - RNA, 19 nt, Homo sapiens
ugaaagugcccgacagaga

SEQ ID NO: 1081078 - RNA, 19 nt, Homo sapiens
ucucuuacguccaacaaug

SEQ ID NO: 1081079 - RNA, 19 nt, Homo sapiens
cacauucucuuacguccaa

SEQ ID NO: 1081080 - RNA, 19 nt, Homo sapiens
caacuccuccuccuucuuc

SEQ ID NO: 1081081 - RNA, 19 nt, Homo sapiens
uagcagaaauacgugacua

SEQ ID NO: 1081082 - RNA, 19 nt, Homo sapiens
gaacagauauccagaacua

SEQ ID NO: 1081083 - RNA, 19 nt, Homo sapiens
ggaccaaccuugaugaaua

SEQ ID NO: 1081084 - RNA, 19 nt, Homo sapiens
gaaggaauguagaaucuuu

SEQ ID NO: 1081085 - RNA, 19 nt, Homo sapiens
aaagagaacuuacaacuga

SEQ ID NO: 1081086 - RNA, 19 nt, Homo sapiens
acaaagaacuggaaaguga

SEQ ID NO: 1081087 - RNA, 19 nt, Homo sapiens
gcaaggaucuaaugaagga

SEQ ID NO: 1081088 - RNA, 19 nt, Homo sapiens
ggcaagaguugaggaauua

SEQ ID NO: 1081089 - RNA, 19 nt, Homo sapiens
acagaacgcuuagaaguua

SEQ ID NO: 1081090 - RNA, 19 nt, Homo sapiens
aaagagagacuacaugaua

SEQ ID NO: 1081091 - RNA, 19 nt, Homo sapiens
ggacauagaaccacucuug

SEQ ID NO: 1081092 - RNA, 19 nt, Homo sapiens
ucgauaagcuugaaaguga

SEQ ID NO: 1081093 - RNA, 19 nt, Homo sapiens
guaccgagaugaauuagau

SEQ ID NO: 1081094 - RNA, 19 nt, Homo sapiens
ggacuuucauugauuucua

SEQ ID NO: 1081095 - RNA, 19 nt, Homo sapiens
gagacuacaugauauugaa

SEQ ID NO: 1081096 - RNA, 19 nt, Homo sapiens
gaaaugggaccaaccuuga

SEQ ID NO: 1081097 - RNA, 19 nt, Homo sapiens
gcaauuagagagugaacua

SEQ ID NO: 1081098 - RNA, 19 nt, Homo sapiens
ggauggaagugacugauau

SEQ ID NO: 1081099 - RNA, 19 nt, Homo sapiens
cuacuuacuuccacguuua

SEQ ID NO: 1081100 - RNA, 19 nt, Homo sapiens
ggacuacuguggauucugu

SEQ ID NO: 1081101 - RNA, 19 nt, Homo sapiens
caaccaagccaggaauuua

SEQ ID NO: 1081102 - RNA, 19 nt, Homo sapiens
caaacagugucuuccuuaa

SEQ ID NO: 1081103 - RNA, 19 nt, Homo sapiens
ucauagaacucucugaaga

SEQ ID NO: 1081104 - RNA, 19 nt, Homo sapiens
cuaccaggguuuagauaua

SEQ ID NO: 1081105 - RNA, 19 nt, Homo sapiens
aaagagaauucccaacuug

SEQ ID NO: 1081106 - RNA, 19 nt, Homo sapiens
agaacgagcugaagaacuu

SEQ ID NO: 1081107 - RNA, 19 nt, Homo sapiens
gaagucagcagauauaaag

SEQ ID NO: 1081108 - RNA, 19 nt, Homo sapiens
gaccaaccuugaugaauau

SEQ ID NO: 1081109 - RNA, 19 nt, Homo sapiens
gaaacaaaguauggaugaa

SEQ ID NO: 1081110 - RNA, 19 nt, Homo sapiens
gacaucaaguagauuauug

SEQ ID NO: 1081111 - RNA, 19 nt, Homo sapiens
gaaauggcacagaaacaaa

SEQ ID NO: 1081112 - RNA, 19 nt, Homo sapiens
gccaugaggugaaugaguu

SEQ ID NO: 1081113 - RNA, 19 nt, Homo sapiens
ggaaauggaacgagauaug

SEQ ID NO: 1081114 - RNA, 19 nt, Homo sapiens
aaagugaagucagcagaua

SEQ ID NO: 1081115 - RNA, 19 nt, Homo sapiens
cagcagauauaaagagaga

SEQ ID NO: 1081116 - RNA, 19 nt, Homo sapiens
ugaauuagaugcacuucga

SEQ ID NO: 1081117 - RNA, 19 nt, Homo sapiens
gcacagaaacaaaguaugg

SEQ ID NO: 1081118 - RNA, 19 nt, Homo sapiens
ggaaauggcacagaaacaa

SEQ ID NO: 1081119 - RNA, 19 nt, Homo sapiens
gaacaugaauuugcuuucg

SEQ ID NO: 1081120 - RNA, 19 nt, Homo sapiens
ggaacgagauauggauaga

SEQ ID NO: 1081121 - RNA, 19 nt, Homo sapiens
gaaagucgacaacaucugu

SEQ ID NO: 1081122 - RNA, 19 nt, Homo sapiens
gcgaaggaauguagaaucu

SEQ ID NO: 1081123 - RNA, 19 nt, Homo sapiens
ugaauugcaucaucuugaa

SEQ ID NO: 1081124 - RNA, 19 nt, Homo sapiens
ccagauaagugcagaagca

SEQ ID NO: 1081125 - RNA, 19 nt, Homo sapiens
uaacguggucucuguuuaa

SEQ ID NO: 1081126 - RNA, 19 nt, Homo sapiens
gaacugcgaaggaauguag

SEQ ID NO: 1081127 - RNA, 19 nt, Homo sapiens
gaauguaccgagaugaauu

SEQ ID NO: 1081128 - RNA, 19 nt, Homo sapiens
gaacuugagcaaauggaaa

SEQ ID NO: 1081129 - RNA, 19 nt, Homo sapiens
aaugaugccucacuuagaa

SEQ ID NO: 1081130 - RNA, 19 nt, Homo sapiens
gagcaguuguuggauugua

SEQ ID NO: 1081131 - RNA, 19 nt, Homo sapiens
aauauggcauugcaucuaa

SEQ ID NO: 1081132 - RNA, 19 nt, Homo sapiens
gaacaaggcacagaagaag

SEQ ID NO: 1081133 - RNA, 19 nt, Homo sapiens
ucaaacagugucuuccuua

SEQ ID NO: 1081134 - RNA, 19 nt, Homo sapiens
gauaagugcagaagcaaga

SEQ ID NO: 1081135 - RNA, 19 nt, Homo sapiens
agcaaagucuucagaauug

SEQ ID NO: 1081136 - RNA, 19 nt, Homo sapiens
agaaaucccugggccauga

SEQ ID NO: 1081137 - RNA, 19 nt, Homo sapiens
gcugggaacuggaacagau

SEQ ID NO: 1081138 - RNA, 19 nt, Homo sapiens
caacugaaagcuaaacuuc

SEQ ID NO: 1081139 - RNA, 19 nt, Homo sapiens
ggaacuggcagaugcuaaa

SEQ ID NO: 1081140 - RNA, 19 nt, Homo sapiens
gcuaagcaagauugaauuu

SEQ ID NO: 1081141 - RNA, 19 nt, Homo sapiens
ucagagagacagauuaaga

SEQ ID NO: 1081142 - RNA, 19 nt, Homo sapiens
cauagaaccacucuugaaa

SEQ ID NO: 1081143 - RNA, 19 nt, Homo sapiens
caggucaugcuccaaauua

SEQ ID NO: 1081144 - RNA, 19 nt, Homo sapiens
gaaaacagaacgcuuagaa

SEQ ID NO: 1081145 - RNA, 19 nt, Homo sapiens
caagaaaacagaacgcuua

SEQ ID NO: 1081146 - RNA, 19 nt, Homo sapiens
gaagugugcaagcaugaaa

SEQ ID NO: 1081147 - RNA, 19 nt, Homo sapiens
gaauguagaaucuuugaag

SEQ ID NO: 1081148 - RNA, 19 nt, Homo sapiens
ucaaaaggcugcaacaaga

SEQ ID NO: 1081149 - RNA, 19 nt, Homo sapiens
gaacagaaagucgacaaca

SEQ ID NO: 1081150 - RNA, 19 nt, Homo sapiens
gcacauauucaagagguaa

SEQ ID NO: 1081151 - RNA, 19 nt, Homo sapiens
aggcagcggucccagauaa

SEQ ID NO: 1081152 - RNA, 19 nt, Homo sapiens
uucaagagguaacucauaa

SEQ ID NO: 1081153 - RNA, 19 nt, Homo sapiens
caauaaugaugccucacuu

SEQ ID NO: 1081154 - RNA, 19 nt, Homo sapiens
caaccuugaugaauaugug

SEQ ID NO: 1081155 - RNA, 19 nt, Homo sapiens
gauggaaaaucaaacauug

SEQ ID NO: 1081156 - RNA, 19 nt, Homo sapiens
gaacuacaagacuuagaga

SEQ ID NO: 1081157 - RNA, 19 nt, Homo sapiens
aaacagaacgcuuagaagu

SEQ ID NO: 1081158 - RNA, 19 nt, Homo sapiens
auucagagcuagaaagaga

SEQ ID NO: 1081159 - RNA, 19 nt, Homo sapiens
cugaagaacuugaaaauga

SEQ ID NO: 1081160 - RNA, 19 nt, Homo sapiens
aacgagauauggauagaaa

SEQ ID NO: 1081161 - RNA, 19 nt, Homo sapiens
caacaagagaacaugaauu

SEQ ID NO: 1081162 - RNA, 19 nt, Homo sapiens
gaacauucagagacuauca

SEQ ID NO: 1081163 - RNA, 19 nt, Homo sapiens
gaagcaagagugaaagaca

SEQ ID NO: 1081164 - RNA, 19 nt, Homo sapiens
gagagaaaauucagagaga

SEQ ID NO: 1081165 - RNA, 19 nt, Homo sapiens
aaagcaaagucuucagaau

SEQ ID NO: 1081166 - RNA, 19 nt, Homo sapiens
uuaacguggucucuguuua

SEQ ID NO: 1081167 - RNA, 19 nt, Homo sapiens
gagagucagagaguaaaua

SEQ ID NO: 1081168 - RNA, 19 nt, Homo sapiens
aagcaaagucuucagaauu

SEQ ID NO: 1081169 - RNA, 19 nt, Homo sapiens
gagaacaugaauuugcuuu

SEQ ID NO: 1081170 - RNA, 19 nt, Homo sapiens
gcuaaagccaagauaagaa

SEQ ID NO: 1081171 - RNA, 19 nt, Homo sapiens
gagugaacuacaagacuua

SEQ ID NO: 1081172 - RNA, 19 nt, Homo sapiens
gaaaauggcucagcuacag

SEQ ID NO: 1081173 - RNA, 19 nt, Homo sapiens
aagcaaggaucuaaugaag

SEQ ID NO: 1081174 - RNA, 19 nt, Homo sapiens
gcaaagucuucagaauugu

SEQ ID NO: 1081175 - RNA, 19 nt, Homo sapiens
gaaaaucaaaggcucagua

SEQ ID NO: 1081176 - RNA, 19 nt, Homo sapiens
gaaauggaacgagauaugg

SEQ ID NO: 1081177 - RNA, 19 nt, Homo sapiens
aagagagacuacaugauau

SEQ ID NO: 1081178 - RNA, 19 nt, Homo sapiens
caagagaacaugaauuugc

SEQ ID NO: 1081179 - RNA, 19 nt, Homo sapiens
gaugcuaaagccaagauaa

SEQ ID NO: 1081180 - RNA, 19 nt, Homo sapiens
agagugaacuacaagacuu

SEQ ID NO: 1081181 - RNA, 19 nt, Homo sapiens
ucaguuagaaucccuagaa

SEQ ID NO: 1081182 - RNA, 19 nt, Homo sapiens
gaagcuaucugcucuguua

SEQ ID NO: 1081183 - RNA, 19 nt, Homo sapiens
uaacaaggcugaugaugaa

SEQ ID NO: 1081184 - RNA, 19 nt, Homo sapiens
gcaaucagguggacauauu

SEQ ID NO: 1081185 - RNA, 19 nt, Homo sapiens
ggaagaagguggcgaaagu

SEQ ID NO: 1081186 - RNA, 19 nt, Homo sapiens
gcucagaaguuguuuaaug

SEQ ID NO: 1081187 - RNA, 19 nt, Homo sapiens
gaaagaaggacaugaacaa

SEQ ID NO: 1081188 - RNA, 19 nt, Homo sapiens
gauaaaguccugaauguga

SEQ ID NO: 1081189 - RNA, 19 nt, Homo sapiens
guaggaagauggaagaaau

SEQ ID NO: 1081190 - RNA, 19 nt, Homo sapiens
gaagguggcgaaagucaua

SEQ ID NO: 1081191 - RNA, 19 nt, Homo sapiens
ggacaugaacaaacgcuua

SEQ ID NO: 1081192 - RNA, 19 nt, Homo sapiens
ugaagaaugugaucuccua

SEQ ID NO: 1081193 - RNA, 19 nt, Homo sapiens
gaacaaacgcuuaaagaac

SEQ ID NO: 1081194 - RNA, 19 nt, Homo sapiens
ugacuggccucuaguuuau

SEQ ID NO: 1081195 - RNA, 19 nt, Homo sapiens
cagauaaaguccugaaugu

SEQ ID NO: 1081196 - RNA, 19 nt, Homo sapiens
gaaagcagccaggaacaaa

SEQ ID NO: 1081197 - RNA, 19 nt, Homo sapiens
gaaaauaugcucagaaguu

SEQ ID NO: 1081198 - RNA, 19 nt, Homo sapiens
ucacgaaaguuuauagcaa

SEQ ID NO: 1081199 - RNA, 19 nt, Homo sapiens
acaaagugcugacgaggaa

SEQ ID NO: 1081200 - RNA, 19 nt, Homo sapiens
gacaucgucuuauauaaca

SEQ ID NO: 1081201 - RNA, 19 nt, Homo sapiens
ggauauggaugaaagaaac

SEQ ID NO: 1081202 - RNA, 19 nt, Homo sapiens
aagaugaacuggucccauu

SEQ ID NO: 1081203 - RNA, 19 nt, Homo sapiens
gaugaaagaaaccaaauuc

SEQ ID NO: 1081204 - RNA, 19 nt, Homo sapiens
cacgaaaguuuauagcaaa

SEQ ID NO: 1081205 - RNA, 19 nt, Homo sapiens
uuaauacaauucccuguga

SEQ ID NO: 1081206 - RNA, 19 nt, Homo sapiens
aaugugacccugcagauua

SEQ ID NO: 1081207 - RNA, 19 nt, Homo sapiens
gaaguuguuuaaugaccuu

SEQ ID NO: 1081208 - RNA, 19 nt, Homo sapiens
cgaggaauauugaguacau

SEQ ID NO: 1081209 - RNA, 19 nt, Homo sapiens
ggaccgagaucaguacgau

SEQ ID NO: 1081210 - RNA, 19 nt, Homo sapiens
ucucucagauuaaggauau

SEQ ID NO: 1081211 - RNA, 19 nt, Homo sapiens
gugacuggccucuaguuua

SEQ ID NO: 1081212 - RNA, 19 nt, Homo sapiens
ccagaaagaaggacaugaa

SEQ ID NO: 1081213 - RNA, 19 nt, Homo sapiens
cucagaaguuguuuaauga

SEQ ID NO: 1081214 - RNA, 19 nt, Homo sapiens
aaaugaaugucgaagcuau

SEQ ID NO: 1081215 - RNA, 19 nt, Homo sapiens
acaauucccugugaucuau

SEQ ID NO: 1081216 - RNA, 19 nt, Homo sapiens
ugaacaaacgcuuaaagaa

SEQ ID NO: 1081217 - RNA, 19 nt, Homo sapiens
gcggauuagucacagauau

SEQ ID NO: 1081218 - RNA, 19 nt, Homo sapiens
ugacgaggaauauugagua

SEQ ID NO: 1081219 - RNA, 19 nt, Homo sapiens
gacaugaacaaacgcuuaa

SEQ ID NO: 1081220 - RNA, 19 nt, Homo sapiens
uuaaggauauggaugaaag

SEQ ID NO: 1081221 - RNA, 19 nt, Homo sapiens
ggguggucauccugaaaua

SEQ ID NO: 1081222 - RNA, 19 nt, Homo sapiens
ggugaugaauauccacuuc

SEQ ID NO: 1081223 - RNA, 19 nt, Homo sapiens
accaaauucugacugcuua

SEQ ID NO: 1081224 - RNA, 19 nt, Homo sapiens
ggaugaaagaaaccaaauu

SEQ ID NO: 1081225 - RNA, 19 nt, Homo sapiens
gcuaucugcucuguuaaau

SEQ ID NO: 1081226 - RNA, 19 nt, Homo sapiens
agucacagauauuggcuuu

SEQ ID NO: 1081227 - RNA, 19 nt, Homo sapiens
gaaagucauagaccgauuc

SEQ ID NO: 1081228 - RNA, 19 nt, Homo sapiens
cgaaagucauagaccgauu

SEQ ID NO: 1081229 - RNA, 19 nt, Homo sapiens
gaccaccucacgaaaguuu

SEQ ID NO: 1081230 - RNA, 19 nt, Homo sapiens
gauuaaggauauggaugaa

SEQ ID NO: 1081231 - RNA, 19 nt, Homo sapiens
auuacgcucucucagauua

SEQ ID NO: 1081232 - RNA, 19 nt, Homo sapiens
gaaugugacccugcagauu

SEQ ID NO: 1081233 - RNA, 19 nt, Homo sapiens
ucaaaugaaugucgaagcu

SEQ ID NO: 1081234 - RNA, 19 nt, Homo sapiens
ccugugaucuauuccaaug

SEQ ID NO: 1081235 - RNA, 19 nt, Homo sapiens
gggaccaccucacgaaagu

SEQ ID NO: 1081236 - RNA, 19 nt, Homo sapiens
ccugauagguaaauacuac

SEQ ID NO: 1081237 - RNA, 19 nt, Homo sapiens
caugcguccucauaucuuu

SEQ ID NO: 1081238 - RNA, 19 nt, Homo sapiens
gauggaagaaauagggaaa

SEQ ID NO: 1081239 - RNA, 19 nt, Homo sapiens
ggauuagucacagauauug

SEQ ID NO: 1081240 - RNA, 19 nt, Homo sapiens
ggaagauacagauaaaguc

SEQ ID NO: 1081241 - RNA, 19 nt, Homo sapiens
aguggaagauacagauaaa

SEQ ID NO: 1081242 - RNA, 19 nt, Homo sapiens
agaaugugaucuccuaugg

SEQ ID NO: 1081243 - RNA, 19 nt, Homo sapiens
caaggcugaugaugaaucu

SEQ ID NO: 1081244 - RNA, 19 nt, Homo sapiens
caaacucauuuuccccuua

SEQ ID NO: 1081245 - RNA, 19 nt, Homo sapiens
ugugaucuauuccaauguu

SEQ ID NO: 1081246 - RNA, 19 nt, Homo sapiens
ucacagauauuggcuuugc

SEQ ID NO: 1081247 - RNA, 19 nt, Homo sapiens
ggucuuguuugucuaugau

SEQ ID NO: 1081248 - RNA, 19 nt, Homo sapiens
uggaagaaauagggaaaga

SEQ ID NO: 1081249 - RNA, 19 nt, Homo sapiens
cuaucuggguagaaauuaa

SEQ ID NO: 1081250 - RNA, 19 nt, Homo sapiens
ggccaugacuguauuucag

SEQ ID NO: 1081251 - RNA, 19 nt, Homo sapiens
agaucucucugacuucauu

SEQ ID NO: 1081252 - RNA, 19 nt, Homo sapiens
uauauaacaaggcugauga

SEQ ID NO: 1081253 - RNA, 19 nt, Homo sapiens
agauuacgcucucucagau

SEQ ID NO: 1081254 - RNA, 19 nt, Homo sapiens
cagauuacgcucucucaga

SEQ ID NO: 1081255 - RNA, 19 nt, Homo sapiens
caagagcggauuagucaca

SEQ ID NO: 1081256 - RNA, 19 nt, Homo sapiens
gugcugacgaggaauauug

SEQ ID NO: 1081257 - RNA, 19 nt, Homo sapiens
agaaggacaugaacaaacg

SEQ ID NO: 1081258 - RNA, 19 nt, Homo sapiens
agucauagaccgauucuuc

SEQ ID NO: 1081259 - RNA, 19 nt, Homo sapiens
cccagagucuaaccugaaa

SEQ ID NO: 1081260 - RNA, 19 nt, Homo sapiens
gggagugaccauccuguug

SEQ ID NO: 1081261 - RNA, 19 nt, Homo sapiens
auaacaaggcugaugauga

SEQ ID NO: 1081262 - RNA, 19 nt, Homo sapiens
caaauucugacugcuuauu

SEQ ID NO: 1081263 - RNA, 19 nt, Homo sapiens
uaggaagauggaagaaaua

SEQ ID NO: 1081264 - RNA, 19 nt, Homo sapiens
gcuaucuggguagaaauua

SEQ ID NO: 1081265 - RNA, 19 nt, Homo sapiens
aaagugcugacgaggaaua

SEQ ID NO: 1081266 - RNA, 19 nt, Homo sapiens
cucaggaggccgagaguua

SEQ ID NO: 1081267 - RNA, 19 nt, Homo sapiens
gcagagacggcagauggaa

SEQ ID NO: 1081268 - RNA, 19 nt, Homo sapiens
ccacugcguugaccaucau

SEQ ID NO: 1081269 - RNA, 19 nt, Homo sapiens
gaaaaugugccccugauag

SEQ ID NO: 1081270 - RNA, 19 nt, Homo sapiens
caaaugaaugucgaagcua

SEQ ID NO: 1081271 - RNA, 19 nt, Homo sapiens
gacggcagauggaaaauau

SEQ ID NO: 1081272 - RNA, 19 nt, Homo sapiens
auagaccgauucuucaugu

SEQ ID NO: 1081273 - RNA, 19 nt, Homo sapiens
gacgaggaauauugaguac

SEQ ID NO: 1081274 - RNA, 19 nt, Homo sapiens
ggaccuacaauggcaauca

SEQ ID NO: 1081275 - RNA, 19 nt, Homo sapiens
gcuccugugugguggaugu

SEQ ID NO: 1081276 - RNA, 19 nt, Homo sapiens
gugggugacuggccucuag

SEQ ID NO: 1081277 - RNA, 19 nt, Homo sapiens
agauuaaggauauggauga

SEQ ID NO: 1081278 - RNA, 19 nt, Homo sapiens
aaagaaggacaugaacaaa

SEQ ID NO: 1081279 - RNA, 19 nt, Homo sapiens
ugaugaauauccacuucug

SEQ ID NO: 1081280 - RNA, 19 nt, Homo sapiens
gcuaaugguggcagaaauc

SEQ ID NO: 1081281 - RNA, 19 nt, Homo sapiens
ccagcagccuccggagaaa

SEQ ID NO: 1081282 - RNA, 19 nt, Homo sapiens
caacaaaucucaauacagu

SEQ ID NO: 1081283 - RNA, 19 nt, Homo sapiens
uaacuuggcugcugucuug

SEQ ID NO: 1081284 - RNA, 19 nt, Homo sapiens
gaaagggaauacucugcua

SEQ ID NO: 1081285 - RNA, 19 nt, Homo sapiens
gaggcaagauuacuuaaau

SEQ ID NO: 1081286 - RNA, 19 nt, Homo sapiens
ggucuugacucaucuuuau

SEQ ID NO: 1081287 - RNA, 19 nt, Homo sapiens
gggaaauuauggauucuuu

SEQ ID NO: 1081288 - RNA, 19 nt, Homo sapiens
agacuuagaucacuaugaa

SEQ ID NO: 1081289 - RNA, 19 nt, Homo sapiens
ugagcugucuucuguauaa

SEQ ID NO: 1081290 - RNA, 19 nt, Homo sapiens
gcauggaacuucucaccaa

SEQ ID NO: 1081291 - RNA, 19 nt, Homo sapiens
ugaaggagcucagggauau

SEQ ID NO: 1081292 - RNA, 19 nt, Homo sapiens
ggacaaugauggcuauucu

SEQ ID NO: 1081293 - RNA, 19 nt, Homo sapiens
gcacagcaguccuacaagu

SEQ ID NO: 1081294 - RNA, 19 nt, Homo sapiens
gagcagugccuacuccaua

SEQ ID NO: 1081295 - RNA, 19 nt, Homo sapiens
gaaacgaugguguuaauuc

SEQ ID NO: 1081296 - RNA, 19 nt, Homo sapiens
gagaugagaggccgcauuu

SEQ ID NO: 1081297 - RNA, 19 nt, Homo sapiens
uagcaggcauucuuauaaa

SEQ ID NO: 1081298 - RNA, 19 nt, Homo sapiens
ggacagcgcuuugcacaac

SEQ ID NO: 1081299 - RNA, 19 nt, Homo sapiens
gggcaugacuuugcaucua

SEQ ID NO: 1081300 - RNA, 19 nt, Homo sapiens
ggauggugaucauugguaa

SEQ ID NO: 1081301 - RNA, 19 nt, Homo sapiens
gcaggacaaugauggcuau

SEQ ID NO: 1081302 - RNA, 19 nt, Homo sapiens
ggacacagaagacuuagau

SEQ ID NO: 1081303 - RNA, 19 nt, Homo sapiens
agaccuagcucugaauuug

SEQ ID NO: 1081304 - RNA, 19 nt, Homo sapiens
acgaugguguuaauucuua

SEQ ID NO: 1081305 - RNA, 19 nt, Homo sapiens
gagcacagcaguccuacaa

SEQ ID NO: 1081306 - RNA, 19 nt, Homo sapiens
gcaguucuguaaugcuuug

SEQ ID NO: 1081307 - RNA, 19 nt, Homo sapiens
cuagaaaggguuagcauuu

SEQ ID NO: 1081308 - RNA, 19 nt, Homo sapiens
caagguggguccuacuaga

SEQ ID NO: 1081309 - RNA, 19 nt, Homo sapiens
gugguucccucccucauuu

SEQ ID NO: 1081310 - RNA, 19 nt, Homo sapiens
ccagaggcaagauuacuua

SEQ ID NO: 1081311 - RNA, 19 nt, Homo sapiens
cagaagacuuagaucacua

SEQ ID NO: 1081312 - RNA, 19 nt, Homo sapiens
gaucaucuccgaccugugu

SEQ ID NO: 1081313 - RNA, 19 nt, Homo sapiens
cacgagcgcuuccgcauug

SEQ ID NO: 1081314 - RNA, 19 nt, Homo sapiens
cuagagcaguucuguaaug

SEQ ID NO: 1081315 - RNA, 19 nt, Homo sapiens
ccuggaaaguggcuucuaa

SEQ ID NO: 1081316 - RNA, 19 nt, Homo sapiens
ggagaugccugaggacaca

SEQ ID NO: 1081317 - RNA, 19 nt, Homo sapiens
cagucgaacucgugaauga

SEQ ID NO: 1081318 - RNA, 19 nt, Homo sapiens
gcuagcaggcauucuuaua

SEQ ID NO: 1081319 - RNA, 19 nt, Homo sapiens
ugaggacacagaagacuua

SEQ ID NO: 1081320 - RNA, 19 nt, Homo sapiens
ccaaaggaugaaacaaaua

SEQ ID NO: 1081321 - RNA, 19 nt, Homo sapiens
aagauaacuuucccuuuga

SEQ ID NO: 1081322 - RNA, 19 nt, Homo sapiens
gagauaaagacgggacaua

SEQ ID NO: 1081323 - RNA, 19 nt, Homo sapiens
acaaugauggcuauucuaa

SEQ ID NO: 1081324 - RNA, 19 nt, Homo sapiens
cagcagcucucauuaacag

SEQ ID NO: 1081325 - RNA, 19 nt, Homo sapiens
caagagcacagcaguccua

SEQ ID NO: 1081326 - RNA, 19 nt, Homo sapiens
gccaacaaaucucaauaca

SEQ ID NO: 1081327 - RNA, 19 nt, Homo sapiens
gauauauaccgaucacaga

SEQ ID NO: 1081328 - RNA, 19 nt, Homo sapiens
ggacauaaagaaagggaau

SEQ ID NO: 1081329 - RNA, 19 nt, Homo sapiens
gcaacaucacggagucaua

SEQ ID NO: 1081330 - RNA, 19 nt, Homo sapiens
ucagugcuguguuguaugu

SEQ ID NO: 1081331 - RNA, 19 nt, Homo sapiens
cggaaacuaugcagucgaa

SEQ ID NO: 1081332 - RNA, 19 nt, Homo sapiens
gaagaugauggcauuggaa

SEQ ID NO: 1081333 - RNA, 19 nt, Homo sapiens
cgaguccacuguugcuuug

SEQ ID NO: 1081334 - RNA, 19 nt, Homo sapiens
ggcuaacccuggaguauca

SEQ ID NO: 1081335 - RNA, 19 nt, Homo sapiens
gagccaacaaaucucaaua

SEQ ID NO: 1081336 - RNA, 19 nt, Homo sapiens
gaaugucaaacuccucaaa

SEQ ID NO: 1081337 - RNA, 19 nt, Homo sapiens
gcuggaauguagauugugu

SEQ ID NO: 1081338 - RNA, 19 nt, Homo sapiens
gauaaagacgggacauaag

SEQ ID NO: 1081339 - RNA, 19 nt, Homo sapiens
augcugagguugagauaaa

SEQ ID NO: 1081340 - RNA, 19 nt, Homo sapiens
cugaaacgaugguguuaau

SEQ ID NO: 1081341 - RNA, 19 nt, Homo sapiens
cagcugugcuccagacuag

SEQ ID NO: 1081342 - RNA, 19 nt, Homo sapiens
cuagcaggcauucuuauaa

SEQ ID NO: 1081343 - RNA, 19 nt, Homo sapiens
uaccaaaggaugaaacaaa

SEQ ID NO: 1081344 - RNA, 19 nt, Homo sapiens
acugugagcugucuucugu

SEQ ID NO: 1081345 - RNA, 19 nt, Homo sapiens
gaaaauucauuccauagag

SEQ ID NO: 1081346 - RNA, 19 nt, Homo sapiens
caaugcugcucuaacucua

SEQ ID NO: 1081347 - RNA, 19 nt, Homo sapiens
aaacgaugguguuaauucu

SEQ ID NO: 1081348 - RNA, 19 nt, Homo sapiens
uuauauugcuggaaacuca

SEQ ID NO: 1081349 - RNA, 19 nt, Homo sapiens
gaucacagaguuucaaagg

SEQ ID NO: 1081350 - RNA, 19 nt, Homo sapiens
ccacugaccggcugaugaa

SEQ ID NO: 1081351 - RNA, 19 nt, Homo sapiens
gcugucuucuguauaaugu

SEQ ID NO: 1081352 - RNA, 19 nt, Homo sapiens
agaaaggguuagcauuuua

SEQ ID NO: 1081353 - RNA, 19 nt, Homo sapiens
uaugauggauguguaugaa

SEQ ID NO: 1081354 - RNA, 19 nt, Homo sapiens
ccaauuaccuuugaaugcu

SEQ ID NO: 1081355 - RNA, 19 nt, Homo sapiens
cauggaacuucucaccaaa

SEQ ID NO: 1081356 - RNA, 19 nt, Homo sapiens
ugaagaugauggcauugga

SEQ ID NO: 1081357 - RNA, 19 nt, Homo sapiens
gccagcagcucucauuaac

SEQ ID NO: 1081358 - RNA, 19 nt, Homo sapiens
ggaaaguggcuucuaacca

SEQ ID NO: 1081359 - RNA, 19 nt, Homo sapiens
cgaccuguguaaacucuau

SEQ ID NO: 1081360 - RNA, 19 nt, Homo sapiens
uuucgagccuccuuauauu

SEQ ID NO: 1081361 - RNA, 19 nt, Homo sapiens
ucaauacagucugacaaga

SEQ ID NO: 1081362 - RNA, 19 nt, Homo sapiens
agaaccagaggcaagauua

SEQ ID NO: 1081363 - RNA, 19 nt, Homo sapiens
ggacauaaggggaaaauuc

SEQ ID NO: 1081364 - RNA, 19 nt, Homo sapiens
ccaaagauggccaagugaa

SEQ ID NO: 1081365 - RNA, 19 nt, Homo sapiens
ggcaugacuuugcaucuag

SEQ ID NO: 1081366 - RNA, 19 nt, Homo sapiens
agagaaacuuggagcugaa

SEQ ID NO: 1081367 - RNA, 19 nt, Homo sapiens
uuaccuaugcuauggauuu

SEQ ID NO: 1081368 - RNA, 19 nt, Homo sapiens
aaugauggcuauucuaaac

SEQ ID NO: 1081369 - RNA, 19 nt, Homo sapiens
ggagccgacuucauucuac

SEQ ID NO: 1081370 - RNA, 19 nt, Homo sapiens
gggagucuguacugagaug

SEQ ID NO: 1081371 - RNA, 19 nt, Homo sapiens
ggugaucauugguaagcuu

SEQ ID NO: 1081372 - RNA, 19 nt, Homo sapiens
gaggcugcuucguagaauu

SEQ ID NO: 1081373 - RNA, 19 nt, Homo sapiens
acuagagccuccuuaccua

SEQ ID NO: 1081374 - RNA, 19 nt, Homo sapiens
agauaaagacgggacauaa

SEQ ID NO: 1081375 - RNA, 19 nt, Homo sapiens
cugcaucucuuugucugua

SEQ ID NO: 1081376 - RNA, 19 nt, Homo sapiens
guauguacuugcuguugug

SEQ ID NO: 1081377 - RNA, 19 nt, Homo sapiens
ugucagugcuguguuguau

SEQ ID NO: 1081378 - RNA, 19 nt, Homo sapiens
gaugccagcagcucucauu

SEQ ID NO: 1081379 - RNA, 19 nt, Homo sapiens
acacagaagacuuagauca

SEQ ID NO: 1081380 - RNA, 19 nt, Homo sapiens
accaaaggaugaaacaaau

SEQ ID NO: 1081381 - RNA, 19 nt, Homo sapiens
ugugagcugucuucuguau

SEQ ID NO: 1081382 - RNA, 19 nt, Homo sapiens
gcacagagcucgggaugua

SEQ ID NO: 1081383 - RNA, 19 nt, Homo sapiens
gagcaagcaugcccaguuu

SEQ ID NO: 1081384 - RNA, 19 nt, Homo sapiens
ggaagguccuggcccuguu

SEQ ID NO: 1081385 - RNA, 19 nt, Homo sapiens
uggaugggcugguggauga

SEQ ID NO: 1081386 - RNA, 19 nt, Homo sapiens
gaugaaguuuaacaaguuc

SEQ ID NO: 1081387 - RNA, 19 nt, Homo sapiens
gugaugaaguuuaacaagu

SEQ ID NO: 1081388 - RNA, 19 nt, Homo sapiens
ucaacaaguucgaccucua

SEQ ID NO: 1081389 - RNA, 19 nt, Homo sapiens
ggagcaagcaugcccaguu

SEQ ID NO: 1081390 - RNA, 19 nt, Homo sapiens
caauaaagaccuggaagga

SEQ ID NO: 1081391 - RNA, 19 nt, Homo sapiens
acccagagguggccaaaga

SEQ ID NO: 1081392 - RNA, 19 nt, Homo sapiens
uguaccaggugaugaaguu

SEQ ID NO: 1081393 - RNA, 19 nt, Homo sapiens
ggaaggcccacccagacaa

SEQ ID NO: 1081394 - RNA, 19 nt, Homo sapiens
ccugaggcuuucuacauga

SEQ ID NO: 1081395 - RNA, 19 nt, Homo sapiens
ccaaagacaaggccagcuu

SEQ ID NO: 1081396 - RNA, 19 nt, Homo sapiens
gcaagcaugcccaguuugg

SEQ ID NO: 1081397 - RNA, 19 nt, Homo sapiens
caacaaguucgaccucuac

SEQ ID NO: 1081398 - RNA, 19 nt, Homo sapiens
uaccaggugaugaaguuua

SEQ ID NO: 1081399 - RNA, 19 nt, Homo sapiens
accaggugaugaaguuuaa

SEQ ID NO: 1081400 - RNA, 19 nt, Homo sapiens
cuggaaggauguugugcuu

SEQ ID NO: 1081401 - RNA, 19 nt, Homo sapiens
ugcgggaguucaacaaguu

SEQ ID NO: 1081402 - RNA, 19 nt, Homo sapiens
gugcgggaguucaacaagu

SEQ ID NO: 1081403 - RNA, 19 nt, Homo sapiens
cccugaggcuuucuacaug

SEQ ID NO: 1081404 - RNA, 19 nt, Homo sapiens
gaagguccuggcccuguuc

SEQ ID NO: 1081405 - RNA, 19 nt, Homo sapiens
ggauguugugcuucugaaa

SEQ ID NO: 1081406 - RNA, 19 nt, Homo sapiens
gaaguuuaacaaguucuca

SEQ ID NO: 1081407 - RNA, 19 nt, Homo sapiens
gcaccagacaguggacuuc

SEQ ID NO: 1081408 - RNA, 19 nt, Homo sapiens
gaaggcccacccagacaag

SEQ ID NO: 1081409 - RNA, 19 nt, Homo sapiens
ggugaugaaguuuaacaag

SEQ ID NO: 1081410 - RNA, 19 nt, Homo sapiens
uaaagaccuggaaggaugu

SEQ ID NO: 1081411 - RNA, 19 nt, Homo sapiens
ggacccagagguggccaaa

SEQ ID NO: 1081412 - RNA, 19 nt, Homo sapiens
acauguaccaggugaugaa

SEQ ID NO: 1081413 - RNA, 19 nt, Homo sapiens
ccuccaggauccucgauac

SEQ ID NO: 1081414 - RNA, 19 nt, Homo sapiens
gcagggagauuggagauua

SEQ ID NO: 1081415 - RNA, 19 nt, Homo sapiens
gaacauagaccugauauau

SEQ ID NO: 1081416 - RNA, 19 nt, Homo sapiens
gaaaaugccugaaagaaaa

SEQ ID NO: 1081417 - RNA, 19 nt, Homo sapiens
ggacugugcuguuaauuca

SEQ ID NO: 1081418 - RNA, 19 nt, Homo sapiens
ggucugagaugcccuuuga

SEQ ID NO: 1081419 - RNA, 19 nt, Homo sapiens
ggaacuauguacuuuguga

SEQ ID NO: 1081420 - RNA, 19 nt, Homo sapiens
gaaaugaucaaccuuuaug

SEQ ID NO: 1081421 - RNA, 19 nt, Homo sapiens
gaggauaauuucucuaagu

SEQ ID NO: 1081422 - RNA, 19 nt, Homo sapiens
caaauuauguugugugcau

SEQ ID NO: 1081423 - RNA, 19 nt, Homo sapiens
ggacagagaauuugaccuu

SEQ ID NO: 1081424 - RNA, 19 nt, Homo sapiens
gcacugggaugucuacucu

SEQ ID NO: 1081425 - RNA, 19 nt, Homo sapiens
ccagaaguguuacagauau

SEQ ID NO: 1081426 - RNA, 19 nt, Homo sapiens
caauauugcugauaguaug

SEQ ID NO: 1081427 - RNA, 19 nt, Homo sapiens
guguaagacuccaauaauu

SEQ ID NO: 1081428 - RNA, 19 nt, Homo sapiens
ggaaguccuuaucuuaaug

SEQ ID NO: 1081429 - RNA, 19 nt, Homo sapiens
aacaugggcuacuacauua

SEQ ID NO: 1081430 - RNA, 19 nt, Homo sapiens
gcacuaagaccuggaaaug

SEQ ID NO: 1081431 - RNA, 19 nt, Homo sapiens
ggagcacuguuaacugaaa

SEQ ID NO: 1081432 - RNA, 19 nt, Homo sapiens
ggaauccgaugugcauuga

SEQ ID NO: 1081433 - RNA, 19 nt, Homo sapiens
ggacagguagugaaucaaa

SEQ ID NO: 1081434 - RNA, 19 nt, Homo sapiens
aaacaugggcuacuacauu

SEQ ID NO: 1081435 - RNA, 19 nt, Homo sapiens
cuacaaugaugccgcagua

SEQ ID NO: 1081436 - RNA, 19 nt, Homo sapiens
gggaaguccuuaucuuaau

SEQ ID NO: 1081437 - RNA, 19 nt, Homo sapiens
ggaaacccaucaccaccaa

SEQ ID NO: 1081438 - RNA, 19 nt, Homo sapiens
auaauggacuccuccuaua

SEQ ID NO: 1081439 - RNA, 19 nt, Homo sapiens
gaauuugaccuucuaagau

SEQ ID NO: 1081440 - RNA, 19 nt, Homo sapiens
aagaggccauugcaaauuu

SEQ ID NO: 1081441 - RNA, 19 nt, Homo sapiens
ugggaugucuacucuauaa

SEQ ID NO: 1081442 - RNA, 19 nt, Homo sapiens
cugaaaugaucaaccuuua

SEQ ID NO: 1081443 - RNA, 19 nt, Homo sapiens
ggugggaacuauguacuuu

SEQ ID NO: 1081444 - RNA, 19 nt, Homo sapiens
gguagugaaucaaaugaau

SEQ ID NO: 1081445 - RNA, 19 nt, Homo sapiens
uaauaagguucaugcuuga

SEQ ID NO: 1081446 - RNA, 19 nt, Homo sapiens
cagaauaacagauaccauu

SEQ ID NO: 1081447 - RNA, 19 nt, Homo sapiens
agagcuaucuggucacaaa

SEQ ID NO: 1081448 - RNA, 19 nt, Homo sapiens
uaacagaagaggaacuauu

SEQ ID NO: 1081449 - RNA, 19 nt, Homo sapiens
uuuaaugaguggugacaua

SEQ ID NO: 1081450 - RNA, 19 nt, Homo sapiens
caacacagcagcaacagau

SEQ ID NO: 1081451 - RNA, 19 nt, Homo sapiens
ugaauucgguaaccauaga

SEQ ID NO: 1081452 - RNA, 19 nt, Homo sapiens
ccugauauauuucaagugu

SEQ ID NO: 1081453 - RNA, 19 nt, Homo sapiens
gcugauaguaugcuaauau

SEQ ID NO: 1081454 - RNA, 19 nt, Homo sapiens
gagacacggagcacuguua

SEQ ID NO: 1081455 - RNA, 19 nt, Homo sapiens
gaguuaauguaguagaaga

SEQ ID NO: 1081456 - RNA, 19 nt, Homo sapiens
caagguugcaucaguguaa

SEQ ID NO: 1081457 - RNA, 19 nt, Homo sapiens
uaaguuaacagaagaggaa

SEQ ID NO: 1081458 - RNA, 19 nt, Homo sapiens
gauuacagcaacuccauuu

SEQ ID NO: 1081459 - RNA, 19 nt, Homo sapiens
uacagaaccagaaguguua

SEQ ID NO: 1081460 - RNA, 19 nt, Homo sapiens
guccuuaucuuaauggaau

SEQ ID NO: 1081461 - RNA, 19 nt, Homo sapiens
ccagugugcugaccauuca

SEQ ID NO: 1081462 - RNA, 19 nt, Homo sapiens
agauggaguuaauguagua

SEQ ID NO: 1081463 - RNA, 19 nt, Homo sapiens
uaaagaggccauugcaaau

SEQ ID NO: 1081464 - RNA, 19 nt, Homo sapiens
gaccugauauauuucaagu

SEQ ID NO: 1081465 - RNA, 19 nt, Homo sapiens
cuauguacuuugugacuuu

SEQ ID NO: 1081466 - RNA, 19 nt, Homo sapiens
gaaugauggugggaacuau

SEQ ID NO: 1081467 - RNA, 19 nt, Homo sapiens
gugaagcuguugcaagguu

SEQ ID NO: 1081468 - RNA, 19 nt, Homo sapiens
ugccagaccucaauguuug

SEQ ID NO: 1081469 - RNA, 19 nt, Homo sapiens
caauccaccugauauguca

SEQ ID NO: 1081470 - RNA, 19 nt, Homo sapiens
ggcaucaccugaauaucuu

SEQ ID NO: 1081471 - RNA, 19 nt, Homo sapiens
caacagaugcuucaacaac

SEQ ID NO: 1081472 - RNA, 19 nt, Homo sapiens
caacagaaaccucaauugc

SEQ ID NO: 1081473 - RNA, 19 nt, Homo sapiens
gcgaauguaugucaauaac

SEQ ID NO: 1081474 - RNA, 19 nt, Homo sapiens
guaagacuccaauaauuca

SEQ ID NO: 1081475 - RNA, 19 nt, Homo sapiens
gcgggaccaugaagaaguu

SEQ ID NO: 1081476 - RNA, 19 nt, Homo sapiens
ucacaaaucagaagaacau

SEQ ID NO: 1081477 - RNA, 19 nt, Homo sapiens
uauuuggacugugcuguua

SEQ ID NO: 1081478 - RNA, 19 nt, Homo sapiens
uauguugugugcauuagaa

SEQ ID NO: 1081479 - RNA, 19 nt, Homo sapiens
auaaagaggccauugcaaa

SEQ ID NO: 1081480 - RNA, 19 nt, Homo sapiens
ucagcaggcuuucuuucaa

SEQ ID NO: 1081481 - RNA, 19 nt, Homo sapiens
gcaacuccauuuacagcau

SEQ ID NO: 1081482 - RNA, 19 nt, Homo sapiens
uaacaugccagaccucaau

SEQ ID NO: 1081483 - RNA, 19 nt, Homo sapiens
ggccaucuucuuauacaua

SEQ ID NO: 1081484 - RNA, 19 nt, Homo sapiens
gaccuucuaagaucaagua

SEQ ID NO: 1081485 - RNA, 19 nt, Homo sapiens
caaccuuuauggagggaaa

SEQ ID NO: 1081486 - RNA, 19 nt, Homo sapiens
cagaaguguuacagauauu

SEQ ID NO: 1081487 - RNA, 19 nt, Homo sapiens
gaaccagaaguguuacaga

SEQ ID NO: 1081488 - RNA, 19 nt, Homo sapiens
aagcgaauguaugucaaua

SEQ ID NO: 1081489 - RNA, 19 nt, Homo sapiens
gcaccaagacaaagaccaa

SEQ ID NO: 1081490 - RNA, 19 nt, Homo sapiens
gccaucuucuuauacauau

SEQ ID NO: 1081491 - RNA, 19 nt, Homo sapiens
cauaauggacuccuccuau

SEQ ID NO: 1081492 - RNA, 19 nt, Homo sapiens
gugcugaccauucaaaguu

SEQ ID NO: 1081493 - RNA, 19 nt, Homo sapiens
acggagcacuguuaacuga

SEQ ID NO: 1081494 - RNA, 19 nt, Homo sapiens
gaaccagauccggaacaua

SEQ ID NO: 1081495 - RNA, 19 nt, Homo sapiens
cagaagaacaucagcaauc

SEQ ID NO: 1081496 - RNA, 19 nt, Homo sapiens
ucaauugcaccaagacaaa

SEQ ID NO: 1081497 - RNA, 19 nt, Homo sapiens
aauaacagauaccauugga

SEQ ID NO: 1081498 - RNA, 19 nt, Homo sapiens
ggaacauagaccugauaua

SEQ ID NO: 1081499 - RNA, 19 nt, Homo sapiens
cuucuaagaucaaguaagg

SEQ ID NO: 1081500 - RNA, 19 nt, Homo sapiens
agaccucaauguuuguaaa

SEQ ID NO: 1081501 - RNA, 19 nt, Homo sapiens
ccaaauaaaagccagaaua

SEQ ID NO: 1081502 - RNA, 19 nt, Homo sapiens
ucaccgggaucugaaggua

SEQ ID NO: 1081503 - RNA, 19 nt, Homo sapiens
uuagaaaucaguugcuuga

SEQ ID NO: 1081504 - RNA, 19 nt, Homo sapiens
ucucuaaguuaacagaaga

SEQ ID NO: 1081505 - RNA, 19 nt, Homo sapiens
gacagguagugaaucaaau

SEQ ID NO: 1081506 - RNA, 19 nt, Homo sapiens
uugagaauguguauggaaa

SEQ ID NO: 1081507 - RNA, 19 nt, Homo sapiens
acagaugcuucaacaacaa

SEQ ID NO: 1081508 - RNA, 19 nt, Homo sapiens
aaagccagaauaacagaua

SEQ ID NO: 1081509 - RNA, 19 nt, Homo sapiens
ggaacuauuggacagagaa

SEQ ID NO: 1081510 - RNA, 19 nt, Homo sapiens
gcaauccaccugauauguc

SEQ ID NO: 1081511 - RNA, 19 nt, Homo sapiens
gauaaagaggccauugcaa

SEQ ID NO: 1081512 - RNA, 19 nt, Homo sapiens
uaugggaaguccuuaucuu

SEQ ID NO: 1081513 - RNA, 19 nt, Homo sapiens
ggugaauucgguaaccaua

SEQ ID NO: 1081514 - RNA, 19 nt, Homo sapiens
gcacauaacuuuacagaug

SEQ ID NO: 1081515 - RNA, 19 nt, Homo sapiens
caagagaacugaauaaugu

SEQ ID NO: 1081516 - RNA, 19 nt, Homo sapiens
gaaagaauguguuaccaau

SEQ ID NO: 1081517 - RNA, 19 nt, Homo sapiens
ggaggaagaacaaauaaua

SEQ ID NO: 1081518 - RNA, 19 nt, Homo sapiens
cagaaccacugcuuuaaua

SEQ ID NO: 1081519 - RNA, 19 nt, Homo sapiens
ggugauaacugauaauguu

SEQ ID NO: 1081520 - RNA, 19 nt, Homo sapiens
ggaauuagaagcuuaugua

SEQ ID NO: 1081521 - RNA, 19 nt, Homo sapiens
gaugagggcuuguaaaaua

SEQ ID NO: 1081522 - RNA, 19 nt, Homo sapiens
cauaagagcuuugagacua

SEQ ID NO: 1081523 - RNA, 19 nt, Homo sapiens
uaagcaagguauccuguua

SEQ ID NO: 1081524 - RNA, 19 nt, Homo sapiens
ggaaugggcuauuaagcaa

SEQ ID NO: 1081525 - RNA, 19 nt, Homo sapiens
cgacucgacucauuacaua

SEQ ID NO: 1081526 - RNA, 19 nt, Homo sapiens
gcaacccacugccuacuaa

SEQ ID NO: 1081527 - RNA, 19 nt, Homo sapiens
acacacagacuuugaaaua

SEQ ID NO: 1081528 - RNA, 19 nt, Homo sapiens
uuacuaaccucgugagaaa

SEQ ID NO: 1081529 - RNA, 19 nt, Homo sapiens
caaugguucucaaacuuua

SEQ ID NO: 1081530 - RNA, 19 nt, Homo sapiens
aagcuaagauguggauuua

SEQ ID NO: 1081531 - RNA, 19 nt, Homo sapiens
gauaauaugugagguguca

SEQ ID NO: 1081532 - RNA, 19 nt, Homo sapiens
gggaaagucugcacuggaa

SEQ ID NO: 1081533 - RNA, 19 nt, Homo sapiens
guaagaaccaagauucaua

SEQ ID NO: 1081534 - RNA, 19 nt, Homo sapiens
gcuaagauguggauuuaca

SEQ ID NO: 1081535 - RNA, 19 nt, Homo sapiens
caacagaagucaagagaac

SEQ ID NO: 1081536 - RNA, 19 nt, Homo sapiens
ggacugaguauuuauguga

SEQ ID NO: 1081537 - RNA, 19 nt, Homo sapiens
uaaguaggacugaguauuu

SEQ ID NO: 1081538 - RNA, 19 nt, Homo sapiens
gaacacacuuucagaacca

SEQ ID NO: 1081539 - RNA, 19 nt, Homo sapiens
guacaauaguugaucuuga

SEQ ID NO: 1081540 - RNA, 19 nt, Homo sapiens
caacuucuauuuagugauc

SEQ ID NO: 1081541 - RNA, 19 nt, Homo sapiens
gagcugggccuuggacuua

SEQ ID NO: 1081542 - RNA, 19 nt, Homo sapiens
gccagaauuugcuaccuua

SEQ ID NO: 1081543 - RNA, 19 nt, Homo sapiens
gaaagggaauaugagugua

SEQ ID NO: 1081544 - RNA, 19 nt, Homo sapiens
ccaaggagcagaagaaaga

SEQ ID NO: 1081545 - RNA, 19 nt, Homo sapiens
gaagugauuuccagaggau

SEQ ID NO: 1081546 - RNA, 19 nt, Homo sapiens
ucagaaccaucaaugaauu

SEQ ID NO: 1081547 - RNA, 19 nt, Homo sapiens
gaaccacugcuuuaauauu

SEQ ID NO: 1081548 - RNA, 19 nt, Homo sapiens
gaucuugaaugcagacuuc

SEQ ID NO: 1081549 - RNA, 19 nt, Homo sapiens
aaacugcuacgaagaaaua

SEQ ID NO: 1081550 - RNA, 19 nt, Homo sapiens
uucauuagcuugcucguua

SEQ ID NO: 1081551 - RNA, 19 nt, Homo sapiens
ggaauaugaguguaaguuu

SEQ ID NO: 1081552 - RNA, 19 nt, Homo sapiens
gcuagguccuuaguuauuu

SEQ ID NO: 1081553 - RNA, 19 nt, Homo sapiens
ggaucaggcccaagaauuu

SEQ ID NO: 1081554 - RNA, 19 nt, Homo sapiens
gaagaggccauuucucaga

SEQ ID NO: 1081555 - RNA, 19 nt, Homo sapiens
ucaagaaaccgaagugauu

SEQ ID NO: 1081556 - RNA, 19 nt, Homo sapiens
gaagauauggccacaaaca

SEQ ID NO: 1081557 - RNA, 19 nt, Homo sapiens
aaagaugacuuacuucaca

SEQ ID NO: 1081558 - RNA, 19 nt, Homo sapiens
guauacauguggaagauau

SEQ ID NO: 1081559 - RNA, 19 nt, Homo sapiens
gcacaacugaucaaucuug

SEQ ID NO: 1081560 - RNA, 19 nt, Homo sapiens
caaguuggauauuggauuc

SEQ ID NO: 1081561 - RNA, 19 nt, Homo sapiens
ggaaagggaauaugagugu

SEQ ID NO: 1081562 - RNA, 19 nt, Homo sapiens
cagaagaaagaauguguua

SEQ ID NO: 1081563 - RNA, 19 nt, Homo sapiens
gcagacuucauuuguauuu

SEQ ID NO: 1081564 - RNA, 19 nt, Homo sapiens
ccaagagggugcuccaaga

SEQ ID NO: 1081565 - RNA, 19 nt, Homo sapiens
gcacuucugccucaucgua

SEQ ID NO: 1081566 - RNA, 19 nt, Homo sapiens
acacagacuuugaaauaug

SEQ ID NO: 1081567 - RNA, 19 nt, Homo sapiens
uaagggcucuuuugaauaa

SEQ ID NO: 1081568 - RNA, 19 nt, Homo sapiens
cuacagcugucaccagauu

SEQ ID NO: 1081569 - RNA, 19 nt, Homo sapiens
gagugaagaugaaccacaa

SEQ ID NO: 1081570 - RNA, 19 nt, Homo sapiens
gaagaggaaaguaauaauc

SEQ ID NO: 1081571 - RNA, 19 nt, Homo sapiens
gacagaagcgugagcauga

SEQ ID NO: 1081572 - RNA, 19 nt, Homo sapiens
cacaagaacuagugucaga

SEQ ID NO: 1081573 - RNA, 19 nt, Homo sapiens
uggaagauauggccacaaa

SEQ ID NO: 1081574 - RNA, 19 nt, Homo sapiens
aaacccacauuguacagua

SEQ ID NO: 1081575 - RNA, 19 nt, Homo sapiens
ggaagcacauaacuuuaca

SEQ ID NO: 1081576 - RNA, 19 nt, Homo sapiens
caaaauaccugggauauag

SEQ ID NO: 1081577 - RNA, 19 nt, Homo sapiens
gaaauaaguaggacugagu

SEQ ID NO: 1081578 - RNA, 19 nt, Homo sapiens
guaauaauccgccacaaca

SEQ ID NO: 1081579 - RNA, 19 nt, Homo sapiens
gggaagaggccauuucuca

SEQ ID NO: 1081580 - RNA, 19 nt, Homo sapiens
cuacaagaguccuaccaaa

SEQ ID NO: 1081581 - RNA, 19 nt, Homo sapiens
cacaacagacaaugaaaua

SEQ ID NO: 1081582 - RNA, 19 nt, Homo sapiens
gcacagaguucagaguucu

SEQ ID NO: 1081583 - RNA, 19 nt, Homo sapiens
agaggaagcacauaacuuu

SEQ ID NO: 1081584 - RNA, 19 nt, Homo sapiens
ggaaaauucuguugcaaga

SEQ ID NO: 1081585 - RNA, 19 nt, Homo sapiens
guguagaaguuauggcuuu

SEQ ID NO: 1081586 - RNA, 19 nt, Homo sapiens
gacaacuucuaccguauga

SEQ ID NO: 1081587 - RNA, 19 nt, Homo sapiens
gagggugcuccaagaauua

SEQ ID NO: 1081588 - RNA, 19 nt, Homo sapiens
gaggaagcacauaacuuua

SEQ ID NO: 1081589 - RNA, 19 nt, Homo sapiens
caacugaucaaucuuggaa

SEQ ID NO: 1081590 - RNA, 19 nt, Homo sapiens
ggacaccuuccaacacuuu

SEQ ID NO: 1081591 - RNA, 19 nt, Homo sapiens
gcaauaagaaagaugacuu

SEQ ID NO: 1081592 - RNA, 19 nt, Homo sapiens
cauuacagcccuccauuaa

SEQ ID NO: 1081593 - RNA, 19 nt, Homo sapiens
aagaauguguuaccaaugu

SEQ ID NO: 1081594 - RNA, 19 nt, Homo sapiens
cgucaugcuucauacuaua

SEQ ID NO: 1081595 - RNA, 19 nt, Homo sapiens
caagaaaccgaagugauuu

SEQ ID NO: 1081596 - RNA, 19 nt, Homo sapiens
aaguaggacugaguauuua

SEQ ID NO: 1081597 - RNA, 19 nt, Homo sapiens
caacagacaaugaaauaag

SEQ ID NO: 1081598 - RNA, 19 nt, Homo sapiens
caagaguccuaccaaaaua

SEQ ID NO: 1081599 - RNA, 19 nt, Homo sapiens
gaauauaaacugcacuuac

SEQ ID NO: 1081600 - RNA, 19 nt, Homo sapiens
cuacgaagaaauacagaua

SEQ ID NO: 1081601 - RNA, 19 nt, Homo sapiens
cauccuagaacagaaauua

SEQ ID NO: 1081602 - RNA, 19 nt, Homo sapiens
ggacacacagacuuugaaa

SEQ ID NO: 1081603 - RNA, 19 nt, Homo sapiens
cagaagaggaagcacauaa

SEQ ID NO: 1081604 - RNA, 19 nt, Homo sapiens
gaggacagccaaacuacaa

SEQ ID NO: 1081605 - RNA, 19 nt, Homo sapiens
ugaggaggaagaacaaaua

SEQ ID NO: 1081606 - RNA, 19 nt, Homo sapiens
agaaguggcugcuagaucu

SEQ ID NO: 1081607 - RNA, 19 nt, Homo sapiens
gagcaggaauuagaagcuu

SEQ ID NO: 1081608 - RNA, 19 nt, Homo sapiens
agauccagguucugaauaa

SEQ ID NO: 1081609 - RNA, 19 nt, Homo sapiens
gguaagggcucuuuugaau

SEQ ID NO: 1081610 - RNA, 19 nt, Homo sapiens
gaggaggaagaacaaauaa

SEQ ID NO: 1081611 - RNA, 19 nt, Homo sapiens
uaaaguccgcauggaauua

SEQ ID NO: 1081612 - RNA, 19 nt, Homo sapiens
gacaaacugcuacgaagaa

SEQ ID NO: 1081613 - RNA, 19 nt, Homo sapiens
gcgcagcuaugaguucuau

SEQ ID NO: 1081614 - RNA, 19 nt, Homo sapiens
gcagaaagcucaaagcaaa

SEQ ID NO: 1081615 - RNA, 19 nt, Homo sapiens
gaacaagacugaaugcaaa

SEQ ID NO: 1081616 - RNA, 19 nt, Homo sapiens
ggaaggagauggacaguga

SEQ ID NO: 1081617 - RNA, 19 nt, Homo sapiens
gcaacaagcucuggacauu

SEQ ID NO: 1081618 - RNA, 19 nt, Homo sapiens
gcaaagcuguggccaagau

SEQ ID NO: 1081619 - RNA, 19 nt, Homo sapiens
gauaauuuguugcuugcua

SEQ ID NO: 1081620 - RNA, 19 nt, Homo sapiens
gaguuuaucugaauagcuu

SEQ ID NO: 1081621 - RNA, 19 nt, Homo sapiens
gagaagcugugggagagua

SEQ ID NO: 1081622 - RNA, 19 nt, Homo sapiens
aagaugaaguuacaggaua

SEQ ID NO: 1081623 - RNA, 19 nt, Homo sapiens
gcgccuggcucaucuguug

SEQ ID NO: 1081624 - RNA, 19 nt, Homo sapiens
uaagaccaaccuuugauua

SEQ ID NO: 1081625 - RNA, 19 nt, Homo sapiens
uugcauagcuucaguaaag

SEQ ID NO: 1081626 - RNA, 19 nt, Homo sapiens
cuagaaguguuuaguaguu

SEQ ID NO: 1081627 - RNA, 19 nt, Homo sapiens
gcaguuacagguccucuuu

SEQ ID NO: 1081628 - RNA, 19 nt, Homo sapiens
guaaaggauuuggcugaaa

SEQ ID NO: 1081629 - RNA, 19 nt, Homo sapiens
ucacaacccuggauaaugc

SEQ ID NO: 1081630 - RNA, 19 nt, Homo sapiens
ggagacagguggagaugag

SEQ ID NO: 1081631 - RNA, 19 nt, Homo sapiens
cugaauagcuuguuuacuc

SEQ ID NO: 1081632 - RNA, 19 nt, Homo sapiens
caacaagcucuggacauua

SEQ ID NO: 1081633 - RNA, 19 nt, Homo sapiens
caauagagcaaauaacaug

SEQ ID NO: 1081634 - RNA, 19 nt, Homo sapiens
ugaaggaacugacccuaca

SEQ ID NO: 1081635 - RNA, 19 nt, Homo sapiens
gacccaaccuagaaaugaa

SEQ ID NO: 1081636 - RNA, 19 nt, Homo sapiens
ugaggaggcugaaugaauc

SEQ ID NO: 1081637 - RNA, 19 nt, Homo sapiens
ggacccaaccuagaaauga

SEQ ID NO: 1081638 - RNA, 19 nt, Homo sapiens
gcaacugcuucaugagaug

SEQ ID NO: 1081639 - RNA, 19 nt, Homo sapiens
guacauugcaacucgcaua

SEQ ID NO: 1081640 - RNA, 19 nt, Homo sapiens
caacugaggaggcugaaug

SEQ ID NO: 1081641 - RNA, 19 nt, Homo sapiens
uagcuucaguaaaggauuu

SEQ ID NO: 1081642 - RNA, 19 nt, Homo sapiens
ggacucacaacccuggaua

SEQ ID NO: 1081643 - RNA, 19 nt, Homo sapiens
ggauauagacacaaaccuu

SEQ ID NO: 1081644 - RNA, 19 nt, Homo sapiens
gcacaccuguacucuccaa

SEQ ID NO: 1081645 - RNA, 19 nt, Homo sapiens
caccuguacucuccaauga

SEQ ID NO: 1081646 - RNA, 19 nt, Homo sapiens
ggaagcauucucccuguga

SEQ ID NO: 1081647 - RNA, 19 nt, Homo sapiens
ugaauagcuuguuuacuca

SEQ ID NO: 1081648 - RNA, 19 nt, Homo sapiens
gagcaaauaacaugggaau

SEQ ID NO: 1081649 - RNA, 19 nt, Homo sapiens
gacacaaaccuucuuggaa

SEQ ID NO: 1081650 - RNA, 19 nt, Homo sapiens
caaguggcauagcagauuc

SEQ ID NO: 1081651 - RNA, 19 nt, Homo sapiens
gcaucaaaccauaccauga

SEQ ID NO: 1081652 - RNA, 19 nt, Homo sapiens
agacugaugagaacaauga

SEQ ID NO: 1081653 - RNA, 19 nt, Homo sapiens
ggagcugcacaaccaguua

SEQ ID NO: 1081654 - RNA, 19 nt, Homo sapiens
uacaggauauagacacaaa

SEQ ID NO: 1081655 - RNA, 19 nt, Homo sapiens
aagaaagagugccaccaaa

SEQ ID NO: 1081656 - RNA, 19 nt, Homo sapiens
guaccagacugaugagaac

SEQ ID NO: 1081657 - RNA, 19 nt, Homo sapiens
ccagaacccugcugaugag

SEQ ID NO: 1081658 - RNA, 19 nt, Homo sapiens
cuaaaaggccacuaaauaa

SEQ ID NO: 1081659 - RNA, 19 nt, Homo sapiens
ggagaugaggugaagauca

SEQ ID NO: 1081660 - RNA, 19 nt, Homo sapiens
gaaguuacaggauauagac

SEQ ID NO: 1081661 - RNA, 19 nt, Homo sapiens
uaagagcaaugaccaccau

SEQ ID NO: 1081662 - RNA, 19 nt, Homo sapiens
augcaaagccggaauaaga

SEQ ID NO: 1081663 - RNA, 19 nt, Homo sapiens
gcacgacgcaucaaaccau

SEQ ID NO: 1081664 - RNA, 19 nt, Homo sapiens
gauagcaauagagcaaaua

SEQ ID NO: 1081665 - RNA, 19 nt, Homo sapiens
ucuaaaaggccacuaaaua

SEQ ID NO: 1081666 - RNA, 19 nt, Homo sapiens
cagaagguuugcauagcuu

SEQ ID NO: 1081667 - RNA, 19 nt, Homo sapiens
ccaaugaacaagacugaau

SEQ ID NO: 1081668 - RNA, 19 nt, Homo sapiens
aaagaaagagugccaccaa

SEQ ID NO: 1081669 - RNA, 19 nt, Homo sapiens
aagaugggcugccaagagu

SEQ ID NO: 1081670 - RNA, 19 nt, Homo sapiens
gcaauagagcaaauaacau

SEQ ID NO: 1081671 - RNA, 19 nt, Homo sapiens
gcuaugcucucuguuguac

SEQ ID NO: 1081672 - RNA, 19 nt, Homo sapiens
gaacaaugaggugaagauc

SEQ ID NO: 1081673 - RNA, 19 nt, Homo sapiens
ggaaggaggaggagugcau

SEQ ID NO: 1081674 - RNA, 19 nt, Homo sapiens
ugaacaagacugaaugcaa

SEQ ID NO: 1081675 - RNA, 19 nt, Homo sapiens
gggaugcaaagccggaaua

SEQ ID NO: 1081676 - RNA, 19 nt, Homo sapiens
cacaguagcaagcauaaga

SEQ ID NO: 1081677 - RNA, 19 nt, Homo sapiens
caagaugggcugccaagag

SEQ ID NO: 1081678 - RNA, 19 nt, Homo sapiens
agaccaaccuuugauuauc

SEQ ID NO: 1081679 - RNA, 19 nt, Homo sapiens
gaauccugcuccagacaca

SEQ ID NO: 1081680 - RNA, 19 nt, Homo sapiens
ccacugagcagcagaucau

SEQ ID NO: 1081681 - RNA, 19 nt, Homo sapiens
cacgacgcaucaaaccaua

SEQ ID NO: 1081682 - RNA, 19 nt, Homo sapiens
uagaaguguuuaguaguug

SEQ ID NO: 1081683 - RNA, 19 nt, Homo sapiens
ccagaagguuugcauagcu

SEQ ID NO: 1081684 - RNA, 19 nt, Homo sapiens
agaugaaguuacaggauau

SEQ ID NO: 1081685 - RNA, 19 nt, Homo sapiens
agggagaggugaaggugaa

SEQ ID NO: 1081686 - RNA, 19 nt, Homo sapiens
gaugggcugccaagaguug

SEQ ID NO: 1081687 - RNA, 19 nt, Homo sapiens
gaugaaguuacaggauaua

SEQ ID NO: 1081688 - RNA, 19 nt, Homo sapiens
gagcaggcacggcuaugug

SEQ ID NO: 1081689 - RNA, 19 nt, Homo sapiens
aggaggagcugcacaacca

SEQ ID NO: 1081690 - RNA, 19 nt, Homo sapiens
gaccaaccuuugauuaucc

SEQ ID NO: 1081691 - RNA, 19 nt, Homo sapiens
ugauagcaauagagcaaau

SEQ ID NO: 1081692 - RNA, 19 nt, Homo sapiens
guugauagcaauagagcaa

SEQ ID NO: 1081693 - RNA, 19 nt, Homo sapiens
caaugaacaagacugaaug

SEQ ID NO: 1081694 - RNA, 19 nt, Homo sapiens
aacaagcucuggacauuac

SEQ ID NO: 1081695 - RNA, 19 nt, Homo sapiens
cccagaacccugcugauga

SEQ ID NO: 1081696 - RNA, 19 nt, Homo sapiens
guccuaagaccaaccuuug

SEQ ID NO: 1081697 - RNA, 19 nt, Homo sapiens
ggaugcaaagccggaauaa

SEQ ID NO: 1081698 - RNA, 19 nt, Homo sapiens
uacagguccucuuuggauu

SEQ ID NO: 1081699 - RNA, 19 nt, Homo sapiens
ugacaagccaggguaguga

SEQ ID NO: 1081700 - RNA, 19 nt, Homo sapiens
gugcaugauugcucucuac

SEQ ID NO: 1081701 - RNA, 19 nt, Homo sapiens
uuacagguccucuuuggau

SEQ ID NO: 1081702 - RNA, 19 nt, Homo sapiens
gcccagaacccugcugaug

SEQ ID NO: 1081703 - RNA, 19 nt, Homo sapiens
acaaguggcauagcagauu

SEQ ID NO: 1081704 - RNA, 19 nt, Homo sapiens
guggacgacugcaacaagu

SEQ ID NO: 1081705 - RNA, 19 nt, Homo sapiens
ggacaagggagaggugaag

SEQ ID NO: 1081706 - RNA, 19 nt, Homo sapiens
aggagcaccuggaagcuau

SEQ ID NO: 1081707 - RNA, 19 nt, Homo sapiens
caccauucacuccagauaa

SEQ ID NO: 1081708 - RNA, 19 nt, Homo sapiens
ccucacaguagcaagcaua

SEQ ID NO: 1081709 - RNA, 19 nt, Homo sapiens
cagcagaaagcucaaagca

SEQ ID NO: 1081710 - RNA, 19 nt, Homo sapiens
ggugcaugauugcucucua

SEQ ID NO: 1081711 - RNA, 19 nt, Homo sapiens
cuaagaccaaccuuugauu

SEQ ID NO: 1081712 - RNA, 19 nt, Homo sapiens
uaccuugaguugauagcaa

SEQ ID NO: 1081713 - RNA, 19 nt, Homo sapiens
agacacaaaccuucuugga

SEQ ID NO: 1081714 - RNA, 19 nt, Homo sapiens
gaaaguggcugauauguua

SEQ ID NO: 1081715 - RNA, 19 nt, Homo sapiens
ccaauuaccuuacuucuaa

SEQ ID NO: 1081716 - RNA, 19 nt, Homo sapiens
gaacacugaugcuucaaua

SEQ ID NO: 1081717 - RNA, 19 nt, Homo sapiens
gaagaaagauuuggaagau

SEQ ID NO: 1081718 - RNA, 19 nt, Homo sapiens
gaagaguccugugccauua

SEQ ID NO: 1081719 - RNA, 19 nt, Homo sapiens
uaaguuagauggaccuaua

SEQ ID NO: 1081720 - RNA, 19 nt, Homo sapiens
caaagaagcagaagaauga

SEQ ID NO: 1081721 - RNA, 19 nt, Homo sapiens
ccacuaaguucaccuuuaa

SEQ ID NO: 1081722 - RNA, 19 nt, Homo sapiens
gaacaaugcuauuucaaag

SEQ ID NO: 1081723 - RNA, 19 nt, Homo sapiens
gaucgugucuuagaauaua

SEQ ID NO: 1081724 - RNA, 19 nt, Homo sapiens
ggacauccauagauuuauu

SEQ ID NO: 1081725 - RNA, 19 nt, Homo sapiens
caaggaagcuuucaguguu

SEQ ID NO: 1081726 - RNA, 19 nt, Homo sapiens
ggugaacgauacuaaguua

SEQ ID NO: 1081727 - RNA, 19 nt, Homo sapiens
ggagaaauacaacagaaua

SEQ ID NO: 1081728 - RNA, 19 nt, Homo sapiens
guggugagguuucauauuu

SEQ ID NO: 1081729 - RNA, 19 nt, Homo sapiens
ggaccuauauuacagauuc

SEQ ID NO: 1081730 - RNA, 19 nt, Homo sapiens
ggcaaccgcuucuaaauga

SEQ ID NO: 1081731 - RNA, 19 nt, Homo sapiens
gggcuuaucuuccuuaaca

SEQ ID NO: 1081732 - RNA, 19 nt, Homo sapiens
gaauauauguucgaaagga

SEQ ID NO: 1081733 - RNA, 19 nt, Homo sapiens
gugcugagauaauugguua

SEQ ID NO: 1081734 - RNA, 19 nt, Homo sapiens
agacugagcucacuaguuc

SEQ ID NO: 1081735 - RNA, 19 nt, Homo sapiens
guuacaagauugcagauuu

SEQ ID NO: 1081736 - RNA, 19 nt, Homo sapiens
ggccaaagccucacuguuu

SEQ ID NO: 1081737 - RNA, 19 nt, Homo sapiens
aauagaagcucaauaagug

SEQ ID NO: 1081738 - RNA, 19 nt, Homo sapiens
gagccaagaucacaccauu

SEQ ID NO: 1081739 - RNA, 19 nt, Homo sapiens
uagaagaacuugaagaaca

SEQ ID NO: 1081740 - RNA, 19 nt, Homo sapiens
ggaauguaccucaggauaa

SEQ ID NO: 1081741 - RNA, 19 nt, Homo sapiens
gaacugaaaguggcugaua

SEQ ID NO: 1081742 - RNA, 19 nt, Homo sapiens
gagcagcuuuaucccauuu

SEQ ID NO: 1081743 - RNA, 19 nt, Homo sapiens
gaggaucuuugguuccaua

SEQ ID NO: 1081744 - RNA, 19 nt, Homo sapiens
gcucaaagaggcugaauug

SEQ ID NO: 1081745 - RNA, 19 nt, Homo sapiens
ugaauaauggcuugacuua

SEQ ID NO: 1081746 - RNA, 19 nt, Homo sapiens
aacagaaguuggagaaaua

SEQ ID NO: 1081747 - RNA, 19 nt, Homo sapiens
guacacaagcccuuaauug

SEQ ID NO: 1081748 - RNA, 19 nt, Homo sapiens
gaggguuuguuaagguuua

SEQ ID NO: 1081749 - RNA, 19 nt, Homo sapiens
gcacugagagcuauuuaau

SEQ ID NO: 1081750 - RNA, 19 nt, Homo sapiens
ggaaacagaaguuggagaa

SEQ ID NO: 1081751 - RNA, 19 nt, Homo sapiens
gaacaccaaaugaaagauu

SEQ ID NO: 1081752 - RNA, 19 nt, Homo sapiens
gccacuaaguucaccuuua

SEQ ID NO: 1081753 - RNA, 19 nt, Homo sapiens
ggaaguguccuguauuuua

SEQ ID NO: 1081754 - RNA, 19 nt, Homo sapiens
gaauauuggugaacgauac

SEQ ID NO: 1081755 - RNA, 19 nt, Homo sapiens
gagaaguaguaguugaauu

SEQ ID NO: 1081756 - RNA, 19 nt, Homo sapiens
ggagcucgauucagauaug

SEQ ID NO: 1081757 - RNA, 19 nt, Homo sapiens
agaaagauuuggaagauuc

SEQ ID NO: 1081758 - RNA, 19 nt, Homo sapiens
ccaaguauccuacauagug

SEQ ID NO: 1081759 - RNA, 19 nt, Homo sapiens
guagauagauaacuuuggu

SEQ ID NO: 1081760 - RNA, 19 nt, Homo sapiens
gaauguaccucaggauaag

SEQ ID NO: 1081761 - RNA, 19 nt, Homo sapiens
aaacagaaguuggagaaau

SEQ ID NO: 1081762 - RNA, 19 nt, Homo sapiens
ggcaagaaauacaaguaaa

SEQ ID NO: 1081763 - RNA, 19 nt, Homo sapiens
ggaagaguccugugccauu

SEQ ID NO: 1081764 - RNA, 19 nt, Homo sapiens
guaccaaacugugacauca

SEQ ID NO: 1081765 - RNA, 19 nt, Homo sapiens
gaagcaaacaaucagaauu

SEQ ID NO: 1081766 - RNA, 19 nt, Homo sapiens
caaguauccuacauaguga

SEQ ID NO: 1081767 - RNA, 19 nt, Homo sapiens
gaaugcugcucgaauaagu

SEQ ID NO: 1081768 - RNA, 19 nt, Homo sapiens
aguuguaggugaugaaaua

SEQ ID NO: 1081769 - RNA, 19 nt, Homo sapiens
guggauagauagaaugguu

SEQ ID NO: 1081770 - RNA, 19 nt, Homo sapiens
gaagaacaccaaaugaaag

SEQ ID NO: 1081771 - RNA, 19 nt, Homo sapiens
acauggagcucgauucaga

SEQ ID NO: 1081772 - RNA, 19 nt, Homo sapiens
ucggaaugcugcucgaaua

SEQ ID NO: 1081773 - RNA, 19 nt, Homo sapiens
ugaagaacaccaaaugaaa

SEQ ID NO: 1081774 - RNA, 19 nt, Homo sapiens
ugagagaaguaguaguuga

SEQ ID NO: 1081775 - RNA, 19 nt, Homo sapiens
gagaggguuuguuaagguu

SEQ ID NO: 1081776 - RNA, 19 nt, Homo sapiens
gugaauaugaccugguuua

SEQ ID NO: 1081777 - RNA, 19 nt, Homo sapiens
gaauggaggaucuuugguu

SEQ ID NO: 1081778 - RNA, 19 nt, Homo sapiens
uaaaugagggcuuaucuuc

SEQ ID NO: 1081779 - RNA, 19 nt, Homo sapiens
guuuagagaggguuuguua

SEQ ID NO: 1081780 - RNA, 19 nt, Homo sapiens
gcucacuaguucaguauau

SEQ ID NO: 1081781 - RNA, 19 nt, Homo sapiens
ggcagaaucuacuggaaug

SEQ ID NO: 1081782 - RNA, 19 nt, Homo sapiens
ucaaagaggcugaauugga

SEQ ID NO: 1081783 - RNA, 19 nt, Homo sapiens
uggcugauauguuagcuuu

SEQ ID NO: 1081784 - RNA, 19 nt, Homo sapiens
gaauaugaccugguuuaga

SEQ ID NO: 1081785 - RNA, 19 nt, Homo sapiens
gggcaagaaauacaaguaa

SEQ ID NO: 1081786 - RNA, 19 nt, Homo sapiens
ccgaauagcugggauuaca

SEQ ID NO: 1081787 - RNA, 19 nt, Homo sapiens
aaauugugccgucauguua

SEQ ID NO: 1081788 - RNA, 19 nt, Homo sapiens
gccaaagccucacuguuuc

SEQ ID NO: 1081789 - RNA, 19 nt, Homo sapiens
ucuagaagggcaagaaaua

SEQ ID NO: 1081790 - RNA, 19 nt, Homo sapiens
uauccuacauagugaauga

SEQ ID NO: 1081791 - RNA, 19 nt, Homo sapiens
acagguauguucaucuuug

SEQ ID NO: 1081792 - RNA, 19 nt, Homo sapiens
cuucauauaugcuugcuau

SEQ ID NO: 1081793 - RNA, 19 nt, Homo sapiens
gauaagaagcuuguuaaag

SEQ ID NO: 1081794 - RNA, 19 nt, Homo sapiens
uuaugcaucuugccacuaa

SEQ ID NO: 1081795 - RNA, 19 nt, Homo sapiens
gaggucagccuggccaaua

SEQ ID NO: 1081796 - RNA, 19 nt, Homo sapiens
guaacuucauccuucauau

SEQ ID NO: 1081797 - RNA, 19 nt, Homo sapiens
aauaugaccugguuuagag

SEQ ID NO: 1081798 - RNA, 19 nt, Homo sapiens
cagaagaaguagaagaaag

SEQ ID NO: 1081799 - RNA, 19 nt, Homo sapiens
guuagauggaccuauauua

SEQ ID NO: 1081800 - RNA, 19 nt, Homo sapiens
ggauaagaagcuuguuaaa

SEQ ID NO: 1081801 - RNA, 19 nt, Homo sapiens
aggauguguuugccaauua

SEQ ID NO: 1081802 - RNA, 19 nt, Homo sapiens
gaaguagaagaaagauuug

SEQ ID NO: 1081803 - RNA, 19 nt, Homo sapiens
gcaagaaauacaaguaaag

SEQ ID NO: 1081804 - RNA, 19 nt, Homo sapiens
gaaugaagaucuuuuaugc

SEQ ID NO: 1081805 - RNA, 19 nt, Homo sapiens
ggaauauuggugaacgaua

SEQ ID NO: 1081806 - RNA, 19 nt, Homo sapiens
gagagaaguaguaguugaa

SEQ ID NO: 1081807 - RNA, 19 nt, Homo sapiens
caggaacacugaugcuuca

SEQ ID NO: 1081808 - RNA, 19 nt, Homo sapiens
gaauggagucucagucugu

SEQ ID NO: 1081809 - RNA, 19 nt, Homo sapiens
gaaagacugagcucacuag

SEQ ID NO: 1081810 - RNA, 19 nt, Homo sapiens
guuugucccucccauguuu

SEQ ID NO: 1081811 - RNA, 19 nt, Homo sapiens
caggauaagaagcuuguua

SEQ ID NO: 1081812 - RNA, 19 nt, Homo sapiens
ccaaagaagcagaagaaug

SEQ ID NO: 1081813 - RNA, 19 nt, Homo sapiens
cagaggaauuccagacgaa

SEQ ID NO: 1081814 - RNA, 19 nt, Homo sapiens
ggagaaagcugcacucugu

SEQ ID NO: 1081815 - RNA, 19 nt, Homo sapiens
gagaacaacuuacccagua

SEQ ID NO: 1081816 - RNA, 19 nt, Homo sapiens
ggaauucacugcgggauuu

SEQ ID NO: 1081817 - RNA, 19 nt, Homo sapiens
ccagaaauauccagugaaa

SEQ ID NO: 1081818 - RNA, 19 nt, Homo sapiens
cagaugaggcuaauacuua

SEQ ID NO: 1081819 - RNA, 19 nt, Homo sapiens
cccaguagcuagaauguua

SEQ ID NO: 1081820 - RNA, 19 nt, Homo sapiens
cagacaagauuacaaugaa

SEQ ID NO: 1081821 - RNA, 19 nt, Homo sapiens
caagaacccuggcuacuac

SEQ ID NO: 1081822 - RNA, 19 nt, Homo sapiens
cagcugugcuucuauucua

SEQ ID NO: 1081823 - RNA, 19 nt, Homo sapiens
ggaaaucaaagacgaaugu

SEQ ID NO: 1081824 - RNA, 19 nt, Homo sapiens
ggaaaguguuggacugaca

SEQ ID NO: 1081825 - RNA, 19 nt, Homo sapiens
gaauggaccuguucuucgu

SEQ ID NO: 1081826 - RNA, 19 nt, Homo sapiens
gaauguuaauggcagaaga

SEQ ID NO: 1081827 - RNA, 19 nt, Homo sapiens
cccagaagcugcaaggaaa

SEQ ID NO: 1081828 - RNA, 19 nt, Homo sapiens
guuaauggcagaagagaaa

SEQ ID NO: 1081829 - RNA, 19 nt, Homo sapiens
ggauauggaacucauguug

SEQ ID NO: 1081830 - RNA, 19 nt, Homo sapiens
gaacucauguugguuacag

SEQ ID NO: 1081831 - RNA, 19 nt, Homo sapiens
uaccagaaauauccaguga

SEQ ID NO: 1081832 - RNA, 19 nt, Homo sapiens
gaggauggaguacagauga

SEQ ID NO: 1081833 - RNA, 19 nt, Homo sapiens
ggugaucccuguggucuau

SEQ ID NO: 1081834 - RNA, 19 nt, Homo sapiens
gaaagcugcacucuguuga

SEQ ID NO: 1081835 - RNA, 19 nt, Homo sapiens
guacagaugaggcuaauac

SEQ ID NO: 1081836 - RNA, 19 nt, Homo sapiens
gugcuucuauucuaucguu

SEQ ID NO: 1081837 - RNA, 19 nt, Homo sapiens
gcaacugggccaacuacaa

SEQ ID NO: 1081838 - RNA, 19 nt, Homo sapiens
ugaggcagcugugcuucua

SEQ ID NO: 1081839 - RNA, 19 nt, Homo sapiens
gaaaacagcaucuuauuac

SEQ ID NO: 1081840 - RNA, 19 nt, Homo sapiens
gcacugagaaugguguuau

SEQ ID NO: 1081841 - RNA, 19 nt, Homo sapiens
cagcagcagccgugagaua

SEQ ID NO: 1081842 - RNA, 19 nt, Homo sapiens
ucagacaagauuacaauga

SEQ ID NO: 1081843 - RNA, 19 nt, Homo sapiens
gaaauauggagaaggaaag

SEQ ID NO: 1081844 - RNA, 19 nt, Homo sapiens
aaagacgaauguccuagug

SEQ ID NO: 1081845 - RNA, 19 nt, Homo sapiens
ggaguacagaugaggcuaa

SEQ ID NO: 1081846 - RNA, 19 nt, Homo sapiens
aacagcaucuuauuacuca

SEQ ID NO: 1081847 - RNA, 19 nt, Homo sapiens
agugaaauauggagaagga

SEQ ID NO: 1081848 - RNA, 19 nt, Homo sapiens
ugagaaugguguuaucuac

SEQ ID NO: 1081849 - RNA, 19 nt, Homo sapiens
auacuuacuucaaggaaug

SEQ ID NO: 1081850 - RNA, 19 nt, Homo sapiens
acaagaacccuggcuacua

SEQ ID NO: 1081851 - RNA, 19 nt, Homo sapiens
gaaaguguuggacugacaa

SEQ ID NO: 1081852 - RNA, 19 nt, Homo sapiens
ugaaauauggagaaggaaa

SEQ ID NO: 1081853 - RNA, 19 nt, Homo sapiens
ccaaggaccugggcaucug

SEQ ID NO: 1081854 - RNA, 19 nt, Homo sapiens
ucccaaggauggagaacaa

SEQ ID NO: 1081855 - RNA, 19 nt, Homo sapiens
gaguacagaugaggcuaau

SEQ ID NO: 1081856 - RNA, 19 nt, Homo sapiens
ggagggagggagugaagga

SEQ ID NO: 1081857 - RNA, 19 nt, Homo sapiens
gcccagaagcugcaaggaa

SEQ ID NO: 1081858 - RNA, 19 nt, Homo sapiens
ggaaagugcagcugagacu

SEQ ID NO: 1081859 - RNA, 19 nt, Homo sapiens
guagcuagaauguuaaugg

SEQ ID NO: 1081860 - RNA, 19 nt, Homo sapiens
guucaguucaggguauuua

SEQ ID NO: 1081861 - RNA, 19 nt, Homo sapiens
ggagaaggaaaguguugga

SEQ ID NO: 1081862 - RNA, 19 nt, Homo sapiens
acugggacauaaucuguuu

SEQ ID NO: 1081863 - RNA, 19 nt, Homo sapiens
cuacaacaccuuuggaucu

SEQ ID NO: 1081864 - RNA, 19 nt, Homo sapiens
cauuugauggccuguauuu

SEQ ID NO: 1081865 - RNA, 19 nt, Homo sapiens
aaggauggagaacaacuua

SEQ ID NO: 1081866 - RNA, 19 nt, Homo sapiens
caacugggccaacuacaac

SEQ ID NO: 1081867 - RNA, 19 nt, Homo sapiens
caaggaaaucaaagacgaa

SEQ ID NO: 1081868 - RNA, 19 nt, Homo sapiens
ucccuguggucuaugauuu

SEQ ID NO: 1081869 - RNA, 19 nt, Homo sapiens
cauaaucuguuuggcaucu

SEQ ID NO: 1081870 - RNA, 19 nt, Homo sapiens
gcagaagagaaaacaauaa

SEQ ID NO: 1081871 - RNA, 19 nt, Homo sapiens
aggcagcugugcuucuauu

SEQ ID NO: 1081872 - RNA, 19 nt, Homo sapiens
cacgagcgaugacuacaag

SEQ ID NO: 1081873 - RNA, 19 nt, Homo sapiens
caacuacaacaccuuugga

SEQ ID NO: 1081874 - RNA, 19 nt, Homo sapiens
augcagcacuggagaaaca

SEQ ID NO: 1081875 - RNA, 19 nt, Homo sapiens
caaagacgaauguccuagu

SEQ ID NO: 1081876 - RNA, 19 nt, Homo sapiens
gauuggaguggauauggaa

SEQ ID NO: 1081877 - RNA, 19 nt, Homo sapiens
agaaagcugcacucuguug

SEQ ID NO: 1081878 - RNA, 19 nt, Homo sapiens
ggccaacuacaacaccuuu

SEQ ID NO: 1081879 - RNA, 19 nt, Homo sapiens
gaagcugcaaggaaaucaa

SEQ ID NO: 1081880 - RNA, 19 nt, Homo sapiens
ugauuggaguggauaugga

SEQ ID NO: 1081881 - RNA, 19 nt, Homo sapiens
ggcuaauacuuacuucaag

SEQ ID NO: 1081882 - RNA, 19 nt, Homo sapiens
gagugaaggagcucucugu

SEQ ID NO: 1081883 - RNA, 19 nt, Homo sapiens
caaggauggagaacaacuu

SEQ ID NO: 1081884 - RNA, 19 nt, Homo sapiens
gggaauucacugcgggauu

SEQ ID NO: 1081885 - RNA, 19 nt, Homo sapiens
ccagugaaauauggagaag

SEQ ID NO: 1081886 - RNA, 19 nt, Homo sapiens
cgagcgaugacuacaagaa

SEQ ID NO: 1081887 - RNA, 19 nt, Homo sapiens
gagaaagcugcacucuguu

SEQ ID NO: 1081888 - RNA, 19 nt, Homo sapiens
aaacagcaucuuauuacuc

SEQ ID NO: 1081889 - RNA, 19 nt, Homo sapiens
ccagcgugcacgagaauga

SEQ ID NO: 1081890 - RNA, 19 nt, Homo sapiens
gcugcaaggaaaucaaaga

SEQ ID NO: 1081891 - RNA, 19 nt, Homo sapiens
acacugagcaccacugcau

SEQ ID NO: 1081892 - RNA, 19 nt, Homo sapiens
gagcagccaacgccuugug

SEQ ID NO: 1081893 - RNA, 19 nt, Homo sapiens
ugaucccuguggucuauga

SEQ ID NO: 1081894 - RNA, 19 nt, Homo sapiens
ccacgagcgaugacuacaa

SEQ ID NO: 1081895 - RNA, 19 nt, Homo sapiens
caaugaaccaacucagcuu

SEQ ID NO: 1081896 - RNA, 19 nt, Homo sapiens
ccaguagcuagaauguuaa

SEQ ID NO: 1081897 - RNA, 19 nt, Homo sapiens
agaacaacuuacccaguag

SEQ ID NO: 1081898 - RNA, 19 nt, Homo sapiens
auucuaucguugagaguuu

SEQ ID NO: 1081899 - RNA, 19 nt, Homo sapiens
cagcagccgugagauaacu

SEQ ID NO: 1081900 - RNA, 19 nt, Homo sapiens
auauggaacucauguuggu

SEQ ID NO: 1081901 - RNA, 19 nt, Homo sapiens
agacaagauuacaaugaac

SEQ ID NO: 1081902 - RNA, 19 nt, Homo sapiens
agaugaggcuaauacuuac

SEQ ID NO: 1081903 - RNA, 19 nt, Homo sapiens
ugcauuugauggccuguau

SEQ ID NO: 1081904 - RNA, 19 nt, Homo sapiens
acacugggacauaaucugu

SEQ ID NO: 1081905 - RNA, 19 nt, Homo sapiens
ucaaggaauggaccuguuc

SEQ ID NO: 1081906 - RNA, 19 nt, Homo sapiens
uacaacaccuuuggaucug

SEQ ID NO: 1081907 - RNA, 19 nt, Homo sapiens
ccucuccucccaaccauga

SEQ ID NO: 1081908 - RNA, 19 nt, Homo sapiens
cgccuugugugcuggaaug

SEQ ID NO: 1081909 - RNA, 19 nt, Homo sapiens
gagcgaugacuacaagaac

SEQ ID NO: 1081910 - RNA, 19 nt, Homo sapiens
gcagcugugcuucuauucu

SEQ ID NO: 1081911 - RNA, 19 nt, Homo sapiens
auggaacucauguugguua

SEQ ID NO: 1081912 - RNA, 19 nt, Homo sapiens
cagaaaacagcaucuuauu

SEQ ID NO: 1081913 - RNA, 19 nt, Homo sapiens
ccagaaaacagcaucuuau

SEQ ID NO: 1081914 - RNA, 19 nt, Homo sapiens
gaaguuaccugcacuauuu

SEQ ID NO: 1081915 - RNA, 19 nt, Homo sapiens
ggaaauacauuacgaugaa

SEQ ID NO: 1081916 - RNA, 19 nt, Homo sapiens
gaccaaggcugaaauaauu

SEQ ID NO: 1081917 - RNA, 19 nt, Homo sapiens
gaagagcaauugaaagaaa

SEQ ID NO: 1081918 - RNA, 19 nt, Homo sapiens
ccagaugccuuaaguauuu

SEQ ID NO: 1081919 - RNA, 19 nt, Homo sapiens
gaacuuugaugaugauuug

SEQ ID NO: 1081920 - RNA, 19 nt, Homo sapiens
gaagagaguuacccauauu

SEQ ID NO: 1081921 - RNA, 19 nt, Homo sapiens
ggacaugaagccuuuauua

SEQ ID NO: 1081922 - RNA, 19 nt, Homo sapiens
uaaagagccuggaagauuu

SEQ ID NO: 1081923 - RNA, 19 nt, Homo sapiens
gaagguauuuggucgagua

SEQ ID NO: 1081924 - RNA, 19 nt, Homo sapiens
gaucaaagccuaauacaug

SEQ ID NO: 1081925 - RNA, 19 nt, Homo sapiens
aaacagaguugcaaucaaa

SEQ ID NO: 1081926 - RNA, 19 nt, Homo sapiens
gaaguucucugugguguuu

SEQ ID NO: 1081927 - RNA, 19 nt, Homo sapiens
aaagacagcuccaaugaaa

SEQ ID NO: 1081928 - RNA, 19 nt, Homo sapiens
ggacagccauuuccucuga

SEQ ID NO: 1081929 - RNA, 19 nt, Homo sapiens
ucaaagagcuugugcuaga

SEQ ID NO: 1081930 - RNA, 19 nt, Homo sapiens
caacaugccuuguaaaucu

SEQ ID NO: 1081931 - RNA, 19 nt, Homo sapiens
gaaagaacauugccgaagu

SEQ ID NO: 1081932 - RNA, 19 nt, Homo sapiens
gauuuaagcuuucagcauu

SEQ ID NO: 1081933 - RNA, 19 nt, Homo sapiens
gcacuggcauucucauaaa

SEQ ID NO: 1081934 - RNA, 19 nt, Homo sapiens
ugaaggagaugcuuauuau

SEQ ID NO: 1081935 - RNA, 19 nt, Homo sapiens
gaaccuccauuucuucuau

SEQ ID NO: 1081936 - RNA, 19 nt, Homo sapiens
gaugggagauguauauuuc

SEQ ID NO: 1081937 - RNA, 19 nt, Homo sapiens
gagauaccauuaugaaaga

SEQ ID NO: 1081938 - RNA, 19 nt, Homo sapiens
ggaagagaguuacccauau

SEQ ID NO: 1081939 - RNA, 19 nt, Homo sapiens
caaacuggcugauaugaau

SEQ ID NO: 1081940 - RNA, 19 nt, Homo sapiens
ggagagagguauaaugauc

SEQ ID NO: 1081941 - RNA, 19 nt, Homo sapiens
gaacaucuccuugucauga

SEQ ID NO: 1081942 - RNA, 19 nt, Homo sapiens
gguucgaucuguuaaauaa

SEQ ID NO: 1081943 - RNA, 19 nt, Homo sapiens
ggaaaugucccaguuaauu

SEQ ID NO: 1081944 - RNA, 19 nt, Homo sapiens
gcgagaauguuguauguga

SEQ ID NO: 1081945 - RNA, 19 nt, Homo sapiens
caaacaugguuccuugaua

SEQ ID NO: 1081946 - RNA, 19 nt, Homo sapiens
gaaggaagaguagcaauuu

SEQ ID NO: 1081947 - RNA, 19 nt, Homo sapiens
ugaagacucucaacucgua

SEQ ID NO: 1081948 - RNA, 19 nt, Homo sapiens
gagaaagcauccagcugua

SEQ ID NO: 1081949 - RNA, 19 nt, Homo sapiens
gcaauguucugucaugaau

SEQ ID NO: 1081950 - RNA, 19 nt, Homo sapiens
ucccaaagcugauaaagaa

SEQ ID NO: 1081951 - RNA, 19 nt, Homo sapiens
gaaauaaaguggguucgau

SEQ ID NO: 1081952 - RNA, 19 nt, Homo sapiens
cuauacagcuauugagaua

SEQ ID NO: 1081953 - RNA, 19 nt, Homo sapiens
gaaagagggcuauuuagau

SEQ ID NO: 1081954 - RNA, 19 nt, Homo sapiens
ggugaaagagggcuauuua

SEQ ID NO: 1081955 - RNA, 19 nt, Homo sapiens
ccacaggacugcacauaug

SEQ ID NO: 1081956 - RNA, 19 nt, Homo sapiens
gaugccauguuucaaauuu

SEQ ID NO: 1081957 - RNA, 19 nt, Homo sapiens
gaacugccacuuagaggua

SEQ ID NO: 1081958 - RNA, 19 nt, Homo sapiens
guauauaagugacuggaaa

SEQ ID NO: 1081959 - RNA, 19 nt, Homo sapiens
ggagauguauauuucuuug

SEQ ID NO: 1081960 - RNA, 19 nt, Homo sapiens
caacuucccugaacuucuu

SEQ ID NO: 1081961 - RNA, 19 nt, Homo sapiens
ggacaauucaccauaguuu

SEQ ID NO: 1081962 - RNA, 19 nt, Homo sapiens
aaucaaaccugcaauguuc

SEQ ID NO: 1081963 - RNA, 19 nt, Homo sapiens
caacucguaucucauuuga

SEQ ID NO: 1081964 - RNA, 19 nt, Homo sapiens
aaagauggaugcuaggaaa

SEQ ID NO: 1081965 - RNA, 19 nt, Homo sapiens
ggaauuugaugaacuugug

SEQ ID NO: 1081966 - RNA, 19 nt, Homo sapiens
gaaagaaaccaucaccaau

SEQ ID NO: 1081967 - RNA, 19 nt, Homo sapiens
ggaaagaaaccaucaccaa

SEQ ID NO: 1081968 - RNA, 19 nt, Homo sapiens
gauggaagauuuguguaaa

SEQ ID NO: 1081969 - RNA, 19 nt, Homo sapiens
ggugaacaguaauugcuua

SEQ ID NO: 1081970 - RNA, 19 nt, Homo sapiens
cagcaagaauggaaagaaa

SEQ ID NO: 1081971 - RNA, 19 nt, Homo sapiens
cagaucauauugaaaggua

SEQ ID NO: 1081972 - RNA, 19 nt, Homo sapiens
aaacauaugccuccuacua

SEQ ID NO: 1081973 - RNA, 19 nt, Homo sapiens
gaacauugccgaagugaag

SEQ ID NO: 1081974 - RNA, 19 nt, Homo sapiens
caugaagccuuuauuacaa

SEQ ID NO: 1081975 - RNA, 19 nt, Homo sapiens
caggaaaugucccaguuaa

SEQ ID NO: 1081976 - RNA, 19 nt, Homo sapiens
acacuucccucucagcaua

SEQ ID NO: 1081977 - RNA, 19 nt, Homo sapiens
gaauaaagagccuggaaga

SEQ ID NO: 1081978 - RNA, 19 nt, Homo sapiens
gaaaccaucaccaaucaaa

SEQ ID NO: 1081979 - RNA, 19 nt, Homo sapiens
caaggaaggucaacguugu

SEQ ID NO: 1081980 - RNA, 19 nt, Homo sapiens
gaacaacugaguacaacuu

SEQ ID NO: 1081981 - RNA, 19 nt, Homo sapiens
gaaggaaaaugucgcuuaa

SEQ ID NO: 1081982 - RNA, 19 nt, Homo sapiens
uaaagaaugugaagacucu

SEQ ID NO: 1081983 - RNA, 19 nt, Homo sapiens
caacagaucauauugaaag

SEQ ID NO: 1081984 - RNA, 19 nt, Homo sapiens
uaucaaaguuggucagaga

SEQ ID NO: 1081985 - RNA, 19 nt, Homo sapiens
gcacucaccauuaaaucua

SEQ ID NO: 1081986 - RNA, 19 nt, Homo sapiens
caaauucacagguaaagaa

SEQ ID NO: 1081987 - RNA, 19 nt, Homo sapiens
ugaagugucuagagaagaa

SEQ ID NO: 1081988 - RNA, 19 nt, Homo sapiens
gaaauaauugcuagagaga

SEQ ID NO: 1081989 - RNA, 19 nt, Homo sapiens
gaaacagucucuucgaaaa

SEQ ID NO: 1081990 - RNA, 19 nt, Homo sapiens
ggugaaauauauucucuuc

SEQ ID NO: 1081991 - RNA, 19 nt, Homo sapiens
guaugugacugaauaacaa

SEQ ID NO: 1081992 - RNA, 19 nt, Homo sapiens
aaacaugguuccuugauag

SEQ ID NO: 1081993 - RNA, 19 nt, Homo sapiens
gcaauuucaccauuuguuu

SEQ ID NO: 1081994 - RNA, 19 nt, Homo sapiens
ggaaggaagaguagcaauu

SEQ ID NO: 1081995 - RNA, 19 nt, Homo sapiens
ccagaaaacuucauucauu

SEQ ID NO: 1081996 - RNA, 19 nt, Homo sapiens
gcacuaacaacagaucaua

SEQ ID NO: 1081997 - RNA, 19 nt, Homo sapiens
caucgugacucaaacuauu

SEQ ID NO: 1081998 - RNA, 19 nt, Homo sapiens
ucagguaguuugaggauug

SEQ ID NO: 1081999 - RNA, 19 nt, Homo sapiens
gaaacuccaaaccauguua

SEQ ID NO: 1082000 - RNA, 19 nt, Homo sapiens
guuaacugcuugcuugaaa

SEQ ID NO: 1082001 - RNA, 19 nt, Homo sapiens
ggucagagacuuugagguu

SEQ ID NO: 1082002 - RNA, 19 nt, Homo sapiens
ugacuuaaaugaugagcuu

SEQ ID NO: 1082003 - RNA, 19 nt, Homo sapiens
gaacugcuuuaauucuuca

SEQ ID NO: 1082004 - RNA, 19 nt, Homo sapiens
ucccugaacuucuuucuuu

SEQ ID NO: 1082005 - RNA, 19 nt, Homo sapiens
gaagauauuuuccaccaaa

SEQ ID NO: 1082006 - RNA, 19 nt, Homo sapiens
aaagagggcuauuuagauc

SEQ ID NO: 1082007 - RNA, 19 nt, Homo sapiens
guugaaauccucuuuagaa

SEQ ID NO: 1082008 - RNA, 19 nt, Homo sapiens
gaaugguacuucagaaucu

SEQ ID NO: 1082009 - RNA, 19 nt, Homo sapiens
ggacugccauuuucauuaa

SEQ ID NO: 1082010 - RNA, 19 nt, Homo sapiens
ggagauaccauuaugaaag

SEQ ID NO: 1082011 - RNA, 19 nt, Homo sapiens
gagaauguaccaucgcuuu

SEQ ID NO: 1082012 - RNA, 19 nt, Homo sapiens
ggaggacaauucaccauag

SEQ ID NO: 1082013 - RNA, 19 nt, Homo sapiens
ccagaaauguggaucaaag

SEQ ID NO: 1082014 - RNA, 19 nt, Homo sapiens
caaauucucuugcaaguua

SEQ ID NO: 1082015 - RNA, 19 nt, Homo sapiens
aauaagagcucucaagaaa

SEQ ID NO: 1082016 - RNA, 19 nt, Homo sapiens
cagaauagcucuacaagug

SEQ ID NO: 1082017 - RNA, 19 nt, Homo sapiens
gaaagucuguaaagcuuaa

SEQ ID NO: 1082018 - RNA, 19 nt, Homo sapiens
gaaagggaccacaguauuu

SEQ ID NO: 1082019 - RNA, 19 nt, Homo sapiens
caagagcacuucccaggua

SEQ ID NO: 1082020 - RNA, 19 nt, Homo sapiens
aaacuuaccuccagcacua

SEQ ID NO: 1082021 - RNA, 19 nt, Homo sapiens
ccagguagcugcaucacua

SEQ ID NO: 1082022 - RNA, 19 nt, Homo sapiens
acaaauacaucgcugcuaa

SEQ ID NO: 1082023 - RNA, 19 nt, Homo sapiens
gagaagcauugaaguuauu

SEQ ID NO: 1082024 - RNA, 19 nt, Homo sapiens
gaacgugucuguuagaaaa

SEQ ID NO: 1082025 - RNA, 19 nt, Homo sapiens
uaaguugucuaccauguuu

SEQ ID NO: 1082026 - RNA, 19 nt, Homo sapiens
gcauugaaguuauuucuca

SEQ ID NO: 1082027 - RNA, 19 nt, Homo sapiens
uaagagcucucaagaaagu

SEQ ID NO: 1082028 - RNA, 19 nt, Homo sapiens
ggaaagggaccacaguauu

SEQ ID NO: 1082029 - RNA, 19 nt, Homo sapiens
gaaaacaguucaacgugua

SEQ ID NO: 1082030 - RNA, 19 nt, Homo sapiens
ccacaguauuugaauguuu

SEQ ID NO: 1082031 - RNA, 19 nt, Homo sapiens
caguagcaguuguaaauaa

SEQ ID NO: 1082032 - RNA, 19 nt, Homo sapiens
auacaucgcugcuaacuuc

SEQ ID NO: 1082033 - RNA, 19 nt, Homo sapiens
aaacacaggcuuucacaaa

SEQ ID NO: 1082034 - RNA, 19 nt, Homo sapiens
caaaguggaucaccuaaaa

SEQ ID NO: 1082035 - RNA, 19 nt, Homo sapiens
caacaaaguggaucaccua

SEQ ID NO: 1082036 - RNA, 19 nt, Homo sapiens
gaaagcaacacuggaugua

SEQ ID NO: 1082037 - RNA, 19 nt, Homo sapiens
acacaggcuuucacaaauu

SEQ ID NO: 1082038 - RNA, 19 nt, Homo sapiens
ugagaguucugucaaauuc

SEQ ID NO: 1082039 - RNA, 19 nt, Homo sapiens
ccucacaguugccuucuaa

SEQ ID NO: 1082040 - RNA, 19 nt, Homo sapiens
caaagcagcagcagcguuu

SEQ ID NO: 1082041 - RNA, 19 nt, Homo sapiens
auacagaggcagugaaaua

SEQ ID NO: 1082042 - RNA, 19 nt, Homo sapiens
gagguagaauugccacuau

SEQ ID NO: 1082043 - RNA, 19 nt, Homo sapiens
gaauagcucuacaagugau

SEQ ID NO: 1082044 - RNA, 19 nt, Homo sapiens
gaauaaaccacaucaaagg

SEQ ID NO: 1082045 - RNA, 19 nt, Homo sapiens
ccaguuggcuucuaagagu

SEQ ID NO: 1082046 - RNA, 19 nt, Homo sapiens
acacgguucugcaucauuu

SEQ ID NO: 1082047 - RNA, 19 nt, Homo sapiens
uaaacacgguucugcauca

SEQ ID NO: 1082048 - RNA, 19 nt, Homo sapiens
uaaaccacaucaaaggaaa

SEQ ID NO: 1082049 - RNA, 19 nt, Homo sapiens
gcagugaaauagaagaucu

SEQ ID NO: 1082050 - RNA, 19 nt, Homo sapiens
caagagaagcauugaaguu

SEQ ID NO: 1082051 - RNA, 19 nt, Homo sapiens
aagcaacacuggauguauu

SEQ ID NO: 1082052 - RNA, 19 nt, Homo sapiens
gcuccaaccuauacaacaa

SEQ ID NO: 1082053 - RNA, 19 nt, Homo sapiens
cagaggcagugaaauagaa

SEQ ID NO: 1082054 - RNA, 19 nt, Homo sapiens
gugcaagucuguguauuug

SEQ ID NO: 1082055 - RNA, 19 nt, Homo sapiens
aacaagagaugaacugguu

SEQ ID NO: 1082056 - RNA, 19 nt, Homo sapiens
gacagaugcuccaaccuau

SEQ ID NO: 1082057 - RNA, 19 nt, Homo sapiens
gcuccuaaaugcagcuauu

SEQ ID NO: 1082058 - RNA, 19 nt, Homo sapiens
ggaccacaguauuugaaug

SEQ ID NO: 1082059 - RNA, 19 nt, Homo sapiens
aagagaagcauugaaguua

SEQ ID NO: 1082060 - RNA, 19 nt, Homo sapiens
agcagaagcuccagauaaa

SEQ ID NO: 1082061 - RNA, 19 nt, Homo sapiens
gaagaaucgaggccuguaa

SEQ ID NO: 1082062 - RNA, 19 nt, Homo sapiens
gcugaaggcaucaaaguga

SEQ ID NO: 1082063 - RNA, 19 nt, Homo sapiens
gcaguugcaucaagagaag

SEQ ID NO: 1082064 - RNA, 19 nt, Homo sapiens
caaguuaaccaaugaagau

SEQ ID NO: 1082065 - RNA, 19 nt, Homo sapiens
cacaggcuuucacaaauuu

SEQ ID NO: 1082066 - RNA, 19 nt, Homo sapiens
ugacagaugcuccaaccua

SEQ ID NO: 1082067 - RNA, 19 nt, Homo sapiens
ugaaacagaagcaaccuuu

SEQ ID NO: 1082068 - RNA, 19 nt, Homo sapiens
gaagcagaagcuccagaua

SEQ ID NO: 1082069 - RNA, 19 nt, Homo sapiens
ggucggccaucaaaucaga

SEQ ID NO: 1082070 - RNA, 19 nt, Homo sapiens
gaaauccagugugaauagu

SEQ ID NO: 1082071 - RNA, 19 nt, Homo sapiens
aaagagggauaucgaguag

SEQ ID NO: 1082072 - RNA, 19 nt, Homo sapiens
cgcaggaggugucggagua

SEQ ID NO: 1082073 - RNA, 19 nt, Homo sapiens
aagcagaagcuccagauaa

SEQ ID NO: 1082074 - RNA, 19 nt, Homo sapiens
gaaauacagaggcagugaa

SEQ ID NO: 1082075 - RNA, 19 nt, Homo sapiens
agagaagcauugaaguuau

SEQ ID NO: 1082076 - RNA, 19 nt, Homo sapiens
ggugcaagucuguguauuu

SEQ ID NO: 1082077 - RNA, 19 nt, Homo sapiens
caaaagcacuuccuuagca

SEQ ID NO: 1082078 - RNA, 19 nt, Homo sapiens
gcaaguuaaccaaugaaga

SEQ ID NO: 1082079 - RNA, 19 nt, Homo sapiens
uagcaagugugucccaguu

SEQ ID NO: 1082080 - RNA, 19 nt, Homo sapiens
gauaucgaguagcaaugaa

SEQ ID NO: 1082081 - RNA, 19 nt, Homo sapiens
cacaguauuugaauguuug

SEQ ID NO: 1082082 - RNA, 19 nt, Homo sapiens
cacaguagcaguuguaaau

SEQ ID NO: 1082083 - RNA, 19 nt, Homo sapiens
ggaaauacagaggcaguga

SEQ ID NO: 1082084 - RNA, 19 nt, Homo sapiens
gcagcagcguuuccucuca

SEQ ID NO: 1082085 - RNA, 19 nt, Homo sapiens
gguagaagagccauccaaa

SEQ ID NO: 1082086 - RNA, 19 nt, Homo sapiens
ggauaucgaguagcaauga

SEQ ID NO: 1082087 - RNA, 19 nt, Homo sapiens
gaucuaguacuccuugaug

SEQ ID NO: 1082088 - RNA, 19 nt, Homo sapiens
caaagaaaaugcaaaagca

SEQ ID NO: 1082089 - RNA, 19 nt, Homo sapiens
guauuaaguugucuaccau

SEQ ID NO: 1082090 - RNA, 19 nt, Homo sapiens
gcugaaauccagugugaau

SEQ ID NO: 1082091 - RNA, 19 nt, Homo sapiens
gguucugcaucauuuguuu

SEQ ID NO: 1082092 - RNA, 19 nt, Homo sapiens
caagacagaacgugcauca

SEQ ID NO: 1082093 - RNA, 19 nt, Homo sapiens
aaacaguucugcaguugag

SEQ ID NO: 1082094 - RNA, 19 nt, Homo sapiens
guacuacuuucaauuuggu

SEQ ID NO: 1082095 - RNA, 19 nt, Homo sapiens
gguagaauugccacuauug

SEQ ID NO: 1082096 - RNA, 19 nt, Homo sapiens
guucugcaguugagcaaga

SEQ ID NO: 1082097 - RNA, 19 nt, Homo sapiens
cugaauaaaccacaucaaa

SEQ ID NO: 1082098 - RNA, 19 nt, Homo sapiens
ucacacaguagcaguugua

SEQ ID NO: 1082099 - RNA, 19 nt, Homo sapiens
aucgaggccuguaaacuua

SEQ ID NO: 1082100 - RNA, 19 nt, Homo sapiens
augaagaugugaaacagaa

SEQ ID NO: 1082101 - RNA, 19 nt, Homo sapiens
ccaaugaagaugugaaaca

SEQ ID NO: 1082102 - RNA, 19 nt, Homo sapiens
uaaaaguacuucacaguca

SEQ ID NO: 1082103 - RNA, 19 nt, Homo sapiens
caaccuauacaacaagaga

SEQ ID NO: 1082104 - RNA, 19 nt, Homo sapiens
gaagcucagagguagaauu

SEQ ID NO: 1082105 - RNA, 19 nt, Homo sapiens
uugaaagucuguaaagcuu

SEQ ID NO: 1082106 - RNA, 19 nt, Homo sapiens
cuaguucucuucacacagu

SEQ ID NO: 1082107 - RNA, 19 nt, Homo sapiens
gcaaguguuucaucaucag

SEQ ID NO: 1082108 - RNA, 19 nt, Homo sapiens
ggcaaguguuucaucauca

SEQ ID NO: 1082109 - RNA, 19 nt, Homo sapiens
uugcugaaauccaguguga

SEQ ID NO: 1082110 - RNA, 19 nt, Homo sapiens
gaccacaguauuugaaugu

SEQ ID NO: 1082111 - RNA, 19 nt, Homo sapiens
ugaauaaaccacaucaaag

SEQ ID NO: 1082112 - RNA, 19 nt, Homo sapiens
ucugguauuugaagagaaa

SEQ ID NO: 1082113 - RNA, 19 nt, Homo sapiens
gcgcuguuguuuggucuuu

SEQ ID NO: 1082114 - RNA, 19 nt, Homo sapiens
gaacugaaauuuguggauu

SEQ ID NO: 1082115 - RNA, 19 nt, Homo sapiens
agacagacuuuaaaccuua

SEQ ID NO: 1082116 - RNA, 19 nt, Homo sapiens
guacauguguuccagguuu

SEQ ID NO: 1082117 - RNA, 19 nt, Homo sapiens
caacagaccuacuccacuu

SEQ ID NO: 1082118 - RNA, 19 nt, Homo sapiens
gaugggacaugaaagaaga

SEQ ID NO: 1082119 - RNA, 19 nt, Homo sapiens
gaugccaacuuuagcaauu

SEQ ID NO: 1082120 - RNA, 19 nt, Homo sapiens
gaaagacgaagucgcuauu

SEQ ID NO: 1082121 - RNA, 19 nt, Homo sapiens
gagaagaucacaccacuca

SEQ ID NO: 1082122 - RNA, 19 nt, Homo sapiens
gagcgucuauggcgauuuc

SEQ ID NO: 1082123 - RNA, 19 nt, Homo sapiens
uguagcagaugccaacuuu

SEQ ID NO: 1082124 - RNA, 19 nt, Homo sapiens
caaauuagacucucuucug

SEQ ID NO: 1082125 - RNA, 19 nt, Homo sapiens
gggaagccauuucagacaa

SEQ ID NO: 1082126 - RNA, 19 nt, Homo sapiens
ggacaugaaagaagacaga

SEQ ID NO: 1082127 - RNA, 19 nt, Homo sapiens
ccacuuggcuacccugcaa

SEQ ID NO: 1082128 - RNA, 19 nt, Homo sapiens
ucugaccgauggagucuua

SEQ ID NO: 1082129 - RNA, 19 nt, Homo sapiens
gggcauugcuuggacuauu

SEQ ID NO: 1082130 - RNA, 19 nt, Homo sapiens
gcucgcagcuccuggaagu

SEQ ID NO: 1082131 - RNA, 19 nt, Homo sapiens
gaacaaagagaagaucaca

SEQ ID NO: 1082132 - RNA, 19 nt, Homo sapiens
gguguuagcugaccaaaau

SEQ ID NO: 1082133 - RNA, 19 nt, Homo sapiens
gcuaaugucacuugcuauu

SEQ ID NO: 1082134 - RNA, 19 nt, Homo sapiens
gaagacagacuuuaaaccu

SEQ ID NO: 1082135 - RNA, 19 nt, Homo sapiens
uggcuaaugucacuugcua

SEQ ID NO: 1082136 - RNA, 19 nt, Homo sapiens
ggaaagacgaagucgcuau

SEQ ID NO: 1082137 - RNA, 19 nt, Homo sapiens
uuauaucccugucaaacaa

SEQ ID NO: 1082138 - RNA, 19 nt, Homo sapiens
uggaagaccgcaaguauga

SEQ ID NO: 1082139 - RNA, 19 nt, Homo sapiens
ggcauugcuuggacuauug

SEQ ID NO: 1082140 - RNA, 19 nt, Homo sapiens
cagagaacccaaugacuga

SEQ ID NO: 1082141 - RNA, 19 nt, Homo sapiens
ggggaggccugcuuaagua

SEQ ID NO: 1082142 - RNA, 19 nt, Homo sapiens
ggaagccuuugaucaccuu

SEQ ID NO: 1082143 - RNA, 19 nt, Homo sapiens
ggaagcuuaugugcagaaa

SEQ ID NO: 1082144 - RNA, 19 nt, Homo sapiens
ggaccuggaccucaucuuc

SEQ ID NO: 1082145 - RNA, 19 nt, Homo sapiens
agacaagacaggagagaaa

SEQ ID NO: 1082146 - RNA, 19 nt, Homo sapiens
cuucaaagguacauguguu

SEQ ID NO: 1082147 - RNA, 19 nt, Homo sapiens
gaagccauuucagacaaga

SEQ ID NO: 1082148 - RNA, 19 nt, Homo sapiens
ggaagccauuucagacaag

SEQ ID NO: 1082149 - RNA, 19 nt, Homo sapiens
aagacgaagucgcuauuug

SEQ ID NO: 1082150 - RNA, 19 nt, Homo sapiens
gcaguuugaauucagugua

SEQ ID NO: 1082151 - RNA, 19 nt, Homo sapiens
ucacaccacucacgcucaa

SEQ ID NO: 1082152 - RNA, 19 nt, Homo sapiens
gcacagguucagccaguau

SEQ ID NO: 1082153 - RNA, 19 nt, Homo sapiens
gaagaccgcaaguaugagu

SEQ ID NO: 1082154 - RNA, 19 nt, Homo sapiens
gaaaacuggaguccuauuu

SEQ ID NO: 1082155 - RNA, 19 nt, Homo sapiens
agagaaaacuggaguccua

SEQ ID NO: 1082156 - RNA, 19 nt, Homo sapiens
guaaaugagagcacagugu

SEQ ID NO: 1082157 - RNA, 19 nt, Homo sapiens
gugagaccauuccgauuca

SEQ ID NO: 1082158 - RNA, 19 nt, Homo sapiens
ggaggcaguuugaauucag

SEQ ID NO: 1082159 - RNA, 19 nt, Homo sapiens
uagcagaugccaacuuuag

SEQ ID NO: 1082160 - RNA, 19 nt, Homo sapiens
gacagacuuuaaaccuuau

SEQ ID NO: 1082161 - RNA, 19 nt, Homo sapiens
gacccuucauggaguggua

SEQ ID NO: 1082162 - RNA, 19 nt, Homo sapiens
aaacuggaguccuauuugc

SEQ ID NO: 1082163 - RNA, 19 nt, Homo sapiens
guuaaagugugcaaugacu

SEQ ID NO: 1082164 - RNA, 19 nt, Homo sapiens
acaaggaccuggaccucau

SEQ ID NO: 1082165 - RNA, 19 nt, Homo sapiens
gcagaugccaacuuuagca

SEQ ID NO: 1082166 - RNA, 19 nt, Homo sapiens
uaauguggcuaaugucacu

SEQ ID NO: 1082167 - RNA, 19 nt, Homo sapiens
aagacagacuuuaaaccuu

SEQ ID NO: 1082168 - RNA, 19 nt, Homo sapiens
caugaaagaagacagacuu

SEQ ID NO: 1082169 - RNA, 19 nt, Homo sapiens
uuacuacauugcacagguu

SEQ ID NO: 1082170 - RNA, 19 nt, Homo sapiens
gagagcgucuauggcgauu

SEQ ID NO: 1082171 - RNA, 19 nt, Homo sapiens
gcucaaggaagcuuaugug

SEQ ID NO: 1082172 - RNA, 19 nt, Homo sapiens
ugcuaaagcuccagagaca

SEQ ID NO: 1082173 - RNA, 19 nt, Homo sapiens
cgacuucucagacauugga

SEQ ID NO: 1082174 - RNA, 19 nt, Homo sapiens
ccaggaacccagaggaaau

SEQ ID NO: 1082175 - RNA, 19 nt, Homo sapiens
ccuuugaucaccuuuguaa

SEQ ID NO: 1082176 - RNA, 19 nt, Homo sapiens
gagaacccaaugacugaga

SEQ ID NO: 1082177 - RNA, 19 nt, Homo sapiens
gaccgauggagucuuauau

SEQ ID NO: 1082178 - RNA, 19 nt, Homo sapiens
uggcuacccugcaauuaag

SEQ ID NO: 1082179 - RNA, 19 nt, Homo sapiens
gaggccugcuuaaguacug

SEQ ID NO: 1082180 - RNA, 19 nt, Homo sapiens
ggacugaccagggccaagu

SEQ ID NO: 1082181 - RNA, 19 nt, Homo sapiens
caguuugaauucaguguag

SEQ ID NO: 1082182 - RNA, 19 nt, Homo sapiens
ugaccgauggagucuuaua

SEQ ID NO: 1082183 - RNA, 19 nt, Homo sapiens
augccaacuuuagcaauua

SEQ ID NO: 1082184 - RNA, 19 nt, Homo sapiens
cuuuaaaccuuaucaccau

SEQ ID NO: 1082185 - RNA, 19 nt, Homo sapiens
gacggcauccugagugaga

SEQ ID NO: 1082186 - RNA, 19 nt, Homo sapiens
uaaguacugcaaccucuug

SEQ ID NO: 1082187 - RNA, 19 nt, Homo sapiens
uuccuaauguggcuaaugu

SEQ ID NO: 1082188 - RNA, 19 nt, Homo sapiens
uuggagagcagcagagaaa

SEQ ID NO: 1082189 - RNA, 19 nt, Homo sapiens
uagacucucuucugcucuu

SEQ ID NO: 1082190 - RNA, 19 nt, Homo sapiens
ggaacugaaauuuguggau

SEQ ID NO: 1082191 - RNA, 19 nt, Homo sapiens
ugguuaaagugugcaauga

SEQ ID NO: 1082192 - RNA, 19 nt, Homo sapiens
gauuggaagaccgcaagua

SEQ ID NO: 1082193 - RNA, 19 nt, Homo sapiens
agucuuauaucccugucaa

SEQ ID NO: 1082194 - RNA, 19 nt, Homo sapiens
caucgacuucucagacauu

SEQ ID NO: 1082195 - RNA, 19 nt, Homo sapiens
gaggcaguuugaauucagu

SEQ ID NO: 1082196 - RNA, 19 nt, Homo sapiens
acccugcaauuaagaauca

SEQ ID NO: 1082197 - RNA, 19 nt, Homo sapiens
ccaacuuuagcaauuacua

SEQ ID NO: 1082198 - RNA, 19 nt, Homo sapiens
guagcagaugccaacuuua

SEQ ID NO: 1082199 - RNA, 19 nt, Homo sapiens
cagcaagagccgccaguuc

SEQ ID NO: 1082200 - RNA, 19 nt, Homo sapiens
ccugaugggacaugaaaga

SEQ ID NO: 1082201 - RNA, 19 nt, Homo sapiens
gagugagaccauuccgauu

SEQ ID NO: 1082202 - RNA, 19 nt, Homo sapiens
ccaggaagccuuugaucac

SEQ ID NO: 1082203 - RNA, 19 nt, Homo sapiens
aaagacgaagucgcuauuu

SEQ ID NO: 1082204 - RNA, 19 nt, Homo sapiens
aagcuuaugugcagaaaau

SEQ ID NO: 1082205 - RNA, 19 nt, Homo sapiens
uggacggcauccugaguga

SEQ ID NO: 1082206 - RNA, 19 nt, Homo sapiens
gucgcuauuugcugucuga

SEQ ID NO: 1082207 - RNA, 19 nt, Homo sapiens
caacuuuagcaauuacuac

SEQ ID NO: 1082208 - RNA, 19 nt, Homo sapiens
gcagcaagagccgccaguu

SEQ ID NO: 1082209 - RNA, 19 nt, Homo sapiens
gcucgcugcgcuccuagaa

SEQ ID NO: 1082210 - RNA, 19 nt, Homo sapiens
ggaguccuauuugcagaac

SEQ ID NO: 1082211 - RNA, 19 nt, Homo sapiens
cauccugagugagaccauu

SEQ ID NO: 1082212 - RNA, 19 nt, Homo sapiens
cggaggcaguuugaauuca

SEQ ID NO: 1082213 - RNA, 19 nt, Homo sapiens
auguggaacugaaauuugu

SEQ ID NO: 1082214 - RNA, 19 nt, Homo sapiens
uaacagagcacacuaauaa

SEQ ID NO: 1082215 - RNA, 19 nt, Homo sapiens
ggaagaagcuggaacacuu

SEQ ID NO: 1082216 - RNA, 19 nt, Homo sapiens
uaacagagauagagcguuu

SEQ ID NO: 1082217 - RNA, 19 nt, Homo sapiens
gaagaacccuccucaccaa

SEQ ID NO: 1082218 - RNA, 19 nt, Homo sapiens
caacaagaauccuuagaga

SEQ ID NO: 1082219 - RNA, 19 nt, Homo sapiens
ugaaauaacuggacacaca

SEQ ID NO: 1082220 - RNA, 19 nt, Homo sapiens
ggaugaagguguagaugaa

SEQ ID NO: 1082221 - RNA, 19 nt, Homo sapiens
ggucugugcugccaacaua

SEQ ID NO: 1082222 - RNA, 19 nt, Homo sapiens
ggaguuugaucuagauaaa

SEQ ID NO: 1082223 - RNA, 19 nt, Homo sapiens
gagaguggaugaaggugua

SEQ ID NO: 1082224 - RNA, 19 nt, Homo sapiens
gcaagacccuuccucaaca

SEQ ID NO: 1082225 - RNA, 19 nt, Homo sapiens
aagcggagcucgggauuua

SEQ ID NO: 1082226 - RNA, 19 nt, Homo sapiens
uaaacuggcugaccauuuc

SEQ ID NO: 1082227 - RNA, 19 nt, Homo sapiens
guaguggcuuucucaauuu

SEQ ID NO: 1082228 - RNA, 19 nt, Homo sapiens
gaaauggaguuugaucuag

SEQ ID NO: 1082229 - RNA, 19 nt, Homo sapiens
gagcacagcuaagaacaga

SEQ ID NO: 1082230 - RNA, 19 nt, Homo sapiens
gcacaggacucaauauagc

SEQ ID NO: 1082231 - RNA, 19 nt, Homo sapiens
ggaaugagguuuuaugaau

SEQ ID NO: 1082232 - RNA, 19 nt, Homo sapiens
caacauagucucacaagau

SEQ ID NO: 1082233 - RNA, 19 nt, Homo sapiens
gagaaucuuugucccaaug

SEQ ID NO: 1082234 - RNA, 19 nt, Homo sapiens
acagauccauuucuuggua

SEQ ID NO: 1082235 - RNA, 19 nt, Homo sapiens
gaagaagcuggaacacuuu

SEQ ID NO: 1082236 - RNA, 19 nt, Homo sapiens
aagcaacgguccuccagua

SEQ ID NO: 1082237 - RNA, 19 nt, Homo sapiens
gugcccagauuaauguaua

SEQ ID NO: 1082238 - RNA, 19 nt, Homo sapiens
aguaguggcuuucucaauu

SEQ ID NO: 1082239 - RNA, 19 nt, Homo sapiens
gcacauuuguuuggucuuc

SEQ ID NO: 1082240 - RNA, 19 nt, Homo sapiens
caacgguccuccaguaaag

SEQ ID NO: 1082241 - RNA, 19 nt, Homo sapiens
cagagcacacuaauaauuu

SEQ ID NO: 1082242 - RNA, 19 nt, Homo sapiens
gaacggauagaggagauaa

SEQ ID NO: 1082243 - RNA, 19 nt, Homo sapiens
gaagagguaccaauucaca

SEQ ID NO: 1082244 - RNA, 19 nt, Homo sapiens
guuaaacguuccaucauca

SEQ ID NO: 1082245 - RNA, 19 nt, Homo sapiens
guuccugucugauagaauu

SEQ ID NO: 1082246 - RNA, 19 nt, Homo sapiens
caagaaauggucaacaaga

SEQ ID NO: 1082247 - RNA, 19 nt, Homo sapiens
gaaccaagggcaacaucuu

SEQ ID NO: 1082248 - RNA, 19 nt, Homo sapiens
uuacaagaguaguagauga

SEQ ID NO: 1082249 - RNA, 19 nt, Homo sapiens
ggagcagucuggaauugau

SEQ ID NO: 1082250 - RNA, 19 nt, Homo sapiens
caucaaggcagcaaaucua

SEQ ID NO: 1082251 - RNA, 19 nt, Homo sapiens
uggcaauucugaacggaua

SEQ ID NO: 1082252 - RNA, 19 nt, Homo sapiens
gcucgggauuuaucucuga

SEQ ID NO: 1082253 - RNA, 19 nt, Homo sapiens
ccacguaccuuuguuaaaa

SEQ ID NO: 1082254 - RNA, 19 nt, Homo sapiens
ccaggaguaucaagaacaa

SEQ ID NO: 1082255 - RNA, 19 nt, Homo sapiens
ugaaauggaguuugaucua

SEQ ID NO: 1082256 - RNA, 19 nt, Homo sapiens
gcaacgguccuccaguaaa

SEQ ID NO: 1082257 - RNA, 19 nt, Homo sapiens
gaacggagugacagcaaga

SEQ ID NO: 1082258 - RNA, 19 nt, Homo sapiens
ccaagaaggugaccaaaau

SEQ ID NO: 1082259 - RNA, 19 nt, Homo sapiens
agagagagauggccagagu

SEQ ID NO: 1082260 - RNA, 19 nt, Homo sapiens
uggaagagguaccaauuca

SEQ ID NO: 1082261 - RNA, 19 nt, Homo sapiens
gaagaucuggauaccugua

SEQ ID NO: 1082262 - RNA, 19 nt, Homo sapiens
uggaugcacucucacauug

SEQ ID NO: 1082263 - RNA, 19 nt, Homo sapiens
ggacucaauauagcaauuu

SEQ ID NO: 1082264 - RNA, 19 nt, Homo sapiens
acagagcacacuaauaauu

SEQ ID NO: 1082265 - RNA, 19 nt, Homo sapiens
ggacacacacucacacaag

SEQ ID NO: 1082266 - RNA, 19 nt, Homo sapiens
caaggcagcaaaucuaaug

SEQ ID NO: 1082267 - RNA, 19 nt, Homo sapiens
caacgaucuugaugacaga

SEQ ID NO: 1082268 - RNA, 19 nt, Homo sapiens
gacccuuccucaacaagaa

SEQ ID NO: 1082269 - RNA, 19 nt, Homo sapiens
guucuucucugggugcuuu

SEQ ID NO: 1082270 - RNA, 19 nt, Homo sapiens
gaaaguugcccuucuucca

SEQ ID NO: 1082271 - RNA, 19 nt, Homo sapiens
ucucugaguugcccucuga

SEQ ID NO: 1082272 - RNA, 19 nt, Homo sapiens
aaauggaguuugaucuaga

SEQ ID NO: 1082273 - RNA, 19 nt, Homo sapiens
gauagagcguuuggaagau

SEQ ID NO: 1082274 - RNA, 19 nt, Homo sapiens
gaaggccuuuaauuucugu

SEQ ID NO: 1082275 - RNA, 19 nt, Homo sapiens
caugggcccuacuugaauu

SEQ ID NO: 1082276 - RNA, 19 nt, Homo sapiens
aaugaaagccagcaauuau

SEQ ID NO: 1082277 - RNA, 19 nt, Homo sapiens
uccaagaaauggucaacaa

SEQ ID NO: 1082278 - RNA, 19 nt, Homo sapiens
caagacccuuccucaacaa

SEQ ID NO: 1082279 - RNA, 19 nt, Homo sapiens
caucaacgagcacagcuaa

SEQ ID NO: 1082280 - RNA, 19 nt, Homo sapiens
gcacaauggcaauucugaa

SEQ ID NO: 1082281 - RNA, 19 nt, Homo sapiens
uaguggcuuucucaauuua

SEQ ID NO: 1082282 - RNA, 19 nt, Homo sapiens
cgaaugcugcggccuguuu

SEQ ID NO: 1082283 - RNA, 19 nt, Homo sapiens
acaagaauccuuagagauc

SEQ ID NO: 1082284 - RNA, 19 nt, Homo sapiens
ccgcacaggacucaauaua

SEQ ID NO: 1082285 - RNA, 19 nt, Homo sapiens
ccuccaacccuuugcauuu

SEQ ID NO: 1082286 - RNA, 19 nt, Homo sapiens
gugcuuuauucucuucuuu

SEQ ID NO: 1082287 - RNA, 19 nt, Homo sapiens
ccaucuagcccgaaaguug

SEQ ID NO: 1082288 - RNA, 19 nt, Homo sapiens
uaccaaagcagaacccaaa

SEQ ID NO: 1082289 - RNA, 19 nt, Homo sapiens
cuaaaggcguugcuugagu

SEQ ID NO: 1082290 - RNA, 19 nt, Homo sapiens
gcuggaagagguaccaauu

SEQ ID NO: 1082291 - RNA, 19 nt, Homo sapiens
gcugaggagaggccaguua

SEQ ID NO: 1082292 - RNA, 19 nt, Homo sapiens
caacgagcacagcuaagaa

SEQ ID NO: 1082293 - RNA, 19 nt, Homo sapiens
uaaguguaccugugucaaa

SEQ ID NO: 1082294 - RNA, 19 nt, Homo sapiens
gacacacacucacacaagu

SEQ ID NO: 1082295 - RNA, 19 nt, Homo sapiens
ugaacagaauggucucaug

SEQ ID NO: 1082296 - RNA, 19 nt, Homo sapiens
acaagauggugaacagaau

SEQ ID NO: 1082297 - RNA, 19 nt, Homo sapiens
gcacagcuaagaacagagu

SEQ ID NO: 1082298 - RNA, 19 nt, Homo sapiens
agagcacacuaauaauuug

SEQ ID NO: 1082299 - RNA, 19 nt, Homo sapiens
cagauccauuucuugguaa

SEQ ID NO: 1082300 - RNA, 19 nt, Homo sapiens
caggaaguuucaaggagaa

SEQ ID NO: 1082301 - RNA, 19 nt, Homo sapiens
gagcagucuggaauugaua

SEQ ID NO: 1082302 - RNA, 19 nt, Homo sapiens
ggaauugauauccuuaaca

SEQ ID NO: 1082303 - RNA, 19 nt, Homo sapiens
gaguauccauagccgaaug

SEQ ID NO: 1082304 - RNA, 19 nt, Homo sapiens
uggaggagcuaacagagau

SEQ ID NO: 1082305 - RNA, 19 nt, Homo sapiens
ccaguuaaacguuccauca

SEQ ID NO: 1082306 - RNA, 19 nt, Homo sapiens
cugauagaauuguggauga

SEQ ID NO: 1082307 - RNA, 19 nt, Homo sapiens
caagaguaguagaugaaca

SEQ ID NO: 1082308 - RNA, 19 nt, Homo sapiens
guauagaaacagauccauu

SEQ ID NO: 1082309 - RNA, 19 nt, Homo sapiens
ucaaaucccgguccaaauc

SEQ ID NO: 1082310 - RNA, 19 nt, Homo sapiens
aacauagucucacaagaug

SEQ ID NO: 1082311 - RNA, 19 nt, Homo sapiens
agauagagcguuuggaaga

SEQ ID NO: 1082312 - RNA, 19 nt, Homo sapiens
gguugaugcugcugagaau

SEQ ID NO: 1082313 - RNA, 19 nt, Homo sapiens
uauuagaucuuggguaugg

SEQ ID NO: 1082314 - RNA, 19 nt, Homo sapiens
ggaaagaaguggaaagaaa

SEQ ID NO: 1082315 - RNA, 19 nt, Homo sapiens
gcaauagaaugcacucuua

SEQ ID NO: 1082316 - RNA, 19 nt, Homo sapiens
ggaacuguguguugaauaa

SEQ ID NO: 1082317 - RNA, 19 nt, Homo sapiens
gagaacagcuccugcaguu

SEQ ID NO: 1082318 - RNA, 19 nt, Homo sapiens
gcaguuggauggaaauaaa

SEQ ID NO: 1082319 - RNA, 19 nt, Homo sapiens
gcagguuucucacugguua

SEQ ID NO: 1082320 - RNA, 19 nt, Homo sapiens
gggagacacuucacuguuu

SEQ ID NO: 1082321 - RNA, 19 nt, Homo sapiens
ccaaauuacuuccaccuaa

SEQ ID NO: 1082322 - RNA, 19 nt, Homo sapiens
cagaugagauccuugauga

SEQ ID NO: 1082323 - RNA, 19 nt, Homo sapiens
gcucagaccuccacucguu

SEQ ID NO: 1082324 - RNA, 19 nt, Homo sapiens
gaucugagaccaguacuua

SEQ ID NO: 1082325 - RNA, 19 nt, Homo sapiens
gaaaggagcaagagcaaau

SEQ ID NO: 1082326 - RNA, 19 nt, Homo sapiens
gaccaguacuuaacuucua

SEQ ID NO: 1082327 - RNA, 19 nt, Homo sapiens
gccuaaaucuggagcagua

SEQ ID NO: 1082328 - RNA, 19 nt, Homo sapiens
gaaaugaagaugucucuag

SEQ ID NO: 1082329 - RNA, 19 nt, Homo sapiens
gauuugcucuuaauucuca

SEQ ID NO: 1082330 - RNA, 19 nt, Homo sapiens
ccagagauuucauuuaagu

SEQ ID NO: 1082331 - RNA, 19 nt, Homo sapiens
ggaggacagucuagagaga

SEQ ID NO: 1082332 - RNA, 19 nt, Homo sapiens
ccacaugcauauuaccaaa

SEQ ID NO: 1082333 - RNA, 19 nt, Homo sapiens
gcgcucugcucuguaguua

SEQ ID NO: 1082334 - RNA, 19 nt, Homo sapiens
gagaaaagcuaaggagaaa

SEQ ID NO: 1082335 - RNA, 19 nt, Homo sapiens
acacauacccucuuacaga

SEQ ID NO: 1082336 - RNA, 19 nt, Homo sapiens
agaaagccaucaaacaguu

SEQ ID NO: 1082337 - RNA, 19 nt, Homo sapiens
aaacaucacuggagaacag

SEQ ID NO: 1082338 - RNA, 19 nt, Homo sapiens
ugccaaagaucccaaauca

SEQ ID NO: 1082339 - RNA, 19 nt, Homo sapiens
gaaaagaugacgucaacua

SEQ ID NO: 1082340 - RNA, 19 nt, Homo sapiens
aaaugaagaugucucuaga

SEQ ID NO: 1082341 - RNA, 19 nt, Homo sapiens
gcagguagcaggaucuuca

SEQ ID NO: 1082342 - RNA, 19 nt, Homo sapiens
caaauuacuuccaccuaag

SEQ ID NO: 1082343 - RNA, 19 nt, Homo sapiens
aguaacacauacccucuua

SEQ ID NO: 1082344 - RNA, 19 nt, Homo sapiens
gagagaaagccaucaaaca

SEQ ID NO: 1082345 - RNA, 19 nt, Homo sapiens
gaugagauccuugaugaug

SEQ ID NO: 1082346 - RNA, 19 nt, Homo sapiens
uaacaaaccagagauuuca

SEQ ID NO: 1082347 - RNA, 19 nt, Homo sapiens
ucaaggaaaugaagauguc

SEQ ID NO: 1082348 - RNA, 19 nt, Homo sapiens
ggauggaaauaaacuuaag

SEQ ID NO: 1082349 - RNA, 19 nt, Homo sapiens
gcgaaggaauuccaacaag

SEQ ID NO: 1082350 - RNA, 19 nt, Homo sapiens
gggccucucuccucuaugu

SEQ ID NO: 1082351 - RNA, 19 nt, Homo sapiens
ggagcaguauguaucugaa

SEQ ID NO: 1082352 - RNA, 19 nt, Homo sapiens
ccaaagaucccaaaucacu

SEQ ID NO: 1082353 - RNA, 19 nt, Homo sapiens
gagacucuaauuucagaua

SEQ ID NO: 1082354 - RNA, 19 nt, Homo sapiens
caaaccagagauuucauuu

SEQ ID NO: 1082355 - RNA, 19 nt, Homo sapiens
cauacccucuuacagauga

SEQ ID NO: 1082356 - RNA, 19 nt, Homo sapiens
gaaagaaguggaaagaaaa

SEQ ID NO: 1082357 - RNA, 19 nt, Homo sapiens
aaagaucccaaaucacuaa

SEQ ID NO: 1082358 - RNA, 19 nt, Homo sapiens
gaggaacuguguguugaau

SEQ ID NO: 1082359 - RNA, 19 nt, Homo sapiens
ccaaaccaccaacaagaaa

SEQ ID NO: 1082360 - RNA, 19 nt, Homo sapiens
gagaaaggagcaagagcaa

SEQ ID NO: 1082361 - RNA, 19 nt, Homo sapiens
gagaaagccaucaaacagu

SEQ ID NO: 1082362 - RNA, 19 nt, Homo sapiens
guuucucacugguuaauga

SEQ ID NO: 1082363 - RNA, 19 nt, Homo sapiens
cuucucgucugaccacaua

SEQ ID NO: 1082364 - RNA, 19 nt, Homo sapiens
caauagaaugcacucuuaa

SEQ ID NO: 1082365 - RNA, 19 nt, Homo sapiens
caaagaucccaaaucacua

SEQ ID NO: 1082366 - RNA, 19 nt, Homo sapiens
uaacacauacccucuuaca

SEQ ID NO: 1082367 - RNA, 19 nt, Homo sapiens
gcucuucucuaacuuacca

SEQ ID NO: 1082368 - RNA, 19 nt, Homo sapiens
gaaccugccugcgccuaca

SEQ ID NO: 1082369 - RNA, 19 nt, Homo sapiens
aaacuuaaggcucuuggaa

SEQ ID NO: 1082370 - RNA, 19 nt, Homo sapiens
aaauuaagcggaaguuugu

SEQ ID NO: 1082371 - RNA, 19 nt, Homo sapiens
ucacuaagggcauccaguu

SEQ ID NO: 1082372 - RNA, 19 nt, Homo sapiens
ggagacacuucacuguuuu

SEQ ID NO: 1082373 - RNA, 19 nt, Homo sapiens
gaaauggcaauugcacaug

SEQ ID NO: 1082374 - RNA, 19 nt, Homo sapiens
cacauacccucuuacagau

SEQ ID NO: 1082375 - RNA, 19 nt, Homo sapiens
gagcaaaugcagaggaagu

SEQ ID NO: 1082376 - RNA, 19 nt, Homo sapiens
ccuuagcacugucaucaga

SEQ ID NO: 1082377 - RNA, 19 nt, Homo sapiens
cuucaaagucugaucauga

SEQ ID NO: 1082378 - RNA, 19 nt, Homo sapiens
uaacuuaccaacaucuugu

SEQ ID NO: 1082379 - RNA, 19 nt, Homo sapiens
caaagucugaucaugaugu

SEQ ID NO: 1082380 - RNA, 19 nt, Homo sapiens
caaugugugggaaagauuu

SEQ ID NO: 1082381 - RNA, 19 nt, Homo sapiens
gcugaggaacuguguguug

SEQ ID NO: 1082382 - RNA, 19 nt, Homo sapiens
gaaacucaaggaaaugaag

SEQ ID NO: 1082383 - RNA, 19 nt, Homo sapiens
acuuaaggcucuuggaaug

SEQ ID NO: 1082384 - RNA, 19 nt, Homo sapiens
caccaaaccaccaacaaga

SEQ ID NO: 1082385 - RNA, 19 nt, Homo sapiens
caccuuugguucauuaaca

SEQ ID NO: 1082386 - RNA, 19 nt, Homo sapiens
aagagcaaaugcagaggaa

SEQ ID NO: 1082387 - RNA, 19 nt, Homo sapiens
ugagauccuugaugaugga

SEQ ID NO: 1082388 - RNA, 19 nt, Homo sapiens
caacaccuacuccaaugug

SEQ ID NO: 1082389 - RNA, 19 nt, Homo sapiens
aaauggcaauugcacaugu

SEQ ID NO: 1082390 - RNA, 19 nt, Homo sapiens
ucuauaaccacaugcauau

SEQ ID NO: 1082391 - RNA, 19 nt, Homo sapiens
ucggaaggcccaagagaaa

SEQ ID NO: 1082392 - RNA, 19 nt, Homo sapiens
cugaggaacuguguguuga

SEQ ID NO: 1082393 - RNA, 19 nt, Homo sapiens
gcaguauguaucugaauuc

SEQ ID NO: 1082394 - RNA, 19 nt, Homo sapiens
uaccuucaaugaugacuuc

SEQ ID NO: 1082395 - RNA, 19 nt, Homo sapiens
ggacacccaagccauguuc

SEQ ID NO: 1082396 - RNA, 19 nt, Homo sapiens
aaaagaagccaguagguuu

SEQ ID NO: 1082397 - RNA, 19 nt, Homo sapiens
ugagaccaguacuuaacuu

SEQ ID NO: 1082398 - RNA, 19 nt, Homo sapiens
uaauggagcgccgugaauu

SEQ ID NO: 1082399 - RNA, 19 nt, Homo sapiens
ucauuuaaguagcuguguu

SEQ ID NO: 1082400 - RNA, 19 nt, Homo sapiens
ggugagcaguaacacauac

SEQ ID NO: 1082401 - RNA, 19 nt, Homo sapiens
gauggacagucucccaaac

SEQ ID NO: 1082402 - RNA, 19 nt, Homo sapiens
caugggcgcucugcucugu

SEQ ID NO: 1082403 - RNA, 19 nt, Homo sapiens
agugugggauccugaaaug

SEQ ID NO: 1082404 - RNA, 19 nt, Homo sapiens
cauuuaaguagcuguguuu

SEQ ID NO: 1082405 - RNA, 19 nt, Homo sapiens
gcccugccaugagaucuga

SEQ ID NO: 1082406 - RNA, 19 nt, Homo sapiens
agccaccuuugguucauua

SEQ ID NO: 1082407 - RNA, 19 nt, Homo sapiens
ggaaaugaagaugucucua

SEQ ID NO: 1082408 - RNA, 19 nt, Homo sapiens
ggaaaaggcaagcaaguca

SEQ ID NO: 1082409 - RNA, 19 nt, Homo sapiens
ugcaacaccuacuccaaug

SEQ ID NO: 1082410 - RNA, 19 nt, Homo sapiens
agagaaagccaucaaacag

SEQ ID NO: 1082411 - RNA, 19 nt, Homo sapiens
ccaccuaaggguuugagaa

SEQ ID NO: 1082412 - RNA, 19 nt, Homo sapiens
aguguuaguuccacagaug

SEQ ID NO: 1082413 - RNA, 19 nt, Homo sapiens
agcaguauguaucugaauu

SEQ ID NO: 1082414 - RNA, 19 nt, Homo sapiens
gaacgaaugucacaacuug

SEQ ID NO: 1082415 - RNA, 19 nt, Homo sapiens
gaaauuagcuuuugucuag

SEQ ID NO: 1082416 - RNA, 19 nt, Homo sapiens
gaacaaaucgaaagagaug

SEQ ID NO: 1082417 - RNA, 19 nt, Homo sapiens
aaagaaagcuagaacugaa

SEQ ID NO: 1082418 - RNA, 19 nt, Homo sapiens
gagaagacccugagagcua

SEQ ID NO: 1082419 - RNA, 19 nt, Homo sapiens
gggauaaccuguacuaugg

SEQ ID NO: 1082420 - RNA, 19 nt, Homo sapiens
gacaggaacuaacggaauu

SEQ ID NO: 1082421 - RNA, 19 nt, Homo sapiens
gcgcuagucucguuccuuu

SEQ ID NO: 1082422 - RNA, 19 nt, Homo sapiens
cuauaacaauggcaucuua

SEQ ID NO: 1082423 - RNA, 19 nt, Homo sapiens
gcguuuggauuuauuguuu

SEQ ID NO: 1082424 - RNA, 19 nt, Homo sapiens
ucagaagacuuuggaguaa

SEQ ID NO: 1082425 - RNA, 19 nt, Homo sapiens
aaagauuucugcagugauu

SEQ ID NO: 1082426 - RNA, 19 nt, Homo sapiens
gaaagcaucccagaacuga

SEQ ID NO: 1082427 - RNA, 19 nt, Homo sapiens
gggaacaaaucgaaagaga

SEQ ID NO: 1082428 - RNA, 19 nt, Homo sapiens
uuaauacugucaccagaua

SEQ ID NO: 1082429 - RNA, 19 nt, Homo sapiens
acacaguggucccuccuua

SEQ ID NO: 1082430 - RNA, 19 nt, Homo sapiens
gcucaaagcuuggauucug

SEQ ID NO: 1082431 - RNA, 19 nt, Homo sapiens
agaagacgaugcugacaaa

SEQ ID NO: 1082432 - RNA, 19 nt, Homo sapiens
cagaauguauuuccuaauc

SEQ ID NO: 1082433 - RNA, 19 nt, Homo sapiens
guacagccuuacaaagauu

SEQ ID NO: 1082434 - RNA, 19 nt, Homo sapiens
ggaggacucagaagacuuu

SEQ ID NO: 1082435 - RNA, 19 nt, Homo sapiens
caaugaagcuuugcagauc

SEQ ID NO: 1082436 - RNA, 19 nt, Homo sapiens
ggaauuagcaguggauuag

SEQ ID NO: 1082437 - RNA, 19 nt, Homo sapiens
guucuaagaguguuacuaa

SEQ ID NO: 1082438 - RNA, 19 nt, Homo sapiens
ggacugaggagccagagaa

SEQ ID NO: 1082439 - RNA, 19 nt, Homo sapiens
gcacguugauagggaguuu

SEQ ID NO: 1082440 - RNA, 19 nt, Homo sapiens
caucugaaccauuucuaua

SEQ ID NO: 1082441 - RNA, 19 nt, Homo sapiens
gcacaugggcaucauuuua

SEQ ID NO: 1082442 - RNA, 19 nt, Homo sapiens
acaaaccaguguucuaaga

SEQ ID NO: 1082443 - RNA, 19 nt, Homo sapiens
gcagugauuugugugaaga

SEQ ID NO: 1082444 - RNA, 19 nt, Homo sapiens
gcagcaacuugaacgaaug

SEQ ID NO: 1082445 - RNA, 19 nt, Homo sapiens
ggccagugcuugacaggaa

SEQ ID NO: 1082446 - RNA, 19 nt, Homo sapiens
gauagggaguuugcuguug

SEQ ID NO: 1082447 - RNA, 19 nt, Homo sapiens
gguacagccuuacaaagau

SEQ ID NO: 1082448 - RNA, 19 nt, Homo sapiens
ccugguaauuuaucucuuu

SEQ ID NO: 1082449 - RNA, 19 nt, Homo sapiens
gagcuaacccugaguugug

SEQ ID NO: 1082450 - RNA, 19 nt, Homo sapiens
acaaagauuucugcaguga

SEQ ID NO: 1082451 - RNA, 19 nt, Homo sapiens
caagcaggagccaacauua

SEQ ID NO: 1082452 - RNA, 19 nt, Homo sapiens
uaaagaaagcuagaacuga

SEQ ID NO: 1082453 - RNA, 19 nt, Homo sapiens
caaaugaacaaaccagugu

SEQ ID NO: 1082454 - RNA, 19 nt, Homo sapiens
ugacggaacacagcuauuu

SEQ ID NO: 1082455 - RNA, 19 nt, Homo sapiens
guaaagaaagcuagaacug

SEQ ID NO: 1082456 - RNA, 19 nt, Homo sapiens
ucuugaaccuccagaauug

SEQ ID NO: 1082457 - RNA, 19 nt, Homo sapiens
cacuauguauauccaguua

SEQ ID NO: 1082458 - RNA, 19 nt, Homo sapiens
agaagacccugagagcuaa

SEQ ID NO: 1082459 - RNA, 19 nt, Homo sapiens
acacagcuauuucccuaug

SEQ ID NO: 1082460 - RNA, 19 nt, Homo sapiens
cagaagacuuuggaguaaa

SEQ ID NO: 1082461 - RNA, 19 nt, Homo sapiens
cagcagacauugcacaaac

SEQ ID NO: 1082462 - RNA, 19 nt, Homo sapiens
uagaaacugucaggucaaa

SEQ ID NO: 1082463 - RNA, 19 nt, Homo sapiens
ggacucagaagacuuugga

SEQ ID NO: 1082464 - RNA, 19 nt, Homo sapiens
acaauggcaucuuaaaugg

SEQ ID NO: 1082465 - RNA, 19 nt, Homo sapiens
uuaacugacuguugacaug

SEQ ID NO: 1082466 - RNA, 19 nt, Homo sapiens
gcgguucucugcaccugaa

SEQ ID NO: 1082467 - RNA, 19 nt, Homo sapiens
ccaggguucucucugcauu

SEQ ID NO: 1082468 - RNA, 19 nt, Homo sapiens
gguuauacucugcaaauau

SEQ ID NO: 1082469 - RNA, 19 nt, Homo sapiens
cagauuccuuuauauguag

SEQ ID NO: 1082470 - RNA, 19 nt, Homo sapiens
gccuugggcuucauggaaa

SEQ ID NO: 1082471 - RNA, 19 nt, Homo sapiens
gguaauuuaucucuuugca

SEQ ID NO: 1082472 - RNA, 19 nt, Homo sapiens
gcaccacggcuccuagaga

SEQ ID NO: 1082473 - RNA, 19 nt, Homo sapiens
aguggucccuccuuaauga

SEQ ID NO: 1082474 - RNA, 19 nt, Homo sapiens
caccagauauugccauuuu

SEQ ID NO: 1082475 - RNA, 19 nt, Homo sapiens
gggcugcguuuggauuuau

SEQ ID NO: 1082476 - RNA, 19 nt, Homo sapiens
ccauguagcagcaacuuga

SEQ ID NO: 1082477 - RNA, 19 nt, Homo sapiens
caucagaauguauuuccua

SEQ ID NO: 1082478 - RNA, 19 nt, Homo sapiens
gcagacgccagcccacauu

SEQ ID NO: 1082479 - RNA, 19 nt, Homo sapiens
ggucccuccuuaaugauga

SEQ ID NO: 1082480 - RNA, 19 nt, Homo sapiens
ggaacaaaucgaaagagau

SEQ ID NO: 1082481 - RNA, 19 nt, Homo sapiens
auugucaucugaaccauuu

SEQ ID NO: 1082482 - RNA, 19 nt, Homo sapiens
gcagauaaaaugucaaaug

SEQ ID NO: 1082483 - RNA, 19 nt, Homo sapiens
gugaagaagagaauguuug

SEQ ID NO: 1082484 - RNA, 19 nt, Homo sapiens
aagcaggagccaacauuaa

SEQ ID NO: 1082485 - RNA, 19 nt, Homo sapiens
caaguuggagugcuuagug

SEQ ID NO: 1082486 - RNA, 19 nt, Homo sapiens
gagccaacauuaacaaacc

SEQ ID NO: 1082487 - RNA, 19 nt, Homo sapiens
aacaauggcaucuuaaaug

SEQ ID NO: 1082488 - RNA, 19 nt, Homo sapiens
ccaagagugugcccagucu

SEQ ID NO: 1082489 - RNA, 19 nt, Homo sapiens
aaaccaguguucuaagagu

SEQ ID NO: 1082490 - RNA, 19 nt, Homo sapiens
ugacuguugacauguauuu

SEQ ID NO: 1082491 - RNA, 19 nt, Homo sapiens
cauguaacagauuccuuua

SEQ ID NO: 1082492 - RNA, 19 nt, Homo sapiens
gcuuguuugugcaugagua

SEQ ID NO: 1082493 - RNA, 19 nt, Homo sapiens
ucaaugaagcuuugcagau

SEQ ID NO: 1082494 - RNA, 19 nt, Homo sapiens
ugaagaagagaauguuugu

SEQ ID NO: 1082495 - RNA, 19 nt, Homo sapiens
ugaccuggcucucggaaac

SEQ ID NO: 1082496 - RNA, 19 nt, Homo sapiens
gguucucucugcauuagug

SEQ ID NO: 1082497 - RNA, 19 nt, Homo sapiens
ucaagcaggagccaacauu

SEQ ID NO: 1082498 - RNA, 19 nt, Homo sapiens
gcugaaagcaucccagaac

SEQ ID NO: 1082499 - RNA, 19 nt, Homo sapiens
uagggaguuugcuguugua

SEQ ID NO: 1082500 - RNA, 19 nt, Homo sapiens
acauguaacagauuccuuu

SEQ ID NO: 1082501 - RNA, 19 nt, Homo sapiens
cuaagugcauagauguuuc

SEQ ID NO: 1082502 - RNA, 19 nt, Homo sapiens
gaguccaaguagcugcaua

SEQ ID NO: 1082503 - RNA, 19 nt, Homo sapiens
ggaguaaagaaagcuagaa

SEQ ID NO: 1082504 - RNA, 19 nt, Homo sapiens
gcaggagccaacauuaaca

SEQ ID NO: 1082505 - RNA, 19 nt, Homo sapiens
gcaacuagugguuauacuc

SEQ ID NO: 1082506 - RNA, 19 nt, Homo sapiens
ccugacagcagcagacauu

SEQ ID NO: 1082507 - RNA, 19 nt, Homo sapiens
uaccacauguaacagauuc

SEQ ID NO: 1082508 - RNA, 19 nt, Homo sapiens
ugaugccaaucucaacauu

SEQ ID NO: 1082509 - RNA, 19 nt, Homo sapiens
gcuagucucguuccuuugu

SEQ ID NO: 1082510 - RNA, 19 nt, Homo sapiens
gcaggaauggccagugcuu

SEQ ID NO: 1082511 - RNA, 19 nt, Homo sapiens
gagccuagaaugcaucagu

SEQ ID NO: 1082512 - RNA, 19 nt, Homo sapiens
gcaacuugaacgaauguca

SEQ ID NO: 1082513 - RNA, 19 nt, Homo sapiens
cggaauuagcaguggauua

SEQ ID NO: 1082514 - RNA, 19 nt, Homo sapiens
ggagaaagcugaacauaag

SEQ ID NO: 1082515 - RNA, 19 nt, Homo sapiens
gacacuagcucucauuauu

SEQ ID NO: 1082516 - RNA, 19 nt, Homo sapiens
agaaagagccaaagacuua

SEQ ID NO: 1082517 - RNA, 19 nt, Homo sapiens
ggagagauaucaaguucaa

SEQ ID NO: 1082518 - RNA, 19 nt, Homo sapiens
gcagaacucuuuauggaau

SEQ ID NO: 1082519 - RNA, 19 nt, Homo sapiens
gaaauuugcugauguccau

SEQ ID NO: 1082520 - RNA, 19 nt, Homo sapiens
ccauaaaccuggugaaaug

SEQ ID NO: 1082521 - RNA, 19 nt, Homo sapiens
ugacuugccuucagaauau

SEQ ID NO: 1082522 - RNA, 19 nt, Homo sapiens
gaaaguugaucauguuagu

SEQ ID NO: 1082523 - RNA, 19 nt, Homo sapiens
cagauuugcugaacaguuu

SEQ ID NO: 1082524 - RNA, 19 nt, Homo sapiens
cuaaagaacuagaaggauu

SEQ ID NO: 1082525 - RNA, 19 nt, Homo sapiens
gaagauguuccucagauaa

SEQ ID NO: 1082526 - RNA, 19 nt, Homo sapiens
caaagucaguuauucaugu

SEQ ID NO: 1082527 - RNA, 19 nt, Homo sapiens
guccagacaugauaacuaa

SEQ ID NO: 1082528 - RNA, 19 nt, Homo sapiens
gcuuaugggucgauucuaa

SEQ ID NO: 1082529 - RNA, 19 nt, Homo sapiens
aaacaucacuuggaacuug

SEQ ID NO: 1082530 - RNA, 19 nt, Homo sapiens
caaguuggaucggauaauu

SEQ ID NO: 1082531 - RNA, 19 nt, Homo sapiens
ucacaaagcucuguuacug

SEQ ID NO: 1082532 - RNA, 19 nt, Homo sapiens
caacugcagugccacauug

SEQ ID NO: 1082533 - RNA, 19 nt, Homo sapiens
gggaguaauuguuaaauca

SEQ ID NO: 1082534 - RNA, 19 nt, Homo sapiens
acaaagaauucacaaguug

SEQ ID NO: 1082535 - RNA, 19 nt, Homo sapiens
gcaaaacucuucuuacaga

SEQ ID NO: 1082536 - RNA, 19 nt, Homo sapiens
gaacucuucucuuuguguu

SEQ ID NO: 1082537 - RNA, 19 nt, Homo sapiens
gagcacaacuucccauugg

SEQ ID NO: 1082538 - RNA, 19 nt, Homo sapiens
ccucaaggcccaccaaaua

SEQ ID NO: 1082539 - RNA, 19 nt, Homo sapiens
cuucauuccuuguucauua

SEQ ID NO: 1082540 - RNA, 19 nt, Homo sapiens
gcagagacccaccaucaaa

SEQ ID NO: 1082541 - RNA, 19 nt, Homo sapiens
gggccuaucauuaacauua

SEQ ID NO: 1082542 - RNA, 19 nt, Homo sapiens
ccuaagagcuuguccaaag

SEQ ID NO: 1082543 - RNA, 19 nt, Homo sapiens
gcaacuacauccacugcaa

SEQ ID NO: 1082544 - RNA, 19 nt, Homo sapiens
ggugaaaugccauauguuu

SEQ ID NO: 1082545 - RNA, 19 nt, Homo sapiens
caugaaacaucacuuggaa

SEQ ID NO: 1082546 - RNA, 19 nt, Homo sapiens
acacuuaagucaacguaaa

SEQ ID NO: 1082547 - RNA, 19 nt, Homo sapiens
gaaacagagcauauucuuu

SEQ ID NO: 1082548 - RNA, 19 nt, Homo sapiens
aaacauccuucuacuucua

SEQ ID NO: 1082549 - RNA, 19 nt, Homo sapiens
ggaugaggaugacgaugaa

SEQ ID NO: 1082550 - RNA, 19 nt, Homo sapiens
gcuaaacacuuaagucaac

SEQ ID NO: 1082551 - RNA, 19 nt, Homo sapiens
ucguauggcuaaacacuua

SEQ ID NO: 1082552 - RNA, 19 nt, Homo sapiens
gaacuugcuauguccauuu

SEQ ID NO: 1082553 - RNA, 19 nt, Homo sapiens
caggaaaguugaucauguu

SEQ ID NO: 1082554 - RNA, 19 nt, Homo sapiens
acaaauaccucaucuccau

SEQ ID NO: 1082555 - RNA, 19 nt, Homo sapiens
acaaagcucuguuacuguu

SEQ ID NO: 1082556 - RNA, 19 nt, Homo sapiens
caacugauaccuguucuuu

SEQ ID NO: 1082557 - RNA, 19 nt, Homo sapiens
ugaagauguuccucagaua

SEQ ID NO: 1082558 - RNA, 19 nt, Homo sapiens
uaacaggcaugcaguccaa

SEQ ID NO: 1082559 - RNA, 19 nt, Homo sapiens
caauuacaguucccaaaga

SEQ ID NO: 1082560 - RNA, 19 nt, Homo sapiens
ccaaauagagcacaacuuc

SEQ ID NO: 1082561 - RNA, 19 nt, Homo sapiens
gccaguagaucuaagacaa

SEQ ID NO: 1082562 - RNA, 19 nt, Homo sapiens
uggcagaacucuuuaugga

SEQ ID NO: 1082563 - RNA, 19 nt, Homo sapiens
ugacugaccucccauaagg

SEQ ID NO: 1082564 - RNA, 19 nt, Homo sapiens
cagauaauaugacuguuca

SEQ ID NO: 1082565 - RNA, 19 nt, Homo sapiens
gcaagccacuuuucuauau

SEQ ID NO: 1082566 - RNA, 19 nt, Homo sapiens
gaagaaaguagaagaaacu

SEQ ID NO: 1082567 - RNA, 19 nt, Homo sapiens
uauggaaugugaagaagaa

SEQ ID NO: 1082568 - RNA, 19 nt, Homo sapiens
uaauuccucuggauaaaga

SEQ ID NO: 1082569 - RNA, 19 nt, Homo sapiens
agacacaguuguucauguu

SEQ ID NO: 1082570 - RNA, 19 nt, Homo sapiens
gagaauguuuccaaaagua

SEQ ID NO: 1082571 - RNA, 19 nt, Homo sapiens
gcgcagcaucguacauuua

SEQ ID NO: 1082572 - RNA, 19 nt, Homo sapiens
caagacauaccagcaauuu

SEQ ID NO: 1082573 - RNA, 19 nt, Homo sapiens
gcagaagaaaguagaagaa

SEQ ID NO: 1082574 - RNA, 19 nt, Homo sapiens
guagaucuaagacaaguaa

SEQ ID NO: 1082575 - RNA, 19 nt, Homo sapiens
cagcaucguacauuuauaa

SEQ ID NO: 1082576 - RNA, 19 nt, Homo sapiens
gaacguccaugugaugaag

SEQ ID NO: 1082577 - RNA, 19 nt, Homo sapiens
gugacauccucccaaguua

SEQ ID NO: 1082578 - RNA, 19 nt, Homo sapiens
gaaacauccuucuacuucu

SEQ ID NO: 1082579 - RNA, 19 nt, Homo sapiens
ugaaacauccuucuacuuc

SEQ ID NO: 1082580 - RNA, 19 nt, Homo sapiens
ggaugacgaugaacugauc

SEQ ID NO: 1082581 - RNA, 19 nt, Homo sapiens
gcuuagggauucugauuuc

SEQ ID NO: 1082582 - RNA, 19 nt, Homo sapiens
ggccagagaugaccucaag

SEQ ID NO: 1082583 - RNA, 19 nt, Homo sapiens
gaauacagauuugcugaac

SEQ ID NO: 1082584 - RNA, 19 nt, Homo sapiens
gauuucguguagcuacuua

SEQ ID NO: 1082585 - RNA, 19 nt, Homo sapiens
guagcuagguuuuauauug

SEQ ID NO: 1082586 - RNA, 19 nt, Homo sapiens
gaagaagcaacacauaagu

SEQ ID NO: 1082587 - RNA, 19 nt, Homo sapiens
gcaguuaaacagccaaguu

SEQ ID NO: 1082588 - RNA, 19 nt, Homo sapiens
caagacaaguuggaaguuc

SEQ ID NO: 1082589 - RNA, 19 nt, Homo sapiens
gcagcaucguacauuuaua

SEQ ID NO: 1082590 - RNA, 19 nt, Homo sapiens
gugaagauguuccucagau

SEQ ID NO: 1082591 - RNA, 19 nt, Homo sapiens
agaauugucuacagauuuc

SEQ ID NO: 1082592 - RNA, 19 nt, Homo sapiens
ccaaguaccugggaugaca

SEQ ID NO: 1082593 - RNA, 19 nt, Homo sapiens
cauccagguugacguuuaa

SEQ ID NO: 1082594 - RNA, 19 nt, Homo sapiens
uagaagaaacucaggauga

SEQ ID NO: 1082595 - RNA, 19 nt, Homo sapiens
gcaugcaguccaaggaaua

SEQ ID NO: 1082596 - RNA, 19 nt, Homo sapiens
gcaugcaguccaaggaaua

SEQ ID NO: 1082597 - RNA, 19 nt, Homo sapiens
ugauaccuguucuuucuuu

SEQ ID NO: 1082598 - RNA, 19 nt, Homo sapiens
cuacauccacugcaaguaa

SEQ ID NO: 1082599 - RNA, 19 nt, Homo sapiens
ccacugcacccgaccgaua

SEQ ID NO: 1082600 - RNA, 19 nt, Homo sapiens
uagcaaccauccagguaaa

SEQ ID NO: 1082601 - RNA, 19 nt, Homo sapiens
aaaugagccuugcuuugaa

SEQ ID NO: 1082602 - RNA, 19 nt, Homo sapiens
uggagcagauuaccuaaga

SEQ ID NO: 1082603 - RNA, 19 nt, Homo sapiens
gaaauauucaggacugcaa

SEQ ID NO: 1082604 - RNA, 19 nt, Homo sapiens
ccaaagugcugggauuaca

SEQ ID NO: 1082605 - RNA, 19 nt, Homo sapiens
cauccaggcugacguuuag

SEQ ID NO: 1082606 - RNA, 19 nt, Homo sapiens
ccauaaggcugaugcugau

SEQ ID NO: 1082607 - RNA, 19 nt, Homo sapiens
aaagugcaauguucaguuc

SEQ ID NO: 1082608 - RNA, 19 nt, Homo sapiens
caaaaggaauaaagaguga

SEQ ID NO: 1082609 - RNA, 19 nt, Homo sapiens
aaaaugcacuuguuucuug

SEQ ID NO: 1082610 - RNA, 19 nt, Homo sapiens
ugucuugggccuaucauua

SEQ ID NO: 1082611 - RNA, 19 nt, Homo sapiens
agacaggguuucaccaugu

SEQ ID NO: 1082612 - RNA, 19 nt, Homo sapiens
acgaugaacugaucuuugu

SEQ ID NO: 1082613 - RNA, 19 nt, Homo sapiens
caauuacaguucccaaagu

SEQ ID NO: 1082614 - RNA, 19 nt, Homo sapiens
gcaccuaucuuaacaaaua

SEQ ID NO: 1082615 - RNA, 19 nt, Homo sapiens
ggacguagcucuuuccaaa

SEQ ID NO: 1082616 - RNA, 19 nt, Homo sapiens
ccacaaagaugaagaaaca

SEQ ID NO: 1082617 - RNA, 19 nt, Homo sapiens
gaacauggacuuacacgaa

SEQ ID NO: 1082618 - RNA, 19 nt, Homo sapiens
gaacacggcucgaugaacu

SEQ ID NO: 1082619 - RNA, 19 nt, Homo sapiens
guaugaaucugaugaacaa

SEQ ID NO: 1082620 - RNA, 19 nt, Homo sapiens
gaaauuagaacauggacuu

SEQ ID NO: 1082621 - RNA, 19 nt, Homo sapiens
ggaacugauuugucuauau

SEQ ID NO: 1082622 - RNA, 19 nt, Homo sapiens
ucaacaagcuuaucgacuu

SEQ ID NO: 1082623 - RNA, 19 nt, Homo sapiens
gaaguuaugcucagcuauu

SEQ ID NO: 1082624 - RNA, 19 nt, Homo sapiens
gaaugcaccuaucuuaaca

SEQ ID NO: 1082625 - RNA, 19 nt, Homo sapiens
gcaaguuggagaagaauuu

SEQ ID NO: 1082626 - RNA, 19 nt, Homo sapiens
ugaagggaguaauaugaua

SEQ ID NO: 1082627 - RNA, 19 nt, Homo sapiens
uaugauagguacugaagaa

SEQ ID NO: 1082628 - RNA, 19 nt, Homo sapiens
gaugcaaguuggagaagaa

SEQ ID NO: 1082629 - RNA, 19 nt, Homo sapiens
gcucccagcuuaucauuuc

SEQ ID NO: 1082630 - RNA, 19 nt, Homo sapiens
gauauaaucagcagguuga

SEQ ID NO: 1082631 - RNA, 19 nt, Homo sapiens
gaaugagacuugggaacuu

SEQ ID NO: 1082632 - RNA, 19 nt, Homo sapiens
uagcaagucugaaguuuua

SEQ ID NO: 1082633 - RNA, 19 nt, Homo sapiens
gcacuucacccaagccauu

SEQ ID NO: 1082634 - RNA, 19 nt, Homo sapiens
ggagaagaauuuuguggua

SEQ ID NO: 1082635 - RNA, 19 nt, Homo sapiens
caagauacuuuggaacaga

SEQ ID NO: 1082636 - RNA, 19 nt, Homo sapiens
uccaaaagcugcaauauaa

SEQ ID NO: 1082637 - RNA, 19 nt, Homo sapiens
gaauauggcaggauguuca

SEQ ID NO: 1082638 - RNA, 19 nt, Homo sapiens
gcaaagcacuaugggaagu

SEQ ID NO: 1082639 - RNA, 19 nt, Homo sapiens
gcaauggaucaacuucaua

SEQ ID NO: 1082640 - RNA, 19 nt, Homo sapiens
caacaagcuuaucgacuuc

SEQ ID NO: 1082641 - RNA, 19 nt, Homo sapiens
caacagacguuuugagaug

SEQ ID NO: 1082642 - RNA, 19 nt, Homo sapiens
gguagcaagucugaaguuu

SEQ ID NO: 1082643 - RNA, 19 nt, Homo sapiens
ggaauggcauggaaagcau

SEQ ID NO: 1082644 - RNA, 19 nt, Homo sapiens
ggaacuaugugcaggaaac

SEQ ID NO: 1082645 - RNA, 19 nt, Homo sapiens
aaccaccgcucccagcuua

SEQ ID NO: 1082646 - RNA, 19 nt, Homo sapiens
ggcaggauguucagcuaaa

SEQ ID NO: 1082647 - RNA, 19 nt, Homo sapiens
gauagguacugaagaaacu

SEQ ID NO: 1082648 - RNA, 19 nt, Homo sapiens
gggaaguuaugcucagcua

SEQ ID NO: 1082649 - RNA, 19 nt, Homo sapiens
ugaaucugaugaacaagaa

SEQ ID NO: 1082650 - RNA, 19 nt, Homo sapiens
ccagacagcuauauuccau

SEQ ID NO: 1082651 - RNA, 19 nt, Homo sapiens
guaauaugauagguacuga

SEQ ID NO: 1082652 - RNA, 19 nt, Homo sapiens
guuaugcucagcuauuaua

SEQ ID NO: 1082653 - RNA, 19 nt, Homo sapiens
ccaaagugcugggauuaca

SEQ ID NO: 1082654 - RNA, 19 nt, Homo sapiens
uaaagugaaugcaccuauc

SEQ ID NO: 1082655 - RNA, 19 nt, Homo sapiens
ugggaacuuuguccuguua

SEQ ID NO: 1082656 - RNA, 19 nt, Homo sapiens
aaagcacuaugggaaguua

SEQ ID NO: 1082657 - RNA, 19 nt, Homo sapiens
gcugcaagauacuuuggaa

SEQ ID NO: 1082658 - RNA, 19 nt, Homo sapiens
auucaaagcugcaagauac

SEQ ID NO: 1082659 - RNA, 19 nt, Homo sapiens
aaguuaugcucagcuauua

SEQ ID NO: 1082660 - RNA, 19 nt, Homo sapiens
caaacgagacuauguggau

SEQ ID NO: 1082661 - RNA, 19 nt, Homo sapiens
ccuguuaagucaaauuuca

SEQ ID NO: 1082662 - RNA, 19 nt, Homo sapiens
gcuuggaacugauuugucu

SEQ ID NO: 1082663 - RNA, 19 nt, Homo sapiens
aaggaucucuguacacaug

SEQ ID NO: 1082664 - RNA, 19 nt, Homo sapiens
ucccauaugugaaccugua

SEQ ID NO: 1082665 - RNA, 19 nt, Homo sapiens
gaagggaguaauaugauag

SEQ ID NO: 1082666 - RNA, 19 nt, Homo sapiens
ggaguacaguggcgcaucu

SEQ ID NO: 1082667 - RNA, 19 nt, Homo sapiens
gugaaugcaccuaucuuaa

SEQ ID NO: 1082668 - RNA, 19 nt, Homo sapiens
caaagaugaagaaacagaa

SEQ ID NO: 1082669 - RNA, 19 nt, Homo sapiens
ucgaugaacugagaauguu

SEQ ID NO: 1082670 - RNA, 19 nt, Homo sapiens
uggaacagauugaggaaca

SEQ ID NO: 1082671 - RNA, 19 nt, Homo sapiens
gggaguaauaugauaggua

SEQ ID NO: 1082672 - RNA, 19 nt, Homo sapiens
gaacucaaacgagacuaug

SEQ ID NO: 1082673 - RNA, 19 nt, Homo sapiens
guaaacagccagucucaac

SEQ ID NO: 1082674 - RNA, 19 nt, Homo sapiens
gcaagauacuuuggaacag

SEQ ID NO: 1082675 - RNA, 19 nt, Homo sapiens
ugaccuuguuugagcagua

SEQ ID NO: 1082676 - RNA, 19 nt, Homo sapiens
ggaacuuuguccuguuaag

SEQ ID NO: 1082677 - RNA, 19 nt, Homo sapiens
gaucucuguacacauguua

SEQ ID NO: 1082678 - RNA, 19 nt, Homo sapiens
caauggaucaacuucauau

SEQ ID NO: 1082679 - RNA, 19 nt, Homo sapiens
ggauacugcuucagcuucu

SEQ ID NO: 1082680 - RNA, 19 nt, Homo sapiens
caaugaggauacugcuuca

SEQ ID NO: 1082681 - RNA, 19 nt, Homo sapiens
caauauaaggaucucugua

SEQ ID NO: 1082682 - RNA, 19 nt, Homo sapiens
ggaacucaaacgagacuau

SEQ ID NO: 1082683 - RNA, 19 nt, Homo sapiens
gagugccuaucaagaguau

SEQ ID NO: 1082684 - RNA, 19 nt, Homo sapiens
caaccacaaagaugaagaa

SEQ ID NO: 1082685 - RNA, 19 nt, Homo sapiens
cagccagucucaacuucuu

SEQ ID NO: 1082686 - RNA, 19 nt, Homo sapiens
ccaucaguuucaccuagua

SEQ ID NO: 1082687 - RNA, 19 nt, Homo sapiens
ucuugcaacuucaugaauu

SEQ ID NO: 1082688 - RNA, 19 nt, Homo sapiens
aaugagacuugggaacuuu

SEQ ID NO: 1082689 - RNA, 19 nt, Homo sapiens
acauggacuuacacgaaua

SEQ ID NO: 1082690 - RNA, 19 nt, Homo sapiens
uguuacaguuugucccaua

SEQ ID NO: 1082691 - RNA, 19 nt, Homo sapiens
guacuguaguggugggaau

SEQ ID NO: 1082692 - RNA, 19 nt, Homo sapiens
cuugcaacuucaugaauuu

SEQ ID NO: 1082693 - RNA, 19 nt, Homo sapiens
ccaagguucaacaagcuua

SEQ ID NO: 1082694 - RNA, 19 nt, Homo sapiens
guaguuacuguccuaguga

SEQ ID NO: 1082695 - RNA, 19 nt, Homo sapiens
accuguagcuugaucguuu

SEQ ID NO: 1082696 - RNA, 19 nt, Homo sapiens
gaacgucauaagacuuguu

SEQ ID NO: 1082697 - RNA, 19 nt, Homo sapiens
ggugggaauccauuugaaa

SEQ ID NO: 1082698 - RNA, 19 nt, Homo sapiens
gcuuaucgacuucuuggaa

SEQ ID NO: 1082699 - RNA, 19 nt, Homo sapiens
gacauuaaccauuauacca

SEQ ID NO: 1082700 - RNA, 19 nt, Homo sapiens
auaaggaucucuguacaca

SEQ ID NO: 1082701 - RNA, 19 nt, Homo sapiens
caggaaacacagacacaaa

SEQ ID NO: 1082702 - RNA, 19 nt, Homo sapiens
uuacuguccuagugaauag

SEQ ID NO: 1082703 - RNA, 19 nt, Homo sapiens
caacauugaacgucauaag

SEQ ID NO: 1082704 - RNA, 19 nt, Homo sapiens
aaacacagacagcaaugga

SEQ ID NO: 1082705 - RNA, 19 nt, Homo sapiens
auggaaagcaugacaauga

SEQ ID NO: 1082706 - RNA, 19 nt, Homo sapiens
gcaggaaacacagacacaa

SEQ ID NO: 1082707 - RNA, 19 nt, Homo sapiens
agugaaugcaccuaucuua

SEQ ID NO: 1082708 - RNA, 19 nt, Homo sapiens
uccaaaaucugcaagaauu

SEQ ID NO: 1082709 - RNA, 19 nt, Homo sapiens
agacagcaauggaucaacu

SEQ ID NO: 1082710 - RNA, 19 nt, Homo sapiens
cuuaucgacuucuuggaaa

SEQ ID NO: 1082711 - RNA, 19 nt, Homo sapiens
ggaucucuguacacauguu

SEQ ID NO: 1082712 - RNA, 19 nt, Homo sapiens
gcaauauaaggaucucugu

SEQ ID NO: 1082713 - RNA, 19 nt, Homo sapiens
gaauagcuuccaccuccuu

SEQ ID NO: 1082714 - RNA, 19 nt, Homo sapiens
caacaucuaucaacagaag

SEQ ID NO: 1082715 - RNA, 19 nt, Homo sapiens
gacaacaucuaucaacaga

SEQ ID NO: 1082716 - RNA, 19 nt, Homo sapiens
gaucaaggaccuccacaaa

SEQ ID NO: 1082717 - RNA, 19 nt, Homo sapiens
ggcaggcccucaauaaaug

SEQ ID NO: 1082718 - RNA, 19 nt, Homo sapiens
gccaggcgcuagacaugua

SEQ ID NO: 1082719 - RNA, 19 nt, Homo sapiens
acgauauccucuacaaaua

SEQ ID NO: 1082720 - RNA, 19 nt, Homo sapiens
uuaacugucuggccuauga

SEQ ID NO: 1082721 - RNA, 19 nt, Homo sapiens
caaggaguaugcugaagau

SEQ ID NO: 1082722 - RNA, 19 nt, Homo sapiens
gguuguaaaugguccuauu

SEQ ID NO: 1082723 - RNA, 19 nt, Homo sapiens
gaccacauccacaucauug

SEQ ID NO: 1082724 - RNA, 19 nt, Homo sapiens
ggaguaugcugaagaugac

SEQ ID NO: 1082725 - RNA, 19 nt, Homo sapiens
uggaggcacugcuggauga

SEQ ID NO: 1082726 - RNA, 19 nt, Homo sapiens
ccgacuaccuuguggucua

SEQ ID NO: 1082727 - RNA, 19 nt, Homo sapiens
cugcuuccuucccuucuua

SEQ ID NO: 1082728 - RNA, 19 nt, Homo sapiens
gauauccucuacaaauagg

SEQ ID NO: 1082729 - RNA, 19 nt, Homo sapiens
gcaaggagagcgaccacau

SEQ ID NO: 1082730 - RNA, 19 nt, Homo sapiens
gacggacugucaaggaguu

SEQ ID NO: 1082731 - RNA, 19 nt, Homo sapiens
gacggcaacuguuucuauc

SEQ ID NO: 1082732 - RNA, 19 nt, Homo sapiens
gagcaccuccgacuaccuu

SEQ ID NO: 1082733 - RNA, 19 nt, Homo sapiens
ccaccaauccgcacaucuu

SEQ ID NO: 1082734 - RNA, 19 nt, Homo sapiens
caauugaggauuuccacaa

SEQ ID NO: 1082735 - RNA, 19 nt, Homo sapiens
uacgauauccucuacaaau

SEQ ID NO: 1082736 - RNA, 19 nt, Homo sapiens
ugacggcaacuguuucuau

SEQ ID NO: 1082737 - RNA, 19 nt, Homo sapiens
acacuacgauauccucuac

SEQ ID NO: 1082738 - RNA, 19 nt, Homo sapiens
ggaccgaauucagcaagag

SEQ ID NO: 1082739 - RNA, 19 nt, Homo sapiens
cuaucgggcuuucggauuc

SEQ ID NO: 1082740 - RNA, 19 nt, Homo sapiens
ccgaagguguuaacugucu

SEQ ID NO: 1082741 - RNA, 19 nt, Homo sapiens
cuucaucugcucccucaua

SEQ ID NO: 1082742 - RNA, 19 nt, Homo sapiens
cuccgaagguguuaacugu

SEQ ID NO: 1082743 - RNA, 19 nt, Homo sapiens
gaggguggacggacuguca

SEQ ID NO: 1082744 - RNA, 19 nt, Homo sapiens
ggccugacggcaacuguuu

SEQ ID NO: 1082745 - RNA, 19 nt, Homo sapiens
cuacaguccucaggucuag

SEQ ID NO: 1082746 - RNA, 19 nt, Homo sapiens
cugcuggccuccuucaaug

SEQ ID NO: 1082747 - RNA, 19 nt, Homo sapiens
gagggcagccuucaaacgu

SEQ ID NO: 1082748 - RNA, 19 nt, Homo sapiens
acuacgauauccucuacaa

SEQ ID NO: 1082749 - RNA, 19 nt, Homo sapiens
ucuaugggauccuggaagu

SEQ ID NO: 1082750 - RNA, 19 nt, Homo sapiens
ccagagcaccuccgacuac

SEQ ID NO: 1082751 - RNA, 19 nt, Homo sapiens
acaaggaguaugcugaaga

SEQ ID NO: 1082752 - RNA, 19 nt, Homo sapiens
cgauauccucuacaaauag

SEQ ID NO: 1082753 - RNA, 19 nt, Homo sapiens
cuaccggccuggacacuac

SEQ ID NO: 1082754 - RNA, 19 nt, Homo sapiens
ggagcucucgguccuauac

SEQ ID NO: 1082755 - RNA, 19 nt, Homo sapiens
aggaguaugcugaagauga

SEQ ID NO: 1082756 - RNA, 19 nt, Homo sapiens
ggccuggacacuacgauau

SEQ ID NO: 1082757 - RNA, 19 nt, Homo sapiens
cagcgacuccgaagguguu

SEQ ID NO: 1082758 - RNA, 19 nt, Homo sapiens
gaccgaauucagcaagaga

SEQ ID NO: 1082759 - RNA, 19 nt, Homo sapiens
gcucagcaggaccgaauuc

SEQ ID NO: 1082760 - RNA, 19 nt, Homo sapiens
cgaccacauccacaucauu

SEQ ID NO: 1082761 - RNA, 19 nt, Homo sapiens
caaggagagcgaccacauc

SEQ ID NO: 1082762 - RNA, 19 nt, Homo sapiens
gacacuacgauauccucua

SEQ ID NO: 1082763 - RNA, 19 nt, Homo sapiens
cgaauucagcaagagauug

SEQ ID NO: 1082764 - RNA, 19 nt, Homo sapiens
gcgaccacauccacaucau

SEQ ID NO: 1082765 - RNA, 19 nt, Homo sapiens
ggcccucaauaaaugugaa

SEQ ID NO: 1082766 - RNA, 19 nt, Homo sapiens
ccuaucuacuccugagcuu

SEQ ID NO: 1082767 - RNA, 19 nt, Homo sapiens
uuucugugguuguaaaugg

SEQ ID NO: 1082768 - RNA, 19 nt, Homo sapiens
cgacuaccuuguggucuac

SEQ ID NO: 1082769 - RNA, 19 nt, Homo sapiens
agagauugcugugcagaac

SEQ ID NO: 1082770 - RNA, 19 nt, Homo sapiens
gaacaucucugccuaauuu

SEQ ID NO: 1082771 - RNA, 19 nt, Homo sapiens
gaacaacucuuauuucaca

SEQ ID NO: 1082772 - RNA, 19 nt, Homo sapiens
gaaggagccucucuuguuu

SEQ ID NO: 1082773 - RNA, 19 nt, Homo sapiens
gugcugaucugucucauua

SEQ ID NO: 1082774 - RNA, 19 nt, Homo sapiens
cagaagagcuuuccuuguu

SEQ ID NO: 1082775 - RNA, 19 nt, Homo sapiens
cagcugcucuuacgauuua

SEQ ID NO: 1082776 - RNA, 19 nt, Homo sapiens
gaagagcuuuccuuguuaa

SEQ ID NO: 1082777 - RNA, 19 nt, Homo sapiens
gcauguagauucuggacua

SEQ ID NO: 1082778 - RNA, 19 nt, Homo sapiens
ggaaggagccucucuuguu

SEQ ID NO: 1082779 - RNA, 19 nt, Homo sapiens
acauggagauucacaaaua

SEQ ID NO: 1082780 - RNA, 19 nt, Homo sapiens
gaauaaaccaacucuauga

SEQ ID NO: 1082781 - RNA, 19 nt, Homo sapiens
gagaguaucuggagaccuu

SEQ ID NO: 1082782 - RNA, 19 nt, Homo sapiens
cgacuugaauccuaaauau

SEQ ID NO: 1082783 - RNA, 19 nt, Homo sapiens
ccaaagaaauaaacaagug

SEQ ID NO: 1082784 - RNA, 19 nt, Homo sapiens
guaaaucacaagccaauaa

SEQ ID NO: 1082785 - RNA, 19 nt, Homo sapiens
gcacaucccuuuccuuacu

SEQ ID NO: 1082786 - RNA, 19 nt, Homo sapiens
gcaagauugugcacgagua

SEQ ID NO: 1082787 - RNA, 19 nt, Homo sapiens
gcucuacaguaccacauua

SEQ ID NO: 1082788 - RNA, 19 nt, Homo sapiens
gaaaggagacaccagcauu

SEQ ID NO: 1082789 - RNA, 19 nt, Homo sapiens
gaaguaaagggaaauauca

SEQ ID NO: 1082790 - RNA, 19 nt, Homo sapiens
gcagacccauucucaaaga

SEQ ID NO: 1082791 - RNA, 19 nt, Homo sapiens
cagaagcacuugcggauau

SEQ ID NO: 1082792 - RNA, 19 nt, Homo sapiens
uauaacugguccuacauua

SEQ ID NO: 1082793 - RNA, 19 nt, Homo sapiens
caucaaagcccucugagaa

SEQ ID NO: 1082794 - RNA, 19 nt, Homo sapiens
ggagaagacagaaagguaa

SEQ ID NO: 1082795 - RNA, 19 nt, Homo sapiens
uaacugguccuacauuaaa

SEQ ID NO: 1082796 - RNA, 19 nt, Homo sapiens
agaagagcuuuccuuguua

SEQ ID NO: 1082797 - RNA, 19 nt, Homo sapiens
gaggagugaugcucaaguu

SEQ ID NO: 1082798 - RNA, 19 nt, Homo sapiens
gaaauaaacaagugugaca

SEQ ID NO: 1082799 - RNA, 19 nt, Homo sapiens
gauuauaacugguccuaca

SEQ ID NO: 1082800 - RNA, 19 nt, Homo sapiens
ccaagaaguuacuaccaaa

SEQ ID NO: 1082801 - RNA, 19 nt, Homo sapiens
ggaaguaacccuagaaggu

SEQ ID NO: 1082802 - RNA, 19 nt, Homo sapiens
caacaucauuugcuuccuu

SEQ ID NO: 1082803 - RNA, 19 nt, Homo sapiens
gaaacaagugcuaagugua

SEQ ID NO: 1082804 - RNA, 19 nt, Homo sapiens
ucccuaaacuugcagauaa

SEQ ID NO: 1082805 - RNA, 19 nt, Homo sapiens
gcacagaggaagaaauguu

SEQ ID NO: 1082806 - RNA, 19 nt, Homo sapiens
ggucagacuuugcucuuug

SEQ ID NO: 1082807 - RNA, 19 nt, Homo sapiens
caacaucccaaagaaauaa

SEQ ID NO: 1082808 - RNA, 19 nt, Homo sapiens
gcaacaucccaaagaaaua

SEQ ID NO: 1082809 - RNA, 19 nt, Homo sapiens
caaagaaacacaaauccaa

SEQ ID NO: 1082810 - RNA, 19 nt, Homo sapiens
caacaugcuuccuuagcuu

SEQ ID NO: 1082811 - RNA, 19 nt, Homo sapiens
ccuacuaccuugucagauu

SEQ ID NO: 1082812 - RNA, 19 nt, Homo sapiens
ggaaucaaguuacuaaucc

SEQ ID NO: 1082813 - RNA, 19 nt, Homo sapiens
cgagguugaugaaauagaa

SEQ ID NO: 1082814 - RNA, 19 nt, Homo sapiens
guccgagguugaugaaaua

SEQ ID NO: 1082815 - RNA, 19 nt, Homo sapiens
aagagcaacuugaugguuu

SEQ ID NO: 1082816 - RNA, 19 nt, Homo sapiens
gggcagacccauucucaaa

SEQ ID NO: 1082817 - RNA, 19 nt, Homo sapiens
caacauggagauucacaaa

SEQ ID NO: 1082818 - RNA, 19 nt, Homo sapiens
uaacagacaacauacauuc

SEQ ID NO: 1082819 - RNA, 19 nt, Homo sapiens
gaacaaggagaaccacuag

SEQ ID NO: 1082820 - RNA, 19 nt, Homo sapiens
ccaaauuccuaugaugaaa

SEQ ID NO: 1082821 - RNA, 19 nt, Homo sapiens
aaauaaugcuucucgaugu

SEQ ID NO: 1082822 - RNA, 19 nt, Homo sapiens
ugagagagugagccaauua

SEQ ID NO: 1082823 - RNA, 19 nt, Homo sapiens
gagaagggcagacccauuc

SEQ ID NO: 1082824 - RNA, 19 nt, Homo sapiens
ugaucugucucauuacuaa

SEQ ID NO: 1082825 - RNA, 19 nt, Homo sapiens
cuacuaccuugucagauuu

SEQ ID NO: 1082826 - RNA, 19 nt, Homo sapiens
caacauccuuucauuucug

SEQ ID NO: 1082827 - RNA, 19 nt, Homo sapiens
agaaacaagugcuaagugu

SEQ ID NO: 1082828 - RNA, 19 nt, Homo sapiens
cagaagugguuuaggcauu

SEQ ID NO: 1082829 - RNA, 19 nt, Homo sapiens
cgucagcuguugcuuuauu

SEQ ID NO: 1082830 - RNA, 19 nt, Homo sapiens
auuaacagcugccugaauu

SEQ ID NO: 1082831 - RNA, 19 nt, Homo sapiens
gauaugaacccagaauguu

SEQ ID NO: 1082832 - RNA, 19 nt, Homo sapiens
gaugugaccaugagaauca

SEQ ID NO: 1082833 - RNA, 19 nt, Homo sapiens
aaaccuaaaugcuacuguu

SEQ ID NO: 1082834 - RNA, 19 nt, Homo sapiens
ccaggcacccgcugaauuu

SEQ ID NO: 1082835 - RNA, 19 nt, Homo sapiens
ccacauagagacagacuug

SEQ ID NO: 1082836 - RNA, 19 nt, Homo sapiens
guaaguccuuugugaagau

SEQ ID NO: 1082837 - RNA, 19 nt, Homo sapiens
caucuggucuuagucauug

SEQ ID NO: 1082838 - RNA, 19 nt, Homo sapiens
gaacccauaauugaagaua

SEQ ID NO: 1082839 - RNA, 19 nt, Homo sapiens
gcaaaauccugaauauuag

SEQ ID NO: 1082840 - RNA, 19 nt, Homo sapiens
guacauuggcggcuacauu

SEQ ID NO: 1082841 - RNA, 19 nt, Homo sapiens
gaaguugugcccgauguaa

SEQ ID NO: 1082842 - RNA, 19 nt, Homo sapiens
cuaaguguaccguauuaua

SEQ ID NO: 1082843 - RNA, 19 nt, Homo sapiens
gaaagacgucacacugaga

SEQ ID NO: 1082844 - RNA, 19 nt, Homo sapiens
ucauuggucuccucagauu

SEQ ID NO: 1082845 - RNA, 19 nt, Homo sapiens
gcuuuuagcuccugucuuu

SEQ ID NO: 1082846 - RNA, 19 nt, Homo sapiens
ggaagaaaauuuggaauca

SEQ ID NO: 1082847 - RNA, 19 nt, Homo sapiens
acuggacccuggacaaaua

SEQ ID NO: 1082848 - RNA, 19 nt, Homo sapiens
ggaaccaacuuuguuuuaa

SEQ ID NO: 1082849 - RNA, 19 nt, Homo sapiens
gcuucucgaugucagauuu

SEQ ID NO: 1082850 - RNA, 19 nt, Homo sapiens
uggaggacauuacugauau

SEQ ID NO: 1082851 - RNA, 19 nt, Homo sapiens
caggugggccauucucuua

SEQ ID NO: 1082852 - RNA, 19 nt, Homo sapiens
uaaggaacccauaauugaa

SEQ ID NO: 1082853 - RNA, 19 nt, Homo sapiens
auaaggaacccauaauuga

SEQ ID NO: 1082854 - RNA, 19 nt, Homo sapiens
uaucuacaguugauucaga

SEQ ID NO: 1082855 - RNA, 19 nt, Homo sapiens
aaaucugguucacaucaua

SEQ ID NO: 1082856 - RNA, 19 nt, Homo sapiens
gagagagugagccaauuaa

SEQ ID NO: 1082857 - RNA, 19 nt, Homo sapiens
uggcacaucccuuuccuua

SEQ ID NO: 1082858 - RNA, 19 nt, Homo sapiens
uaaaugcuacuguuccaaa

SEQ ID NO: 1082859 - RNA, 19 nt, Homo sapiens
agaagugguuuaggcauuu

SEQ ID NO: 1082860 - RNA, 19 nt, Homo sapiens
gagaagacagaaagguaaa

SEQ ID NO: 1082861 - RNA, 19 nt, Homo sapiens
ggauaugaacccagaaugu

SEQ ID NO: 1082862 - RNA, 19 nt, Homo sapiens
uaaauuaaugggcaccuuu

SEQ ID NO: 1082863 - RNA, 19 nt, Homo sapiens
gaagugguuuaggcauuug

SEQ ID NO: 1082864 - RNA, 19 nt, Homo sapiens
agggaaauaucagacaaua

SEQ ID NO: 1082865 - RNA, 19 nt, Homo sapiens
cauggagauucacaaauau

SEQ ID NO: 1082866 - RNA, 19 nt, Homo sapiens
caaggagaaccacuagaaa

SEQ ID NO: 1082867 - RNA, 19 nt, Homo sapiens
cgaauaaaccaacucuaug

SEQ ID NO: 1082868 - RNA, 19 nt, Homo sapiens
gaucagaagagcuuuccuu

SEQ ID NO: 1082869 - RNA, 19 nt, Homo sapiens
ccaggcagaugcaaagcuu

SEQ ID NO: 1082870 - RNA, 19 nt, Homo sapiens
gaaaguggauggaaacuga

SEQ ID NO: 1082871 - RNA, 19 nt, Homo sapiens
caacagaaacuaugagaua

SEQ ID NO: 1082872 - RNA, 19 nt, Homo sapiens
gugcagaccuccaccauaa

SEQ ID NO: 1082873 - RNA, 19 nt, Homo sapiens
gaaaccagcuaaugggauu

SEQ ID NO: 1082874 - RNA, 19 nt, Homo sapiens
uauaaaggcuucacuaugu

SEQ ID NO: 1082875 - RNA, 19 nt, Homo sapiens
ugaaauugguggaucguua

SEQ ID NO: 1082876 - RNA, 19 nt, Homo sapiens
gaacugcagucauggauca

SEQ ID NO: 1082877 - RNA, 19 nt, Homo sapiens
ucacaauggucaauaauga

SEQ ID NO: 1082878 - RNA, 19 nt, Homo sapiens
gggaauuacuuuacugauu

SEQ ID NO: 1082879 - RNA, 19 nt, Homo sapiens
ggaaguuugugaauugaaa

SEQ ID NO: 1082880 - RNA, 19 nt, Homo sapiens
gcaguaaugugaaagugaa

SEQ ID NO: 1082881 - RNA, 19 nt, Homo sapiens
gacuguaucuggcaauuaa

SEQ ID NO: 1082882 - RNA, 19 nt, Homo sapiens
cugaagaucuuuaugcuuu

SEQ ID NO: 1082883 - RNA, 19 nt, Homo sapiens
caccuacccuccugaaaua

SEQ ID NO: 1082884 - RNA, 19 nt, Homo sapiens
caccauaacuguugugaga

SEQ ID NO: 1082885 - RNA, 19 nt, Homo sapiens
guucaaaguucagaaguaa

SEQ ID NO: 1082886 - RNA, 19 nt, Homo sapiens
uaacagaugccaacagaaa

SEQ ID NO: 1082887 - RNA, 19 nt, Homo sapiens
ggagacaugugcaccuuug

SEQ ID NO: 1082888 - RNA, 19 nt, Homo sapiens
caacccaccugaucuaugu

SEQ ID NO: 1082889 - RNA, 19 nt, Homo sapiens
gcaauuaauggaacaguuu

SEQ ID NO: 1082890 - RNA, 19 nt, Homo sapiens
cauaacagaugccaacaga

SEQ ID NO: 1082891 - RNA, 19 nt, Homo sapiens
gccaugagguuuauauuuc

SEQ ID NO: 1082892 - RNA, 19 nt, Homo sapiens
ggagacagaugugcaugaa

SEQ ID NO: 1082893 - RNA, 19 nt, Homo sapiens
caggaacccucucuauaaa

SEQ ID NO: 1082894 - RNA, 19 nt, Homo sapiens
ucaggaacccucucuauaa

SEQ ID NO: 1082895 - RNA, 19 nt, Homo sapiens
ucaaaggacucaugaucuu

SEQ ID NO: 1082896 - RNA, 19 nt, Homo sapiens
ugaauacccugauggagaa

SEQ ID NO: 1082897 - RNA, 19 nt, Homo sapiens
aacagaaacuggaccauaa

SEQ ID NO: 1082898 - RNA, 19 nt, Homo sapiens
gagggaaaguggauggaaa

SEQ ID NO: 1082899 - RNA, 19 nt, Homo sapiens
agacaacuaugccaacauu

SEQ ID NO: 1082900 - RNA, 19 nt, Homo sapiens
gaaauagugguuccuaaau

SEQ ID NO: 1082901 - RNA, 19 nt, Homo sapiens
gaaacuggaccauaacaga

SEQ ID NO: 1082902 - RNA, 19 nt, Homo sapiens
caacagaaacuggaccaua

SEQ ID NO: 1082903 - RNA, 19 nt, Homo sapiens
gcagucauggaucauauua

SEQ ID NO: 1082904 - RNA, 19 nt, Homo sapiens
gaagggaauuacuuuacug

SEQ ID NO: 1082905 - RNA, 19 nt, Homo sapiens
gaagacaacuaugccaaca

SEQ ID NO: 1082906 - RNA, 19 nt, Homo sapiens
gagcucagauggaucaagu

SEQ ID NO: 1082907 - RNA, 19 nt, Homo sapiens
gaucuaagagucuaugaga

SEQ ID NO: 1082908 - RNA, 19 nt, Homo sapiens
uuacucaucuuccaugcua

SEQ ID NO: 1082909 - RNA, 19 nt, Homo sapiens
gggcuucuccaaagacuua

SEQ ID NO: 1082910 - RNA, 19 nt, Homo sapiens
gagagccuccuggaaauua

SEQ ID NO: 1082911 - RNA, 19 nt, Homo sapiens
ggagccaguuuauguaugu

SEQ ID NO: 1082912 - RNA, 19 nt, Homo sapiens
ccauaacuguugugagauu

SEQ ID NO: 1082913 - RNA, 19 nt, Homo sapiens
gggaagaucuaagagucua

SEQ ID NO: 1082914 - RNA, 19 nt, Homo sapiens
caaaggcagugaagguaga

SEQ ID NO: 1082915 - RNA, 19 nt, Homo sapiens
ggaagggaauuacuuuacu

SEQ ID NO: 1082916 - RNA, 19 nt, Homo sapiens
uggcaucucuggaaacuug

SEQ ID NO: 1082917 - RNA, 19 nt, Homo sapiens
cuaaugggauucuuuaucu

SEQ ID NO: 1082918 - RNA, 19 nt, Homo sapiens
gaaagugaaguggaaauau

SEQ ID NO: 1082919 - RNA, 19 nt, Homo sapiens
gcaccuacccuccugaaau

SEQ ID NO: 1082920 - RNA, 19 nt, Homo sapiens
cagcugagacacauauuaa

SEQ ID NO: 1082921 - RNA, 19 nt, Homo sapiens
cugauuaagugaccaauau

SEQ ID NO: 1082922 - RNA, 19 nt, Homo sapiens
ucuggaaacuuggguauuu

SEQ ID NO: 1082923 - RNA, 19 nt, Homo sapiens
ggaaguccuuugaccaauc

SEQ ID NO: 1082924 - RNA, 19 nt, Homo sapiens
ccacuggcaucucuggaaa

SEQ ID NO: 1082925 - RNA, 19 nt, Homo sapiens
cuagagagccuccuggaaa

SEQ ID NO: 1082926 - RNA, 19 nt, Homo sapiens
gaaauugguggaucguuau

SEQ ID NO: 1082927 - RNA, 19 nt, Homo sapiens
gcagguaacugugaauugc

SEQ ID NO: 1082928 - RNA, 19 nt, Homo sapiens
uuaucgaccugcccuauuu

SEQ ID NO: 1082929 - RNA, 19 nt, Homo sapiens
uauuauggaugcuggaauu

SEQ ID NO: 1082930 - RNA, 19 nt, Homo sapiens
cagcuaaugggauucuuua

SEQ ID NO: 1082931 - RNA, 19 nt, Homo sapiens
guaagaaaccagcuaaugg

SEQ ID NO: 1082932 - RNA, 19 nt, Homo sapiens
ggaacccucucuauaaagg

SEQ ID NO: 1082933 - RNA, 19 nt, Homo sapiens
ggagagcucagggugguua

SEQ ID NO: 1082934 - RNA, 19 nt, Homo sapiens
ucuccuaccucuacaaaga

SEQ ID NO: 1082935 - RNA, 19 nt, Homo sapiens
gcaagagaaagaauauguu

SEQ ID NO: 1082936 - RNA, 19 nt, Homo sapiens
uacagcagcuacaaugauu

SEQ ID NO: 1082937 - RNA, 19 nt, Homo sapiens
gcucagauggaucaaguaa

SEQ ID NO: 1082938 - RNA, 19 nt, Homo sapiens
gauagagaaggaauggaua

SEQ ID NO: 1082939 - RNA, 19 nt, Homo sapiens
guggagaaguuacccauca

SEQ ID NO: 1082940 - RNA, 19 nt, Homo sapiens
gcaccaaggaggcagacua

SEQ ID NO: 1082941 - RNA, 19 nt, Homo sapiens
ucagauggaucaaguaaaa

SEQ ID NO: 1082942 - RNA, 19 nt, Homo sapiens
auaaaggcuucacuaugua

SEQ ID NO: 1082943 - RNA, 19 nt, Homo sapiens
gaaacuuccuugguaacug

SEQ ID NO: 1082944 - RNA, 19 nt, Homo sapiens
uauccucacugcaguaaug

SEQ ID NO: 1082945 - RNA, 19 nt, Homo sapiens
gagauugugggcagccuua

SEQ ID NO: 1082946 - RNA, 19 nt, Homo sapiens
ccagggagccaguuuaugu

SEQ ID NO: 1082947 - RNA, 19 nt, Homo sapiens
ugaaauagugguuccuaaa

SEQ ID NO: 1082948 - RNA, 19 nt, Homo sapiens
gaaagaaacauggauugca

SEQ ID NO: 1082949 - RNA, 19 nt, Homo sapiens
gaguagcacugagaucuuc

SEQ ID NO: 1082950 - RNA, 19 nt, Homo sapiens
cuuggaaguuugugaauug

SEQ ID NO: 1082951 - RNA, 19 nt, Homo sapiens
gguuggaaguucaaaguuc

SEQ ID NO: 1082952 - RNA, 19 nt, Homo sapiens
acugugaauugcagaauaa

SEQ ID NO: 1082953 - RNA, 19 nt, Homo sapiens
ggcgggaacugcagucaug

SEQ ID NO: 1082954 - RNA, 19 nt, Homo sapiens
auagaaauguugccucuca

SEQ ID NO: 1082955 - RNA, 19 nt, Homo sapiens
guaggcaagagaaagaaua

SEQ ID NO: 1082956 - RNA, 19 nt, Homo sapiens
gcaccccucuccccacuua

SEQ ID NO: 1082957 - RNA, 19 nt, Homo sapiens
gcuacgggcuucuccaaag

SEQ ID NO: 1082958 - RNA, 19 nt, Homo sapiens
aacauucgcuucagauuca

SEQ ID NO: 1082959 - RNA, 19 nt, Homo sapiens
gaagggguaugaaaaugaa

SEQ ID NO: 1082960 - RNA, 19 nt, Homo sapiens
ggauugcacuccaucacau

SEQ ID NO: 1082961 - RNA, 19 nt, Homo sapiens
caucuuccaugcuagguau

SEQ ID NO: 1082962 - RNA, 19 nt, Homo sapiens
uagagagccuccuggaaau

SEQ ID NO: 1082963 - RNA, 19 nt, Homo sapiens
ucuaagagucuaugagaaa

SEQ ID NO: 1082964 - RNA, 19 nt, Homo sapiens
aaauagugguuccuaaauc

SEQ ID NO: 1082965 - RNA, 19 nt, Homo sapiens
gaugguauacagcagguaa

SEQ ID NO: 1082966 - RNA, 19 nt, Homo sapiens
gcagcuacaaugauucuug

SEQ ID NO: 1082967 - RNA, 19 nt, Homo sapiens
agacagaugugcaugaacu

SEQ ID NO: 1082968 - RNA, 19 nt, Homo sapiens
ggcaauuaauggaacaguu

SEQ ID NO: 1082969 - RNA, 19 nt, Homo sapiens
gagaaguuacccaucacua

SEQ ID NO: 1082970 - RNA, 19 nt, Homo sapiens
gaacgucauuucugccuua

SEQ ID NO: 1082971 - RNA, 19 nt, Homo sapiens
ucaaagaacucaacaacaa

SEQ ID NO: 1082972 - RNA, 19 nt, Homo sapiens
guacuggaaucaucuuaua

SEQ ID NO: 1082973 - RNA, 19 nt, Homo sapiens
gagcugcuaucaauauuaa

SEQ ID NO: 1082974 - RNA, 19 nt, Homo sapiens
ggaagugccucaagauuuc

SEQ ID NO: 1082975 - RNA, 19 nt, Homo sapiens
gcacagaugucgugaaguc

SEQ ID NO: 1082976 - RNA, 19 nt, Homo sapiens
gaugagacauggacuguau

SEQ ID NO: 1082977 - RNA, 19 nt, Homo sapiens
gaaccugucugcagucaug

SEQ ID NO: 1082978 - RNA, 19 nt, Homo sapiens
gaugaaggauaaugagaaa

SEQ ID NO: 1082979 - RNA, 19 nt, Homo sapiens
aagaacagcuugcacagua

SEQ ID NO: 1082980 - RNA, 19 nt, Homo sapiens
cgagaaggcugagaaguuu

SEQ ID NO: 1082981 - RNA, 19 nt, Homo sapiens
agaacaagcuaaaggauuu

SEQ ID NO: 1082982 - RNA, 19 nt, Homo sapiens
aaaggaaacucauagaaga

SEQ ID NO: 1082983 - RNA, 19 nt, Homo sapiens
caacaagccuaccauuaau

SEQ ID NO: 1082984 - RNA, 19 nt, Homo sapiens
ugaauucacugccaacauu

SEQ ID NO: 1082985 - RNA, 19 nt, Homo sapiens
gggaagaaccaauauguuu

SEQ ID NO: 1082986 - RNA, 19 nt, Homo sapiens
gcagaaagacauccugaaa

SEQ ID NO: 1082987 - RNA, 19 nt, Homo sapiens
ugaaauagccagacugaaa

SEQ ID NO: 1082988 - RNA, 19 nt, Homo sapiens
gaauuauggugacguagaa

SEQ ID NO: 1082989 - RNA, 19 nt, Homo sapiens
acgcaaagcuaaaugcaua

SEQ ID NO: 1082990 - RNA, 19 nt, Homo sapiens
ggaggaaacucuaaaacua

SEQ ID NO: 1082991 - RNA, 19 nt, Homo sapiens
gcaaagaagaagcaaguuu

SEQ ID NO: 1082992 - RNA, 19 nt, Homo sapiens
guacaguaguuccaucaaa

SEQ ID NO: 1082993 - RNA, 19 nt, Homo sapiens
ucaacaagccuaccauuaa

SEQ ID NO: 1082994 - RNA, 19 nt, Homo sapiens
gcccuuauguugaggauuu

SEQ ID NO: 1082995 - RNA, 19 nt, Homo sapiens
ccacagugcuuccuucuca

SEQ ID NO: 1082996 - RNA, 19 nt, Homo sapiens
aaagacgccuucaggauuu

SEQ ID NO: 1082997 - RNA, 19 nt, Homo sapiens
caacacucuuuaucaagua

SEQ ID NO: 1082998 - RNA, 19 nt, Homo sapiens
ggacaaauaaguggaauga

SEQ ID NO: 1082999 - RNA, 19 nt, Homo sapiens
caagauuacuguccuagau

SEQ ID NO: 1083000 - RNA, 19 nt, Homo sapiens
caaagacgccuucaggauu

SEQ ID NO: 1083001 - RNA, 19 nt, Homo sapiens
agacaacacucuuuaucaa

SEQ ID NO: 1083002 - RNA, 19 nt, Homo sapiens
gaagaagagacaagaagaa

SEQ ID NO: 1083003 - RNA, 19 nt, Homo sapiens
gaaagaagggauuggaguu

SEQ ID NO: 1083004 - RNA, 19 nt, Homo sapiens
ccauguggcuggcuauauu

SEQ ID NO: 1083005 - RNA, 19 nt, Homo sapiens
gagcagaggcagaaacuug

SEQ ID NO: 1083006 - RNA, 19 nt, Homo sapiens
aaaucgagcugcagaagaa

SEQ ID NO: 1083007 - RNA, 19 nt, Homo sapiens
uaaaggaaggucagacaua

SEQ ID NO: 1083008 - RNA, 19 nt, Homo sapiens
cagauuacguuucacaaga

SEQ ID NO: 1083009 - RNA, 19 nt, Homo sapiens
cagaaucuauuggaucuuu

SEQ ID NO: 1083010 - RNA, 19 nt, Homo sapiens
caaauuggauguagacaac

SEQ ID NO: 1083011 - RNA, 19 nt, Homo sapiens
cagacacgaugaaggauaa

SEQ ID NO: 1083012 - RNA, 19 nt, Homo sapiens
ggauuugcaucgugugauu

SEQ ID NO: 1083013 - RNA, 19 nt, Homo sapiens
gagcauugcaucuuugaaa

SEQ ID NO: 1083014 - RNA, 19 nt, Homo sapiens
ugaacugccucauuugauu

SEQ ID NO: 1083015 - RNA, 19 nt, Homo sapiens
ggaccaagaccuucaccua

SEQ ID NO: 1083016 - RNA, 19 nt, Homo sapiens
gagagaagcagcagagaga

SEQ ID NO: 1083017 - RNA, 19 nt, Homo sapiens
aguacaggcugcaauauaa

SEQ ID NO: 1083018 - RNA, 19 nt, Homo sapiens
ccaagaccuucaccuauga

SEQ ID NO: 1083019 - RNA, 19 nt, Homo sapiens
acacugauguuuacacaga

SEQ ID NO: 1083020 - RNA, 19 nt, Homo sapiens
gaguacaggcugcaauaua

SEQ ID NO: 1083021 - RNA, 19 nt, Homo sapiens
gaagaacuccaacgacuca

SEQ ID NO: 1083022 - RNA, 19 nt, Homo sapiens
gcaacagcgugaagaacuu

SEQ ID NO: 1083023 - RNA, 19 nt, Homo sapiens
gggauucuguguugacuug

SEQ ID NO: 1083024 - RNA, 19 nt, Homo sapiens
cgaaacauaccauuuguga

SEQ ID NO: 1083025 - RNA, 19 nt, Homo sapiens
aaacgacaaucacaaacuu

SEQ ID NO: 1083026 - RNA, 19 nt, Homo sapiens
aaauaaagccaguggagua

SEQ ID NO: 1083027 - RNA, 19 nt, Homo sapiens
accaauauguuucgcuuua

SEQ ID NO: 1083028 - RNA, 19 nt, Homo sapiens
gagugagcauugcaucuuu

SEQ ID NO: 1083029 - RNA, 19 nt, Homo sapiens
ggagaaacccuaaguacuc

SEQ ID NO: 1083030 - RNA, 19 nt, Homo sapiens
gaccuucaccuaugacuuu

SEQ ID NO: 1083031 - RNA, 19 nt, Homo sapiens
gaacaugacaaagaaucua

SEQ ID NO: 1083032 - RNA, 19 nt, Homo sapiens
ggucagacauacguuggua

SEQ ID NO: 1083033 - RNA, 19 nt, Homo sapiens
ucacggaagugccucaaga

SEQ ID NO: 1083034 - RNA, 19 nt, Homo sapiens
ucacagaugucacggaagu

SEQ ID NO: 1083035 - RNA, 19 nt, Homo sapiens
caacugcguuucuucgaau

SEQ ID NO: 1083036 - RNA, 19 nt, Homo sapiens
gaacauucucccaaaucua

SEQ ID NO: 1083037 - RNA, 19 nt, Homo sapiens
gagaacaagcuaaaggauu

SEQ ID NO: 1083038 - RNA, 19 nt, Homo sapiens
ccaaggaauggacaaauaa

SEQ ID NO: 1083039 - RNA, 19 nt, Homo sapiens
aagcaagaguucaagaauu

SEQ ID NO: 1083040 - RNA, 19 nt, Homo sapiens
caaguucacucaggcuaaa

SEQ ID NO: 1083041 - RNA, 19 nt, Homo sapiens
gaugggaaauucaggagau

SEQ ID NO: 1083042 - RNA, 19 nt, Homo sapiens
caaaguggguggcuuacca

SEQ ID NO: 1083043 - RNA, 19 nt, Homo sapiens
gaagcaagaguucaagaau

SEQ ID NO: 1083044 - RNA, 19 nt, Homo sapiens
ccaaacauuuaguacagaa

SEQ ID NO: 1083045 - RNA, 19 nt, Homo sapiens
gcauugcacuucuguguac

SEQ ID NO: 1083046 - RNA, 19 nt, Homo sapiens
agaaauaccucagggacuu

SEQ ID NO: 1083047 - RNA, 19 nt, Homo sapiens
ggacuguauucaggcguua

SEQ ID NO: 1083048 - RNA, 19 nt, Homo sapiens
gaccugaaggacccaauua

SEQ ID NO: 1083049 - RNA, 19 nt, Homo sapiens
gcagacacgaugaaggaua

SEQ ID NO: 1083050 - RNA, 19 nt, Homo sapiens
gaagagacaagaagaagag

SEQ ID NO: 1083051 - RNA, 19 nt, Homo sapiens
auucugaacugccucauuu

SEQ ID NO: 1083052 - RNA, 19 nt, Homo sapiens
gaugccaacgucaaacuua

SEQ ID NO: 1083053 - RNA, 19 nt, Homo sapiens
uaaaugaaaccaccagaug

SEQ ID NO: 1083054 - RNA, 19 nt, Homo sapiens
gaaggauaaugagaaacuu

SEQ ID NO: 1083055 - RNA, 19 nt, Homo sapiens
ugaagaagaaguccaaaga

SEQ ID NO: 1083056 - RNA, 19 nt, Homo sapiens
caggagagguuagaauaug

SEQ ID NO: 1083057 - RNA, 19 nt, Homo sapiens
ggaagaaccaauauguuuc

SEQ ID NO: 1083058 - RNA, 19 nt, Homo sapiens
aggagauucuggcuuaaua

SEQ ID NO: 1083059 - RNA, 19 nt, Homo sapiens
gaagagaacggaccaagac

SEQ ID NO: 1083060 - RNA, 19 nt, Homo sapiens
ccagaccacccuuaaauga

SEQ ID NO: 1083061 - RNA, 19 nt, Homo sapiens
gggacugacucucucgaaa

SEQ ID NO: 1083062 - RNA, 19 nt, Homo sapiens
gaugguuucucgcucuuug

SEQ ID NO: 1083063 - RNA, 19 nt, Homo sapiens
gagguuagaauaugaaauc

SEQ ID NO: 1083064 - RNA, 19 nt, Homo sapiens
gaggccaaguucauuauuc

SEQ ID NO: 1083065 - RNA, 19 nt, Homo sapiens
gagagaagcaggagaugau

SEQ ID NO: 1083066 - RNA, 19 nt, Homo sapiens
ucagauauuucaagaacug

SEQ ID NO: 1083067 - RNA, 19 nt, Homo sapiens
ggaaacucauagaagaaau

SEQ ID NO: 1083068 - RNA, 19 nt, Homo sapiens
ccaauauguuucgcuuuaa

SEQ ID NO: 1083069 - RNA, 19 nt, Homo sapiens
accaaggaauggacaaaua

SEQ ID NO: 1083070 - RNA, 19 nt, Homo sapiens
gaaagaagggagaguaaua

SEQ ID NO: 1083071 - RNA, 19 nt, Homo sapiens
ggacucagcugguuuauac

SEQ ID NO: 1083072 - RNA, 19 nt, Homo sapiens
ccacuaacaucucaacuug

SEQ ID NO: 1083073 - RNA, 19 nt, Homo sapiens
cgagacagcucuggacaua

SEQ ID NO: 1083074 - RNA, 19 nt, Homo sapiens
gaaggacuaugaagccaaa

SEQ ID NO: 1083075 - RNA, 19 nt, Homo sapiens
ggaagaagcaccacaagga

SEQ ID NO: 1083076 - RNA, 19 nt, Homo sapiens
uguacuggcuguuaaauaa

SEQ ID NO: 1083077 - RNA, 19 nt, Homo sapiens
gaacucgucuugcauuugg

SEQ ID NO: 1083078 - RNA, 19 nt, Homo sapiens
gaaacacgagcuucaauga

SEQ ID NO: 1083079 - RNA, 19 nt, Homo sapiens
gaacaggguugucuuuuga

SEQ ID NO: 1083080 - RNA, 19 nt, Homo sapiens
gaacacggcucugcacuac

SEQ ID NO: 1083081 - RNA, 19 nt, Homo sapiens
ucacucaucucuaauaaag

SEQ ID NO: 1083082 - RNA, 19 nt, Homo sapiens
gaagggagaguaauagaau

SEQ ID NO: 1083083 - RNA, 19 nt, Homo sapiens
caacaugcaugcuguacug

SEQ ID NO: 1083084 - RNA, 19 nt, Homo sapiens
gaaagcagauacaccuaag

SEQ ID NO: 1083085 - RNA, 19 nt, Homo sapiens
guucuuuccuaucucauua

SEQ ID NO: 1083086 - RNA, 19 nt, Homo sapiens
guucagagcugggacuuga

SEQ ID NO: 1083087 - RNA, 19 nt, Homo sapiens
gaauggagaggcaaagaaa

SEQ ID NO: 1083088 - RNA, 19 nt, Homo sapiens
guggaaagcuggucuuaag

SEQ ID NO: 1083089 - RNA, 19 nt, Homo sapiens
ggacuacuccuggguaauu

SEQ ID NO: 1083090 - RNA, 19 nt, Homo sapiens
ucagauaccacacgaguaa

SEQ ID NO: 1083091 - RNA, 19 nt, Homo sapiens
gagggacacugcagcuuga

SEQ ID NO: 1083092 - RNA, 19 nt, Homo sapiens
ccacuucucuucucuuucu

SEQ ID NO: 1083093 - RNA, 19 nt, Homo sapiens
gggcauggcucuggacuca

SEQ ID NO: 1083094 - RNA, 19 nt, Homo sapiens
gaacucaggauguggcuau

SEQ ID NO: 1083095 - RNA, 19 nt, Homo sapiens
ucacuaaauuccaacucua

SEQ ID NO: 1083096 - RNA, 19 nt, Homo sapiens
caagaaaagugacggaauu

SEQ ID NO: 1083097 - RNA, 19 nt, Homo sapiens
ccacaggcuuccuaaacuu

SEQ ID NO: 1083098 - RNA, 19 nt, Homo sapiens
gcccacuucucuucucuuu

SEQ ID NO: 1083099 - RNA, 19 nt, Homo sapiens
ggacauagccaggaagaag

SEQ ID NO: 1083100 - RNA, 19 nt, Homo sapiens
gccaaacccugaggagaaa

SEQ ID NO: 1083101 - RNA, 19 nt, Homo sapiens
ggaaacacgagcuucaaug

SEQ ID NO: 1083102 - RNA, 19 nt, Homo sapiens
ggaaguguggagucaagua

SEQ ID NO: 1083103 - RNA, 19 nt, Homo sapiens
caucucagacuuguuauuu

SEQ ID NO: 1083104 - RNA, 19 nt, Homo sapiens
ggaauggagaggcaaagaa

SEQ ID NO: 1083105 - RNA, 19 nt, Homo sapiens
cuacagaucacauccauuc

SEQ ID NO: 1083106 - RNA, 19 nt, Homo sapiens
ggaacacggcucugcacua

SEQ ID NO: 1083107 - RNA, 19 nt, Homo sapiens
ggucaacucaggagccuuu

SEQ ID NO: 1083108 - RNA, 19 nt, Homo sapiens
guugauggaugcccacuuc

SEQ ID NO: 1083109 - RNA, 19 nt, Homo sapiens
uauaugaccauuacaguug

SEQ ID NO: 1083110 - RNA, 19 nt, Homo sapiens
gaauaggcagggucagauu

SEQ ID NO: 1083111 - RNA, 19 nt, Homo sapiens
caacaagaccuaugagacu

SEQ ID NO: 1083112 - RNA, 19 nt, Homo sapiens
gagaggccguggaauccuu

SEQ ID NO: 1083113 - RNA, 19 nt, Homo sapiens
caaccggacguaccacuuu

SEQ ID NO: 1083114 - RNA, 19 nt, Homo sapiens
ggccaaacccugaggagaa

SEQ ID NO: 1083115 - RNA, 19 nt, Homo sapiens
ucucagacuuguuauuuca

SEQ ID NO: 1083116 - RNA, 19 nt, Homo sapiens
gcacuacgcagcacucuac

SEQ ID NO: 1083117 - RNA, 19 nt, Homo sapiens
ccacguggcucagcaccaa

SEQ ID NO: 1083118 - RNA, 19 nt, Homo sapiens
ggaacaggguugucuuuug

SEQ ID NO: 1083119 - RNA, 19 nt, Homo sapiens
ucagaucgagacucuauuu

SEQ ID NO: 1083120 - RNA, 19 nt, Homo sapiens
gaaguguggagucaaguau

SEQ ID NO: 1083121 - RNA, 19 nt, Homo sapiens
uggccaagcuggagaagga

SEQ ID NO: 1083122 - RNA, 19 nt, Homo sapiens
aaagaaagaagggagagua

SEQ ID NO: 1083123 - RNA, 19 nt, Homo sapiens
ggagaucguucugaagucu

SEQ ID NO: 1083124 - RNA, 19 nt, Homo sapiens
ggacagccauuugcaacag

SEQ ID NO: 1083125 - RNA, 19 nt, Homo sapiens
acucaucucuaauaaagga

SEQ ID NO: 1083126 - RNA, 19 nt, Homo sapiens
gcucuggacucagcugguu

SEQ ID NO: 1083127 - RNA, 19 nt, Homo sapiens
caucagaucgagacucuau

SEQ ID NO: 1083128 - RNA, 19 nt, Homo sapiens
ugauggcgguucuuuccua

SEQ ID NO: 1083129 - RNA, 19 nt, Homo sapiens
gaacaccugagccggaaga

SEQ ID NO: 1083130 - RNA, 19 nt, Homo sapiens
cauuacaguugucuacaga

SEQ ID NO: 1083131 - RNA, 19 nt, Homo sapiens
cggaagaacucaggaugug

SEQ ID NO: 1083132 - RNA, 19 nt, Homo sapiens
gagggacggucgacaggau

SEQ ID NO: 1083133 - RNA, 19 nt, Homo sapiens
gaacugggcgugcgcuuuu

SEQ ID NO: 1083134 - RNA, 19 nt, Homo sapiens
cuucucagccagccauuua

SEQ ID NO: 1083135 - RNA, 19 nt, Homo sapiens
caguggagaucguucugaa

SEQ ID NO: 1083136 - RNA, 19 nt, Homo sapiens
ugauuuagcaggaaggaaa

SEQ ID NO: 1083137 - RNA, 19 nt, Homo sapiens
gauggcgguucuuuccuau

SEQ ID NO: 1083138 - RNA, 19 nt, Homo sapiens
acauggccuuucccuguua

SEQ ID NO: 1083139 - RNA, 19 nt, Homo sapiens
uggcaucacugaaggagau

SEQ ID NO: 1083140 - RNA, 19 nt, Homo sapiens
gagaaagcagauacaccua

SEQ ID NO: 1083141 - RNA, 19 nt, Homo sapiens
cagccaaauuguagaguca

SEQ ID NO: 1083142 - RNA, 19 nt, Homo sapiens
guacuggcuguuaaauaaa

SEQ ID NO: 1083143 - RNA, 19 nt, Homo sapiens
agacauuuguucucuugga

SEQ ID NO: 1083144 - RNA, 19 nt, Homo sapiens
cugcugacgugccaaguga

SEQ ID NO: 1083145 - RNA, 19 nt, Homo sapiens
auucaucucagacuuguua

SEQ ID NO: 1083146 - RNA, 19 nt, Homo sapiens
ggguugggcuugggaauag

SEQ ID NO: 1083147 - RNA, 19 nt, Homo sapiens
gcggagcccugaagauggu

SEQ ID NO: 1083148 - RNA, 19 nt, Homo sapiens
gacuacuccuggguaauuu

SEQ ID NO: 1083149 - RNA, 19 nt, Homo sapiens
ggucauggaggcccagcua

SEQ ID NO: 1083150 - RNA, 19 nt, Homo sapiens
agaaagcagauacaccuaa

SEQ ID NO: 1083151 - RNA, 19 nt, Homo sapiens
ggaccuguguuaggcacuu

SEQ ID NO: 1083152 - RNA, 19 nt, Homo sapiens
cacauggccuuucccuguu

SEQ ID NO: 1083153 - RNA, 19 nt, Homo sapiens
caagccauccugcagagaa

SEQ ID NO: 1083154 - RNA, 19 nt, Homo sapiens
ucagaugcacccacauuug

SEQ ID NO: 1083155 - RNA, 19 nt, Homo sapiens
ggaauaggcagggucagau

SEQ ID NO: 1083156 - RNA, 19 nt, Homo sapiens
guguuaggcacuucagaua

SEQ ID NO: 1083157 - RNA, 19 nt, Homo sapiens
ccaagggugugcaagacau

SEQ ID NO: 1083158 - RNA, 19 nt, Homo sapiens
guggacuacuccuggguaa

SEQ ID NO: 1083159 - RNA, 19 nt, Homo sapiens
gaagagcaggccugggaau

SEQ ID NO: 1083160 - RNA, 19 nt, Homo sapiens
cuucagagccucaucaagu

SEQ ID NO: 1083161 - RNA, 19 nt, Homo sapiens
aguagggacugucuucuca

SEQ ID NO: 1083162 - RNA, 19 nt, Homo sapiens
ccaaguagggacugucuuc

SEQ ID NO: 1083163 - RNA, 19 nt, Homo sapiens
gcgguucuuuccuaucuca

SEQ ID NO: 1083164 - RNA, 19 nt, Homo sapiens
gacauuuguucucuuggau

SEQ ID NO: 1083165 - RNA, 19 nt, Homo sapiens
gagcugagacauuuguucu

SEQ ID NO: 1083166 - RNA, 19 nt, Homo sapiens
agacagcucuggacauagc

SEQ ID NO: 1083167 - RNA, 19 nt, Homo sapiens
aagaaagaagggagaguaa

SEQ ID NO: 1083168 - RNA, 19 nt, Homo sapiens
guaccgagaggccguggaa

SEQ ID NO: 1083169 - RNA, 19 nt, Homo sapiens
ucagcugguuuauaccuau

SEQ ID NO: 1083170 - RNA, 19 nt, Homo sapiens
ggaaugggaucuaaucuaa

SEQ ID NO: 1083171 - RNA, 19 nt, Homo sapiens
aaacaaagcaguccuauaa

SEQ ID NO: 1083172 - RNA, 19 nt, Homo sapiens
gaaacaaucuagcagagaa

SEQ ID NO: 1083173 - RNA, 19 nt, Homo sapiens
ggcaguagaucauggaaua

SEQ ID NO: 1083174 - RNA, 19 nt, Homo sapiens
guaaagagaacauacagua

SEQ ID NO: 1083175 - RNA, 19 nt, Homo sapiens
guaaagagguaccaacugu

SEQ ID NO: 1083176 - RNA, 19 nt, Homo sapiens
caaacgagcuugucagaag

SEQ ID NO: 1083177 - RNA, 19 nt, Homo sapiens
gaacugaagaguaaaucua

SEQ ID NO: 1083178 - RNA, 19 nt, Homo sapiens
gagcaugugugucggauau

SEQ ID NO: 1083179 - RNA, 19 nt, Homo sapiens
gcagagaauuaaugucaga

SEQ ID NO: 1083180 - RNA, 19 nt, Homo sapiens
ccaacagacucuuauguga

SEQ ID NO: 1083181 - RNA, 19 nt, Homo sapiens
gaaauagaaacuccucauu

SEQ ID NO: 1083182 - RNA, 19 nt, Homo sapiens
gaaacaaagcaguccuaua

SEQ ID NO: 1083183 - RNA, 19 nt, Homo sapiens
caaggaguauaaacaugua

SEQ ID NO: 1083184 - RNA, 19 nt, Homo sapiens
guagugcuccauuuaauaa

SEQ ID NO: 1083185 - RNA, 19 nt, Homo sapiens
gcucucggcuggcagaauu

SEQ ID NO: 1083186 - RNA, 19 nt, Homo sapiens
aagcaaaguuuaugggaaa

SEQ ID NO: 1083187 - RNA, 19 nt, Homo sapiens
caaagaaugguuucaguga

SEQ ID NO: 1083188 - RNA, 19 nt, Homo sapiens
uuaaguggauccuguggua

SEQ ID NO: 1083189 - RNA, 19 nt, Homo sapiens
cagaaaggguggacacaga

SEQ ID NO: 1083190 - RNA, 19 nt, Homo sapiens
gaaacaagaggaaacuaga

SEQ ID NO: 1083191 - RNA, 19 nt, Homo sapiens
gagccugacuucucccaaa

SEQ ID NO: 1083192 - RNA, 19 nt, Homo sapiens
cagaauuccucccugcuuu

SEQ ID NO: 1083193 - RNA, 19 nt, Homo sapiens
gaauuaaugucagaaccuu

SEQ ID NO: 1083194 - RNA, 19 nt, Homo sapiens
aauagaaacuccucauugu

SEQ ID NO: 1083195 - RNA, 19 nt, Homo sapiens
ccaaagccaaggaguauaa

SEQ ID NO: 1083196 - RNA, 19 nt, Homo sapiens
cacaagugcugcuguaguu

SEQ ID NO: 1083197 - RNA, 19 nt, Homo sapiens
gcaccauacuggcuagaga

SEQ ID NO: 1083198 - RNA, 19 nt, Homo sapiens
ggacacagauuuuaugcaa

SEQ ID NO: 1083199 - RNA, 19 nt, Homo sapiens
caaagcaguccuauaaaga

SEQ ID NO: 1083200 - RNA, 19 nt, Homo sapiens
gcaguccuauaaagagaaa

SEQ ID NO: 1083201 - RNA, 19 nt, Homo sapiens
agacacaagugcugcugua

SEQ ID NO: 1083202 - RNA, 19 nt, Homo sapiens
uaggugaaauugaguguga

SEQ ID NO: 1083203 - RNA, 19 nt, Homo sapiens
gguagugcuccauuuaaua

SEQ ID NO: 1083204 - RNA, 19 nt, Homo sapiens
gaccacaagauucaguuua

SEQ ID NO: 1083205 - RNA, 19 nt, Homo sapiens
caacagacucuuaugugaa

SEQ ID NO: 1083206 - RNA, 19 nt, Homo sapiens
gguaauuccucuccugcaa

SEQ ID NO: 1083207 - RNA, 19 nt, Homo sapiens
acaaagcaguccuauaaag

SEQ ID NO: 1083208 - RNA, 19 nt, Homo sapiens
uaaaguugcaggaaacauu

SEQ ID NO: 1083209 - RNA, 19 nt, Homo sapiens
cauacuggcuagagaaugu

SEQ ID NO: 1083210 - RNA, 19 nt, Homo sapiens
guacuuauuucaucaagcu

SEQ ID NO: 1083211 - RNA, 19 nt, Homo sapiens
gcaugugugucggauauau

SEQ ID NO: 1083212 - RNA, 19 nt, Homo sapiens
cgagcuguauggacuauau

SEQ ID NO: 1083213 - RNA, 19 nt, Homo sapiens
gaugugauaugucagaacu

SEQ ID NO: 1083214 - RNA, 19 nt, Homo sapiens
gaaaaugacucaggcacuu

SEQ ID NO: 1083215 - RNA, 19 nt, Homo sapiens
agaagacaaucaagugaga

SEQ ID NO: 1083216 - RNA, 19 nt, Homo sapiens
ggagaaugaccauggagaa

SEQ ID NO: 1083217 - RNA, 19 nt, Homo sapiens
gaaacgaggaggcuuugug

SEQ ID NO: 1083218 - RNA, 19 nt, Homo sapiens
aagagaacauacaguaaug

SEQ ID NO: 1083219 - RNA, 19 nt, Homo sapiens
uggauccugugguaacuua

SEQ ID NO: 1083220 - RNA, 19 nt, Homo sapiens
aaauagaaacuccucauug

SEQ ID NO: 1083221 - RNA, 19 nt, Homo sapiens
gaaaggguggacacagauu

SEQ ID NO: 1083222 - RNA, 19 nt, Homo sapiens
gaaacuagagcuggcagaa

SEQ ID NO: 1083223 - RNA, 19 nt, Homo sapiens
ccucuucucagacuaauaa

SEQ ID NO: 1083224 - RNA, 19 nt, Homo sapiens
gagaaggagccuacagaug

SEQ ID NO: 1083225 - RNA, 19 nt, Homo sapiens
uagcagagaauuaauguca

SEQ ID NO: 1083226 - RNA, 19 nt, Homo sapiens
caaucuagcagagaauuaa

SEQ ID NO: 1083227 - RNA, 19 nt, Homo sapiens
ugugguaacuuaaacuguu

SEQ ID NO: 1083228 - RNA, 19 nt, Homo sapiens
aacugucgcugaugugaua

SEQ ID NO: 1083229 - RNA, 19 nt, Homo sapiens
aauaacagccaaagaguug

SEQ ID NO: 1083230 - RNA, 19 nt, Homo sapiens
gcaggaaugggaucuaauc

SEQ ID NO: 1083231 - RNA, 19 nt, Homo sapiens
guaaugcacaguccuuaau

SEQ ID NO: 1083232 - RNA, 19 nt, Homo sapiens
gaaguugguuguuuuaucu

SEQ ID NO: 1083233 - RNA, 19 nt, Homo sapiens
gccaaggaguauaaacaug

SEQ ID NO: 1083234 - RNA, 19 nt, Homo sapiens
aaugcacaguccuuaauuu

SEQ ID NO: 1083235 - RNA, 19 nt, Homo sapiens
gcuuaaauauugcauagcu

SEQ ID NO: 1083236 - RNA, 19 nt, Homo sapiens
ucgcugaugugauauguca

SEQ ID NO: 1083237 - RNA, 19 nt, Homo sapiens
gguaggcgcugugguugug

SEQ ID NO: 1083238 - RNA, 19 nt, Homo sapiens
ccggugcucuugcaacuga

SEQ ID NO: 1083239 - RNA, 19 nt, Homo sapiens
caggaaugguuaaaucauc

SEQ ID NO: 1083240 - RNA, 19 nt, Homo sapiens
gaaacuccucauuguguga

SEQ ID NO: 1083241 - RNA, 19 nt, Homo sapiens
uagaaacuccucauugugu

SEQ ID NO: 1083242 - RNA, 19 nt, Homo sapiens
gaaugggaucuaaucuaaa

SEQ ID NO: 1083243 - RNA, 19 nt, Homo sapiens
gcaggugcagguuaucauu

SEQ ID NO: 1083244 - RNA, 19 nt, Homo sapiens
gaaagccaagacucacauu

SEQ ID NO: 1083245 - RNA, 19 nt, Homo sapiens
aaagaagacaaucaaguga

SEQ ID NO: 1083246 - RNA, 19 nt, Homo sapiens
ccaaggaguauaaacaugu

SEQ ID NO: 1083247 - RNA, 19 nt, Homo sapiens
gguuucggcugguaaaaua

SEQ ID NO: 1083248 - RNA, 19 nt, Homo sapiens
aaccuaaaguugcaggaaa

SEQ ID NO: 1083249 - RNA, 19 nt, Homo sapiens
caccuuuccuugccaguga

SEQ ID NO: 1083250 - RNA, 19 nt, Homo sapiens
gaaaauacuggagcucaua

SEQ ID NO: 1083251 - RNA, 19 nt, Homo sapiens
ggagaaggagccuacagau

SEQ ID NO: 1083252 - RNA, 19 nt, Homo sapiens
guuguucucaucccuuaua

SEQ ID NO: 1083253 - RNA, 19 nt, Homo sapiens
cgacggagagcaugugugu

SEQ ID NO: 1083254 - RNA, 19 nt, Homo sapiens
caucaugaccacaagauuc

SEQ ID NO: 1083255 - RNA, 19 nt, Homo sapiens
gaucauggaauacccucuu

SEQ ID NO: 1083256 - RNA, 19 nt, Homo sapiens
cagcacugguggaacuuga

SEQ ID NO: 1083257 - RNA, 19 nt, Homo sapiens
gugguaacuuaaacuguug

SEQ ID NO: 1083258 - RNA, 19 nt, Homo sapiens
aaaguugcaggaaacauuu

SEQ ID NO: 1083259 - RNA, 19 nt, Homo sapiens
caaaaugugugcuuuaacu

SEQ ID NO: 1083260 - RNA, 19 nt, Homo sapiens
guguauguguggaguaugu

SEQ ID NO: 1083261 - RNA, 19 nt, Homo sapiens
gaaaagaagacaaucaagu

SEQ ID NO: 1083262 - RNA, 19 nt, Homo sapiens
ggaaacaaagcaguccuau

SEQ ID NO: 1083263 - RNA, 19 nt, Homo sapiens
aagcaguccuauaaagaga

SEQ ID NO: 1083264 - RNA, 19 nt, Homo sapiens
cagugaagauggcgugcuu

SEQ ID NO: 1083265 - RNA, 19 nt, Homo sapiens
caagugagaaggaaaauga

SEQ ID NO: 1083266 - RNA, 19 nt, Homo sapiens
gcaaacgagcuugucagaa

SEQ ID NO: 1083267 - RNA, 19 nt, Homo sapiens
gauccugugguaacuuaaa

SEQ ID NO: 1083268 - RNA, 19 nt, Homo sapiens
cuccguggaugaaauagaa

SEQ ID NO: 1083269 - RNA, 19 nt, Homo sapiens
acaaucaagugagaaggaa

SEQ ID NO: 1083270 - RNA, 19 nt, Homo sapiens
gcaaugggaugugaaauua

SEQ ID NO: 1083271 - RNA, 19 nt, Homo sapiens
gaacugagguccacuacaa

SEQ ID NO: 1083272 - RNA, 19 nt, Homo sapiens
gauagcaacucauuacuaa

SEQ ID NO: 1083273 - RNA, 19 nt, Homo sapiens
gcacagaacugaauccaau

SEQ ID NO: 1083274 - RNA, 19 nt, Homo sapiens
ggaccuggcuggaaaguau

SEQ ID NO: 1083275 - RNA, 19 nt, Homo sapiens
gaagagaaagauagguuua

SEQ ID NO: 1083276 - RNA, 19 nt, Homo sapiens
ggaguuccuuuauuuguaa

SEQ ID NO: 1083277 - RNA, 19 nt, Homo sapiens
gaaguacccugacaaccaa

SEQ ID NO: 1083278 - RNA, 19 nt, Homo sapiens
caagccaaguugaauauuu

SEQ ID NO: 1083279 - RNA, 19 nt, Homo sapiens
gcaaagaaguacccugaca

SEQ ID NO: 1083280 - RNA, 19 nt, Homo sapiens
ggaagcauguucucuaugg

SEQ ID NO: 1083281 - RNA, 19 nt, Homo sapiens
gaagaagagaauacaagua

SEQ ID NO: 1083282 - RNA, 19 nt, Homo sapiens
gaggaagcauguucucuau

SEQ ID NO: 1083283 - RNA, 19 nt, Homo sapiens
cgagauuucccaaagauua

SEQ ID NO: 1083284 - RNA, 19 nt, Homo sapiens
gaaaguauggccaagauuc

SEQ ID NO: 1083285 - RNA, 19 nt, Homo sapiens
agaagaagguaaagaguau

SEQ ID NO: 1083286 - RNA, 19 nt, Homo sapiens
gaaacaacgagacuucaaa

SEQ ID NO: 1083287 - RNA, 19 nt, Homo sapiens
gaaaugcaccacaacauca

SEQ ID NO: 1083288 - RNA, 19 nt, Homo sapiens
ccauauugcugcucucauu

SEQ ID NO: 1083289 - RNA, 19 nt, Homo sapiens
caacauucgcuugcaauua

SEQ ID NO: 1083290 - RNA, 19 nt, Homo sapiens
uaaguuugcugucaguuau

SEQ ID NO: 1083291 - RNA, 19 nt, Homo sapiens
gcucaaaugcaaaccauaa

SEQ ID NO: 1083292 - RNA, 19 nt, Homo sapiens
ggaggaagcauguucucua

SEQ ID NO: 1083293 - RNA, 19 nt, Homo sapiens
gaagaaaccaaugcaaaga

SEQ ID NO: 1083294 - RNA, 19 nt, Homo sapiens
gcucuaugcagauaaauuu

SEQ ID NO: 1083295 - RNA, 19 nt, Homo sapiens
uggcagagguggugaauuc

SEQ ID NO: 1083296 - RNA, 19 nt, Homo sapiens
caagauacaccauacaaug

SEQ ID NO: 1083297 - RNA, 19 nt, Homo sapiens
caccaaacauuaaggaaga

SEQ ID NO: 1083298 - RNA, 19 nt, Homo sapiens
ccucugaauuugcacauuu

SEQ ID NO: 1083299 - RNA, 19 nt, Homo sapiens
caagcucuaugcagauaaa

SEQ ID NO: 1083300 - RNA, 19 nt, Homo sapiens
ggaccugacuaagcguaua

SEQ ID NO: 1083301 - RNA, 19 nt, Homo sapiens
gaagguuucugagcuuaau

SEQ ID NO: 1083302 - RNA, 19 nt, Homo sapiens
gaacugaauccaauugaag

SEQ ID NO: 1083303 - RNA, 19 nt, Homo sapiens
ugucagaucucuacuacga

SEQ ID NO: 1083304 - RNA, 19 nt, Homo sapiens
gcauuacaccaaacauuaa

SEQ ID NO: 1083305 - RNA, 19 nt, Homo sapiens
aagaaaggguuacuggaaa

SEQ ID NO: 1083306 - RNA, 19 nt, Homo sapiens
ccaauaauuucgccaaugg

SEQ ID NO: 1083307 - RNA, 19 nt, Homo sapiens
ggaagagaaagauagguuu

SEQ ID NO: 1083308 - RNA, 19 nt, Homo sapiens
aaagauuacucaagcucua

SEQ ID NO: 1083309 - RNA, 19 nt, Homo sapiens
gaagaacugagguccacua

SEQ ID NO: 1083310 - RNA, 19 nt, Homo sapiens
gcagacaaugugaagauaa

SEQ ID NO: 1083311 - RNA, 19 nt, Homo sapiens
gcccaucauugcugucuuu

SEQ ID NO: 1083312 - RNA, 19 nt, Homo sapiens
ggaagaaggagcgaugaaa

SEQ ID NO: 1083313 - RNA, 19 nt, Homo sapiens
cgcaagcacuccugaacua

SEQ ID NO: 1083314 - RNA, 19 nt, Homo sapiens
caauggagauaagcaaaug

SEQ ID NO: 1083315 - RNA, 19 nt, Homo sapiens
aaacacaguuacuuugcaa

SEQ ID NO: 1083316 - RNA, 19 nt, Homo sapiens
gagcauuacaccaaacauu

SEQ ID NO: 1083317 - RNA, 19 nt, Homo sapiens
caaaugcaaaccauaaguu

SEQ ID NO: 1083318 - RNA, 19 nt, Homo sapiens
cucgcuagcuucagaauuu

SEQ ID NO: 1083319 - RNA, 19 nt, Homo sapiens
ccacuuacaacucaucaaa

SEQ ID NO: 1083320 - RNA, 19 nt, Homo sapiens
gaagaaggagcgaugaaag

SEQ ID NO: 1083321 - RNA, 19 nt, Homo sapiens
gccaugaaauuccagugaa

SEQ ID NO: 1083322 - RNA, 19 nt, Homo sapiens
cagacaaugugaagauaau

SEQ ID NO: 1083323 - RNA, 19 nt, Homo sapiens
gagcagacaaugugaagau

SEQ ID NO: 1083324 - RNA, 19 nt, Homo sapiens
gaaugcaagauacaccaua

SEQ ID NO: 1083325 - RNA, 19 nt, Homo sapiens
aaagaaaggguuacuggaa

SEQ ID NO: 1083326 - RNA, 19 nt, Homo sapiens
uggaguuccuuuauuugua

SEQ ID NO: 1083327 - RNA, 19 nt, Homo sapiens
aaccugcacucgaguaauu

SEQ ID NO: 1083328 - RNA, 19 nt, Homo sapiens
gcugugagccaguuaauag

SEQ ID NO: 1083329 - RNA, 19 nt, Homo sapiens
uuaaucagcuuugcacaau

SEQ ID NO: 1083330 - RNA, 19 nt, Homo sapiens
ugaagaagaagaagguaaa

SEQ ID NO: 1083331 - RNA, 19 nt, Homo sapiens
ugaaggagcacgagaagga

SEQ ID NO: 1083332 - RNA, 19 nt, Homo sapiens
aagccaaguugaauauuug

SEQ ID NO: 1083333 - RNA, 19 nt, Homo sapiens
gcacucgaguaauuagcaa

SEQ ID NO: 1083334 - RNA, 19 nt, Homo sapiens
aaaccaaugcaaagaagua

SEQ ID NO: 1083335 - RNA, 19 nt, Homo sapiens
gaagaagaagguaaagagu

SEQ ID NO: 1083336 - RNA, 19 nt, Homo sapiens
caucauugcugucuuugag

SEQ ID NO: 1083337 - RNA, 19 nt, Homo sapiens
gauacaccauacaaugaga

SEQ ID NO: 1083338 - RNA, 19 nt, Homo sapiens
caaaagcguugauaaauac

SEQ ID NO: 1083339 - RNA, 19 nt, Homo sapiens
aaggagaucuucaggcaau

SEQ ID NO: 1083340 - RNA, 19 nt, Homo sapiens
ggaagaaguggacaugauc

SEQ ID NO: 1083341 - RNA, 19 nt, Homo sapiens
gaaaagauuugcacagcau

SEQ ID NO: 1083342 - RNA, 19 nt, Homo sapiens
gauuggaggcucucgguuu

SEQ ID NO: 1083343 - RNA, 19 nt, Homo sapiens
gcaucagacccaccucuaa

SEQ ID NO: 1083344 - RNA, 19 nt, Homo sapiens
gacaacgagucaccuguuc

SEQ ID NO: 1083345 - RNA, 19 nt, Homo sapiens
gaagaccggaagucagauu

SEQ ID NO: 1083346 - RNA, 19 nt, Homo sapiens
gaagaagguaaagaguaua

SEQ ID NO: 1083347 - RNA, 19 nt, Homo sapiens
ugccagaaacggagauuua

SEQ ID NO: 1083348 - RNA, 19 nt, Homo sapiens
gggaagagaaagauagguu

SEQ ID NO: 1083349 - RNA, 19 nt, Homo sapiens
ugagggcucugcagcauca

SEQ ID NO: 1083350 - RNA, 19 nt, Homo sapiens
gcuguuuggucgcuacuau

SEQ ID NO: 1083351 - RNA, 19 nt, Homo sapiens
auucaucggucauaucuga

SEQ ID NO: 1083352 - RNA, 19 nt, Homo sapiens
auacauguguguggaguuu

SEQ ID NO: 1083353 - RNA, 19 nt, Homo sapiens
ccacagcucagaugaagga

SEQ ID NO: 1083354 - RNA, 19 nt, Homo sapiens
guacaaaagcguugauaaa

SEQ ID NO: 1083355 - RNA, 19 nt, Homo sapiens
caucucaucuagugcugaa

SEQ ID NO: 1083356 - RNA, 19 nt, Homo sapiens
gaagaaguggacaugauca

SEQ ID NO: 1083357 - RNA, 19 nt, Homo sapiens
aagaagaagguaaagagua

SEQ ID NO: 1083358 - RNA, 19 nt, Homo sapiens
cgacauucaucggucauau

SEQ ID NO: 1083359 - RNA, 19 nt, Homo sapiens
caccauacaaugagaauau

SEQ ID NO: 1083360 - RNA, 19 nt, Homo sapiens
gcaagauacaccauacaau

SEQ ID NO: 1083361 - RNA, 19 nt, Homo sapiens
aaugggaugugaaauuaug

SEQ ID NO: 1083362 - RNA, 19 nt, Homo sapiens
caaagaaguacccugacaa

SEQ ID NO: 1083363 - RNA, 19 nt, Homo sapiens
gcucucgguuucaacauuc

SEQ ID NO: 1083364 - RNA, 19 nt, Homo sapiens
ggaagucugagcgauauga

SEQ ID NO: 1083365 - RNA, 19 nt, Homo sapiens
ucaaagcugugagccaguu

SEQ ID NO: 1083366 - RNA, 19 nt, Homo sapiens
gugaauguguagcucaaau

SEQ ID NO: 1083367 - RNA, 19 nt, Homo sapiens
agaacugaauccaauugaa

SEQ ID NO: 1083368 - RNA, 19 nt, Homo sapiens
ggagaucuucaggcaauuu

SEQ ID NO: 1083369 - RNA, 19 nt, Homo sapiens
uggaagaaguggacaugau

SEQ ID NO: 1083370 - RNA, 19 nt, Homo sapiens
uaugagagcuuucuagaga

SEQ ID NO: 1083371 - RNA, 19 nt, Homo sapiens
uggaaaggcuucaucuuaa

SEQ ID NO: 1083372 - RNA, 19 nt, Homo sapiens
cggcagagcuacagaagaa

SEQ ID NO: 1083373 - RNA, 19 nt, Homo sapiens
guggaaaggcuucaucuua

SEQ ID NO: 1083374 - RNA, 19 nt, Homo sapiens
caugaugucugaagucuug

SEQ ID NO: 1083375 - RNA, 19 nt, Homo sapiens
ccaaguacgugaucgaugu

SEQ ID NO: 1083376 - RNA, 19 nt, Homo sapiens
gcccagcuguugacuauga

SEQ ID NO: 1083377 - RNA, 19 nt, Homo sapiens
ggaaucaggagaucaaguu

SEQ ID NO: 1083378 - RNA, 19 nt, Homo sapiens
ggagaucaaguucaaggua

SEQ ID NO: 1083379 - RNA, 19 nt, Homo sapiens
ccaaagaaguugccaaagc

SEQ ID NO: 1083380 - RNA, 19 nt, Homo sapiens
ggagauggcccagcuguug

SEQ ID NO: 1083381 - RNA, 19 nt, Homo sapiens
ggaaaggcuucaucuuaac

SEQ ID NO: 1083382 - RNA, 19 nt, Homo sapiens
ugcagggucucaccauuua

SEQ ID NO: 1083383 - RNA, 19 nt, Homo sapiens
gauguggcuuccucuaguu

SEQ ID NO: 1083384 - RNA, 19 nt, Homo sapiens
gagaauggcgagaaugugu

SEQ ID NO: 1083385 - RNA, 19 nt, Homo sapiens
gcuggugccauuccuguua

SEQ ID NO: 1083386 - RNA, 19 nt, Homo sapiens
uaaggagaauggcgagaau

SEQ ID NO: 1083387 - RNA, 19 nt, Homo sapiens
ccucaucugucuucucuuc

SEQ ID NO: 1083388 - RNA, 19 nt, Homo sapiens
ggaagccgauaaggagaau

SEQ ID NO: 1083389 - RNA, 19 nt, Homo sapiens
acacuacuaugagagcuuu

SEQ ID NO: 1083390 - RNA, 19 nt, Homo sapiens
uggcccagcuguugacuau

SEQ ID NO: 1083391 - RNA, 19 nt, Homo sapiens
gacccaagccaguagagaa

SEQ ID NO: 1083392 - RNA, 19 nt, Homo sapiens
caauagcaaucgggacuuc

SEQ ID NO: 1083393 - RNA, 19 nt, Homo sapiens
ggccucaucugucuucucu

SEQ ID NO: 1083394 - RNA, 19 nt, Homo sapiens
caccacaccuggccucauc

SEQ ID NO: 1083395 - RNA, 19 nt, Homo sapiens
gaacuccugaccucaagug

SEQ ID NO: 1083396 - RNA, 19 nt, Homo sapiens
gagauggcccagcuguuga

SEQ ID NO: 1083397 - RNA, 19 nt, Homo sapiens
aaaaggcgcuggugccauu

SEQ ID NO: 1083398 - RNA, 19 nt, Homo sapiens
ugaccgggauuacaagaag

SEQ ID NO: 1083399 - RNA, 19 nt, Homo sapiens
agacaugacggcagagcua

SEQ ID NO: 1083400 - RNA, 19 nt, Homo sapiens
ggaagcugccagucaguuc

SEQ ID NO: 1083401 - RNA, 19 nt, Homo sapiens
caagauguggcuuccucua

SEQ ID NO: 1083402 - RNA, 19 nt, Homo sapiens
gaagcugccagucaguuca

SEQ ID NO: 1083403 - RNA, 19 nt, Homo sapiens
guacgugaucgauguggaa

SEQ ID NO: 1083404 - RNA, 19 nt, Homo sapiens
gaagggguuucaccauguu

SEQ ID NO: 1083405 - RNA, 19 nt, Homo sapiens
acgccguggucaacuauuu

SEQ ID NO: 1083406 - RNA, 19 nt, Homo sapiens
ggacgccguggucaacuau

SEQ ID NO: 1083407 - RNA, 19 nt, Homo sapiens
cuugggagcauuugagaaa

SEQ ID NO: 1083408 - RNA, 19 nt, Homo sapiens
ggugcuaggcuacguggaa

SEQ ID NO: 1083409 - RNA, 19 nt, Homo sapiens
ggacuacgagaaggugcua

SEQ ID NO: 1083410 - RNA, 19 nt, Homo sapiens
caccuggccucaucugucu

SEQ ID NO: 1083411 - RNA, 19 nt, Homo sapiens
cagggucucaccauuuauu

SEQ ID NO: 1083412 - RNA, 19 nt, Homo sapiens
ggucucaccauuuauuucu

SEQ ID NO: 1083413 - RNA, 19 nt, Homo sapiens
cuccugaccucaagugauc

SEQ ID NO: 1083414 - RNA, 19 nt, Homo sapiens
agauguggcuuccucuagu

SEQ ID NO: 1083415 - RNA, 19 nt, Homo sapiens
caacuugggagcauuugag

SEQ ID NO: 1083416 - RNA, 19 nt, Homo sapiens
caccucagccucccaaagu

SEQ ID NO: 1083417 - RNA, 19 nt, Homo sapiens
cgaaccaggaagagaacua

SEQ ID NO: 1083418 - RNA, 19 nt, Homo sapiens
ccugggcaccuauacauga

SEQ ID NO: 1083419 - RNA, 19 nt, Homo sapiens
gaaccaggaagagaacuac

SEQ ID NO: 1083420 - RNA, 19 nt, Homo sapiens
cugcagggucucaccauuu

SEQ ID NO: 1083421 - RNA, 19 nt, Homo sapiens
gaaucaggagaucaaguuc

SEQ ID NO: 1083422 - RNA, 19 nt, Homo sapiens
ggagaauggcgagaaugug

SEQ ID NO: 1083423 - RNA, 19 nt, Homo sapiens
uggacgccguggucaacua

SEQ ID NO: 1083424 - RNA, 19 nt, Homo sapiens
gaaaggcuucaucuuaacg

SEQ ID NO: 1083425 - RNA, 19 nt, Homo sapiens
gguagagaccuuggagugu

SEQ ID NO: 1083426 - RNA, 19 nt, Homo sapiens
agaucaaguucaagguaga

SEQ ID NO: 1083427 - RNA, 19 nt, Homo sapiens
uacagaagaagcuggagaa

SEQ ID NO: 1083428 - RNA, 19 nt, Homo sapiens
ggacccaagccaguagaga

SEQ ID NO: 1083429 - RNA, 19 nt, Homo sapiens
uaccgaaccaggaagagaa

SEQ ID NO: 1083430 - RNA, 19 nt, Homo sapiens
ccugcagggucucaccauu

SEQ ID NO: 1083431 - RNA, 19 nt, Homo sapiens
ccacgcggcagaugcacaa

SEQ ID NO: 1083432 - RNA, 19 nt, Homo sapiens
ccaaagugcugggauuacc

SEQ ID NO: 1083433 - RNA, 19 nt, Homo sapiens
gaccgggauuacaagaagu

SEQ ID NO: 1083434 - RNA, 19 nt, Homo sapiens
aucaggagaucaaguucaa

SEQ ID NO: 1083435 - RNA, 19 nt, Homo sapiens
caaagccuccugccaagcu

SEQ ID NO: 1083436 - RNA, 19 nt, Homo sapiens
ccugugaccgggauuacaa

SEQ ID NO: 1083437 - RNA, 19 nt, Homo sapiens
uagacgaggacuacgagaa

SEQ ID NO: 1083438 - RNA, 19 nt, Homo sapiens
ugccuucacacuacuauga

SEQ ID NO: 1083439 - RNA, 19 nt, Homo sapiens
gggcacuggagcacugauu

SEQ ID NO: 1083440 - RNA, 19 nt, Homo sapiens
agacgaggacuacgagaag

SEQ ID NO: 1083441 - RNA, 19 nt, Homo sapiens
gcacagacauggcgguguu

SEQ ID NO: 1083442 - RNA, 19 nt, Homo sapiens
ggcauagacugaaccaaua

SEQ ID NO: 1083443 - RNA, 19 nt, Homo sapiens
gaaggaauguccggugaaa

SEQ ID NO: 1083444 - RNA, 19 nt, Homo sapiens
gaacugaaagagagugaaa

SEQ ID NO: 1083445 - RNA, 19 nt, Homo sapiens
ggaaaagguugaacugaaa

SEQ ID NO: 1083446 - RNA, 19 nt, Homo sapiens
ccaacgaggucuuuuauaa

SEQ ID NO: 1083447 - RNA, 19 nt, Homo sapiens
ccaaaggaauccagaucaa

SEQ ID NO: 1083448 - RNA, 19 nt, Homo sapiens
ggaauguccagcucaauga

SEQ ID NO: 1083449 - RNA, 19 nt, Homo sapiens
gaaacgggagcgacuauca

SEQ ID NO: 1083450 - RNA, 19 nt, Homo sapiens
ucagaucugugguugcaaa

SEQ ID NO: 1083451 - RNA, 19 nt, Homo sapiens
ggacgugccucuguacuac

SEQ ID NO: 1083452 - RNA, 19 nt, Homo sapiens
ggagagguuugacgucauc

SEQ ID NO: 1083453 - RNA, 19 nt, Homo sapiens
gaucugugguugcaaacga

SEQ ID NO: 1083454 - RNA, 19 nt, Homo sapiens
gaccugacaugugcuguga

SEQ ID NO: 1083455 - RNA, 19 nt, Homo sapiens
gcauagacugaaccaauaa

SEQ ID NO: 1083456 - RNA, 19 nt, Homo sapiens
gagcgacuaucagagacua

SEQ ID NO: 1083457 - RNA, 19 nt, Homo sapiens
gcucagaucugugguugca

SEQ ID NO: 1083458 - RNA, 19 nt, Homo sapiens
caccaagccuccugcaguu

SEQ ID NO: 1083459 - RNA, 19 nt, Homo sapiens
cagcggaugucucaugcaa

SEQ ID NO: 1083460 - RNA, 19 nt, Homo sapiens
gcaagcaggcgcugguguu

SEQ ID NO: 1083461 - RNA, 19 nt, Homo sapiens
ggagagaaggacacgcaaa

SEQ ID NO: 1083462 - RNA, 19 nt, Homo sapiens
gaucucauacgccggaaug

SEQ ID NO: 1083463 - RNA, 19 nt, Homo sapiens
gaucgucucuguggcuaag

SEQ ID NO: 1083464 - RNA, 19 nt, Homo sapiens
gugcugugaucaccgaguu

SEQ ID NO: 1083465 - RNA, 19 nt, Homo sapiens
ucaagcgcuuccaggcuaa

SEQ ID NO: 1083466 - RNA, 19 nt, Homo sapiens
gagauggcccugagaaucg

SEQ ID NO: 1083467 - RNA, 19 nt, Homo sapiens
guaagaacgcugugaagac

SEQ ID NO: 1083468 - RNA, 19 nt, Homo sapiens
ggaggguugcuguguguga

SEQ ID NO: 1083469 - RNA, 19 nt, Homo sapiens
gaaccaauaaagagauguc

SEQ ID NO: 1083470 - RNA, 19 nt, Homo sapiens
gguuugacgucaucgaucu

SEQ ID NO: 1083471 - RNA, 19 nt, Homo sapiens
cuccagggcugccgaauac

SEQ ID NO: 1083472 - RNA, 19 nt, Homo sapiens
agacugaaccaauaaagag

SEQ ID NO: 1083473 - RNA, 19 nt, Homo sapiens
gccaaaggaauccagauca

SEQ ID NO: 1083474 - RNA, 19 nt, Homo sapiens
cgagauggcccugagaauc

SEQ ID NO: 1083475 - RNA, 19 nt, Homo sapiens
ggccuacguuccauucgau

SEQ ID NO: 1083476 - RNA, 19 nt, Homo sapiens
gaugucacgucaccuucuc

SEQ ID NO: 1083477 - RNA, 19 nt, Homo sapiens
gagagaaggacacgcaaaa

SEQ ID NO: 1083478 - RNA, 19 nt, Homo sapiens
augcaaggaucgucucugu

SEQ ID NO: 1083479 - RNA, 19 nt, Homo sapiens
ccugacaugugcugugauc

SEQ ID NO: 1083480 - RNA, 19 nt, Homo sapiens
aaggaggguugcugugugu

SEQ ID NO: 1083481 - RNA, 19 nt, Homo sapiens
auaacccggugcaggaauu

SEQ ID NO: 1083482 - RNA, 19 nt, Homo sapiens
uagacugaaccaauaaaga

SEQ ID NO: 1083483 - RNA, 19 nt, Homo sapiens
aggcauagacugaaccaau

SEQ ID NO: 1083484 - RNA, 19 nt, Homo sapiens
uuaaggagggcaccuguca

SEQ ID NO: 1083485 - RNA, 19 nt, Homo sapiens
ggaugucucaugcaaggau

SEQ ID NO: 1083486 - RNA, 19 nt, Homo sapiens
ucccggacgugccucugua

SEQ ID NO: 1083487 - RNA, 19 nt, Homo sapiens
gccggaauguccagcucaa

SEQ ID NO: 1083488 - RNA, 19 nt, Homo sapiens
cggaauguccagcucaaug

SEQ ID NO: 1083489 - RNA, 19 nt, Homo sapiens
cuacguuccauucgauuug

SEQ ID NO: 1083490 - RNA, 19 nt, Homo sapiens
caaaggaauccagaucaag

SEQ ID NO: 1083491 - RNA, 19 nt, Homo sapiens
gagggugucggagagguuu

SEQ ID NO: 1083492 - RNA, 19 nt, Homo sapiens
agaggugccugggcucaga

SEQ ID NO: 1083493 - RNA, 19 nt, Homo sapiens
gacugaaccaauaaagaga

SEQ ID NO: 1083494 - RNA, 19 nt, Homo sapiens
cauagacugaaccaauaaa

SEQ ID NO: 1083495 - RNA, 19 nt, Homo sapiens
cgggagcgacuaucagaga

SEQ ID NO: 1083496 - RNA, 19 nt, Homo sapiens
uguaagaacgcugugaaga

SEQ ID NO: 1083497 - RNA, 19 nt, Homo sapiens
gcaagaggaggaaaagguu

SEQ ID NO: 1083498 - RNA, 19 nt, Homo sapiens
gugaaacgggagcgacuau

SEQ ID NO: 1083499 - RNA, 19 nt, Homo sapiens
auacagcagcgauggagaa

SEQ ID NO: 1083500 - RNA, 19 nt, Homo sapiens
ucuccagggcugccgaaua

SEQ ID NO: 1083501 - RNA, 19 nt, Homo sapiens
aggaaaagguugaacugaa

SEQ ID NO: 1083502 - RNA, 19 nt, Homo sapiens
ggccaaaggaauccagauc

SEQ ID NO: 1083503 - RNA, 19 nt, Homo sapiens
cugaaccaauaaagagaug

SEQ ID NO: 1083504 - RNA, 19 nt, Homo sapiens
cggacgugccucuguacua

SEQ ID NO: 1083505 - RNA, 19 nt, Homo sapiens
ugaaggaggguugcugugu

SEQ ID NO: 1083506 - RNA, 19 nt, Homo sapiens
gagguuugacgucaucgau

SEQ ID NO: 1083507 - RNA, 19 nt, Homo sapiens
gcugugaucaccgaguuug

SEQ ID NO: 1083508 - RNA, 19 nt, Homo sapiens
ggugaaacgggagcgacua

SEQ ID NO: 1083509 - RNA, 19 nt, Homo sapiens
ggaauuagcugaugacaua

SEQ ID NO: 1083510 - RNA, 19 nt, Homo sapiens
ccaagaagcuguacaaaug

SEQ ID NO: 1083511 - RNA, 19 nt, Homo sapiens
gaagagaucgcuauuauuc

SEQ ID NO: 1083512 - RNA, 19 nt, Homo sapiens
ggacuuacgugacaaauac

SEQ ID NO: 1083513 - RNA, 19 nt, Homo sapiens
gggaagauguugucauuug

SEQ ID NO: 1083514 - RNA, 19 nt, Homo sapiens
gaagaaauccuuagacaag

SEQ ID NO: 1083515 - RNA, 19 nt, Homo sapiens
caacuggccucaaaggaaa

SEQ ID NO: 1083516 - RNA, 19 nt, Homo sapiens
uaaggaaguuguucaaaga

SEQ ID NO: 1083517 - RNA, 19 nt, Homo sapiens
gacauaaacugacagcuau

SEQ ID NO: 1083518 - RNA, 19 nt, Homo sapiens
acaagaagcucucaagugu

SEQ ID NO: 1083519 - RNA, 19 nt, Homo sapiens
aagaagcucucaaguguaa

SEQ ID NO: 1083520 - RNA, 19 nt, Homo sapiens
ggagaaauguccagggaau

SEQ ID NO: 1083521 - RNA, 19 nt, Homo sapiens
caaguuugcucuuugaguu

SEQ ID NO: 1083522 - RNA, 19 nt, Homo sapiens
gcagaccaauuugaagaua

SEQ ID NO: 1083523 - RNA, 19 nt, Homo sapiens
ggaaugugcauauguguuu

SEQ ID NO: 1083524 - RNA, 19 nt, Homo sapiens
guucagcccuucagauauu

SEQ ID NO: 1083525 - RNA, 19 nt, Homo sapiens
gcaauucagugagguuaaa

SEQ ID NO: 1083526 - RNA, 19 nt, Homo sapiens
caaagagccuuaggacuug

SEQ ID NO: 1083527 - RNA, 19 nt, Homo sapiens
gggauguccuuucaaauug

SEQ ID NO: 1083528 - RNA, 19 nt, Homo sapiens
guaguaacauuccuggauu

SEQ ID NO: 1083529 - RNA, 19 nt, Homo sapiens
gaguggaucuuuccuacaa

SEQ ID NO: 1083530 - RNA, 19 nt, Homo sapiens
ggaaaugggcagagugaaa

SEQ ID NO: 1083531 - RNA, 19 nt, Homo sapiens
ggaagacuaucaagguuca

SEQ ID NO: 1083532 - RNA, 19 nt, Homo sapiens
caaauccaguucccaagaa

SEQ ID NO: 1083533 - RNA, 19 nt, Homo sapiens
ucaaagagccuuaggacuu

SEQ ID NO: 1083534 - RNA, 19 nt, Homo sapiens
aaggaaagcugcaggaguu

SEQ ID NO: 1083535 - RNA, 19 nt, Homo sapiens
ggacaaaacuugagaaagg

SEQ ID NO: 1083536 - RNA, 19 nt, Homo sapiens
ggacaucagccaauuacaa

SEQ ID NO: 1083537 - RNA, 19 nt, Homo sapiens
uuaaaggacuggaugcauu

SEQ ID NO: 1083538 - RNA, 19 nt, Homo sapiens
cagaagaaauccuuagaca

SEQ ID NO: 1083539 - RNA, 19 nt, Homo sapiens
gugggaagauguugucauu

SEQ ID NO: 1083540 - RNA, 19 nt, Homo sapiens
cugaagagaucgcuauuau

SEQ ID NO: 1083541 - RNA, 19 nt, Homo sapiens
gacauaaaguuagcagauu

SEQ ID NO: 1083542 - RNA, 19 nt, Homo sapiens
uaacagcuauggacaccuu

SEQ ID NO: 1083543 - RNA, 19 nt, Homo sapiens
caaaugcuuucuucuguuc

SEQ ID NO: 1083544 - RNA, 19 nt, Homo sapiens
gacaaaugauggagaaauc

SEQ ID NO: 1083545 - RNA, 19 nt, Homo sapiens
ggaagauguugucauuugu

SEQ ID NO: 1083546 - RNA, 19 nt, Homo sapiens
gcaacuggccucaaaggaa

SEQ ID NO: 1083547 - RNA, 19 nt, Homo sapiens
ccaaagcccuccuucaucu

SEQ ID NO: 1083548 - RNA, 19 nt, Homo sapiens
aaagaucaguuggauauug

SEQ ID NO: 1083549 - RNA, 19 nt, Homo sapiens
caacagauuuggacacaac

SEQ ID NO: 1083550 - RNA, 19 nt, Homo sapiens
uauggacacuggcagauuu

SEQ ID NO: 1083551 - RNA, 19 nt, Homo sapiens
gcacggaaaggcagaagaa

SEQ ID NO: 1083552 - RNA, 19 nt, Homo sapiens
cuuggaaucugcacuaauu

SEQ ID NO: 1083553 - RNA, 19 nt, Homo sapiens
gaauauucaucagcauuug

SEQ ID NO: 1083554 - RNA, 19 nt, Homo sapiens
gaaagcugcaggaguuauu

SEQ ID NO: 1083555 - RNA, 19 nt, Homo sapiens
gaacgcucgguuaagauua

SEQ ID NO: 1083556 - RNA, 19 nt, Homo sapiens
ggacacaacggaaagacaa

SEQ ID NO: 1083557 - RNA, 19 nt, Homo sapiens
uaacauuccuggauuacuc

SEQ ID NO: 1083558 - RNA, 19 nt, Homo sapiens
gcaaccaguuucgaaauca

SEQ ID NO: 1083559 - RNA, 19 nt, Homo sapiens
agaaauguccagggaauua

SEQ ID NO: 1083560 - RNA, 19 nt, Homo sapiens
cuucaagagugacaaauga

SEQ ID NO: 1083561 - RNA, 19 nt, Homo sapiens
caacugauucuagauguaa

SEQ ID NO: 1083562 - RNA, 19 nt, Homo sapiens
gacaucagccaauuacaaa

SEQ ID NO: 1083563 - RNA, 19 nt, Homo sapiens
agagaucgcuauuauucuu

SEQ ID NO: 1083564 - RNA, 19 nt, Homo sapiens
gcacaacugauucuagaug

SEQ ID NO: 1083565 - RNA, 19 nt, Homo sapiens
caguugauauuucuacuug

SEQ ID NO: 1083566 - RNA, 19 nt, Homo sapiens
agaagcagguaguaacauu

SEQ ID NO: 1083567 - RNA, 19 nt, Homo sapiens
caacaacaaccgcugaaga

SEQ ID NO: 1083568 - RNA, 19 nt, Homo sapiens
gcugaagcuuggaacaauu

SEQ ID NO: 1083569 - RNA, 19 nt, Homo sapiens
uaguaacauuccuggauua

SEQ ID NO: 1083570 - RNA, 19 nt, Homo sapiens
gaguugggauguaccaguu

SEQ ID NO: 1083571 - RNA, 19 nt, Homo sapiens
ugauucaggucgauauuug

SEQ ID NO: 1083572 - RNA, 19 nt, Homo sapiens
agacauaaacugacagcua

SEQ ID NO: 1083573 - RNA, 19 nt, Homo sapiens
uacaaaugcuuucuucugu

SEQ ID NO: 1083574 - RNA, 19 nt, Homo sapiens
guacaaaugcuuucuucug

SEQ ID NO: 1083575 - RNA, 19 nt, Homo sapiens
gauauuacaccauuuaagg

SEQ ID NO: 1083576 - RNA, 19 nt, Homo sapiens
gaagauguugucauuuguu

SEQ ID NO: 1083577 - RNA, 19 nt, Homo sapiens
cagaccaauuugaagauaa

SEQ ID NO: 1083578 - RNA, 19 nt, Homo sapiens
cuaaggacaucagccaauu

SEQ ID NO: 1083579 - RNA, 19 nt, Homo sapiens
uaaaggacuggaugcauuu

SEQ ID NO: 1083580 - RNA, 19 nt, Homo sapiens
ugaaaagccugaugaaaau

SEQ ID NO: 1083581 - RNA, 19 nt, Homo sapiens
gcucucaaguguaacuaug

SEQ ID NO: 1083582 - RNA, 19 nt, Homo sapiens
acauaaaguuagcagauug

SEQ ID NO: 1083583 - RNA, 19 nt, Homo sapiens
gaacauuuaaccaagaauc

SEQ ID NO: 1083584 - RNA, 19 nt, Homo sapiens
gaggcuguaugcccacgua

SEQ ID NO: 1083585 - RNA, 19 nt, Homo sapiens
aaaguuagcagauugugaa

SEQ ID NO: 1083586 - RNA, 19 nt, Homo sapiens
ccagggaauuagcugauga

SEQ ID NO: 1083587 - RNA, 19 nt, Homo sapiens
uuaaggaaguuguucaaag

SEQ ID NO: 1083588 - RNA, 19 nt, Homo sapiens
agagugacuucaagaguga

SEQ ID NO: 1083589 - RNA, 19 nt, Homo sapiens
uaacccagugcacacauua

SEQ ID NO: 1083590 - RNA, 19 nt, Homo sapiens
uggcacaacugauucuaga

SEQ ID NO: 1083591 - RNA, 19 nt, Homo sapiens
uaaggacaucagccaauua

SEQ ID NO: 1083592 - RNA, 19 nt, Homo sapiens
caaaagaucaguuggauau

SEQ ID NO: 1083593 - RNA, 19 nt, Homo sapiens
gcuuucaccugcugguaaa

SEQ ID NO: 1083594 - RNA, 19 nt, Homo sapiens
ggucgucgguucagagagu

SEQ ID NO: 1083595 - RNA, 19 nt, Homo sapiens
caguucagcccuucagaua

SEQ ID NO: 1083596 - RNA, 19 nt, Homo sapiens
ccaaaguucugggccauuc

SEQ ID NO: 1083597 - RNA, 19 nt, Homo sapiens
gguaguauccgcacaugga

SEQ ID NO: 1083598 - RNA, 19 nt, Homo sapiens
ggauguccuuucaaauugu

SEQ ID NO: 1083599 - RNA, 19 nt, Homo sapiens
guggaucuuuccuacaauu

SEQ ID NO: 1083600 - RNA, 19 nt, Homo sapiens
gccauaaaaugcaguaaaa

SEQ ID NO: 1083601 - RNA, 19 nt, Homo sapiens
ugacaaggccugggaguug

SEQ ID NO: 1083602 - RNA, 19 nt, Homo sapiens
ggagaccauucuugcuaug

SEQ ID NO: 1083603 - RNA, 19 nt, Homo sapiens
aaguggagcuucuggcauu

SEQ ID NO: 1083604 - RNA, 19 nt, Homo sapiens
ugaugaaacuacagaaucu

SEQ ID NO: 1083605 - RNA, 19 nt, Homo sapiens
gcuauggacaccuuaguga

SEQ ID NO: 1083606 - RNA, 19 nt, Homo sapiens
acaaaugcuuucuucuguu

SEQ ID NO: 1083607 - RNA, 19 nt, Homo sapiens
gugaaaagccugaugaaaa

SEQ ID NO: 1083608 - RNA, 19 nt, Homo sapiens
gauguugucauuuguuaug

SEQ ID NO: 1083609 - RNA, 19 nt, Homo sapiens
gaacaaggccaauauauaa

SEQ ID NO: 1083610 - RNA, 19 nt, Homo sapiens
gaaaucaccuuuagucaaa

SEQ ID NO: 1083611 - RNA, 19 nt, Homo sapiens
gaaagaaguuggugacauu

SEQ ID NO: 1083612 - RNA, 19 nt, Homo sapiens
ggaagaagcuaaacuggaa

SEQ ID NO: 1083613 - RNA, 19 nt, Homo sapiens
gaagugaauuguuuaguga

SEQ ID NO: 1083614 - RNA, 19 nt, Homo sapiens
ggauagagccugagaaauu

SEQ ID NO: 1083615 - RNA, 19 nt, Homo sapiens
gagaagaaguuaucagaga

SEQ ID NO: 1083616 - RNA, 19 nt, Homo sapiens
gcauagaacuacagacauu

SEQ ID NO: 1083617 - RNA, 19 nt, Homo sapiens
gagaugagguuaagaagau

SEQ ID NO: 1083618 - RNA, 19 nt, Homo sapiens
caacagguuucacuaauau

SEQ ID NO: 1083619 - RNA, 19 nt, Homo sapiens
guacaaaucucgaaauaac

SEQ ID NO: 1083620 - RNA, 19 nt, Homo sapiens
gaacuuaucucaggaaagg

SEQ ID NO: 1083621 - RNA, 19 nt, Homo sapiens
cgucacagcuuaacucaaa

SEQ ID NO: 1083622 - RNA, 19 nt, Homo sapiens
aaagaagacucgaguuauu

SEQ ID NO: 1083623 - RNA, 19 nt, Homo sapiens
gguuagaagugaauuguuu

SEQ ID NO: 1083624 - RNA, 19 nt, Homo sapiens
gauagagccugagaaauug

SEQ ID NO: 1083625 - RNA, 19 nt, Homo sapiens
ucaacagguuucacuaaua

SEQ ID NO: 1083626 - RNA, 19 nt, Homo sapiens
gcacuaugcuguucucaca

SEQ ID NO: 1083627 - RNA, 19 nt, Homo sapiens
cgaaauaacagucauguga

SEQ ID NO: 1083628 - RNA, 19 nt, Homo sapiens
caccuuaaauugugacuaa

SEQ ID NO: 1083629 - RNA, 19 nt, Homo sapiens
ggagugaacuaccugugaa

SEQ ID NO: 1083630 - RNA, 19 nt, Homo sapiens
ugugaaagauuacauguug

SEQ ID NO: 1083631 - RNA, 19 nt, Homo sapiens
aaagggacauuucagauug

SEQ ID NO: 1083632 - RNA, 19 nt, Homo sapiens
gaaauuggugcaucauauu

SEQ ID NO: 1083633 - RNA, 19 nt, Homo sapiens
gaaauaacagucaugugaa

SEQ ID NO: 1083634 - RNA, 19 nt, Homo sapiens
caaauaacguugucuucau

SEQ ID NO: 1083635 - RNA, 19 nt, Homo sapiens
gaugaugagucaacagguu

SEQ ID NO: 1083636 - RNA, 19 nt, Homo sapiens
guguacaaaucucgaaaua

SEQ ID NO: 1083637 - RNA, 19 nt, Homo sapiens
caacaagggacacaaagaa

SEQ ID NO: 1083638 - RNA, 19 nt, Homo sapiens
guucagaaaucaccuuuag

SEQ ID NO: 1083639 - RNA, 19 nt, Homo sapiens
ugaguguugugaaagauua

SEQ ID NO: 1083640 - RNA, 19 nt, Homo sapiens
uaaaguggaucucaccaau

SEQ ID NO: 1083641 - RNA, 19 nt, Homo sapiens
gaauagagaagaaguuauc

SEQ ID NO: 1083642 - RNA, 19 nt, Homo sapiens
gcaagaugcaguacaaguu

SEQ ID NO: 1083643 - RNA, 19 nt, Homo sapiens
ggacauuucagauugugua

SEQ ID NO: 1083644 - RNA, 19 nt, Homo sapiens
agaaauuggugcaucauau

SEQ ID NO: 1083645 - RNA, 19 nt, Homo sapiens
gcaaaggcaaggcucagua

SEQ ID NO: 1083646 - RNA, 19 nt, Homo sapiens
gaagucauuugguguugga

SEQ ID NO: 1083647 - RNA, 19 nt, Homo sapiens
caaagggacauuucagauu

SEQ ID NO: 1083648 - RNA, 19 nt, Homo sapiens
guugugacaucauaucuga

SEQ ID NO: 1083649 - RNA, 19 nt, Homo sapiens
agaacaaggccaauauaua

SEQ ID NO: 1083650 - RNA, 19 nt, Homo sapiens
gaagugagggagaggauga

SEQ ID NO: 1083651 - RNA, 19 nt, Homo sapiens
gcaaauaacguugucuuca

SEQ ID NO: 1083652 - RNA, 19 nt, Homo sapiens
gguauuauguggacucagu

SEQ ID NO: 1083653 - RNA, 19 nt, Homo sapiens
ggauccaagucaaaugaaa

SEQ ID NO: 1083654 - RNA, 19 nt, Homo sapiens
caagggacacaaagaaauu

SEQ ID NO: 1083655 - RNA, 19 nt, Homo sapiens
gccaauauauaauguugug

SEQ ID NO: 1083656 - RNA, 19 nt, Homo sapiens
aaagguuggugaugaagaa

SEQ ID NO: 1083657 - RNA, 19 nt, Homo sapiens
agaagaaguuaucagagaa

SEQ ID NO: 1083658 - RNA, 19 nt, Homo sapiens
caucauauucuccaggaua

SEQ ID NO: 1083659 - RNA, 19 nt, Homo sapiens
gagaaauuggugcaucaua

SEQ ID NO: 1083660 - RNA, 19 nt, Homo sapiens
agaagugaauuguuuagug

SEQ ID NO: 1083661 - RNA, 19 nt, Homo sapiens
aaggauccgucacagcuua

SEQ ID NO: 1083662 - RNA, 19 nt, Homo sapiens
guacacagugguaguagaa

SEQ ID NO: 1083663 - RNA, 19 nt, Homo sapiens
gugaauagagaagaaguua

SEQ ID NO: 1083664 - RNA, 19 nt, Homo sapiens
gcaacaagggacacaaaga

SEQ ID NO: 1083665 - RNA, 19 nt, Homo sapiens
ucauguagguuagaaguga

SEQ ID NO: 1083666 - RNA, 19 nt, Homo sapiens
gguaguagaaaucaucaaa

SEQ ID NO: 1083667 - RNA, 19 nt, Homo sapiens
cuacagagaugagguuaag

SEQ ID NO: 1083668 - RNA, 19 nt, Homo sapiens
caaggccaauauauaaugu

SEQ ID NO: 1083669 - RNA, 19 nt, Homo sapiens
ccagaacaaggccaauaua

SEQ ID NO: 1083670 - RNA, 19 nt, Homo sapiens
uaacagucaugugaauaga

SEQ ID NO: 1083671 - RNA, 19 nt, Homo sapiens
cgacauguaugggccagaa

SEQ ID NO: 1083672 - RNA, 19 nt, Homo sapiens
caucaggacacuugggaua

SEQ ID NO: 1083673 - RNA, 19 nt, Homo sapiens
caagaugcaguacaaguug

SEQ ID NO: 1083674 - RNA, 19 nt, Homo sapiens
ggaaucugcggacaaauca

SEQ ID NO: 1083675 - RNA, 19 nt, Homo sapiens
gaagaaguuaucagagaau

SEQ ID NO: 1083676 - RNA, 19 nt, Homo sapiens
aaacaacacagcagaagga

SEQ ID NO: 1083677 - RNA, 19 nt, Homo sapiens
gaaguuaucagagaauugg

SEQ ID NO: 1083678 - RNA, 19 nt, Homo sapiens
gaaaguggagcaaauaacg

SEQ ID NO: 1083679 - RNA, 19 nt, Homo sapiens
gucaacagguuucacuaau

SEQ ID NO: 1083680 - RNA, 19 nt, Homo sapiens
gaaggcaagaugugagaga

SEQ ID NO: 1083681 - RNA, 19 nt, Homo sapiens
ugauugcgcagcccuguua

SEQ ID NO: 1083682 - RNA, 19 nt, Homo sapiens
caacacagcagaaggaaaa

SEQ ID NO: 1083683 - RNA, 19 nt, Homo sapiens
uaagaagauuccagucagu

SEQ ID NO: 1083684 - RNA, 19 nt, Homo sapiens
ucagagaauuggcaggaau

SEQ ID NO: 1083685 - RNA, 19 nt, Homo sapiens
aaauaacguugucuucauc

SEQ ID NO: 1083686 - RNA, 19 nt, Homo sapiens
gagcaaauaacguugucuu

SEQ ID NO: 1083687 - RNA, 19 nt, Homo sapiens
cagaacaaggccaauauau

SEQ ID NO: 1083688 - RNA, 19 nt, Homo sapiens
gagggaaguuuucauucua

SEQ ID NO: 1083689 - RNA, 19 nt, Homo sapiens
acagaaggauccaagucaa

SEQ ID NO: 1083690 - RNA, 19 nt, Homo sapiens
gggaggagccaaaccugaa

SEQ ID NO: 1083691 - RNA, 19 nt, Homo sapiens
acagucaugugaauagaga

SEQ ID NO: 1083692 - RNA, 19 nt, Homo sapiens
ucagaaaucaccuuuaguc

SEQ ID NO: 1083693 - RNA, 19 nt, Homo sapiens
agagagacgagaaccauuu

SEQ ID NO: 1083694 - RNA, 19 nt, Homo sapiens
gaaggauccaagucaaaug

SEQ ID NO: 1083695 - RNA, 19 nt, Homo sapiens
cuacagggcauccucauca

SEQ ID NO: 1083696 - RNA, 19 nt, Homo sapiens
caaacaaagggacauuuca

SEQ ID NO: 1083697 - RNA, 19 nt, Homo sapiens
cuacuucucaaggguauua

SEQ ID NO: 1083698 - RNA, 19 nt, Homo sapiens
gugaacuaccugugaagua

SEQ ID NO: 1083699 - RNA, 19 nt, Homo sapiens
cgaauacggcgacgacaug

SEQ ID NO: 1083700 - RNA, 19 nt, Homo sapiens
gcggacaaaucagaccaaa

SEQ ID NO: 1083701 - RNA, 19 nt, Homo sapiens
acacagugguaguagaaau

SEQ ID NO: 1083702 - RNA, 19 nt, Homo sapiens
cagagaauuggcaggaaua

SEQ ID NO: 1083703 - RNA, 19 nt, Homo sapiens
uagagaagaaguuaucaga

SEQ ID NO: 1083704 - RNA, 19 nt, Homo sapiens
caaaggcaaggcucaguau

SEQ ID NO: 1083705 - RNA, 19 nt, Homo sapiens
cauaagucauuuugcguua

SEQ ID NO: 1083706 - RNA, 19 nt, Homo sapiens
cagaacuuaucucaggaaa

SEQ ID NO: 1083707 - RNA, 19 nt, Homo sapiens
agaaaucaccuuuagucaa

SEQ ID NO: 1083708 - RNA, 19 nt, Homo sapiens
cauugugcauugucuguga

SEQ ID NO: 1083709 - RNA, 19 nt, Homo sapiens
gaaagaagcuuaugaagug

SEQ ID NO: 1083710 - RNA, 19 nt, Homo sapiens
ggagaaagaugaugacuuc

SEQ ID NO: 1083711 - RNA, 19 nt, Homo sapiens
caacaugaauggcuacuuu

SEQ ID NO: 1083712 - RNA, 19 nt, Homo sapiens
gaagacagaugugccauug

SEQ ID NO: 1083713 - RNA, 19 nt, Homo sapiens
gaagaaagaagcuuaugaa

SEQ ID NO: 1083714 - RNA, 19 nt, Homo sapiens
aagcggagcugguaccuua

SEQ ID NO: 1083715 - RNA, 19 nt, Homo sapiens
uaccuuaccuggaaguaua

SEQ ID NO: 1083716 - RNA, 19 nt, Homo sapiens
gcagggaaccgacccaauu

SEQ ID NO: 1083717 - RNA, 19 nt, Homo sapiens
ggaagaagcggagcuggua

SEQ ID NO: 1083718 - RNA, 19 nt, Homo sapiens
ccacggugcuggaggauga

SEQ ID NO: 1083719 - RNA, 19 nt, Homo sapiens
gaagaggaccuggacauug

SEQ ID NO: 1083720 - RNA, 19 nt, Homo sapiens
ugaagaagcuacccucagu

SEQ ID NO: 1083721 - RNA, 19 nt, Homo sapiens
ggaaguauaaacugacaaa

SEQ ID NO: 1083722 - RNA, 19 nt, Homo sapiens
ggagaagcccucugggaaa

SEQ ID NO: 1083723 - RNA, 19 nt, Homo sapiens
ggacauugcuguggauuuu

SEQ ID NO: 1083724 - RNA, 19 nt, Homo sapiens
acaacaagguccucaaugu

SEQ ID NO: 1083725 - RNA, 19 nt, Homo sapiens
cucagaaucuaaccuauuu

SEQ ID NO: 1083726 - RNA, 19 nt, Homo sapiens
gaauggagaaagaugauga

SEQ ID NO: 1083727 - RNA, 19 nt, Homo sapiens
uaaaucaccugcccucucu

SEQ ID NO: 1083728 - RNA, 19 nt, Homo sapiens
ggagauuguuucggaagaa

SEQ ID NO: 1083729 - RNA, 19 nt, Homo sapiens
uggauaaguuggucauuga

SEQ ID NO: 1083730 - RNA, 19 nt, Homo sapiens
gagaguaccugggaaucau

SEQ ID NO: 1083731 - RNA, 19 nt, Homo sapiens
ccaagugccuccauaucug

SEQ ID NO: 1083732 - RNA, 19 nt, Homo sapiens
ucaagaagcacaaguucaa

SEQ ID NO: 1083733 - RNA, 19 nt, Homo sapiens
ggaagaggaccuggacauu

SEQ ID NO: 1083734 - RNA, 19 nt, Homo sapiens
cagggaaccgacccaauua

SEQ ID NO: 1083735 - RNA, 19 nt, Homo sapiens
ugacacagacucacucaga

SEQ ID NO: 1083736 - RNA, 19 nt, Homo sapiens
gcucagaaucuaaccuauu

SEQ ID NO: 1083737 - RNA, 19 nt, Homo sapiens
ccucagaugauaacaguuu

SEQ ID NO: 1083738 - RNA, 19 nt, Homo sapiens
cagcaaaguugagggcuau

SEQ ID NO: 1083739 - RNA, 19 nt, Homo sapiens
caucugcacugucaaggau

SEQ ID NO: 1083740 - RNA, 19 nt, Homo sapiens
ucaagucgcagcaaaguau

SEQ ID NO: 1083741 - RNA, 19 nt, Homo sapiens
ggacguagagguguauuca

SEQ ID NO: 1083742 - RNA, 19 nt, Homo sapiens
caacaagguccucaaugug

SEQ ID NO: 1083743 - RNA, 19 nt, Homo sapiens
guauucaagucgcagcaaa

SEQ ID NO: 1083744 - RNA, 19 nt, Homo sapiens
guagagguguauucaaguc

SEQ ID NO: 1083745 - RNA, 19 nt, Homo sapiens
gauaaguuggucauugauu

SEQ ID NO: 1083746 - RNA, 19 nt, Homo sapiens
gagaagggcaggagaguac

SEQ ID NO: 1083747 - RNA, 19 nt, Homo sapiens
acaccuacguggccuuuau

SEQ ID NO: 1083748 - RNA, 19 nt, Homo sapiens
ugagggcuauggaagugua

SEQ ID NO: 1083749 - RNA, 19 nt, Homo sapiens
ugaagaaagaagcuuauga

SEQ ID NO: 1083750 - RNA, 19 nt, Homo sapiens
gagccaauccauccaccua

SEQ ID NO: 1083751 - RNA, 19 nt, Homo sapiens
agacagaugugccauugag

SEQ ID NO: 1083752 - RNA, 19 nt, Homo sapiens
gggcauccaugucauuguc

SEQ ID NO: 1083753 - RNA, 19 nt, Homo sapiens
ggagaagggcaggagagua

SEQ ID NO: 1083754 - RNA, 19 nt, Homo sapiens
uggacagucugaagaaaga

SEQ ID NO: 1083755 - RNA, 19 nt, Homo sapiens
gcucugggauugggacaug

SEQ ID NO: 1083756 - RNA, 19 nt, Homo sapiens
ugaauacccucacuuucca

SEQ ID NO: 1083757 - RNA, 19 nt, Homo sapiens
gaguaccugggaaucauua

SEQ ID NO: 1083758 - RNA, 19 nt, Homo sapiens
acacagagggccacaccua

SEQ ID NO: 1083759 - RNA, 19 nt, Homo sapiens
agaaagaagcuuaugaagu

SEQ ID NO: 1083760 - RNA, 19 nt, Homo sapiens
ccauugagcucagcagaag

SEQ ID NO: 1083761 - RNA, 19 nt, Homo sapiens
gagaagcccucugggaaaa

SEQ ID NO: 1083762 - RNA, 19 nt, Homo sapiens
aguauaaacugacaaacca

SEQ ID NO: 1083763 - RNA, 19 nt, Homo sapiens
ggagaguaccugggaauca

SEQ ID NO: 1083764 - RNA, 19 nt, Homo sapiens
ucaggaauguggacagucu

SEQ ID NO: 1083765 - RNA, 19 nt, Homo sapiens
ggccaaguuugcugugguu

SEQ ID NO: 1083766 - RNA, 19 nt, Homo sapiens
ggaugcggaugccugaaca

SEQ ID NO: 1083767 - RNA, 19 nt, Homo sapiens
augcugcgcucucugcuuu

SEQ ID NO: 1083768 - RNA, 19 nt, Homo sapiens
ggagggccuggauuucuuu

SEQ ID NO: 1083769 - RNA, 19 nt, Homo sapiens
ucacgaggccuacuucaag

SEQ ID NO: 1083770 - RNA, 19 nt, Homo sapiens
ggacccagcacuacuguac

SEQ ID NO: 1083771 - RNA, 19 nt, Homo sapiens
ggugucuccucagaugaua

SEQ ID NO: 1083772 - RNA, 19 nt, Homo sapiens
gacacguacucaccucaug

SEQ ID NO: 1083773 - RNA, 19 nt, Homo sapiens
ucagugaagccaaugaaga

SEQ ID NO: 1083774 - RNA, 19 nt, Homo sapiens
ccucucagccuucucuuug

SEQ ID NO: 1083775 - RNA, 19 nt, Homo sapiens
uuacuuccuuguuggagaa

SEQ ID NO: 1083776 - RNA, 19 nt, Homo sapiens
uacguggccuuuauucgaa

SEQ ID NO: 1083777 - RNA, 19 nt, Homo sapiens
ccuaagccauuccugaagu

SEQ ID NO: 1083778 - RNA, 19 nt, Homo sapiens
caucaucccugacguuucc

SEQ ID NO: 1083779 - RNA, 19 nt, Homo sapiens
cggaaaagcucugggauug

SEQ ID NO: 1083780 - RNA, 19 nt, Homo sapiens
caaguuugcugugguucug

SEQ ID NO: 1083781 - RNA, 19 nt, Homo sapiens
ggaugugguggcacuguuu

SEQ ID NO: 1083782 - RNA, 19 nt, Homo sapiens
gaacccuugugaagacucu

SEQ ID NO: 1083783 - RNA, 19 nt, Homo sapiens
cacgaggccuacuucaaga

SEQ ID NO: 1083784 - RNA, 19 nt, Homo sapiens
guugagggcuauggaagug

SEQ ID NO: 1083785 - RNA, 19 nt, Homo sapiens
gagacuuaauuacuaacuc

SEQ ID NO: 1083786 - RNA, 19 nt, Homo sapiens
gcucaggaauguggacagu

SEQ ID NO: 1083787 - RNA, 19 nt, Homo sapiens
aagaggaccuggacauugc

SEQ ID NO: 1083788 - RNA, 19 nt, Homo sapiens
cagccucacugccacuuuc

SEQ ID NO: 1083789 - RNA, 19 nt, Homo sapiens
cuggauaaguuggucauug

SEQ ID NO: 1083790 - RNA, 19 nt, Homo sapiens
cuacguggccuuuauucga

SEQ ID NO: 1083791 - RNA, 19 nt, Homo sapiens
cugcaucucugccuggaau

SEQ ID NO: 1083792 - RNA, 19 nt, Homo sapiens
ucagagacccuuagacacu

SEQ ID NO: 1083793 - RNA, 19 nt, Homo sapiens
gaaccuggagggccuggau

SEQ ID NO: 1083794 - RNA, 19 nt, Homo sapiens
cagcucauccugcccuuug

SEQ ID NO: 1083795 - RNA, 19 nt, Homo sapiens
caagucgcagcaaaguaua

SEQ ID NO: 1083796 - RNA, 19 nt, Homo sapiens
gacaacaagguccucaaug

SEQ ID NO: 1083797 - RNA, 19 nt, Homo sapiens
uggagggccuggauuucuu

SEQ ID NO: 1083798 - RNA, 19 nt, Homo sapiens
gagauuguuucggaagaag

SEQ ID NO: 1083799 - RNA, 19 nt, Homo sapiens
gccaagugccuccauaucu

SEQ ID NO: 1083800 - RNA, 19 nt, Homo sapiens
gaauguggacagucugaag

SEQ ID NO: 1083801 - RNA, 19 nt, Homo sapiens
ggaaugaccagggguauga

SEQ ID NO: 1083802 - RNA, 19 nt, Homo sapiens
ugacggcuacuaugaggaa

SEQ ID NO: 1083803 - RNA, 19 nt, Homo sapiens
ggaugugcguggcaaccau

SEQ ID NO: 1083804 - RNA, 19 nt, Homo sapiens
caucgucggccucaacaug

SEQ ID NO: 1083805 - RNA, 19 nt, Homo sapiens
gggcagacacagagcugaa

SEQ ID NO: 1083806 - RNA, 19 nt, Homo sapiens
cagagcaagacuaugauga

SEQ ID NO: 1083807 - RNA, 19 nt, Homo sapiens
agccagagcaagacuauga

SEQ ID NO: 1083808 - RNA, 19 nt, Homo sapiens
gcuauuccucaacauggua

SEQ ID NO: 1083809 - RNA, 19 nt, Homo sapiens
gaacaauuguguaggagaa

SEQ ID NO: 1083810 - RNA, 19 nt, Homo sapiens
gcucacagacuuccaguua

SEQ ID NO: 1083811 - RNA, 19 nt, Homo sapiens
cccaagugcugcuguauua

SEQ ID NO: 1083812 - RNA, 19 nt, Homo sapiens
gaggacaucucgauccaaa

SEQ ID NO: 1083813 - RNA, 19 nt, Homo sapiens
gaaacuugcucacagacuu

SEQ ID NO: 1083814 - RNA, 19 nt, Homo sapiens
gaaacgcuacgaaagaaua

SEQ ID NO: 1083815 - RNA, 19 nt, Homo sapiens
gcagggcguuuacauagaa

SEQ ID NO: 1083816 - RNA, 19 nt, Homo sapiens
ucacagacuuccaguuauu

SEQ ID NO: 1083817 - RNA, 19 nt, Homo sapiens
gcaagugugugcaaaucaa

SEQ ID NO: 1083818 - RNA, 19 nt, Homo sapiens
gagcugcuguuuccaauca

SEQ ID NO: 1083819 - RNA, 19 nt, Homo sapiens
gcucuucacuauguauaua

SEQ ID NO: 1083820 - RNA, 19 nt, Homo sapiens
guauauagcucugucuuca

SEQ ID NO: 1083821 - RNA, 19 nt, Homo sapiens
gaaccuacacaaaccaauu

SEQ ID NO: 1083822 - RNA, 19 nt, Homo sapiens
gaagcaaucugugacaaag

SEQ ID NO: 1083823 - RNA, 19 nt, Homo sapiens
gaucacagcagggcguuua

SEQ ID NO: 1083824 - RNA, 19 nt, Homo sapiens
ggacaucucgauccaaaga

SEQ ID NO: 1083825 - RNA, 19 nt, Homo sapiens
caaaagaucugugcacuga

SEQ ID NO: 1083826 - RNA, 19 nt, Homo sapiens
cauauucguuugcacauug

SEQ ID NO: 1083827 - RNA, 19 nt, Homo sapiens
gcccgugggugaacaauug

SEQ ID NO: 1083828 - RNA, 19 nt, Homo sapiens
caaaggaaacgcuacgaaa

SEQ ID NO: 1083829 - RNA, 19 nt, Homo sapiens
uuugugggcuuccgauuua

SEQ ID NO: 1083830 - RNA, 19 nt, Homo sapiens
ggugaacaauuguguagga

SEQ ID NO: 1083831 - RNA, 19 nt, Homo sapiens
gcggcucggugacuugaua

SEQ ID NO: 1083832 - RNA, 19 nt, Homo sapiens
ggagaauacuucggguuau

SEQ ID NO: 1083833 - RNA, 19 nt, Homo sapiens
caacuggaaccuacacaaa

SEQ ID NO: 1083834 - RNA, 19 nt, Homo sapiens
guuauuacauggguuauuc

SEQ ID NO: 1083835 - RNA, 19 nt, Homo sapiens
caaauccacuccauaugca

SEQ ID NO: 1083836 - RNA, 19 nt, Homo sapiens
cgugugggcuucaguguga

SEQ ID NO: 1083837 - RNA, 19 nt, Homo sapiens
ccaaauuagcaguguauaa

SEQ ID NO: 1083838 - RNA, 19 nt, Homo sapiens
caaaagauguauucggaaa

SEQ ID NO: 1083839 - RNA, 19 nt, Homo sapiens
cggcacaggugauaaaaua

SEQ ID NO: 1083840 - RNA, 19 nt, Homo sapiens
gugcggagcuuaaaauuau

SEQ ID NO: 1083841 - RNA, 19 nt, Homo sapiens
aagaauacauggagagcuu

SEQ ID NO: 1083842 - RNA, 19 nt, Homo sapiens
caagugcugcuguauuaaa

SEQ ID NO: 1083843 - RNA, 19 nt, Homo sapiens
gggaagucaucuacaagug

SEQ ID NO: 1083844 - RNA, 19 nt, Homo sapiens
gcaagcagaguuuuauaua

SEQ ID NO: 1083845 - RNA, 19 nt, Homo sapiens
gcauauucguuugcacauu

SEQ ID NO: 1083846 - RNA, 19 nt, Homo sapiens
gccuuaaacuugccugguu

SEQ ID NO: 1083847 - RNA, 19 nt, Homo sapiens
auaaauggcaccuagguaa

SEQ ID NO: 1083848 - RNA, 19 nt, Homo sapiens
gauuaacuccgaugcuuug

SEQ ID NO: 1083849 - RNA, 19 nt, Homo sapiens
gggaugaaguccgucuuug

SEQ ID NO: 1083850 - RNA, 19 nt, Homo sapiens
ggcaugaucugugcuguca

SEQ ID NO: 1083851 - RNA, 19 nt, Homo sapiens
gagauuguucugcauauuc

SEQ ID NO: 1083852 - RNA, 19 nt, Homo sapiens
guacagcaaacaagcuauu

SEQ ID NO: 1083853 - RNA, 19 nt, Homo sapiens
ugacgacuaugacucuuca

SEQ ID NO: 1083854 - RNA, 19 nt, Homo sapiens
cggaagagacauccuuuga

SEQ ID NO: 1083855 - RNA, 19 nt, Homo sapiens
uggagaauacuucggguua

SEQ ID NO: 1083856 - RNA, 19 nt, Homo sapiens
ucacuccucuggaugaauc

SEQ ID NO: 1083857 - RNA, 19 nt, Homo sapiens
uaacuguaauccuguugau

SEQ ID NO: 1083858 - RNA, 19 nt, Homo sapiens
gacaaagucugagggucuu

SEQ ID NO: 1083859 - RNA, 19 nt, Homo sapiens
ccacggcacaggugauaaa

SEQ ID NO: 1083860 - RNA, 19 nt, Homo sapiens
ucacugcaguuauguuugg

SEQ ID NO: 1083861 - RNA, 19 nt, Homo sapiens
ccuugagggucuucuguuu

SEQ ID NO: 1083862 - RNA, 19 nt, Homo sapiens
gacaguaugcaccuuaaga

SEQ ID NO: 1083863 - RNA, 19 nt, Homo sapiens
cgagauuguucugcauauu

SEQ ID NO: 1083864 - RNA, 19 nt, Homo sapiens
cagcagggcguuuacauag

SEQ ID NO: 1083865 - RNA, 19 nt, Homo sapiens
gaagaaacggcacaaaaug

SEQ ID NO: 1083866 - RNA, 19 nt, Homo sapiens
gcacccaaauccacuccau

SEQ ID NO: 1083867 - RNA, 19 nt, Homo sapiens
gucugagggucuuccuuua

SEQ ID NO: 1083868 - RNA, 19 nt, Homo sapiens
aggaaacgcuacgaaagaa

SEQ ID NO: 1083869 - RNA, 19 nt, Homo sapiens
gggcaguacccaaaggaaa

SEQ ID NO: 1083870 - RNA, 19 nt, Homo sapiens
ggacaaagugugggugauc

SEQ ID NO: 1083871 - RNA, 19 nt, Homo sapiens
gugcaugugugucaaaauu

SEQ ID NO: 1083872 - RNA, 19 nt, Homo sapiens
guucaagugauguuuagaa

SEQ ID NO: 1083873 - RNA, 19 nt, Homo sapiens
ggacuuggucaccgcagaa

SEQ ID NO: 1083874 - RNA, 19 nt, Homo sapiens
cugagggucuuccuuuaug

SEQ ID NO: 1083875 - RNA, 19 nt, Homo sapiens
aaagaucugugcacugaac

SEQ ID NO: 1083876 - RNA, 19 nt, Homo sapiens
gcacaaaauguucaaguga

SEQ ID NO: 1083877 - RNA, 19 nt, Homo sapiens
ccaaaggaaacgcuacgaa

SEQ ID NO: 1083878 - RNA, 19 nt, Homo sapiens
ccaaagacuucugguacuc

SEQ ID NO: 1083879 - RNA, 19 nt, Homo sapiens
cagacuucguggugacuuu

SEQ ID NO: 1083880 - RNA, 19 nt, Homo sapiens
ggucgccuaugcagacuuc

SEQ ID NO: 1083881 - RNA, 19 nt, Homo sapiens
gacgccaguuuccgagauu

SEQ ID NO: 1083882 - RNA, 19 nt, Homo sapiens
gggccuugccuuaaacuug

SEQ ID NO: 1083883 - RNA, 19 nt, Homo sapiens
gcaacuggaaccuacacaa

SEQ ID NO: 1083884 - RNA, 19 nt, Homo sapiens
caaccucuucuuucaaugu

SEQ ID NO: 1083885 - RNA, 19 nt, Homo sapiens
gugguugaauccugugaga

SEQ ID NO: 1083886 - RNA, 19 nt, Homo sapiens
acagacuuccaguuauuua

SEQ ID NO: 1083887 - RNA, 19 nt, Homo sapiens
ccaaauccacuccauaugc

SEQ ID NO: 1083888 - RNA, 19 nt, Homo sapiens
cgauaacuguaauccuguu

SEQ ID NO: 1083889 - RNA, 19 nt, Homo sapiens
gcaucaagaagcaaucugu

SEQ ID NO: 1083890 - RNA, 19 nt, Homo sapiens
cagccaaauuagcagugua

SEQ ID NO: 1083891 - RNA, 19 nt, Homo sapiens
ucgauuaacuccgaugcuu

SEQ ID NO: 1083892 - RNA, 19 nt, Homo sapiens
aaagugagaagcccacaug

SEQ ID NO: 1083893 - RNA, 19 nt, Homo sapiens
aaggaaacgcuacgaaaga

SEQ ID NO: 1083894 - RNA, 19 nt, Homo sapiens
ucaacggggucaucuuuaa

SEQ ID NO: 1083895 - RNA, 19 nt, Homo sapiens
cuacacaaaccaauugcuu

SEQ ID NO: 1083896 - RNA, 19 nt, Homo sapiens
gauaucaacagcucaucug

SEQ ID NO: 1083897 - RNA, 19 nt, Homo sapiens
ccgagauuguucugcauau

SEQ ID NO: 1083898 - RNA, 19 nt, Homo sapiens
uauaaauggcaccuaggua

SEQ ID NO: 1083899 - RNA, 19 nt, Homo sapiens
aaauugccaguguuguuua

SEQ ID NO: 1083900 - RNA, 19 nt, Homo sapiens
acagcagggcguuuacaua

SEQ ID NO: 1083901 - RNA, 19 nt, Homo sapiens
uaggacaguaugcaccuua

SEQ ID NO: 1083902 - RNA, 19 nt, Homo sapiens
uccaugcucugauccuuug

SEQ ID NO: 1083903 - RNA, 19 nt, Homo sapiens
uuugugcucuucacuaugu

SEQ ID NO: 1083904 - RNA, 19 nt, Homo sapiens
aaccucuucuuucaaugua

SEQ ID NO: 1083905 - RNA, 19 nt, Homo sapiens
caagaagcaaucugugaca

SEQ ID NO: 1083906 - RNA, 19 nt, Homo sapiens
ggaugaaguccgucuuugg

SEQ ID NO: 1083907 - RNA, 19 nt, Homo sapiens
cacuuucacugcaguuaug

SEQ ID NO: 1083908 - RNA, 19 nt, Homo sapiens
ggaaacgcuacgaaagaau

SEQ ID NO: 1083909 - RNA, 19 nt, Homo sapiens
gaagacagcuagugagaug

SEQ ID NO: 1083910 - RNA, 19 nt, Homo sapiens
gaacagaauuaucccacua

SEQ ID NO: 1083911 - RNA, 19 nt, Homo sapiens
gaaagcugguucacagaua

SEQ ID NO: 1083912 - RNA, 19 nt, Homo sapiens
gcuacucacucuucuguua

SEQ ID NO: 1083913 - RNA, 19 nt, Homo sapiens
ccagagagcacccaauuua

SEQ ID NO: 1083914 - RNA, 19 nt, Homo sapiens
gaaccgacuuggaauuuga

SEQ ID NO: 1083915 - RNA, 19 nt, Homo sapiens
ccaaagaucacaucauuaa

SEQ ID NO: 1083916 - RNA, 19 nt, Homo sapiens
gccaugagcuucaguguga

SEQ ID NO: 1083917 - RNA, 19 nt, Homo sapiens
caccaaagaucacaucauu

SEQ ID NO: 1083918 - RNA, 19 nt, Homo sapiens
aaagaaugcuguccggaua

SEQ ID NO: 1083919 - RNA, 19 nt, Homo sapiens
gcaccgagcuccacgcaau

SEQ ID NO: 1083920 - RNA, 19 nt, Homo sapiens
caaccaggguccaucagua

SEQ ID NO: 1083921 - RNA, 19 nt, Homo sapiens
aggaaaugcucaacaauaa

SEQ ID NO: 1083922 - RNA, 19 nt, Homo sapiens
ggacuucggcauuuacuaa

SEQ ID NO: 1083923 - RNA, 19 nt, Homo sapiens
gaguagaacugccggauag

SEQ ID NO: 1083924 - RNA, 19 nt, Homo sapiens
gaacggaccccuuccuuua

SEQ ID NO: 1083925 - RNA, 19 nt, Homo sapiens
gauuuaagguguugcaugu

SEQ ID NO: 1083926 - RNA, 19 nt, Homo sapiens
ccaaugggcagauauguaa

SEQ ID NO: 1083927 - RNA, 19 nt, Homo sapiens
ggaccuguauggccucauu

SEQ ID NO: 1083928 - RNA, 19 nt, Homo sapiens
ggacagggacuucggcauu

SEQ ID NO: 1083929 - RNA, 19 nt, Homo sapiens
gaacuggacauguggaaga

SEQ ID NO: 1083930 - RNA, 19 nt, Homo sapiens
gcgaaaugcucuacaccaa

SEQ ID NO: 1083931 - RNA, 19 nt, Homo sapiens
gaugccagcugugacauuu

SEQ ID NO: 1083932 - RNA, 19 nt, Homo sapiens
gaaagaaccacaccuaacu

SEQ ID NO: 1083933 - RNA, 19 nt, Homo sapiens
ccaaugagauccacuucug

SEQ ID NO: 1083934 - RNA, 19 nt, Homo sapiens
ggucucagucugugauuua

SEQ ID NO: 1083935 - RNA, 19 nt, Homo sapiens
caggaaaugcucaacaaua

SEQ ID NO: 1083936 - RNA, 19 nt, Homo sapiens
ccacccaugugaaccauaa

SEQ ID NO: 1083937 - RNA, 19 nt, Homo sapiens
gcacaagacagucaaaugg

SEQ ID NO: 1083938 - RNA, 19 nt, Homo sapiens
aaucuucccucauuucauu

SEQ ID NO: 1083939 - RNA, 19 nt, Homo sapiens
gaaaugcucaacaauaaca

SEQ ID NO: 1083940 - RNA, 19 nt, Homo sapiens
gaaaugggagggcaagaga

SEQ ID NO: 1083941 - RNA, 19 nt, Homo sapiens
guuacuugcuccuucauuu

SEQ ID NO: 1083942 - RNA, 19 nt, Homo sapiens
gacagggacuucggcauuu

SEQ ID NO: 1083943 - RNA, 19 nt, Homo sapiens
ugaaugugcuggugcagaa

SEQ ID NO: 1083944 - RNA, 19 nt, Homo sapiens
ggugaagacuggcaagugu

SEQ ID NO: 1083945 - RNA, 19 nt, Homo sapiens
gauuaucuccugcugcaua

SEQ ID NO: 1083946 - RNA, 19 nt, Homo sapiens
ggacgccucuccuccacaa

SEQ ID NO: 1083947 - RNA, 19 nt, Homo sapiens
acucuuaacuguacgugua

SEQ ID NO: 1083948 - RNA, 19 nt, Homo sapiens
ugccucagcuucccaagua

SEQ ID NO: 1083949 - RNA, 19 nt, Homo sapiens
guuuguaacucaucauaga

SEQ ID NO: 1083950 - RNA, 19 nt, Homo sapiens
ggaaccgacuuggaauuug

SEQ ID NO: 1083951 - RNA, 19 nt, Homo sapiens
ggagacaugucaguaucaa

SEQ ID NO: 1083952 - RNA, 19 nt, Homo sapiens
gauagucuacagcuaauga

SEQ ID NO: 1083953 - RNA, 19 nt, Homo sapiens
gaacagucuuccagaucug

SEQ ID NO: 1083954 - RNA, 19 nt, Homo sapiens
cggaacagguagagacaaa

SEQ ID NO: 1083955 - RNA, 19 nt, Homo sapiens
uaguagagauggaguuuca

SEQ ID NO: 1083956 - RNA, 19 nt, Homo sapiens
ggagagcucugaggaggau

SEQ ID NO: 1083957 - RNA, 19 nt, Homo sapiens
gcagaaaccggaccucaca

SEQ ID NO: 1083958 - RNA, 19 nt, Homo sapiens
gagaaccacggaacaggua

SEQ ID NO: 1083959 - RNA, 19 nt, Homo sapiens
guucacagauagcaacaau

SEQ ID NO: 1083960 - RNA, 19 nt, Homo sapiens
ggacucagcccuggacaga

SEQ ID NO: 1083961 - RNA, 19 nt, Homo sapiens
gggaaagaaccacaccuaa

SEQ ID NO: 1083962 - RNA, 19 nt, Homo sapiens
ggugagauuugauccacuu

SEQ ID NO: 1083963 - RNA, 19 nt, Homo sapiens
cauguggacucuuaacugu

SEQ ID NO: 1083964 - RNA, 19 nt, Homo sapiens
ucaacagggugaugacgaa

SEQ ID NO: 1083965 - RNA, 19 nt, Homo sapiens
gguuaggauuugggauuua

SEQ ID NO: 1083966 - RNA, 19 nt, Homo sapiens
gauaaaacccgguggauga

SEQ ID NO: 1083967 - RNA, 19 nt, Homo sapiens
ugcaggagcugguagaaga

SEQ ID NO: 1083968 - RNA, 19 nt, Homo sapiens
ucaaggcucugaucauuuu

SEQ ID NO: 1083969 - RNA, 19 nt, Homo sapiens
ggagaaaucaaggcucuga

SEQ ID NO: 1083970 - RNA, 19 nt, Homo sapiens
gcagugagaacaacuccaa

SEQ ID NO: 1083971 - RNA, 19 nt, Homo sapiens
gugauuuccuuucuguuug

SEQ ID NO: 1083972 - RNA, 19 nt, Homo sapiens
gaaccacaccuaacuacuc

SEQ ID NO: 1083973 - RNA, 19 nt, Homo sapiens
ggaaagaaccacaccuaac

SEQ ID NO: 1083974 - RNA, 19 nt, Homo sapiens
gagguuaggauuugggauu

SEQ ID NO: 1083975 - RNA, 19 nt, Homo sapiens
caugaagguugucccagaa

SEQ ID NO: 1083976 - RNA, 19 nt, Homo sapiens
gggauagucuacagcuaau

SEQ ID NO: 1083977 - RNA, 19 nt, Homo sapiens
gcggagacaugucaguauc

SEQ ID NO: 1083978 - RNA, 19 nt, Homo sapiens
ugcaagaucuacaaugaug

SEQ ID NO: 1083979 - RNA, 19 nt, Homo sapiens
acugcaagaucuacaauga

SEQ ID NO: 1083980 - RNA, 19 nt, Homo sapiens
gggaaccgacuuggaauuu

SEQ ID NO: 1083981 - RNA, 19 nt, Homo sapiens
acagggacuucggcauuua

SEQ ID NO: 1083982 - RNA, 19 nt, Homo sapiens
gugaauagaggaacaagug

SEQ ID NO: 1083983 - RNA, 19 nt, Homo sapiens
cugaaucgcugucgugcuu

SEQ ID NO: 1083984 - RNA, 19 nt, Homo sapiens
gaacugcaagaucuacaau

SEQ ID NO: 1083985 - RNA, 19 nt, Homo sapiens
gccacaaucuccugaccuu

SEQ ID NO: 1083986 - RNA, 19 nt, Homo sapiens
cauagauggaacagaauua

SEQ ID NO: 1083987 - RNA, 19 nt, Homo sapiens
uuacucacagcaauuguua

SEQ ID NO: 1083988 - RNA, 19 nt, Homo sapiens
ggacaccgccguacuccau

SEQ ID NO: 1083989 - RNA, 19 nt, Homo sapiens
gggcuuggcuuggccuaug

SEQ ID NO: 1083990 - RNA, 19 nt, Homo sapiens
caguaaugcuuccgugaau

SEQ ID NO: 1083991 - RNA, 19 nt, Homo sapiens
gaucggugauggacagucu

SEQ ID NO: 1083992 - RNA, 19 nt, Homo sapiens
aaacaacucgggcagcauu

SEQ ID NO: 1083993 - RNA, 19 nt, Homo sapiens
ccaccucagugacaucuca

SEQ ID NO: 1083994 - RNA, 19 nt, Homo sapiens
gaccagaggccuuaaacuc

SEQ ID NO: 1083995 - RNA, 19 nt, Homo sapiens
ugaggacaauggugacaga

SEQ ID NO: 1083996 - RNA, 19 nt, Homo sapiens
ugaacagucuuccagaucu

SEQ ID NO: 1083997 - RNA, 19 nt, Homo sapiens
cagagagccuccagagagu

SEQ ID NO: 1083998 - RNA, 19 nt, Homo sapiens
gcuucuuucuggaguauga

SEQ ID NO: 1083999 - RNA, 19 nt, Homo sapiens
gaccugagacgcuucuuuc

SEQ ID NO: 1084000 - RNA, 19 nt, Homo sapiens
uguugcauguggacucuua

SEQ ID NO: 1084001 - RNA, 19 nt, Homo sapiens
acugcgaguugaccaauaa

SEQ ID NO: 1084002 - RNA, 19 nt, Homo sapiens
caaaggagaccuggugauc

SEQ ID NO: 1084003 - RNA, 19 nt, Homo sapiens
ggccuaugguacuaacaaa

SEQ ID NO: 1084004 - RNA, 19 nt, Homo sapiens
gaaggcauccuggcagugu

SEQ ID NO: 1084005 - RNA, 19 nt, Homo sapiens
cgaggcugcuggaaucuuc

SEQ ID NO: 1084006 - RNA, 19 nt, Homo sapiens
ugagucagauggagggaau

SEQ ID NO: 1084007 - RNA, 19 nt, Homo sapiens
gagggaaacaccaaagauc

SEQ ID NO: 1084008 - RNA, 19 nt, Homo sapiens
acucagcccuggacagaga

SEQ ID NO: 1084009 - RNA, 19 nt, Homo sapiens
gagaguggcuguccugauu

SEQ ID NO: 1084010 - RNA, 19 nt, Homo sapiens
ccugaaagcugacucuaua

SEQ ID NO: 1084011 - RNA, 19 nt, Homo sapiens
cgacacaucucucaucaga

SEQ ID NO: 1084012 - RNA, 19 nt, Homo sapiens
ugaauccguucgaguauua

SEQ ID NO: 1084013 - RNA, 19 nt, Homo sapiens
caaaggagcugcacaccau

SEQ ID NO: 1084014 - RNA, 19 nt, Homo sapiens
gaaguugguuuauaagcuu

SEQ ID NO: 1084015 - RNA, 19 nt, Homo sapiens
caaccuggcugagaugauu

SEQ ID NO: 1084016 - RNA, 19 nt, Homo sapiens
gauguaaacugagcauaau

SEQ ID NO: 1084017 - RNA, 19 nt, Homo sapiens
ccauggaucugaauaaaca

SEQ ID NO: 1084018 - RNA, 19 nt, Homo sapiens
aaauguggcuucaucacua

SEQ ID NO: 1084019 - RNA, 19 nt, Homo sapiens
gcuaugagaucgccagcuu

SEQ ID NO: 1084020 - RNA, 19 nt, Homo sapiens
gaaucaaaguuucuagagu

SEQ ID NO: 1084021 - RNA, 19 nt, Homo sapiens
ggugucagcugccuucaga

SEQ ID NO: 1084022 - RNA, 19 nt, Homo sapiens
gaaacucuaccucuucuug

SEQ ID NO: 1084023 - RNA, 19 nt, Homo sapiens
gaauaaacauguccuugcu

SEQ ID NO: 1084024 - RNA, 19 nt, Homo sapiens
caggaaagaaucaaaguuu

SEQ ID NO: 1084025 - RNA, 19 nt, Homo sapiens
ucagaaaggugagcagcua

SEQ ID NO: 1084026 - RNA, 19 nt, Homo sapiens
ggagaaaugggcacccuuu

SEQ ID NO: 1084027 - RNA, 19 nt, Homo sapiens
gaaagcugacucuauaaau

SEQ ID NO: 1084028 - RNA, 19 nt, Homo sapiens
guucgaguauuacauauuc

SEQ ID NO: 1084029 - RNA, 19 nt, Homo sapiens
aggagaaccugcugaugua

SEQ ID NO: 1084030 - RNA, 19 nt, Homo sapiens
ggaggaaacgcaaccaaga

SEQ ID NO: 1084031 - RNA, 19 nt, Homo sapiens
gaaaugggcacccuuuguc

SEQ ID NO: 1084032 - RNA, 19 nt, Homo sapiens
ggaccaggacaguggcuua

SEQ ID NO: 1084033 - RNA, 19 nt, Homo sapiens
gcagaaacucuaccucuuc

SEQ ID NO: 1084034 - RNA, 19 nt, Homo sapiens
caaaguuucuagaguugug

SEQ ID NO: 1084035 - RNA, 19 nt, Homo sapiens
ucaaugggcugcgaagguu

SEQ ID NO: 1084036 - RNA, 19 nt, Homo sapiens
gccguagaauuccauguuu

SEQ ID NO: 1084037 - RNA, 19 nt, Homo sapiens
ccaacgaccuggacgagau

SEQ ID NO: 1084038 - RNA, 19 nt, Homo sapiens
ccaaagcaguggccaacau

SEQ ID NO: 1084039 - RNA, 19 nt, Homo sapiens
gaggaaacgcaaccaagaa

SEQ ID NO: 1084040 - RNA, 19 nt, Homo sapiens
gguaccagaucaucaaugg

SEQ ID NO: 1084041 - RNA, 19 nt, Homo sapiens
guaaauguugggcuuugua

SEQ ID NO: 1084042 - RNA, 19 nt, Homo sapiens
cugcgaagguuugaaauug

SEQ ID NO: 1084043 - RNA, 19 nt, Homo sapiens
uggcaaccguucaguggua

SEQ ID NO: 1084044 - RNA, 19 nt, Homo sapiens
agacugggccguagaauuc

SEQ ID NO: 1084045 - RNA, 19 nt, Homo sapiens
ugccagggcucaacagcua

SEQ ID NO: 1084046 - RNA, 19 nt, Homo sapiens
gagcuguccuggagaugug

SEQ ID NO: 1084047 - RNA, 19 nt, Homo sapiens
cacagugguuugcuaagaa

SEQ ID NO: 1084048 - RNA, 19 nt, Homo sapiens
ugauguaaacugagcauaa

SEQ ID NO: 1084049 - RNA, 19 nt, Homo sapiens
ggucggauucugccaguuu

SEQ ID NO: 1084050 - RNA, 19 nt, Homo sapiens
ccaccacacuagccuccua

SEQ ID NO: 1084051 - RNA, 19 nt, Homo sapiens
gcgugaauccuguggagua

SEQ ID NO: 1084052 - RNA, 19 nt, Homo sapiens
ugaaagcugacucuauaaa

SEQ ID NO: 1084053 - RNA, 19 nt, Homo sapiens
aauguugggcuuuguauuu

SEQ ID NO: 1084054 - RNA, 19 nt, Homo sapiens
cauugucacuucaguaaca

SEQ ID NO: 1084055 - RNA, 19 nt, Homo sapiens
caaguuguuugugggcuuu

SEQ ID NO: 1084056 - RNA, 19 nt, Homo sapiens
gggguuugcuuuaauguuu

SEQ ID NO: 1084057 - RNA, 19 nt, Homo sapiens
gcaucucaguggugauuuc

SEQ ID NO: 1084058 - RNA, 19 nt, Homo sapiens
gagcacaucacccaaagca

SEQ ID NO: 1084059 - RNA, 19 nt, Homo sapiens
ccaggacaguggcuuaagu

SEQ ID NO: 1084060 - RNA, 19 nt, Homo sapiens
gaagguuugaaauugagua

SEQ ID NO: 1084061 - RNA, 19 nt, Homo sapiens
ggccaggacugcaaguaca

SEQ ID NO: 1084062 - RNA, 19 nt, Homo sapiens
gaaaggugagcagcuauuc

SEQ ID NO: 1084063 - RNA, 19 nt, Homo sapiens
gaaauguggcuucaucacu

SEQ ID NO: 1084064 - RNA, 19 nt, Homo sapiens
caaugaugaaguugguuua

SEQ ID NO: 1084065 - RNA, 19 nt, Homo sapiens
gaaacgcaaccaagaaagg

SEQ ID NO: 1084066 - RNA, 19 nt, Homo sapiens
ucgcucagcucaucacaca

SEQ ID NO: 1084067 - RNA, 19 nt, Homo sapiens
gauguacaccaaguuguuu

SEQ ID NO: 1084068 - RNA, 19 nt, Homo sapiens
ccaaagauggucagaagca

SEQ ID NO: 1084069 - RNA, 19 nt, Homo sapiens
ucucccagcuguuccaaga

SEQ ID NO: 1084070 - RNA, 19 nt, Homo sapiens
agagcaggcuggagggauu

SEQ ID NO: 1084071 - RNA, 19 nt, Homo sapiens
gcaccacccaggaugagaa

SEQ ID NO: 1084072 - RNA, 19 nt, Homo sapiens
ggagaaggcccuggaguac

SEQ ID NO: 1084073 - RNA, 19 nt, Homo sapiens
ucuacuggcuagccugaaa

SEQ ID NO: 1084074 - RNA, 19 nt, Homo sapiens
gcgaagguuugaaauugag

SEQ ID NO: 1084075 - RNA, 19 nt, Homo sapiens
gggcugcgaagguuugaaa

SEQ ID NO: 1084076 - RNA, 19 nt, Homo sapiens
ggaguaccugcgccagaua

SEQ ID NO: 1084077 - RNA, 19 nt, Homo sapiens
ucucauggcugggcuuuag

SEQ ID NO: 1084078 - RNA, 19 nt, Homo sapiens
aacaucaagugcucaaaga

SEQ ID NO: 1084079 - RNA, 19 nt, Homo sapiens
gguuugaaauugaguacca

SEQ ID NO: 1084080 - RNA, 19 nt, Homo sapiens
ucccauggcugguagaaag

SEQ ID NO: 1084081 - RNA, 19 nt, Homo sapiens
gcuggaaccuccgcugcuu

SEQ ID NO: 1084082 - RNA, 19 nt, Homo sapiens
uggagaaggcccuggagua

SEQ ID NO: 1084083 - RNA, 19 nt, Homo sapiens
gagaaaugggcacccuuug

SEQ ID NO: 1084084 - RNA, 19 nt, Homo sapiens
ucagagcuguccuggagau

SEQ ID NO: 1084085 - RNA, 19 nt, Homo sapiens
gacaccagccauacccuuu

SEQ ID NO: 1084086 - RNA, 19 nt, Homo sapiens
ugaaguugguuuauaagcu

SEQ ID NO: 1084087 - RNA, 19 nt, Homo sapiens
ucacuucaguaacaucaag

SEQ ID NO: 1084088 - RNA, 19 nt, Homo sapiens
uaacgacccauggaucuga

SEQ ID NO: 1084089 - RNA, 19 nt, Homo sapiens
uaacaucaagugcucaaag

SEQ ID NO: 1084090 - RNA, 19 nt, Homo sapiens
ugcgaagguuugaaauuga

SEQ ID NO: 1084091 - RNA, 19 nt, Homo sapiens
ccacaacaagguccaguuc

SEQ ID NO: 1084092 - RNA, 19 nt, Homo sapiens
aacauguccuugcuucuga

SEQ ID NO: 1084093 - RNA, 19 nt, Homo sapiens
gacccauggaucugaauaa

SEQ ID NO: 1084094 - RNA, 19 nt, Homo sapiens
ucucaguggugauuuccaa

SEQ ID NO: 1084095 - RNA, 19 nt, Homo sapiens
caaagauggucagaagcau

SEQ ID NO: 1084096 - RNA, 19 nt, Homo sapiens
ggccguagaauuccauguu

SEQ ID NO: 1084097 - RNA, 19 nt, Homo sapiens
gcugcgaagguuugaaauu

SEQ ID NO: 1084098 - RNA, 19 nt, Homo sapiens
aagcgcagcucaggcaguu

SEQ ID NO: 1084099 - RNA, 19 nt, Homo sapiens
ucacugaugccuccuucaa

SEQ ID NO: 1084100 - RNA, 19 nt, Homo sapiens
ccugguggcccaaugauga

SEQ ID NO: 1084101 - RNA, 19 nt, Homo sapiens
ccuagaugguguccucguu

SEQ ID NO: 1084102 - RNA, 19 nt, Homo sapiens
agccaaagauggucagaag

SEQ ID NO: 1084103 - RNA, 19 nt, Homo sapiens
ccaggaaagaaucaaaguu

SEQ ID NO: 1084104 - RNA, 19 nt, Homo sapiens
gaccaggacaguggcuuaa

SEQ ID NO: 1084105 - RNA, 19 nt, Homo sapiens
cuacgccucugccaugaca

SEQ ID NO: 1084106 - RNA, 19 nt, Homo sapiens
gcagcagcccagcuuucua

SEQ ID NO: 1084107 - RNA, 19 nt, Homo sapiens
acuauuccuuggagaugua

SEQ ID NO: 1084108 - RNA, 19 nt, Homo sapiens
uaaagcgacacaucucuca

SEQ ID NO: 1084109 - RNA, 19 nt, Homo sapiens
gagaguggcuguccugauu

SEQ ID NO: 1084110 - RNA, 19 nt, Homo sapiens
cgacacaucucucaucaga

SEQ ID NO: 1084111 - RNA, 19 nt, Homo sapiens
ugaauccguucgaguauua

SEQ ID NO: 1084112 - RNA, 19 nt, Homo sapiens
gaccauggaucugaauaaa

SEQ ID NO: 1084113 - RNA, 19 nt, Homo sapiens
caaccuggcugagaugauu

SEQ ID NO: 1084114 - RNA, 19 nt, Homo sapiens
ccauggaucugaauaaaca

SEQ ID NO: 1084115 - RNA, 19 nt, Homo sapiens
aaauguggcuucaucacua

SEQ ID NO: 1084116 - RNA, 19 nt, Homo sapiens
gcuaugagaucgccagcuu

SEQ ID NO: 1084117 - RNA, 19 nt, Homo sapiens
gaaucaaaguuucuagagu

SEQ ID NO: 1084118 - RNA, 19 nt, Homo sapiens
ggugucagcugccuucaga

SEQ ID NO: 1084119 - RNA, 19 nt, Homo sapiens
gaaacucuaccucuucuug

SEQ ID NO: 1084120 - RNA, 19 nt, Homo sapiens
gaauaaacauguccuugcu

SEQ ID NO: 1084121 - RNA, 19 nt, Homo sapiens
caggaaagaaucaaaguuu

SEQ ID NO: 1084122 - RNA, 19 nt, Homo sapiens
ucagaaaggugagcagcua

SEQ ID NO: 1084123 - RNA, 19 nt, Homo sapiens
ggagaaaugggcacccuuu

SEQ ID NO: 1084124 - RNA, 19 nt, Homo sapiens
acacaucucucaucagaca

SEQ ID NO: 1084125 - RNA, 19 nt, Homo sapiens
guucgaguauuacauauuc

SEQ ID NO: 1084126 - RNA, 19 nt, Homo sapiens
aggagaaccugcugaugua

SEQ ID NO: 1084127 - RNA, 19 nt, Homo sapiens
ggaggaaacgcaaccaaga

SEQ ID NO: 1084128 - RNA, 19 nt, Homo sapiens
uaacgaccauggaucugaa

SEQ ID NO: 1084129 - RNA, 19 nt, Homo sapiens
gaaaugggcacccuuuguc

SEQ ID NO: 1084130 - RNA, 19 nt, Homo sapiens
gagcagggccuccuuacug

SEQ ID NO: 1084131 - RNA, 19 nt, Homo sapiens
ggaccaggacaguggcuua

SEQ ID NO: 1084132 - RNA, 19 nt, Homo sapiens
gcagaaacucuaccucuuc

SEQ ID NO: 1084133 - RNA, 19 nt, Homo sapiens
caaaguuucuagaguugug

SEQ ID NO: 1084134 - RNA, 19 nt, Homo sapiens
ucaaugggcugcgaagguu

SEQ ID NO: 1084135 - RNA, 19 nt, Homo sapiens
gccguagaauuccauguuu

SEQ ID NO: 1084136 - RNA, 19 nt, Homo sapiens
ccaacgaccuggacgagau

SEQ ID NO: 1084137 - RNA, 19 nt, Homo sapiens
ccaaagcaguggccaacau

SEQ ID NO: 1084138 - RNA, 19 nt, Homo sapiens
gaggaaacgcaaccaagaa

SEQ ID NO: 1084139 - RNA, 19 nt, Homo sapiens
gguaccagaucaucaaugg

SEQ ID NO: 1084140 - RNA, 19 nt, Homo sapiens
cugcgaagguuugaaauug

SEQ ID NO: 1084141 - RNA, 19 nt, Homo sapiens
uggcaaccguucaguggua

SEQ ID NO: 1084142 - RNA, 19 nt, Homo sapiens
agacugggccguagaauuc

SEQ ID NO: 1084143 - RNA, 19 nt, Homo sapiens
ugccagggcucaacagcua

SEQ ID NO: 1084144 - RNA, 19 nt, Homo sapiens
gagcuguccuggagaugug

SEQ ID NO: 1084145 - RNA, 19 nt, Homo sapiens
gagccaacccucacugaug

SEQ ID NO: 1084146 - RNA, 19 nt, Homo sapiens
ggucggauucugccaguuu

SEQ ID NO: 1084147 - RNA, 19 nt, Homo sapiens
ccaccacacuagccuccua

SEQ ID NO: 1084148 - RNA, 19 nt, Homo sapiens
cauugucacuucaguaaca

SEQ ID NO: 1084149 - RNA, 19 nt, Homo sapiens
caaguuguuugugggcuuu

SEQ ID NO: 1084150 - RNA, 19 nt, Homo sapiens
gggguuugcuuuaauguuu

SEQ ID NO: 1084151 - RNA, 19 nt, Homo sapiens
gcaucucaguggugauuuc

SEQ ID NO: 1084152 - RNA, 19 nt, Homo sapiens
gagcacaucacccaaagca

SEQ ID NO: 1084153 - RNA, 19 nt, Homo sapiens
ccaggacaguggcuuaagu

SEQ ID NO: 1084154 - RNA, 19 nt, Homo sapiens
gaagguuugaaauugagua

SEQ ID NO: 1084155 - RNA, 19 nt, Homo sapiens
ggccaggacugcaaguaca

SEQ ID NO: 1084156 - RNA, 19 nt, Homo sapiens
gaaaggugagcagcuauuc

SEQ ID NO: 1084157 - RNA, 19 nt, Homo sapiens
gaaauguggcuucaucacu

SEQ ID NO: 1084158 - RNA, 19 nt, Homo sapiens
gaaacgcaaccaagaaagg

SEQ ID NO: 1084159 - RNA, 19 nt, Homo sapiens
ucgcucagcucaucacaca

SEQ ID NO: 1084160 - RNA, 19 nt, Homo sapiens
gauguacaccaaguuguuu

SEQ ID NO: 1084161 - RNA, 19 nt, Homo sapiens
ccaaagauggucagaagca

SEQ ID NO: 1084162 - RNA, 19 nt, Homo sapiens
ucucccagcuguuccaaga

SEQ ID NO: 1084163 - RNA, 19 nt, Homo sapiens
agagcaggcuggagggauu

SEQ ID NO: 1084164 - RNA, 19 nt, Homo sapiens
gcaccacccaggaugagaa

SEQ ID NO: 1084165 - RNA, 19 nt, Homo sapiens
ggagaaggcccuggaguac

SEQ ID NO: 1084166 - RNA, 19 nt, Homo sapiens
guucugcacuaccgacuca

SEQ ID NO: 1084167 - RNA, 19 nt, Homo sapiens
cgaccauggaucugaauaa

SEQ ID NO: 1084168 - RNA, 19 nt, Homo sapiens
gcgaagguuugaaauugag

SEQ ID NO: 1084169 - RNA, 19 nt, Homo sapiens
gggcugcgaagguuugaaa

SEQ ID NO: 1084170 - RNA, 19 nt, Homo sapiens
ggaguaccugcgccagaua

SEQ ID NO: 1084171 - RNA, 19 nt, Homo sapiens
ucucauggcugggcuuuag

SEQ ID NO: 1084172 - RNA, 19 nt, Homo sapiens
guaacgaccauggaucuga

SEQ ID NO: 1084173 - RNA, 19 nt, Homo sapiens
aacaucaagugcucaaaga

SEQ ID NO: 1084174 - RNA, 19 nt, Homo sapiens
gguuugaaauugaguacca

SEQ ID NO: 1084175 - RNA, 19 nt, Homo sapiens
uggagaaggcccuggagua

SEQ ID NO: 1084176 - RNA, 19 nt, Homo sapiens
gacaccagccauacccuuu

SEQ ID NO: 1084177 - RNA, 19 nt, Homo sapiens
gagaaaugggcacccuuug

SEQ ID NO: 1084178 - RNA, 19 nt, Homo sapiens
ucagagcuguccuggagau

SEQ ID NO: 1084179 - RNA, 19 nt, Homo sapiens
ucacuucaguaacaucaag

SEQ ID NO: 1084180 - RNA, 19 nt, Homo sapiens
uaacaucaagugcucaaag

SEQ ID NO: 1084181 - RNA, 19 nt, Homo sapiens
ugcgaagguuugaaauuga

SEQ ID NO: 1084182 - RNA, 19 nt, Homo sapiens
uggaggaguucaaacgaau

SEQ ID NO: 1084183 - RNA, 19 nt, Homo sapiens
ucucaguggugauuuccaa

SEQ ID NO: 1084184 - RNA, 19 nt, Homo sapiens
caaagauggucagaagcau

SEQ ID NO: 1084185 - RNA, 19 nt, Homo sapiens
ggccguagaauuccauguu

SEQ ID NO: 1084186 - RNA, 19 nt, Homo sapiens
gcugcgaagguuugaaauu

SEQ ID NO: 1084187 - RNA, 19 nt, Homo sapiens
aagcgcagcucaggcaguu

SEQ ID NO: 1084188 - RNA, 19 nt, Homo sapiens
ucacugaugccuccuucaa

SEQ ID NO: 1084189 - RNA, 19 nt, Homo sapiens
uaaagcgacacaucucuca

SEQ ID NO: 1084190 - RNA, 19 nt, Homo sapiens
agccaaagauggucagaag

SEQ ID NO: 1084191 - RNA, 19 nt, Homo sapiens
ccaggaaagaaucaaaguu

SEQ ID NO: 1084192 - RNA, 19 nt, Homo sapiens
gaccaggacaguggcuuaa

SEQ ID NO: 1084193 - RNA, 19 nt, Homo sapiens
cuacgccucugccaugaca

SEQ ID NO: 1084194 - RNA, 19 nt, Homo sapiens
acuauuccuuggagaugua

SEQ ID NO: 1084195 - RNA, 19 nt, Homo sapiens
ccauacccuuugcuuccua

SEQ ID NO: 1084196 - RNA, 19 nt, Homo sapiens
ggaaacgcaaccaagaaag

SEQ ID NO: 1084197 - RNA, 19 nt, Homo sapiens
gccaucaaccacagauuug

SEQ ID NO: 1084198 - RNA, 19 nt, Homo sapiens
gcugauguacaccaaguug

SEQ ID NO: 1084199 - RNA, 19 nt, Homo sapiens
cgagguucguccagcagaa

SEQ ID NO: 1084200 - RNA, 19 nt, Homo sapiens
cuucagacugugccuauuu

SEQ ID NO: 1084201 - RNA, 19 nt, Homo sapiens
caucaagugcucaaagaca

SEQ ID NO: 1084202 - RNA, 19 nt, Homo sapiens
ccaagacugggccguagaa

SEQ ID NO: 1084203 - RNA, 19 nt, Homo sapiens
cagcaucucaguggugauu

SEQ ID NO: 1084204 - RNA, 19 nt, Homo sapiens
cuacugaggagcauguguu

SEQ ID NO: 1084205 - RNA, 19 nt, Homo sapiens
aaagauggucagaagcauu

SEQ ID NO: 1084206 - RNA, 19 nt, Homo sapiens
gcucaucacacaggccaaa

SEQ ID NO: 1084207 - RNA, 19 nt, Homo sapiens
gcaaguacaccccgauguu

SEQ ID NO: 1084208 - RNA, 19 nt, Homo sapiens
agacugugccuauuucauc

SEQ ID NO: 1084209 - RNA, 19 nt, Homo sapiens
caccaaagaugaugaauua

SEQ ID NO: 1084210 - RNA, 19 nt, Homo sapiens
gaagagggcuugauagcaa

SEQ ID NO: 1084211 - RNA, 19 nt, Homo sapiens
gaaaugagaguaguuguua

SEQ ID NO: 1084212 - RNA, 19 nt, Homo sapiens
gcacagagcccuuugauuc

SEQ ID NO: 1084213 - RNA, 19 nt, Homo sapiens
gagaugaugucacuuacua

SEQ ID NO: 1084214 - RNA, 19 nt, Homo sapiens
ccauauaggugugcaauua

SEQ ID NO: 1084215 - RNA, 19 nt, Homo sapiens
gaaauuuacaugccacuua

SEQ ID NO: 1084216 - RNA, 19 nt, Homo sapiens
gcacuuaaauacucaucua

SEQ ID NO: 1084217 - RNA, 19 nt, Homo sapiens
guacaguucuggucgauuu

SEQ ID NO: 1084218 - RNA, 19 nt, Homo sapiens
ggaaacgucugcaaguauu

SEQ ID NO: 1084219 - RNA, 19 nt, Homo sapiens
gaauaaguauguaguggaa

SEQ ID NO: 1084220 - RNA, 19 nt, Homo sapiens
gcaaaguguguaaguauua

SEQ ID NO: 1084221 - RNA, 19 nt, Homo sapiens
gauagaaguuucacagaga

SEQ ID NO: 1084222 - RNA, 19 nt, Homo sapiens
aaacuugacuguucacauu

SEQ ID NO: 1084223 - RNA, 19 nt, Homo sapiens
gaaaagccguuuaaaugua

SEQ ID NO: 1084224 - RNA, 19 nt, Homo sapiens
gaaaugagcaggccagugu

SEQ ID NO: 1084225 - RNA, 19 nt, Homo sapiens
gagaguaguuguuaaaucu

SEQ ID NO: 1084226 - RNA, 19 nt, Homo sapiens
gaucacagcaguuauaaug

SEQ ID NO: 1084227 - RNA, 19 nt, Homo sapiens
gcaacgggagugagaauua

SEQ ID NO: 1084228 - RNA, 19 nt, Homo sapiens
gcaaacacauucugcauac

SEQ ID NO: 1084229 - RNA, 19 nt, Homo sapiens
gcagauugcucuauuuuaa

SEQ ID NO: 1084230 - RNA, 19 nt, Homo sapiens
gaggagaugaugucacuua

SEQ ID NO: 1084231 - RNA, 19 nt, Homo sapiens
gaaagacugugcucaaggu

SEQ ID NO: 1084232 - RNA, 19 nt, Homo sapiens
uaaaggacggguagaaaua

SEQ ID NO: 1084233 - RNA, 19 nt, Homo sapiens
ggaagacacugagcaaauc

SEQ ID NO: 1084234 - RNA, 19 nt, Homo sapiens
gaauaaagaacccugaaga

SEQ ID NO: 1084235 - RNA, 19 nt, Homo sapiens
cgauuugacuccuccauaa

SEQ ID NO: 1084236 - RNA, 19 nt, Homo sapiens
ucucaacucugcuaaugua

SEQ ID NO: 1084237 - RNA, 19 nt, Homo sapiens
guacaacugucccaagugu

SEQ ID NO: 1084238 - RNA, 19 nt, Homo sapiens
caacucugcuaauguagaa

SEQ ID NO: 1084239 - RNA, 19 nt, Homo sapiens
aagcauaguugaccugaaa

SEQ ID NO: 1084240 - RNA, 19 nt, Homo sapiens
ucaggaagcucugccuuaa

SEQ ID NO: 1084241 - RNA, 19 nt, Homo sapiens
gaauacaagugucaugucu

SEQ ID NO: 1084242 - RNA, 19 nt, Homo sapiens
gaagaagagcaucaacaaa

SEQ ID NO: 1084243 - RNA, 19 nt, Homo sapiens
gagaaaagccguuuaaaug

SEQ ID NO: 1084244 - RNA, 19 nt, Homo sapiens
cgaauuugcugugaugauu

SEQ ID NO: 1084245 - RNA, 19 nt, Homo sapiens
caugagauaucgaaugaug

SEQ ID NO: 1084246 - RNA, 19 nt, Homo sapiens
gaauuagcuucaaccacua

SEQ ID NO: 1084247 - RNA, 19 nt, Homo sapiens
gagcauuccuaucuugaga

SEQ ID NO: 1084248 - RNA, 19 nt, Homo sapiens
gcaguuauaaugcuauuug

SEQ ID NO: 1084249 - RNA, 19 nt, Homo sapiens
ccacaacucagucccauuu

SEQ ID NO: 1084250 - RNA, 19 nt, Homo sapiens
gggaagaugugucgaagca

SEQ ID NO: 1084251 - RNA, 19 nt, Homo sapiens
gcacuuccauuguuuacuc

SEQ ID NO: 1084252 - RNA, 19 nt, Homo sapiens
uuagugagcugcccuugaa

SEQ ID NO: 1084253 - RNA, 19 nt, Homo sapiens
uaacagccaucuucuugau

SEQ ID NO: 1084254 - RNA, 19 nt, Homo sapiens
uaacaaaccagcugaguca

SEQ ID NO: 1084255 - RNA, 19 nt, Homo sapiens
guaauggaguagaguaugu

SEQ ID NO: 1084256 - RNA, 19 nt, Homo sapiens
aaacacaguucagauauca

SEQ ID NO: 1084257 - RNA, 19 nt, Homo sapiens
gaaauagaagcaaguggaa

SEQ ID NO: 1084258 - RNA, 19 nt, Homo sapiens
cuaacaggauuucauguga

SEQ ID NO: 1084259 - RNA, 19 nt, Homo sapiens
ggaccucgcuuaccugcau

SEQ ID NO: 1084260 - RNA, 19 nt, Homo sapiens
gaagcucugccuuaaauug

SEQ ID NO: 1084261 - RNA, 19 nt, Homo sapiens
gaaaauauccgcaaacaca

SEQ ID NO: 1084262 - RNA, 19 nt, Homo sapiens
ugaaaguagugaugucuau

SEQ ID NO: 1084263 - RNA, 19 nt, Homo sapiens
ccaaagagagggagaccua

SEQ ID NO: 1084264 - RNA, 19 nt, Homo sapiens
ugaagaagcacuuaaauac

SEQ ID NO: 1084265 - RNA, 19 nt, Homo sapiens
gaaaggugaccaagaagau

SEQ ID NO: 1084266 - RNA, 19 nt, Homo sapiens
ggaggugaauaaguaugua

SEQ ID NO: 1084267 - RNA, 19 nt, Homo sapiens
ugaagauggugaguugaua

SEQ ID NO: 1084268 - RNA, 19 nt, Homo sapiens
ggaaaacacaguucagaua

SEQ ID NO: 1084269 - RNA, 19 nt, Homo sapiens
gcaccaaagaugaugaauu

SEQ ID NO: 1084270 - RNA, 19 nt, Homo sapiens
ugacaagaauaaccagaga

SEQ ID NO: 1084271 - RNA, 19 nt, Homo sapiens
aauugaagcugaaguugaa

SEQ ID NO: 1084272 - RNA, 19 nt, Homo sapiens
ggaaauggaaggauugaag

SEQ ID NO: 1084273 - RNA, 19 nt, Homo sapiens
aagaagaguuugauguuuc

SEQ ID NO: 1084274 - RNA, 19 nt, Homo sapiens
ggagauauggaacgucauu

SEQ ID NO: 1084275 - RNA, 19 nt, Homo sapiens
gcucugcgcugcugacucu

SEQ ID NO: 1084276 - RNA, 19 nt, Homo sapiens
ggaacagcauccugacauc

SEQ ID NO: 1084277 - RNA, 19 nt, Homo sapiens
caaagaugaugaauuagcu

SEQ ID NO: 1084278 - RNA, 19 nt, Homo sapiens
ggacugaguggacugaaug

SEQ ID NO: 1084279 - RNA, 19 nt, Homo sapiens
guagugaugucuaugaaac

SEQ ID NO: 1084280 - RNA, 19 nt, Homo sapiens
ugaaagcccugugcucguu

SEQ ID NO: 1084281 - RNA, 19 nt, Homo sapiens
gcacaggugagaauaagug

SEQ ID NO: 1084282 - RNA, 19 nt, Homo sapiens
guuaacagccaucuucuug

SEQ ID NO: 1084283 - RNA, 19 nt, Homo sapiens
agaugaacaugcuaacaaa

SEQ ID NO: 1084284 - RNA, 19 nt, Homo sapiens
aaaguacauuccaguuuga

SEQ ID NO: 1084285 - RNA, 19 nt, Homo sapiens
gaaaaguacauuccaguuu

SEQ ID NO: 1084286 - RNA, 19 nt, Homo sapiens
gagaaaagcccuacagaug

SEQ ID NO: 1084287 - RNA, 19 nt, Homo sapiens
ccaugaagcauccuacaaa

SEQ ID NO: 1084288 - RNA, 19 nt, Homo sapiens
gagcugcccuugaaagacu

SEQ ID NO: 1084289 - RNA, 19 nt, Homo sapiens
gaagccagaucguggaaac

SEQ ID NO: 1084290 - RNA, 19 nt, Homo sapiens
uaguugaccugaaaugaga

SEQ ID NO: 1084291 - RNA, 19 nt, Homo sapiens
gaagaagcacuuaaauacu

SEQ ID NO: 1084292 - RNA, 19 nt, Homo sapiens
ugcgggaggugaauaagua

SEQ ID NO: 1084293 - RNA, 19 nt, Homo sapiens
uguggaaagucguucuaua

SEQ ID NO: 1084294 - RNA, 19 nt, Homo sapiens
ugaugauuguggcuucuua

SEQ ID NO: 1084295 - RNA, 19 nt, Homo sapiens
aggaagcucugccuuaaau

SEQ ID NO: 1084296 - RNA, 19 nt, Homo sapiens
gaguaguuguuaaaucuuc

SEQ ID NO: 1084297 - RNA, 19 nt, Homo sapiens
uaacaggauuucaugugau

SEQ ID NO: 1084298 - RNA, 19 nt, Homo sapiens
gagucaagauguacaacug

SEQ ID NO: 1084299 - RNA, 19 nt, Homo sapiens
guaaugaagaagcacuuaa

SEQ ID NO: 1084300 - RNA, 19 nt, Homo sapiens
aaagaacccugaagauggu

SEQ ID NO: 1084301 - RNA, 19 nt, Homo sapiens
gcugcagauugcucuauuu

SEQ ID NO: 1084302 - RNA, 19 nt, Homo sapiens
uaucucaacucugcuaaug

SEQ ID NO: 1084303 - RNA, 19 nt, Homo sapiens
caggugagaauaaguguuu

SEQ ID NO: 1084304 - RNA, 19 nt, Homo sapiens
uuacaaacuugacuguuca

SEQ ID NO: 1084305 - RNA, 19 nt, Homo sapiens
gaucguggaaacucaauug

SEQ ID NO: 1084306 - RNA, 19 nt, Homo sapiens
acagucaccaguauaguua

SEQ ID NO: 1084307 - RNA, 19 nt, Homo sapiens
ggaaccauuugaaggaaca

SEQ ID NO: 1084308 - RNA, 19 nt, Homo sapiens
aagaagcacuuaaauacuc

SEQ ID NO: 1084309 - RNA, 19 nt, Homo sapiens
gaacagaauucccagauga

SEQ ID NO: 1084310 - RNA, 19 nt, Homo sapiens
gauguaaacucuugcauaa

SEQ ID NO: 1084311 - RNA, 19 nt, Homo sapiens
gaacuaugcuggugccaaa

SEQ ID NO: 1084312 - RNA, 19 nt, Homo sapiens
ggagagagguauaacauuc

SEQ ID NO: 1084313 - RNA, 19 nt, Homo sapiens
ccaauggcccuguuuauua

SEQ ID NO: 1084314 - RNA, 19 nt, Homo sapiens
gaaagagccauguaaauau

SEQ ID NO: 1084315 - RNA, 19 nt, Homo sapiens
ccucuaagcccaaagauua

SEQ ID NO: 1084316 - RNA, 19 nt, Homo sapiens
caauggcccuguuuauuaa

SEQ ID NO: 1084317 - RNA, 19 nt, Homo sapiens
ggaguuggauaaugugaaa

SEQ ID NO: 1084318 - RNA, 19 nt, Homo sapiens
ggaagacaguaauuuauca

SEQ ID NO: 1084319 - RNA, 19 nt, Homo sapiens
gcacugugauauaauggua

SEQ ID NO: 1084320 - RNA, 19 nt, Homo sapiens
ggacuucucucaaacuugu

SEQ ID NO: 1084321 - RNA, 19 nt, Homo sapiens
guaagaccguggacuguuu

SEQ ID NO: 1084322 - RNA, 19 nt, Homo sapiens
agaaagagccauguaaaua

SEQ ID NO: 1084323 - RNA, 19 nt, Homo sapiens
uagagucccuccaaccuua

SEQ ID NO: 1084324 - RNA, 19 nt, Homo sapiens
aaaguaaacccuaguguaa

SEQ ID NO: 1084325 - RNA, 19 nt, Homo sapiens
gaaagaggacaugguuaua

SEQ ID NO: 1084326 - RNA, 19 nt, Homo sapiens
aguaaacccuaguguaaua

SEQ ID NO: 1084327 - RNA, 19 nt, Homo sapiens
ggagaaagagccauguaaa

SEQ ID NO: 1084328 - RNA, 19 nt, Homo sapiens
caaaguaaacccuagugua

SEQ ID NO: 1084329 - RNA, 19 nt, Homo sapiens
uuaagugucugucaacaaa

SEQ ID NO: 1084330 - RNA, 19 nt, Homo sapiens
guaauaugcuaaccugaug

SEQ ID NO: 1084331 - RNA, 19 nt, Homo sapiens
gcccaaagauuaacuagag

SEQ ID NO: 1084332 - RNA, 19 nt, Homo sapiens
gaugugaaaugcaguaugg

SEQ ID NO: 1084333 - RNA, 19 nt, Homo sapiens
gauauuaaguguucucaac

SEQ ID NO: 1084334 - RNA, 19 nt, Homo sapiens
guacugcccaaguuaaaua

SEQ ID NO: 1084335 - RNA, 19 nt, Homo sapiens
gaaguacugcccaaguuaa

SEQ ID NO: 1084336 - RNA, 19 nt, Homo sapiens
gaaaugcaguaugggacua

SEQ ID NO: 1084337 - RNA, 19 nt, Homo sapiens
caauuggucugaaacaaau

SEQ ID NO: 1084338 - RNA, 19 nt, Homo sapiens
gcagaugccuaagcuguau

SEQ ID NO: 1084339 - RNA, 19 nt, Homo sapiens
gcaaggaagaggacaggua

SEQ ID NO: 1084340 - RNA, 19 nt, Homo sapiens
gauuguuaaugcccuauuu

SEQ ID NO: 1084341 - RNA, 19 nt, Homo sapiens
ccuccaaccuuauagauug

SEQ ID NO: 1084342 - RNA, 19 nt, Homo sapiens
gaaacacccaaaccaguaa

SEQ ID NO: 1084343 - RNA, 19 nt, Homo sapiens
caugaaaacuucuguauug

SEQ ID NO: 1084344 - RNA, 19 nt, Homo sapiens
gagaaagagccauguaaau

SEQ ID NO: 1084345 - RNA, 19 nt, Homo sapiens
acugaaaggugacaaagaa

SEQ ID NO: 1084346 - RNA, 19 nt, Homo sapiens
gugcuaaagugccagugua

SEQ ID NO: 1084347 - RNA, 19 nt, Homo sapiens
gaaaacuucuguauugaga

SEQ ID NO: 1084348 - RNA, 19 nt, Homo sapiens
guaugaauuugcugaaugu

SEQ ID NO: 1084349 - RNA, 19 nt, Homo sapiens
uaguaucagugcaacuuua

SEQ ID NO: 1084350 - RNA, 19 nt, Homo sapiens
uagggaaucuauuugugua

SEQ ID NO: 1084351 - RNA, 19 nt, Homo sapiens
uuucuuggccuuuaucuua

SEQ ID NO: 1084352 - RNA, 19 nt, Homo sapiens
ccaaaccaguaauaugcua

SEQ ID NO: 1084353 - RNA, 19 nt, Homo sapiens
cagugcaacuuuaaugauu

SEQ ID NO: 1084354 - RNA, 19 nt, Homo sapiens
aaagagccauguaaauauc

SEQ ID NO: 1084355 - RNA, 19 nt, Homo sapiens
uaucauucauggaccagua

SEQ ID NO: 1084356 - RNA, 19 nt, Homo sapiens
ggacaugguuauaacucau

SEQ ID NO: 1084357 - RNA, 19 nt, Homo sapiens
ugaaguacugcccaaguua

SEQ ID NO: 1084358 - RNA, 19 nt, Homo sapiens
guaagcagaugccuaagcu

SEQ ID NO: 1084359 - RNA, 19 nt, Homo sapiens
cgaaaccaguagcaaguau

SEQ ID NO: 1084360 - RNA, 19 nt, Homo sapiens
ugacaaagaagcugaagau

SEQ ID NO: 1084361 - RNA, 19 nt, Homo sapiens
uaagcuguauuucuccaaa

SEQ ID NO: 1084362 - RNA, 19 nt, Homo sapiens
ugaauuugcugaauguaag

SEQ ID NO: 1084363 - RNA, 19 nt, Homo sapiens
gggagaaagagccauguaa

SEQ ID NO: 1084364 - RNA, 19 nt, Homo sapiens
gcuagggaaucuauuugug

SEQ ID NO: 1084365 - RNA, 19 nt, Homo sapiens
aaagaggacaugguuauaa

SEQ ID NO: 1084366 - RNA, 19 nt, Homo sapiens
aaagaaagaggacaugguu

SEQ ID NO: 1084367 - RNA, 19 nt, Homo sapiens
aacaacagcuuaacagaca

SEQ ID NO: 1084368 - RNA, 19 nt, Homo sapiens
cagguaagcagaugccuaa

SEQ ID NO: 1084369 - RNA, 19 nt, Homo sapiens
caucugaagguuuaguaua

SEQ ID NO: 1084370 - RNA, 19 nt, Homo sapiens
aagugucugucaacaaaua

SEQ ID NO: 1084371 - RNA, 19 nt, Homo sapiens
cacuaggacuucucucaaa

SEQ ID NO: 1084372 - RNA, 19 nt, Homo sapiens
agaaacacccaaaccagua

SEQ ID NO: 1084373 - RNA, 19 nt, Homo sapiens
agaauuagguaaacaucug

SEQ ID NO: 1084374 - RNA, 19 nt, Homo sapiens
gaggacagguaguggagau

SEQ ID NO: 1084375 - RNA, 19 nt, Homo sapiens
guaugugggucagcuuaaa

SEQ ID NO: 1084376 - RNA, 19 nt, Homo sapiens
ugugugcacugugauauaa

SEQ ID NO: 1084377 - RNA, 19 nt, Homo sapiens
ucaauuggucugaaacaaa

SEQ ID NO: 1084378 - RNA, 19 nt, Homo sapiens
caaaggaagggaucuguca

SEQ ID NO: 1084379 - RNA, 19 nt, Homo sapiens
gccaguguauguauguuau

SEQ ID NO: 1084380 - RNA, 19 nt, Homo sapiens
cugaugcacugcugaaaga

SEQ ID NO: 1084381 - RNA, 19 nt, Homo sapiens
ccuuuaauccuucagauaa

SEQ ID NO: 1084382 - RNA, 19 nt, Homo sapiens
aaaucaagaugaaguacug

SEQ ID NO: 1084383 - RNA, 19 nt, Homo sapiens
ccucgucucucccuggaaa

SEQ ID NO: 1084384 - RNA, 19 nt, Homo sapiens
agaaagaggacaugguuau

SEQ ID NO: 1084385 - RNA, 19 nt, Homo sapiens
gagaaggucggguuguaga

SEQ ID NO: 1084386 - RNA, 19 nt, Homo sapiens
guugaaaguuggugaaucg

SEQ ID NO: 1084387 - RNA, 19 nt, Homo sapiens
gacagaagaccaaggaaca

SEQ ID NO: 1084388 - RNA, 19 nt, Homo sapiens
cagcuuaacagacagaaga

SEQ ID NO: 1084389 - RNA, 19 nt, Homo sapiens
guaaacucuugcauaauac

SEQ ID NO: 1084390 - RNA, 19 nt, Homo sapiens
caacccaauggaccacuua

SEQ ID NO: 1084391 - RNA, 19 nt, Homo sapiens
uaaagugccaguguaugua

SEQ ID NO: 1084392 - RNA, 19 nt, Homo sapiens
cagcagaucggcccaugaa

SEQ ID NO: 1084393 - RNA, 19 nt, Homo sapiens
aaacuucuguauugagaca

SEQ ID NO: 1084394 - RNA, 19 nt, Homo sapiens
gggaagacaguaauuuauc

SEQ ID NO: 1084395 - RNA, 19 nt, Homo sapiens
gagccgccaucaccaagug

SEQ ID NO: 1084396 - RNA, 19 nt, Homo sapiens
gcaacccaauggaccacuu

SEQ ID NO: 1084397 - RNA, 19 nt, Homo sapiens
ccaguagauuguugaaagu

SEQ ID NO: 1084398 - RNA, 19 nt, Homo sapiens
gaagaccaaggaacagaau

SEQ ID NO: 1084399 - RNA, 19 nt, Homo sapiens
gaauuagguaaacaucuga

SEQ ID NO: 1084400 - RNA, 19 nt, Homo sapiens
gcaguaugggacuaucuuu

SEQ ID NO: 1084401 - RNA, 19 nt, Homo sapiens
aaaguuugcccuugugcua

SEQ ID NO: 1084402 - RNA, 19 nt, Homo sapiens
cuaaagugccaguguaugu

SEQ ID NO: 1084403 - RNA, 19 nt, Homo sapiens
uuacagcacugcacaagcu

SEQ ID NO: 1084404 - RNA, 19 nt, Homo sapiens
gcauuuggagcucauuaga

SEQ ID NO: 1084405 - RNA, 19 nt, Homo sapiens
guugucaauuggucugaaa

SEQ ID NO: 1084406 - RNA, 19 nt, Homo sapiens
gaaaccaguagcaaguaug

SEQ ID NO: 1084407 - RNA, 19 nt, Homo sapiens
gcgaaaccaguagcaagua

SEQ ID NO: 1084408 - RNA, 19 nt, Homo sapiens
ugccaacuuuaaaugcuua

SEQ ID NO: 1084409 - RNA, 19 nt, Homo sapiens
ggacguuguuggacuugaa

SEQ ID NO: 1084410 - RNA, 19 nt, Homo sapiens
cauauggacugucggaaca

SEQ ID NO: 1084411 - RNA, 19 nt, Homo sapiens
cgugauggcugcauaugga

SEQ ID NO: 1084412 - RNA, 19 nt, Homo sapiens
cuacugcccuauaugauca

SEQ ID NO: 1084413 - RNA, 19 nt, Homo sapiens
gggacgugauggcugcaua

SEQ ID NO: 1084414 - RNA, 19 nt, Homo sapiens
caagacggccugcguagau

SEQ ID NO: 1084415 - RNA, 19 nt, Homo sapiens
ugaggcuacugcccuauau

SEQ ID NO: 1084416 - RNA, 19 nt, Homo sapiens
gcagcgaggucccuaugac

SEQ ID NO: 1084417 - RNA, 19 nt, Homo sapiens
agacugagcccagaguuga

SEQ ID NO: 1084418 - RNA, 19 nt, Homo sapiens
agcaacagcuccagugugu

SEQ ID NO: 1084419 - RNA, 19 nt, Homo sapiens
ggacgugauggcugcauau

SEQ ID NO: 1084420 - RNA, 19 nt, Homo sapiens
gguggacguuguuggacuu

SEQ ID NO: 1084421 - RNA, 19 nt, Homo sapiens
aagacggccugcguagaua

SEQ ID NO: 1084422 - RNA, 19 nt, Homo sapiens
gaugguggacguuguugga

SEQ ID NO: 1084423 - RNA, 19 nt, Homo sapiens
gccaccggccuguuccuua

SEQ ID NO: 1084424 - RNA, 19 nt, Homo sapiens
gcgacgccgugcacaacuu

SEQ ID NO: 1084425 - RNA, 19 nt, Homo sapiens
gagacugagcccagaguug

SEQ ID NO: 1084426 - RNA, 19 nt, Homo sapiens
uaagaucccacaccucaca

SEQ ID NO: 1084427 - RNA, 19 nt, Homo sapiens
cagcucagccagucagaga

SEQ ID NO: 1084428 - RNA, 19 nt, Homo sapiens
ccaccggccuguuccuuac

SEQ ID NO: 1084429 - RNA, 19 nt, Homo sapiens
gccgagcccucaguacuuc

SEQ ID NO: 1084430 - RNA, 19 nt, Homo sapiens
gaggaugguggacguuguu

SEQ ID NO: 1084431 - RNA, 19 nt, Homo sapiens
gcucagccagucagagaga

SEQ ID NO: 1084432 - RNA, 19 nt, Homo sapiens
caacuccaguaaagacacu

SEQ ID NO: 1084433 - RNA, 19 nt, Homo sapiens
ggccuucgcuggucuuacg

SEQ ID NO: 1084434 - RNA, 19 nt, Homo sapiens
gcuacugcccuauaugauc

SEQ ID NO: 1084435 - RNA, 19 nt, Homo sapiens
gacgcuguccugcaucuga

SEQ ID NO: 1084436 - RNA, 19 nt, Homo sapiens
cucaucagcuccagcaaca

SEQ ID NO: 1084437 - RNA, 19 nt, Homo sapiens
guacuucguggacuuugug

SEQ ID NO: 1084438 - RNA, 19 nt, Homo sapiens
cugauacccugcccuaguc

SEQ ID NO: 1084439 - RNA, 19 nt, Homo sapiens
ggagacugagcccagaguu

SEQ ID NO: 1084440 - RNA, 19 nt, Homo sapiens
ggacacgguaugccugagu

SEQ ID NO: 1084441 - RNA, 19 nt, Homo sapiens
ggcccucugccaucaaauu

SEQ ID NO: 1084442 - RNA, 19 nt, Homo sapiens
acacucuugucccuuggaa

SEQ ID NO: 1084443 - RNA, 19 nt, Homo sapiens
agucccaacuccaguaaag

SEQ ID NO: 1084444 - RNA, 19 nt, Homo sapiens
caaaccuacagcccagaaa

SEQ ID NO: 1084445 - RNA, 19 nt, Homo sapiens
gcccucugccaucaaauug

SEQ ID NO: 1084446 - RNA, 19 nt, Homo sapiens
ccagucccaacuccaguaa

SEQ ID NO: 1084447 - RNA, 19 nt, Homo sapiens
aggcuacugcccuauauga

SEQ ID NO: 1084448 - RNA, 19 nt, Homo sapiens
cuacgccuucuuccuguuu

SEQ ID NO: 1084449 - RNA, 19 nt, Homo sapiens
cagcagcgaggucccuaug

SEQ ID NO: 1084450 - RNA, 19 nt, Homo sapiens
cauauggacugucggaaca

SEQ ID NO: 1084451 - RNA, 19 nt, Homo sapiens
cgugauggcugcauaugga

SEQ ID NO: 1084452 - RNA, 19 nt, Homo sapiens
cuacugcccuauaugauca

SEQ ID NO: 1084453 - RNA, 19 nt, Homo sapiens
ccaccggccuguuccucua

SEQ ID NO: 1084454 - RNA, 19 nt, Homo sapiens
gggacgugauggcugcaua

SEQ ID NO: 1084455 - RNA, 19 nt, Homo sapiens
caagacggccugcguagau

SEQ ID NO: 1084456 - RNA, 19 nt, Homo sapiens
ggccuucgcuggucucuac

SEQ ID NO: 1084457 - RNA, 19 nt, Homo sapiens
ugaggcuacugcccuauau

SEQ ID NO: 1084458 - RNA, 19 nt, Homo sapiens
gcagcgaggucccuaugac

SEQ ID NO: 1084459 - RNA, 19 nt, Homo sapiens
agacugagcccagaguuga

SEQ ID NO: 1084460 - RNA, 19 nt, Homo sapiens
ccacagcaacacccacuga

SEQ ID NO: 1084461 - RNA, 19 nt, Homo sapiens
agcaacagcuccagugugu

SEQ ID NO: 1084462 - RNA, 19 nt, Homo sapiens
ggacgugauggcugcauau

SEQ ID NO: 1084463 - RNA, 19 nt, Homo sapiens
aagacggccugcguagaua

SEQ ID NO: 1084464 - RNA, 19 nt, Homo sapiens
gcgacgccgugcacaacuu

SEQ ID NO: 1084465 - RNA, 19 nt, Homo sapiens
gagacugagcccagaguug

SEQ ID NO: 1084466 - RNA, 19 nt, Homo sapiens
uaagaucccacaccucaca

SEQ ID NO: 1084467 - RNA, 19 nt, Homo sapiens
cagcucagccagucagaga

SEQ ID NO: 1084468 - RNA, 19 nt, Homo sapiens
gccgagcccucaguacuuc

SEQ ID NO: 1084469 - RNA, 19 nt, Homo sapiens
gaaaccagaagccccuaua

SEQ ID NO: 1084470 - RNA, 19 nt, Homo sapiens
caacuccaguaaagacacu

SEQ ID NO: 1084471 - RNA, 19 nt, Homo sapiens
gcuacugcccuauaugauc

SEQ ID NO: 1084472 - RNA, 19 nt, Homo sapiens
gacgcuguccugcaucuga

SEQ ID NO: 1084473 - RNA, 19 nt, Homo sapiens
cucaucagcuccagcaaca

SEQ ID NO: 1084474 - RNA, 19 nt, Homo sapiens
guacuucguggacuuugug

SEQ ID NO: 1084475 - RNA, 19 nt, Homo sapiens
acacucuuguccuuggaaa

SEQ ID NO: 1084476 - RNA, 19 nt, Homo sapiens
ggagacugagcccagaguu

SEQ ID NO: 1084477 - RNA, 19 nt, Homo sapiens
ggacacgguaugccugagu

SEQ ID NO: 1084478 - RNA, 19 nt, Homo sapiens
gcacgcugggagcugagua

SEQ ID NO: 1084479 - RNA, 19 nt, Homo sapiens
agucccaacuccaguaaag

SEQ ID NO: 1084480 - RNA, 19 nt, Homo sapiens
caaaccuacagcccagaaa

SEQ ID NO: 1084481 - RNA, 19 nt, Homo sapiens
ccagucccaacuccaguaa

SEQ ID NO: 1084482 - RNA, 19 nt, Homo sapiens
aggcuacugcccuauauga

SEQ ID NO: 1084483 - RNA, 19 nt, Homo sapiens
cuacgccuucuuccuguuu

SEQ ID NO: 1084484 - RNA, 19 nt, Homo sapiens
cagcagcgaggucccuaug

SEQ ID NO: 1084485 - RNA, 19 nt, Homo sapiens
gaagcaagaucaaagauga

SEQ ID NO: 1084486 - RNA, 19 nt, Homo sapiens
gaaauggaaucacugguaa

SEQ ID NO: 1084487 - RNA, 19 nt, Homo sapiens
ccaauugacuugaauauga

SEQ ID NO: 1084488 - RNA, 19 nt, Homo sapiens
gaauaugacuagccaguuu

SEQ ID NO: 1084489 - RNA, 19 nt, Homo sapiens
gaaaggaacagcugcuaua

SEQ ID NO: 1084490 - RNA, 19 nt, Homo sapiens
gaacaacuuuccaauuuag

SEQ ID NO: 1084491 - RNA, 19 nt, Homo sapiens
caauauacaugccaucauu

SEQ ID NO: 1084492 - RNA, 19 nt, Homo sapiens
gaaguagguugauuaguca

SEQ ID NO: 1084493 - RNA, 19 nt, Homo sapiens
ggaaauccuuugagaacaa

SEQ ID NO: 1084494 - RNA, 19 nt, Homo sapiens
caacuuugauuccugauga

SEQ ID NO: 1084495 - RNA, 19 nt, Homo sapiens
guagauagcuuuuggauga

SEQ ID NO: 1084496 - RNA, 19 nt, Homo sapiens
uaucguaucuucacacuug

SEQ ID NO: 1084497 - RNA, 19 nt, Homo sapiens
ucaaaucucuuggaaacua

SEQ ID NO: 1084498 - RNA, 19 nt, Homo sapiens
gaacagcugcuauacuuga

SEQ ID NO: 1084499 - RNA, 19 nt, Homo sapiens
caccagagcucgguaauug

SEQ ID NO: 1084500 - RNA, 19 nt, Homo sapiens
ugaauuggcuggcauggaa

SEQ ID NO: 1084501 - RNA, 19 nt, Homo sapiens
caguacacauuucaacuua

SEQ ID NO: 1084502 - RNA, 19 nt, Homo sapiens
gcauuuggauuguaauuca

SEQ ID NO: 1084503 - RNA, 19 nt, Homo sapiens
guagguugauuagucauua

SEQ ID NO: 1084504 - RNA, 19 nt, Homo sapiens
gagaccgaauuccuacuua

SEQ ID NO: 1084505 - RNA, 19 nt, Homo sapiens
gagaacaauucgaagagaa

SEQ ID NO: 1084506 - RNA, 19 nt, Homo sapiens
gacucaaucuuucuaguaa

SEQ ID NO: 1084507 - RNA, 19 nt, Homo sapiens
gaccuaagcaacaaugaua

SEQ ID NO: 1084508 - RNA, 19 nt, Homo sapiens
gagaauaaauguggauauc

SEQ ID NO: 1084509 - RNA, 19 nt, Homo sapiens
gagcagccauauuaaugaa

SEQ ID NO: 1084510 - RNA, 19 nt, Homo sapiens
gaacugaaggaaaugguuu

SEQ ID NO: 1084511 - RNA, 19 nt, Homo sapiens
ugaauuaaccugcauauca

SEQ ID NO: 1084512 - RNA, 19 nt, Homo sapiens
gcacugacuguucuugaua

SEQ ID NO: 1084513 - RNA, 19 nt, Homo sapiens
aaagggaauuugauaggua

SEQ ID NO: 1084514 - RNA, 19 nt, Homo sapiens
gauuuauccugcuaacuuu

SEQ ID NO: 1084515 - RNA, 19 nt, Homo sapiens
uaacccuugucauguauua

SEQ ID NO: 1084516 - RNA, 19 nt, Homo sapiens
acauggaguugcuuuauaa

SEQ ID NO: 1084517 - RNA, 19 nt, Homo sapiens
gaaguucuauaucguaucu

SEQ ID NO: 1084518 - RNA, 19 nt, Homo sapiens
gaauuaaccugcauaucag

SEQ ID NO: 1084519 - RNA, 19 nt, Homo sapiens
agacuaaacuugcaguguu

SEQ ID NO: 1084520 - RNA, 19 nt, Homo sapiens
ugaagcauuuggauuguaa

SEQ ID NO: 1084521 - RNA, 19 nt, Homo sapiens
ugaggaagcuaaucagaau

SEQ ID NO: 1084522 - RNA, 19 nt, Homo sapiens
cagaacaucuuaaacaucu

SEQ ID NO: 1084523 - RNA, 19 nt, Homo sapiens
gaaacuauaccuccugaau

SEQ ID NO: 1084524 - RNA, 19 nt, Homo sapiens
cagugugucuggagaauaa

SEQ ID NO: 1084525 - RNA, 19 nt, Homo sapiens
agaaguagguugauuaguc

SEQ ID NO: 1084526 - RNA, 19 nt, Homo sapiens
uaugugugcuucagaaauu

SEQ ID NO: 1084527 - RNA, 19 nt, Homo sapiens
gaggaagagcggccaguua

SEQ ID NO: 1084528 - RNA, 19 nt, Homo sapiens
guaagaaucaacuauguga

SEQ ID NO: 1084529 - RNA, 19 nt, Homo sapiens
acaaucaucuuacaacugu

SEQ ID NO: 1084530 - RNA, 19 nt, Homo sapiens
gccuguaucuccagcauaa

SEQ ID NO: 1084531 - RNA, 19 nt, Homo sapiens
guagaaaccucagugaagu

SEQ ID NO: 1084532 - RNA, 19 nt, Homo sapiens
cagcugcuauacuugaaua

SEQ ID NO: 1084533 - RNA, 19 nt, Homo sapiens
uuauaacccuugucaugua

SEQ ID NO: 1084534 - RNA, 19 nt, Homo sapiens
gauaaacaagcaacuuuga

SEQ ID NO: 1084535 - RNA, 19 nt, Homo sapiens
gaacaucuuaaacaucuga

SEQ ID NO: 1084536 - RNA, 19 nt, Homo sapiens
ggugggagcagacagauuu

SEQ ID NO: 1084537 - RNA, 19 nt, Homo sapiens
gaggcaugcuuauauuaug

SEQ ID NO: 1084538 - RNA, 19 nt, Homo sapiens
gcuaaucucaguacacauu

SEQ ID NO: 1084539 - RNA, 19 nt, Homo sapiens
cacaagaaguccuaaaaua

SEQ ID NO: 1084540 - RNA, 19 nt, Homo sapiens
aggaacagcugcuauacuu

SEQ ID NO: 1084541 - RNA, 19 nt, Homo sapiens
gaacaugucgcgccugaag

SEQ ID NO: 1084542 - RNA, 19 nt, Homo sapiens
gcaacaucgucacuucuau

SEQ ID NO: 1084543 - RNA, 19 nt, Homo sapiens
ccaagugaauccagaguca

SEQ ID NO: 1084544 - RNA, 19 nt, Homo sapiens
gaacacaagaaguccuaaa

SEQ ID NO: 1084545 - RNA, 19 nt, Homo sapiens
cuacuacgguccuuggaaa

SEQ ID NO: 1084546 - RNA, 19 nt, Homo sapiens
aauacucccugaagaaauu

SEQ ID NO: 1084547 - RNA, 19 nt, Homo sapiens
gaagcuaaucagaaucuuu

SEQ ID NO: 1084548 - RNA, 19 nt, Homo sapiens
acaauaaacuucagucacu

SEQ ID NO: 1084549 - RNA, 19 nt, Homo sapiens
uuaguagucuucccuauuc

SEQ ID NO: 1084550 - RNA, 19 nt, Homo sapiens
aacuauaccuccugaauug

SEQ ID NO: 1084551 - RNA, 19 nt, Homo sapiens
gaugauugaggcaugcuua

SEQ ID NO: 1084552 - RNA, 19 nt, Homo sapiens
gaugauggaccuagccaaa

SEQ ID NO: 1084553 - RNA, 19 nt, Homo sapiens
gaguuugccagcagaaaua

SEQ ID NO: 1084554 - RNA, 19 nt, Homo sapiens
gaaaauacucccugaagaa

SEQ ID NO: 1084555 - RNA, 19 nt, Homo sapiens
ucaauucaguagcauguau

SEQ ID NO: 1084556 - RNA, 19 nt, Homo sapiens
cagaagaaauggaaucacu

SEQ ID NO: 1084557 - RNA, 19 nt, Homo sapiens
gaaauccuuugagaacaau

SEQ ID NO: 1084558 - RNA, 19 nt, Homo sapiens
gaauuuccuucuuguaguc

SEQ ID NO: 1084559 - RNA, 19 nt, Homo sapiens
ggaggaauaaauuacguuu

SEQ ID NO: 1084560 - RNA, 19 nt, Homo sapiens
cgacucaaucuuucuagua

SEQ ID NO: 1084561 - RNA, 19 nt, Homo sapiens
gauugaggcaugcuuauau

SEQ ID NO: 1084562 - RNA, 19 nt, Homo sapiens
cauggaaucacuagaauug

SEQ ID NO: 1084563 - RNA, 19 nt, Homo sapiens
cuuaaugucagccauaaua

SEQ ID NO: 1084564 - RNA, 19 nt, Homo sapiens
uaagagagcuagaaaaucu

SEQ ID NO: 1084565 - RNA, 19 nt, Homo sapiens
gcagccauauuaaugaaag

SEQ ID NO: 1084566 - RNA, 19 nt, Homo sapiens
cgguaauuguguaaacuua

SEQ ID NO: 1084567 - RNA, 19 nt, Homo sapiens
aaugaccucuuacaaauuc

SEQ ID NO: 1084568 - RNA, 19 nt, Homo sapiens
agaaauggaaucacuggua

SEQ ID NO: 1084569 - RNA, 19 nt, Homo sapiens
ggaccuagccaaagugagu

SEQ ID NO: 1084570 - RNA, 19 nt, Homo sapiens
uaaaggaacacaagaaguc

SEQ ID NO: 1084571 - RNA, 19 nt, Homo sapiens
gcaacaaugauauuaguag

SEQ ID NO: 1084572 - RNA, 19 nt, Homo sapiens
ugaaaagguugaagcauuu

SEQ ID NO: 1084573 - RNA, 19 nt, Homo sapiens
gcuagaaaaucuucagaaa

SEQ ID NO: 1084574 - RNA, 19 nt, Homo sapiens
aacauggaguugcuuuaua

SEQ ID NO: 1084575 - RNA, 19 nt, Homo sapiens
caguaagaaucaacuaugu

SEQ ID NO: 1084576 - RNA, 19 nt, Homo sapiens
caacaucgucacuucuauu

SEQ ID NO: 1084577 - RNA, 19 nt, Homo sapiens
ggcagaacaucuuaaacau

SEQ ID NO: 1084578 - RNA, 19 nt, Homo sapiens
gcuauaagagagcuagaaa

SEQ ID NO: 1084579 - RNA, 19 nt, Homo sapiens
ugacuguucuugauauaca

SEQ ID NO: 1084580 - RNA, 19 nt, Homo sapiens
agaccgaauuccuacuuaa

SEQ ID NO: 1084581 - RNA, 19 nt, Homo sapiens
ggaagagcggccaguuaaa

SEQ ID NO: 1084582 - RNA, 19 nt, Homo sapiens
gugauaaacaagcaacuuu

SEQ ID NO: 1084583 - RNA, 19 nt, Homo sapiens
gguugaagcauuuggauug

SEQ ID NO: 1084584 - RNA, 19 nt, Homo sapiens
ugauaggacuuuugugaua

SEQ ID NO: 1084585 - RNA, 19 nt, Homo sapiens
ucaaagaacuugucucuaa

SEQ ID NO: 1084586 - RNA, 19 nt, Homo sapiens
gaguuaggauuccaaauua

SEQ ID NO: 1084587 - RNA, 19 nt, Homo sapiens
gaaauggaaucucacugua

SEQ ID NO: 1084588 - RNA, 19 nt, Homo sapiens
gaacuugucucuaaauucu

SEQ ID NO: 1084589 - RNA, 19 nt, Homo sapiens
caugaugacuguccuaaua

SEQ ID NO: 1084590 - RNA, 19 nt, Homo sapiens
ggaauauuauagccacuua

SEQ ID NO: 1084591 - RNA, 19 nt, Homo sapiens
gauuacagauuguuuguug

SEQ ID NO: 1084592 - RNA, 19 nt, Homo sapiens
gauagcaaaugggaaauaa

SEQ ID NO: 1084593 - RNA, 19 nt, Homo sapiens
gccaauaucuggaauagug

SEQ ID NO: 1084594 - RNA, 19 nt, Homo sapiens
gaagagucaucaccuaaau

SEQ ID NO: 1084595 - RNA, 19 nt, Homo sapiens
agaaagagauguugagaau

SEQ ID NO: 1084596 - RNA, 19 nt, Homo sapiens
ccaucgaccuguucaaaua

SEQ ID NO: 1084597 - RNA, 19 nt, Homo sapiens
gcaauucccaucaccaaua

SEQ ID NO: 1084598 - RNA, 19 nt, Homo sapiens
caaagaacuugucucuaaa

SEQ ID NO: 1084599 - RNA, 19 nt, Homo sapiens
gaugguaaaucuacaacaa

SEQ ID NO: 1084600 - RNA, 19 nt, Homo sapiens
guacacacauuaccugaug

SEQ ID NO: 1084601 - RNA, 19 nt, Homo sapiens
gaaguagcauauguuauug

SEQ ID NO: 1084602 - RNA, 19 nt, Homo sapiens
gaagaaauguaucaacacu

SEQ ID NO: 1084603 - RNA, 19 nt, Homo sapiens
gcagagaggcaaagaagaa

SEQ ID NO: 1084604 - RNA, 19 nt, Homo sapiens
caaacuaguuagcuucuug

SEQ ID NO: 1084605 - RNA, 19 nt, Homo sapiens
gaagaaggaguuuaugguu

SEQ ID NO: 1084606 - RNA, 19 nt, Homo sapiens
aagaaacacucuaagacua

SEQ ID NO: 1084607 - RNA, 19 nt, Homo sapiens
aaagagauguugagaaugg

SEQ ID NO: 1084608 - RNA, 19 nt, Homo sapiens
gaaauaaagcgcugucagu

SEQ ID NO: 1084609 - RNA, 19 nt, Homo sapiens
ggaaacgaguguaauaacu

SEQ ID NO: 1084610 - RNA, 19 nt, Homo sapiens
auacuuggcuaccauguaa

SEQ ID NO: 1084611 - RNA, 19 nt, Homo sapiens
ggaaaacgcuuaucaagag

SEQ ID NO: 1084612 - RNA, 19 nt, Homo sapiens
guacauuacuacuguuugu

SEQ ID NO: 1084613 - RNA, 19 nt, Homo sapiens
caacaacaauggaagacau

SEQ ID NO: 1084614 - RNA, 19 nt, Homo sapiens
caaagaagaagaaggaguu

SEQ ID NO: 1084615 - RNA, 19 nt, Homo sapiens
uaaacccacuccuucaauu

SEQ ID NO: 1084616 - RNA, 19 nt, Homo sapiens
ggaaucucacuguacauua

SEQ ID NO: 1084617 - RNA, 19 nt, Homo sapiens
gcccagcucuccuuguaaa

SEQ ID NO: 1084618 - RNA, 19 nt, Homo sapiens
caaagaagggcgagacuau

SEQ ID NO: 1084619 - RNA, 19 nt, Homo sapiens
gaagaugucguugcaaaga

SEQ ID NO: 1084620 - RNA, 19 nt, Homo sapiens
caacaacuguagcugacuu

SEQ ID NO: 1084621 - RNA, 19 nt, Homo sapiens
gauaaauacugcaacaacu

SEQ ID NO: 1084622 - RNA, 19 nt, Homo sapiens
caauugaaguagcauaugu

SEQ ID NO: 1084623 - RNA, 19 nt, Homo sapiens
gaacucaucauuguuugaa

SEQ ID NO: 1084624 - RNA, 19 nt, Homo sapiens
agagucaucaccuaaauua

SEQ ID NO: 1084625 - RNA, 19 nt, Homo sapiens
ggaagagucaucaccuaaa

SEQ ID NO: 1084626 - RNA, 19 nt, Homo sapiens
uaaugcaccugauagcaaa

SEQ ID NO: 1084627 - RNA, 19 nt, Homo sapiens
cgaaguccuuguuguaaga

SEQ ID NO: 1084628 - RNA, 19 nt, Homo sapiens
aagaaggaguuuaugguuu

SEQ ID NO: 1084629 - RNA, 19 nt, Homo sapiens
gaaucucacuguacauuac

SEQ ID NO: 1084630 - RNA, 19 nt, Homo sapiens
gcagcaaauuuagaagaaa

SEQ ID NO: 1084631 - RNA, 19 nt, Homo sapiens
ggcagcaaauuuagaagaa

SEQ ID NO: 1084632 - RNA, 19 nt, Homo sapiens
auaaagcgcugucaguguu

SEQ ID NO: 1084633 - RNA, 19 nt, Homo sapiens
gcaauaauagugacaucuu

SEQ ID NO: 1084634 - RNA, 19 nt, Homo sapiens
gagccuauuccaaguuaua

SEQ ID NO: 1084635 - RNA, 19 nt, Homo sapiens
uaaauuacccagacaguca

SEQ ID NO: 1084636 - RNA, 19 nt, Homo sapiens
gagaacucaucauuguuug

SEQ ID NO: 1084637 - RNA, 19 nt, Homo sapiens
uaucuggaauagugccuua

SEQ ID NO: 1084638 - RNA, 19 nt, Homo sapiens
ucgaagaugucguugcaaa

SEQ ID NO: 1084639 - RNA, 19 nt, Homo sapiens
ugaacaaacuaguuagcuu

SEQ ID NO: 1084640 - RNA, 19 nt, Homo sapiens
cgaguguaauaacuguuua

SEQ ID NO: 1084641 - RNA, 19 nt, Homo sapiens
uaccugaugugaaagcuuu

SEQ ID NO: 1084642 - RNA, 19 nt, Homo sapiens
gaggcaaggcagcaaauuu

SEQ ID NO: 1084643 - RNA, 19 nt, Homo sapiens
aaacuaaggagaaauggaa

SEQ ID NO: 1084644 - RNA, 19 nt, Homo sapiens
uaugguagcaugguuaaua

SEQ ID NO: 1084645 - RNA, 19 nt, Homo sapiens
caaaaugguuguauggauu

SEQ ID NO: 1084646 - RNA, 19 nt, Homo sapiens
cauaagaaacacucuaaga

SEQ ID NO: 1084647 - RNA, 19 nt, Homo sapiens
gaaacgaguguaauaacug

SEQ ID NO: 1084648 - RNA, 19 nt, Homo sapiens
uagaugauguuucagacuu

SEQ ID NO: 1084649 - RNA, 19 nt, Homo sapiens
caaggcagcaaauuuagaa

SEQ ID NO: 1084650 - RNA, 19 nt, Homo sapiens
aggcaaggcagcaaauuua

SEQ ID NO: 1084651 - RNA, 19 nt, Homo sapiens
uaagaacgcuugguuucau

SEQ ID NO: 1084652 - RNA, 19 nt, Homo sapiens
gguguacaauaugcaauaa

SEQ ID NO: 1084653 - RNA, 19 nt, Homo sapiens
cauguggacuucagagaga

SEQ ID NO: 1084654 - RNA, 19 nt, Homo sapiens
uagaagauaucaggaagga

SEQ ID NO: 1084655 - RNA, 19 nt, Homo sapiens
gagaaucuuuacuaugaag

SEQ ID NO: 1084656 - RNA, 19 nt, Homo sapiens
gaauuucugagucucuuaa

SEQ ID NO: 1084657 - RNA, 19 nt, Homo sapiens
gguauuaucuacaauucag

SEQ ID NO: 1084658 - RNA, 19 nt, Homo sapiens
gaagggcgagacuauaaug

SEQ ID NO: 1084659 - RNA, 19 nt, Homo sapiens
gaaccuugcuuguguuuuc

SEQ ID NO: 1084660 - RNA, 19 nt, Homo sapiens
gcaaagaagggcgagacua

SEQ ID NO: 1084661 - RNA, 19 nt, Homo sapiens
uaacugccuuguuuaugga

SEQ ID NO: 1084662 - RNA, 19 nt, Homo sapiens
ccuaauaaauacggagaaa

SEQ ID NO: 1084663 - RNA, 19 nt, Homo sapiens
gagaauguauuuuccaguu

SEQ ID NO: 1084664 - RNA, 19 nt, Homo sapiens
aaacgaguguaauaacugu

SEQ ID NO: 1084665 - RNA, 19 nt, Homo sapiens
guuggaaacgaguguaaua

SEQ ID NO: 1084666 - RNA, 19 nt, Homo sapiens
agaguuaggauuccaaauu

SEQ ID NO: 1084667 - RNA, 19 nt, Homo sapiens
aagaagggcgagacuauaa

SEQ ID NO: 1084668 - RNA, 19 nt, Homo sapiens
cgaccuguucaaauaauua

SEQ ID NO: 1084669 - RNA, 19 nt, Homo sapiens
cucauuacauuggacauua

SEQ ID NO: 1084670 - RNA, 19 nt, Homo sapiens
uuagaugcauucagaaauc

SEQ ID NO: 1084671 - RNA, 19 nt, Homo sapiens
gaauagugccuuagaugca

SEQ ID NO: 1084672 - RNA, 19 nt, Homo sapiens
gcacugaggcucuggaacu

SEQ ID NO: 1084673 - RNA, 19 nt, Homo sapiens
guucgaagaugucguugca

SEQ ID NO: 1084674 - RNA, 19 nt, Homo sapiens
aaguaaaccuggugacuca

SEQ ID NO: 1084675 - RNA, 19 nt, Homo sapiens
ugaugacuguccuaauaaa

SEQ ID NO: 1084676 - RNA, 19 nt, Homo sapiens
gaugucaaguggaauuugg

SEQ ID NO: 1084677 - RNA, 19 nt, Homo sapiens
gaaaguucucauuacauug

SEQ ID NO: 1084678 - RNA, 19 nt, Homo sapiens
caacuguagcugacuuaaa

SEQ ID NO: 1084679 - RNA, 19 nt, Homo sapiens
uuguuuaacugccuuguuu

SEQ ID NO: 1084680 - RNA, 19 nt, Homo sapiens
gcaaggcagcaaauuuaga

SEQ ID NO: 1084681 - RNA, 19 nt, Homo sapiens
aagaacgcuugguuucaua

SEQ ID NO: 1084682 - RNA, 19 nt, Homo sapiens
uuacgaaguccuuguugua

SEQ ID NO: 1084683 - RNA, 19 nt, Homo sapiens
cuucagagagaauguauuu

SEQ ID NO: 1084684 - RNA, 19 nt, Homo sapiens
agaagaagaaggaguuuau

SEQ ID NO: 1084685 - RNA, 19 nt, Homo sapiens
ggguaaagauguacaaaua

SEQ ID NO: 1084686 - RNA, 19 nt, Homo sapiens
ccacacagcucaugagaug

SEQ ID NO: 1084687 - RNA, 19 nt, Homo sapiens
caaccggacuaauuaaaga

SEQ ID NO: 1084688 - RNA, 19 nt, Homo sapiens
guauauggguaaagaugua

SEQ ID NO: 1084689 - RNA, 19 nt, Homo sapiens
gcagguacauaaucacuuc

SEQ ID NO: 1084690 - RNA, 19 nt, Homo sapiens
uaugggaaauuguggauaa

SEQ ID NO: 1084691 - RNA, 19 nt, Homo sapiens
ggagguacgagguagaaua

SEQ ID NO: 1084692 - RNA, 19 nt, Homo sapiens
ucacaugucugaauuucug

SEQ ID NO: 1084693 - RNA, 19 nt, Homo sapiens
gaaggguucucccacuuuc

SEQ ID NO: 1084694 - RNA, 19 nt, Homo sapiens
caggauaacuacaccuuug

SEQ ID NO: 1084695 - RNA, 19 nt, Homo sapiens
gaaauuguggauaaaguga

SEQ ID NO: 1084696 - RNA, 19 nt, Homo sapiens
gaaccuaccuacaauacac

SEQ ID NO: 1084697 - RNA, 19 nt, Homo sapiens
aaaagaaacuggacaaaga

SEQ ID NO: 1084698 - RNA, 19 nt, Homo sapiens
cuacagaaccuaccuacaa

SEQ ID NO: 1084699 - RNA, 19 nt, Homo sapiens
gcaagcugcuggauggaau

SEQ ID NO: 1084700 - RNA, 19 nt, Homo sapiens
ccuggucacuccauucuuu

SEQ ID NO: 1084701 - RNA, 19 nt, Homo sapiens
cagaggaaguugccaggaa

SEQ ID NO: 1084702 - RNA, 19 nt, Homo sapiens
ccagugaccaaguguauaa

SEQ ID NO: 1084703 - RNA, 19 nt, Homo sapiens
uagaauaccugcaguuugc

SEQ ID NO: 1084704 - RNA, 19 nt, Homo sapiens
gcuuguaacucuggaaaga

SEQ ID NO: 1084705 - RNA, 19 nt, Homo sapiens
ggacaggccccaacugaua

SEQ ID NO: 1084706 - RNA, 19 nt, Homo sapiens
gggaaauuguggauaaagu

SEQ ID NO: 1084707 - RNA, 19 nt, Homo sapiens
ucaguggucuccuucauag

SEQ ID NO: 1084708 - RNA, 19 nt, Homo sapiens
guaacacccucaagucucu

SEQ ID NO: 1084709 - RNA, 19 nt, Homo sapiens
ggcaagcccucucuaugug

SEQ ID NO: 1084710 - RNA, 19 nt, Homo sapiens
gaugacccacuccaagaua

SEQ ID NO: 1084711 - RNA, 19 nt, Homo sapiens
gcccaggucuuaacuuucu

SEQ ID NO: 1084712 - RNA, 19 nt, Homo sapiens
uaacuacaccuuugcacaa

SEQ ID NO: 1084713 - RNA, 19 nt, Homo sapiens
ggucucaccucacauuguc

SEQ ID NO: 1084714 - RNA, 19 nt, Homo sapiens
ccgcccaggucuuaacuuu

SEQ ID NO: 1084715 - RNA, 19 nt, Homo sapiens
ggaaauuguggauaaagug

SEQ ID NO: 1084716 - RNA, 19 nt, Homo sapiens
gaaccacuccuguuguaca

SEQ ID NO: 1084717 - RNA, 19 nt, Homo sapiens
gaucuuggaugaggaggau

SEQ ID NO: 1084718 - RNA, 19 nt, Homo sapiens
ggaagaggauguggagaac

SEQ ID NO: 1084719 - RNA, 19 nt, Homo sapiens
ggaggcugcugaagugagu

SEQ ID NO: 1084720 - RNA, 19 nt, Homo sapiens
uuagucacaugucugaauu

SEQ ID NO: 1084721 - RNA, 19 nt, Homo sapiens
aagaggauguggagaacuu

SEQ ID NO: 1084722 - RNA, 19 nt, Homo sapiens
gagcuugucagccggauug

SEQ ID NO: 1084723 - RNA, 19 nt, Homo sapiens
caucugcccuuugcuccua

SEQ ID NO: 1084724 - RNA, 19 nt, Homo sapiens
guauaagcaucccuugaag

SEQ ID NO: 1084725 - RNA, 19 nt, Homo sapiens
guagaauaccugcaguuug

SEQ ID NO: 1084726 - RNA, 19 nt, Homo sapiens
gagagcagcacuccauauc

SEQ ID NO: 1084727 - RNA, 19 nt, Homo sapiens
gacccacuccaagauauua

SEQ ID NO: 1084728 - RNA, 19 nt, Homo sapiens
agacugccuucaucucuga

SEQ ID NO: 1084729 - RNA, 19 nt, Homo sapiens
cauacagacucaaguacau

SEQ ID NO: 1084730 - RNA, 19 nt, Homo sapiens
uacagaaccuaccuacaau

SEQ ID NO: 1084731 - RNA, 19 nt, Homo sapiens
uugaugagcagguacauaa

SEQ ID NO: 1084732 - RNA, 19 nt, Homo sapiens
gaaggugaaggcacuggaa

SEQ ID NO: 1084733 - RNA, 19 nt, Homo sapiens
cagugucccugguggguaa

SEQ ID NO: 1084734 - RNA, 19 nt, Homo sapiens
ggguauguccagggaauua

SEQ ID NO: 1084735 - RNA, 19 nt, Homo sapiens
aaagaaacuggacaaagaa

SEQ ID NO: 1084736 - RNA, 19 nt, Homo sapiens
aaccaggaauccagaagaa

SEQ ID NO: 1084737 - RNA, 19 nt, Homo sapiens
caagcccucucuauguguu

SEQ ID NO: 1084738 - RNA, 19 nt, Homo sapiens
aaagcaaucuaggucacua

SEQ ID NO: 1084739 - RNA, 19 nt, Homo sapiens
caaguucagcauuguauuc

SEQ ID NO: 1084740 - RNA, 19 nt, Homo sapiens
uguauaagcaucccuugaa

SEQ ID NO: 1084741 - RNA, 19 nt, Homo sapiens
gacccagacugccuucauc

SEQ ID NO: 1084742 - RNA, 19 nt, Homo sapiens
agacucaaguacauguuug

SEQ ID NO: 1084743 - RNA, 19 nt, Homo sapiens
gcauacagacucaaguaca

SEQ ID NO: 1084744 - RNA, 19 nt, Homo sapiens
ggagccaucccaagcauca

SEQ ID NO: 1084745 - RNA, 19 nt, Homo sapiens
gugaacauaguuugauuug

SEQ ID NO: 1084746 - RNA, 19 nt, Homo sapiens
ccacuccuguuguacaaag

SEQ ID NO: 1084747 - RNA, 19 nt, Homo sapiens
cgaagaaauugggcugcuu

SEQ ID NO: 1084748 - RNA, 19 nt, Homo sapiens
gaugagcagguacauaauc

SEQ ID NO: 1084749 - RNA, 19 nt, Homo sapiens
caaccaggaauccagaaga

SEQ ID NO: 1084750 - RNA, 19 nt, Homo sapiens
cggacuaauuaaagaaaga

SEQ ID NO: 1084751 - RNA, 19 nt, Homo sapiens
uggaugaacaaccugcuua

SEQ ID NO: 1084752 - RNA, 19 nt, Homo sapiens
gcaucaacaugugaaagca

SEQ ID NO: 1084753 - RNA, 19 nt, Homo sapiens
gcacugaugcuuguaacuc

SEQ ID NO: 1084754 - RNA, 19 nt, Homo sapiens
gugcagccuucuugaucaa

SEQ ID NO: 1084755 - RNA, 19 nt, Homo sapiens
ggaugaacaaccugcuuau

SEQ ID NO: 1084756 - RNA, 19 nt, Homo sapiens
caagucucuuugccaguga

SEQ ID NO: 1084757 - RNA, 19 nt, Homo sapiens
cagcacuccauaucccuua

SEQ ID NO: 1084758 - RNA, 19 nt, Homo sapiens
ggaaaggggcuucuugugu

SEQ ID NO: 1084759 - RNA, 19 nt, Homo sapiens
gaguuagguuucucaucug

SEQ ID NO: 1084760 - RNA, 19 nt, Homo sapiens
guggguauguccagggaau

SEQ ID NO: 1084761 - RNA, 19 nt, Homo sapiens
ucagagagcagcacuccau

SEQ ID NO: 1084762 - RNA, 19 nt, Homo sapiens
uggaagaggauguggagaa

SEQ ID NO: 1084763 - RNA, 19 nt, Homo sapiens
gagguacgagguagaauac

SEQ ID NO: 1084764 - RNA, 19 nt, Homo sapiens
agacuuuccuggagcaucu

SEQ ID NO: 1084765 - RNA, 19 nt, Homo sapiens
acuccaagauauuaugugu

SEQ ID NO: 1084766 - RNA, 19 nt, Homo sapiens
gaugaacaaccugcuuaug

SEQ ID NO: 1084767 - RNA, 19 nt, Homo sapiens
gcacuggaagagcuuguca

SEQ ID NO: 1084768 - RNA, 19 nt, Homo sapiens
gaauccagaagaaggugaa

SEQ ID NO: 1084769 - RNA, 19 nt, Homo sapiens
gaggcacugaugcuuguaa

SEQ ID NO: 1084770 - RNA, 19 nt, Homo sapiens
gauggaggaggcacugaug

SEQ ID NO: 1084771 - RNA, 19 nt, Homo sapiens
acagaaccuaccuacaaua

SEQ ID NO: 1084772 - RNA, 19 nt, Homo sapiens
ccggauugaugagcaggua

SEQ ID NO: 1084773 - RNA, 19 nt, Homo sapiens
gaagacucagugccaagga

SEQ ID NO: 1084774 - RNA, 19 nt, Homo sapiens
gugugggugugaaugugua

SEQ ID NO: 1084775 - RNA, 19 nt, Homo sapiens
ggaggaggcacugaugcuu

SEQ ID NO: 1084776 - RNA, 19 nt, Homo sapiens
cagacucaaguacauguuu

SEQ ID NO: 1084777 - RNA, 19 nt, Homo sapiens
uuucucaucuggagcuguu

SEQ ID NO: 1084778 - RNA, 19 nt, Homo sapiens
cagagagcagcacuccaua

SEQ ID NO: 1084779 - RNA, 19 nt, Homo sapiens
gcaagcccucucuaugugu

SEQ ID NO: 1084780 - RNA, 19 nt, Homo sapiens
gugaccaaguguauaagca

SEQ ID NO: 1084781 - RNA, 19 nt, Homo sapiens
gauaaccguugcuuuucuu

SEQ ID NO: 1084782 - RNA, 19 nt, Homo sapiens
ggacccagacugccuucau

SEQ ID NO: 1084783 - RNA, 19 nt, Homo sapiens
ccaggauaacuacaccuuu

SEQ ID NO: 1084784 - RNA, 19 nt, Homo sapiens
caucuggagcuguuucuca

SEQ ID NO: 1084785 - RNA, 19 nt, Homo sapiens
ggagaaaccuuaugaaugu

SEQ ID NO: 1084786 - RNA, 19 nt, Homo sapiens
gaagucaacucucauuaaa

SEQ ID NO: 1084787 - RNA, 19 nt, Homo sapiens
ggcaaagacucccuaaaua

SEQ ID NO: 1084788 - RNA, 19 nt, Homo sapiens
gaaagaugauggauguaaa

SEQ ID NO: 1084789 - RNA, 19 nt, Homo sapiens
gaagucaacucugauuaaa

SEQ ID NO: 1084790 - RNA, 19 nt, Homo sapiens
gggagaaacucuacaaaug

SEQ ID NO: 1084791 - RNA, 19 nt, Homo sapiens
gcagauagaucacuacaag

SEQ ID NO: 1084792 - RNA, 19 nt, Homo sapiens
gagaaagccuucaguagga

SEQ ID NO: 1084793 - RNA, 19 nt, Homo sapiens
gaaaguaugcuuccauuau

SEQ ID NO: 1084794 - RNA, 19 nt, Homo sapiens
guuauaaagugcuuccuua

SEQ ID NO: 1084795 - RNA, 19 nt, Homo sapiens
gcaaucagguucgguacua

SEQ ID NO: 1084796 - RNA, 19 nt, Homo sapiens
ggagagagacccuauaaau

SEQ ID NO: 1084797 - RNA, 19 nt, Homo sapiens
aaagaaagaugauggaugu

SEQ ID NO: 1084798 - RNA, 19 nt, Homo sapiens
gcaaagacucccuaaauau

SEQ ID NO: 1084799 - RNA, 19 nt, Homo sapiens
gcaaguugaugagcagaua

SEQ ID NO: 1084800 - RNA, 19 nt, Homo sapiens
guagugauguuggcaauuu

SEQ ID NO: 1084801 - RNA, 19 nt, Homo sapiens
ggaagucaacucucauuaa

SEQ ID NO: 1084802 - RNA, 19 nt, Homo sapiens
cauuaaagcuacccuuauu

SEQ ID NO: 1084803 - RNA, 19 nt, Homo sapiens
caaagacucccuaaauauu

SEQ ID NO: 1084804 - RNA, 19 nt, Homo sapiens
gagagaaaccuuaugaaug

SEQ ID NO: 1084805 - RNA, 19 nt, Homo sapiens
caaagcuacucaaaucauu

SEQ ID NO: 1084806 - RNA, 19 nt, Homo sapiens
cuagggaucuuggaacaua

SEQ ID NO: 1084807 - RNA, 19 nt, Homo sapiens
gcaaaucagugaaucuuuu

SEQ ID NO: 1084808 - RNA, 19 nt, Homo sapiens
ggagagaaaccuuaugaau

SEQ ID NO: 1084809 - RNA, 19 nt, Homo sapiens
ggaaagcccuccaccaaaa

SEQ ID NO: 1084810 - RNA, 19 nt, Homo sapiens
aagcuacccuuauuguaua

SEQ ID NO: 1084811 - RNA, 19 nt, Homo sapiens
gaagcuauguaagaaagaa

SEQ ID NO: 1084812 - RNA, 19 nt, Homo sapiens
gaugaaagcggucaagaau

SEQ ID NO: 1084813 - RNA, 19 nt, Homo sapiens
gagagagacccuauaaaug

SEQ ID NO: 1084814 - RNA, 19 nt, Homo sapiens
ggagaaacucuacaaaugu

SEQ ID NO: 1084815 - RNA, 19 nt, Homo sapiens
gggagaagcccuaugaaug

SEQ ID NO: 1084816 - RNA, 19 nt, Homo sapiens
agagaaaccuuaugaaugc

SEQ ID NO: 1084817 - RNA, 19 nt, Homo sapiens
gaugauggauguaaagcau

SEQ ID NO: 1084818 - RNA, 19 nt, Homo sapiens
gcacccggcuugaaucauc

SEQ ID NO: 1084819 - RNA, 19 nt, Homo sapiens
gggagaaaccuuaugaaug

SEQ ID NO: 1084820 - RNA, 19 nt, Homo sapiens
caaggaaagccaagacaaa

SEQ ID NO: 1084821 - RNA, 19 nt, Homo sapiens
cacagaacauaaaugcaua

SEQ ID NO: 1084822 - RNA, 19 nt, Homo sapiens
gagaaaccuuaugaaugua

SEQ ID NO: 1084823 - RNA, 19 nt, Homo sapiens
gaagucaacccucauagca

SEQ ID NO: 1084824 - RNA, 19 nt, Homo sapiens
gaaaaguguuuauccagaa

SEQ ID NO: 1084825 - RNA, 19 nt, Homo sapiens
gaaaaggcauucaaaacau

SEQ ID NO: 1084826 - RNA, 19 nt, Homo sapiens
aggaaacacugaaggauga

SEQ ID NO: 1084827 - RNA, 19 nt, Homo sapiens
cuacagggaugucaugcuu

SEQ ID NO: 1084828 - RNA, 19 nt, Homo sapiens
guaagucuaacacacauuu

SEQ ID NO: 1084829 - RNA, 19 nt, Homo sapiens
aaucaacucucauuguaug

SEQ ID NO: 1084830 - RNA, 19 nt, Homo sapiens
uaaagugcuuccuuaaagu

SEQ ID NO: 1084831 - RNA, 19 nt, Homo sapiens
auaaagugcuuccuuaaag

SEQ ID NO: 1084832 - RNA, 19 nt, Homo sapiens
ggucaagaauccagaacau

SEQ ID NO: 1084833 - RNA, 19 nt, Homo sapiens
gcaaggaaacacugaagga

SEQ ID NO: 1084834 - RNA, 19 nt, Homo sapiens
ggaaagccaagacaaacuu

SEQ ID NO: 1084835 - RNA, 19 nt, Homo sapiens
cuugucauauugugcauua

SEQ ID NO: 1084836 - RNA, 19 nt, Homo sapiens
uuggcaagcugcauucaua

SEQ ID NO: 1084837 - RNA, 19 nt, Homo sapiens
ucccuuagcugucucaguu

SEQ ID NO: 1084838 - RNA, 19 nt, Homo sapiens
agucaacucucauuaaaca

SEQ ID NO: 1084839 - RNA, 19 nt, Homo sapiens
agucaacucugauuaaaca

SEQ ID NO: 1084840 - RNA, 19 nt, Homo sapiens
caagaauccagaacaugua

SEQ ID NO: 1084841 - RNA, 19 nt, Homo sapiens
ggaugaaagcggucaagaa

SEQ ID NO: 1084842 - RNA, 19 nt, Homo sapiens
guacggaccugugcagaag

SEQ ID NO: 1084843 - RNA, 19 nt, Homo sapiens
auucaaagcuacucaaauc

SEQ ID NO: 1084844 - RNA, 19 nt, Homo sapiens
caacucucauuaaacauca

SEQ ID NO: 1084845 - RNA, 19 nt, Homo sapiens
gagagacccuauaaaugca

SEQ ID NO: 1084846 - RNA, 19 nt, Homo sapiens
ggagaagcccuaugaaugc

SEQ ID NO: 1084847 - RNA, 19 nt, Homo sapiens
uggaaggcgugaauagaaa

SEQ ID NO: 1084848 - RNA, 19 nt, Homo sapiens
ccaaagugcugggauuaca

SEQ ID NO: 1084849 - RNA, 19 nt, Homo sapiens
agacaggguuucaccaugu

SEQ ID NO: 1084850 - RNA, 19 nt, Homo sapiens
uaaguugcaugcuauugug

SEQ ID NO: 1084851 - RNA, 19 nt, Homo sapiens
gggaaagcccuccaccaaa

SEQ ID NO: 1084852 - RNA, 19 nt, Homo sapiens
cugagguuguuaagauuua

SEQ ID NO: 1084853 - RNA, 19 nt, Homo sapiens
aaagcuacccuuauuguau

SEQ ID NO: 1084854 - RNA, 19 nt, Homo sapiens
caccauacgcagcuaauuu

SEQ ID NO: 1084855 - RNA, 19 nt, Homo sapiens
caacucucauuguauguca

SEQ ID NO: 1084856 - RNA, 19 nt, Homo sapiens
ugaaagcggucaagaaucc

SEQ ID NO: 1084857 - RNA, 19 nt, Homo sapiens
uacuguaccuugucauauu

SEQ ID NO: 1084858 - RNA, 19 nt, Homo sapiens
uaaagcuacccuuauugua

SEQ ID NO: 1084859 - RNA, 19 nt, Homo sapiens
acagggaugucaugcuuga

SEQ ID NO: 1084860 - RNA, 19 nt, Homo sapiens
gcauuaaagcuacccuuau

SEQ ID NO: 1084861 - RNA, 19 nt, Homo sapiens
agaagucaacucugauuaa

SEQ ID NO: 1084862 - RNA, 19 nt, Homo sapiens
ccucauagcacaccagaga

SEQ ID NO: 1084863 - RNA, 19 nt, Homo sapiens
ccagaagucaacccucaua

SEQ ID NO: 1084864 - RNA, 19 nt, Homo sapiens
cauaagugcuaagacgaaa

SEQ ID NO: 1084865 - RNA, 19 nt, Homo sapiens
ggaaaaggcauucaaaaca

SEQ ID NO: 1084866 - RNA, 19 nt, Homo sapiens
gaauccagaacauguagaa

SEQ ID NO: 1084867 - RNA, 19 nt, Homo sapiens
ggacguguuuguggacuuc

SEQ ID NO: 1084868 - RNA, 19 nt, Homo sapiens
ccacagugcaucauaagug

SEQ ID NO: 1084869 - RNA, 19 nt, Homo sapiens
ucauaugggagaaaccuua

SEQ ID NO: 1084870 - RNA, 19 nt, Homo sapiens
gaacucacaccggagagaa

SEQ ID NO: 1084871 - RNA, 19 nt, Homo sapiens
gaccacugcucaccgacuu

SEQ ID NO: 1084872 - RNA, 19 nt, Homo sapiens
gauguaaagcauauuggaa

SEQ ID NO: 1084873 - RNA, 19 nt, Homo sapiens
ucaagaauccagaacaugu

SEQ ID NO: 1084874 - RNA, 19 nt, Homo sapiens
gggaaaucuuuuaguguua

SEQ ID NO: 1084875 - RNA, 19 nt, Homo sapiens
gauaauucauaugggagaa

SEQ ID NO: 1084876 - RNA, 19 nt, Homo sapiens
aaauucauauggagagaga

SEQ ID NO: 1084877 - RNA, 19 nt, Homo sapiens
ugauggauguaaagcauau

SEQ ID NO: 1084878 - RNA, 19 nt, Homo sapiens
gacuucagacuccaguuua

SEQ ID NO: 1084879 - RNA, 19 nt, Homo sapiens
auagaucacuacaaggaaa

SEQ ID NO: 1084880 - RNA, 19 nt, Homo sapiens
ucgguacuauucacaguuu

SEQ ID NO: 1084881 - RNA, 19 nt, Homo sapiens
gugcaagaguagugauguu

SEQ ID NO: 1084882 - RNA, 19 nt, Homo sapiens
ucacagaacauaaaugcau

SEQ ID NO: 1084883 - RNA, 19 nt, Homo sapiens
caucagauaauucauaugg

SEQ ID NO: 1084884 - RNA, 19 nt, Homo sapiens
gggaugucaugcuugagaa

SEQ ID NO: 1084885 - RNA, 19 nt, Homo sapiens
ggaggaaguugucauaauu

SEQ ID NO: 1084886 - RNA, 19 nt, Homo sapiens
caagaaagaugugcuaaga

SEQ ID NO: 1084887 - RNA, 19 nt, Homo sapiens
caucgaugcucuacaguua

SEQ ID NO: 1084888 - RNA, 19 nt, Homo sapiens
agaaagaugugcuaagaaa

SEQ ID NO: 1084889 - RNA, 19 nt, Homo sapiens
ccaggaagauguugaagaa

SEQ ID NO: 1084890 - RNA, 19 nt, Homo sapiens
ggaaugaaguuaccacauc

SEQ ID NO: 1084891 - RNA, 19 nt, Homo sapiens
gaagaaguuuggagauaug

SEQ ID NO: 1084892 - RNA, 19 nt, Homo sapiens
gcaaacagcuauggaaagu

SEQ ID NO: 1084893 - RNA, 19 nt, Homo sapiens
guacaagaaggaauaguua

SEQ ID NO: 1084894 - RNA, 19 nt, Homo sapiens
aaacagcuauggaaaguga

SEQ ID NO: 1084895 - RNA, 19 nt, Homo sapiens
caagaggaguuguguaaug

SEQ ID NO: 1084896 - RNA, 19 nt, Homo sapiens
ggagauauguuauucugau

SEQ ID NO: 1084897 - RNA, 19 nt, Homo sapiens
gaaguuuggagauauguua

SEQ ID NO: 1084898 - RNA, 19 nt, Homo sapiens
ggaagauguugaagaaguu

SEQ ID NO: 1084899 - RNA, 19 nt, Homo sapiens
gaaaauggcgagaaaauaa

SEQ ID NO: 1084900 - RNA, 19 nt, Homo sapiens
ucaggaaauucuucaagua

SEQ ID NO: 1084901 - RNA, 19 nt, Homo sapiens
ggaaggaauuguagaugug

SEQ ID NO: 1084902 - RNA, 19 nt, Homo sapiens
gguacgaggucacugauga

SEQ ID NO: 1084903 - RNA, 19 nt, Homo sapiens
gguauuaucugccaugaag

SEQ ID NO: 1084904 - RNA, 19 nt, Homo sapiens
gaagagugagugcuaauga

SEQ ID NO: 1084905 - RNA, 19 nt, Homo sapiens
gaagcaaugauaugaauga

SEQ ID NO: 1084906 - RNA, 19 nt, Homo sapiens
ugaagugccuagcaaauug

SEQ ID NO: 1084907 - RNA, 19 nt, Homo sapiens
gaacuaagccaggaagaug

SEQ ID NO: 1084908 - RNA, 19 nt, Homo sapiens
ggacaaggcagcacaagug

SEQ ID NO: 1084909 - RNA, 19 nt, Homo sapiens
gaagaagucauaaauccaa

SEQ ID NO: 1084910 - RNA, 19 nt, Homo sapiens
aaacacagacaacacuuua

SEQ ID NO: 1084911 - RNA, 19 nt, Homo sapiens
cgagauguauucagaacaa

SEQ ID NO: 1084912 - RNA, 19 nt, Homo sapiens
aaacuuaucucguagaacu

SEQ ID NO: 1084913 - RNA, 19 nt, Homo sapiens
acaaccagcucuucagauu

SEQ ID NO: 1084914 - RNA, 19 nt, Homo sapiens
gauuagugcucaggaguuu

SEQ ID NO: 1084915 - RNA, 19 nt, Homo sapiens
gggaggaaguugucauaau

SEQ ID NO: 1084916 - RNA, 19 nt, Homo sapiens
ccacgaagguauccagaau

SEQ ID NO: 1084917 - RNA, 19 nt, Homo sapiens
gcaggaaugccucuaagaa

SEQ ID NO: 1084918 - RNA, 19 nt, Homo sapiens
caucacaguuucagauaga

SEQ ID NO: 1084919 - RNA, 19 nt, Homo sapiens
gaacauagaaggacaaaau

SEQ ID NO: 1084920 - RNA, 19 nt, Homo sapiens
gcucuacaguuauguuguu

SEQ ID NO: 1084921 - RNA, 19 nt, Homo sapiens
aaaagacucugcaaaagua

SEQ ID NO: 1084922 - RNA, 19 nt, Homo sapiens
ggaguuguguaaugggaaa

SEQ ID NO: 1084923 - RNA, 19 nt, Homo sapiens
ugaagaaguuuggagauau

SEQ ID NO: 1084924 - RNA, 19 nt, Homo sapiens
gaaguuacaaggcaacaga

SEQ ID NO: 1084925 - RNA, 19 nt, Homo sapiens
auacaggaguuuaccuuaa

SEQ ID NO: 1084926 - RNA, 19 nt, Homo sapiens
cguaugauuucccgaauga

SEQ ID NO: 1084927 - RNA, 19 nt, Homo sapiens
caacauggccaauacaagu

SEQ ID NO: 1084928 - RNA, 19 nt, Homo sapiens
guaaagaggcauccagugu

SEQ ID NO: 1084929 - RNA, 19 nt, Homo sapiens
gaaugaaguuaccacaucu

SEQ ID NO: 1084930 - RNA, 19 nt, Homo sapiens
aaaccaaggugcuguucuu

SEQ ID NO: 1084931 - RNA, 19 nt, Homo sapiens
cgaaacuuaucucguagaa

SEQ ID NO: 1084932 - RNA, 19 nt, Homo sapiens
gcaacagacuauccaacug

SEQ ID NO: 1084933 - RNA, 19 nt, Homo sapiens
ccaagaagcaaugauauga

SEQ ID NO: 1084934 - RNA, 19 nt, Homo sapiens
gcaauugcuagaacucuuu

SEQ ID NO: 1084935 - RNA, 19 nt, Homo sapiens
gaggaaguugucauaauuu

SEQ ID NO: 1084936 - RNA, 19 nt, Homo sapiens
ugaaugauccaacuuaugu

SEQ ID NO: 1084937 - RNA, 19 nt, Homo sapiens
aggcauggauuacauuuau

SEQ ID NO: 1084938 - RNA, 19 nt, Homo sapiens
gcaguggauuggcuuuaug

SEQ ID NO: 1084939 - RNA, 19 nt, Homo sapiens
guuaugcugugcugaagaa

SEQ ID NO: 1084940 - RNA, 19 nt, Homo sapiens
ugcaugaucuauccucuaa

SEQ ID NO: 1084941 - RNA, 19 nt, Homo sapiens
gcuaguggauaauaacauc

SEQ ID NO: 1084942 - RNA, 19 nt, Homo sapiens
ggauuggcuuuaugaccua

SEQ ID NO: 1084943 - RNA, 19 nt, Homo sapiens
cgaggucacugaugauaca

SEQ ID NO: 1084944 - RNA, 19 nt, Homo sapiens
uggcugaaauuaucaugaa

SEQ ID NO: 1084945 - RNA, 19 nt, Homo sapiens
gaaccucuacuuugacugu

SEQ ID NO: 1084946 - RNA, 19 nt, Homo sapiens
caugaucuauccucuaaca

SEQ ID NO: 1084947 - RNA, 19 nt, Homo sapiens
gaacgagauguauucagaa

SEQ ID NO: 1084948 - RNA, 19 nt, Homo sapiens
uugaagaaguuuggagaua

SEQ ID NO: 1084949 - RNA, 19 nt, Homo sapiens
gagcaggaaugccucuaag

SEQ ID NO: 1084950 - RNA, 19 nt, Homo sapiens
gcaaauuggccaagaagca

SEQ ID NO: 1084951 - RNA, 19 nt, Homo sapiens
gaagguauccagaauugag

SEQ ID NO: 1084952 - RNA, 19 nt, Homo sapiens
acgaagguauccagaauug

SEQ ID NO: 1084953 - RNA, 19 nt, Homo sapiens
ugcuagaacucuuuagaaa

SEQ ID NO: 1084954 - RNA, 19 nt, Homo sapiens
acacagacaacacuuuaaa

SEQ ID NO: 1084955 - RNA, 19 nt, Homo sapiens
caaacuucaugaugcaaug

SEQ ID NO: 1084956 - RNA, 19 nt, Homo sapiens
ccagggaauucaaguaaag

SEQ ID NO: 1084957 - RNA, 19 nt, Homo sapiens
uuaagaaacagaagaguga

SEQ ID NO: 1084958 - RNA, 19 nt, Homo sapiens
cuaacuuacucauacugua

SEQ ID NO: 1084959 - RNA, 19 nt, Homo sapiens
uagaagaagucauaaaucc

SEQ ID NO: 1084960 - RNA, 19 nt, Homo sapiens
cuacaguuauguuguuugu

SEQ ID NO: 1084961 - RNA, 19 nt, Homo sapiens
gcugcaaccucauuuagag

SEQ ID NO: 1084962 - RNA, 19 nt, Homo sapiens
gccagggaauucaaguaaa

SEQ ID NO: 1084963 - RNA, 19 nt, Homo sapiens
agugagugcuaaugacaua

SEQ ID NO: 1084964 - RNA, 19 nt, Homo sapiens
gauaacaaccagcucuuca

SEQ ID NO: 1084965 - RNA, 19 nt, Homo sapiens
acugagagacuacagauaa

SEQ ID NO: 1084966 - RNA, 19 nt, Homo sapiens
cugaaccucuacuuacuuu

SEQ ID NO: 1084967 - RNA, 19 nt, Homo sapiens
caagaagcaaugauaugaa

SEQ ID NO: 1084968 - RNA, 19 nt, Homo sapiens
aaguaaacguggaguaguu

SEQ ID NO: 1084969 - RNA, 19 nt, Homo sapiens
caggaaugccucuaagaaa

SEQ ID NO: 1084970 - RNA, 19 nt, Homo sapiens
uccuggagauggacuauuu

SEQ ID NO: 1084971 - RNA, 19 nt, Homo sapiens
gagaaccucuacuuugacu

SEQ ID NO: 1084972 - RNA, 19 nt, Homo sapiens
ugacagaccuauggagagu

SEQ ID NO: 1084973 - RNA, 19 nt, Homo sapiens
gccaugaagugccuagcaa

SEQ ID NO: 1084974 - RNA, 19 nt, Homo sapiens
aaccagcucuucagauuuc

SEQ ID NO: 1084975 - RNA, 19 nt, Homo sapiens
ucagucugcuucauagaga

SEQ ID NO: 1084976 - RNA, 19 nt, Homo sapiens
uggaaggaauuguagaugu

SEQ ID NO: 1084977 - RNA, 19 nt, Homo sapiens
ggaaaauggcgagaaaaua

SEQ ID NO: 1084978 - RNA, 19 nt, Homo sapiens
ccugcaacuucgccacuua

SEQ ID NO: 1084979 - RNA, 19 nt, Homo sapiens
caaccagcucuucagauuu

SEQ ID NO: 1084980 - RNA, 19 nt, Homo sapiens
uaacaaccagcucuucaga

SEQ ID NO: 1084981 - RNA, 19 nt, Homo sapiens
ggucacugaugauacauac

SEQ ID NO: 1084982 - RNA, 19 nt, Homo sapiens
ucucagaguuugcuuuuaa

SEQ ID NO: 1084983 - RNA, 19 nt, Homo sapiens
uaaacguggaguaguuaua

SEQ ID NO: 1084984 - RNA, 19 nt, Homo sapiens
gagauauguuauucugauc

SEQ ID NO: 1084985 - RNA, 19 nt, Homo sapiens
gaacggauccuguguauaa

SEQ ID NO: 1084986 - RNA, 19 nt, Homo sapiens
ggaagucaaucaucuguga

SEQ ID NO: 1084987 - RNA, 19 nt, Homo sapiens
gugcauaaguuuacaugua

SEQ ID NO: 1084988 - RNA, 19 nt, Homo sapiens
gcacagguuuguucgauga

SEQ ID NO: 1084989 - RNA, 19 nt, Homo sapiens
uuaaauggcuuguuuguuc

SEQ ID NO: 1084990 - RNA, 19 nt, Homo sapiens
gaauagcucuuuacugucu

SEQ ID NO: 1084991 - RNA, 19 nt, Homo sapiens
caagacagcuucucuaagg

SEQ ID NO: 1084992 - RNA, 19 nt, Homo sapiens
agaaagaaaugcacgauug

SEQ ID NO: 1084993 - RNA, 19 nt, Homo sapiens
guacaugucuugcggugaa

SEQ ID NO: 1084994 - RNA, 19 nt, Homo sapiens
cauguuaucuccuugcuuu

SEQ ID NO: 1084995 - RNA, 19 nt, Homo sapiens
aaaccaagcugaaggaauc

SEQ ID NO: 1084996 - RNA, 19 nt, Homo sapiens
gauaaaggcauucagaaau

SEQ ID NO: 1084997 - RNA, 19 nt, Homo sapiens
gauaagauuugaguguuug

SEQ ID NO: 1084998 - RNA, 19 nt, Homo sapiens
uugaauagcucuuuacugu

SEQ ID NO: 1084999 - RNA, 19 nt, Homo sapiens
ccaauggucuugugcauag

SEQ ID NO: 1085000 - RNA, 19 nt, Homo sapiens
caauguggaugcagaaguu

SEQ ID NO: 1085001 - RNA, 19 nt, Homo sapiens
acaagaagcuggagucucu

SEQ ID NO: 1085002 - RNA, 19 nt, Homo sapiens
caacucaggcuccuacaaa

SEQ ID NO: 1085003 - RNA, 19 nt, Homo sapiens
gggaacggauccuguguau

SEQ ID NO: 1085004 - RNA, 19 nt, Homo sapiens
guaauugguuugaagaagu

SEQ ID NO: 1085005 - RNA, 19 nt, Homo sapiens
gaagccuguucacuguuua

SEQ ID NO: 1085006 - RNA, 19 nt, Homo sapiens
agucuuaaauggcuuguuu

SEQ ID NO: 1085007 - RNA, 19 nt, Homo sapiens
gcucuuuacugucuuacuu

SEQ ID NO: 1085008 - RNA, 19 nt, Homo sapiens
cagcugagcccugucaaua

SEQ ID NO: 1085009 - RNA, 19 nt, Homo sapiens
caauauccaucccaguuau

SEQ ID NO: 1085010 - RNA, 19 nt, Homo sapiens
gaaaugcacgauuggaaug

SEQ ID NO: 1085011 - RNA, 19 nt, Homo sapiens
aaauguagcuccaagucuu

SEQ ID NO: 1085012 - RNA, 19 nt, Homo sapiens
cacaauggcagauggguua

SEQ ID NO: 1085013 - RNA, 19 nt, Homo sapiens
gcacacaguggcucucuga

SEQ ID NO: 1085014 - RNA, 19 nt, Homo sapiens
caaaccgccucaugagaga

SEQ ID NO: 1085015 - RNA, 19 nt, Homo sapiens
gcugagcccugucaauauc

SEQ ID NO: 1085016 - RNA, 19 nt, Homo sapiens
ucaaacaggucaucgaaac

SEQ ID NO: 1085017 - RNA, 19 nt, Homo sapiens
cucuaaggcuggcauguua

SEQ ID NO: 1085018 - RNA, 19 nt, Homo sapiens
ggagauagcauagccaaca

SEQ ID NO: 1085019 - RNA, 19 nt, Homo sapiens
ucaauauccaucccaguua

SEQ ID NO: 1085020 - RNA, 19 nt, Homo sapiens
gcuccuugguauuugauuu

SEQ ID NO: 1085021 - RNA, 19 nt, Homo sapiens
caagcggucuucuucuuca

SEQ ID NO: 1085022 - RNA, 19 nt, Homo sapiens
gaaaccagguagugaagcu

SEQ ID NO: 1085023 - RNA, 19 nt, Homo sapiens
gguauuugauuugcacuau

SEQ ID NO: 1085024 - RNA, 19 nt, Homo sapiens
gugaaaucguggagcuuaa

SEQ ID NO: 1085025 - RNA, 19 nt, Homo sapiens
gcaguuugcacuuucaaga

SEQ ID NO: 1085026 - RNA, 19 nt, Homo sapiens
ugacagggagcuacuggua

SEQ ID NO: 1085027 - RNA, 19 nt, Homo sapiens
gaacugugccuagacuuuc

SEQ ID NO: 1085028 - RNA, 19 nt, Homo sapiens
ccaguuggcacucaaagaa

SEQ ID NO: 1085029 - RNA, 19 nt, Homo sapiens
gaaagaaaugcacgauugg

SEQ ID NO: 1085030 - RNA, 19 nt, Homo sapiens
gagcagcacaggcagcauu

SEQ ID NO: 1085031 - RNA, 19 nt, Homo sapiens
uaagaaggaaucaaaguca

SEQ ID NO: 1085032 - RNA, 19 nt, Homo sapiens
gcucaaacaggucaucgaa

SEQ ID NO: 1085033 - RNA, 19 nt, Homo sapiens
gaagccaggaaagagauua

SEQ ID NO: 1085034 - RNA, 19 nt, Homo sapiens
gcauucaguccucucgaua

SEQ ID NO: 1085035 - RNA, 19 nt, Homo sapiens
uccaagaaauccaaacuca

SEQ ID NO: 1085036 - RNA, 19 nt, Homo sapiens
aaagauaaaggcauucaga

SEQ ID NO: 1085037 - RNA, 19 nt, Homo sapiens
ucaaagaagccaggaaaga

SEQ ID NO: 1085038 - RNA, 19 nt, Homo sapiens
gaaagaggugacagugaga

SEQ ID NO: 1085039 - RNA, 19 nt, Homo sapiens
aaagucaggccuugugaaa

SEQ ID NO: 1085040 - RNA, 19 nt, Homo sapiens
auucaguccucucgauaua

SEQ ID NO: 1085041 - RNA, 19 nt, Homo sapiens
gcaggggacuguaaccaaa

SEQ ID NO: 1085042 - RNA, 19 nt, Homo sapiens
aaccggagguaucuucaaa

SEQ ID NO: 1085043 - RNA, 19 nt, Homo sapiens
gccuagacuuuccauguga

SEQ ID NO: 1085044 - RNA, 19 nt, Homo sapiens
gagcgccgacuccaugaaa

SEQ ID NO: 1085045 - RNA, 19 nt, Homo sapiens
gaagacacccucagaugcu

SEQ ID NO: 1085046 - RNA, 19 nt, Homo sapiens
gauuugaguguuugcaauu

SEQ ID NO: 1085047 - RNA, 19 nt, Homo sapiens
agucuugaauagcucuuua

SEQ ID NO: 1085048 - RNA, 19 nt, Homo sapiens
caaagaagccaggaaagag

SEQ ID NO: 1085049 - RNA, 19 nt, Homo sapiens
caugaaagggaaagugaaa

SEQ ID NO: 1085050 - RNA, 19 nt, Homo sapiens
cgaacugugccuagacuuu

SEQ ID NO: 1085051 - RNA, 19 nt, Homo sapiens
ggauugaggaggaguguca

SEQ ID NO: 1085052 - RNA, 19 nt, Homo sapiens
uggaaugguuggugaagga

SEQ ID NO: 1085053 - RNA, 19 nt, Homo sapiens
cagcacagguuuguucgau

SEQ ID NO: 1085054 - RNA, 19 nt, Homo sapiens
agauaaaggcauucagaaa

SEQ ID NO: 1085055 - RNA, 19 nt, Homo sapiens
gcaagcggucuucuucuuc

SEQ ID NO: 1085056 - RNA, 19 nt, Homo sapiens
gaaauuguaaccacacacu

SEQ ID NO: 1085057 - RNA, 19 nt, Homo sapiens
uaaauggcuuguuuguucu

SEQ ID NO: 1085058 - RNA, 19 nt, Homo sapiens
gcuggcauguuaucuccuu

SEQ ID NO: 1085059 - RNA, 19 nt, Homo sapiens
gaaacaggaagucaaucau

SEQ ID NO: 1085060 - RNA, 19 nt, Homo sapiens
gggacgaacugugccuaga

SEQ ID NO: 1085061 - RNA, 19 nt, Homo sapiens
gugaagacacccucagaug

SEQ ID NO: 1085062 - RNA, 19 nt, Homo sapiens
aaagaagccaggaaagaga

SEQ ID NO: 1085063 - RNA, 19 nt, Homo sapiens
caaacccagagcaguauuu

SEQ ID NO: 1085064 - RNA, 19 nt, Homo sapiens
gaugaaacugugcauaagu

SEQ ID NO: 1085065 - RNA, 19 nt, Homo sapiens
uggcuuguuuguucuuaaa

SEQ ID NO: 1085066 - RNA, 19 nt, Homo sapiens
gguacccguucuuauccua

SEQ ID NO: 1085067 - RNA, 19 nt, Homo sapiens
gugccaaugugucccaugu

SEQ ID NO: 1085068 - RNA, 19 nt, Homo sapiens
ccucaugggcggaguaaug

SEQ ID NO: 1085069 - RNA, 19 nt, Homo sapiens
ugagguacccguucuuauc

SEQ ID NO: 1085070 - RNA, 19 nt, Homo sapiens
cagacucgauggagagcuu

SEQ ID NO: 1085071 - RNA, 19 nt, Homo sapiens
gagcugcugcccauaguca

SEQ ID NO: 1085072 - RNA, 19 nt, Homo sapiens
cagaaagaggugacaguga

SEQ ID NO: 1085073 - RNA, 19 nt, Homo sapiens
gucaauauccaucccaguu

SEQ ID NO: 1085074 - RNA, 19 nt, Homo sapiens
uugaugaaacugugcauaa

SEQ ID NO: 1085075 - RNA, 19 nt, Homo sapiens
ggcauucaguacucagaga

SEQ ID NO: 1085076 - RNA, 19 nt, Homo sapiens
gcagcuuccugguggaucu

SEQ ID NO: 1085077 - RNA, 19 nt, Homo sapiens
gagauagcauagccaacag

SEQ ID NO: 1085078 - RNA, 19 nt, Homo sapiens
ccaggaaagagauuaaaca

SEQ ID NO: 1085079 - RNA, 19 nt, Homo sapiens
ucaguccucucgauauaag

SEQ ID NO: 1085080 - RNA, 19 nt, Homo sapiens
ugaugaaacugugcauaag

SEQ ID NO: 1085081 - RNA, 19 nt, Homo sapiens
uguaauuguuccagcauuc

SEQ ID NO: 1085082 - RNA, 19 nt, Homo sapiens
agaaacaggaagucaauca

SEQ ID NO: 1085083 - RNA, 19 nt, Homo sapiens
ugccuuagugguugauuua

SEQ ID NO: 1085084 - RNA, 19 nt, Homo sapiens
ugacagccaccaccacaga

SEQ ID NO: 1085085 - RNA, 19 nt, Homo sapiens
caacauaucugcacaggua

SEQ ID NO: 1085086 - RNA, 19 nt, Homo sapiens
acaaugggcuucuuuauga

SEQ ID NO: 1085087 - RNA, 19 nt, Homo sapiens
gagcuuggaugauuuaguu

SEQ ID NO: 1085088 - RNA, 19 nt, Homo sapiens
gagcaaaccaaccauaaua

SEQ ID NO: 1085089 - RNA, 19 nt, Homo sapiens
gaaagccuauucaggauau

SEQ ID NO: 1085090 - RNA, 19 nt, Homo sapiens
uaccaaaccuauugcuuua

SEQ ID NO: 1085091 - RNA, 19 nt, Homo sapiens
gaauugagccuguuagaau

SEQ ID NO: 1085092 - RNA, 19 nt, Homo sapiens
gaagaaagaaguccacguu

SEQ ID NO: 1085093 - RNA, 19 nt, Homo sapiens
ucaggaaucuggcuggaua

SEQ ID NO: 1085094 - RNA, 19 nt, Homo sapiens
cguaagagcuuggaugauu

SEQ ID NO: 1085095 - RNA, 19 nt, Homo sapiens
agagaaagauguuuacuca

SEQ ID NO: 1085096 - RNA, 19 nt, Homo sapiens
guaagagcuuggaugauuu

SEQ ID NO: 1085097 - RNA, 19 nt, Homo sapiens
uaacgggucugucuccaaa

SEQ ID NO: 1085098 - RNA, 19 nt, Homo sapiens
ccaaaccuauugcuuuauu

SEQ ID NO: 1085099 - RNA, 19 nt, Homo sapiens
ggaaucagugggacuauuu

SEQ ID NO: 1085100 - RNA, 19 nt, Homo sapiens
ugacagagauaccgacuca

SEQ ID NO: 1085101 - RNA, 19 nt, Homo sapiens
gcaaaccaaccauaauaaa

SEQ ID NO: 1085102 - RNA, 19 nt, Homo sapiens
uagaacaacuccaucagaa

SEQ ID NO: 1085103 - RNA, 19 nt, Homo sapiens
gacaaugccugcaaaauuu

SEQ ID NO: 1085104 - RNA, 19 nt, Homo sapiens
gaacaacuccaucagaaca

SEQ ID NO: 1085105 - RNA, 19 nt, Homo sapiens
ggaagguggugacaacuca

SEQ ID NO: 1085106 - RNA, 19 nt, Homo sapiens
gcacagguauuugggauca

SEQ ID NO: 1085107 - RNA, 19 nt, Homo sapiens
caguacggcuccaucaaua

SEQ ID NO: 1085108 - RNA, 19 nt, Homo sapiens
ucaaggagaaaccuaaaua

SEQ ID NO: 1085109 - RNA, 19 nt, Homo sapiens
gaggugagggugugcuuua

SEQ ID NO: 1085110 - RNA, 19 nt, Homo sapiens
gggcuucgcuagagauguu

SEQ ID NO: 1085111 - RNA, 19 nt, Homo sapiens
gagcuugccuaccacauca

SEQ ID NO: 1085112 - RNA, 19 nt, Homo sapiens
gcaaggaacaugcuguaug

SEQ ID NO: 1085113 - RNA, 19 nt, Homo sapiens
gcacauauuugggaacucu

SEQ ID NO: 1085114 - RNA, 19 nt, Homo sapiens
ggaagcaccauuagaacaa

SEQ ID NO: 1085115 - RNA, 19 nt, Homo sapiens
ggacuugugggccuaaauu

SEQ ID NO: 1085116 - RNA, 19 nt, Homo sapiens
ucucuugccuucccucuuu

SEQ ID NO: 1085117 - RNA, 19 nt, Homo sapiens
gggaucaucuuuaccaucu

SEQ ID NO: 1085118 - RNA, 19 nt, Homo sapiens
aagcugaucuuuccuaucu

SEQ ID NO: 1085119 - RNA, 19 nt, Homo sapiens
ucaacuuacucuaaccuuu

SEQ ID NO: 1085120 - RNA, 19 nt, Homo sapiens
gcacaaugggcuucuuuau

SEQ ID NO: 1085121 - RNA, 19 nt, Homo sapiens
ggacaaugccugcaaaauu

SEQ ID NO: 1085122 - RNA, 19 nt, Homo sapiens
uaagagcuuggaugauuua

SEQ ID NO: 1085123 - RNA, 19 nt, Homo sapiens
caaagggcuucgcuagaga

SEQ ID NO: 1085124 - RNA, 19 nt, Homo sapiens
ucaauaacaucuucaugca

SEQ ID NO: 1085125 - RNA, 19 nt, Homo sapiens
caacuuacucuaaccuuug

SEQ ID NO: 1085126 - RNA, 19 nt, Homo sapiens
gaaccaagccugggaacau

SEQ ID NO: 1085127 - RNA, 19 nt, Homo sapiens
uccaaacccucuuuccuaa

SEQ ID NO: 1085128 - RNA, 19 nt, Homo sapiens
uggcauggauggccuauuc

SEQ ID NO: 1085129 - RNA, 19 nt, Homo sapiens
acagaaagcaaacaaagaa

SEQ ID NO: 1085130 - RNA, 19 nt, Homo sapiens
ccacugggauuugaguuug

SEQ ID NO: 1085131 - RNA, 19 nt, Homo sapiens
gaauugcgauuggguucuu

SEQ ID NO: 1085132 - RNA, 19 nt, Homo sapiens
gaaauuuccaguguccuaa

SEQ ID NO: 1085133 - RNA, 19 nt, Homo sapiens
ugugcuacaugcugacuua

SEQ ID NO: 1085134 - RNA, 19 nt, Homo sapiens
cucaugggcuuugguaaua

SEQ ID NO: 1085135 - RNA, 19 nt, Homo sapiens
ucugaugccuuuaucuuga

SEQ ID NO: 1085136 - RNA, 19 nt, Homo sapiens
guauuugggaucaucuuua

SEQ ID NO: 1085137 - RNA, 19 nt, Homo sapiens
caucacugcuggcacaaug

SEQ ID NO: 1085138 - RNA, 19 nt, Homo sapiens
gggacgagcuugccuacca

SEQ ID NO: 1085139 - RNA, 19 nt, Homo sapiens
ggaauugagccuguuagaa

SEQ ID NO: 1085140 - RNA, 19 nt, Homo sapiens
gagcaacaccagcaaagug

SEQ ID NO: 1085141 - RNA, 19 nt, Homo sapiens
caaagagacaacccuggua

SEQ ID NO: 1085142 - RNA, 19 nt, Homo sapiens
uguaagaucugacauuucg

SEQ ID NO: 1085143 - RNA, 19 nt, Homo sapiens
uaaaccaacucaagcugau

SEQ ID NO: 1085144 - RNA, 19 nt, Homo sapiens
gcuuugagcgauaaucuuu

SEQ ID NO: 1085145 - RNA, 19 nt, Homo sapiens
gguaauccccgucaacuua

SEQ ID NO: 1085146 - RNA, 19 nt, Homo sapiens
agaggaagcaccauuagaa

SEQ ID NO: 1085147 - RNA, 19 nt, Homo sapiens
ccagauuauugacaacuau

SEQ ID NO: 1085148 - RNA, 19 nt, Homo sapiens
gccagauuauugacaacua

SEQ ID NO: 1085149 - RNA, 19 nt, Homo sapiens
gcauggugguguacacguu

SEQ ID NO: 1085150 - RNA, 19 nt, Homo sapiens
agaagugaaugcuggaaga

SEQ ID NO: 1085151 - RNA, 19 nt, Homo sapiens
uuaccaaaccuauugcuuu

SEQ ID NO: 1085152 - RNA, 19 nt, Homo sapiens
gggaaucagugggacuauu

SEQ ID NO: 1085153 - RNA, 19 nt, Homo sapiens
gaaagcaaacaaagaaacu

SEQ ID NO: 1085154 - RNA, 19 nt, Homo sapiens
gcugugaucucaggaaucu

SEQ ID NO: 1085155 - RNA, 19 nt, Homo sapiens
caaggagaaaccuaaauau

SEQ ID NO: 1085156 - RNA, 19 nt, Homo sapiens
ccucauccuugucaucauu

SEQ ID NO: 1085157 - RNA, 19 nt, Homo sapiens
uggcuuggcugcuggagaa

SEQ ID NO: 1085158 - RNA, 19 nt, Homo sapiens
gagccagguuugugugugu

SEQ ID NO: 1085159 - RNA, 19 nt, Homo sapiens
acucuaaccuuugcugaaa

SEQ ID NO: 1085160 - RNA, 19 nt, Homo sapiens
ggacugauugcucaaguuc

SEQ ID NO: 1085161 - RNA, 19 nt, Homo sapiens
ucaugaagcccaguucuaa

SEQ ID NO: 1085162 - RNA, 19 nt, Homo sapiens
gacagaaagcaaacaaaga

SEQ ID NO: 1085163 - RNA, 19 nt, Homo sapiens
ggagacagaaagcaaacaa

SEQ ID NO: 1085164 - RNA, 19 nt, Homo sapiens
gaauuggccugacgaucgu

SEQ ID NO: 1085165 - RNA, 19 nt, Homo sapiens
agugaaugcuggaagaauu

SEQ ID NO: 1085166 - RNA, 19 nt, Homo sapiens
caugcuguauguaauagaa

SEQ ID NO: 1085167 - RNA, 19 nt, Homo sapiens
guacucaugggcuuuggua

SEQ ID NO: 1085168 - RNA, 19 nt, Homo sapiens
gcugaucuuuccuaucuag

SEQ ID NO: 1085169 - RNA, 19 nt, Homo sapiens
gggacaggguggcagagaa

SEQ ID NO: 1085170 - RNA, 19 nt, Homo sapiens
acaaagggcuucgcuagag

SEQ ID NO: 1085171 - RNA, 19 nt, Homo sapiens
gagcucacguacccagaau

SEQ ID NO: 1085172 - RNA, 19 nt, Homo sapiens
agaaagaaguccacguuuu

SEQ ID NO: 1085173 - RNA, 19 nt, Homo sapiens
ugaccacugugcugucuug

SEQ ID NO: 1085174 - RNA, 19 nt, Homo sapiens
gaagcccaguucuaauaag

SEQ ID NO: 1085175 - RNA, 19 nt, Homo sapiens
ggaauaggcaagcguccuu

SEQ ID NO: 1085176 - RNA, 19 nt, Homo sapiens
caacccugguagucuauau

SEQ ID NO: 1085177 - RNA, 19 nt, Homo sapiens
caucaccuauggucugaau

SEQ ID NO: 1085178 - RNA, 19 nt, Homo sapiens
cagcaucauguucuauaua

SEQ ID NO: 1085179 - RNA, 19 nt, Homo sapiens
gcuacaugcugacuuacau

SEQ ID NO: 1085180 - RNA, 19 nt, Homo sapiens
cggcagaaguagugaguca

SEQ ID NO: 1085181 - RNA, 19 nt, Homo sapiens
gagaggaagcaccauuaga

SEQ ID NO: 1085182 - RNA, 19 nt, Homo sapiens
ggacaggguggcagagaau

SEQ ID NO: 1085183 - RNA, 19 nt, Homo sapiens
ucacguacccagaaucaga

SEQ ID NO: 1085184 - RNA, 19 nt, Homo sapiens
gcaacuccuuucaguggau

SEQ ID NO: 1085185 - RNA, 19 nt, Homo sapiens
gcaaauccaucacaaguuc

SEQ ID NO: 1085186 - RNA, 19 nt, Homo sapiens
ugaccuagauuaacucuuu

SEQ ID NO: 1085187 - RNA, 19 nt, Homo sapiens
uaacugaggccuucuuuaa

SEQ ID NO: 1085188 - RNA, 19 nt, Homo sapiens
gggcagggcugacagaugu

SEQ ID NO: 1085189 - RNA, 19 nt, Homo sapiens
caggauacauugaguuuga

SEQ ID NO: 1085190 - RNA, 19 nt, Homo sapiens
ggaaguagcccaauuugca

SEQ ID NO: 1085191 - RNA, 19 nt, Homo sapiens
gcaugaggauggugaauca

SEQ ID NO: 1085192 - RNA, 19 nt, Homo sapiens
gagauacccguaccuuaua

SEQ ID NO: 1085193 - RNA, 19 nt, Homo sapiens
aaacggaaguagcccaauu

SEQ ID NO: 1085194 - RNA, 19 nt, Homo sapiens
ucacaaguguaccuucaaa

SEQ ID NO: 1085195 - RNA, 19 nt, Homo sapiens
ggacaggaaagcugaaaug

SEQ ID NO: 1085196 - RNA, 19 nt, Homo sapiens
gaaaaggacccucauauag

SEQ ID NO: 1085197 - RNA, 19 nt, Homo sapiens
gcagaguguugaccuagau

SEQ ID NO: 1085198 - RNA, 19 nt, Homo sapiens
gagaagaggcaccguagga

SEQ ID NO: 1085199 - RNA, 19 nt, Homo sapiens
ccacaaguucuaauccaua

SEQ ID NO: 1085200 - RNA, 19 nt, Homo sapiens
guggagagauuugagaaga

SEQ ID NO: 1085201 - RNA, 19 nt, Homo sapiens
ugagauacccguaccuuau

SEQ ID NO: 1085202 - RNA, 19 nt, Homo sapiens
ccaaagugcugggauuaca

SEQ ID NO: 1085203 - RNA, 19 nt, Homo sapiens
gcagaggcguuccuuugag

SEQ ID NO: 1085204 - RNA, 19 nt, Homo sapiens
ggagugcaguggcgcaauc

SEQ ID NO: 1085205 - RNA, 19 nt, Homo sapiens
guaggaacaccuuugcauu

SEQ ID NO: 1085206 - RNA, 19 nt, Homo sapiens
gggacugccgugagacuua

SEQ ID NO: 1085207 - RNA, 19 nt, Homo sapiens
cacaaguucuaauccauau

SEQ ID NO: 1085208 - RNA, 19 nt, Homo sapiens
caaggucauuaguugcaaa

SEQ ID NO: 1085209 - RNA, 19 nt, Homo sapiens
cagaggcguuccuuugaga

SEQ ID NO: 1085210 - RNA, 19 nt, Homo sapiens
uagcagaggcguuccuuug

SEQ ID NO: 1085211 - RNA, 19 nt, Homo sapiens
guaacugaggccuucuuua

SEQ ID NO: 1085212 - RNA, 19 nt, Homo sapiens
uuacaaaugggcugagaaa

SEQ ID NO: 1085213 - RNA, 19 nt, Homo sapiens
uaggaacaccuuugcauug

SEQ ID NO: 1085214 - RNA, 19 nt, Homo sapiens
ggacugccgugagacuuag

SEQ ID NO: 1085215 - RNA, 19 nt, Homo sapiens
aaguguaccuucaaaguca

SEQ ID NO: 1085216 - RNA, 19 nt, Homo sapiens
gaguaguccuggcuuccuu

SEQ ID NO: 1085217 - RNA, 19 nt, Homo sapiens
gaguguugaccuagauuaa

SEQ ID NO: 1085218 - RNA, 19 nt, Homo sapiens
gaggcguuccuuugagaua

SEQ ID NO: 1085219 - RNA, 19 nt, Homo sapiens
ggcgggaauuuauuagaga

SEQ ID NO: 1085220 - RNA, 19 nt, Homo sapiens
aguccuggcuuccuuguug

SEQ ID NO: 1085221 - RNA, 19 nt, Homo sapiens
ggaacaccuuugcauuguc

SEQ ID NO: 1085222 - RNA, 19 nt, Homo sapiens
gggacucacugcagggaau

SEQ ID NO: 1085223 - RNA, 19 nt, Homo sapiens
acccguaccuuauauguca

SEQ ID NO: 1085224 - RNA, 19 nt, Homo sapiens
gagaaaaggacccucauau

SEQ ID NO: 1085225 - RNA, 19 nt, Homo sapiens
ggaguggagagauuugaga

SEQ ID NO: 1085226 - RNA, 19 nt, Homo sapiens
acacacacccucaucuuuc

SEQ ID NO: 1085227 - RNA, 19 nt, Homo sapiens
cauauagggugcuggaaaa

SEQ ID NO: 1085228 - RNA, 19 nt, Homo sapiens
ucauauagggugcuggaaa

SEQ ID NO: 1085229 - RNA, 19 nt, Homo sapiens
ucagugggaugagccaaga

SEQ ID NO: 1085230 - RNA, 19 nt, Homo sapiens
cugaguagcugggauuaca

SEQ ID NO: 1085231 - RNA, 19 nt, Homo sapiens
gguaacugaggccuucuuu

SEQ ID NO: 1085232 - RNA, 19 nt, Homo sapiens
gggaauuuauuagagauac

SEQ ID NO: 1085233 - RNA, 19 nt, Homo sapiens
agaaaaggacccucauaua

SEQ ID NO: 1085234 - RNA, 19 nt, Homo sapiens
ggucauuaguugcaaaucc

SEQ ID NO: 1085235 - RNA, 19 nt, Homo sapiens
ccaauuugcacacucaauc

SEQ ID NO: 1085236 - RNA, 19 nt, Homo sapiens
caaguguaccuucaaaguc

SEQ ID NO: 1085237 - RNA, 19 nt, Homo sapiens
acacccucaucuuuccuua

SEQ ID NO: 1085238 - RNA, 19 nt, Homo sapiens
gcgggaauuuauuagagau

SEQ ID NO: 1085239 - RNA, 19 nt, Homo sapiens
caaguucuaauccauaugg

SEQ ID NO: 1085240 - RNA, 19 nt, Homo sapiens
gcccagcccacaaguucua

SEQ ID NO: 1085241 - RNA, 19 nt, Homo sapiens
uaaaacgugugguagcauu

SEQ ID NO: 1085242 - RNA, 19 nt, Homo sapiens
cacacacacccucaucuuu

SEQ ID NO: 1085243 - RNA, 19 nt, Homo sapiens
caaaugggcugagaaaagg

SEQ ID NO: 1085244 - RNA, 19 nt, Homo sapiens
cuucacaaguguaccuuca

SEQ ID NO: 1085245 - RNA, 19 nt, Homo sapiens
aggaacaccuuugcauugu

SEQ ID NO: 1085246 - RNA, 19 nt, Homo sapiens
gaguggagagauuugagaa

SEQ ID NO: 1085247 - RNA, 19 nt, Homo sapiens
ggaugugggugggcuaagg

SEQ ID NO: 1085248 - RNA, 19 nt, Homo sapiens
ccacuucaggauacauuga

SEQ ID NO: 1085249 - RNA, 19 nt, Homo sapiens
ucacugcagggaaugguuu

SEQ ID NO: 1085250 - RNA, 19 nt, Homo sapiens
gcccacaaguucuaaucca

SEQ ID NO: 1085251 - RNA, 19 nt, Homo sapiens
gugcaguggcgcaaucuug

SEQ ID NO: 1085252 - RNA, 19 nt, Homo sapiens
caauuugcacacucaauca

SEQ ID NO: 1085253 - RNA, 19 nt, Homo sapiens
guguugaccuagauuaacu

SEQ ID NO: 1085254 - RNA, 19 nt, Homo sapiens
guuaacagccagguggaaa

SEQ ID NO: 1085255 - RNA, 19 nt, Homo sapiens
uaugcagaguguugaccua

SEQ ID NO: 1085256 - RNA, 19 nt, Homo sapiens
ugacauagaggaucuucag

SEQ ID NO: 1085257 - RNA, 19 nt, Homo sapiens
agauacccguaccuuauau

SEQ ID NO: 1085258 - RNA, 19 nt, Homo sapiens
ccaaggucauuaguugcaa

SEQ ID NO: 1085259 - RNA, 19 nt, Homo sapiens
gguaggggcugaguuacaa

SEQ ID NO: 1085260 - RNA, 19 nt, Homo sapiens
acccaggaguggagagauu

SEQ ID NO: 1085261 - RNA, 19 nt, Homo sapiens
acaaguguaccuucaaagu

SEQ ID NO: 1085262 - RNA, 19 nt, Homo sapiens
gucauuaguugcaaaucca

SEQ ID NO: 1085263 - RNA, 19 nt, Homo sapiens
uuugcacacucaaucauau

SEQ ID NO: 1085264 - RNA, 19 nt, Homo sapiens
agaguguugaccuagauua

SEQ ID NO: 1085265 - RNA, 19 nt, Homo sapiens
aagaggccacuucaggaua

SEQ ID NO: 1085266 - RNA, 19 nt, Homo sapiens
acugaggccuucuuuaaaa

SEQ ID NO: 1085267 - RNA, 19 nt, Homo sapiens
gcaguaggaacaccuuugc

SEQ ID NO: 1085268 - RNA, 19 nt, Homo sapiens
acacacacacccucaucuu

SEQ ID NO: 1085269 - RNA, 19 nt, Homo sapiens
agaggccacuucaggauac

SEQ ID NO: 1085270 - RNA, 19 nt, Homo sapiens
gucucuagcuccucacaca

SEQ ID NO: 1085271 - RNA, 19 nt, Homo sapiens
ugccagaccugugcagauc

SEQ ID NO: 1085272 - RNA, 19 nt, Homo sapiens
ugaggauggugaaucaaaa

SEQ ID NO: 1085273 - RNA, 19 nt, Homo sapiens
uuacaccaauugaccuuuu

SEQ ID NO: 1085274 - RNA, 19 nt, Homo sapiens
uugagauacccguaccuua

SEQ ID NO: 1085275 - RNA, 19 nt, Homo sapiens
aaacgugugguagcauuga

SEQ ID NO: 1085276 - RNA, 19 nt, Homo sapiens
caagugaacauccagauua

SEQ ID NO: 1085277 - RNA, 19 nt, Homo sapiens
caacauccacggagauuga

SEQ ID NO: 1085278 - RNA, 19 nt, Homo sapiens
gaguguggcugcuggauca

SEQ ID NO: 1085279 - RNA, 19 nt, Homo sapiens
gggaaggagugcagcauca

SEQ ID NO: 1085280 - RNA, 19 nt, Homo sapiens
gacaaucccucaggacuag

SEQ ID NO: 1085281 - RNA, 19 nt, Homo sapiens
gcguggaguuccugaagaa

SEQ ID NO: 1085282 - RNA, 19 nt, Homo sapiens
gcgcuucgccuuccucuuc

SEQ ID NO: 1085283 - RNA, 19 nt, Homo sapiens
gugaacauccagauuauuc

SEQ ID NO: 1085284 - RNA, 19 nt, Homo sapiens
caagaccugcuucaccuuu

SEQ ID NO: 1085285 - RNA, 19 nt, Homo sapiens
ccaaaggccugcgcaaggu

SEQ ID NO: 1085286 - RNA, 19 nt, Homo sapiens
gggcagcgccgucuuugau

SEQ ID NO: 1085287 - RNA, 19 nt, Homo sapiens
gcauuugcgauucccauuu

SEQ ID NO: 1085288 - RNA, 19 nt, Homo sapiens
uggaguuccugaagaagaa

SEQ ID NO: 1085289 - RNA, 19 nt, Homo sapiens
ggugagcgguuugcagugu

SEQ ID NO: 1085290 - RNA, 19 nt, Homo sapiens
cauuugcgauucccauuuc

SEQ ID NO: 1085291 - RNA, 19 nt, Homo sapiens
gcacugcucgccuguacau

SEQ ID NO: 1085292 - RNA, 19 nt, Homo sapiens
gaggugcggcuguucaaug

SEQ ID NO: 1085293 - RNA, 19 nt, Homo sapiens
aagugaacauccagauuau

SEQ ID NO: 1085294 - RNA, 19 nt, Homo sapiens
ccaagugaacauccagauu

SEQ ID NO: 1085295 - RNA, 19 nt, Homo sapiens
ccagugaccgcaucagguu

SEQ ID NO: 1085296 - RNA, 19 nt, Homo sapiens
cgucuuugaugccauguuc

SEQ ID NO: 1085297 - RNA, 19 nt, Homo sapiens
agacaaucccucaggacua

SEQ ID NO: 1085298 - RNA, 19 nt, Homo sapiens
cagauuauucacaccgaua

SEQ ID NO: 1085299 - RNA, 19 nt, Homo sapiens
gaugccggcuugaguucug

SEQ ID NO: 1085300 - RNA, 19 nt, Homo sapiens
ggauuugggcuguauggau

SEQ ID NO: 1085301 - RNA, 19 nt, Homo sapiens
cgcaucagguucucaguca

SEQ ID NO: 1085302 - RNA, 19 nt, Homo sapiens
ggugggauuugggcuguau

SEQ ID NO: 1085303 - RNA, 19 nt, Homo sapiens
gcuauacaccgccaagaag

SEQ ID NO: 1085304 - RNA, 19 nt, Homo sapiens
gcacugcucaaguuucucu

SEQ ID NO: 1085305 - RNA, 19 nt, Homo sapiens
ccugaugggcccagauaaa

SEQ ID NO: 1085306 - RNA, 19 nt, Homo sapiens
ucaugaccaucgaggaguu

SEQ ID NO: 1085307 - RNA, 19 nt, Homo sapiens
caccugaugggcccagaua

SEQ ID NO: 1085308 - RNA, 19 nt, Homo sapiens
gcaucagguucucagucaa

SEQ ID NO: 1085309 - RNA, 19 nt, Homo sapiens
ggaaggagugcagcaucaa

SEQ ID NO: 1085310 - RNA, 19 nt, Homo sapiens
uauacaccgccaagaagua

SEQ ID NO: 1085311 - RNA, 19 nt, Homo sapiens
ggaauggccacaacaucca

SEQ ID NO: 1085312 - RNA, 19 nt, Homo sapiens
gcaucuucguggugggauu

SEQ ID NO: 1085313 - RNA, 19 nt, Homo sapiens
gcuguucaaugccguuguc

SEQ ID NO: 1085314 - RNA, 19 nt, Homo sapiens
aggcgcgacucuucgauga

SEQ ID NO: 1085315 - RNA, 19 nt, Homo sapiens
cggacgaggugcagauugg

SEQ ID NO: 1085316 - RNA, 19 nt, Homo sapiens
gcucgccuguacauacugu

SEQ ID NO: 1085317 - RNA, 19 nt, Homo sapiens
gcgcgacucuucgaugaac

SEQ ID NO: 1085318 - RNA, 19 nt, Homo sapiens
gcaccuuccgcgucauguu

SEQ ID NO: 1085319 - RNA, 19 nt, Homo sapiens
gugaugaccacgcuauaca

SEQ ID NO: 1085320 - RNA, 19 nt, Homo sapiens
ucucuucacugcacauugc

SEQ ID NO: 1085321 - RNA, 19 nt, Homo sapiens
gaacauccagauuauucac

SEQ ID NO: 1085322 - RNA, 19 nt, Homo sapiens
ggagggcuucaccgacauu

SEQ ID NO: 1085323 - RNA, 19 nt, Homo sapiens
ucgcacugcucaaguuucu

SEQ ID NO: 1085324 - RNA, 19 nt, Homo sapiens
ccacaacauccacggagau

SEQ ID NO: 1085325 - RNA, 19 nt, Homo sapiens
guggaguuccugaagaaga

SEQ ID NO: 1085326 - RNA, 19 nt, Homo sapiens
ggaacaacaauggcacauc

SEQ ID NO: 1085327 - RNA, 19 nt, Homo sapiens
gcccaccgacuaccaagug

SEQ ID NO: 1085328 - RNA, 19 nt, Homo sapiens
gaaggagugcagcaucaac

SEQ ID NO: 1085329 - RNA, 19 nt, Homo sapiens
gauucccauuucucugcua

SEQ ID NO: 1085330 - RNA, 19 nt, Homo sapiens
cgauagcaacaccgucuug

SEQ ID NO: 1085331 - RNA, 19 nt, Homo sapiens
gcaggugacgccagagaac

SEQ ID NO: 1085332 - RNA, 19 nt, Homo sapiens
ucgccuuccucuucaacaa

SEQ ID NO: 1085333 - RNA, 19 nt, Homo sapiens
gaugagagauucuguauug

SEQ ID NO: 1085334 - RNA, 19 nt, Homo sapiens
ggauuaaccucccaggaua

SEQ ID NO: 1085335 - RNA, 19 nt, Homo sapiens
guaauugucuggaucguuu

SEQ ID NO: 1085336 - RNA, 19 nt, Homo sapiens
cagaguagauaguuccuua

SEQ ID NO: 1085337 - RNA, 19 nt, Homo sapiens
gaacaucguuaccguaucu

SEQ ID NO: 1085338 - RNA, 19 nt, Homo sapiens
ucaccgagcuguuauccua

SEQ ID NO: 1085339 - RNA, 19 nt, Homo sapiens
gaaggcagcgccaauaaga

SEQ ID NO: 1085340 - RNA, 19 nt, Homo sapiens
caggaugacucagcaauaa

SEQ ID NO: 1085341 - RNA, 19 nt, Homo sapiens
gcaaagcuauagacuccaa

SEQ ID NO: 1085342 - RNA, 19 nt, Homo sapiens
guagauaguuccuuaaucg

SEQ ID NO: 1085343 - RNA, 19 nt, Homo sapiens
gauacaacauugaacagau

SEQ ID NO: 1085344 - RNA, 19 nt, Homo sapiens
gagagauucuguauugaca

SEQ ID NO: 1085345 - RNA, 19 nt, Homo sapiens
auacgcaggugauugcaua

SEQ ID NO: 1085346 - RNA, 19 nt, Homo sapiens
gaaauacgcaggugauugc

SEQ ID NO: 1085347 - RNA, 19 nt, Homo sapiens
ggaaauacgcaggugauug

SEQ ID NO: 1085348 - RNA, 19 nt, Homo sapiens
gagaugauggcaacaaugu

SEQ ID NO: 1085349 - RNA, 19 nt, Homo sapiens
gggauccugucuuucauug

SEQ ID NO: 1085350 - RNA, 19 nt, Homo sapiens
gaucaacagaaucagagua

SEQ ID NO: 1085351 - RNA, 19 nt, Homo sapiens
gauccugucuuucauugag

SEQ ID NO: 1085352 - RNA, 19 nt, Homo sapiens
cuccacagcuccugacauu

SEQ ID NO: 1085353 - RNA, 19 nt, Homo sapiens
gaaucagaguagauaguuc

SEQ ID NO: 1085354 - RNA, 19 nt, Homo sapiens
ggagugggguguaauguga

SEQ ID NO: 1085355 - RNA, 19 nt, Homo sapiens
gcucgagugcugaagauuu

SEQ ID NO: 1085356 - RNA, 19 nt, Homo sapiens
caacagaaucagaguagau

SEQ ID NO: 1085357 - RNA, 19 nt, Homo sapiens
gaccuggagggacuaauaa

SEQ ID NO: 1085358 - RNA, 19 nt, Homo sapiens
ugaccuggagggacuaaua

SEQ ID NO: 1085359 - RNA, 19 nt, Homo sapiens
gggaaaccaucgauauugc

SEQ ID NO: 1085360 - RNA, 19 nt, Homo sapiens
ccaggaugacucagcaaua

SEQ ID NO: 1085361 - RNA, 19 nt, Homo sapiens
ggacuaauaagaucaacag

SEQ ID NO: 1085362 - RNA, 19 nt, Homo sapiens
guaugugaguggaggaaau

SEQ ID NO: 1085363 - RNA, 19 nt, Homo sapiens
auacaacauugaacagaug

SEQ ID NO: 1085364 - RNA, 19 nt, Homo sapiens
ggugugaaccacuguauag

SEQ ID NO: 1085365 - RNA, 19 nt, Homo sapiens
ggauggacgucucauucuc

SEQ ID NO: 1085366 - RNA, 19 nt, Homo sapiens
gaguagauaguuccuuaau

SEQ ID NO: 1085367 - RNA, 19 nt, Homo sapiens
uaagaucaacagaaucaga

SEQ ID NO: 1085368 - RNA, 19 nt, Homo sapiens
gacaauggagcgaugauag

SEQ ID NO: 1085369 - RNA, 19 nt, Homo sapiens
gauauugcaguggguaauu

SEQ ID NO: 1085370 - RNA, 19 nt, Homo sapiens
uggcccaacuguggaauaa

SEQ ID NO: 1085371 - RNA, 19 nt, Homo sapiens
agagguaucggacagauga

SEQ ID NO: 1085372 - RNA, 19 nt, Homo sapiens
ggauacaacauugaacaga

SEQ ID NO: 1085373 - RNA, 19 nt, Homo sapiens
caggauaucgacugcauug

SEQ ID NO: 1085374 - RNA, 19 nt, Homo sapiens
guaucggacagaugaagua

SEQ ID NO: 1085375 - RNA, 19 nt, Homo sapiens
ggagaugauggcaacaaug

SEQ ID NO: 1085376 - RNA, 19 nt, Homo sapiens
ggaacaucguuaccguauc

SEQ ID NO: 1085377 - RNA, 19 nt, Homo sapiens
gaggaaauacgcaggugau

SEQ ID NO: 1085378 - RNA, 19 nt, Homo sapiens
ucucuauccugaugucaug

SEQ ID NO: 1085379 - RNA, 19 nt, Homo sapiens
ccacagcuccugacauugc

SEQ ID NO: 1085380 - RNA, 19 nt, Homo sapiens
gauggacgucucauucuca

SEQ ID NO: 1085381 - RNA, 19 nt, Homo sapiens
aggcaucaccgagcuguua

SEQ ID NO: 1085382 - RNA, 19 nt, Homo sapiens
ucaugggaguccuagcaaa

SEQ ID NO: 1085383 - RNA, 19 nt, Homo sapiens
ugacaauggagcgaugaua

SEQ ID NO: 1085384 - RNA, 19 nt, Homo sapiens
gcccaacuguggaauaagc

SEQ ID NO: 1085385 - RNA, 19 nt, Homo sapiens
aggcagcgccaauaagauu

SEQ ID NO: 1085386 - RNA, 19 nt, Homo sapiens
ucggacagaugaaguagag

SEQ ID NO: 1085387 - RNA, 19 nt, Homo sapiens
gagcgagccauggcacauu

SEQ ID NO: 1085388 - RNA, 19 nt, Homo sapiens
cgacccaaguccaggauac

SEQ ID NO: 1085389 - RNA, 19 nt, Homo sapiens
cucaaucucuauccugaug

SEQ ID NO: 1085390 - RNA, 19 nt, Homo sapiens
gcaaugcugguagagauca

SEQ ID NO: 1085391 - RNA, 19 nt, Homo sapiens
uugcaaugcugguagagau

SEQ ID NO: 1085392 - RNA, 19 nt, Homo sapiens
ggaaaccaucgauauugca

SEQ ID NO: 1085393 - RNA, 19 nt, Homo sapiens
caucguuaccguaucuuug

SEQ ID NO: 1085394 - RNA, 19 nt, Homo sapiens
gauuaaccucccaggauau

SEQ ID NO: 1085395 - RNA, 19 nt, Homo sapiens
uaugugaguggaggaaaua

SEQ ID NO: 1085396 - RNA, 19 nt, Homo sapiens
aacagaaucagaguagaua

SEQ ID NO: 1085397 - RNA, 19 nt, Homo sapiens
ggagggacuaauaagauca

SEQ ID NO: 1085398 - RNA, 19 nt, Homo sapiens
uggagggacuaauaagauc

SEQ ID NO: 1085399 - RNA, 19 nt, Homo sapiens
cauacucggaacaucguua

SEQ ID NO: 1085400 - RNA, 19 nt, Homo sapiens
cggaacaucguuaccguau

SEQ ID NO: 1085401 - RNA, 19 nt, Homo sapiens
agaaucagaguagauaguu

SEQ ID NO: 1085402 - RNA, 19 nt, Homo sapiens
caggauacaacauugaaca

SEQ ID NO: 1085403 - RNA, 19 nt, Homo sapiens
guauaggccacauugagau

SEQ ID NO: 1085404 - RNA, 19 nt, Homo sapiens
uguauaggccacauugaga

SEQ ID NO: 1085405 - RNA, 19 nt, Homo sapiens
gggugugaaccacuguaua

SEQ ID NO: 1085406 - RNA, 19 nt, Homo sapiens
ggaugacucagcaauaaaa

SEQ ID NO: 1085407 - RNA, 19 nt, Homo sapiens
caaucucuauccugauguc

SEQ ID NO: 1085408 - RNA, 19 nt, Homo sapiens
ucaacagaaucagaguaga

SEQ ID NO: 1085409 - RNA, 19 nt, Homo sapiens
acauugaacagauggcaaa

SEQ ID NO: 1085410 - RNA, 19 nt, Homo sapiens
gagggacuaauaagaucaa

SEQ ID NO: 1085411 - RNA, 19 nt, Homo sapiens
aguccaggauacaacauug

SEQ ID NO: 1085412 - RNA, 19 nt, Homo sapiens
cucgagugcugaagauuuc

SEQ ID NO: 1085413 - RNA, 19 nt, Homo sapiens
uggauuaaccucccaggau

SEQ ID NO: 1085414 - RNA, 19 nt, Homo sapiens
caggcuggcugggagaugu

SEQ ID NO: 1085415 - RNA, 19 nt, Homo sapiens
ugucuuucauugaggaugu

SEQ ID NO: 1085416 - RNA, 19 nt, Homo sapiens
uggcaaagcgaggcaagaa

SEQ ID NO: 1085417 - RNA, 19 nt, Homo sapiens
ugcugaagauuucuaacga

SEQ ID NO: 1085418 - RNA, 19 nt, Homo sapiens
gagugcugaagauuucuaa

SEQ ID NO: 1085419 - RNA, 19 nt, Homo sapiens
aguagauaguuccuuaauc

SEQ ID NO: 1085420 - RNA, 19 nt, Homo sapiens
cagaaucagaguagauagu

SEQ ID NO: 1085421 - RNA, 19 nt, Homo sapiens
aggagaugauggcaacaau

SEQ ID NO: 1085422 - RNA, 19 nt, Homo sapiens
uugaaggcagcgccaauaa

SEQ ID NO: 1085423 - RNA, 19 nt, Homo sapiens
gggauggacgucucauucu

SEQ ID NO: 1085424 - RNA, 19 nt, Homo sapiens
ccaaguccaggauacaaca

SEQ ID NO: 1085425 - RNA, 19 nt, Homo sapiens
ggacacaggaccccacuca

SEQ ID NO: 1085426 - RNA, 19 nt, Homo sapiens
gcaagaacccuaccuuuaa

SEQ ID NO: 1085427 - RNA, 19 nt, Homo sapiens
gaagggaacuauuaaagca

SEQ ID NO: 1085428 - RNA, 19 nt, Homo sapiens
ccacaaaggcgacaucaaa

SEQ ID NO: 1085429 - RNA, 19 nt, Homo sapiens
caaaggcuaugaagguaaa

SEQ ID NO: 1085430 - RNA, 19 nt, Homo sapiens
gaacccuaccuuuaaguua

SEQ ID NO: 1085431 - RNA, 19 nt, Homo sapiens
ugacugaauuucuacauga

SEQ ID NO: 1085432 - RNA, 19 nt, Homo sapiens
gaacuccuggucaucuuua

SEQ ID NO: 1085433 - RNA, 19 nt, Homo sapiens
ggacagcgccagugaggaa

SEQ ID NO: 1085434 - RNA, 19 nt, Homo sapiens
ggaaucagaagccuaagaa

SEQ ID NO: 1085435 - RNA, 19 nt, Homo sapiens
ucacagauccgaagaggaa

SEQ ID NO: 1085436 - RNA, 19 nt, Homo sapiens
ggaagaggagcaagaagaa

SEQ ID NO: 1085437 - RNA, 19 nt, Homo sapiens
caaggaaucagaagccuaa

SEQ ID NO: 1085438 - RNA, 19 nt, Homo sapiens
gcucaguacuacacaguga

SEQ ID NO: 1085439 - RNA, 19 nt, Homo sapiens
ggcaaaggcuaugaaggua

SEQ ID NO: 1085440 - RNA, 19 nt, Homo sapiens
caagaacccuaccuuuaag

SEQ ID NO: 1085441 - RNA, 19 nt, Homo sapiens
uaagugaagaucagaagua

SEQ ID NO: 1085442 - RNA, 19 nt, Homo sapiens
caaugcauguggugaauca

SEQ ID NO: 1085443 - RNA, 19 nt, Homo sapiens
gcaaggacagcgccaguga

SEQ ID NO: 1085444 - RNA, 19 nt, Homo sapiens
gaccagguguggaauaucu

SEQ ID NO: 1085445 - RNA, 19 nt, Homo sapiens
gcaaaggcuaugaagguaa

SEQ ID NO: 1085446 - RNA, 19 nt, Homo sapiens
ucagaaguaugguggcaaa

SEQ ID NO: 1085447 - RNA, 19 nt, Homo sapiens
ggaagucccugaggccaau

SEQ ID NO: 1085448 - RNA, 19 nt, Homo sapiens
gcgaaccagucaauaagga

SEQ ID NO: 1085449 - RNA, 19 nt, Homo sapiens
uggagugacugaauuucua

SEQ ID NO: 1085450 - RNA, 19 nt, Homo sapiens
caaagucaagcuugugaaa

SEQ ID NO: 1085451 - RNA, 19 nt, Homo sapiens
gggaagaggagcaagaaga

SEQ ID NO: 1085452 - RNA, 19 nt, Homo sapiens
ugacugcgguaaagauuuc

SEQ ID NO: 1085453 - RNA, 19 nt, Homo sapiens
caacagcgaaccagucaau

SEQ ID NO: 1085454 - RNA, 19 nt, Homo sapiens
cagcaggcguggauucaga

SEQ ID NO: 1085455 - RNA, 19 nt, Homo sapiens
guuccagccuccaaaguga

SEQ ID NO: 1085456 - RNA, 19 nt, Homo sapiens
ugucuuggauagagaauau

SEQ ID NO: 1085457 - RNA, 19 nt, Homo sapiens
aagucaagcuugugaaaug

SEQ ID NO: 1085458 - RNA, 19 nt, Homo sapiens
ccauuggagugacugaauu

SEQ ID NO: 1085459 - RNA, 19 nt, Homo sapiens
ggaagaacggcagaagaaa

SEQ ID NO: 1085460 - RNA, 19 nt, Homo sapiens
gacaggaggcugaccuuga

SEQ ID NO: 1085461 - RNA, 19 nt, Homo sapiens
gcaaauccacaugcagaaa

SEQ ID NO: 1085462 - RNA, 19 nt, Homo sapiens
agcaagaacccuaccuuua

SEQ ID NO: 1085463 - RNA, 19 nt, Homo sapiens
gggaggugaagaagaauaa

SEQ ID NO: 1085464 - RNA, 19 nt, Homo sapiens
ggaugaagaacaguuuaaa

SEQ ID NO: 1085465 - RNA, 19 nt, Homo sapiens
auaaagagacccaauguca

SEQ ID NO: 1085466 - RNA, 19 nt, Homo sapiens
gaaagacgccguggaacag

SEQ ID NO: 1085467 - RNA, 19 nt, Homo sapiens
gugaagaucagaaguaugg

SEQ ID NO: 1085468 - RNA, 19 nt, Homo sapiens
ugaaaugcauaagugaaga

SEQ ID NO: 1085469 - RNA, 19 nt, Homo sapiens
cagcaagaacccuaccuuu

SEQ ID NO: 1085470 - RNA, 19 nt, Homo sapiens
agaauuggaugaagaacag

SEQ ID NO: 1085471 - RNA, 19 nt, Homo sapiens
uaauaaagagacccaaugu

SEQ ID NO: 1085472 - RNA, 19 nt, Homo sapiens
cacgugaaaugcauaagug

SEQ ID NO: 1085473 - RNA, 19 nt, Homo sapiens
gcagggaagaggagcaaga

SEQ ID NO: 1085474 - RNA, 19 nt, Homo sapiens
acagcgaaccagucaauaa

SEQ ID NO: 1085475 - RNA, 19 nt, Homo sapiens
gaaaagcaugugucuguuu

SEQ ID NO: 1085476 - RNA, 19 nt, Homo sapiens
aacccuaccuuuaaguuau

SEQ ID NO: 1085477 - RNA, 19 nt, Homo sapiens
gacaaugaaauaaccauca

SEQ ID NO: 1085478 - RNA, 19 nt, Homo sapiens
caacuggaagggaacuauu

SEQ ID NO: 1085479 - RNA, 19 nt, Homo sapiens
gaagaacggcagaagaaaa

SEQ ID NO: 1085480 - RNA, 19 nt, Homo sapiens
caaauccacaugcagaaau

SEQ ID NO: 1085481 - RNA, 19 nt, Homo sapiens
ggaacuccuggucaucuuu

SEQ ID NO: 1085482 - RNA, 19 nt, Homo sapiens
ggaagggaacuauuaaagc

SEQ ID NO: 1085483 - RNA, 19 nt, Homo sapiens
gaaaggaagaacggcagaa

SEQ ID NO: 1085484 - RNA, 19 nt, Homo sapiens
gugacugaauuucuacaug

SEQ ID NO: 1085485 - RNA, 19 nt, Homo sapiens
ugaaagacgccguggaaca

SEQ ID NO: 1085486 - RNA, 19 nt, Homo sapiens
gaaaugcauaagugaagau

SEQ ID NO: 1085487 - RNA, 19 nt, Homo sapiens
ccauucugcugacuucuuc

SEQ ID NO: 1085488 - RNA, 19 nt, Homo sapiens
uggcugagaggcaauguuu

SEQ ID NO: 1085489 - RNA, 19 nt, Homo sapiens
aagguaaauucaacuggaa

SEQ ID NO: 1085490 - RNA, 19 nt, Homo sapiens
ggagcaagaagaagaagca

SEQ ID NO: 1085491 - RNA, 19 nt, Homo sapiens
agaaaucuccaccaagguu

SEQ ID NO: 1085492 - RNA, 19 nt, Homo sapiens
ucaaacagcaggcguggau

SEQ ID NO: 1085493 - RNA, 19 nt, Homo sapiens
gggaacuauuaaagcaauu

SEQ ID NO: 1085494 - RNA, 19 nt, Homo sapiens
ucaauaaggaacaggauca

SEQ ID NO: 1085495 - RNA, 19 nt, Homo sapiens
ucugcugacuucuuccuuu

SEQ ID NO: 1085496 - RNA, 19 nt, Homo sapiens
aggaagaacggcagaagaa

SEQ ID NO: 1085497 - RNA, 19 nt, Homo sapiens
aaagagaaagaaaggaaga

SEQ ID NO: 1085498 - RNA, 19 nt, Homo sapiens
gaaacaggccccagacaau

SEQ ID NO: 1085499 - RNA, 19 nt, Homo sapiens
caggaaaacucaaggaauc

SEQ ID NO: 1085500 - RNA, 19 nt, Homo sapiens
gaagaaaauacaaguggaa

SEQ ID NO: 1085501 - RNA, 19 nt, Homo sapiens
cgaugaggcuccugcaaaa

SEQ ID NO: 1085502 - RNA, 19 nt, Homo sapiens
acaggaggcugaccuugag

SEQ ID NO: 1085503 - RNA, 19 nt, Homo sapiens
gaagaaaaggaaaagagaa

SEQ ID NO: 1085504 - RNA, 19 nt, Homo sapiens
gagagaacuuuuagagcaa

SEQ ID NO: 1085505 - RNA, 19 nt, Homo sapiens
aagugaagaucagaaguau

SEQ ID NO: 1085506 - RNA, 19 nt, Homo sapiens
aaaccugucuuggauagag

SEQ ID NO: 1085507 - RNA, 19 nt, Homo sapiens
gugaaucagugaagaaaau

SEQ ID NO: 1085508 - RNA, 19 nt, Homo sapiens
guugaaacagauucuaaga

SEQ ID NO: 1085509 - RNA, 19 nt, Homo sapiens
ggaaaagcaugugucuguu

SEQ ID NO: 1085510 - RNA, 19 nt, Homo sapiens
agucaagcuugugaaauga

SEQ ID NO: 1085511 - RNA, 19 nt, Homo sapiens
gaaaauacaaguggaaaag

SEQ ID NO: 1085512 - RNA, 19 nt, Homo sapiens
gcauaagugaagaucagaa

SEQ ID NO: 1085513 - RNA, 19 nt, Homo sapiens
gagaaccagaagacgauga

SEQ ID NO: 1085514 - RNA, 19 nt, Homo sapiens
agaagaagcagcgcaagga

SEQ ID NO: 1085515 - RNA, 19 nt, Homo sapiens
aagaggagcaagaagaaga

SEQ ID NO: 1085516 - RNA, 19 nt, Homo sapiens
augcagaaaucuccaccaa

SEQ ID NO: 1085517 - RNA, 19 nt, Homo sapiens
uggaauaucuuuucugaag

SEQ ID NO: 1085518 - RNA, 19 nt, Homo sapiens
uuaauaaagagacccaaug

SEQ ID NO: 1085519 - RNA, 19 nt, Homo sapiens
aaacagcaggcguggauuc

SEQ ID NO: 1085520 - RNA, 19 nt, Homo sapiens
uggcaaaggcuaugaaggu

SEQ ID NO: 1085521 - RNA, 19 nt, Homo sapiens
uaaaaccugucuuggauag

SEQ ID NO: 1085522 - RNA, 19 nt, Homo sapiens
aaauccacaugcagaaauc

SEQ ID NO: 1085523 - RNA, 19 nt, Homo sapiens
cagcgaaccagucaauaag

SEQ ID NO: 1085524 - RNA, 19 nt, Homo sapiens
guuauuaaaggacaaaguc

SEQ ID NO: 1085525 - RNA, 19 nt, Homo sapiens
ggaaaagagaaaagaaaga

SEQ ID NO: 1085526 - RNA, 19 nt, Homo sapiens
gaacagcaaggaauuauuu

SEQ ID NO: 1085527 - RNA, 19 nt, Homo sapiens
gaagagugcagucccaaua

SEQ ID NO: 1085528 - RNA, 19 nt, Homo sapiens
gcagaauguuggaguggaa

SEQ ID NO: 1085529 - RNA, 19 nt, Homo sapiens
ggcaagcugugaucugaaa

SEQ ID NO: 1085530 - RNA, 19 nt, Homo sapiens
cuacaacucugacauuucu

SEQ ID NO: 1085531 - RNA, 19 nt, Homo sapiens
aaugauggcuggcuaugaa

SEQ ID NO: 1085532 - RNA, 19 nt, Homo sapiens
ggacucagacugugcaugu

SEQ ID NO: 1085533 - RNA, 19 nt, Homo sapiens
gcaaggaacagcaaggaau

SEQ ID NO: 1085534 - RNA, 19 nt, Homo sapiens
ugacauuucuuguucucaa

SEQ ID NO: 1085535 - RNA, 19 nt, Homo sapiens
caggcaagcugugaucuga

SEQ ID NO: 1085536 - RNA, 19 nt, Homo sapiens
caauguggaccuccuguuu

SEQ ID NO: 1085537 - RNA, 19 nt, Homo sapiens
caaggaacagcaaggaauu

SEQ ID NO: 1085538 - RNA, 19 nt, Homo sapiens
aguacaagaugcuggauga

SEQ ID NO: 1085539 - RNA, 19 nt, Homo sapiens
aggaugcgguggcccuuua

SEQ ID NO: 1085540 - RNA, 19 nt, Homo sapiens
acuuguaucuugaugcuuu

SEQ ID NO: 1085541 - RNA, 19 nt, Homo sapiens
ggaacagcaaggaauuauu

SEQ ID NO: 1085542 - RNA, 19 nt, Homo sapiens
acucugacauuucuuguuc

SEQ ID NO: 1085543 - RNA, 19 nt, Homo sapiens
gaaaugauggcuggcuaug

SEQ ID NO: 1085544 - RNA, 19 nt, Homo sapiens
guacuuguaucuugaugcu

SEQ ID NO: 1085545 - RNA, 19 nt, Homo sapiens
ggaaaugauggcuggcuau

SEQ ID NO: 1085546 - RNA, 19 nt, Homo sapiens
ugaggaagcccgacagcaa

SEQ ID NO: 1085547 - RNA, 19 nt, Homo sapiens
gccaagaccggcuacaaug

SEQ ID NO: 1085548 - RNA, 19 nt, Homo sapiens
gcugagaggccgucacaca

SEQ ID NO: 1085549 - RNA, 19 nt, Homo sapiens
gagcugagaggccgucaca

SEQ ID NO: 1085550 - RNA, 19 nt, Homo sapiens
ucucaagcguuucucuuca

SEQ ID NO: 1085551 - RNA, 19 nt, Homo sapiens
gagcaaggaacagcaagga

SEQ ID NO: 1085552 - RNA, 19 nt, Homo sapiens
caguggcgcuccuacaaca

SEQ ID NO: 1085553 - RNA, 19 nt, Homo sapiens
caagaccggcuacaaugug

SEQ ID NO: 1085554 - RNA, 19 nt, Homo sapiens
agagugcagucccaauaug

SEQ ID NO: 1085555 - RNA, 19 nt, Homo sapiens
aagcguuucucuucacugu

SEQ ID NO: 1085556 - RNA, 19 nt, Homo sapiens
gaccugguggugccaauga

SEQ ID NO: 1085557 - RNA, 19 nt, Homo sapiens
gacagacacagccagcaaa

SEQ ID NO: 1085558 - RNA, 19 nt, Homo sapiens
gaucugaaaggagcaagga

SEQ ID NO: 1085559 - RNA, 19 nt, Homo sapiens
ucacacacaguggauauau

SEQ ID NO: 1085560 - RNA, 19 nt, Homo sapiens
cucgacguguucauuuaua

SEQ ID NO: 1085561 - RNA, 19 nt, Homo sapiens
ccaagaccggcuacaaugu

SEQ ID NO: 1085562 - RNA, 19 nt, Homo sapiens
aaaagauccucaaguacaa

SEQ ID NO: 1085563 - RNA, 19 nt, Homo sapiens
gaugcgguggcccuuuaua

SEQ ID NO: 1085564 - RNA, 19 nt, Homo sapiens
gcacacgcgcuuccucucu

SEQ ID NO: 1085565 - RNA, 19 nt, Homo sapiens
ggaagagugcagucccaau

SEQ ID NO: 1085566 - RNA, 19 nt, Homo sapiens
ugacagacacagccagcaa

SEQ ID NO: 1085567 - RNA, 19 nt, Homo sapiens
ccggagcguucacgagaau

SEQ ID NO: 1085568 - RNA, 19 nt, Homo sapiens
gguggugccaaugaucuua

SEQ ID NO: 1085569 - RNA, 19 nt, Homo sapiens
cuugguacuuguaucuuga

SEQ ID NO: 1085570 - RNA, 19 nt, Homo sapiens
uccuacaacucugacauuu

SEQ ID NO: 1085571 - RNA, 19 nt, Homo sapiens
gccuggcacugguccuuug

SEQ ID NO: 1085572 - RNA, 19 nt, Homo sapiens
gauccucaaguacaagaug

SEQ ID NO: 1085573 - RNA, 19 nt, Homo sapiens
cacacgcgcuuccucucuu

SEQ ID NO: 1085574 - RNA, 19 nt, Homo sapiens
aaggaacagcaaggaauua

SEQ ID NO: 1085575 - RNA, 19 nt, Homo sapiens
cucucgacguguucauuua

SEQ ID NO: 1085576 - RNA, 19 nt, Homo sapiens
ccacuugguacuuguaucu

SEQ ID NO: 1085577 - RNA, 19 nt, Homo sapiens
gaauguuggaguggaaaug

SEQ ID NO: 1085578 - RNA, 19 nt, Homo sapiens
acacgcgcuuccucucuug

SEQ ID NO: 1085579 - RNA, 19 nt, Homo sapiens
agucauaagccacccaaga

SEQ ID NO: 1085580 - RNA, 19 nt, Homo sapiens
gccaucauccucaccuaug

SEQ ID NO: 1085581 - RNA, 19 nt, Homo sapiens
cuuguaucuugaugcuuua

SEQ ID NO: 1085582 - RNA, 19 nt, Homo sapiens
ccacguccuacaacucuga

SEQ ID NO: 1085583 - RNA, 19 nt, Homo sapiens
ccuacaacaucuccaucug

SEQ ID NO: 1085584 - RNA, 19 nt, Homo sapiens
gaaggucccggagcguuca

SEQ ID NO: 1085585 - RNA, 19 nt, Homo sapiens
auguggaccuccuguuuga

SEQ ID NO: 1085586 - RNA, 19 nt, Homo sapiens
gacguguucauuuauacaa

SEQ ID NO: 1085587 - RNA, 19 nt, Homo sapiens
cugcaccucugaccguuuc

SEQ ID NO: 1085588 - RNA, 19 nt, Homo sapiens
aaugacacccgcagcagaa

SEQ ID NO: 1085589 - RNA, 19 nt, Homo sapiens
uguuugagacccucuuuga

SEQ ID NO: 1085590 - RNA, 19 nt, Homo sapiens
agacacagccagcaaagac

SEQ ID NO: 1085591 - RNA, 19 nt, Homo sapiens
guccuacaacucugacauu

SEQ ID NO: 1085592 - RNA, 19 nt, Homo sapiens
gcuaugaagaggaggucaa

SEQ ID NO: 1085593 - RNA, 19 nt, Homo sapiens
guggaccuccuguuugaga

SEQ ID NO: 1085594 - RNA, 19 nt, Homo sapiens
ggaggugggaaacaggaau

SEQ ID NO: 1085595 - RNA, 19 nt, Homo sapiens
gauauauccagucauaagc

SEQ ID NO: 1085596 - RNA, 19 nt, Homo sapiens
cacacacaguggauauauc

SEQ ID NO: 1085597 - RNA, 19 nt, Homo sapiens
gacacccgcagcagaaugu

SEQ ID NO: 1085598 - RNA, 19 nt, Homo sapiens
aagcugugaucugaaagga

SEQ ID NO: 1085599 - RNA, 19 nt, Homo sapiens
gucauaagccacccaagag

SEQ ID NO: 1085600 - RNA, 19 nt, Homo sapiens
cgucacacacaguggauau

SEQ ID NO: 1085601 - RNA, 19 nt, Homo sapiens
ggccugggauccauguacu

SEQ ID NO: 1085602 - RNA, 19 nt, Homo sapiens
gcgccaagaccggcuacaa

SEQ ID NO: 1085603 - RNA, 19 nt, Homo sapiens
gcgguggcccuuuauaaaa

SEQ ID NO: 1085604 - RNA, 19 nt, Homo sapiens
ugcgguggcccuuuauaaa

SEQ ID NO: 1085605 - RNA, 19 nt, Homo sapiens
gcacaacuuugccuucuuu

SEQ ID NO: 1085606 - RNA, 19 nt, Homo sapiens
ggacauacgugaccacuca

SEQ ID NO: 1085607 - RNA, 19 nt, Homo sapiens
ggaaggaggugcugagguu

SEQ ID NO: 1085608 - RNA, 19 nt, Homo sapiens
caaaggagcaagaacaaua

SEQ ID NO: 1085609 - RNA, 19 nt, Homo sapiens
ucaagcaggugcccaauuu

SEQ ID NO: 1085610 - RNA, 19 nt, Homo sapiens
gagggaagcugucaaaugg

SEQ ID NO: 1085611 - RNA, 19 nt, Homo sapiens
ugaccuguguguaaauuua

SEQ ID NO: 1085612 - RNA, 19 nt, Homo sapiens
gacaagggcuaccggauug

SEQ ID NO: 1085613 - RNA, 19 nt, Homo sapiens
gagcauggcuaccuguaug

SEQ ID NO: 1085614 - RNA, 19 nt, Homo sapiens
gcugauggccucucuguuu

SEQ ID NO: 1085615 - RNA, 19 nt, Homo sapiens
guaauaaagugggaccauu

SEQ ID NO: 1085616 - RNA, 19 nt, Homo sapiens
gggaagcugucaaauggaa

SEQ ID NO: 1085617 - RNA, 19 nt, Homo sapiens
uaaagacugugccuuggaa

SEQ ID NO: 1085618 - RNA, 19 nt, Homo sapiens
gaaauacuaugagcucaag

SEQ ID NO: 1085619 - RNA, 19 nt, Homo sapiens
gaucauuacuguguccauu

SEQ ID NO: 1085620 - RNA, 19 nt, Homo sapiens
uagcaucacucaauuucuu

SEQ ID NO: 1085621 - RNA, 19 nt, Homo sapiens
guauaggccugaacagugu

SEQ ID NO: 1085622 - RNA, 19 nt, Homo sapiens
gaagcccgaucuuggauuc

SEQ ID NO: 1085623 - RNA, 19 nt, Homo sapiens
ggagggaagcugucaaaug

SEQ ID NO: 1085624 - RNA, 19 nt, Homo sapiens
gacaaaagguccccagaaa

SEQ ID NO: 1085625 - RNA, 19 nt, Homo sapiens
cuacuggaauguuggcuuu

SEQ ID NO: 1085626 - RNA, 19 nt, Homo sapiens
gaccuggguugucugguuu

SEQ ID NO: 1085627 - RNA, 19 nt, Homo sapiens
uuugaaagcuggucaggaa

SEQ ID NO: 1085628 - RNA, 19 nt, Homo sapiens
ccaacgggcuggucagugu

SEQ ID NO: 1085629 - RNA, 19 nt, Homo sapiens
uaauaaagugggaccauuu

SEQ ID NO: 1085630 - RNA, 19 nt, Homo sapiens
ggaucugucuagucaauca

SEQ ID NO: 1085631 - RNA, 19 nt, Homo sapiens
gaugucuacuggaauguug

SEQ ID NO: 1085632 - RNA, 19 nt, Homo sapiens
gugcaugcauguucagguu

SEQ ID NO: 1085633 - RNA, 19 nt, Homo sapiens
acaauaagacccuagagaa

SEQ ID NO: 1085634 - RNA, 19 nt, Homo sapiens
uaggcuacuuccugacuua

SEQ ID NO: 1085635 - RNA, 19 nt, Homo sapiens
ccauugaccuguguguaaa

SEQ ID NO: 1085636 - RNA, 19 nt, Homo sapiens
gaagauugucguauuccaa

SEQ ID NO: 1085637 - RNA, 19 nt, Homo sapiens
ggacuacuccuacauugca

SEQ ID NO: 1085638 - RNA, 19 nt, Homo sapiens
caggaugucuacuggaaug

SEQ ID NO: 1085639 - RNA, 19 nt, Homo sapiens
guacuccucuuugccuuug

SEQ ID NO: 1085640 - RNA, 19 nt, Homo sapiens
ggacuaguguacuccucuu

SEQ ID NO: 1085641 - RNA, 19 nt, Homo sapiens
gagcacaacuuugccuucu

SEQ ID NO: 1085642 - RNA, 19 nt, Homo sapiens
gaaagcuggucaggaaugg

SEQ ID NO: 1085643 - RNA, 19 nt, Homo sapiens
gcccugggaucauuacugu

SEQ ID NO: 1085644 - RNA, 19 nt, Homo sapiens
guccucagguguuugugua

SEQ ID NO: 1085645 - RNA, 19 nt, Homo sapiens
gggauguuccacuaauaua

SEQ ID NO: 1085646 - RNA, 19 nt, Homo sapiens
ccucugagacagcucuuua

SEQ ID NO: 1085647 - RNA, 19 nt, Homo sapiens
ugaccuggguugucugguu

SEQ ID NO: 1085648 - RNA, 19 nt, Homo sapiens
gaacaguguaguggcagua

SEQ ID NO: 1085649 - RNA, 19 nt, Homo sapiens
aaaggagcaagaacaauaa

SEQ ID NO: 1085650 - RNA, 19 nt, Homo sapiens
gaugcugaauccucugaga

SEQ ID NO: 1085651 - RNA, 19 nt, Homo sapiens
gguaacaguccacacaaga

SEQ ID NO: 1085652 - RNA, 19 nt, Homo sapiens
guucuccagucacacgaua

SEQ ID NO: 1085653 - RNA, 19 nt, Homo sapiens
gugcugagguuugcaguca

SEQ ID NO: 1085654 - RNA, 19 nt, Homo sapiens
ccuggcagcugguuacuca

SEQ ID NO: 1085655 - RNA, 19 nt, Homo sapiens
aagugaagauugucguauu

SEQ ID NO: 1085656 - RNA, 19 nt, Homo sapiens
ucauuacuguguccauuau

SEQ ID NO: 1085657 - RNA, 19 nt, Homo sapiens
ccacuccuauuauguacug

SEQ ID NO: 1085658 - RNA, 19 nt, Homo sapiens
ccuuugcccucuuucagua

SEQ ID NO: 1085659 - RNA, 19 nt, Homo sapiens
cuguugagauccuuaaaga

SEQ ID NO: 1085660 - RNA, 19 nt, Homo sapiens
ccucaguccucagguguuu

SEQ ID NO: 1085661 - RNA, 19 nt, Homo sapiens
acacuuggccuucccuuug

SEQ ID NO: 1085662 - RNA, 19 nt, Homo sapiens
uuacucagaagcuuuguuu

SEQ ID NO: 1085663 - RNA, 19 nt, Homo sapiens
guaagugaagauugucgua

SEQ ID NO: 1085664 - RNA, 19 nt, Homo sapiens
cuucugggauguuccacua

SEQ ID NO: 1085665 - RNA, 19 nt, Homo sapiens
ggaaaugaaccgccuuggu

SEQ ID NO: 1085666 - RNA, 19 nt, Homo sapiens
ggaagccgguagaaaugag

SEQ ID NO: 1085667 - RNA, 19 nt, Homo sapiens
uaacaguccacacaagaug

SEQ ID NO: 1085668 - RNA, 19 nt, Homo sapiens
caauaagacccuagagaag

SEQ ID NO: 1085669 - RNA, 19 nt, Homo sapiens
ucaaaggcauuagcugaca

SEQ ID NO: 1085670 - RNA, 19 nt, Homo sapiens
agacaagggcuaccggauu

SEQ ID NO: 1085671 - RNA, 19 nt, Homo sapiens
gguagcaucacucaauuuc

SEQ ID NO: 1085672 - RNA, 19 nt, Homo sapiens
caguguaguggcaguaaua

SEQ ID NO: 1085673 - RNA, 19 nt, Homo sapiens
ccuauuauguacugguuuc

SEQ ID NO: 1085674 - RNA, 19 nt, Homo sapiens
gcuacuuccugacuuacug

SEQ ID NO: 1085675 - RNA, 19 nt, Homo sapiens
gcaaaggagcaagaacaau

SEQ ID NO: 1085676 - RNA, 19 nt, Homo sapiens
gaaccgccuuggugcuucu

SEQ ID NO: 1085677 - RNA, 19 nt, Homo sapiens
aauggaagccgguagaaau

SEQ ID NO: 1085678 - RNA, 19 nt, Homo sapiens
gaccuguguguaaauuuaa

SEQ ID NO: 1085679 - RNA, 19 nt, Homo sapiens
gcaugcauguucagguucu

SEQ ID NO: 1085680 - RNA, 19 nt, Homo sapiens
gauguuccacuaauauaca

SEQ ID NO: 1085681 - RNA, 19 nt, Homo sapiens
gaaggaggugcugagguuu

SEQ ID NO: 1085682 - RNA, 19 nt, Homo sapiens
ugucguauuccaagucuaa

SEQ ID NO: 1085683 - RNA, 19 nt, Homo sapiens
caaaagguccccagaaauc

SEQ ID NO: 1085684 - RNA, 19 nt, Homo sapiens
ugagauccuuaaagacugu

SEQ ID NO: 1085685 - RNA, 19 nt, Homo sapiens
aagagccgcuguugagauc

SEQ ID NO: 1085686 - RNA, 19 nt, Homo sapiens
ccuccacuccuauuaugua

SEQ ID NO: 1085687 - RNA, 19 nt, Homo sapiens
cugggauguuccacuaaua

SEQ ID NO: 1085688 - RNA, 19 nt, Homo sapiens
guguaaauuucaucaaagg

SEQ ID NO: 1085689 - RNA, 19 nt, Homo sapiens
ucaaauggaagccgguaga

SEQ ID NO: 1085690 - RNA, 19 nt, Homo sapiens
caagagccgcuguugagau

SEQ ID NO: 1085691 - RNA, 19 nt, Homo sapiens
ucgguagcaucacucaauu

SEQ ID NO: 1085692 - RNA, 19 nt, Homo sapiens
ccucuucaaugccaucauc

SEQ ID NO: 1085693 - RNA, 19 nt, Homo sapiens
guaacaguccacacaagau

SEQ ID NO: 1085694 - RNA, 19 nt, Homo sapiens
gauacauucuaggcuacuu

SEQ ID NO: 1085695 - RNA, 19 nt, Homo sapiens
guugagauccuuaaagacu

SEQ ID NO: 1085696 - RNA, 19 nt, Homo sapiens
ucacugggaugcugaacac

SEQ ID NO: 1085697 - RNA, 19 nt, Homo sapiens
gaacaauaagacccuagag

SEQ ID NO: 1085698 - RNA, 19 nt, Homo sapiens
acacuugggcugcaaagga

SEQ ID NO: 1085699 - RNA, 19 nt, Homo sapiens
ugucuagucaaucaacaua

SEQ ID NO: 1085700 - RNA, 19 nt, Homo sapiens
ugaaagcuggucaggaaug

SEQ ID NO: 1085701 - RNA, 19 nt, Homo sapiens
ggucugugcaugcauguuc

SEQ ID NO: 1085702 - RNA, 19 nt, Homo sapiens
gagaagcccgaucuuggau

SEQ ID NO: 1085703 - RNA, 19 nt, Homo sapiens
ggagcaagaacaauaagac

SEQ ID NO: 1085704 - RNA, 19 nt, Homo sapiens
caaauggaagccgguagaa

SEQ ID NO: 1085705 - RNA, 19 nt, Homo sapiens
gaaagagguucagaaauuu

SEQ ID NO: 1085706 - RNA, 19 nt, Homo sapiens
gaaaguaaaugcuaagacu

SEQ ID NO: 1085707 - RNA, 19 nt, Homo sapiens
gaaauuugcccuaugucua

SEQ ID NO: 1085708 - RNA, 19 nt, Homo sapiens
uaacagcccuuucaugaag

SEQ ID NO: 1085709 - RNA, 19 nt, Homo sapiens
gagacacacugcccauuga

SEQ ID NO: 1085710 - RNA, 19 nt, Homo sapiens
agaaagcggugaagcagaa

SEQ ID NO: 1085711 - RNA, 19 nt, Homo sapiens
uaaaggcuguuccaagaau

SEQ ID NO: 1085712 - RNA, 19 nt, Homo sapiens
acuaaaggcuguuccaaga

SEQ ID NO: 1085713 - RNA, 19 nt, Homo sapiens
gccauuuccuguagaacua

SEQ ID NO: 1085714 - RNA, 19 nt, Homo sapiens
ggaccgaaauuugcccuau

SEQ ID NO: 1085715 - RNA, 19 nt, Homo sapiens
ggagacacacugcccauug

SEQ ID NO: 1085716 - RNA, 19 nt, Homo sapiens
ucuaacagcccuuucauga

SEQ ID NO: 1085717 - RNA, 19 nt, Homo sapiens
cuacaaaugcaucaagaaa

SEQ ID NO: 1085718 - RNA, 19 nt, Homo sapiens
gacggcaucuucccaguuc

SEQ ID NO: 1085719 - RNA, 19 nt, Homo sapiens
guucagaaauuugucaaca

SEQ ID NO: 1085720 - RNA, 19 nt, Homo sapiens
ccaggaggcuuacgaugag

SEQ ID NO: 1085721 - RNA, 19 nt, Homo sapiens
gaccgaaauuugcccuaug

SEQ ID NO: 1085722 - RNA, 19 nt, Homo sapiens
gaggaugaccuggaaguga

SEQ ID NO: 1085723 - RNA, 19 nt, Homo sapiens
acaaaugcaucaagaaagc

SEQ ID NO: 1085724 - RNA, 19 nt, Homo sapiens
ucagugccauuuccuguag

SEQ ID NO: 1085725 - RNA, 19 nt, Homo sapiens
aaauuugcccuaugucuau

SEQ ID NO: 1085726 - RNA, 19 nt, Homo sapiens
aggaguaccaggaggcuua

SEQ ID NO: 1085727 - RNA, 19 nt, Homo sapiens
ucaagaaagcggugaagca

SEQ ID NO: 1085728 - RNA, 19 nt, Homo sapiens
cuaacagcccuuucaugaa

SEQ ID NO: 1085729 - RNA, 19 nt, Homo sapiens
ugaagguaaugcuagucuu

SEQ ID NO: 1085730 - RNA, 19 nt, Homo sapiens
ucaugaagguaaugcuagu

SEQ ID NO: 1085731 - RNA, 19 nt, Homo sapiens
aggaugaccuggaagugau

SEQ ID NO: 1085732 - RNA, 19 nt, Homo sapiens
ccaccugugugauaauggu

SEQ ID NO: 1085733 - RNA, 19 nt, Homo sapiens
ggaaaguaaaugcuaagac

SEQ ID NO: 1085734 - RNA, 19 nt, Homo sapiens
aaagagguucagaaauuug

SEQ ID NO: 1085735 - RNA, 19 nt, Homo sapiens
cuaaaggcuguuccaagaa

SEQ ID NO: 1085736 - RNA, 19 nt, Homo sapiens
ccacacugacggcaucuuc

SEQ ID NO: 1085737 - RNA, 19 nt, Homo sapiens
aaaggcuguuccaagaaug

SEQ ID NO: 1085738 - RNA, 19 nt, Homo sapiens
gcuagucuucuguccauca

SEQ ID NO: 1085739 - RNA, 19 nt, Homo sapiens
gguaaugcuagucuucugu

SEQ ID NO: 1085740 - RNA, 19 nt, Homo sapiens
cgaaauuugcccuaugucu

SEQ ID NO: 1085741 - RNA, 19 nt, Homo sapiens
gggaaaguaaaugcuaaga

SEQ ID NO: 1085742 - RNA, 19 nt, Homo sapiens
accgaaauuugcccuaugu

SEQ ID NO: 1085743 - RNA, 19 nt, Homo sapiens
ugugugaggaccgaaauuu

SEQ ID NO: 1085744 - RNA, 19 nt, Homo sapiens
aauuugcccuaugucuaua

SEQ ID NO: 1085745 - RNA, 19 nt, Homo sapiens
accaggaggcuuacgauga

SEQ ID NO: 1085746 - RNA, 19 nt, Homo sapiens
gugugaggaccgaaauuug

SEQ ID NO: 1085747 - RNA, 19 nt, Homo sapiens
gagguucagaaauuuguca

SEQ ID NO: 1085748 - RNA, 19 nt, Homo sapiens
ggaggucaguucagaaaua

SEQ ID NO: 1085749 - RNA, 19 nt, Homo sapiens
ugaggaaucuuuguacuua

SEQ ID NO: 1085750 - RNA, 19 nt, Homo sapiens
ccaaagugcugggauuaua

SEQ ID NO: 1085751 - RNA, 19 nt, Homo sapiens
ugauguacaugcaagauua

SEQ ID NO: 1085752 - RNA, 19 nt, Homo sapiens
gucaagaggucaaggugua

SEQ ID NO: 1085753 - RNA, 19 nt, Homo sapiens
gagggcagcuuuagaccuu

SEQ ID NO: 1085754 - RNA, 19 nt, Homo sapiens
ucaaguagcugggauuaca

SEQ ID NO: 1085755 - RNA, 19 nt, Homo sapiens
gcagugaggaaucuuugua

SEQ ID NO: 1085756 - RNA, 19 nt, Homo sapiens
caaggaugauuuucuguua

SEQ ID NO: 1085757 - RNA, 19 nt, Homo sapiens
aacuagagcuuucaccuuu

SEQ ID NO: 1085758 - RNA, 19 nt, Homo sapiens
gagcuggucucccaugagu

SEQ ID NO: 1085759 - RNA, 19 nt, Homo sapiens
gaggaaucuuuguacuuaa

SEQ ID NO: 1085760 - RNA, 19 nt, Homo sapiens
ucacugcccuucaacuaga

SEQ ID NO: 1085761 - RNA, 19 nt, Homo sapiens
gaggucaguucagaaauau

SEQ ID NO: 1085762 - RNA, 19 nt, Homo sapiens
gagcuucauuuccuucaag

SEQ ID NO: 1085763 - RNA, 19 nt, Homo sapiens
caugaggccuggaccuaug

SEQ ID NO: 1085764 - RNA, 19 nt, Homo sapiens
gccuggaucuguuuucuua

SEQ ID NO: 1085765 - RNA, 19 nt, Homo sapiens
caacuagagcuuucaccuu

SEQ ID NO: 1085766 - RNA, 19 nt, Homo sapiens
cugugucacugucacuuua

SEQ ID NO: 1085767 - RNA, 19 nt, Homo sapiens
ggaaggggcuguugguaca

SEQ ID NO: 1085768 - RNA, 19 nt, Homo sapiens
gaaggacacaaaucugcuu

SEQ ID NO: 1085769 - RNA, 19 nt, Homo sapiens
guacaaggaugauuuucug

SEQ ID NO: 1085770 - RNA, 19 nt, Homo sapiens
ugacgcacgugauguacau

SEQ ID NO: 1085771 - RNA, 19 nt, Homo sapiens
cccaagggcucaccuaacu

SEQ ID NO: 1085772 - RNA, 19 nt, Homo sapiens
ggagcuucauuuccuucaa

SEQ ID NO: 1085773 - RNA, 19 nt, Homo sapiens
guacaugcaagauuauugg

SEQ ID NO: 1085774 - RNA, 19 nt, Homo sapiens
guugguacaaggaugauuu

SEQ ID NO: 1085775 - RNA, 19 nt, Homo sapiens
acacacacaggcauccaua

SEQ ID NO: 1085776 - RNA, 19 nt, Homo sapiens
cagagcuggucucccauga

SEQ ID NO: 1085777 - RNA, 19 nt, Homo sapiens
caaagugcugggauuauag

SEQ ID NO: 1085778 - RNA, 19 nt, Homo sapiens
gggcugacuuugcugacau

SEQ ID NO: 1085779 - RNA, 19 nt, Homo sapiens
ccagaacuguggcagaaaa

SEQ ID NO: 1085780 - RNA, 19 nt, Homo sapiens
ggucaguucagaaauaucu

SEQ ID NO: 1085781 - RNA, 19 nt, Homo sapiens
gcacgugauguacaugcaa

SEQ ID NO: 1085782 - RNA, 19 nt, Homo sapiens
gugaggaaucuuuguacuu

SEQ ID NO: 1085783 - RNA, 19 nt, Homo sapiens
ucagcauccucagcgauuu

SEQ ID NO: 1085784 - RNA, 19 nt, Homo sapiens
ucucacugcccuucaacua

SEQ ID NO: 1085785 - RNA, 19 nt, Homo sapiens
cauaguagaggcuggaaag

SEQ ID NO: 1085786 - RNA, 19 nt, Homo sapiens
gcuggucucccaugagugu

SEQ ID NO: 1085787 - RNA, 19 nt, Homo sapiens
gauguacaugcaagauuau

SEQ ID NO: 1085788 - RNA, 19 nt, Homo sapiens
ucacagaccccaccagcua

SEQ ID NO: 1085789 - RNA, 19 nt, Homo sapiens
cuuccaaagugcugggauu

SEQ ID NO: 1085790 - RNA, 19 nt, Homo sapiens
gccaucacccggcaucaga

SEQ ID NO: 1085791 - RNA, 19 nt, Homo sapiens
ggccagggcaacaaaguca

SEQ ID NO: 1085792 - RNA, 19 nt, Homo sapiens
cagcggccauuuguaucaa

SEQ ID NO: 1085793 - RNA, 19 nt, Homo sapiens
ucacugucacuuuagcaaa

SEQ ID NO: 1085794 - RNA, 19 nt, Homo sapiens
gcuguugguacaaggauga

SEQ ID NO: 1085795 - RNA, 19 nt, Homo sapiens
gugauguacaugcaagauu

SEQ ID NO: 1085796 - RNA, 19 nt, Homo sapiens
ucucaaguagcugggauua

SEQ ID NO: 1085797 - RNA, 19 nt, Homo sapiens
ccagagggcagcuuuagac

SEQ ID NO: 1085798 - RNA, 19 nt, Homo sapiens
gccaugaggccuggaccua

SEQ ID NO: 1085799 - RNA, 19 nt, Homo sapiens
ccucccagguucaagcaau

SEQ ID NO: 1085800 - RNA, 19 nt, Homo sapiens
gcccugcguuuccauucug

SEQ ID NO: 1085801 - RNA, 19 nt, Homo sapiens
cuuuagaccuuuucaaaug

SEQ ID NO: 1085802 - RNA, 19 nt, Homo sapiens
gaaaccugagugugguaga

SEQ ID NO: 1085803 - RNA, 19 nt, Homo sapiens
cuaccgggcugacuuugcu

SEQ ID NO: 1085804 - RNA, 19 nt, Homo sapiens
acacacaggcauccauaca

SEQ ID NO: 1085805 - RNA, 19 nt, Homo sapiens
aggaaucuuuguacuuaag

SEQ ID NO: 1085806 - RNA, 19 nt, Homo sapiens
ggcaucagagccucacaga

SEQ ID NO: 1085807 - RNA, 19 nt, Homo sapiens
gccucagccuuccaaagug

SEQ ID NO: 1085808 - RNA, 19 nt, Homo sapiens
gugcaguagugcgaucuca

SEQ ID NO: 1085809 - RNA, 19 nt, Homo sapiens
caggaacgcuggaaaguga

SEQ ID NO: 1085810 - RNA, 19 nt, Homo sapiens
ccaaguagcugggauuaca

SEQ ID NO: 1085811 - RNA, 19 nt, Homo sapiens
gaaaacaucccaguccuua

SEQ ID NO: 1085812 - RNA, 19 nt, Homo sapiens
gagcugcccacacuguaua

SEQ ID NO: 1085813 - RNA, 19 nt, Homo sapiens
gcuggaaagugacauugug

SEQ ID NO: 1085814 - RNA, 19 nt, Homo sapiens
uagcugggauuacagaagu

SEQ ID NO: 1085815 - RNA, 19 nt, Homo sapiens
ggaaagugacauuguguac

SEQ ID NO: 1085816 - RNA, 19 nt, Homo sapiens
cuagaggccuucgucaaga

SEQ ID NO: 1085817 - RNA, 19 nt, Homo sapiens
gaaagugacauuguguaca

SEQ ID NO: 1085818 - RNA, 19 nt, Homo sapiens
gcuagaggccuucgucaag

SEQ ID NO: 1085819 - RNA, 19 nt, Homo sapiens
aaagugacauuguguacac

SEQ ID NO: 1085820 - RNA, 19 nt, Homo sapiens
aggccaaacugacagaaau

SEQ ID NO: 1085821 - RNA, 19 nt, Homo sapiens
aaacaucccaguccuuaag

SEQ ID NO: 1085822 - RNA, 19 nt, Homo sapiens
cguacgagcugcccacacu

SEQ ID NO: 1085823 - RNA, 19 nt, Homo sapiens
uagaggccuucgucaagau

SEQ ID NO: 1085824 - RNA, 19 nt, Homo sapiens
uguauaggacggaggacua

SEQ ID NO: 1085825 - RNA, 19 nt, Homo sapiens
caaaguggaccggcuagag

SEQ ID NO: 1085826 - RNA, 19 nt, Homo sapiens
guccuuaaggccaaacuga

SEQ ID NO: 1085827 - RNA, 19 nt, Homo sapiens
caucaggaacgcuggaaag

SEQ ID NO: 1085828 - RNA, 19 nt, Homo sapiens
uggaaagugacauugugua

SEQ ID NO: 1085829 - RNA, 19 nt, Homo sapiens
ggccaaacugacagaaaug

SEQ ID NO: 1085830 - RNA, 19 nt, Homo sapiens
ugccuccgccucccaagua

SEQ ID NO: 1085831 - RNA, 19 nt, Homo sapiens
ccucaggcuggaagaguuu

SEQ ID NO: 1085832 - RNA, 19 nt, Homo sapiens
gaacuaagucuuucuguua

SEQ ID NO: 1085833 - RNA, 19 nt, Homo sapiens
ggccaaagauguaauuuaa

SEQ ID NO: 1085834 - RNA, 19 nt, Homo sapiens
gaagaucacucgucgcuau

SEQ ID NO: 1085835 - RNA, 19 nt, Homo sapiens
gaacguggcuccuaaacuc

SEQ ID NO: 1085836 - RNA, 19 nt, Homo sapiens
ccaaagugcugggauuaua

SEQ ID NO: 1085837 - RNA, 19 nt, Homo sapiens
ccaaggaacugaacuaagu

SEQ ID NO: 1085838 - RNA, 19 nt, Homo sapiens
gaacugaacuaagucuuuc

SEQ ID NO: 1085839 - RNA, 19 nt, Homo sapiens
gagcaagacuggagaaugg

SEQ ID NO: 1085840 - RNA, 19 nt, Homo sapiens
aaacugcacuuucuuugaa

SEQ ID NO: 1085841 - RNA, 19 nt, Homo sapiens
ucagggagcagcccauuua

SEQ ID NO: 1085842 - RNA, 19 nt, Homo sapiens
gaaccuggccucaguuuag

SEQ ID NO: 1085843 - RNA, 19 nt, Homo sapiens
gcagaacaaacuacacuuu

SEQ ID NO: 1085844 - RNA, 19 nt, Homo sapiens
auacacaucuuucuuggaa

SEQ ID NO: 1085845 - RNA, 19 nt, Homo sapiens
ggaacugaacuaagucuuu

SEQ ID NO: 1085846 - RNA, 19 nt, Homo sapiens
ccagaaaccacgaauaaga

SEQ ID NO: 1085847 - RNA, 19 nt, Homo sapiens
gauggaaccuggccucagu

SEQ ID NO: 1085848 - RNA, 19 nt, Homo sapiens
cagcaugggcgauaucuuu

SEQ ID NO: 1085849 - RNA, 19 nt, Homo sapiens
gggaaggucauccaaguuu

SEQ ID NO: 1085850 - RNA, 19 nt, Homo sapiens
cgaauaagaauggaaauga

SEQ ID NO: 1085851 - RNA, 19 nt, Homo sapiens
gcacaaagccaaggaacug

SEQ ID NO: 1085852 - RNA, 19 nt, Homo sapiens
ucaaagggcccaagggaaa

SEQ ID NO: 1085853 - RNA, 19 nt, Homo sapiens
ggaggaaauagacuucuuu

SEQ ID NO: 1085854 - RNA, 19 nt, Homo sapiens
uagaacagcuagaaauagu

SEQ ID NO: 1085855 - RNA, 19 nt, Homo sapiens
gcgccacuaugcccagaua

SEQ ID NO: 1085856 - RNA, 19 nt, Homo sapiens
gaauaagaauggaaaugac

SEQ ID NO: 1085857 - RNA, 19 nt, Homo sapiens
gaacagcuagaaauaguag

SEQ ID NO: 1085858 - RNA, 19 nt, Homo sapiens
gaaagaccuucaguguaga

SEQ ID NO: 1085859 - RNA, 19 nt, Homo sapiens
ucugugcacuuuacucuuu

SEQ ID NO: 1085860 - RNA, 19 nt, Homo sapiens
gaccgagacuuuccuugga

SEQ ID NO: 1085861 - RNA, 19 nt, Homo sapiens
acacugauaguuugucaua

SEQ ID NO: 1085862 - RNA, 19 nt, Homo sapiens
ucuguuaaguccugaguuu

SEQ ID NO: 1085863 - RNA, 19 nt, Homo sapiens
auagauaguuugagcaaga

SEQ ID NO: 1085864 - RNA, 19 nt, Homo sapiens
ggaguucugugcacuuuac

SEQ ID NO: 1085865 - RNA, 19 nt, Homo sapiens
ucacagggaucaguguuug

SEQ ID NO: 1085866 - RNA, 19 nt, Homo sapiens
ggaaggucauccaaguuuc

SEQ ID NO: 1085867 - RNA, 19 nt, Homo sapiens
ccauagguaaugaaucuua

SEQ ID NO: 1085868 - RNA, 19 nt, Homo sapiens
caaagggacuggucaucuc

SEQ ID NO: 1085869 - RNA, 19 nt, Homo sapiens
ugaacuaagucuuucuguu

SEQ ID NO: 1085870 - RNA, 19 nt, Homo sapiens
ccugagaucugggcauaaa

SEQ ID NO: 1085871 - RNA, 19 nt, Homo sapiens
cauaagaaguaccauggau

SEQ ID NO: 1085872 - RNA, 19 nt, Homo sapiens
gaauggacaacacuaugaa

SEQ ID NO: 1085873 - RNA, 19 nt, Homo sapiens
gggaggaaauagacuucuu

SEQ ID NO: 1085874 - RNA, 19 nt, Homo sapiens
agacaggguuucaccaugu

SEQ ID NO: 1085875 - RNA, 19 nt, Homo sapiens
cagaaaccacgaauaagaa

SEQ ID NO: 1085876 - RNA, 19 nt, Homo sapiens
aaccagaaaccacgaauaa

SEQ ID NO: 1085877 - RNA, 19 nt, Homo sapiens
ccaggcaacagcaacaaua

SEQ ID NO: 1085878 - RNA, 19 nt, Homo sapiens
gaaaccauagguaaugaau

SEQ ID NO: 1085879 - RNA, 19 nt, Homo sapiens
cagagaagcaggagauguu

SEQ ID NO: 1085880 - RNA, 19 nt, Homo sapiens
gauuugguuuguucccuuu

SEQ ID NO: 1085881 - RNA, 19 nt, Homo sapiens
ccacuaugcccagauaauu

SEQ ID NO: 1085882 - RNA, 19 nt, Homo sapiens
ggagaauggacaacacuau

SEQ ID NO: 1085883 - RNA, 19 nt, Homo sapiens
uaugucaccuucgccguua

SEQ ID NO: 1085884 - RNA, 19 nt, Homo sapiens
caccgugccuggccaaaga

SEQ ID NO: 1085885 - RNA, 19 nt, Homo sapiens
ccacgaauaagaauggaaa

SEQ ID NO: 1085886 - RNA, 19 nt, Homo sapiens
gagaauggacaacacuaug

SEQ ID NO: 1085887 - RNA, 19 nt, Homo sapiens
gugcugcccuagacucuga

SEQ ID NO: 1085888 - RNA, 19 nt, Homo sapiens
ggagccagcgugagacuga

SEQ ID NO: 1085889 - RNA, 19 nt, Homo sapiens
ggugagcuauagaggagaa

SEQ ID NO: 1085890 - RNA, 19 nt, Homo sapiens
ugaauguacucuggucuug

SEQ ID NO: 1085891 - RNA, 19 nt, Homo sapiens
cagggaaggucauccaagu

SEQ ID NO: 1085892 - RNA, 19 nt, Homo sapiens
gagugugcaucacgguaaa

SEQ ID NO: 1085893 - RNA, 19 nt, Homo sapiens
aaccauagguaaugaaucu

SEQ ID NO: 1085894 - RNA, 19 nt, Homo sapiens
ggaaccuggccucaguuua

SEQ ID NO: 1085895 - RNA, 19 nt, Homo sapiens
guaggauccugaccaucuu

SEQ ID NO: 1085896 - RNA, 19 nt, Homo sapiens
ggaaguuucuaggucuuuc

SEQ ID NO: 1085897 - RNA, 19 nt, Homo sapiens
caucagacccacacuguca

SEQ ID NO: 1085898 - RNA, 19 nt, Homo sapiens
ggcaacagcaacaauauuc

SEQ ID NO: 1085899 - RNA, 19 nt, Homo sapiens
ucacauucacgagucauua

SEQ ID NO: 1085900 - RNA, 19 nt, Homo sapiens
gcagugugccaccgucauu

SEQ ID NO: 1085901 - RNA, 19 nt, Homo sapiens
gacaggguuucaccauguu

SEQ ID NO: 1085902 - RNA, 19 nt, Homo sapiens
uguguagucucuccgcuuu

SEQ ID NO: 1085903 - RNA, 19 nt, Homo sapiens
cuucuuccuucauacauuu

SEQ ID NO: 1085904 - RNA, 19 nt, Homo sapiens
gaggaaauagacuucuuug

SEQ ID NO: 1085905 - RNA, 19 nt, Homo sapiens
gggcauaaaguggaugaaa

SEQ ID NO: 1085906 - RNA, 19 nt, Homo sapiens
acauguaucccauuccuuu

SEQ ID NO: 1085907 - RNA, 19 nt, Homo sapiens
ccaaguaucccugcucuca

SEQ ID NO: 1085908 - RNA, 19 nt, Homo sapiens
gguaggauccugaccaucu

SEQ ID NO: 1085909 - RNA, 19 nt, Homo sapiens
cggaccugcugaaagauuu

SEQ ID NO: 1085910 - RNA, 19 nt, Homo sapiens
ggcauaaaguggaugaaac

SEQ ID NO: 1085911 - RNA, 19 nt, Homo sapiens
ucucugcccuugcuucaug

SEQ ID NO: 1085912 - RNA, 19 nt, Homo sapiens
ggagagggaaucgcuguug

SEQ ID NO: 1085913 - RNA, 19 nt, Homo sapiens
gggagcagcccauuuaggu

SEQ ID NO: 1085914 - RNA, 19 nt, Homo sapiens
acccggaccugcugaaaga

SEQ ID NO: 1085915 - RNA, 19 nt, Homo sapiens
gaaaccacgaauaagaaug

SEQ ID NO: 1085916 - RNA, 19 nt, Homo sapiens
cuucuggacucuucucuca

SEQ ID NO: 1085917 - RNA, 19 nt, Homo sapiens
cuaugaagcuguggcuaga

SEQ ID NO: 1085918 - RNA, 19 nt, Homo sapiens
gcauaaaguggaugaaacu

SEQ ID NO: 1085919 - RNA, 19 nt, Homo sapiens
ccgagucucucccaguaga

SEQ ID NO: 1085920 - RNA, 19 nt, Homo sapiens
gcagugccaggccuugauu

SEQ ID NO: 1085921 - RNA, 19 nt, Homo sapiens
aaaccagaaaccacgaaua

SEQ ID NO: 1085922 - RNA, 19 nt, Homo sapiens
agaauggacaacacuauga

SEQ ID NO: 1085923 - RNA, 19 nt, Homo sapiens
uccaaucucuuccaaccuu

SEQ ID NO: 1085924 - RNA, 19 nt, Homo sapiens
ggacugcagcacugagaug

SEQ ID NO: 1085925 - RNA, 19 nt, Homo sapiens
ccuggaggcucacuucaca

SEQ ID NO: 1085926 - RNA, 19 nt, Homo sapiens
gucauuggcuuuucuuauu

SEQ ID NO: 1085927 - RNA, 19 nt, Homo sapiens
uggccaaagauguaauuua

SEQ ID NO: 1085928 - RNA, 19 nt, Homo sapiens
ccugaggaccuguacauga

SEQ ID NO: 1085929 - RNA, 19 nt, Homo sapiens
ccaaucucuuccaaccuuu

SEQ ID NO: 1085930 - RNA, 19 nt, Homo sapiens
ucacucuggucaccuuguu

SEQ ID NO: 1085931 - RNA, 19 nt, Homo sapiens
caacagcaacaauauucug

SEQ ID NO: 1085932 - RNA, 19 nt, Homo sapiens
gcaaagagguccagguuau

SEQ ID NO: 1085933 - RNA, 19 nt, Homo sapiens
ucacaaagcuucuccaaga

SEQ ID NO: 1085934 - RNA, 19 nt, Homo sapiens
gacaauaggugcagguaua

SEQ ID NO: 1085935 - RNA, 19 nt, Homo sapiens
gcacaagcguuuacagaaa

SEQ ID NO: 1085936 - RNA, 19 nt, Homo sapiens
aaggaaaccucuaucauua

SEQ ID NO: 1085937 - RNA, 19 nt, Homo sapiens
acaaugagcuucuggauga

SEQ ID NO: 1085938 - RNA, 19 nt, Homo sapiens
ucaauaagcugcuggaaga

SEQ ID NO: 1085939 - RNA, 19 nt, Homo sapiens
gaaugaaguuccuguguga

SEQ ID NO: 1085940 - RNA, 19 nt, Homo sapiens
ggaagcaacugguagaaau

SEQ ID NO: 1085941 - RNA, 19 nt, Homo sapiens
gauccugugugaacaaaua

SEQ ID NO: 1085942 - RNA, 19 nt, Homo sapiens
ggaccuuuguuccauauuu

SEQ ID NO: 1085943 - RNA, 19 nt, Homo sapiens
uaacguaucugacccuuca

SEQ ID NO: 1085944 - RNA, 19 nt, Homo sapiens
gagugaagaugcuguuuga

SEQ ID NO: 1085945 - RNA, 19 nt, Homo sapiens
gaaauaucccugcacuuaa

SEQ ID NO: 1085946 - RNA, 19 nt, Homo sapiens
aaucaagccuguuguguuu

SEQ ID NO: 1085947 - RNA, 19 nt, Homo sapiens
ucacaagacuguaacguau

SEQ ID NO: 1085948 - RNA, 19 nt, Homo sapiens
gaaaggccuucuucucaug

SEQ ID NO: 1085949 - RNA, 19 nt, Homo sapiens
ggaccuugcugcuguguug

SEQ ID NO: 1085950 - RNA, 19 nt, Homo sapiens
gcaaugaccaggaugauau

SEQ ID NO: 1085951 - RNA, 19 nt, Homo sapiens
gaagagagccaaggaguug

SEQ ID NO: 1085952 - RNA, 19 nt, Homo sapiens
agaaauaucccugcacuua

SEQ ID NO: 1085953 - RNA, 19 nt, Homo sapiens
ugaccaggaugauauguuu

SEQ ID NO: 1085954 - RNA, 19 nt, Homo sapiens
gcacuuaaaugcaguagac

SEQ ID NO: 1085955 - RNA, 19 nt, Homo sapiens
aaauaucccugcacuuaaa

SEQ ID NO: 1085956 - RNA, 19 nt, Homo sapiens
ggaugagggugcuaaguug

SEQ ID NO: 1085957 - RNA, 19 nt, Homo sapiens
ggugauggcucaguucaaa

SEQ ID NO: 1085958 - RNA, 19 nt, Homo sapiens
ggaaaccacugugcaacuu

SEQ ID NO: 1085959 - RNA, 19 nt, Homo sapiens
gaacaaauagccucugaca

SEQ ID NO: 1085960 - RNA, 19 nt, Homo sapiens
ccacaacugauuauugaua

SEQ ID NO: 1085961 - RNA, 19 nt, Homo sapiens
aaaggaaaccucuaucauu

SEQ ID NO: 1085962 - RNA, 19 nt, Homo sapiens
gaauguaaccugcgauauc

SEQ ID NO: 1085963 - RNA, 19 nt, Homo sapiens
ggacggaccuuuguuccau

SEQ ID NO: 1085964 - RNA, 19 nt, Homo sapiens
gaaagaacgaccaccucua

SEQ ID NO: 1085965 - RNA, 19 nt, Homo sapiens
gaaacgaaaggaaauguca

SEQ ID NO: 1085966 - RNA, 19 nt, Homo sapiens
ggaaaccucuaucauuagg

SEQ ID NO: 1085967 - RNA, 19 nt, Homo sapiens
aaauaaaggugagagcauu

SEQ ID NO: 1085968 - RNA, 19 nt, Homo sapiens
guaaaccucuccgacaaug

SEQ ID NO: 1085969 - RNA, 19 nt, Homo sapiens
gcguaaaccucuccgacaa

SEQ ID NO: 1085970 - RNA, 19 nt, Homo sapiens
gugaagaugcuguuugaaa

SEQ ID NO: 1085971 - RNA, 19 nt, Homo sapiens
acaagaugcugaucccauu

SEQ ID NO: 1085972 - RNA, 19 nt, Homo sapiens
gggugaaguuucuguguga

SEQ ID NO: 1085973 - RNA, 19 nt, Homo sapiens
ggacaucaaacaggaauug

SEQ ID NO: 1085974 - RNA, 19 nt, Homo sapiens
gaaugucacugcgucugaa

SEQ ID NO: 1085975 - RNA, 19 nt, Homo sapiens
gcagguauauauugaagac

SEQ ID NO: 1085976 - RNA, 19 nt, Homo sapiens
gaaauccucaccacccauu

SEQ ID NO: 1085977 - RNA, 19 nt, Homo sapiens
gaaauaaaggugagagcau

SEQ ID NO: 1085978 - RNA, 19 nt, Homo sapiens
gugaacaaauagccucuga

SEQ ID NO: 1085979 - RNA, 19 nt, Homo sapiens
gaccuuuguuccauauuug

SEQ ID NO: 1085980 - RNA, 19 nt, Homo sapiens
ggaggagccgaucuacaua

SEQ ID NO: 1085981 - RNA, 19 nt, Homo sapiens
aggaggagcuggugaagga

SEQ ID NO: 1085982 - RNA, 19 nt, Homo sapiens
uuugaaaccuugacauguu

SEQ ID NO: 1085983 - RNA, 19 nt, Homo sapiens
cacacgagcuccagaagau

SEQ ID NO: 1085984 - RNA, 19 nt, Homo sapiens
uaguaaggauccuguguga

SEQ ID NO: 1085985 - RNA, 19 nt, Homo sapiens
gaugcgacauaaguuguaa

SEQ ID NO: 1085986 - RNA, 19 nt, Homo sapiens
ggacaaccucauccacaaa

SEQ ID NO: 1085987 - RNA, 19 nt, Homo sapiens
acccacaacugauuauuga

SEQ ID NO: 1085988 - RNA, 19 nt, Homo sapiens
gaggagccgaucuacauaa

SEQ ID NO: 1085989 - RNA, 19 nt, Homo sapiens
uuacagaaacgaaaggaaa

SEQ ID NO: 1085990 - RNA, 19 nt, Homo sapiens
cugcagaccuuggugcuuu

SEQ ID NO: 1085991 - RNA, 19 nt, Homo sapiens
ggccacaccugggacauug

SEQ ID NO: 1085992 - RNA, 19 nt, Homo sapiens
ggagugaagaugcuguuug

SEQ ID NO: 1085993 - RNA, 19 nt, Homo sapiens
aaaccacugugcaacuuga

SEQ ID NO: 1085994 - RNA, 19 nt, Homo sapiens
gcacacgagcuccagaaga

SEQ ID NO: 1085995 - RNA, 19 nt, Homo sapiens
guaaggauccugugugaac

SEQ ID NO: 1085996 - RNA, 19 nt, Homo sapiens
gacggaccuuuguuccaua

SEQ ID NO: 1085997 - RNA, 19 nt, Homo sapiens
ucacggguauauugagaga

SEQ ID NO: 1085998 - RNA, 19 nt, Homo sapiens
uaucacggguauauugaga

SEQ ID NO: 1085999 - RNA, 19 nt, Homo sapiens
ggaaaacugucaccuuaca

SEQ ID NO: 1086000 - RNA, 19 nt, Homo sapiens
uaaaugcaguagacguugu

SEQ ID NO: 1086001 - RNA, 19 nt, Homo sapiens
ucucagugccucccuagua

SEQ ID NO: 1086002 - RNA, 19 nt, Homo sapiens
gguauauauugaagacgaa

SEQ ID NO: 1086003 - RNA, 19 nt, Homo sapiens
ugaaucacauaggaguuaa

SEQ ID NO: 1086004 - RNA, 19 nt, Homo sapiens
ugagcaaguucaaguaucu

SEQ ID NO: 1086005 - RNA, 19 nt, Homo sapiens
gagggccuauuuccugaga

SEQ ID NO: 1086006 - RNA, 19 nt, Homo sapiens
acggguauauugagagaaa

SEQ ID NO: 1086007 - RNA, 19 nt, Homo sapiens
guucauugcugggcuagau

SEQ ID NO: 1086008 - RNA, 19 nt, Homo sapiens
gaaaccacugugcaacuug

SEQ ID NO: 1086009 - RNA, 19 nt, Homo sapiens
cagaauguaaccugcgaua

SEQ ID NO: 1086010 - RNA, 19 nt, Homo sapiens
ugauauguuucccgcauug

SEQ ID NO: 1086011 - RNA, 19 nt, Homo sapiens
gaaaaugucacugcaggua

SEQ ID NO: 1086012 - RNA, 19 nt, Homo sapiens
gauccaagcaggcuacuac

SEQ ID NO: 1086013 - RNA, 19 nt, Homo sapiens
guucgugauugacggcuuu

SEQ ID NO: 1086014 - RNA, 19 nt, Homo sapiens
caaaggaugaagucagaga

SEQ ID NO: 1086015 - RNA, 19 nt, Homo sapiens
gcuggaagaaauagaagaa

SEQ ID NO: 1086016 - RNA, 19 nt, Homo sapiens
ugagaugucugugguugug

SEQ ID NO: 1086017 - RNA, 19 nt, Homo sapiens
ggaguuaagggaaugaagu

SEQ ID NO: 1086018 - RNA, 19 nt, Homo sapiens
ucaaggcaaugaccaggau

SEQ ID NO: 1086019 - RNA, 19 nt, Homo sapiens
cucagugccucccuaguaa

SEQ ID NO: 1086020 - RNA, 19 nt, Homo sapiens
aaaugucacugcagguaau

SEQ ID NO: 1086021 - RNA, 19 nt, Homo sapiens
gcaggcuacuacuccuuug

SEQ ID NO: 1086022 - RNA, 19 nt, Homo sapiens
gguuauggcugagagauac

SEQ ID NO: 1086023 - RNA, 19 nt, Homo sapiens
uagcaaagagguccagguu

SEQ ID NO: 1086024 - RNA, 19 nt, Homo sapiens
gagcuggccuggagauagc

SEQ ID NO: 1086025 - RNA, 19 nt, Homo sapiens
gaucugaugggucuagcaa

SEQ ID NO: 1086026 - RNA, 19 nt, Homo sapiens
aaagaacgaccaccucuag

SEQ ID NO: 1086027 - RNA, 19 nt, Homo sapiens
gaguuaagggaaugaaguu

SEQ ID NO: 1086028 - RNA, 19 nt, Homo sapiens
uuacagaagccaauugcaa

SEQ ID NO: 1086029 - RNA, 19 nt, Homo sapiens
gaagcaacugguagaaauc

SEQ ID NO: 1086030 - RNA, 19 nt, Homo sapiens
agcaaaggaugaagucaga

SEQ ID NO: 1086031 - RNA, 19 nt, Homo sapiens
caggaugaguugagcaagu

SEQ ID NO: 1086032 - RNA, 19 nt, Homo sapiens
cagcagcucuucauuauua

SEQ ID NO: 1086033 - RNA, 19 nt, Homo sapiens
ggagugaacugcuuucuuu

SEQ ID NO: 1086034 - RNA, 19 nt, Homo sapiens
gaaaugaggcuuccugaua

SEQ ID NO: 1086035 - RNA, 19 nt, Homo sapiens
ugaaagagcuaguucgaua

SEQ ID NO: 1086036 - RNA, 19 nt, Homo sapiens
gaguaaaucugugcauuaa

SEQ ID NO: 1086037 - RNA, 19 nt, Homo sapiens
gaacgaaagcuacuuguug

SEQ ID NO: 1086038 - RNA, 19 nt, Homo sapiens
guucaaaucuguagugugu

SEQ ID NO: 1086039 - RNA, 19 nt, Homo sapiens
gaaagcuacuuguugauca

SEQ ID NO: 1086040 - RNA, 19 nt, Homo sapiens
uggcagaguuaguuuaaua

SEQ ID NO: 1086041 - RNA, 19 nt, Homo sapiens
guacgaggcuaucuggaaa

SEQ ID NO: 1086042 - RNA, 19 nt, Homo sapiens
ggaaaugauggcagaguua

SEQ ID NO: 1086043 - RNA, 19 nt, Homo sapiens
gaagaucugcaguauguuu

SEQ ID NO: 1086044 - RNA, 19 nt, Homo sapiens
ucagagaaauugacuacaa

SEQ ID NO: 1086045 - RNA, 19 nt, Homo sapiens
guuagagcaucaacuuaua

SEQ ID NO: 1086046 - RNA, 19 nt, Homo sapiens
ccaggcagauauuuacuuu

SEQ ID NO: 1086047 - RNA, 19 nt, Homo sapiens
gguguuauccugggaauua

SEQ ID NO: 1086048 - RNA, 19 nt, Homo sapiens
uggaagaucugcaguaugu

SEQ ID NO: 1086049 - RNA, 19 nt, Homo sapiens
guaaaucugugcauuaaac

SEQ ID NO: 1086050 - RNA, 19 nt, Homo sapiens
gcagauauuuacuuugcaa

SEQ ID NO: 1086051 - RNA, 19 nt, Homo sapiens
gcugaacacauuucuauuu

SEQ ID NO: 1086052 - RNA, 19 nt, Homo sapiens
uauuacagcugaacacauu

SEQ ID NO: 1086053 - RNA, 19 nt, Homo sapiens
ggaaguuguuguucaaauc

SEQ ID NO: 1086054 - RNA, 19 nt, Homo sapiens
cagagaaauugacuacaaa

SEQ ID NO: 1086055 - RNA, 19 nt, Homo sapiens
aaaugaggcuuccugauau

SEQ ID NO: 1086056 - RNA, 19 nt, Homo sapiens
gaagagauccccuagagua

SEQ ID NO: 1086057 - RNA, 19 nt, Homo sapiens
ggaauguguugccuuuaug

SEQ ID NO: 1086058 - RNA, 19 nt, Homo sapiens
ugaggaauguguugccuuu

SEQ ID NO: 1086059 - RNA, 19 nt, Homo sapiens
gcucuuugcugcuuguuug

SEQ ID NO: 1086060 - RNA, 19 nt, Homo sapiens
gcauuaaaccuguaacuuc

SEQ ID NO: 1086061 - RNA, 19 nt, Homo sapiens
guugaaagaugaagaacga

SEQ ID NO: 1086062 - RNA, 19 nt, Homo sapiens
ugucaacauuggucaguua

SEQ ID NO: 1086063 - RNA, 19 nt, Homo sapiens
gaagaacgaaagcuacuug

SEQ ID NO: 1086064 - RNA, 19 nt, Homo sapiens
gcaguacuguuaaggacuu

SEQ ID NO: 1086065 - RNA, 19 nt, Homo sapiens
uuaaaucucugcaagaaca

SEQ ID NO: 1086066 - RNA, 19 nt, Homo sapiens
gaaucuacguuagguauca

SEQ ID NO: 1086067 - RNA, 19 nt, Homo sapiens
aaacauggcugcuuuucua

SEQ ID NO: 1086068 - RNA, 19 nt, Homo sapiens
cauuaaaccuguaacuuca

SEQ ID NO: 1086069 - RNA, 19 nt, Homo sapiens
cauccgaccuuauaaguag

SEQ ID NO: 1086070 - RNA, 19 nt, Homo sapiens
gaacaaaacagucaugaug

SEQ ID NO: 1086071 - RNA, 19 nt, Homo sapiens
ucagaguaauccauaugua

SEQ ID NO: 1086072 - RNA, 19 nt, Homo sapiens
guuuaaaucucugcaagaa

SEQ ID NO: 1086073 - RNA, 19 nt, Homo sapiens
gagcaucaacuuauauugu

SEQ ID NO: 1086074 - RNA, 19 nt, Homo sapiens
gaacugcuuucuuuuauca

SEQ ID NO: 1086075 - RNA, 19 nt, Homo sapiens
gauggcagaguuaguuuaa

SEQ ID NO: 1086076 - RNA, 19 nt, Homo sapiens
aaggaaacauggcugcuuu

SEQ ID NO: 1086077 - RNA, 19 nt, Homo sapiens
gcacaaacgaggaaaugau

SEQ ID NO: 1086078 - RNA, 19 nt, Homo sapiens
ugaaugagauguugcuuuu

SEQ ID NO: 1086079 - RNA, 19 nt, Homo sapiens
guucugacuucuuuaacaa

SEQ ID NO: 1086080 - RNA, 19 nt, Homo sapiens
gaaagagcuaguucgauau

SEQ ID NO: 1086081 - RNA, 19 nt, Homo sapiens
gggaaguuguuguucaaau

SEQ ID NO: 1086082 - RNA, 19 nt, Homo sapiens
cagaguaauccauauguaa

SEQ ID NO: 1086083 - RNA, 19 nt, Homo sapiens
cugaacacauuucuauuug

SEQ ID NO: 1086084 - RNA, 19 nt, Homo sapiens
aacgaaagcuacuuguuga

SEQ ID NO: 1086085 - RNA, 19 nt, Homo sapiens
uugcgaaacuucacaaugu

SEQ ID NO: 1086086 - RNA, 19 nt, Homo sapiens
uguguugccuuuauguuaa

SEQ ID NO: 1086087 - RNA, 19 nt, Homo sapiens
gcacugcaguacuguuaag

SEQ ID NO: 1086088 - RNA, 19 nt, Homo sapiens
agaguaaaucugugcauua

SEQ ID NO: 1086089 - RNA, 19 nt, Homo sapiens
gauauuuacuuugcaacga

SEQ ID NO: 1086090 - RNA, 19 nt, Homo sapiens
aaagagcuaguucgauaua

SEQ ID NO: 1086091 - RNA, 19 nt, Homo sapiens
ugaauuacaugguaugacu

SEQ ID NO: 1086092 - RNA, 19 nt, Homo sapiens
auacagaccagguaauaaa

SEQ ID NO: 1086093 - RNA, 19 nt, Homo sapiens
cagcugaacacauuucuau

SEQ ID NO: 1086094 - RNA, 19 nt, Homo sapiens
caacauuggucaguuagag

SEQ ID NO: 1086095 - RNA, 19 nt, Homo sapiens
caauccagaagaaguguua

SEQ ID NO: 1086096 - RNA, 19 nt, Homo sapiens
gaggcuaucuggaaaugag

SEQ ID NO: 1086097 - RNA, 19 nt, Homo sapiens
aaacagucaugaugcuaug

SEQ ID NO: 1086098 - RNA, 19 nt, Homo sapiens
gcagcuacaugcaaagaac

SEQ ID NO: 1086099 - RNA, 19 nt, Homo sapiens
ggauauucauacacacgaa

SEQ ID NO: 1086100 - RNA, 19 nt, Homo sapiens
acagagggaaucuacguua

SEQ ID NO: 1086101 - RNA, 19 nt, Homo sapiens
gaacuuccaggcccuaaag

SEQ ID NO: 1086102 - RNA, 19 nt, Homo sapiens
guuggaagaucugcaguau

SEQ ID NO: 1086103 - RNA, 19 nt, Homo sapiens
gaucagaugaggaagagau

SEQ ID NO: 1086104 - RNA, 19 nt, Homo sapiens
guuguucuuugcugaauug

SEQ ID NO: 1086105 - RNA, 19 nt, Homo sapiens
guagacggacugccaaaga

SEQ ID NO: 1086106 - RNA, 19 nt, Homo sapiens
gaaagaugaagaacgaaag

SEQ ID NO: 1086107 - RNA, 19 nt, Homo sapiens
cagcaagugucaacauugg

SEQ ID NO: 1086108 - RNA, 19 nt, Homo sapiens
uagaguaaaucugugcauu

SEQ ID NO: 1086109 - RNA, 19 nt, Homo sapiens
uggaauacuugacuuaucu

SEQ ID NO: 1086110 - RNA, 19 nt, Homo sapiens
ccacucguuuugacuauua

SEQ ID NO: 1086111 - RNA, 19 nt, Homo sapiens
gagagaaaaugaauaccuu

SEQ ID NO: 1086112 - RNA, 19 nt, Homo sapiens
gaaauugacuacaaaacag

SEQ ID NO: 1086113 - RNA, 19 nt, Homo sapiens
uacguuagguaucauguau

SEQ ID NO: 1086114 - RNA, 19 nt, Homo sapiens
gggaaucuacguuagguau

SEQ ID NO: 1086115 - RNA, 19 nt, Homo sapiens
gcaucaacuuauauuguca

SEQ ID NO: 1086116 - RNA, 19 nt, Homo sapiens
uguguguucugacuucuuu

SEQ ID NO: 1086117 - RNA, 19 nt, Homo sapiens
cuaguucgauauacacuca

SEQ ID NO: 1086118 - RNA, 19 nt, Homo sapiens
gaaaugauggcagaguuag

SEQ ID NO: 1086119 - RNA, 19 nt, Homo sapiens
acuccaaguuccugcauuu

SEQ ID NO: 1086120 - RNA, 19 nt, Homo sapiens
aggaauguguugccuuuau

SEQ ID NO: 1086121 - RNA, 19 nt, Homo sapiens
gagggaaucuacguuaggu

SEQ ID NO: 1086122 - RNA, 19 nt, Homo sapiens
aguuauagcugaggaaugu

SEQ ID NO: 1086123 - RNA, 19 nt, Homo sapiens
ugcaagcaauccagaagaa

SEQ ID NO: 1086124 - RNA, 19 nt, Homo sapiens
ugaaagaugaagaacgaaa

SEQ ID NO: 1086125 - RNA, 19 nt, Homo sapiens
uaucccagcuucagcaagu

SEQ ID NO: 1086126 - RNA, 19 nt, Homo sapiens
uucagcagcucuucauuau

SEQ ID NO: 1086127 - RNA, 19 nt, Homo sapiens
gaaguuguuguucaaaucu

SEQ ID NO: 1086128 - RNA, 19 nt, Homo sapiens
guuuggaguugguaacaga

SEQ ID NO: 1086129 - RNA, 19 nt, Homo sapiens
caggagcuguguguucuga

SEQ ID NO: 1086130 - RNA, 19 nt, Homo sapiens
gaaugcaagcaauccagaa

SEQ ID NO: 1086131 - RNA, 19 nt, Homo sapiens
aaagaggagaaacagauaa

SEQ ID NO: 1086132 - RNA, 19 nt, Homo sapiens
ggcaggagcuugcagauuu

SEQ ID NO: 1086133 - RNA, 19 nt, Homo sapiens
gcucagugaugccagcuua

SEQ ID NO: 1086134 - RNA, 19 nt, Homo sapiens
gagagggucugcuugagaa

SEQ ID NO: 1086135 - RNA, 19 nt, Homo sapiens
ggaagagggugaggaagaa

SEQ ID NO: 1086136 - RNA, 19 nt, Homo sapiens
ugaggacacugcacaaauu

SEQ ID NO: 1086137 - RNA, 19 nt, Homo sapiens
gaggcaccguuucuucuua

SEQ ID NO: 1086138 - RNA, 19 nt, Homo sapiens
ggacaaugaugaggaugaa

SEQ ID NO: 1086139 - RNA, 19 nt, Homo sapiens
acaugaagcugcacaguga

SEQ ID NO: 1086140 - RNA, 19 nt, Homo sapiens
gcugaugccuugugacuuc

SEQ ID NO: 1086141 - RNA, 19 nt, Homo sapiens
aagaggagaugcucaguga

SEQ ID NO: 1086142 - RNA, 19 nt, Homo sapiens
gcaggagcuugcagauuug

SEQ ID NO: 1086143 - RNA, 19 nt, Homo sapiens
ggaagaagaggacaaugau

SEQ ID NO: 1086144 - RNA, 19 nt, Homo sapiens
gagagcugaugccuuguga

SEQ ID NO: 1086145 - RNA, 19 nt, Homo sapiens
caaaaggucugcaguaucu

SEQ ID NO: 1086146 - RNA, 19 nt, Homo sapiens
gcagcaaccuugucaucca

SEQ ID NO: 1086147 - RNA, 19 nt, Homo sapiens
uaggaaagcugccaaaaga

SEQ ID NO: 1086148 - RNA, 19 nt, Homo sapiens
gaggagaugcucagugaug

SEQ ID NO: 1086149 - RNA, 19 nt, Homo sapiens
ggagagggucugcuugaga

SEQ ID NO: 1086150 - RNA, 19 nt, Homo sapiens
ugugagauaugcggguuua

SEQ ID NO: 1086151 - RNA, 19 nt, Homo sapiens
gggcaagacugggcuguag

SEQ ID NO: 1086152 - RNA, 19 nt, Homo sapiens
aagaagaggacaaugauga

SEQ ID NO: 1086153 - RNA, 19 nt, Homo sapiens
acucgcagcucgccaaguu

SEQ ID NO: 1086154 - RNA, 19 nt, Homo sapiens
gaagaagaggacaaugaug

SEQ ID NO: 1086155 - RNA, 19 nt, Homo sapiens
ggacuacaucugugaguuc

SEQ ID NO: 1086156 - RNA, 19 nt, Homo sapiens
ccacagacguauccacacu

SEQ ID NO: 1086157 - RNA, 19 nt, Homo sapiens
gggacuacaucugugaguu

SEQ ID NO: 1086158 - RNA, 19 nt, Homo sapiens
ccugucaccugcacaccua

SEQ ID NO: 1086159 - RNA, 19 nt, Homo sapiens
uuaagaaacaccugaagga

SEQ ID NO: 1086160 - RNA, 19 nt, Homo sapiens
gaggacacugcacaaauug

SEQ ID NO: 1086161 - RNA, 19 nt, Homo sapiens
ccacauacuacucggagaa

SEQ ID NO: 1086162 - RNA, 19 nt, Homo sapiens
gaugaggacacugcacaaa

SEQ ID NO: 1086163 - RNA, 19 nt, Homo sapiens
ggacucaagaggccagguu

SEQ ID NO: 1086164 - RNA, 19 nt, Homo sapiens
gagaagccagacaguguug

SEQ ID NO: 1086165 - RNA, 19 nt, Homo sapiens
ucuccaaccggcaguauuu

SEQ ID NO: 1086166 - RNA, 19 nt, Homo sapiens
gaugauagugagccugaug

SEQ ID NO: 1086167 - RNA, 19 nt, Homo sapiens
ggagcuugcagauuuggaa

SEQ ID NO: 1086168 - RNA, 19 nt, Homo sapiens
gcggcaagcgcuuugagaa

SEQ ID NO: 1086169 - RNA, 19 nt, Homo sapiens
aggcaccguuucuucuuaa

SEQ ID NO: 1086170 - RNA, 19 nt, Homo sapiens
gcacucuccaguccucuug

SEQ ID NO: 1086171 - RNA, 19 nt, Homo sapiens
ugaaggagcacaugaagcu

SEQ ID NO: 1086172 - RNA, 19 nt, Homo sapiens
acaaugaugaggaugaaga

SEQ ID NO: 1086173 - RNA, 19 nt, Homo sapiens
aggaagaagaggacaauga

SEQ ID NO: 1086174 - RNA, 19 nt, Homo sapiens
ggaacuaaggcgacagagu

SEQ ID NO: 1086175 - RNA, 19 nt, Homo sapiens
gcacuagcagcaaccuugu

SEQ ID NO: 1086176 - RNA, 19 nt, Homo sapiens
gcacauccaccagaagucu

SEQ ID NO: 1086177 - RNA, 19 nt, Homo sapiens
ggaaagcugccaaaagaga

SEQ ID NO: 1086178 - RNA, 19 nt, Homo sapiens
gagaggcaccguuucuucu

SEQ ID NO: 1086179 - RNA, 19 nt, Homo sapiens
cgagaggcaccguuucuuc

SEQ ID NO: 1086180 - RNA, 19 nt, Homo sapiens
cagccucccuuccacauac

SEQ ID NO: 1086181 - RNA, 19 nt, Homo sapiens
gagcugaugccuugugacu

SEQ ID NO: 1086182 - RNA, 19 nt, Homo sapiens
gagccagccugugggaagu

SEQ ID NO: 1086183 - RNA, 19 nt, Homo sapiens
ccaaccggcaguauuugaa

SEQ ID NO: 1086184 - RNA, 19 nt, Homo sapiens
caagagaauuaggaaagcu

SEQ ID NO: 1086185 - RNA, 19 nt, Homo sapiens
ccaagagaauuaggaaagc

SEQ ID NO: 1086186 - RNA, 19 nt, Homo sapiens
ugcaguaucuggugcucuu

SEQ ID NO: 1086187 - RNA, 19 nt, Homo sapiens
agaggacaaugaugaggau

SEQ ID NO: 1086188 - RNA, 19 nt, Homo sapiens
gggcaggagcuugcagauu

SEQ ID NO: 1086189 - RNA, 19 nt, Homo sapiens
uaggggagcuggacuacuu

SEQ ID NO: 1086190 - RNA, 19 nt, Homo sapiens
cuggugcucuugucucaug

SEQ ID NO: 1086191 - RNA, 19 nt, Homo sapiens
cauacuacucggagaaguu

SEQ ID NO: 1086192 - RNA, 19 nt, Homo sapiens
caaccggcaguauuugaau

SEQ ID NO: 1086193 - RNA, 19 nt, Homo sapiens
acaaggagagggucugcuu

SEQ ID NO: 1086194 - RNA, 19 nt, Homo sapiens
ugagaagccagacaguguu

SEQ ID NO: 1086195 - RNA, 19 nt, Homo sapiens
gcacaugaagcugcacagu

SEQ ID NO: 1086196 - RNA, 19 nt, Homo sapiens
gcaguggugccuccucaag

SEQ ID NO: 1086197 - RNA, 19 nt, Homo sapiens
agaggaagagggugaggaa

SEQ ID NO: 1086198 - RNA, 19 nt, Homo sapiens
ggaugaggacacugcacaa

SEQ ID NO: 1086199 - RNA, 19 nt, Homo sapiens
aaggagagggucugcuuga

SEQ ID NO: 1086200 - RNA, 19 nt, Homo sapiens
ucacccagcccugcuucua

SEQ ID NO: 1086201 - RNA, 19 nt, Homo sapiens
gaagccagacaguguugca

SEQ ID NO: 1086202 - RNA, 19 nt, Homo sapiens
cagcacauccaccagaagu

SEQ ID NO: 1086203 - RNA, 19 nt, Homo sapiens
ggcaccguuucuucuuaaa

SEQ ID NO: 1086204 - RNA, 19 nt, Homo sapiens
aggaagagggugaggaaga

SEQ ID NO: 1086205 - RNA, 19 nt, Homo sapiens
ugagaaaugccagaugcuu

SEQ ID NO: 1086206 - RNA, 19 nt, Homo sapiens
gacuacaucugugaguucu

SEQ ID NO: 1086207 - RNA, 19 nt, Homo sapiens
uggaaucugagcaugauga

SEQ ID NO: 1086208 - RNA, 19 nt, Homo sapiens
agggucugcuugagaaaug

SEQ ID NO: 1086209 - RNA, 19 nt, Homo sapiens
uagcagcaaccuugucauc

SEQ ID NO: 1086210 - RNA, 19 nt, Homo sapiens
gcucagcaggccauaccuu

SEQ ID NO: 1086211 - RNA, 19 nt, Homo sapiens
ggaccgguacacuucuuca

SEQ ID NO: 1086212 - RNA, 19 nt, Homo sapiens
cccaagagaauuaggaaag

SEQ ID NO: 1086213 - RNA, 19 nt, Homo sapiens
ucacacagcuccucaauca

SEQ ID NO: 1086214 - RNA, 19 nt, Homo sapiens
gaacaaaacugcuccaaca

SEQ ID NO: 1086215 - RNA, 19 nt, Homo sapiens
caucaacucugacauagug

SEQ ID NO: 1086216 - RNA, 19 nt, Homo sapiens
guucagcgguggaaagauu

SEQ ID NO: 1086217 - RNA, 19 nt, Homo sapiens
gcagggcuacggacaguuu

SEQ ID NO: 1086218 - RNA, 19 nt, Homo sapiens
ugucuaaccucacccucua

SEQ ID NO: 1086219 - RNA, 19 nt, Homo sapiens
ccucaucaacucugacaua

SEQ ID NO: 1086220 - RNA, 19 nt, Homo sapiens
caagaugcgagucugguuu

SEQ ID NO: 1086221 - RNA, 19 nt, Homo sapiens
acucaaacccuauggacua

SEQ ID NO: 1086222 - RNA, 19 nt, Homo sapiens
ccaugaggaugaccagcaa

SEQ ID NO: 1086223 - RNA, 19 nt, Homo sapiens
gcaacgagaacgccacaag

SEQ ID NO: 1086224 - RNA, 19 nt, Homo sapiens
gagaccaggagcacagaaa

SEQ ID NO: 1086225 - RNA, 19 nt, Homo sapiens
cagcaaaauucaagaacaa

SEQ ID NO: 1086226 - RNA, 19 nt, Homo sapiens
cgaguggacuaagaucaau

SEQ ID NO: 1086227 - RNA, 19 nt, Homo sapiens
acacagcuccucaaucagu

SEQ ID NO: 1086228 - RNA, 19 nt, Homo sapiens
gcuacggacaguuugcuuu

SEQ ID NO: 1086229 - RNA, 19 nt, Homo sapiens
gcgaacaggacaucuacga

SEQ ID NO: 1086230 - RNA, 19 nt, Homo sapiens
auguguaucuugaaagcua

SEQ ID NO: 1086231 - RNA, 19 nt, Homo sapiens
aaacugcuccaacagacuu

SEQ ID NO: 1086232 - RNA, 19 nt, Homo sapiens
gaggaugaccagcaaaauu

SEQ ID NO: 1086233 - RNA, 19 nt, Homo sapiens
gauaccuccucaucaacuc

SEQ ID NO: 1086234 - RNA, 19 nt, Homo sapiens
cacagcuccucaaucaguu

SEQ ID NO: 1086235 - RNA, 19 nt, Homo sapiens
caugguuuguggcggaaga

SEQ ID NO: 1086236 - RNA, 19 nt, Homo sapiens
ggauaccuccucaucaacu

SEQ ID NO: 1086237 - RNA, 19 nt, Homo sapiens
ccaagaugcgagucugguu

SEQ ID NO: 1086238 - RNA, 19 nt, Homo sapiens
ugacauagugugcgaacag

SEQ ID NO: 1086239 - RNA, 19 nt, Homo sapiens
caucacacagcuccucaau

SEQ ID NO: 1086240 - RNA, 19 nt, Homo sapiens
gcucgucaacggcaucauc

SEQ ID NO: 1086241 - RNA, 19 nt, Homo sapiens
cuacggacaguuugcuuuc

SEQ ID NO: 1086242 - RNA, 19 nt, Homo sapiens
uaaccucacccucuaaacg

SEQ ID NO: 1086243 - RNA, 19 nt, Homo sapiens
gagaacgccacaagcaacu

SEQ ID NO: 1086244 - RNA, 19 nt, Homo sapiens
ggauuauaucuguccaaga

SEQ ID NO: 1086245 - RNA, 19 nt, Homo sapiens
ggacauaacucuagaaucu

SEQ ID NO: 1086246 - RNA, 19 nt, Homo sapiens
gagcacuacuguaauauaa

SEQ ID NO: 1086247 - RNA, 19 nt, Homo sapiens
gcagaugucucuacuuugu

SEQ ID NO: 1086248 - RNA, 19 nt, Homo sapiens
gauaaaggauuuguaguug

SEQ ID NO: 1086249 - RNA, 19 nt, Homo sapiens
gaaacuugguagacccuua

SEQ ID NO: 1086250 - RNA, 19 nt, Homo sapiens
agacagaacuagacaaaga

SEQ ID NO: 1086251 - RNA, 19 nt, Homo sapiens
gaugauagccauucaaaga

SEQ ID NO: 1086252 - RNA, 19 nt, Homo sapiens
ggaaaggauucugguaauu

SEQ ID NO: 1086253 - RNA, 19 nt, Homo sapiens
gguagacccuuaauuauag

SEQ ID NO: 1086254 - RNA, 19 nt, Homo sapiens
aaacacaaaucgccuaaga

SEQ ID NO: 1086255 - RNA, 19 nt, Homo sapiens
gaaucugcauuuaagagua

SEQ ID NO: 1086256 - RNA, 19 nt, Homo sapiens
cuaaugagcacuacuguaa

SEQ ID NO: 1086257 - RNA, 19 nt, Homo sapiens
ggauaaaggauuuguaguu

SEQ ID NO: 1086258 - RNA, 19 nt, Homo sapiens
gcacuacuguaauauaaag

SEQ ID NO: 1086259 - RNA, 19 nt, Homo sapiens
aaugagcacuacuguaaua

SEQ ID NO: 1086260 - RNA, 19 nt, Homo sapiens
gaaaggauucugguaauug

SEQ ID NO: 1086261 - RNA, 19 nt, Homo sapiens
gucaugaggugauuugauu

SEQ ID NO: 1086262 - RNA, 19 nt, Homo sapiens
gcaaaggaaauugaaagua

SEQ ID NO: 1086263 - RNA, 19 nt, Homo sapiens
gcaauauccuugucuaaaa

SEQ ID NO: 1086264 - RNA, 19 nt, Homo sapiens
gaggugauuugauuuacuu

SEQ ID NO: 1086265 - RNA, 19 nt, Homo sapiens
cugcagaugucucuacuuu

SEQ ID NO: 1086266 - RNA, 19 nt, Homo sapiens
gaagauauccgugagagau

SEQ ID NO: 1086267 - RNA, 19 nt, Homo sapiens
cuaaagcauuucugauuug

SEQ ID NO: 1086268 - RNA, 19 nt, Homo sapiens
gaaauaacacuggguuuua

SEQ ID NO: 1086269 - RNA, 19 nt, Homo sapiens
acacaaaucgccuaagaaa

SEQ ID NO: 1086270 - RNA, 19 nt, Homo sapiens
agacaaagaucagaaucaa

SEQ ID NO: 1086271 - RNA, 19 nt, Homo sapiens
guaagaagaggagacauaa

SEQ ID NO: 1086272 - RNA, 19 nt, Homo sapiens
gaaugugccaccagacuuu

SEQ ID NO: 1086273 - RNA, 19 nt, Homo sapiens
caacugcacuugaucuuuu

SEQ ID NO: 1086274 - RNA, 19 nt, Homo sapiens
gaugcugucugggaagaua

SEQ ID NO: 1086275 - RNA, 19 nt, Homo sapiens
gguggcaauuuacugauaa

SEQ ID NO: 1086276 - RNA, 19 nt, Homo sapiens
cuugguagacccuuaauua

SEQ ID NO: 1086277 - RNA, 19 nt, Homo sapiens
uauagaagcuggauuuuga

SEQ ID NO: 1086278 - RNA, 19 nt, Homo sapiens
ugauagccauucaaagaaa

SEQ ID NO: 1086279 - RNA, 19 nt, Homo sapiens
caaagaacaagaaacauuc

SEQ ID NO: 1086280 - RNA, 19 nt, Homo sapiens
uacauuagaugcuggaaau

SEQ ID NO: 1086281 - RNA, 19 nt, Homo sapiens
uuaaggcccuacuaaagaa

SEQ ID NO: 1086282 - RNA, 19 nt, Homo sapiens
gacgagaagaagauaauaa

SEQ ID NO: 1086283 - RNA, 19 nt, Homo sapiens
gaagaggagacauaaaucu

SEQ ID NO: 1086284 - RNA, 19 nt, Homo sapiens
acauaacucuagaaucuga

SEQ ID NO: 1086285 - RNA, 19 nt, Homo sapiens
caugaggugauuugauuua

SEQ ID NO: 1086286 - RNA, 19 nt, Homo sapiens
uggagcaacuggaugauga

SEQ ID NO: 1086287 - RNA, 19 nt, Homo sapiens
guacacauucuaaagcauu

SEQ ID NO: 1086288 - RNA, 19 nt, Homo sapiens
gaucuuaaagcacaguuau

SEQ ID NO: 1086289 - RNA, 19 nt, Homo sapiens
uaaaagagccagcauuuga

SEQ ID NO: 1086290 - RNA, 19 nt, Homo sapiens
acaagcugcuccuccgaua

SEQ ID NO: 1086291 - RNA, 19 nt, Homo sapiens
ugguagacccuuaauuaua

SEQ ID NO: 1086292 - RNA, 19 nt, Homo sapiens
aaagacagaacuagacaaa

SEQ ID NO: 1086293 - RNA, 19 nt, Homo sapiens
uggugaaacuccuaagaaa

SEQ ID NO: 1086294 - RNA, 19 nt, Homo sapiens
ggauuaaagguggcaauuu

SEQ ID NO: 1086295 - RNA, 19 nt, Homo sapiens
uaaagcacaguuaucauga

SEQ ID NO: 1086296 - RNA, 19 nt, Homo sapiens
gugaaacuccuaagaaaca

SEQ ID NO: 1086297 - RNA, 19 nt, Homo sapiens
agucauaacugucuuucug

SEQ ID NO: 1086298 - RNA, 19 nt, Homo sapiens
caucaucauucaaagaaca

SEQ ID NO: 1086299 - RNA, 19 nt, Homo sapiens
gaccagggacucuauuuua

SEQ ID NO: 1086300 - RNA, 19 nt, Homo sapiens
gaacuagacaaagaucaga

SEQ ID NO: 1086301 - RNA, 19 nt, Homo sapiens
ggucagauucagaugauga

SEQ ID NO: 1086302 - RNA, 19 nt, Homo sapiens
uggaaaggauucugguaau

SEQ ID NO: 1086303 - RNA, 19 nt, Homo sapiens
aagaagaggagacauaaau

SEQ ID NO: 1086304 - RNA, 19 nt, Homo sapiens
uaaaccuucucuucuagug

SEQ ID NO: 1086305 - RNA, 19 nt, Homo sapiens
gaagcuggauuuugaagau

SEQ ID NO: 1086306 - RNA, 19 nt, Homo sapiens
agaagaggcuccggaagau

SEQ ID NO: 1086307 - RNA, 19 nt, Homo sapiens
gguuaaagccaaugugauc

SEQ ID NO: 1086308 - RNA, 19 nt, Homo sapiens
gcuaaugagcacuacugua

SEQ ID NO: 1086309 - RNA, 19 nt, Homo sapiens
aaagguggcaauuuacuga

SEQ ID NO: 1086310 - RNA, 19 nt, Homo sapiens
aagaagaggcuccggaaga

SEQ ID NO: 1086311 - RNA, 19 nt, Homo sapiens
cgugaaccgugaaagagaa

SEQ ID NO: 1086312 - RNA, 19 nt, Homo sapiens
aaaggauucugguaauugg

SEQ ID NO: 1086313 - RNA, 19 nt, Homo sapiens
uuaaagcacaguuaucaug

SEQ ID NO: 1086314 - RNA, 19 nt, Homo sapiens
aguaagaagaggagacaua

SEQ ID NO: 1086315 - RNA, 19 nt, Homo sapiens
agauauccgugagagauuu

SEQ ID NO: 1086316 - RNA, 19 nt, Homo sapiens
guugcaauauccuugucua

SEQ ID NO: 1086317 - RNA, 19 nt, Homo sapiens
cuuaaggcccuacuaaaga

SEQ ID NO: 1086318 - RNA, 19 nt, Homo sapiens
ugagcacuacuguaauaua

SEQ ID NO: 1086319 - RNA, 19 nt, Homo sapiens
gacaaagaucagaaucaaa

SEQ ID NO: 1086320 - RNA, 19 nt, Homo sapiens
gccagcauuugaggacaua

SEQ ID NO: 1086321 - RNA, 19 nt, Homo sapiens
aaacuugguagacccuuaa

SEQ ID NO: 1086322 - RNA, 19 nt, Homo sapiens
aaagaucgggaaagugaaa

SEQ ID NO: 1086323 - RNA, 19 nt, Homo sapiens
acaguuaucaugacgagaa

SEQ ID NO: 1086324 - RNA, 19 nt, Homo sapiens
aagccaaugugaucuuuua

SEQ ID NO: 1086325 - RNA, 19 nt, Homo sapiens
acugauaacugcagauguc

SEQ ID NO: 1086326 - RNA, 19 nt, Homo sapiens
ggauuuguaguugaaguaa

SEQ ID NO: 1086327 - RNA, 19 nt, Homo sapiens
uaagaagaggagacauaaa

SEQ ID NO: 1086328 - RNA, 19 nt, Homo sapiens
gaggacauaacucuagaau

SEQ ID NO: 1086329 - RNA, 19 nt, Homo sapiens
aaccuucucuucuagugaa

SEQ ID NO: 1086330 - RNA, 19 nt, Homo sapiens
ggaucuuaaagcacaguua

SEQ ID NO: 1086331 - RNA, 19 nt, Homo sapiens
uaagucaugaggugauuug

SEQ ID NO: 1086332 - RNA, 19 nt, Homo sapiens
gcugagcgagagaaggaua

SEQ ID NO: 1086333 - RNA, 19 nt, Homo sapiens
agaugucucuacuuuguuc

SEQ ID NO: 1086334 - RNA, 19 nt, Homo sapiens
agaggagacauaaaucuga

SEQ ID NO: 1086335 - RNA, 19 nt, Homo sapiens
agauucagaugaugaugau

SEQ ID NO: 1086336 - RNA, 19 nt, Homo sapiens
cagauucagaugaugauga

SEQ ID NO: 1086337 - RNA, 19 nt, Homo sapiens
ggaagauauccgugagaga

SEQ ID NO: 1086338 - RNA, 19 nt, Homo sapiens
ugacuucgugguacacauu

SEQ ID NO: 1086339 - RNA, 19 nt, Homo sapiens
guauugacuucgugguaca

SEQ ID NO: 1086340 - RNA, 19 nt, Homo sapiens
cauuagaugcuggaaauau

SEQ ID NO: 1086341 - RNA, 19 nt, Homo sapiens
aaacaucauaggaaacguu

SEQ ID NO: 1086342 - RNA, 19 nt, Homo sapiens
gaagaggcuccggaagaug

SEQ ID NO: 1086343 - RNA, 19 nt, Homo sapiens
aaauucagucuuucucuug

SEQ ID NO: 1086344 - RNA, 19 nt, Homo sapiens
aagaggcuccggaagauga

SEQ ID NO: 1086345 - RNA, 19 nt, Homo sapiens
ggaggaaacuuuaaaucua

SEQ ID NO: 1086346 - RNA, 19 nt, Homo sapiens
ggaagaaguuuaugaagga

SEQ ID NO: 1086347 - RNA, 19 nt, Homo sapiens
gcagauacacucaaaguaa

SEQ ID NO: 1086348 - RNA, 19 nt, Homo sapiens
ccaaagcucugcaggaauu

SEQ ID NO: 1086349 - RNA, 19 nt, Homo sapiens
cugauuagcuuucauauga

SEQ ID NO: 1086350 - RNA, 19 nt, Homo sapiens
gaggaaaggucucaguuug

SEQ ID NO: 1086351 - RNA, 19 nt, Homo sapiens
ggaaaggucucaguuugaa

SEQ ID NO: 1086352 - RNA, 19 nt, Homo sapiens
ugaaagaucuggcuucugu

SEQ ID NO: 1086353 - RNA, 19 nt, Homo sapiens
caaagcagauacacucaaa

SEQ ID NO: 1086354 - RNA, 19 nt, Homo sapiens
ggaagaagaagaagaagaa

SEQ ID NO: 1086355 - RNA, 19 nt, Homo sapiens
ugagaaaguucgaaagaaa

SEQ ID NO: 1086356 - RNA, 19 nt, Homo sapiens
gaauuugacuuggccuuaa

SEQ ID NO: 1086357 - RNA, 19 nt, Homo sapiens
ggaagaugcugaaggagau

SEQ ID NO: 1086358 - RNA, 19 nt, Homo sapiens
ggaaggcucugaaccaaag

SEQ ID NO: 1086359 - RNA, 19 nt, Homo sapiens
guaaucaacuucacaaugc

SEQ ID NO: 1086360 - RNA, 19 nt, Homo sapiens
gcaagaaggcccugaaaca

SEQ ID NO: 1086361 - RNA, 19 nt, Homo sapiens
cagauacacucaaaguaaa

SEQ ID NO: 1086362 - RNA, 19 nt, Homo sapiens
ggagaaagaagcaaaggaa

SEQ ID NO: 1086363 - RNA, 19 nt, Homo sapiens
agaaggcccugaaacagua

SEQ ID NO: 1086364 - RNA, 19 nt, Homo sapiens
gagggcagccacuacauua

SEQ ID NO: 1086365 - RNA, 19 nt, Homo sapiens
gaaccgcagugcugauuuc

SEQ ID NO: 1086366 - RNA, 19 nt, Homo sapiens
ggagaaagauguguaugca

SEQ ID NO: 1086367 - RNA, 19 nt, Homo sapiens
uaaaggaucggaagaagaa

SEQ ID NO: 1086368 - RNA, 19 nt, Homo sapiens
gaggaaggcucagaagaug

SEQ ID NO: 1086369 - RNA, 19 nt, Homo sapiens
ugaaggagaucauccgaau

SEQ ID NO: 1086370 - RNA, 19 nt, Homo sapiens
guacguagcuauuuuccua

SEQ ID NO: 1086371 - RNA, 19 nt, Homo sapiens
gaagaacucaccaacacaa

SEQ ID NO: 1086372 - RNA, 19 nt, Homo sapiens
uggagcgucugauuuauaa

SEQ ID NO: 1086373 - RNA, 19 nt, Homo sapiens
ggaauuugacuuggccuua

SEQ ID NO: 1086374 - RNA, 19 nt, Homo sapiens
ucaagagaaugaugaggaa

SEQ ID NO: 1086375 - RNA, 19 nt, Homo sapiens
gagacgaggaggaaacuuu

SEQ ID NO: 1086376 - RNA, 19 nt, Homo sapiens
gaagaagaaaggacaggaa

SEQ ID NO: 1086377 - RNA, 19 nt, Homo sapiens
gaaaacagaggauaaagaa

SEQ ID NO: 1086378 - RNA, 19 nt, Homo sapiens
ccuaauaccaucaaacauu

SEQ ID NO: 1086379 - RNA, 19 nt, Homo sapiens
gaugcuggaugaguacuuu

SEQ ID NO: 1086380 - RNA, 19 nt, Homo sapiens
acaggaugcuggaugagua

SEQ ID NO: 1086381 - RNA, 19 nt, Homo sapiens
ggaaggcucagaagaugaa

SEQ ID NO: 1086382 - RNA, 19 nt, Homo sapiens
ggagaugacagcagaggaa

SEQ ID NO: 1086383 - RNA, 19 nt, Homo sapiens
gaccuucacugaccaugug

SEQ ID NO: 1086384 - RNA, 19 nt, Homo sapiens
ucagaagcccagaucaaua

SEQ ID NO: 1086385 - RNA, 19 nt, Homo sapiens
gugcauaccugugggucua

SEQ ID NO: 1086386 - RNA, 19 nt, Homo sapiens
gagaacauccucaccaaag

SEQ ID NO: 1086387 - RNA, 19 nt, Homo sapiens
cauggcaacuugucacaga

SEQ ID NO: 1086388 - RNA, 19 nt, Homo sapiens
acaggaagcaggaggauuu

SEQ ID NO: 1086389 - RNA, 19 nt, Homo sapiens
gaagagggcagccacuaca

SEQ ID NO: 1086390 - RNA, 19 nt, Homo sapiens
gauacaagaggaggaagua

SEQ ID NO: 1086391 - RNA, 19 nt, Homo sapiens
ggauauuugugaacagcaa

SEQ ID NO: 1086392 - RNA, 19 nt, Homo sapiens
gagaucauccgaauguguu

SEQ ID NO: 1086393 - RNA, 19 nt, Homo sapiens
gguaaucaacuucacaaug

SEQ ID NO: 1086394 - RNA, 19 nt, Homo sapiens
gaagaaaggacaggaagca

SEQ ID NO: 1086395 - RNA, 19 nt, Homo sapiens
gucguggccugaagaaauu

SEQ ID NO: 1086396 - RNA, 19 nt, Homo sapiens
gaaagauguguaugcaguu

SEQ ID NO: 1086397 - RNA, 19 nt, Homo sapiens
caaauuccgggacaagauu

SEQ ID NO: 1086398 - RNA, 19 nt, Homo sapiens
ugacagacgaggugaaaga

SEQ ID NO: 1086399 - RNA, 19 nt, Homo sapiens
gcccaguucugcaacauca

SEQ ID NO: 1086400 - RNA, 19 nt, Homo sapiens
uuucaacccugauuucguu

SEQ ID NO: 1086401 - RNA, 19 nt, Homo sapiens
agacgaggaggaaacuuua

SEQ ID NO: 1086402 - RNA, 19 nt, Homo sapiens
ugagagguccugccaagaa

SEQ ID NO: 1086403 - RNA, 19 nt, Homo sapiens
gaagaaguuuaugaaggau

SEQ ID NO: 1086404 - RNA, 19 nt, Homo sapiens
gacuuggccuuaagaggaa

SEQ ID NO: 1086405 - RNA, 19 nt, Homo sapiens
gaacucaccaacacaagca

SEQ ID NO: 1086406 - RNA, 19 nt, Homo sapiens
gagagguccugccaagaag

SEQ ID NO: 1086407 - RNA, 19 nt, Homo sapiens
ugacgaggaccuucacuga

SEQ ID NO: 1086408 - RNA, 19 nt, Homo sapiens
gcuuggaugugaagucuca

SEQ ID NO: 1086409 - RNA, 19 nt, Homo sapiens
gaagaagaagaagaagaaa

SEQ ID NO: 1086410 - RNA, 19 nt, Homo sapiens
guaaaggaucggaagaaga

SEQ ID NO: 1086411 - RNA, 19 nt, Homo sapiens
ccacuacauuagaugagaa

SEQ ID NO: 1086412 - RNA, 19 nt, Homo sapiens
ggcccuggcugaugucaug

SEQ ID NO: 1086413 - RNA, 19 nt, Homo sapiens
ugccaaagcucugcaggaa

SEQ ID NO: 1086414 - RNA, 19 nt, Homo sapiens
gauccggccuaaucgugaa

SEQ ID NO: 1086415 - RNA, 19 nt, Homo sapiens
cagacgaggugaaagaucu

SEQ ID NO: 1086416 - RNA, 19 nt, Homo sapiens
gcauccaggugcacucugu

SEQ ID NO: 1086417 - RNA, 19 nt, Homo sapiens
ggauaaagaagccaagucu

SEQ ID NO: 1086418 - RNA, 19 nt, Homo sapiens
gaaaggucucaguuugaaa

SEQ ID NO: 1086419 - RNA, 19 nt, Homo sapiens
ccaaagaagagaggaagaa

SEQ ID NO: 1086420 - RNA, 19 nt, Homo sapiens
caucguggcagcuuuguug

SEQ ID NO: 1086421 - RNA, 19 nt, Homo sapiens
gaaagaaaaggaaaacaga

SEQ ID NO: 1086422 - RNA, 19 nt, Homo sapiens
gaacauccucaccaaagca

SEQ ID NO: 1086423 - RNA, 19 nt, Homo sapiens
ugagaagauugagaaaguu

SEQ ID NO: 1086424 - RNA, 19 nt, Homo sapiens
gggacaagauugagaaaau

SEQ ID NO: 1086425 - RNA, 19 nt, Homo sapiens
ggagaucauccgaaugugu

SEQ ID NO: 1086426 - RNA, 19 nt, Homo sapiens
uagaugagaagauugagaa

SEQ ID NO: 1086427 - RNA, 19 nt, Homo sapiens
gcaugguacuugcgcaaag

SEQ ID NO: 1086428 - RNA, 19 nt, Homo sapiens
gggcagccacuacauuaga

SEQ ID NO: 1086429 - RNA, 19 nt, Homo sapiens
ccagaucaauacagcaaag

SEQ ID NO: 1086430 - RNA, 19 nt, Homo sapiens
ggugaaagaucuggcuucu

SEQ ID NO: 1086431 - RNA, 19 nt, Homo sapiens
gagaagauugagaaaguuc

SEQ ID NO: 1086432 - RNA, 19 nt, Homo sapiens
cauccuggcuggucugucu

SEQ ID NO: 1086433 - RNA, 19 nt, Homo sapiens
gaggaggaaacuuuaaauc

SEQ ID NO: 1086434 - RNA, 19 nt, Homo sapiens
ggacaagauugagaaaaug

SEQ ID NO: 1086435 - RNA, 19 nt, Homo sapiens
ggagacugacuacucauca

SEQ ID NO: 1086436 - RNA, 19 nt, Homo sapiens
augagaagauugagaaagu

SEQ ID NO: 1086437 - RNA, 19 nt, Homo sapiens
ucucccuucuugcugauua

SEQ ID NO: 1086438 - RNA, 19 nt, Homo sapiens
gaugaagaacucaccaaca

SEQ ID NO: 1086439 - RNA, 19 nt, Homo sapiens
gcgcagauguuugcugaac

SEQ ID NO: 1086440 - RNA, 19 nt, Homo sapiens
aagaagagaggaagaagga

SEQ ID NO: 1086441 - RNA, 19 nt, Homo sapiens
gaaggaggcagugguccaa

SEQ ID NO: 1086442 - RNA, 19 nt, Homo sapiens
gaucggaagaagaagaaga

SEQ ID NO: 1086443 - RNA, 19 nt, Homo sapiens
gguaugguacguagcuauu

SEQ ID NO: 1086444 - RNA, 19 nt, Homo sapiens
gcauaccugugggucuauu

SEQ ID NO: 1086445 - RNA, 19 nt, Homo sapiens
agaagaagauggccaauuu

SEQ ID NO: 1086446 - RNA, 19 nt, Homo sapiens
ucucaaagcucaucagaaa

SEQ ID NO: 1086447 - RNA, 19 nt, Homo sapiens
cacauaggcuugcgucuua

SEQ ID NO: 1086448 - RNA, 19 nt, Homo sapiens
cagaggagcuuauugagaa

SEQ ID NO: 1086449 - RNA, 19 nt, Homo sapiens
gagaugagaugcucuugga

SEQ ID NO: 1086450 - RNA, 19 nt, Homo sapiens
gaaaguggccauaaugaga

SEQ ID NO: 1086451 - RNA, 19 nt, Homo sapiens
gagcauggaagucgaauuu

SEQ ID NO: 1086452 - RNA, 19 nt, Homo sapiens
ccacaccgcuucauugaug

SEQ ID NO: 1086453 - RNA, 19 nt, Homo sapiens
ccaggcagcucauucacua

SEQ ID NO: 1086454 - RNA, 19 nt, Homo sapiens
ccuacaagcucaagccaua

SEQ ID NO: 1086455 - RNA, 19 nt, Homo sapiens
gagcuagucugaccauuag

SEQ ID NO: 1086456 - RNA, 19 nt, Homo sapiens
ucacauagagucauuacua

SEQ ID NO: 1086457 - RNA, 19 nt, Homo sapiens
ggaacuggauuaauaagca

SEQ ID NO: 1086458 - RNA, 19 nt, Homo sapiens
gaaaugggaccuugaauac

SEQ ID NO: 1086459 - RNA, 19 nt, Homo sapiens
caacagggaagaaaugaaa

SEQ ID NO: 1086460 - RNA, 19 nt, Homo sapiens
ugagaaacauugagaagau

SEQ ID NO: 1086461 - RNA, 19 nt, Homo sapiens
uacgagagguucccuaauu

SEQ ID NO: 1086462 - RNA, 19 nt, Homo sapiens
gaacuggauuaauaagcaa

SEQ ID NO: 1086463 - RNA, 19 nt, Homo sapiens
gaaauuucaugaguucguu

SEQ ID NO: 1086464 - RNA, 19 nt, Homo sapiens
guguagcucuuucaaauau

SEQ ID NO: 1086465 - RNA, 19 nt, Homo sapiens
uuacaaacgaugcaucuua

SEQ ID NO: 1086466 - RNA, 19 nt, Homo sapiens
gauaaaagguuacaaacga

SEQ ID NO: 1086467 - RNA, 19 nt, Homo sapiens
ugaaaugggaccuugaaua

SEQ ID NO: 1086468 - RNA, 19 nt, Homo sapiens
guuggaaggucucugguuu

SEQ ID NO: 1086469 - RNA, 19 nt, Homo sapiens
gcacuccacuccuauuugg

SEQ ID NO: 1086470 - RNA, 19 nt, Homo sapiens
uuaauggacuggacucuug

SEQ ID NO: 1086471 - RNA, 19 nt, Homo sapiens
cacauagagucauuacuaa

SEQ ID NO: 1086472 - RNA, 19 nt, Homo sapiens
cgaauuuccuuuucuguua

SEQ ID NO: 1086473 - RNA, 19 nt, Homo sapiens
aacuggaacuggauuaaua

SEQ ID NO: 1086474 - RNA, 19 nt, Homo sapiens
gacauaagaaccaaugauu

SEQ ID NO: 1086475 - RNA, 19 nt, Homo sapiens
cuauauagccuuccuguga

SEQ ID NO: 1086476 - RNA, 19 nt, Homo sapiens
uugaauaccugcaagagaa

SEQ ID NO: 1086477 - RNA, 19 nt, Homo sapiens
gggcagaggagcuuauuga

SEQ ID NO: 1086478 - RNA, 19 nt, Homo sapiens
uaugguaccuucucaagug

SEQ ID NO: 1086479 - RNA, 19 nt, Homo sapiens
gcaagccucuguguguuug

SEQ ID NO: 1086480 - RNA, 19 nt, Homo sapiens
gcacacgcauguauguauc

SEQ ID NO: 1086481 - RNA, 19 nt, Homo sapiens
ggaagauugucauggacuu

SEQ ID NO: 1086482 - RNA, 19 nt, Homo sapiens
gcgggaagauugucaugga

SEQ ID NO: 1086483 - RNA, 19 nt, Homo sapiens
gaagggccaucauucacau

SEQ ID NO: 1086484 - RNA, 19 nt, Homo sapiens
acugugaacuucugguaua

SEQ ID NO: 1086485 - RNA, 19 nt, Homo sapiens
gcagaggagcuuauugaga

SEQ ID NO: 1086486 - RNA, 19 nt, Homo sapiens
aguuauagcuucccgacua

SEQ ID NO: 1086487 - RNA, 19 nt, Homo sapiens
gagaaacauugagaagaug

SEQ ID NO: 1086488 - RNA, 19 nt, Homo sapiens
gagguucccuaauuuccaa

SEQ ID NO: 1086489 - RNA, 19 nt, Homo sapiens
uacaaacgaugcaucuuau

SEQ ID NO: 1086490 - RNA, 19 nt, Homo sapiens
aaguguagcucuuucaaau

SEQ ID NO: 1086491 - RNA, 19 nt, Homo sapiens
uggccagccucccuacuua

SEQ ID NO: 1086492 - RNA, 19 nt, Homo sapiens
guacugguggcaucacaua

SEQ ID NO: 1086493 - RNA, 19 nt, Homo sapiens
ucgagugccucuacccaua

SEQ ID NO: 1086494 - RNA, 19 nt, Homo sapiens
uugagaaacugcaggauau

SEQ ID NO: 1086495 - RNA, 19 nt, Homo sapiens
ccaauuuccagaacuuuaa

SEQ ID NO: 1086496 - RNA, 19 nt, Homo sapiens
ggccaucauucacaucuau

SEQ ID NO: 1086497 - RNA, 19 nt, Homo sapiens
gcccaggccauauccuuua

SEQ ID NO: 1086498 - RNA, 19 nt, Homo sapiens
gaaggucucugguuuucuu

SEQ ID NO: 1086499 - RNA, 19 nt, Homo sapiens
ugagcuuccuggcugaaua

SEQ ID NO: 1086500 - RNA, 19 nt, Homo sapiens
caucaugucuguguguaug

SEQ ID NO: 1086501 - RNA, 19 nt, Homo sapiens
acgagagguucccuaauuu

SEQ ID NO: 1086502 - RNA, 19 nt, Homo sapiens
caaacgaugcaucuuauuc

SEQ ID NO: 1086503 - RNA, 19 nt, Homo sapiens
gggaagagagguuguaucu

SEQ ID NO: 1086504 - RNA, 19 nt, Homo sapiens
guugagaaacugcaggaua

SEQ ID NO: 1086505 - RNA, 19 nt, Homo sapiens
uauagucaaugcugggaaa

SEQ ID NO: 1086506 - RNA, 19 nt, Homo sapiens
acaacacccucaauaguca

SEQ ID NO: 1086507 - RNA, 19 nt, Homo sapiens
ggaaguacugccugaccua

SEQ ID NO: 1086508 - RNA, 19 nt, Homo sapiens
ggacauaagaaccaaugau

SEQ ID NO: 1086509 - RNA, 19 nt, Homo sapiens
ugugagagaggauuagaua

SEQ ID NO: 1086510 - RNA, 19 nt, Homo sapiens
gucauggacuucuuagguu

SEQ ID NO: 1086511 - RNA, 19 nt, Homo sapiens
gagaagaagauggccaauu

SEQ ID NO: 1086512 - RNA, 19 nt, Homo sapiens
guagcucuuucaaauauag

SEQ ID NO: 1086513 - RNA, 19 nt, Homo sapiens
gaagaagauggccaauuuc

SEQ ID NO: 1086514 - RNA, 19 nt, Homo sapiens
ccacaacacccucaauagu

SEQ ID NO: 1086515 - RNA, 19 nt, Homo sapiens
ccaagguucuccacugcuu

SEQ ID NO: 1086516 - RNA, 19 nt, Homo sapiens
cuaaaguccugcauucagu

SEQ ID NO: 1086517 - RNA, 19 nt, Homo sapiens
ucauggacuucuuagguuu

SEQ ID NO: 1086518 - RNA, 19 nt, Homo sapiens
ggggagggguguuuauuuu

SEQ ID NO: 1086519 - RNA, 19 nt, Homo sapiens
gcccaggagucagguguuu

SEQ ID NO: 1086520 - RNA, 19 nt, Homo sapiens
cagaaaguggccauaauga

SEQ ID NO: 1086521 - RNA, 19 nt, Homo sapiens
gccaauuuccagaacuuua

SEQ ID NO: 1086522 - RNA, 19 nt, Homo sapiens
caguguggaugugaagaua

SEQ ID NO: 1086523 - RNA, 19 nt, Homo sapiens
agagcuagucugaccauua

SEQ ID NO: 1086524 - RNA, 19 nt, Homo sapiens
gggcacgggcaaacacaua

SEQ ID NO: 1086525 - RNA, 19 nt, Homo sapiens
gauugugcauaaguucuaa

SEQ ID NO: 1086526 - RNA, 19 nt, Homo sapiens
ucaaagcucaucagaaagu

SEQ ID NO: 1086527 - RNA, 19 nt, Homo sapiens
ggcaucacauagagucauu

SEQ ID NO: 1086528 - RNA, 19 nt, Homo sapiens
ugacaccugcucacuauga

SEQ ID NO: 1086529 - RNA, 19 nt, Homo sapiens
ucagaaaguggccauaaug

SEQ ID NO: 1086530 - RNA, 19 nt, Homo sapiens
agaauugaauauccucuca

SEQ ID NO: 1086531 - RNA, 19 nt, Homo sapiens
caucagaaaguggccauaa

SEQ ID NO: 1086532 - RNA, 19 nt, Homo sapiens
aaaugugguugguuacgaa

SEQ ID NO: 1086533 - RNA, 19 nt, Homo sapiens
uuaauaagcaacagggaaa

SEQ ID NO: 1086534 - RNA, 19 nt, Homo sapiens
guacuaugaugagaagaag

SEQ ID NO: 1086535 - RNA, 19 nt, Homo sapiens
cauauaguuucucucuuuc

SEQ ID NO: 1086536 - RNA, 19 nt, Homo sapiens
caagcucaagccauacaua

SEQ ID NO: 1086537 - RNA, 19 nt, Homo sapiens
gguuggcccuggugauguu

SEQ ID NO: 1086538 - RNA, 19 nt, Homo sapiens
gaauaccugcaagagaaua

SEQ ID NO: 1086539 - RNA, 19 nt, Homo sapiens
gguuguaucugcagcaaac

SEQ ID NO: 1086540 - RNA, 19 nt, Homo sapiens
caaguguagcucuuucaaa

SEQ ID NO: 1086541 - RNA, 19 nt, Homo sapiens
gugcacugaugaacugaga

SEQ ID NO: 1086542 - RNA, 19 nt, Homo sapiens
agacacauauaguuucucu

SEQ ID NO: 1086543 - RNA, 19 nt, Homo sapiens
agagccagguggacuuuga

SEQ ID NO: 1086544 - RNA, 19 nt, Homo sapiens
gaaucccaguugcgcaguu

SEQ ID NO: 1086545 - RNA, 19 nt, Homo sapiens
gggaugcgaugcuggagaa

SEQ ID NO: 1086546 - RNA, 19 nt, Homo sapiens
ucgaaggacugcagcauga

SEQ ID NO: 1086547 - RNA, 19 nt, Homo sapiens
gaagacagaggaaccacuu

SEQ ID NO: 1086548 - RNA, 19 nt, Homo sapiens
ggucuggguucccuucuau

SEQ ID NO: 1086549 - RNA, 19 nt, Homo sapiens
gcugcucucucucuucuug

SEQ ID NO: 1086550 - RNA, 19 nt, Homo sapiens
ggaagucaguguucgucau

SEQ ID NO: 1086551 - RNA, 19 nt, Homo sapiens
ggacaggcgucugcagaag

SEQ ID NO: 1086552 - RNA, 19 nt, Homo sapiens
gaaccauggacaccaagaa

SEQ ID NO: 1086553 - RNA, 19 nt, Homo sapiens
gcacaguuggcuuccguuu

SEQ ID NO: 1086554 - RNA, 19 nt, Homo sapiens
ugucaggccuggucucuca

SEQ ID NO: 1086555 - RNA, 19 nt, Homo sapiens
acaguuggcuuccguuucu

SEQ ID NO: 1086556 - RNA, 19 nt, Homo sapiens
gaaccagccuccacauccu

SEQ ID NO: 1086557 - RNA, 19 nt, Homo sapiens
agaccugggugcaaggaaa

SEQ ID NO: 1086558 - RNA, 19 nt, Homo sapiens
ugaaggaggagcccaaugu

SEQ ID NO: 1086559 - RNA, 19 nt, Homo sapiens
augcgaugcuggagaagua

SEQ ID NO: 1086560 - RNA, 19 nt, Homo sapiens
gcacacugccucccgagau

SEQ ID NO: 1086561 - RNA, 19 nt, Homo sapiens
gaagucaguguucgucauc

SEQ ID NO: 1086562 - RNA, 19 nt, Homo sapiens
ggccugggcugacaacacu

SEQ ID NO: 1086563 - RNA, 19 nt, Homo sapiens
cagcagaagacccaggaaa

SEQ ID NO: 1086564 - RNA, 19 nt, Homo sapiens
gcaugacccugggcaacug

SEQ ID NO: 1086565 - RNA, 19 nt, Homo sapiens
ggaagucgcagcuggucau

SEQ ID NO: 1086566 - RNA, 19 nt, Homo sapiens
ggaagucgcagcuggucau

SEQ ID NO: 1086567 - RNA, 19 nt, Homo sapiens
gaaggaggagcccaauguc

SEQ ID NO: 1086568 - RNA, 19 nt, Homo sapiens
gacauggccugggcugaca

SEQ ID NO: 1086569 - RNA, 19 nt, Homo sapiens
ggagcccaaugucgaugga

SEQ ID NO: 1086570 - RNA, 19 nt, Homo sapiens
ucacagcccauguccugaa

SEQ ID NO: 1086571 - RNA, 19 nt, Homo sapiens
gcucgggaaaugagaguga

SEQ ID NO: 1086572 - RNA, 19 nt, Homo sapiens
ggaggagcccaaugucgau

SEQ ID NO: 1086573 - RNA, 19 nt, Homo sapiens
gggacaggcgucugcagaa

SEQ ID NO: 1086574 - RNA, 19 nt, Homo sapiens
gcagaagacccaggaaagc

SEQ ID NO: 1086575 - RNA, 19 nt, Homo sapiens
gagugcgggugcagcuuca

SEQ ID NO: 1086576 - RNA, 19 nt, Homo sapiens
ggaccggucacagaaggaa

SEQ ID NO: 1086577 - RNA, 19 nt, Homo sapiens
gaagccugcgcucgggaaa

SEQ ID NO: 1086578 - RNA, 19 nt, Homo sapiens
aggcccaucuugacgauuc

SEQ ID NO: 1086579 - RNA, 19 nt, Homo sapiens
ccaggcccaucuugacgau

SEQ ID NO: 1086580 - RNA, 19 nt, Homo sapiens
ggaaccauggacaccaaga

SEQ ID NO: 1086581 - RNA, 19 nt, Homo sapiens
cagcccauguccugaagca

SEQ ID NO: 1086582 - RNA, 19 nt, Homo sapiens
cagaagacccaggaaagca

SEQ ID NO: 1086583 - RNA, 19 nt, Homo sapiens
guggagagcagcagaagac

SEQ ID NO: 1086584 - RNA, 19 nt, Homo sapiens
acagagaagccaccacaag

SEQ ID NO: 1086585 - RNA, 19 nt, Homo sapiens
cacacugccucccgagauc

SEQ ID NO: 1086586 - RNA, 19 nt, Homo sapiens
gaaagaagaagcucuagua

SEQ ID NO: 1086587 - RNA, 19 nt, Homo sapiens
gauggacacuguauaauuu

SEQ ID NO: 1086588 - RNA, 19 nt, Homo sapiens
agaagaagcucuaguacaa

SEQ ID NO: 1086589 - RNA, 19 nt, Homo sapiens
gaagaagaguggcgacaga

SEQ ID NO: 1086590 - RNA, 19 nt, Homo sapiens
uaaacucggugguacauaa

SEQ ID NO: 1086591 - RNA, 19 nt, Homo sapiens
gugaagaaacugcuaaaua

SEQ ID NO: 1086592 - RNA, 19 nt, Homo sapiens
gaagagugguaccauaugu

SEQ ID NO: 1086593 - RNA, 19 nt, Homo sapiens
gaacuuggcuauuuucuug

SEQ ID NO: 1086594 - RNA, 19 nt, Homo sapiens
gaguaagacuuuauucuca

SEQ ID NO: 1086595 - RNA, 19 nt, Homo sapiens
cacagaagaugaagauaaa

SEQ ID NO: 1086596 - RNA, 19 nt, Homo sapiens
ggaagaagguuauuuugaa

SEQ ID NO: 1086597 - RNA, 19 nt, Homo sapiens
gaaagaguacugaaauguu

SEQ ID NO: 1086598 - RNA, 19 nt, Homo sapiens
acagaaacuugguagcuua

SEQ ID NO: 1086599 - RNA, 19 nt, Homo sapiens
gaacaaauagcacaucaag

SEQ ID NO: 1086600 - RNA, 19 nt, Homo sapiens
aggaagaacuuggcuauuu

SEQ ID NO: 1086601 - RNA, 19 nt, Homo sapiens
uacaagaacugguugauuc

SEQ ID NO: 1086602 - RNA, 19 nt, Homo sapiens
caaauggaaucuugcugaa

SEQ ID NO: 1086603 - RNA, 19 nt, Homo sapiens
caaaugcaauguuuacaag

SEQ ID NO: 1086604 - RNA, 19 nt, Homo sapiens
gcuuagcacugcauaauuc

SEQ ID NO: 1086605 - RNA, 19 nt, Homo sapiens
gggaaagaguacugaaaug

SEQ ID NO: 1086606 - RNA, 19 nt, Homo sapiens
ggaagaacuuggcuauuuu

SEQ ID NO: 1086607 - RNA, 19 nt, Homo sapiens
uuaaugugcugcuagguuu

SEQ ID NO: 1086608 - RNA, 19 nt, Homo sapiens
gagaagagugguaccauau

SEQ ID NO: 1086609 - RNA, 19 nt, Homo sapiens
agagaagagugguaccaua

SEQ ID NO: 1086610 - RNA, 19 nt, Homo sapiens
gguguuggaucuauagguu

SEQ ID NO: 1086611 - RNA, 19 nt, Homo sapiens
acaucaagcuguuguaaug

SEQ ID NO: 1086612 - RNA, 19 nt, Homo sapiens
agaaagaguuugugaagag

SEQ ID NO: 1086613 - RNA, 19 nt, Homo sapiens
ggaaagaguacugaaaugu

SEQ ID NO: 1086614 - RNA, 19 nt, Homo sapiens
acacagaagaugaagauaa

SEQ ID NO: 1086615 - RNA, 19 nt, Homo sapiens
gcagaaagaguuugugaag

SEQ ID NO: 1086616 - RNA, 19 nt, Homo sapiens
guauagccauggaauugaa

SEQ ID NO: 1086617 - RNA, 19 nt, Homo sapiens
gcacaaaugcaauguuuac

SEQ ID NO: 1086618 - RNA, 19 nt, Homo sapiens
gcuuucaagucaagaguaa

SEQ ID NO: 1086619 - RNA, 19 nt, Homo sapiens
gcacaucaagcuguuguaa

SEQ ID NO: 1086620 - RNA, 19 nt, Homo sapiens
gaagaaacugcuaaauauc

SEQ ID NO: 1086621 - RNA, 19 nt, Homo sapiens
ccuggaagcugagaagaaa

SEQ ID NO: 1086622 - RNA, 19 nt, Homo sapiens
gcacggaugccauuagcaa

SEQ ID NO: 1086623 - RNA, 19 nt, Homo sapiens
guacaaagagagaagaugu

SEQ ID NO: 1086624 - RNA, 19 nt, Homo sapiens
gaaaagacacagaagauga

SEQ ID NO: 1086625 - RNA, 19 nt, Homo sapiens
guacauguccuauucuaca

SEQ ID NO: 1086626 - RNA, 19 nt, Homo sapiens
gaaacuugguagcuuagca

SEQ ID NO: 1086627 - RNA, 19 nt, Homo sapiens
uguuggaucuauagguuua

SEQ ID NO: 1086628 - RNA, 19 nt, Homo sapiens
ucacaaaguuuucaaccua

SEQ ID NO: 1086629 - RNA, 19 nt, Homo sapiens
gaugauagccagagauuuu

SEQ ID NO: 1086630 - RNA, 19 nt, Homo sapiens
gaagaagcucuaguacaaa

SEQ ID NO: 1086631 - RNA, 19 nt, Homo sapiens
acaaacagcaguaucagaa

SEQ ID NO: 1086632 - RNA, 19 nt, Homo sapiens
gccaagugcuauuuuguua

SEQ ID NO: 1086633 - RNA, 19 nt, Homo sapiens
gaaucuugcugaagcucaa

SEQ ID NO: 1086634 - RNA, 19 nt, Homo sapiens
agaagaugaugaacccaaa

SEQ ID NO: 1086635 - RNA, 19 nt, Homo sapiens
ggugguacauaaagaagau

SEQ ID NO: 1086636 - RNA, 19 nt, Homo sapiens
cagaaagaguuugugaaga

SEQ ID NO: 1086637 - RNA, 19 nt, Homo sapiens
uaccacagaguccagauua

SEQ ID NO: 1086638 - RNA, 19 nt, Homo sapiens
gagggaaagaguacugaaa

SEQ ID NO: 1086639 - RNA, 19 nt, Homo sapiens
gcuauuuucuugacacuuu

SEQ ID NO: 1086640 - RNA, 19 nt, Homo sapiens
uuagaauccuuaccacaga

SEQ ID NO: 1086641 - RNA, 19 nt, Homo sapiens
gaagaguggcgacagaaag

SEQ ID NO: 1086642 - RNA, 19 nt, Homo sapiens
ugauggacacuguauaauu

SEQ ID NO: 1086643 - RNA, 19 nt, Homo sapiens
aagcagaggaagaagguua

SEQ ID NO: 1086644 - RNA, 19 nt, Homo sapiens
gggcuuuaauggaacaaau

SEQ ID NO: 1086645 - RNA, 19 nt, Homo sapiens
ugcugaagcucaacagaaa

SEQ ID NO: 1086646 - RNA, 19 nt, Homo sapiens
aaugauggacacuguauaa

SEQ ID NO: 1086647 - RNA, 19 nt, Homo sapiens
gaaagccaaagcagaggaa

SEQ ID NO: 1086648 - RNA, 19 nt, Homo sapiens
gggaugauagccagagauu

SEQ ID NO: 1086649 - RNA, 19 nt, Homo sapiens
gaagcucaacagaaacuug

SEQ ID NO: 1086650 - RNA, 19 nt, Homo sapiens
gcgugcaaauggaaucuug

SEQ ID NO: 1086651 - RNA, 19 nt, Homo sapiens
gauauguacauguccuauu

SEQ ID NO: 1086652 - RNA, 19 nt, Homo sapiens
gacacuguauaauuugguu

SEQ ID NO: 1086653 - RNA, 19 nt, Homo sapiens
gcuguuguaaugcaguuua

SEQ ID NO: 1086654 - RNA, 19 nt, Homo sapiens
acaaauagcacaucaagcu

SEQ ID NO: 1086655 - RNA, 19 nt, Homo sapiens
ccagauguauagccaugga

SEQ ID NO: 1086656 - RNA, 19 nt, Homo sapiens
caaagcacaaacagcagua

SEQ ID NO: 1086657 - RNA, 19 nt, Homo sapiens
auauguacauguccuauuc

SEQ ID NO: 1086658 - RNA, 19 nt, Homo sapiens
cuaugacaguucagaauca

SEQ ID NO: 1086659 - RNA, 19 nt, Homo sapiens
gaagaagguuauuuugaag

SEQ ID NO: 1086660 - RNA, 19 nt, Homo sapiens
gagcacggaugccauuagc

SEQ ID NO: 1086661 - RNA, 19 nt, Homo sapiens
aagaagcucuaguacaaag

SEQ ID NO: 1086662 - RNA, 19 nt, Homo sapiens
aaaggaagaacuuggcuau

SEQ ID NO: 1086663 - RNA, 19 nt, Homo sapiens
gccauuagcaaggauguuu

SEQ ID NO: 1086664 - RNA, 19 nt, Homo sapiens
acagaaagaagaagcucua

SEQ ID NO: 1086665 - RNA, 19 nt, Homo sapiens
gcucaacagaaacuuggua

SEQ ID NO: 1086666 - RNA, 19 nt, Homo sapiens
guacauaaagaagaugaug

SEQ ID NO: 1086667 - RNA, 19 nt, Homo sapiens
aaaugaacuugaagcuuuc

SEQ ID NO: 1086668 - RNA, 19 nt, Homo sapiens
caaagcagaggaagaaggu

SEQ ID NO: 1086669 - RNA, 19 nt, Homo sapiens
aaagagagaagaugugucu

SEQ ID NO: 1086670 - RNA, 19 nt, Homo sapiens
aaacagcaguaucagaacu

SEQ ID NO: 1086671 - RNA, 19 nt, Homo sapiens
gccaagggcgguuguagga

SEQ ID NO: 1086672 - RNA, 19 nt, Homo sapiens
ccaagaggguguuuucguu

SEQ ID NO: 1086673 - RNA, 19 nt, Homo sapiens
uugagucgaugggaugaua

SEQ ID NO: 1086674 - RNA, 19 nt, Homo sapiens
gagcaugccaaagcacaaa

SEQ ID NO: 1086675 - RNA, 19 nt, Homo sapiens
gauguauagccauggaauu

SEQ ID NO: 1086676 - RNA, 19 nt, Homo sapiens
cagcuuaaacucgguggua

SEQ ID NO: 1086677 - RNA, 19 nt, Homo sapiens
cuucaguauucuaucagua

SEQ ID NO: 1086678 - RNA, 19 nt, Homo sapiens
uggaacaaauagcacauca

SEQ ID NO: 1086679 - RNA, 19 nt, Homo sapiens
cagaagaugaagauaaauc

SEQ ID NO: 1086680 - RNA, 19 nt, Homo sapiens
agacacagaagaugaagau

SEQ ID NO: 1086681 - RNA, 19 nt, Homo sapiens
caucugcuacagucucuuu

SEQ ID NO: 1086682 - RNA, 19 nt, Homo sapiens
ccacagaguccagauuauc

SEQ ID NO: 1086683 - RNA, 19 nt, Homo sapiens
caacagaaacuugguagcu

SEQ ID NO: 1086684 - RNA, 19 nt, Homo sapiens
gcaguuuauuauggaaaug

SEQ ID NO: 1086685 - RNA, 19 nt, Homo sapiens
ggaacaaauagcacaucaa

SEQ ID NO: 1086686 - RNA, 19 nt, Homo sapiens
caagaaaugcugucacuuu

SEQ ID NO: 1086687 - RNA, 19 nt, Homo sapiens
ucagagauguuaccaagaa

SEQ ID NO: 1086688 - RNA, 19 nt, Homo sapiens
gaagagaugccuacucgaa

SEQ ID NO: 1086689 - RNA, 19 nt, Homo sapiens
gaaccacuaccauacauuu

SEQ ID NO: 1086690 - RNA, 19 nt, Homo sapiens
aaccugagauuucugaaua

SEQ ID NO: 1086691 - RNA, 19 nt, Homo sapiens
ggacccagcugaugaccuu

SEQ ID NO: 1086692 - RNA, 19 nt, Homo sapiens
gguagaaauuuccugguuu

SEQ ID NO: 1086693 - RNA, 19 nt, Homo sapiens
uguagacgcuuaauaaaug

SEQ ID NO: 1086694 - RNA, 19 nt, Homo sapiens
ccacucacauguccuggua

SEQ ID NO: 1086695 - RNA, 19 nt, Homo sapiens
gaacagcuguggccauugc

SEQ ID NO: 1086696 - RNA, 19 nt, Homo sapiens
gaaacccaguucaggugua

SEQ ID NO: 1086697 - RNA, 19 nt, Homo sapiens
gaagccauauuugaauuga

SEQ ID NO: 1086698 - RNA, 19 nt, Homo sapiens
ccaaagacuugcccuggaa

SEQ ID NO: 1086699 - RNA, 19 nt, Homo sapiens
cguuguaacucauguguuu

SEQ ID NO: 1086700 - RNA, 19 nt, Homo sapiens
ccacagcacuuuguuauac

SEQ ID NO: 1086701 - RNA, 19 nt, Homo sapiens
ccagaaccuucaugaugua

SEQ ID NO: 1086702 - RNA, 19 nt, Homo sapiens
ggaccagcauucaagaugu

SEQ ID NO: 1086703 - RNA, 19 nt, Homo sapiens
gcagugagcuuggccuaca

SEQ ID NO: 1086704 - RNA, 19 nt, Homo sapiens
caacacaaaccugagauuu

SEQ ID NO: 1086705 - RNA, 19 nt, Homo sapiens
cauuguagacgcuuaauaa

SEQ ID NO: 1086706 - RNA, 19 nt, Homo sapiens
gaaccuucaugauguaucu

SEQ ID NO: 1086707 - RNA, 19 nt, Homo sapiens
ggucaaggcuggugguucu

SEQ ID NO: 1086708 - RNA, 19 nt, Homo sapiens
gauuuggaauggagagaaa

SEQ ID NO: 1086709 - RNA, 19 nt, Homo sapiens
gugaagccauauuugaauu

SEQ ID NO: 1086710 - RNA, 19 nt, Homo sapiens
gagaaaggcagcccaagug

SEQ ID NO: 1086711 - RNA, 19 nt, Homo sapiens
uuuaagcucuugacagaaa

SEQ ID NO: 1086712 - RNA, 19 nt, Homo sapiens
ggacagagguggggaaguu

SEQ ID NO: 1086713 - RNA, 19 nt, Homo sapiens
gagcuuggccuacagugaa

SEQ ID NO: 1086714 - RNA, 19 nt, Homo sapiens
ggagaggauuaccaggaaa

SEQ ID NO: 1086715 - RNA, 19 nt, Homo sapiens
gaccagcucagagauguua

SEQ ID NO: 1086716 - RNA, 19 nt, Homo sapiens
gagaaccacuaccauacau

SEQ ID NO: 1086717 - RNA, 19 nt, Homo sapiens
gaaauagcguugaaaaugg

SEQ ID NO: 1086718 - RNA, 19 nt, Homo sapiens
gcauucagauuugggagaa

SEQ ID NO: 1086719 - RNA, 19 nt, Homo sapiens
ggccuacagugaagccaua

SEQ ID NO: 1086720 - RNA, 19 nt, Homo sapiens
gcaugcauuucugagguua

SEQ ID NO: 1086721 - RNA, 19 nt, Homo sapiens
cagcagaacggccaugauu

SEQ ID NO: 1086722 - RNA, 19 nt, Homo sapiens
acacaaaccugagauuucu

SEQ ID NO: 1086723 - RNA, 19 nt, Homo sapiens
gauguuaccaagaauauca

SEQ ID NO: 1086724 - RNA, 19 nt, Homo sapiens
agaaguagccccagaaaua

SEQ ID NO: 1086725 - RNA, 19 nt, Homo sapiens
ugaccuugcugccgacauu

SEQ ID NO: 1086726 - RNA, 19 nt, Homo sapiens
gaaauggaaggagaugauu

SEQ ID NO: 1086727 - RNA, 19 nt, Homo sapiens
gcacauuguagacgcuuaa

SEQ ID NO: 1086728 - RNA, 19 nt, Homo sapiens
ggacauuccagcagcuauu

SEQ ID NO: 1086729 - RNA, 19 nt, Homo sapiens
uuuauugacugaucuguga

SEQ ID NO: 1086730 - RNA, 19 nt, Homo sapiens
gagauguuaccaagaauau

SEQ ID NO: 1086731 - RNA, 19 nt, Homo sapiens
ucacagaccagcucagaga

SEQ ID NO: 1086732 - RNA, 19 nt, Homo sapiens
cagcuauucugcaugcauu

SEQ ID NO: 1086733 - RNA, 19 nt, Homo sapiens
guuaauuccugugcugaaa

SEQ ID NO: 1086734 - RNA, 19 nt, Homo sapiens
acaaauugcuguacuccau

SEQ ID NO: 1086735 - RNA, 19 nt, Homo sapiens
gaaaucuccuccgcugugu

SEQ ID NO: 1086736 - RNA, 19 nt, Homo sapiens
ggaauggagagaaauggaa

SEQ ID NO: 1086737 - RNA, 19 nt, Homo sapiens
cuacagugaagccauauuu

SEQ ID NO: 1086738 - RNA, 19 nt, Homo sapiens
gaaccuguggccuuucuga

SEQ ID NO: 1086739 - RNA, 19 nt, Homo sapiens
ggagcagcguccuuaguca

SEQ ID NO: 1086740 - RNA, 19 nt, Homo sapiens
gaaaauagaccacucacau

SEQ ID NO: 1086741 - RNA, 19 nt, Homo sapiens
guagaaauuuccugguuuu

SEQ ID NO: 1086742 - RNA, 19 nt, Homo sapiens
gggcagggacuguacauuc

SEQ ID NO: 1086743 - RNA, 19 nt, Homo sapiens
ggagaaaggcagcccaagu

SEQ ID NO: 1086744 - RNA, 19 nt, Homo sapiens
gaccggauggagaggauua

SEQ ID NO: 1086745 - RNA, 19 nt, Homo sapiens
cuguauagcugcucucugu

SEQ ID NO: 1086746 - RNA, 19 nt, Homo sapiens
aguuuaagcucuugacaga

SEQ ID NO: 1086747 - RNA, 19 nt, Homo sapiens
ggacaaugauuuuccaaca

SEQ ID NO: 1086748 - RNA, 19 nt, Homo sapiens
uuauggagaugguacaaau

SEQ ID NO: 1086749 - RNA, 19 nt, Homo sapiens
guagacgcuuaauaaaugu

SEQ ID NO: 1086750 - RNA, 19 nt, Homo sapiens
gaccagcauucaagaugug

SEQ ID NO: 1086751 - RNA, 19 nt, Homo sapiens
ggagaaccacuaccauaca

SEQ ID NO: 1086752 - RNA, 19 nt, Homo sapiens
gaaauaaaagcaucagaga

SEQ ID NO: 1086753 - RNA, 19 nt, Homo sapiens
gaaguagccccagaaauaa

SEQ ID NO: 1086754 - RNA, 19 nt, Homo sapiens
uaccagaaccuucaugaug

SEQ ID NO: 1086755 - RNA, 19 nt, Homo sapiens
gcaacacaaaccugagauu

SEQ ID NO: 1086756 - RNA, 19 nt, Homo sapiens
gaggugacaucgggucuca

SEQ ID NO: 1086757 - RNA, 19 nt, Homo sapiens
gaagggaggacuuggacau

SEQ ID NO: 1086758 - RNA, 19 nt, Homo sapiens
gaaaugcugucacuuuugg

SEQ ID NO: 1086759 - RNA, 19 nt, Homo sapiens
caccguauuuauugacuga

SEQ ID NO: 1086760 - RNA, 19 nt, Homo sapiens
ucaugcagcucaucacagu

SEQ ID NO: 1086761 - RNA, 19 nt, Homo sapiens
uggagaggauuaccaggaa

SEQ ID NO: 1086762 - RNA, 19 nt, Homo sapiens
gcacugacagcgacagcuu

SEQ ID NO: 1086763 - RNA, 19 nt, Homo sapiens
gugggaagcgcaacacaaa

SEQ ID NO: 1086764 - RNA, 19 nt, Homo sapiens
ucaguaagaaggaauacaa

SEQ ID NO: 1086765 - RNA, 19 nt, Homo sapiens
cagcccagauggagaaaca

SEQ ID NO: 1086766 - RNA, 19 nt, Homo sapiens
ugaaggagucaaccacaaa

SEQ ID NO: 1086767 - RNA, 19 nt, Homo sapiens
caauaucaguaagaaggaa

SEQ ID NO: 1086768 - RNA, 19 nt, Homo sapiens
gcauggacgucaguagcaa

SEQ ID NO: 1086769 - RNA, 19 nt, Homo sapiens
aacaagaaauagcguugaa

SEQ ID NO: 1086770 - RNA, 19 nt, Homo sapiens
ggagacaagcagcaguuug

SEQ ID NO: 1086771 - RNA, 19 nt, Homo sapiens
acagugaagccauauuuga

SEQ ID NO: 1086772 - RNA, 19 nt, Homo sapiens
gauuucggauggguuggua

SEQ ID NO: 1086773 - RNA, 19 nt, Homo sapiens
ggcagggacuguacauucu

SEQ ID NO: 1086774 - RNA, 19 nt, Homo sapiens
cauggcaccguauuuauug

SEQ ID NO: 1086775 - RNA, 19 nt, Homo sapiens
ccauggcaccguauuuauu

SEQ ID NO: 1086776 - RNA, 19 nt, Homo sapiens
cgaguuccguuauggagau

SEQ ID NO: 1086777 - RNA, 19 nt, Homo sapiens
ugucucagcuccugucaag

SEQ ID NO: 1086778 - RNA, 19 nt, Homo sapiens
acaguuuccugcaacaaga

SEQ ID NO: 1086779 - RNA, 19 nt, Homo sapiens
aaauagaccacucacaugu

SEQ ID NO: 1086780 - RNA, 19 nt, Homo sapiens
aaauugcuguacuccauga

SEQ ID NO: 1086781 - RNA, 19 nt, Homo sapiens
ugguagaaauuuccugguu

SEQ ID NO: 1086782 - RNA, 19 nt, Homo sapiens
ggagaaggagagccagaug

SEQ ID NO: 1086783 - RNA, 19 nt, Homo sapiens
gaaguugcaggcccucaau

SEQ ID NO: 1086784 - RNA, 19 nt, Homo sapiens
cagaccagcucagagaugu

SEQ ID NO: 1086785 - RNA, 19 nt, Homo sapiens
accagaaccuucaugaugu

SEQ ID NO: 1086786 - RNA, 19 nt, Homo sapiens
aaacaagacuggagagaua

SEQ ID NO: 1086787 - RNA, 19 nt, Homo sapiens
gaacaagcaucccaacaug

SEQ ID NO: 1086788 - RNA, 19 nt, Homo sapiens
guacgugccugauguguuu

SEQ ID NO: 1086789 - RNA, 19 nt, Homo sapiens
caacaaaucccucaacuug

SEQ ID NO: 1086790 - RNA, 19 nt, Homo sapiens
gaacaucagcugcaagauu

SEQ ID NO: 1086791 - RNA, 19 nt, Homo sapiens
ccacuuuccucuucuagua

SEQ ID NO: 1086792 - RNA, 19 nt, Homo sapiens
aagguuggcuggauauuua

SEQ ID NO: 1086793 - RNA, 19 nt, Homo sapiens
aauaauggcuucucgguuu

SEQ ID NO: 1086794 - RNA, 19 nt, Homo sapiens
aacaucagcugcaagauua

SEQ ID NO: 1086795 - RNA, 19 nt, Homo sapiens
gcacggacuucuagagaga

SEQ ID NO: 1086796 - RNA, 19 nt, Homo sapiens
ugaaauugcugccaaacuu

SEQ ID NO: 1086797 - RNA, 19 nt, Homo sapiens
ggacaccuauuuccuaagu

SEQ ID NO: 1086798 - RNA, 19 nt, Homo sapiens
ggccaaggcuuccugcauu

SEQ ID NO: 1086799 - RNA, 19 nt, Homo sapiens
gcaggagacuuccagaaca

SEQ ID NO: 1086800 - RNA, 19 nt, Homo sapiens
gacaauaucauguuugaga

SEQ ID NO: 1086801 - RNA, 19 nt, Homo sapiens
agaaacagcagcaacauuu

SEQ ID NO: 1086802 - RNA, 19 nt, Homo sapiens
caaagagagucagagcuaa

SEQ ID NO: 1086803 - RNA, 19 nt, Homo sapiens
gcauuucccuuacucugaa

SEQ ID NO: 1086804 - RNA, 19 nt, Homo sapiens
gagaggagcuggguugaag

SEQ ID NO: 1086805 - RNA, 19 nt, Homo sapiens
ccacccagccuucucuuua

SEQ ID NO: 1086806 - RNA, 19 nt, Homo sapiens
aggaugagauugaucagua

SEQ ID NO: 1086807 - RNA, 19 nt, Homo sapiens
ccaaagagagucagagcua

SEQ ID NO: 1086808 - RNA, 19 nt, Homo sapiens
ugaaguggcugcgauuuau

SEQ ID NO: 1086809 - RNA, 19 nt, Homo sapiens
ccacacagcugcagcaacu

SEQ ID NO: 1086810 - RNA, 19 nt, Homo sapiens
ccacauccuucccuccuuu

SEQ ID NO: 1086811 - RNA, 19 nt, Homo sapiens
cgaauggcaucuguacuaa

SEQ ID NO: 1086812 - RNA, 19 nt, Homo sapiens
aaacaggacgggaagauuu

SEQ ID NO: 1086813 - RNA, 19 nt, Homo sapiens
uggaguaucucaucauaga

SEQ ID NO: 1086814 - RNA, 19 nt, Homo sapiens
gcggaagguuggcuggaua

SEQ ID NO: 1086815 - RNA, 19 nt, Homo sapiens
gaaaagcauuggcgauuug

SEQ ID NO: 1086816 - RNA, 19 nt, Homo sapiens
gaagguuggcuggauauuu

SEQ ID NO: 1086817 - RNA, 19 nt, Homo sapiens
gcugggcccucaucugaaa

SEQ ID NO: 1086818 - RNA, 19 nt, Homo sapiens
ggugagcccugcugugaga

SEQ ID NO: 1086819 - RNA, 19 nt, Homo sapiens
gaucacagcaacaaagaga

SEQ ID NO: 1086820 - RNA, 19 nt, Homo sapiens
gaccucgucucagaagaua

SEQ ID NO: 1086821 - RNA, 19 nt, Homo sapiens
ggacagcacggacuucuag

SEQ ID NO: 1086822 - RNA, 19 nt, Homo sapiens
gguaccagguguccaauca

SEQ ID NO: 1086823 - RNA, 19 nt, Homo sapiens
caccgucgcugaccgcuuu

SEQ ID NO: 1086824 - RNA, 19 nt, Homo sapiens
gacacacccucucaugcua

SEQ ID NO: 1086825 - RNA, 19 nt, Homo sapiens
ucaguucucccuugaagua

SEQ ID NO: 1086826 - RNA, 19 nt, Homo sapiens
ggucaccaaugaaguuaug

SEQ ID NO: 1086827 - RNA, 19 nt, Homo sapiens
gaaauugcugccaaacuug

SEQ ID NO: 1086828 - RNA, 19 nt, Homo sapiens
gagaacaucagcugcaaga

SEQ ID NO: 1086829 - RNA, 19 nt, Homo sapiens
gcugggagcucuugguuac

SEQ ID NO: 1086830 - RNA, 19 nt, Homo sapiens
ccagcaauuuggguacuua

SEQ ID NO: 1086831 - RNA, 19 nt, Homo sapiens
ggaaaagcauuggcgauuu

SEQ ID NO: 1086832 - RNA, 19 nt, Homo sapiens
ggagugagagagacuaguu

SEQ ID NO: 1086833 - RNA, 19 nt, Homo sapiens
ccaccuauuugucucagaa

SEQ ID NO: 1086834 - RNA, 19 nt, Homo sapiens
gccgagagcaucauaauuc

SEQ ID NO: 1086835 - RNA, 19 nt, Homo sapiens
aagcugaaguggucgauga

SEQ ID NO: 1086836 - RNA, 19 nt, Homo sapiens
gaaauggagacgucaguuc

SEQ ID NO: 1086837 - RNA, 19 nt, Homo sapiens
guacaggcauguggacaau

SEQ ID NO: 1086838 - RNA, 19 nt, Homo sapiens
guucaguaaugcacuuuau

SEQ ID NO: 1086839 - RNA, 19 nt, Homo sapiens
gagaaacagcagcaacauu

SEQ ID NO: 1086840 - RNA, 19 nt, Homo sapiens
cugcauugcuucccuguga

SEQ ID NO: 1086841 - RNA, 19 nt, Homo sapiens
gggcacugcacaauugaua

SEQ ID NO: 1086842 - RNA, 19 nt, Homo sapiens
gaaacaagacuggagagau

SEQ ID NO: 1086843 - RNA, 19 nt, Homo sapiens
uuuaaagucugcauugguu

SEQ ID NO: 1086844 - RNA, 19 nt, Homo sapiens
cagaagcguugcugagugu

SEQ ID NO: 1086845 - RNA, 19 nt, Homo sapiens
ucccaggucuccaugagua

SEQ ID NO: 1086846 - RNA, 19 nt, Homo sapiens
ugaaguggucgaugaaauu

SEQ ID NO: 1086847 - RNA, 19 nt, Homo sapiens
ccgaauggcaucuguacua

SEQ ID NO: 1086848 - RNA, 19 nt, Homo sapiens
ccaccgggcuucaaagucu

SEQ ID NO: 1086849 - RNA, 19 nt, Homo sapiens
gcauggcgauuuguuguuc

SEQ ID NO: 1086850 - RNA, 19 nt, Homo sapiens
caggagacuuccagaacaa

SEQ ID NO: 1086851 - RNA, 19 nt, Homo sapiens
gaaguggucgaugaaauug

SEQ ID NO: 1086852 - RNA, 19 nt, Homo sapiens
uggacaauaucauguuuga

SEQ ID NO: 1086853 - RNA, 19 nt, Homo sapiens
acaggcauguggacaauau

SEQ ID NO: 1086854 - RNA, 19 nt, Homo sapiens
gagagaaacagcagcaaca

SEQ ID NO: 1086855 - RNA, 19 nt, Homo sapiens
auaauggcuucucgguuua

SEQ ID NO: 1086856 - RNA, 19 nt, Homo sapiens
ccagucaguucucccuuga

SEQ ID NO: 1086857 - RNA, 19 nt, Homo sapiens
uguggaguaucucaucaua

SEQ ID NO: 1086858 - RNA, 19 nt, Homo sapiens
cgguuuacaucaauagaaa

SEQ ID NO: 1086859 - RNA, 19 nt, Homo sapiens
gcccugcaguggaaccuaa

SEQ ID NO: 1086860 - RNA, 19 nt, Homo sapiens
gaauaccucaucuguguuc

SEQ ID NO: 1086861 - RNA, 19 nt, Homo sapiens
ccaacgugguggaggauga

SEQ ID NO: 1086862 - RNA, 19 nt, Homo sapiens
auaaggacguagacaaguu

SEQ ID NO: 1086863 - RNA, 19 nt, Homo sapiens
gccaaggcuuccugcauug

SEQ ID NO: 1086864 - RNA, 19 nt, Homo sapiens
guucuuggauaccaucuca

SEQ ID NO: 1086865 - RNA, 19 nt, Homo sapiens
acacaggacuuccauagcu

SEQ ID NO: 1086866 - RNA, 19 nt, Homo sapiens
cgaugaaauugcugccaaa

SEQ ID NO: 1086867 - RNA, 19 nt, Homo sapiens
gcaauuuggguacuuauac

SEQ ID NO: 1086868 - RNA, 19 nt, Homo sapiens
guccugagaugagcuguga

SEQ ID NO: 1086869 - RNA, 19 nt, Homo sapiens
caucauagacaucacaaca

SEQ ID NO: 1086870 - RNA, 19 nt, Homo sapiens
uagcagcugucacacugaa

SEQ ID NO: 1086871 - RNA, 19 nt, Homo sapiens
cugaguguguucccuguaa

SEQ ID NO: 1086872 - RNA, 19 nt, Homo sapiens
gcugaccgcuuucuugacu

SEQ ID NO: 1086873 - RNA, 19 nt, Homo sapiens
gccauucgaugaggacuau

SEQ ID NO: 1086874 - RNA, 19 nt, Homo sapiens
uaaaagcgccugaagcaaa

SEQ ID NO: 1086875 - RNA, 19 nt, Homo sapiens
gcucagccaccuccucuug

SEQ ID NO: 1086876 - RNA, 19 nt, Homo sapiens
cuacguggcaccuggaauu

SEQ ID NO: 1086877 - RNA, 19 nt, Homo sapiens
ccucaucuguguucuugga

SEQ ID NO: 1086878 - RNA, 19 nt, Homo sapiens
uaaggacguagacaaguuu

SEQ ID NO: 1086879 - RNA, 19 nt, Homo sapiens
acaccuauuuccuaaguuc

SEQ ID NO: 1086880 - RNA, 19 nt, Homo sapiens
acaaaucccucaacuugcu

SEQ ID NO: 1086881 - RNA, 19 nt, Homo sapiens
ggacacacccucucaugcu

SEQ ID NO: 1086882 - RNA, 19 nt, Homo sapiens
cacccagccuucucuuuau

SEQ ID NO: 1086883 - RNA, 19 nt, Homo sapiens
aaagaccucucgccucuac

SEQ ID NO: 1086884 - RNA, 19 nt, Homo sapiens
ugucagcacugcacguuca

SEQ ID NO: 1086885 - RNA, 19 nt, Homo sapiens
gaugaggacuaucuaaacc

SEQ ID NO: 1086886 - RNA, 19 nt, Homo sapiens
ccaaagaucugagaaauaa

SEQ ID NO: 1086887 - RNA, 19 nt, Homo sapiens
gaucauaacugaagaaaca

SEQ ID NO: 1086888 - RNA, 19 nt, Homo sapiens
caagauagauguccugaaa

SEQ ID NO: 1086889 - RNA, 19 nt, Homo sapiens
gaaaucaucucuccuguca

SEQ ID NO: 1086890 - RNA, 19 nt, Homo sapiens
gguaguaaaucuucuagua

SEQ ID NO: 1086891 - RNA, 19 nt, Homo sapiens
gagaauauaucgccuaaca

SEQ ID NO: 1086892 - RNA, 19 nt, Homo sapiens
gcaggaauguugcuuaaga

SEQ ID NO: 1086893 - RNA, 19 nt, Homo sapiens
gaucaugguucuucucaaa

SEQ ID NO: 1086894 - RNA, 19 nt, Homo sapiens
cuacuaaucucaagaagaa

SEQ ID NO: 1086895 - RNA, 19 nt, Homo sapiens
gaaauaaugaggaaccaua

SEQ ID NO: 1086896 - RNA, 19 nt, Homo sapiens
uaaucuggcugaugaaaua

SEQ ID NO: 1086897 - RNA, 19 nt, Homo sapiens
gaaacaggcucugcaguug

SEQ ID NO: 1086898 - RNA, 19 nt, Homo sapiens
ggcuaaagcuggauaauau

SEQ ID NO: 1086899 - RNA, 19 nt, Homo sapiens
cauggcaucucaacaguua

SEQ ID NO: 1086900 - RNA, 19 nt, Homo sapiens
gaaacaagcacuuuaguag

SEQ ID NO: 1086901 - RNA, 19 nt, Homo sapiens
gaucaagccuaccuuuaga

SEQ ID NO: 1086902 - RNA, 19 nt, Homo sapiens
gcauugacauguccuaaga

SEQ ID NO: 1086903 - RNA, 19 nt, Homo sapiens
ugaaauggcuaucaugaug

SEQ ID NO: 1086904 - RNA, 19 nt, Homo sapiens
ccugaaaucugguaugaaa

SEQ ID NO: 1086905 - RNA, 19 nt, Homo sapiens
ugaaccaagugaugaaaua

SEQ ID NO: 1086906 - RNA, 19 nt, Homo sapiens
ggagauguccaaacuauga

SEQ ID NO: 1086907 - RNA, 19 nt, Homo sapiens
gagaggaguuguaguuuua

SEQ ID NO: 1086908 - RNA, 19 nt, Homo sapiens
caagaagaauggugauaga

SEQ ID NO: 1086909 - RNA, 19 nt, Homo sapiens
caaauagucugcaggaagu

SEQ ID NO: 1086910 - RNA, 19 nt, Homo sapiens
gaaacaagcagcgacagua

SEQ ID NO: 1086911 - RNA, 19 nt, Homo sapiens
gcauuaccuugaaauauga

SEQ ID NO: 1086912 - RNA, 19 nt, Homo sapiens
gagcgccucucauuuaaau

SEQ ID NO: 1086913 - RNA, 19 nt, Homo sapiens
ggaggcccauugcagaaua

SEQ ID NO: 1086914 - RNA, 19 nt, Homo sapiens
gagagguucugcaagcuuu

SEQ ID NO: 1086915 - RNA, 19 nt, Homo sapiens
cguaagaacuggugaauac

SEQ ID NO: 1086916 - RNA, 19 nt, Homo sapiens
gagcuuuaguuuaugauga

SEQ ID NO: 1086917 - RNA, 19 nt, Homo sapiens
aaacuggacuagauccuuu

SEQ ID NO: 1086918 - RNA, 19 nt, Homo sapiens
gagagucuacuaagugaua

SEQ ID NO: 1086919 - RNA, 19 nt, Homo sapiens
gggagcagaugccaagauu

SEQ ID NO: 1086920 - RNA, 19 nt, Homo sapiens
gaauguugcuuaagaagag

SEQ ID NO: 1086921 - RNA, 19 nt, Homo sapiens
ggaaccauauucauucuag

SEQ ID NO: 1086922 - RNA, 19 nt, Homo sapiens
ucccagggcuuauuaauau

SEQ ID NO: 1086923 - RNA, 19 nt, Homo sapiens
gcaaacuuguguauauuca

SEQ ID NO: 1086924 - RNA, 19 nt, Homo sapiens
gaaccugacuugaucaacu

SEQ ID NO: 1086925 - RNA, 19 nt, Homo sapiens
gaaguuccauuuccaagag

SEQ ID NO: 1086926 - RNA, 19 nt, Homo sapiens
gggagaauauaucgccuaa

SEQ ID NO: 1086927 - RNA, 19 nt, Homo sapiens
gaaaguuccgucugguaua

SEQ ID NO: 1086928 - RNA, 19 nt, Homo sapiens
ggacuuguaugucugaaag

SEQ ID NO: 1086929 - RNA, 19 nt, Homo sapiens
gaaaccaucaggcagagua

SEQ ID NO: 1086930 - RNA, 19 nt, Homo sapiens
gaacuuacccagagcaaca

SEQ ID NO: 1086931 - RNA, 19 nt, Homo sapiens
gcaagaacccauagcuuug

SEQ ID NO: 1086932 - RNA, 19 nt, Homo sapiens
guuuggaccuuccuaguaa

SEQ ID NO: 1086933 - RNA, 19 nt, Homo sapiens
gagaucaagccuaccuuua

SEQ ID NO: 1086934 - RNA, 19 nt, Homo sapiens
gagggaagauguugaaacu

SEQ ID NO: 1086935 - RNA, 19 nt, Homo sapiens
caaucaacauccaaucauu

SEQ ID NO: 1086936 - RNA, 19 nt, Homo sapiens
cagcagaugacucaaauuu

SEQ ID NO: 1086937 - RNA, 19 nt, Homo sapiens
cagcaugucuagcaucuau

SEQ ID NO: 1086938 - RNA, 19 nt, Homo sapiens
gaauauaucgccuaacaca

SEQ ID NO: 1086939 - RNA, 19 nt, Homo sapiens
gauaguaggacuuguaugu

SEQ ID NO: 1086940 - RNA, 19 nt, Homo sapiens
aauaugaagugccauuuga

SEQ ID NO: 1086941 - RNA, 19 nt, Homo sapiens
ggacuuauccucacaucug

SEQ ID NO: 1086942 - RNA, 19 nt, Homo sapiens
gacagcagaugacucaaau

SEQ ID NO: 1086943 - RNA, 19 nt, Homo sapiens
aacaagcacuuuaguagaa

SEQ ID NO: 1086944 - RNA, 19 nt, Homo sapiens
acaguuagucuuccaaaua

SEQ ID NO: 1086945 - RNA, 19 nt, Homo sapiens
gggcagcaguauugugaaa

SEQ ID NO: 1086946 - RNA, 19 nt, Homo sapiens
ggacagcagaugacucaaa

SEQ ID NO: 1086947 - RNA, 19 nt, Homo sapiens
ggaauugaaguaacucuug

SEQ ID NO: 1086948 - RNA, 19 nt, Homo sapiens
uaaugaagguguacagcuu

SEQ ID NO: 1086949 - RNA, 19 nt, Homo sapiens
ggaccuuccuaguaacuug

SEQ ID NO: 1086950 - RNA, 19 nt, Homo sapiens
gaaccucguuugguauuuc

SEQ ID NO: 1086951 - RNA, 19 nt, Homo sapiens
gaaccaagugaugaaauaa

SEQ ID NO: 1086952 - RNA, 19 nt, Homo sapiens
cacguaaucuggcugauga

SEQ ID NO: 1086953 - RNA, 19 nt, Homo sapiens
gcacugguaguauaucaaa

SEQ ID NO: 1086954 - RNA, 19 nt, Homo sapiens
aaucaucucuccugucaga

SEQ ID NO: 1086955 - RNA, 19 nt, Homo sapiens
ccucacaucugaacauugu

SEQ ID NO: 1086956 - RNA, 19 nt, Homo sapiens
ggugacaguuuacaaagug

SEQ ID NO: 1086957 - RNA, 19 nt, Homo sapiens
gaugaggaagaaacuaaua

SEQ ID NO: 1086958 - RNA, 19 nt, Homo sapiens
gggcuaaagcuggauaaua

SEQ ID NO: 1086959 - RNA, 19 nt, Homo sapiens
uggcaugacuacugcauuu

SEQ ID NO: 1086960 - RNA, 19 nt, Homo sapiens
ggaauuacacagagaggaa

SEQ ID NO: 1086961 - RNA, 19 nt, Homo sapiens
agacuucucuacuucauau

SEQ ID NO: 1086962 - RNA, 19 nt, Homo sapiens
caagguggguggaucacuu

SEQ ID NO: 1086963 - RNA, 19 nt, Homo sapiens
cauauugcauuaccuugaa

SEQ ID NO: 1086964 - RNA, 19 nt, Homo sapiens
ucuggaaccucguuuggua

SEQ ID NO: 1086965 - RNA, 19 nt, Homo sapiens
cuagauccuuugucucuuu

SEQ ID NO: 1086966 - RNA, 19 nt, Homo sapiens
caacaguagauacauauga

SEQ ID NO: 1086967 - RNA, 19 nt, Homo sapiens
uuacugaguuugaggaaug

SEQ ID NO: 1086968 - RNA, 19 nt, Homo sapiens
caucugugccuaauaguuu

SEQ ID NO: 1086969 - RNA, 19 nt, Homo sapiens
caagugaaauggcuaucau

SEQ ID NO: 1086970 - RNA, 19 nt, Homo sapiens
gauaguaacaguaaucagu

SEQ ID NO: 1086971 - RNA, 19 nt, Homo sapiens
caaccuacuuucacagcaa

SEQ ID NO: 1086972 - RNA, 19 nt, Homo sapiens
acaagaaacaagcacuuua

SEQ ID NO: 1086973 - RNA, 19 nt, Homo sapiens
ucauacaucuucuuucauc

SEQ ID NO: 1086974 - RNA, 19 nt, Homo sapiens
ggaaguuguggauccuuua

SEQ ID NO: 1086975 - RNA, 19 nt, Homo sapiens
gcagcaguauugugaaagu

SEQ ID NO: 1086976 - RNA, 19 nt, Homo sapiens
ccaaguaccucuggugaca

SEQ ID NO: 1086977 - RNA, 19 nt, Homo sapiens
cagcaguaguggagaugua

SEQ ID NO: 1086978 - RNA, 19 nt, Homo sapiens
gacaguagccaguaagaug

SEQ ID NO: 1086979 - RNA, 19 nt, Homo sapiens
gaucugagaaauaagagaa

SEQ ID NO: 1086980 - RNA, 19 nt, Homo sapiens
ugacauguccuaagacuuc

SEQ ID NO: 1086981 - RNA, 19 nt, Homo sapiens
gaauggugauagaggagaa

SEQ ID NO: 1086982 - RNA, 19 nt, Homo sapiens
cagagauucuugaaagguu

SEQ ID NO: 1086983 - RNA, 19 nt, Homo sapiens
caucuucuuucaucaauca

SEQ ID NO: 1086984 - RNA, 19 nt, Homo sapiens
gaaaucugguaugaaacaa

SEQ ID NO: 1086985 - RNA, 19 nt, Homo sapiens
ggagaucaagccuaccuuu

SEQ ID NO: 1086986 - RNA, 19 nt, Homo sapiens
aagcaggacuuuauuguua

SEQ ID NO: 1086987 - RNA, 19 nt, Homo sapiens
gcaugaaucugacuccuuu

SEQ ID NO: 1086988 - RNA, 19 nt, Homo sapiens
gcagagugccaauaagaua

SEQ ID NO: 1086989 - RNA, 19 nt, Homo sapiens
gcaguugucuuuguucuug

SEQ ID NO: 1086990 - RNA, 19 nt, Homo sapiens
gagaaugugucccaggauu

SEQ ID NO: 1086991 - RNA, 19 nt, Homo sapiens
gucaguggauugugucuua

SEQ ID NO: 1086992 - RNA, 19 nt, Homo sapiens
gaaagaggacguguguaua

SEQ ID NO: 1086993 - RNA, 19 nt, Homo sapiens
acacagcaguggauucuuu

SEQ ID NO: 1086994 - RNA, 19 nt, Homo sapiens
gagagaggcugcagguuca

SEQ ID NO: 1086995 - RNA, 19 nt, Homo sapiens
aaacagggcucugaugaga

SEQ ID NO: 1086996 - RNA, 19 nt, Homo sapiens
gcucaaagaggguaccaua

SEQ ID NO: 1086997 - RNA, 19 nt, Homo sapiens
ggaaggagaccagcauaaa

SEQ ID NO: 1086998 - RNA, 19 nt, Homo sapiens
ccacggauugugugaauua

SEQ ID NO: 1086999 - RNA, 19 nt, Homo sapiens
gaaaggauggagugugaaa

SEQ ID NO: 1087000 - RNA, 19 nt, Homo sapiens
aagaaaggauggaguguga

SEQ ID NO: 1087001 - RNA, 19 nt, Homo sapiens
gauugugucuuacuacuuc

SEQ ID NO: 1087002 - RNA, 19 nt, Homo sapiens
uaccucaucuucagaguuu

SEQ ID NO: 1087003 - RNA, 19 nt, Homo sapiens
cagcagaaauucauacucu

SEQ ID NO: 1087004 - RNA, 19 nt, Homo sapiens
gaagaugguuuagguguac

SEQ ID NO: 1087005 - RNA, 19 nt, Homo sapiens
gaaucugacuccuuuacug

SEQ ID NO: 1087006 - RNA, 19 nt, Homo sapiens
cuucagaguuuauguucua

SEQ ID NO: 1087007 - RNA, 19 nt, Homo sapiens
gcagcucgaugccucagaa

SEQ ID NO: 1087008 - RNA, 19 nt, Homo sapiens
acacugggcucuuuaccaa

SEQ ID NO: 1087009 - RNA, 19 nt, Homo sapiens
gaauaagcuuggugaacug

SEQ ID NO: 1087010 - RNA, 19 nt, Homo sapiens
uaauggagaagaugguuua

SEQ ID NO: 1087011 - RNA, 19 nt, Homo sapiens
gaguuuauguucuacugaa

SEQ ID NO: 1087012 - RNA, 19 nt, Homo sapiens
guugagaccuguauggaau

SEQ ID NO: 1087013 - RNA, 19 nt, Homo sapiens
gaugagaacaugucagaau

SEQ ID NO: 1087014 - RNA, 19 nt, Homo sapiens
gcagaaauucauacucuau

SEQ ID NO: 1087015 - RNA, 19 nt, Homo sapiens
gcagcuguauuguauuuua

SEQ ID NO: 1087016 - RNA, 19 nt, Homo sapiens
gucauccucugcucuauuu

SEQ ID NO: 1087017 - RNA, 19 nt, Homo sapiens
caagugggcuccugaucau

SEQ ID NO: 1087018 - RNA, 19 nt, Homo sapiens
ugaaagaggacguguguau

SEQ ID NO: 1087019 - RNA, 19 nt, Homo sapiens
guucaagucugcuaagaag

SEQ ID NO: 1087020 - RNA, 19 nt, Homo sapiens
guagccaguuccaaacaaa

SEQ ID NO: 1087021 - RNA, 19 nt, Homo sapiens
gaaguagaaagaauggauu

SEQ ID NO: 1087022 - RNA, 19 nt, Homo sapiens
gaaaccagcagugugugua

SEQ ID NO: 1087023 - RNA, 19 nt, Homo sapiens
agaagaugguuuaggugua

SEQ ID NO: 1087024 - RNA, 19 nt, Homo sapiens
cagcugauguggccucaug

SEQ ID NO: 1087025 - RNA, 19 nt, Homo sapiens
caaagaggguaccauacuc

SEQ ID NO: 1087026 - RNA, 19 nt, Homo sapiens
gcaacauucuuggcaugaa

SEQ ID NO: 1087027 - RNA, 19 nt, Homo sapiens
uaaggacugucgagaagug

SEQ ID NO: 1087028 - RNA, 19 nt, Homo sapiens
aauguuggacuuuguguua

SEQ ID NO: 1087029 - RNA, 19 nt, Homo sapiens
ugaagcaaauguuggacuu

SEQ ID NO: 1087030 - RNA, 19 nt, Homo sapiens
guaccauacucgcuugaau

SEQ ID NO: 1087031 - RNA, 19 nt, Homo sapiens
gcaaggugaugacgaacag

SEQ ID NO: 1087032 - RNA, 19 nt, Homo sapiens
gaaccaacuccucuuucaa

SEQ ID NO: 1087033 - RNA, 19 nt, Homo sapiens
ccaaaucacccagcucuga

SEQ ID NO: 1087034 - RNA, 19 nt, Homo sapiens
agaauaagcuuggugaacu

SEQ ID NO: 1087035 - RNA, 19 nt, Homo sapiens
gaucauuguucugaaguag

SEQ ID NO: 1087036 - RNA, 19 nt, Homo sapiens
gauggagugugaaacagau

SEQ ID NO: 1087037 - RNA, 19 nt, Homo sapiens
uggcuccggugaccaauuu

SEQ ID NO: 1087038 - RNA, 19 nt, Homo sapiens
ccaaauuuguagccaguuc

SEQ ID NO: 1087039 - RNA, 19 nt, Homo sapiens
agaaccaacuccucuuuca

SEQ ID NO: 1087040 - RNA, 19 nt, Homo sapiens
gaaaagagcccuggauaca

SEQ ID NO: 1087041 - RNA, 19 nt, Homo sapiens
caacuccucuuucaaacac

SEQ ID NO: 1087042 - RNA, 19 nt, Homo sapiens
gggaaggagaccagcauaa

SEQ ID NO: 1087043 - RNA, 19 nt, Homo sapiens
uggagaagaugguuuaggu

SEQ ID NO: 1087044 - RNA, 19 nt, Homo sapiens
ggccacggauugugugaau

SEQ ID NO: 1087045 - RNA, 19 nt, Homo sapiens
ccaguuccaaacaaauuua

SEQ ID NO: 1087046 - RNA, 19 nt, Homo sapiens
guuagauagucuugcauau

SEQ ID NO: 1087047 - RNA, 19 nt, Homo sapiens
agaccagcauaaacacuuu

SEQ ID NO: 1087048 - RNA, 19 nt, Homo sapiens
gaaggagaccagcauaaac

SEQ ID NO: 1087049 - RNA, 19 nt, Homo sapiens
ccagaaccaacuccucuuu

SEQ ID NO: 1087050 - RNA, 19 nt, Homo sapiens
cgcaacuacugcuacauuu

SEQ ID NO: 1087051 - RNA, 19 nt, Homo sapiens
uguaagccuuuauguccua

SEQ ID NO: 1087052 - RNA, 19 nt, Homo sapiens
gaagcaaauguuggacuuu

SEQ ID NO: 1087053 - RNA, 19 nt, Homo sapiens
ugaagcgagugacaucaga

SEQ ID NO: 1087054 - RNA, 19 nt, Homo sapiens
agaguaagcaacauucuug

SEQ ID NO: 1087055 - RNA, 19 nt, Homo sapiens
gcaggacuuuauuguuagu

SEQ ID NO: 1087056 - RNA, 19 nt, Homo sapiens
cagagugccaauaagauaa

SEQ ID NO: 1087057 - RNA, 19 nt, Homo sapiens
cuacagcuccauuuacaga

SEQ ID NO: 1087058 - RNA, 19 nt, Homo sapiens
auugcugucucaacauuua

SEQ ID NO: 1087059 - RNA, 19 nt, Homo sapiens
ccagugcaguucacaugga

SEQ ID NO: 1087060 - RNA, 19 nt, Homo sapiens
cacgugacaucaagaggaa

SEQ ID NO: 1087061 - RNA, 19 nt, Homo sapiens
gagaccagcauaaacacuu

SEQ ID NO: 1087062 - RNA, 19 nt, Homo sapiens
gaaggcugguugggaagga

SEQ ID NO: 1087063 - RNA, 19 nt, Homo sapiens
gauucuggauuggauaaau

SEQ ID NO: 1087064 - RNA, 19 nt, Homo sapiens
ccaagugggcuccugauca

SEQ ID NO: 1087065 - RNA, 19 nt, Homo sapiens
ugacucugaugacacaaug

SEQ ID NO: 1087066 - RNA, 19 nt, Homo sapiens
gaaagaaaggauggagugu

SEQ ID NO: 1087067 - RNA, 19 nt, Homo sapiens
uaagcaggacuuuauuguu

SEQ ID NO: 1087068 - RNA, 19 nt, Homo sapiens
cagcgaggccucugaguca

SEQ ID NO: 1087069 - RNA, 19 nt, Homo sapiens
ggauggagugugaaacaga

SEQ ID NO: 1087070 - RNA, 19 nt, Homo sapiens
ggugucagauuggagcuau

SEQ ID NO: 1087071 - RNA, 19 nt, Homo sapiens
aauagucaguggauugugu

SEQ ID NO: 1087072 - RNA, 19 nt, Homo sapiens
ucaugcagagugccaauaa

SEQ ID NO: 1087073 - RNA, 19 nt, Homo sapiens
uacuacagcuccauuuaca

SEQ ID NO: 1087074 - RNA, 19 nt, Homo sapiens
aaccaacuccucuuucaaa

SEQ ID NO: 1087075 - RNA, 19 nt, Homo sapiens
gcuaagaagcagcgucugu

SEQ ID NO: 1087076 - RNA, 19 nt, Homo sapiens
uuauugcugucucaacauu

SEQ ID NO: 1087077 - RNA, 19 nt, Homo sapiens
ggaagcgucguucugacuu

SEQ ID NO: 1087078 - RNA, 19 nt, Homo sapiens
ugaucauuguucugaagua

SEQ ID NO: 1087079 - RNA, 19 nt, Homo sapiens
acagagugauugguucuau

SEQ ID NO: 1087080 - RNA, 19 nt, Homo sapiens
uagguguacagcaaauuua

SEQ ID NO: 1087081 - RNA, 19 nt, Homo sapiens
aaagaggacguguguauac

SEQ ID NO: 1087082 - RNA, 19 nt, Homo sapiens
cuaaucuucugcccaagug

SEQ ID NO: 1087083 - RNA, 19 nt, Homo sapiens
acuaaggacugucgagaag

SEQ ID NO: 1087084 - RNA, 19 nt, Homo sapiens
cagaguuuauguucuacug

SEQ ID NO: 1087085 - RNA, 19 nt, Homo sapiens
aaacucagacagcucauca

SEQ ID NO: 1087086 - RNA, 19 nt, Homo sapiens
aagcaggacuuuauuguua

SEQ ID NO: 1087087 - RNA, 19 nt, Homo sapiens
gcagagugccaauaagaua

SEQ ID NO: 1087088 - RNA, 19 nt, Homo sapiens
gcaguugucuuuguucuug

SEQ ID NO: 1087089 - RNA, 19 nt, Homo sapiens
gagaaugugucccaggauu

SEQ ID NO: 1087090 - RNA, 19 nt, Homo sapiens
gucaguggauugugucuua

SEQ ID NO: 1087091 - RNA, 19 nt, Homo sapiens
gaaagaggacguguguaua

SEQ ID NO: 1087092 - RNA, 19 nt, Homo sapiens
acacagcaguggauucuuu

SEQ ID NO: 1087093 - RNA, 19 nt, Homo sapiens
aaacagggcucugaugaga

SEQ ID NO: 1087094 - RNA, 19 nt, Homo sapiens
gcucaaagaggguaccaua

SEQ ID NO: 1087095 - RNA, 19 nt, Homo sapiens
ggaaggagaccagcauaaa

SEQ ID NO: 1087096 - RNA, 19 nt, Homo sapiens
gaaaggauggagugugaaa

SEQ ID NO: 1087097 - RNA, 19 nt, Homo sapiens
aagaaaggauggaguguga

SEQ ID NO: 1087098 - RNA, 19 nt, Homo sapiens
gauugugucuuacuacuuc

SEQ ID NO: 1087099 - RNA, 19 nt, Homo sapiens
acacagagauugguauaau

SEQ ID NO: 1087100 - RNA, 19 nt, Homo sapiens
gcgacaaggugaugacgaa

SEQ ID NO: 1087101 - RNA, 19 nt, Homo sapiens
uaccucaucuucagaguuu

SEQ ID NO: 1087102 - RNA, 19 nt, Homo sapiens
cagcagaaauucauacucu

SEQ ID NO: 1087103 - RNA, 19 nt, Homo sapiens
gaagaugguuuagguguac

SEQ ID NO: 1087104 - RNA, 19 nt, Homo sapiens
cuucagaguuuauguucua

SEQ ID NO: 1087105 - RNA, 19 nt, Homo sapiens
gcagcucgaugccucagaa

SEQ ID NO: 1087106 - RNA, 19 nt, Homo sapiens
acacugggcucuuuaccaa

SEQ ID NO: 1087107 - RNA, 19 nt, Homo sapiens
uaauggagaagaugguuua

SEQ ID NO: 1087108 - RNA, 19 nt, Homo sapiens
gaguuuauguucuacugaa

SEQ ID NO: 1087109 - RNA, 19 nt, Homo sapiens
guugagaccuguauggaau

SEQ ID NO: 1087110 - RNA, 19 nt, Homo sapiens
uaagccauaucauuaguga

SEQ ID NO: 1087111 - RNA, 19 nt, Homo sapiens
gaugagaacaugucagaau

SEQ ID NO: 1087112 - RNA, 19 nt, Homo sapiens
gcagaaauucauacucuau

SEQ ID NO: 1087113 - RNA, 19 nt, Homo sapiens
gcagcuguauuguauuuua

SEQ ID NO: 1087114 - RNA, 19 nt, Homo sapiens
gucauccucugcucuauuu

SEQ ID NO: 1087115 - RNA, 19 nt, Homo sapiens
caagugggcuccugaucau

SEQ ID NO: 1087116 - RNA, 19 nt, Homo sapiens
ugaaagaggacguguguau

SEQ ID NO: 1087117 - RNA, 19 nt, Homo sapiens
guagccaguuccaaacaaa

SEQ ID NO: 1087118 - RNA, 19 nt, Homo sapiens
gaaguagaaagaauggauu

SEQ ID NO: 1087119 - RNA, 19 nt, Homo sapiens
gaaaccagcagugugugua

SEQ ID NO: 1087120 - RNA, 19 nt, Homo sapiens
agaagaugguuuaggugua

SEQ ID NO: 1087121 - RNA, 19 nt, Homo sapiens
caaagaggguaccauacuc

SEQ ID NO: 1087122 - RNA, 19 nt, Homo sapiens
aauguuggacuuuguguua

SEQ ID NO: 1087123 - RNA, 19 nt, Homo sapiens
ugaagcaaauguuggacuu

SEQ ID NO: 1087124 - RNA, 19 nt, Homo sapiens
guaccauacucgcuugaau

SEQ ID NO: 1087125 - RNA, 19 nt, Homo sapiens
gaaccaacuccucuuucaa

SEQ ID NO: 1087126 - RNA, 19 nt, Homo sapiens
ccaaaucacccagcucuga

SEQ ID NO: 1087127 - RNA, 19 nt, Homo sapiens
gaucauuguucugaaguag

SEQ ID NO: 1087128 - RNA, 19 nt, Homo sapiens
gauggagugugaaacagau

SEQ ID NO: 1087129 - RNA, 19 nt, Homo sapiens
ccaaauuuguagccaguuc

SEQ ID NO: 1087130 - RNA, 19 nt, Homo sapiens
agaaccaacuccucuuuca

SEQ ID NO: 1087131 - RNA, 19 nt, Homo sapiens
gaaaagagcccuggauaca

SEQ ID NO: 1087132 - RNA, 19 nt, Homo sapiens
caacuccucuuucaaacac

SEQ ID NO: 1087133 - RNA, 19 nt, Homo sapiens
aaagagaacgaaaucaguu

SEQ ID NO: 1087134 - RNA, 19 nt, Homo sapiens
gggaaggagaccagcauaa

SEQ ID NO: 1087135 - RNA, 19 nt, Homo sapiens
uggagaagaugguuuaggu

SEQ ID NO: 1087136 - RNA, 19 nt, Homo sapiens
ggccacggauugugugaau

SEQ ID NO: 1087137 - RNA, 19 nt, Homo sapiens
ccaguuccaaacaaauuua

SEQ ID NO: 1087138 - RNA, 19 nt, Homo sapiens
guuagauagucuugcauau

SEQ ID NO: 1087139 - RNA, 19 nt, Homo sapiens
agaccagcauaaacacuuu

SEQ ID NO: 1087140 - RNA, 19 nt, Homo sapiens
gaaggagaccagcauaaac

SEQ ID NO: 1087141 - RNA, 19 nt, Homo sapiens
ccagaaccaacuccucuuu

SEQ ID NO: 1087142 - RNA, 19 nt, Homo sapiens
cgcaacuacugcuacauuu

SEQ ID NO: 1087143 - RNA, 19 nt, Homo sapiens
uguaagccuuuauguccua

SEQ ID NO: 1087144 - RNA, 19 nt, Homo sapiens
gaagcaaauguuggacuuu

SEQ ID NO: 1087145 - RNA, 19 nt, Homo sapiens
gcaggacuuuauuguuagu

SEQ ID NO: 1087146 - RNA, 19 nt, Homo sapiens
cacagagauugguauaaug

SEQ ID NO: 1087147 - RNA, 19 nt, Homo sapiens
acacacagagauugguaua

SEQ ID NO: 1087148 - RNA, 19 nt, Homo sapiens
cagagugccaauaagauaa

SEQ ID NO: 1087149 - RNA, 19 nt, Homo sapiens
cuacagcuccauuuacaga

SEQ ID NO: 1087150 - RNA, 19 nt, Homo sapiens
auugcugucucaacauuua

SEQ ID NO: 1087151 - RNA, 19 nt, Homo sapiens
ccagugcaguucacaugga

SEQ ID NO: 1087152 - RNA, 19 nt, Homo sapiens
gagaccagcauaaacacuu

SEQ ID NO: 1087153 - RNA, 19 nt, Homo sapiens
gaaggcugguugggaagga

SEQ ID NO: 1087154 - RNA, 19 nt, Homo sapiens
gauucuggauuggauaaau

SEQ ID NO: 1087155 - RNA, 19 nt, Homo sapiens
ccaagugggcuccugauca

SEQ ID NO: 1087156 - RNA, 19 nt, Homo sapiens
gaaagaaaggauggagugu

SEQ ID NO: 1087157 - RNA, 19 nt, Homo sapiens
uaagcaggacuuuauuguu

SEQ ID NO: 1087158 - RNA, 19 nt, Homo sapiens
ggauggagugugaaacaga

SEQ ID NO: 1087159 - RNA, 19 nt, Homo sapiens
aauagucaguggauugugu

SEQ ID NO: 1087160 - RNA, 19 nt, Homo sapiens
ucaugcagagugccaauaa

SEQ ID NO: 1087161 - RNA, 19 nt, Homo sapiens
uacuacagcuccauuuaca

SEQ ID NO: 1087162 - RNA, 19 nt, Homo sapiens
aaccaacuccucuuucaaa

SEQ ID NO: 1087163 - RNA, 19 nt, Homo sapiens
uuauugcugucucaacauu

SEQ ID NO: 1087164 - RNA, 19 nt, Homo sapiens
ugaucauuguucugaagua

SEQ ID NO: 1087165 - RNA, 19 nt, Homo sapiens
acagagugauugguucuau

SEQ ID NO: 1087166 - RNA, 19 nt, Homo sapiens
uagguguacagcaaauuua

SEQ ID NO: 1087167 - RNA, 19 nt, Homo sapiens
aaagaggacguguguauac

SEQ ID NO: 1087168 - RNA, 19 nt, Homo sapiens
cuaaucuucugcccaagug

SEQ ID NO: 1087169 - RNA, 19 nt, Homo sapiens
cagaguuuauguucuacug

SEQ ID NO: 1087170 - RNA, 19 nt, Homo sapiens
aaacucagacagcucauca

SEQ ID NO: 1087171 - RNA, 19 nt, Homo sapiens
guguagagcuuuuaauauc

SEQ ID NO: 1087172 - RNA, 19 nt, Homo sapiens
cagcagagaaagccacaga

SEQ ID NO: 1087173 - RNA, 19 nt, Homo sapiens
ccacagcaucuuugucuag

SEQ ID NO: 1087174 - RNA, 19 nt, Homo sapiens
ucagauuccacauuccuuu

SEQ ID NO: 1087175 - RNA, 19 nt, Homo sapiens
cagagugauugguucuaug

SEQ ID NO: 1087176 - RNA, 19 nt, Homo sapiens
uaaaauagucaguggauug

SEQ ID NO: 1087177 - RNA, 19 nt, Homo sapiens
gccuugagaacuuccauuu

SEQ ID NO: 1087178 - RNA, 19 nt, Homo sapiens
ccuuugagccuacucuuga

SEQ ID NO: 1087179 - RNA, 19 nt, Homo sapiens
ggucauccucugcucuauu

SEQ ID NO: 1087180 - RNA, 19 nt, Homo sapiens
gacauucccaguccuuuca

SEQ ID NO: 1087181 - RNA, 19 nt, Homo sapiens
ucaaagaggguaccauacu

SEQ ID NO: 1087182 - RNA, 19 nt, Homo sapiens
guaagccuuuauguccuaa

SEQ ID NO: 1087183 - RNA, 19 nt, Homo sapiens
gguguacagcaaauuuaaa

SEQ ID NO: 1087184 - RNA, 19 nt, Homo sapiens
acacacacacacagagauu

SEQ ID NO: 1087185 - RNA, 19 nt, Homo sapiens
ugagaccuguauggaauug

SEQ ID NO: 1087186 - RNA, 19 nt, Homo sapiens
gaagagcucuguuaucaau

SEQ ID NO: 1087187 - RNA, 19 nt, Homo sapiens
gcacagaugucacuacaga

SEQ ID NO: 1087188 - RNA, 19 nt, Homo sapiens
gcugugagcucuuaauuug

SEQ ID NO: 1087189 - RNA, 19 nt, Homo sapiens
gauacuagcuacugugaaa

SEQ ID NO: 1087190 - RNA, 19 nt, Homo sapiens
gcaaagcccuguguagauu

SEQ ID NO: 1087191 - RNA, 19 nt, Homo sapiens
gggaagagcucuguuauca

SEQ ID NO: 1087192 - RNA, 19 nt, Homo sapiens
gaagaauccuaacaauaga

SEQ ID NO: 1087193 - RNA, 19 nt, Homo sapiens
cuggauagcuggauugaua

SEQ ID NO: 1087194 - RNA, 19 nt, Homo sapiens
aaacugaggaugauuguua

SEQ ID NO: 1087195 - RNA, 19 nt, Homo sapiens
gagcggagacuuagcauaa

SEQ ID NO: 1087196 - RNA, 19 nt, Homo sapiens
guucagaguuucauccuaa

SEQ ID NO: 1087197 - RNA, 19 nt, Homo sapiens
ccaaagaaauagaucaguu

SEQ ID NO: 1087198 - RNA, 19 nt, Homo sapiens
ggauauugcuggauuauac

SEQ ID NO: 1087199 - RNA, 19 nt, Homo sapiens
aaacugcagucaccaagua

SEQ ID NO: 1087200 - RNA, 19 nt, Homo sapiens
gagaugaccugguguuagu

SEQ ID NO: 1087201 - RNA, 19 nt, Homo sapiens
gauaggagacgucugaauu

SEQ ID NO: 1087202 - RNA, 19 nt, Homo sapiens
gcagcuaugugaaacacua

SEQ ID NO: 1087203 - RNA, 19 nt, Homo sapiens
caucagagccagaauauau

SEQ ID NO: 1087204 - RNA, 19 nt, Homo sapiens
acuccuaucuguuucauua

SEQ ID NO: 1087205 - RNA, 19 nt, Homo sapiens
gggcuggucuucccuugua

SEQ ID NO: 1087206 - RNA, 19 nt, Homo sapiens
gaaccuguuucuccacuga

SEQ ID NO: 1087207 - RNA, 19 nt, Homo sapiens
gaagaguguuauguccuua

SEQ ID NO: 1087208 - RNA, 19 nt, Homo sapiens
gcaaggauauaaagacaag

SEQ ID NO: 1087209 - RNA, 19 nt, Homo sapiens
ggaguaaaguuugaagaga

SEQ ID NO: 1087210 - RNA, 19 nt, Homo sapiens
gaugaaauuugucgacugu

SEQ ID NO: 1087211 - RNA, 19 nt, Homo sapiens
caagaaauuugaucucagu

SEQ ID NO: 1087212 - RNA, 19 nt, Homo sapiens
ugaagaauccuaacaauag

SEQ ID NO: 1087213 - RNA, 19 nt, Homo sapiens
gcuggaaacuccuaucugu

SEQ ID NO: 1087214 - RNA, 19 nt, Homo sapiens
ugaaggaacugauggagau

SEQ ID NO: 1087215 - RNA, 19 nt, Homo sapiens
gaagcaacauauaagaauc

SEQ ID NO: 1087216 - RNA, 19 nt, Homo sapiens
uaucagagccuaucuuuca

SEQ ID NO: 1087217 - RNA, 19 nt, Homo sapiens
ccuagaugcugaugucuuu

SEQ ID NO: 1087218 - RNA, 19 nt, Homo sapiens
aagcaacaguaccaacuua

SEQ ID NO: 1087219 - RNA, 19 nt, Homo sapiens
cauaauggauucaguaaac

SEQ ID NO: 1087220 - RNA, 19 nt, Homo sapiens
gaauagccacugaagauga

SEQ ID NO: 1087221 - RNA, 19 nt, Homo sapiens
gaguaaaguuugaagagau

SEQ ID NO: 1087222 - RNA, 19 nt, Homo sapiens
ggaggaaacgaaacuugua

SEQ ID NO: 1087223 - RNA, 19 nt, Homo sapiens
gaaauaaagcuguucaacu

SEQ ID NO: 1087224 - RNA, 19 nt, Homo sapiens
gaagaacucaugauuacau

SEQ ID NO: 1087225 - RNA, 19 nt, Homo sapiens
gacaagcuuuccaucauug

SEQ ID NO: 1087226 - RNA, 19 nt, Homo sapiens
gauugagucuguacauaug

SEQ ID NO: 1087227 - RNA, 19 nt, Homo sapiens
gcaaugacagaugaaauuu

SEQ ID NO: 1087228 - RNA, 19 nt, Homo sapiens
gauugagccuuucaucuuc

SEQ ID NO: 1087229 - RNA, 19 nt, Homo sapiens
caggaagaacucaugauua

SEQ ID NO: 1087230 - RNA, 19 nt, Homo sapiens
gauaaacuacauacacuga

SEQ ID NO: 1087231 - RNA, 19 nt, Homo sapiens
gaaagcuggcugucuugua

SEQ ID NO: 1087232 - RNA, 19 nt, Homo sapiens
ggauaaaguucucccuagu

SEQ ID NO: 1087233 - RNA, 19 nt, Homo sapiens
gaaaugcaaggauauaaag

SEQ ID NO: 1087234 - RNA, 19 nt, Homo sapiens
gcauuugccuaggauauug

SEQ ID NO: 1087235 - RNA, 19 nt, Homo sapiens
acaaauagcuaccacuuuu

SEQ ID NO: 1087236 - RNA, 19 nt, Homo sapiens
guauggagcuuuguaucuu

SEQ ID NO: 1087237 - RNA, 19 nt, Homo sapiens
gaacucaugauuacauuag

SEQ ID NO: 1087238 - RNA, 19 nt, Homo sapiens
ccuggcagcugaagauaaa

SEQ ID NO: 1087239 - RNA, 19 nt, Homo sapiens
gcaaaggaaguucuuagug

SEQ ID NO: 1087240 - RNA, 19 nt, Homo sapiens
ggcgauuacugcagucuuu

SEQ ID NO: 1087241 - RNA, 19 nt, Homo sapiens
caucauggcagcuauguga

SEQ ID NO: 1087242 - RNA, 19 nt, Homo sapiens
ggaaacgaaacuuguaaga

SEQ ID NO: 1087243 - RNA, 19 nt, Homo sapiens
caacaaauagcuaccacuu

SEQ ID NO: 1087244 - RNA, 19 nt, Homo sapiens
ggaagaaauuuggcugauc

SEQ ID NO: 1087245 - RNA, 19 nt, Homo sapiens
gaugguaugggaagaaauu

SEQ ID NO: 1087246 - RNA, 19 nt, Homo sapiens
ggcacuugcugaaggauuu

SEQ ID NO: 1087247 - RNA, 19 nt, Homo sapiens
agacaagcuuuccaucauu

SEQ ID NO: 1087248 - RNA, 19 nt, Homo sapiens
aaagauaggagacgucuga

SEQ ID NO: 1087249 - RNA, 19 nt, Homo sapiens
cagcuuugcucccauuaug

SEQ ID NO: 1087250 - RNA, 19 nt, Homo sapiens
gaggaaacgaaacuuguaa

SEQ ID NO: 1087251 - RNA, 19 nt, Homo sapiens
caaagaaauagaucaguug

SEQ ID NO: 1087252 - RNA, 19 nt, Homo sapiens
cagcugguauacaggauaa

SEQ ID NO: 1087253 - RNA, 19 nt, Homo sapiens
ggagacgucugaauuuuga

SEQ ID NO: 1087254 - RNA, 19 nt, Homo sapiens
ggaagaagaaauugcuaga

SEQ ID NO: 1087255 - RNA, 19 nt, Homo sapiens
ucagcucccuagaucuuua

SEQ ID NO: 1087256 - RNA, 19 nt, Homo sapiens
uagcuggauugauaaguuu

SEQ ID NO: 1087257 - RNA, 19 nt, Homo sapiens
guagaaaugcaaggauaua

SEQ ID NO: 1087258 - RNA, 19 nt, Homo sapiens
ccuaggauauugcuggauu

SEQ ID NO: 1087259 - RNA, 19 nt, Homo sapiens
caacaguaccaacuuaugu

SEQ ID NO: 1087260 - RNA, 19 nt, Homo sapiens
gaaacgaaacuuguaagau

SEQ ID NO: 1087261 - RNA, 19 nt, Homo sapiens
gaagaaauugcuagauuac

SEQ ID NO: 1087262 - RNA, 19 nt, Homo sapiens
aaagggugcuccuaggauu

SEQ ID NO: 1087263 - RNA, 19 nt, Homo sapiens
gcucaaaguuguaaaugcu

SEQ ID NO: 1087264 - RNA, 19 nt, Homo sapiens
uggaggagcucaaaguugu

SEQ ID NO: 1087265 - RNA, 19 nt, Homo sapiens
gacagcacauggaaagaug

SEQ ID NO: 1087266 - RNA, 19 nt, Homo sapiens
acagaaggaucagaugaaa

SEQ ID NO: 1087267 - RNA, 19 nt, Homo sapiens
aagccuaucuuaugacaga

SEQ ID NO: 1087268 - RNA, 19 nt, Homo sapiens
guaaaucgcauugcuggaa

SEQ ID NO: 1087269 - RNA, 19 nt, Homo sapiens
ugugagcucuuaauuuguu

SEQ ID NO: 1087270 - RNA, 19 nt, Homo sapiens
ggagugauuuggaaaacua

SEQ ID NO: 1087271 - RNA, 19 nt, Homo sapiens
gaacuucuaugggcaucau

SEQ ID NO: 1087272 - RNA, 19 nt, Homo sapiens
gcagacagcacauggaaag

SEQ ID NO: 1087273 - RNA, 19 nt, Homo sapiens
uauaaccaauugcuuccua

SEQ ID NO: 1087274 - RNA, 19 nt, Homo sapiens
gcggagacuuagcauaaug

SEQ ID NO: 1087275 - RNA, 19 nt, Homo sapiens
aguguuauguccuuaguuu

SEQ ID NO: 1087276 - RNA, 19 nt, Homo sapiens
aggaagaacucaugauuac

SEQ ID NO: 1087277 - RNA, 19 nt, Homo sapiens
uaaacuacauacacugauc

SEQ ID NO: 1087278 - RNA, 19 nt, Homo sapiens
caugugcaaugacagauga

SEQ ID NO: 1087279 - RNA, 19 nt, Homo sapiens
gagagaugaccugguguua

SEQ ID NO: 1087280 - RNA, 19 nt, Homo sapiens
ugaagaguguuauguccuu

SEQ ID NO: 1087281 - RNA, 19 nt, Homo sapiens
uaaagccuaucuuaugaca

SEQ ID NO: 1087282 - RNA, 19 nt, Homo sapiens
ugguagaaaugcaaggaua

SEQ ID NO: 1087283 - RNA, 19 nt, Homo sapiens
aguuagagauugagccuuu

SEQ ID NO: 1087284 - RNA, 19 nt, Homo sapiens
gcaaugaagaauccuaaca

SEQ ID NO: 1087285 - RNA, 19 nt, Homo sapiens
cacaaguuauguucagauu

SEQ ID NO: 1087286 - RNA, 19 nt, Homo sapiens
gaagagcucuguuaucaau

SEQ ID NO: 1087287 - RNA, 19 nt, Homo sapiens
gcacagaugucacuacaga

SEQ ID NO: 1087288 - RNA, 19 nt, Homo sapiens
gcugugagcucuuaauuug

SEQ ID NO: 1087289 - RNA, 19 nt, Homo sapiens
gauacuagcuacugugaaa

SEQ ID NO: 1087290 - RNA, 19 nt, Homo sapiens
gcaaagcccuguguagauu

SEQ ID NO: 1087291 - RNA, 19 nt, Homo sapiens
gggaagagcucuguuauca

SEQ ID NO: 1087292 - RNA, 19 nt, Homo sapiens
gaagaauccuaacaauaga

SEQ ID NO: 1087293 - RNA, 19 nt, Homo sapiens
cuggauagcuggauugaua

SEQ ID NO: 1087294 - RNA, 19 nt, Homo sapiens
aaacugaggaugauuguua

SEQ ID NO: 1087295 - RNA, 19 nt, Homo sapiens
gagcggagacuuagcauaa

SEQ ID NO: 1087296 - RNA, 19 nt, Homo sapiens
guucagaguuucauccuaa

SEQ ID NO: 1087297 - RNA, 19 nt, Homo sapiens
ccaaagaaauagaucaguu

SEQ ID NO: 1087298 - RNA, 19 nt, Homo sapiens
ggauauugcuggauuauac

SEQ ID NO: 1087299 - RNA, 19 nt, Homo sapiens
aaacugcagucaccaagua

SEQ ID NO: 1087300 - RNA, 19 nt, Homo sapiens
gagaugaccugguguuagu

SEQ ID NO: 1087301 - RNA, 19 nt, Homo sapiens
gauaggagacgucugaauu

SEQ ID NO: 1087302 - RNA, 19 nt, Homo sapiens
gcagcuaugugaaacacua

SEQ ID NO: 1087303 - RNA, 19 nt, Homo sapiens
caucagagccagaauauau

SEQ ID NO: 1087304 - RNA, 19 nt, Homo sapiens
acuccuaucuguuucauua

SEQ ID NO: 1087305 - RNA, 19 nt, Homo sapiens
gggcuggucuucccuugua

SEQ ID NO: 1087306 - RNA, 19 nt, Homo sapiens
gaaccuguuucuccacuga

SEQ ID NO: 1087307 - RNA, 19 nt, Homo sapiens
gaagaguguuauguccuua

SEQ ID NO: 1087308 - RNA, 19 nt, Homo sapiens
gcaaggauauaaagacaag

SEQ ID NO: 1087309 - RNA, 19 nt, Homo sapiens
ggaguaaaguuugaagaga

SEQ ID NO: 1087310 - RNA, 19 nt, Homo sapiens
gaugaaauuugucgacugu

SEQ ID NO: 1087311 - RNA, 19 nt, Homo sapiens
caagaaauuugaucucagu

SEQ ID NO: 1087312 - RNA, 19 nt, Homo sapiens
ugaagaauccuaacaauag

SEQ ID NO: 1087313 - RNA, 19 nt, Homo sapiens
gcuggaaacuccuaucugu

SEQ ID NO: 1087314 - RNA, 19 nt, Homo sapiens
ugaaggaacugauggagau

SEQ ID NO: 1087315 - RNA, 19 nt, Homo sapiens
gaagcaacauauaagaauc

SEQ ID NO: 1087316 - RNA, 19 nt, Homo sapiens
uaucagagccuaucuuuca

SEQ ID NO: 1087317 - RNA, 19 nt, Homo sapiens
ccuagaugcugaugucuuu

SEQ ID NO: 1087318 - RNA, 19 nt, Homo sapiens
aagcaacaguaccaacuua

SEQ ID NO: 1087319 - RNA, 19 nt, Homo sapiens
agacuggacuuuauucgaa

SEQ ID NO: 1087320 - RNA, 19 nt, Homo sapiens
cauaauggauucaguaaac

SEQ ID NO: 1087321 - RNA, 19 nt, Homo sapiens
gaauagccacugaagauga

SEQ ID NO: 1087322 - RNA, 19 nt, Homo sapiens
gaguaaaguuugaagagau

SEQ ID NO: 1087323 - RNA, 19 nt, Homo sapiens
ggaggaaacgaaacuugua

SEQ ID NO: 1087324 - RNA, 19 nt, Homo sapiens
gaaauaaagcuguucaacu

SEQ ID NO: 1087325 - RNA, 19 nt, Homo sapiens
gaagaacucaugauuacau

SEQ ID NO: 1087326 - RNA, 19 nt, Homo sapiens
gaaaccagaugaaccuuuu

SEQ ID NO: 1087327 - RNA, 19 nt, Homo sapiens
gacaagcuuuccaucauug

SEQ ID NO: 1087328 - RNA, 19 nt, Homo sapiens
gauugagucuguacauaug

SEQ ID NO: 1087329 - RNA, 19 nt, Homo sapiens
gcaaugacagaugaaauuu

SEQ ID NO: 1087330 - RNA, 19 nt, Homo sapiens
gauugagccuuucaucuuc

SEQ ID NO: 1087331 - RNA, 19 nt, Homo sapiens
caggaagaacucaugauua

SEQ ID NO: 1087332 - RNA, 19 nt, Homo sapiens
gauaaacuacauacacuga

SEQ ID NO: 1087333 - RNA, 19 nt, Homo sapiens
ggauaaaguucucccuagu

SEQ ID NO: 1087334 - RNA, 19 nt, Homo sapiens
gaaaugcaaggauauaaag

SEQ ID NO: 1087335 - RNA, 19 nt, Homo sapiens
gcauuugccuaggauauug

SEQ ID NO: 1087336 - RNA, 19 nt, Homo sapiens
acaaauagcuaccacuuuu

SEQ ID NO: 1087337 - RNA, 19 nt, Homo sapiens
guauggagcuuuguaucuu

SEQ ID NO: 1087338 - RNA, 19 nt, Homo sapiens
gaacucaugauuacauuag

SEQ ID NO: 1087339 - RNA, 19 nt, Homo sapiens
ccuggcagcugaagauaaa

SEQ ID NO: 1087340 - RNA, 19 nt, Homo sapiens
gcaaaggaaguucuuagug

SEQ ID NO: 1087341 - RNA, 19 nt, Homo sapiens
caucauggcagcuauguga

SEQ ID NO: 1087342 - RNA, 19 nt, Homo sapiens
ggaaacgaaacuuguaaga

SEQ ID NO: 1087343 - RNA, 19 nt, Homo sapiens
caacaaauagcuaccacuu

SEQ ID NO: 1087344 - RNA, 19 nt, Homo sapiens
ggaagaaauuuggcugauc

SEQ ID NO: 1087345 - RNA, 19 nt, Homo sapiens
gaugguaugggaagaaauu

SEQ ID NO: 1087346 - RNA, 19 nt, Homo sapiens
ggcacuugcugaaggauuu

SEQ ID NO: 1087347 - RNA, 19 nt, Homo sapiens
agacaagcuuuccaucauu

SEQ ID NO: 1087348 - RNA, 19 nt, Homo sapiens
aaagauaggagacgucuga

SEQ ID NO: 1087349 - RNA, 19 nt, Homo sapiens
cagcuuugcucccauuaug

SEQ ID NO: 1087350 - RNA, 19 nt, Homo sapiens
gaggaaacgaaacuuguaa

SEQ ID NO: 1087351 - RNA, 19 nt, Homo sapiens
caaagaaauagaucaguug

SEQ ID NO: 1087352 - RNA, 19 nt, Homo sapiens
cagcugguauacaggauaa

SEQ ID NO: 1087353 - RNA, 19 nt, Homo sapiens
ggagacgucugaauuuuga

SEQ ID NO: 1087354 - RNA, 19 nt, Homo sapiens
ggaagaagaaauugcuaga

SEQ ID NO: 1087355 - RNA, 19 nt, Homo sapiens
ucagcucccuagaucuuua

SEQ ID NO: 1087356 - RNA, 19 nt, Homo sapiens
uagcuggauugauaaguuu

SEQ ID NO: 1087357 - RNA, 19 nt, Homo sapiens
guagaaaugcaaggauaua

SEQ ID NO: 1087358 - RNA, 19 nt, Homo sapiens
ccuaggauauugcuggauu

SEQ ID NO: 1087359 - RNA, 19 nt, Homo sapiens
caacaguaccaacuuaugu

SEQ ID NO: 1087360 - RNA, 19 nt, Homo sapiens
gaaacgaaacuuguaagau

SEQ ID NO: 1087361 - RNA, 19 nt, Homo sapiens
gaagaaauugcuagauuac

SEQ ID NO: 1087362 - RNA, 19 nt, Homo sapiens
aaagggugcuccuaggauu

SEQ ID NO: 1087363 - RNA, 19 nt, Homo sapiens
ggagguggcaaacaaaguu

SEQ ID NO: 1087364 - RNA, 19 nt, Homo sapiens
ccgaggagguggcaaacaa

SEQ ID NO: 1087365 - RNA, 19 nt, Homo sapiens
gacagcacauggaaagaug

SEQ ID NO: 1087366 - RNA, 19 nt, Homo sapiens
acagaaggaucagaugaaa

SEQ ID NO: 1087367 - RNA, 19 nt, Homo sapiens
aagccuaucuuaugacaga

SEQ ID NO: 1087368 - RNA, 19 nt, Homo sapiens
guaaaucgcauugcuggaa

SEQ ID NO: 1087369 - RNA, 19 nt, Homo sapiens
ugugagcucuuaauuuguu

SEQ ID NO: 1087370 - RNA, 19 nt, Homo sapiens
ugcaaucuuugaccaguua

SEQ ID NO: 1087371 - RNA, 19 nt, Homo sapiens
gcggagacuuagcauaaug

SEQ ID NO: 1087372 - RNA, 19 nt, Homo sapiens
ggagugauuuggaaaacua

SEQ ID NO: 1087373 - RNA, 19 nt, Homo sapiens
gaacuucuaugggcaucau

SEQ ID NO: 1087374 - RNA, 19 nt, Homo sapiens
gcagacagcacauggaaag

SEQ ID NO: 1087375 - RNA, 19 nt, Homo sapiens
uauaaccaauugcuuccua

SEQ ID NO: 1087376 - RNA, 19 nt, Homo sapiens
aguguuauguccuuaguuu

SEQ ID NO: 1087377 - RNA, 19 nt, Homo sapiens
aggaagaacucaugauuac

SEQ ID NO: 1087378 - RNA, 19 nt, Homo sapiens
uaaacuacauacacugauc

SEQ ID NO: 1087379 - RNA, 19 nt, Homo sapiens
caugugcaaugacagauga

SEQ ID NO: 1087380 - RNA, 19 nt, Homo sapiens
gagagaugaccugguguua

SEQ ID NO: 1087381 - RNA, 19 nt, Homo sapiens
ugaagaguguuauguccuu

SEQ ID NO: 1087382 - RNA, 19 nt, Homo sapiens
gaagagagggaagaccaaa

SEQ ID NO: 1087383 - RNA, 19 nt, Homo sapiens
gcucaaaguugcaaaugcu

SEQ ID NO: 1087384 - RNA, 19 nt, Homo sapiens
uaaagccuaucuuaugaca

SEQ ID NO: 1087385 - RNA, 19 nt, Homo sapiens
ugguagaaaugcaaggaua

SEQ ID NO: 1087386 - RNA, 19 nt, Homo sapiens
ggaagcaaaucuauacuuu

SEQ ID NO: 1087387 - RNA, 19 nt, Homo sapiens
gcacaugaguguuuguaga

SEQ ID NO: 1087388 - RNA, 19 nt, Homo sapiens
gauacagucucugauagua

SEQ ID NO: 1087389 - RNA, 19 nt, Homo sapiens
uagaagggaugaggaaaua

SEQ ID NO: 1087390 - RNA, 19 nt, Homo sapiens
ccacuuaacuacccuagau

SEQ ID NO: 1087391 - RNA, 19 nt, Homo sapiens
uagaugauguggaaacaaa

SEQ ID NO: 1087392 - RNA, 19 nt, Homo sapiens
ggaaaugggaccagccuaa

SEQ ID NO: 1087393 - RNA, 19 nt, Homo sapiens
gccgagagcugaggaacua

SEQ ID NO: 1087394 - RNA, 19 nt, Homo sapiens
gguuugagauuccuucuau

SEQ ID NO: 1087395 - RNA, 19 nt, Homo sapiens
gaagugacccuuggccuuu

SEQ ID NO: 1087396 - RNA, 19 nt, Homo sapiens
gcagucaggugagguuuga

SEQ ID NO: 1087397 - RNA, 19 nt, Homo sapiens
caugaaacauuccaucuuc

SEQ ID NO: 1087398 - RNA, 19 nt, Homo sapiens
uaauggagcuggagguuca

SEQ ID NO: 1087399 - RNA, 19 nt, Homo sapiens
gcuaagaucuccccuuuga

SEQ ID NO: 1087400 - RNA, 19 nt, Homo sapiens
ccuggguccuucaguauua

SEQ ID NO: 1087401 - RNA, 19 nt, Homo sapiens
ucccauggcucacuggaua

SEQ ID NO: 1087402 - RNA, 19 nt, Homo sapiens
gcacagcaccuccagaaca

SEQ ID NO: 1087403 - RNA, 19 nt, Homo sapiens
ggaaagcaggaaccaguaa

SEQ ID NO: 1087404 - RNA, 19 nt, Homo sapiens
gggcaugguucaagucugu

SEQ ID NO: 1087405 - RNA, 19 nt, Homo sapiens
gaaaaucugggcccacuua

SEQ ID NO: 1087406 - RNA, 19 nt, Homo sapiens
gcagaaacaggaacacuca

SEQ ID NO: 1087407 - RNA, 19 nt, Homo sapiens
gaaacauuccaucuucuug

SEQ ID NO: 1087408 - RNA, 19 nt, Homo sapiens
uguagaccauagaccauua

SEQ ID NO: 1087409 - RNA, 19 nt, Homo sapiens
ggugcaagcaggacagaua

SEQ ID NO: 1087410 - RNA, 19 nt, Homo sapiens
caucuaaauucuucaugga

SEQ ID NO: 1087411 - RNA, 19 nt, Homo sapiens
uacagucucugauaguaaa

SEQ ID NO: 1087412 - RNA, 19 nt, Homo sapiens
gacccggacucguuaugaa

SEQ ID NO: 1087413 - RNA, 19 nt, Homo sapiens
guaauugcguaucaacagu

SEQ ID NO: 1087414 - RNA, 19 nt, Homo sapiens
guaggaagcaaaucuauac

SEQ ID NO: 1087415 - RNA, 19 nt, Homo sapiens
gaagggaugaggaaauagu

SEQ ID NO: 1087416 - RNA, 19 nt, Homo sapiens
cauagaacagauaccuuua

SEQ ID NO: 1087417 - RNA, 19 nt, Homo sapiens
gaaaugggaccagccuaau

SEQ ID NO: 1087418 - RNA, 19 nt, Homo sapiens
caggugagguuugagauuc

SEQ ID NO: 1087419 - RNA, 19 nt, Homo sapiens
gauguugguucgccagcuu

SEQ ID NO: 1087420 - RNA, 19 nt, Homo sapiens
gaagucaggaguucgagau

SEQ ID NO: 1087421 - RNA, 19 nt, Homo sapiens
gaaagcaggaaccaguaau

SEQ ID NO: 1087422 - RNA, 19 nt, Homo sapiens
acauagaacagauaccuuu

SEQ ID NO: 1087423 - RNA, 19 nt, Homo sapiens
gagaggaaacaggcuauug

SEQ ID NO: 1087424 - RNA, 19 nt, Homo sapiens
cccgggaccuguuucauau

SEQ ID NO: 1087425 - RNA, 19 nt, Homo sapiens
gcuaauacagucuuucuac

SEQ ID NO: 1087426 - RNA, 19 nt, Homo sapiens
ggauguacuucaggccauu

SEQ ID NO: 1087427 - RNA, 19 nt, Homo sapiens
cuggagcugugcauucuuu

SEQ ID NO: 1087428 - RNA, 19 nt, Homo sapiens
caggcuuacucaaagaauu

SEQ ID NO: 1087429 - RNA, 19 nt, Homo sapiens
gaagugcucccuguguguu

SEQ ID NO: 1087430 - RNA, 19 nt, Homo sapiens
ggagcuggagguucagaaa

SEQ ID NO: 1087431 - RNA, 19 nt, Homo sapiens
cccauggucuuguaauugu

SEQ ID NO: 1087432 - RNA, 19 nt, Homo sapiens
ucuccuggguccuucagua

SEQ ID NO: 1087433 - RNA, 19 nt, Homo sapiens
gguagaugauguggaaaca

SEQ ID NO: 1087434 - RNA, 19 nt, Homo sapiens
cgcgguagaugauguggaa

SEQ ID NO: 1087435 - RNA, 19 nt, Homo sapiens
ucaaaaccuuccagaauau

SEQ ID NO: 1087436 - RNA, 19 nt, Homo sapiens
ggacccggacucguuauga

SEQ ID NO: 1087437 - RNA, 19 nt, Homo sapiens
gcaagcaggacagauagug

SEQ ID NO: 1087438 - RNA, 19 nt, Homo sapiens
uggauuugcugguuguuuc

SEQ ID NO: 1087439 - RNA, 19 nt, Homo sapiens
cuggauaacaucuaaauuc

SEQ ID NO: 1087440 - RNA, 19 nt, Homo sapiens
guuugagauuccuucuaua

SEQ ID NO: 1087441 - RNA, 19 nt, Homo sapiens
gauccggaaggcugcauuu

SEQ ID NO: 1087442 - RNA, 19 nt, Homo sapiens
caagacccagccaaucaaa

SEQ ID NO: 1087443 - RNA, 19 nt, Homo sapiens
ugaagcaugcaacauagaa

SEQ ID NO: 1087444 - RNA, 19 nt, Homo sapiens
ggaacuacaacuccuagag

SEQ ID NO: 1087445 - RNA, 19 nt, Homo sapiens
guagaccauagaccauuaa

SEQ ID NO: 1087446 - RNA, 19 nt, Homo sapiens
cgaggcagcagcagaaaca

SEQ ID NO: 1087447 - RNA, 19 nt, Homo sapiens
ccuguaaucccagcacuuu

SEQ ID NO: 1087448 - RNA, 19 nt, Homo sapiens
aaaaggguauucuuggaaa

SEQ ID NO: 1087449 - RNA, 19 nt, Homo sapiens
gaggaaauaguucauagcu

SEQ ID NO: 1087450 - RNA, 19 nt, Homo sapiens
ucugaagcaugcaacauag

SEQ ID NO: 1087451 - RNA, 19 nt, Homo sapiens
gggagugcuuguugcagau

SEQ ID NO: 1087452 - RNA, 19 nt, Homo sapiens
guaauugugaacuucuuug

SEQ ID NO: 1087453 - RNA, 19 nt, Homo sapiens
ccuccaccuuccaggcuua

SEQ ID NO: 1087454 - RNA, 19 nt, Homo sapiens
uguaggaagcaaaucuaua

SEQ ID NO: 1087455 - RNA, 19 nt, Homo sapiens
gcguaucaacaguggauuu

SEQ ID NO: 1087456 - RNA, 19 nt, Homo sapiens
gcaagggguugguucuuca

SEQ ID NO: 1087457 - RNA, 19 nt, Homo sapiens
ugaaacauuccaucuucuu

SEQ ID NO: 1087458 - RNA, 19 nt, Homo sapiens
gaccagaggccccuugaaa

SEQ ID NO: 1087459 - RNA, 19 nt, Homo sapiens
cagcgaggcagcagcagaa

SEQ ID NO: 1087460 - RNA, 19 nt, Homo sapiens
gauaguagucacauacacu

SEQ ID NO: 1087461 - RNA, 19 nt, Homo sapiens
gggaugaggaaauaguuca

SEQ ID NO: 1087462 - RNA, 19 nt, Homo sapiens
caacauagaacagauaccu

SEQ ID NO: 1087463 - RNA, 19 nt, Homo sapiens
ccaugaaacauuccaucuu

SEQ ID NO: 1087464 - RNA, 19 nt, Homo sapiens
cgacagagcgacacaucca

SEQ ID NO: 1087465 - RNA, 19 nt, Homo sapiens
ccaagacccagccaaucaa

SEQ ID NO: 1087466 - RNA, 19 nt, Homo sapiens
aucaaaaccuuccagaaua

SEQ ID NO: 1087467 - RNA, 19 nt, Homo sapiens
gagaucagcauggccaaca

SEQ ID NO: 1087468 - RNA, 19 nt, Homo sapiens
cuaauacagucuuucuacu

SEQ ID NO: 1087469 - RNA, 19 nt, Homo sapiens
ggagaggaaacaggcuauu

SEQ ID NO: 1087470 - RNA, 19 nt, Homo sapiens
gguaauugcguaucaacag

SEQ ID NO: 1087471 - RNA, 19 nt, Homo sapiens
ugccuuggcucgcacuguu

SEQ ID NO: 1087472 - RNA, 19 nt, Homo sapiens
cacaggccccuuagaauua

SEQ ID NO: 1087473 - RNA, 19 nt, Homo sapiens
cuucaggucaggauguuaa

SEQ ID NO: 1087474 - RNA, 19 nt, Homo sapiens
ucuccuggcugccuugauc

SEQ ID NO: 1087475 - RNA, 19 nt, Homo sapiens
acacaaaugauaguaguca

SEQ ID NO: 1087476 - RNA, 19 nt, Homo sapiens
gcuccaagacccagccaau

SEQ ID NO: 1087477 - RNA, 19 nt, Homo sapiens
agaggaaacaggcuauugu

SEQ ID NO: 1087478 - RNA, 19 nt, Homo sapiens
uaucaacaguggauuugcu

SEQ ID NO: 1087479 - RNA, 19 nt, Homo sapiens
ucccgggaccuguuucaua

SEQ ID NO: 1087480 - RNA, 19 nt, Homo sapiens
cuuccaggcuuacucaaag

SEQ ID NO: 1087481 - RNA, 19 nt, Homo sapiens
uggcuaagaucuccccuuu

SEQ ID NO: 1087482 - RNA, 19 nt, Homo sapiens
gaggccaacucgggauauc

SEQ ID NO: 1087483 - RNA, 19 nt, Homo sapiens
gcaugcaacauagaacaga

SEQ ID NO: 1087484 - RNA, 19 nt, Homo sapiens
cucacuggauaacaucuaa

SEQ ID NO: 1087485 - RNA, 19 nt, Homo sapiens
gcucacuggauaacaucua

SEQ ID NO: 1087486 - RNA, 19 nt, Homo sapiens
ccaaagagauucugaaauu

SEQ ID NO: 1087487 - RNA, 19 nt, Homo sapiens
gaugaacucugccauaaua

SEQ ID NO: 1087488 - RNA, 19 nt, Homo sapiens
ggaaggaaauggaaacaaa

SEQ ID NO: 1087489 - RNA, 19 nt, Homo sapiens
gaagagaugugguuuaaca

SEQ ID NO: 1087490 - RNA, 19 nt, Homo sapiens
gaagauacguuaccauugu

SEQ ID NO: 1087491 - RNA, 19 nt, Homo sapiens
ggaaagcacuggaagaugu

SEQ ID NO: 1087492 - RNA, 19 nt, Homo sapiens
ggacgucauuggauguuua

SEQ ID NO: 1087493 - RNA, 19 nt, Homo sapiens
gcaacugucuugagaauuc

SEQ ID NO: 1087494 - RNA, 19 nt, Homo sapiens
gauuaaagauugaguggaa

SEQ ID NO: 1087495 - RNA, 19 nt, Homo sapiens
uaucaacacuucacucuuu

SEQ ID NO: 1087496 - RNA, 19 nt, Homo sapiens
guacagacauuuaaaggau

SEQ ID NO: 1087497 - RNA, 19 nt, Homo sapiens
gaaguuauguucucugaag

SEQ ID NO: 1087498 - RNA, 19 nt, Homo sapiens
gaagaagagaugugguuua

SEQ ID NO: 1087499 - RNA, 19 nt, Homo sapiens
caccauaccuaccacauaa

SEQ ID NO: 1087500 - RNA, 19 nt, Homo sapiens
gcaguggucucuugugaau

SEQ ID NO: 1087501 - RNA, 19 nt, Homo sapiens
gacgguacauuaaaucaaa

SEQ ID NO: 1087502 - RNA, 19 nt, Homo sapiens
caucacaguucuuaauuug

SEQ ID NO: 1087503 - RNA, 19 nt, Homo sapiens
aagaagagaugugguuuaa

SEQ ID NO: 1087504 - RNA, 19 nt, Homo sapiens
ccagaacacuagaagauga

SEQ ID NO: 1087505 - RNA, 19 nt, Homo sapiens
ggagagugcuaguucuuau

SEQ ID NO: 1087506 - RNA, 19 nt, Homo sapiens
agacaaaccuaguaaagau

SEQ ID NO: 1087507 - RNA, 19 nt, Homo sapiens
ucucauacuugguugaaua

SEQ ID NO: 1087508 - RNA, 19 nt, Homo sapiens
agaauaugauccugcuuua

SEQ ID NO: 1087509 - RNA, 19 nt, Homo sapiens
ggacaucacucaggaccuu

SEQ ID NO: 1087510 - RNA, 19 nt, Homo sapiens
gagcgacgguucucuacuu

SEQ ID NO: 1087511 - RNA, 19 nt, Homo sapiens
ugaauuaagucgccuugaa

SEQ ID NO: 1087512 - RNA, 19 nt, Homo sapiens
gcaagauaaucccaaacuu

SEQ ID NO: 1087513 - RNA, 19 nt, Homo sapiens
gcucaucaaccucauuaua

SEQ ID NO: 1087514 - RNA, 19 nt, Homo sapiens
ucacagauaucgaagagau

SEQ ID NO: 1087515 - RNA, 19 nt, Homo sapiens
gaauugccaucuugugaau

SEQ ID NO: 1087516 - RNA, 19 nt, Homo sapiens
gaggauggaugauuuaaaa

SEQ ID NO: 1087517 - RNA, 19 nt, Homo sapiens
ggacuugauuaauagcaaa

SEQ ID NO: 1087518 - RNA, 19 nt, Homo sapiens
gaagacaaaccuaguaaag

SEQ ID NO: 1087519 - RNA, 19 nt, Homo sapiens
caacaggacacucugauug

SEQ ID NO: 1087520 - RNA, 19 nt, Homo sapiens
gcgcaguggucucuuguga

SEQ ID NO: 1087521 - RNA, 19 nt, Homo sapiens
gcuagccacugccaauaaa

SEQ ID NO: 1087522 - RNA, 19 nt, Homo sapiens
caaagagaaaggcaagaua

SEQ ID NO: 1087523 - RNA, 19 nt, Homo sapiens
gcacuuguauuggaauugu

SEQ ID NO: 1087524 - RNA, 19 nt, Homo sapiens
uagauuauccugaugauga

SEQ ID NO: 1087525 - RNA, 19 nt, Homo sapiens
gacaguaugcguuccauuu

SEQ ID NO: 1087526 - RNA, 19 nt, Homo sapiens
gcaccauaccuaccacaua

SEQ ID NO: 1087527 - RNA, 19 nt, Homo sapiens
gaagugcugcuacugauau

SEQ ID NO: 1087528 - RNA, 19 nt, Homo sapiens
ugaagaaauugcagaacuu

SEQ ID NO: 1087529 - RNA, 19 nt, Homo sapiens
aaagagaaaggcaagauaa

SEQ ID NO: 1087530 - RNA, 19 nt, Homo sapiens
uacaaccgcuacauaauga

SEQ ID NO: 1087531 - RNA, 19 nt, Homo sapiens
augagggacuugauuaaua

SEQ ID NO: 1087532 - RNA, 19 nt, Homo sapiens
agacugaauuucuggguuu

SEQ ID NO: 1087533 - RNA, 19 nt, Homo sapiens
gacaggaauugguuaacuu

SEQ ID NO: 1087534 - RNA, 19 nt, Homo sapiens
caucagacauacagaguuc

SEQ ID NO: 1087535 - RNA, 19 nt, Homo sapiens
ccacuuguaugaaauuauc

SEQ ID NO: 1087536 - RNA, 19 nt, Homo sapiens
ugacuuggcccuuagcuuu

SEQ ID NO: 1087537 - RNA, 19 nt, Homo sapiens
cggcagcuauuacuacaaa

SEQ ID NO: 1087538 - RNA, 19 nt, Homo sapiens
uaacacagaugaagaugac

SEQ ID NO: 1087539 - RNA, 19 nt, Homo sapiens
gaaagcacuggaagaugua

SEQ ID NO: 1087540 - RNA, 19 nt, Homo sapiens
uaacugcucauguaauuga

SEQ ID NO: 1087541 - RNA, 19 nt, Homo sapiens
gcugcugucucuuuaaaug

SEQ ID NO: 1087542 - RNA, 19 nt, Homo sapiens
uccaugaucuccaaagaaa

SEQ ID NO: 1087543 - RNA, 19 nt, Homo sapiens
cauauuaccagcuuuagaa

SEQ ID NO: 1087544 - RNA, 19 nt, Homo sapiens
gaaaauaugucagguucaa

SEQ ID NO: 1087545 - RNA, 19 nt, Homo sapiens
gggccuuucugccauaauu

SEQ ID NO: 1087546 - RNA, 19 nt, Homo sapiens
gugaaugacugacacagau

SEQ ID NO: 1087547 - RNA, 19 nt, Homo sapiens
gaggagcaguccagcuuau

SEQ ID NO: 1087548 - RNA, 19 nt, Homo sapiens
gggcauauuaccagcuuua

SEQ ID NO: 1087549 - RNA, 19 nt, Homo sapiens
aaacacagggaauuucuaa

SEQ ID NO: 1087550 - RNA, 19 nt, Homo sapiens
gcuuagaauugccaucuug

SEQ ID NO: 1087551 - RNA, 19 nt, Homo sapiens
cagcaacugucuugagaau

SEQ ID NO: 1087552 - RNA, 19 nt, Homo sapiens
ggaagauacguuaccauug

SEQ ID NO: 1087553 - RNA, 19 nt, Homo sapiens
gcuacaaucugaugaacuc

SEQ ID NO: 1087554 - RNA, 19 nt, Homo sapiens
ugauacagauccugaacuu

SEQ ID NO: 1087555 - RNA, 19 nt, Homo sapiens
ggacuucucccuacuugau

SEQ ID NO: 1087556 - RNA, 19 nt, Homo sapiens
ccacauaaagaacuacauu

SEQ ID NO: 1087557 - RNA, 19 nt, Homo sapiens
acagggaauuucuaacaaa

SEQ ID NO: 1087558 - RNA, 19 nt, Homo sapiens
gaagaaauugcagaacuug

SEQ ID NO: 1087559 - RNA, 19 nt, Homo sapiens
uaagucgccuugaagaaau

SEQ ID NO: 1087560 - RNA, 19 nt, Homo sapiens
ccagucaucuacaacaaau

SEQ ID NO: 1087561 - RNA, 19 nt, Homo sapiens
gaagaugacauggaagaug

SEQ ID NO: 1087562 - RNA, 19 nt, Homo sapiens
agaugaagaugacauggaa

SEQ ID NO: 1087563 - RNA, 19 nt, Homo sapiens
cgacgguucucuacuuuua

SEQ ID NO: 1087564 - RNA, 19 nt, Homo sapiens
uggaagauguagauuaugu

SEQ ID NO: 1087565 - RNA, 19 nt, Homo sapiens
cugaugaacucugccauaa

SEQ ID NO: 1087566 - RNA, 19 nt, Homo sapiens
ugagggacuugauuaauag

SEQ ID NO: 1087567 - RNA, 19 nt, Homo sapiens
ucaucaaccucauuauaga

SEQ ID NO: 1087568 - RNA, 19 nt, Homo sapiens
ggaugaagauaaggaagau

SEQ ID NO: 1087569 - RNA, 19 nt, Homo sapiens
ucgaagagaugccagaaca

SEQ ID NO: 1087570 - RNA, 19 nt, Homo sapiens
ggaagauguagauuaugua

SEQ ID NO: 1087571 - RNA, 19 nt, Homo sapiens
ccacuuccaugaucuccaa

SEQ ID NO: 1087572 - RNA, 19 nt, Homo sapiens
ucucacugcuccuuuacua

SEQ ID NO: 1087573 - RNA, 19 nt, Homo sapiens
uaaagaagugauucccaua

SEQ ID NO: 1087574 - RNA, 19 nt, Homo sapiens
gcuuaguuguugaguauau

SEQ ID NO: 1087575 - RNA, 19 nt, Homo sapiens
gccagcaguuucuuuguau

SEQ ID NO: 1087576 - RNA, 19 nt, Homo sapiens
cggcagagcccaaguuuca

SEQ ID NO: 1087577 - RNA, 19 nt, Homo sapiens
uggagaagcuguagugucu

SEQ ID NO: 1087578 - RNA, 19 nt, Homo sapiens
gcgaagugcugcuacugau

SEQ ID NO: 1087579 - RNA, 19 nt, Homo sapiens
ggcaucaucuuuaccuuca

SEQ ID NO: 1087580 - RNA, 19 nt, Homo sapiens
ucagggaaauagaauggaa

SEQ ID NO: 1087581 - RNA, 19 nt, Homo sapiens
gaucagccucuuacacuug

SEQ ID NO: 1087582 - RNA, 19 nt, Homo sapiens
ucgugggucugguagauua

SEQ ID NO: 1087583 - RNA, 19 nt, Homo sapiens
uaacacugcauaccagaaa

SEQ ID NO: 1087584 - RNA, 19 nt, Homo sapiens
aaacugagauuugaacaac

SEQ ID NO: 1087585 - RNA, 19 nt, Homo sapiens
ggaucccgcuacaaucuga

SEQ ID NO: 1087586 - RNA, 19 nt, Homo sapiens
ccaaagagauucugaaauu

SEQ ID NO: 1087587 - RNA, 19 nt, Homo sapiens
gaugaacucugccauaaua

SEQ ID NO: 1087588 - RNA, 19 nt, Homo sapiens
ggaaggaaauggaaacaaa

SEQ ID NO: 1087589 - RNA, 19 nt, Homo sapiens
gaagagaugugguuuaaca

SEQ ID NO: 1087590 - RNA, 19 nt, Homo sapiens
gaagauacguuaccauugu

SEQ ID NO: 1087591 - RNA, 19 nt, Homo sapiens
ggaaagcacuggaagaugu

SEQ ID NO: 1087592 - RNA, 19 nt, Homo sapiens
ggacgucauuggauguuua

SEQ ID NO: 1087593 - RNA, 19 nt, Homo sapiens
gcaacugucuugagaauuc

SEQ ID NO: 1087594 - RNA, 19 nt, Homo sapiens
gauuaaagauugaguggaa

SEQ ID NO: 1087595 - RNA, 19 nt, Homo sapiens
uaucaacacuucacucuuu

SEQ ID NO: 1087596 - RNA, 19 nt, Homo sapiens
guacagacauuuaaaggau

SEQ ID NO: 1087597 - RNA, 19 nt, Homo sapiens
gaaguuauguucucugaag

SEQ ID NO: 1087598 - RNA, 19 nt, Homo sapiens
gaagaagagaugugguuua

SEQ ID NO: 1087599 - RNA, 19 nt, Homo sapiens
caccauaccuaccacauaa

SEQ ID NO: 1087600 - RNA, 19 nt, Homo sapiens
ggucauuugugucauaauu

SEQ ID NO: 1087601 - RNA, 19 nt, Homo sapiens
gcaguggucucuugugaau

SEQ ID NO: 1087602 - RNA, 19 nt, Homo sapiens
gacgguacauuaaaucaaa

SEQ ID NO: 1087603 - RNA, 19 nt, Homo sapiens
caucacaguucuuaauuug

SEQ ID NO: 1087604 - RNA, 19 nt, Homo sapiens
aagaagagaugugguuuaa

SEQ ID NO: 1087605 - RNA, 19 nt, Homo sapiens
ccagaacacuagaagauga

SEQ ID NO: 1087606 - RNA, 19 nt, Homo sapiens
ggagagugcuaguucuuau

SEQ ID NO: 1087607 - RNA, 19 nt, Homo sapiens
agacaaaccuaguaaagau

SEQ ID NO: 1087608 - RNA, 19 nt, Homo sapiens
guaaauucauggaaaggaa

SEQ ID NO: 1087609 - RNA, 19 nt, Homo sapiens
ucucauacuugguugaaua

SEQ ID NO: 1087610 - RNA, 19 nt, Homo sapiens
agaauaugauccugcuuua

SEQ ID NO: 1087611 - RNA, 19 nt, Homo sapiens
ggacaucacucaggaccuu

SEQ ID NO: 1087612 - RNA, 19 nt, Homo sapiens
gagcgacgguucucuacuu

SEQ ID NO: 1087613 - RNA, 19 nt, Homo sapiens
ugaauuaagucgccuugaa

SEQ ID NO: 1087614 - RNA, 19 nt, Homo sapiens
gcaagauaaucccaaacuu

SEQ ID NO: 1087615 - RNA, 19 nt, Homo sapiens
gcucaucaaccucauuaua

SEQ ID NO: 1087616 - RNA, 19 nt, Homo sapiens
ucacagauaucgaagagau

SEQ ID NO: 1087617 - RNA, 19 nt, Homo sapiens
gaauugccaucuugugaau

SEQ ID NO: 1087618 - RNA, 19 nt, Homo sapiens
gaggauggaugauuuaaaa

SEQ ID NO: 1087619 - RNA, 19 nt, Homo sapiens
gaagacaaaccuaguaaag

SEQ ID NO: 1087620 - RNA, 19 nt, Homo sapiens
caacaggacacucugauug

SEQ ID NO: 1087621 - RNA, 19 nt, Homo sapiens
gcgcaguggucucuuguga

SEQ ID NO: 1087622 - RNA, 19 nt, Homo sapiens
gcuagccacugccaauaaa

SEQ ID NO: 1087623 - RNA, 19 nt, Homo sapiens
caaagagaaaggcaagaua

SEQ ID NO: 1087624 - RNA, 19 nt, Homo sapiens
gcacuuguauuggaauugu

SEQ ID NO: 1087625 - RNA, 19 nt, Homo sapiens
gacaguaugcguuccauuu

SEQ ID NO: 1087626 - RNA, 19 nt, Homo sapiens
gcaccauaccuaccacaua

SEQ ID NO: 1087627 - RNA, 19 nt, Homo sapiens
gaagugcugcuacugauau

SEQ ID NO: 1087628 - RNA, 19 nt, Homo sapiens
ugaagaaauugcagaacuu

SEQ ID NO: 1087629 - RNA, 19 nt, Homo sapiens
aaagagaaaggcaagauaa

SEQ ID NO: 1087630 - RNA, 19 nt, Homo sapiens
uacaaccgcuacauaauga

SEQ ID NO: 1087631 - RNA, 19 nt, Homo sapiens
agacugaauuucuggguuu

SEQ ID NO: 1087632 - RNA, 19 nt, Homo sapiens
gacaggaauugguuaacuu

SEQ ID NO: 1087633 - RNA, 19 nt, Homo sapiens
caucagacauacagaguuc

SEQ ID NO: 1087634 - RNA, 19 nt, Homo sapiens
ccacuuguaugaaauuauc

SEQ ID NO: 1087635 - RNA, 19 nt, Homo sapiens
ugacuuggcccuuagcuuu

SEQ ID NO: 1087636 - RNA, 19 nt, Homo sapiens
cggcagcuauuacuacaaa

SEQ ID NO: 1087637 - RNA, 19 nt, Homo sapiens
uaacacagaugaagaugac

SEQ ID NO: 1087638 - RNA, 19 nt, Homo sapiens
gaaagcacuggaagaugua

SEQ ID NO: 1087639 - RNA, 19 nt, Homo sapiens
uaacugcucauguaauuga

SEQ ID NO: 1087640 - RNA, 19 nt, Homo sapiens
gcugcugucucuuuaaaug

SEQ ID NO: 1087641 - RNA, 19 nt, Homo sapiens
uagauuauccugacgauga

SEQ ID NO: 1087642 - RNA, 19 nt, Homo sapiens
cauauuaccagcuuuagaa

SEQ ID NO: 1087643 - RNA, 19 nt, Homo sapiens
gaaaauaugucagguucaa

SEQ ID NO: 1087644 - RNA, 19 nt, Homo sapiens
gggccuuucugccauaauu

SEQ ID NO: 1087645 - RNA, 19 nt, Homo sapiens
gugaaugacugacacagau

SEQ ID NO: 1087646 - RNA, 19 nt, Homo sapiens
gaggagcaguccagcuuau

SEQ ID NO: 1087647 - RNA, 19 nt, Homo sapiens
gggcauauuaccagcuuua

SEQ ID NO: 1087648 - RNA, 19 nt, Homo sapiens
aaacacagggaauuucuaa

SEQ ID NO: 1087649 - RNA, 19 nt, Homo sapiens
gcuuagaauugccaucuug

SEQ ID NO: 1087650 - RNA, 19 nt, Homo sapiens
cagcaacugucuugagaau

SEQ ID NO: 1087651 - RNA, 19 nt, Homo sapiens
ggaagauacguuaccauug

SEQ ID NO: 1087652 - RNA, 19 nt, Homo sapiens
gcuacaaucugaugaacuc

SEQ ID NO: 1087653 - RNA, 19 nt, Homo sapiens
ugauacagauccugaacuu

SEQ ID NO: 1087654 - RNA, 19 nt, Homo sapiens
gaaaccgacuuccacuagu

SEQ ID NO: 1087655 - RNA, 19 nt, Homo sapiens
ggacuucucccuacuugau

SEQ ID NO: 1087656 - RNA, 19 nt, Homo sapiens
ccacauaaagaacuacauu

SEQ ID NO: 1087657 - RNA, 19 nt, Homo sapiens
acagggaauuucuaacaaa

SEQ ID NO: 1087658 - RNA, 19 nt, Homo sapiens
gaagaaauugcagaacuug

SEQ ID NO: 1087659 - RNA, 19 nt, Homo sapiens
uaagucgccuugaagaaau

SEQ ID NO: 1087660 - RNA, 19 nt, Homo sapiens
ccagucaucuacaacaaau

SEQ ID NO: 1087661 - RNA, 19 nt, Homo sapiens
gaagaugacauggaagaug

SEQ ID NO: 1087662 - RNA, 19 nt, Homo sapiens
agaugaagaugacauggaa

SEQ ID NO: 1087663 - RNA, 19 nt, Homo sapiens
uggaagauguagauuaugu

SEQ ID NO: 1087664 - RNA, 19 nt, Homo sapiens
cugaugaacucugccauaa

SEQ ID NO: 1087665 - RNA, 19 nt, Homo sapiens
cgacgguucucuacuuuua

SEQ ID NO: 1087666 - RNA, 19 nt, Homo sapiens
ucaucaaccucauuauaga

SEQ ID NO: 1087667 - RNA, 19 nt, Homo sapiens
ggaugaagauaaggaagau

SEQ ID NO: 1087668 - RNA, 19 nt, Homo sapiens
ucgaagagaugccagaaca

SEQ ID NO: 1087669 - RNA, 19 nt, Homo sapiens
ggaagauguagauuaugua

SEQ ID NO: 1087670 - RNA, 19 nt, Homo sapiens
ucucacugcuccuuuacua

SEQ ID NO: 1087671 - RNA, 19 nt, Homo sapiens
uaaagaagugauucccaua

SEQ ID NO: 1087672 - RNA, 19 nt, Homo sapiens
gcuuaguuguugaguauau

SEQ ID NO: 1087673 - RNA, 19 nt, Homo sapiens
gccagcaguuucuuuguau

SEQ ID NO: 1087674 - RNA, 19 nt, Homo sapiens
cggcagagcccaaguuuca

SEQ ID NO: 1087675 - RNA, 19 nt, Homo sapiens
uggagaagcuguagugucu

SEQ ID NO: 1087676 - RNA, 19 nt, Homo sapiens
gcgaagugcugcuacugau

SEQ ID NO: 1087677 - RNA, 19 nt, Homo sapiens
ggcaucaucuuuaccuuca

SEQ ID NO: 1087678 - RNA, 19 nt, Homo sapiens
ucagggaaauagaauggaa

SEQ ID NO: 1087679 - RNA, 19 nt, Homo sapiens
gaucagccucuuacacuug

SEQ ID NO: 1087680 - RNA, 19 nt, Homo sapiens
ucgugggucugguagauua

SEQ ID NO: 1087681 - RNA, 19 nt, Homo sapiens
aaacugagauuugaacaac

SEQ ID NO: 1087682 - RNA, 19 nt, Homo sapiens
uaacacugcauaccagaaa

SEQ ID NO: 1087683 - RNA, 19 nt, Homo sapiens
ggaucccgcuacaaucuga

SEQ ID NO: 1087684 - RNA, 19 nt, Homo sapiens
ggaggagcaguccagcuua

SEQ ID NO: 1087685 - RNA, 19 nt, Homo sapiens
caacagaaugaugaugaua

SEQ ID NO: 1087686 - RNA, 19 nt, Homo sapiens
ggagagagaucgauugaaa

SEQ ID NO: 1087687 - RNA, 19 nt, Homo sapiens
gugcagagauucauuauug

SEQ ID NO: 1087688 - RNA, 19 nt, Homo sapiens
caacauggauuacgacauc

SEQ ID NO: 1087689 - RNA, 19 nt, Homo sapiens
gaaauacgaaucccagaaa

SEQ ID NO: 1087690 - RNA, 19 nt, Homo sapiens
ccagacagauggugcuuga

SEQ ID NO: 1087691 - RNA, 19 nt, Homo sapiens
cagccaaccuccuggauga

SEQ ID NO: 1087692 - RNA, 19 nt, Homo sapiens
agagagaucgauugaaaua

SEQ ID NO: 1087693 - RNA, 19 nt, Homo sapiens
agacucaguuucccucuuu

SEQ ID NO: 1087694 - RNA, 19 nt, Homo sapiens
aaauacaacucgaggagaa

SEQ ID NO: 1087695 - RNA, 19 nt, Homo sapiens
gggacaagcugaaacacau

SEQ ID NO: 1087696 - RNA, 19 nt, Homo sapiens
gaggugcagagauucauua

SEQ ID NO: 1087697 - RNA, 19 nt, Homo sapiens
ggacagggaggccauguuc

SEQ ID NO: 1087698 - RNA, 19 nt, Homo sapiens
gacagauggugcuugagaa

SEQ ID NO: 1087699 - RNA, 19 nt, Homo sapiens
gagaaggacaguaagagau

SEQ ID NO: 1087700 - RNA, 19 nt, Homo sapiens
ggaaacgacuuuggcuuuu

SEQ ID NO: 1087701 - RNA, 19 nt, Homo sapiens
uauaggcagcagccaauua

SEQ ID NO: 1087702 - RNA, 19 nt, Homo sapiens
gaggaaggccugcgagaag

SEQ ID NO: 1087703 - RNA, 19 nt, Homo sapiens
cggaaacgacuuuggcuuu

SEQ ID NO: 1087704 - RNA, 19 nt, Homo sapiens
ccggagaucuuggaaagga

SEQ ID NO: 1087705 - RNA, 19 nt, Homo sapiens
gucugaagaugccuuauuc

SEQ ID NO: 1087706 - RNA, 19 nt, Homo sapiens
gagaucgauugaaauacga

SEQ ID NO: 1087707 - RNA, 19 nt, Homo sapiens
gcagagauucauuauugug

SEQ ID NO: 1087708 - RNA, 19 nt, Homo sapiens
ggaggaaggccugcgagaa

SEQ ID NO: 1087709 - RNA, 19 nt, Homo sapiens
gaaaguccacccggaggaa

SEQ ID NO: 1087710 - RNA, 19 nt, Homo sapiens
ccugauagcucggaugaag

SEQ ID NO: 1087711 - RNA, 19 nt, Homo sapiens
gcccaaccacugccacuuu

SEQ ID NO: 1087712 - RNA, 19 nt, Homo sapiens
ugaaacacaugggaaaguc

SEQ ID NO: 1087713 - RNA, 19 nt, Homo sapiens
caaccuuccggaugacuuu

SEQ ID NO: 1087714 - RNA, 19 nt, Homo sapiens
ccacuuuccaugggacuua

SEQ ID NO: 1087715 - RNA, 19 nt, Homo sapiens
cgagaaggacaguaagaga

SEQ ID NO: 1087716 - RNA, 19 nt, Homo sapiens
ggauuacgacaucaucgaa

SEQ ID NO: 1087717 - RNA, 19 nt, Homo sapiens
gcagaggugcagagauuca

SEQ ID NO: 1087718 - RNA, 19 nt, Homo sapiens
acgaaucccagaaaucuaa

SEQ ID NO: 1087719 - RNA, 19 nt, Homo sapiens
aaauacgaaucccagaaau

SEQ ID NO: 1087720 - RNA, 19 nt, Homo sapiens
ugaaauacgaaucccagaa

SEQ ID NO: 1087721 - RNA, 19 nt, Homo sapiens
acgaggaguucaugaagga

SEQ ID NO: 1087722 - RNA, 19 nt, Homo sapiens
ugggcaaccuuccggauga

SEQ ID NO: 1087723 - RNA, 19 nt, Homo sapiens
ccaugggacuuagaacuuc

SEQ ID NO: 1087724 - RNA, 19 nt, Homo sapiens
agacagauggugcuugaga

SEQ ID NO: 1087725 - RNA, 19 nt, Homo sapiens
gagagagaucgauugaaau

SEQ ID NO: 1087726 - RNA, 19 nt, Homo sapiens
cccaggagcucaacaacag

SEQ ID NO: 1087727 - RNA, 19 nt, Homo sapiens
ucaaagaggaaacacuugu

SEQ ID NO: 1087728 - RNA, 19 nt, Homo sapiens
cagagacgcuaucggaacu

SEQ ID NO: 1087729 - RNA, 19 nt, Homo sapiens
ggacaagcugaaacacaug

SEQ ID NO: 1087730 - RNA, 19 nt, Homo sapiens
gcaacggaaccgcgacuuc

SEQ ID NO: 1087731 - RNA, 19 nt, Homo sapiens
gcguuccuauggucaaaga

SEQ ID NO: 1087732 - RNA, 19 nt, Homo sapiens
gggcguuccuauggucaaa

SEQ ID NO: 1087733 - RNA, 19 nt, Homo sapiens
gaacuugcccgagccuucu

SEQ ID NO: 1087734 - RNA, 19 nt, Homo sapiens
agagaucgauugaaauacg

SEQ ID NO: 1087735 - RNA, 19 nt, Homo sapiens
cgagaccgcagggcaagua

SEQ ID NO: 1087736 - RNA, 19 nt, Homo sapiens
ggaagucaaagaggaaaca

SEQ ID NO: 1087737 - RNA, 19 nt, Homo sapiens
ggucaaagaguggaaaugc

SEQ ID NO: 1087738 - RNA, 19 nt, Homo sapiens
agaaggacaguaagagaug

SEQ ID NO: 1087739 - RNA, 19 nt, Homo sapiens
ccaaccuccuggaugaugu

SEQ ID NO: 1087740 - RNA, 19 nt, Homo sapiens
gacgagaggaucgcgcuuu

SEQ ID NO: 1087741 - RNA, 19 nt, Homo sapiens
gucaaagaguggaaaugca

SEQ ID NO: 1087742 - RNA, 19 nt, Homo sapiens
ggaaggccugcgagaagga

SEQ ID NO: 1087743 - RNA, 19 nt, Homo sapiens
gggccacgcgugugaugaa

SEQ ID NO: 1087744 - RNA, 19 nt, Homo sapiens
ggacuuuggaaccugauag

SEQ ID NO: 1087745 - RNA, 19 nt, Homo sapiens
ugaggaagucaaagaggaa

SEQ ID NO: 1087746 - RNA, 19 nt, Homo sapiens
gacgcuaucggaacuggaa

SEQ ID NO: 1087747 - RNA, 19 nt, Homo sapiens
ggccauggacgacuucaag

SEQ ID NO: 1087748 - RNA, 19 nt, Homo sapiens
ccucuugccuguccugacu

SEQ ID NO: 1087749 - RNA, 19 nt, Homo sapiens
cccaaccacugccacuuuc

SEQ ID NO: 1087750 - RNA, 19 nt, Homo sapiens
agucaaagaggaaacacuu

SEQ ID NO: 1087751 - RNA, 19 nt, Homo sapiens
gaggaagucaaagaggaaa

SEQ ID NO: 1087752 - RNA, 19 nt, Homo sapiens
ugucugaagaugccuuauu

SEQ ID NO: 1087753 - RNA, 19 nt, Homo sapiens
caaaaugaccagccuguuc

SEQ ID NO: 1087754 - RNA, 19 nt, Homo sapiens
ccacgcgugugaugaagac

SEQ ID NO: 1087755 - RNA, 19 nt, Homo sapiens
ucccagaaaucuaaaucca

SEQ ID NO: 1087756 - RNA, 19 nt, Homo sapiens
caggaaccaaccucccuuu

SEQ ID NO: 1087757 - RNA, 19 nt, Homo sapiens
gagaccgcagggcaaguaa

SEQ ID NO: 1087758 - RNA, 19 nt, Homo sapiens
ccugcgagaaggacaguaa

SEQ ID NO: 1087759 - RNA, 19 nt, Homo sapiens
ggcuggaggugggaccauu

SEQ ID NO: 1087760 - RNA, 19 nt, Homo sapiens
ucagagaagaccaaaauga

SEQ ID NO: 1087761 - RNA, 19 nt, Homo sapiens
gcaaccuuccggaugacuu

SEQ ID NO: 1087762 - RNA, 19 nt, Homo sapiens
ugugggaccauccgugaaa

SEQ ID NO: 1087763 - RNA, 19 nt, Homo sapiens
auacgaaucccagaaaucu

SEQ ID NO: 1087764 - RNA, 19 nt, Homo sapiens
auuacgacaucaucgaaug

SEQ ID NO: 1087765 - RNA, 19 nt, Homo sapiens
gauuacgacaucaucgaau

SEQ ID NO: 1087766 - RNA, 19 nt, Homo sapiens
gcacagacguuuaacagua

SEQ ID NO: 1087767 - RNA, 19 nt, Homo sapiens
gaagaaggcugauaucaca

SEQ ID NO: 1087768 - RNA, 19 nt, Homo sapiens
gagcaaagacuuaaacuaa

SEQ ID NO: 1087769 - RNA, 19 nt, Homo sapiens
gaaagacagugacgaagaa

SEQ ID NO: 1087770 - RNA, 19 nt, Homo sapiens
caacaggccugauggaauu

SEQ ID NO: 1087771 - RNA, 19 nt, Homo sapiens
gaacaacucuaugaaaugu

SEQ ID NO: 1087772 - RNA, 19 nt, Homo sapiens
gcucauggauagccaaaua

SEQ ID NO: 1087773 - RNA, 19 nt, Homo sapiens
gcaaagacuuaaacuaaug

SEQ ID NO: 1087774 - RNA, 19 nt, Homo sapiens
gaaagcagcugcaaaauau

SEQ ID NO: 1087775 - RNA, 19 nt, Homo sapiens
ggaauuugcccaccacuua

SEQ ID NO: 1087776 - RNA, 19 nt, Homo sapiens
gcagacaccuauauuaugu

SEQ ID NO: 1087777 - RNA, 19 nt, Homo sapiens
gaacaagaacugcauuuga

SEQ ID NO: 1087778 - RNA, 19 nt, Homo sapiens
gaacaggacagaauauuau

SEQ ID NO: 1087779 - RNA, 19 nt, Homo sapiens
gaaaggugguccggaauuu

SEQ ID NO: 1087780 - RNA, 19 nt, Homo sapiens
guacagcaguuccaugaaa

SEQ ID NO: 1087781 - RNA, 19 nt, Homo sapiens
gaacaccagcuccuuuaua

SEQ ID NO: 1087782 - RNA, 19 nt, Homo sapiens
cgagaaagcugccuugauc

SEQ ID NO: 1087783 - RNA, 19 nt, Homo sapiens
gugguugacugauagauua

SEQ ID NO: 1087784 - RNA, 19 nt, Homo sapiens
ugucuaagcugucaaggua

SEQ ID NO: 1087785 - RNA, 19 nt, Homo sapiens
acacuagacucaccgaaua

SEQ ID NO: 1087786 - RNA, 19 nt, Homo sapiens
caauauaccuuugcuaugu

SEQ ID NO: 1087787 - RNA, 19 nt, Homo sapiens
gaagaggacuugugcaaac

SEQ ID NO: 1087788 - RNA, 19 nt, Homo sapiens
ugaagaaaguggucagaaa

SEQ ID NO: 1087789 - RNA, 19 nt, Homo sapiens
cagaagaggugaagaaagu

SEQ ID NO: 1087790 - RNA, 19 nt, Homo sapiens
gcaaacagccaaauagaau

SEQ ID NO: 1087791 - RNA, 19 nt, Homo sapiens
gcaaggaacaacucuauga

SEQ ID NO: 1087792 - RNA, 19 nt, Homo sapiens
ggacauaggagaugagaau

SEQ ID NO: 1087793 - RNA, 19 nt, Homo sapiens
ugaagacgcucaucaagau

SEQ ID NO: 1087794 - RNA, 19 nt, Homo sapiens
guggaugccuucuuuauau

SEQ ID NO: 1087795 - RNA, 19 nt, Homo sapiens
cacaaacacuugcaagaaa

SEQ ID NO: 1087796 - RNA, 19 nt, Homo sapiens
cuagaaagcuggaagagau

SEQ ID NO: 1087797 - RNA, 19 nt, Homo sapiens
gcaacgcaguucggaguua

SEQ ID NO: 1087798 - RNA, 19 nt, Homo sapiens
caaaucagcugaauuacac

SEQ ID NO: 1087799 - RNA, 19 nt, Homo sapiens
ccacagauuccuaacauuu

SEQ ID NO: 1087800 - RNA, 19 nt, Homo sapiens
gauaagccauuucagauac

SEQ ID NO: 1087801 - RNA, 19 nt, Homo sapiens
uagccaggauucugacuua

SEQ ID NO: 1087802 - RNA, 19 nt, Homo sapiens
caacagucuucccaaugua

SEQ ID NO: 1087803 - RNA, 19 nt, Homo sapiens
agaaagauuugaggagaua

SEQ ID NO: 1087804 - RNA, 19 nt, Homo sapiens
gaaagaaaauuccccaaau

SEQ ID NO: 1087805 - RNA, 19 nt, Homo sapiens
ccacaggucaaucauauaa

SEQ ID NO: 1087806 - RNA, 19 nt, Homo sapiens
ggccacaggucaaucauau

SEQ ID NO: 1087807 - RNA, 19 nt, Homo sapiens
ccgcaagacuccugggaua

SEQ ID NO: 1087808 - RNA, 19 nt, Homo sapiens
guaaagaugcagaucguuu

SEQ ID NO: 1087809 - RNA, 19 nt, Homo sapiens
aaagaagucugaaccacaa

SEQ ID NO: 1087810 - RNA, 19 nt, Homo sapiens
gauaaaccagcacauauga

SEQ ID NO: 1087811 - RNA, 19 nt, Homo sapiens
ugggaagggugauauuaua

SEQ ID NO: 1087812 - RNA, 19 nt, Homo sapiens
aacaagaacugcauuugaa

SEQ ID NO: 1087813 - RNA, 19 nt, Homo sapiens
uaaagaaggagauacugua

SEQ ID NO: 1087814 - RNA, 19 nt, Homo sapiens
gaagucaguugcucccaau

SEQ ID NO: 1087815 - RNA, 19 nt, Homo sapiens
uaacgcagaugaacaagca

SEQ ID NO: 1087816 - RNA, 19 nt, Homo sapiens
ccaacagucuucccaaugu

SEQ ID NO: 1087817 - RNA, 19 nt, Homo sapiens
aagcugccuugaucaauua

SEQ ID NO: 1087818 - RNA, 19 nt, Homo sapiens
cccagaaacugaauccuaa

SEQ ID NO: 1087819 - RNA, 19 nt, Homo sapiens
gguuguauguucuuuaaug

SEQ ID NO: 1087820 - RNA, 19 nt, Homo sapiens
gaucaaugguacagcaguu

SEQ ID NO: 1087821 - RNA, 19 nt, Homo sapiens
caauguagcucuuccaaaa

SEQ ID NO: 1087822 - RNA, 19 nt, Homo sapiens
ggaggcagcagaagcuuaa

SEQ ID NO: 1087823 - RNA, 19 nt, Homo sapiens
uaaaccaguuccugcaauu

SEQ ID NO: 1087824 - RNA, 19 nt, Homo sapiens
aacaccagcuccuuuauaa

SEQ ID NO: 1087825 - RNA, 19 nt, Homo sapiens
gcaaagcaccaaacucugu

SEQ ID NO: 1087826 - RNA, 19 nt, Homo sapiens
gcuagaggccugugucaaa

SEQ ID NO: 1087827 - RNA, 19 nt, Homo sapiens
gcagaagcuuaacaaacaa

SEQ ID NO: 1087828 - RNA, 19 nt, Homo sapiens
ugaacaggacagaauauua

SEQ ID NO: 1087829 - RNA, 19 nt, Homo sapiens
gagcaaagagacaguguug

SEQ ID NO: 1087830 - RNA, 19 nt, Homo sapiens
aaaguaagccugaauguag

SEQ ID NO: 1087831 - RNA, 19 nt, Homo sapiens
aaacuaauggccagugaua

SEQ ID NO: 1087832 - RNA, 19 nt, Homo sapiens
agaaggagauacuguaauc

SEQ ID NO: 1087833 - RNA, 19 nt, Homo sapiens
ugaauuacaccgaauggua

SEQ ID NO: 1087834 - RNA, 19 nt, Homo sapiens
gaguugcggucuucaguga

SEQ ID NO: 1087835 - RNA, 19 nt, Homo sapiens
ucaucaagauugugaagaa

SEQ ID NO: 1087836 - RNA, 19 nt, Homo sapiens
aaagcugccuugaucaauu

SEQ ID NO: 1087837 - RNA, 19 nt, Homo sapiens
gugguuguauguucuuuaa

SEQ ID NO: 1087838 - RNA, 19 nt, Homo sapiens
ggauaaaccagcacauaug

SEQ ID NO: 1087839 - RNA, 19 nt, Homo sapiens
gaacaagcagcccagauca

SEQ ID NO: 1087840 - RNA, 19 nt, Homo sapiens
ggauaacgcagaugaacaa

SEQ ID NO: 1087841 - RNA, 19 nt, Homo sapiens
gagcaaggaacaacucuau

SEQ ID NO: 1087842 - RNA, 19 nt, Homo sapiens
gugcggaguuugccagaaa

SEQ ID NO: 1087843 - RNA, 19 nt, Homo sapiens
gagcaacaguaccauucaa

SEQ ID NO: 1087844 - RNA, 19 nt, Homo sapiens
ucagaaacaugguauggau

SEQ ID NO: 1087845 - RNA, 19 nt, Homo sapiens
ggaacaacucuaugaaaug

SEQ ID NO: 1087846 - RNA, 19 nt, Homo sapiens
ggacuucagggcauuacua

SEQ ID NO: 1087847 - RNA, 19 nt, Homo sapiens
gaaaaugucucgagaaagc

SEQ ID NO: 1087848 - RNA, 19 nt, Homo sapiens
cuccaaaucagcugaauua

SEQ ID NO: 1087849 - RNA, 19 nt, Homo sapiens
ucacacagcuuugcagaag

SEQ ID NO: 1087850 - RNA, 19 nt, Homo sapiens
uggaaggcguguugucuaa

SEQ ID NO: 1087851 - RNA, 19 nt, Homo sapiens
ccaaauagaauggcccuaa

SEQ ID NO: 1087852 - RNA, 19 nt, Homo sapiens
gcaaagagacaguguugag

SEQ ID NO: 1087853 - RNA, 19 nt, Homo sapiens
ucuaauagcuccaaaucag

SEQ ID NO: 1087854 - RNA, 19 nt, Homo sapiens
ccuuagagauugucauaau

SEQ ID NO: 1087855 - RNA, 19 nt, Homo sapiens
guguugagcucauggauag

SEQ ID NO: 1087856 - RNA, 19 nt, Homo sapiens
cuacagggacuuucgauug

SEQ ID NO: 1087857 - RNA, 19 nt, Homo sapiens
uagaacaccagcuccuuua

SEQ ID NO: 1087858 - RNA, 19 nt, Homo sapiens
caaauagaauggcccuaag

SEQ ID NO: 1087859 - RNA, 19 nt, Homo sapiens
gcacuggccagaacaggaa

SEQ ID NO: 1087860 - RNA, 19 nt, Homo sapiens
agcagaagcuuaacaaaca

SEQ ID NO: 1087861 - RNA, 19 nt, Homo sapiens
cuucguggaugccuucuuu

SEQ ID NO: 1087862 - RNA, 19 nt, Homo sapiens
gaauaucgccaacagucuu

SEQ ID NO: 1087863 - RNA, 19 nt, Homo sapiens
gcaacaggccugauggaau

SEQ ID NO: 1087864 - RNA, 19 nt, Homo sapiens
gaacugggaagggugauau

SEQ ID NO: 1087865 - RNA, 19 nt, Homo sapiens
aggaacaacucuaugaaau

SEQ ID NO: 1087866 - RNA, 19 nt, Homo sapiens
gaguagaucugucacauua

SEQ ID NO: 1087867 - RNA, 19 nt, Homo sapiens
gaaauccucguaaauguua

SEQ ID NO: 1087868 - RNA, 19 nt, Homo sapiens
ggagcucucuuuauauuaa

SEQ ID NO: 1087869 - RNA, 19 nt, Homo sapiens
guugggagcucucuuuaua

SEQ ID NO: 1087870 - RNA, 19 nt, Homo sapiens
gaugugaccuuaccuuuau

SEQ ID NO: 1087871 - RNA, 19 nt, Homo sapiens
guaguugacugcaguguga

SEQ ID NO: 1087872 - RNA, 19 nt, Homo sapiens
ggaauaaaccuuuugcuua

SEQ ID NO: 1087873 - RNA, 19 nt, Homo sapiens
gaacccaguuauucuucua

SEQ ID NO: 1087874 - RNA, 19 nt, Homo sapiens
ccaaguagauauggaacua

SEQ ID NO: 1087875 - RNA, 19 nt, Homo sapiens
caauucaucucuuucgaaa

SEQ ID NO: 1087876 - RNA, 19 nt, Homo sapiens
ggaagauuauuaguuggua

SEQ ID NO: 1087877 - RNA, 19 nt, Homo sapiens
gcagugugaugugaccuua

SEQ ID NO: 1087878 - RNA, 19 nt, Homo sapiens
gcauuugcucuuuguauua

SEQ ID NO: 1087879 - RNA, 19 nt, Homo sapiens
caugaaaccuaugaaacua

SEQ ID NO: 1087880 - RNA, 19 nt, Homo sapiens
gauacacacgggaagauua

SEQ ID NO: 1087881 - RNA, 19 nt, Homo sapiens
gauaauaguagucuuguuc

SEQ ID NO: 1087882 - RNA, 19 nt, Homo sapiens
uaaaggguacugaugauuu

SEQ ID NO: 1087883 - RNA, 19 nt, Homo sapiens
uguacuggcuuccugcuua

SEQ ID NO: 1087884 - RNA, 19 nt, Homo sapiens
gugaaauccucguaaaugu

SEQ ID NO: 1087885 - RNA, 19 nt, Homo sapiens
caaccaagaccaugauaga

SEQ ID NO: 1087886 - RNA, 19 nt, Homo sapiens
caaacaaggccuuaugguu

SEQ ID NO: 1087887 - RNA, 19 nt, Homo sapiens
agucgaagcuuguguggaa

SEQ ID NO: 1087888 - RNA, 19 nt, Homo sapiens
uugagguucuccugaauua

SEQ ID NO: 1087889 - RNA, 19 nt, Homo sapiens
guacagugggaaagucuua

SEQ ID NO: 1087890 - RNA, 19 nt, Homo sapiens
ucuccugaauuaugucuua

SEQ ID NO: 1087891 - RNA, 19 nt, Homo sapiens
aaaggguacugaugauuug

SEQ ID NO: 1087892 - RNA, 19 nt, Homo sapiens
cgaagcuuguguggaauua

SEQ ID NO: 1087893 - RNA, 19 nt, Homo sapiens
ugggagcucucuuuauauu

SEQ ID NO: 1087894 - RNA, 19 nt, Homo sapiens
acagugaaauccucguaaa

SEQ ID NO: 1087895 - RNA, 19 nt, Homo sapiens
gaucagugcauguaagaau

SEQ ID NO: 1087896 - RNA, 19 nt, Homo sapiens
uuacgggaauuuagacuug

SEQ ID NO: 1087897 - RNA, 19 nt, Homo sapiens
ggacugguuuuacaaauau

SEQ ID NO: 1087898 - RNA, 19 nt, Homo sapiens
uaccuuagauggaguuuua

SEQ ID NO: 1087899 - RNA, 19 nt, Homo sapiens
gcuauugccuugaugacau

SEQ ID NO: 1087900 - RNA, 19 nt, Homo sapiens
gaacagcccgagauacaca

SEQ ID NO: 1087901 - RNA, 19 nt, Homo sapiens
uggagcaacucaaggauug

SEQ ID NO: 1087902 - RNA, 19 nt, Homo sapiens
acgggaagauuauuaguug

SEQ ID NO: 1087903 - RNA, 19 nt, Homo sapiens
auacugcucuuugguguaa

SEQ ID NO: 1087904 - RNA, 19 nt, Homo sapiens
uaacuuaaggcuguacuuu

SEQ ID NO: 1087905 - RNA, 19 nt, Homo sapiens
aaauaggcuuccuuuagaa

SEQ ID NO: 1087906 - RNA, 19 nt, Homo sapiens
cagccaauguccuaaacuu

SEQ ID NO: 1087907 - RNA, 19 nt, Homo sapiens
gaugacauuuggcacuaug

SEQ ID NO: 1087908 - RNA, 19 nt, Homo sapiens
acacacgggaagauuauua

SEQ ID NO: 1087909 - RNA, 19 nt, Homo sapiens
uagaaguccuggcuguauu

SEQ ID NO: 1087910 - RNA, 19 nt, Homo sapiens
gagguucuccugaauuaug

SEQ ID NO: 1087911 - RNA, 19 nt, Homo sapiens
aagcuuguguggaauuauu

SEQ ID NO: 1087912 - RNA, 19 nt, Homo sapiens
guacuggcuuccugcuuau

SEQ ID NO: 1087913 - RNA, 19 nt, Homo sapiens
acuuaaggcuguacuuuau

SEQ ID NO: 1087914 - RNA, 19 nt, Homo sapiens
guagaucugucacauuacu

SEQ ID NO: 1087915 - RNA, 19 nt, Homo sapiens
ugaugugaccuuaccuuua

SEQ ID NO: 1087916 - RNA, 19 nt, Homo sapiens
ugcauugacuguuuaauca

SEQ ID NO: 1087917 - RNA, 19 nt, Homo sapiens
uacaucaacuccagcuaaa

SEQ ID NO: 1087918 - RNA, 19 nt, Homo sapiens
uggacaaacucaucagaga

SEQ ID NO: 1087919 - RNA, 19 nt, Homo sapiens
gagcauguugcagaucuua

SEQ ID NO: 1087920 - RNA, 19 nt, Homo sapiens
acucuagugucuacucuaa

SEQ ID NO: 1087921 - RNA, 19 nt, Homo sapiens
gcucuuugguguaauaaac

SEQ ID NO: 1087922 - RNA, 19 nt, Homo sapiens
guaagaauucgacgagaug

SEQ ID NO: 1087923 - RNA, 19 nt, Homo sapiens
gaucuuagucgaagcuugu

SEQ ID NO: 1087924 - RNA, 19 nt, Homo sapiens
cauucuaucuagcacaauu

SEQ ID NO: 1087925 - RNA, 19 nt, Homo sapiens
ggaguagaucugucacauu

SEQ ID NO: 1087926 - RNA, 19 nt, Homo sapiens
guaauccaacuuugcauug

SEQ ID NO: 1087927 - RNA, 19 nt, Homo sapiens
uaguccaccuccagaauuu

SEQ ID NO: 1087928 - RNA, 19 nt, Homo sapiens
gcaaguuguuacgggaauu

SEQ ID NO: 1087929 - RNA, 19 nt, Homo sapiens
auacuuaccugaccauuuu

SEQ ID NO: 1087930 - RNA, 19 nt, Homo sapiens
ugacugcagugugauguga

SEQ ID NO: 1087931 - RNA, 19 nt, Homo sapiens
ggaauuggagcaacucaag

SEQ ID NO: 1087932 - RNA, 19 nt, Homo sapiens
uuucaaggaugacuggauu

SEQ ID NO: 1087933 - RNA, 19 nt, Homo sapiens
cauuuggguuugaaagauu

SEQ ID NO: 1087934 - RNA, 19 nt, Homo sapiens
gugcugggauuagguguga

SEQ ID NO: 1087935 - RNA, 19 nt, Homo sapiens
ccgaguagcugggauuaca

SEQ ID NO: 1087936 - RNA, 19 nt, Homo sapiens
uaauccaacuuugcauuga

SEQ ID NO: 1087937 - RNA, 19 nt, Homo sapiens
uaauagaauuggacaacca

SEQ ID NO: 1087938 - RNA, 19 nt, Homo sapiens
cgaagguccuggaagauac

SEQ ID NO: 1087939 - RNA, 19 nt, Homo sapiens
uggugcaguucuacuaaua

SEQ ID NO: 1087940 - RNA, 19 nt, Homo sapiens
ucaagagcauguugcagau

SEQ ID NO: 1087941 - RNA, 19 nt, Homo sapiens
caccgcaccuggccgauau

SEQ ID NO: 1087942 - RNA, 19 nt, Homo sapiens
uuacaucaacuccagcuaa

SEQ ID NO: 1087943 - RNA, 19 nt, Homo sapiens
gaugauuugaacccaguua

SEQ ID NO: 1087944 - RNA, 19 nt, Homo sapiens
ggcacuauguaucccauga

SEQ ID NO: 1087945 - RNA, 19 nt, Homo sapiens
ucacgaugcuuucuauucg

SEQ ID NO: 1087946 - RNA, 19 nt, Homo sapiens
guauuugccuccacagucu

SEQ ID NO: 1087947 - RNA, 19 nt, Homo sapiens
caccuuagccucccaaagu

SEQ ID NO: 1087948 - RNA, 19 nt, Homo sapiens
ggacaaccaagaccaugau

SEQ ID NO: 1087949 - RNA, 19 nt, Homo sapiens
guaguccaccuccagaauu

SEQ ID NO: 1087950 - RNA, 19 nt, Homo sapiens
gacaauucaucucuuucga

SEQ ID NO: 1087951 - RNA, 19 nt, Homo sapiens
ucgacgagaugccaaugaa

SEQ ID NO: 1087952 - RNA, 19 nt, Homo sapiens
agacacugccucugcuaua

SEQ ID NO: 1087953 - RNA, 19 nt, Homo sapiens
ccacagucuuggcacaguu

SEQ ID NO: 1087954 - RNA, 19 nt, Homo sapiens
aaaccuagcccugucuauu

SEQ ID NO: 1087955 - RNA, 19 nt, Homo sapiens
ccaccacgcccagcuaauu

SEQ ID NO: 1087956 - RNA, 19 nt, Homo sapiens
cuccugaguucaaaugauu

SEQ ID NO: 1087957 - RNA, 19 nt, Homo sapiens
cagcaugcuuaaucaagga

SEQ ID NO: 1087958 - RNA, 19 nt, Homo sapiens
gggagcucucuuuauauua

SEQ ID NO: 1087959 - RNA, 19 nt, Homo sapiens
ccgaagguccuggaagaua

SEQ ID NO: 1087960 - RNA, 19 nt, Homo sapiens
ccaaagugcugggauuagg

SEQ ID NO: 1087961 - RNA, 19 nt, Homo sapiens
guaaucccaaugccucuuu

SEQ ID NO: 1087962 - RNA, 19 nt, Homo sapiens
gacacugccucugcuauag

SEQ ID NO: 1087963 - RNA, 19 nt, Homo sapiens
ugaaauccucguaaauguu

SEQ ID NO: 1087964 - RNA, 19 nt, Homo sapiens
ccaguuauucuucuaaaca

SEQ ID NO: 1087965 - RNA, 19 nt, Homo sapiens
uguaagaauucgacgagau

SEQ ID NO: 1087966 - RNA, 19 nt, Homo sapiens
ggaaagaauugucugauaa

SEQ ID NO: 1087967 - RNA, 19 nt, Homo sapiens
gaugagcccuuaaaucuua

SEQ ID NO: 1087968 - RNA, 19 nt, Homo sapiens
ggaagaagcugggaaagaa

SEQ ID NO: 1087969 - RNA, 19 nt, Homo sapiens
gaaugaagcugcugaggaa

SEQ ID NO: 1087970 - RNA, 19 nt, Homo sapiens
gaagaagaauuuacagguu

SEQ ID NO: 1087971 - RNA, 19 nt, Homo sapiens
ggacauggcagggaaauua

SEQ ID NO: 1087972 - RNA, 19 nt, Homo sapiens
gggaaagaauugucugaua

SEQ ID NO: 1087973 - RNA, 19 nt, Homo sapiens
gcagggaaauuaaucaaug

SEQ ID NO: 1087974 - RNA, 19 nt, Homo sapiens
gcagugauguaucucuaua

SEQ ID NO: 1087975 - RNA, 19 nt, Homo sapiens
ggacagugaugaagaugaa

SEQ ID NO: 1087976 - RNA, 19 nt, Homo sapiens
ggcagucucugaacacuua

SEQ ID NO: 1087977 - RNA, 19 nt, Homo sapiens
gcagagagaucuagaacag

SEQ ID NO: 1087978 - RNA, 19 nt, Homo sapiens
gggaggagcugcugaagau

SEQ ID NO: 1087979 - RNA, 19 nt, Homo sapiens
auacagaaaugcagaauga

SEQ ID NO: 1087980 - RNA, 19 nt, Homo sapiens
ugagaaaguucacagauau

SEQ ID NO: 1087981 - RNA, 19 nt, Homo sapiens
ccaagaagaucuggaagaa

SEQ ID NO: 1087982 - RNA, 19 nt, Homo sapiens
aagaagaucuggaagaaga

SEQ ID NO: 1087983 - RNA, 19 nt, Homo sapiens
gcaaagaagagucguguug

SEQ ID NO: 1087984 - RNA, 19 nt, Homo sapiens
uguaucagauguugucaua

SEQ ID NO: 1087985 - RNA, 19 nt, Homo sapiens
gagcagugauguaucucua

SEQ ID NO: 1087986 - RNA, 19 nt, Homo sapiens
gagaaagcaucagcaaaga

SEQ ID NO: 1087987 - RNA, 19 nt, Homo sapiens
gaaugaaacuagugaucga

SEQ ID NO: 1087988 - RNA, 19 nt, Homo sapiens
gaagagaccaggaaauuac

SEQ ID NO: 1087989 - RNA, 19 nt, Homo sapiens
caaaggaauacuagucaua

SEQ ID NO: 1087990 - RNA, 19 nt, Homo sapiens
caaauggaauguggaaaug

SEQ ID NO: 1087991 - RNA, 19 nt, Homo sapiens
ggucuuaccucaaacuaca

SEQ ID NO: 1087992 - RNA, 19 nt, Homo sapiens
ggaagcaucccgccaguga

SEQ ID NO: 1087993 - RNA, 19 nt, Homo sapiens
ugagaacgaugagcccuua

SEQ ID NO: 1087994 - RNA, 19 nt, Homo sapiens
ucacauuucucucaguuau

SEQ ID NO: 1087995 - RNA, 19 nt, Homo sapiens
guaaaugguucagcgugua

SEQ ID NO: 1087996 - RNA, 19 nt, Homo sapiens
gaagcaggaccuuaaagaa

SEQ ID NO: 1087997 - RNA, 19 nt, Homo sapiens
gaagaggaagaagaauuua

SEQ ID NO: 1087998 - RNA, 19 nt, Homo sapiens
ggacagcgacucugaaucu

SEQ ID NO: 1087999 - RNA, 19 nt, Homo sapiens
guucacagauauaaggaaa

SEQ ID NO: 1088000 - RNA, 19 nt, Homo sapiens
gaauggcucucaccucuac

SEQ ID NO: 1088001 - RNA, 19 nt, Homo sapiens
gcagacauauuuggagaau

SEQ ID NO: 1088002 - RNA, 19 nt, Homo sapiens
gaagagaaagcaucagcaa

SEQ ID NO: 1088003 - RNA, 19 nt, Homo sapiens
acaaaggaaugacaagaga

SEQ ID NO: 1088004 - RNA, 19 nt, Homo sapiens
ugaagaggaagaagaauuu

SEQ ID NO: 1088005 - RNA, 19 nt, Homo sapiens
gggagaggauacagaaaug

SEQ ID NO: 1088006 - RNA, 19 nt, Homo sapiens
ggucagugauucagaaagu

SEQ ID NO: 1088007 - RNA, 19 nt, Homo sapiens
gaccuugccuggaaugugu

SEQ ID NO: 1088008 - RNA, 19 nt, Homo sapiens
gagaaaguucacagauaua

SEQ ID NO: 1088009 - RNA, 19 nt, Homo sapiens
uagugaagaugaagagaaa

SEQ ID NO: 1088010 - RNA, 19 nt, Homo sapiens
uggagaaucuggugaugaa

SEQ ID NO: 1088011 - RNA, 19 nt, Homo sapiens
agacauauuuggagaaucu

SEQ ID NO: 1088012 - RNA, 19 nt, Homo sapiens
gaagagaaggaucuguuug

SEQ ID NO: 1088013 - RNA, 19 nt, Homo sapiens
gaaagcaucagcaaagaag

SEQ ID NO: 1088014 - RNA, 19 nt, Homo sapiens
acagacaguugaacaauca

SEQ ID NO: 1088015 - RNA, 19 nt, Homo sapiens
gaagacagacaguugaaca

SEQ ID NO: 1088016 - RNA, 19 nt, Homo sapiens
gcaugcaagugacucagaa

SEQ ID NO: 1088017 - RNA, 19 nt, Homo sapiens
gaacgaugagcccuuaaau

SEQ ID NO: 1088018 - RNA, 19 nt, Homo sapiens
ugcaagagcugccuagugu

SEQ ID NO: 1088019 - RNA, 19 nt, Homo sapiens
ccauggacucggaauauua

SEQ ID NO: 1088020 - RNA, 19 nt, Homo sapiens
gaaaaugaggaacuucuua

SEQ ID NO: 1088021 - RNA, 19 nt, Homo sapiens
ugaagagaccaggaaauua

SEQ ID NO: 1088022 - RNA, 19 nt, Homo sapiens
ggaaugacaagagaagaaa

SEQ ID NO: 1088023 - RNA, 19 nt, Homo sapiens
cagggaaauuaaucaauga

SEQ ID NO: 1088024 - RNA, 19 nt, Homo sapiens
gagaauaagggagaggaua

SEQ ID NO: 1088025 - RNA, 19 nt, Homo sapiens
gcucucaccucuaccagau

SEQ ID NO: 1088026 - RNA, 19 nt, Homo sapiens
gaaagaauugucugauaag

SEQ ID NO: 1088027 - RNA, 19 nt, Homo sapiens
gaccauagcaucugacagu

SEQ ID NO: 1088028 - RNA, 19 nt, Homo sapiens
caaggaaccaggccaguga

SEQ ID NO: 1088029 - RNA, 19 nt, Homo sapiens
gugaagagaccaggaaauu

SEQ ID NO: 1088030 - RNA, 19 nt, Homo sapiens
ggaauacuagucauacuuc

SEQ ID NO: 1088031 - RNA, 19 nt, Homo sapiens
augagaaaguucacagaua

SEQ ID NO: 1088032 - RNA, 19 nt, Homo sapiens
ccucaacgacgaagaauga

SEQ ID NO: 1088033 - RNA, 19 nt, Homo sapiens
caagagcugccuaguguga

SEQ ID NO: 1088034 - RNA, 19 nt, Homo sapiens
aaacagaagaugcucuaaa

SEQ ID NO: 1088035 - RNA, 19 nt, Homo sapiens
gcuagugacucugaaagug

SEQ ID NO: 1088036 - RNA, 19 nt, Homo sapiens
ugucauaggacucacauuu

SEQ ID NO: 1088037 - RNA, 19 nt, Homo sapiens
gagcuucccagaccucgua

SEQ ID NO: 1088038 - RNA, 19 nt, Homo sapiens
guacaaaggaauacuaguc

SEQ ID NO: 1088039 - RNA, 19 nt, Homo sapiens
ccaaauggaauguggaaau

SEQ ID NO: 1088040 - RNA, 19 nt, Homo sapiens
gacagacaguugaacaauc

SEQ ID NO: 1088041 - RNA, 19 nt, Homo sapiens
gaggaugcguccagacaca

SEQ ID NO: 1088042 - RNA, 19 nt, Homo sapiens
uaucagauguugucauagg

SEQ ID NO: 1088043 - RNA, 19 nt, Homo sapiens
gauaaacagaugagaaagu

SEQ ID NO: 1088044 - RNA, 19 nt, Homo sapiens
aagcaggaccuuaaagaaa

SEQ ID NO: 1088045 - RNA, 19 nt, Homo sapiens
guaguuaugcaccuuaaga

SEQ ID NO: 1088046 - RNA, 19 nt, Homo sapiens
gagaaucuggugaugaaga

SEQ ID NO: 1088047 - RNA, 19 nt, Homo sapiens
gagaaaguagcgaagagaa

SEQ ID NO: 1088048 - RNA, 19 nt, Homo sapiens
ggucagacggugaggauga

SEQ ID NO: 1088049 - RNA, 19 nt, Homo sapiens
gccauggacucggaauauu

SEQ ID NO: 1088050 - RNA, 19 nt, Homo sapiens
gacgagcagugauguaucu

SEQ ID NO: 1088051 - RNA, 19 nt, Homo sapiens
gcaggaccuuaaagaaaca

SEQ ID NO: 1088052 - RNA, 19 nt, Homo sapiens
gaggaagacagacaguuga

SEQ ID NO: 1088053 - RNA, 19 nt, Homo sapiens
gccaugaucgucaagauga

SEQ ID NO: 1088054 - RNA, 19 nt, Homo sapiens
uaaccaagaagaucuggaa

SEQ ID NO: 1088055 - RNA, 19 nt, Homo sapiens
uaagggagaggauacagaa

SEQ ID NO: 1088056 - RNA, 19 nt, Homo sapiens
ucaggucagugauucagaa

SEQ ID NO: 1088057 - RNA, 19 nt, Homo sapiens
ggucuaggccuauauuugg

SEQ ID NO: 1088058 - RNA, 19 nt, Homo sapiens
gugaggaugauguaaauga

SEQ ID NO: 1088059 - RNA, 19 nt, Homo sapiens
agaagaccauagcaucuga

SEQ ID NO: 1088060 - RNA, 19 nt, Homo sapiens
ucauaggacucacauuucu

SEQ ID NO: 1088061 - RNA, 19 nt, Homo sapiens
cgacgugagugccaugauc

SEQ ID NO: 1088062 - RNA, 19 nt, Homo sapiens
gcuuccaggucaaagaauu

SEQ ID NO: 1088063 - RNA, 19 nt, Homo sapiens
ggaaguguagaacgucauu

SEQ ID NO: 1088064 - RNA, 19 nt, Homo sapiens
agaagaguccugcuaguga

SEQ ID NO: 1088065 - RNA, 19 nt, Homo sapiens
aaacagaugagaaaguuca

SEQ ID NO: 1088066 - RNA, 19 nt, Homo sapiens
gaacacgacuuccaaaugc

SEQ ID NO: 1088067 - RNA, 19 nt, Homo sapiens
gcucacgccugcacaauga

SEQ ID NO: 1088068 - RNA, 19 nt, Homo sapiens
ugaagaagcggcugaagaa

SEQ ID NO: 1088069 - RNA, 19 nt, Homo sapiens
ggccguggcuucugucugu

SEQ ID NO: 1088070 - RNA, 19 nt, Homo sapiens
caacugcagccaugugauu

SEQ ID NO: 1088071 - RNA, 19 nt, Homo sapiens
acaugaagcccguguguaa

SEQ ID NO: 1088072 - RNA, 19 nt, Homo sapiens
aacaaggccugguguguga

SEQ ID NO: 1088073 - RNA, 19 nt, Homo sapiens
gguguuuguuuguuuguug

SEQ ID NO: 1088074 - RNA, 19 nt, Homo sapiens
acagcaagcucacccugaa

SEQ ID NO: 1088075 - RNA, 19 nt, Homo sapiens
ggacaggacccaccuccau

SEQ ID NO: 1088076 - RNA, 19 nt, Homo sapiens
gcucuucuaugaguuugaa

SEQ ID NO: 1088077 - RNA, 19 nt, Homo sapiens
gcggugaguucaucauugg

SEQ ID NO: 1088078 - RNA, 19 nt, Homo sapiens
cgaacacgacuuccaaaug

SEQ ID NO: 1088079 - RNA, 19 nt, Homo sapiens
gaccugguguuuguuuguu

SEQ ID NO: 1088080 - RNA, 19 nt, Homo sapiens
ccaugucucuccucuccuu

SEQ ID NO: 1088081 - RNA, 19 nt, Homo sapiens
gaccucaacucugccugaa

SEQ ID NO: 1088082 - RNA, 19 nt, Homo sapiens
guacugcgaacacgacuuc

SEQ ID NO: 1088083 - RNA, 19 nt, Homo sapiens
uccaaucccucaccacuca

SEQ ID NO: 1088084 - RNA, 19 nt, Homo sapiens
ccgaggggcucuucuauga

SEQ ID NO: 1088085 - RNA, 19 nt, Homo sapiens
caucuuacccucccuuucu

SEQ ID NO: 1088086 - RNA, 19 nt, Homo sapiens
guaagaggugcuacgagaa

SEQ ID NO: 1088087 - RNA, 19 nt, Homo sapiens
gcaagcucacccugaagaa

SEQ ID NO: 1088088 - RNA, 19 nt, Homo sapiens
agaagcggcugaagaagcu

SEQ ID NO: 1088089 - RNA, 19 nt, Homo sapiens
cccuuucucuuuccucauu

SEQ ID NO: 1088090 - RNA, 19 nt, Homo sapiens
gacaugaagcccgugugua

SEQ ID NO: 1088091 - RNA, 19 nt, Homo sapiens
ucaucaaggccaaguguga

SEQ ID NO: 1088092 - RNA, 19 nt, Homo sapiens
gcgaacacgacuuccaaau

SEQ ID NO: 1088093 - RNA, 19 nt, Homo sapiens
uaagaggugcuacgagaag

SEQ ID NO: 1088094 - RNA, 19 nt, Homo sapiens
cgacaugaagcccgugugu

SEQ ID NO: 1088095 - RNA, 19 nt, Homo sapiens
ccaagugugagaagccauu

SEQ ID NO: 1088096 - RNA, 19 nt, Homo sapiens
ccagggacaggagcaaauu

SEQ ID NO: 1088097 - RNA, 19 nt, Homo sapiens
gcaccggcacuaugagaag

SEQ ID NO: 1088098 - RNA, 19 nt, Homo sapiens
ggcucaugcuguccuguga

SEQ ID NO: 1088099 - RNA, 19 nt, Homo sapiens
gaagaagcggcugaagaag

SEQ ID NO: 1088100 - RNA, 19 nt, Homo sapiens
ccugguguuuguuuguuug

SEQ ID NO: 1088101 - RNA, 19 nt, Homo sapiens
cugaagaagcggcugaaga

SEQ ID NO: 1088102 - RNA, 19 nt, Homo sapiens
cagaccugguguuuguuug

SEQ ID NO: 1088103 - RNA, 19 nt, Homo sapiens
uacccucccuuucucuuuc

SEQ ID NO: 1088104 - RNA, 19 nt, Homo sapiens
ggccacagaccucaacucu

SEQ ID NO: 1088105 - RNA, 19 nt, Homo sapiens
gggcaccggcacuaugaga

SEQ ID NO: 1088106 - RNA, 19 nt, Homo sapiens
gaggggcucuucuaugagu

SEQ ID NO: 1088107 - RNA, 19 nt, Homo sapiens
cugcagccaugugauugaa

SEQ ID NO: 1088108 - RNA, 19 nt, Homo sapiens
caccggcacuaugagaaga

SEQ ID NO: 1088109 - RNA, 19 nt, Homo sapiens
cgacuuccaaaugcuguuu

SEQ ID NO: 1088110 - RNA, 19 nt, Homo sapiens
ugcggugaguucaucauug

SEQ ID NO: 1088111 - RNA, 19 nt, Homo sapiens
gaagauggcuugaaagaaa

SEQ ID NO: 1088112 - RNA, 19 nt, Homo sapiens
aaacugagcuucaaacaua

SEQ ID NO: 1088113 - RNA, 19 nt, Homo sapiens
gaaacaagauacucugaua

SEQ ID NO: 1088114 - RNA, 19 nt, Homo sapiens
ucaaauugcugccauauua

SEQ ID NO: 1088115 - RNA, 19 nt, Homo sapiens
gaaacacggucuuaaagua

SEQ ID NO: 1088116 - RNA, 19 nt, Homo sapiens
gaaacugacuugaagauug

SEQ ID NO: 1088117 - RNA, 19 nt, Homo sapiens
gaaaggaauguucaaauug

SEQ ID NO: 1088118 - RNA, 19 nt, Homo sapiens
gcaacacauuguaaacuuu

SEQ ID NO: 1088119 - RNA, 19 nt, Homo sapiens
ggaagaagaaggagcagua

SEQ ID NO: 1088120 - RNA, 19 nt, Homo sapiens
auacuaagcugauugaaga

SEQ ID NO: 1088121 - RNA, 19 nt, Homo sapiens
cagcaauucuuuguuguua

SEQ ID NO: 1088122 - RNA, 19 nt, Homo sapiens
agaaagauauccaugagaa

SEQ ID NO: 1088123 - RNA, 19 nt, Homo sapiens
gcaacaagcuuagcgaauc

SEQ ID NO: 1088124 - RNA, 19 nt, Homo sapiens
cuacaagaaugucucagua

SEQ ID NO: 1088125 - RNA, 19 nt, Homo sapiens
gcaauucuuuguuguuaug

SEQ ID NO: 1088126 - RNA, 19 nt, Homo sapiens
gaacucggcaacaagcuua

SEQ ID NO: 1088127 - RNA, 19 nt, Homo sapiens
gccaucagcuccaauauca

SEQ ID NO: 1088128 - RNA, 19 nt, Homo sapiens
aaacugacuugaagauuga

SEQ ID NO: 1088129 - RNA, 19 nt, Homo sapiens
ugaaauaauugcccgacua

SEQ ID NO: 1088130 - RNA, 19 nt, Homo sapiens
gacaggauguagagaauga

SEQ ID NO: 1088131 - RNA, 19 nt, Homo sapiens
ugaaguugcuggagaaaga

SEQ ID NO: 1088132 - RNA, 19 nt, Homo sapiens
gauuuagacucacaaguug

SEQ ID NO: 1088133 - RNA, 19 nt, Homo sapiens
ggagaaagauauccaugag

SEQ ID NO: 1088134 - RNA, 19 nt, Homo sapiens
gaacuaccuuugccuucuu

SEQ ID NO: 1088135 - RNA, 19 nt, Homo sapiens
agagagagcaaacuuguua

SEQ ID NO: 1088136 - RNA, 19 nt, Homo sapiens
ggauuuagacucacaaguu

SEQ ID NO: 1088137 - RNA, 19 nt, Homo sapiens
aaacauggcuaaacugagu

SEQ ID NO: 1088138 - RNA, 19 nt, Homo sapiens
uaagcugauugaagaguua

SEQ ID NO: 1088139 - RNA, 19 nt, Homo sapiens
gaagaaggagcaguaauug

SEQ ID NO: 1088140 - RNA, 19 nt, Homo sapiens
acaagaaugucucaguaaa

SEQ ID NO: 1088141 - RNA, 19 nt, Homo sapiens
caaaguagauguggaaacu

SEQ ID NO: 1088142 - RNA, 19 nt, Homo sapiens
caacaagcuuagcgaauca

SEQ ID NO: 1088143 - RNA, 19 nt, Homo sapiens
gagcuagcaguacaaguua

SEQ ID NO: 1088144 - RNA, 19 nt, Homo sapiens
ggaaauaaagaaaggaaug

SEQ ID NO: 1088145 - RNA, 19 nt, Homo sapiens
gggagaggauuuagacuca

SEQ ID NO: 1088146 - RNA, 19 nt, Homo sapiens
cuccagaacuaaauccuua

SEQ ID NO: 1088147 - RNA, 19 nt, Homo sapiens
aagcaccacuguagaaauu

SEQ ID NO: 1088148 - RNA, 19 nt, Homo sapiens
gaugagaaauaucuacaag

SEQ ID NO: 1088149 - RNA, 19 nt, Homo sapiens
gaugaaauguacaaugaag

SEQ ID NO: 1088150 - RNA, 19 nt, Homo sapiens
ugaaugugaucgaugcuaa

SEQ ID NO: 1088151 - RNA, 19 nt, Homo sapiens
gcaaauggaagcugaagau

SEQ ID NO: 1088152 - RNA, 19 nt, Homo sapiens
ucauuaaacuccaggaaga

SEQ ID NO: 1088153 - RNA, 19 nt, Homo sapiens
gaucgaugcuaaucugugu

SEQ ID NO: 1088154 - RNA, 19 nt, Homo sapiens
gaaagcaccacuguagaaa

SEQ ID NO: 1088155 - RNA, 19 nt, Homo sapiens
caaagaagcaacacauugu

SEQ ID NO: 1088156 - RNA, 19 nt, Homo sapiens
gaacucguauuggauuuag

SEQ ID NO: 1088157 - RNA, 19 nt, Homo sapiens
guaugaagcaugagauuga

SEQ ID NO: 1088158 - RNA, 19 nt, Homo sapiens
aagaugaggaugagaaaua

SEQ ID NO: 1088159 - RNA, 19 nt, Homo sapiens
gcaguacaaguuaguauga

SEQ ID NO: 1088160 - RNA, 19 nt, Homo sapiens
gagacucaacaaaucauua

SEQ ID NO: 1088161 - RNA, 19 nt, Homo sapiens
gaaagauauccaugagaaa

SEQ ID NO: 1088162 - RNA, 19 nt, Homo sapiens
gaaugaagaagauauugga

SEQ ID NO: 1088163 - RNA, 19 nt, Homo sapiens
gaagaagaaggagcaguaa

SEQ ID NO: 1088164 - RNA, 19 nt, Homo sapiens
gcaagagcguggcuucgau

SEQ ID NO: 1088165 - RNA, 19 nt, Homo sapiens
ggugagaagaacuaaauaa

SEQ ID NO: 1088166 - RNA, 19 nt, Homo sapiens
gaaggagcaguaauuguug

SEQ ID NO: 1088167 - RNA, 19 nt, Homo sapiens
uauggaacauugccugaaa

SEQ ID NO: 1088168 - RNA, 19 nt, Homo sapiens
gaaauaauugcccgacuag

SEQ ID NO: 1088169 - RNA, 19 nt, Homo sapiens
gacaacaacuagaggaagu

SEQ ID NO: 1088170 - RNA, 19 nt, Homo sapiens
aaacacggucuuaaaguaa

SEQ ID NO: 1088171 - RNA, 19 nt, Homo sapiens
agaaacagcuggugcaacu

SEQ ID NO: 1088172 - RNA, 19 nt, Homo sapiens
gauaggccuucgacaacaa

SEQ ID NO: 1088173 - RNA, 19 nt, Homo sapiens
agauugaacuugccaugaa

SEQ ID NO: 1088174 - RNA, 19 nt, Homo sapiens
caaauacuaagcugauuga

SEQ ID NO: 1088175 - RNA, 19 nt, Homo sapiens
agaagaaggagcaguaauu

SEQ ID NO: 1088176 - RNA, 19 nt, Homo sapiens
gaguaucacgcacuaauga

SEQ ID NO: 1088177 - RNA, 19 nt, Homo sapiens
gaaaaggaauucucacucu

SEQ ID NO: 1088178 - RNA, 19 nt, Homo sapiens
agaaugagcuagcaguaca

SEQ ID NO: 1088179 - RNA, 19 nt, Homo sapiens
ggaucuaccuggucugaag

SEQ ID NO: 1088180 - RNA, 19 nt, Homo sapiens
gcaccacuguagaaauugu

SEQ ID NO: 1088181 - RNA, 19 nt, Homo sapiens
agaggaaguuaaagcaauu

SEQ ID NO: 1088182 - RNA, 19 nt, Homo sapiens
aaucaucaauuacgaagug

SEQ ID NO: 1088183 - RNA, 19 nt, Homo sapiens
caaguuggagugauugauu

SEQ ID NO: 1088184 - RNA, 19 nt, Homo sapiens
agaaggagcaguaauuguu

SEQ ID NO: 1088185 - RNA, 19 nt, Homo sapiens
gaaagacaaagaagcaaca

SEQ ID NO: 1088186 - RNA, 19 nt, Homo sapiens
ggacugguuuggcugaaag

SEQ ID NO: 1088187 - RNA, 19 nt, Homo sapiens
ccaugaaguugcuggagaa

SEQ ID NO: 1088188 - RNA, 19 nt, Homo sapiens
caucuaacuugcccugaga

SEQ ID NO: 1088189 - RNA, 19 nt, Homo sapiens
ugccuuaucucaucuuaga

SEQ ID NO: 1088190 - RNA, 19 nt, Homo sapiens
ugaggcagcuggaacaaag

SEQ ID NO: 1088191 - RNA, 19 nt, Homo sapiens
uagaggaaguuaaagcaau

SEQ ID NO: 1088192 - RNA, 19 nt, Homo sapiens
ccuagagguuaccaaagua

SEQ ID NO: 1088193 - RNA, 19 nt, Homo sapiens
uaaacugaguaucaaagga

SEQ ID NO: 1088194 - RNA, 19 nt, Homo sapiens
aaguagauguggaaacuga

SEQ ID NO: 1088195 - RNA, 19 nt, Homo sapiens
gagaggauuuagacucaca

SEQ ID NO: 1088196 - RNA, 19 nt, Homo sapiens
gcacuuuggauucugacua

SEQ ID NO: 1088197 - RNA, 19 nt, Homo sapiens
aaacaaaucucccaaaagg

SEQ ID NO: 1088198 - RNA, 19 nt, Homo sapiens
aagaaugucucaguaaauc

SEQ ID NO: 1088199 - RNA, 19 nt, Homo sapiens
gagaaacaagauacucuga

SEQ ID NO: 1088200 - RNA, 19 nt, Homo sapiens
gaagggagaggauuuagac

SEQ ID NO: 1088201 - RNA, 19 nt, Homo sapiens
caacacauuguaaacuuug

SEQ ID NO: 1088202 - RNA, 19 nt, Homo sapiens
acaaagaagcaacacauug

SEQ ID NO: 1088203 - RNA, 19 nt, Homo sapiens
ggaaacugacuugaagauu

SEQ ID NO: 1088204 - RNA, 19 nt, Homo sapiens
gauagucugcagaaacaaa

SEQ ID NO: 1088205 - RNA, 19 nt, Homo sapiens
gcagagaaggcgcaaaugg

SEQ ID NO: 1088206 - RNA, 19 nt, Homo sapiens
guagagagagcaaacuugu

SEQ ID NO: 1088207 - RNA, 19 nt, Homo sapiens
gaaacugagcuucaaacau

SEQ ID NO: 1088208 - RNA, 19 nt, Homo sapiens
aaacacagcagcaccuaga

SEQ ID NO: 1088209 - RNA, 19 nt, Homo sapiens
aaaggaauguucaaauugc

SEQ ID NO: 1088210 - RNA, 19 nt, Homo sapiens
gagaaagcaccacuguaga

SEQ ID NO: 1088211 - RNA, 19 nt, Homo sapiens
gaacauaccugauaucaag

SEQ ID NO: 1088212 - RNA, 19 nt, Homo sapiens
gcagaaaucuuuggauaua

SEQ ID NO: 1088213 - RNA, 19 nt, Homo sapiens
guaggaagaucaaauguuu

SEQ ID NO: 1088214 - RNA, 19 nt, Homo sapiens
cagauuagcuguccuguuu

SEQ ID NO: 1088215 - RNA, 19 nt, Homo sapiens
caacaaagacccacagaua

SEQ ID NO: 1088216 - RNA, 19 nt, Homo sapiens
gauaauaugucauccuuga

SEQ ID NO: 1088217 - RNA, 19 nt, Homo sapiens
agucugaccucauuaauua

SEQ ID NO: 1088218 - RNA, 19 nt, Homo sapiens
caggaaacaugcuuuauuu

SEQ ID NO: 1088219 - RNA, 19 nt, Homo sapiens
gagcaucacuuacacuuga

SEQ ID NO: 1088220 - RNA, 19 nt, Homo sapiens
gaagucagcuuucacaucu

SEQ ID NO: 1088221 - RNA, 19 nt, Homo sapiens
cagcagaaaucuuuggaua

SEQ ID NO: 1088222 - RNA, 19 nt, Homo sapiens
gguaugugcugauuuguuu

SEQ ID NO: 1088223 - RNA, 19 nt, Homo sapiens
gcucaucuauuaaguacua

SEQ ID NO: 1088224 - RNA, 19 nt, Homo sapiens
caucuuaagugcaaacuaa

SEQ ID NO: 1088225 - RNA, 19 nt, Homo sapiens
aaagagaaguaucagguua

SEQ ID NO: 1088226 - RNA, 19 nt, Homo sapiens
gagcugauuuacaucuuua

SEQ ID NO: 1088227 - RNA, 19 nt, Homo sapiens
gaggacggguuacagaaua

SEQ ID NO: 1088228 - RNA, 19 nt, Homo sapiens
caauugaacuguuaccauu

SEQ ID NO: 1088229 - RNA, 19 nt, Homo sapiens
gaagagguaugugcugauu

SEQ ID NO: 1088230 - RNA, 19 nt, Homo sapiens
caacuuaaccuucauuuca

SEQ ID NO: 1088231 - RNA, 19 nt, Homo sapiens
ccacagagccuuaugcuau

SEQ ID NO: 1088232 - RNA, 19 nt, Homo sapiens
ggacacagaugaacgugau

SEQ ID NO: 1088233 - RNA, 19 nt, Homo sapiens
ucaauucucuuaacaggaa

SEQ ID NO: 1088234 - RNA, 19 nt, Homo sapiens
acacagcacuugauuacaa

SEQ ID NO: 1088235 - RNA, 19 nt, Homo sapiens
cagaauugcuaaagaaaug

SEQ ID NO: 1088236 - RNA, 19 nt, Homo sapiens
guacagagacugagcaaau

SEQ ID NO: 1088237 - RNA, 19 nt, Homo sapiens
gcacagccaccaacuacua

SEQ ID NO: 1088238 - RNA, 19 nt, Homo sapiens
gcaggguaauccuuucuuu

SEQ ID NO: 1088239 - RNA, 19 nt, Homo sapiens
gaaaugcauccaauaaaug

SEQ ID NO: 1088240 - RNA, 19 nt, Homo sapiens
ccaaaucaguggcuuaauc

SEQ ID NO: 1088241 - RNA, 19 nt, Homo sapiens
aaacaucauuccaaccuuu

SEQ ID NO: 1088242 - RNA, 19 nt, Homo sapiens
ggagcaacuucauauaaug

SEQ ID NO: 1088243 - RNA, 19 nt, Homo sapiens
uaaaauaccucacaugguu

SEQ ID NO: 1088244 - RNA, 19 nt, Homo sapiens
guacuugguuaacuugauu

SEQ ID NO: 1088245 - RNA, 19 nt, Homo sapiens
auugcaagcucaucuauua

SEQ ID NO: 1088246 - RNA, 19 nt, Homo sapiens
gcuuugauaccaagaauua

SEQ ID NO: 1088247 - RNA, 19 nt, Homo sapiens
ccucagaaacccaaaguua

SEQ ID NO: 1088248 - RNA, 19 nt, Homo sapiens
cagacacacugauggauaa

SEQ ID NO: 1088249 - RNA, 19 nt, Homo sapiens
guugagaaauugccucuga

SEQ ID NO: 1088250 - RNA, 19 nt, Homo sapiens
guugaacucuuaaacagaa

SEQ ID NO: 1088251 - RNA, 19 nt, Homo sapiens
uaacaggaaacaugcuuua

SEQ ID NO: 1088252 - RNA, 19 nt, Homo sapiens
cuaaagaaaugcauccaau

SEQ ID NO: 1088253 - RNA, 19 nt, Homo sapiens
ggaaccagcaaucauuuaa

SEQ ID NO: 1088254 - RNA, 19 nt, Homo sapiens
cagaugaacuauuguuuag

SEQ ID NO: 1088255 - RNA, 19 nt, Homo sapiens
ggaucuugguguuauuuaa

SEQ ID NO: 1088256 - RNA, 19 nt, Homo sapiens
guaguuguauggacuucua

SEQ ID NO: 1088257 - RNA, 19 nt, Homo sapiens
gaaggauuauuucaguuuc

SEQ ID NO: 1088258 - RNA, 19 nt, Homo sapiens
ugaggugucuuacuucuau

SEQ ID NO: 1088259 - RNA, 19 nt, Homo sapiens
gcacacaccuguugcuacu

SEQ ID NO: 1088260 - RNA, 19 nt, Homo sapiens
cauaagaaguugggaauca

SEQ ID NO: 1088261 - RNA, 19 nt, Homo sapiens
cacagagccuuaugcuaua

SEQ ID NO: 1088262 - RNA, 19 nt, Homo sapiens
gugcugauuuguuuggaua

SEQ ID NO: 1088263 - RNA, 19 nt, Homo sapiens
uauuauaguugcugccaua

SEQ ID NO: 1088264 - RNA, 19 nt, Homo sapiens
caacagaaaccaaaucagu

SEQ ID NO: 1088265 - RNA, 19 nt, Homo sapiens
ggacuaacagaauugcuaa

SEQ ID NO: 1088266 - RNA, 19 nt, Homo sapiens
gagcaguuguaucuucuga

SEQ ID NO: 1088267 - RNA, 19 nt, Homo sapiens
gaugugacuucccugacua

SEQ ID NO: 1088268 - RNA, 19 nt, Homo sapiens
gcauucacuuggauauauu

SEQ ID NO: 1088269 - RNA, 19 nt, Homo sapiens
gcaaagcagacccaacaaa

SEQ ID NO: 1088270 - RNA, 19 nt, Homo sapiens
caacaugcccguuaauaca

SEQ ID NO: 1088271 - RNA, 19 nt, Homo sapiens
aagauucccuugcauuuga

SEQ ID NO: 1088272 - RNA, 19 nt, Homo sapiens
cuucugagguugcagcaua

SEQ ID NO: 1088273 - RNA, 19 nt, Homo sapiens
aaauaaagaggacggguua

SEQ ID NO: 1088274 - RNA, 19 nt, Homo sapiens
ggauauaggaaaucaaaug

SEQ ID NO: 1088275 - RNA, 19 nt, Homo sapiens
gaaccagcaaucauuuaaa

SEQ ID NO: 1088276 - RNA, 19 nt, Homo sapiens
ugagguuucugcuguauug

SEQ ID NO: 1088277 - RNA, 19 nt, Homo sapiens
cagcauauaugaauugcau

SEQ ID NO: 1088278 - RNA, 19 nt, Homo sapiens
ccucaagguucuccaacua

SEQ ID NO: 1088279 - RNA, 19 nt, Homo sapiens
acacacugauggauaauau

SEQ ID NO: 1088280 - RNA, 19 nt, Homo sapiens
ggaguaugcaccaaauaaa

SEQ ID NO: 1088281 - RNA, 19 nt, Homo sapiens
uacagagacugagcaaaua

SEQ ID NO: 1088282 - RNA, 19 nt, Homo sapiens
agagguaugugcugauuug

SEQ ID NO: 1088283 - RNA, 19 nt, Homo sapiens
ccaguuaucacaacagaaa

SEQ ID NO: 1088284 - RNA, 19 nt, Homo sapiens
ggauucaacaugcccguua

SEQ ID NO: 1088285 - RNA, 19 nt, Homo sapiens
gauuggagucugaacauaa

SEQ ID NO: 1088286 - RNA, 19 nt, Homo sapiens
gcuuauagaacuugaacua

SEQ ID NO: 1088287 - RNA, 19 nt, Homo sapiens
caagaugacucugggaaca

SEQ ID NO: 1088288 - RNA, 19 nt, Homo sapiens
gauucaacaugcccguuaa

SEQ ID NO: 1088289 - RNA, 19 nt, Homo sapiens
ggaaucagcaaauugacaa

SEQ ID NO: 1088290 - RNA, 19 nt, Homo sapiens
aguagucacuguuuauuga

SEQ ID NO: 1088291 - RNA, 19 nt, Homo sapiens
gauagucugaccucauuaa

SEQ ID NO: 1088292 - RNA, 19 nt, Homo sapiens
gguuucugcuguauuguuu

SEQ ID NO: 1088293 - RNA, 19 nt, Homo sapiens
aauaugggcuuucagacuu

SEQ ID NO: 1088294 - RNA, 19 nt, Homo sapiens
acaauuaaguccguuaugu

SEQ ID NO: 1088295 - RNA, 19 nt, Homo sapiens
cuaacagaauugcuaaaga

SEQ ID NO: 1088296 - RNA, 19 nt, Homo sapiens
agaaguaucagguuauuug

SEQ ID NO: 1088297 - RNA, 19 nt, Homo sapiens
gaugcuguauugauuuguu

SEQ ID NO: 1088298 - RNA, 19 nt, Homo sapiens
guacacagucuaugaguca

SEQ ID NO: 1088299 - RNA, 19 nt, Homo sapiens
gcaagcucaucuauuaagu

SEQ ID NO: 1088300 - RNA, 19 nt, Homo sapiens
gauuagcuguccuguuugu

SEQ ID NO: 1088301 - RNA, 19 nt, Homo sapiens
ugacuucccugacuacuac

SEQ ID NO: 1088302 - RNA, 19 nt, Homo sapiens
gggcauugguaugauguuu

SEQ ID NO: 1088303 - RNA, 19 nt, Homo sapiens
aguacuagaucaccuuaaa

SEQ ID NO: 1088304 - RNA, 19 nt, Homo sapiens
gcauuuaagaugacaguga

SEQ ID NO: 1088305 - RNA, 19 nt, Homo sapiens
cauaaaagagcaucacuua

SEQ ID NO: 1088306 - RNA, 19 nt, Homo sapiens
gaauguuucugaggagaug

SEQ ID NO: 1088307 - RNA, 19 nt, Homo sapiens
acaaggcacucugauguga

SEQ ID NO: 1088308 - RNA, 19 nt, Homo sapiens
caaaucaguggcuuaauca

SEQ ID NO: 1088309 - RNA, 19 nt, Homo sapiens
ggagaugaaaguuacaaau

SEQ ID NO: 1088310 - RNA, 19 nt, Homo sapiens
agacuaaacuggagcaacu

SEQ ID NO: 1088311 - RNA, 19 nt, Homo sapiens
gaacuaggcugucaucuuu

SEQ ID NO: 1088312 - RNA, 19 nt, Homo sapiens
gcacgaaaguaccauauga

SEQ ID NO: 1088313 - RNA, 19 nt, Homo sapiens
gcaaagugcuggagauuca

SEQ ID NO: 1088314 - RNA, 19 nt, Homo sapiens
gaacaggcucccauacuua

SEQ ID NO: 1088315 - RNA, 19 nt, Homo sapiens
caacagggauucacacaga

SEQ ID NO: 1088316 - RNA, 19 nt, Homo sapiens
ggaagaugauugacaguga

SEQ ID NO: 1088317 - RNA, 19 nt, Homo sapiens
aaagagcaguggacaauaa

SEQ ID NO: 1088318 - RNA, 19 nt, Homo sapiens
gaaaguaccauaugauugu

SEQ ID NO: 1088319 - RNA, 19 nt, Homo sapiens
gcagagacuuggccuuuga

SEQ ID NO: 1088320 - RNA, 19 nt, Homo sapiens
acaauaagcuaagguagua

SEQ ID NO: 1088321 - RNA, 19 nt, Homo sapiens
gaugacagaugcauguuga

SEQ ID NO: 1088322 - RNA, 19 nt, Homo sapiens
ucaaagcccugcagucuga

SEQ ID NO: 1088323 - RNA, 19 nt, Homo sapiens
ggacagauguauucaggau

SEQ ID NO: 1088324 - RNA, 19 nt, Homo sapiens
uuugauagcuuuacaggua

SEQ ID NO: 1088325 - RNA, 19 nt, Homo sapiens
gaagaagaguaauagaaca

SEQ ID NO: 1088326 - RNA, 19 nt, Homo sapiens
ccaggaaacuuguggcauu

SEQ ID NO: 1088327 - RNA, 19 nt, Homo sapiens
cagauaagcugaagaagag

SEQ ID NO: 1088328 - RNA, 19 nt, Homo sapiens
gagaaguggucacagaaga

SEQ ID NO: 1088329 - RNA, 19 nt, Homo sapiens
ccaacugucuucagagaaa

SEQ ID NO: 1088330 - RNA, 19 nt, Homo sapiens
gaggaucucuccagugugu

SEQ ID NO: 1088331 - RNA, 19 nt, Homo sapiens
caaaggaaguggcuugaag

SEQ ID NO: 1088332 - RNA, 19 nt, Homo sapiens
ccaaggaagugcuccagaa

SEQ ID NO: 1088333 - RNA, 19 nt, Homo sapiens
gagagggacuuccagacuu

SEQ ID NO: 1088334 - RNA, 19 nt, Homo sapiens
gaugacaaucucagaauaa

SEQ ID NO: 1088335 - RNA, 19 nt, Homo sapiens
agaacaagcuauucaacaa

SEQ ID NO: 1088336 - RNA, 19 nt, Homo sapiens
ggugaaaccugggcccuuu

SEQ ID NO: 1088337 - RNA, 19 nt, Homo sapiens
ggucagaauucccuucaau

SEQ ID NO: 1088338 - RNA, 19 nt, Homo sapiens
gaagaucccaaccuugauu

SEQ ID NO: 1088339 - RNA, 19 nt, Homo sapiens
cagccuaccuggaugcuuu

SEQ ID NO: 1088340 - RNA, 19 nt, Homo sapiens
gauaaauucuagugugcuu

SEQ ID NO: 1088341 - RNA, 19 nt, Homo sapiens
caggaaacuuguggcauua

SEQ ID NO: 1088342 - RNA, 19 nt, Homo sapiens
cuaaacaacccauucauga

SEQ ID NO: 1088343 - RNA, 19 nt, Homo sapiens
gaaguggcuugaaggaugu

SEQ ID NO: 1088344 - RNA, 19 nt, Homo sapiens
ucagaaggguugacucaga

SEQ ID NO: 1088345 - RNA, 19 nt, Homo sapiens
agaauucccuucaauguca

SEQ ID NO: 1088346 - RNA, 19 nt, Homo sapiens
ugaaucagacgucccaaua

SEQ ID NO: 1088347 - RNA, 19 nt, Homo sapiens
gaagaacuccacaacugaa

SEQ ID NO: 1088348 - RNA, 19 nt, Homo sapiens
ucaggaaguucuuagauuc

SEQ ID NO: 1088349 - RNA, 19 nt, Homo sapiens
gauauguccuccuuaccaa

SEQ ID NO: 1088350 - RNA, 19 nt, Homo sapiens
acagauguauucaggauga

SEQ ID NO: 1088351 - RNA, 19 nt, Homo sapiens
ugaugacaaucucagaaua

SEQ ID NO: 1088352 - RNA, 19 nt, Homo sapiens
gcccagaaguccagucaga

SEQ ID NO: 1088353 - RNA, 19 nt, Homo sapiens
gcaaagcaaagaagaaauc

SEQ ID NO: 1088354 - RNA, 19 nt, Homo sapiens
acacaaacccauuaucuug

SEQ ID NO: 1088355 - RNA, 19 nt, Homo sapiens
guuaaauaccugugaagua

SEQ ID NO: 1088356 - RNA, 19 nt, Homo sapiens
gagcugagcggcugugaug

SEQ ID NO: 1088357 - RNA, 19 nt, Homo sapiens
gaagcuauccuccagaaca

SEQ ID NO: 1088358 - RNA, 19 nt, Homo sapiens
aagcuaagguaguaucuug

SEQ ID NO: 1088359 - RNA, 19 nt, Homo sapiens
ccacaaacaagcucaaguu

SEQ ID NO: 1088360 - RNA, 19 nt, Homo sapiens
ugaacggcaugucaucuuu

SEQ ID NO: 1088361 - RNA, 19 nt, Homo sapiens
uuagaaaccacgucagaua

SEQ ID NO: 1088362 - RNA, 19 nt, Homo sapiens
ccacccaucugcugaacaa

SEQ ID NO: 1088363 - RNA, 19 nt, Homo sapiens
ggacaauggcccagaacaa

SEQ ID NO: 1088364 - RNA, 19 nt, Homo sapiens
aaucagacgucccaauaga

SEQ ID NO: 1088365 - RNA, 19 nt, Homo sapiens
ggaaguucuuagauucuug

SEQ ID NO: 1088366 - RNA, 19 nt, Homo sapiens
ggacaauaagacuauauga

SEQ ID NO: 1088367 - RNA, 19 nt, Homo sapiens
ccuauuuccucaccuguuu

SEQ ID NO: 1088368 - RNA, 19 nt, Homo sapiens
aaggaagcuuuaccuauuu

SEQ ID NO: 1088369 - RNA, 19 nt, Homo sapiens
gaacuccacaacugaagaa

SEQ ID NO: 1088370 - RNA, 19 nt, Homo sapiens
agaacaggcucccauacuu

SEQ ID NO: 1088371 - RNA, 19 nt, Homo sapiens
gacagugacucuacuaugc

SEQ ID NO: 1088372 - RNA, 19 nt, Homo sapiens
ugaagaugcugugugauau

SEQ ID NO: 1088373 - RNA, 19 nt, Homo sapiens
uagaagcuauccuccagaa

SEQ ID NO: 1088374 - RNA, 19 nt, Homo sapiens
guaccaaccugagcccuau

SEQ ID NO: 1088375 - RNA, 19 nt, Homo sapiens
gagcuuugguggccuguca

SEQ ID NO: 1088376 - RNA, 19 nt, Homo sapiens
gcaagugugagcugggaua

SEQ ID NO: 1088377 - RNA, 19 nt, Homo sapiens
gcaccucgcugcucuucca

SEQ ID NO: 1088378 - RNA, 19 nt, Homo sapiens
uaauagaacagcaaaggaa

SEQ ID NO: 1088379 - RNA, 19 nt, Homo sapiens
aaagagaacuaggcuguca

SEQ ID NO: 1088380 - RNA, 19 nt, Homo sapiens
cggaagaccuguuuaagac

SEQ ID NO: 1088381 - RNA, 19 nt, Homo sapiens
ggacagacagagcccuaaa

SEQ ID NO: 1088382 - RNA, 19 nt, Homo sapiens
gaauguuucuaguuaaggu

SEQ ID NO: 1088383 - RNA, 19 nt, Homo sapiens
agaagaauuugccaaguca

SEQ ID NO: 1088384 - RNA, 19 nt, Homo sapiens
gauaagcugaagaagagua

SEQ ID NO: 1088385 - RNA, 19 nt, Homo sapiens
gaaaccacgucagauacug

SEQ ID NO: 1088386 - RNA, 19 nt, Homo sapiens
ugggugugcuuucucauaa

SEQ ID NO: 1088387 - RNA, 19 nt, Homo sapiens
caacgccuaugccacucua

SEQ ID NO: 1088388 - RNA, 19 nt, Homo sapiens
caagugggaagaugauuga

SEQ ID NO: 1088389 - RNA, 19 nt, Homo sapiens
gcaaagaagaaaucagaag

SEQ ID NO: 1088390 - RNA, 19 nt, Homo sapiens
gaauaagcaaagcaaagaa

SEQ ID NO: 1088391 - RNA, 19 nt, Homo sapiens
cgaaaguaccauaugauug

SEQ ID NO: 1088392 - RNA, 19 nt, Homo sapiens
guaggugacuuucucaaaa

SEQ ID NO: 1088393 - RNA, 19 nt, Homo sapiens
ggugaagcagggacaauaa

SEQ ID NO: 1088394 - RNA, 19 nt, Homo sapiens
cugaagaugcugugugaua

SEQ ID NO: 1088395 - RNA, 19 nt, Homo sapiens
gggaagcccaucaccauga

SEQ ID NO: 1088396 - RNA, 19 nt, Homo sapiens
ggaugagauuguggacuuu

SEQ ID NO: 1088397 - RNA, 19 nt, Homo sapiens
uacagugucucgagcauau

SEQ ID NO: 1088398 - RNA, 19 nt, Homo sapiens
aaucucagcuguccugcuu

SEQ ID NO: 1088399 - RNA, 19 nt, Homo sapiens
gaacaagcuauucaacaag

SEQ ID NO: 1088400 - RNA, 19 nt, Homo sapiens
ggaaggaucaggaaguucu

SEQ ID NO: 1088401 - RNA, 19 nt, Homo sapiens
uugaagaacuccacaacug

SEQ ID NO: 1088402 - RNA, 19 nt, Homo sapiens
agacagagcccuaaacaac

SEQ ID NO: 1088403 - RNA, 19 nt, Homo sapiens
ggucaccuguguucaaucu

SEQ ID NO: 1088404 - RNA, 19 nt, Homo sapiens
ggcagucccuggagaagug

SEQ ID NO: 1088405 - RNA, 19 nt, Homo sapiens
uuaggucucugcucugcua

SEQ ID NO: 1088406 - RNA, 19 nt, Homo sapiens
ugaaggaugugcuaguaag

SEQ ID NO: 1088407 - RNA, 19 nt, Homo sapiens
gaagaugcugugugauaug

SEQ ID NO: 1088408 - RNA, 19 nt, Homo sapiens
ucagaucucuaaccaagca

SEQ ID NO: 1088409 - RNA, 19 nt, Homo sapiens
gaucaggaaguucuuagau

SEQ ID NO: 1088410 - RNA, 19 nt, Homo sapiens
acaacccauucaugacuua

SEQ ID NO: 1088411 - RNA, 19 nt, Homo sapiens
gaaauaagccacaauaaca

SEQ ID NO: 1088412 - RNA, 19 nt, Homo sapiens
cguaguaccuaauguaaua

SEQ ID NO: 1088413 - RNA, 19 nt, Homo sapiens
caacgggucucccuccuaa

SEQ ID NO: 1088414 - RNA, 19 nt, Homo sapiens
ggagaaauaagccacaaua

SEQ ID NO: 1088415 - RNA, 19 nt, Homo sapiens
caaaguagcccagcaaaug

SEQ ID NO: 1088416 - RNA, 19 nt, Homo sapiens
uaaacucacuuuccuuugu

SEQ ID NO: 1088417 - RNA, 19 nt, Homo sapiens
ggccuaaaguaccuucaua

SEQ ID NO: 1088418 - RNA, 19 nt, Homo sapiens
ggacuaaacucacuuuccu

SEQ ID NO: 1088419 - RNA, 19 nt, Homo sapiens
aaacucacuuuccuuugua

SEQ ID NO: 1088420 - RNA, 19 nt, Homo sapiens
gagaaauaagccacaauaa

SEQ ID NO: 1088421 - RNA, 19 nt, Homo sapiens
gcuuaaagauggagaacga

SEQ ID NO: 1088422 - RNA, 19 nt, Homo sapiens
cgaggucgcuguucacauc

SEQ ID NO: 1088423 - RNA, 19 nt, Homo sapiens
aagaacagcuucggccuaa

SEQ ID NO: 1088424 - RNA, 19 nt, Homo sapiens
guucuucaauaucccauuu

SEQ ID NO: 1088425 - RNA, 19 nt, Homo sapiens
gaacagcuucggccuaaag

SEQ ID NO: 1088426 - RNA, 19 nt, Homo sapiens
ccaccugucucccaaagug

SEQ ID NO: 1088427 - RNA, 19 nt, Homo sapiens
aauguaauaccgcauguua

SEQ ID NO: 1088428 - RNA, 19 nt, Homo sapiens
gaacgggacccuggacaga

SEQ ID NO: 1088429 - RNA, 19 nt, Homo sapiens
uguaauaccgcauguuaaa

SEQ ID NO: 1088430 - RNA, 19 nt, Homo sapiens
gcuacaagaccacggauga

SEQ ID NO: 1088431 - RNA, 19 nt, Homo sapiens
uuucaggccuucuuuaugu

SEQ ID NO: 1088432 - RNA, 19 nt, Homo sapiens
guugauuacuccuuagaga

SEQ ID NO: 1088433 - RNA, 19 nt, Homo sapiens
ggagugcaguggcgcaauc

SEQ ID NO: 1088434 - RNA, 19 nt, Homo sapiens
gcaagggcccagcguucua

SEQ ID NO: 1088435 - RNA, 19 nt, Homo sapiens
gaccguaguaccuaaugua

SEQ ID NO: 1088436 - RNA, 19 nt, Homo sapiens
gcaaauuucaggccuucuu

SEQ ID NO: 1088437 - RNA, 19 nt, Homo sapiens
caaauuucaggccuucuuu

SEQ ID NO: 1088438 - RNA, 19 nt, Homo sapiens
gcaaaguagcccagcaaau

SEQ ID NO: 1088439 - RNA, 19 nt, Homo sapiens
ucaccgaggucgcuguuca

SEQ ID NO: 1088440 - RNA, 19 nt, Homo sapiens
gcaguggaccuucaauuac

SEQ ID NO: 1088441 - RNA, 19 nt, Homo sapiens
gcuggucucucaccuccuu

SEQ ID NO: 1088442 - RNA, 19 nt, Homo sapiens
cauaaguucuucaauaucc

SEQ ID NO: 1088443 - RNA, 19 nt, Homo sapiens
aaaguaccuucauaaguuc

SEQ ID NO: 1088444 - RNA, 19 nt, Homo sapiens
cgacgugcgugacuucauc

SEQ ID NO: 1088445 - RNA, 19 nt, Homo sapiens
caguggaccuucaauuaca

SEQ ID NO: 1088446 - RNA, 19 nt, Homo sapiens
aaaguagcccagcaaauga

SEQ ID NO: 1088447 - RNA, 19 nt, Homo sapiens
ugaagucugggauguagua

SEQ ID NO: 1088448 - RNA, 19 nt, Homo sapiens
cugcucagcugcuccauuc

SEQ ID NO: 1088449 - RNA, 19 nt, Homo sapiens
aaaccaaggaaccaacuuu

SEQ ID NO: 1088450 - RNA, 19 nt, Homo sapiens
gcugagcugugugugacua

SEQ ID NO: 1088451 - RNA, 19 nt, Homo sapiens
ggauguaguagacaaagga

SEQ ID NO: 1088452 - RNA, 19 nt, Homo sapiens
guucacaucucacauuucc

SEQ ID NO: 1088453 - RNA, 19 nt, Homo sapiens
cuaaaguaccuucauaagu

SEQ ID NO: 1088454 - RNA, 19 nt, Homo sapiens
agcaguggaccuucaauua

SEQ ID NO: 1088455 - RNA, 19 nt, Homo sapiens
gcguagggcugagcugugu

SEQ ID NO: 1088456 - RNA, 19 nt, Homo sapiens
cuggguugauuacuccuua

SEQ ID NO: 1088457 - RNA, 19 nt, Homo sapiens
gcagcagccuuggucuuuc

SEQ ID NO: 1088458 - RNA, 19 nt, Homo sapiens
gcuguucacaucucacauu

SEQ ID NO: 1088459 - RNA, 19 nt, Homo sapiens
gcaacgggucucccuccua

SEQ ID NO: 1088460 - RNA, 19 nt, Homo sapiens
guugaagucugggauguag

SEQ ID NO: 1088461 - RNA, 19 nt, Homo sapiens
gaccuucaauuacauucuc

SEQ ID NO: 1088462 - RNA, 19 nt, Homo sapiens
gccuaaaguaccuucauaa

SEQ ID NO: 1088463 - RNA, 19 nt, Homo sapiens
ggacgacgugcgugacuuc

SEQ ID NO: 1088464 - RNA, 19 nt, Homo sapiens
ggaggcggagucugaaaug

SEQ ID NO: 1088465 - RNA, 19 nt, Homo sapiens
agaaauaagccacaauaac

SEQ ID NO: 1088466 - RNA, 19 nt, Homo sapiens
cagcugcuccauucccuaa

SEQ ID NO: 1088467 - RNA, 19 nt, Homo sapiens
ggccguucguggaggagua

SEQ ID NO: 1088468 - RNA, 19 nt, Homo sapiens
ggcccuggaugcugaguuc

SEQ ID NO: 1088469 - RNA, 19 nt, Homo sapiens
aaauuucaggccuucuuua

SEQ ID NO: 1088470 - RNA, 19 nt, Homo sapiens
cuauggauguguucaagca

SEQ ID NO: 1088471 - RNA, 19 nt, Homo sapiens
caaaugaugaggcuugaac

SEQ ID NO: 1088472 - RNA, 19 nt, Homo sapiens
acuaaacucacuuuccuuu

SEQ ID NO: 1088473 - RNA, 19 nt, Homo sapiens
uaugcugagucuuccauga

SEQ ID NO: 1088474 - RNA, 19 nt, Homo sapiens
ggaccccuguuuccucuuu

SEQ ID NO: 1088475 - RNA, 19 nt, Homo sapiens
cuaaugguuugcccuccaa

SEQ ID NO: 1088476 - RNA, 19 nt, Homo sapiens
ggaaggaaggcggcaguca

SEQ ID NO: 1088477 - RNA, 19 nt, Homo sapiens
gcgaggcgacggcuuaaag

SEQ ID NO: 1088478 - RNA, 19 nt, Homo sapiens
cagcagccuuggucuuucu

SEQ ID NO: 1088479 - RNA, 19 nt, Homo sapiens
cuguucacaucucacauuu

SEQ ID NO: 1088480 - RNA, 19 nt, Homo sapiens
ggucgcuguucacaucuca

SEQ ID NO: 1088481 - RNA, 19 nt, Homo sapiens
cuaauguaauaccgcaugu

SEQ ID NO: 1088482 - RNA, 19 nt, Homo sapiens
acauuucccuggugcuugu

SEQ ID NO: 1088483 - RNA, 19 nt, Homo sapiens
guuaaacucacagaagguu

SEQ ID NO: 1088484 - RNA, 19 nt, Homo sapiens
cauguuaaacucacagaag

SEQ ID NO: 1088485 - RNA, 19 nt, Homo sapiens
uaauaccgcauguuaaacu

SEQ ID NO: 1088486 - RNA, 19 nt, Homo sapiens
ugucaggcuugcccaggaa

SEQ ID NO: 1088487 - RNA, 19 nt, Homo sapiens
gacaggaacacgggcaaga

SEQ ID NO: 1088488 - RNA, 19 nt, Homo sapiens
gcaguccucccaccugucu

SEQ ID NO: 1088489 - RNA, 19 nt, Homo sapiens
ugaccguaguaccuaaugu

SEQ ID NO: 1088490 - RNA, 19 nt, Homo sapiens
gauguaguagacaaaggaa

SEQ ID NO: 1088491 - RNA, 19 nt, Homo sapiens
gcaacgggguggucaugau

SEQ ID NO: 1088492 - RNA, 19 nt, Homo sapiens
cagcuucggccuaaaguac

SEQ ID NO: 1088493 - RNA, 19 nt, Homo sapiens
cgaggcgacggcuuaaaga

SEQ ID NO: 1088494 - RNA, 19 nt, Homo sapiens
cagugugcgugcugggaaa

SEQ ID NO: 1088495 - RNA, 19 nt, Homo sapiens
gacccuggacagagucuug

SEQ ID NO: 1088496 - RNA, 19 nt, Homo sapiens
gcaaaugaugaggcuugaa

SEQ ID NO: 1088497 - RNA, 19 nt, Homo sapiens
cccuggugcuugugucaaa

SEQ ID NO: 1088498 - RNA, 19 nt, Homo sapiens
gugcaguggcgcaaucaug

SEQ ID NO: 1088499 - RNA, 19 nt, Homo sapiens
ccuaaaguaccuucauaag

SEQ ID NO: 1088500 - RNA, 19 nt, Homo sapiens
gggaaacuaccgggacaug

SEQ ID NO: 1088501 - RNA, 19 nt, Homo sapiens
gguugaagucugggaugua

SEQ ID NO: 1088502 - RNA, 19 nt, Homo sapiens
aaggaaggcggcagucaga

SEQ ID NO: 1088503 - RNA, 19 nt, Homo sapiens
gggauguaguagacaaagg

SEQ ID NO: 1088504 - RNA, 19 nt, Homo sapiens
gcauguuaaacucacagaa

SEQ ID NO: 1088505 - RNA, 19 nt, Homo sapiens
gaggcggagucugaaaugg

SEQ ID NO: 1088506 - RNA, 19 nt, Homo sapiens
gauguccucgccugucuca

SEQ ID NO: 1088507 - RNA, 19 nt, Homo sapiens
ucugggauguaguagacaa

SEQ ID NO: 1088508 - RNA, 19 nt, Homo sapiens
ggccuacggacuaaacuca

SEQ ID NO: 1088509 - RNA, 19 nt, Homo sapiens
guaccuucauaaguucuuc

SEQ ID NO: 1088510 - RNA, 19 nt, Homo sapiens
gagaagaauuuauggagua

SEQ ID NO: 1088511 - RNA, 19 nt, Homo sapiens
caauuuaacugcuguguuu

SEQ ID NO: 1088512 - RNA, 19 nt, Homo sapiens
ggcagaagcucaacuauga

SEQ ID NO: 1088513 - RNA, 19 nt, Homo sapiens
gaaugcagcuugcuucucu

SEQ ID NO: 1088514 - RNA, 19 nt, Homo sapiens
gauccguguucuccauuua

SEQ ID NO: 1088515 - RNA, 19 nt, Homo sapiens
gaagcugacucuuuguugu

SEQ ID NO: 1088516 - RNA, 19 nt, Homo sapiens
aaggaaagcucgagagaug

SEQ ID NO: 1088517 - RNA, 19 nt, Homo sapiens
uguagacucucgcaagaua

SEQ ID NO: 1088518 - RNA, 19 nt, Homo sapiens
gggaugaugagaagaauuu

SEQ ID NO: 1088519 - RNA, 19 nt, Homo sapiens
guaaucagcaggccaaaga

SEQ ID NO: 1088520 - RNA, 19 nt, Homo sapiens
aaauuagccugcagauauu

SEQ ID NO: 1088521 - RNA, 19 nt, Homo sapiens
caauccauauuccucauuu

SEQ ID NO: 1088522 - RNA, 19 nt, Homo sapiens
gucaagagaucaugguuca

SEQ ID NO: 1088523 - RNA, 19 nt, Homo sapiens
ggaaagcucgagagauguu

SEQ ID NO: 1088524 - RNA, 19 nt, Homo sapiens
gaaguaagaaacagaugga

SEQ ID NO: 1088525 - RNA, 19 nt, Homo sapiens
gcugagaacaauggaaaua

SEQ ID NO: 1088526 - RNA, 19 nt, Homo sapiens
guauugcacugaagaucuu

SEQ ID NO: 1088527 - RNA, 19 nt, Homo sapiens
gaucuuugcuggaccuucu

SEQ ID NO: 1088528 - RNA, 19 nt, Homo sapiens
gcugaagaaaccaguauuu

SEQ ID NO: 1088529 - RNA, 19 nt, Homo sapiens
gcucaacuaugauauccau

SEQ ID NO: 1088530 - RNA, 19 nt, Homo sapiens
cagaagcucaacuaugaua

SEQ ID NO: 1088531 - RNA, 19 nt, Homo sapiens
gcacauaugcagggaguau

SEQ ID NO: 1088532 - RNA, 19 nt, Homo sapiens
guaagaaacagauggaagu

SEQ ID NO: 1088533 - RNA, 19 nt, Homo sapiens
ggugagggaugaugagaag

SEQ ID NO: 1088534 - RNA, 19 nt, Homo sapiens
gcagcuugcuucucucuac

SEQ ID NO: 1088535 - RNA, 19 nt, Homo sapiens
cucgagagauguuguuaaa

SEQ ID NO: 1088536 - RNA, 19 nt, Homo sapiens
gcagauauuuucucucaau

SEQ ID NO: 1088537 - RNA, 19 nt, Homo sapiens
ggaagcugacucuuuguug

SEQ ID NO: 1088538 - RNA, 19 nt, Homo sapiens
agaggacugugacuugaaa

SEQ ID NO: 1088539 - RNA, 19 nt, Homo sapiens
aaaauuagccugcagauau

SEQ ID NO: 1088540 - RNA, 19 nt, Homo sapiens
uugcuucucucuacagauu

SEQ ID NO: 1088541 - RNA, 19 nt, Homo sapiens
gaagggaaguaagaaacag

SEQ ID NO: 1088542 - RNA, 19 nt, Homo sapiens
ucagugauaacaauccaua

SEQ ID NO: 1088543 - RNA, 19 nt, Homo sapiens
gacugugacuugaaaauuu

SEQ ID NO: 1088544 - RNA, 19 nt, Homo sapiens
gcagauggccagaaagaac

SEQ ID NO: 1088545 - RNA, 19 nt, Homo sapiens
ugacuaaacucagcaccau

SEQ ID NO: 1088546 - RNA, 19 nt, Homo sapiens
caacucuggugagggauga

SEQ ID NO: 1088547 - RNA, 19 nt, Homo sapiens
ggaccuucuucucuucaga

SEQ ID NO: 1088548 - RNA, 19 nt, Homo sapiens
gaagcucaacuaugauauc

SEQ ID NO: 1088549 - RNA, 19 nt, Homo sapiens
uuagaggacugugacuuga

SEQ ID NO: 1088550 - RNA, 19 nt, Homo sapiens
gugauaacaauccauauuc

SEQ ID NO: 1088551 - RNA, 19 nt, Homo sapiens
gguagcguccacaauguuu

SEQ ID NO: 1088552 - RNA, 19 nt, Homo sapiens
auccauagauugcugagaa

SEQ ID NO: 1088553 - RNA, 19 nt, Homo sapiens
ccucgucagugauaacaau

SEQ ID NO: 1088554 - RNA, 19 nt, Homo sapiens
gcuucucucuacagauuga

SEQ ID NO: 1088555 - RNA, 19 nt, Homo sapiens
gcagggaguauugcacuga

SEQ ID NO: 1088556 - RNA, 19 nt, Homo sapiens
gaugagaagaauuuaugga

SEQ ID NO: 1088557 - RNA, 19 nt, Homo sapiens
ucuguagacucucgcaaga

SEQ ID NO: 1088558 - RNA, 19 nt, Homo sapiens
caaguugggagcucucaga

SEQ ID NO: 1088559 - RNA, 19 nt, Homo sapiens
gcucgagagauguuguuaa

SEQ ID NO: 1088560 - RNA, 19 nt, Homo sapiens
gagggaugaugagaagaau

SEQ ID NO: 1088561 - RNA, 19 nt, Homo sapiens
cguguucuccauuuauuaa

SEQ ID NO: 1088562 - RNA, 19 nt, Homo sapiens
ggaccucucaugcagacuu

SEQ ID NO: 1088563 - RNA, 19 nt, Homo sapiens
gauagucauucguaaucag

SEQ ID NO: 1088564 - RNA, 19 nt, Homo sapiens
guagcguccacaauguuua

SEQ ID NO: 1088565 - RNA, 19 nt, Homo sapiens
gcuggaccuucuucucuuc

SEQ ID NO: 1088566 - RNA, 19 nt, Homo sapiens
gaccucucaugcagacuug

SEQ ID NO: 1088567 - RNA, 19 nt, Homo sapiens
ugagggaugaugagaagaa

SEQ ID NO: 1088568 - RNA, 19 nt, Homo sapiens
cugagggacuggcugagaa

SEQ ID NO: 1088569 - RNA, 19 nt, Homo sapiens
ucucaauucuguagacucu

SEQ ID NO: 1088570 - RNA, 19 nt, Homo sapiens
uuaaugcauuguagaccaa

SEQ ID NO: 1088571 - RNA, 19 nt, Homo sapiens
cagggaguauugcacugaa

SEQ ID NO: 1088572 - RNA, 19 nt, Homo sapiens
uaaucuuugccucauguua

SEQ ID NO: 1088573 - RNA, 19 nt, Homo sapiens
ggaugaugagaagaauuua

SEQ ID NO: 1088574 - RNA, 19 nt, Homo sapiens
cgagagauguuguuaaaac

SEQ ID NO: 1088575 - RNA, 19 nt, Homo sapiens
guuguggaccgucucauug

SEQ ID NO: 1088576 - RNA, 19 nt, Homo sapiens
cgaagggaaguaagaaaca

SEQ ID NO: 1088577 - RNA, 19 nt, Homo sapiens
cuuaaucuuugccucaugu

SEQ ID NO: 1088578 - RNA, 19 nt, Homo sapiens
uagcguccacaauguuuaa

SEQ ID NO: 1088579 - RNA, 19 nt, Homo sapiens
guauuuagucugcuuagag

SEQ ID NO: 1088580 - RNA, 19 nt, Homo sapiens
cuuccuaguuuaauaagca

SEQ ID NO: 1088581 - RNA, 19 nt, Homo sapiens
gggaguauugcacugaaga

SEQ ID NO: 1088582 - RNA, 19 nt, Homo sapiens
uaagcuugcucgucgaacu

SEQ ID NO: 1088583 - RNA, 19 nt, Homo sapiens
aagaauuuauggaguaugc

SEQ ID NO: 1088584 - RNA, 19 nt, Homo sapiens
ucaaacagugaaacaaaca

SEQ ID NO: 1088585 - RNA, 19 nt, Homo sapiens
guagacucucgcaagauaa

SEQ ID NO: 1088586 - RNA, 19 nt, Homo sapiens
aaucuuugccucauguuau

SEQ ID NO: 1088587 - RNA, 19 nt, Homo sapiens
acaaggaaagcucgagaga

SEQ ID NO: 1088588 - RNA, 19 nt, Homo sapiens
agaacccuguacaauuuga

SEQ ID NO: 1088589 - RNA, 19 nt, Homo sapiens
caaacagugaaacaaacaa

SEQ ID NO: 1088590 - RNA, 19 nt, Homo sapiens
uagacucucgcaagauaaa

SEQ ID NO: 1088591 - RNA, 19 nt, Homo sapiens
gcuuaaucuuugccucaug

SEQ ID NO: 1088592 - RNA, 19 nt, Homo sapiens
guaagguuaauccauagau

SEQ ID NO: 1088593 - RNA, 19 nt, Homo sapiens
ccacuuaagcaaggaacuu

SEQ ID NO: 1088594 - RNA, 19 nt, Homo sapiens
gcuugcuucucucuacaga

SEQ ID NO: 1088595 - RNA, 19 nt, Homo sapiens
gcagaagcucaacuaugau

SEQ ID NO: 1088596 - RNA, 19 nt, Homo sapiens
cgcaagauaaacauucaaa

SEQ ID NO: 1088597 - RNA, 19 nt, Homo sapiens
ccaauuuaacugcuguguu

SEQ ID NO: 1088598 - RNA, 19 nt, Homo sapiens
cuuagaggacugugacuug

SEQ ID NO: 1088599 - RNA, 19 nt, Homo sapiens
gaccgucucauugcacuug

SEQ ID NO: 1088600 - RNA, 19 nt, Homo sapiens
gcaagauaaacauucaaac

SEQ ID NO: 1088601 - RNA, 19 nt, Homo sapiens
uccguguucuccauuuauu

SEQ ID NO: 1088602 - RNA, 19 nt, Homo sapiens
ggacugugacuugaaaauu

SEQ ID NO: 1088603 - RNA, 19 nt, Homo sapiens
caaggaaagcucgagagau

SEQ ID NO: 1088604 - RNA, 19 nt, Homo sapiens
uggcagaagcucaacuaug

SEQ ID NO: 1088605 - RNA, 19 nt, Homo sapiens
ugauaacaauccauauucc

SEQ ID NO: 1088606 - RNA, 19 nt, Homo sapiens
cagcuugcuucucucuaca

SEQ ID NO: 1088607 - RNA, 19 nt, Homo sapiens
acauaugcagggaguauug

SEQ ID NO: 1088608 - RNA, 19 nt, Homo sapiens
gaaagcucgagagauguug

SEQ ID NO: 1088609 - RNA, 19 nt, Homo sapiens
gacucuuuguugucaguga

SEQ ID NO: 1088610 - RNA, 19 nt, Homo sapiens
ggaaugauguguucaguga

SEQ ID NO: 1088611 - RNA, 19 nt, Homo sapiens
cgaaagaguuuguaaagaa

SEQ ID NO: 1088612 - RNA, 19 nt, Homo sapiens
gcaacaagcacaucaaauu

SEQ ID NO: 1088613 - RNA, 19 nt, Homo sapiens
aaacauagguggccugaga

SEQ ID NO: 1088614 - RNA, 19 nt, Homo sapiens
gaccagaccuucuuucuca

SEQ ID NO: 1088615 - RNA, 19 nt, Homo sapiens
agaaaucgguuugaaguua

SEQ ID NO: 1088616 - RNA, 19 nt, Homo sapiens
gaagaugcuuacagaguuu

SEQ ID NO: 1088617 - RNA, 19 nt, Homo sapiens
gaaaaucgcugcugagaau

SEQ ID NO: 1088618 - RNA, 19 nt, Homo sapiens
gagaauagacuucaucaug

SEQ ID NO: 1088619 - RNA, 19 nt, Homo sapiens
caacaagcacaucaaauuu

SEQ ID NO: 1088620 - RNA, 19 nt, Homo sapiens
gagcugggauggccacuga

SEQ ID NO: 1088621 - RNA, 19 nt, Homo sapiens
gaauagacuucaucaugug

SEQ ID NO: 1088622 - RNA, 19 nt, Homo sapiens
gaaaucgguuugaaguuag

SEQ ID NO: 1088623 - RNA, 19 nt, Homo sapiens
caucaaguguccuacguaa

SEQ ID NO: 1088624 - RNA, 19 nt, Homo sapiens
guaaaggaguauuggaaug

SEQ ID NO: 1088625 - RNA, 19 nt, Homo sapiens
gaacauuuccuucuucagu

SEQ ID NO: 1088626 - RNA, 19 nt, Homo sapiens
ugacauaguuugcaacaag

SEQ ID NO: 1088627 - RNA, 19 nt, Homo sapiens
ugaagaugcuuacagaguu

SEQ ID NO: 1088628 - RNA, 19 nt, Homo sapiens
cgacaaagacugugaagau

SEQ ID NO: 1088629 - RNA, 19 nt, Homo sapiens
agaauagacuucaucaugu

SEQ ID NO: 1088630 - RNA, 19 nt, Homo sapiens
gacaaagacugugaagaug

SEQ ID NO: 1088631 - RNA, 19 nt, Homo sapiens
agacaucccuuuccaucaa

SEQ ID NO: 1088632 - RNA, 19 nt, Homo sapiens
cagcguggaauaaacauua

SEQ ID NO: 1088633 - RNA, 19 nt, Homo sapiens
gaacugggacucacuggau

SEQ ID NO: 1088634 - RNA, 19 nt, Homo sapiens
aaagguugguuccuguaua

SEQ ID NO: 1088635 - RNA, 19 nt, Homo sapiens
gggauuaacgaaagaguuu

SEQ ID NO: 1088636 - RNA, 19 nt, Homo sapiens
ggucuguacugccgacaaa

SEQ ID NO: 1088637 - RNA, 19 nt, Homo sapiens
gaaguuagaaaugcgguaa

SEQ ID NO: 1088638 - RNA, 19 nt, Homo sapiens
uuacagaguuugccagauc

SEQ ID NO: 1088639 - RNA, 19 nt, Homo sapiens
ggacagcguggaauaaaca

SEQ ID NO: 1088640 - RNA, 19 nt, Homo sapiens
acaagcacaucaaauuuag

SEQ ID NO: 1088641 - RNA, 19 nt, Homo sapiens
guauuggaaugauguguuc

SEQ ID NO: 1088642 - RNA, 19 nt, Homo sapiens
uaaaggaguauuggaauga

SEQ ID NO: 1088643 - RNA, 19 nt, Homo sapiens
gaagaggaauuuugaacau

SEQ ID NO: 1088644 - RNA, 19 nt, Homo sapiens
gaucuuagacaucccuuuc

SEQ ID NO: 1088645 - RNA, 19 nt, Homo sapiens
cauagaagacaauaagguu

SEQ ID NO: 1088646 - RNA, 19 nt, Homo sapiens
gggacucacuggaugaaca

SEQ ID NO: 1088647 - RNA, 19 nt, Homo sapiens
gagcagaagcacguuaaga

SEQ ID NO: 1088648 - RNA, 19 nt, Homo sapiens
aacauuuccuucuucagua

SEQ ID NO: 1088649 - RNA, 19 nt, Homo sapiens
gcagaagcacguuaagaag

SEQ ID NO: 1088650 - RNA, 19 nt, Homo sapiens
ccuggaagaugaagaaguc

SEQ ID NO: 1088651 - RNA, 19 nt, Homo sapiens
gaacacauaaagguugguu

SEQ ID NO: 1088652 - RNA, 19 nt, Homo sapiens
caaagacugugaagaugcu

SEQ ID NO: 1088653 - RNA, 19 nt, Homo sapiens
ucaaguguccuacguaaag

SEQ ID NO: 1088654 - RNA, 19 nt, Homo sapiens
ucagaaaucgguuugaagu

SEQ ID NO: 1088655 - RNA, 19 nt, Homo sapiens
ugacagggguguuuaugaa

SEQ ID NO: 1088656 - RNA, 19 nt, Homo sapiens
ccagagagcaaacauaggu

SEQ ID NO: 1088657 - RNA, 19 nt, Homo sapiens
ggccagagagcaaacauag

SEQ ID NO: 1088658 - RNA, 19 nt, Homo sapiens
ucccaauccugacauaguu

SEQ ID NO: 1088659 - RNA, 19 nt, Homo sapiens
ggagaaggacagcgucaag

SEQ ID NO: 1088660 - RNA, 19 nt, Homo sapiens
gguacgugguggagaagga

SEQ ID NO: 1088661 - RNA, 19 nt, Homo sapiens
ccugguacgugguggagaa

SEQ ID NO: 1088662 - RNA, 19 nt, Homo sapiens
acgaaagaguuuguaaaga

SEQ ID NO: 1088663 - RNA, 19 nt, Homo sapiens
gugaagaugcuuacagagu

SEQ ID NO: 1088664 - RNA, 19 nt, Homo sapiens
acaggucacuaugcaagaa

SEQ ID NO: 1088665 - RNA, 19 nt, Homo sapiens
gugcugacccucaaucaag

SEQ ID NO: 1088666 - RNA, 19 nt, Homo sapiens
gacucccaauccugacaua

SEQ ID NO: 1088667 - RNA, 19 nt, Homo sapiens
gggacagcguggaauaaac

SEQ ID NO: 1088668 - RNA, 19 nt, Homo sapiens
gggccagagagcaaacaua

SEQ ID NO: 1088669 - RNA, 19 nt, Homo sapiens
guugguuccuguauaccuu

SEQ ID NO: 1088670 - RNA, 19 nt, Homo sapiens
gaacauggggucuguacug

SEQ ID NO: 1088671 - RNA, 19 nt, Homo sapiens
gaguuugccagaucuuaga

SEQ ID NO: 1088672 - RNA, 19 nt, Homo sapiens
acauuuccuucuucaguau

SEQ ID NO: 1088673 - RNA, 19 nt, Homo sapiens
cagaguuugccagaucuua

SEQ ID NO: 1088674 - RNA, 19 nt, Homo sapiens
uaaagguugguuccuguau

SEQ ID NO: 1088675 - RNA, 19 nt, Homo sapiens
gauuaacgaaagaguuugu

SEQ ID NO: 1088676 - RNA, 19 nt, Homo sapiens
gguuugaaguuagaaaugc

SEQ ID NO: 1088677 - RNA, 19 nt, Homo sapiens
cagaaaucgguuugaaguu

SEQ ID NO: 1088678 - RNA, 19 nt, Homo sapiens
agcagaagcacguuaagaa

SEQ ID NO: 1088679 - RNA, 19 nt, Homo sapiens
aaaggaaggacucccaauc

SEQ ID NO: 1088680 - RNA, 19 nt, Homo sapiens
aaaggaguauuggaaugau

SEQ ID NO: 1088681 - RNA, 19 nt, Homo sapiens
ccagugacagcccagaaga

SEQ ID NO: 1088682 - RNA, 19 nt, Homo sapiens
aagguugguuccuguauac

SEQ ID NO: 1088683 - RNA, 19 nt, Homo sapiens
ccauagaagacaauaaggu

SEQ ID NO: 1088684 - RNA, 19 nt, Homo sapiens
ggacucacuggaugaacau

SEQ ID NO: 1088685 - RNA, 19 nt, Homo sapiens
cguaaaggaguauuggaau

SEQ ID NO: 1088686 - RNA, 19 nt, Homo sapiens
ugagagagcccugguacgu

SEQ ID NO: 1088687 - RNA, 19 nt, Homo sapiens
aaaucgguuugaaguuaga

SEQ ID NO: 1088688 - RNA, 19 nt, Homo sapiens
ccuggucacuuuauuucca

SEQ ID NO: 1088689 - RNA, 19 nt, Homo sapiens
gcugagaauagacuucauc

SEQ ID NO: 1088690 - RNA, 19 nt, Homo sapiens
gacaucccuuuccaucaag

SEQ ID NO: 1088691 - RNA, 19 nt, Homo sapiens
ccaucaaguguccuacgua

SEQ ID NO: 1088692 - RNA, 19 nt, Homo sapiens
ccaauccugacauaguuug

SEQ ID NO: 1088693 - RNA, 19 nt, Homo sapiens
caaguguccuacguaaagg

SEQ ID NO: 1088694 - RNA, 19 nt, Homo sapiens
cgggacagcguggaauaaa

SEQ ID NO: 1088695 - RNA, 19 nt, Homo sapiens
ugacagcccagaagauggu

SEQ ID NO: 1088696 - RNA, 19 nt, Homo sapiens
gcugggauggccacugaga

SEQ ID NO: 1088697 - RNA, 19 nt, Homo sapiens
uuugaacauuuccuucuuc

SEQ ID NO: 1088698 - RNA, 19 nt, Homo sapiens
ggaagaggaauuuugaaca

SEQ ID NO: 1088699 - RNA, 19 nt, Homo sapiens
aaucgcugcugagaauaga

SEQ ID NO: 1088700 - RNA, 19 nt, Homo sapiens
aacgaaagaguuuguaaag

SEQ ID NO: 1088701 - RNA, 19 nt, Homo sapiens
cagccagguuucccaggau

SEQ ID NO: 1088702 - RNA, 19 nt, Homo sapiens
ugccacaggucacuaugca

SEQ ID NO: 1088703 - RNA, 19 nt, Homo sapiens
aaugauguguucagugacu

SEQ ID NO: 1088704 - RNA, 19 nt, Homo sapiens
caagaaggaugauggauaa

SEQ ID NO: 1088705 - RNA, 19 nt, Homo sapiens
gaaagacucucaaacaaca

SEQ ID NO: 1088706 - RNA, 19 nt, Homo sapiens
gagaacagauugguuauug

SEQ ID NO: 1088707 - RNA, 19 nt, Homo sapiens
caaaugaccuuguggaagu

SEQ ID NO: 1088708 - RNA, 19 nt, Homo sapiens
gaugagacuucacgacuuu

SEQ ID NO: 1088709 - RNA, 19 nt, Homo sapiens
gcaagaaggaugauggaua

SEQ ID NO: 1088710 - RNA, 19 nt, Homo sapiens
caaagucuguggagcagua

SEQ ID NO: 1088711 - RNA, 19 nt, Homo sapiens
gaacccagcauuaaucauu

SEQ ID NO: 1088712 - RNA, 19 nt, Homo sapiens
guucugagcugggaaacua

SEQ ID NO: 1088713 - RNA, 19 nt, Homo sapiens
gauaauaacagcaauaugg

SEQ ID NO: 1088714 - RNA, 19 nt, Homo sapiens
ggaaguggauagauugcuu

SEQ ID NO: 1088715 - RNA, 19 nt, Homo sapiens
uaaagugguucagucauuu

SEQ ID NO: 1088716 - RNA, 19 nt, Homo sapiens
agggauacuucuagaauua

SEQ ID NO: 1088717 - RNA, 19 nt, Homo sapiens
guagagaacccagcauuaa

SEQ ID NO: 1088718 - RNA, 19 nt, Homo sapiens
ggcaauguguccaaguaua

SEQ ID NO: 1088719 - RNA, 19 nt, Homo sapiens
gaggaaagacucucaaaca

SEQ ID NO: 1088720 - RNA, 19 nt, Homo sapiens
acaaugacuucuuaucuga

SEQ ID NO: 1088721 - RNA, 19 nt, Homo sapiens
ucagcacaaugacuucuua

SEQ ID NO: 1088722 - RNA, 19 nt, Homo sapiens
gaaggaugauggauaaacu

SEQ ID NO: 1088723 - RNA, 19 nt, Homo sapiens
gcaaagagcaaugacaaug

SEQ ID NO: 1088724 - RNA, 19 nt, Homo sapiens
uccagcaacuccuaacuua

SEQ ID NO: 1088725 - RNA, 19 nt, Homo sapiens
gcauaaagcaauugagaau

SEQ ID NO: 1088726 - RNA, 19 nt, Homo sapiens
gauagaccauuuagaaacu

SEQ ID NO: 1088727 - RNA, 19 nt, Homo sapiens
gaauaaagugguucaguca

SEQ ID NO: 1088728 - RNA, 19 nt, Homo sapiens
gcacaaugacuucuuaucu

SEQ ID NO: 1088729 - RNA, 19 nt, Homo sapiens
cagaagauugagacuauua

SEQ ID NO: 1088730 - RNA, 19 nt, Homo sapiens
caagaaauccuggagaaga

SEQ ID NO: 1088731 - RNA, 19 nt, Homo sapiens
gggaaacuaugucauuaag

SEQ ID NO: 1088732 - RNA, 19 nt, Homo sapiens
cauccuagcuauaaaccaa

SEQ ID NO: 1088733 - RNA, 19 nt, Homo sapiens
gcaauguguccaaguauau

SEQ ID NO: 1088734 - RNA, 19 nt, Homo sapiens
acaguuugcucuugaaaug

SEQ ID NO: 1088735 - RNA, 19 nt, Homo sapiens
gaauucagcucgagaugcu

SEQ ID NO: 1088736 - RNA, 19 nt, Homo sapiens
uacaagaaauccuggagaa

SEQ ID NO: 1088737 - RNA, 19 nt, Homo sapiens
ccaaauaagcggcauaaag

SEQ ID NO: 1088738 - RNA, 19 nt, Homo sapiens
aaacguguaucauaaugug

SEQ ID NO: 1088739 - RNA, 19 nt, Homo sapiens
uaucacagccuaaagaaau

SEQ ID NO: 1088740 - RNA, 19 nt, Homo sapiens
aaugagaacagauugguua

SEQ ID NO: 1088741 - RNA, 19 nt, Homo sapiens
caaauaagcggcauaaagc

SEQ ID NO: 1088742 - RNA, 19 nt, Homo sapiens
aagaaauccuggagaagaa

SEQ ID NO: 1088743 - RNA, 19 nt, Homo sapiens
auaaguggaugguauaugu

SEQ ID NO: 1088744 - RNA, 19 nt, Homo sapiens
ucaaagacaugugauacga

SEQ ID NO: 1088745 - RNA, 19 nt, Homo sapiens
gaacaugaaauugaaguca

SEQ ID NO: 1088746 - RNA, 19 nt, Homo sapiens
gcagaagauugagacuauu

SEQ ID NO: 1088747 - RNA, 19 nt, Homo sapiens
ucaaacguguaucauaaug

SEQ ID NO: 1088748 - RNA, 19 nt, Homo sapiens
ccacguguguuaauguuuc

SEQ ID NO: 1088749 - RNA, 19 nt, Homo sapiens
gaacagauugguuauugca

SEQ ID NO: 1088750 - RNA, 19 nt, Homo sapiens
ucagcaaagugaacuguga

SEQ ID NO: 1088751 - RNA, 19 nt, Homo sapiens
auaaagugguucagucauu

SEQ ID NO: 1088752 - RNA, 19 nt, Homo sapiens
cgaaauacuggaagggaua

SEQ ID NO: 1088753 - RNA, 19 nt, Homo sapiens
gaacaguuugcucuugaaa

SEQ ID NO: 1088754 - RNA, 19 nt, Homo sapiens
ggacagagggagaaagauc

SEQ ID NO: 1088755 - RNA, 19 nt, Homo sapiens
gaauuacuggcucccauaa

SEQ ID NO: 1088756 - RNA, 19 nt, Homo sapiens
ggaaucaagcgaaccauca

SEQ ID NO: 1088757 - RNA, 19 nt, Homo sapiens
caucaucuccugccaauca

SEQ ID NO: 1088758 - RNA, 19 nt, Homo sapiens
gucuauaccugaacugcua

SEQ ID NO: 1088759 - RNA, 19 nt, Homo sapiens
gcggaaugcugaucucaca

SEQ ID NO: 1088760 - RNA, 19 nt, Homo sapiens
aggaaagacucucaaacaa

SEQ ID NO: 1088761 - RNA, 19 nt, Homo sapiens
caaagaaaccgacccugau

SEQ ID NO: 1088762 - RNA, 19 nt, Homo sapiens
ugcagaagauugagacuau

SEQ ID NO: 1088763 - RNA, 19 nt, Homo sapiens
uggaggaccugcaacaguu

SEQ ID NO: 1088764 - RNA, 19 nt, Homo sapiens
uacuauggcuggaacauug

SEQ ID NO: 1088765 - RNA, 19 nt, Homo sapiens
guauauaccuccggauaag

SEQ ID NO: 1088766 - RNA, 19 nt, Homo sapiens
gaagaauaaggaacaugaa

SEQ ID NO: 1088767 - RNA, 19 nt, Homo sapiens
caagcgaaccaucaaagaa

SEQ ID NO: 1088768 - RNA, 19 nt, Homo sapiens
gaaacaccaucagccaauc

SEQ ID NO: 1088769 - RNA, 19 nt, Homo sapiens
ugaagaauaaggaacauga

SEQ ID NO: 1088770 - RNA, 19 nt, Homo sapiens
ucaaaccacucagcguaaa

SEQ ID NO: 1088771 - RNA, 19 nt, Homo sapiens
gcagagaccaagccgaaau

SEQ ID NO: 1088772 - RNA, 19 nt, Homo sapiens
ggaaagacucucaaacaac

SEQ ID NO: 1088773 - RNA, 19 nt, Homo sapiens
cacaaugacuucuuaucug

SEQ ID NO: 1088774 - RNA, 19 nt, Homo sapiens
uaaacugcgugccugcauu

SEQ ID NO: 1088775 - RNA, 19 nt, Homo sapiens
auagggaaguggauagauu

SEQ ID NO: 1088776 - RNA, 19 nt, Homo sapiens
cugggaaacuaugucauua

SEQ ID NO: 1088777 - RNA, 19 nt, Homo sapiens
gaaguuagagagccuccuu

SEQ ID NO: 1088778 - RNA, 19 nt, Homo sapiens
uaaaccaaaugaccuugug

SEQ ID NO: 1088779 - RNA, 19 nt, Homo sapiens
acucauaaguggaugguau

SEQ ID NO: 1088780 - RNA, 19 nt, Homo sapiens
gcagucuccacguguguua

SEQ ID NO: 1088781 - RNA, 19 nt, Homo sapiens
gcuauaagcaaggucgaua

SEQ ID NO: 1088782 - RNA, 19 nt, Homo sapiens
guauauaaggcucaaauag

SEQ ID NO: 1088783 - RNA, 19 nt, Homo sapiens
gcugggaaacuaugucauu

SEQ ID NO: 1088784 - RNA, 19 nt, Homo sapiens
aaagugaacugugagaucu

SEQ ID NO: 1088785 - RNA, 19 nt, Homo sapiens
auauaaggcucaaauaguc

SEQ ID NO: 1088786 - RNA, 19 nt, Homo sapiens
aaagaaaccgacccugauu

SEQ ID NO: 1088787 - RNA, 19 nt, Homo sapiens
ccugaugccugugaauaaa

SEQ ID NO: 1088788 - RNA, 19 nt, Homo sapiens
ggaaugcugaucucacaga

SEQ ID NO: 1088789 - RNA, 19 nt, Homo sapiens
ccugagagccugaggaaug

SEQ ID NO: 1088790 - RNA, 19 nt, Homo sapiens
cguagagaacccagcauua

SEQ ID NO: 1088791 - RNA, 19 nt, Homo sapiens
gcagguaucacagccuaaa

SEQ ID NO: 1088792 - RNA, 19 nt, Homo sapiens
caaagugaacugugagauc

SEQ ID NO: 1088793 - RNA, 19 nt, Homo sapiens
gagcaaugacaaugcgaaa

SEQ ID NO: 1088794 - RNA, 19 nt, Homo sapiens
cgucagaguucaaguucau

SEQ ID NO: 1088795 - RNA, 19 nt, Homo sapiens
cagagaccaagccgaaaua

SEQ ID NO: 1088796 - RNA, 19 nt, Homo sapiens
uaagcggcauaaagcaauu

SEQ ID NO: 1088797 - RNA, 19 nt, Homo sapiens
gaaucaagcgaaccaucaa

SEQ ID NO: 1088798 - RNA, 19 nt, Homo sapiens
gaagauugagacuauuauc

SEQ ID NO: 1088799 - RNA, 19 nt, Homo sapiens
agugaagacugaaccagaa

SEQ ID NO: 1088800 - RNA, 19 nt, Homo sapiens
gagaacccagcauuaauca

SEQ ID NO: 1088801 - RNA, 19 nt, Homo sapiens
cuguggcccuuccaaauaa

SEQ ID NO: 1088802 - RNA, 19 nt, Homo sapiens
ugggcaauguguccaagua

SEQ ID NO: 1088803 - RNA, 19 nt, Homo sapiens
aagaaaccgacccugauua

SEQ ID NO: 1088804 - RNA, 19 nt, Homo sapiens
ggacaaagaucuuaacuca

SEQ ID NO: 1088805 - RNA, 19 nt, Homo sapiens
caagaaaggugguguauga

SEQ ID NO: 1088806 - RNA, 19 nt, Homo sapiens
ggaauuggcugcucuagaa

SEQ ID NO: 1088807 - RNA, 19 nt, Homo sapiens
ggaaacagagcuccaauua

SEQ ID NO: 1088808 - RNA, 19 nt, Homo sapiens
gaugacagcuugacugaaa

SEQ ID NO: 1088809 - RNA, 19 nt, Homo sapiens
ggacuuggaugaauuguau

SEQ ID NO: 1088810 - RNA, 19 nt, Homo sapiens
gcacgcagauuccaagaaa

SEQ ID NO: 1088811 - RNA, 19 nt, Homo sapiens
ggaaucaaauccaagcuuu

SEQ ID NO: 1088812 - RNA, 19 nt, Homo sapiens
gcacagaacuucauuuuga

SEQ ID NO: 1088813 - RNA, 19 nt, Homo sapiens
gaagaucuccggaaaguga

SEQ ID NO: 1088814 - RNA, 19 nt, Homo sapiens
aaacagagcuccaauuaac

SEQ ID NO: 1088815 - RNA, 19 nt, Homo sapiens
gaugaagacuccuaucaga

SEQ ID NO: 1088816 - RNA, 19 nt, Homo sapiens
gaagaggacuuggaugaau

SEQ ID NO: 1088817 - RNA, 19 nt, Homo sapiens
acaaagaucuuaacucagu

SEQ ID NO: 1088818 - RNA, 19 nt, Homo sapiens
gaaauggacaaagaucuua

SEQ ID NO: 1088819 - RNA, 19 nt, Homo sapiens
gaaacagagcuccaauuaa

SEQ ID NO: 1088820 - RNA, 19 nt, Homo sapiens
ggagugacaucaaguucuu

SEQ ID NO: 1088821 - RNA, 19 nt, Homo sapiens
gaagaaacucgucaugcua

SEQ ID NO: 1088822 - RNA, 19 nt, Homo sapiens
gacaguaaauacaguaguu

SEQ ID NO: 1088823 - RNA, 19 nt, Homo sapiens
gaaggugggucugguugaa

SEQ ID NO: 1088824 - RNA, 19 nt, Homo sapiens
cugaagcgguuuaaaguuu

SEQ ID NO: 1088825 - RNA, 19 nt, Homo sapiens
agacgaagaucuccggaaa

SEQ ID NO: 1088826 - RNA, 19 nt, Homo sapiens
gguuuaaaguuucagauga

SEQ ID NO: 1088827 - RNA, 19 nt, Homo sapiens
gaagaacacccucaagagu

SEQ ID NO: 1088828 - RNA, 19 nt, Homo sapiens
ggcauaaguucccugauga

SEQ ID NO: 1088829 - RNA, 19 nt, Homo sapiens
aaaaggagguggauucuaa

SEQ ID NO: 1088830 - RNA, 19 nt, Homo sapiens
ccaacaagcugcagaucau

SEQ ID NO: 1088831 - RNA, 19 nt, Homo sapiens
ucaagucccuggccaacaa

SEQ ID NO: 1088832 - RNA, 19 nt, Homo sapiens
gaacaggaaggcagugaug

SEQ ID NO: 1088833 - RNA, 19 nt, Homo sapiens
gaaaugagaaagcuggaau

SEQ ID NO: 1088834 - RNA, 19 nt, Homo sapiens
gaagaagacccggaggaaa

SEQ ID NO: 1088835 - RNA, 19 nt, Homo sapiens
ugacaauuauucugaggaa

SEQ ID NO: 1088836 - RNA, 19 nt, Homo sapiens
caaccuaacaucaaacaga

SEQ ID NO: 1088837 - RNA, 19 nt, Homo sapiens
gagaaaacguuacaagaau

SEQ ID NO: 1088838 - RNA, 19 nt, Homo sapiens
cggcauaaguucccugaug

SEQ ID NO: 1088839 - RNA, 19 nt, Homo sapiens
caccauacaugcugucugu

SEQ ID NO: 1088840 - RNA, 19 nt, Homo sapiens
ugacacagcguuucuagga

SEQ ID NO: 1088841 - RNA, 19 nt, Homo sapiens
gaagacuccuaucagaagu

SEQ ID NO: 1088842 - RNA, 19 nt, Homo sapiens
ucugaucguucuccugaua

SEQ ID NO: 1088843 - RNA, 19 nt, Homo sapiens
uggcagaaauaaagaucua

SEQ ID NO: 1088844 - RNA, 19 nt, Homo sapiens
gaaaguucccaccaucuuc

SEQ ID NO: 1088845 - RNA, 19 nt, Homo sapiens
ccaagcagcagcagacuau

SEQ ID NO: 1088846 - RNA, 19 nt, Homo sapiens
uacaugcgcuuccucauca

SEQ ID NO: 1088847 - RNA, 19 nt, Homo sapiens
ggagaaaacguuacaagaa

SEQ ID NO: 1088848 - RNA, 19 nt, Homo sapiens
uaagcgagaugccaacaag

SEQ ID NO: 1088849 - RNA, 19 nt, Homo sapiens
ucaguacccucauuuccuu

SEQ ID NO: 1088850 - RNA, 19 nt, Homo sapiens
ccgaagccaugcugacuug

SEQ ID NO: 1088851 - RNA, 19 nt, Homo sapiens
ggaagaggacuuggaugaa

SEQ ID NO: 1088852 - RNA, 19 nt, Homo sapiens
ugaagaaacucgucaugcu

SEQ ID NO: 1088853 - RNA, 19 nt, Homo sapiens
caacauggcagaggugaug

SEQ ID NO: 1088854 - RNA, 19 nt, Homo sapiens
uaaguucccugaugaagac

SEQ ID NO: 1088855 - RNA, 19 nt, Homo sapiens
aagaggacuuggaugaauu

SEQ ID NO: 1088856 - RNA, 19 nt, Homo sapiens
gcuuugggcuggagcaugu

SEQ ID NO: 1088857 - RNA, 19 nt, Homo sapiens
gaagcgguuuaaaguuuca

SEQ ID NO: 1088858 - RNA, 19 nt, Homo sapiens
ggaaggcagugaugaucca

SEQ ID NO: 1088859 - RNA, 19 nt, Homo sapiens
gccaacccauugaccauga

SEQ ID NO: 1088860 - RNA, 19 nt, Homo sapiens
ggaccaucuugggcuauaa

SEQ ID NO: 1088861 - RNA, 19 nt, Homo sapiens
cuuccacccuuguuaauga

SEQ ID NO: 1088862 - RNA, 19 nt, Homo sapiens
caaggccacuuucaacucu

SEQ ID NO: 1088863 - RNA, 19 nt, Homo sapiens
gggagggacugaguugaug

SEQ ID NO: 1088864 - RNA, 19 nt, Homo sapiens
caaggcaaccuaacaucaa

SEQ ID NO: 1088865 - RNA, 19 nt, Homo sapiens
gagaucguccuuccagcua

SEQ ID NO: 1088866 - RNA, 19 nt, Homo sapiens
guaguuccuuccuggauuc

SEQ ID NO: 1088867 - RNA, 19 nt, Homo sapiens
aaccuaacaucaaacagaa

SEQ ID NO: 1088868 - RNA, 19 nt, Homo sapiens
ucaaauccaagcuuucuga

SEQ ID NO: 1088869 - RNA, 19 nt, Homo sapiens
gagauuggcagccucaaca

SEQ ID NO: 1088870 - RNA, 19 nt, Homo sapiens
cgacuggcuuggcuacaug

SEQ ID NO: 1088871 - RNA, 19 nt, Homo sapiens
ucacugaccaggacauguu

SEQ ID NO: 1088872 - RNA, 19 nt, Homo sapiens
caccagcccuauggaauug

SEQ ID NO: 1088873 - RNA, 19 nt, Homo sapiens
ccaccagcccuauggaauu

SEQ ID NO: 1088874 - RNA, 19 nt, Homo sapiens
caaacucuuccuuguggua

SEQ ID NO: 1088875 - RNA, 19 nt, Homo sapiens
cugcagaugucgugugugu

SEQ ID NO: 1088876 - RNA, 19 nt, Homo sapiens
acaagaaaguucccaccau

SEQ ID NO: 1088877 - RNA, 19 nt, Homo sapiens
aagaaacucgucaugcuaa

SEQ ID NO: 1088878 - RNA, 19 nt, Homo sapiens
gacgccagcucgaagaaca

SEQ ID NO: 1088879 - RNA, 19 nt, Homo sapiens
guaaauacaguaguuccuu

SEQ ID NO: 1088880 - RNA, 19 nt, Homo sapiens
agcccaagcucaagccuuu

SEQ ID NO: 1088881 - RNA, 19 nt, Homo sapiens
gcagauccgggaaguggaa

SEQ ID NO: 1088882 - RNA, 19 nt, Homo sapiens
aaggcaaccuaacaucaaa

SEQ ID NO: 1088883 - RNA, 19 nt, Homo sapiens
ccuaggcuauucagcuuga

SEQ ID NO: 1088884 - RNA, 19 nt, Homo sapiens
agacuccuaucagaaguuu

SEQ ID NO: 1088885 - RNA, 19 nt, Homo sapiens
uggaagaggacuuggauga

SEQ ID NO: 1088886 - RNA, 19 nt, Homo sapiens
ugaagcgguuuaaaguuuc

SEQ ID NO: 1088887 - RNA, 19 nt, Homo sapiens
aggcagugaugauccauug

SEQ ID NO: 1088888 - RNA, 19 nt, Homo sapiens
ccacccaugucaagcacuu

SEQ ID NO: 1088889 - RNA, 19 nt, Homo sapiens
gcaagaaaccccgagaaaa

SEQ ID NO: 1088890 - RNA, 19 nt, Homo sapiens
gcauaaguucccugaugaa

SEQ ID NO: 1088891 - RNA, 19 nt, Homo sapiens
gaugcagcccucccagaaa

SEQ ID NO: 1088892 - RNA, 19 nt, Homo sapiens
acgaagaucuccggaaagu

SEQ ID NO: 1088893 - RNA, 19 nt, Homo sapiens
gagcuccaauuaaccuucu

SEQ ID NO: 1088894 - RNA, 19 nt, Homo sapiens
cgaguggagugacaucaag

SEQ ID NO: 1088895 - RNA, 19 nt, Homo sapiens
cuaagagccaggucauuga

SEQ ID NO: 1088896 - RNA, 19 nt, Homo sapiens
agaaacucgucaugcuaaa

SEQ ID NO: 1088897 - RNA, 19 nt, Homo sapiens
gaauuggcugcucuagaaa

SEQ ID NO: 1088898 - RNA, 19 nt, Homo sapiens
caagcucaagccuuucuuu

SEQ ID NO: 1088899 - RNA, 19 nt, Homo sapiens
cagaugaggugggcuuugg

SEQ ID NO: 1088900 - RNA, 19 nt, Homo sapiens
ggcaggacuuguucuacga

SEQ ID NO: 1088901 - RNA, 19 nt, Homo sapiens
acaauuauucugaggaaga

SEQ ID NO: 1088902 - RNA, 19 nt, Homo sapiens
cugaguugauguuggguuu

SEQ ID NO: 1088903 - RNA, 19 nt, Homo sapiens
cgaagaacacccucaagag

SEQ ID NO: 1088904 - RNA, 19 nt, Homo sapiens
gaacaugacuucccuaaaa

SEQ ID NO: 1088905 - RNA, 19 nt, Homo sapiens
caagaaagauauuccaaug

SEQ ID NO: 1088906 - RNA, 19 nt, Homo sapiens
gaagaaagcuagagaugcu

SEQ ID NO: 1088907 - RNA, 19 nt, Homo sapiens
gaagcaaaguugacauuuc

SEQ ID NO: 1088908 - RNA, 19 nt, Homo sapiens
acaaagggaucuuccagua

SEQ ID NO: 1088909 - RNA, 19 nt, Homo sapiens
gaagaguauuggaacauga

SEQ ID NO: 1088910 - RNA, 19 nt, Homo sapiens
gacaagaggucaagcaauc

SEQ ID NO: 1088911 - RNA, 19 nt, Homo sapiens
gaauagaucccaaagacuu

SEQ ID NO: 1088912 - RNA, 19 nt, Homo sapiens
gcgaagugguguuugaauu

SEQ ID NO: 1088913 - RNA, 19 nt, Homo sapiens
cgaagugguguuugaauua

SEQ ID NO: 1088914 - RNA, 19 nt, Homo sapiens
gcacgcagccugagugaga

SEQ ID NO: 1088915 - RNA, 19 nt, Homo sapiens
ucagcuagaucgaagagua

SEQ ID NO: 1088916 - RNA, 19 nt, Homo sapiens
uaaacuggcuucagcuaga

SEQ ID NO: 1088917 - RNA, 19 nt, Homo sapiens
caguaugacuaccaugaua

SEQ ID NO: 1088918 - RNA, 19 nt, Homo sapiens
aaagggaucuuccaguaug

SEQ ID NO: 1088919 - RNA, 19 nt, Homo sapiens
gaagugguguuugaauuag

SEQ ID NO: 1088920 - RNA, 19 nt, Homo sapiens
gaagcuggaacuccuagua

SEQ ID NO: 1088921 - RNA, 19 nt, Homo sapiens
caaaugcgaaucugagaaa

SEQ ID NO: 1088922 - RNA, 19 nt, Homo sapiens
gaaagcagaguaaguccaa

SEQ ID NO: 1088923 - RNA, 19 nt, Homo sapiens
gucaagcaaucguaaacua

SEQ ID NO: 1088924 - RNA, 19 nt, Homo sapiens
caaaccacaucuugacuca

SEQ ID NO: 1088925 - RNA, 19 nt, Homo sapiens
ugacuaccaugauaaagug

SEQ ID NO: 1088926 - RNA, 19 nt, Homo sapiens
gaugaaacgggacacuuaa

SEQ ID NO: 1088927 - RNA, 19 nt, Homo sapiens
acacacagcuguacaccau

SEQ ID NO: 1088928 - RNA, 19 nt, Homo sapiens
gagaagcaaaguugacauu

SEQ ID NO: 1088929 - RNA, 19 nt, Homo sapiens
gaaaauuccuuauggaucu

SEQ ID NO: 1088930 - RNA, 19 nt, Homo sapiens
ccucgaagcuggccaacau

SEQ ID NO: 1088931 - RNA, 19 nt, Homo sapiens
gaacacacacacacacaca

SEQ ID NO: 1088932 - RNA, 19 nt, Homo sapiens
ggaguacuuuggaauagca

SEQ ID NO: 1088933 - RNA, 19 nt, Homo sapiens
ccgaauagaucccaaagac

SEQ ID NO: 1088934 - RNA, 19 nt, Homo sapiens
uccaggagaccauaacuua

SEQ ID NO: 1088935 - RNA, 19 nt, Homo sapiens
ugacucagauggucgaaag

SEQ ID NO: 1088936 - RNA, 19 nt, Homo sapiens
aaagugaagccaagaaaga

SEQ ID NO: 1088937 - RNA, 19 nt, Homo sapiens
aagcaaaguugacauuucu

SEQ ID NO: 1088938 - RNA, 19 nt, Homo sapiens
gcuucucacuucaaucuga

SEQ ID NO: 1088939 - RNA, 19 nt, Homo sapiens
ucauugagcacuacaagaa

SEQ ID NO: 1088940 - RNA, 19 nt, Homo sapiens
agaugaaacgggacacuua

SEQ ID NO: 1088941 - RNA, 19 nt, Homo sapiens
aaccacaucuugacucaga

SEQ ID NO: 1088942 - RNA, 19 nt, Homo sapiens
gaaaacugcucccaggaau

SEQ ID NO: 1088943 - RNA, 19 nt, Homo sapiens
ggagugacuugaagaagcu

SEQ ID NO: 1088944 - RNA, 19 nt, Homo sapiens
cgaagaguauuggaacaug

SEQ ID NO: 1088945 - RNA, 19 nt, Homo sapiens
ugagugagaucgccaucga

SEQ ID NO: 1088946 - RNA, 19 nt, Homo sapiens
gauaaagugaagccaagaa

SEQ ID NO: 1088947 - RNA, 19 nt, Homo sapiens
caaagggaucuuccaguau

SEQ ID NO: 1088948 - RNA, 19 nt, Homo sapiens
acagcgaagugguguuuga

SEQ ID NO: 1088949 - RNA, 19 nt, Homo sapiens
gcgaaguccugcaucuaca

SEQ ID NO: 1088950 - RNA, 19 nt, Homo sapiens
ugugucagguucuauauag

SEQ ID NO: 1088951 - RNA, 19 nt, Homo sapiens
caauggagacaguuggaaa

SEQ ID NO: 1088952 - RNA, 19 nt, Homo sapiens
caaggagcuuauugacguu

SEQ ID NO: 1088953 - RNA, 19 nt, Homo sapiens
acgcagggcuucagugaca

SEQ ID NO: 1088954 - RNA, 19 nt, Homo sapiens
gcagaacuugggcugguuu

SEQ ID NO: 1088955 - RNA, 19 nt, Homo sapiens
gaaacgggacacuuaaacu

SEQ ID NO: 1088956 - RNA, 19 nt, Homo sapiens
guaugacuaccaugauaaa

SEQ ID NO: 1088957 - RNA, 19 nt, Homo sapiens
gaaggacaagcagggcaua

SEQ ID NO: 1088958 - RNA, 19 nt, Homo sapiens
gauggaagaaagcuagaga

SEQ ID NO: 1088959 - RNA, 19 nt, Homo sapiens
acagagucauugagcacua

SEQ ID NO: 1088960 - RNA, 19 nt, Homo sapiens
ccacgcagggcuucaguga

SEQ ID NO: 1088961 - RNA, 19 nt, Homo sapiens
ccaagaaagauauuccaau

SEQ ID NO: 1088962 - RNA, 19 nt, Homo sapiens
ccuacgggguucacuauua

SEQ ID NO: 1088963 - RNA, 19 nt, Homo sapiens
gcaaucguaaacuacauga

SEQ ID NO: 1088964 - RNA, 19 nt, Homo sapiens
ugacagcgaagugguguuu

SEQ ID NO: 1088965 - RNA, 19 nt, Homo sapiens
ccuuguggcuucucacuuc

SEQ ID NO: 1088966 - RNA, 19 nt, Homo sapiens
gauccaaaugcgaaucuga

SEQ ID NO: 1088967 - RNA, 19 nt, Homo sapiens
gcacacgugguaugcaugu

SEQ ID NO: 1088968 - RNA, 19 nt, Homo sapiens
aaccuguacuucagagaaa

SEQ ID NO: 1088969 - RNA, 19 nt, Homo sapiens
aaacugcucccaggaauca

SEQ ID NO: 1088970 - RNA, 19 nt, Homo sapiens
gagaaggcgcagcguugaa

SEQ ID NO: 1088971 - RNA, 19 nt, Homo sapiens
gcagugcacacgugguaug

SEQ ID NO: 1088972 - RNA, 19 nt, Homo sapiens
gugaagacagagucauuga

SEQ ID NO: 1088973 - RNA, 19 nt, Homo sapiens
ucccaggaaucaaauagug

SEQ ID NO: 1088974 - RNA, 19 nt, Homo sapiens
ucaaguccaucugggcuau

SEQ ID NO: 1088975 - RNA, 19 nt, Homo sapiens
gacagaaagcagaguaagu

SEQ ID NO: 1088976 - RNA, 19 nt, Homo sapiens
ggacagaaagcagaguaag

SEQ ID NO: 1088977 - RNA, 19 nt, Homo sapiens
gugaagccaagaaagauau

SEQ ID NO: 1088978 - RNA, 19 nt, Homo sapiens
ggacaagcagggcauacca

SEQ ID NO: 1088979 - RNA, 19 nt, Homo sapiens
caagcaaucguaaacuaca

SEQ ID NO: 1088980 - RNA, 19 nt, Homo sapiens
gagcacuacaagaaacuga

SEQ ID NO: 1088981 - RNA, 19 nt, Homo sapiens
ccauugagcuuuucuuucu

SEQ ID NO: 1088982 - RNA, 19 nt, Homo sapiens
ccaaaugcgaaucugagaa

SEQ ID NO: 1088983 - RNA, 19 nt, Homo sapiens
ccacgagaagcaaaguuga

SEQ ID NO: 1088984 - RNA, 19 nt, Homo sapiens
aaacgggacacuuaaacug

SEQ ID NO: 1088985 - RNA, 19 nt, Homo sapiens
ugacaaaccacaucuugac

SEQ ID NO: 1088986 - RNA, 19 nt, Homo sapiens
aaaccuguacuucagagaa

SEQ ID NO: 1088987 - RNA, 19 nt, Homo sapiens
gccaacaccaguucuaucu

SEQ ID NO: 1088988 - RNA, 19 nt, Homo sapiens
uaagccaacaccaguucua

SEQ ID NO: 1088989 - RNA, 19 nt, Homo sapiens
gccacgagaagcaaaguug

SEQ ID NO: 1088990 - RNA, 19 nt, Homo sapiens
gcaguggcuccgaauagau

SEQ ID NO: 1088991 - RNA, 19 nt, Homo sapiens
cagagggacagauggaaga

SEQ ID NO: 1088992 - RNA, 19 nt, Homo sapiens
acagaaagcagaguaaguc

SEQ ID NO: 1088993 - RNA, 19 nt, Homo sapiens
gcauugaucaaguccaucu

SEQ ID NO: 1088994 - RNA, 19 nt, Homo sapiens
gaucuuccaguaugacuac

SEQ ID NO: 1088995 - RNA, 19 nt, Homo sapiens
gaggucaagcaaucguaaa

SEQ ID NO: 1088996 - RNA, 19 nt, Homo sapiens
aaacuggcuucagcuagau

SEQ ID NO: 1088997 - RNA, 19 nt, Homo sapiens
aaggaguacuuuggaauag

SEQ ID NO: 1088998 - RNA, 19 nt, Homo sapiens
ccugacaaaccacaucuug

SEQ ID NO: 1088999 - RNA, 19 nt, Homo sapiens
cauaagccaacaccaguuc

SEQ ID NO: 1089000 - RNA, 19 nt, Homo sapiens
cggcauugaucaaguccau

SEQ ID NO: 1089001 - RNA, 19 nt, Homo sapiens
ugacaaggaggacguuugg

SEQ ID NO: 1089002 - RNA, 19 nt, Homo sapiens
uaaagugaagccaagaaag

SEQ ID NO: 1089003 - RNA, 19 nt, Homo sapiens
cgugggcgcugaaguugca

SEQ ID NO: 1089004 - RNA, 19 nt, Homo sapiens
gaacugagcucgccaagaa

SEQ ID NO: 1089005 - RNA, 19 nt, Homo sapiens
gagagaagcuugaucaguu

SEQ ID NO: 1089006 - RNA, 19 nt, Homo sapiens
gaggaagaauacagaaauu

SEQ ID NO: 1089007 - RNA, 19 nt, Homo sapiens
ggaaaucagugcggaaguu

SEQ ID NO: 1089008 - RNA, 19 nt, Homo sapiens
gcgcauggauuuaggagaa

SEQ ID NO: 1089009 - RNA, 19 nt, Homo sapiens
guacaugaguuaaaugaag

SEQ ID NO: 1089010 - RNA, 19 nt, Homo sapiens
ugaauuagaugcaauggau

SEQ ID NO: 1089011 - RNA, 19 nt, Homo sapiens
ggagugagcccuucucugu

SEQ ID NO: 1089012 - RNA, 19 nt, Homo sapiens
gaagugcgaaauacaagua

SEQ ID NO: 1089013 - RNA, 19 nt, Homo sapiens
agacagagggucaaguuua

SEQ ID NO: 1089014 - RNA, 19 nt, Homo sapiens
ggacucaggugugggaaga

SEQ ID NO: 1089015 - RNA, 19 nt, Homo sapiens
uaaagaaagagaccuguuu

SEQ ID NO: 1089016 - RNA, 19 nt, Homo sapiens
ggaaaacugucgcugaaaa

SEQ ID NO: 1089017 - RNA, 19 nt, Homo sapiens
ccgagcagauuaugagauu

SEQ ID NO: 1089018 - RNA, 19 nt, Homo sapiens
gaaaucagugcggaaguuu

SEQ ID NO: 1089019 - RNA, 19 nt, Homo sapiens
gugcggaaguuucugcaaa

SEQ ID NO: 1089020 - RNA, 19 nt, Homo sapiens
ggaccgaagugcgaaauac

SEQ ID NO: 1089021 - RNA, 19 nt, Homo sapiens
aaaagaagcugaggaagaa

SEQ ID NO: 1089022 - RNA, 19 nt, Homo sapiens
gacagagggucaaguuuac

SEQ ID NO: 1089023 - RNA, 19 nt, Homo sapiens
gauugcaaguaaagaaaga

SEQ ID NO: 1089024 - RNA, 19 nt, Homo sapiens
gagauugcaaguaaagaaa

SEQ ID NO: 1089025 - RNA, 19 nt, Homo sapiens
gggcucacccucaggagua

SEQ ID NO: 1089026 - RNA, 19 nt, Homo sapiens
gaggaaaacugucgcugaa

SEQ ID NO: 1089027 - RNA, 19 nt, Homo sapiens
gggucaaguuuacagauga

SEQ ID NO: 1089028 - RNA, 19 nt, Homo sapiens
cggaggcggucaagaucua

SEQ ID NO: 1089029 - RNA, 19 nt, Homo sapiens
agagaagcuugaucaguug

SEQ ID NO: 1089030 - RNA, 19 nt, Homo sapiens
ucacuuggaguccuuuauu

SEQ ID NO: 1089031 - RNA, 19 nt, Homo sapiens
gugcauauaguguuguauu

SEQ ID NO: 1089032 - RNA, 19 nt, Homo sapiens
gaacgggaggagcgucuga

SEQ ID NO: 1089033 - RNA, 19 nt, Homo sapiens
ccagacagagggucaaguu

SEQ ID NO: 1089034 - RNA, 19 nt, Homo sapiens
guaaagaaagagaccuguu

SEQ ID NO: 1089035 - RNA, 19 nt, Homo sapiens
gucauguucugugcauaua

SEQ ID NO: 1089036 - RNA, 19 nt, Homo sapiens
cagaguggcugagacuugu

SEQ ID NO: 1089037 - RNA, 19 nt, Homo sapiens
cgagagcgacggaaauugu

SEQ ID NO: 1089038 - RNA, 19 nt, Homo sapiens
gcagaaacacaggaggaaa

SEQ ID NO: 1089039 - RNA, 19 nt, Homo sapiens
uagaugcaauggaucacuu

SEQ ID NO: 1089040 - RNA, 19 nt, Homo sapiens
ggacgcgcauggauuuagg

SEQ ID NO: 1089041 - RNA, 19 nt, Homo sapiens
ugaggaagaauacagaaau

SEQ ID NO: 1089042 - RNA, 19 nt, Homo sapiens
ccuuugcacuguuuauguu

SEQ ID NO: 1089043 - RNA, 19 nt, Homo sapiens
aagaagcugaggaagaaua

SEQ ID NO: 1089044 - RNA, 19 nt, Homo sapiens
cagaaacacaggaggaaau

SEQ ID NO: 1089045 - RNA, 19 nt, Homo sapiens
ugagauugcaaguaaagaa

SEQ ID NO: 1089046 - RNA, 19 nt, Homo sapiens
gauuaugagauugcaagua

SEQ ID NO: 1089047 - RNA, 19 nt, Homo sapiens
cauauaguguuguauucuc

SEQ ID NO: 1089048 - RNA, 19 nt, Homo sapiens
aagguaauguggaugaauc

SEQ ID NO: 1089049 - RNA, 19 nt, Homo sapiens
cacuuggaguccuuuauug

SEQ ID NO: 1089050 - RNA, 19 nt, Homo sapiens
cauguucugugcauauagu

SEQ ID NO: 1089051 - RNA, 19 nt, Homo sapiens
gaagguaauguggaugaau

SEQ ID NO: 1089052 - RNA, 19 nt, Homo sapiens
gcauggauuuaggagaaug

SEQ ID NO: 1089053 - RNA, 19 nt, Homo sapiens
gaaaacuccuugcuaaagc

SEQ ID NO: 1089054 - RNA, 19 nt, Homo sapiens
ggagacgaaaccagacaga

SEQ ID NO: 1089055 - RNA, 19 nt, Homo sapiens
ggaguccuuuauugcugaa

SEQ ID NO: 1089056 - RNA, 19 nt, Homo sapiens
agugagcccuucucugugu

SEQ ID NO: 1089057 - RNA, 19 nt, Homo sapiens
ucauucagauccgagagaa

SEQ ID NO: 1089058 - RNA, 19 nt, Homo sapiens
agaagcggcuggcagaaac

SEQ ID NO: 1089059 - RNA, 19 nt, Homo sapiens
gaucacuuggaguccuuua

SEQ ID NO: 1089060 - RNA, 19 nt, Homo sapiens
gaaaucaggaucgcuugag

SEQ ID NO: 1089061 - RNA, 19 nt, Homo sapiens
ugaagguaauguggaugaa

SEQ ID NO: 1089062 - RNA, 19 nt, Homo sapiens
gcuaggggcugaagguaau

SEQ ID NO: 1089063 - RNA, 19 nt, Homo sapiens
guaacuacucugacuccuu

SEQ ID NO: 1089064 - RNA, 19 nt, Homo sapiens
gagcagauuaugagauugc

SEQ ID NO: 1089065 - RNA, 19 nt, Homo sapiens
gcugggacgcgcauggauu

SEQ ID NO: 1089066 - RNA, 19 nt, Homo sapiens
gagaagcuugaucaguuga

SEQ ID NO: 1089067 - RNA, 19 nt, Homo sapiens
gcauauaguguuguauucu

SEQ ID NO: 1089068 - RNA, 19 nt, Homo sapiens
guaccaaaauccacgacuu

SEQ ID NO: 1089069 - RNA, 19 nt, Homo sapiens
gggaccgaagugcgaaaua

SEQ ID NO: 1089070 - RNA, 19 nt, Homo sapiens
ggagaagagaaaucaggau

SEQ ID NO: 1089071 - RNA, 19 nt, Homo sapiens
ugcuaaagccgaacagcua

SEQ ID NO: 1089072 - RNA, 19 nt, Homo sapiens
ggaaaacuccuugcuaaag

SEQ ID NO: 1089073 - RNA, 19 nt, Homo sapiens
gaaacacaggaggaaauca

SEQ ID NO: 1089074 - RNA, 19 nt, Homo sapiens
gaaugugaucggagaacug

SEQ ID NO: 1089075 - RNA, 19 nt, Homo sapiens
gaccgaagugcgaaauaca

SEQ ID NO: 1089076 - RNA, 19 nt, Homo sapiens
cgucggaggcggucaagau

SEQ ID NO: 1089077 - RNA, 19 nt, Homo sapiens
caggaggucgggaucaaga

SEQ ID NO: 1089078 - RNA, 19 nt, Homo sapiens
ugcauauaguguuguauuc

SEQ ID NO: 1089079 - RNA, 19 nt, Homo sapiens
gaaaagcaggagaagagaa

SEQ ID NO: 1089080 - RNA, 19 nt, Homo sapiens
ggcugaagguaauguggau

SEQ ID NO: 1089081 - RNA, 19 nt, Homo sapiens
aguguuguauucuccuuug

SEQ ID NO: 1089082 - RNA, 19 nt, Homo sapiens
cgagagaagcuugaucagu

SEQ ID NO: 1089083 - RNA, 19 nt, Homo sapiens
gaugaccgugucugcaaga

SEQ ID NO: 1089084 - RNA, 19 nt, Homo sapiens
cagacagagggucaaguuu

SEQ ID NO: 1089085 - RNA, 19 nt, Homo sapiens
guucugugcauauaguguu

SEQ ID NO: 1089086 - RNA, 19 nt, Homo sapiens
uuuaggagaauguaccaaa

SEQ ID NO: 1089087 - RNA, 19 nt, Homo sapiens
aagaagcggcuggcagaaa

SEQ ID NO: 1089088 - RNA, 19 nt, Homo sapiens
ugucauguucugugcauau

SEQ ID NO: 1089089 - RNA, 19 nt, Homo sapiens
agggucaaguuuacagaug

SEQ ID NO: 1089090 - RNA, 19 nt, Homo sapiens
gcugaggaagaauacagaa

SEQ ID NO: 1089091 - RNA, 19 nt, Homo sapiens
ggcagaaacacaggaggaa

SEQ ID NO: 1089092 - RNA, 19 nt, Homo sapiens
guccuuuauugcugaaugu

SEQ ID NO: 1089093 - RNA, 19 nt, Homo sapiens
gcgcagaggccaucaauuu

SEQ ID NO: 1089094 - RNA, 19 nt, Homo sapiens
gaagaauccugagcuuuga

SEQ ID NO: 1089095 - RNA, 19 nt, Homo sapiens
cagaggacauggaccuuua

SEQ ID NO: 1089096 - RNA, 19 nt, Homo sapiens
caguagaguuccagaauaa

SEQ ID NO: 1089097 - RNA, 19 nt, Homo sapiens
ugaugaaacugguuacauu

SEQ ID NO: 1089098 - RNA, 19 nt, Homo sapiens
ccacugcccugcuguguga

SEQ ID NO: 1089099 - RNA, 19 nt, Homo sapiens
ucaguagaguuccagaaua

SEQ ID NO: 1089100 - RNA, 19 nt, Homo sapiens
ccagaaggaaguccaguua

SEQ ID NO: 1089101 - RNA, 19 nt, Homo sapiens
gaaacugguuacauuuaca

SEQ ID NO: 1089102 - RNA, 19 nt, Homo sapiens
gaugaaacugguuacauuu

SEQ ID NO: 1089103 - RNA, 19 nt, Homo sapiens
ggaagcugcugcacuugug

SEQ ID NO: 1089104 - RNA, 19 nt, Homo sapiens
gauaaggucaguagaguuc

SEQ ID NO: 1089105 - RNA, 19 nt, Homo sapiens
ggaaugucuuuggauauug

SEQ ID NO: 1089106 - RNA, 19 nt, Homo sapiens
ucaggaggcuggagaguuc

SEQ ID NO: 1089107 - RNA, 19 nt, Homo sapiens
ugaagaauccugagcuuug

SEQ ID NO: 1089108 - RNA, 19 nt, Homo sapiens
ccuggaaugucuuuggaua

SEQ ID NO: 1089109 - RNA, 19 nt, Homo sapiens
gagcuuugauuccucuuca

SEQ ID NO: 1089110 - RNA, 19 nt, Homo sapiens
uggaaugucuuuggauauu

SEQ ID NO: 1089111 - RNA, 19 nt, Homo sapiens
acuaaacaauggaaucuug

SEQ ID NO: 1089112 - RNA, 19 nt, Homo sapiens
uccacgggcugucuuuaua

SEQ ID NO: 1089113 - RNA, 19 nt, Homo sapiens
caucaguggcuccuuguuu

SEQ ID NO: 1089114 - RNA, 19 nt, Homo sapiens
cugcugcacuugugaagaa

SEQ ID NO: 1089115 - RNA, 19 nt, Homo sapiens
cagauaaggucaguagagu

SEQ ID NO: 1089116 - RNA, 19 nt, Homo sapiens
uguggaagcugcugcacuu

SEQ ID NO: 1089117 - RNA, 19 nt, Homo sapiens
ugaaacugguuacauuuac

SEQ ID NO: 1089118 - RNA, 19 nt, Homo sapiens
gagaguucauggugaccuu

SEQ ID NO: 1089119 - RNA, 19 nt, Homo sapiens
gauaugacuuuucugaguu

SEQ ID NO: 1089120 - RNA, 19 nt, Homo sapiens
gaaugucuuuggauauugc

SEQ ID NO: 1089121 - RNA, 19 nt, Homo sapiens
cauagaaggcgucaauaca

SEQ ID NO: 1089122 - RNA, 19 nt, Homo sapiens
ccucuucagucuacgcauu

SEQ ID NO: 1089123 - RNA, 19 nt, Homo sapiens
agaacuaggucuuguugag

SEQ ID NO: 1089124 - RNA, 19 nt, Homo sapiens
gcuaugaccuguggaaacg

SEQ ID NO: 1089125 - RNA, 19 nt, Homo sapiens
caaaauggccucccagugu

SEQ ID NO: 1089126 - RNA, 19 nt, Homo sapiens
aaaauggccucccagugua

SEQ ID NO: 1089127 - RNA, 19 nt, Homo sapiens
gcacaagguggcccucauc

SEQ ID NO: 1089128 - RNA, 19 nt, Homo sapiens
gauuuauggugcugacauc

SEQ ID NO: 1089129 - RNA, 19 nt, Homo sapiens
ccaaguccaugguaguuuu

SEQ ID NO: 1089130 - RNA, 19 nt, Homo sapiens
ccugcaaccugaacgcuau

SEQ ID NO: 1089131 - RNA, 19 nt, Homo sapiens
cuacaguucucaaggaaaa

SEQ ID NO: 1089132 - RNA, 19 nt, Homo sapiens
acuagguucuuuauacaga

SEQ ID NO: 1089133 - RNA, 19 nt, Homo sapiens
ugaaaacacuaaacaaugg

SEQ ID NO: 1089134 - RNA, 19 nt, Homo sapiens
cgcgauggauugauuaugg

SEQ ID NO: 1089135 - RNA, 19 nt, Homo sapiens
gccuacaguucucaaggaa

SEQ ID NO: 1089136 - RNA, 19 nt, Homo sapiens
ggcacaacaugcacagcuu

SEQ ID NO: 1089137 - RNA, 19 nt, Homo sapiens
ugagaacuaggucuuguug

SEQ ID NO: 1089138 - RNA, 19 nt, Homo sapiens
acauggaccuuuacagcau

SEQ ID NO: 1089139 - RNA, 19 nt, Homo sapiens
gaagcugcugcacuuguga

SEQ ID NO: 1089140 - RNA, 19 nt, Homo sapiens
acuccgcgauggauugauu

SEQ ID NO: 1089141 - RNA, 19 nt, Homo sapiens
gcagaggccaucaauuuug

SEQ ID NO: 1089142 - RNA, 19 nt, Homo sapiens
ugucauagaaggcgucaau

SEQ ID NO: 1089143 - RNA, 19 nt, Homo sapiens
gcaggacucuaggcaugca

SEQ ID NO: 1089144 - RNA, 19 nt, Homo sapiens
ccacgggcugucuuuauau

SEQ ID NO: 1089145 - RNA, 19 nt, Homo sapiens
gugaagaauccugagcuuu

SEQ ID NO: 1089146 - RNA, 19 nt, Homo sapiens
gacaagccuguaccacuga

SEQ ID NO: 1089147 - RNA, 19 nt, Homo sapiens
gcaagaccgggcaguugug

SEQ ID NO: 1089148 - RNA, 19 nt, Homo sapiens
ggaaugugggguugucaua

SEQ ID NO: 1089149 - RNA, 19 nt, Homo sapiens
gcccucaucucgccuacag

SEQ ID NO: 1089150 - RNA, 19 nt, Homo sapiens
ugugaagaauccugagcuu

SEQ ID NO: 1089151 - RNA, 19 nt, Homo sapiens
acucuaggcaugcaugaaa

SEQ ID NO: 1089152 - RNA, 19 nt, Homo sapiens
ggacucuaggcaugcauga

SEQ ID NO: 1089153 - RNA, 19 nt, Homo sapiens
gcuccagcauccugucaag

SEQ ID NO: 1089154 - RNA, 19 nt, Homo sapiens
cauggugaccuuucccuau

SEQ ID NO: 1089155 - RNA, 19 nt, Homo sapiens
ccucaucucgccuacaguu

SEQ ID NO: 1089156 - RNA, 19 nt, Homo sapiens
gcugagcacccagaaggaa

SEQ ID NO: 1089157 - RNA, 19 nt, Homo sapiens
ggcaagaccgggcaguugu

SEQ ID NO: 1089158 - RNA, 19 nt, Homo sapiens
cgccuacaguucucaagga

SEQ ID NO: 1089159 - RNA, 19 nt, Homo sapiens
auacagauaaggucaguag

SEQ ID NO: 1089160 - RNA, 19 nt, Homo sapiens
ugauuccucuucagucuac

SEQ ID NO: 1089161 - RNA, 19 nt, Homo sapiens
acacccuacuuguacuuug

SEQ ID NO: 1089162 - RNA, 19 nt, Homo sapiens
cagauuauccacccgucaa

SEQ ID NO: 1089163 - RNA, 19 nt, Homo sapiens
gucaauacacccuacuugu

SEQ ID NO: 1089164 - RNA, 19 nt, Homo sapiens
gagaacuaggucuuguuga

SEQ ID NO: 1089165 - RNA, 19 nt, Homo sapiens
ccaugguaguuuucaauuu

SEQ ID NO: 1089166 - RNA, 19 nt, Homo sapiens
cgucaauacacccuacuug

SEQ ID NO: 1089167 - RNA, 19 nt, Homo sapiens
aucaguggcuccuuguuug

SEQ ID NO: 1089168 - RNA, 19 nt, Homo sapiens
gggcaccugggaacaauuc

SEQ ID NO: 1089169 - RNA, 19 nt, Homo sapiens
gucaguagaguuccagaau

SEQ ID NO: 1089170 - RNA, 19 nt, Homo sapiens
guggcuccuuguuugauga

SEQ ID NO: 1089171 - RNA, 19 nt, Homo sapiens
gugugacaguuugaugaaa

SEQ ID NO: 1089172 - RNA, 19 nt, Homo sapiens
aagcccagcucaacuccau

SEQ ID NO: 1089173 - RNA, 19 nt, Homo sapiens
cuaccaugcuggcuucaac

SEQ ID NO: 1089174 - RNA, 19 nt, Homo sapiens
guagaguuccagaauaaaa

SEQ ID NO: 1089175 - RNA, 19 nt, Homo sapiens
ggucaguagaguuccagaa

SEQ ID NO: 1089176 - RNA, 19 nt, Homo sapiens
gucuuuggauauugcuaaa

SEQ ID NO: 1089177 - RNA, 19 nt, Homo sapiens
cuaagaagcccagcucaac

SEQ ID NO: 1089178 - RNA, 19 nt, Homo sapiens
ucauagaaggcgucaauac

SEQ ID NO: 1089179 - RNA, 19 nt, Homo sapiens
ugugagaacuaggucuugu

SEQ ID NO: 1089180 - RNA, 19 nt, Homo sapiens
gccaaguccaugguaguuu

SEQ ID NO: 1089181 - RNA, 19 nt, Homo sapiens
auggauugauuauggcaaa

SEQ ID NO: 1089182 - RNA, 19 nt, Homo sapiens
uaaggucaguagaguucca

SEQ ID NO: 1089183 - RNA, 19 nt, Homo sapiens
ucaguggcuccuuguuuga

SEQ ID NO: 1089184 - RNA, 19 nt, Homo sapiens
cacgggcugucuuuauauc

SEQ ID NO: 1089185 - RNA, 19 nt, Homo sapiens
uaagaagcccagcucaacu

SEQ ID NO: 1089186 - RNA, 19 nt, Homo sapiens
agaaggaaguccaguuacc

SEQ ID NO: 1089187 - RNA, 19 nt, Homo sapiens
auggugaccuuucccuaug

SEQ ID NO: 1089188 - RNA, 19 nt, Homo sapiens
gggaagaucuuugccuuug

SEQ ID NO: 1089189 - RNA, 19 nt, Homo sapiens
ccgaugauguaguugauua

SEQ ID NO: 1089190 - RNA, 19 nt, Homo sapiens
ccaaggugcuaguguauga

SEQ ID NO: 1089191 - RNA, 19 nt, Homo sapiens
gcacaccgccuugcacaua

SEQ ID NO: 1089192 - RNA, 19 nt, Homo sapiens
agacagaucugcaugaaca

SEQ ID NO: 1089193 - RNA, 19 nt, Homo sapiens
caucuaacaucuacacuuc

SEQ ID NO: 1089194 - RNA, 19 nt, Homo sapiens
ggaagaucuuugccuuuga

SEQ ID NO: 1089195 - RNA, 19 nt, Homo sapiens
gacaagguuucuccuauca

SEQ ID NO: 1089196 - RNA, 19 nt, Homo sapiens
gaaagaagagacagcaaag

SEQ ID NO: 1089197 - RNA, 19 nt, Homo sapiens
gaaccaagggaagaucuuu

SEQ ID NO: 1089198 - RNA, 19 nt, Homo sapiens
gcaauaagaccagucacuu

SEQ ID NO: 1089199 - RNA, 19 nt, Homo sapiens
ggaaugaggaccuguugga

SEQ ID NO: 1089200 - RNA, 19 nt, Homo sapiens
ucacuuggcugcucuucug

SEQ ID NO: 1089201 - RNA, 19 nt, Homo sapiens
gaccugcuccgaugaugua

SEQ ID NO: 1089202 - RNA, 19 nt, Homo sapiens
gaagaucuuugccuuugac

SEQ ID NO: 1089203 - RNA, 19 nt, Homo sapiens
gcuaguguaugaguuguug

SEQ ID NO: 1089204 - RNA, 19 nt, Homo sapiens
caaagcaucagcaccagaa

SEQ ID NO: 1089205 - RNA, 19 nt, Homo sapiens
caauaagaccagucacuug

SEQ ID NO: 1089206 - RNA, 19 nt, Homo sapiens
cuucuucguugcuguaauu

SEQ ID NO: 1089207 - RNA, 19 nt, Homo sapiens
guuauugggucccuuccuu

SEQ ID NO: 1089208 - RNA, 19 nt, Homo sapiens
uaacaucuacacuucucua

SEQ ID NO: 1089209 - RNA, 19 nt, Homo sapiens
caucuacacuucucuagcu

SEQ ID NO: 1089210 - RNA, 19 nt, Homo sapiens
cuucguugcuguaauugaa

SEQ ID NO: 1089211 - RNA, 19 nt, Homo sapiens
uggccaaggugcuagugua

SEQ ID NO: 1089212 - RNA, 19 nt, Homo sapiens
agaaagaagagacagcaaa

SEQ ID NO: 1089213 - RNA, 19 nt, Homo sapiens
ccaagcggcuggcauccau

SEQ ID NO: 1089214 - RNA, 19 nt, Homo sapiens
agacaagguuucuccuauc

SEQ ID NO: 1089215 - RNA, 19 nt, Homo sapiens
ccucccagcugccucgauu

SEQ ID NO: 1089216 - RNA, 19 nt, Homo sapiens
gaaugaggaccuguuggaa

SEQ ID NO: 1089217 - RNA, 19 nt, Homo sapiens
cggcacaucuaacaucuac

SEQ ID NO: 1089218 - RNA, 19 nt, Homo sapiens
cagccucgaugacuuacga

SEQ ID NO: 1089219 - RNA, 19 nt, Homo sapiens
ccagcugccucgauuugug

SEQ ID NO: 1089220 - RNA, 19 nt, Homo sapiens
ugccggagcugcugguguu

SEQ ID NO: 1089221 - RNA, 19 nt, Homo sapiens
caaagagaaagaagagaca

SEQ ID NO: 1089222 - RNA, 19 nt, Homo sapiens
gccaggaggagaaugaaga

SEQ ID NO: 1089223 - RNA, 19 nt, Homo sapiens
cugcuccgaugauguaguu

SEQ ID NO: 1089224 - RNA, 19 nt, Homo sapiens
gcaugaacacccacuguac

SEQ ID NO: 1089225 - RNA, 19 nt, Homo sapiens
gcacaucuaacaucuacac

SEQ ID NO: 1089226 - RNA, 19 nt, Homo sapiens
acucagcaguggcuucuuc

SEQ ID NO: 1089227 - RNA, 19 nt, Homo sapiens
gaagaaccaagggaagauc

SEQ ID NO: 1089228 - RNA, 19 nt, Homo sapiens
gagaaagaagagacagcaa

SEQ ID NO: 1089229 - RNA, 19 nt, Homo sapiens
cagcaguggcuucuucguu

SEQ ID NO: 1089230 - RNA, 19 nt, Homo sapiens
gaggugccaaggugaguga

SEQ ID NO: 1089231 - RNA, 19 nt, Homo sapiens
uggcucggcucaagguuca

SEQ ID NO: 1089232 - RNA, 19 nt, Homo sapiens
gcaacuuccagaacgugaa

SEQ ID NO: 1089233 - RNA, 19 nt, Homo sapiens
gcuccgaugauguaguuga

SEQ ID NO: 1089234 - RNA, 19 nt, Homo sapiens
ucuaacaucuacacuucuc

SEQ ID NO: 1089235 - RNA, 19 nt, Homo sapiens
gaacgugaagcagcuguac

SEQ ID NO: 1089236 - RNA, 19 nt, Homo sapiens
augaggaccuguuggaagu

SEQ ID NO: 1089237 - RNA, 19 nt, Homo sapiens
ggugcuaguguaugaguug

SEQ ID NO: 1089238 - RNA, 19 nt, Homo sapiens
gguguacuccagcaacuuc

SEQ ID NO: 1089239 - RNA, 19 nt, Homo sapiens
aagaagagacagcaaagag

SEQ ID NO: 1089240 - RNA, 19 nt, Homo sapiens
ggccaaggugcuaguguau

SEQ ID NO: 1089241 - RNA, 19 nt, Homo sapiens
accaugagguccacuacau

SEQ ID NO: 1089242 - RNA, 19 nt, Homo sapiens
augcagaacguacucuaaa

SEQ ID NO: 1089243 - RNA, 19 nt, Homo sapiens
aaagaagagacagcaaaga

SEQ ID NO: 1089244 - RNA, 19 nt, Homo sapiens
caagaccugcuccgaugau

SEQ ID NO: 1089245 - RNA, 19 nt, Homo sapiens
gcuggugagcaaaguguug

SEQ ID NO: 1089246 - RNA, 19 nt, Homo sapiens
gggaagaucuuugccuuug

SEQ ID NO: 1089247 - RNA, 19 nt, Homo sapiens
ccgaugauguaguugauua

SEQ ID NO: 1089248 - RNA, 19 nt, Homo sapiens
ccaaggugcuaguguauga

SEQ ID NO: 1089249 - RNA, 19 nt, Homo sapiens
gcacaccgccuugcacaua

SEQ ID NO: 1089250 - RNA, 19 nt, Homo sapiens
agacagaucugcaugaaca

SEQ ID NO: 1089251 - RNA, 19 nt, Homo sapiens
ggaagaucuuugccuuuga

SEQ ID NO: 1089252 - RNA, 19 nt, Homo sapiens
gacaagguuucuccuauca

SEQ ID NO: 1089253 - RNA, 19 nt, Homo sapiens
gaaagaagagacagcaaag

SEQ ID NO: 1089254 - RNA, 19 nt, Homo sapiens
gaaccaagggaagaucuuu

SEQ ID NO: 1089255 - RNA, 19 nt, Homo sapiens
gcaauaagaccagucacuu

SEQ ID NO: 1089256 - RNA, 19 nt, Homo sapiens
ggaaugaggaccuguugga

SEQ ID NO: 1089257 - RNA, 19 nt, Homo sapiens
ucacuuggcugcucuucug

SEQ ID NO: 1089258 - RNA, 19 nt, Homo sapiens
gaccugcuccgaugaugua

SEQ ID NO: 1089259 - RNA, 19 nt, Homo sapiens
gaagaucuuugccuuugac

SEQ ID NO: 1089260 - RNA, 19 nt, Homo sapiens
gcuaguguaugaguuguug

SEQ ID NO: 1089261 - RNA, 19 nt, Homo sapiens
caaagcaucagcaccagaa

SEQ ID NO: 1089262 - RNA, 19 nt, Homo sapiens
caauaagaccagucacuug

SEQ ID NO: 1089263 - RNA, 19 nt, Homo sapiens
cuucuucguugcuguaauu

SEQ ID NO: 1089264 - RNA, 19 nt, Homo sapiens
guuauugggucccuuccuu

SEQ ID NO: 1089265 - RNA, 19 nt, Homo sapiens
cuucguugcuguaauugaa

SEQ ID NO: 1089266 - RNA, 19 nt, Homo sapiens
uggccaaggugcuagugua

SEQ ID NO: 1089267 - RNA, 19 nt, Homo sapiens
agaaagaagagacagcaaa

SEQ ID NO: 1089268 - RNA, 19 nt, Homo sapiens
ccaagcggcuggcauccau

SEQ ID NO: 1089269 - RNA, 19 nt, Homo sapiens
agacaagguuucuccuauc

SEQ ID NO: 1089270 - RNA, 19 nt, Homo sapiens
ccucccagcugccucgauu

SEQ ID NO: 1089271 - RNA, 19 nt, Homo sapiens
gaaugaggaccuguuggaa

SEQ ID NO: 1089272 - RNA, 19 nt, Homo sapiens
cagccucgaugacuuacga

SEQ ID NO: 1089273 - RNA, 19 nt, Homo sapiens
ccagcugccucgauuugug

SEQ ID NO: 1089274 - RNA, 19 nt, Homo sapiens
ugccggagcugcugguguu

SEQ ID NO: 1089275 - RNA, 19 nt, Homo sapiens
caaagagaaagaagagaca

SEQ ID NO: 1089276 - RNA, 19 nt, Homo sapiens
gccaggaggagaaugaaga

SEQ ID NO: 1089277 - RNA, 19 nt, Homo sapiens
cugcuccgaugauguaguu

SEQ ID NO: 1089278 - RNA, 19 nt, Homo sapiens
gcaugaacacccacuguac

SEQ ID NO: 1089279 - RNA, 19 nt, Homo sapiens
acucagcaguggcuucuuc

SEQ ID NO: 1089280 - RNA, 19 nt, Homo sapiens
gaagaaccaagggaagauc

SEQ ID NO: 1089281 - RNA, 19 nt, Homo sapiens
gagaaagaagagacagcaa

SEQ ID NO: 1089282 - RNA, 19 nt, Homo sapiens
cagcaguggcuucuucguu

SEQ ID NO: 1089283 - RNA, 19 nt, Homo sapiens
uggcucggcucaagguuca

SEQ ID NO: 1089284 - RNA, 19 nt, Homo sapiens
gcuccgaugauguaguuga

SEQ ID NO: 1089285 - RNA, 19 nt, Homo sapiens
gcaacuuccagaacgugaa

SEQ ID NO: 1089286 - RNA, 19 nt, Homo sapiens
gaacgugaagcagcuguac

SEQ ID NO: 1089287 - RNA, 19 nt, Homo sapiens
augaggaccuguuggaagu

SEQ ID NO: 1089288 - RNA, 19 nt, Homo sapiens
ggugcuaguguaugaguug

SEQ ID NO: 1089289 - RNA, 19 nt, Homo sapiens
aagaagagacagcaaagag

SEQ ID NO: 1089290 - RNA, 19 nt, Homo sapiens
gguguacuccagcaacuuc

SEQ ID NO: 1089291 - RNA, 19 nt, Homo sapiens
ggccaaggugcuaguguau

SEQ ID NO: 1089292 - RNA, 19 nt, Homo sapiens
accaugagguccacuacau

SEQ ID NO: 1089293 - RNA, 19 nt, Homo sapiens
augcagaacguacucuaaa

SEQ ID NO: 1089294 - RNA, 19 nt, Homo sapiens
aaagaagagacagcaaaga

SEQ ID NO: 1089295 - RNA, 19 nt, Homo sapiens
caagaccugcuccgaugau

SEQ ID NO: 1089296 - RNA, 19 nt, Homo sapiens
gcuggugagcaaaguguug

SEQ ID NO: 1089297 - RNA, 19 nt, Homo sapiens
guaaagaacuuccuguaaa

SEQ ID NO: 1089298 - RNA, 19 nt, Homo sapiens
gcugagaaguccuuuaaua

SEQ ID NO: 1089299 - RNA, 19 nt, Homo sapiens
ggauauaacugaauuguag

SEQ ID NO: 1089300 - RNA, 19 nt, Homo sapiens
gcuguaacaugacuaauaa

SEQ ID NO: 1089301 - RNA, 19 nt, Homo sapiens
guaaauaagcugccauuaa

SEQ ID NO: 1089302 - RNA, 19 nt, Homo sapiens
uaaauaagcugccauuaac

SEQ ID NO: 1089303 - RNA, 19 nt, Homo sapiens
gcaguaaauugaagaaugu

SEQ ID NO: 1089304 - RNA, 19 nt, Homo sapiens
gcagaugagugaauuggaa

SEQ ID NO: 1089305 - RNA, 19 nt, Homo sapiens
gaaaggagaguguaagaga

SEQ ID NO: 1089306 - RNA, 19 nt, Homo sapiens
guaaauggccgcagacuga

SEQ ID NO: 1089307 - RNA, 19 nt, Homo sapiens
gagaaguccuuuaauaagu

SEQ ID NO: 1089308 - RNA, 19 nt, Homo sapiens
agaguuacccucccaauua

SEQ ID NO: 1089309 - RNA, 19 nt, Homo sapiens
aaagucagaugucaacaaa

SEQ ID NO: 1089310 - RNA, 19 nt, Homo sapiens
ggaauguccagcagaguua

SEQ ID NO: 1089311 - RNA, 19 nt, Homo sapiens
caacaaagaguacuauaca

SEQ ID NO: 1089312 - RNA, 19 nt, Homo sapiens
ggaagaaagggcacuuaaa

SEQ ID NO: 1089313 - RNA, 19 nt, Homo sapiens
ggagaggaauguccauaca

SEQ ID NO: 1089314 - RNA, 19 nt, Homo sapiens
uaaaggaaucugaccauuu

SEQ ID NO: 1089315 - RNA, 19 nt, Homo sapiens
ugacagccaugcuuuccua

SEQ ID NO: 1089316 - RNA, 19 nt, Homo sapiens
cccaguaaaucuuggaaua

SEQ ID NO: 1089317 - RNA, 19 nt, Homo sapiens
gaagaaagggcacuuaaaa

SEQ ID NO: 1089318 - RNA, 19 nt, Homo sapiens
gaguuacccucccaauuau

SEQ ID NO: 1089319 - RNA, 19 nt, Homo sapiens
cagcccagaucuucucuuu

SEQ ID NO: 1089320 - RNA, 19 nt, Homo sapiens
gaaguccuuuaauaaguug

SEQ ID NO: 1089321 - RNA, 19 nt, Homo sapiens
gaccacacccuacuacaaa

SEQ ID NO: 1089322 - RNA, 19 nt, Homo sapiens
agucagaugucaacaaaga

SEQ ID NO: 1089323 - RNA, 19 nt, Homo sapiens
aaaggaaucugaccauuuu

SEQ ID NO: 1089324 - RNA, 19 nt, Homo sapiens
ugccaaaccugcaguaaau

SEQ ID NO: 1089325 - RNA, 19 nt, Homo sapiens
ugauuuaacucuugaaguc

SEQ ID NO: 1089326 - RNA, 19 nt, Homo sapiens
ugaaugugcucagauguga

SEQ ID NO: 1089327 - RNA, 19 nt, Homo sapiens
gaagaagccucugccaacu

SEQ ID NO: 1089328 - RNA, 19 nt, Homo sapiens
agagagagauuucuaacuc

SEQ ID NO: 1089329 - RNA, 19 nt, Homo sapiens
agagaaagauggaacuaca

SEQ ID NO: 1089330 - RNA, 19 nt, Homo sapiens
gaauauggagagagagauu

SEQ ID NO: 1089331 - RNA, 19 nt, Homo sapiens
gaugguaaaggaaauuuga

SEQ ID NO: 1089332 - RNA, 19 nt, Homo sapiens
uaacugaauuguagauggu

SEQ ID NO: 1089333 - RNA, 19 nt, Homo sapiens
gaagucacacccuccgaaa

SEQ ID NO: 1089334 - RNA, 19 nt, Homo sapiens
aaggaucgauggaccguaa

SEQ ID NO: 1089335 - RNA, 19 nt, Homo sapiens
agaaguggcugcugagaag

SEQ ID NO: 1089336 - RNA, 19 nt, Homo sapiens
ggugauaccauuacugaga

SEQ ID NO: 1089337 - RNA, 19 nt, Homo sapiens
ggaccacacccuacuacaa

SEQ ID NO: 1089338 - RNA, 19 nt, Homo sapiens
cacagaauauggagagaga

SEQ ID NO: 1089339 - RNA, 19 nt, Homo sapiens
aaagaguacuauacacaga

SEQ ID NO: 1089340 - RNA, 19 nt, Homo sapiens
agaggaauguccauacaga

SEQ ID NO: 1089341 - RNA, 19 nt, Homo sapiens
acacgcagaugagugaauu

SEQ ID NO: 1089342 - RNA, 19 nt, Homo sapiens
cugagaaguccuuuaauaa

SEQ ID NO: 1089343 - RNA, 19 nt, Homo sapiens
ugucagaccugccucuuag

SEQ ID NO: 1089344 - RNA, 19 nt, Homo sapiens
aaauugaccugcaguaaaa

SEQ ID NO: 1089345 - RNA, 19 nt, Homo sapiens
ggaccaauccacuauccuu

SEQ ID NO: 1089346 - RNA, 19 nt, Homo sapiens
gcgguccucucucccaauu

SEQ ID NO: 1089347 - RNA, 19 nt, Homo sapiens
ccuggugucuggcaugaaa

SEQ ID NO: 1089348 - RNA, 19 nt, Homo sapiens
cuaaaggaaucugaccauu

SEQ ID NO: 1089349 - RNA, 19 nt, Homo sapiens
ccaguaaaucuuggaauaa

SEQ ID NO: 1089350 - RNA, 19 nt, Homo sapiens
gauggaacacggccaguug

SEQ ID NO: 1089351 - RNA, 19 nt, Homo sapiens
aauuguagaugguaaagga

SEQ ID NO: 1089352 - RNA, 19 nt, Homo sapiens
ccuuguaguuuccauggua

SEQ ID NO: 1089353 - RNA, 19 nt, Homo sapiens
ugucaucccugcuucuguu

SEQ ID NO: 1089354 - RNA, 19 nt, Homo sapiens
uguaaagaacuuccuguaa

SEQ ID NO: 1089355 - RNA, 19 nt, Homo sapiens
ucaacuggauggaaacaca

SEQ ID NO: 1089356 - RNA, 19 nt, Homo sapiens
gcccagaucuucucuuucc

SEQ ID NO: 1089357 - RNA, 19 nt, Homo sapiens
ggucuaggugauaccauua

SEQ ID NO: 1089358 - RNA, 19 nt, Homo sapiens
guaaaggaaauuugaugug

SEQ ID NO: 1089359 - RNA, 19 nt, Homo sapiens
ccugucaacuggauggaaa

SEQ ID NO: 1089360 - RNA, 19 nt, Homo sapiens
gaucgauggaccguaaaua

SEQ ID NO: 1089361 - RNA, 19 nt, Homo sapiens
ccagugacaugcugcucaa

SEQ ID NO: 1089362 - RNA, 19 nt, Homo sapiens
caaagucagaugucaacaa

SEQ ID NO: 1089363 - RNA, 19 nt, Homo sapiens
ugucuucagugucucauug

SEQ ID NO: 1089364 - RNA, 19 nt, Homo sapiens
ggagcuguguaccaucgaa

SEQ ID NO: 1089365 - RNA, 19 nt, Homo sapiens
gaucaaacuagaaccuguu

SEQ ID NO: 1089366 - RNA, 19 nt, Homo sapiens
ccaaaccugcaguaaauug

SEQ ID NO: 1089367 - RNA, 19 nt, Homo sapiens
cugcuucuguuuggucuua

SEQ ID NO: 1089368 - RNA, 19 nt, Homo sapiens
uguaguggccuaaguguga

SEQ ID NO: 1089369 - RNA, 19 nt, Homo sapiens
cagccaugcuuuccuauac

SEQ ID NO: 1089370 - RNA, 19 nt, Homo sapiens
uaagagaggagaggaaugu

SEQ ID NO: 1089371 - RNA, 19 nt, Homo sapiens
ugcaguaaauugaagaaug

SEQ ID NO: 1089372 - RNA, 19 nt, Homo sapiens
uccgaaagaugaguagaaa

SEQ ID NO: 1089373 - RNA, 19 nt, Homo sapiens
gccauuaacacaucugguu

SEQ ID NO: 1089374 - RNA, 19 nt, Homo sapiens
gcagacugaaugugaaaug

SEQ ID NO: 1089375 - RNA, 19 nt, Homo sapiens
ugagaaguccuuuaauaag

SEQ ID NO: 1089376 - RNA, 19 nt, Homo sapiens
aaacuaucaccacacuaua

SEQ ID NO: 1089377 - RNA, 19 nt, Homo sapiens
gaggagaggaauguccaua

SEQ ID NO: 1089378 - RNA, 19 nt, Homo sapiens
aagaugacaugccaaaguc

SEQ ID NO: 1089379 - RNA, 19 nt, Homo sapiens
gguaaaggaaauuugaugu

SEQ ID NO: 1089380 - RNA, 19 nt, Homo sapiens
cuuagaguguuuggauaua

SEQ ID NO: 1089381 - RNA, 19 nt, Homo sapiens
ggucuuagaguguuuggau

SEQ ID NO: 1089382 - RNA, 19 nt, Homo sapiens
guuauuacggaaucaauga

SEQ ID NO: 1089383 - RNA, 19 nt, Homo sapiens
uuaaagaugacaugccaaa

SEQ ID NO: 1089384 - RNA, 19 nt, Homo sapiens
gacgcaggauugucuuuua

SEQ ID NO: 1089385 - RNA, 19 nt, Homo sapiens
aaacccauauauccgaaug

SEQ ID NO: 1089386 - RNA, 19 nt, Homo sapiens
gggacacgcagaugaguga

SEQ ID NO: 1089387 - RNA, 19 nt, Homo sapiens
gcacuuaaaacucccagua

SEQ ID NO: 1089388 - RNA, 19 nt, Homo sapiens
caaaccugcaguaaauuga

SEQ ID NO: 1089389 - RNA, 19 nt, Homo sapiens
ggaguccgcaugcguuuca

SEQ ID NO: 1089390 - RNA, 19 nt, Homo sapiens
uggccuaagugugauuuaa

SEQ ID NO: 1089391 - RNA, 19 nt, Homo sapiens
gccaugcuuuccuauacuu

SEQ ID NO: 1089392 - RNA, 19 nt, Homo sapiens
uaggugauaccauuacuga

SEQ ID NO: 1089393 - RNA, 19 nt, Homo sapiens
aaagaugacaugccaaagu

SEQ ID NO: 1089394 - RNA, 19 nt, Homo sapiens
gcacagcccagaucuucuc

SEQ ID NO: 1089395 - RNA, 19 nt, Homo sapiens
cagcacagcccagaucuuc

SEQ ID NO: 1089396 - RNA, 19 nt, Homo sapiens
ggccgcagacugaauguga

SEQ ID NO: 1089397 - RNA, 19 nt, Homo sapiens
gaacaccucugguaccaaa

SEQ ID NO: 1089398 - RNA, 19 nt, Homo sapiens
ggaaucaaccucuuucuaa

SEQ ID NO: 1089399 - RNA, 19 nt, Homo sapiens
gaaucaaccucuuucuaau

SEQ ID NO: 1089400 - RNA, 19 nt, Homo sapiens
gagaacaucuuccacucaa

SEQ ID NO: 1089401 - RNA, 19 nt, Homo sapiens
caccaugaauucuuacuuu

SEQ ID NO: 1089402 - RNA, 19 nt, Homo sapiens
gauccugacugcugucuug

SEQ ID NO: 1089403 - RNA, 19 nt, Homo sapiens
gcucuggccuuguguguau

SEQ ID NO: 1089404 - RNA, 19 nt, Homo sapiens
gaacaucuuccacucaaug

SEQ ID NO: 1089405 - RNA, 19 nt, Homo sapiens
gcaaagagauucgcaaaau

SEQ ID NO: 1089406 - RNA, 19 nt, Homo sapiens
auacauacgugaacacaug

SEQ ID NO: 1089407 - RNA, 19 nt, Homo sapiens
ggccuuguguguauaugua

SEQ ID NO: 1089408 - RNA, 19 nt, Homo sapiens
gcacacggacagccucuuu

SEQ ID NO: 1089409 - RNA, 19 nt, Homo sapiens
ggauugcaguucucaagug

SEQ ID NO: 1089410 - RNA, 19 nt, Homo sapiens
gaacaagcaccuggaagug

SEQ ID NO: 1089411 - RNA, 19 nt, Homo sapiens
ucaaagaaguggccaacgu

SEQ ID NO: 1089412 - RNA, 19 nt, Homo sapiens
cuacugaacaccucuggua

SEQ ID NO: 1089413 - RNA, 19 nt, Homo sapiens
ucuaauacccucuuggaaa

SEQ ID NO: 1089414 - RNA, 19 nt, Homo sapiens
ggucagaggcccuuucauc

SEQ ID NO: 1089415 - RNA, 19 nt, Homo sapiens
ccaaaggcuuagaauguuc

SEQ ID NO: 1089416 - RNA, 19 nt, Homo sapiens
cagaggcccuuucaucauc

SEQ ID NO: 1089417 - RNA, 19 nt, Homo sapiens
uaccaaaggcuuagaaugu

SEQ ID NO: 1089418 - RNA, 19 nt, Homo sapiens
cuagagcucuggccuugug

SEQ ID NO: 1089419 - RNA, 19 nt, Homo sapiens
gaacuaccggcacgccuau

SEQ ID NO: 1089420 - RNA, 19 nt, Homo sapiens
uaaggaaccagcugaagga

SEQ ID NO: 1089421 - RNA, 19 nt, Homo sapiens
uugagaagguccagaacaa

SEQ ID NO: 1089422 - RNA, 19 nt, Homo sapiens
ggagaacaucuuccacuca

SEQ ID NO: 1089423 - RNA, 19 nt, Homo sapiens
caacucccaccaugaauuc

SEQ ID NO: 1089424 - RNA, 19 nt, Homo sapiens
gcaaccagagccugaugaa

SEQ ID NO: 1089425 - RNA, 19 nt, Homo sapiens
guaggcaccagcacaaaga

SEQ ID NO: 1089426 - RNA, 19 nt, Homo sapiens
cuaauacccucuuggaaaa

SEQ ID NO: 1089427 - RNA, 19 nt, Homo sapiens
uggauuaccugccggagau

SEQ ID NO: 1089428 - RNA, 19 nt, Homo sapiens
gaacaaccccuaccugauc

SEQ ID NO: 1089429 - RNA, 19 nt, Homo sapiens
gggaugaugaccaggauug

SEQ ID NO: 1089430 - RNA, 19 nt, Homo sapiens
ccacucauccucuggaauc

SEQ ID NO: 1089431 - RNA, 19 nt, Homo sapiens
caaagagauucgcaaaaug

SEQ ID NO: 1089432 - RNA, 19 nt, Homo sapiens
ugacaauggcaaagagauu

SEQ ID NO: 1089433 - RNA, 19 nt, Homo sapiens
gcaagaaaagcaucaaaga

SEQ ID NO: 1089434 - RNA, 19 nt, Homo sapiens
ugcccaagcuccucucaga

SEQ ID NO: 1089435 - RNA, 19 nt, Homo sapiens
guaccaaaggcuuagaaug

SEQ ID NO: 1089436 - RNA, 19 nt, Homo sapiens
gaccacucauccucuggaa

SEQ ID NO: 1089437 - RNA, 19 nt, Homo sapiens
cgaguggucccaugaaaca

SEQ ID NO: 1089438 - RNA, 19 nt, Homo sapiens
ugaucaaccuucucaagag

SEQ ID NO: 1089439 - RNA, 19 nt, Homo sapiens
cucccaccaugaauucuua

SEQ ID NO: 1089440 - RNA, 19 nt, Homo sapiens
accaaaggcuuagaauguu

SEQ ID NO: 1089441 - RNA, 19 nt, Homo sapiens
ccagaugguuccugugacu

SEQ ID NO: 1089442 - RNA, 19 nt, Homo sapiens
gugauccacugccagacaa

SEQ ID NO: 1089443 - RNA, 19 nt, Homo sapiens
uaacagaaaacccucaaaa

SEQ ID NO: 1089444 - RNA, 19 nt, Homo sapiens
ucgcagagguggacaagcu

SEQ ID NO: 1089445 - RNA, 19 nt, Homo sapiens
gaccucauccagaaguuug

SEQ ID NO: 1089446 - RNA, 19 nt, Homo sapiens
caaaaugugugagguuguu

SEQ ID NO: 1089447 - RNA, 19 nt, Homo sapiens
ggaggucaccguggacuuc

SEQ ID NO: 1089448 - RNA, 19 nt, Homo sapiens
uggaggugcuggcagaaau

SEQ ID NO: 1089449 - RNA, 19 nt, Homo sapiens
ucaacucccaccaugaauu

SEQ ID NO: 1089450 - RNA, 19 nt, Homo sapiens
caagaaaagcaucaaagaa

SEQ ID NO: 1089451 - RNA, 19 nt, Homo sapiens
gacaauggcaaagagauuc

SEQ ID NO: 1089452 - RNA, 19 nt, Homo sapiens
cuacgaugaccgcaagaaa

SEQ ID NO: 1089453 - RNA, 19 nt, Homo sapiens
uggaaucaaccucuuucua

SEQ ID NO: 1089454 - RNA, 19 nt, Homo sapiens
gucagaggcccuuucauca

SEQ ID NO: 1089455 - RNA, 19 nt, Homo sapiens
ugaccaggauugcaguucu

SEQ ID NO: 1089456 - RNA, 19 nt, Homo sapiens
uugcugagauggccaacau

SEQ ID NO: 1089457 - RNA, 19 nt, Homo sapiens
guggucccaugaaacacua

SEQ ID NO: 1089458 - RNA, 19 nt, Homo sapiens
cagccucuuucccauccua

SEQ ID NO: 1089459 - RNA, 19 nt, Homo sapiens
ucuaccaccucuacaucaa

SEQ ID NO: 1089460 - RNA, 19 nt, Homo sapiens
guccagaugguuccuguga

SEQ ID NO: 1089461 - RNA, 19 nt, Homo sapiens
gaggucagaggcccuuuca

SEQ ID NO: 1089462 - RNA, 19 nt, Homo sapiens
gugugaaguuugcugagau

SEQ ID NO: 1089463 - RNA, 19 nt, Homo sapiens
ugaaucggaugaggugauc

SEQ ID NO: 1089464 - RNA, 19 nt, Homo sapiens
aaacuccucggaagauguu

SEQ ID NO: 1089465 - RNA, 19 nt, Homo sapiens
gaccaggauugcaguucuc

SEQ ID NO: 1089466 - RNA, 19 nt, Homo sapiens
ccaccccaauaaagaaaua

SEQ ID NO: 1089467 - RNA, 19 nt, Homo sapiens
agaacaagcaccuggaagu

SEQ ID NO: 1089468 - RNA, 19 nt, Homo sapiens
ugaaugcggagaacaucuu

SEQ ID NO: 1089469 - RNA, 19 nt, Homo sapiens
uggcaaagagauucgcaaa

SEQ ID NO: 1089470 - RNA, 19 nt, Homo sapiens
gacguuaucggaugaaucg

SEQ ID NO: 1089471 - RNA, 19 nt, Homo sapiens
ugugaaguuugcugagaug

SEQ ID NO: 1089472 - RNA, 19 nt, Homo sapiens
gaaaagcaucaaagaagug

SEQ ID NO: 1089473 - RNA, 19 nt, Homo sapiens
ccucuggaaucaaccucuu

SEQ ID NO: 1089474 - RNA, 19 nt, Homo sapiens
gcucuaccaccucuacauc

SEQ ID NO: 1089475 - RNA, 19 nt, Homo sapiens
gaaugcggagaacaucuuc

SEQ ID NO: 1089476 - RNA, 19 nt, Homo sapiens
ucagaggcccuuucaucau

SEQ ID NO: 1089477 - RNA, 19 nt, Homo sapiens
gggugacaauggcaaagag

SEQ ID NO: 1089478 - RNA, 19 nt, Homo sapiens
gccgcgucaugcugccuua

SEQ ID NO: 1089479 - RNA, 19 nt, Homo sapiens
uaucggaugaaucggauga

SEQ ID NO: 1089480 - RNA, 19 nt, Homo sapiens
acgaugcccugccaaagca

SEQ ID NO: 1089481 - RNA, 19 nt, Homo sapiens
gagcucuggccuugugugu

SEQ ID NO: 1089482 - RNA, 19 nt, Homo sapiens
ggugauccacugccagaca

SEQ ID NO: 1089483 - RNA, 19 nt, Homo sapiens
ccaacauccuggugaucca

SEQ ID NO: 1089484 - RNA, 19 nt, Homo sapiens
caugaucaaccuucucaag

SEQ ID NO: 1089485 - RNA, 19 nt, Homo sapiens
ccaccaugaauucuuacuu

SEQ ID NO: 1089486 - RNA, 19 nt, Homo sapiens
ggaggugcuggcagaaauc

SEQ ID NO: 1089487 - RNA, 19 nt, Homo sapiens
gaucgugcagguccuaaac

SEQ ID NO: 1089488 - RNA, 19 nt, Homo sapiens
ggaucgugcagguccuaaa

SEQ ID NO: 1089489 - RNA, 19 nt, Homo sapiens
agaaaagcaucaaagaagu

SEQ ID NO: 1089490 - RNA, 19 nt, Homo sapiens
ccaaagaacuagcagagaa

SEQ ID NO: 1089491 - RNA, 19 nt, Homo sapiens
gaaguacgguucaauaaac

SEQ ID NO: 1089492 - RNA, 19 nt, Homo sapiens
uaacaugcaucucagugua

SEQ ID NO: 1089493 - RNA, 19 nt, Homo sapiens
ggagaaguacgguucaaua

SEQ ID NO: 1089494 - RNA, 19 nt, Homo sapiens
ggacaugccuguugauaac

SEQ ID NO: 1089495 - RNA, 19 nt, Homo sapiens
gcacaucuccgucaacuuc

SEQ ID NO: 1089496 - RNA, 19 nt, Homo sapiens
gagaaguacgguucaauaa

SEQ ID NO: 1089497 - RNA, 19 nt, Homo sapiens
gaaaugcccacucuacaug

SEQ ID NO: 1089498 - RNA, 19 nt, Homo sapiens
ggacacugcuucucaacca

SEQ ID NO: 1089499 - RNA, 19 nt, Homo sapiens
gacgugaaauugugauguu

SEQ ID NO: 1089500 - RNA, 19 nt, Homo sapiens
caguguagguucuauuuau

SEQ ID NO: 1089501 - RNA, 19 nt, Homo sapiens
gcagaugacgugaaauugu

SEQ ID NO: 1089502 - RNA, 19 nt, Homo sapiens
cuauuuauauggcagauga

SEQ ID NO: 1089503 - RNA, 19 nt, Homo sapiens
ccaucgagcuccuguacuu

SEQ ID NO: 1089504 - RNA, 19 nt, Homo sapiens
cagaugacgugaaauugug

SEQ ID NO: 1089505 - RNA, 19 nt, Homo sapiens
uauggcagaugacgugaaa

SEQ ID NO: 1089506 - RNA, 19 nt, Homo sapiens
ccaagucccuguacaucug

SEQ ID NO: 1089507 - RNA, 19 nt, Homo sapiens
cgccauggcugaucugguu

SEQ ID NO: 1089508 - RNA, 19 nt, Homo sapiens
ggaaacagccaagaagauc

SEQ ID NO: 1089509 - RNA, 19 nt, Homo sapiens
ggacuucugcuacgucuuc

SEQ ID NO: 1089510 - RNA, 19 nt, Homo sapiens
gcagaaaugcccacucuac

SEQ ID NO: 1089511 - RNA, 19 nt, Homo sapiens
cagcagaaaugcccacucu

SEQ ID NO: 1089512 - RNA, 19 nt, Homo sapiens
ggagaaaaccaaagaacua

SEQ ID NO: 1089513 - RNA, 19 nt, Homo sapiens
uggaggagguggugcugua

SEQ ID NO: 1089514 - RNA, 19 nt, Homo sapiens
gggacaugccuguugauaa

SEQ ID NO: 1089515 - RNA, 19 nt, Homo sapiens
gggcccagcucauccagau

SEQ ID NO: 1089516 - RNA, 19 nt, Homo sapiens
ucuacuaccugcugcuauu

SEQ ID NO: 1089517 - RNA, 19 nt, Homo sapiens
gugaaauugugauguuugu

SEQ ID NO: 1089518 - RNA, 19 nt, Homo sapiens
cagccaagaagauccauuu

SEQ ID NO: 1089519 - RNA, 19 nt, Homo sapiens
guucuggaguccuacgaaa

SEQ ID NO: 1089520 - RNA, 19 nt, Homo sapiens
agaaguacgguucaauaaa

SEQ ID NO: 1089521 - RNA, 19 nt, Homo sapiens
gagcguacucuucccuuga

SEQ ID NO: 1089522 - RNA, 19 nt, Homo sapiens
gcucuacguccgccacuuu

SEQ ID NO: 1089523 - RNA, 19 nt, Homo sapiens
guugauaacaugcaucuca

SEQ ID NO: 1089524 - RNA, 19 nt, Homo sapiens
cagaggaucaugacguuga

SEQ ID NO: 1089525 - RNA, 19 nt, Homo sapiens
gaugcucgccuaccucuuc

SEQ ID NO: 1089526 - RNA, 19 nt, Homo sapiens
uggcagaugacgugaaauu

SEQ ID NO: 1089527 - RNA, 19 nt, Homo sapiens
guuuaaagacuucaaugga

SEQ ID NO: 1089528 - RNA, 19 nt, Homo sapiens
ucaguguagguucuauuua

SEQ ID NO: 1089529 - RNA, 19 nt, Homo sapiens
cgucauggcgggaagaaga

SEQ ID NO: 1089530 - RNA, 19 nt, Homo sapiens
ucgccuaccucuucuucuu
